United States Patent 7,341,835 (METHODS OF ANALYSIS OF ALTERNATIVE SPLICING IN MOUSE) - sequence listing, part 14

SEQ ID NO: 518493 - DNA, 25 bp, Mus musculus
accggaagtgaaggcagcttcccgc

SEQ ID NO: 518494 - DNA, 25 bp, Mus musculus
accggaccagaaagaagagaggcga

SEQ ID NO: 518495 - DNA, 25 bp, Mus musculus
accggaccagaatgaagagaggcga

SEQ ID NO: 518496 - DNA, 25 bp, Mus musculus
accggaccagccagagccggcgata

SEQ ID NO: 518497 - DNA, 25 bp, Mus musculus
accggaccagcctgagccggcgata

SEQ ID NO: 518498 - DNA, 25 bp, Mus musculus
accggagaccaacgttgtacagatt

SEQ ID NO: 518499 - DNA, 25 bp, Mus musculus
accggagaccaaggttgtacagatt

SEQ ID NO: 518500 - DNA, 25 bp, Mus musculus
accggagactgaaggctctgcgcga

SEQ ID NO: 518501 - DNA, 25 bp, Mus musculus
accggagactgatggctctgcgcga

SEQ ID NO: 518502 - DNA, 25 bp, Mus musculus
accggagagctactgccaatgccca

SEQ ID NO: 518503 - DNA, 25 bp, Mus musculus
accggagagctagtgccaatgccca

SEQ ID NO: 518504 - DNA, 25 bp, Mus musculus
accggagccccgagattagaagact

SEQ ID NO: 518505 - DNA, 25 bp, Mus musculus
accggagccccgtgattagaagact

SEQ ID NO: 518506 - DNA, 25 bp, Mus musculus
accggaggctggaggccaagtatcc

SEQ ID NO: 518507 - DNA, 25 bp, Mus musculus
accggaggctggtggccaagtatcc

SEQ ID NO: 518508 - DNA, 25 bp, Mus musculus
accggattccggatcccggctgcgg

SEQ ID NO: 518509 - DNA, 25 bp, Mus musculus
accggattccggttcccggctgcgg

SEQ ID NO: 518510 - DNA, 25 bp, Mus musculus
accggattgtagagagtggcgccca

SEQ ID NO: 518511 - DNA, 25 bp, Mus musculus
accggattgtagtgagtggcgccca

SEQ ID NO: 518512 - DNA, 25 bp, Mus musculus
accggcaagattaccttagatcaga

SEQ ID NO: 518513 - DNA, 25 bp, Mus musculus
accggcaagatttccttagatcaga

SEQ ID NO: 518514 - DNA, 25 bp, Mus musculus
accggcacaggcctgagctgattga

SEQ ID NO: 518515 - DNA, 25 bp, Mus musculus
accggcacaggcgtgagctgattga

SEQ ID NO: 518516 - DNA, 25 bp, Mus musculus
accggcagagctagcgagtgcagca

SEQ ID NO: 518517 - DNA, 25 bp, Mus musculus
accggcagagcttgcgagtgcagca

SEQ ID NO: 518518 - DNA, 25 bp, Mus musculus
accggcagatcgagcagctacggcg

SEQ ID NO: 518519 - DNA, 25 bp, Mus musculus
accggcagatcgtgcagctacggcg

SEQ ID NO: 518520 - DNA, 25 bp, Mus musculus
accggcagcctcagatcatcgcagt

SEQ ID NO: 518521 - DNA, 25 bp, Mus musculus
accggcagcctctgatcatcgcagt

SEQ ID NO: 518522 - DNA, 25 bp, Mus musculus
accggcagctgtcaacctcaaagtg

SEQ ID NO: 518523 - DNA, 25 bp, Mus musculus
accggcagctgtgaacctcaaagtg

SEQ ID NO: 518524 - DNA, 25 bp, Mus musculus
accggccagagtatgcagtcaattc

SEQ ID NO: 518525 - DNA, 25 bp, Mus musculus
accggccagagtttgcagtcaattc

SEQ ID NO: 518526 - DNA, 25 bp, Mus musculus
accggccgcaggaagttgccgcaaa

SEQ ID NO: 518527 - DNA, 25 bp, Mus musculus
accggccgcaggtagttgccgcaaa

SEQ ID NO: 518528 - DNA, 25 bp, Mus musculus
accggccgggaacatctggaactgt

SEQ ID NO: 518529 - DNA, 25 bp, Mus musculus
accggccgggaagatctggaactgt

SEQ ID NO: 518530 - DNA, 25 bp, Mus musculus
accggcctcaagatggctacatcag

SEQ ID NO: 518531 - DNA, 25 bp, Mus musculus
accggcctcaagttggctacatcag

SEQ ID NO: 518532 - DNA, 25 bp, Mus musculus
accggcctgaagacggacaagcagg

SEQ ID NO: 518533 - DNA, 25 bp, Mus musculus
accggcctgaagtcggacaagcagg

SEQ ID NO: 518534 - DNA, 25 bp, Mus musculus
accggcgagtcacaggccctgagta

SEQ ID NO: 518535 - DNA, 25 bp, Mus musculus
accggcgagtcagaggccctgagta

SEQ ID NO: 518536 - DNA, 25 bp, Mus musculus
accggcgcccgaagtgagaaagaca

SEQ ID NO: 518537 - DNA, 25 bp, Mus musculus
accggcgcccgatgtgagaaagaca

SEQ ID NO: 518538 - DNA, 25 bp, Mus musculus
accggctagacgaggctgcacagcg

SEQ ID NO: 518539 - DNA, 25 bp, Mus musculus
accggctagacgtggctgcacagcg

SEQ ID NO: 518540 - DNA, 25 bp, Mus musculus
accggctcttcgagggccgcaagta

SEQ ID NO: 518541 - DNA, 25 bp, Mus musculus
accggctcttcgtgggccgcaagta

SEQ ID NO: 518542 - DNA, 25 bp, Mus musculus
accggctgcctcagtgctgctatca

SEQ ID NO: 518543 - DNA, 25 bp, Mus musculus
accggctgcctctgtgctgctatca

SEQ ID NO: 518544 - DNA, 25 bp, Mus musculus
accggctgggatctatcagatgcag

SEQ ID NO: 518545 - DNA, 25 bp, Mus musculus
accggctgggatgtatcagatgcag

SEQ ID NO: 518546 - DNA, 25 bp, Mus musculus
accggctgtaatcgatgcattgaag

SEQ ID NO: 518547 - DNA, 25 bp, Mus musculus
accggctgtaatggatgcattgaag

SEQ ID NO: 518548 - DNA, 25 bp, Mus musculus
accggcttagtactgtccgtgcagc

SEQ ID NO: 518549 - DNA, 25 bp, Mus musculus
accggcttagtagtgtccgtgcagc

SEQ ID NO: 518550 - DNA, 25 bp, Mus musculus
accggcttcggtctctgatagagcg

SEQ ID NO: 518551 - DNA, 25 bp, Mus musculus
accggcttcggtgtctgatagagcg

SEQ ID NO: 518552 - DNA, 25 bp, Mus musculus
accggcttcttcactactgtggcag

SEQ ID NO: 518553 - DNA, 25 bp, Mus musculus
accggcttcttctctactgtggcag

SEQ ID NO: 518554 - DNA, 25 bp, Mus musculus
accgggaatggaaccacgtgcaaag

SEQ ID NO: 518555 - DNA, 25 bp, Mus musculus
accgggaatggatccacgtgcaaag

SEQ ID NO: 518556 - DNA, 25 bp, Mus musculus
accgggactctgctgataaccctag

SEQ ID NO: 518557 - DNA, 25 bp, Mus musculus
accgggactctggtgataaccctag

SEQ ID NO: 518558 - DNA, 25 bp, Mus musculus
accgggagagaacgagcccacactg

SEQ ID NO: 518559 - DNA, 25 bp, Mus musculus
accgggagagaaggagcccacactg

SEQ ID NO: 518560 - DNA, 25 bp, Mus musculus
accgggagagttcgaggccaccaca

SEQ ID NO: 518561 - DNA, 25 bp, Mus musculus
accgggagagttggaggccaccaca

SEQ ID NO: 518562 - DNA, 25 bp, Mus musculus
accgggagatgcacggcctgtacac

SEQ ID NO: 518563 - DNA, 25 bp, Mus musculus
accgggagatgctcggcctgtacac

SEQ ID NO: 518564 - DNA, 25 bp, Mus musculus
accgggagatggagcatttgagaca

SEQ ID NO: 518565 - DNA, 25 bp, Mus musculus
accgggagatggtgcatttgagaca

SEQ ID NO: 518566 - DNA, 25 bp, Mus musculus
accgggagcaatcgtgtactaggcc

SEQ ID NO: 518567 - DNA, 25 bp, Mus musculus
accgggagcaatggtgtactaggcc

SEQ ID NO: 518568 - DNA, 25 bp, Mus musculus
accgggagctgcagctagccaactc

SEQ ID NO: 518569 - DNA, 25 bp, Mus musculus
accgggagctgctgctagccaactc

SEQ ID NO: 518570 - DNA, 25 bp, Mus musculus
accgggatgatgacaacgtggagat

SEQ ID NO: 518571 - DNA, 25 bp, Mus musculus
accgggatgatgtcaacgtggagat

SEQ ID NO: 518572 - DNA, 25 bp, Mus musculus
accgggatgcacaggagtttgctgc

SEQ ID NO: 518573 - DNA, 25 bp, Mus musculus
accgggatgcactggagtttgctgc

SEQ ID NO: 518574 - DNA, 25 bp, Mus musculus
accgggcccgctactatggtgcgga

SEQ ID NO: 518575 - DNA, 25 bp, Mus musculus
accgggcccgcttctatggtgcgga

SEQ ID NO: 518576 - DNA, 25 bp, Mus musculus
accgggcgaatcctggcagtcatcg

SEQ ID NO: 518577 - DNA, 25 bp, Mus musculus
accgggcgaatcgtggcagtcatcg

SEQ ID NO: 518578 - DNA, 25 bp, Mus musculus
accgggctctttagatggctgcatc

SEQ ID NO: 518579 - DNA, 25 bp, Mus musculus
accgggctcttttgatggctgcatc

SEQ ID NO: 518580 - DNA, 25 bp, Mus musculus
accgggtgcctcagaagaccatcca

SEQ ID NO: 518581 - DNA, 25 bp, Mus musculus
accgggtgcctctgaagaccatcca

SEQ ID NO: 518582 - DNA, 25 bp, Mus musculus
accggtatccagagccagctgtggc

SEQ ID NO: 518583 - DNA, 25 bp, Mus musculus
accggtatccagtgccagctgtggc

SEQ ID NO: 518584 - DNA, 25 bp, Mus musculus
accggtcgtgaccagatccagcttg

SEQ ID NO: 518585 - DNA, 25 bp, Mus musculus
accggtcgtgacgagatccagcttg

SEQ ID NO: 518586 - DNA, 25 bp, Mus musculus
accggtggctatcgcgacacgtcga

SEQ ID NO: 518587 - DNA, 25 bp, Mus musculus
accggtggctatggcgacacgtcga

SEQ ID NO: 518588 - DNA, 25 bp, Mus musculus
accggtgtcgccaactgcaaggagt

SEQ ID NO: 518589 - DNA, 25 bp, Mus musculus
accggtgtcgcctactgcaaggagt

SEQ ID NO: 518590 - DNA, 25 bp, Mus musculus
accggttgctcaatttctggtctga

SEQ ID NO: 518591 - DNA, 25 bp, Mus musculus
accggttgctcattttctggtctga

SEQ ID NO: 518592 - DNA, 25 bp, Mus musculus
accgtaaagctcaccagtagcctgg

SEQ ID NO: 518593 - DNA, 25 bp, Mus musculus
accgtaaagctctccagtagcctgg

SEQ ID NO: 518594 - DNA, 25 bp, Mus musculus
accgtaagcctccaaaaagatctat

SEQ ID NO: 518595 - DNA, 25 bp, Mus musculus
accgtaagcctcgaaaaagatctat

SEQ ID NO: 518596 - DNA, 25 bp, Mus musculus
accgtagtgggcagaaactttggca

SEQ ID NO: 518597 - DNA, 25 bp, Mus musculus
accgtagtgggctgaaactttggca

SEQ ID NO: 518598 - DNA, 25 bp, Mus musculus
accgtcagcatcaccgagggtgtca

SEQ ID NO: 518599 - DNA, 25 bp, Mus musculus
accgtcagcatctccgagggtgtca

SEQ ID NO: 518600 - DNA, 25 bp, Mus musculus
accgtcagctacaccacaaatgcat

SEQ ID NO: 518601 - DNA, 25 bp, Mus musculus
accgtcagctactccacaaatgcat

SEQ ID NO: 518602 - DNA, 25 bp, Mus musculus
accgtcctgccacgaagttcctgaa

SEQ ID NO: 518603 - DNA, 25 bp, Mus musculus
accgtcctgccaggaagttcctgaa

SEQ ID NO: 518604 - DNA, 25 bp, Mus musculus
accgtcctgtgtatggcttgttcca

SEQ ID NO: 518605 - DNA, 25 bp, Mus musculus
accgtcctgtgtttggcttgttcca

SEQ ID NO: 518606 - DNA, 25 bp, Mus musculus
accgtcgggttgaagatgggatatt

SEQ ID NO: 518607 - DNA, 25 bp, Mus musculus
accgtcgggttgtagatgggatatt

SEQ ID NO: 518608 - DNA, 25 bp, Mus musculus
accgtctccaagaagatactctcct

SEQ ID NO: 518609 - DNA, 25 bp, Mus musculus
accgtctccaagtagatactctcct

SEQ ID NO: 518610 - DNA, 25 bp, Mus musculus
accgtctgggcacaatgtcacgatg

SEQ ID NO: 518611 - DNA, 25 bp, Mus musculus
accgtctgggcagaatgtcacgatg

SEQ ID NO: 518612 - DNA, 25 bp, Mus musculus
accgtcttggcacttagattgggag

SEQ ID NO: 518613 - DNA, 25 bp, Mus musculus
accgtcttggcagttagattgggag

SEQ ID NO: 518614 - DNA, 25 bp, Mus musculus
accgtgaaggtgaagagttcaaaca

SEQ ID NO: 518615 - DNA, 25 bp, Mus musculus
accgtgaaggtgtagagttcaaaca

SEQ ID NO: 518616 - DNA, 25 bp, Mus musculus
accgtgaatcttcgctgtaaacttg

SEQ ID NO: 518617 - DNA, 25 bp, Mus musculus
accgtgaatcttggctgtaaacttg

SEQ ID NO: 518618 - DNA, 25 bp, Mus musculus
accgtgaccatcatcaaagcctcta

SEQ ID NO: 518619 - DNA, 25 bp, Mus musculus
accgtgaccatcttcaaagcctcta

SEQ ID NO: 518620 - DNA, 25 bp, Mus musculus
accgtgactgtcagattgatcagca

SEQ ID NO: 518621 - DNA, 25 bp, Mus musculus
accgtgactgtctgattgatcagca

SEQ ID NO: 518622 - DNA, 25 bp, Mus musculus
accgtgaggcccaggtgatctcagg

SEQ ID NO: 518623 - DNA, 25 bp, Mus musculus
accgtgaggccctggtgatctcagg

SEQ ID NO: 518624 - DNA, 25 bp, Mus musculus
accgtgatccaccagctggacaggg

SEQ ID NO: 518625 - DNA, 25 bp, Mus musculus
accgtgatccacgagctggacaggg

SEQ ID NO: 518626 - DNA, 25 bp, Mus musculus
accgtgatctctctccccaccaagt

SEQ ID NO: 518627 - DNA, 25 bp, Mus musculus
accgtgatctctgtccccaccaagt

SEQ ID NO: 518628 - DNA, 25 bp, Mus musculus
accgtgcagctgacctgcgacagga

SEQ ID NO: 518629 - DNA, 25 bp, Mus musculus
accgtgcagctgtcctgcgacagga

SEQ ID NO: 518630 - DNA, 25 bp, Mus musculus
accgtgcctggccagaggaacttga

SEQ ID NO: 518631 - DNA, 25 bp, Mus musculus
accgtgcctggcgagaggaacttga

SEQ ID NO: 518632 - DNA, 25 bp, Mus musculus
accgtgcggccaaggtgatccgagc

SEQ ID NO: 518633 - DNA, 25 bp, Mus musculus
accgtgcggccatggtgatccgagc

SEQ ID NO: 518634 - DNA, 25 bp, Mus musculus
accgtgctagctacaaaggctgcac

SEQ ID NO: 518635 - DNA, 25 bp, Mus musculus
accgtgctagcttcaaaggctgcac

SEQ ID NO: 518636 - DNA, 25 bp, Mus musculus
accgtgctgctgaggcgccaaggac

SEQ ID NO: 518637 - DNA, 25 bp, Mus musculus
accgtgctgctgtggcgccaaggac

SEQ ID NO: 518638 - DNA, 25 bp, Mus musculus
accgtgcttgctacccgggtggaga

SEQ ID NO: 518639 - DNA, 25 bp, Mus musculus
accgtgcttgcttcccgggtggaga

SEQ ID NO: 518640 - DNA, 25 bp, Mus musculus
accgtggcgaggaagacgttacaga

SEQ ID NO: 518641 - DNA, 25 bp, Mus musculus
accgtggcgaggtagacgttacaga

SEQ ID NO: 518642 - DNA, 25 bp, Mus musculus
accgtgtacagcactaaaagcctta

SEQ ID NO: 518643 - DNA, 25 bp, Mus musculus
accgtgtacagctctaaaagcctta

SEQ ID NO: 518644 - DNA, 25 bp, Mus musculus
accgtgtcagacagctgcatgaagc

SEQ ID NO: 518645 - DNA, 25 bp, Mus musculus
accgtgtcagactgctgcatgaagc

SEQ ID NO: 518646 - DNA, 25 bp, Mus musculus
accgtgtccagaagatgaatgaagt

SEQ ID NO: 518647 - DNA, 25 bp, Mus musculus
accgtgtccagatgatgaatgaagt

SEQ ID NO: 518648 - DNA, 25 bp, Mus musculus
accgtgtgcaggcaagagttcgcct

SEQ ID NO: 518649 - DNA, 25 bp, Mus musculus
accgtgtgcagggaagagttcgcct

SEQ ID NO: 518650 - DNA, 25 bp, Mus musculus
accgtgttctcgactatcctccaga

SEQ ID NO: 518651 - DNA, 25 bp, Mus musculus
accgtgttctcgtctatcctccaga

SEQ ID NO: 518652 - DNA, 25 bp, Mus musculus
accgtgttggaaccatgggcccctt

SEQ ID NO: 518653 - DNA, 25 bp, Mus musculus
accgtgttggaagcatgggcccctt

SEQ ID NO: 518654 - DNA, 25 bp, Mus musculus
accgttaagtttcactcattgctgc

SEQ ID NO: 518655 - DNA, 25 bp, Mus musculus
accgttaagtttgactcattgctgc

SEQ ID NO: 518656 - DNA, 25 bp, Mus musculus
accgttacactgagcgggccaagcg

SEQ ID NO: 518657 - DNA, 25 bp, Mus musculus
accgttacactgtgcgggccaagcg

SEQ ID NO: 518658 - DNA, 25 bp, Mus musculus
accgttcttgctcctccggatgtac

SEQ ID NO: 518659 - DNA, 25 bp, Mus musculus
accgttcttgctgctccggatgtac

SEQ ID NO: 518660 - DNA, 25 bp, Mus musculus
accgttggatctcccaaaaggaact

SEQ ID NO: 518661 - DNA, 25 bp, Mus musculus
accgttggatctgccaaaaggaact

SEQ ID NO: 518662 - DNA, 25 bp, Mus musculus
accgttgtcagcacacagcgttcac

SEQ ID NO: 518663 - DNA, 25 bp, Mus musculus
accgttgtcagctcacagcgttcac

SEQ ID NO: 518664 - DNA, 25 bp, Mus musculus
accgtttcgtggaactggcgctgcg

SEQ ID NO: 518665 - DNA, 25 bp, Mus musculus
accgtttcgtggtactggcgctgcg

SEQ ID NO: 518666 - DNA, 25 bp, Mus musculus
accgtttgtgtgcaaagtctgtggc

SEQ ID NO: 518667 - DNA, 25 bp, Mus musculus
accgtttgtgtggaaagtctgtggc

SEQ ID NO: 518668 - DNA, 25 bp, Mus musculus
acctaaagcatgagccagataccag

SEQ ID NO: 518669 - DNA, 25 bp, Mus musculus
acctaaagcatgtgccagataccag

SEQ ID NO: 518670 - DNA, 25 bp, Mus musculus
acctaacgtcttcaacctgagtggg

SEQ ID NO: 518671 - DNA, 25 bp, Mus musculus
acctaacgtcttgaacctgagtggg

SEQ ID NO: 518672 - DNA, 25 bp, Mus musculus
acctaagccctcaaaggcaaagccg

SEQ ID NO: 518673 - DNA, 25 bp, Mus musculus
acctaagccctctaaggcaaagccg

SEQ ID NO: 518674 - DNA, 25 bp, Mus musculus
acctaattgagaattgtcggaccaa

SEQ ID NO: 518675 - DNA, 25 bp, Mus musculus
acctaattgagatttgtcggaccaa

SEQ ID NO: 518676 - DNA, 25 bp, Mus musculus
acctacaaggcgcagagaaggaaga

SEQ ID NO: 518677 - DNA, 25 bp, Mus musculus
acctacaaggcggagagaaggaaga

SEQ ID NO: 518678 - DNA, 25 bp, Mus musculus
acctacaccgttaacctagagctgg

SEQ ID NO: 518679 - DNA, 25 bp, Mus musculus
acctacaccgtttacctagagctgg

SEQ ID NO: 518680 - DNA, 25 bp, Mus musculus
acctacatacctcgagcctgggatc

SEQ ID NO: 518681 - DNA, 25 bp, Mus musculus
acctacatacctggagcctgggatc

SEQ ID NO: 518682 - DNA, 25 bp, Mus musculus
acctacatgttgaagggcctaacca

SEQ ID NO: 518683 - DNA, 25 bp, Mus musculus
acctacatgttgtagggcctaacca

SEQ ID NO: 518684 - DNA, 25 bp, Mus musculus
acctaccaagtgagggactgctgac

SEQ ID NO: 518685 - DNA, 25 bp, Mus musculus
acctaccaagtgtgggactgctgac

SEQ ID NO: 518686 - DNA, 25 bp, Mus musculus
acctaccagcagaggcaagaccgca

SEQ ID NO: 518687 - DNA, 25 bp, Mus musculus
acctaccagcagtggcaagaccgca

SEQ ID NO: 518688 - DNA, 25 bp, Mus musculus
acctaccagggccacgtctctgtgg

SEQ ID NO: 518689 - DNA, 25 bp, Mus musculus
acctaccagggcgacgtctctgtgg

SEQ ID NO: 518690 - DNA, 25 bp, Mus musculus
acctaccctggtcttggcaagggtg

SEQ ID NO: 518691 - DNA, 25 bp, Mus musculus
acctaccctggtgttggcaagggtg

SEQ ID NO: 518692 - DNA, 25 bp, Mus musculus
acctaccggaacatgactgagaagc

SEQ ID NO: 518693 - DNA, 25 bp, Mus musculus
acctaccggaacttgactgagaagc

SEQ ID NO: 518694 - DNA, 25 bp, Mus musculus
acctacctcccaccggctctttggg

SEQ ID NO: 518695 - DNA, 25 bp, Mus musculus
acctacctcccagcggctctttggg

SEQ ID NO: 518696 - DNA, 25 bp, Mus musculus
acctaccttcagattcttgaccaaa

SEQ ID NO: 518697 - DNA, 25 bp, Mus musculus
acctaccttcagtttcttgaccaaa

SEQ ID NO: 518698 - DNA, 25 bp, Mus musculus
acctacctttcacggtggtcaggag

SEQ ID NO: 518699 - DNA, 25 bp, Mus musculus
acctacctttcagggtggtcaggag

SEQ ID NO: 518700 - DNA, 25 bp, Mus musculus
acctacgaggacatccacaccatag

SEQ ID NO: 518701 - DNA, 25 bp, Mus musculus
acctacgaggacttccacaccatag

SEQ ID NO: 518702 - DNA, 25 bp, Mus musculus
acctacggcggaatggaaggttcag

SEQ ID NO: 518703 - DNA, 25 bp, Mus musculus
acctacggcggattggaaggttcag

SEQ ID NO: 518704 - DNA, 25 bp, Mus musculus
acctagaagacacctgtggcttgaa

SEQ ID NO: 518705 - DNA, 25 bp, Mus musculus
acctagaagacagctgtggcttgaa

SEQ ID NO: 518706 - DNA, 25 bp, Mus musculus
acctagaccgcgactgcagttccaa

SEQ ID NO: 518707 - DNA, 25 bp, Mus musculus
acctagaccgcgtctgcagttccaa

SEQ ID NO: 518708 - DNA, 25 bp, Mus musculus
acctagagacccaactggaggaaga

SEQ ID NO: 518709 - DNA, 25 bp, Mus musculus
acctagagaccctactggaggaaga

SEQ ID NO: 518710 - DNA, 25 bp, Mus musculus
acctagagatgaatgtcacagtgca

SEQ ID NO: 518711 - DNA, 25 bp, Mus musculus
acctagagatgattgtcacagtgca

SEQ ID NO: 518712 - DNA, 25 bp, Mus musculus
acctagagcgccaggtgctagcagg

SEQ ID NO: 518713 - DNA, 25 bp, Mus musculus
acctagagcgcctggtgctagcagg

SEQ ID NO: 518714 - DNA, 25 bp, Mus musculus
acctagagtccgactgtcattcaaa

SEQ ID NO: 518715 - DNA, 25 bp, Mus musculus
acctagagtccgtctgtcattcaaa

SEQ ID NO: 518716 - DNA, 25 bp, Mus musculus
acctagatggaccagcttgattgct

SEQ ID NO: 518717 - DNA, 25 bp, Mus musculus
acctagatggacgagcttgattgct

SEQ ID NO: 518718 - DNA, 25 bp, Mus musculus
acctagcatcagagcacagttccag

SEQ ID NO: 518719 - DNA, 25 bp, Mus musculus
acctagcatcagtgcacagttccag

SEQ ID NO: 518720 - DNA, 25 bp, Mus musculus
acctagccacctacgttctgcagag

SEQ ID NO: 518721 - DNA, 25 bp, Mus musculus
acctagccaccttcgttctgcagag

SEQ ID NO: 518722 - DNA, 25 bp, Mus musculus
acctagcggcgacatggatgctgcc

SEQ ID NO: 518723 - DNA, 25 bp, Mus musculus
acctagcggcgagatggatgctgcc

SEQ ID NO: 518724 - DNA, 25 bp, Mus musculus
acctagctcaagacgaggagagtga

SEQ ID NO: 518725 - DNA, 25 bp, Mus musculus
acctagctcaagtcgaggagagtga

SEQ ID NO: 518726 - DNA, 25 bp, Mus musculus
acctaggtcgctctggccaacatgc

SEQ ID NO: 518727 - DNA, 25 bp, Mus musculus
acctaggtcgctgtggccaacatgc

SEQ ID NO: 518728 - DNA, 25 bp, Mus musculus
acctagttgatcaactcaaagggaa

SEQ ID NO: 518729 - DNA, 25 bp, Mus musculus
acctagttgatctactcaaagggaa

SEQ ID NO: 518730 - DNA, 25 bp, Mus musculus
acctataccagaagatgaagttcaa

SEQ ID NO: 518731 - DNA, 25 bp, Mus musculus
acctataccagatgatgaagttcaa

SEQ ID NO: 518732 - DNA, 25 bp, Mus musculus
acctataccccgagtgtgttctgga

SEQ ID NO: 518733 - DNA, 25 bp, Mus musculus
acctataccccgtgtgtgttctgga

SEQ ID NO: 518734 - DNA, 25 bp, Mus musculus
acctatacctgcctgtgtacagaag

SEQ ID NO: 518735 - DNA, 25 bp, Mus musculus
acctatacctgcgtgtgtacagaag

SEQ ID NO: 518736 - DNA, 25 bp, Mus musculus
acctatcctcggaaggcagtgcacg

SEQ ID NO: 518737 - DNA, 25 bp, Mus musculus
acctatcctcggtaggcagtgcacg

SEQ ID NO: 518738 - DNA, 25 bp, Mus musculus
acctatgacaatcctgcggtgacat

SEQ ID NO: 518739 - DNA, 25 bp, Mus musculus
acctatgacaatgctgcggtgacat

SEQ ID NO: 518740 - DNA, 25 bp, Mus musculus
acctatgatgtgaagaggctgctac

SEQ ID NO: 518741 - DNA, 25 bp, Mus musculus
acctatgatgtgtagaggctgctac

SEQ ID NO: 518742 - DNA, 25 bp, Mus musculus
acctatgcagaacaacgagaacgac

SEQ ID NO: 518743 - DNA, 25 bp, Mus musculus
acctatgcagaagaacgagaacgac

SEQ ID NO: 518744 - DNA, 25 bp, Mus musculus
acctatggatctcgtcagaaagctt

SEQ ID NO: 518745 - DNA, 25 bp, Mus musculus
acctatggatctggtcagaaagctt

SEQ ID NO: 518746 - DNA, 25 bp, Mus musculus
acctatgggctaaacaggacaatcg

SEQ ID NO: 518747 - DNA, 25 bp, Mus musculus
acctatgggctatacaggacaatcg

SEQ ID NO: 518748 - DNA, 25 bp, Mus musculus
acctatggtttcatctccagcagca

SEQ ID NO: 518749 - DNA, 25 bp, Mus musculus
acctatggtttcttctccagcagca

SEQ ID NO: 518750 - DNA, 25 bp, Mus musculus
acctatgtgccgcacagtcctggct

SEQ ID NO: 518751 - DNA, 25 bp, Mus musculus
acctatgtgccggacagtcctggct

SEQ ID NO: 518752 - DNA, 25 bp, Mus musculus
acctcaaatatgattggctgcaggg

SEQ ID NO: 518753 - DNA, 25 bp, Mus musculus
acctcaaatatgtttggctgcaggg

SEQ ID NO: 518754 - DNA, 25 bp, Mus musculus
acctcaactcgacggatgccgctga

SEQ ID NO: 518755 - DNA, 25 bp, Mus musculus
acctcaactcgagggatgccgctga

SEQ ID NO: 518756 - DNA, 25 bp, Mus musculus
acctcaagagggagtgggaaacact

SEQ ID NO: 518757 - DNA, 25 bp, Mus musculus
acctcaagagggtgtgggaaacact

SEQ ID NO: 518758 - DNA, 25 bp, Mus musculus
acctcaaggcccacaggaccattgt

SEQ ID NO: 518759 - DNA, 25 bp, Mus musculus
acctcaaggccctcaggaccattgt

SEQ ID NO: 518760 - DNA, 25 bp, Mus musculus
acctcaaggtccaagatgccaatcc

SEQ ID NO: 518761 - DNA, 25 bp, Mus musculus
acctcaaggtcctagatgccaatcc

SEQ ID NO: 518762 - DNA, 25 bp, Mus musculus
acctcaagtttcaggttgatggaaa

SEQ ID NO: 518763 - DNA, 25 bp, Mus musculus
acctcaagtttctggttgatggaaa

SEQ ID NO: 518764 - DNA, 25 bp, Mus musculus
acctcacactgcagatgcagcagcg

SEQ ID NO: 518765 - DNA, 25 bp, Mus musculus
acctcacactgctgatgcagcagcg

SEQ ID NO: 518766 - DNA, 25 bp, Mus musculus
acctcacagggaatgcagaagcacc

SEQ ID NO: 518767 - DNA, 25 bp, Mus musculus
acctcacagggattgcagaagcacc

SEQ ID NO: 518768 - DNA, 25 bp, Mus musculus
acctcacctcagaggtcagggctgc

SEQ ID NO: 518769 - DNA, 25 bp, Mus musculus
acctcacctcagtggtcagggctgc

SEQ ID NO: 518770 - DNA, 25 bp, Mus musculus
acctcacggacaaggaccctgaagt

SEQ ID NO: 518771 - DNA, 25 bp, Mus musculus
acctcacggacatggaccctgaagt

SEQ ID NO: 518772 - DNA, 25 bp, Mus musculus
acctcactgcttaccggagcggtag

SEQ ID NO: 518773 - DNA, 25 bp, Mus musculus
acctcactgctttccggagcggtag

SEQ ID NO: 518774 - DNA, 25 bp, Mus musculus
acctcactttgtcgtagtccactgc

SEQ ID NO: 518775 - DNA, 25 bp, Mus musculus
acctcactttgtggtagtccactgc

SEQ ID NO: 518776 - DNA, 25 bp, Mus musculus
acctcagaagatcagcggcccaaga

SEQ ID NO: 518777 - DNA, 25 bp, Mus musculus
acctcagaagatgagcggcccaaga

SEQ ID NO: 518778 - DNA, 25 bp, Mus musculus
acctcagacaacagccactgtctta

SEQ ID NO: 518779 - DNA, 25 bp, Mus musculus
acctcagacaactgccactgtctta

SEQ ID NO: 518780 - DNA, 25 bp, Mus musculus
acctcagagttgaggtccccggctc

SEQ ID NO: 518781 - DNA, 25 bp, Mus musculus
acctcagagttgtggtccccggctc

SEQ ID NO: 518782 - DNA, 25 bp, Mus musculus
acctcagcactgcattcgttaaaga

SEQ ID NO: 518783 - DNA, 25 bp, Mus musculus
acctcagcactggattcgttaaaga

SEQ ID NO: 518784 - DNA, 25 bp, Mus musculus
acctcagcatggcaactaccaggag

SEQ ID NO: 518785 - DNA, 25 bp, Mus musculus
acctcagcatgggaactaccaggag

SEQ ID NO: 518786 - DNA, 25 bp, Mus musculus
acctcagcgcatcttacgcatcatg

SEQ ID NO: 518787 - DNA, 25 bp, Mus musculus
acctcagcgcatgttacgcatcatg

SEQ ID NO: 518788 - DNA, 25 bp, Mus musculus
acctcagcggccagcaggtgacctt

SEQ ID NO: 518789 - DNA, 25 bp, Mus musculus
acctcagcggcctgcaggtgacctt

SEQ ID NO: 518790 - DNA, 25 bp, Mus musculus
acctcagctacaacgttcgagctag

SEQ ID NO: 518791 - DNA, 25 bp, Mus musculus
acctcagctacatcgttcgagctag

SEQ ID NO: 518792 - DNA, 25 bp, Mus musculus
acctcaggagtaaaggtgttgctga

SEQ ID NO: 518793 - DNA, 25 bp, Mus musculus
acctcaggagtataggtgttgctga

SEQ ID NO: 518794 - DNA, 25 bp, Mus musculus
acctcaggatcactgccgaggtgga

SEQ ID NO: 518795 - DNA, 25 bp, Mus musculus
acctcaggatcagtgccgaggtgga

SEQ ID NO: 518796 - DNA, 25 bp, Mus musculus
acctcaggcagcatgggacagctcc

SEQ ID NO: 518797 - DNA, 25 bp, Mus musculus
acctcaggcagcttgggacagctcc

SEQ ID NO: 518798 - DNA, 25 bp, Mus musculus
acctcaggctggacactaacagggc

SEQ ID NO: 518799 - DNA, 25 bp, Mus musculus
acctcaggctggtcactaacagggc

SEQ ID NO: 518800 - DNA, 25 bp, Mus musculus
acctcagggcataccaggtgcagct

SEQ ID NO: 518801 - DNA, 25 bp, Mus musculus
acctcagggcattccaggtgcagct

SEQ ID NO: 518802 - DNA, 25 bp, Mus musculus
acctcagggcctcaggctctgcgag

SEQ ID NO: 518803 - DNA, 25 bp, Mus musculus
acctcagggcctgaggctctgcgag

SEQ ID NO: 518804 - DNA, 25 bp, Mus musculus
acctcagggtctcagaggcatcact

SEQ ID NO: 518805 - DNA, 25 bp, Mus musculus
acctcagggtctgagaggcatcact

SEQ ID NO: 518806 - DNA, 25 bp, Mus musculus
acctcagtattacggtgttccatgg

SEQ ID NO: 518807 - DNA, 25 bp, Mus musculus
acctcagtattagggtgttccatgg

SEQ ID NO: 518808 - DNA, 25 bp, Mus musculus
acctcagtgcatacaacactcggct

SEQ ID NO: 518809 - DNA, 25 bp, Mus musculus
acctcagtgcattcaacactcggct

SEQ ID NO: 518810 - DNA, 25 bp, Mus musculus
acctcagtgggcagcgctgtgtgaa

SEQ ID NO: 518811 - DNA, 25 bp, Mus musculus
acctcagtgggctgcgctgtgtgaa

SEQ ID NO: 518812 - DNA, 25 bp, Mus musculus
acctcagtgtgtactaccctgggac

SEQ ID NO: 518813 - DNA, 25 bp, Mus musculus
acctcagtgtgttctaccctgggac

SEQ ID NO: 518814 - DNA, 25 bp, Mus musculus
acctcatcagtgcagatgctgagca

SEQ ID NO: 518815 - DNA, 25 bp, Mus musculus
acctcatcagtggagatgctgagca

SEQ ID NO: 518816 - DNA, 25 bp, Mus musculus
acctcatccagccttatggcgaatg

SEQ ID NO: 518817 - DNA, 25 bp, Mus musculus
acctcatccagcgttatggcgaatg

SEQ ID NO: 518818 - DNA, 25 bp, Mus musculus
acctcatcgggcacatctgttggca

SEQ ID NO: 518819 - DNA, 25 bp, Mus musculus
acctcatcgggctcatctgttggca

SEQ ID NO: 518820 - DNA, 25 bp, Mus musculus
acctcatcgtggctgtgcatacgga

SEQ ID NO: 518821 - DNA, 25 bp, Mus musculus
acctcatcgtgggtgtgcatacgga

SEQ ID NO: 518822 - DNA, 25 bp, Mus musculus
acctcatgtcaaacgggactctgct

SEQ ID NO: 518823 - DNA, 25 bp, Mus musculus
acctcatgtcaatcgggactctgct

SEQ ID NO: 518824 - DNA, 25 bp, Mus musculus
acctccaaaaggctgtttgctctat

SEQ ID NO: 518825 - DNA, 25 bp, Mus musculus
acctccaaaagggtgtttgctctat

SEQ ID NO: 518826 - DNA, 25 bp, Mus musculus
acctccaagtggacagagcacctca

SEQ ID NO: 518827 - DNA, 25 bp, Mus musculus
acctccaagtggtcagagcacctca

SEQ ID NO: 518828 - DNA, 25 bp, Mus musculus
acctccacaaaacgaaatgagtttg

SEQ ID NO: 518829 - DNA, 25 bp, Mus musculus
acctccacaaaaggaaatgagtttg

SEQ ID NO: 518830 - DNA, 25 bp, Mus musculus
acctccaggccgagacggtagcagt

SEQ ID NO: 518831 - DNA, 25 bp, Mus musculus
acctccaggccgtgacggtagcagt

SEQ ID NO: 518832 - DNA, 25 bp, Mus musculus
acctccagggctcctatgtctgtgt

SEQ ID NO: 518833 - DNA, 25 bp, Mus musculus
acctccagggctgctatgtctgtgt

SEQ ID NO: 518834 - DNA, 25 bp, Mus musculus
acctccaggtgacaggcagtgccca

SEQ ID NO: 518835 - DNA, 25 bp, Mus musculus
acctccaggtgagaggcagtgccca

SEQ ID NO: 518836 - DNA, 25 bp, Mus musculus
acctccatgggtcgaacgcagcagc

SEQ ID NO: 518837 - DNA, 25 bp, Mus musculus
acctccatgggtggaacgcagcagc

SEQ ID NO: 518838 - DNA, 25 bp, Mus musculus
acctcccaaggaccagatggccaag

SEQ ID NO: 518839 - DNA, 25 bp, Mus musculus
acctcccaaggagcagatggccaag

SEQ ID NO: 518840 - DNA, 25 bp, Mus musculus
acctcccaggctattgcagagccgg

SEQ ID NO: 518841 - DNA, 25 bp, Mus musculus
acctcccaggcttttgcagagccgg

SEQ ID NO: 518842 - DNA, 25 bp, Mus musculus
acctccccagctaagctaagcgtgt

SEQ ID NO: 518843 - DNA, 25 bp, Mus musculus
acctccccagcttagctaagcgtgt

SEQ ID NO: 518844 - DNA, 25 bp, Mus musculus
acctccgcagagacaaagatcggag

SEQ ID NO: 518845 - DNA, 25 bp, Mus musculus
acctccgcagagtcaaagatcggag

SEQ ID NO: 518846 - DNA, 25 bp, Mus musculus
acctccgcagcacaacagcgatgga

SEQ ID NO: 518847 - DNA, 25 bp, Mus musculus
acctccgcagcagaacagcgatgga

SEQ ID NO: 518848 - DNA, 25 bp, Mus musculus
acctccgcgatgcatcggctgcagg

SEQ ID NO: 518849 - DNA, 25 bp, Mus musculus
acctccgcgatggatcggctgcagg

SEQ ID NO: 518850 - DNA, 25 bp, Mus musculus
acctccggaatcagccgtggtttga

SEQ ID NO: 518851 - DNA, 25 bp, Mus musculus
acctccggaatctgccgtggtttga

SEQ ID NO: 518852 - DNA, 25 bp, Mus musculus
acctccggaggccaagttgtgacct

SEQ ID NO: 518853 - DNA, 25 bp, Mus musculus
acctccggaggcgaagttgtgacct

SEQ ID NO: 518854 - DNA, 25 bp, Mus musculus
acctccggatcccactcatgtggaa

SEQ ID NO: 518855 - DNA, 25 bp, Mus musculus
acctccggatccgactcatgtggaa

SEQ ID NO: 518856 - DNA, 25 bp, Mus musculus
acctcctctcggctagttcggaagc

SEQ ID NO: 518857 - DNA, 25 bp, Mus musculus
acctcctctcgggtagttcggaagc

SEQ ID NO: 518858 - DNA, 25 bp, Mus musculus
acctcctggactcaagggtgccaag

SEQ ID NO: 518859 - DNA, 25 bp, Mus musculus
acctcctggactgaagggtgccaag

SEQ ID NO: 518860 - DNA, 25 bp, Mus musculus
acctcctggagacggtcaagcagaa

SEQ ID NO: 518861 - DNA, 25 bp, Mus musculus
acctcctggagagggtcaagcagaa

SEQ ID NO: 518862 - DNA, 25 bp, Mus musculus
acctcctgtggtcaattacgaagaa

SEQ ID NO: 518863 - DNA, 25 bp, Mus musculus
acctcctgtggtgaattacgaagaa

SEQ ID NO: 518864 - DNA, 25 bp, Mus musculus
acctccttatatccagagccaggga

SEQ ID NO: 518865 - DNA, 25 bp, Mus musculus
acctccttatatgcagagccaggga

SEQ ID NO: 518866 - DNA, 25 bp, Mus musculus
acctcgagtcctattcatctttctg

SEQ ID NO: 518867 - DNA, 25 bp, Mus musculus
acctcgagtccttttcatctttctg

SEQ ID NO: 518868 - DNA, 25 bp, Mus musculus
acctcgcgacgcatgcgcactaggg

SEQ ID NO: 518869 - DNA, 25 bp, Mus musculus
acctcgcgacgcttgcgcactaggg

SEQ ID NO: 518870 - DNA, 25 bp, Mus musculus
acctcgctcggcagacagcatctgt

SEQ ID NO: 518871 - DNA, 25 bp, Mus musculus
acctcgctcggctgacagcatctgt

SEQ ID NO: 518872 - DNA, 25 bp, Mus musculus
acctcgctcgggagttcgcagagcg

SEQ ID NO: 518873 - DNA, 25 bp, Mus musculus
acctcgctcgggtgttcgcagagcg

SEQ ID NO: 518874 - DNA, 25 bp, Mus musculus
acctcggacgtgatgaatgctgcca

SEQ ID NO: 518875 - DNA, 25 bp, Mus musculus
acctcggacgtgttgaatgctgcca

SEQ ID NO: 518876 - DNA, 25 bp, Mus musculus
acctcggatcctcgggaattcctca

SEQ ID NO: 518877 - DNA, 25 bp, Mus musculus
acctcggatcctggggaattcctca

SEQ ID NO: 518878 - DNA, 25 bp, Mus musculus
acctcgggaccacaagacaccagag

SEQ ID NO: 518879 - DNA, 25 bp, Mus musculus
acctcgggaccagaagacaccagag

SEQ ID NO: 518880 - DNA, 25 bp, Mus musculus
acctcgggatctatgtggccttctg

SEQ ID NO: 518881 - DNA, 25 bp, Mus musculus
acctcgggatctttgtggccttctg

SEQ ID NO: 518882 - DNA, 25 bp, Mus musculus
acctcgggccaaacaatcagtggtg

SEQ ID NO: 518883 - DNA, 25 bp, Mus musculus
acctcgggccaatcaatcagtggtg

SEQ ID NO: 518884 - DNA, 25 bp, Mus musculus
acctcgggtagtctgtgctgtccct

SEQ ID NO: 518885 - DNA, 25 bp, Mus musculus
acctcgggtagtgtgtgctgtccct

SEQ ID NO: 518886 - DNA, 25 bp, Mus musculus
acctcggtgagacccttcgtcagga

SEQ ID NO: 518887 - DNA, 25 bp, Mus musculus
acctcggtgagagccttcgtcagga

SEQ ID NO: 518888 - DNA, 25 bp, Mus musculus
acctcggtgtccacttgctgtccag

SEQ ID NO: 518889 - DNA, 25 bp, Mus musculus
acctcggtgtcctcttgctgtccag

SEQ ID NO: 518890 - DNA, 25 bp, Mus musculus
acctcgtgaggcaggcatgcaggat

SEQ ID NO: 518891 - DNA, 25 bp, Mus musculus
acctcgtgaggctggcatgcaggat

SEQ ID NO: 518892 - DNA, 25 bp, Mus musculus
acctcgtggagaaagattattttgg

SEQ ID NO: 518893 - DNA, 25 bp, Mus musculus
acctcgtggagatagattattttgg

SEQ ID NO: 518894 - DNA, 25 bp, Mus musculus
acctcgtggtcaaggttggcaataa

SEQ ID NO: 518895 - DNA, 25 bp, Mus musculus
acctcgtggtcatggttggcaataa

SEQ ID NO: 518896 - DNA, 25 bp, Mus musculus
acctctaagagtataagctcagatg

SEQ ID NO: 518897 - DNA, 25 bp, Mus musculus
acctctaagagtttaagctcagatg

SEQ ID NO: 518898 - DNA, 25 bp, Mus musculus
acctctacgctgagcagctctcggg

SEQ ID NO: 518899 - DNA, 25 bp, Mus musculus
acctctacgctgtgcagctctcggg

SEQ ID NO: 518900 - DNA, 25 bp, Mus musculus
acctctatcagcaaatgaaagacag

SEQ ID NO: 518901 - DNA, 25 bp, Mus musculus
acctctatcagctaatgaaagacag

SEQ ID NO: 518902 - DNA, 25 bp, Mus musculus
acctctatccttatttaggccccag

SEQ ID NO: 518903 - DNA, 25 bp, Mus musculus
acctctatccttttttaggccccag

SEQ ID NO: 518904 - DNA, 25 bp, Mus musculus
acctctcacattagctggctcagca

SEQ ID NO: 518905 - DNA, 25 bp, Mus musculus
acctctcacatttgctggctcagca

SEQ ID NO: 518906 - DNA, 25 bp, Mus musculus
acctctcatggtcctgtacgggctg

SEQ ID NO: 518907 - DNA, 25 bp, Mus musculus
acctctcatggtgctgtacgggctg

SEQ ID NO: 518908 - DNA, 25 bp, Mus musculus
acctctcctctcattgacagaggac

SEQ ID NO: 518909 - DNA, 25 bp, Mus musculus
acctctcctctctttgacagaggac

SEQ ID NO: 518910 - DNA, 25 bp, Mus musculus
acctctctaaggagtcaggctctgg

SEQ ID NO: 518911 - DNA, 25 bp, Mus musculus
acctctctaaggtgtcaggctctgg

SEQ ID NO: 518912 - DNA, 25 bp, Mus musculus
acctctctgtggagaacgctgcaga

SEQ ID NO: 518913 - DNA, 25 bp, Mus musculus
acctctctgtggtgaacgctgcaga

SEQ ID NO: 518914 - DNA, 25 bp, Mus musculus
acctctcttgccacagtgccatgga

SEQ ID NO: 518915 - DNA, 25 bp, Mus musculus
acctctcttgcctcagtgccatgga

SEQ ID NO: 518916 - DNA, 25 bp, Mus musculus
acctctctttcaacatcactgagga

SEQ ID NO: 518917 - DNA, 25 bp, Mus musculus
acctctctttcatcatcactgagga

SEQ ID NO: 518918 - DNA, 25 bp, Mus musculus
acctctgaaaccattctggtgggca

SEQ ID NO: 518919 - DNA, 25 bp, Mus musculus
acctctgaaacctttctggtgggca

SEQ ID NO: 518920 - DNA, 25 bp, Mus musculus
acctctgagctgaccggcaggctca

SEQ ID NO: 518921 - DNA, 25 bp, Mus musculus
acctctgagctgtccggcaggctca

SEQ ID NO: 518922 - DNA, 25 bp, Mus musculus
acctctgagggaagtgcctacagga

SEQ ID NO: 518923 - DNA, 25 bp, Mus musculus
acctctgagggatgtgcctacagga

SEQ ID NO: 518924 - DNA, 25 bp, Mus musculus
acctctgagttaatctatccccggg

SEQ ID NO: 518925 - DNA, 25 bp, Mus musculus
acctctgagttattctatccccggg

SEQ ID NO: 518926 - DNA, 25 bp, Mus musculus
acctctgatgagcagtacctgagcc

SEQ ID NO: 518927 - DNA, 25 bp, Mus musculus
acctctgatgaggagtacctgagcc

SEQ ID NO: 518928 - DNA, 25 bp, Mus musculus
acctctgcgggtcataccacttaaa

SEQ ID NO: 518929 - DNA, 25 bp, Mus musculus
acctctgcgggtgataccacttaaa

SEQ ID NO: 518930 - DNA, 25 bp, Mus musculus
acctctgctcagagaaacgtctgtg

SEQ ID NO: 518931 - DNA, 25 bp, Mus musculus
acctctgctcagtgaaacgtctgtg

SEQ ID NO: 518932 - DNA, 25 bp, Mus musculus
acctctgctcgaagctaaaaccact

SEQ ID NO: 518933 - DNA, 25 bp, Mus musculus
acctctgctcgatgctaaaaccact

SEQ ID NO: 518934 - DNA, 25 bp, Mus musculus
acctctgctgtcctggccactgtgg

SEQ ID NO: 518935 - DNA, 25 bp, Mus musculus
acctctgctgtcgtggccactgtgg

SEQ ID NO: 518936 - DNA, 25 bp, Mus musculus
acctctgctgtgagcgcagcagcct

SEQ ID NO: 518937 - DNA, 25 bp, Mus musculus
acctctgctgtgtgcgcagcagcct

SEQ ID NO: 518938 - DNA, 25 bp, Mus musculus
acctctgggacaattaaggacttgg

SEQ ID NO: 518939 - DNA, 25 bp, Mus musculus
acctctgggacatttaaggacttgg

SEQ ID NO: 518940 - DNA, 25 bp, Mus musculus
acctctggttttcagtgttgttggc

SEQ ID NO: 518941 - DNA, 25 bp, Mus musculus
acctctggttttgagtgttgttggc

SEQ ID NO: 518942 - DNA, 25 bp, Mus musculus
acctctgtcgccatgatctgtgcca

SEQ ID NO: 518943 - DNA, 25 bp, Mus musculus
acctctgtcgccttgatctgtgcca

SEQ ID NO: 518944 - DNA, 25 bp, Mus musculus
acctctgtgcgcagtgtccttcacg

SEQ ID NO: 518945 - DNA, 25 bp, Mus musculus
acctctgtgcgctgtgtccttcacg

SEQ ID NO: 518946 - DNA, 25 bp, Mus musculus
acctcttacaataaggtggctgacg

SEQ ID NO: 518947 - DNA, 25 bp, Mus musculus
acctcttacaattaggtggctgacg

SEQ ID NO: 518948 - DNA, 25 bp, Mus musculus
acctcttatcacaagtcaggctggg

SEQ ID NO: 518949 - DNA, 25 bp, Mus musculus
acctcttatcactagtcaggctggg

SEQ ID NO: 518950 - DNA, 25 bp, Mus musculus
acctcttcatggcagactttgtgga

SEQ ID NO: 518951 - DNA, 25 bp, Mus musculus
acctcttcatgggagactttgtgga

SEQ ID NO: 518952 - DNA, 25 bp, Mus musculus
acctcttccgtaatgcgggatgtgc

SEQ ID NO: 518953 - DNA, 25 bp, Mus musculus
acctcttccgtattgcgggatgtgc

SEQ ID NO: 518954 - DNA, 25 bp, Mus musculus
acctcttcgtggcagaccagcggag

SEQ ID NO: 518955 - DNA, 25 bp, Mus musculus
acctcttcgtgggagaccagcggag

SEQ ID NO: 518956 - DNA, 25 bp, Mus musculus
acctcttgagagcagacgggacagc

SEQ ID NO: 518957 - DNA, 25 bp, Mus musculus
acctcttgagaggagacgggacagc

SEQ ID NO: 518958 - DNA, 25 bp, Mus musculus
acctcttggaccaggagatgcccct

SEQ ID NO: 518959 - DNA, 25 bp, Mus musculus
acctcttggacctggagatgcccct

SEQ ID NO: 518960 - DNA, 25 bp, Mus musculus
acctcttggaggaagctcatgagtg

SEQ ID NO: 518961 - DNA, 25 bp, Mus musculus
acctcttggaggtagctcatgagtg

SEQ ID NO: 518962 - DNA, 25 bp, Mus musculus
acctctttccggcaggttctccatg

SEQ ID NO: 518963 - DNA, 25 bp, Mus musculus
acctctttccgggaggttctccatg

SEQ ID NO: 518964 - DNA, 25 bp, Mus musculus
acctgaaaaaggcagccatcgtgtt

SEQ ID NO: 518965 - DNA, 25 bp, Mus musculus
acctgaaaaagggagccatcgtgtt

SEQ ID NO: 518966 - DNA, 25 bp, Mus musculus
acctgaaagaaaaagcctgcgggcg

SEQ ID NO: 518967 - DNA, 25 bp, Mus musculus
acctgaaagaaatagcctgcgggcg

SEQ ID NO: 518968 - DNA, 25 bp, Mus musculus
acctgaaagcaaagaccgagtggag

SEQ ID NO: 518969 - DNA, 25 bp, Mus musculus
acctgaaagcaatgaccgagtggag

SEQ ID NO: 518970 - DNA, 25 bp, Mus musculus
acctgaaattcgagagaagatagaa

SEQ ID NO: 518971 - DNA, 25 bp, Mus musculus
acctgaaattcgtgagaagatagaa

SEQ ID NO: 518972 - DNA, 25 bp, Mus musculus
acctgaacaactcacaaagcaacgt

SEQ ID NO: 518973 - DNA, 25 bp, Mus musculus
acctgaacaactgacaaagcaacgt

SEQ ID NO: 518974 - DNA, 25 bp, Mus musculus
acctgaacgtggacaacctgctggg

SEQ ID NO: 518975 - DNA, 25 bp, Mus musculus
acctgaacgtggtcaacctgctggg

SEQ ID NO: 518976 - DNA, 25 bp, Mus musculus
acctgaactttgagcgaggtggtga

SEQ ID NO: 518977 - DNA, 25 bp, Mus musculus
acctgaactttgtgcgaggtggtga

SEQ ID NO: 518978 - DNA, 25 bp, Mus musculus
acctgaagcagtacgagcgcagcat

SEQ ID NO: 518979 - DNA, 25 bp, Mus musculus
acctgaagcagttcgagcgcagcat

SEQ ID NO: 518980 - DNA, 25 bp, Mus musculus
acctgaagctggagcacatcgcctg

SEQ ID NO: 518981 - DNA, 25 bp, Mus musculus
acctgaagctggtgcacatcgcctg

SEQ ID NO: 518982 - DNA, 25 bp, Mus musculus
acctgaaggatcctcagcagttgct

SEQ ID NO: 518983 - DNA, 25 bp, Mus musculus
acctgaaggatcgtcagcagttgct

SEQ ID NO: 518984 - DNA, 25 bp, Mus musculus
acctgaaggcccaagggcagcgcca

SEQ ID NO: 518985 - DNA, 25 bp, Mus musculus
acctgaaggccctagggcagcgcca

SEQ ID NO: 518986 - DNA, 25 bp, Mus musculus
acctgacaccttaacatggcatcct

SEQ ID NO: 518987 - DNA, 25 bp, Mus musculus
acctgacacctttacatggcatcct

SEQ ID NO: 518988 - DNA, 25 bp, Mus musculus
acctgacactccagggcgctggaga

SEQ ID NO: 518989 - DNA, 25 bp, Mus musculus
acctgacactcctgggcgctggaga

SEQ ID NO: 518990 - DNA, 25 bp, Mus musculus
acctgacagagtaggcccagtaccg

SEQ ID NO: 518991 - DNA, 25 bp, Mus musculus
acctgacagagttggcccagtaccg

SEQ ID NO: 518992 - DNA, 25 bp, Mus musculus
acctgacagtcaattgtatgaagtt

SEQ ID NO: 518993 - DNA, 25 bp, Mus musculus
acctgacagtcatttgtatgaagtt

SEQ ID NO: 518994 - DNA, 25 bp, Mus musculus
acctgacatctgaactagggaaaga

SEQ ID NO: 518995 - DNA, 25 bp, Mus musculus
acctgacatctgtactagggaaaga

SEQ ID NO: 518996 - DNA, 25 bp, Mus musculus
acctgaccagcgagagggaagtcct

SEQ ID NO: 518997 - DNA, 25 bp, Mus musculus
acctgaccagcgtgagggaagtcct

SEQ ID NO: 518998 - DNA, 25 bp, Mus musculus
acctgacccgcaagctggcagagat

SEQ ID NO: 518999 - DNA, 25 bp, Mus musculus
acctgacccgcatgctggcagagat

SEQ ID NO: 519000 - DNA, 25 bp, Mus musculus
acctgaccgactctttgttctcttg

SEQ ID NO: 519001 - DNA, 25 bp, Mus musculus
acctgaccgactgtttgttctcttg

SEQ ID NO: 519002 - DNA, 25 bp, Mus musculus
acctgaccgggaagaaattccaatg

SEQ ID NO: 519003 - DNA, 25 bp, Mus musculus
acctgaccgggatgaaattccaatg

SEQ ID NO: 519004 - DNA, 25 bp, Mus musculus
acctgaccgtggatgagggtgtaca

SEQ ID NO: 519005 - DNA, 25 bp, Mus musculus
acctgaccgtggttgagggtgtaca

SEQ ID NO: 519006 - DNA, 25 bp, Mus musculus
acctgacggcgtcacggccacattg

SEQ ID NO: 519007 - DNA, 25 bp, Mus musculus
acctgacggcgtgacggccacattg

SEQ ID NO: 519008 - DNA, 25 bp, Mus musculus
acctgactcaggattgctggatgga

SEQ ID NO: 519009 - DNA, 25 bp, Mus musculus
acctgactcaggtttgctggatgga

SEQ ID NO: 519010 - DNA, 25 bp, Mus musculus
acctgactctgacgcctggagtgcc

SEQ ID NO: 519011 - DNA, 25 bp, Mus musculus
acctgactctgaggcctggagtgcc

SEQ ID NO: 519012 - DNA, 25 bp, Mus musculus
acctgactgagcactgccgggtaga

SEQ ID NO: 519013 - DNA, 25 bp, Mus musculus
acctgactgagctctgccgggtaga

SEQ ID NO: 519014 - DNA, 25 bp, Mus musculus
acctgactgcagaagagcgtcaaga

SEQ ID NO: 519015 - DNA, 25 bp, Mus musculus
acctgactgcagtagagcgtcaaga

SEQ ID NO: 519016 - DNA, 25 bp, Mus musculus
acctgactgtggcatgtgtgcccat

SEQ ID NO: 519017 - DNA, 25 bp, Mus musculus
acctgactgtgggatgtgtgcccat

SEQ ID NO: 519018 - DNA, 25 bp, Mus musculus
acctgactttgtcaacatccagctg

SEQ ID NO: 519019 - DNA, 25 bp, Mus musculus
acctgactttgtgaacatccagctg

SEQ ID NO: 519020 - DNA, 25 bp, Mus musculus
acctgagaaaggagatcaaaaaggc

SEQ ID NO: 519021 - DNA, 25 bp, Mus musculus
acctgagaaaggtgatcaaaaaggc

SEQ ID NO: 519022 - DNA, 25 bp, Mus musculus
acctgagagacaagactatcgggca

SEQ ID NO: 519023 - DNA, 25 bp, Mus musculus
acctgagagacatgactatcgggca

SEQ ID NO: 519024 - DNA, 25 bp, Mus musculus
acctgagagcttcccgcagagggcc

SEQ ID NO: 519025 - DNA, 25 bp, Mus musculus
acctgagagcttgccgcagagggcc

SEQ ID NO: 519026 - DNA, 25 bp, Mus musculus
acctgagagtgtcacttccgcggcg

SEQ ID NO: 519027 - DNA, 25 bp, Mus musculus
acctgagagtgtgacttccgcggcg

SEQ ID NO: 519028 - DNA, 25 bp, Mus musculus
acctgagccattccggcaagactag

SEQ ID NO: 519029 - DNA, 25 bp, Mus musculus
acctgagccattgcggcaagactag

SEQ ID NO: 519030 - DNA, 25 bp, Mus musculus
acctgagctcaactcagctgggcac

SEQ ID NO: 519031 - DNA, 25 bp, Mus musculus
acctgagctcaagtcagctgggcac

SEQ ID NO: 519032 - DNA, 25 bp, Mus musculus
acctgaggacccacggaagtgacag

SEQ ID NO: 519033 - DNA, 25 bp, Mus musculus
acctgaggaccctcggaagtgacag

SEQ ID NO: 519034 - DNA, 25 bp, Mus musculus
acctgaggagagaagtgaagctatg

SEQ ID NO: 519035 - DNA, 25 bp, Mus musculus
acctgaggagagtagtgaagctatg

SEQ ID NO: 519036 - DNA, 25 bp, Mus musculus
acctgaggccctcaggatttccttg

SEQ ID NO: 519037 - DNA, 25 bp, Mus musculus
acctgaggccctgaggatttccttg

SEQ ID NO: 519038 - DNA, 25 bp, Mus musculus
acctgagggacaaccggctccgaga

SEQ ID NO: 519039 - DNA, 25 bp, Mus musculus
acctgagggacatccggctccgaga

SEQ ID NO: 519040 - DNA, 25 bp, Mus musculus
acctgaggtggaagtgctggctctc

SEQ ID NO: 519041 - DNA, 25 bp, Mus musculus
acctgaggtggatgtgctggctctc

SEQ ID NO: 519042 - DNA, 25 bp, Mus musculus
acctgaggttatcaagcagtcggcc

SEQ ID NO: 519043 - DNA, 25 bp, Mus musculus
acctgaggttatgaagcagtcggcc

SEQ ID NO: 519044 - DNA, 25 bp, Mus musculus
acctgagtatcccagaagtggagga

SEQ ID NO: 519045 - DNA, 25 bp, Mus musculus
acctgagtatccgagaagtggagga

SEQ ID NO: 519046 - DNA, 25 bp, Mus musculus
acctgattccgtccttgtgctgtga

SEQ ID NO: 519047 - DNA, 25 bp, Mus musculus
acctgattccgtgcttgtgctgtga

SEQ ID NO: 519048 - DNA, 25 bp, Mus musculus
acctgattgacaagggtcctgaccc

SEQ ID NO: 519049 - DNA, 25 bp, Mus musculus
acctgattgacatgggtcctgaccc

SEQ ID NO: 519050 - DNA, 25 bp, Mus musculus
acctgattgtctctgcgcaagtcca

SEQ ID NO: 519051 - DNA, 25 bp, Mus musculus
acctgattgtctgtgcgcaagtcca

SEQ ID NO: 519052 - DNA, 25 bp, Mus musculus
acctgcaagaagacgggaacccgct

SEQ ID NO: 519053 - DNA, 25 bp, Mus musculus
acctgcaagaagtcgggaacccgct

SEQ ID NO: 519054 - DNA, 25 bp, Mus musculus
acctgcaatgtgcagcagtccttct

SEQ ID NO: 519055 - DNA, 25 bp, Mus musculus
acctgcaatgtggagcagtccttct

SEQ ID NO: 519056 - DNA, 25 bp, Mus musculus
acctgcacaaaactggatttttgcc

SEQ ID NO: 519057 - DNA, 25 bp, Mus musculus
acctgcacaaaagtggatttttgcc

SEQ ID NO: 519058 - DNA, 25 bp, Mus musculus
acctgcacacggaagctggactaac

SEQ ID NO: 519059 - DNA, 25 bp, Mus musculus
acctgcacacggtagctggactaac

SEQ ID NO: 519060 - DNA, 25 bp, Mus musculus
acctgcacagaaagccttgttttcc

SEQ ID NO: 519061 - DNA, 25 bp, Mus musculus
acctgcacagaatgccttgttttcc

SEQ ID NO: 519062 - DNA, 25 bp, Mus musculus
acctgcacctggatgtaatggacgg

SEQ ID NO: 519063 - DNA, 25 bp, Mus musculus
acctgcacctggttgtaatggacgg

SEQ ID NO: 519064 - DNA, 25 bp, Mus musculus
acctgcacgcctcggaaatgaagcc

SEQ ID NO: 519065 - DNA, 25 bp, Mus musculus
acctgcacgcctgggaaatgaagcc

SEQ ID NO: 519066 - DNA, 25 bp, Mus musculus
acctgcactcttcaggagcgccgaa

SEQ ID NO: 519067 - DNA, 25 bp, Mus musculus
acctgcactcttgaggagcgccgaa

SEQ ID NO: 519068 - DNA, 25 bp, Mus musculus
acctgcagagctaggtggcacacca

SEQ ID NO: 519069 - DNA, 25 bp, Mus musculus
acctgcagagcttggtggcacacca

SEQ ID NO: 519070 - DNA, 25 bp, Mus musculus
acctgcagcccgagacattgtccag

SEQ ID NO: 519071 - DNA, 25 bp, Mus musculus
acctgcagcccgtgacattgtccag

SEQ ID NO: 519072 - DNA, 25 bp, Mus musculus
acctgcagctgcagcacggcgctgg

SEQ ID NO: 519073 - DNA, 25 bp, Mus musculus
acctgcagctgctgcacggcgctgg

SEQ ID NO: 519074 - DNA, 25 bp, Mus musculus
acctgcaggaccagggtcatgctcc

SEQ ID NO: 519075 - DNA, 25 bp, Mus musculus
acctgcaggacctgggtcatgctcc

SEQ ID NO: 519076 - DNA, 25 bp, Mus musculus
acctgcaggccaaccttgtcctgga

SEQ ID NO: 519077 - DNA, 25 bp, Mus musculus
acctgcaggccatccttgtcctgga

SEQ ID NO: 519078 - DNA, 25 bp, Mus musculus
acctgcagtaccagccaaaaaggct

SEQ ID NO: 519079 - DNA, 25 bp, Mus musculus
acctgcagtacctgccaaaaaggct

SEQ ID NO: 519080 - DNA, 25 bp, Mus musculus
acctgcatagccagctgcagctgga

SEQ ID NO: 519081 - DNA, 25 bp, Mus musculus
acctgcatagcctgctgcagctgga

SEQ ID NO: 519082 - DNA, 25 bp, Mus musculus
acctgcatcaacctcttcattggca

SEQ ID NO: 519083 - DNA, 25 bp, Mus musculus
acctgcatcaacgtcttcattggca

SEQ ID NO: 519084 - DNA, 25 bp, Mus musculus
acctgcatggcgagaaaggccgccg

SEQ ID NO: 519085 - DNA, 25 bp, Mus musculus
acctgcatggcgtgaaaggccgccg

SEQ ID NO: 519086 - DNA, 25 bp, Mus musculus
acctgcatgtggatctgagcctcct

SEQ ID NO: 519087 - DNA, 25 bp, Mus musculus
acctgcatgtggttctgagcctcct

SEQ ID NO: 519088 - DNA, 25 bp, Mus musculus
acctgccaaaagatatgctccagag

SEQ ID NO: 519089 - DNA, 25 bp, Mus musculus
acctgccaaaagttatgctccagag

SEQ ID NO: 519090 - DNA, 25 bp, Mus musculus
acctgccactgaacactcggcttga

SEQ ID NO: 519091 - DNA, 25 bp, Mus musculus
acctgccactgactgaagcaaggaa

SEQ ID NO: 519092 - DNA, 25 bp, Mus musculus
acctgccactgagtgaagcaaggaa

SEQ ID NO: 519093 - DNA, 25 bp, Mus musculus
acctgccactgatcactcggcttga

SEQ ID NO: 519094 - DNA, 25 bp, Mus musculus
acctgccagatgaacgcgggctgga

SEQ ID NO: 519095 - DNA, 25 bp, Mus musculus
acctgccagatgtacgcgggctgga

SEQ ID NO: 519096 - DNA, 25 bp, Mus musculus
acctgccagcagcaggatttctcca

SEQ ID NO: 519097 - DNA, 25 bp, Mus musculus
acctgccagcaggaggatttctcca

SEQ ID NO: 519098 - DNA, 25 bp, Mus musculus
acctgccagttcagaggctcctgac

SEQ ID NO: 519099 - DNA, 25 bp, Mus musculus
acctgccagttctgaggctcctgac

SEQ ID NO: 519100 - DNA, 25 bp, Mus musculus
acctgcccacctatcttgtggatgc

SEQ ID NO: 519101 - DNA, 25 bp, Mus musculus
acctgcccacctttcttgtggatgc

SEQ ID NO: 519102 - DNA, 25 bp, Mus musculus
acctgcccctttctggagaagttct

SEQ ID NO: 519103 - DNA, 25 bp, Mus musculus
acctgcccctttgtggagaagttct

SEQ ID NO: 519104 - DNA, 25 bp, Mus musculus
acctgccctcacatttgatgactgc

SEQ ID NO: 519105 - DNA, 25 bp, Mus musculus
acctgccctcacttttgatgactgc

SEQ ID NO: 519106 - DNA, 25 bp, Mus musculus
acctgccgctgtccatggatgagca

SEQ ID NO: 519107 - DNA, 25 bp, Mus musculus
acctgccgctgtgcatggatgagca

SEQ ID NO: 519108 - DNA, 25 bp, Mus musculus
acctgccgtgccatgcagcagcgga

SEQ ID NO: 519109 - DNA, 25 bp, Mus musculus
acctgccgtgccttgcagcagcgga

SEQ ID NO: 519110 - DNA, 25 bp, Mus musculus
acctgcctatgcctgggatccttca

SEQ ID NO: 519111 - DNA, 25 bp, Mus musculus
acctgcctatgcgtgggatccttca

SEQ ID NO: 519112 - DNA, 25 bp, Mus musculus
acctgcctctcgacaccgatgaaga

SEQ ID NO: 519113 - DNA, 25 bp, Mus musculus
acctgcctctcgtcaccgatgaaga

SEQ ID NO: 519114 - DNA, 25 bp, Mus musculus
acctgcctcttgagctcgagaacct

SEQ ID NO: 519115 - DNA, 25 bp, Mus musculus
acctgcctcttgtgctcgagaacct

SEQ ID NO: 519116 - DNA, 25 bp, Mus musculus
acctgcctggccacctatctgtaag

SEQ ID NO: 519117 - DNA, 25 bp, Mus musculus
acctgcctggcctcctatctgtaag

SEQ ID NO: 519118 - DNA, 25 bp, Mus musculus
acctgcctgtttactttcagataag

SEQ ID NO: 519119 - DNA, 25 bp, Mus musculus
acctgcctgttttctttcagataag

SEQ ID NO: 519120 - DNA, 25 bp, Mus musculus
acctgccttcagcacgcgtgtattg

SEQ ID NO: 519121 - DNA, 25 bp, Mus musculus
acctgccttcaggacgcgtgtattg

SEQ ID NO: 519122 - DNA, 25 bp, Mus musculus
acctgccttgtgatcctgtttgcct

SEQ ID NO: 519123 - DNA, 25 bp, Mus musculus
acctgccttgtgttcctgtttgcct

SEQ ID NO: 519124 - DNA, 25 bp, Mus musculus
acctgcgcaccaagattgagtctgg

SEQ ID NO: 519125 - DNA, 25 bp, Mus musculus
acctgcgcaccatgattgagtctgg

SEQ ID NO: 519126 - DNA, 25 bp, Mus musculus
acctgcgctgagcacccgggaagtt

SEQ ID NO: 519127 - DNA, 25 bp, Mus musculus
acctgcgctgaggacccgggaagtt

SEQ ID NO: 519128 - DNA, 25 bp, Mus musculus
acctgcggaggaaactgtgtgtgct

SEQ ID NO: 519129 - DNA, 25 bp, Mus musculus
acctgcggaggatactgtgtgtgct

SEQ ID NO: 519130 - DNA, 25 bp, Mus musculus
acctgcggagtgaagccgtggccca

SEQ ID NO: 519131 - DNA, 25 bp, Mus musculus
acctgcggagtgtagccgtggccca

SEQ ID NO: 519132 - DNA, 25 bp, Mus musculus
acctgcggcgccatgagctgcgttt

SEQ ID NO: 519133 - DNA, 25 bp, Mus musculus
acctgcggcgccttgagctgcgttt

SEQ ID NO: 519134 - DNA, 25 bp, Mus musculus
acctgcgggagcagatggagacaat

SEQ ID NO: 519135 - DNA, 25 bp, Mus musculus
acctgcgggagctgatggagacaat

SEQ ID NO: 519136 - DNA, 25 bp, Mus musculus
acctgcggtgatcagcccaagcact

SEQ ID NO: 519137 - DNA, 25 bp, Mus musculus
acctgcggtgatgagcccaagcact

SEQ ID NO: 519138 - DNA, 25 bp, Mus musculus
acctgcgttcctcgaccgcgaatga

SEQ ID NO: 519139 - DNA, 25 bp, Mus musculus
acctgcgttcctggaccgcgaatga

SEQ ID NO: 519140 - DNA, 25 bp, Mus musculus
acctgctatgtcctgtccttcgcaa

SEQ ID NO: 519141 - DNA, 25 bp, Mus musculus
acctgctatgtcgtgtccttcgcaa

SEQ ID NO: 519142 - DNA, 25 bp, Mus musculus
acctgctcactcagagaccagagct

SEQ ID NO: 519143 - DNA, 25 bp, Mus musculus
acctgctcactctgagaccagagct

SEQ ID NO: 519144 - DNA, 25 bp, Mus musculus
acctgctcatccacgagaaggccag

SEQ ID NO: 519145 - DNA, 25 bp, Mus musculus
acctgctcatcctcgagaaggccag

SEQ ID NO: 519146 - DNA, 25 bp, Mus musculus
acctgctctgggacacctaactcaa

SEQ ID NO: 519147 - DNA, 25 bp, Mus musculus
acctgctctgggtcacctaactcaa

SEQ ID NO: 519148 - DNA, 25 bp, Mus musculus
acctgctctgtgattgggcctgatg

SEQ ID NO: 519149 - DNA, 25 bp, Mus musculus
acctgctctgtgtttgggcctgatg

SEQ ID NO: 519150 - DNA, 25 bp, Mus musculus
acctgctgaattacaccggtacaat

SEQ ID NO: 519151 - DNA, 25 bp, Mus musculus
acctgctgaatttcaccggtacaat

SEQ ID NO: 519152 - DNA, 25 bp, Mus musculus
acctgctgacggaccagcgggaaga

SEQ ID NO: 519153 - DNA, 25 bp, Mus musculus
acctgctgacggtccagcgggaaga

SEQ ID NO: 519154 - DNA, 25 bp, Mus musculus
acctgctgagatatcctgctgatcc

SEQ ID NO: 519155 - DNA, 25 bp, Mus musculus
acctgctgagatttcctgctgatcc

SEQ ID NO: 519156 - DNA, 25 bp, Mus musculus
acctgctgcccaacaacaatgacga

SEQ ID NO: 519157 - DNA, 25 bp, Mus musculus
acctgctgcccatcaacaatgacga

SEQ ID NO: 519158 - DNA, 25 bp, Mus musculus
acctgctgccggaatgaatgcagcc

SEQ ID NO: 519159 - DNA, 25 bp, Mus musculus
acctgctgccggtatgaatgcagcc

SEQ ID NO: 519160 - DNA, 25 bp, Mus musculus
acctgctgcgtgaccctgtgacagg

SEQ ID NO: 519161 - DNA, 25 bp, Mus musculus
acctgctgcgtgtccctgtgacagg

SEQ ID NO: 519162 - DNA, 25 bp, Mus musculus
acctgctgctttcccggacttcgga

SEQ ID NO: 519163 - DNA, 25 bp, Mus musculus
acctgctgctttgccggacttcgga

SEQ ID NO: 519164 - DNA, 25 bp, Mus musculus
acctgctggatcagaaactctgtgg

SEQ ID NO: 519165 - DNA, 25 bp, Mus musculus
acctgctggatctgaaactctgtgg

SEQ ID NO: 519166 - DNA, 25 bp, Mus musculus
acctgctggctacgactatgttggc

SEQ ID NO: 519167 - DNA, 25 bp, Mus musculus
acctgctggctaggactatgttggc

SEQ ID NO: 519168 - DNA, 25 bp, Mus musculus
acctgctgtcgcaacaggagctgca

SEQ ID NO: 519169 - DNA, 25 bp, Mus musculus
acctgctgtcgctacaggagctgca

SEQ ID NO: 519170 - DNA, 25 bp, Mus musculus
acctgcttccttcccaagaagatag

SEQ ID NO: 519171 - DNA, 25 bp, Mus musculus
acctgcttccttgccaagaagatag

SEQ ID NO: 519172 - DNA, 25 bp, Mus musculus
acctggaacccaatgaaaccttgat

SEQ ID NO: 519173 - DNA, 25 bp, Mus musculus
acctggaacccattgaaaccttgat

SEQ ID NO: 519174 - DNA, 25 bp, Mus musculus
acctggaactctcttaccgctgcga

SEQ ID NO: 519175 - DNA, 25 bp, Mus musculus
acctggaactctgttaccgctgcga

SEQ ID NO: 519176 - DNA, 25 bp, Mus musculus
acctggaagacccttctgtcctgga

SEQ ID NO: 519177 - DNA, 25 bp, Mus musculus
acctggaagaccgttctgtcctgga

SEQ ID NO: 519178 - DNA, 25 bp, Mus musculus
acctggaaggcacctacaagtgtga

SEQ ID NO: 519179 - DNA, 25 bp, Mus musculus
acctggaaggcagctacaagtgtga

SEQ ID NO: 519180 - DNA, 25 bp, Mus musculus
acctggaagtgtccattgaagtggt

SEQ ID NO: 519181 - DNA, 25 bp, Mus musculus
acctggaagtgtgcattgaagtggt

SEQ ID NO: 519182 - DNA, 25 bp, Mus musculus
acctggaatggaaagcacacaggac

SEQ ID NO: 519183 - DNA, 25 bp, Mus musculus
acctggaatggatagcacacaggac

SEQ ID NO: 519184 - DNA, 25 bp, Mus musculus
acctggaatgtcatcattatctgct

SEQ ID NO: 519185 - DNA, 25 bp, Mus musculus
acctggaatgtcttcattatctgct

SEQ ID NO: 519186 - DNA, 25 bp, Mus musculus
acctggacagaacgccatactgttt

SEQ ID NO: 519187 - DNA, 25 bp, Mus musculus
acctggacagaaggccatactgttt

SEQ ID NO: 519188 - DNA, 25 bp, Mus musculus
acctggacagtcctgaggctcgaga

SEQ ID NO: 519189 - DNA, 25 bp, Mus musculus
acctggacagtcgtgaggctcgaga

SEQ ID NO: 519190 - DNA, 25 bp, Mus musculus
acctggaccggcagatcgagcagct

SEQ ID NO: 519191 - DNA, 25 bp, Mus musculus
acctggaccggctgatcgagcagct

SEQ ID NO: 519192 - DNA, 25 bp, Mus musculus
acctggacctgcaggcaatgttgct

SEQ ID NO: 519193 - DNA, 25 bp, Mus musculus
acctggacctgctggcaatgttgct

SEQ ID NO: 519194 - DNA, 25 bp, Mus musculus
acctggacgtggatgacgtagagat

SEQ ID NO: 519195 - DNA, 25 bp, Mus musculus
acctggacgtggttgacgtagagat

SEQ ID NO: 519196 - DNA, 25 bp, Mus musculus
acctggactactacacggaggtcct

SEQ ID NO: 519197 - DNA, 25 bp, Mus musculus
acctggactacttcacggaggtcct

SEQ ID NO: 519198 - DNA, 25 bp, Mus musculus
acctggagaagaacaggcgagagtc

SEQ ID NO: 519199 - DNA, 25 bp, Mus musculus
acctggagaagatcaggcgagagtc

SEQ ID NO: 519200 - DNA, 25 bp, Mus musculus
acctggagacagatcgtgagcggct

SEQ ID NO: 519201 - DNA, 25 bp, Mus musculus
acctggagacagttcgtgagcggct

SEQ ID NO: 519202 - DNA, 25 bp, Mus musculus
acctggagacctcatcttcgccaag

SEQ ID NO: 519203 - DNA, 25 bp, Mus musculus
acctggagacctgatcttcgccaag

SEQ ID NO: 519204 - DNA, 25 bp, Mus musculus
acctggagcgacagctaaaagaaca

SEQ ID NO: 519205 - DNA, 25 bp, Mus musculus
acctggagcgactgctaaaagaaca

SEQ ID NO: 519206 - DNA, 25 bp, Mus musculus
acctggagcgtcagacttaacagga

SEQ ID NO: 519207 - DNA, 25 bp, Mus musculus
acctggagcgtctgacttaacagga

SEQ ID NO: 519208 - DNA, 25 bp, Mus musculus
acctggagctacagagaaagcataa

SEQ ID NO: 519209 - DNA, 25 bp, Mus musculus
acctggagctactgagaaagcataa

SEQ ID NO: 519210 - DNA, 25 bp, Mus musculus
acctggagctgtcgctacctgttgg

SEQ ID NO: 519211 - DNA, 25 bp, Mus musculus
acctggagctgtggctacctgttgg

SEQ ID NO: 519212 - DNA, 25 bp, Mus musculus
acctggaggatgagtatgagccacg

SEQ ID NO: 519213 - DNA, 25 bp, Mus musculus
acctggaggatgtgtatgagccacg

SEQ ID NO: 519214 - DNA, 25 bp, Mus musculus
acctggaggcaaagtcactattccc

SEQ ID NO: 519215 - DNA, 25 bp, Mus musculus
acctggaggcaatgtcactattccc

SEQ ID NO: 519216 - DNA, 25 bp, Mus musculus
acctggaggcgcagggacacatgtt

SEQ ID NO: 519217 - DNA, 25 bp, Mus musculus
acctggaggcgctgggacacatgtt

SEQ ID NO: 519218 - DNA, 25 bp, Mus musculus
acctggagtgtcagccgcaggacag

SEQ ID NO: 519219 - DNA, 25 bp, Mus musculus
acctggagtgtctgccgcaggacag

SEQ ID NO: 519220 - DNA, 25 bp, Mus musculus
acctggatgagtctgcactgggcac

SEQ ID NO: 519221 - DNA, 25 bp, Mus musculus
acctggatgagtgtgcactgggcac

SEQ ID NO: 519222 - DNA, 25 bp, Mus musculus
acctggatgcttctatactttgctc

SEQ ID NO: 519223 - DNA, 25 bp, Mus musculus
acctggatgcttgtatactttgctc

SEQ ID NO: 519224 - DNA, 25 bp, Mus musculus
acctggatgtgcaccctctgcctgt

SEQ ID NO: 519225 - DNA, 25 bp, Mus musculus
acctggatgtgctccctctgcctgt

SEQ ID NO: 519226 - DNA, 25 bp, Mus musculus
acctggcaataacagtgactgatct

SEQ ID NO: 519227 - DNA, 25 bp, Mus musculus
acctggcaataagagtgactgatct

SEQ ID NO: 519228 - DNA, 25 bp, Mus musculus
acctggcagcgacgacggaacaatt

SEQ ID NO: 519229 - DNA, 25 bp, Mus musculus
acctggcagcgaggacggaacaatt

SEQ ID NO: 519230 - DNA, 25 bp, Mus musculus
acctggcaggcactgaacgagccga

SEQ ID NO: 519231 - DNA, 25 bp, Mus musculus
acctggcaggcagtgaacgagccga

SEQ ID NO: 519232 - DNA, 25 bp, Mus musculus
acctggccataaacctcattcttag

SEQ ID NO: 519233 - DNA, 25 bp, Mus musculus
acctggccataatcctcattcttag

SEQ ID NO: 519234 - DNA, 25 bp, Mus musculus
acctggccatggaagccacctacat

SEQ ID NO: 519235 - DNA, 25 bp, Mus musculus
acctggccatggtagccacctacat

SEQ ID NO: 519236 - DNA, 25 bp, Mus musculus
acctggccgaggcagttctctctag

SEQ ID NO: 519237 - DNA, 25 bp, Mus musculus
acctggccgagggagttctctctag

SEQ ID NO: 519238 - DNA, 25 bp, Mus musculus
acctggcctggcagtatgggccttg

SEQ ID NO: 519239 - DNA, 25 bp, Mus musculus
acctggcctggctgtatgggccttg

SEQ ID NO: 519240 - DNA, 25 bp, Mus musculus
acctggcgcctcaggactcaaagga

SEQ ID NO: 519241 - DNA, 25 bp, Mus musculus
acctggcgcctctggactcaaagga

SEQ ID NO: 519242 - DNA, 25 bp, Mus musculus
acctggcgctcgagcccgggtagct

SEQ ID NO: 519243 - DNA, 25 bp, Mus musculus
acctggcgctcgtgcccgggtagct

SEQ ID NO: 519244 - DNA, 25 bp, Mus musculus
acctggcgctgaaggcggcggaatc

SEQ ID NO: 519245 - DNA, 25 bp, Mus musculus
acctggcgctgatggcggcggaatc

SEQ ID NO: 519246 - DNA, 25 bp, Mus musculus
acctggcgctggagtctgccctggc

SEQ ID NO: 519247 - DNA, 25 bp, Mus musculus
acctggcgctggtgtctgccctggc

SEQ ID NO: 519248 - DNA, 25 bp, Mus musculus
acctggctgcgcagtacgggcatta

SEQ ID NO: 519249 - DNA, 25 bp, Mus musculus
acctggctgcgctgtacgggcatta

SEQ ID NO: 519250 - DNA, 25 bp, Mus musculus
acctggctgggcaaacccagacaac

SEQ ID NO: 519251 - DNA, 25 bp, Mus musculus
acctggctgggctaacccagacaac

SEQ ID NO: 519252 - DNA, 25 bp, Mus musculus
acctgggactggactcgagcagaga

SEQ ID NO: 519253 - DNA, 25 bp, Mus musculus
acctgggactggtctcgagcagaga

SEQ ID NO: 519254 - DNA, 25 bp, Mus musculus
acctgggacttgcagctacaaacaa

SEQ ID NO: 519255 - DNA, 25 bp, Mus musculus
acctgggacttggagctacaaacaa

SEQ ID NO: 519256 - DNA, 25 bp, Mus musculus
acctgggagcccatgcagaactggg

SEQ ID NO: 519257 - DNA, 25 bp, Mus musculus
acctgggagcccttgcagaactggg

SEQ ID NO: 519258 - DNA, 25 bp, Mus musculus
acctgggcacaaaccgccttcagtg

SEQ ID NO: 519259 - DNA, 25 bp, Mus musculus
acctgggcacaatccgccttcagtg

SEQ ID NO: 519260 - DNA, 25 bp, Mus musculus
acctgggccactcacgtagccaaag

SEQ ID NO: 519261 - DNA, 25 bp, Mus musculus
acctgggccactgacgtagccaaag

SEQ ID NO: 519262 - DNA, 25 bp, Mus musculus
acctgggcccgacttacgccttgtg

SEQ ID NO: 519263 - DNA, 25 bp, Mus musculus
acctgggcccgagttacgccttgtg

SEQ ID NO: 519264 - DNA, 25 bp, Mus musculus
acctgggcgcagcagtttcgtctgc

SEQ ID NO: 519265 - DNA, 25 bp, Mus musculus
acctgggcgcaggagtttcgtctgc

SEQ ID NO: 519266 - DNA, 25 bp, Mus musculus
acctgggcgtggacttcctgaccat

SEQ ID NO: 519267 - DNA, 25 bp, Mus musculus
acctgggcgtggtcttcctgaccat

SEQ ID NO: 519268 - DNA, 25 bp, Mus musculus
acctgggctactcggtatggtatac

SEQ ID NO: 519269 - DNA, 25 bp, Mus musculus
acctgggctactgggtatggtatac

SEQ ID NO: 519270 - DNA, 25 bp, Mus musculus
acctgggctgccacagatactggaa

SEQ ID NO: 519271 - DNA, 25 bp, Mus musculus
acctgggctgcctcagatactggaa

SEQ ID NO: 519272 - DNA, 25 bp, Mus musculus
acctgggctggcatgccgacaacat

SEQ ID NO: 519273 - DNA, 25 bp, Mus musculus
acctgggctggcttgccgacaacat

SEQ ID NO: 519274 - DNA, 25 bp, Mus musculus
acctgggtcctgagcgcatcgggcc

SEQ ID NO: 519275 - DNA, 25 bp, Mus musculus
acctgggtcctgtgcgcatcgggcc

SEQ ID NO: 519276 - DNA, 25 bp, Mus musculus
acctgggtgtctaccggcccgtgct

SEQ ID NO: 519277 - DNA, 25 bp, Mus musculus
acctgggtgtcttccggcccgtgct

SEQ ID NO: 519278 - DNA, 25 bp, Mus musculus
acctgggtgttcagagctgggctac

SEQ ID NO: 519279 - DNA, 25 bp, Mus musculus
acctgggtgttctgagctgggctac

SEQ ID NO: 519280 - DNA, 25 bp, Mus musculus
acctggtatatgacctggagcccct

SEQ ID NO: 519281 - DNA, 25 bp, Mus musculus
acctggtatatgtcctggagcccct

SEQ ID NO: 519282 - DNA, 25 bp, Mus musculus
acctggtctatacaaggcattccag

SEQ ID NO: 519283 - DNA, 25 bp, Mus musculus
acctggtctatagaaggcattccag

SEQ ID NO: 519284 - DNA, 25 bp, Mus musculus
acctggtgagccaccgttggacctg

SEQ ID NO: 519285 - DNA, 25 bp, Mus musculus
acctggtgagcctccgttggacctg

SEQ ID NO: 519286 - DNA, 25 bp, Mus musculus
acctggtgatgaaggcagagactca

SEQ ID NO: 519287 - DNA, 25 bp, Mus musculus
acctggtgatgatggcagagactca

SEQ ID NO: 519288 - DNA, 25 bp, Mus musculus
acctggtggcgaccaaaacttgtat

SEQ ID NO: 519289 - DNA, 25 bp, Mus musculus
acctggtggcgagcaaaacttgtat

SEQ ID NO: 519290 - DNA, 25 bp, Mus musculus
acctggtgggagaggtcatgaaccc

SEQ ID NO: 519291 - DNA, 25 bp, Mus musculus
acctggtgggagtggtcatgaaccc

SEQ ID NO: 519292 - DNA, 25 bp, Mus musculus
acctggtgtaccagggtctcgtgga

SEQ ID NO: 519293 - DNA, 25 bp, Mus musculus
acctggtgtacctgggtctcgtgga

SEQ ID NO: 519294 - DNA, 25 bp, Mus musculus
acctggtgtcgcagcagttcgcgga

SEQ ID NO: 519295 - DNA, 25 bp, Mus musculus
acctggtgtcgctgcagttcgcgga

SEQ ID NO: 519296 - DNA, 25 bp, Mus musculus
acctggtgtggtcgctattgacctt

SEQ ID NO: 519297 - DNA, 25 bp, Mus musculus
acctggtgtggtggctattgacctt

SEQ ID NO: 519298 - DNA, 25 bp, Mus musculus
acctggtgtgtcacgggaagacaga

SEQ ID NO: 519299 - DNA, 25 bp, Mus musculus
acctggtgtgtctcgggaagacaga

SEQ ID NO: 519300 - DNA, 25 bp, Mus musculus
acctggttacatccctggcaaaggc

SEQ ID NO: 519301 - DNA, 25 bp, Mus musculus
acctggttacatgcctggcaaaggc

SEQ ID NO: 519302 - DNA, 25 bp, Mus musculus
acctgtaaccgcagtgccccaggtt

SEQ ID NO: 519303 - DNA, 25 bp, Mus musculus
acctgtaaccgctgtgccccaggtt

SEQ ID NO: 519304 - DNA, 25 bp, Mus musculus
acctgtaacggccacgtgtctgtct

SEQ ID NO: 519305 - DNA, 25 bp, Mus musculus
acctgtaacggcgacgtgtctgtct

SEQ ID NO: 519306 - DNA, 25 bp, Mus musculus
acctgtaatgcgcacggaggaccga

SEQ ID NO: 519307 - DNA, 25 bp, Mus musculus
acctgtaatgcggacggaggaccga

SEQ ID NO: 519308 - DNA, 25 bp, Mus musculus
acctgtacatccacggccaggctga

SEQ ID NO: 519309 - DNA, 25 bp, Mus musculus
acctgtacatcctcggccaggctga

SEQ ID NO: 519310 - DNA, 25 bp, Mus musculus
acctgtagccatacatacacggacg

SEQ ID NO: 519311 - DNA, 25 bp, Mus musculus
acctgtagccattcatacacggacg

SEQ ID NO: 519312 - DNA, 25 bp, Mus musculus
acctgtagtgagcaggtgacagctt

SEQ ID NO: 519313 - DNA, 25 bp, Mus musculus
acctgtagtgaggaggtgacagctt

SEQ ID NO: 519314 - DNA, 25 bp, Mus musculus
acctgtatatcccaggactgcagcc

SEQ ID NO: 519315 - DNA, 25 bp, Mus musculus
acctgtatatccgaggactgcagcc

SEQ ID NO: 519316 - DNA, 25 bp, Mus musculus
acctgtatgcgaatgttaatggcgg

SEQ ID NO: 519317 - DNA, 25 bp, Mus musculus
acctgtatgcgattgttaatggcgg

SEQ ID NO: 519318 - DNA, 25 bp, Mus musculus
acctgtcagaccacgtgcttcctgg

SEQ ID NO: 519319 - DNA, 25 bp, Mus musculus
acctgtcagacctcgtgcttcctgg

SEQ ID NO: 519320 - DNA, 25 bp, Mus musculus
acctgtcctccccagatttggaatc

SEQ ID NO: 519321 - DNA, 25 bp, Mus musculus
acctgtcctcccgagatttggaatc

SEQ ID NO: 519322 - DNA, 25 bp, Mus musculus
acctgtctcattacaccggaatctg

SEQ ID NO: 519323 - DNA, 25 bp, Mus musculus
acctgtctcatttcaccggaatctg

SEQ ID NO: 519324 - DNA, 25 bp, Mus musculus
acctgtgaaagtaagtcacacacag

SEQ ID NO: 519325 - DNA, 25 bp, Mus musculus
acctgtgaaagttagtcacacacag

SEQ ID NO: 519326 - DNA, 25 bp, Mus musculus
acctgtgaatttcccagccgaaacg

SEQ ID NO: 519327 - DNA, 25 bp, Mus musculus
acctgtgaatttgccagccgaaacg

SEQ ID NO: 519328 - DNA, 25 bp, Mus musculus
acctgtgcgactacgcggccgtgga

SEQ ID NO: 519329 - DNA, 25 bp, Mus musculus
acctgtgcgacttcgcggccgtgga

SEQ ID NO: 519330 - DNA, 25 bp, Mus musculus
acctgtggaactcggcagttactaa

SEQ ID NO: 519331 - DNA, 25 bp, Mus musculus
acctgtggaactgggcagttactaa

SEQ ID NO: 519332 - DNA, 25 bp, Mus musculus
acctgtggaagaactgcgttaccga

SEQ ID NO: 519333 - DNA, 25 bp, Mus musculus
acctgtggaagatctgcgttaccga

SEQ ID NO: 519334 - DNA, 25 bp, Mus musculus
acctgtggctggaggttctctgctc

SEQ ID NO: 519335 - DNA, 25 bp, Mus musculus
acctgtggctggtggttctctgctc

SEQ ID NO: 519336 - DNA, 25 bp, Mus musculus
acctgtggtcctcgagggttctatg

SEQ ID NO: 519337 - DNA, 25 bp, Mus musculus
acctgtggtcctggagggttctatg

SEQ ID NO: 519338 - DNA, 25 bp, Mus musculus
acctgtggtgaactcctggtcgaca

SEQ ID NO: 519339 - DNA, 25 bp, Mus musculus
acctgtggtgaagtcctggtcgaca

SEQ ID NO: 519340 - DNA, 25 bp, Mus musculus
acctgtggtggacaccacacaaggc

SEQ ID NO: 519341 - DNA, 25 bp, Mus musculus
acctgtggtggagaccacacaaggc

SEQ ID NO: 519342 - DNA, 25 bp, Mus musculus
acctgtgtgagcagcaaaaggtgga

SEQ ID NO: 519343 - DNA, 25 bp, Mus musculus
acctgtgtgagctgcaaaaggtgga

SEQ ID NO: 519344 - DNA, 25 bp, Mus musculus
acctgtgtggtcctgagacacttca

SEQ ID NO: 519345 - DNA, 25 bp, Mus musculus
acctgtgtggtcgtgagacacttca

SEQ ID NO: 519346 - DNA, 25 bp, Mus musculus
acctgtgttacaatgcccctgcttt

SEQ ID NO: 519347 - DNA, 25 bp, Mus musculus
acctgtgttacattgcccctgcttt

SEQ ID NO: 519348 - DNA, 25 bp, Mus musculus
acctgttacacacagcggtgccggg

SEQ ID NO: 519349 - DNA, 25 bp, Mus musculus
acctgttacacagagcggtgccggg

SEQ ID NO: 519350 - DNA, 25 bp, Mus musculus
acctgttcccgtctaactgagcgtg

SEQ ID NO: 519351 - DNA, 25 bp, Mus musculus
acctgttcccgtgtaactgagcgtg

SEQ ID NO: 519352 - DNA, 25 bp, Mus musculus
acctgttcgatacggcggaggtcta

SEQ ID NO: 519353 - DNA, 25 bp, Mus musculus
acctgttcgatagggcggaggtcta

SEQ ID NO: 519354 - DNA, 25 bp, Mus musculus
acctgttggacccagtatagcggca

SEQ ID NO: 519355 - DNA, 25 bp, Mus musculus
acctgttggaccgagtatagcggca

SEQ ID NO: 519356 - DNA, 25 bp, Mus musculus
acctgttggagcagtgggactccct

SEQ ID NO: 519357 - DNA, 25 bp, Mus musculus
acctgttggagctgtgggactccct

SEQ ID NO: 519358 - DNA, 25 bp, Mus musculus
acctgttgtgcaccgggccagcagt

SEQ ID NO: 519359 - DNA, 25 bp, Mus musculus
acctgttgtgcagcgggccagcagt

SEQ ID NO: 519360 - DNA, 25 bp, Mus musculus
acctgtttgaccagtgaggctgagc

SEQ ID NO: 519361 - DNA, 25 bp, Mus musculus
acctgtttgacctgtgaggctgagc

SEQ ID NO: 519362 - DNA, 25 bp, Mus musculus
acctgtttggcactggcagcctgcg

SEQ ID NO: 519363 - DNA, 25 bp, Mus musculus
acctgtttggcagtggcagcctgcg

SEQ ID NO: 519364 - DNA, 25 bp, Mus musculus
accttaagggaacagcagacaagaa

SEQ ID NO: 519365 - DNA, 25 bp, Mus musculus
accttaagggaagagcagacaagaa

SEQ ID NO: 519366 - DNA, 25 bp, Mus musculus
accttacaagcaagcacactgattg

SEQ ID NO: 519367 - DNA, 25 bp, Mus musculus
accttacaagcatgcacactgattg

SEQ ID NO: 519368 - DNA, 25 bp, Mus musculus
accttactgggtaagagatggtgag

SEQ ID NO: 519369 - DNA, 25 bp, Mus musculus
accttactgggttagagatggtgag

SEQ ID NO: 519370 - DNA, 25 bp, Mus musculus
accttaggatcaaacaggtgacagt

SEQ ID NO: 519371 - DNA, 25 bp, Mus musculus
accttaggatcatacaggtgacagt

SEQ ID NO: 519372 - DNA, 25 bp, Mus musculus
accttagggttcatcattgcggact

SEQ ID NO: 519373 - DNA, 25 bp, Mus musculus
accttagggttcttcattgcggact

SEQ ID NO: 519374 - DNA, 25 bp, Mus musculus
accttcaagagtcgacccatccgga

SEQ ID NO: 519375 - DNA, 25 bp, Mus musculus
accttcaagagtggacccatccgga

SEQ ID NO: 519376 - DNA, 25 bp, Mus musculus
accttcacaagaagtatcgagtggg

SEQ ID NO: 519377 - DNA, 25 bp, Mus musculus
accttcacaagatgtatcgagtggg

SEQ ID NO: 519378 - DNA, 25 bp, Mus musculus
accttcaggtggctcagcccagctg

SEQ ID NO: 519379 - DNA, 25 bp, Mus musculus
accttcaggtgggtcagcccagctg

SEQ ID NO: 519380 - DNA, 25 bp, Mus musculus
accttcagtgatctggctcagctca

SEQ ID NO: 519381 - DNA, 25 bp, Mus musculus
accttcagtgatgtggctcagctca

SEQ ID NO: 519382 - DNA, 25 bp, Mus musculus
accttcattgtgattgacatcctta

SEQ ID NO: 519383 - DNA, 25 bp, Mus musculus
accttcattgtgtttgacatcctta

SEQ ID NO: 519384 - DNA, 25 bp, Mus musculus
accttccaaggaataaaagtgctga

SEQ ID NO: 519385 - DNA, 25 bp, Mus musculus
accttccaaggattaaaagtgctga

SEQ ID NO: 519386 - DNA, 25 bp, Mus musculus
accttccagaggagccaagtatgtg

SEQ ID NO: 519387 - DNA, 25 bp, Mus musculus
accttccagaggtgccaagtatgtg

SEQ ID NO: 519388 - DNA, 25 bp, Mus musculus
accttccgacggaggatggagctgc

SEQ ID NO: 519389 - DNA, 25 bp, Mus musculus
accttccgacggtggatggagctgc

SEQ ID NO: 519390 - DNA, 25 bp, Mus musculus
accttccgagatcttagtaagccag

SEQ ID NO: 519391 - DNA, 25 bp, Mus musculus
accttccgagatgttagtaagccag

SEQ ID NO: 519392 - DNA, 25 bp, Mus musculus
accttccggaataatgacaacatta

SEQ ID NO: 519393 - DNA, 25 bp, Mus musculus
accttccggaattatgacaacatta

SEQ ID NO: 519394 - DNA, 25 bp, Mus musculus
accttccggctgctcacagtgtttg

SEQ ID NO: 519395 - DNA, 25 bp, Mus musculus
accttccggctggtcacagtgtttg

SEQ ID NO: 519396 - DNA, 25 bp, Mus musculus
accttcctactgaacagcctactgg

SEQ ID NO: 519397 - DNA, 25 bp, Mus musculus
accttcctactgtacagcctactgg

SEQ ID NO: 519398 - DNA, 25 bp, Mus musculus
accttcctcgggactacggagtgca

SEQ ID NO: 519399 - DNA, 25 bp, Mus musculus
accttcctcgggtctacggagtgca

SEQ ID NO: 519400 - DNA, 25 bp, Mus musculus
accttcctcgtcctcctgtgttcca

SEQ ID NO: 519401 - DNA, 25 bp, Mus musculus
accttcctcgtcgtcctgtgttcca

SEQ ID NO: 519402 - DNA, 25 bp, Mus musculus
accttcctgaagaatacggtgatgg

SEQ ID NO: 519403 - DNA, 25 bp, Mus musculus
accttcctgaagtatacggtgatgg

SEQ ID NO: 519404 - DNA, 25 bp, Mus musculus
accttcgatgatccccagcaggagg

SEQ ID NO: 519405 - DNA, 25 bp, Mus musculus
accttcgatgatgcccagcaggagg

SEQ ID NO: 519406 - DNA, 25 bp, Mus musculus
accttcgccttgctgcctgtcttca

SEQ ID NO: 519407 - DNA, 25 bp, Mus musculus
accttcgccttggtgcctgtcttca

SEQ ID NO: 519408 - DNA, 25 bp, Mus musculus
accttcggacagagtgcagcctgct

SEQ ID NO: 519409 - DNA, 25 bp, Mus musculus
accttcggacagtgtgcagcctgct

SEQ ID NO: 519410 - DNA, 25 bp, Mus musculus
accttcgggcccatgcagaagagcc

SEQ ID NO: 519411 - DNA, 25 bp, Mus musculus
accttcgggcccttgcagaagagcc

SEQ ID NO: 519412 - DNA, 25 bp, Mus musculus
accttcgtgcggctacagcagagtc

SEQ ID NO: 519413 - DNA, 25 bp, Mus musculus
accttcgtgcgggtacagcagagtc

SEQ ID NO: 519414 - DNA, 25 bp, Mus musculus
accttcgtgctacaactgctttcag

SEQ ID NO: 519415 - DNA, 25 bp, Mus musculus
accttcgtgctagaactgctttcag

SEQ ID NO: 519416 - DNA, 25 bp, Mus musculus
accttctctatcaaatgctgtgtgg

SEQ ID NO: 519417 - DNA, 25 bp, Mus musculus
accttctctatctaatgctgtgtgg

SEQ ID NO: 519418 - DNA, 25 bp, Mus musculus
accttctctggacagtgcccggctg

SEQ ID NO: 519419 - DNA, 25 bp, Mus musculus
accttctctggagagtgcccggctg

SEQ ID NO: 519420 - DNA, 25 bp, Mus musculus
accttctgctctcaacccgagaaag

SEQ ID NO: 519421 - DNA, 25 bp, Mus musculus
accttctgctctgaacccgagaaag

SEQ ID NO: 519422 - DNA, 25 bp, Mus musculus
accttctttaagagcacagtggatg

SEQ ID NO: 519423 - DNA, 25 bp, Mus musculus
accttctttaagtgcacagtggatg

SEQ ID NO: 519424 - DNA, 25 bp, Mus musculus
accttgaagatccagtttttgagac

SEQ ID NO: 519425 - DNA, 25 bp, Mus musculus
accttgaagatcgagtttttgagac

SEQ ID NO: 519426 - DNA, 25 bp, Mus musculus
accttgacattaagcttggcaacaa

SEQ ID NO: 519427 - DNA, 25 bp, Mus musculus
accttgacattatgcttggcaacaa

SEQ ID NO: 519428 - DNA, 25 bp, Mus musculus
accttgacctggagcggaactgggt

SEQ ID NO: 519429 - DNA, 25 bp, Mus musculus
accttgacctggtgcggaactgggt

SEQ ID NO: 519430 - DNA, 25 bp, Mus musculus
accttgaggctcagcaactgcgagc

SEQ ID NO: 519431 - DNA, 25 bp, Mus musculus
accttgaggctctgcaactgcgagc

SEQ ID NO: 519432 - DNA, 25 bp, Mus musculus
accttgatgatgctcttatgaagca

SEQ ID NO: 519433 - DNA, 25 bp, Mus musculus
accttgatgatggtcttatgaagca

SEQ ID NO: 519434 - DNA, 25 bp, Mus musculus
accttgcaggctagcaggatggagc

SEQ ID NO: 519435 - DNA, 25 bp, Mus musculus
accttgcaggcttgcaggatggagc

SEQ ID NO: 519436 - DNA, 25 bp, Mus musculus
accttgcccggcagtacgagagcca

SEQ ID NO: 519437 - DNA, 25 bp, Mus musculus
accttgcccggctgtacgagagcca

SEQ ID NO: 519438 - DNA, 25 bp, Mus musculus
accttgccgacgctcgtaggagccg

SEQ ID NO: 519439 - DNA, 25 bp, Mus musculus
accttgccgacggtcgtaggagccg

SEQ ID NO: 519440 - DNA, 25 bp, Mus musculus
accttgcctcgaaaacaaatcaaca

SEQ ID NO: 519441 - DNA, 25 bp, Mus musculus
accttgcctcgataacaaatcaaca

SEQ ID NO: 519442 - DNA, 25 bp, Mus musculus
accttgcgctgtctggcccgtggca

SEQ ID NO: 519443 - DNA, 25 bp, Mus musculus
accttgcgctgtgtggcccgtggca

SEQ ID NO: 519444 - DNA, 25 bp, Mus musculus
accttgctgaacaaccctttgagca

SEQ ID NO: 519445 - DNA, 25 bp, Mus musculus
accttgctgaactaccctttgagca

SEQ ID NO: 519446 - DNA, 25 bp, Mus musculus
accttgctgaagcagtccctgtgac

SEQ ID NO: 519447 - DNA, 25 bp, Mus musculus
accttgctgaaggagtccctgtgac

SEQ ID NO: 519448 - DNA, 25 bp, Mus musculus
accttgctggccctgacacttattg

SEQ ID NO: 519449 - DNA, 25 bp, Mus musculus
accttgctggccgtgacacttattg

SEQ ID NO: 519450 - DNA, 25 bp, Mus musculus
accttggaaaacagcctgctgcccg

SEQ ID NO: 519451 - DNA, 25 bp, Mus musculus
accttggaaaactgcctgctgcccg

SEQ ID NO: 519452 - DNA, 25 bp, Mus musculus
accttggacaagctccctctgtggc

SEQ ID NO: 519453 - DNA, 25 bp, Mus musculus
accttggacaaggtccctctgtggc

SEQ ID NO: 519454 - DNA, 25 bp, Mus musculus
accttggaccagatccggacaattg

SEQ ID NO: 519455 - DNA, 25 bp, Mus musculus
accttggaccagttccggacaattg

SEQ ID NO: 519456 - DNA, 25 bp, Mus musculus
accttggactccatcagaggcttct

SEQ ID NO: 519457 - DNA, 25 bp, Mus musculus
accttggactccttcagaggcttct

SEQ ID NO: 519458 - DNA, 25 bp, Mus musculus
accttggaggatctagcaagaatga

SEQ ID NO: 519459 - DNA, 25 bp, Mus musculus
accttggaggatgtagcaagaatga

SEQ ID NO: 519460 - DNA, 25 bp, Mus musculus
accttggcctgaaaatgcgaccttg

SEQ ID NO: 519461 - DNA, 25 bp, Mus musculus
accttggcctgataatgcgaccttg

SEQ ID NO: 519462 - DNA, 25 bp, Mus musculus
accttggctaatcggatgagcctcc

SEQ ID NO: 519463 - DNA, 25 bp, Mus musculus
accttggctaatgggatgagcctcc

SEQ ID NO: 519464 - DNA, 25 bp, Mus musculus
accttggctggacgcgtcattatca

SEQ ID NO: 519465 - DNA, 25 bp, Mus musculus
accttggctggaggcgtcattatca

SEQ ID NO: 519466 - DNA, 25 bp, Mus musculus
accttgggaattccctgattgagcg

SEQ ID NO: 519467 - DNA, 25 bp, Mus musculus
accttgggaattgcctgattgagcg

SEQ ID NO: 519468 - DNA, 25 bp, Mus musculus
accttgggactgctttaccacaact

SEQ ID NO: 519469 - DNA, 25 bp, Mus musculus
accttgggactggtttaccacaact

SEQ ID NO: 519470 - DNA, 25 bp, Mus musculus
accttgggctacagtgtttctctga

SEQ ID NO: 519471 - DNA, 25 bp, Mus musculus
accttgggctactgtgtttctctga

SEQ ID NO: 519472 - DNA, 25 bp, Mus musculus
accttgggttatcgagcagagaaaa

SEQ ID NO: 519473 - DNA, 25 bp, Mus musculus
accttgggttatggagcagagaaaa

SEQ ID NO: 519474 - DNA, 25 bp, Mus musculus
accttgtactgaagcaccgtgaccc

SEQ ID NO: 519475 - DNA, 25 bp, Mus musculus
accttgtactgatgcaccgtgaccc

SEQ ID NO: 519476 - DNA, 25 bp, Mus musculus
accttgtagagactctcaagttcgc

SEQ ID NO: 519477 - DNA, 25 bp, Mus musculus
accttgtagagagtctcaagttcgc

SEQ ID NO: 519478 - DNA, 25 bp, Mus musculus
accttgtaggtgctaggctctccca

SEQ ID NO: 519479 - DNA, 25 bp, Mus musculus
accttgtaggtggtaggctctccca

SEQ ID NO: 519480 - DNA, 25 bp, Mus musculus
accttgtcaatgactccacggcaac

SEQ ID NO: 519481 - DNA, 25 bp, Mus musculus
accttgtcaatgtctccacggcaac

SEQ ID NO: 519482 - DNA, 25 bp, Mus musculus
accttgtcaccgacatgctctcagg

SEQ ID NO: 519483 - DNA, 25 bp, Mus musculus
accttgtcaccgtcatgctctcagg

SEQ ID NO: 519484 - DNA, 25 bp, Mus musculus
accttgtcatcaaaacacagaacag

SEQ ID NO: 519485 - DNA, 25 bp, Mus musculus
accttgtcatcataacacagaacag

SEQ ID NO: 519486 - DNA, 25 bp, Mus musculus
accttgtggtggcactctgcacagg

SEQ ID NO: 519487 - DNA, 25 bp, Mus musculus
accttgtggtgggactctgcacagg

SEQ ID NO: 519488 - DNA, 25 bp, Mus musculus
accttgttatcactgatggctcttc

SEQ ID NO: 519489 - DNA, 25 bp, Mus musculus
accttgttatcagtgatggctcttc

SEQ ID NO: 519490 - DNA, 25 bp, Mus musculus
accttgttcacaccgcgcagtatgg

SEQ ID NO: 519491 - DNA, 25 bp, Mus musculus
accttgttcacagcgcgcagtatgg

SEQ ID NO: 519492 - DNA, 25 bp, Mus musculus
accttgttcatccagttccagtgca

SEQ ID NO: 519493 - DNA, 25 bp, Mus musculus
accttgttcatcgagttccagtgca

SEQ ID NO: 519494 - DNA, 25 bp, Mus musculus
acctttaggcttcgagttcaggaag

SEQ ID NO: 519495 - DNA, 25 bp, Mus musculus
acctttaggcttggagttcaggaag

SEQ ID NO: 519496 - DNA, 25 bp, Mus musculus
acctttcaccgtaacactgtgcggg

SEQ ID NO: 519497 - DNA, 25 bp, Mus musculus
acctttcaccgttacactgtgcggg

SEQ ID NO: 519498 - DNA, 25 bp, Mus musculus
acctttccctctatggcacacttgg

SEQ ID NO: 519499 - DNA, 25 bp, Mus musculus
acctttccctctttggcacacttgg

SEQ ID NO: 519500 - DNA, 25 bp, Mus musculus
acctttcgaatcatagcagtggaga

SEQ ID NO: 519501 - DNA, 25 bp, Mus musculus
acctttcgaatcttagcagtggaga

SEQ ID NO: 519502 - DNA, 25 bp, Mus musculus
acctttcgtagcaccgccgcaggtg

SEQ ID NO: 519503 - DNA, 25 bp, Mus musculus
acctttcgtagctccgccgcaggtg

SEQ ID NO: 519504 - DNA, 25 bp, Mus musculus
acctttctctctaagtggccccagg

SEQ ID NO: 519505 - DNA, 25 bp, Mus musculus
acctttctctcttagtggccccagg

SEQ ID NO: 519506 - DNA, 25 bp, Mus musculus
acctttctgagaatacatgttccgg

SEQ ID NO: 519507 - DNA, 25 bp, Mus musculus
acctttctgagattacatgttccgg

SEQ ID NO: 519508 - DNA, 25 bp, Mus musculus
acctttgacaaacacggagagcacc

SEQ ID NO: 519509 - DNA, 25 bp, Mus musculus
acctttgacaaagacggagagcacc

SEQ ID NO: 519510 - DNA, 25 bp, Mus musculus
acctttgaggacctgttctctgacc

SEQ ID NO: 519511 - DNA, 25 bp, Mus musculus
acctttgaggacgtgttctctgacc

SEQ ID NO: 519512 - DNA, 25 bp, Mus musculus
acctttgatgacacatggtggcaca

SEQ ID NO: 519513 - DNA, 25 bp, Mus musculus
acctttgatgactcatggtggcaca

SEQ ID NO: 519514 - DNA, 25 bp, Mus musculus
acctttgcagatcaaatttttggag

SEQ ID NO: 519515 - DNA, 25 bp, Mus musculus
acctttgcagatgaaatttttggag

SEQ ID NO: 519516 - DNA, 25 bp, Mus musculus
acctttgtcttcagcacgaacctga

SEQ ID NO: 519517 - DNA, 25 bp, Mus musculus
acctttgtcttctgcacgaacctga

SEQ ID NO: 519518 - DNA, 25 bp, Mus musculus
accttttcaactccgcacaaggcgt

SEQ ID NO: 519519 - DNA, 25 bp, Mus musculus
accttttcaactgcgcacaaggcgt

SEQ ID NO: 519520 - DNA, 25 bp, Mus musculus
accttttcatggctctctcctctgg

SEQ ID NO: 519521 - DNA, 25 bp, Mus musculus
accttttcatgggtctctcctctgg

SEQ ID NO: 519522 - DNA, 25 bp, Mus musculus
acgaaaaagattaccagtctggcca

SEQ ID NO: 519523 - DNA, 25 bp, Mus musculus
acgaaaaagatttccagtctggcca

SEQ ID NO: 519524 - DNA, 25 bp, Mus musculus
acgaaaatcaagatggtgtcatgca

SEQ ID NO: 519525 - DNA, 25 bp, Mus musculus
acgaaaatcaagttggtgtcatgca

SEQ ID NO: 519526 - DNA, 25 bp, Mus musculus
acgaaacaatgaatcagaaaagccc

SEQ ID NO: 519527 - DNA, 25 bp, Mus musculus
acgaaacaatgattcagaaaagccc

SEQ ID NO: 519528 - DNA, 25 bp, Mus musculus
acgaaacactgacgaatttccacca

SEQ ID NO: 519529 - DNA, 25 bp, Mus musculus
acgaaacactgaggaatttccacca

SEQ ID NO: 519530 - DNA, 25 bp, Mus musculus
acgaaaccccggcaggagcagatca

SEQ ID NO: 519531 - DNA, 25 bp, Mus musculus
acgaaaccccgggaggagcagatca

SEQ ID NO: 519532 - DNA, 25 bp, Mus musculus
acgaaacgcccaacaatccaagaag

SEQ ID NO: 519533 - DNA, 25 bp, Mus musculus
acgaaacgcccatcaatccaagaag

SEQ ID NO: 519534 - DNA, 25 bp, Mus musculus
acgaaagccaacaaagacgaagata

SEQ ID NO: 519535 - DNA, 25 bp, Mus musculus
acgaaagccaactaagacgaagata

SEQ ID NO: 519536 - DNA, 25 bp, Mus musculus
acgaaatcctgccaacgttcactat

SEQ ID NO: 519537 - DNA, 25 bp, Mus musculus
acgaaatcctgcgaacgttcactat

SEQ ID NO: 519538 - DNA, 25 bp, Mus musculus
acgaaatctggcctatgacaccctc

SEQ ID NO: 519539 - DNA, 25 bp, Mus musculus
acgaaatctggcgtatgacaccctc

SEQ ID NO: 519540 - DNA, 25 bp, Mus musculus
acgaacaatttcaatgcagcaatct

SEQ ID NO: 519541 - DNA, 25 bp, Mus musculus
acgaacaatttctatgcagcaatct

SEQ ID NO: 519542 - DNA, 25 bp, Mus musculus
acgaactagtggactggttcctgga

SEQ ID NO: 519543 - DNA, 25 bp, Mus musculus
acgaactagtggtctggttcctgga

SEQ ID NO: 519544 - DNA, 25 bp, Mus musculus
acgaactgacccatggctatgacga

SEQ ID NO: 519545 - DNA, 25 bp, Mus musculus
acgaactgacccttggctatgacga

SEQ ID NO: 519546 - DNA, 25 bp, Mus musculus
acgaacttcaccaggaccacaacaa

SEQ ID NO: 519547 - DNA, 25 bp, Mus musculus
acgaacttcacctggaccacaacaa

SEQ ID NO: 519548 - DNA, 25 bp, Mus musculus
acgaagatgaagctagccgcgctgc

SEQ ID NO: 519549 - DNA, 25 bp, Mus musculus
acgaagatgaaggtagccgcgctgc

SEQ ID NO: 519550 - DNA, 25 bp, Mus musculus
acgaagatgtccatgacctgctggg

SEQ ID NO: 519551 - DNA, 25 bp, Mus musculus
acgaagatgtccttgacctgctggg

SEQ ID NO: 519552 - DNA, 25 bp, Mus musculus
acgaagcgagcgacgctctcacaaa

SEQ ID NO: 519553 - DNA, 25 bp, Mus musculus
acgaagcgagcgtcgctctcacaaa

SEQ ID NO: 519554 - DNA, 25 bp, Mus musculus
acgaagctgctgagcgcacggaaga

SEQ ID NO: 519555 - DNA, 25 bp, Mus musculus
acgaagctgctgtgcgcacggaaga

SEQ ID NO: 519556 - DNA, 25 bp, Mus musculus
acgaaggagcgccaagtagcctcac

SEQ ID NO: 519557 - DNA, 25 bp, Mus musculus
acgaaggagcgcgaagtagcctcac

SEQ ID NO: 519558 - DNA, 25 bp, Mus musculus
acgaaggatacacgcctttgatgga

SEQ ID NO: 519559 - DNA, 25 bp, Mus musculus
acgaaggatacaggcctttgatgga

SEQ ID NO: 519560 - DNA, 25 bp, Mus musculus
acgaagggctttccacgtgtcgccg

SEQ ID NO: 519561 - DNA, 25 bp, Mus musculus
acgaagggctttgcacgtgtcgccg

SEQ ID NO: 519562 - DNA, 25 bp, Mus musculus
acgaataggatgattgtccttactg

SEQ ID NO: 519563 - DNA, 25 bp, Mus musculus
acgaataggatgtttgtccttactg

SEQ ID NO: 519564 - DNA, 25 bp, Mus musculus
acgaatcaaactaggattcactcag

SEQ ID NO: 519565 - DNA, 25 bp, Mus musculus
acgaatcaaacttggattcactcag

SEQ ID NO: 519566 - DNA, 25 bp, Mus musculus
acgaatgaggaaccacctcctcctg

SEQ ID NO: 519567 - DNA, 25 bp, Mus musculus
acgaatgaggaagcacctcctcctg

SEQ ID NO: 519568 - DNA, 25 bp, Mus musculus
acgaatgatgcacgaagggctgtgg

SEQ ID NO: 519569 - DNA, 25 bp, Mus musculus
acgaatgatgcaggaagggctgtgg

SEQ ID NO: 519570 - DNA, 25 bp, Mus musculus
acgaatgccgtcaccctggtacctg

SEQ ID NO: 519571 - DNA, 25 bp, Mus musculus
acgaatgccgtctccctggtacctg

SEQ ID NO: 519572 - DNA, 25 bp, Mus musculus
acgaatgcctggacaataatggtgg

SEQ ID NO: 519573 - DNA, 25 bp, Mus musculus
acgaatgcctggtcaataatggtgg

SEQ ID NO: 519574 - DNA, 25 bp, Mus musculus
acgaattgctcactcttgctagcag

SEQ ID NO: 519575 - DNA, 25 bp, Mus musculus
acgaattgctcagtcttgctagcag

SEQ ID NO: 519576 - DNA, 25 bp, Mus musculus
acgacaacatgtcctactctgtgga

SEQ ID NO: 519577 - DNA, 25 bp, Mus musculus
acgacaacatgtgctactctgtgga

SEQ ID NO: 519578 - DNA, 25 bp, Mus musculus
acgacaagggcaatctcaaccgctg

SEQ ID NO: 519579 - DNA, 25 bp, Mus musculus
acgacaagggcattctcaaccgctg

SEQ ID NO: 519580 - DNA, 25 bp, Mus musculus
acgacagaaccaagcccgtgagctg

SEQ ID NO: 519581 - DNA, 25 bp, Mus musculus
acgacagaaccatgcccgtgagctg

SEQ ID NO: 519582 - DNA, 25 bp, Mus musculus
acgacagacactaggccctggctag

SEQ ID NO: 519583 - DNA, 25 bp, Mus musculus
acgacagacacttggccctggctag

SEQ ID NO: 519584 - DNA, 25 bp, Mus musculus
acgacagggacgctgattacgtatc

SEQ ID NO: 519585 - DNA, 25 bp, Mus musculus
acgacagggacggtgattacgtatc

SEQ ID NO: 519586 - DNA, 25 bp, Mus musculus
acgacagtgcgcaggccagattcct

SEQ ID NO: 519587 - DNA, 25 bp, Mus musculus
acgacagtgcgctggccagattcct

SEQ ID NO: 519588 - DNA, 25 bp, Mus musculus
acgacatggcttccctggccgagct

SEQ ID NO: 519589 - DNA, 25 bp, Mus musculus
acgacatggcttgcctggccgagct

SEQ ID NO: 519590 - DNA, 25 bp, Mus musculus
acgaccacagcaacccctggtgggt

SEQ ID NO: 519591 - DNA, 25 bp, Mus musculus
acgaccacagcatcccctggtgggt

SEQ ID NO: 519592 - DNA, 25 bp, Mus musculus
acgaccacttgacgcggcagcacga

SEQ ID NO: 519593 - DNA, 25 bp, Mus musculus
acgaccacttgaggcggcagcacga

SEQ ID NO: 519594 - DNA, 25 bp, Mus musculus
acgaccagctcacccgggagatgaa

SEQ ID NO: 519595 - DNA, 25 bp, Mus musculus
acgaccagctcagccgggagatgaa

SEQ ID NO: 519596 - DNA, 25 bp, Mus musculus
acgacccatacaagcacactgcggg

SEQ ID NO: 519597 - DNA, 25 bp, Mus musculus
acgacccatacatgcacactgcggg

SEQ ID NO: 519598 - DNA, 25 bp, Mus musculus
acgaccccgatgagggcaacttcca

SEQ ID NO: 519599 - DNA, 25 bp, Mus musculus
acgaccccgatgtgggcaacttcca

SEQ ID NO: 519600 - DNA, 25 bp, Mus musculus
acgaccccttggagcacgaaagcct

SEQ ID NO: 519601 - DNA, 25 bp, Mus musculus
acgaccccttggtgcacgaaagcct

SEQ ID NO: 519602 - DNA, 25 bp, Mus musculus
acgaccctactgatgtggcctccaa

SEQ ID NO: 519603 - DNA, 25 bp, Mus musculus
acgaccctactgttgtggcctccaa

SEQ ID NO: 519604 - DNA, 25 bp, Mus musculus
acgaccctgtgcctatcttcagaca

SEQ ID NO: 519605 - DNA, 25 bp, Mus musculus
acgaccctgtgcgtatcttcagaca

SEQ ID NO: 519606 - DNA, 25 bp, Mus musculus
acgaccgcaccgagcgggaaccaga

SEQ ID NO: 519607 - DNA, 25 bp, Mus musculus
acgaccgcaccgtgcgggaaccaga

SEQ ID NO: 519608 - DNA, 25 bp, Mus musculus
acgaccgcctctcctttgtcatgga

SEQ ID NO: 519609 - DNA, 25 bp, Mus musculus
acgaccgcctctgctttgtcatgga

SEQ ID NO: 519610 - DNA, 25 bp, Mus musculus
acgaccgctaagatatccacagaca

SEQ ID NO: 519611 - DNA, 25 bp, Mus musculus
acgaccgctaagttatccacagaca

SEQ ID NO: 519612 - DNA, 25 bp, Mus musculus
acgacctctatgactccgacgcatt

SEQ ID NO: 519613 - DNA, 25 bp, Mus musculus
acgacctctatgtctccgacgcatt

SEQ ID NO: 519614 - DNA, 25 bp, Mus musculus
acgaccttgcgaccggatctgggac

SEQ ID NO: 519615 - DNA, 25 bp, Mus musculus
acgaccttgcgagcggatctgggac

SEQ ID NO: 519616 - DNA, 25 bp, Mus musculus
acgacgccccacagagcgaggctgg

SEQ ID NO: 519617 - DNA, 25 bp, Mus musculus
acgacgccccactgagcgaggctgg

SEQ ID NO: 519618 - DNA, 25 bp, Mus musculus
acgacgcgggcaagctctatgccat

SEQ ID NO: 519619 - DNA, 25 bp, Mus musculus
acgacgcgggcatgctctatgccat

SEQ ID NO: 519620 - DNA, 25 bp, Mus musculus
acgacggcacgccaagctgaagcca

SEQ ID NO: 519621 - DNA, 25 bp, Mus musculus
acgacggcacgcgaagctgaagcca

SEQ ID NO: 519622 - DNA, 25 bp, Mus musculus
acgacgggaatcagcctccagctca

SEQ ID NO: 519623 - DNA, 25 bp, Mus musculus
acgacgggaatctgcctccagctca

SEQ ID NO: 519624 - DNA, 25 bp, Mus musculus
acgacggtccccacagtgccttata

SEQ ID NO: 519625 - DNA, 25 bp, Mus musculus
acgacggtcccctcagtgccttata

SEQ ID NO: 519626 - DNA, 25 bp, Mus musculus
acgactccaacaacgggattcccga

SEQ ID NO: 519627 - DNA, 25 bp, Mus musculus
acgactccaacatcgggattcccga

SEQ ID NO: 519628 - DNA, 25 bp, Mus musculus
acgactctgggcacttggcttctca

SEQ ID NO: 519629 - DNA, 25 bp, Mus musculus
acgactctgggctcttggcttctca

SEQ ID NO: 519630 - DNA, 25 bp, Mus musculus
acgagaagcggcagtactgaggaca

SEQ ID NO: 519631 - DNA, 25 bp, Mus musculus
acgagaagcggctgtactgaggaca

SEQ ID NO: 519632 - DNA, 25 bp, Mus musculus
acgagaagctggatatggtcaaggc

SEQ ID NO: 519633 - DNA, 25 bp, Mus musculus
acgagaagctggttatggtcaaggc

SEQ ID NO: 519634 - DNA, 25 bp, Mus musculus
acgagaccaggtctcagtacgaggc

SEQ ID NO: 519635 - DNA, 25 bp, Mus musculus
acgagaccaggtgtcagtacgaggc

SEQ ID NO: 519636 - DNA, 25 bp, Mus musculus
acgagagactgaacgcgcgcgtcaa

SEQ ID NO: 519637 - DNA, 25 bp, Mus musculus
acgagagactgatcgcgcgcgtcaa

SEQ ID NO: 519638 - DNA, 25 bp, Mus musculus
acgagagcctttactcccggcagct

SEQ ID NO: 519639 - DNA, 25 bp, Mus musculus
acgagagccttttctcccggcagct

SEQ ID NO: 519640 - DNA, 25 bp, Mus musculus
acgagaggaacgagtccacgcgcca

SEQ ID NO: 519641 - DNA, 25 bp, Mus musculus
acgagaggaacgtgtccacgcgcca

SEQ ID NO: 519642 - DNA, 25 bp, Mus musculus
acgagagtctgcaccgaggtctgag

SEQ ID NO: 519643 - DNA, 25 bp, Mus musculus
acgagagtctgctccgaggtctgag

SEQ ID NO: 519644 - DNA, 25 bp, Mus musculus
acgagatagaccatcaaacagagaa

SEQ ID NO: 519645 - DNA, 25 bp, Mus musculus
acgagatagaccttcaaacagagaa

SEQ ID NO: 519646 - DNA, 25 bp, Mus musculus
acgagatcgcctacccgctggtgga

SEQ ID NO: 519647 - DNA, 25 bp, Mus musculus
acgagatcgccttcccgctggtgga

SEQ ID NO: 519648 - DNA, 25 bp, Mus musculus
acgagatctatgacggaatagagga

SEQ ID NO: 519649 - DNA, 25 bp, Mus musculus
acgagatctatgtcggaatagagga

SEQ ID NO: 519650 - DNA, 25 bp, Mus musculus
acgagatgaaggaggtcacagccct

SEQ ID NO: 519651 - DNA, 25 bp, Mus musculus
acgagatgaaggtggtcacagccct

SEQ ID NO: 519652 - DNA, 25 bp, Mus musculus
acgagatgccaccagaggctctgag

SEQ ID NO: 519653 - DNA, 25 bp, Mus musculus
acgagatgccacgagaggctctgag

SEQ ID NO: 519654 - DNA, 25 bp, Mus musculus
acgagcaagctacgctctggagaag

SEQ ID NO: 519655 - DNA, 25 bp, Mus musculus
acgagcaagctaggctctggagaag

SEQ ID NO: 519656 - DNA, 25 bp, Mus musculus
acgagcagagctccgcggccatcta

SEQ ID NO: 519657 - DNA, 25 bp, Mus musculus
acgagcagagctgcgcggccatcta

SEQ ID NO: 519658 - DNA, 25 bp, Mus musculus
acgagcagttgcatgcaggcagcat

SEQ ID NO: 519659 - DNA, 25 bp, Mus musculus
acgagcagttgcttgcaggcagcat

SEQ ID NO: 519660 - DNA, 25 bp, Mus musculus
acgagcccatgcacgacgtctgctg

SEQ ID NO: 519661 - DNA, 25 bp, Mus musculus
acgagcccatgctcgacgtctgctg

SEQ ID NO: 519662 - DNA, 25 bp, Mus musculus
acgagcctccctcatgcagagattt

SEQ ID NO: 519663 - DNA, 25 bp, Mus musculus
acgagcctccctgatgcagagattt

SEQ ID NO: 519664 - DNA, 25 bp, Mus musculus
acgagcgcccgacaggcagacctaa

SEQ ID NO: 519665 - DNA, 25 bp, Mus musculus
acgagcgcccgagaggcagacctaa

SEQ ID NO: 519666 - DNA, 25 bp, Mus musculus
acgagcgccgctaccgttgtggaga

SEQ ID NO: 519667 - DNA, 25 bp, Mus musculus
acgagcgccgcttccgttgtggaga

SEQ ID NO: 519668 - DNA, 25 bp, Mus musculus
acgagcgcctctcggaacctcatgg

SEQ ID NO: 519669 - DNA, 25 bp, Mus musculus
acgagcgcctctgggaacctcatgg

SEQ ID NO: 519670 - DNA, 25 bp, Mus musculus
acgagcgcgcacagcggctgctgca

SEQ ID NO: 519671 - DNA, 25 bp, Mus musculus
acgagcgcgcactgcggctgctgca

SEQ ID NO: 519672 - DNA, 25 bp, Mus musculus
acgagcggactcacagtgtgctggc

SEQ ID NO: 519673 - DNA, 25 bp, Mus musculus
acgagcggactctcagtgtgctggc

SEQ ID NO: 519674 - DNA, 25 bp, Mus musculus
acgagctgaatcacagcggtaatag

SEQ ID NO: 519675 - DNA, 25 bp, Mus musculus
acgagctgaatctcagcggtaatag

SEQ ID NO: 519676 - DNA, 25 bp, Mus musculus
acgagctggaccacgccctcaatga

SEQ ID NO: 519677 - DNA, 25 bp, Mus musculus
acgagctggacctcgccctcaatga

SEQ ID NO: 519678 - DNA, 25 bp, Mus musculus
acgagctgtgccctccagaagcagt

SEQ ID NO: 519679 - DNA, 25 bp, Mus musculus
acgagctgtgccgtccagaagcagt

SEQ ID NO: 519680 - DNA, 25 bp, Mus musculus
acgagcttctgtcggccgtgttgac

SEQ ID NO: 519681 - DNA, 25 bp, Mus musculus
acgagcttctgtgggccgtgttgac

SEQ ID NO: 519682 - DNA, 25 bp, Mus musculus
acgaggaaccctatgcagcatggca

SEQ ID NO: 519683 - DNA, 25 bp, Mus musculus
acgaggaaccctttgcagcatggca

SEQ ID NO: 519684 - DNA, 25 bp, Mus musculus
acgaggaagaatacgaggcatggaa

SEQ ID NO: 519685 - DNA, 25 bp, Mus musculus
acgaggaagaattcgaggcatggaa

SEQ ID NO: 519686 - DNA, 25 bp, Mus musculus
acgaggacaatgcagctcaagtcca

SEQ ID NO: 519687 - DNA, 25 bp, Mus musculus
acgaggacaatggagctcaagtcca

SEQ ID NO: 519688 - DNA, 25 bp, Mus musculus
acgaggaccagcagcccttctccaa

SEQ ID NO: 519689 - DNA, 25 bp, Mus musculus
acgaggaccagctgcccttctccaa

SEQ ID NO: 519690 - DNA, 25 bp, Mus musculus
acgaggagcgccagacacgcttcca

SEQ ID NO: 519691 - DNA, 25 bp, Mus musculus
acgaggagcgcctgacacgcttcca

SEQ ID NO: 519692 - DNA, 25 bp, Mus musculus
acgaggcctatccagaccacatgtg

SEQ ID NO: 519693 - DNA, 25 bp, Mus musculus
acgaggcctatcgagaccacatgtg

SEQ ID NO: 519694 - DNA, 25 bp, Mus musculus
acgaggccttggacggtccgcgact

SEQ ID NO: 519695 - DNA, 25 bp, Mus musculus
acgaggccttggtcggtccgcgact

SEQ ID NO: 519696 - DNA, 25 bp, Mus musculus
acgaggcgctgcaggactatgagct

SEQ ID NO: 519697 - DNA, 25 bp, Mus musculus
acgaggcgctgctggactatgagct

SEQ ID NO: 519698 - DNA, 25 bp, Mus musculus
acgaggcgtttcacactcatgacgc

SEQ ID NO: 519699 - DNA, 25 bp, Mus musculus
acgaggcgtttctcactcatgacgc

SEQ ID NO: 519700 - DNA, 25 bp, Mus musculus
acgaggctcgcacagtcttccgcgt

SEQ ID NO: 519701 - DNA, 25 bp, Mus musculus
acgaggctcgcagagtcttccgcgt

SEQ ID NO: 519702 - DNA, 25 bp, Mus musculus
acgaggctgcgcagtatggcaagac

SEQ ID NO: 519703 - DNA, 25 bp, Mus musculus
acgaggctgcgctgtatggcaagac

SEQ ID NO: 519704 - DNA, 25 bp, Mus musculus
acgagggctccaactgtgacaccaa

SEQ ID NO: 519705 - DNA, 25 bp, Mus musculus
acgagggctccatctgtgacaccaa

SEQ ID NO: 519706 - DNA, 25 bp, Mus musculus
acgagggctcttacacatgcagtgc

SEQ ID NO: 519707 - DNA, 25 bp, Mus musculus
acgagggctctttcacatgcagtgc

SEQ ID NO: 519708 - DNA, 25 bp, Mus musculus
acgagggctgagcatatctccagct

SEQ ID NO: 519709 - DNA, 25 bp, Mus musculus
acgagggctgaggatatctccagct

SEQ ID NO: 519710 - DNA, 25 bp, Mus musculus
acgagggctgtcagattgagatcct

SEQ ID NO: 519711 - DNA, 25 bp, Mus musculus
acgagggctgtctgattgagatcct

SEQ ID NO: 519712 - DNA, 25 bp, Mus musculus
acgaggtggtgcaggtctttgacac

SEQ ID NO: 519713 - DNA, 25 bp, Mus musculus
acgaggtggtgctggtctttgacac

SEQ ID NO: 519714 - DNA, 25 bp, Mus musculus
acgagtacaacaccggcacggtctg

SEQ ID NO: 519715 - DNA, 25 bp, Mus musculus
acgagtacaacagcggcacggtctg

SEQ ID NO: 519716 - DNA, 25 bp, Mus musculus
acgagtcccaaaattggaaaagctg

SEQ ID NO: 519717 - DNA, 25 bp, Mus musculus
acgagtcccaaatttggaaaagctg

SEQ ID NO: 519718 - DNA, 25 bp, Mus musculus
acgagtccgacaccttccgtggcta

SEQ ID NO: 519719 - DNA, 25 bp, Mus musculus
acgagtccgacagcttccgtggcta

SEQ ID NO: 519720 - DNA, 25 bp, Mus musculus
acgagtcctccgagagcgagctggt

SEQ ID NO: 519721 - DNA, 25 bp, Mus musculus
acgagtcctccgtgagcgagctggt

SEQ ID NO: 519722 - DNA, 25 bp, Mus musculus
acgagtcgcgtgctgactctctggc

SEQ ID NO: 519723 - DNA, 25 bp, Mus musculus
acgagtcgcgtggtgactctctggc

SEQ ID NO: 519724 - DNA, 25 bp, Mus musculus
acgagtcgggccaggacacctacag

SEQ ID NO: 519725 - DNA, 25 bp, Mus musculus
acgagtcgggcctggacacctacag

SEQ ID NO: 519726 - DNA, 25 bp, Mus musculus
acgagtctcagtccgaccgggctag

SEQ ID NO: 519727 - DNA, 25 bp, Mus musculus
acgagtctcagtgcgaccgggctag

SEQ ID NO: 519728 - DNA, 25 bp, Mus musculus
acgagtctgacaacaatgccatatg

SEQ ID NO: 519729 - DNA, 25 bp, Mus musculus
acgagtctgacatcaatgccatatg

SEQ ID NO: 519730 - DNA, 25 bp, Mus musculus
acgagtgcttccaggagccgggacc

SEQ ID NO: 519731 - DNA, 25 bp, Mus musculus
acgagtgcttcctggagccgggacc

SEQ ID NO: 519732 - DNA, 25 bp, Mus musculus
acgagtgtcgcgaccctagcacctg

SEQ ID NO: 519733 - DNA, 25 bp, Mus musculus
acgagtgtcgcgtccctagcacctg

SEQ ID NO: 519734 - DNA, 25 bp, Mus musculus
acgagtgtgccacccgagcctcgtg

SEQ ID NO: 519735 - DNA, 25 bp, Mus musculus
acgagtgtgccagccgagcctcgtg

SEQ ID NO: 519736 - DNA, 25 bp, Mus musculus
acgagtgtggccagaagcctcggcc

SEQ ID NO: 519737 - DNA, 25 bp, Mus musculus
acgagtgtggcctgaagcctcggcc

SEQ ID NO: 519738 - DNA, 25 bp, Mus musculus
acgagtgtggtgatgtcctggtcat

SEQ ID NO: 519739 - DNA, 25 bp, Mus musculus
acgagtgtggtgttgtcctggtcat

SEQ ID NO: 519740 - DNA, 25 bp, Mus musculus
acgagttcaccgacctgaacctcgt

SEQ ID NO: 519741 - DNA, 25 bp, Mus musculus
acgagttcaccgtcctgaacctcgt

SEQ ID NO: 519742 - DNA, 25 bp, Mus musculus
acgagtttaggacccagcacctcaa

SEQ ID NO: 519743 - DNA, 25 bp, Mus musculus
acgagtttaggagccagcacctcaa

SEQ ID NO: 519744 - DNA, 25 bp, Mus musculus
acgagtttctggcacggatcaatga

SEQ ID NO: 519745 - DNA, 25 bp, Mus musculus
acgagtttctgggacggatcaatga

SEQ ID NO: 519746 - DNA, 25 bp, Mus musculus
acgataccaacgaggtccacaccgt

SEQ ID NO: 519747 - DNA, 25 bp, Mus musculus
acgataccaacgtggtccacaccgt

SEQ ID NO: 519748 - DNA, 25 bp, Mus musculus
acgatcactctgactgatgtcaacg

SEQ ID NO: 519749 - DNA, 25 bp, Mus musculus
acgatcactctgtctgatgtcaacg

SEQ ID NO: 519750 - DNA, 25 bp, Mus musculus
acgatctccgaaatttggagcagga

SEQ ID NO: 519751 - DNA, 25 bp, Mus musculus
acgatctccgaattttggagcagga

SEQ ID NO: 519752 - DNA, 25 bp, Mus musculus
acgatgaacgcaagggcagcaacct

SEQ ID NO: 519753 - DNA, 25 bp, Mus musculus
acgatgaacgcatgggcagcaacct

SEQ ID NO: 519754 - DNA, 25 bp, Mus musculus
acgatgaccaccatgccttggccga

SEQ ID NO: 519755 - DNA, 25 bp, Mus musculus
acgatgaccaccttgccttggccga

SEQ ID NO: 519756 - DNA, 25 bp, Mus musculus
acgatgaccagtcctttcatgctga

SEQ ID NO: 519757 - DNA, 25 bp, Mus musculus
acgatgaccagtgctttcatgctga

SEQ ID NO: 519758 - DNA, 25 bp, Mus musculus
acgatgacgatcagggcccaccagc

SEQ ID NO: 519759 - DNA, 25 bp, Mus musculus
acgatgacgatctgggcccaccagc

SEQ ID NO: 519760 - DNA, 25 bp, Mus musculus
acgatgacgtatagcccacctcggg

SEQ ID NO: 519761 - DNA, 25 bp, Mus musculus
acgatgacgtattgcccacctcggg

SEQ ID NO: 519762 - DNA, 25 bp, Mus musculus
acgatgactcctcctcggaggagaa

SEQ ID NO: 519763 - DNA, 25 bp, Mus musculus
acgatgactcctgctcggaggagaa

SEQ ID NO: 519764 - DNA, 25 bp, Mus musculus
acgatgagacccagaggcttcggca

SEQ ID NO: 519765 - DNA, 25 bp, Mus musculus
acgatgagaccctgaggcttcggca

SEQ ID NO: 519766 - DNA, 25 bp, Mus musculus
acgatgaggcctactccactgaacc

SEQ ID NO: 519767 - DNA, 25 bp, Mus musculus
acgatgaggccttctccactgaacc

SEQ ID NO: 519768 - DNA, 25 bp, Mus musculus
acgatgaggtccaaacacgcctgca

SEQ ID NO: 519769 - DNA, 25 bp, Mus musculus
acgatgaggtcctaacacgcctgca

SEQ ID NO: 519770 - DNA, 25 bp, Mus musculus
acgatgatgactacgttgatgaagg

SEQ ID NO: 519771 - DNA, 25 bp, Mus musculus
acgatgatgacttcgttgatgaagg

SEQ ID NO: 519772 - DNA, 25 bp, Mus musculus
acgatgcctccacagcttccggaaa

SEQ ID NO: 519773 - DNA, 25 bp, Mus musculus
acgatgcctccagagcttccggaaa

SEQ ID NO: 519774 - DNA, 25 bp, Mus musculus
acgatgctccttacatgttcctgga

SEQ ID NO: 519775 - DNA, 25 bp, Mus musculus
acgatgctcctttcatgttcctgga

SEQ ID NO: 519776 - DNA, 25 bp, Mus musculus
acgatgctctcaccatccgggagag

SEQ ID NO: 519777 - DNA, 25 bp, Mus musculus
acgatgctctcagcatccgggagag

SEQ ID NO: 519778 - DNA, 25 bp, Mus musculus
acgatgctgactcagatcatgtcca

SEQ ID NO: 519779 - DNA, 25 bp, Mus musculus
acgatgctgactgagatcatgtcca

SEQ ID NO: 519780 - DNA, 25 bp, Mus musculus
acgatgcttcaaaaaatacagaccc

SEQ ID NO: 519781 - DNA, 25 bp, Mus musculus
acgatgcttcaataaatacagaccc

SEQ ID NO: 519782 - DNA, 25 bp, Mus musculus
acgatggactgacacgatgcacgcc

SEQ ID NO: 519783 - DNA, 25 bp, Mus musculus
acgatggactgagacgatgcacgcc

SEQ ID NO: 519784 - DNA, 25 bp, Mus musculus
acgatggatttgactgtgtttatgg

SEQ ID NO: 519785 - DNA, 25 bp, Mus musculus
acgatggatttgtctgtgtttatgg

SEQ ID NO: 519786 - DNA, 25 bp, Mus musculus
acgatggcaaccagctggagtgcgt

SEQ ID NO: 519787 - DNA, 25 bp, Mus musculus
acgatggcaacctgctggagtgcgt

SEQ ID NO: 519788 - DNA, 25 bp, Mus musculus
acgatggcactaacaccttcttttg

SEQ ID NO: 519789 - DNA, 25 bp, Mus musculus
acgatggcactatcaccttcttttg

SEQ ID NO: 519790 - DNA, 25 bp, Mus musculus
acgatgggcccacgctcaagtcaag

SEQ ID NO: 519791 - DNA, 25 bp, Mus musculus
acgatgggcccaggctcaagtcaag

SEQ ID NO: 519792 - DNA, 25 bp, Mus musculus
acgatgtgattaataacggtcattc

SEQ ID NO: 519793 - DNA, 25 bp, Mus musculus
acgatgtgattattaacggtcattc

SEQ ID NO: 519794 - DNA, 25 bp, Mus musculus
acgatgtgcgcccagccttcttggg

SEQ ID NO: 519795 - DNA, 25 bp, Mus musculus
acgatgtgcgccgagccttcttggg

SEQ ID NO: 519796 - DNA, 25 bp, Mus musculus
acgatgtggaccaagagctgcgcct

SEQ ID NO: 519797 - DNA, 25 bp, Mus musculus
acgatgtggacctagagctgcgcct

SEQ ID NO: 519798 - DNA, 25 bp, Mus musculus
acgatgtgtattagatgctgcccca

SEQ ID NO: 519799 - DNA, 25 bp, Mus musculus
acgatgtgtatttgatgctgcccca

SEQ ID NO: 519800 - DNA, 25 bp, Mus musculus
acgatgttccggatgctgagcagca

SEQ ID NO: 519801 - DNA, 25 bp, Mus musculus
acgatgttccggttgctgagcagca

SEQ ID NO: 519802 - DNA, 25 bp, Mus musculus
acgattaatatgcaagggcccagcc

SEQ ID NO: 519803 - DNA, 25 bp, Mus musculus
acgattaatatggaagggcccagcc

SEQ ID NO: 519804 - DNA, 25 bp, Mus musculus
acgattctgaagacgcgcagcctgg

SEQ ID NO: 519805 - DNA, 25 bp, Mus musculus
acgattctgaagtcgcgcagcctgg

SEQ ID NO: 519806 - DNA, 25 bp, Mus musculus
acgattgagtagcagcacacaggcg

SEQ ID NO: 519807 - DNA, 25 bp, Mus musculus
acgattgagtaggagcacacaggcg

SEQ ID NO: 519808 - DNA, 25 bp, Mus musculus
acgattgctttcaaagtccacccgg

SEQ ID NO: 519809 - DNA, 25 bp, Mus musculus
acgattgctttctaagtccacccgg

SEQ ID NO: 519810 - DNA, 25 bp, Mus musculus
acgattgggtgcagaggccgcttac

SEQ ID NO: 519811 - DNA, 25 bp, Mus musculus
acgattgggtgctgaggccgcttac

SEQ ID NO: 519812 - DNA, 25 bp, Mus musculus
acgattggtttaagtcttcagtcag

SEQ ID NO: 519813 - DNA, 25 bp, Mus musculus
acgattggtttatgtcttcagtcag

SEQ ID NO: 519814 - DNA, 25 bp, Mus musculus
acgatttcctgaagactttcagctc

SEQ ID NO: 519815 - DNA, 25 bp, Mus musculus
acgatttcctgatgactttcagctc

SEQ ID NO: 519816 - DNA, 25 bp, Mus musculus
acgatttgaaggcacccgagtctgg

SEQ ID NO: 519817 - DNA, 25 bp, Mus musculus
acgatttgaagggacccgagtctgg

SEQ ID NO: 519818 - DNA, 25 bp, Mus musculus
acgcaaaagtgtcgaggctacagag

SEQ ID NO: 519819 - DNA, 25 bp, Mus musculus
acgcaaaagtgtggaggctacagag

SEQ ID NO: 519820 - DNA, 25 bp, Mus musculus
acgcaaactaccaagcactcagctt

SEQ ID NO: 519821 - DNA, 25 bp, Mus musculus
acgcaaactacctagcactcagctt

SEQ ID NO: 519822 - DNA, 25 bp, Mus musculus
acgcaacgggaacaggtcaacaagt

SEQ ID NO: 519823 - DNA, 25 bp, Mus musculus
acgcaacgggaagaggtcaacaagt

SEQ ID NO: 519824 - DNA, 25 bp, Mus musculus
acgcaagatggccacggcgactata

SEQ ID NO: 519825 - DNA, 25 bp, Mus musculus
acgcaagatggcgacggcgactata

SEQ ID NO: 519826 - DNA, 25 bp, Mus musculus
acgcaagtgtgaccccatagtcatg

SEQ ID NO: 519827 - DNA, 25 bp, Mus musculus
acgcaagtgtgagcccatagtcatg

SEQ ID NO: 519828 - DNA, 25 bp, Mus musculus
acgcacagaataccgtgacggcgcc

SEQ ID NO: 519829 - DNA, 25 bp, Mus musculus
acgcacagaatagcgtgacggcgcc

SEQ ID NO: 519830 - DNA, 25 bp, Mus musculus
acgcacagccggaagttcctatccg

SEQ ID NO: 519831 - DNA, 25 bp, Mus musculus
acgcacagccggtagttcctatccg

SEQ ID NO: 519832 - DNA, 25 bp, Mus musculus
acgcacgtgcacaagcaggcggaga

SEQ ID NO: 519833 - DNA, 25 bp, Mus musculus
acgcacgtgcactagcaggcggaga

SEQ ID NO: 519834 - DNA, 25 bp, Mus musculus
acgcagaattggcaaactctgtgcc

SEQ ID NO: 519835 - DNA, 25 bp, Mus musculus
acgcagaattgggaaactctgtgcc

SEQ ID NO: 519836 - DNA, 25 bp, Mus musculus
acgcagcaagctaggcccgtacaat

SEQ ID NO: 519837 - DNA, 25 bp, Mus musculus
acgcagcaagcttggcccgtacaat

SEQ ID NO: 519838 - DNA, 25 bp, Mus musculus
acgcagcactgcacagcaactatga

SEQ ID NO: 519839 - DNA, 25 bp, Mus musculus
acgcagcactgctcagcaactatga

SEQ ID NO: 519840 - DNA, 25 bp, Mus musculus
acgcagcccggcaacgagtgctact

SEQ ID NO: 519841 - DNA, 25 bp, Mus musculus
acgcagcccggctacgagtgctact

SEQ ID NO: 519842 - DNA, 25 bp, Mus musculus
acgcagcgcgggaaccttcgccaga

SEQ ID NO: 519843 - DNA, 25 bp, Mus musculus
acgcagcgcgggtaccttcgccaga

SEQ ID NO: 519844 - DNA, 25 bp, Mus musculus
acgcagcggaggaagtctggtatca

SEQ ID NO: 519845 - DNA, 25 bp, Mus musculus
acgcagcggaggtagtctggtatca

SEQ ID NO: 519846 - DNA, 25 bp, Mus musculus
acgcagctgtacagccaggcccgga

SEQ ID NO: 519847 - DNA, 25 bp, Mus musculus
acgcagctgtactgccaggcccgga

SEQ ID NO: 519848 - DNA, 25 bp, Mus musculus
acgcatagttggagggcagcctgca

SEQ ID NO: 519849 - DNA, 25 bp, Mus musculus
acgcatagttggtgggcagcctgca

SEQ ID NO: 519850 - DNA, 25 bp, Mus musculus
acgcatcgaggccacatgggcacgc

SEQ ID NO: 519851 - DNA, 25 bp, Mus musculus
acgcatcgaggcgacatgggcacgc

SEQ ID NO: 519852 - DNA, 25 bp, Mus musculus
acgcatctatgtcgccctgggatat

SEQ ID NO: 519853 - DNA, 25 bp, Mus musculus
acgcatctatgtggccctgggatat

SEQ ID NO: 519854 - DNA, 25 bp, Mus musculus
acgcatgcaggccagctatcgggac

SEQ ID NO: 519855 - DNA, 25 bp, Mus musculus
acgcatgcaggcgagctatcgggac

SEQ ID NO: 519856 - DNA, 25 bp, Mus musculus
acgcattgggacactccttacacag

SEQ ID NO: 519857 - DNA, 25 bp, Mus musculus
acgcattgggactctccttacacag

SEQ ID NO: 519858 - DNA, 25 bp, Mus musculus
acgccaacctgtctcaggtgattca

SEQ ID NO: 519859 - DNA, 25 bp, Mus musculus
acgccaacctgtgtcaggtgattca

SEQ ID NO: 519860 - DNA, 25 bp, Mus musculus
acgccaagaagcactccatgtatgg

SEQ ID NO: 519861 - DNA, 25 bp, Mus musculus
acgccaagaagctctccatgtatgg

SEQ ID NO: 519862 - DNA, 25 bp, Mus musculus
acgccaaggtcgacgccgtgctggc

SEQ ID NO: 519863 - DNA, 25 bp, Mus musculus
acgccaaggtcgtcgccgtgctggc

SEQ ID NO: 519864 - DNA, 25 bp, Mus musculus
acgccacagggcatgatgccatatg

SEQ ID NO: 519865 - DNA, 25 bp, Mus musculus
acgccacagggcttgatgccatatg

SEQ ID NO: 519866 - DNA, 25 bp, Mus musculus
acgccacctggaagcctgtgagacc

SEQ ID NO: 519867 - DNA, 25 bp, Mus musculus
acgccacctggatgcctgtgagacc

SEQ ID NO: 519868 - DNA, 25 bp, Mus musculus
acgccacggtgacgttcccgggatg

SEQ ID NO: 519869 - DNA, 25 bp, Mus musculus
acgccacggtgaggttcccgggatg

SEQ ID NO: 519870 - DNA, 25 bp, Mus musculus
acgccagagagcaccgtcacgtgat

SEQ ID NO: 519871 - DNA, 25 bp, Mus musculus
acgccagagagctccgtcacgtgat

SEQ ID NO: 519872 - DNA, 25 bp, Mus musculus
acgccagagccactggaagaaaaca

SEQ ID NO: 519873 - DNA, 25 bp, Mus musculus
acgccagagccagtggaagaaaaca

SEQ ID NO: 519874 - DNA, 25 bp, Mus musculus
acgccagcaggaattgcccacctaa

SEQ ID NO: 519875 - DNA, 25 bp, Mus musculus
acgccagcaggatttgcccacctaa

SEQ ID NO: 519876 - DNA, 25 bp, Mus musculus
acgccagtacgcagagaagaaggcc

SEQ ID NO: 519877 - DNA, 25 bp, Mus musculus
acgccagtacgctgagaagaaggcc

SEQ ID NO: 519878 - DNA, 25 bp, Mus musculus
acgccatccggaccagaaaaagcca

SEQ ID NO: 519879 - DNA, 25 bp, Mus musculus
acgccatccggagcagaaaaagcca

SEQ ID NO: 519880 - DNA, 25 bp, Mus musculus
acgccatgacggctctgttgttcct

SEQ ID NO: 519881 - DNA, 25 bp, Mus musculus
acgccatgacgggtctgttgttcct

SEQ ID NO: 519882 - DNA, 25 bp, Mus musculus
acgccattgaagaagcaaaggcccg

SEQ ID NO: 519883 - DNA, 25 bp, Mus musculus
acgccattgaagtagcaaaggcccg

SEQ ID NO: 519884 - DNA, 25 bp, Mus musculus
acgcccaagaggaaccggtggctga

SEQ ID NO: 519885 - DNA, 25 bp, Mus musculus
acgcccaagaggtaccggtggctga

SEQ ID NO: 519886 - DNA, 25 bp, Mus musculus
acgcccaagcttctcccaaggagga

SEQ ID NO: 519887 - DNA, 25 bp, Mus musculus
acgcccaagcttgtcccaaggagga

SEQ ID NO: 519888 - DNA, 25 bp, Mus musculus
acgcccagcttgcagaagtggagaa

SEQ ID NO: 519889 - DNA, 25 bp, Mus musculus
acgcccagcttggagaagtggagaa

SEQ ID NO: 519890 - DNA, 25 bp, Mus musculus
acgcccatgattcctggccttggga

SEQ ID NO: 519891 - DNA, 25 bp, Mus musculus
acgcccatgattgctggccttggga

SEQ ID NO: 519892 - DNA, 25 bp, Mus musculus
acgcccatgctgcaggtggcgctca

SEQ ID NO: 519893 - DNA, 25 bp, Mus musculus
acgcccatgctggaggtggcgctca

SEQ ID NO: 519894 - DNA, 25 bp, Mus musculus
acgccccaggagaatacaggtgcca

SEQ ID NO: 519895 - DNA, 25 bp, Mus musculus
acgccccaggagtatacaggtgcca

SEQ ID NO: 519896 - DNA, 25 bp, Mus musculus
acgcccctactcactgttcagaagg

SEQ ID NO: 519897 - DNA, 25 bp, Mus musculus
acgcccctactctctgttcagaagg

SEQ ID NO: 519898 - DNA, 25 bp, Mus musculus
acgcccggatgcagctagcgtctca

SEQ ID NO: 519899 - DNA, 25 bp, Mus musculus
acgcccggatgctgctagcgtctca

SEQ ID NO: 519900 - DNA, 25 bp, Mus musculus
acgccctcaatgacatgacctctat

SEQ ID NO: 519901 - DNA, 25 bp, Mus musculus
acgccctcaatgtcatgacctctat

SEQ ID NO: 519902 - DNA, 25 bp, Mus musculus
acgccctgctgcctgtggaacatgg

SEQ ID NO: 519903 - DNA, 25 bp, Mus musculus
acgccctgctgcgtgtggaacatgg

SEQ ID NO: 519904 - DNA, 25 bp, Mus musculus
acgccgacctgcaggacacatcgga

SEQ ID NO: 519905 - DNA, 25 bp, Mus musculus
acgccgacctgctggacacatcgga

SEQ ID NO: 519906 - DNA, 25 bp, Mus musculus
acgccgagcgacagagaagcccagt

SEQ ID NO: 519907 - DNA, 25 bp, Mus musculus
acgccgagcgactgagaagcccagt

SEQ ID NO: 519908 - DNA, 25 bp, Mus musculus
acgccgcactgtcgtagacagtgag

SEQ ID NO: 519909 - DNA, 25 bp, Mus musculus
acgccgcactgtggtagacagtgag

SEQ ID NO: 519910 - DNA, 25 bp, Mus musculus
acgccgcctccgcagatttaagcga

SEQ ID NO: 519911 - DNA, 25 bp, Mus musculus
acgccgcctccggagatttaagcga

SEQ ID NO: 519912 - DNA, 25 bp, Mus musculus
acgccggacgccatgttgtggaaaa

SEQ ID NO: 519913 - DNA, 25 bp, Mus musculus
acgccggacgccttgttgtggaaaa

SEQ ID NO: 519914 - DNA, 25 bp, Mus musculus
acgccgggactgaccagcgaacgag

SEQ ID NO: 519915 - DNA, 25 bp, Mus musculus
acgccgggactgtccagcgaacgag

SEQ ID NO: 519916 - DNA, 25 bp, Mus musculus
acgccgggccgaacatggaagcttg

SEQ ID NO: 519917 - DNA, 25 bp, Mus musculus
acgccgggccgatcatggaagcttg

SEQ ID NO: 519918 - DNA, 25 bp, Mus musculus
acgccgtcagcacgaaaacatttcc

SEQ ID NO: 519919 - DNA, 25 bp, Mus musculus
acgccgtcagcaggaaaacatttcc

SEQ ID NO: 519920 - DNA, 25 bp, Mus musculus
acgcctacggcaaggccgggaagat

SEQ ID NO: 519921 - DNA, 25 bp, Mus musculus
acgcctacggcatggccgggaagat

SEQ ID NO: 519922 - DNA, 25 bp, Mus musculus
acgcctagacctccggtggtgatag

SEQ ID NO: 519923 - DNA, 25 bp, Mus musculus
acgcctagacctgcggtggtgatag

SEQ ID NO: 519924 - DNA, 25 bp, Mus musculus
acgcctccttccatatcagggcatt

SEQ ID NO: 519925 - DNA, 25 bp, Mus musculus
acgcctccttccttatcagggcatt

SEQ ID NO: 519926 - DNA, 25 bp, Mus musculus
acgcctcgaaaactgtgccctgctg

SEQ ID NO: 519927 - DNA, 25 bp, Mus musculus
acgcctcgaaaagtgtgccctgctg

SEQ ID NO: 519928 - DNA, 25 bp, Mus musculus
acgcctcttactagggtggccctgg

SEQ ID NO: 519929 - DNA, 25 bp, Mus musculus
acgcctcttacttgggtggccctgg

SEQ ID NO: 519930 - DNA, 25 bp, Mus musculus
acgcctgcatacattccctgggaaa

SEQ ID NO: 519931 - DNA, 25 bp, Mus musculus
acgcctgcatactttccctgggaaa

SEQ ID NO: 519932 - DNA, 25 bp, Mus musculus
acgcctggctggaatcctaggacaa

SEQ ID NO: 519933 - DNA, 25 bp, Mus musculus
acgcctggctggtatcctaggacaa

SEQ ID NO: 519934 - DNA, 25 bp, Mus musculus
acgcctgtgctcctgtttccttaag

SEQ ID NO: 519935 - DNA, 25 bp, Mus musculus
acgcctgtgctcgtgtttccttaag

SEQ ID NO: 519936 - DNA, 25 bp, Mus musculus
acgcctttagaacagtggtgcctag

SEQ ID NO: 519937 - DNA, 25 bp, Mus musculus
acgcctttagaagagtggtgcctag

SEQ ID NO: 519938 - DNA, 25 bp, Mus musculus
acgcctttattactctgcagctttg

SEQ ID NO: 519939 - DNA, 25 bp, Mus musculus
acgcctttattagtctgcagctttg

SEQ ID NO: 519940 - DNA, 25 bp, Mus musculus
acgcgaacccggacgtggcgactcg

SEQ ID NO: 519941 - DNA, 25 bp, Mus musculus
acgcgaacccggtcgtggcgactcg

SEQ ID NO: 519942 - DNA, 25 bp, Mus musculus
acgcgcgacgctaggaaagatctgc

SEQ ID NO: 519943 - DNA, 25 bp, Mus musculus
acgcgcgacgcttggaaagatctgc

SEQ ID NO: 519944 - DNA, 25 bp, Mus musculus
acgcggaacacccagggatgctcaa

SEQ ID NO: 519945 - DNA, 25 bp, Mus musculus
acgcggaacaccgagggatgctcaa

SEQ ID NO: 519946 - DNA, 25 bp, Mus musculus
acgcggagactgactgacctgcgga

SEQ ID NO: 519947 - DNA, 25 bp, Mus musculus
acgcggagactgtctgacctgcgga

SEQ ID NO: 519948 - DNA, 25 bp, Mus musculus
acgcggagccgaaccgtagcctgac

SEQ ID NO: 519949 - DNA, 25 bp, Mus musculus
acgcggagccgatccgtagcctgac

SEQ ID NO: 519950 - DNA, 25 bp, Mus musculus
acgcggagcgttagctggaaactgc

SEQ ID NO: 519951 - DNA, 25 bp, Mus musculus
acgcggagcgtttgctggaaactgc

SEQ ID NO: 519952 - DNA, 25 bp, Mus musculus
acgcggcagagcagacagcagtgac

SEQ ID NO: 519953 - DNA, 25 bp, Mus musculus
acgcggcagagctgacagcagtgac

SEQ ID NO: 519954 - DNA, 25 bp, Mus musculus
acgcggccctgcacgacatcgattt

SEQ ID NO: 519955 - DNA, 25 bp, Mus musculus
acgcggccctgctcgacatcgattt

SEQ ID NO: 519956 - DNA, 25 bp, Mus musculus
acgcggcgctgcaggctctttctaa

SEQ ID NO: 519957 - DNA, 25 bp, Mus musculus
acgcggcgctgctggctctttctaa

SEQ ID NO: 519958 - DNA, 25 bp, Mus musculus
acgcgggcgggcacctgaaacaaag

SEQ ID NO: 519959 - DNA, 25 bp, Mus musculus
acgcgggcgggctcctgaaacaaag

SEQ ID NO: 519960 - DNA, 25 bp, Mus musculus
acgcgggcttgtacaccaacgatga

SEQ ID NO: 519961 - DNA, 25 bp, Mus musculus
acgcgggcttgttcaccaacgatga

SEQ ID NO: 519962 - DNA, 25 bp, Mus musculus
acgcggtgtaagctgggactcctct

SEQ ID NO: 519963 - DNA, 25 bp, Mus musculus
acgcggtgtaaggtgggactcctct

SEQ ID NO: 519964 - DNA, 25 bp, Mus musculus
acgcgtcccggactgcgcagaactg

SEQ ID NO: 519965 - DNA, 25 bp, Mus musculus
acgcgtcccggagtgcgcagaactg

SEQ ID NO: 519966 - DNA, 25 bp, Mus musculus
acgcgtgcgcgcctgctcgtgaatc

SEQ ID NO: 519967 - DNA, 25 bp, Mus musculus
acgcgtgcgcgcgtgctcgtgaatc

SEQ ID NO: 519968 - DNA, 25 bp, Mus musculus
acgctacttccgaagcatttttgag

SEQ ID NO: 519969 - DNA, 25 bp, Mus musculus
acgctacttccgtagcatttttgag

SEQ ID NO: 519970 - DNA, 25 bp, Mus musculus
acgctatcaagcagaactggagtca

SEQ ID NO: 519971 - DNA, 25 bp, Mus musculus
acgctatcaagctgaactggagtca

SEQ ID NO: 519972 - DNA, 25 bp, Mus musculus
acgctcagacagacctctgtgcttc

SEQ ID NO: 519973 - DNA, 25 bp, Mus musculus
acgctcagacagtcctctgtgcttc

SEQ ID NO: 519974 - DNA, 25 bp, Mus musculus
acgctcagcaacctcatgttcctgg

SEQ ID NO: 519975 - DNA, 25 bp, Mus musculus
acgctcagcaacgtcatgttcctgg

SEQ ID NO: 519976 - DNA, 25 bp, Mus musculus
acgctccctttgagcgcctgcaggg

SEQ ID NO: 519977 - DNA, 25 bp, Mus musculus
acgctccctttgtgcgcctgcaggg

SEQ ID NO: 519978 - DNA, 25 bp, Mus musculus
acgctcgccgggaactgagcattgc

SEQ ID NO: 519979 - DNA, 25 bp, Mus musculus
acgctcgccgggtactgagcattgc

SEQ ID NO: 519980 - DNA, 25 bp, Mus musculus
acgctctcaacgatatgacttccat

SEQ ID NO: 519981 - DNA, 25 bp, Mus musculus
acgctctcaacgttatgacttccat

SEQ ID NO: 519982 - DNA, 25 bp, Mus musculus
acgctctggccgctccttgttcttt

SEQ ID NO: 519983 - DNA, 25 bp, Mus musculus
acgctctggccggtccttgttcttt

SEQ ID NO: 519984 - DNA, 25 bp, Mus musculus
acgctgaacgaaagggacacggagc

SEQ ID NO: 519985 - DNA, 25 bp, Mus musculus
acgctgaacgaatgggacacggagc

SEQ ID NO: 519986 - DNA, 25 bp, Mus musculus
acgctgaagatgatccagccttctg

SEQ ID NO: 519987 - DNA, 25 bp, Mus musculus
acgctgaagatgttccagccttctg

SEQ ID NO: 519988 - DNA, 25 bp, Mus musculus
acgctgacagtacacggccgagaca

SEQ ID NO: 519989 - DNA, 25 bp, Mus musculus
acgctgacagtagacggccgagaca

SEQ ID NO: 519990 - DNA, 25 bp, Mus musculus
acgctgagaaggctatcgccccctg

SEQ ID NO: 519991 - DNA, 25 bp, Mus musculus
acgctgagaagggtatcgccccctg

SEQ ID NO: 519992 - DNA, 25 bp, Mus musculus
acgctgagcaggctcctatggctct

SEQ ID NO: 519993 - DNA, 25 bp, Mus musculus
acgctgagcagggtcctatggctct

SEQ ID NO: 519994 - DNA, 25 bp, Mus musculus
acgctgagtgccctggtgaagccct

SEQ ID NO: 519995 - DNA, 25 bp, Mus musculus
acgctgagtgccgtggtgaagccct

SEQ ID NO: 519996 - DNA, 25 bp, Mus musculus
acgctgatgaggaagacagtaggaa

SEQ ID NO: 519997 - DNA, 25 bp, Mus musculus
acgctgatgaggtagacagtaggaa

SEQ ID NO: 519998 - DNA, 25 bp, Mus musculus
acgctgccaggacgtcacccaggat

SEQ ID NO: 519999 - DNA, 25 bp, Mus musculus
acgctgccaggaggtcacccaggat

SEQ ID NO: 520000 - DNA, 25 bp, Mus musculus
acgctgccagttcctttggagccaa

SEQ ID NO: 520001 - DNA, 25 bp, Mus musculus
acgctgccagttgctttggagccaa

SEQ ID NO: 520002 - DNA, 25 bp, Mus musculus
acgctgcccaccagaacaagtttgg

SEQ ID NO: 520003 - DNA, 25 bp, Mus musculus
acgctgcccacctgaacaagtttgg

SEQ ID NO: 520004 - DNA, 25 bp, Mus musculus
acgctgcgcacaacatgggaaacca

SEQ ID NO: 520005 - DNA, 25 bp, Mus musculus
acgctgcgcacatcatgggaaacca

SEQ ID NO: 520006 - DNA, 25 bp, Mus musculus
acgctgctaagcacggctgggacat

SEQ ID NO: 520007 - DNA, 25 bp, Mus musculus
acgctgctaagctcggctgggacat

SEQ ID NO: 520008 - DNA, 25 bp, Mus musculus
acgctgctcacacagagacattgta

SEQ ID NO: 520009 - DNA, 25 bp, Mus musculus
acgctgctcacagagagacattgta

SEQ ID NO: 520010 - DNA, 25 bp, Mus musculus
acgctgctgaccagcgcatgtctgc

SEQ ID NO: 520011 - DNA, 25 bp, Mus musculus
acgctgctgacctgcgcatgtctgc

SEQ ID NO: 520012 - DNA, 25 bp, Mus musculus
acgctgctgcacatcatctcttggg

SEQ ID NO: 520013 - DNA, 25 bp, Mus musculus
acgctgctgcacttcatctcttggg

SEQ ID NO: 520014 - DNA, 25 bp, Mus musculus
acgctggctccgagcgccatggtca

SEQ ID NO: 520015 - DNA, 25 bp, Mus musculus
acgctggctccgtgcgccatggtca

SEQ ID NO: 520016 - DNA, 25 bp, Mus musculus
acgctggctctgacgcccatgctgg

SEQ ID NO: 520017 - DNA, 25 bp, Mus musculus
acgctggctctgtcgcccatgctgg

SEQ ID NO: 520018 - DNA, 25 bp, Mus musculus
acgctgggccacacaagtgttcaaa

SEQ ID NO: 520019 - DNA, 25 bp, Mus musculus
acgctgggccactcaagtgttcaaa

SEQ ID NO: 520020 - DNA, 25 bp, Mus musculus
acgctgggccgcactgaaggtacca

SEQ ID NO: 520021 - DNA, 25 bp, Mus musculus
acgctgggccgctctgaaggtacca

SEQ ID NO: 520022 - DNA, 25 bp, Mus musculus
acgctggttgctctgaagccagatg

SEQ ID NO: 520023 - DNA, 25 bp, Mus musculus
acgctggttgctgtgaagccagatg

SEQ ID NO: 520024 - DNA, 25 bp, Mus musculus
acgctgtcccggaggaactggaaga

SEQ ID NO: 520025 - DNA, 25 bp, Mus musculus
acgctgtcccggtggaactggaaga

SEQ ID NO: 520026 - DNA, 25 bp, Mus musculus
acgctgtcgacactggatcctcaca

SEQ ID NO: 520027 - DNA, 25 bp, Mus musculus
acgctgtcgacagtggatcctcaca

SEQ ID NO: 520028 - DNA, 25 bp, Mus musculus
acgctgtctgagcagccacgcgaga

SEQ ID NO: 520029 - DNA, 25 bp, Mus musculus
acgctgtctgaggagccacgcgaga

SEQ ID NO: 520030 - DNA, 25 bp, Mus musculus
acgctgtgagtgaccaagtagctgg

SEQ ID NO: 520031 - DNA, 25 bp, Mus musculus
acgctgtgagtgtccaagtagctgg

SEQ ID NO: 520032 - DNA, 25 bp, Mus musculus
acgctgtttggacatcctagagcag

SEQ ID NO: 520033 - DNA, 25 bp, Mus musculus
acgctgtttggagatcctagagcag

SEQ ID NO: 520034 - DNA, 25 bp, Mus musculus
acgcttccgaacaggccagactgct

SEQ ID NO: 520035 - DNA, 25 bp, Mus musculus
acgcttccgaactggccagactgct

SEQ ID NO: 520036 - DNA, 25 bp, Mus musculus
acgcttccgtgacacttgacaatag

SEQ ID NO: 520037 - DNA, 25 bp, Mus musculus
acgcttccgtgagacttgacaatag

SEQ ID NO: 520038 - DNA, 25 bp, Mus musculus
acgcttctatgtcaacagaaattca

SEQ ID NO: 520039 - DNA, 25 bp, Mus musculus
acgcttctatgtgaacagaaattca

SEQ ID NO: 520040 - DNA, 25 bp, Mus musculus
acgcttgtggccaagatggtggcca

SEQ ID NO: 520041 - DNA, 25 bp, Mus musculus
acgcttgtggcctagatggtggcca

SEQ ID NO: 520042 - DNA, 25 bp, Mus musculus
acgctttaccgtctacagctctaaa

SEQ ID NO: 520043 - DNA, 25 bp, Mus musculus
acgctttaccgtgtacagctctaaa

SEQ ID NO: 520044 - DNA, 25 bp, Mus musculus
acgctttccaagatgttgctgtgga

SEQ ID NO: 520045 - DNA, 25 bp, Mus musculus
acgctttccaagttgttgctgtgga

SEQ ID NO: 520046 - DNA, 25 bp, Mus musculus
acgctttgactgagtgtgaggagct

SEQ ID NO: 520047 - DNA, 25 bp, Mus musculus
acgctttgactgtgtgtgaggagct

SEQ ID NO: 520048 - DNA, 25 bp, Mus musculus
acggaaagttttcatcacccgcaag

SEQ ID NO: 520049 - DNA, 25 bp, Mus musculus
acggaaagttttgatcacccgcaag

SEQ ID NO: 520050 - DNA, 25 bp, Mus musculus
acggaacacaaacctggatcacttt

SEQ ID NO: 520051 - DNA, 25 bp, Mus musculus
acggaacacaaagctggatcacttt

SEQ ID NO: 520052 - DNA, 25 bp, Mus musculus
acggaacagaaaccgagcgagtaga

SEQ ID NO: 520053 - DNA, 25 bp, Mus musculus
acggaacagaaagcgagcgagtaga

SEQ ID NO: 520054 - DNA, 25 bp, Mus musculus
acggaaccgctacaaggaagagatg

SEQ ID NO: 520055 - DNA, 25 bp, Mus musculus
acggaaccgctagaaggaagagatg

SEQ ID NO: 520056 - DNA, 25 bp, Mus musculus
acggaaccggagacaggaactcctg

SEQ ID NO: 520057 - DNA, 25 bp, Mus musculus
acggaaccggagtcaggaactcctg

SEQ ID NO: 520058 - DNA, 25 bp, Mus musculus
acggaagacagcaggccatgagcag

SEQ ID NO: 520059 - DNA, 25 bp, Mus musculus
acggaagacagctggccatgagcag

SEQ ID NO: 520060 - DNA, 25 bp, Mus musculus
acggaagagaacagagagctggtca

SEQ ID NO: 520061 - DNA, 25 bp, Mus musculus
acggaagagaactgagagctggtca

SEQ ID NO: 520062 - DNA, 25 bp, Mus musculus
acggacaccatcaggagacggcgct

SEQ ID NO: 520063 - DNA, 25 bp, Mus musculus
acggacaccatctggagacggcgct

SEQ ID NO: 520064 - DNA, 25 bp, Mus musculus
acggacaggcctagcagctggacaa

SEQ ID NO: 520065 - DNA, 25 bp, Mus musculus
acggacaggccttgcagctggacaa

SEQ ID NO: 520066 - DNA, 25 bp, Mus musculus
acggacatcttcctgcccaagccaa

SEQ ID NO: 520067 - DNA, 25 bp, Mus musculus
acggacatcttcgtgcccaagccaa

SEQ ID NO: 520068 - DNA, 25 bp, Mus musculus
acggaccacaatcgagctgtgagct

SEQ ID NO: 520069 - DNA, 25 bp, Mus musculus
acggaccacaatggagctgtgagct

SEQ ID NO: 520070 - DNA, 25 bp, Mus musculus
acggaccagaagagagctcctgccc

SEQ ID NO: 520071 - DNA, 25 bp, Mus musculus
acggaccagaagtgagctcctgccc

SEQ ID NO: 520072 - DNA, 25 bp, Mus musculus
acggaccagatgagaagaccaggtc

SEQ ID NO: 520073 - DNA, 25 bp, Mus musculus
acggaccagatgtgaagaccaggtc

SEQ ID NO: 520074 - DNA, 25 bp, Mus musculus
acggacccctacacagctggattgg

SEQ ID NO: 520075 - DNA, 25 bp, Mus musculus
acggacccctactcagctggattgg

SEQ ID NO: 520076 - DNA, 25 bp, Mus musculus
acggaccctctgattggcgggctcg

SEQ ID NO: 520077 - DNA, 25 bp, Mus musculus
acggaccctctgtttggcgggctcg

SEQ ID NO: 520078 - DNA, 25 bp, Mus musculus
acggaccgtgccagagattgagaag

SEQ ID NO: 520079 - DNA, 25 bp, Mus musculus
acggaccgtgcctgagattgagaag

SEQ ID NO: 520080 - DNA, 25 bp, Mus musculus
acggactacaaccagggcctggtgc

SEQ ID NO: 520081 - DNA, 25 bp, Mus musculus
acggactacaacgagggcctggtgc

SEQ ID NO: 520082 - DNA, 25 bp, Mus musculus
acggagagctgcatacatcaggcgg

SEQ ID NO: 520083 - DNA, 25 bp, Mus musculus
acggagagctgcttacatcaggcgg

SEQ ID NO: 520084 - DNA, 25 bp, Mus musculus
acggagagtaacagtgaggtgcctc

SEQ ID NO: 520085 - DNA, 25 bp, Mus musculus
acggagagtaactgtgaggtgcctc

SEQ ID NO: 520086 - DNA, 25 bp, Mus musculus
acggagagtgcgacgggccaaacaa

SEQ ID NO: 520087 - DNA, 25 bp, Mus musculus
acggagagtgcgtcgggccaaacaa

SEQ ID NO: 520088 - DNA, 25 bp, Mus musculus
acggagccttctacgccgtgaaggt

SEQ ID NO: 520089 - DNA, 25 bp, Mus musculus
acggagccttcttcgccgtgaaggt

SEQ ID NO: 520090 - DNA, 25 bp, Mus musculus
acggagcgccaaaaagtgcactgcc

SEQ ID NO: 520091 - DNA, 25 bp, Mus musculus
acggagcgccaataagtgcactgcc

SEQ ID NO: 520092 - DNA, 25 bp, Mus musculus
acggagcggcctatcatccagaagc

SEQ ID NO: 520093 - DNA, 25 bp, Mus musculus
acggagcggcctttcatccagaagc

SEQ ID NO: 520094 - DNA, 25 bp, Mus musculus
acggagctggacagctggattgata

SEQ ID NO: 520095 - DNA, 25 bp, Mus musculus
acggagctggactgctggattgata

SEQ ID NO: 520096 - DNA, 25 bp, Mus musculus
acggagcttcggcaggcacagaccc

SEQ ID NO: 520097 - DNA, 25 bp, Mus musculus
acggagcttcgggaggcacagaccc

SEQ ID NO: 520098 - DNA, 25 bp, Mus musculus
acggaggagcgtccattgctgccaa

SEQ ID NO: 520099 - DNA, 25 bp, Mus musculus
acggaggagcgtgcattgctgccaa

SEQ ID NO: 520100 - DNA, 25 bp, Mus musculus
acggaggagtttcctggctgattcc

SEQ ID NO: 520101 - DNA, 25 bp, Mus musculus
acggaggagtttgctggctgattcc

SEQ ID NO: 520102 - DNA, 25 bp, Mus musculus
acggaggcacctccctgaggctatc

SEQ ID NO: 520103 - DNA, 25 bp, Mus musculus
acggaggcacctgcctgaggctatc

SEQ ID NO: 520104 - DNA, 25 bp, Mus musculus
acggaggcgcaactcctgtcaggcc

SEQ ID NO: 520105 - DNA, 25 bp, Mus musculus
acggaggcgcaagtcctgtcaggcc

SEQ ID NO: 520106 - DNA, 25 bp, Mus musculus
acggaggctgcgaccgcacctgtaa

SEQ ID NO: 520107 - DNA, 25 bp, Mus musculus
acggaggctgcgtccgcacctgtaa

SEQ ID NO: 520108 - DNA, 25 bp, Mus musculus
acggaggcttctccgcgctacctta

SEQ ID NO: 520109 - DNA, 25 bp, Mus musculus
acggaggcttctgcgcgctacctta

SEQ ID NO: 520110 - DNA, 25 bp, Mus musculus
acggagggctccatcacctgctcag

SEQ ID NO: 520111 - DNA, 25 bp, Mus musculus
acggagggctccttcacctgctcag

SEQ ID NO: 520112 - DNA, 25 bp, Mus musculus
acggagggctcgaaccactgcgagt

SEQ ID NO: 520113 - DNA, 25 bp, Mus musculus
acggagggctcgtaccactgcgagt

SEQ ID NO: 520114 - DNA, 25 bp, Mus musculus
acggagtgatgaatggtgaatacta

SEQ ID NO: 520115 - DNA, 25 bp, Mus musculus
acggagtgatgattggtgaatacta

SEQ ID NO: 520116 - DNA, 25 bp, Mus musculus
acggagtggaggcactaaccctacg

SEQ ID NO: 520117 - DNA, 25 bp, Mus musculus
acggagtggagggactaaccctacg

SEQ ID NO: 520118 - DNA, 25 bp, Mus musculus
acggataagcacacgctggtcaaag

SEQ ID NO: 520119 - DNA, 25 bp, Mus musculus
acggataagcactcgctggtcaaag

SEQ ID NO: 520120 - DNA, 25 bp, Mus musculus
acggatccaaagacagtctcttctc

SEQ ID NO: 520121 - DNA, 25 bp, Mus musculus
acggatccaaagtcagtctcttctc

SEQ ID NO: 520122 - DNA, 25 bp, Mus musculus
acggatcgtaccatcgtttcttggg

SEQ ID NO: 520123 - DNA, 25 bp, Mus musculus
acggatcgtaccttcgtttcttggg

SEQ ID NO: 520124 - DNA, 25 bp, Mus musculus
acggatctgggtagatgcagaagaa

SEQ ID NO: 520125 - DNA, 25 bp, Mus musculus
acggatctgggttgatgcagaagaa

SEQ ID NO: 520126 - DNA, 25 bp, Mus musculus
acggatgacgacactgtgcaggtgc

SEQ ID NO: 520127 - DNA, 25 bp, Mus musculus
acggatgacgactctgtgcaggtgc

SEQ ID NO: 520128 - DNA, 25 bp, Mus musculus
acggatgagtcccaggcccgaatcc

SEQ ID NO: 520129 - DNA, 25 bp, Mus musculus
acggatgagtccgaggcccgaatcc

SEQ ID NO: 520130 - DNA, 25 bp, Mus musculus
acggatgagtttcaatatgatgagc

SEQ ID NO: 520131 - DNA, 25 bp, Mus musculus
acggatgagtttgaatatgatgagc

SEQ ID NO: 520132 - DNA, 25 bp, Mus musculus
acggatgcagatcccgaagtttgca

SEQ ID NO: 520133 - DNA, 25 bp, Mus musculus
acggatgcagatgccgaagtttgca

SEQ ID NO: 520134 - DNA, 25 bp, Mus musculus
acggattgttcacagagacctcaag

SEQ ID NO: 520135 - DNA, 25 bp, Mus musculus
acggattgttcagagagacctcaag

SEQ ID NO: 520136 - DNA, 25 bp, Mus musculus
acggatttccgacccagcatgttct

SEQ ID NO: 520137 - DNA, 25 bp, Mus musculus
acggatttccgagccagcatgttct

SEQ ID NO: 520138 - DNA, 25 bp, Mus musculus
acggcaatggaactcatgcaattca

SEQ ID NO: 520139 - DNA, 25 bp, Mus musculus
acggcaatggaagtcatgcaattca

SEQ ID NO: 520140 - DNA, 25 bp, Mus musculus
acggcagaacctactaagcctacct

SEQ ID NO: 520141 - DNA, 25 bp, Mus musculus
acggcagaaccttctaagcctacct

SEQ ID NO: 520142 - DNA, 25 bp, Mus musculus
acggcagagatcagcctttacccca

SEQ ID NO: 520143 - DNA, 25 bp, Mus musculus
acggcagagatctgcctttacccca

SEQ ID NO: 520144 - DNA, 25 bp, Mus musculus
acggcagcacacagtcggcatgggt

SEQ ID NO: 520145 - DNA, 25 bp, Mus musculus
acggcagcacactgtcggcatgggt

SEQ ID NO: 520146 - DNA, 25 bp, Mus musculus
acggcagccggcatcaagcagacga

SEQ ID NO: 520147 - DNA, 25 bp, Mus musculus
acggcagccggcttcaagcagacga

SEQ ID NO: 520148 - DNA, 25 bp, Mus musculus
acggcagctgatcccttctacaaag

SEQ ID NO: 520149 - DNA, 25 bp, Mus musculus
acggcagctgatgccttctacaaag

SEQ ID NO: 520150 - DNA, 25 bp, Mus musculus
acggcagctgttctgcatagcaaga

SEQ ID NO: 520151 - DNA, 25 bp, Mus musculus
acggcagctgttgtgcatagcaaga

SEQ ID NO: 520152 - DNA, 25 bp, Mus musculus
acggcaggtcagcagctccattcag

SEQ ID NO: 520153 - DNA, 25 bp, Mus musculus
acggcaggtcaggagctccattcag

SEQ ID NO: 520154 - DNA, 25 bp, Mus musculus
acggcagtggtcacgtcagtggcaa

SEQ ID NO: 520155 - DNA, 25 bp, Mus musculus
acggcagtggtctcgtcagtggcaa

SEQ ID NO: 520156 - DNA, 25 bp, Mus musculus
acggcatcgtttccaagtgttttga

SEQ ID NO: 520157 - DNA, 25 bp, Mus musculus
acggcatcgtttgcaagtgttttga

SEQ ID NO: 520158 - DNA, 25 bp, Mus musculus
acggccaacagcacggagaatcgct

SEQ ID NO: 520159 - DNA, 25 bp, Mus musculus
acggccaacagctcggagaatcgct

SEQ ID NO: 520160 - DNA, 25 bp, Mus musculus
acggccaaggcgaggccccagagta

SEQ ID NO: 520161 - DNA, 25 bp, Mus musculus
acggccaaggcgtggccccagagta

SEQ ID NO: 520162 - DNA, 25 bp, Mus musculus
acggccagcatgcaacagctccagg

SEQ ID NO: 520163 - DNA, 25 bp, Mus musculus
acggccagcatggaacagctccagg

SEQ ID NO: 520164 - DNA, 25 bp, Mus musculus
acggccagttcacggtgatgcacac

SEQ ID NO: 520165 - DNA, 25 bp, Mus musculus
acggccagttcagggtgatgcacac

SEQ ID NO: 520166 - DNA, 25 bp, Mus musculus
acggccatcctaaatggtaacgggc

SEQ ID NO: 520167 - DNA, 25 bp, Mus musculus
acggccatcctatatggtaacgggc

SEQ ID NO: 520168 - DNA, 25 bp, Mus musculus
acggccattgagcacgaaggagtcc

SEQ ID NO: 520169 - DNA, 25 bp, Mus musculus
acggccattgaggacgaaggagtcc

SEQ ID NO: 520170 - DNA, 25 bp, Mus musculus
acggcccatctacttggctctgtgg

SEQ ID NO: 520171 - DNA, 25 bp, Mus musculus
acggcccatctagttggctctgtgg

SEQ ID NO: 520172 - DNA, 25 bp, Mus musculus
acggccccgatgcagactgctttga

SEQ ID NO: 520173 - DNA, 25 bp, Mus musculus
acggccccgatggagactgctttga

SEQ ID NO: 520174 - DNA, 25 bp, Mus musculus
acggccgagacacctatgaggaagt

SEQ ID NO: 520175 - DNA, 25 bp, Mus musculus
acggccgagacagctatgaggaagt

SEQ ID NO: 520176 - DNA, 25 bp, Mus musculus
acggccgcgtgcacttcatcaagga

SEQ ID NO: 520177 - DNA, 25 bp, Mus musculus
acggccgcgtgctcttcatcaagga

SEQ ID NO: 520178 - DNA, 25 bp, Mus musculus
acggccgggactatagagaaacaca

SEQ ID NO: 520179 - DNA, 25 bp, Mus musculus
acggccgggactttagagaaacaca

SEQ ID NO: 520180 - DNA, 25 bp, Mus musculus
acggccgggctgaacagcaccgtga

SEQ ID NO: 520181 - DNA, 25 bp, Mus musculus
acggccgggctgtacagcaccgtga

SEQ ID NO: 520182 - DNA, 25 bp, Mus musculus
acggccgtgacgagcattggcttca

SEQ ID NO: 520183 - DNA, 25 bp, Mus musculus
acggccgtgacgtgcattggcttca

SEQ ID NO: 520184 - DNA, 25 bp, Mus musculus
acggcctactatcgcggagctatgg

SEQ ID NO: 520185 - DNA, 25 bp, Mus musculus
acggcctactatggcggagctatgg

SEQ ID NO: 520186 - DNA, 25 bp, Mus musculus
acggcctcgggcaactttgtcagca

SEQ ID NO: 520187 - DNA, 25 bp, Mus musculus
acggcctcgggctactttgtcagca

SEQ ID NO: 520188 - DNA, 25 bp, Mus musculus
acggcctctcgtaccttctcaggtg

SEQ ID NO: 520189 - DNA, 25 bp, Mus musculus
acggcctctcgttccttctcaggtg

SEQ ID NO: 520190 - DNA, 25 bp, Mus musculus
acggcctgcgaacgatcttggatga

SEQ ID NO: 520191 - DNA, 25 bp, Mus musculus
acggcctgcgaaggatcttggatga

SEQ ID NO: 520192 - DNA, 25 bp, Mus musculus
acggcctgggtacagagagaccact

SEQ ID NO: 520193 - DNA, 25 bp, Mus musculus
acggcctgggtagagagagaccact

SEQ ID NO: 520194 - DNA, 25 bp, Mus musculus
acggccttcgccagcgtggtgcaca

SEQ ID NO: 520195 - DNA, 25 bp, Mus musculus
acggccttcgcctgcgtggtgcaca

SEQ ID NO: 520196 - DNA, 25 bp, Mus musculus
acggccttgctgagcacatttttct

SEQ ID NO: 520197 - DNA, 25 bp, Mus musculus
acggccttgctgtgcacatttttct

SEQ ID NO: 520198 - DNA, 25 bp, Mus musculus
acggcgaagacaccggccgtcatct

SEQ ID NO: 520199 - DNA, 25 bp, Mus musculus
acggcgaagacagcggccgtcatct

SEQ ID NO: 520200 - DNA, 25 bp, Mus musculus
acggcgaagtcaaggccttgaggtt

SEQ ID NO: 520201 - DNA, 25 bp, Mus musculus
acggcgaagtcatggccttgaggtt

SEQ ID NO: 520202 - DNA, 25 bp, Mus musculus
acggcgaccacaactctgtgcacag

SEQ ID NO: 520203 - DNA, 25 bp, Mus musculus
acggcgaccacatctctgtgcacag

SEQ ID NO: 520204 - DNA, 25 bp, Mus musculus
acggcgaggactaggcctgccttcc

SEQ ID NO: 520205 - DNA, 25 bp, Mus musculus
acggcgaggacttggcctgccttcc

SEQ ID NO: 520206 - DNA, 25 bp, Mus musculus
acggcgagtgccacaacagcctggg

SEQ ID NO: 520207 - DNA, 25 bp, Mus musculus
acggcgagtgcctcaacagcctggg

SEQ ID NO: 520208 - DNA, 25 bp, Mus musculus
acggcgcgctcgatactggccgaga

SEQ ID NO: 520209 - DNA, 25 bp, Mus musculus
acggcgcgctcgttactggccgaga

SEQ ID NO: 520210 - DNA, 25 bp, Mus musculus
acggcgcggacgatgagcgtcctct

SEQ ID NO: 520211 - DNA, 25 bp, Mus musculus
acggcgcggacgttgagcgtcctct

SEQ ID NO: 520212 - DNA, 25 bp, Mus musculus
acggcggcactcagacggcggttcc

SEQ ID NO: 520213 - DNA, 25 bp, Mus musculus
acggcggcactctgacggcggttcc

SEQ ID NO: 520214 - DNA, 25 bp, Mus musculus
acggcggccctgagaagattggcca

SEQ ID NO: 520215 - DNA, 25 bp, Mus musculus
acggcggccctgtgaagattggcca

SEQ ID NO: 520216 - DNA, 25 bp, Mus musculus
acggcggcgcagctcaacacagagc

SEQ ID NO: 520217 - DNA, 25 bp, Mus musculus
acggcggcgcaggtcaacacagagc

SEQ ID NO: 520218 - DNA, 25 bp, Mus musculus
acggcggctcgcaagggagcatccc

SEQ ID NO: 520219 - DNA, 25 bp, Mus musculus
acggcggctcgctagggagcatccc

SEQ ID NO: 520220 - DNA, 25 bp, Mus musculus
acggctaaagcactcacaggaggag

SEQ ID NO: 520221 - DNA, 25 bp, Mus musculus
acggctaaagcagtcacaggaggag

SEQ ID NO: 520222 - DNA, 25 bp, Mus musculus
acggctaccagcagggctacgggcc

SEQ ID NO: 520223 - DNA, 25 bp, Mus musculus
acggctaccagctgggctacgggcc

SEQ ID NO: 520224 - DNA, 25 bp, Mus musculus
acggctactctgaacattttgttga

SEQ ID NO: 520225 - DNA, 25 bp, Mus musculus
acggctactctgtacattttgttga

SEQ ID NO: 520226 - DNA, 25 bp, Mus musculus
acggctatcttcaggagctctctga

SEQ ID NO: 520227 - DNA, 25 bp, Mus musculus
acggctatcttctggagctctctga

SEQ ID NO: 520228 - DNA, 25 bp, Mus musculus
acggctcctgggagcacctgacagt

SEQ ID NO: 520229 - DNA, 25 bp, Mus musculus
acggctcctgggtgcacctgacagt

SEQ ID NO: 520230 - DNA, 25 bp, Mus musculus
acggctgaaacaccggaagctccgg

SEQ ID NO: 520231 - DNA, 25 bp, Mus musculus
acggctgaaacagcggaagctccgg

SEQ ID NO: 520232 - DNA, 25 bp, Mus musculus
acggctggccagcactgttgttccc

SEQ ID NO: 520233 - DNA, 25 bp, Mus musculus
acggctggccaggactgttgttccc

SEQ ID NO: 520234 - DNA, 25 bp, Mus musculus
acggctggtgcgagcagccctcctg

SEQ ID NO: 520235 - DNA, 25 bp, Mus musculus
acggctggtgcgtgcagccctcctg

SEQ ID NO: 520236 - DNA, 25 bp, Mus musculus
acggctgttaggaggttggactcaa

SEQ ID NO: 520237 - DNA, 25 bp, Mus musculus
acggctgttaggtggttggactcaa

SEQ ID NO: 520238 - DNA, 25 bp, Mus musculus
acggctgtttccacttatccaagcc

SEQ ID NO: 520239 - DNA, 25 bp, Mus musculus
acggctgtttcctcttatccaagcc

SEQ ID NO: 520240 - DNA, 25 bp, Mus musculus
acggcttagatgaccagctcatgaa

SEQ ID NO: 520241 - DNA, 25 bp, Mus musculus
acggcttagatgtccagctcatgaa

SEQ ID NO: 520242 - DNA, 25 bp, Mus musculus
acggcttcagatcatggctacatca

SEQ ID NO: 520243 - DNA, 25 bp, Mus musculus
acggcttcagatgatggctacatca

SEQ ID NO: 520244 - DNA, 25 bp, Mus musculus
acggcttctgctactgccgcagtct

SEQ ID NO: 520245 - DNA, 25 bp, Mus musculus
acggcttctgcttctgccgcagtct

SEQ ID NO: 520246 - DNA, 25 bp, Mus musculus
acggcttctgggagccttcacctgc

SEQ ID NO: 520247 - DNA, 25 bp, Mus musculus
acggcttctgggtgccttcacctgc

SEQ ID NO: 520248 - DNA, 25 bp, Mus musculus
acggcttggcaaccaggacccgtga

SEQ ID NO: 520249 - DNA, 25 bp, Mus musculus
acggcttggcaagcaggacccgtga

SEQ ID NO: 520250 - DNA, 25 bp, Mus musculus
acgggaagaggtcaacaagtttcat

SEQ ID NO: 520251 - DNA, 25 bp, Mus musculus
acgggaagaggtgaacaagtttcat

SEQ ID NO: 520252 - DNA, 25 bp, Mus musculus
acgggaagccctctgaaggtgaagc

SEQ ID NO: 520253 - DNA, 25 bp, Mus musculus
acgggaagccctgtgaaggtgaagc

SEQ ID NO: 520254 - DNA, 25 bp, Mus musculus
acgggacactggctctcaagccaaa

SEQ ID NO: 520255 - DNA, 25 bp, Mus musculus
acgggacactgggtctcaagccaaa

SEQ ID NO: 520256 - DNA, 25 bp, Mus musculus
acgggacgactcagctgactacatc

SEQ ID NO: 520257 - DNA, 25 bp, Mus musculus
acgggacgactctgctgactacatc

SEQ ID NO: 520258 - DNA, 25 bp, Mus musculus
acgggagatattatggcaggctgcc

SEQ ID NO: 520259 - DNA, 25 bp, Mus musculus
acgggagatattttggcaggctgcc

SEQ ID NO: 520260 - DNA, 25 bp, Mus musculus
acgggagatctaagaccgctatggc

SEQ ID NO: 520261 - DNA, 25 bp, Mus musculus
acgggagatctatgaccgctatggc

SEQ ID NO: 520262 - DNA, 25 bp, Mus musculus
acgggagcacacatcgcagagactt

SEQ ID NO: 520263 - DNA, 25 bp, Mus musculus
acgggagcacacttcgcagagactt

SEQ ID NO: 520264 - DNA, 25 bp, Mus musculus
acgggagcggcacgatcgcatctcc

SEQ ID NO: 520265 - DNA, 25 bp, Mus musculus
acgggagcggcaggatcgcatctcc

SEQ ID NO: 520266 - DNA, 25 bp, Mus musculus
acgggagcttcgaaatctggttcca

SEQ ID NO: 520267 - DNA, 25 bp, Mus musculus
acgggagcttcgtaatctggttcca

SEQ ID NO: 520268 - DNA, 25 bp, Mus musculus
acgggatcccagctactcctggtgt

SEQ ID NO: 520269 - DNA, 25 bp, Mus musculus
acgggatcccaggtactcctggtgt

SEQ ID NO: 520270 - DNA, 25 bp, Mus musculus
acgggatcccgtagcgacccaatgg

SEQ ID NO: 520271 - DNA, 25 bp, Mus musculus
acgggatcccgttgcgacccaatgg

SEQ ID NO: 520272 - DNA, 25 bp, Mus musculus
acgggcactggcagaaaattctggc

SEQ ID NO: 520273 - DNA, 25 bp, Mus musculus
acgggcactggctgaaaattctggc

SEQ ID NO: 520274 - DNA, 25 bp, Mus musculus
acgggcatgcggcacgctgactaca

SEQ ID NO: 520275 - DNA, 25 bp, Mus musculus
acgggcatgcgggacgctgactaca

SEQ ID NO: 520276 - DNA, 25 bp, Mus musculus
acgggcatgttcagctcatcatctg

SEQ ID NO: 520277 - DNA, 25 bp, Mus musculus
acgggcatgttctgctcatcatctg

SEQ ID NO: 520278 - DNA, 25 bp, Mus musculus
acgggcatgtttaaggaactctgga

SEQ ID NO: 520279 - DNA, 25 bp, Mus musculus
acgggcatgttttaggaactctgga

SEQ ID NO: 520280 - DNA, 25 bp, Mus musculus
acgggcccgccaacaaagacggcag

SEQ ID NO: 520281 - DNA, 25 bp, Mus musculus
acgggcccgccatcaaagacggcag

SEQ ID NO: 520282 - DNA, 25 bp, Mus musculus
acgggcccgtgacctgagtatacaa

SEQ ID NO: 520283 - DNA, 25 bp, Mus musculus
acgggcccgtgagctgagtatacaa

SEQ ID NO: 520284 - DNA, 25 bp, Mus musculus
acgggcctcaggcaacttcagccaa

SEQ ID NO: 520285 - DNA, 25 bp, Mus musculus
acgggcctcagggaacttcagccaa

SEQ ID NO: 520286 - DNA, 25 bp, Mus musculus
acgggcctgctcacaagaaggcaga

SEQ ID NO: 520287 - DNA, 25 bp, Mus musculus
acgggcctgctctcaagaaggcaga

SEQ ID NO: 520288 - DNA, 25 bp, Mus musculus
acgggccttgtgaatctagacctgc

SEQ ID NO: 520289 - DNA, 25 bp, Mus musculus
acgggccttgtgtatctagacctgc

SEQ ID NO: 520290 - DNA, 25 bp, Mus musculus
acgggcgaggagacaccgagcacta

SEQ ID NO: 520291 - DNA, 25 bp, Mus musculus
acgggcgaggagtcaccgagcacta

SEQ ID NO: 520292 - DNA, 25 bp, Mus musculus
acgggcgcatctacgtgggcaacct

SEQ ID NO: 520293 - DNA, 25 bp, Mus musculus
acgggcgcatcttcgtgggcaacct

SEQ ID NO: 520294 - DNA, 25 bp, Mus musculus
acgggcggtgccatctggacagcaa

SEQ ID NO: 520295 - DNA, 25 bp, Mus musculus
acgggcggtgccttctggacagcaa

SEQ ID NO: 520296 - DNA, 25 bp, Mus musculus
acgggctctggacgaccatcaccat

SEQ ID NO: 520297 - DNA, 25 bp, Mus musculus
acgggctctggaggaccatcaccat

SEQ ID NO: 520298 - DNA, 25 bp, Mus musculus
acgggcttccagctcgccgttggct

SEQ ID NO: 520299 - DNA, 25 bp, Mus musculus
acgggcttccaggtcgccgttggct

SEQ ID NO: 520300 - DNA, 25 bp, Mus musculus
acgggcttcttactccggcgttgca

SEQ ID NO: 520301 - DNA, 25 bp, Mus musculus
acgggcttcttagtccggcgttgca

SEQ ID NO: 520302 - DNA, 25 bp, Mus musculus
acgggtaggtgcagtcatgacgtcc

SEQ ID NO: 520303 - DNA, 25 bp, Mus musculus
acgggtaggtgctgtcatgacgtcc

SEQ ID NO: 520304 - DNA, 25 bp, Mus musculus
acgggtatcgcgctcctgaagcaga

SEQ ID NO: 520305 - DNA, 25 bp, Mus musculus
acgggtatcgcggtcctgaagcaga

SEQ ID NO: 520306 - DNA, 25 bp, Mus musculus
acgggtccaccaccgcagtgtcaag

SEQ ID NO: 520307 - DNA, 25 bp, Mus musculus
acgggtccaccagcgcagtgtcaag

SEQ ID NO: 520308 - DNA, 25 bp, Mus musculus
acgggtgaggcgcagaccatcacca

SEQ ID NO: 520309 - DNA, 25 bp, Mus musculus
acgggtgaggcggagaccatcacca

SEQ ID NO: 520310 - DNA, 25 bp, Mus musculus
acgggtggcaagagtcagcgaccct

SEQ ID NO: 520311 - DNA, 25 bp, Mus musculus
acgggtggcaagtgtcagcgaccct

SEQ ID NO: 520312 - DNA, 25 bp, Mus musculus
acgggtggtgtaagtctctgactca

SEQ ID NO: 520313 - DNA, 25 bp, Mus musculus
acgggtggtgtatgtctctgactca

SEQ ID NO: 520314 - DNA, 25 bp, Mus musculus
acgggtgtaactagctctggaggca

SEQ ID NO: 520315 - DNA, 25 bp, Mus musculus
acgggtgtaacttgctctggaggca

SEQ ID NO: 520316 - DNA, 25 bp, Mus musculus
acggtatacctcctgcatgatggct

SEQ ID NO: 520317 - DNA, 25 bp, Mus musculus
acggtatacctcgtgcatgatggct

SEQ ID NO: 520318 - DNA, 25 bp, Mus musculus
acggtcacagctcatgatggaggcc

SEQ ID NO: 520319 - DNA, 25 bp, Mus musculus
acggtcacagctgatgatggaggcc

SEQ ID NO: 520320 - DNA, 25 bp, Mus musculus
acggtcacttggactccggcggagc

SEQ ID NO: 520321 - DNA, 25 bp, Mus musculus
acggtcacttggtctccggcggagc

SEQ ID NO: 520322 - DNA, 25 bp, Mus musculus
acggtccatgcgatccgtagggctg

SEQ ID NO: 520323 - DNA, 25 bp, Mus musculus
acggtccatgcgttccgtagggctg

SEQ ID NO: 520324 - DNA, 25 bp, Mus musculus
acggtctacctgaagctaggaggca

SEQ ID NO: 520325 - DNA, 25 bp, Mus musculus
acggtctacctgtagctaggaggca

SEQ ID NO: 520326 - DNA, 25 bp, Mus musculus
acggtctcatctctcatctcttagg

SEQ ID NO: 520327 - DNA, 25 bp, Mus musculus
acggtctcatctgtcatctcttagg

SEQ ID NO: 520328 - DNA, 25 bp, Mus musculus
acggtctgagccattcgcaggccac

SEQ ID NO: 520329 - DNA, 25 bp, Mus musculus
acggtctgagcctttcgcaggccac

SEQ ID NO: 520330 - DNA, 25 bp, Mus musculus
acggtctttctcaacccatggtaga

SEQ ID NO: 520331 - DNA, 25 bp, Mus musculus
acggtctttctctacccatggtaga

SEQ ID NO: 520332 - DNA, 25 bp, Mus musculus
acggtgacaagacgatcatcgacac

SEQ ID NO: 520333 - DNA, 25 bp, Mus musculus
acggtgacaagaggatcatcgacac

SEQ ID NO: 520334 - DNA, 25 bp, Mus musculus
acggtgacactgacatgcgaaggga

SEQ ID NO: 520335 - DNA, 25 bp, Mus musculus
acggtgacactgtcatgcgaaggga

SEQ ID NO: 520336 - DNA, 25 bp, Mus musculus
acggtgacctagacccctgggcagg

SEQ ID NO: 520337 - DNA, 25 bp, Mus musculus
acggtgacctagtcccctgggcagg

SEQ ID NO: 520338 - DNA, 25 bp, Mus musculus
acggtgaggccaagaaaatggctcc

SEQ ID NO: 520339 - DNA, 25 bp, Mus musculus
acggtgaggccatgaaaatggctcc

SEQ ID NO: 520340 - DNA, 25 bp, Mus musculus
acggtgcggacaagcagtgcaaaag

SEQ ID NO: 520341 - DNA, 25 bp, Mus musculus
acggtgcggacatgcagtgcaaaag

SEQ ID NO: 520342 - DNA, 25 bp, Mus musculus
acggtggatccacttgtcaagacaa

SEQ ID NO: 520343 - DNA, 25 bp, Mus musculus
acggtggatccagttgtcaagacaa

SEQ ID NO: 520344 - DNA, 25 bp, Mus musculus
acggtggcacctccaaggacatgac

SEQ ID NO: 520345 - DNA, 25 bp, Mus musculus
acggtggcacctgcaaggacatgac

SEQ ID NO: 520346 - DNA, 25 bp, Mus musculus
acggtggccgccagggacagatcat

SEQ ID NO: 520347 - DNA, 25 bp, Mus musculus
acggtggccgcctgggacagatcat

SEQ ID NO: 520348 - DNA, 25 bp, Mus musculus
acggtggcctgcactactgcatgga

SEQ ID NO: 520349 - DNA, 25 bp, Mus musculus
acggtggcctgctctactgcatgga

SEQ ID NO: 520350 - DNA, 25 bp, Mus musculus
acggtgtccaacacccagcaggctt

SEQ ID NO: 520351 - DNA, 25 bp, Mus musculus
acggtgtccaactcccagcaggctt

SEQ ID NO: 520352 - DNA, 25 bp, Mus musculus
acggttcctcataggcgcctactca

SEQ ID NO: 520353 - DNA, 25 bp, Mus musculus
acggttcctcattggcgcctactca

SEQ ID NO: 520354 - DNA, 25 bp, Mus musculus
acggttctgtgcaaacatcataaag

SEQ ID NO: 520355 - DNA, 25 bp, Mus musculus
acggttctgtgctaacatcataaag

SEQ ID NO: 520356 - DNA, 25 bp, Mus musculus
acggtttgagctctcgtgcccgcag

SEQ ID NO: 520357 - DNA, 25 bp, Mus musculus
acggtttgagctgtcgtgcccgcag

SEQ ID NO: 520358 - DNA, 25 bp, Mus musculus
acggtttggagacactcttcccaag

SEQ ID NO: 520359 - DNA, 25 bp, Mus musculus
acggtttggagagactcttcccaag

SEQ ID NO: 520360 - DNA, 25 bp, Mus musculus
acgtaactgggcattacccgcatca

SEQ ID NO: 520361 - DNA, 25 bp, Mus musculus
acgtaactgggctttacccgcatca

SEQ ID NO: 520362 - DNA, 25 bp, Mus musculus
acgtaagcgactccggccctacagt

SEQ ID NO: 520363 - DNA, 25 bp, Mus musculus
acgtaagcgactgcggccctacagt

SEQ ID NO: 520364 - DNA, 25 bp, Mus musculus
acgtaaggctacaggcccttccgag

SEQ ID NO: 520365 - DNA, 25 bp, Mus musculus
acgtaaggctactggcccttccgag

SEQ ID NO: 520366 - DNA, 25 bp, Mus musculus
acgtaagtgctcagtctcccggtct

SEQ ID NO: 520367 - DNA, 25 bp, Mus musculus
acgtaagtgctctgtctcccggtct

SEQ ID NO: 520368 - DNA, 25 bp, Mus musculus
acgtacaaggaccaggcacctgctt

SEQ ID NO: 520369 - DNA, 25 bp, Mus musculus
acgtacaaggacgaggcacctgctt

SEQ ID NO: 520370 - DNA, 25 bp, Mus musculus
acgtacagggcaagtctgaaggcag

SEQ ID NO: 520371 - DNA, 25 bp, Mus musculus
acgtacagggcatgtctgaaggcag

SEQ ID NO: 520372 - DNA, 25 bp, Mus musculus
acgtacatgcgcaacaccagtaagc

SEQ ID NO: 520373 - DNA, 25 bp, Mus musculus
acgtacatgcgctacaccagtaagc

SEQ ID NO: 520374 - DNA, 25 bp, Mus musculus
acgtacgagggcagccgcgagacca

SEQ ID NO: 520375 - DNA, 25 bp, Mus musculus
acgtacgagggctgccgcgagacca

SEQ ID NO: 520376 - DNA, 25 bp, Mus musculus
acgtacgggaccctggctgtcgcta

SEQ ID NO: 520377 - DNA, 25 bp, Mus musculus
acgtacgggaccgtggctgtcgcta

SEQ ID NO: 520378 - DNA, 25 bp, Mus musculus
acgtactatggactgtccgccctga

SEQ ID NO: 520379 - DNA, 25 bp, Mus musculus
acgtactatggagtgtccgccctga

SEQ ID NO: 520380 - DNA, 25 bp, Mus musculus
acgtagaaggatattcacagcctgt

SEQ ID NO: 520381 - DNA, 25 bp, Mus musculus
acgtagaaggattttcacagcctgt

SEQ ID NO: 520382 - DNA, 25 bp, Mus musculus
acgtagagggcgagacgcatcacca

SEQ ID NO: 520383 - DNA, 25 bp, Mus musculus
acgtagagggcgtgacgcatcacca

SEQ ID NO: 520384 - DNA, 25 bp, Mus musculus
acgtagccagtgagtgccggcagct

SEQ ID NO: 520385 - DNA, 25 bp, Mus musculus
acgtagccagtgtgtgccggcagct

SEQ ID NO: 520386 - DNA, 25 bp, Mus musculus
acgtagcccctgacgggcgcatcta

SEQ ID NO: 520387 - DNA, 25 bp, Mus musculus
acgtagcccctgtcgggcgcatcta

SEQ ID NO: 520388 - DNA, 25 bp, Mus musculus
acgtagccctgactgaactccaact

SEQ ID NO: 520389 - DNA, 25 bp, Mus musculus
acgtagccctgagtgaactccaact

SEQ ID NO: 520390 - DNA, 25 bp, Mus musculus
acgtaggtgccaagcagccccggac

SEQ ID NO: 520391 - DNA, 25 bp, Mus musculus
acgtaggtgccatgcagccccggac

SEQ ID NO: 520392 - DNA, 25 bp, Mus musculus
acgtaggtggccaggacaagattcg

SEQ ID NO: 520393 - DNA, 25 bp, Mus musculus
acgtaggtggcctggacaagattcg

SEQ ID NO: 520394 - DNA, 25 bp, Mus musculus
acgtatgctgaaccccaattctaca

SEQ ID NO: 520395 - DNA, 25 bp, Mus musculus
acgtatgctgaagcccaattctaca

SEQ ID NO: 520396 - DNA, 25 bp, Mus musculus
acgtattgatgaccgggctggacct

SEQ ID NO: 520397 - DNA, 25 bp, Mus musculus
acgtattgatgagcgggctggacct

SEQ ID NO: 520398 - DNA, 25 bp, Mus musculus
acgtattgccttcggctctcagcag

SEQ ID NO: 520399 - DNA, 25 bp, Mus musculus
acgtattgccttgggctctcagcag

SEQ ID NO: 520400 - DNA, 25 bp, Mus musculus
acgtatttctctaatttgacttggg

SEQ ID NO: 520401 - DNA, 25 bp, Mus musculus
acgtatttctcttatttgacttggg

SEQ ID NO: 520402 - DNA, 25 bp, Mus musculus
acgtcaacagcaagggccatgtgga

SEQ ID NO: 520403 - DNA, 25 bp, Mus musculus
acgtcaacagcatgggccatgtgga

SEQ ID NO: 520404 - DNA, 25 bp, Mus musculus
acgtcaactgtgacccctgtaagcc

SEQ ID NO: 520405 - DNA, 25 bp, Mus musculus
acgtcaactgtgtcccctgtaagcc

SEQ ID NO: 520406 - DNA, 25 bp, Mus musculus
acgtcacaaaaacaaatgcatcttc

SEQ ID NO: 520407 - DNA, 25 bp, Mus musculus
acgtcacaaaaagaaatgcatcttc

SEQ ID NO: 520408 - DNA, 25 bp, Mus musculus
acgtcacactacactgagccttctg

SEQ ID NO: 520409 - DNA, 25 bp, Mus musculus
acgtcacactactctgagccttctg

SEQ ID NO: 520410 - DNA, 25 bp, Mus musculus
acgtcactcgaaaggcctactggca

SEQ ID NO: 520411 - DNA, 25 bp, Mus musculus
acgtcactcgaacggccgttgcagg

SEQ ID NO: 520412 - DNA, 25 bp, Mus musculus
acgtcactcgaagggccgttgcagg

SEQ ID NO: 520413 - DNA, 25 bp, Mus musculus
acgtcactcgaatggcctactggca

SEQ ID NO: 520414 - DNA, 25 bp, Mus musculus
acgtcactgcctaactttgtgctca

SEQ ID NO: 520415 - DNA, 25 bp, Mus musculus
acgtcactgccttactttgtgctca

SEQ ID NO: 520416 - DNA, 25 bp, Mus musculus
acgtcagaaagcaacgggagatcct

SEQ ID NO: 520417 - DNA, 25 bp, Mus musculus
acgtcagaaagctacgggagatcct

SEQ ID NO: 520418 - DNA, 25 bp, Mus musculus
acgtcagtggcaaatatgcacgaca

SEQ ID NO: 520419 - DNA, 25 bp, Mus musculus
acgtcagtggcatatatgcacgaca

SEQ ID NO: 520420 - DNA, 25 bp, Mus musculus
acgtcatcgtgcctgtggtgcccct

SEQ ID NO: 520421 - DNA, 25 bp, Mus musculus
acgtcatcgtgcgtgtggtgcccct

SEQ ID NO: 520422 - DNA, 25 bp, Mus musculus
acgtccactgtgctgtgcaagccca

SEQ ID NO: 520423 - DNA, 25 bp, Mus musculus
acgtccactgtggtgtgcaagccca

SEQ ID NO: 520424 - DNA, 25 bp, Mus musculus
acgtccaggataagtgtgagtgcat

SEQ ID NO: 520425 - DNA, 25 bp, Mus musculus
acgtccaggatatgtgtgagtgcat

SEQ ID NO: 520426 - DNA, 25 bp, Mus musculus
acgtccaggccaagaggcgaagatg

SEQ ID NO: 520427 - DNA, 25 bp, Mus musculus
acgtccaggccatgaggcgaagatg

SEQ ID NO: 520428 - DNA, 25 bp, Mus musculus
acgtcccactttcccagcagaataa

SEQ ID NO: 520429 - DNA, 25 bp, Mus musculus
acgtcccactttgccagcagaataa

SEQ ID NO: 520430 - DNA, 25 bp, Mus musculus
acgtccccggcgacggagctgttca

SEQ ID NO: 520431 - DNA, 25 bp, Mus musculus
acgtccccggcgtcggagctgttca

SEQ ID NO: 520432 - DNA, 25 bp, Mus musculus
acgtcgactgtgactgggagagcca

SEQ ID NO: 520433 - DNA, 25 bp, Mus musculus
acgtcgactgtgtctgggagagcca

SEQ ID NO: 520434 - DNA, 25 bp, Mus musculus
acgtcgcatttacagctgcagcctc

SEQ ID NO: 520435 - DNA, 25 bp, Mus musculus
acgtcgcatttagagctgcagcctc

SEQ ID NO: 520436 - DNA, 25 bp, Mus musculus
acgtcggacggcatgctgtggaaaa

SEQ ID NO: 520437 - DNA, 25 bp, Mus musculus
acgtcggacggcttgctgtggaaaa

SEQ ID NO: 520438 - DNA, 25 bp, Mus musculus
acgtcggcggaaactggagcgacat

SEQ ID NO: 520439 - DNA, 25 bp, Mus musculus
acgtcggcggaatctggagcgacat

SEQ ID NO: 520440 - DNA, 25 bp, Mus musculus
acgtcgtcatggctggcattgtcca

SEQ ID NO: 520441 - DNA, 25 bp, Mus musculus
acgtcgtcatgggtggcattgtcca

SEQ ID NO: 520442 - DNA, 25 bp, Mus musculus
acgtcgtgcactagacagagaaaat

SEQ ID NO: 520443 - DNA, 25 bp, Mus musculus
acgtcgtgcacttgacagagaaaat

SEQ ID NO: 520444 - DNA, 25 bp, Mus musculus
acgtctacgtggaagaggtcccctg

SEQ ID NO: 520445 - DNA, 25 bp, Mus musculus
acgtctacgtggtagaggtcccctg

SEQ ID NO: 520446 - DNA, 25 bp, Mus musculus
acgtctcatggacctgatctttatg

SEQ ID NO: 520447 - DNA, 25 bp, Mus musculus
acgtctcatggagctgatctttatg

SEQ ID NO: 520448 - DNA, 25 bp, Mus musculus
acgtctgcagatagatgagcagctg

SEQ ID NO: 520449 - DNA, 25 bp, Mus musculus
acgtctgcagattgatgagcagctg

SEQ ID NO: 520450 - DNA, 25 bp, Mus musculus
acgtctgccagcaggtctatgtgga

SEQ ID NO: 520451 - DNA, 25 bp, Mus musculus
acgtctgccagctggtctatgtgga

SEQ ID NO: 520452 - DNA, 25 bp, Mus musculus
acgtctgccgtcattgttcactgca

SEQ ID NO: 520453 - DNA, 25 bp, Mus musculus
acgtctgccgtctttgttcactgca

SEQ ID NO: 520454 - DNA, 25 bp, Mus musculus
acgtctgctcacatcgacccagatg

SEQ ID NO: 520455 - DNA, 25 bp, Mus musculus
acgtctgctcacttcgacccagatg

SEQ ID NO: 520456 - DNA, 25 bp, Mus musculus
acgtctgtagccatcccggtgactg

SEQ ID NO: 520457 - DNA, 25 bp, Mus musculus
acgtctgtagccttcccggtgactg

SEQ ID NO: 520458 - DNA, 25 bp, Mus musculus
acgtctgtatcaccgccagcgagag

SEQ ID NO: 520459 - DNA, 25 bp, Mus musculus
acgtctgtatcagcgccagcgagag

SEQ ID NO: 520460 - DNA, 25 bp, Mus musculus
acgtcttagtgcacaggctgtctga

SEQ ID NO: 520461 - DNA, 25 bp, Mus musculus
acgtcttagtgctcaggctgtctga

SEQ ID NO: 520462 - DNA, 25 bp, Mus musculus
acgtgaagcgccatcgagaaatgag

SEQ ID NO: 520463 - DNA, 25 bp, Mus musculus
acgtgaagcgccttcgagaaatgag

SEQ ID NO: 520464 - DNA, 25 bp, Mus musculus
acgtgagcacatccccctgtggaga

SEQ ID NO: 520465 - DNA, 25 bp, Mus musculus
acgtgagcacatgcccctgtggaga

SEQ ID NO: 520466 - DNA, 25 bp, Mus musculus
acgtgagcagcgctaccaggaacag

SEQ ID NO: 520467 - DNA, 25 bp, Mus musculus
acgtgagcagcggtaccaggaacag

SEQ ID NO: 520468 - DNA, 25 bp, Mus musculus
acgtgagcgccacgatcggcagcag

SEQ ID NO: 520469 - DNA, 25 bp, Mus musculus
acgtgagcgccaggatcggcagcag

SEQ ID NO: 520470 - DNA, 25 bp, Mus musculus
acgtgagggaaaacgaactggctct

SEQ ID NO: 520471 - DNA, 25 bp, Mus musculus
acgtgagggaaatcgaactggctct

SEQ ID NO: 520472 - DNA, 25 bp, Mus musculus
acgtgatcaccacagtttcccagct

SEQ ID NO: 520473 - DNA, 25 bp, Mus musculus
acgtgatcaccagagtttcccagct

SEQ ID NO: 520474 - DNA, 25 bp, Mus musculus
acgtgatgccctccgtgaaagggct

SEQ ID NO: 520475 - DNA, 25 bp, Mus musculus
acgtgatgccctgcgtgaaagggct

SEQ ID NO: 520476 - DNA, 25 bp, Mus musculus
acgtgatgccgcctgctattcctgc

SEQ ID NO: 520477 - DNA, 25 bp, Mus musculus
acgtgatgccgcgtgctattcctgc

SEQ ID NO: 520478 - DNA, 25 bp, Mus musculus
acgtgccagggtagttcaggagccc

SEQ ID NO: 520479 - DNA, 25 bp, Mus musculus
acgtgccagggttgttcaggagccc

SEQ ID NO: 520480 - DNA, 25 bp, Mus musculus
acgtgcctgggacctaccagtgtgc

SEQ ID NO: 520481 - DNA, 25 bp, Mus musculus
acgtgcctgggagctaccagtgtgc

SEQ ID NO: 520482 - DNA, 25 bp, Mus musculus
acgtgcgctaggagccctaggcccg

SEQ ID NO: 520483 - DNA, 25 bp, Mus musculus
acgtgcgctaggtgccctaggcccg

SEQ ID NO: 520484 - DNA, 25 bp, Mus musculus
acgtgctcagcaaccggccggtgca

SEQ ID NO: 520485 - DNA, 25 bp, Mus musculus
acgtgctcagcatccggccggtgca

SEQ ID NO: 520486 - DNA, 25 bp, Mus musculus
acgtgctccagtcgcccgggctagt

SEQ ID NO: 520487 - DNA, 25 bp, Mus musculus
acgtgctccagtggcccgggctagt

SEQ ID NO: 520488 - DNA, 25 bp, Mus musculus
acgtgctcctggcatatgggctaca

SEQ ID NO: 520489 - DNA, 25 bp, Mus musculus
acgtgctcctgggatatgggctaca

SEQ ID NO: 520490 - DNA, 25 bp, Mus musculus
acgtgctcggcgaataagtagcggc

SEQ ID NO: 520491 - DNA, 25 bp, Mus musculus
acgtgctcggcgtataagtagcggc

SEQ ID NO: 520492 - DNA, 25 bp, Mus musculus
acgtgctgcgccagcatggcctcgt

SEQ ID NO: 520493 - DNA, 25 bp, Mus musculus
acgtgctgcgcctgcatggcctcgt

SEQ ID NO: 520494 - DNA, 25 bp, Mus musculus
acgtgctggccaaagccctctatga

SEQ ID NO: 520495 - DNA, 25 bp, Mus musculus
acgtgctggccatagccctctatga

SEQ ID NO: 520496 - DNA, 25 bp, Mus musculus
acgtgcttgactcgcgacagctacc

SEQ ID NO: 520497 - DNA, 25 bp, Mus musculus
acgtgcttgactggcgacagctacc

SEQ ID NO: 520498 - DNA, 25 bp, Mus musculus
acgtgcttgtctactacaacctggt

SEQ ID NO: 520499 - DNA, 25 bp, Mus musculus
acgtgcttgtcttctacaacctggt

SEQ ID NO: 520500 - DNA, 25 bp, Mus musculus
acgtggaagcccacactggtcatcc

SEQ ID NO: 520501 - DNA, 25 bp, Mus musculus
acgtggaagccctcactggtcatcc

SEQ ID NO: 520502 - DNA, 25 bp, Mus musculus
acgtggagattgactttcttcacaa

SEQ ID NO: 520503 - DNA, 25 bp, Mus musculus
acgtggagattgtctttcttcacaa

SEQ ID NO: 520504 - DNA, 25 bp, Mus musculus
acgtggagctcaacaggctgctgcg

SEQ ID NO: 520505 - DNA, 25 bp, Mus musculus
acgtggagctcatcaggctgctgcg

SEQ ID NO: 520506 - DNA, 25 bp, Mus musculus
acgtggaggatgagtccacaggcct

SEQ ID NO: 520507 - DNA, 25 bp, Mus musculus
acgtggaggatgtgtccacaggcct

SEQ ID NO: 520508 - DNA, 25 bp, Mus musculus
acgtggatgaatcctcagagggcac

SEQ ID NO: 520509 - DNA, 25 bp, Mus musculus
acgtggatgaatgctcagagggcac

SEQ ID NO: 520510 - DNA, 25 bp, Mus musculus
acgtggccatcaaggagcccctggt

SEQ ID NO: 520511 - DNA, 25 bp, Mus musculus
acgtggccatcatggagcccctggt

SEQ ID NO: 520512 - DNA, 25 bp, Mus musculus
acgtggccgaggaactcatccagga

SEQ ID NO: 520513 - DNA, 25 bp, Mus musculus
acgtggccgaggtactcatccagga

SEQ ID NO: 520514 - DNA, 25 bp, Mus musculus
acgtggctaagacaaggatcatgct

SEQ ID NO: 520515 - DNA, 25 bp, Mus musculus
acgtggctaagagaaggatcatgct

SEQ ID NO: 520516 - DNA, 25 bp, Mus musculus
acgtggctgggtctccagctgtccc

SEQ ID NO: 520517 - DNA, 25 bp, Mus musculus
acgtggctgggtgtccagctgtccc

SEQ ID NO: 520518 - DNA, 25 bp, Mus musculus
acgtgggatgcaagaaatgccctgg

SEQ ID NO: 520519 - DNA, 25 bp, Mus musculus
acgtgggatgcatgaaatgccctgg

SEQ ID NO: 520520 - DNA, 25 bp, Mus musculus
acgtgggtgaacagatcttggttgc

SEQ ID NO: 520521 - DNA, 25 bp, Mus musculus
acgtgggtgaactgatcttggttgc

SEQ ID NO: 520522 - DNA, 25 bp, Mus musculus
acgtggtatctcatctgaagaagaa

SEQ ID NO: 520523 - DNA, 25 bp, Mus musculus
acgtggtatctcttctgaagaagaa

SEQ ID NO: 520524 - DNA, 25 bp, Mus musculus
acgtggtcaggtaggaccctcagcc

SEQ ID NO: 520525 - DNA, 25 bp, Mus musculus
acgtggtcaggttggaccctcagcc

SEQ ID NO: 520526 - DNA, 25 bp, Mus musculus
acgtggtcgtcaccagccgcaaaca

SEQ ID NO: 520527 - DNA, 25 bp, Mus musculus
acgtggtcgtcagcagccgcaaaca

SEQ ID NO: 520528 - DNA, 25 bp, Mus musculus
acgtggtgagtcctatggaagacac

SEQ ID NO: 520529 - DNA, 25 bp, Mus musculus
acgtggtgagtcgtatggaagacac

SEQ ID NO: 520530 - DNA, 25 bp, Mus musculus
acgtggtgatcccaactcgacggtc

SEQ ID NO: 520531 - DNA, 25 bp, Mus musculus
acgtggtgatccgaactcgacggtc

SEQ ID NO: 520532 - DNA, 25 bp, Mus musculus
acgtggtgctctcgcccgtctggtt

SEQ ID NO: 520533 - DNA, 25 bp, Mus musculus
acgtggtgctctggcccgtctggtt

SEQ ID NO: 520534 - DNA, 25 bp, Mus musculus
acgtggtggacactgcccgaagctt

SEQ ID NO: 520535 - DNA, 25 bp, Mus musculus
acgtggtggacagtgcccgaagctt

SEQ ID NO: 520536 - DNA, 25 bp, Mus musculus
acgtggtggagtattctaagtcgca

SEQ ID NO: 520537 - DNA, 25 bp, Mus musculus
acgtggtggagttttctaagtcgca

SEQ ID NO: 520538 - DNA, 25 bp, Mus musculus
acgtggtggcctactcccagctggg

SEQ ID NO: 520539 - DNA, 25 bp, Mus musculus
acgtggtggccttctcccagctggg

SEQ ID NO: 520540 - DNA, 25 bp, Mus musculus
acgtggtgtcctccgcatctgcctt

SEQ ID NO: 520541 - DNA, 25 bp, Mus musculus
acgtggtgtcctgcgcatctgcctt

SEQ ID NO: 520542 - DNA, 25 bp, Mus musculus
acgtgtacattgagtcccaggacaa

SEQ ID NO: 520543 - DNA, 25 bp, Mus musculus
acgtgtacattgtgtcccaggacaa

SEQ ID NO: 520544 - DNA, 25 bp, Mus musculus
acgtgtacgagcagcacgagaacag

SEQ ID NO: 520545 - DNA, 25 bp, Mus musculus
acgtgtacgagctgcacgagaacag

SEQ ID NO: 520546 - DNA, 25 bp, Mus musculus
acgtgtacggtgattctgatggctg

SEQ ID NO: 520547 - DNA, 25 bp, Mus musculus
acgtgtacggtgtttctgatggctg

SEQ ID NO: 520548 - DNA, 25 bp, Mus musculus
acgtgtccgaacactgcatcccgga

SEQ ID NO: 520549 - DNA, 25 bp, Mus musculus
acgtgtccgaacagaggagagtcac

SEQ ID NO: 520550 - DNA, 25 bp, Mus musculus
acgtgtccgaactctgcatcccgga

SEQ ID NO: 520551 - DNA, 25 bp, Mus musculus
acgtgtccgaactgaggagagtcac

SEQ ID NO: 520552 - DNA, 25 bp, Mus musculus
acgtgtccggcgcagtttctccagc

SEQ ID NO: 520553 - DNA, 25 bp, Mus musculus
acgtgtccggcggagtttctccagc

SEQ ID NO: 520554 - DNA, 25 bp, Mus musculus
acgtgtgaagctagaagggaaagaa

SEQ ID NO: 520555 - DNA, 25 bp, Mus musculus
acgtgtgaagcttgaagggaaagaa

SEQ ID NO: 520556 - DNA, 25 bp, Mus musculus
acgtgtggaacgactgctggatgaa

SEQ ID NO: 520557 - DNA, 25 bp, Mus musculus
acgtgtggaacgtctgctggatgaa

SEQ ID NO: 520558 - DNA, 25 bp, Mus musculus
acgtgtgtccccatggcgaattaag

SEQ ID NO: 520559 - DNA, 25 bp, Mus musculus
acgtgtgtccccttggcgaattaag

SEQ ID NO: 520560 - DNA, 25 bp, Mus musculus
acgtgtgttcgcaccgtatgcctgt

SEQ ID NO: 520561 - DNA, 25 bp, Mus musculus
acgtgtgttcgctccgtatgcctgt

SEQ ID NO: 520562 - DNA, 25 bp, Mus musculus
acgtgtgttcttcggcagggtctga

SEQ ID NO: 520563 - DNA, 25 bp, Mus musculus
acgtgtgttcttgggcagggtctga

SEQ ID NO: 520564 - DNA, 25 bp, Mus musculus
acgtgttcactaagccagaggatga

SEQ ID NO: 520565 - DNA, 25 bp, Mus musculus
acgtgttcactatgccagaggatga

SEQ ID NO: 520566 - DNA, 25 bp, Mus musculus
acgtgttcattcatgactacgtggg

SEQ ID NO: 520567 - DNA, 25 bp, Mus musculus
acgtgttcattcttgactacgtggg

SEQ ID NO: 520568 - DNA, 25 bp, Mus musculus
acgtgttccgagcaagccgcaggcc

SEQ ID NO: 520569 - DNA, 25 bp, Mus musculus
acgtgttccgaggaagccgcaggcc

SEQ ID NO: 520570 - DNA, 25 bp, Mus musculus
acgtgttctctgaccgtgcccttcg

SEQ ID NO: 520571 - DNA, 25 bp, Mus musculus
acgtgttctctgtccgtgcccttcg

SEQ ID NO: 520572 - DNA, 25 bp, Mus musculus
acgtgttcttccacctctactttgg

SEQ ID NO: 520573 - DNA, 25 bp, Mus musculus
acgtgttcttcctcctctactttgg

SEQ ID NO: 520574 - DNA, 25 bp, Mus musculus
acgtgttgctggagcccttccgctg

SEQ ID NO: 520575 - DNA, 25 bp, Mus musculus
acgtgttgctggtgcccttccgctg

SEQ ID NO: 520576 - DNA, 25 bp, Mus musculus
acgttaaggtggatatgctgggcaa

SEQ ID NO: 520577 - DNA, 25 bp, Mus musculus
acgttaaggtggttatgctgggcaa

SEQ ID NO: 520578 - DNA, 25 bp, Mus musculus
acgttaccaaatcgtcccagcggca

SEQ ID NO: 520579 - DNA, 25 bp, Mus musculus
acgttaccaaatggtcccagcggca

SEQ ID NO: 520580 - DNA, 25 bp, Mus musculus
acgttaggggataagcaatagggct

SEQ ID NO: 520581 - DNA, 25 bp, Mus musculus
acgttaggggattagcaatagggct

SEQ ID NO: 520582 - DNA, 25 bp, Mus musculus
acgttcccaggcagtcgcgtgagcc

SEQ ID NO: 520583 - DNA, 25 bp, Mus musculus
acgttcccaggctgtcgcgtgagcc

SEQ ID NO: 520584 - DNA, 25 bp, Mus musculus
acgttctgccagaaccgagtccctg

SEQ ID NO: 520585 - DNA, 25 bp, Mus musculus
acgttctgccagtaccgagtccctg

SEQ ID NO: 520586 - DNA, 25 bp, Mus musculus
acgttgaagtatctgtcctttgtcg

SEQ ID NO: 520587 - DNA, 25 bp, Mus musculus
acgttgaagtatgtgtcctttgtcg

SEQ ID NO: 520588 - DNA, 25 bp, Mus musculus
acgttgagagccaaccgtcctgggc

SEQ ID NO: 520589 - DNA, 25 bp, Mus musculus
acgttgagagcctaccgtcctgggc

SEQ ID NO: 520590 - DNA, 25 bp, Mus musculus
acgttgagtggcaggagagaatttt

SEQ ID NO: 520591 - DNA, 25 bp, Mus musculus
acgttgagtggctggagagaatttt

SEQ ID NO: 520592 - DNA, 25 bp, Mus musculus
acgttgcaaggcacatgtcacccca

SEQ ID NO: 520593 - DNA, 25 bp, Mus musculus
acgttgcaaggctcatgtcacccca

SEQ ID NO: 520594 - DNA, 25 bp, Mus musculus
acgttggcgcacatgcacgcgcgca

SEQ ID NO: 520595 - DNA, 25 bp, Mus musculus
acgttggcgcacttgcacgcgcgca

SEQ ID NO: 520596 - DNA, 25 bp, Mus musculus
acgttggctctgcaggcctaagccc

SEQ ID NO: 520597 - DNA, 25 bp, Mus musculus
acgttggctctggaggcctaagccc

SEQ ID NO: 520598 - DNA, 25 bp, Mus musculus
acgttgggcctcagccctcacaggg

SEQ ID NO: 520599 - DNA, 25 bp, Mus musculus
acgttgggcctctgccctcacaggg

SEQ ID NO: 520600 - DNA, 25 bp, Mus musculus
acgtttatgagaaggagtcccgaca

SEQ ID NO: 520601 - DNA, 25 bp, Mus musculus
acgtttatgagatggagtcccgaca

SEQ ID NO: 520602 - DNA, 25 bp, Mus musculus
acgtttcatactccattcagccaac

SEQ ID NO: 520603 - DNA, 25 bp, Mus musculus
acgtttcatactgcattcagccaac

SEQ ID NO: 520604 - DNA, 25 bp, Mus musculus
acgtttctgaggacagcgctcggct

SEQ ID NO: 520605 - DNA, 25 bp, Mus musculus
acgtttctgaggtcagcgctcggct

SEQ ID NO: 520606 - DNA, 25 bp, Mus musculus
actaaaaaagcactgaagacccagg

SEQ ID NO: 520607 - DNA, 25 bp, Mus musculus
actaaaaaagcagtgaagacccagg

SEQ ID NO: 520608 - DNA, 25 bp, Mus musculus
actaaaacccgaatctgatcaacag

SEQ ID NO: 520609 - DNA, 25 bp, Mus musculus
actaaaacccgattctgatcaacag

SEQ ID NO: 520610 - DNA, 25 bp, Mus musculus
actaaacaatccaatgcatcgtctg

SEQ ID NO: 520611 - DNA, 25 bp, Mus musculus
actaaacaatcctatgcatcgtctg

SEQ ID NO: 520612 - DNA, 25 bp, Mus musculus
actaaacagtcacaggtgggtgccc

SEQ ID NO: 520613 - DNA, 25 bp, Mus musculus
actaaacagtcagaggtgggtgccc

SEQ ID NO: 520614 - DNA, 25 bp, Mus musculus
actaaagcagcacgtggagcccttg

SEQ ID NO: 520615 - DNA, 25 bp, Mus musculus
actaaagcagcaggtggagcccttg

SEQ ID NO: 520616 - DNA, 25 bp, Mus musculus
actaaagtgtgaagtgacccagagc

SEQ ID NO: 520617 - DNA, 25 bp, Mus musculus
actaaagtgtgatgtgacccagagc

SEQ ID NO: 520618 - DNA, 25 bp, Mus musculus
actaaatggactagctgtcaaactt

SEQ ID NO: 520619 - DNA, 25 bp, Mus musculus
actaaatggacttgctgtcaaactt

SEQ ID NO: 520620 - DNA, 25 bp, Mus musculus
actaaccagaagctacggctctctc

SEQ ID NO: 520621 - DNA, 25 bp, Mus musculus
actaaccagaaggtacggctctctc

SEQ ID NO: 520622 - DNA, 25 bp, Mus musculus
actaaccagttcaccgtgaccaggc

SEQ ID NO: 520623 - DNA, 25 bp, Mus musculus
actaaccagttctccgtgaccaggc

SEQ ID NO: 520624 - DNA, 25 bp, Mus musculus
actaaccctgcacagagctgtgaag

SEQ ID NO: 520625 - DNA, 25 bp, Mus musculus
actaaccctgcagagagctgtgaag

SEQ ID NO: 520626 - DNA, 25 bp, Mus musculus
actaaccgggccctgtgctatctga

SEQ ID NO: 520627 - DNA, 25 bp, Mus musculus
actaaccgggccgtgtgctatctga

SEQ ID NO: 520628 - DNA, 25 bp, Mus musculus
actaactcggctcctgcaggtcatg

SEQ ID NO: 520629 - DNA, 25 bp, Mus musculus
actaactcggctgctgcaggtcatg

SEQ ID NO: 520630 - DNA, 25 bp, Mus musculus
actaactttctaaagaagcatgaga

SEQ ID NO: 520631 - DNA, 25 bp, Mus musculus
actaactttctatagaagcatgaga

SEQ ID NO: 520632 - DNA, 25 bp, Mus musculus
actaactttgagagtcccctgtcta

SEQ ID NO: 520633 - DNA, 25 bp, Mus musculus
actaactttgagtgtcccctgtcta

SEQ ID NO: 520634 - DNA, 25 bp, Mus musculus
actaagaacccactcagggccagag

SEQ ID NO: 520635 - DNA, 25 bp, Mus musculus
actaagaacccagtcagggccagag

SEQ ID NO: 520636 - DNA, 25 bp, Mus musculus
actaagaagatccacgtctacctcc

SEQ ID NO: 520637 - DNA, 25 bp, Mus musculus
actaagaagatcgacgtctacctcc

SEQ ID NO: 520638 - DNA, 25 bp, Mus musculus
actaagaagtccatgccaggtggaa

SEQ ID NO: 520639 - DNA, 25 bp, Mus musculus
actaagaagtccttgccaggtggaa

SEQ ID NO: 520640 - DNA, 25 bp, Mus musculus
actaagaatgaaacaaccgtgtctg

SEQ ID NO: 520641 - DNA, 25 bp, Mus musculus
actaagaatgaatcaaccgtgtctg

SEQ ID NO: 520642 - DNA, 25 bp, Mus musculus
actaagaatggcctagtcaaaggcc

SEQ ID NO: 520643 - DNA, 25 bp, Mus musculus
actaagaatggcgtagtcaaaggcc

SEQ ID NO: 520644 - DNA, 25 bp, Mus musculus
actaagacttctcctctgctgtcca

SEQ ID NO: 520645 - DNA, 25 bp, Mus musculus
actaagacttctgctctgctgtcca

SEQ ID NO: 520646 - DNA, 25 bp, Mus musculus
actaagatactaaggcagcgaactc

SEQ ID NO: 520647 - DNA, 25 bp, Mus musculus
actaagatactatggcagcgaactc

SEQ ID NO: 520648 - DNA, 25 bp, Mus musculus
actaagcaggtaattgagctccctc

SEQ ID NO: 520649 - DNA, 25 bp, Mus musculus
actaagcaggtatttgagctccctc

SEQ ID NO: 520650 - DNA, 25 bp, Mus musculus
actaagcatcggctctcttgtgatc

SEQ ID NO: 520651 - DNA, 25 bp, Mus musculus
actaagcatcgggtctcttgtgatc

SEQ ID NO: 520652 - DNA, 25 bp, Mus musculus
actaagcatcgtctttcagctactt

SEQ ID NO: 520653 - DNA, 25 bp, Mus musculus
actaagcatcgtgtttcagctactt

SEQ ID NO: 520654 - DNA, 25 bp, Mus musculus
actaagccgggtctccgagcagtcc

SEQ ID NO: 520655 - DNA, 25 bp, Mus musculus
actaagccgggtgtccgagcagtcc

SEQ ID NO: 520656 - DNA, 25 bp, Mus musculus
actaagctcagcacgatgacacggc

SEQ ID NO: 520657 - DNA, 25 bp, Mus musculus
actaagctcagctcgatgacacggc

SEQ ID NO: 520658 - DNA, 25 bp, Mus musculus
actaagcttcggcagaccaatgcgg

SEQ ID NO: 520659 - DNA, 25 bp, Mus musculus
actaagcttcgggagaccaatgcgg

SEQ ID NO: 520660 - DNA, 25 bp, Mus musculus
actaaggaattactggattcttgga

SEQ ID NO: 520661 - DNA, 25 bp, Mus musculus
actaaggaattagtggattcttgga

SEQ ID NO: 520662 - DNA, 25 bp, Mus musculus
actaaggagctgagagcgagcgaac

SEQ ID NO: 520663 - DNA, 25 bp, Mus musculus
actaaggagctgtgagcgagcgaac

SEQ ID NO: 520664 - DNA, 25 bp, Mus musculus
actaagttcaagagccatgatgtcg

SEQ ID NO: 520665 - DNA, 25 bp, Mus musculus
actaagttcaagtgccatgatgtcg

SEQ ID NO: 520666 - DNA, 25 bp, Mus musculus
actaataccgctcctggttggcgga

SEQ ID NO: 520667 - DNA, 25 bp, Mus musculus
actaataccgctgctggttggcgga

SEQ ID NO: 520668 - DNA, 25 bp, Mus musculus
actaatccggaacaacaaaatggtg

SEQ ID NO: 520669 - DNA, 25 bp, Mus musculus
actaatccggaagaacaaaatggtg

SEQ ID NO: 520670 - DNA, 25 bp, Mus musculus
actaatgagctaagaagttccggaa

SEQ ID NO: 520671 - DNA, 25 bp, Mus musculus
actaatgagctatgaagttccggaa

SEQ ID NO: 520672 - DNA, 25 bp, Mus musculus
actaatgcagtgatcgccggcttga

SEQ ID NO: 520673 - DNA, 25 bp, Mus musculus
actaatgcagtgttcgccggcttga

SEQ ID NO: 520674 - DNA, 25 bp, Mus musculus
actaatgcggcgctgcaagacgtga

SEQ ID NO: 520675 - DNA, 25 bp, Mus musculus
actaatgcggcggtgcaagacgtga

SEQ ID NO: 520676 - DNA, 25 bp, Mus musculus
actaatgcgtcacactttttctcca

SEQ ID NO: 520677 - DNA, 25 bp, Mus musculus
actaatgcgtcagactttttctcca

SEQ ID NO: 520678 - DNA, 25 bp, Mus musculus
actaatgtgctgctcatgaaccttc

SEQ ID NO: 520679 - DNA, 25 bp, Mus musculus
actaatgtgctggtcatgaaccttc

SEQ ID NO: 520680 - DNA, 25 bp, Mus musculus
actaattctttgaggtgtttgtgca

SEQ ID NO: 520681 - DNA, 25 bp, Mus musculus
actaattctttgtggtgtttgtgca

SEQ ID NO: 520682 - DNA, 25 bp, Mus musculus
actaattggcttagctggtgctccg

SEQ ID NO: 520683 - DNA, 25 bp, Mus musculus
actaattggctttgctggtgctccg

SEQ ID NO: 520684 - DNA, 25 bp, Mus musculus
actacaaacgcaacgagacaggcct

SEQ ID NO: 520685 - DNA, 25 bp, Mus musculus
actacaaacgcatcgagacaggcct

SEQ ID NO: 520686 - DNA, 25 bp, Mus musculus
actacaacaactaccacgcagctgg

SEQ ID NO: 520687 - DNA, 25 bp, Mus musculus
actacaacaacttccacgcagctgg

SEQ ID NO: 520688 - DNA, 25 bp, Mus musculus
actacaacagctcccgatctcgatt

SEQ ID NO: 520689 - DNA, 25 bp, Mus musculus
actacaacagctgccgatctcgatt

SEQ ID NO: 520690 - DNA, 25 bp, Mus musculus
actacaacatcaagaagcaaaatgc

SEQ ID NO: 520691 - DNA, 25 bp, Mus musculus
actacaacatcatgaagcaaaatgc

SEQ ID NO: 520692 - DNA, 25 bp, Mus musculus
actacaacctgcatccatgatcagc

SEQ ID NO: 520693 - DNA, 25 bp, Mus musculus
actacaacctgcttccatgatcagc

SEQ ID NO: 520694 - DNA, 25 bp, Mus musculus
actacaacggcgcttccatggcctg

SEQ ID NO: 520695 - DNA, 25 bp, Mus musculus
actacaacggcggttccatggcctg

SEQ ID NO: 520696 - DNA, 25 bp, Mus musculus
actacaaggagaaccccgatcccag

SEQ ID NO: 520697 - DNA, 25 bp, Mus musculus
actacaaggagatccccgatcccag

SEQ ID NO: 520698 - DNA, 25 bp, Mus musculus
actacaccacagatgccgatggact

SEQ ID NO: 520699 - DNA, 25 bp, Mus musculus
actacaccacagttgccgatggact

SEQ ID NO: 520700 - DNA, 25 bp, Mus musculus
actacaccctcaacgtgctgcggga

SEQ ID NO: 520701 - DNA, 25 bp, Mus musculus
actacaccctcatcgtgctgcggga

SEQ ID NO: 520702 - DNA, 25 bp, Mus musculus
actacaccgtccaagactttgagcg

SEQ ID NO: 520703 - DNA, 25 bp, Mus musculus
actacaccgtcctagactttgagcg

SEQ ID NO: 520704 - DNA, 25 bp, Mus musculus
actacactgccaatgccaccagtag

SEQ ID NO: 520705 - DNA, 25 bp, Mus musculus
actacactgccattgccaccagtag

SEQ ID NO: 520706 - DNA, 25 bp, Mus musculus
actacactgcccagcaggaccagga

SEQ ID NO: 520707 - DNA, 25 bp, Mus musculus
actacactgccctgcaggaccagga

SEQ ID NO: 520708 - DNA, 25 bp, Mus musculus
actacacttaccagtgcttccaaag

SEQ ID NO: 520709 - DNA, 25 bp, Mus musculus
actacacttacctgtgcttccaaag

SEQ ID NO: 520710 - DNA, 25 bp, Mus musculus
actacagatgctcaatgcaaagaaa

SEQ ID NO: 520711 - DNA, 25 bp, Mus musculus
actacagatgctgaatgcaaagaaa

SEQ ID NO: 520712 - DNA, 25 bp, Mus musculus
actacagcatctacttggcagacat

SEQ ID NO: 520713 - DNA, 25 bp, Mus musculus
actacagcatcttcttggcagacat

SEQ ID NO: 520714 - DNA, 25 bp, Mus musculus
actacagcatgaagggcatgcaggg

SEQ ID NO: 520715 - DNA, 25 bp, Mus musculus
actacagcatgatgggcatgcaggg

SEQ ID NO: 520716 - DNA, 25 bp, Mus musculus
actacagcctagcaccctgtttggg

SEQ ID NO: 520717 - DNA, 25 bp, Mus musculus
actacagcctaggaccctgtttggg

SEQ ID NO: 520718 - DNA, 25 bp, Mus musculus
actacagctcatagccgaggacctg

SEQ ID NO: 520719 - DNA, 25 bp, Mus musculus
actacagctcattgccgaggacctg

SEQ ID NO: 520720 - DNA, 25 bp, Mus musculus
actacaggaccgacagtgacctcgt

SEQ ID NO: 520721 - DNA, 25 bp, Mus musculus
actacaggaccgtcagtgacctcgt

SEQ ID NO: 520722 - DNA, 25 bp, Mus musculus
actacaggatgacgtgcatcctgca

SEQ ID NO: 520723 - DNA, 25 bp, Mus musculus
actacaggatgaggtgcatcctgca

SEQ ID NO: 520724 - DNA, 25 bp, Mus musculus
actacaggcccgctggagacatctg

SEQ ID NO: 520725 - DNA, 25 bp, Mus musculus
actacaggcccggtggagacatctg

SEQ ID NO: 520726 - DNA, 25 bp, Mus musculus
actacagtgtgcagcgtgaagaagc

SEQ ID NO: 520727 - DNA, 25 bp, Mus musculus
actacagtgtgctgcgtgaagaagc

SEQ ID NO: 520728 - DNA, 25 bp, Mus musculus
actacagtttggaggcggctcccca

SEQ ID NO: 520729 - DNA, 25 bp, Mus musculus
actacagtttggtggcggctcccca

SEQ ID NO: 520730 - DNA, 25 bp, Mus musculus
actacatagagacgctgcagcgccg

SEQ ID NO: 520731 - DNA, 25 bp, Mus musculus
actacatagagaggctgcagcgccg

SEQ ID NO: 520732 - DNA, 25 bp, Mus musculus
actacatcatgtacatcttttgggc

SEQ ID NO: 520733 - DNA, 25 bp, Mus musculus
actacatcatgttcatcttttgggc

SEQ ID NO: 520734 - DNA, 25 bp, Mus musculus
actacatccaggcttccacgtacgt

SEQ ID NO: 520735 - DNA, 25 bp, Mus musculus
actacatccagggttccacgtacgt

SEQ ID NO: 520736 - DNA, 25 bp, Mus musculus
actacatccggacaagatgttcgcg

SEQ ID NO: 520737 - DNA, 25 bp, Mus musculus
actacatccggagaagatgttcgcg

SEQ ID NO: 520738 - DNA, 25 bp, Mus musculus
actacatgaatgctgcgatggtgca

SEQ ID NO: 520739 - DNA, 25 bp, Mus musculus
actacatgaatggtgcgatggtgca

SEQ ID NO: 520740 - DNA, 25 bp, Mus musculus
actacatgatctcccgttcgctggg

SEQ ID NO: 520741 - DNA, 25 bp, Mus musculus
actacatgatctgccgttcgctggg

SEQ ID NO: 520742 - DNA, 25 bp, Mus musculus
actacatggagcagtgcaagcccca

SEQ ID NO: 520743 - DNA, 25 bp, Mus musculus
actacatggagctgtgcaagcccca

SEQ ID NO: 520744 - DNA, 25 bp, Mus musculus
actacattaggtaagtcgggctgcc

SEQ ID NO: 520745 - DNA, 25 bp, Mus musculus
actacattaggttagtcgggctgcc

SEQ ID NO: 520746 - DNA, 25 bp, Mus musculus
actacattgcatatgcccatagtac

SEQ ID NO: 520747 - DNA, 25 bp, Mus musculus
actacattgcatttgcccatagtac

SEQ ID NO: 520748 - DNA, 25 bp, Mus musculus
actaccaacacacttatagcaaaga

SEQ ID NO: 520749 - DNA, 25 bp, Mus musculus
actaccaacacagttatagcaaaga

SEQ ID NO: 520750 - DNA, 25 bp, Mus musculus
actaccaggacgaggactcagacct

SEQ ID NO: 520751 - DNA, 25 bp, Mus musculus
actaccaggacgtggactcagacct

SEQ ID NO: 520752 - DNA, 25 bp, Mus musculus
actaccataggtcagtccgcatggg

SEQ ID NO: 520753 - DNA, 25 bp, Mus musculus
actaccataggtgagtccgcatggg

SEQ ID NO: 520754 - DNA, 25 bp, Mus musculus
actaccatcacactgtcaagtgacc

SEQ ID NO: 520755 - DNA, 25 bp, Mus musculus
actaccatcacagtgtcaagtgacc

SEQ ID NO: 520756 - DNA, 25 bp, Mus musculus
actaccatctacagccaccaaagga

SEQ ID NO: 520757 - DNA, 25 bp, Mus musculus
actaccatctactgccaccaaagga

SEQ ID NO: 520758 - DNA, 25 bp, Mus musculus
actaccgagatacccagttcaccat

SEQ ID NO: 520759 - DNA, 25 bp, Mus musculus
actaccgagatagccagttcaccat

SEQ ID NO: 520760 - DNA, 25 bp, Mus musculus
actaccgcattgctgcctttggcca

SEQ ID NO: 520761 - DNA, 25 bp, Mus musculus
actaccgcattggtgcctttggcca

SEQ ID NO: 520762 - DNA, 25 bp, Mus musculus
actaccgcgtggagctgcccacttg

SEQ ID NO: 520763 - DNA, 25 bp, Mus musculus
actaccgcgtggtgctgcccacttg

SEQ ID NO: 520764 - DNA, 25 bp, Mus musculus
actaccgctccgcacgtggagaacg

SEQ ID NO: 520765 - DNA, 25 bp, Mus musculus
actaccgctccggacgtggagaacg

SEQ ID NO: 520766 - DNA, 25 bp, Mus musculus
actaccggcggtcgaaatcgtcagc

SEQ ID NO: 520767 - DNA, 25 bp, Mus musculus
actaccggcggtggaaatcgtcagc

SEQ ID NO: 520768 - DNA, 25 bp, Mus musculus
actaccgggactcgttcagcagcca

SEQ ID NO: 520769 - DNA, 25 bp, Mus musculus
actaccgggactggttcagcagcca

SEQ ID NO: 520770 - DNA, 25 bp, Mus musculus
actacctcaacacacattacaaagc

SEQ ID NO: 520771 - DNA, 25 bp, Mus musculus
actacctcaacagacattacaaagc

SEQ ID NO: 520772 - DNA, 25 bp, Mus musculus
actacctgccatacagaagctaatg

SEQ ID NO: 520773 - DNA, 25 bp, Mus musculus
actacctgccattcagaagctaatg

SEQ ID NO: 520774 - DNA, 25 bp, Mus musculus
actacctgccgacaaatttgttggc

SEQ ID NO: 520775 - DNA, 25 bp, Mus musculus
actacctgccgagaaatttgttggc

SEQ ID NO: 520776 - DNA, 25 bp, Mus musculus
actacctgtgctcccctgaggaaaa

SEQ ID NO: 520777 - DNA, 25 bp, Mus musculus
actacctgtgctgccctgaggaaaa

SEQ ID NO: 520778 - DNA, 25 bp, Mus musculus
actaccttgtagctgtggataaatg

SEQ ID NO: 520779 - DNA, 25 bp, Mus musculus
actaccttgtaggtgtggataaatg

SEQ ID NO: 520780 - DNA, 25 bp, Mus musculus
actacctttctgcagccgagcggtc

SEQ ID NO: 520781 - DNA, 25 bp, Mus musculus
actacctttctggagccgagcggtc

SEQ ID NO: 520782 - DNA, 25 bp, Mus musculus
actacgaagacgacgaggtggagac

SEQ ID NO: 520783 - DNA, 25 bp, Mus musculus
actacgaagacgtcgaggtggagac

SEQ ID NO: 520784 - DNA, 25 bp, Mus musculus
actacgacaggaaccgaagggagcg

SEQ ID NO: 520785 - DNA, 25 bp, Mus musculus
actacgacaggatccgaagggagcg

SEQ ID NO: 520786 - DNA, 25 bp, Mus musculus
actacgaccgctaagttatccacag

SEQ ID NO: 520787 - DNA, 25 bp, Mus musculus
actacgaccgcttagttatccacag

SEQ ID NO: 520788 - DNA, 25 bp, Mus musculus
actacgacggagagctgcaggcctg

SEQ ID NO: 520789 - DNA, 25 bp, Mus musculus
actacgacggagtgctgcaggcctg

SEQ ID NO: 520790 - DNA, 25 bp, Mus musculus
actacgagagtcaccggctgcagag

SEQ ID NO: 520791 - DNA, 25 bp, Mus musculus
actacgagagtctccggctgcagag

SEQ ID NO: 520792 - DNA, 25 bp, Mus musculus
actacgagcggtacagaggcctggt

SEQ ID NO: 520793 - DNA, 25 bp, Mus musculus
actacgagcggttcagaggcctggt

SEQ ID NO: 520794 - DNA, 25 bp, Mus musculus
actacgaggcagagcaagagtctcg

SEQ ID NO: 520795 - DNA, 25 bp, Mus musculus
actacgaggcagtgcaagagtctcg

SEQ ID NO: 520796 - DNA, 25 bp, Mus musculus
actacgaggtctcaagcccacactt

SEQ ID NO: 520797 - DNA, 25 bp, Mus musculus
actacgaggtctgaagcccacactt

SEQ ID NO: 520798 - DNA, 25 bp, Mus musculus
actacgcagtgcctttgggccgccg

SEQ ID NO: 520799 - DNA, 25 bp, Mus musculus
actacgcagtgcgtttgggccgccg

SEQ ID NO: 520800 - DNA, 25 bp, Mus musculus
actacgcatatgaaacggagcgcca

SEQ ID NO: 520801 - DNA, 25 bp, Mus musculus
actacgcatatgtaacggagcgcca

SEQ ID NO: 520802 - DNA, 25 bp, Mus musculus
actacgcatgctacaccatatgtgc

SEQ ID NO: 520803 - DNA, 25 bp, Mus musculus
actacgcatgcttcaccatatgtgc

SEQ ID NO: 520804 - DNA, 25 bp, Mus musculus
actacgccttccagggtacagcact

SEQ ID NO: 520805 - DNA, 25 bp, Mus musculus
actacgccttcctgggtacagcact

SEQ ID NO: 520806 - DNA, 25 bp, Mus musculus
actacgctgcgaaaggctgctggga

SEQ ID NO: 520807 - DNA, 25 bp, Mus musculus
actacgctgcgataggctgctggga

SEQ ID NO: 520808 - DNA, 25 bp, Mus musculus
actacggctcagcaagcctctctgg

SEQ ID NO: 520809 - DNA, 25 bp, Mus musculus
actacggctcaggaagcctctctgg

SEQ ID NO: 520810 - DNA, 25 bp, Mus musculus
actacgggaagcctatgtgcccagt

SEQ ID NO: 520811 - DNA, 25 bp, Mus musculus
actacgggaagcgtatgtgcccagt

SEQ ID NO: 520812 - DNA, 25 bp, Mus musculus
actacgggacttaactgcgactgga

SEQ ID NO: 520813 - DNA, 25 bp, Mus musculus
actacgggactttactgcgactgga

SEQ ID NO: 520814 - DNA, 25 bp, Mus musculus
actacgggttggacgagatgtgact

SEQ ID NO: 520815 - DNA, 25 bp, Mus musculus
actacgggttggtcgagatgtgact

SEQ ID NO: 520816 - DNA, 25 bp, Mus musculus
actacggtcgggaccgagcacctcg

SEQ ID NO: 520817 - DNA, 25 bp, Mus musculus
actacggtcgggtccgagcacctcg

SEQ ID NO: 520818 - DNA, 25 bp, Mus musculus
actacgtagcccagactgaactcca

SEQ ID NO: 520819 - DNA, 25 bp, Mus musculus
actacgtagccctgactgaactcca

SEQ ID NO: 520820 - DNA, 25 bp, Mus musculus
actacgtggtgcacatggctgcggc

SEQ ID NO: 520821 - DNA, 25 bp, Mus musculus
actacgtggtgctcatggctgcggc

SEQ ID NO: 520822 - DNA, 25 bp, Mus musculus
actacgttgcctctggaggcttgga

SEQ ID NO: 520823 - DNA, 25 bp, Mus musculus
actacgttgcctgtggaggcttgga

SEQ ID NO: 520824 - DNA, 25 bp, Mus musculus
actactaccgcacctggaacgtcgt

SEQ ID NO: 520825 - DNA, 25 bp, Mus musculus
actactaccgcagctggaacgtcgt

SEQ ID NO: 520826 - DNA, 25 bp, Mus musculus
actactactttgactcctatgccca

SEQ ID NO: 520827 - DNA, 25 bp, Mus musculus
actactactttgtctcctatgccca

SEQ ID NO: 520828 - DNA, 25 bp, Mus musculus
actactatgtcgacacagctgtgcg

SEQ ID NO: 520829 - DNA, 25 bp, Mus musculus
actactatgtcgtcacagctgtgcg

SEQ ID NO: 520830 - DNA, 25 bp, Mus musculus
actactcgggaacaaatgctttgcg

SEQ ID NO: 520831 - DNA, 25 bp, Mus musculus
actactcgggaagaaatgctttgcg

SEQ ID NO: 520832 - DNA, 25 bp, Mus musculus
actactgcacagacccagccaagtt

SEQ ID NO: 520833 - DNA, 25 bp, Mus musculus
actactgcacagtcccagccaagtt

SEQ ID NO: 520834 - DNA, 25 bp, Mus musculus
actactgctagaaggccagccacgg

SEQ ID NO: 520835 - DNA, 25 bp, Mus musculus
actactgctagatggccagccacgg

SEQ ID NO: 520836 - DNA, 25 bp, Mus musculus
actactgctgctcaccgttgagaga

SEQ ID NO: 520837 - DNA, 25 bp, Mus musculus
actactgctgctcgaaatggacacg

SEQ ID NO: 520838 - DNA, 25 bp, Mus musculus
actactgctgctgaccgttgagaga

SEQ ID NO: 520839 - DNA, 25 bp, Mus musculus
actactgctgctggaaatggacacg

SEQ ID NO: 520840 - DNA, 25 bp, Mus musculus
actactggacataccctggctctct

SEQ ID NO: 520841 - DNA, 25 bp, Mus musculus
actactggacattccctggctctct

SEQ ID NO: 520842 - DNA, 25 bp, Mus musculus
actactgtgcctatgtaacttgcca

SEQ ID NO: 520843 - DNA, 25 bp, Mus musculus
actactgtgcctttgtaacttgcca

SEQ ID NO: 520844 - DNA, 25 bp, Mus musculus
actactgtgtaacagcgagcggtgc

SEQ ID NO: 520845 - DNA, 25 bp, Mus musculus
actactgtgtaagagcgagcggtgc

SEQ ID NO: 520846 - DNA, 25 bp, Mus musculus
actactgttcaaaatgtacttagtt

SEQ ID NO: 520847 - DNA, 25 bp, Mus musculus
actactgttcaatatgtacttagtt

SEQ ID NO: 520848 - DNA, 25 bp, Mus musculus
actacttaaaccaacccaatgcagc

SEQ ID NO: 520849 - DNA, 25 bp, Mus musculus
actacttaaacctacccaatgcagc

SEQ ID NO: 520850 - DNA, 25 bp, Mus musculus
actacttcattgcaactttcatcgc

SEQ ID NO: 520851 - DNA, 25 bp, Mus musculus
actacttcattggaactttcatcgc

SEQ ID NO: 520852 - DNA, 25 bp, Mus musculus
actacttcttcaaggcggccctctg

SEQ ID NO: 520853 - DNA, 25 bp, Mus musculus
actacttcttcatggcggccctctg

SEQ ID NO: 520854 - DNA, 25 bp, Mus musculus
actactttaaccaacaagcacaggg

SEQ ID NO: 520855 - DNA, 25 bp, Mus musculus
actactttaacctacaagcacaggg

SEQ ID NO: 520856 - DNA, 25 bp, Mus musculus
actactttgcacaagtcgactgcag

SEQ ID NO: 520857 - DNA, 25 bp, Mus musculus
actactttgcactagtcgactgcag

SEQ ID NO: 520858 - DNA, 25 bp, Mus musculus
actagaaaatccatcctgacccaca

SEQ ID NO: 520859 - DNA, 25 bp, Mus musculus
actagaaaatccttcctgacccaca

SEQ ID NO: 520860 - DNA, 25 bp, Mus musculus
actagaaaccatcgccagtgaagaa

SEQ ID NO: 520861 - DNA, 25 bp, Mus musculus
actagaaaccatggccagtgaagaa

SEQ ID NO: 520862 - DNA, 25 bp, Mus musculus
actagaaaggaacactgggctccga

SEQ ID NO: 520863 - DNA, 25 bp, Mus musculus
actagaaaggaagactgggctccga

SEQ ID NO: 520864 - DNA, 25 bp, Mus musculus
actagaacgaaacgagcagaaggag

SEQ ID NO: 520865 - DNA, 25 bp, Mus musculus
actagaacgaaaggagcagaaggag

SEQ ID NO: 520866 - DNA, 25 bp, Mus musculus
actagaattagtcagtccggagccg

SEQ ID NO: 520867 - DNA, 25 bp, Mus musculus
actagaattagtgagtccggagccg

SEQ ID NO: 520868 - DNA, 25 bp, Mus musculus
actagaattcttctcctggttatgg

SEQ ID NO: 520869 - DNA, 25 bp, Mus musculus
actagaattcttgtcctggttatgg

SEQ ID NO: 520870 - DNA, 25 bp, Mus musculus
actagacatgagacggaaggactcg

SEQ ID NO: 520871 - DNA, 25 bp, Mus musculus
actagacatgagtcggaaggactcg

SEQ ID NO: 520872 - DNA, 25 bp, Mus musculus
actagactggcccttggataccatc

SEQ ID NO: 520873 - DNA, 25 bp, Mus musculus
actagactggccgttggataccatc

SEQ ID NO: 520874 - DNA, 25 bp, Mus musculus
actagactgggtatgtctgataacc

SEQ ID NO: 520875 - DNA, 25 bp, Mus musculus
actagactgggtttgtctgataacc

SEQ ID NO: 520876 - DNA, 25 bp, Mus musculus
actagagaaagaaggcacatgatcc

SEQ ID NO: 520877 - DNA, 25 bp, Mus musculus
actagagaaagatggcacatgatcc

SEQ ID NO: 520878 - DNA, 25 bp, Mus musculus
actagagctaaaaatgaccttggac

SEQ ID NO: 520879 - DNA, 25 bp, Mus musculus
actagagctaaatatgaccttggac

SEQ ID NO: 520880 - DNA, 25 bp, Mus musculus
actagagctccacgcacaagggcgg

SEQ ID NO: 520881 - DNA, 25 bp, Mus musculus
actagagctccaggcacaagggcgg

SEQ ID NO: 520882 - DNA, 25 bp, Mus musculus
actagaggctggctaccagatagca

SEQ ID NO: 520883 - DNA, 25 bp, Mus musculus
actagaggctgggtaccagatagca

SEQ ID NO: 520884 - DNA, 25 bp, Mus musculus
actagaggttggacctcacagacgg

SEQ ID NO: 520885 - DNA, 25 bp, Mus musculus
actagaggttggtcctcacagacgg

SEQ ID NO: 520886 - DNA, 25 bp, Mus musculus
actagagtaacaccctgaatgcttc

SEQ ID NO: 520887 - DNA, 25 bp, Mus musculus
actagagtaacagcctgaatgcttc

SEQ ID NO: 520888 - DNA, 25 bp, Mus musculus
actagatgtctccttcctgtacctg

SEQ ID NO: 520889 - DNA, 25 bp, Mus musculus
actagatgtctcgttcctgtacctg

SEQ ID NO: 520890 - DNA, 25 bp, Mus musculus
actagcacagccatcacgggcctga

SEQ ID NO: 520891 - DNA, 25 bp, Mus musculus
actagcacagccttcacgggcctga

SEQ ID NO: 520892 - DNA, 25 bp, Mus musculus
actagcatgacaccgcgtgtgtccc

SEQ ID NO: 520893 - DNA, 25 bp, Mus musculus
actagcatgacagcgcgtgtgtccc

SEQ ID NO: 520894 - DNA, 25 bp, Mus musculus
actagcctagagacctgagtctgaa

SEQ ID NO: 520895 - DNA, 25 bp, Mus musculus
actagcctagagtcctgagtctgaa

SEQ ID NO: 520896 - DNA, 25 bp, Mus musculus
actaggaacattatacctgatgaag

SEQ ID NO: 520897 - DNA, 25 bp, Mus musculus
actaggaacattttacctgatgaag

SEQ ID NO: 520898 - DNA, 25 bp, Mus musculus
actaggaccttgagcacgcggagca

SEQ ID NO: 520899 - DNA, 25 bp, Mus musculus
actaggaccttgtgcacgcggagca

SEQ ID NO: 520900 - DNA, 25 bp, Mus musculus
actaggaggcagctgctagcctgac

SEQ ID NO: 520901 - DNA, 25 bp, Mus musculus
actaggaggcaggtgctagcctgac

SEQ ID NO: 520902 - DNA, 25 bp, Mus musculus
actaggaggccaaccttgaatccag

SEQ ID NO: 520903 - DNA, 25 bp, Mus musculus
actaggaggccatccttgaatccag

SEQ ID NO: 520904 - DNA, 25 bp, Mus musculus
actaggagtccgcaccacgtcgtgt

SEQ ID NO: 520905 - DNA, 25 bp, Mus musculus
actaggagtccggaccacgtcgtgt

SEQ ID NO: 520906 - DNA, 25 bp, Mus musculus
actaggatcgatcgcaacttggtca

SEQ ID NO: 520907 - DNA, 25 bp, Mus musculus
actaggatcgatggcaacttggtca

SEQ ID NO: 520908 - DNA, 25 bp, Mus musculus
actaggctctggctgcctcttctgg

SEQ ID NO: 520909 - DNA, 25 bp, Mus musculus
actaggctctgggtgcctcttctgg

SEQ ID NO: 520910 - DNA, 25 bp, Mus musculus
actaggctgccgaattgccattgcg

SEQ ID NO: 520911 - DNA, 25 bp, Mus musculus
actaggctgccgtattgccattgcg

SEQ ID NO: 520912 - DNA, 25 bp, Mus musculus
actaggtgatctcacctcttgtgac

SEQ ID NO: 520913 - DNA, 25 bp, Mus musculus
actaggtgatctgacctcttgtgac

SEQ ID NO: 520914 - DNA, 25 bp, Mus musculus
actagtaaagacagctctggcacca

SEQ ID NO: 520915 - DNA, 25 bp, Mus musculus
actagtaaagactgctctggcacca

SEQ ID NO: 520916 - DNA, 25 bp, Mus musculus
actagtactcctactggccccgtat

SEQ ID NO: 520917 - DNA, 25 bp, Mus musculus
actagtactccttctggccccgtat

SEQ ID NO: 520918 - DNA, 25 bp, Mus musculus
actagtatggagacccaggagaccc

SEQ ID NO: 520919 - DNA, 25 bp, Mus musculus
actagtatggagtcccaggagaccc

SEQ ID NO: 520920 - DNA, 25 bp, Mus musculus
actagtattcgcattgaggaagccg

SEQ ID NO: 520921 - DNA, 25 bp, Mus musculus
actagtattcgctttgaggaagccg

SEQ ID NO: 520922 - DNA, 25 bp, Mus musculus
actagtcagtgcatcgcaagatgga

SEQ ID NO: 520923 - DNA, 25 bp, Mus musculus
actagtcagtgcttcgcaagatgga

SEQ ID NO: 520924 - DNA, 25 bp, Mus musculus
actagtccgaagcacagatgagccg

SEQ ID NO: 520925 - DNA, 25 bp, Mus musculus
actagtccgaaggacagatgagccg

SEQ ID NO: 520926 - DNA, 25 bp, Mus musculus
actagtcctgcgaggcttggaagcc

SEQ ID NO: 520927 - DNA, 25 bp, Mus musculus
actagtcctgcgtggcttggaagcc

SEQ ID NO: 520928 - DNA, 25 bp, Mus musculus
actagtgaatgtccagatccccttg

SEQ ID NO: 520929 - DNA, 25 bp, Mus musculus
actagtgaatgtgcagatccccttg

SEQ ID NO: 520930 - DNA, 25 bp, Mus musculus
actagtgatggcagcgccattttcc

SEQ ID NO: 520931 - DNA, 25 bp, Mus musculus
actagtgatggctgcgccattttcc

SEQ ID NO: 520932 - DNA, 25 bp, Mus musculus
actagtggagtcctgagtcagcacc

SEQ ID NO: 520933 - DNA, 25 bp, Mus musculus
actagtggagtcgtgagtcagcacc

SEQ ID NO: 520934 - DNA, 25 bp, Mus musculus
actagtgggacaatcctgttatgga

SEQ ID NO: 520935 - DNA, 25 bp, Mus musculus
actagtgggacattcctgttatgga

SEQ ID NO: 520936 - DNA, 25 bp, Mus musculus
actagttacgttacctgttgctgtg

SEQ ID NO: 520937 - DNA, 25 bp, Mus musculus
actagttacgtttcctgttgctgtg

SEQ ID NO: 520938 - DNA, 25 bp, Mus musculus
actagttagtgcctcccagtctgac

SEQ ID NO: 520939 - DNA, 25 bp, Mus musculus
actagttagtgcgtcccagtctgac

SEQ ID NO: 520940 - DNA, 25 bp, Mus musculus
actagttcttgtcaggtccgaggca

SEQ ID NO: 520941 - DNA, 25 bp, Mus musculus
actagttcttgtgaggtccgaggca

SEQ ID NO: 520942 - DNA, 25 bp, Mus musculus
actagtttcttgataacccatacaa

SEQ ID NO: 520943 - DNA, 25 bp, Mus musculus
actagtttcttgttaacccatacaa

SEQ ID NO: 520944 - DNA, 25 bp, Mus musculus
actataaaaataacccattggtttg

SEQ ID NO: 520945 - DNA, 25 bp, Mus musculus
actataaaaatatcccattggtttg

SEQ ID NO: 520946 - DNA, 25 bp, Mus musculus
actataacagttagtgtgagcctga

SEQ ID NO: 520947 - DNA, 25 bp, Mus musculus
actataacagtttgtgtgagcctga

SEQ ID NO: 520948 - DNA, 25 bp, Mus musculus
actataagttatccccagctctcca

SEQ ID NO: 520949 - DNA, 25 bp, Mus musculus
actataagttatgcccagctctcca

SEQ ID NO: 520950 - DNA, 25 bp, Mus musculus
actatacacccacctgtagtcatat

SEQ ID NO: 520951 - DNA, 25 bp, Mus musculus
actatacacccagctgtagtcatat

SEQ ID NO: 520952 - DNA, 25 bp, Mus musculus
actatacagccacgctgtctctgct

SEQ ID NO: 520953 - DNA, 25 bp, Mus musculus
actatacagccaggctgtctctgct

SEQ ID NO: 520954 - DNA, 25 bp, Mus musculus
actataccaaccagagccagggtgt

SEQ ID NO: 520955 - DNA, 25 bp, Mus musculus
actataccaacctgagccagggtgt

SEQ ID NO: 520956 - DNA, 25 bp, Mus musculus
actataggcgtgagcacaagccgcc

SEQ ID NO: 520957 - DNA, 25 bp, Mus musculus
actataggcgtgtgcacaagccgcc

SEQ ID NO: 520958 - DNA, 25 bp, Mus musculus
actatagtccctacaagagggagga

SEQ ID NO: 520959 - DNA, 25 bp, Mus musculus
actatagtcccttcaagagggagga

SEQ ID NO: 520960 - DNA, 25 bp, Mus musculus
actatagtggctatggcggctatga

SEQ ID NO: 520961 - DNA, 25 bp, Mus musculus
actatagtggctttggcggctatga

SEQ ID NO: 520962 - DNA, 25 bp, Mus musculus
actatatcacaacgcgggcccagtt

SEQ ID NO: 520963 - DNA, 25 bp, Mus musculus
actatatcacaaggcgggcccagtt

SEQ ID NO: 520964 - DNA, 25 bp, Mus musculus
actatccccgttcgatcaccaagga

SEQ ID NO: 520965 - DNA, 25 bp, Mus musculus
actatccccgttggatcaccaagga

SEQ ID NO: 520966 - DNA, 25 bp, Mus musculus
actatcgctgggatcctcttcatct

SEQ ID NO: 520967 - DNA, 25 bp, Mus musculus
actatcgctgggttcctcttcatct

SEQ ID NO: 520968 - DNA, 25 bp, Mus musculus
actatctctatgatcccagctatgg

SEQ ID NO: 520969 - DNA, 25 bp, Mus musculus
actatctctatgttcccagctatgg

SEQ ID NO: 520970 - DNA, 25 bp, Mus musculus
actatctgccaacccgggagggaag

SEQ ID NO: 520971 - DNA, 25 bp, Mus musculus
actatctgccaagccgggagggaag

SEQ ID NO: 520972 - DNA, 25 bp, Mus musculus
actatctgcccaacaagaatcaaat

SEQ ID NO: 520973 - DNA, 25 bp, Mus musculus
actatctgcccatcaagaatcaaat

SEQ ID NO: 520974 - DNA, 25 bp, Mus musculus
actatctgtgctcagtccccgacaa

SEQ ID NO: 520975 - DNA, 25 bp, Mus musculus
actatctgtgctgagtccccgacaa

SEQ ID NO: 520976 - DNA, 25 bp, Mus musculus
actatgacaaggacgggattggcga

SEQ ID NO: 520977 - DNA, 25 bp, Mus musculus
actatgacaaggtcgggattggcga

SEQ ID NO: 520978 - DNA, 25 bp, Mus musculus
actatgacccgtacgcggtggaaga

SEQ ID NO: 520979 - DNA, 25 bp, Mus musculus
actatgacccgttcgcggtggaaga

SEQ ID NO: 520980 - DNA, 25 bp, Mus musculus
actatgacggaactaaaggcttaca

SEQ ID NO: 520981 - DNA, 25 bp, Mus musculus
actatgacggaagtaaaggcttaca

SEQ ID NO: 520982 - DNA, 25 bp, Mus musculus
actatgactaacaacggacacacag

SEQ ID NO: 520983 - DNA, 25 bp, Mus musculus
actatgactaactacggacacacag

SEQ ID NO: 520984 - DNA, 25 bp, Mus musculus
actatgagccacatggcttggaggc

SEQ ID NO: 520985 - DNA, 25 bp, Mus musculus
actatgagccacttggcttggaggc

SEQ ID NO: 520986 - DNA, 25 bp, Mus musculus
actatgaggaagagagctgcatgag

SEQ ID NO: 520987 - DNA, 25 bp, Mus musculus
actatgaggaagtgagctgcatgag

SEQ ID NO: 520988 - DNA, 25 bp, Mus musculus
actatgaggtgaccgtgagcgccct

SEQ ID NO: 520989 - DNA, 25 bp, Mus musculus
actatgaggtgagcgtgagcgccct

SEQ ID NO: 520990 - DNA, 25 bp, Mus musculus
actatgatatttcccctgcagaccg

SEQ ID NO: 520991 - DNA, 25 bp, Mus musculus
actatgatatttgccctgcagaccg

SEQ ID NO: 520992 - DNA, 25 bp, Mus musculus
actatgatgaagaaagctcagaaga

SEQ ID NO: 520993 - DNA, 25 bp, Mus musculus
actatgatgaagtaagctcagaaga

SEQ ID NO: 520994 - DNA, 25 bp, Mus musculus
actatgcaagctccgagatgcccta

SEQ ID NO: 520995 - DNA, 25 bp, Mus musculus
actatgcaagctgcgagatgcccta

SEQ ID NO: 520996 - DNA, 25 bp, Mus musculus
actatgcagctactggtgtatgcct

SEQ ID NO: 520997 - DNA, 25 bp, Mus musculus
actatgcagctagtggtgtatgcct

SEQ ID NO: 520998 - DNA, 25 bp, Mus musculus
actatgccagagcatgattattgga

SEQ ID NO: 520999 - DNA, 25 bp, Mus musculus
actatgccagaggatgattattgga

SEQ ID NO: 521000 - DNA, 25 bp, Mus musculus
actatgctgaccatgtccgccagga

SEQ ID NO: 521001 - DNA, 25 bp, Mus musculus
actatgctgaccttgtccgccagga

SEQ ID NO: 521002 - DNA, 25 bp, Mus musculus
actatggaccgtccttgggccccat

SEQ ID NO: 521003 - DNA, 25 bp, Mus musculus
actatggaccgtgcttgggccccat

SEQ ID NO: 521004 - DNA, 25 bp, Mus musculus
actatggacgtaaggtgcaatggtc

SEQ ID NO: 521005 - DNA, 25 bp, Mus musculus
actatggacgtatggtgcaatggtc

SEQ ID NO: 521006 - DNA, 25 bp, Mus musculus
actatggagctccagtctgtgttcc

SEQ ID NO: 521007 - DNA, 25 bp, Mus musculus
actatggagctcgagtctgtgttcc

SEQ ID NO: 521008 - DNA, 25 bp, Mus musculus
actatggatggtctgagcacagcca

SEQ ID NO: 521009 - DNA, 25 bp, Mus musculus
actatggatggtgtgagcacagcca

SEQ ID NO: 521010 - DNA, 25 bp, Mus musculus
actatgggagggatcttcagagtgt

SEQ ID NO: 521011 - DNA, 25 bp, Mus musculus
actatgggagggttcttcagagtgt

SEQ ID NO: 521012 - DNA, 25 bp, Mus musculus
actatggtggttaaagctggctgcc

SEQ ID NO: 521013 - DNA, 25 bp, Mus musculus
actatggtggtttaagctggctgcc

SEQ ID NO: 521014 - DNA, 25 bp, Mus musculus
actatggttttgcaccaagaggacg

SEQ ID NO: 521015 - DNA, 25 bp, Mus musculus
actatggttttggaccaagaggacg

SEQ ID NO: 521016 - DNA, 25 bp, Mus musculus
actatgtagatcagcctagcctgga

SEQ ID NO: 521017 - DNA, 25 bp, Mus musculus
actatgtagatctgcctagcctgga

SEQ ID NO: 521018 - DNA, 25 bp, Mus musculus
actatgtccagaagcgtgagggtgt

SEQ ID NO: 521019 - DNA, 25 bp, Mus musculus
actatgtccagatgcgtgagggtgt

SEQ ID NO: 521020 - DNA, 25 bp, Mus musculus
actatgtcgacacagctgtgcgcca

SEQ ID NO: 521021 - DNA, 25 bp, Mus musculus
actatgtcgacagagctgtgcgcca

SEQ ID NO: 521022 - DNA, 25 bp, Mus musculus
actatgtctctgagcagtgccttca

SEQ ID NO: 521023 - DNA, 25 bp, Mus musculus
actatgtctctgtgcagtgccttca

SEQ ID NO: 521024 - DNA, 25 bp, Mus musculus
actatgtgatcactattgagggcat

SEQ ID NO: 521025 - DNA, 25 bp, Mus musculus
actatgtgatcagtattgagggcat

SEQ ID NO: 521026 - DNA, 25 bp, Mus musculus
actatgtgccagcttagcctttcta

SEQ ID NO: 521027 - DNA, 25 bp, Mus musculus
actatgtgccaggttagcctttcta

SEQ ID NO: 521028 - DNA, 25 bp, Mus musculus
actatgtgctggcatgttacgggta

SEQ ID NO: 521029 - DNA, 25 bp, Mus musculus
actatgtgctgggatgttacgggta

SEQ ID NO: 521030 - DNA, 25 bp, Mus musculus
actatgtggcggcaaatgtgaacct

SEQ ID NO: 521031 - DNA, 25 bp, Mus musculus
actatgtggcgggaaatgtgaacct

SEQ ID NO: 521032 - DNA, 25 bp, Mus musculus
actatgttcgatcccctggcggacc

SEQ ID NO: 521033 - DNA, 25 bp, Mus musculus
actatgttcgatgccctggcggacc

SEQ ID NO: 521034 - DNA, 25 bp, Mus musculus
actattacacctacccaggctcgct

SEQ ID NO: 521035 - DNA, 25 bp, Mus musculus
actattacaccttcccaggctcgct

SEQ ID NO: 521036 - DNA, 25 bp, Mus musculus
actattaggatcaagcaatctgaac

SEQ ID NO: 521037 - DNA, 25 bp, Mus musculus
actattaggatctagcaatctgaac

SEQ ID NO: 521038 - DNA, 25 bp, Mus musculus
actattcaagccaatgtcgtgggca

SEQ ID NO: 521039 - DNA, 25 bp, Mus musculus
actattcaagcctatgtcgtgggca

SEQ ID NO: 521040 - DNA, 25 bp, Mus musculus
actattcaggacatactgttcaccg

SEQ ID NO: 521041 - DNA, 25 bp, Mus musculus
actattcaggacttactgttcaccg

SEQ ID NO: 521042 - DNA, 25 bp, Mus musculus
actattctacccatcttcaacgctg

SEQ ID NO: 521043 - DNA, 25 bp, Mus musculus
actattctacccttcttcaacgctg

SEQ ID NO: 521044 - DNA, 25 bp, Mus musculus
actattctcacacgttcagcttttc

SEQ ID NO: 521045 - DNA, 25 bp, Mus musculus
actattctcacaggttcagcttttc

SEQ ID NO: 521046 - DNA, 25 bp, Mus musculus
actattctgcagctgtacccaggga

SEQ ID NO: 521047 - DNA, 25 bp, Mus musculus
actattctgcaggtgtacccaggga

SEQ ID NO: 521048 - DNA, 25 bp, Mus musculus
actattcttcgccatactcttcagc

SEQ ID NO: 521049 - DNA, 25 bp, Mus musculus
actattcttcgcgatactcttcagc

SEQ ID NO: 521050 - DNA, 25 bp, Mus musculus
actattgaggctctccgtctgctga

SEQ ID NO: 521051 - DNA, 25 bp, Mus musculus
actattgaggctgtccgtctgctga

SEQ ID NO: 521052 - DNA, 25 bp, Mus musculus
actattgcacataaggccatgaaaa

SEQ ID NO: 521053 - DNA, 25 bp, Mus musculus
actattgcacattaggccatgaaaa

SEQ ID NO: 521054 - DNA, 25 bp, Mus musculus
actattgcggccaggagcagtgcca

SEQ ID NO: 521055 - DNA, 25 bp, Mus musculus
actattgcggcctggagcagtgcca

SEQ ID NO: 521056 - DNA, 25 bp, Mus musculus
actattgtaccacatagatctctgc

SEQ ID NO: 521057 - DNA, 25 bp, Mus musculus
actattgtaccagatagatctctgc

SEQ ID NO: 521058 - DNA, 25 bp, Mus musculus
actattgtcgccctgattctgccca

SEQ ID NO: 521059 - DNA, 25 bp, Mus musculus
actattgtcgccgtgattctgccca

SEQ ID NO: 521060 - DNA, 25 bp, Mus musculus
actatttaaaatctgtgcaggcctc

SEQ ID NO: 521061 - DNA, 25 bp, Mus musculus
actatttaaaatgtgtgcaggcctc

SEQ ID NO: 521062 - DNA, 25 bp, Mus musculus
actatttcaacaagatccacacatg

SEQ ID NO: 521063 - DNA, 25 bp, Mus musculus
actatttcaacatgatccacacatg

SEQ ID NO: 521064 - DNA, 25 bp, Mus musculus
actatttccatgagttgaaacggca

SEQ ID NO: 521065 - DNA, 25 bp, Mus musculus
actatttccatgtgttgaaacggca

SEQ ID NO: 521066 - DNA, 25 bp, Mus musculus
actatttggttgcacatggaagaat

SEQ ID NO: 521067 - DNA, 25 bp, Mus musculus
actatttggttggacatggaagaat

SEQ ID NO: 521068 - DNA, 25 bp, Mus musculus
actcaaaaaattctacttgcctctg

SEQ ID NO: 521069 - DNA, 25 bp, Mus musculus
actcaaaaaattgtacttgcctctg

SEQ ID NO: 521070 - DNA, 25 bp, Mus musculus
actcaaaaggacctcagagaagtgc

SEQ ID NO: 521071 - DNA, 25 bp, Mus musculus
actcaaaaggacgtcagagaagtgc

SEQ ID NO: 521072 - DNA, 25 bp, Mus musculus
actcaaaagtcacgcagggctggtg

SEQ ID NO: 521073 - DNA, 25 bp, Mus musculus
actcaaaagtcaggcagggctggtg

SEQ ID NO: 521074 - DNA, 25 bp, Mus musculus
actcaaaagttgaaagctgtcagca

SEQ ID NO: 521075 - DNA, 25 bp, Mus musculus
actcaaaagttgtaagctgtcagca

SEQ ID NO: 521076 - DNA, 25 bp, Mus musculus
actcaaacccgaagggctccaggag

SEQ ID NO: 521077 - DNA, 25 bp, Mus musculus
actcaaacccgatgggctccaggag

SEQ ID NO: 521078 - DNA, 25 bp, Mus musculus
actcaaagcccacaatggcaagaga

SEQ ID NO: 521079 - DNA, 25 bp, Mus musculus
actcaaagcccagaatggcaagaga

SEQ ID NO: 521080 - DNA, 25 bp, Mus musculus
actcaaagctctaaaatggcccgtt

SEQ ID NO: 521081 - DNA, 25 bp, Mus musculus
actcaaagctcttaaatggcccgtt

SEQ ID NO: 521082 - DNA, 25 bp, Mus musculus
actcaaatataaatccagccatacg

SEQ ID NO: 521083 - DNA, 25 bp, Mus musculus
actcaaatataattccagccatacg

SEQ ID NO: 521084 - DNA, 25 bp, Mus musculus
actcaacgcaaacacaggcaaactg

SEQ ID NO: 521085 - DNA, 25 bp, Mus musculus
actcaacgcaaagacaggcaaactg

SEQ ID NO: 521086 - DNA, 25 bp, Mus musculus
actcaagaaatgcaggcccggcagg

SEQ ID NO: 521087 - DNA, 25 bp, Mus musculus
actcaagaaatggaggcccggcagg

SEQ ID NO: 521088 - DNA, 25 bp, Mus musculus
actcaagaagccagtgcccggactc

SEQ ID NO: 521089 - DNA, 25 bp, Mus musculus
actcaagaagcctgtgcccggactc

SEQ ID NO: 521090 - DNA, 25 bp, Mus musculus
actcaagaccaactcagctgtccgg

SEQ ID NO: 521091 - DNA, 25 bp, Mus musculus
actcaagaccaagtcagctgtccgg

SEQ ID NO: 521092 - DNA, 25 bp, Mus musculus
actcaaggaccacgtgctgttggag

SEQ ID NO: 521093 - DNA, 25 bp, Mus musculus
actcaaggaccaggtgctgttggag

SEQ ID NO: 521094 - DNA, 25 bp, Mus musculus
actcaatgttatcggaagttctgcg

SEQ ID NO: 521095 - DNA, 25 bp, Mus musculus
actcaatgttatgggaagttctgcg

SEQ ID NO: 521096 - DNA, 25 bp, Mus musculus
actcaattctgtctttgtggcacct

SEQ ID NO: 521097 - DNA, 25 bp, Mus musculus
actcaattctgtgtttgtggcacct

SEQ ID NO: 521098 - DNA, 25 bp, Mus musculus
actcacaagggccaaagattgattt

SEQ ID NO: 521099 - DNA, 25 bp, Mus musculus
actcacaagggcgaaagattgattt

SEQ ID NO: 521100 - DNA, 25 bp, Mus musculus
actcacacctttagatatgagcatc

SEQ ID NO: 521101 - DNA, 25 bp, Mus musculus
actcacaccttttgatatgagcatc

SEQ ID NO: 521102 - DNA, 25 bp, Mus musculus
actcacagagatccggactaggcac

SEQ ID NO: 521103 - DNA, 25 bp, Mus musculus
actcacagagatgcggactaggcac

SEQ ID NO: 521104 - DNA, 25 bp, Mus musculus
actcacaggccacctcagcgagact

SEQ ID NO: 521105 - DNA, 25 bp, Mus musculus
actcacaggccagctcagcgagact

SEQ ID NO: 521106 - DNA, 25 bp, Mus musculus
actcacattcgaccagtcttctctg

SEQ ID NO: 521107 - DNA, 25 bp, Mus musculus
actcacattcgagcagtcttctctg

SEQ ID NO: 521108 - DNA, 25 bp, Mus musculus
actcaccccgacagtatcatgaact

SEQ ID NO: 521109 - DNA, 25 bp, Mus musculus
actcaccccgactgtatcatgaact

SEQ ID NO: 521110 - DNA, 25 bp, Mus musculus
actcacccggagctggacacagatg

SEQ ID NO: 521111 - DNA, 25 bp, Mus musculus
actcacccggaggtggacacagatg

SEQ ID NO: 521112 - DNA, 25 bp, Mus musculus
actcaccgggagcatccaggaggct

SEQ ID NO: 521113 - DNA, 25 bp, Mus musculus
actcaccgggaggatccaggaggct

SEQ ID NO: 521114 - DNA, 25 bp, Mus musculus
actcacctcagtcctatgtcacaga

SEQ ID NO: 521115 - DNA, 25 bp, Mus musculus
actcacctcagtgctatgtcacaga

SEQ ID NO: 521116 - DNA, 25 bp, Mus musculus
actcacctgtggcagtttatccgag

SEQ ID NO: 521117 - DNA, 25 bp, Mus musculus
actcacctgtgggagtttatccgag

SEQ ID NO: 521118 - DNA, 25 bp, Mus musculus
actcaccttccgatctagaggctca

SEQ ID NO: 521119 - DNA, 25 bp, Mus musculus
actcaccttccgttctagaggctca

SEQ ID NO: 521120 - DNA, 25 bp, Mus musculus
actcacggagatcgcgccggttttc

SEQ ID NO: 521121 - DNA, 25 bp, Mus musculus
actcacggagatggcgccggttttc

SEQ ID NO: 521122 - DNA, 25 bp, Mus musculus
actcactctgtgcagacaccttatg

SEQ ID NO: 521123 - DNA, 25 bp, Mus musculus
actcactctgtggagacaccttatg

SEQ ID NO: 521124 - DNA, 25 bp, Mus musculus
actcactcttaccacctgtggtgga

SEQ ID NO: 521125 - DNA, 25 bp, Mus musculus
actcactcttacgacctgtggtgga

SEQ ID NO: 521126 - DNA, 25 bp, Mus musculus
actcactggcaaagagtcctttgcg

SEQ ID NO: 521127 - DNA, 25 bp, Mus musculus
actcactggcaatgagtcctttgcg

SEQ ID NO: 521128 - DNA, 25 bp, Mus musculus
actcacttatgacccgactacagct

SEQ ID NO: 521129 - DNA, 25 bp, Mus musculus
actcacttatgagccgactacagct

SEQ ID NO: 521130 - DNA, 25 bp, Mus musculus
actcacttcgtacgccagactggac

SEQ ID NO: 521131 - DNA, 25 bp, Mus musculus
actcacttcgtaggccagactggac

SEQ ID NO: 521132 - DNA, 25 bp, Mus musculus
actcacttgcttagcccagcatgga

SEQ ID NO: 521133 - DNA, 25 bp, Mus musculus
actcacttgctttgcccagcatgga

SEQ ID NO: 521134 - DNA, 25 bp, Mus musculus
actcagaacaccctgtgtaactgcc

SEQ ID NO: 521135 - DNA, 25 bp, Mus musculus
actcagaacaccgtgtgtaactgcc

SEQ ID NO: 521136 - DNA, 25 bp, Mus musculus
actcagaacaggctggccggtgaac

SEQ ID NO: 521137 - DNA, 25 bp, Mus musculus
actcagaacagggtggccggtgaac

SEQ ID NO: 521138 - DNA, 25 bp, Mus musculus
actcagaatagtatgtggacatgca

SEQ ID NO: 521139 - DNA, 25 bp, Mus musculus
actcagaatagtttgtggacatgca

SEQ ID NO: 521140 - DNA, 25 bp, Mus musculus
actcagaatcttatgcgcacacaaa

SEQ ID NO: 521141 - DNA, 25 bp, Mus musculus
actcagaatcttttgcgcacacaaa

SEQ ID NO: 521142 - DNA, 25 bp, Mus musculus
actcagacatgtatgatctgcccaa

SEQ ID NO: 521143 - DNA, 25 bp, Mus musculus
actcagacatgtttgatctgcccaa

SEQ ID NO: 521144 - DNA, 25 bp, Mus musculus
actcagacgtggaggaaaacaattt

SEQ ID NO: 521145 - DNA, 25 bp, Mus musculus
actcagacgtggtggaaaacaattt

SEQ ID NO: 521146 - DNA, 25 bp, Mus musculus
actcagactataccccaaaagccaa

SEQ ID NO: 521147 - DNA, 25 bp, Mus musculus
actcagactatagcccaaaagccaa

SEQ ID NO: 521148 - DNA, 25 bp, Mus musculus
actcagactggtcgacccaaacgca

SEQ ID NO: 521149 - DNA, 25 bp, Mus musculus
actcagactggtggacccaaacgca

SEQ ID NO: 521150 - DNA, 25 bp, Mus musculus
actcagactttgagccgtctcagaa

SEQ ID NO: 521151 - DNA, 25 bp, Mus musculus
actcagactttgtgccgtctcagaa

SEQ ID NO: 521152 - DNA, 25 bp, Mus musculus
actcagagctcgcattagtcagtcg

SEQ ID NO: 521153 - DNA, 25 bp, Mus musculus
actcagagctcggattagtcagtcg

SEQ ID NO: 521154 - DNA, 25 bp, Mus musculus
actcagaggtggagtcgaccgccag

SEQ ID NO: 521155 - DNA, 25 bp, Mus musculus
actcagaggtggtgtcgaccgccag

SEQ ID NO: 521156 - DNA, 25 bp, Mus musculus
actcagagtgagaggttgtcggatt

SEQ ID NO: 521157 - DNA, 25 bp, Mus musculus
actcagagtgagtggttgtcggatt

SEQ ID NO: 521158 - DNA, 25 bp, Mus musculus
actcagataagacgatcacagcagc

SEQ ID NO: 521159 - DNA, 25 bp, Mus musculus
actcagataagaggatcacagcagc

SEQ ID NO: 521160 - DNA, 25 bp, Mus musculus
actcagatgggaccaccgcggagtt

SEQ ID NO: 521161 - DNA, 25 bp, Mus musculus
actcagatgggagcaccgcggagtt

SEQ ID NO: 521162 - DNA, 25 bp, Mus musculus
actcagcaaagccatcgttctacag

SEQ ID NO: 521163 - DNA, 25 bp, Mus musculus
actcagcaaagcgatcgttctacag

SEQ ID NO: 521164 - DNA, 25 bp, Mus musculus
actcagcacaaactcatccagtgtc

SEQ ID NO: 521165 - DNA, 25 bp, Mus musculus
actcagcacaaagtcatccagtgtc

SEQ ID NO: 521166 - DNA, 25 bp, Mus musculus
actcagcagggcacatgaggacctc

SEQ ID NO: 521167 - DNA, 25 bp, Mus musculus
actcagcagggctcatgaggacctc

SEQ ID NO: 521168 - DNA, 25 bp, Mus musculus
actcagcatgctctggatggacatg

SEQ ID NO: 521169 - DNA, 25 bp, Mus musculus
actcagcatgctgtggatggacatg

SEQ ID NO: 521170 - DNA, 25 bp, Mus musculus
actcagccacctacaagtcatttga

SEQ ID NO: 521171 - DNA, 25 bp, Mus musculus
actcagccaccttcaagtcatttga

SEQ ID NO: 521172 - DNA, 25 bp, Mus musculus
actcagccaggtactgcagttgatg

SEQ ID NO: 521173 - DNA, 25 bp, Mus musculus
actcagccaggttctgcagttgatg

SEQ ID NO: 521174 - DNA, 25 bp, Mus musculus
actcagccccaacgagatgaagaag

SEQ ID NO: 521175 - DNA, 25 bp, Mus musculus
actcagccccaaggagatgaagaag

SEQ ID NO: 521176 - DNA, 25 bp, Mus musculus
actcagcgatatatcactatttgga

SEQ ID NO: 521177 - DNA, 25 bp, Mus musculus
actcagcgatatttcactatttgga

SEQ ID NO: 521178 - DNA, 25 bp, Mus musculus
actcagcgggttagggcttcccttg

SEQ ID NO: 521179 - DNA, 25 bp, Mus musculus
actcagcgggtttgggcttcccttg

SEQ ID NO: 521180 - DNA, 25 bp, Mus musculus
actcagctatcaaccaaagaggaaa

SEQ ID NO: 521181 - DNA, 25 bp, Mus musculus
actcagctatcatccaaagaggaaa

SEQ ID NO: 521182 - DNA, 25 bp, Mus musculus
actcagctccgaattacgtatagaa

SEQ ID NO: 521183 - DNA, 25 bp, Mus musculus
actcagctccgatttacgtatagaa

SEQ ID NO: 521184 - DNA, 25 bp, Mus musculus
actcagctgtgaatgagggacctcc

SEQ ID NO: 521185 - DNA, 25 bp, Mus musculus
actcagctgtgattgagggacctcc

SEQ ID NO: 521186 - DNA, 25 bp, Mus musculus
actcaggactggagatccgggaccg

SEQ ID NO: 521187 - DNA, 25 bp, Mus musculus
actcaggactggtgatccgggaccg

SEQ ID NO: 521188 - DNA, 25 bp, Mus musculus
actcaggagagcctgggcctcgtac

SEQ ID NO: 521189 - DNA, 25 bp, Mus musculus
actcaggagagcgtgggcctcgtac

SEQ ID NO: 521190 - DNA, 25 bp, Mus musculus
actcagggccagaggacccctgaaa

SEQ ID NO: 521191 - DNA, 25 bp, Mus musculus
actcagggccagtggacccctgaaa

SEQ ID NO: 521192 - DNA, 25 bp, Mus musculus
actcagggccctctctcaatggtgg

SEQ ID NO: 521193 - DNA, 25 bp, Mus musculus
actcagggccctgtctcaatggtgg

SEQ ID NO: 521194 - DNA, 25 bp, Mus musculus
actcagtacctgctctacacgagca

SEQ ID NO: 521195 - DNA, 25 bp, Mus musculus
actcagtacctggtctacacgagca

SEQ ID NO: 521196 - DNA, 25 bp, Mus musculus
actcagtcgcctacatggaacgcct

SEQ ID NO: 521197 - DNA, 25 bp, Mus musculus
actcagtcgccttcatggaacgcct

SEQ ID NO: 521198 - DNA, 25 bp, Mus musculus
actcagtctcggattgatctaatga

SEQ ID NO: 521199 - DNA, 25 bp, Mus musculus
actcagtctcggtttgatctaatga

SEQ ID NO: 521200 - DNA, 25 bp, Mus musculus
actcagtcttgcagctccatttgaa

SEQ ID NO: 521201 - DNA, 25 bp, Mus musculus
actcagtcttgctgctccatttgaa

SEQ ID NO: 521202 - DNA, 25 bp, Mus musculus
actcagtgacggagccgcttgttgg

SEQ ID NO: 521203 - DNA, 25 bp, Mus musculus
actcagtgacggtgccgcttgttgg

SEQ ID NO: 521204 - DNA, 25 bp, Mus musculus
actcagtggaggagtgccgcctccc

SEQ ID NO: 521205 - DNA, 25 bp, Mus musculus
actcagtggaggtgtgccgcctccc

SEQ ID NO: 521206 - DNA, 25 bp, Mus musculus
actcagtgggtcagctagaaacaac

SEQ ID NO: 521207 - DNA, 25 bp, Mus musculus
actcagtgggtctgctagaaacaac

SEQ ID NO: 521208 - DNA, 25 bp, Mus musculus
actcagttggagctggacattttcg

SEQ ID NO: 521209 - DNA, 25 bp, Mus musculus
actcagttggaggtggacattttcg

SEQ ID NO: 521210 - DNA, 25 bp, Mus musculus
actcatagccttcctgctggaggct

SEQ ID NO: 521211 - DNA, 25 bp, Mus musculus
actcatagccttgctgctggaggct

SEQ ID NO: 521212 - DNA, 25 bp, Mus musculus
actcatatggctaggaaggtgggaa

SEQ ID NO: 521213 - DNA, 25 bp, Mus musculus
actcatatggcttggaaggtgggaa

SEQ ID NO: 521214 - DNA, 25 bp, Mus musculus
actcatcactggcttggcaagactc

SEQ ID NO: 521215 - DNA, 25 bp, Mus musculus
actcatcactgggttggcaagactc

SEQ ID NO: 521216 - DNA, 25 bp, Mus musculus
actcatccacgcagtcctgtttcaa

SEQ ID NO: 521217 - DNA, 25 bp, Mus musculus
actcatccacgctgtcctgtttcaa

SEQ ID NO: 521218 - DNA, 25 bp, Mus musculus
actcatccgggaatgtcttactgga

SEQ ID NO: 521219 - DNA, 25 bp, Mus musculus
actcatccgggattgtcttactgga

SEQ ID NO: 521220 - DNA, 25 bp, Mus musculus
actcatctaggaatccagagagaga

SEQ ID NO: 521221 - DNA, 25 bp, Mus musculus
actcatctaggattccagagagaga

SEQ ID NO: 521222 - DNA, 25 bp, Mus musculus
actcatctgaaaaactgccacagga

SEQ ID NO: 521223 - DNA, 25 bp, Mus musculus
actcatctgaaatactgccacagga

SEQ ID NO: 521224 - DNA, 25 bp, Mus musculus
actcatgcaatcaaaagcgactctg

SEQ ID NO: 521225 - DNA, 25 bp, Mus musculus
actcatgcaatctaaagcgactctg

SEQ ID NO: 521226 - DNA, 25 bp, Mus musculus
actcatgcatatcgctgggagagcg

SEQ ID NO: 521227 - DNA, 25 bp, Mus musculus
actcatgcatatggctgggagagcg

SEQ ID NO: 521228 - DNA, 25 bp, Mus musculus
actcatgctcagcaccgactgggct

SEQ ID NO: 521229 - DNA, 25 bp, Mus musculus
actcatgctcaggaccgactgggct

SEQ ID NO: 521230 - DNA, 25 bp, Mus musculus
actcatgcttgcctttggcccaggg

SEQ ID NO: 521231 - DNA, 25 bp, Mus musculus
actcatgcttgcgtttggcccaggg

SEQ ID NO: 521232 - DNA, 25 bp, Mus musculus
actcatggctgcaccgtagacaacc

SEQ ID NO: 521233 - DNA, 25 bp, Mus musculus
actcatggctgctccgtagacaacc

SEQ ID NO: 521234 - DNA, 25 bp, Mus musculus
actcatgggcatcttgtctacatcc

SEQ ID NO: 521235 - DNA, 25 bp, Mus musculus
actcatgggcatgttgtctacatcc

SEQ ID NO: 521236 - DNA, 25 bp, Mus musculus
actcatggtcctctactggtaggca

SEQ ID NO: 521237 - DNA, 25 bp, Mus musculus
actcatggtcctgtactggtaggca

SEQ ID NO: 521238 - DNA, 25 bp, Mus musculus
actcatgttcatcccgcatggtggt

SEQ ID NO: 521239 - DNA, 25 bp, Mus musculus
actcatgttcatgccgcatggtggt

SEQ ID NO: 521240 - DNA, 25 bp, Mus musculus
actcattgccatctcccagggtgtg

SEQ ID NO: 521241 - DNA, 25 bp, Mus musculus
actcattgccatgtcccagggtgtg

SEQ ID NO: 521242 - DNA, 25 bp, Mus musculus
actcattgctggaaccctgggcctc

SEQ ID NO: 521243 - DNA, 25 bp, Mus musculus
actcattgctggtaccctgggcctc

SEQ ID NO: 521244 - DNA, 25 bp, Mus musculus
actcattgcttaccttaccactgtg

SEQ ID NO: 521245 - DNA, 25 bp, Mus musculus
actcattgcttagcttaccactgtg

SEQ ID NO: 521246 - DNA, 25 bp, Mus musculus
actcattttcttacactgtgtcttc

SEQ ID NO: 521247 - DNA, 25 bp, Mus musculus
actcattttctttcactgtgtcttc

SEQ ID NO: 521248 - DNA, 25 bp, Mus musculus
actcatttttacacaacaaggcgga

SEQ ID NO: 521249 - DNA, 25 bp, Mus musculus
actcatttttactcaacaaggcgga

SEQ ID NO: 521250 - DNA, 25 bp, Mus musculus
actccaaaagccagctagagagctg

SEQ ID NO: 521251 - DNA, 25 bp, Mus musculus
actccaaaagcctgctagagagctg

SEQ ID NO: 521252 - DNA, 25 bp, Mus musculus
actccaacacagattggcttaagtt

SEQ ID NO: 521253 - DNA, 25 bp, Mus musculus
actccaacacagtttggcttaagtt

SEQ ID NO: 521254 - DNA, 25 bp, Mus musculus
actccaagcataaggccccaggaga

SEQ ID NO: 521255 - DNA, 25 bp, Mus musculus
actccaagcatatggccccaggaga

SEQ ID NO: 521256 - DNA, 25 bp, Mus musculus
actccaaggcttcgccagatgcagc

SEQ ID NO: 521257 - DNA, 25 bp, Mus musculus
actccaaggcttggccagatgcagc

SEQ ID NO: 521258 - DNA, 25 bp, Mus musculus
actccaatggtgaaagacttcatga

SEQ ID NO: 521259 - DNA, 25 bp, Mus musculus
actccaatggtgtaagacttcatga

SEQ ID NO: 521260 - DNA, 25 bp, Mus musculus
actccagaatttcccggagctgaag

SEQ ID NO: 521261 - DNA, 25 bp, Mus musculus
actccagaatttgccggagctgaag

SEQ ID NO: 521262 - DNA, 25 bp, Mus musculus
actccagagacgacttcacagagga

SEQ ID NO: 521263 - DNA, 25 bp, Mus musculus
actccagagacgtcttcacagagga

SEQ ID NO: 521264 - DNA, 25 bp, Mus musculus
actccagccgatccttcagcagaag

SEQ ID NO: 521265 - DNA, 25 bp, Mus musculus
actccagccgatgcttcagcagaag

SEQ ID NO: 521266 - DNA, 25 bp, Mus musculus
actccagcgagcaggctatctccta

SEQ ID NO: 521267 - DNA, 25 bp, Mus musculus
actccagcgagctggctatctccta

SEQ ID NO: 521268 - DNA, 25 bp, Mus musculus
actccagctgaaccggcgagtccag

SEQ ID NO: 521269 - DNA, 25 bp, Mus musculus
actccagctgaagcggcgagtccag

SEQ ID NO: 521270 - DNA, 25 bp, Mus musculus
actccaggatatctgcccactgagc

SEQ ID NO: 521271 - DNA, 25 bp, Mus musculus
actccaggatatgtgcccactgagc

SEQ ID NO: 521272 - DNA, 25 bp, Mus musculus
actccaggcctgagcgtgcggccag

SEQ ID NO: 521273 - DNA, 25 bp, Mus musculus
actccaggcctgtgcgtgcggccag

SEQ ID NO: 521274 - DNA, 25 bp, Mus musculus
actccaggctgccacggcagtggtc

SEQ ID NO: 521275 - DNA, 25 bp, Mus musculus
actccaggctgcgacggcagtggtc

SEQ ID NO: 521276 - DNA, 25 bp, Mus musculus
actccaggctgtccgcatgtttgct

SEQ ID NO: 521277 - DNA, 25 bp, Mus musculus
actccaggctgtgcgcatgtttgct

SEQ ID NO: 521278 - DNA, 25 bp, Mus musculus
actccagggccaagagagatctgtc

SEQ ID NO: 521279 - DNA, 25 bp, Mus musculus
actccagggccatgagagatctgtc

SEQ ID NO: 521280 - DNA, 25 bp, Mus musculus
actccagtagctcaccgaggaccta

SEQ ID NO: 521281 - DNA, 25 bp, Mus musculus
actccagtagctgaccgaggaccta

SEQ ID NO: 521282 - DNA, 25 bp, Mus musculus
actccagtctgacggttccgggcgc

SEQ ID NO: 521283 - DNA, 25 bp, Mus musculus
actccagtctgagggttccgggcgc

SEQ ID NO: 521284 - DNA, 25 bp, Mus musculus
actccagtgacgagagtgacgtgga

SEQ ID NO: 521285 - DNA, 25 bp, Mus musculus
actccagtgacgtgagtgacgtgga

SEQ ID NO: 521286 - DNA, 25 bp, Mus musculus
actccagtgctcaggctcctcaatg

SEQ ID NO: 521287 - DNA, 25 bp, Mus musculus
actccagtgctctggctcctcaatg

SEQ ID NO: 521288 - DNA, 25 bp, Mus musculus
actccagtgcttactgcaggtcggg

SEQ ID NO: 521289 - DNA, 25 bp, Mus musculus
actccagtgctttctgcaggtcggg

SEQ ID NO: 521290 - DNA, 25 bp, Mus musculus
actccagtggaacaggtccctgctg

SEQ ID NO: 521291 - DNA, 25 bp, Mus musculus
actccagtggaagaggtccctgctg

SEQ ID NO: 521292 - DNA, 25 bp, Mus musculus
actccatatacacaaatcgaagcag

SEQ ID NO: 521293 - DNA, 25 bp, Mus musculus
actccatatacagaaatcgaagcag

SEQ ID NO: 521294 - DNA, 25 bp, Mus musculus
actccatcatttatatgcctgacag

SEQ ID NO: 521295 - DNA, 25 bp, Mus musculus
actccatcatttttatgcctgacag

SEQ ID NO: 521296 - DNA, 25 bp, Mus musculus
actccatgaataacaaggcccatat

SEQ ID NO: 521297 - DNA, 25 bp, Mus musculus
actccatgaatatcaaggcccatat

SEQ ID NO: 521298 - DNA, 25 bp, Mus musculus
actccatggagcattagtggtaaaa

SEQ ID NO: 521299 - DNA, 25 bp, Mus musculus
actccatggagctttagtggtaaaa

SEQ ID NO: 521300 - DNA, 25 bp, Mus musculus
actccattatggcacagtggagcca

SEQ ID NO: 521301 - DNA, 25 bp, Mus musculus
actccattatgggacagtggagcca

SEQ ID NO: 521302 - DNA, 25 bp, Mus musculus
actccattcaggaatacatacgaca

SEQ ID NO: 521303 - DNA, 25 bp, Mus musculus
actccattcaggtatacatacgaca

SEQ ID NO: 521304 - DNA, 25 bp, Mus musculus
actccattgggccaagaacgccgag

SEQ ID NO: 521305 - DNA, 25 bp, Mus musculus
actccattgggcgaagaacgccgag

SEQ ID NO: 521306 - DNA, 25 bp, Mus musculus
actccatttaccaagaggatactgc

SEQ ID NO: 521307 - DNA, 25 bp, Mus musculus
actccatttacctagaggatactgc

SEQ ID NO: 521308 - DNA, 25 bp, Mus musculus
actcccactggtcagcatctttgtg

SEQ ID NO: 521309 - DNA, 25 bp, Mus musculus
actcccactggtgagcatctttgtg

SEQ ID NO: 521310 - DNA, 25 bp, Mus musculus
actcccagggttagctgtggcagcg

SEQ ID NO: 521311 - DNA, 25 bp, Mus musculus
actcccagggtttgctgtggcagcg

SEQ ID NO: 521312 - DNA, 25 bp, Mus musculus
actcccagtatcaggccacaggaac

SEQ ID NO: 521313 - DNA, 25 bp, Mus musculus
actcccagtatctggccacaggaac

SEQ ID NO: 521314 - DNA, 25 bp, Mus musculus
actccccagaagatgagaatgcaga

SEQ ID NO: 521315 - DNA, 25 bp, Mus musculus
actccccagaagttgagaatgcaga

SEQ ID NO: 521316 - DNA, 25 bp, Mus musculus
actccccatggacggtcagcttgcg

SEQ ID NO: 521317 - DNA, 25 bp, Mus musculus
actccccatggagggtcagcttgcg

SEQ ID NO: 521318 - DNA, 25 bp, Mus musculus
actcccctagccaatagtttggcca

SEQ ID NO: 521319 - DNA, 25 bp, Mus musculus
actcccctagcctatagtttggcca

SEQ ID NO: 521320 - DNA, 25 bp, Mus musculus
actcccgaaatcagctaccagagat

SEQ ID NO: 521321 - DNA, 25 bp, Mus musculus
actcccgaaatctgctaccagagat

SEQ ID NO: 521322 - DNA, 25 bp, Mus musculus
actcccgaattcaggacatcagcaa

SEQ ID NO: 521323 - DNA, 25 bp, Mus musculus
actcccgaattctggacatcagcaa

SEQ ID NO: 521324 - DNA, 25 bp, Mus musculus
actcccgaccagaacctgaagatga

SEQ ID NO: 521325 - DNA, 25 bp, Mus musculus
actcccgaccagtacctgaagatga

SEQ ID NO: 521326 - DNA, 25 bp, Mus musculus
actcccgaggacagagacgaggatg

SEQ ID NO: 521327 - DNA, 25 bp, Mus musculus
actcccgaggactgagacgaggatg

SEQ ID NO: 521328 - DNA, 25 bp, Mus musculus
actcccgtgcatccatgtagaggcc

SEQ ID NO: 521329 - DNA, 25 bp, Mus musculus
actcccgtgcatgcatgtagaggcc

SEQ ID NO: 521330 - DNA, 25 bp, Mus musculus
actccctagccacagactgtgttca

SEQ ID NO: 521331 - DNA, 25 bp, Mus musculus
actccctagccagagactgtgttca

SEQ ID NO: 521332 - DNA, 25 bp, Mus musculus
actccctccaaacgatctaagaatc

SEQ ID NO: 521333 - DNA, 25 bp, Mus musculus
actccctccaaaggatctaagaatc

SEQ ID NO: 521334 - DNA, 25 bp, Mus musculus
actccctcctagatcgggcagaaga

SEQ ID NO: 521335 - DNA, 25 bp, Mus musculus
actccctcctagttcgggcagaaga

SEQ ID NO: 521336 - DNA, 25 bp, Mus musculus
actccctctacaacgtctcaggaga

SEQ ID NO: 521337 - DNA, 25 bp, Mus musculus
actccctctacatcgtctcaggaga

SEQ ID NO: 521338 - DNA, 25 bp, Mus musculus
actccctgaagaaggtcctgctcga

SEQ ID NO: 521339 - DNA, 25 bp, Mus musculus
actccctgaagatggtcctgctcga

SEQ ID NO: 521340 - DNA, 25 bp, Mus musculus
actccctgcatgcaagcaagcactt

SEQ ID NO: 521341 - DNA, 25 bp, Mus musculus
actccctgcatggaagcaagcactt

SEQ ID NO: 521342 - DNA, 25 bp, Mus musculus
actccctggaatcatgaggctttac

SEQ ID NO: 521343 - DNA, 25 bp, Mus musculus
actccctggaatgatgaggctttac

SEQ ID NO: 521344 - DNA, 25 bp, Mus musculus
actccctggataagatcatagaaga

SEQ ID NO: 521345 - DNA, 25 bp, Mus musculus
actccctggatatgatcatagaaga

SEQ ID NO: 521346 - DNA, 25 bp, Mus musculus
actccgaccatgagcctacctgagg

SEQ ID NO: 521347 - DNA, 25 bp, Mus musculus
actccgaccatgtgcctacctgagg

SEQ ID NO: 521348 - DNA, 25 bp, Mus musculus
actccgagaagaacgtggtgtaccg

SEQ ID NO: 521349 - DNA, 25 bp, Mus musculus
actccgagaagatcgtggtgtaccg

SEQ ID NO: 521350 - DNA, 25 bp, Mus musculus
actccgagtgatcgctcctaccgtg

SEQ ID NO: 521351 - DNA, 25 bp, Mus musculus
actccgagtgatggctcctaccgtg

SEQ ID NO: 521352 - DNA, 25 bp, Mus musculus
actccgcagacacacacttctgacg

SEQ ID NO: 521353 - DNA, 25 bp, Mus musculus
actccgcagacagacacttctgacg

SEQ ID NO: 521354 - DNA, 25 bp, Mus musculus
actccgccatcaccaggaggcggga

SEQ ID NO: 521355 - DNA, 25 bp, Mus musculus
actccgccatcagcaggaggcggga

SEQ ID NO: 521356 - DNA, 25 bp, Mus musculus
actccgcgctgcagttggtgccgct

SEQ ID NO: 521357 - DNA, 25 bp, Mus musculus
actccgcgctgctgttggtgccgct

SEQ ID NO: 521358 - DNA, 25 bp, Mus musculus
actccgcgggtcacctcgcgggtat

SEQ ID NO: 521359 - DNA, 25 bp, Mus musculus
actccgcgggtctcctcgcgggtat

SEQ ID NO: 521360 - DNA, 25 bp, Mus musculus
actccggaaaggagcgagatccaca

SEQ ID NO: 521361 - DNA, 25 bp, Mus musculus
actccggaaaggtgcgagatccaca

SEQ ID NO: 521362 - DNA, 25 bp, Mus musculus
actccggagccaacatgctgcggga

SEQ ID NO: 521363 - DNA, 25 bp, Mus musculus
actccggagccatcatgctgcggga

SEQ ID NO: 521364 - DNA, 25 bp, Mus musculus
actccggcaacgactgtgagtttgc

SEQ ID NO: 521365 - DNA, 25 bp, Mus musculus
actccggcaacgtctgtgagtttgc

SEQ ID NO: 521366 - DNA, 25 bp, Mus musculus
actccggctcagcagccgatgctgg

SEQ ID NO: 521367 - DNA, 25 bp, Mus musculus
actccggctcaggagccgatgctgg

SEQ ID NO: 521368 - DNA, 25 bp, Mus musculus
actccgggcgcaattgatcccgctg

SEQ ID NO: 521369 - DNA, 25 bp, Mus musculus
actccgggcgcatttgatcccgctg

SEQ ID NO: 521370 - DNA, 25 bp, Mus musculus
actccggtggaactgatgtggacct

SEQ ID NO: 521371 - DNA, 25 bp, Mus musculus
actccggtggaagtgatgtggacct

SEQ ID NO: 521372 - DNA, 25 bp, Mus musculus
actccgtagccaacacagctaaact

SEQ ID NO: 521373 - DNA, 25 bp, Mus musculus
actccgtagccatcacagctaaact

SEQ ID NO: 521374 - DNA, 25 bp, Mus musculus
actccgtggactcgtatttctgtcg

SEQ ID NO: 521375 - DNA, 25 bp, Mus musculus
actccgtggactggtatttctgtcg

SEQ ID NO: 521376 - DNA, 25 bp, Mus musculus
actccgtgttggaggtcgatgaaga

SEQ ID NO: 521377 - DNA, 25 bp, Mus musculus
actccgtgttggtggtcgatgaaga

SEQ ID NO: 521378 - DNA, 25 bp, Mus musculus
actccgttccggagctgactttcgc

SEQ ID NO: 521379 - DNA, 25 bp, Mus musculus
actccgttccggtgctgactttcgc

SEQ ID NO: 521380 - DNA, 25 bp, Mus musculus
actcctacagccctcagtatgtgga

SEQ ID NO: 521381 - DNA, 25 bp, Mus musculus
actcctacagccgtcagtatgtgga

SEQ ID NO: 521382 - DNA, 25 bp, Mus musculus
actcctaccagcctgtgtgcaacat

SEQ ID NO: 521383 - DNA, 25 bp, Mus musculus
actcctaccagcgtgtgtgcaacat

SEQ ID NO: 521384 - DNA, 25 bp, Mus musculus
actcctacgcagatatctttagttg

SEQ ID NO: 521385 - DNA, 25 bp, Mus musculus
actcctacgcagttatctttagttg

SEQ ID NO: 521386 - DNA, 25 bp, Mus musculus
actcctatgctactcagtgctggca

SEQ ID NO: 521387 - DNA, 25 bp, Mus musculus
actcctatgctagtcagtgctggca

SEQ ID NO: 521388 - DNA, 25 bp, Mus musculus
actcctatggataccaggcgccgca

SEQ ID NO: 521389 - DNA, 25 bp, Mus musculus
actcctatggattccaggcgccgca

SEQ ID NO: 521390 - DNA, 25 bp, Mus musculus
actcctcaaggtcctaggctggctg

SEQ ID NO: 521391 - DNA, 25 bp, Mus musculus
actcctcaaggtgctaggctggctg

SEQ ID NO: 521392 - DNA, 25 bp, Mus musculus
actcctcaatgacaaatcgactggg

SEQ ID NO: 521393 - DNA, 25 bp, Mus musculus
actcctcaatgagaaatcgactggg

SEQ ID NO: 521394 - DNA, 25 bp, Mus musculus
actcctcatcttctcaacctgaatg

SEQ ID NO: 521395 - DNA, 25 bp, Mus musculus
actcctcatcttgtcaacctgaatg

SEQ ID NO: 521396 - DNA, 25 bp, Mus musculus
actcctcccgtccaagaagaaatgg

SEQ ID NO: 521397 - DNA, 25 bp, Mus musculus
actcctcccgtcgaagaagaaatgg

SEQ ID NO: 521398 - DNA, 25 bp, Mus musculus
actcctcggagtatcccggcaatcg

SEQ ID NO: 521399 - DNA, 25 bp, Mus musculus
actcctcggagtttcccggcaatcg

SEQ ID NO: 521400 - DNA, 25 bp, Mus musculus
actcctcgtttgaagatgtagatgc

SEQ ID NO: 521401 - DNA, 25 bp, Mus musculus
actcctcgtttgtagatgtagatgc

SEQ ID NO: 521402 - DNA, 25 bp, Mus musculus
actcctctgtccctcaggctatgag

SEQ ID NO: 521403 - DNA, 25 bp, Mus musculus
actcctctgtccgtcaggctatgag

SEQ ID NO: 521404 - DNA, 25 bp, Mus musculus
actcctgaacaccagagagacttca

SEQ ID NO: 521405 - DNA, 25 bp, Mus musculus
actcctgaacacgagagagacttca

SEQ ID NO: 521406 - DNA, 25 bp, Mus musculus
actcctgaagcgatgcgctgcggtg

SEQ ID NO: 521407 - DNA, 25 bp, Mus musculus
actcctgaagcgttgcgctgcggtg

SEQ ID NO: 521408 - DNA, 25 bp, Mus musculus
actcctgaatcacaggaacaaggag

SEQ ID NO: 521409 - DNA, 25 bp, Mus musculus
actcctgaatcagaggaacaaggag

SEQ ID NO: 521410 - DNA, 25 bp, Mus musculus
actcctgattgacattggctctggc

SEQ ID NO: 521411 - DNA, 25 bp, Mus musculus
actcctgattgagattggctctggc

SEQ ID NO: 521412 - DNA, 25 bp, Mus musculus
actcctgcaaaacttgttcctatga

SEQ ID NO: 521413 - DNA, 25 bp, Mus musculus
actcctgcaaaagttgttcctatga

SEQ ID NO: 521414 - DNA, 25 bp, Mus musculus
actcctgcatctcagcaaggacggt

SEQ ID NO: 521415 - DNA, 25 bp, Mus musculus
actcctgcatctgagcaaggacggt

SEQ ID NO: 521416 - DNA, 25 bp, Mus musculus
actcctgctgcgctgggctaactac

SEQ ID NO: 521417 - DNA, 25 bp, Mus musculus
actcctgctgcggtgggctaactac

SEQ ID NO: 521418 - DNA, 25 bp, Mus musculus
actcctggactccaattgggtcttg

SEQ ID NO: 521419 - DNA, 25 bp, Mus musculus
actcctggactcgaattgggtcttg

SEQ ID NO: 521420 - DNA, 25 bp, Mus musculus
actcctggctaccgctcacatgagt

SEQ ID NO: 521421 - DNA, 25 bp, Mus musculus
actcctggctacggctcacatgagt

SEQ ID NO: 521422 - DNA, 25 bp, Mus musculus
actcctgggtcaccagtcgggcagc

SEQ ID NO: 521423 - DNA, 25 bp, Mus musculus
actcctgggtcagcagtcgggcagc

SEQ ID NO: 521424 - DNA, 25 bp, Mus musculus
actcctggtgtgacacaggattcag

SEQ ID NO: 521425 - DNA, 25 bp, Mus musculus
actcctggtgtgtcacaggattcag

SEQ ID NO: 521426 - DNA, 25 bp, Mus musculus
actccttaacctccatcagtaatga

SEQ ID NO: 521427 - DNA, 25 bp, Mus musculus
actccttaacctgcatcagtaatga

SEQ ID NO: 521428 - DNA, 25 bp, Mus musculus
actccttgcaggaccttaccttgtt

SEQ ID NO: 521429 - DNA, 25 bp, Mus musculus
actccttgcaggtccttaccttgtt

SEQ ID NO: 521430 - DNA, 25 bp, Mus musculus
actccttgctgtatcagcagcgcct

SEQ ID NO: 521431 - DNA, 25 bp, Mus musculus
actccttgctgtttcagcagcgcct

SEQ ID NO: 521432 - DNA, 25 bp, Mus musculus
actccttggaatctatccctgcagg

SEQ ID NO: 521433 - DNA, 25 bp, Mus musculus
actccttggaatgtatccctgcagg

SEQ ID NO: 521434 - DNA, 25 bp, Mus musculus
actccttggatgagcacgccgtcac

SEQ ID NO: 521435 - DNA, 25 bp, Mus musculus
actccttggatgtgcacgccgtcac

SEQ ID NO: 521436 - DNA, 25 bp, Mus musculus
actccttggttaatgtggacctacg

SEQ ID NO: 521437 - DNA, 25 bp, Mus musculus
actccttggttattgtggacctacg

SEQ ID NO: 521438 - DNA, 25 bp, Mus musculus
actccttgtagtagcaaccagtcta

SEQ ID NO: 521439 - DNA, 25 bp, Mus musculus
actccttgtagttgcaaccagtcta

SEQ ID NO: 521440 - DNA, 25 bp, Mus musculus
actcctttgggccacaagagggcac

SEQ ID NO: 521441 - DNA, 25 bp, Mus musculus
actcctttgggcgacaagagggcac

SEQ ID NO: 521442 - DNA, 25 bp, Mus musculus
actcctttggtcagcacagtgtggc

SEQ ID NO: 521443 - DNA, 25 bp, Mus musculus
actcctttggtctgcacagtgtggc

SEQ ID NO: 521444 - DNA, 25 bp, Mus musculus
actcgaacctggacaggccgccatg

SEQ ID NO: 521445 - DNA, 25 bp, Mus musculus
actcgaacctggtcaggccgccatg

SEQ ID NO: 521446 - DNA, 25 bp, Mus musculus
actcgaagtccgagaagggtagaga

SEQ ID NO: 521447 - DNA, 25 bp, Mus musculus
actcgaagtccgtgaagggtagaga

SEQ ID NO: 521448 - DNA, 25 bp, Mus musculus
actcgaattgggacttggtgctctc

SEQ ID NO: 521449 - DNA, 25 bp, Mus musculus
actcgaattgggtcttggtgctctc

SEQ ID NO: 521450 - DNA, 25 bp, Mus musculus
actcgacctgttctggtttctcttg

SEQ ID NO: 521451 - DNA, 25 bp, Mus musculus
actcgacctgttgtggtttctcttg

SEQ ID NO: 521452 - DNA, 25 bp, Mus musculus
actcgacgaatccaagcccagggaa

SEQ ID NO: 521453 - DNA, 25 bp, Mus musculus
actcgacgaatcgaagcccagggaa

SEQ ID NO: 521454 - DNA, 25 bp, Mus musculus
actcgagaagctaggtagagaagag

SEQ ID NO: 521455 - DNA, 25 bp, Mus musculus
actcgagaagcttggtagagaagag

SEQ ID NO: 521456 - DNA, 25 bp, Mus musculus
actcgagagacacgcgcaggatcag

SEQ ID NO: 521457 - DNA, 25 bp, Mus musculus
actcgagagacaggcgcaggatcag

SEQ ID NO: 521458 - DNA, 25 bp, Mus musculus
actcgagattctccacccctgccag

SEQ ID NO: 521459 - DNA, 25 bp, Mus musculus
actcgagattctgcacccctgccag

SEQ ID NO: 521460 - DNA, 25 bp, Mus musculus
actcgataagtaagcctgtcatgag

SEQ ID NO: 521461 - DNA, 25 bp, Mus musculus
actcgataagtatgcctgtcatgag

SEQ ID NO: 521462 - DNA, 25 bp, Mus musculus
actcgatattgcctgtggacgatga

SEQ ID NO: 521463 - DNA, 25 bp, Mus musculus
actcgatattgcgtgtggacgatga

SEQ ID NO: 521464 - DNA, 25 bp, Mus musculus
actcgatggtcaagatggcggcgac

SEQ ID NO: 521465 - DNA, 25 bp, Mus musculus
actcgatggtcatgatggcggcgac

SEQ ID NO: 521466 - DNA, 25 bp, Mus musculus
actcgcacagcgaacggaccaaatg

SEQ ID NO: 521467 - DNA, 25 bp, Mus musculus
actcgcacagcgtacggaccaaatg

SEQ ID NO: 521468 - DNA, 25 bp, Mus musculus
actcgcagtgtacagctccaggctg

SEQ ID NO: 521469 - DNA, 25 bp, Mus musculus
actcgcagtgtagagctccaggctg

SEQ ID NO: 521470 - DNA, 25 bp, Mus musculus
actcgccaggaacccattgctgctg

SEQ ID NO: 521471 - DNA, 25 bp, Mus musculus
actcgccaggaagccattgctgctg

SEQ ID NO: 521472 - DNA, 25 bp, Mus musculus
actcgccgttttctgcgcgtttgca

SEQ ID NO: 521473 - DNA, 25 bp, Mus musculus
actcgccgttttgtgcgcgtttgca

SEQ ID NO: 521474 - DNA, 25 bp, Mus musculus
actcgcgcgcggatcgaccggagca

SEQ ID NO: 521475 - DNA, 25 bp, Mus musculus
actcgcgcgcggttcgaccggagca

SEQ ID NO: 521476 - DNA, 25 bp, Mus musculus
actcgcgcgttgacctggagattga

SEQ ID NO: 521477 - DNA, 25 bp, Mus musculus
actcgcgcgttgtcctggagattga

SEQ ID NO: 521478 - DNA, 25 bp, Mus musculus
actcggaacccacttgtggcagtgt

SEQ ID NO: 521479 - DNA, 25 bp, Mus musculus
actcggaacccagttgtggcagtgt

SEQ ID NO: 521480 - DNA, 25 bp, Mus musculus
actcggacctatatgcgtcaagtgc

SEQ ID NO: 521481 - DNA, 25 bp, Mus musculus
actcggacctatttgcgtcaagtgc

SEQ ID NO: 521482 - DNA, 25 bp, Mus musculus
actcggaggagcacccctgtccagt

SEQ ID NO: 521483 - DNA, 25 bp, Mus musculus
actcggaggagctcccctgtccagt

SEQ ID NO: 521484 - DNA, 25 bp, Mus musculus
actcggatcaccacccatcagaaat

SEQ ID NO: 521485 - DNA, 25 bp, Mus musculus
actcggatcacctcccatcagaaat

SEQ ID NO: 521486 - DNA, 25 bp, Mus musculus
actcggcagaagatgcgcgagtgcc

SEQ ID NO: 521487 - DNA, 25 bp, Mus musculus
actcggcagaagttgcgcgagtgcc

SEQ ID NO: 521488 - DNA, 25 bp, Mus musculus
actcggctcagcatcgcgggcgtca

SEQ ID NO: 521489 - DNA, 25 bp, Mus musculus
actcggctcagcttcgcgggcgtca

SEQ ID NO: 521490 - DNA, 25 bp, Mus musculus
actcgggatgacctggcaaggttac

SEQ ID NO: 521491 - DNA, 25 bp, Mus musculus
actcgggatgacgtggcaaggttac

SEQ ID NO: 521492 - DNA, 25 bp, Mus musculus
actcgggttgaactgagcagattcc

SEQ ID NO: 521493 - DNA, 25 bp, Mus musculus
actcgggttgaagtgagcagattcc

SEQ ID NO: 521494 - DNA, 25 bp, Mus musculus
actcggtaagccacgaggcaggttg

SEQ ID NO: 521495 - DNA, 25 bp, Mus musculus
actcggtaagcctcgaggcaggttg

SEQ ID NO: 521496 - DNA, 25 bp, Mus musculus
actcggtctgagagagaatgggatc

SEQ ID NO: 521497 - DNA, 25 bp, Mus musculus
actcggtctgagtgagaatgggatc

SEQ ID NO: 521498 - DNA, 25 bp, Mus musculus
actcggtggcgtcctcagcggcttc

SEQ ID NO: 521499 - DNA, 25 bp, Mus musculus
actcggtggcgtgctcagcggcttc

SEQ ID NO: 521500 - DNA, 25 bp, Mus musculus
actcgtactgggagatggaaggcct

SEQ ID NO: 521501 - DNA, 25 bp, Mus musculus
actcgtactgggtgatggaaggcct

SEQ ID NO: 521502 - DNA, 25 bp, Mus musculus
actcgtaggactattcgtgaactct

SEQ ID NO: 521503 - DNA, 25 bp, Mus musculus
actcgtaggacttttcgtgaactct

SEQ ID NO: 521504 - DNA, 25 bp, Mus musculus
actcgtagttgtcggaccagaggcc

SEQ ID NO: 521505 - DNA, 25 bp, Mus musculus
actcgtagttgtgggaccagaggcc

SEQ ID NO: 521506 - DNA, 25 bp, Mus musculus
actcgtcccaggaaaaactgcccag

SEQ ID NO: 521507 - DNA, 25 bp, Mus musculus
actcgtcccaggtaaaactgcccag

SEQ ID NO: 521508 - DNA, 25 bp, Mus musculus
actcgtctaggaatgccccgagcct

SEQ ID NO: 521509 - DNA, 25 bp, Mus musculus
actcgtctaggattgccccgagcct

SEQ ID NO: 521510 - DNA, 25 bp, Mus musculus
actcgtctgcagcaatcctgggaga

SEQ ID NO: 521511 - DNA, 25 bp, Mus musculus
actcgtctgcaggaatcctgggaga

SEQ ID NO: 521512 - DNA, 25 bp, Mus musculus
actcgtctttttcctgtgctgagat

SEQ ID NO: 521513 - DNA, 25 bp, Mus musculus
actcgtctttttgctgtgctgagat

SEQ ID NO: 521514 - DNA, 25 bp, Mus musculus
actcgtgaacctaagcgctcgatcc

SEQ ID NO: 521515 - DNA, 25 bp, Mus musculus
actcgtgaaccttagcgctcgatcc

SEQ ID NO: 521516 - DNA, 25 bp, Mus musculus
actcgtggcatcaaccagaaggcca

SEQ ID NO: 521517 - DNA, 25 bp, Mus musculus
actcgtggcatctaccagaaggcca

SEQ ID NO: 521518 - DNA, 25 bp, Mus musculus
actcgttgatgtcgtgaaaaagaag

SEQ ID NO: 521519 - DNA, 25 bp, Mus musculus
actcgttgatgtggtgaaaaagaag

SEQ ID NO: 521520 - DNA, 25 bp, Mus musculus
actctaagaaagactggatgtggga

SEQ ID NO: 521521 - DNA, 25 bp, Mus musculus
actctaagaaagtctggatgtggga

SEQ ID NO: 521522 - DNA, 25 bp, Mus musculus
actctaagtcggaggtgcccgagcc

SEQ ID NO: 521523 - DNA, 25 bp, Mus musculus
actctaagtcggtggtgcccgagcc

SEQ ID NO: 521524 - DNA, 25 bp, Mus musculus
actctacacggaccacggcaacgga

SEQ ID NO: 521525 - DNA, 25 bp, Mus musculus
actctacacggagcacggcaacgga

SEQ ID NO: 521526 - DNA, 25 bp, Mus musculus
actctacagagaccacgggtcctgg

SEQ ID NO: 521527 - DNA, 25 bp, Mus musculus
actctacagagagcacgggtcctgg

SEQ ID NO: 521528 - DNA, 25 bp, Mus musculus
actctacatcgtagcacggatcata

SEQ ID NO: 521529 - DNA, 25 bp, Mus musculus
actctacatcgttgcacggatcata

SEQ ID NO: 521530 - DNA, 25 bp, Mus musculus
actctacatggccttcctgatgctg

SEQ ID NO: 521531 - DNA, 25 bp, Mus musculus
actctacatggcgttcctgatgctg

SEQ ID NO: 521532 - DNA, 25 bp, Mus musculus
actctagcaagactgttgtggatga

SEQ ID NO: 521533 - DNA, 25 bp, Mus musculus
actctagcaagagtgttgtggatga

SEQ ID NO: 521534 - DNA, 25 bp, Mus musculus
actctagcctctcaactggacttct

SEQ ID NO: 521535 - DNA, 25 bp, Mus musculus
actctagcctctgaactggacttct

SEQ ID NO: 521536 - DNA, 25 bp, Mus musculus
actctatccgggagacagcctgtac

SEQ ID NO: 521537 - DNA, 25 bp, Mus musculus
actctatccgggtgacagcctgtac

SEQ ID NO: 521538 - DNA, 25 bp, Mus musculus
actctatgacatagagcaacagcag

SEQ ID NO: 521539 - DNA, 25 bp, Mus musculus
actctatgacattgagcaacagcag

SEQ ID NO: 521540 - DNA, 25 bp, Mus musculus
actctatggccactttcgtttggac

SEQ ID NO: 521541 - DNA, 25 bp, Mus musculus
actctatggccagtttcgtttggac

SEQ ID NO: 521542 - DNA, 25 bp, Mus musculus
actctatgtggtcaacatgtttgac

SEQ ID NO: 521543 - DNA, 25 bp, Mus musculus
actctatgtggtgaacatgtttgac

SEQ ID NO: 521544 - DNA, 25 bp, Mus musculus
actctcacacacaacagtggctgca

SEQ ID NO: 521545 - DNA, 25 bp, Mus musculus
actctcacacactacagtggctgca

SEQ ID NO: 521546 - DNA, 25 bp, Mus musculus
actctccactttagatctgaaccag

SEQ ID NO: 521547 - DNA, 25 bp, Mus musculus
actctccacttttgatctgaaccag

SEQ ID NO: 521548 - DNA, 25 bp, Mus musculus
actctccatgctcagccaagatggg

SEQ ID NO: 521549 - DNA, 25 bp, Mus musculus
actctccatgctgagccaagatggg

SEQ ID NO: 521550 - DNA, 25 bp, Mus musculus
actctcccctagaagtgcccgatgg

SEQ ID NO: 521551 - DNA, 25 bp, Mus musculus
actctcccctagtagtgcccgatgg

SEQ ID NO: 521552 - DNA, 25 bp, Mus musculus
actctcccctgcagaaactggctgg

SEQ ID NO: 521553 - DNA, 25 bp, Mus musculus
actctcccctgctgaaactggctgg

SEQ ID NO: 521554 - DNA, 25 bp, Mus musculus
actctcccgacaatctgtggtcctg

SEQ ID NO: 521555 - DNA, 25 bp, Mus musculus
actctcccgacattctgtggtcctg

SEQ ID NO: 521556 - DNA, 25 bp, Mus musculus
actctcccgcgaagagcctggtgga

SEQ ID NO: 521557 - DNA, 25 bp, Mus musculus
actctcccgcgatgagcctggtgga

SEQ ID NO: 521558 - DNA, 25 bp, Mus musculus
actctccggtaaaagcacagattcc

SEQ ID NO: 521559 - DNA, 25 bp, Mus musculus
actctccggtaatagcacagattcc

SEQ ID NO: 521560 - DNA, 25 bp, Mus musculus
actctcctcacgactctcgtggaag

SEQ ID NO: 521561 - DNA, 25 bp, Mus musculus
actctcctcacgtctctcgtggaag

SEQ ID NO: 521562 - DNA, 25 bp, Mus musculus
actctcctcctgagggcacgctggg

SEQ ID NO: 521563 - DNA, 25 bp, Mus musculus
actctcctcctgtgggcacgctggg

SEQ ID NO: 521564 - DNA, 25 bp, Mus musculus
actctcggcagaacaatgacatcca

SEQ ID NO: 521565 - DNA, 25 bp, Mus musculus
actctcggcagatcaatgacatcca

SEQ ID NO: 521566 - DNA, 25 bp, Mus musculus
actctcggccttatgtggcatccct

SEQ ID NO: 521567 - DNA, 25 bp, Mus musculus
actctcggccttttgtggcatccct

SEQ ID NO: 521568 - DNA, 25 bp, Mus musculus
actctcgggctgatcaggtgagtga

SEQ ID NO: 521569 - DNA, 25 bp, Mus musculus
actctcgggctgttcaggtgagtga

SEQ ID NO: 521570 - DNA, 25 bp, Mus musculus
actctcggtggacgctcaagcccag

SEQ ID NO: 521571 - DNA, 25 bp, Mus musculus
actctcggtggaggctcaagcccag

SEQ ID NO: 521572 - DNA, 25 bp, Mus musculus
actctcgtcagcacttacgccaagg

SEQ ID NO: 521573 - DNA, 25 bp, Mus musculus
actctcgtcagctcttacgccaagg

SEQ ID NO: 521574 - DNA, 25 bp, Mus musculus
actctcgtctgtcttggaaggttca

SEQ ID NO: 521575 - DNA, 25 bp, Mus musculus
actctcgtctgtgttggaaggttca

SEQ ID NO: 521576 - DNA, 25 bp, Mus musculus
actctctgctttagttccagggagg

SEQ ID NO: 521577 - DNA, 25 bp, Mus musculus
actctctgcttttgttccagggagg

SEQ ID NO: 521578 - DNA, 25 bp, Mus musculus
actctctgtggccaggcctggcaga

SEQ ID NO: 521579 - DNA, 25 bp, Mus musculus
actctctgtggcgaggcctggcaga

SEQ ID NO: 521580 - DNA, 25 bp, Mus musculus
actctcttacctcagctgaccaggg

SEQ ID NO: 521581 - DNA, 25 bp, Mus musculus
actctcttacctgagctgaccaggg

SEQ ID NO: 521582 - DNA, 25 bp, Mus musculus
actctcttcactattcctaggagga

SEQ ID NO: 521583 - DNA, 25 bp, Mus musculus
actctcttcacttttcctaggagga

SEQ ID NO: 521584 - DNA, 25 bp, Mus musculus
actctgaaaagcaactaaagaaaat

SEQ ID NO: 521585 - DNA, 25 bp, Mus musculus
actctgaaaagctactaaagaaaat

SEQ ID NO: 521586 - DNA, 25 bp, Mus musculus
actctgaacaatctggaagtctgca

SEQ ID NO: 521587 - DNA, 25 bp, Mus musculus
actctgaacaatgtggaagtctgca

SEQ ID NO: 521588 - DNA, 25 bp, Mus musculus
actctgagccccaggtgcaggaggc

SEQ ID NO: 521589 - DNA, 25 bp, Mus musculus
actctgagcccctggtgcaggaggc

SEQ ID NO: 521590 - DNA, 25 bp, Mus musculus
actctgagctggcaggacgatccag

SEQ ID NO: 521591 - DNA, 25 bp, Mus musculus
actctgagctgggaggacgatccag

SEQ ID NO: 521592 - DNA, 25 bp, Mus musculus
actctgaggccacatgagaaggcca

SEQ ID NO: 521593 - DNA, 25 bp, Mus musculus
actctgaggccagatgagaaggcca

SEQ ID NO: 521594 - DNA, 25 bp, Mus musculus
actctgagtgcccacgacacaggcg

SEQ ID NO: 521595 - DNA, 25 bp, Mus musculus
actctgagtgccgacgacacaggcg

SEQ ID NO: 521596 - DNA, 25 bp, Mus musculus
actctgatagacatgtgtgcccgga

SEQ ID NO: 521597 - DNA, 25 bp, Mus musculus
actctgatagacttgtgtgcccgga

SEQ ID NO: 521598 - DNA, 25 bp, Mus musculus
actctgatatcaccaaagtggtatc

SEQ ID NO: 521599 - DNA, 25 bp, Mus musculus
actctgatatcagcaaagtggtatc

SEQ ID NO: 521600 - DNA, 25 bp, Mus musculus
actctgcaaccaccataggaaacaa

SEQ ID NO: 521601 - DNA, 25 bp, Mus musculus
actctgcaaccagcataggaaacaa

SEQ ID NO: 521602 - DNA, 25 bp, Mus musculus
actctgcactagagcgggatacgaa

SEQ ID NO: 521603 - DNA, 25 bp, Mus musculus
actctgcactagtgcgggatacgaa

SEQ ID NO: 521604 - DNA, 25 bp, Mus musculus
actctgcagaggacgttcgtaagtt

SEQ ID NO: 521605 - DNA, 25 bp, Mus musculus
actctgcagaggtcgttcgtaagtt

SEQ ID NO: 521606 - DNA, 25 bp, Mus musculus
actctgcagctgatttttgacctgt

SEQ ID NO: 521607 - DNA, 25 bp, Mus musculus
actctgcagctgttttttgacctgt

SEQ ID NO: 521608 - DNA, 25 bp, Mus musculus
actctgcaggtaagtgggccctcag

SEQ ID NO: 521609 - DNA, 25 bp, Mus musculus
actctgcaggtatgtgggccctcag

SEQ ID NO: 521610 - DNA, 25 bp, Mus musculus
actctgcatgtgagtctctcgtact

SEQ ID NO: 521611 - DNA, 25 bp, Mus musculus
actctgcatgtgtgtctctcgtact

SEQ ID NO: 521612 - DNA, 25 bp, Mus musculus
actctgccctttatggtgagtcaat

SEQ ID NO: 521613 - DNA, 25 bp, Mus musculus
actctgccctttttggtgagtcaat

SEQ ID NO: 521614 - DNA, 25 bp, Mus musculus
actctgccgggcacaaacgagccat

SEQ ID NO: 521615 - DNA, 25 bp, Mus musculus
actctgccgggctcaaacgagccat

SEQ ID NO: 521616 - DNA, 25 bp, Mus musculus
actctgccgtggatgatgcgtccca

SEQ ID NO: 521617 - DNA, 25 bp, Mus musculus
actctgccgtggttgatgcgtccca

SEQ ID NO: 521618 - DNA, 25 bp, Mus musculus
actctgcctgcactgggcccgggat

SEQ ID NO: 521619 - DNA, 25 bp, Mus musculus
actctgcctgcagtgggcccgggat

SEQ ID NO: 521620 - DNA, 25 bp, Mus musculus
actctgctagtcagggtcggtgtca

SEQ ID NO: 521621 - DNA, 25 bp, Mus musculus
actctgctagtctgggtcggtgtca

SEQ ID NO: 521622 - DNA, 25 bp, Mus musculus
actctgctcaagaagctgttccagg

SEQ ID NO: 521623 - DNA, 25 bp, Mus musculus
actctgctcaagtagctgttccagg

SEQ ID NO: 521624 - DNA, 25 bp, Mus musculus
actctgctcctccaaggttgacaag

SEQ ID NO: 521625 - DNA, 25 bp, Mus musculus
actctgctcctcgaaggttgacaag

SEQ ID NO: 521626 - DNA, 25 bp, Mus musculus
actctgctctcaccgcaaaggtgaa

SEQ ID NO: 521627 - DNA, 25 bp, Mus musculus
actctgctctcagcgcaaaggtgaa

SEQ ID NO: 521628 - DNA, 25 bp, Mus musculus
actctgctgtggactatgggagcag

SEQ ID NO: 521629 - DNA, 25 bp, Mus musculus
actctgctgtggtctatgggagcag

SEQ ID NO: 521630 - DNA, 25 bp, Mus musculus
actctgctgtttcctgcatgctgca

SEQ ID NO: 521631 - DNA, 25 bp, Mus musculus
actctgctgtttgctgcatgctgca

SEQ ID NO: 521632 - DNA, 25 bp, Mus musculus
actctggaatcccaacttgaagcaa

SEQ ID NO: 521633 - DNA, 25 bp, Mus musculus
actctggaatccgaacttgaagcaa

SEQ ID NO: 521634 - DNA, 25 bp, Mus musculus
actctggacctgcacaagggctgca

SEQ ID NO: 521635 - DNA, 25 bp, Mus musculus
actctggacctggacaagggctgca

SEQ ID NO: 521636 - DNA, 25 bp, Mus musculus
actctggacgcaagcgcacggccaa

SEQ ID NO: 521637 - DNA, 25 bp, Mus musculus
actctggacgcatgcgcacggccaa

SEQ ID NO: 521638 - DNA, 25 bp, Mus musculus
actctggagactctgagaatatttc

SEQ ID NO: 521639 - DNA, 25 bp, Mus musculus
actctggagactgtgagaatatttc

SEQ ID NO: 521640 - DNA, 25 bp, Mus musculus
actctggaggagctgtgtctcatct

SEQ ID NO: 521641 - DNA, 25 bp, Mus musculus
actctggaggaggtgtgtctcatct

SEQ ID NO: 521642 - DNA, 25 bp, Mus musculus
actctggatcagctgaaaatgggca

SEQ ID NO: 521643 - DNA, 25 bp, Mus musculus
actctggatcaggtgaaaatgggca

SEQ ID NO: 521644 - DNA, 25 bp, Mus musculus
actctggcactaaggtcatggcgga

SEQ ID NO: 521645 - DNA, 25 bp, Mus musculus
actctggcactatggtcatggcgga

SEQ ID NO: 521646 - DNA, 25 bp, Mus musculus
actctggcagctccttagggccatg

SEQ ID NO: 521647 - DNA, 25 bp, Mus musculus
actctggcagctgcttagggccatg

SEQ ID NO: 521648 - DNA, 25 bp, Mus musculus
actctggcgagcataccagagagcc

SEQ ID NO: 521649 - DNA, 25 bp, Mus musculus
actctggcgagcttaccagagagcc

SEQ ID NO: 521650 - DNA, 25 bp, Mus musculus
actctggctacaccccaatggatct

SEQ ID NO: 521651 - DNA, 25 bp, Mus musculus
actctggctacagcccaatggatct

SEQ ID NO: 521652 - DNA, 25 bp, Mus musculus
actctgggtgtcagcaagtacacgg

SEQ ID NO: 521653 - DNA, 25 bp, Mus musculus
actctgggtgtctgcaagtacacgg

SEQ ID NO: 521654 - DNA, 25 bp, Mus musculus
actctggtgtctaccgtgctgcctg

SEQ ID NO: 521655 - DNA, 25 bp, Mus musculus
actctggtgtcttccgtgctgcctg

SEQ ID NO: 521656 - DNA, 25 bp, Mus musculus
actctgtagcccctgctaggctgaa

SEQ ID NO: 521657 - DNA, 25 bp, Mus musculus
actctgtagcccgtgctaggctgaa

SEQ ID NO: 521658 - DNA, 25 bp, Mus musculus
actctgtccaggctgaaaggtgccc

SEQ ID NO: 521659 - DNA, 25 bp, Mus musculus
actctgtccagggtgaaaggtgccc

SEQ ID NO: 521660 - DNA, 25 bp, Mus musculus
actctgtcccagacactgacctgat

SEQ ID NO: 521661 - DNA, 25 bp, Mus musculus
actctgtcccagtcactgacctgat

SEQ ID NO: 521662 - DNA, 25 bp, Mus musculus
actctgtgacaaatttagtggccat

SEQ ID NO: 521663 - DNA, 25 bp, Mus musculus
actctgtgacaattttagtggccat

SEQ ID NO: 521664 - DNA, 25 bp, Mus musculus
actctgtgaccaagcctgtggccta

SEQ ID NO: 521665 - DNA, 25 bp, Mus musculus
actctgtgaccatgcctgtggccta

SEQ ID NO: 521666 - DNA, 25 bp, Mus musculus
actctgtgcacacggtcactgtgag

SEQ ID NO: 521667 - DNA, 25 bp, Mus musculus
actctgtgcacagggtcactgtgag

SEQ ID NO: 521668 - DNA, 25 bp, Mus musculus
actctgtggtccaagctggtcatcg

SEQ ID NO: 521669 - DNA, 25 bp, Mus musculus
actctgtggtcctagctggtcatcg

SEQ ID NO: 521670 - DNA, 25 bp, Mus musculus
actcttaagtataggatcacgtggc

SEQ ID NO: 521671 - DNA, 25 bp, Mus musculus
actcttaagtattggatcacgtggc

SEQ ID NO: 521672 - DNA, 25 bp, Mus musculus
actcttaccctacaagaagtgcaag

SEQ ID NO: 521673 - DNA, 25 bp, Mus musculus
actcttaccctagaagaagtgcaag

SEQ ID NO: 521674 - DNA, 25 bp, Mus musculus
actcttacctgtccgctgtgacctg

SEQ ID NO: 521675 - DNA, 25 bp, Mus musculus
actcttacctgtgcgctgtgacctg

SEQ ID NO: 521676 - DNA, 25 bp, Mus musculus
actcttcaatcacctcatcaagtga

SEQ ID NO: 521677 - DNA, 25 bp, Mus musculus
actcttcaatcagctcatcaagtga

SEQ ID NO: 521678 - DNA, 25 bp, Mus musculus
actcttcataggcagacattttacc

SEQ ID NO: 521679 - DNA, 25 bp, Mus musculus
actcttcatagggagacattttacc

SEQ ID NO: 521680 - DNA, 25 bp, Mus musculus
actcttccatcgctgtccgaggcaa

SEQ ID NO: 521681 - DNA, 25 bp, Mus musculus
actcttccatcggtgtccgaggcaa

SEQ ID NO: 521682 - DNA, 25 bp, Mus musculus
actcttccctgtacctggagaggag

SEQ ID NO: 521683 - DNA, 25 bp, Mus musculus
actcttccctgttcctggagaggag

SEQ ID NO: 521684 - DNA, 25 bp, Mus musculus
actcttcgttatcggaagatcatga

SEQ ID NO: 521685 - DNA, 25 bp, Mus musculus
actcttcgttatgggaagatcatga

SEQ ID NO: 521686 - DNA, 25 bp, Mus musculus
actcttctgcggcactgcgtgatgg

SEQ ID NO: 521687 - DNA, 25 bp, Mus musculus
actcttctgcgggactgcgtgatgg

SEQ ID NO: 521688 - DNA, 25 bp, Mus musculus
actcttcttgtactgggccatgcag

SEQ ID NO: 521689 - DNA, 25 bp, Mus musculus
actcttcttgtagtgggccatgcag

SEQ ID NO: 521690 - DNA, 25 bp, Mus musculus
actcttgaggtgaagcgcggctctc

SEQ ID NO: 521691 - DNA, 25 bp, Mus musculus
actcttgaggtgtagcgcggctctc

SEQ ID NO: 521692 - DNA, 25 bp, Mus musculus
actcttgcatatcgtaaaagctagc

SEQ ID NO: 521693 - DNA, 25 bp, Mus musculus
actcttgcatatggtaaaagctagc

SEQ ID NO: 521694 - DNA, 25 bp, Mus musculus
actcttggaggtccagaagcggatc

SEQ ID NO: 521695 - DNA, 25 bp, Mus musculus
actcttggaggtgcagaagcggatc

SEQ ID NO: 521696 - DNA, 25 bp, Mus musculus
actcttggtcctcgcgggtcctgcg

SEQ ID NO: 521697 - DNA, 25 bp, Mus musculus
actcttggtcctggcgggtcctgcg

SEQ ID NO: 521698 - DNA, 25 bp, Mus musculus
actcttgttcttcgtgccacaaaca

SEQ ID NO: 521699 - DNA, 25 bp, Mus musculus
actcttgttcttggtgccacaaaca

SEQ ID NO: 521700 - DNA, 25 bp, Mus musculus
actctttcagttactcaggatgagt

SEQ ID NO: 521701 - DNA, 25 bp, Mus musculus
actctttcagtttctcaggatgagt

SEQ ID NO: 521702 - DNA, 25 bp, Mus musculus
actctttcccagagtaatgacacct

SEQ ID NO: 521703 - DNA, 25 bp, Mus musculus
actctttcccagtgtaatgacacct

SEQ ID NO: 521704 - DNA, 25 bp, Mus musculus
actctttcctaccaaatcgttccag

SEQ ID NO: 521705 - DNA, 25 bp, Mus musculus
actctttcctacgaaatcgttccag

SEQ ID NO: 521706 - DNA, 25 bp, Mus musculus
actctttgacgtcccctggatcagc

SEQ ID NO: 521707 - DNA, 25 bp, Mus musculus
actctttgacgtgccctggatcagc

SEQ ID NO: 521708 - DNA, 25 bp, Mus musculus
actctttggtgcaacagtgacattc

SEQ ID NO: 521709 - DNA, 25 bp, Mus musculus
actctttggtgctacagtgacattc

SEQ ID NO: 521710 - DNA, 25 bp, Mus musculus
actgaaaaagatatggaggaactcc

SEQ ID NO: 521711 - DNA, 25 bp, Mus musculus
actgaaaaagatttggaggaactcc

SEQ ID NO: 521712 - DNA, 25 bp, Mus musculus
actgaaaagacacgccgagagtggt

SEQ ID NO: 521713 - DNA, 25 bp, Mus musculus
actgaaaagacaggccgagagtggt

SEQ ID NO: 521714 - DNA, 25 bp, Mus musculus
actgaaaagtaacgcgcctcactgg

SEQ ID NO: 521715 - DNA, 25 bp, Mus musculus
actgaaaagtaaggcgcctcactgg

SEQ ID NO: 521716 - DNA, 25 bp, Mus musculus
actgaaacaagcaaagaagttctgg

SEQ ID NO: 521717 - DNA, 25 bp, Mus musculus
actgaaacaagctaagaagttctgg

SEQ ID NO: 521718 - DNA, 25 bp, Mus musculus
actgaaacatctcttgcagagagcc

SEQ ID NO: 521719 - DNA, 25 bp, Mus musculus
actgaaacatctgttgcagagagcc

SEQ ID NO: 521720 - DNA, 25 bp, Mus musculus
actgaaacgctacgaaggccctctc

SEQ ID NO: 521721 - DNA, 25 bp, Mus musculus
actgaaacgctaggaaggccctctc

SEQ ID NO: 521722 - DNA, 25 bp, Mus musculus
actgaaagagatagggccaggctga

SEQ ID NO: 521723 - DNA, 25 bp, Mus musculus
actgaaagagattgggccaggctga

SEQ ID NO: 521724 - DNA, 25 bp, Mus musculus
actgaaagtcgcacgcttggacaac

SEQ ID NO: 521725 - DNA, 25 bp, Mus musculus
actgaaagtcgctcgcttggacaac

SEQ ID NO: 521726 - DNA, 25 bp, Mus musculus
actgaaatcataaatacatggaaaa

SEQ ID NO: 521727 - DNA, 25 bp, Mus musculus
actgaaatcatatatacatggaaaa

SEQ ID NO: 521728 - DNA, 25 bp, Mus musculus
actgaaatcccaacaagagaagccg

SEQ ID NO: 521729 - DNA, 25 bp, Mus musculus
actgaaatcccatcaagagaagccg

SEQ ID NO: 521730 - DNA, 25 bp, Mus musculus
actgaaattacccactcgaccacag

SEQ ID NO: 521731 - DNA, 25 bp, Mus musculus
actgaaattaccgactcgaccacag

SEQ ID NO: 521732 - DNA, 25 bp, Mus musculus
actgaacagcaaccacacaggctac

SEQ ID NO: 521733 - DNA, 25 bp, Mus musculus
actgaacagcaagcacacaggctac

SEQ ID NO: 521734 - DNA, 25 bp, Mus musculus
actgaacagcgccacagacaatcct

SEQ ID NO: 521735 - DNA, 25 bp, Mus musculus
actgaacagcgcgacagacaatcct

SEQ ID NO: 521736 - DNA, 25 bp, Mus musculus
actgaaccaagcacctgtctgtgtg

SEQ ID NO: 521737 - DNA, 25 bp, Mus musculus
actgaaccaagctcctgtctgtgtg

SEQ ID NO: 521738 - DNA, 25 bp, Mus musculus
actgaaccaatgagcctgagacctg

SEQ ID NO: 521739 - DNA, 25 bp, Mus musculus
actgaaccaatgtgcctgagacctg

SEQ ID NO: 521740 - DNA, 25 bp, Mus musculus
actgaacgaggccactaggtggtcc

SEQ ID NO: 521741 - DNA, 25 bp, Mus musculus
actgaacgaggcgactaggtggtcc

SEQ ID NO: 521742 - DNA, 25 bp, Mus musculus
actgaacgcatgatggcctactgtg

SEQ ID NO: 521743 - DNA, 25 bp, Mus musculus
actgaacgcatgttggcctactgtg

SEQ ID NO: 521744 - DNA, 25 bp, Mus musculus
actgaacggcaaagacctgtgtggc

SEQ ID NO: 521745 - DNA, 25 bp, Mus musculus
actgaacggcaatgacctgtgtggc

SEQ ID NO: 521746 - DNA, 25 bp, Mus musculus
actgaactacgcctggtggatacct

SEQ ID NO: 521747 - DNA, 25 bp, Mus musculus
actgaactacgcgtggtggatacct

SEQ ID NO: 521748 - DNA, 25 bp, Mus musculus
actgaagaaaaacacgtggacgctg

SEQ ID NO: 521749 - DNA, 25 bp, Mus musculus
actgaagaaaaactggcagaggcag

SEQ ID NO: 521750 - DNA, 25 bp, Mus musculus
actgaagaaaaagacgtggacgctg

SEQ ID NO: 521751 - DNA, 25 bp, Mus musculus
actgaagaaaaagtggcagaggcag

SEQ ID NO: 521752 - DNA, 25 bp, Mus musculus
actgaagaaaggaccctatgcccgg

SEQ ID NO: 521753 - DNA, 25 bp, Mus musculus
actgaagaaaggtccctatgcccgg

SEQ ID NO: 521754 - DNA, 25 bp, Mus musculus
actgaagaaggacccacactctcag

SEQ ID NO: 521755 - DNA, 25 bp, Mus musculus
actgaagaaggagccacactctcag

SEQ ID NO: 521756 - DNA, 25 bp, Mus musculus
actgaagacccacggaagctccatg

SEQ ID NO: 521757 - DNA, 25 bp, Mus musculus
actgaagacccagggaagctccatg

SEQ ID NO: 521758 - DNA, 25 bp, Mus musculus
actgaagacttgctgttgaccctga

SEQ ID NO: 521759 - DNA, 25 bp, Mus musculus
actgaagacttggtgttgaccctga

SEQ ID NO: 521760 - DNA, 25 bp, Mus musculus
actgaagagctcctgtatttggcgg

SEQ ID NO: 521761 - DNA, 25 bp, Mus musculus
actgaagagctcgtgtatttggcgg

SEQ ID NO: 521762 - DNA, 25 bp, Mus musculus
actgaagagcttccccaacattggc

SEQ ID NO: 521763 - DNA, 25 bp, Mus musculus
actgaagagcttgcccaacattggc

SEQ ID NO: 521764 - DNA, 25 bp, Mus musculus
actgaagaggacctgtcgatagaca

SEQ ID NO: 521765 - DNA, 25 bp, Mus musculus
actgaagaggacgtgtcgatagaca

SEQ ID NO: 521766 - DNA, 25 bp, Mus musculus
actgaagagtctaaggctctcctgg

SEQ ID NO: 521767 - DNA, 25 bp, Mus musculus
actgaagagtcttaggctctcctgg

SEQ ID NO: 521768 - DNA, 25 bp, Mus musculus
actgaagatactaccccaaagggag

SEQ ID NO: 521769 - DNA, 25 bp, Mus musculus
actgaagatactcggatggcacagg

SEQ ID NO: 521770 - DNA, 25 bp, Mus musculus
actgaagatactgggatggcacagg

SEQ ID NO: 521771 - DNA, 25 bp, Mus musculus
actgaagatacttccccaaagggag

SEQ ID NO: 521772 - DNA, 25 bp, Mus musculus
actgaagcccatcgattccaatggc

SEQ ID NO: 521773 - DNA, 25 bp, Mus musculus
actgaagcccatggattccaatggc

SEQ ID NO: 521774 - DNA, 25 bp, Mus musculus
actgaagctaggcagcagcatccgg

SEQ ID NO: 521775 - DNA, 25 bp, Mus musculus
actgaagctagggagcagcatccgg

SEQ ID NO: 521776 - DNA, 25 bp, Mus musculus
actgaagctgagacgaaggtgctgc

SEQ ID NO: 521777 - DNA, 25 bp, Mus musculus
actgaagctgagtcgaaggtgctgc

SEQ ID NO: 521778 - DNA, 25 bp, Mus musculus
actgaaggacgactgcctgttttca

SEQ ID NO: 521779 - DNA, 25 bp, Mus musculus
actgaaggacgagtgcctgttttca

SEQ ID NO: 521780 - DNA, 25 bp, Mus musculus
actgaaggagccagcagcgctcacc

SEQ ID NO: 521781 - DNA, 25 bp, Mus musculus
actgaaggagcctgcagcgctcacc

SEQ ID NO: 521782 - DNA, 25 bp, Mus musculus
actgaaggagcgagtatccctgccc

SEQ ID NO: 521783 - DNA, 25 bp, Mus musculus
actgaaggagcgtgtatccctgccc

SEQ ID NO: 521784 - DNA, 25 bp, Mus musculus
actgaaggcagtcatggccgtttcc

SEQ ID NO: 521785 - DNA, 25 bp, Mus musculus
actgaaggcagtgatggccgtttcc

SEQ ID NO: 521786 - DNA, 25 bp, Mus musculus
actgaaggctatcgaccaggagatc

SEQ ID NO: 521787 - DNA, 25 bp, Mus musculus
actgaaggctatggaccaggagatc

SEQ ID NO: 521788 - DNA, 25 bp, Mus musculus
actgaaggcttcaggaggcccctgc

SEQ ID NO: 521789 - DNA, 25 bp, Mus musculus
actgaaggcttctggaggcccctgc

SEQ ID NO: 521790 - DNA, 25 bp, Mus musculus
actgaagtcaagattcccaaaccaa

SEQ ID NO: 521791 - DNA, 25 bp, Mus musculus
actgaagtcaagtttcccaaaccaa

SEQ ID NO: 521792 - DNA, 25 bp, Mus musculus
actgaagttgtactttgcttctctt

SEQ ID NO: 521793 - DNA, 25 bp, Mus musculus
actgaagttgtagtttgcttctctt

SEQ ID NO: 521794 - DNA, 25 bp, Mus musculus
actgaagtttctcgattgaagcgga

SEQ ID NO: 521795 - DNA, 25 bp, Mus musculus
actgaagtttctggattgaagcgga

SEQ ID NO: 521796 - DNA, 25 bp, Mus musculus
actgaatagggaccctctgtctctc

SEQ ID NO: 521797 - DNA, 25 bp, Mus musculus
actgaatagggagcctctgtctctc

SEQ ID NO: 521798 - DNA, 25 bp, Mus musculus
actgaatcccgaagcagttgaattg

SEQ ID NO: 521799 - DNA, 25 bp, Mus musculus
actgaatcccgatgcagttgaattg

SEQ ID NO: 521800 - DNA, 25 bp, Mus musculus
actgaatgtgaactttgtgggtccg

SEQ ID NO: 521801 - DNA, 25 bp, Mus musculus
actgaatgtgaagtttgtgggtccg

SEQ ID NO: 521802 - DNA, 25 bp, Mus musculus
actgaattattcaagcgaccttggc

SEQ ID NO: 521803 - DNA, 25 bp, Mus musculus
actgaattattctagcgaccttggc

SEQ ID NO: 521804 - DNA, 25 bp, Mus musculus
actgacaagcacctttctcctgatg

SEQ ID NO: 521805 - DNA, 25 bp, Mus musculus
actgacaagcacgtttctcctgatg

SEQ ID NO: 521806 - DNA, 25 bp, Mus musculus
actgacacagaacacgagggcactc

SEQ ID NO: 521807 - DNA, 25 bp, Mus musculus
actgacacagaagacgagggcactc

SEQ ID NO: 521808 - DNA, 25 bp, Mus musculus
actgacactgaaccaggcacccaag

SEQ ID NO: 521809 - DNA, 25 bp, Mus musculus
actgacactgaagcaggcacccaag

SEQ ID NO: 521810 - DNA, 25 bp, Mus musculus
actgacagacgacgagaaggagatc

SEQ ID NO: 521811 - DNA, 25 bp, Mus musculus
actgacagacgaggagaaggagatc

SEQ ID NO: 521812 - DNA, 25 bp, Mus musculus
actgacatgcggctcatatattgga

SEQ ID NO: 521813 - DNA, 25 bp, Mus musculus
actgacatgcgggtcatatattgga

SEQ ID NO: 521814 - DNA, 25 bp, Mus musculus
actgaccagagtccgcgaatcgtcc

SEQ ID NO: 521815 - DNA, 25 bp, Mus musculus
actgaccagagtgcgcgaatcgtcc

SEQ ID NO: 521816 - DNA, 25 bp, Mus musculus
actgacccacatcaatgaggtctgg

SEQ ID NO: 521817 - DNA, 25 bp, Mus musculus
actgacccacatgaatgaggtctgg

SEQ ID NO: 521818 - DNA, 25 bp, Mus musculus
actgacccagttcaaggctggcgta

SEQ ID NO: 521819 - DNA, 25 bp, Mus musculus
actgacccagttgaaggctggcgta

SEQ ID NO: 521820 - DNA, 25 bp, Mus musculus
actgacccatggctatgacgactgg

SEQ ID NO: 521821 - DNA, 25 bp, Mus musculus
actgacccatgggtatgacgactgg

SEQ ID NO: 521822 - DNA, 25 bp, Mus musculus
actgacccctgcagagcttcgagac

SEQ ID NO: 521823 - DNA, 25 bp, Mus musculus
actgacccctgctgagcttcgagac

SEQ ID NO: 521824 - DNA, 25 bp, Mus musculus
actgacccgagtcttgccaaaagca

SEQ ID NO: 521825 - DNA, 25 bp, Mus musculus
actgacccgagtgttgccaaaagca

SEQ ID NO: 521826 - DNA, 25 bp, Mus musculus
actgaccctcaaagtcaagagtgaa

SEQ ID NO: 521827 - DNA, 25 bp, Mus musculus
actgaccctcaatgtcaagagtgaa

SEQ ID NO: 521828 - DNA, 25 bp, Mus musculus
actgaccgctcgcaagggaaaagtg

SEQ ID NO: 521829 - DNA, 25 bp, Mus musculus
actgaccgctcggaagggaaaagtg

SEQ ID NO: 521830 - DNA, 25 bp, Mus musculus
actgacctgcaacaacagggtccag

SEQ ID NO: 521831 - DNA, 25 bp, Mus musculus
actgacctgcaagaacagggtccag

SEQ ID NO: 521832 - DNA, 25 bp, Mus musculus
actgacctggctatctcgggatttc

SEQ ID NO: 521833 - DNA, 25 bp, Mus musculus
actgacctggctttctcgggatttc

SEQ ID NO: 521834 - DNA, 25 bp, Mus musculus
actgacgaggcccacgctgaagaga

SEQ ID NO: 521835 - DNA, 25 bp, Mus musculus
actgacgaggccgacgctgaagaga

SEQ ID NO: 521836 - DNA, 25 bp, Mus musculus
actgacggacgaccggacatgccaa

SEQ ID NO: 521837 - DNA, 25 bp, Mus musculus
actgacggacgagcggacatgccaa

SEQ ID NO: 521838 - DNA, 25 bp, Mus musculus
actgacgtggcccagatgtatgaga

SEQ ID NO: 521839 - DNA, 25 bp, Mus musculus
actgacgtggccgagatgtatgaga

SEQ ID NO: 521840 - DNA, 25 bp, Mus musculus
actgacgtgtctctcggtcgaggaa

SEQ ID NO: 521841 - DNA, 25 bp, Mus musculus
actgacgtgtctgtcggtcgaggaa

SEQ ID NO: 521842 - DNA, 25 bp, Mus musculus
actgacgtttgtcgctggtcaagtt

SEQ ID NO: 521843 - DNA, 25 bp, Mus musculus
actgacgtttgtggctggtcaagtt

SEQ ID NO: 521844 - DNA, 25 bp, Mus musculus
actgactaacgaagccaccgatgcc

SEQ ID NO: 521845 - DNA, 25 bp, Mus musculus
actgactaacgatgccaccgatgcc

SEQ ID NO: 521846 - DNA, 25 bp, Mus musculus
actgactcagttactaagggaagac

SEQ ID NO: 521847 - DNA, 25 bp, Mus musculus
actgactcagtttctaagggaagac

SEQ ID NO: 521848 - DNA, 25 bp, Mus musculus
actgactctaaacaaaggccaggcc

SEQ ID NO: 521849 - DNA, 25 bp, Mus musculus
actgactctaaagaaaggccaggcc

SEQ ID NO: 521850 - DNA, 25 bp, Mus musculus
actgactgacctccggagccactga

SEQ ID NO: 521851 - DNA, 25 bp, Mus musculus
actgactgacctgcggagccactga

SEQ ID NO: 521852 - DNA, 25 bp, Mus musculus
actgactgaggcctataagtgcctg

SEQ ID NO: 521853 - DNA, 25 bp, Mus musculus
actgactgaggcgtataagtgcctg

SEQ ID NO: 521854 - DNA, 25 bp, Mus musculus
actgactgattacagagggatcccc

SEQ ID NO: 521855 - DNA, 25 bp, Mus musculus
actgactgattagagagggatcccc

SEQ ID NO: 521856 - DNA, 25 bp, Mus musculus
actgactggactctggctgttggca

SEQ ID NO: 521857 - DNA, 25 bp, Mus musculus
actgactggactgtggctgttggca

SEQ ID NO: 521858 - DNA, 25 bp, Mus musculus
actgacttcgagcagttctttctga

SEQ ID NO: 521859 - DNA, 25 bp, Mus musculus
actgacttcgaggagttctttctga

SEQ ID NO: 521860 - DNA, 25 bp, Mus musculus
actgagaaaacccatagttaaagct

SEQ ID NO: 521861 - DNA, 25 bp, Mus musculus
actgagaaaaccgatagttaaagct

SEQ ID NO: 521862 - DNA, 25 bp, Mus musculus
actgagaaacggaaccgcgagcagg

SEQ ID NO: 521863 - DNA, 25 bp, Mus musculus
actgagaaacggtaccgcgagcagg

SEQ ID NO: 521864 - DNA, 25 bp, Mus musculus
actgagaagaggacgctcccgggaa

SEQ ID NO: 521865 - DNA, 25 bp, Mus musculus
actgagaagaggtcgctcccgggaa

SEQ ID NO: 521866 - DNA, 25 bp, Mus musculus
actgagaagatcagtgctgaagcac

SEQ ID NO: 521867 - DNA, 25 bp, Mus musculus
actgagaagatctgtgctgaagcac

SEQ ID NO: 521868 - DNA, 25 bp, Mus musculus
actgagaagcaactgtatgacgcgc

SEQ ID NO: 521869 - DNA, 25 bp, Mus musculus
actgagaagcaagtgtatgacgcgc

SEQ ID NO: 521870 - DNA, 25 bp, Mus musculus
actgagaccaggataccgggagagt

SEQ ID NO: 521871 - DNA, 25 bp, Mus musculus
actgagaccaggttaccgggagagt

SEQ ID NO: 521872 - DNA, 25 bp, Mus musculus
actgagactctacggcgctgccgga

SEQ ID NO: 521873 - DNA, 25 bp, Mus musculus
actgagactctagggcgctgccgga

SEQ ID NO: 521874 - DNA, 25 bp, Mus musculus
actgagagaggcctttccaggaagc

SEQ ID NO: 521875 - DNA, 25 bp, Mus musculus
actgagagaggcgtttccaggaagc

SEQ ID NO: 521876 - DNA, 25 bp, Mus musculus
actgagagctgcctttcctgcaggg

SEQ ID NO: 521877 - DNA, 25 bp, Mus musculus
actgagagctgcgtttcctgcaggg

SEQ ID NO: 521878 - DNA, 25 bp, Mus musculus
actgagaggccccagtttctcaacc

SEQ ID NO: 521879 - DNA, 25 bp, Mus musculus
actgagaggcccgagtttctcaacc

SEQ ID NO: 521880 - DNA, 25 bp, Mus musculus
actgagatagagaaaggctccagct

SEQ ID NO: 521881 - DNA, 25 bp, Mus musculus
actgagatagagtaaggctccagct

SEQ ID NO: 521882 - DNA, 25 bp, Mus musculus
actgagatcggaaaccgcctcgggc

SEQ ID NO: 521883 - DNA, 25 bp, Mus musculus
actgagatcggataccgcctcgggc

SEQ ID NO: 521884 - DNA, 25 bp, Mus musculus
actgagcaatctcatacctaaggag

SEQ ID NO: 521885 - DNA, 25 bp, Mus musculus
actgagcaatctgatacctaaggag

SEQ ID NO: 521886 - DNA, 25 bp, Mus musculus
actgagcaggacatcctccgaacca

SEQ ID NO: 521887 - DNA, 25 bp, Mus musculus
actgagcaggacttcctccgaacca

SEQ ID NO: 521888 - DNA, 25 bp, Mus musculus
actgagcagtctcggaacccaggaa

SEQ ID NO: 521889 - DNA, 25 bp, Mus musculus
actgagcagtctgggaacccaggaa

SEQ ID NO: 521890 - DNA, 25 bp, Mus musculus
actgagccattaacctctggcactg

SEQ ID NO: 521891 - DNA, 25 bp, Mus musculus
actgagccattatcctctggcactg

SEQ ID NO: 521892 - DNA, 25 bp, Mus musculus
actgagcccagcatcctacggtcag

SEQ ID NO: 521893 - DNA, 25 bp, Mus musculus
actgagcccagcttcctacggtcag

SEQ ID NO: 521894 - DNA, 25 bp, Mus musculus
actgagccctcacatgtaagtacag

SEQ ID NO: 521895 - DNA, 25 bp, Mus musculus
actgagccctcagatgtaagtacag

SEQ ID NO: 521896 - DNA, 25 bp, Mus musculus
actgagccctcgatctgtggcaggg

SEQ ID NO: 521897 - DNA, 25 bp, Mus musculus
actgagccctcgttctgtggcaggg

SEQ ID NO: 521898 - DNA, 25 bp, Mus musculus
actgagcgaggccaggtaactaact

SEQ ID NO: 521899 - DNA, 25 bp, Mus musculus
actgagcgaggcgaggtaactaact

SEQ ID NO: 521900 - DNA, 25 bp, Mus musculus
actgagcgggagacacccctacttc

SEQ ID NO: 521901 - DNA, 25 bp, Mus musculus
actgagcgggagtcacccctacttc

SEQ ID NO: 521902 - DNA, 25 bp, Mus musculus
actgagctagtaagagtgtcacaaa

SEQ ID NO: 521903 - DNA, 25 bp, Mus musculus
actgagctagtatgagtgtcacaaa

SEQ ID NO: 521904 - DNA, 25 bp, Mus musculus
actgagctgaggacctagatgtggt

SEQ ID NO: 521905 - DNA, 25 bp, Mus musculus
actgagctgaggtcctagatgtggt

SEQ ID NO: 521906 - DNA, 25 bp, Mus musculus
actgagctggctcatccatcatggc

SEQ ID NO: 521907 - DNA, 25 bp, Mus musculus
actgagctggctgatccatcatggc

SEQ ID NO: 521908 - DNA, 25 bp, Mus musculus
actgagctgtgaaactggacgcggt

SEQ ID NO: 521909 - DNA, 25 bp, Mus musculus
actgagctgtgatactggacgcggt

SEQ ID NO: 521910 - DNA, 25 bp, Mus musculus
actgaggagtcaacacccagcctgg

SEQ ID NO: 521911 - DNA, 25 bp, Mus musculus
actgaggagtcatcacccagcctgg

SEQ ID NO: 521912 - DNA, 25 bp, Mus musculus
actgaggcaaatcacttctgagctg

SEQ ID NO: 521913 - DNA, 25 bp, Mus musculus
actgaggcaaatgacttctgagctg

SEQ ID NO: 521914 - DNA, 25 bp, Mus musculus
actgaggctcctagaggagcttgaa

SEQ ID NO: 521915 - DNA, 25 bp, Mus musculus
actgaggctccttgaggagcttgaa

SEQ ID NO: 521916 - DNA, 25 bp, Mus musculus
actgagggagctatgccgtatagtg

SEQ ID NO: 521917 - DNA, 25 bp, Mus musculus
actgagggagctttgccgtatagtg

SEQ ID NO: 521918 - DNA, 25 bp, Mus musculus
actgagggcccacagactgaccttg

SEQ ID NO: 521919 - DNA, 25 bp, Mus musculus
actgagggcccagagactgaccttg

SEQ ID NO: 521920 - DNA, 25 bp, Mus musculus
actgaggtgggcagctctaacatcg

SEQ ID NO: 521921 - DNA, 25 bp, Mus musculus
actgaggtgggctgctctaacatcg

SEQ ID NO: 521922 - DNA, 25 bp, Mus musculus
actgagtcccggagtgaacagagac

SEQ ID NO: 521923 - DNA, 25 bp, Mus musculus
actgagtcccggtgtgaacagagac

SEQ ID NO: 521924 - DNA, 25 bp, Mus musculus
actgagtggacccaagaagaagcca

SEQ ID NO: 521925 - DNA, 25 bp, Mus musculus
actgagtggaccgaagaagaagcca

SEQ ID NO: 521926 - DNA, 25 bp, Mus musculus
actgagttatgtagtctatggagcc

SEQ ID NO: 521927 - DNA, 25 bp, Mus musculus
actgagttatgttgtctatggagcc

SEQ ID NO: 521928 - DNA, 25 bp, Mus musculus
actgagttctctagagtgcttggcc

SEQ ID NO: 521929 - DNA, 25 bp, Mus musculus
actgagttctcttgagtgcttggcc

SEQ ID NO: 521930 - DNA, 25 bp, Mus musculus
actgagtttacaaggagataccaaa

SEQ ID NO: 521931 - DNA, 25 bp, Mus musculus
actgagtttacatggagataccaaa

SEQ ID NO: 521932 - DNA, 25 bp, Mus musculus
actgagtttggaagcctctgggcag

SEQ ID NO: 521933 - DNA, 25 bp, Mus musculus
actgagtttggatgcctctgggcag

SEQ ID NO: 521934 - DNA, 25 bp, Mus musculus
actgataagtggaatggagaatctc

SEQ ID NO: 521935 - DNA, 25 bp, Mus musculus
actgataagtggtatggagaatctc

SEQ ID NO: 521936 - DNA, 25 bp, Mus musculus
actgataggcgtacaagagcccacg

SEQ ID NO: 521937 - DNA, 25 bp, Mus musculus
actgataggcgttcaagagcccacg

SEQ ID NO: 521938 - DNA, 25 bp, Mus musculus
actgatcaccaacttcctagtcttg

SEQ ID NO: 521939 - DNA, 25 bp, Mus musculus
actgatcaccaagttcctagtcttg

SEQ ID NO: 521940 - DNA, 25 bp, Mus musculus
actgatcccaaacatagagtacctg

SEQ ID NO: 521941 - DNA, 25 bp, Mus musculus
actgatcccaaagatagagtacctg

SEQ ID NO: 521942 - DNA, 25 bp, Mus musculus
actgatccccgtcctcagggcagtt

SEQ ID NO: 521943 - DNA, 25 bp, Mus musculus
actgatccccgtgctcagggcagtt

SEQ ID NO: 521944 - DNA, 25 bp, Mus musculus
actgatccctgcagtgaccatttca

SEQ ID NO: 521945 - DNA, 25 bp, Mus musculus
actgatccctgctgtgaccatttca

SEQ ID NO: 521946 - DNA, 25 bp, Mus musculus
actgatcgctccattcggtcctgag

SEQ ID NO: 521947 - DNA, 25 bp, Mus musculus
actgatcgctcctttcggtcctgag

SEQ ID NO: 521948 - DNA, 25 bp, Mus musculus
actgatgaaagtaccgtctcttctg

SEQ ID NO: 521949 - DNA, 25 bp, Mus musculus
actgatgaaagttccgtctcttctg

SEQ ID NO: 521950 - DNA, 25 bp, Mus musculus
actgatgagattatcccaaatactg

SEQ ID NO: 521951 - DNA, 25 bp, Mus musculus
actgatgagattttcccaaatactg

SEQ ID NO: 521952 - DNA, 25 bp, Mus musculus
actgatgagcccacagacggcagga

SEQ ID NO: 521953 - DNA, 25 bp, Mus musculus
actgatgagccctcagacggcagga

SEQ ID NO: 521954 - DNA, 25 bp, Mus musculus
actgatgattaccttctgggagaag

SEQ ID NO: 521955 - DNA, 25 bp, Mus musculus
actgatgattacgttctgggagaag

SEQ ID NO: 521956 - DNA, 25 bp, Mus musculus
actgatgctaatcagcagtgtgttg

SEQ ID NO: 521957 - DNA, 25 bp, Mus musculus
actgatgctaatgagcagtgtgttg

SEQ ID NO: 521958 - DNA, 25 bp, Mus musculus
actgatgctccacctgcatattcag

SEQ ID NO: 521959 - DNA, 25 bp, Mus musculus
actgatgctccagctgcatattcag

SEQ ID NO: 521960 - DNA, 25 bp, Mus musculus
actgatgctgctctgatgtatgatg

SEQ ID NO: 521961 - DNA, 25 bp, Mus musculus
actgatgctgctgtgatgtatgatg

SEQ ID NO: 521962 - DNA, 25 bp, Mus musculus
actgatgctgtcatccgggagcggc

SEQ ID NO: 521963 - DNA, 25 bp, Mus musculus
actgatgctgtcttccgggagcggc

SEQ ID NO: 521964 - DNA, 25 bp, Mus musculus
actgatggcaagaaggtttactacc

SEQ ID NO: 521965 - DNA, 25 bp, Mus musculus
actgatggcaagtaggtttactacc

SEQ ID NO: 521966 - DNA, 25 bp, Mus musculus
actgatggctctccgcgagcgcaat

SEQ ID NO: 521967 - DNA, 25 bp, Mus musculus
actgatggctctgcgcgagcgcaat

SEQ ID NO: 521968 - DNA, 25 bp, Mus musculus
actgatgggcgtaggtgacatgatc

SEQ ID NO: 521969 - DNA, 25 bp, Mus musculus
actgatgggcgttggtgacatgatc

SEQ ID NO: 521970 - DNA, 25 bp, Mus musculus
actgatgtgttcctgttcctgtggg

SEQ ID NO: 521971 - DNA, 25 bp, Mus musculus
actgatgtgttcgtgttcctgtggg

SEQ ID NO: 521972 - DNA, 25 bp, Mus musculus
actgattcagaaaatggatgcctct

SEQ ID NO: 521973 - DNA, 25 bp, Mus musculus
actgattcagaatatggatgcctct

SEQ ID NO: 521974 - DNA, 25 bp, Mus musculus
actgattctcagagcggccccgagt

SEQ ID NO: 521975 - DNA, 25 bp, Mus musculus
actgattctcagtgcggccccgagt

SEQ ID NO: 521976 - DNA, 25 bp, Mus musculus
actgattctgcacgatgccgagagt

SEQ ID NO: 521977 - DNA, 25 bp, Mus musculus
actgattctgcaggatgccgagagt

SEQ ID NO: 521978 - DNA, 25 bp, Mus musculus
actgattgataaagaggactcctcc

SEQ ID NO: 521979 - DNA, 25 bp, Mus musculus
actgattgataatgaggactcctcc

SEQ ID NO: 521980 - DNA, 25 bp, Mus musculus
actgattggcaaccagggacggtac

SEQ ID NO: 521981 - DNA, 25 bp, Mus musculus
actgattggcaagcagggacggtac

SEQ ID NO: 521982 - DNA, 25 bp, Mus musculus
actgcaacgcagaggcctccaagcg

SEQ ID NO: 521983 - DNA, 25 bp, Mus musculus
actgcaacgcagtggcctccaagcg

SEQ ID NO: 521984 - DNA, 25 bp, Mus musculus
actgcaagaagtagaaaaacgacaa

SEQ ID NO: 521985 - DNA, 25 bp, Mus musculus
actgcaagaagttgaaaaacgacaa

SEQ ID NO: 521986 - DNA, 25 bp, Mus musculus
actgcaagaggcagttcatggagaa

SEQ ID NO: 521987 - DNA, 25 bp, Mus musculus
actgcaagaggctgttcatggagaa

SEQ ID NO: 521988 - DNA, 25 bp, Mus musculus
actgcaagccacagcgggctcagca

SEQ ID NO: 521989 - DNA, 25 bp, Mus musculus
actgcaagccactgcgggctcagca

SEQ ID NO: 521990 - DNA, 25 bp, Mus musculus
actgcaagcctcacatatattctac

SEQ ID NO: 521991 - DNA, 25 bp, Mus musculus
actgcaagcctctcatatattctac

SEQ ID NO: 521992 - DNA, 25 bp, Mus musculus
actgcaaggcaaagctgggcgagct

SEQ ID NO: 521993 - DNA, 25 bp, Mus musculus
actgcaaggcaatgctgggcgagct

SEQ ID NO: 521994 - DNA, 25 bp, Mus musculus
actgcaaggtgtactaagggtataa

SEQ ID NO: 521995 - DNA, 25 bp, Mus musculus
actgcaaggtgttctaagggtataa

SEQ ID NO: 521996 - DNA, 25 bp, Mus musculus
actgcaagtggtccccttagggtgc

SEQ ID NO: 521997 - DNA, 25 bp, Mus musculus
actgcaagtggtgcccttagggtgc

SEQ ID NO: 521998 - DNA, 25 bp, Mus musculus
actgcaatcaaacggctaaatgaca

SEQ ID NO: 521999 - DNA, 25 bp, Mus musculus
actgcaatcaaagggctaaatgaca

SEQ ID NO: 522000 - DNA, 25 bp, Mus musculus
actgcaatgacgcagacatttgtgc

SEQ ID NO: 522001 - DNA, 25 bp, Mus musculus
actgcaatgacggagacatttgtgc

SEQ ID NO: 522002 - DNA, 25 bp, Mus musculus
actgcacaggacagatccatatgga

SEQ ID NO: 522003 - DNA, 25 bp, Mus musculus
actgcacaggactgatccatatgga

SEQ ID NO: 522004 - DNA, 25 bp, Mus musculus
actgcaccaacactgggtacaagcc

SEQ ID NO: 522005 - DNA, 25 bp, Mus musculus
actgcaccaacagtgggtacaagcc

SEQ ID NO: 522006 - DNA, 25 bp, Mus musculus
actgcaccgcagcagcatgccggtg

SEQ ID NO: 522007 - DNA, 25 bp, Mus musculus
actgcaccgcaggagcatgccggtg

SEQ ID NO: 522008 - DNA, 25 bp, Mus musculus
actgcacctgatcaagtggataagg

SEQ ID NO: 522009 - DNA, 25 bp, Mus musculus
actgcacctgatgaagtggataagg

SEQ ID NO: 522010 - DNA, 25 bp, Mus musculus
actgcacggacgaggacaggatcgt

SEQ ID NO: 522011 - DNA, 25 bp, Mus musculus
actgcacggacgtggacaggatcgt

SEQ ID NO: 522012 - DNA, 25 bp, Mus musculus
actgcactacgccttccagacggat

SEQ ID NO: 522013 - DNA, 25 bp, Mus musculus
actgcactacgcgttccagacggat

SEQ ID NO: 522014 - DNA, 25 bp, Mus musculus
actgcactctagaagcccttgaacc

SEQ ID NO: 522015 - DNA, 25 bp, Mus musculus
actgcactctagtagcccttgaacc

SEQ ID NO: 522016 - DNA, 25 bp, Mus musculus
actgcactcttccactgtaccagtg

SEQ ID NO: 522017 - DNA, 25 bp, Mus musculus
actgcactcttcgactgtaccagtg

SEQ ID NO: 522018 - DNA, 25 bp, Mus musculus
actgcactgcacagggccgctgctg

SEQ ID NO: 522019 - DNA, 25 bp, Mus musculus
actgcactgcactgggccgctgctg

SEQ ID NO: 522020 - DNA, 25 bp, Mus musculus
actgcagaaggaatttaaacgccac

SEQ ID NO: 522021 - DNA, 25 bp, Mus musculus
actgcagaaggattttaaacgccac

SEQ ID NO: 522022 - DNA, 25 bp, Mus musculus
actgcagaagggacagatgacaggt

SEQ ID NO: 522023 - DNA, 25 bp, Mus musculus
actgcagaagggtcagatgacaggt

SEQ ID NO: 522024 - DNA, 25 bp, Mus musculus
actgcagaagtgatgccaataatgg

SEQ ID NO: 522025 - DNA, 25 bp, Mus musculus
actgcagaagtgttgccaataatgg

SEQ ID NO: 522026 - DNA, 25 bp, Mus musculus
actgcagagccaagagaagcccttg

SEQ ID NO: 522027 - DNA, 25 bp, Mus musculus
actgcagagccatgagaagcccttg

SEQ ID NO: 522028 - DNA, 25 bp, Mus musculus
actgcagaggcaacacaccctgttg

SEQ ID NO: 522029 - DNA, 25 bp, Mus musculus
actgcagaggcatcacaccctgttg

SEQ ID NO: 522030 - DNA, 25 bp, Mus musculus
actgcagatcttcgactggacattg

SEQ ID NO: 522031 - DNA, 25 bp, Mus musculus
actgcagatcttggactggacattg

SEQ ID NO: 522032 - DNA, 25 bp, Mus musculus
actgcagcatgcagtccgtcctcat

SEQ ID NO: 522033 - DNA, 25 bp, Mus musculus
actgcagcatgctgtccgtcctcat

SEQ ID NO: 522034 - DNA, 25 bp, Mus musculus
actgcagccaggcacaggctctcta

SEQ ID NO: 522035 - DNA, 25 bp, Mus musculus
actgcagccagggacaggctctcta

SEQ ID NO: 522036 - DNA, 25 bp, Mus musculus
actgcagcgctgaggaagtcaagag

SEQ ID NO: 522037 - DNA, 25 bp, Mus musculus
actgcagcgctgtggaagtcaagag

SEQ ID NO: 522038 - DNA, 25 bp, Mus musculus
actgcagctcatcgcggagttcctg

SEQ ID NO: 522039 - DNA, 25 bp, Mus musculus
actgcagctcatggcggagttcctg

SEQ ID NO: 522040 - DNA, 25 bp, Mus musculus
actgcagctttccacagtggtggca

SEQ ID NO: 522041 - DNA, 25 bp, Mus musculus
actgcagctttcgacagtggtggca

SEQ ID NO: 522042 - DNA, 25 bp, Mus musculus
actgcaggcctgatcacccgcaagg

SEQ ID NO: 522043 - DNA, 25 bp, Mus musculus
actgcaggcctgttcacccgcaagg

SEQ ID NO: 522044 - DNA, 25 bp, Mus musculus
actgcagggttgagtccctagcaaa

SEQ ID NO: 522045 - DNA, 25 bp, Mus musculus
actgcagggttgtgtccctagcaaa

SEQ ID NO: 522046 - DNA, 25 bp, Mus musculus
actgcagtacctatggccctggagc

SEQ ID NO: 522047 - DNA, 25 bp, Mus musculus
actgcagtacctttggccctggagc

SEQ ID NO: 522048 - DNA, 25 bp, Mus musculus
actgcagttcatcttgagccatctt

SEQ ID NO: 522049 - DNA, 25 bp, Mus musculus
actgcagttcatgttgagccatctt

SEQ ID NO: 522050 - DNA, 25 bp, Mus musculus
actgcataatggcacgaaagccttc

SEQ ID NO: 522051 - DNA, 25 bp, Mus musculus
actgcataatgggacgaaagccttc

SEQ ID NO: 522052 - DNA, 25 bp, Mus musculus
actgcatgaacgcaagtgtgagccc

SEQ ID NO: 522053 - DNA, 25 bp, Mus musculus
actgcatgaacggaagtgtgagccc

SEQ ID NO: 522054 - DNA, 25 bp, Mus musculus
actgcatgcgcaccatgggctacat

SEQ ID NO: 522055 - DNA, 25 bp, Mus musculus
actgcatgcgcagcatgggctacat

SEQ ID NO: 522056 - DNA, 25 bp, Mus musculus
actgcatgcgccagaagacggagga

SEQ ID NO: 522057 - DNA, 25 bp, Mus musculus
actgcatgcgcctgaagacggagga

SEQ ID NO: 522058 - DNA, 25 bp, Mus musculus
actgcatgcggaagcgtgccgagca

SEQ ID NO: 522059 - DNA, 25 bp, Mus musculus
actgcatgcggatgcgtgccgagca

SEQ ID NO: 522060 - DNA, 25 bp, Mus musculus
actgcatggacactccttggtggtg

SEQ ID NO: 522061 - DNA, 25 bp, Mus musculus
actgcatggacagtccttggtggtg

SEQ ID NO: 522062 - DNA, 25 bp, Mus musculus
actgcattctgtacccaccctggga

SEQ ID NO: 522063 - DNA, 25 bp, Mus musculus
actgcattctgttcccaccctggga

SEQ ID NO: 522064 - DNA, 25 bp, Mus musculus
actgccaagattactgacttcagct

SEQ ID NO: 522065 - DNA, 25 bp, Mus musculus
actgccaagatttctgacttcagct

SEQ ID NO: 522066 - DNA, 25 bp, Mus musculus
actgccaaggagctcaatgtcagct

SEQ ID NO: 522067 - DNA, 25 bp, Mus musculus
actgccaaggaggtcaatgtcagct

SEQ ID NO: 522068 - DNA, 25 bp, Mus musculus
actgccacaggaattgcttctctgc

SEQ ID NO: 522069 - DNA, 25 bp, Mus musculus
actgccacaggatttgcttctctgc

SEQ ID NO: 522070 - DNA, 25 bp, Mus musculus
actgccacccaaagatcatagatgc

SEQ ID NO: 522071 - DNA, 25 bp, Mus musculus
actgccacccaatgatcatagatgc

SEQ ID NO: 522072 - DNA, 25 bp, Mus musculus
actgccactggcctgcggtgcagct

SEQ ID NO: 522073 - DNA, 25 bp, Mus musculus
actgccactggcgtgcggtgcagct

SEQ ID NO: 522074 - DNA, 25 bp, Mus musculus
actgccacttggagtctcgcggccg

SEQ ID NO: 522075 - DNA, 25 bp, Mus musculus
actgccacttggtgtctcgcggccg

SEQ ID NO: 522076 - DNA, 25 bp, Mus musculus
actgccagctcaacgctcacaagga

SEQ ID NO: 522077 - DNA, 25 bp, Mus musculus
actgccagctcaccgagggacagtg

SEQ ID NO: 522078 - DNA, 25 bp, Mus musculus
actgccagctcagcgagggacagtg

SEQ ID NO: 522079 - DNA, 25 bp, Mus musculus
actgccagctcatcgctcacaagga

SEQ ID NO: 522080 - DNA, 25 bp, Mus musculus
actgccatcaccagtcacgaacggg

SEQ ID NO: 522081 - DNA, 25 bp, Mus musculus
actgccatcacctgtcacgaacggg

SEQ ID NO: 522082 - DNA, 25 bp, Mus musculus
actgcccaggtgacaagatgagacc

SEQ ID NO: 522083 - DNA, 25 bp, Mus musculus
actgcccaggtgtcaagatgagacc

SEQ ID NO: 522084 - DNA, 25 bp, Mus musculus
actgcccgatatctggacctgttca

SEQ ID NO: 522085 - DNA, 25 bp, Mus musculus
actgcccgatatgtggacctgttca

SEQ ID NO: 522086 - DNA, 25 bp, Mus musculus
actgccctgcggcaacttctgtgca

SEQ ID NO: 522087 - DNA, 25 bp, Mus musculus
actgccctgcgggaacttctgtgca

SEQ ID NO: 522088 - DNA, 25 bp, Mus musculus
actgccctggctcagatgaggctgt

SEQ ID NO: 522089 - DNA, 25 bp, Mus musculus
actgccctggctgagatgaggctgt

SEQ ID NO: 522090 - DNA, 25 bp, Mus musculus
actgcccttaccactgccgggtgga

SEQ ID NO: 522091 - DNA, 25 bp, Mus musculus
actgcccttacctctgccgggtgga

SEQ ID NO: 522092 - DNA, 25 bp, Mus musculus
actgccgaggacatcgtaggcgctg

SEQ ID NO: 522093 - DNA, 25 bp, Mus musculus
actgccgaggacttcgtaggcgctg

SEQ ID NO: 522094 - DNA, 25 bp, Mus musculus
actgccggccacatttcactatctt

SEQ ID NO: 522095 - DNA, 25 bp, Mus musculus
actgccggccacttttcactatctt

SEQ ID NO: 522096 - DNA, 25 bp, Mus musculus
actgccggtgtgctgaggaggatga

SEQ ID NO: 522097 - DNA, 25 bp, Mus musculus
actgccggtgtggtgaggaggatga

SEQ ID NO: 522098 - DNA, 25 bp, Mus musculus
actgccgtggaccactgtgtgtctg

SEQ ID NO: 522099 - DNA, 25 bp, Mus musculus
actgccgtggacgactgtgtgtctg

SEQ ID NO: 522100 - DNA, 25 bp, Mus musculus
actgcctacagacagacggcaacca

SEQ ID NO: 522101 - DNA, 25 bp, Mus musculus
actgcctacagagagacggcaacca

SEQ ID NO: 522102 - DNA, 25 bp, Mus musculus
actgcctactcgctcagacatgata

SEQ ID NO: 522103 - DNA, 25 bp, Mus musculus
actgcctactcggtcagacatgata

SEQ ID NO: 522104 - DNA, 25 bp, Mus musculus
actgcctagctgaaggccacgcctt

SEQ ID NO: 522105 - DNA, 25 bp, Mus musculus
actgcctagctgtaggccacgcctt

SEQ ID NO: 522106 - DNA, 25 bp, Mus musculus
actgcctatgctatgtaccttaggc

SEQ ID NO: 522107 - DNA, 25 bp, Mus musculus
actgcctatgctttgtaccttaggc

SEQ ID NO: 522108 - DNA, 25 bp, Mus musculus
actgcctcaactctgacgtggtgga

SEQ ID NO: 522109 - DNA, 25 bp, Mus musculus
actgcctcaactgtgacgtggtgga

SEQ ID NO: 522110 - DNA, 25 bp, Mus musculus
actgcctccgcacgatctgtgtgag

SEQ ID NO: 522111 - DNA, 25 bp, Mus musculus
actgcctccgcaggatctgtgtgag

SEQ ID NO: 522112 - DNA, 25 bp, Mus musculus
actgcctcgtcaagtatgtcatcct

SEQ ID NO: 522113 - DNA, 25 bp, Mus musculus
actgcctcgtcatgtatgtcatcct

SEQ ID NO: 522114 - DNA, 25 bp, Mus musculus
actgcctctgagctccttcggcttt

SEQ ID NO: 522115 - DNA, 25 bp, Mus musculus
actgcctctgaggtccttcggcttt

SEQ ID NO: 522116 - DNA, 25 bp, Mus musculus
actgcctgacctaccgacggatcta

SEQ ID NO: 522117 - DNA, 25 bp, Mus musculus
actgcctgaccttccgacggatcta

SEQ ID NO: 522118 - DNA, 25 bp, Mus musculus
actgcctgcgacatctggaggaggc

SEQ ID NO: 522119 - DNA, 25 bp, Mus musculus
actgcctgcgacttctggaggaggc

SEQ ID NO: 522120 - DNA, 25 bp, Mus musculus
actgcctgctcgaggaatacctctg

SEQ ID NO: 522121 - DNA, 25 bp, Mus musculus
actgcctgctcgtggaatacctctg

SEQ ID NO: 522122 - DNA, 25 bp, Mus musculus
actgccttacgactgtgcggtggac

SEQ ID NO: 522123 - DNA, 25 bp, Mus musculus
actgccttacgagtgtgcggtggac

SEQ ID NO: 522124 - DNA, 25 bp, Mus musculus
actgccttacttagtgctcatcatc

SEQ ID NO: 522125 - DNA, 25 bp, Mus musculus
actgccttactttgtgctcatcatc

SEQ ID NO: 522126 - DNA, 25 bp, Mus musculus
actgccttctccagtcaggccggga

SEQ ID NO: 522127 - DNA, 25 bp, Mus musculus
actgccttctcctgtcaggccggga

SEQ ID NO: 522128 - DNA, 25 bp, Mus musculus
actgccttgcggcagctcacagaga

SEQ ID NO: 522129 - DNA, 25 bp, Mus musculus
actgccttgcgggagctcacagaga

SEQ ID NO: 522130 - DNA, 25 bp, Mus musculus
actgccttggcactacaaagccctg

SEQ ID NO: 522131 - DNA, 25 bp, Mus musculus
actgccttggcagtacaaagccctg

SEQ ID NO: 522132 - DNA, 25 bp, Mus musculus
actgcgaaggaacacgcttcacaga

SEQ ID NO: 522133 - DNA, 25 bp, Mus musculus
actgcgaaggaagacgcttcacaga

SEQ ID NO: 522134 - DNA, 25 bp, Mus musculus
actgcgaattctacgggagccgaaa

SEQ ID NO: 522135 - DNA, 25 bp, Mus musculus
actgcgaattcttcgggagccgaaa

SEQ ID NO: 522136 - DNA, 25 bp, Mus musculus
actgcgacacctccgtacgcgggag

SEQ ID NO: 522137 - DNA, 25 bp, Mus musculus
actgcgacacctgcgtacgcgggag

SEQ ID NO: 522138 - DNA, 25 bp, Mus musculus
actgcgaccatgcacggacctgatg

SEQ ID NO: 522139 - DNA, 25 bp, Mus musculus
actgcgaccatggacggacctgatg

SEQ ID NO: 522140 - DNA, 25 bp, Mus musculus
actgcgactggcagcgactttggag

SEQ ID NO: 522141 - DNA, 25 bp, Mus musculus
actgcgactggctgcgactttggag

SEQ ID NO: 522142 - DNA, 25 bp, Mus musculus
actgcgagccatcgcccgaaagatc

SEQ ID NO: 522143 - DNA, 25 bp, Mus musculus
actgcgagccatggcccgaaagatc

SEQ ID NO: 522144 - DNA, 25 bp, Mus musculus
actgcgaggttccactcgagcgcag

SEQ ID NO: 522145 - DNA, 25 bp, Mus musculus
actgcgaggttcgactcgagcgcag

SEQ ID NO: 522146 - DNA, 25 bp, Mus musculus
actgcgagtgctacggccactccaa

SEQ ID NO: 522147 - DNA, 25 bp, Mus musculus
actgcgagtgcttcggccactccaa

SEQ ID NO: 522148 - DNA, 25 bp, Mus musculus
actgcgagttccctctgctgtgtga

SEQ ID NO: 522149 - DNA, 25 bp, Mus musculus
actgcgagttccgtctgctgtgtga

SEQ ID NO: 522150 - DNA, 25 bp, Mus musculus
actgcgagttgtcgataacctgcag

SEQ ID NO: 522151 - DNA, 25 bp, Mus musculus
actgcgagttgtggataacctgcag

SEQ ID NO: 522152 - DNA, 25 bp, Mus musculus
actgcgatggctattccacctttga

SEQ ID NO: 522153 - DNA, 25 bp, Mus musculus
actgcgatggcttttccacctttga

SEQ ID NO: 522154 - DNA, 25 bp, Mus musculus
actgcgcaccggctcaggagaccag

SEQ ID NO: 522155 - DNA, 25 bp, Mus musculus
actgcgcaccgggtcaggagaccag

SEQ ID NO: 522156 - DNA, 25 bp, Mus musculus
actgcgcagaccagaaggctacttc

SEQ ID NO: 522157 - DNA, 25 bp, Mus musculus
actgcgcagacctgaaggctacttc

SEQ ID NO: 522158 - DNA, 25 bp, Mus musculus
actgcgcaggtaacgctctgggctc

SEQ ID NO: 522159 - DNA, 25 bp, Mus musculus
actgcgcaggtatcgctctgggctc

SEQ ID NO: 522160 - DNA, 25 bp, Mus musculus
actgcgccgtcaacgggctcctggt

SEQ ID NO: 522161 - DNA, 25 bp, Mus musculus
actgcgccgtcatcgggctcctggt

SEQ ID NO: 522162 - DNA, 25 bp, Mus musculus
actgcggagtgtcatgaatacttcc

SEQ ID NO: 522163 - DNA, 25 bp, Mus musculus
actgcggagtgtgatgaatacttcc

SEQ ID NO: 522164 - DNA, 25 bp, Mus musculus
actgcggatactataaatttatgac

SEQ ID NO: 522165 - DNA, 25 bp, Mus musculus
actgcggatactttaaatttatgac

SEQ ID NO: 522166 - DNA, 25 bp, Mus musculus
actgcggcacgtccttagggatttt

SEQ ID NO: 522167 - DNA, 25 bp, Mus musculus
actgcggcacgtgcttagggatttt

SEQ ID NO: 522168 - DNA, 25 bp, Mus musculus
actgcggccctgagcttactgctgc

SEQ ID NO: 522169 - DNA, 25 bp, Mus musculus
actgcggccctgtgcttactgctgc

SEQ ID NO: 522170 - DNA, 25 bp, Mus musculus
actgcgggcagccaaagaagaagca

SEQ ID NO: 522171 - DNA, 25 bp, Mus musculus
actgcgggcagcgaaagaagaagca

SEQ ID NO: 522172 - DNA, 25 bp, Mus musculus
actgcgggccagcaggaatatgacc

SEQ ID NO: 522173 - DNA, 25 bp, Mus musculus
actgcgggccaggaggaatatgacc

SEQ ID NO: 522174 - DNA, 25 bp, Mus musculus
actgcgtgacggagcccaattcggg

SEQ ID NO: 522175 - DNA, 25 bp, Mus musculus
actgcgtgacggtgcccaattcggg

SEQ ID NO: 522176 - DNA, 25 bp, Mus musculus
actgcgtgagctccgacaaagaaag

SEQ ID NO: 522177 - DNA, 25 bp, Mus musculus
actgcgtgagctgcgacaaagaaag

SEQ ID NO: 522178 - DNA, 25 bp, Mus musculus
actgcgtgatggacatgtacatgcg

SEQ ID NO: 522179 - DNA, 25 bp, Mus musculus
actgcgtgatggtcatgtacatgcg

SEQ ID NO: 522180 - DNA, 25 bp, Mus musculus
actgcgtgcgctcggaagatctcca

SEQ ID NO: 522181 - DNA, 25 bp, Mus musculus
actgcgtgcgctgggaagatctcca

SEQ ID NO: 522182 - DNA, 25 bp, Mus musculus
actgctaaaatcctggagtcctcca

SEQ ID NO: 522183 - DNA, 25 bp, Mus musculus
actgctaaaatcgtggagtcctcca

SEQ ID NO: 522184 - DNA, 25 bp, Mus musculus
actgctaagagcagagacagcatga

SEQ ID NO: 522185 - DNA, 25 bp, Mus musculus
actgctaagagctgagacagcatga

SEQ ID NO: 522186 - DNA, 25 bp, Mus musculus
actgctagagtcaggcacactgggc

SEQ ID NO: 522187 - DNA, 25 bp, Mus musculus
actgctagagtctggcacactgggc

SEQ ID NO: 522188 - DNA, 25 bp, Mus musculus
actgctagtggcagctctgcccgcg

SEQ ID NO: 522189 - DNA, 25 bp, Mus musculus
actgctagtggctgctctgcccgcg

SEQ ID NO: 522190 - DNA, 25 bp, Mus musculus
actgctatgttcaggcctcaggccg

SEQ ID NO: 522191 - DNA, 25 bp, Mus musculus
actgctatgttctggcctcaggccg

SEQ ID NO: 522192 - DNA, 25 bp, Mus musculus
actgctcaactcagtgttgaagggc

SEQ ID NO: 522193 - DNA, 25 bp, Mus musculus
actgctcaactctgtgttgaagggc

SEQ ID NO: 522194 - DNA, 25 bp, Mus musculus
actgctcaggttatataaaagcaac

SEQ ID NO: 522195 - DNA, 25 bp, Mus musculus
actgctcaggttttataaaagcaac

SEQ ID NO: 522196 - DNA, 25 bp, Mus musculus
actgctccagaaccgcactgggctg

SEQ ID NO: 522197 - DNA, 25 bp, Mus musculus
actgctccagaagcgcactgggctg

SEQ ID NO: 522198 - DNA, 25 bp, Mus musculus
actgctcccagcctacaggggagag

SEQ ID NO: 522199 - DNA, 25 bp, Mus musculus
actgctcccagcgtacaggggagag

SEQ ID NO: 522200 - DNA, 25 bp, Mus musculus
actgctccctcacgatgaaggtcga

SEQ ID NO: 522201 - DNA, 25 bp, Mus musculus
actgctccctcaggatgaaggtcga

SEQ ID NO: 522202 - DNA, 25 bp, Mus musculus
actgctccgcccagctgtatgtgga

SEQ ID NO: 522203 - DNA, 25 bp, Mus musculus
actgctccgccctgctgtatgtgga

SEQ ID NO: 522204 - DNA, 25 bp, Mus musculus
actgctcgatgcctccagagtgggc

SEQ ID NO: 522205 - DNA, 25 bp, Mus musculus
actgctcgatgcgtccagagtgggc

SEQ ID NO: 522206 - DNA, 25 bp, Mus musculus
actgctgaaaaaacaccatcgctaa

SEQ ID NO: 522207 - DNA, 25 bp, Mus musculus
actgctgaaaaatcaccatcgctaa

SEQ ID NO: 522208 - DNA, 25 bp, Mus musculus
actgctgaatccctttggctccctg

SEQ ID NO: 522209 - DNA, 25 bp, Mus musculus
actgctgaatccgtttggctccctg

SEQ ID NO: 522210 - DNA, 25 bp, Mus musculus
actgctgaggcgaatttgggaaaga

SEQ ID NO: 522211 - DNA, 25 bp, Mus musculus
actgctgaggcgtatttgggaaaga

SEQ ID NO: 522212 - DNA, 25 bp, Mus musculus
actgctgcacctagacctgaagcca

SEQ ID NO: 522213 - DNA, 25 bp, Mus musculus
actgctgcaccttgacctgaagcca

SEQ ID NO: 522214 - DNA, 25 bp, Mus musculus
actgctgcagccctctcagattggc

SEQ ID NO: 522215 - DNA, 25 bp, Mus musculus
actgctgcagccgtctcagattggc

SEQ ID NO: 522216 - DNA, 25 bp, Mus musculus
actgctgcagctcgcgttgggcatc

SEQ ID NO: 522217 - DNA, 25 bp, Mus musculus
actgctgcagctggcgttgggcatc

SEQ ID NO: 522218 - DNA, 25 bp, Mus musculus
actgctgcccagagacactggtcag

SEQ ID NO: 522219 - DNA, 25 bp, Mus musculus
actgctgcccagtgacactggtcag

SEQ ID NO: 522220 - DNA, 25 bp, Mus musculus
actgctgcgcatacctccgtcaggg

SEQ ID NO: 522221 - DNA, 25 bp, Mus musculus
actgctgcgcattcctccgtcaggg

SEQ ID NO: 522222 - DNA, 25 bp, Mus musculus
actgctgctttccttttgtggcttg

SEQ ID NO: 522223 - DNA, 25 bp, Mus musculus
actgctgctttcgttttgtggcttg

SEQ ID NO: 522224 - DNA, 25 bp, Mus musculus
actgctggagaaccaaggcattgac

SEQ ID NO: 522225 - DNA, 25 bp, Mus musculus
actgctggagaagcaaggcattgac

SEQ ID NO: 522226 - DNA, 25 bp, Mus musculus
actgctggagacaatctttctggac

SEQ ID NO: 522227 - DNA, 25 bp, Mus musculus
actgctggagactatctttctggac

SEQ ID NO: 522228 - DNA, 25 bp, Mus musculus
actgctggagttaataccaccgaca

SEQ ID NO: 522229 - DNA, 25 bp, Mus musculus
actgctggagtttataccaccgaca

SEQ ID NO: 522230 - DNA, 25 bp, Mus musculus
actgctggatacagaggatgagctt

SEQ ID NO: 522231 - DNA, 25 bp, Mus musculus
actgctggatactgaggatgagctt

SEQ ID NO: 522232 - DNA, 25 bp, Mus musculus
actgctggcagcatgtatatctttc

SEQ ID NO: 522233 - DNA, 25 bp, Mus musculus
actgctggcagcttgtatatctttc

SEQ ID NO: 522234 - DNA, 25 bp, Mus musculus
actgctgggaagcacggcctaagat

SEQ ID NO: 522235 - DNA, 25 bp, Mus musculus
actgctgggaaggacggcctaagat

SEQ ID NO: 522236 - DNA, 25 bp, Mus musculus
actgctgggagtagcgggtcaaccc

SEQ ID NO: 522237 - DNA, 25 bp, Mus musculus
actgctgggagttgcgggtcaaccc

SEQ ID NO: 522238 - DNA, 25 bp, Mus musculus
actgctgggctcctatcctgtggat

SEQ ID NO: 522239 - DNA, 25 bp, Mus musculus
actgctgggctcgtatcctgtggat

SEQ ID NO: 522240 - DNA, 25 bp, Mus musculus
actgctgggctgatcgatccccact

SEQ ID NO: 522241 - DNA, 25 bp, Mus musculus
actgctgggctgttcgatccccact

SEQ ID NO: 522242 - DNA, 25 bp, Mus musculus
actgctgtcgccaaatactcagatg

SEQ ID NO: 522243 - DNA, 25 bp, Mus musculus
actgctgtcgcctaatactcagatg

SEQ ID NO: 522244 - DNA, 25 bp, Mus musculus
actgctgtggctacgaacgtgtctg

SEQ ID NO: 522245 - DNA, 25 bp, Mus musculus
actgctgtggcttcgaacgtgtctg

SEQ ID NO: 522246 - DNA, 25 bp, Mus musculus
actgctgttaggcaagaggaaagaa

SEQ ID NO: 522247 - DNA, 25 bp, Mus musculus
actgctgttagggaagaggaaagaa

SEQ ID NO: 522248 - DNA, 25 bp, Mus musculus
actgctgttccgaggacagggcaga

SEQ ID NO: 522249 - DNA, 25 bp, Mus musculus
actgctgttccgtggacagggcaga

SEQ ID NO: 522250 - DNA, 25 bp, Mus musculus
actgctgttctcacatatggcctag

SEQ ID NO: 522251 - DNA, 25 bp, Mus musculus
actgctgttctctcatatggcctag

SEQ ID NO: 522252 - DNA, 25 bp, Mus musculus
actgctgtttgccacaccgatgcct

SEQ ID NO: 522253 - DNA, 25 bp, Mus musculus
actgctgtttgcgacaccgatgcct

SEQ ID NO: 522254 - DNA, 25 bp, Mus musculus
actgcttacatgacgtgcgggctgc

SEQ ID NO: 522255 - DNA, 25 bp, Mus musculus
actgcttacatgtcgtgcgggctgc

SEQ ID NO: 522256 - DNA, 25 bp, Mus musculus
actgcttccccgaaagctggagaag

SEQ ID NO: 522257 - DNA, 25 bp, Mus musculus
actgcttccccgtaagctggagaag

SEQ ID NO: 522258 - DNA, 25 bp, Mus musculus
actgcttctcaacttggaggagtac

SEQ ID NO: 522259 - DNA, 25 bp, Mus musculus
actgcttctcaagttggaggagtac

SEQ ID NO: 522260 - DNA, 25 bp, Mus musculus
actgcttctgccagttatcattgac

SEQ ID NO: 522261 - DNA, 25 bp, Mus musculus
actgcttctgcctgttatcattgac

SEQ ID NO: 522262 - DNA, 25 bp, Mus musculus
actgcttcttacatccctgatgcta

SEQ ID NO: 522263 - DNA, 25 bp, Mus musculus
actgcttcttacttccctgatgcta

SEQ ID NO: 522264 - DNA, 25 bp, Mus musculus
actgcttctttgacctgaccattca

SEQ ID NO: 522265 - DNA, 25 bp, Mus musculus
actgcttctttgtcctgaccattca

SEQ ID NO: 522266 - DNA, 25 bp, Mus musculus
actgctttccggagcggtagcacct

SEQ ID NO: 522267 - DNA, 25 bp, Mus musculus
actgctttccggtgcggtagcacct

SEQ ID NO: 522268 - DNA, 25 bp, Mus musculus
actgctttgagcaactgagtgtact

SEQ ID NO: 522269 - DNA, 25 bp, Mus musculus
actgctttgagctactgagtgtact

SEQ ID NO: 522270 - DNA, 25 bp, Mus musculus
actgctttgtagattccttgtatga

SEQ ID NO: 522271 - DNA, 25 bp, Mus musculus
actgctttgtagtttccttgtatga

SEQ ID NO: 522272 - DNA, 25 bp, Mus musculus
actgcttttctgcttcgttacctcc

SEQ ID NO: 522273 - DNA, 25 bp, Mus musculus
actgcttttctggttcgttacctcc

SEQ ID NO: 522274 - DNA, 25 bp, Mus musculus
actggaaaatttacaagctccttgc

SEQ ID NO: 522275 - DNA, 25 bp, Mus musculus
actggaaaattttcaagctccttgc

SEQ ID NO: 522276 - DNA, 25 bp, Mus musculus
actggaaagaggctgatgacgcaat

SEQ ID NO: 522277 - DNA, 25 bp, Mus musculus
actggaaagagggtgatgacgcaat

SEQ ID NO: 522278 - DNA, 25 bp, Mus musculus
actggaaagtccaaaggctatggtt

SEQ ID NO: 522279 - DNA, 25 bp, Mus musculus
actggaaagtcctaaggctatggtt

SEQ ID NO: 522280 - DNA, 25 bp, Mus musculus
actggaacaagccaatgatgacctg

SEQ ID NO: 522281 - DNA, 25 bp, Mus musculus
actggaacaagcgaatgatgacctg

SEQ ID NO: 522282 - DNA, 25 bp, Mus musculus
actggaacaggacagattggctctg

SEQ ID NO: 522283 - DNA, 25 bp, Mus musculus
actggaacaggagagattggctctg

SEQ ID NO: 522284 - DNA, 25 bp, Mus musculus
actggaaccaggctctccacaatcg

SEQ ID NO: 522285 - DNA, 25 bp, Mus musculus
actggaaccagggtctccacaatcg

SEQ ID NO: 522286 - DNA, 25 bp, Mus musculus
actggaactgctcttatctcgcttt

SEQ ID NO: 522287 - DNA, 25 bp, Mus musculus
actggaactgctgttatctcgcttt

SEQ ID NO: 522288 - DNA, 25 bp, Mus musculus
actggaaggtccatgcctcagcgcg

SEQ ID NO: 522289 - DNA, 25 bp, Mus musculus
actggaaggtccttgcctcagcgcg

SEQ ID NO: 522290 - DNA, 25 bp, Mus musculus
actggaatcgaaacaagattgccaa

SEQ ID NO: 522291 - DNA, 25 bp, Mus musculus
actggaatcgaatcaagattgccaa

SEQ ID NO: 522292 - DNA, 25 bp, Mus musculus
actggaatggagctaccatctgaag

SEQ ID NO: 522293 - DNA, 25 bp, Mus musculus
actggaatggaggtaccatctgaag

SEQ ID NO: 522294 - DNA, 25 bp, Mus musculus
actggacaagagaattcatggaggg

SEQ ID NO: 522295 - DNA, 25 bp, Mus musculus
actggacaagagtattcatggaggg

SEQ ID NO: 522296 - DNA, 25 bp, Mus musculus
actggacagtgcactgtaatggacc

SEQ ID NO: 522297 - DNA, 25 bp, Mus musculus
actggacagtgctctgtaatggacc

SEQ ID NO: 522298 - DNA, 25 bp, Mus musculus
actggacatgatcttctcagctgca

SEQ ID NO: 522299 - DNA, 25 bp, Mus musculus
actggacatgatgttctcagctgca

SEQ ID NO: 522300 - DNA, 25 bp, Mus musculus
actggacatggacctccgagcagcg

SEQ ID NO: 522301 - DNA, 25 bp, Mus musculus
actggacatggagctccgagcagcg

SEQ ID NO: 522302 - DNA, 25 bp, Mus musculus
actggaccacgccaactgacattgg

SEQ ID NO: 522303 - DNA, 25 bp, Mus musculus
actggaccacgcgaactgacattgg

SEQ ID NO: 522304 - DNA, 25 bp, Mus musculus
actggaccgttaatgattgagctga

SEQ ID NO: 522305 - DNA, 25 bp, Mus musculus
actggaccgttattgattgagctga

SEQ ID NO: 522306 - DNA, 25 bp, Mus musculus
actggacctgcaccagggacaggac

SEQ ID NO: 522307 - DNA, 25 bp, Mus musculus
actggacctgcagcagggacaggac

SEQ ID NO: 522308 - DNA, 25 bp, Mus musculus
actggacgaaggcactcagagacag

SEQ ID NO: 522309 - DNA, 25 bp, Mus musculus
actggacgaagggactcagagacag

SEQ ID NO: 522310 - DNA, 25 bp, Mus musculus
actggacgagtacacaagaacgtgc

SEQ ID NO: 522311 - DNA, 25 bp, Mus musculus
actggacgagtagacaagaacgtgc

SEQ ID NO: 522312 - DNA, 25 bp, Mus musculus
actggacggagtaagcaggcttgcc

SEQ ID NO: 522313 - DNA, 25 bp, Mus musculus
actggacggagttagcaggcttgcc

SEQ ID NO: 522314 - DNA, 25 bp, Mus musculus
actggacgtaaacaggcctctgtgg

SEQ ID NO: 522315 - DNA, 25 bp, Mus musculus
actggacgtaaagaggcctctgtgg

SEQ ID NO: 522316 - DNA, 25 bp, Mus musculus
actggacgtcacacgaagggccgtt

SEQ ID NO: 522317 - DNA, 25 bp, Mus musculus
actggacgtcactcgaagggccgtt

SEQ ID NO: 522318 - DNA, 25 bp, Mus musculus
actggactgagactgtgcttagcgc

SEQ ID NO: 522319 - DNA, 25 bp, Mus musculus
actggactgagagtgtgcttagcgc

SEQ ID NO: 522320 - DNA, 25 bp, Mus musculus
actggactgtggatgaggtgataca

SEQ ID NO: 522321 - DNA, 25 bp, Mus musculus
actggactgtggttgaggtgataca

SEQ ID NO: 522322 - DNA, 25 bp, Mus musculus
actggagaccctaacacacctggct

SEQ ID NO: 522323 - DNA, 25 bp, Mus musculus
actggagacccttacacacctggct

SEQ ID NO: 522324 - DNA, 25 bp, Mus musculus
actggagagaaaagggttgtgtgac

SEQ ID NO: 522325 - DNA, 25 bp, Mus musculus
actggagagaaatgggttgtgtgac

SEQ ID NO: 522326 - DNA, 25 bp, Mus musculus
actggagagagcacatacagagctt

SEQ ID NO: 522327 - DNA, 25 bp, Mus musculus
actggagagagctcatacagagctt

SEQ ID NO: 522328 - DNA, 25 bp, Mus musculus
actggagccgggacggtgctctcat

SEQ ID NO: 522329 - DNA, 25 bp, Mus musculus
actggagccgggtcggtgctctcat

SEQ ID NO: 522330 - DNA, 25 bp, Mus musculus
actggagcctgaagcagtgctgtcc

SEQ ID NO: 522331 - DNA, 25 bp, Mus musculus
actggagcctgatgcagtgctgtcc

SEQ ID NO: 522332 - DNA, 25 bp, Mus musculus
actggagcgtgtcgccaagtctaac

SEQ ID NO: 522333 - DNA, 25 bp, Mus musculus
actggagcgtgtggccaagtctaac

SEQ ID NO: 522334 - DNA, 25 bp, Mus musculus
actggagctataaggagcagacgac

SEQ ID NO: 522335 - DNA, 25 bp, Mus musculus
actggagctatatggagcagacgac

SEQ ID NO: 522336 - DNA, 25 bp, Mus musculus
actggagctcagagtgcctgctgac

SEQ ID NO: 522337 - DNA, 25 bp, Mus musculus
actggagctcagtgtgcctgctgac

SEQ ID NO: 522338 - DNA, 25 bp, Mus musculus
actggaggctgtcagccacttacta

SEQ ID NO: 522339 - DNA, 25 bp, Mus musculus
actggaggctgtgagccacttacta

SEQ ID NO: 522340 - DNA, 25 bp, Mus musculus
actggagggccaccctcaagaccat

SEQ ID NO: 522341 - DNA, 25 bp, Mus musculus
actggagggccagcctcaagaccat

SEQ ID NO: 522342 - DNA, 25 bp, Mus musculus
actggagtgacgagcccctgaagga

SEQ ID NO: 522343 - DNA, 25 bp, Mus musculus
actggagtgacgtgcccctgaagga

SEQ ID NO: 522344 - DNA, 25 bp, Mus musculus
actggagttaggcagctgccttcgc

SEQ ID NO: 522345 - DNA, 25 bp, Mus musculus
actggagttagggagctgccttcgc

SEQ ID NO: 522346 - DNA, 25 bp, Mus musculus
actggagtttgtagctgatgaaggc

SEQ ID NO: 522347 - DNA, 25 bp, Mus musculus
actggagtttgttgctgatgaaggc

SEQ ID NO: 522348 - DNA, 25 bp, Mus musculus
actggataaggacatctgtgctgac

SEQ ID NO: 522349 - DNA, 25 bp, Mus musculus
actggataaggagatctgtgctgac

SEQ ID NO: 522350 - DNA, 25 bp, Mus musculus
actggatatggtaccaggaagagat

SEQ ID NO: 522351 - DNA, 25 bp, Mus musculus
actggatatggttccaggaagagat

SEQ ID NO: 522352 - DNA, 25 bp, Mus musculus
actggatcagagaccagtagaggaa

SEQ ID NO: 522353 - DNA, 25 bp, Mus musculus
actggatcagagtccagtagaggaa

SEQ ID NO: 522354 - DNA, 25 bp, Mus musculus
actggatcctcacaggaactcctct

SEQ ID NO: 522355 - DNA, 25 bp, Mus musculus
actggatcctcagaggaactcctct

SEQ ID NO: 522356 - DNA, 25 bp, Mus musculus
actggatcctggctattagtggtag

SEQ ID NO: 522357 - DNA, 25 bp, Mus musculus
actggatcctgggtattagtggtag

SEQ ID NO: 522358 - DNA, 25 bp, Mus musculus
actggatctgagcatggtgatattc

SEQ ID NO: 522359 - DNA, 25 bp, Mus musculus
actggatctgaggatggtgatattc

SEQ ID NO: 522360 - DNA, 25 bp, Mus musculus
actggatctggcaacctcaaaggag

SEQ ID NO: 522361 - DNA, 25 bp, Mus musculus
actggatctggctacctcaaaggag

SEQ ID NO: 522362 - DNA, 25 bp, Mus musculus
actggatgaagcctccggtgtgaac

SEQ ID NO: 522363 - DNA, 25 bp, Mus musculus
actggatgaagcgtccggtgtgaac

SEQ ID NO: 522364 - DNA, 25 bp, Mus musculus
actggatgagctaaatctctcctgg

SEQ ID NO: 522365 - DNA, 25 bp, Mus musculus
actggatgagcttaatctctcctgg

SEQ ID NO: 522366 - DNA, 25 bp, Mus musculus
actggatgtcccaaaacagagcatc

SEQ ID NO: 522367 - DNA, 25 bp, Mus musculus
actggatgtccctaaacagagcatc

SEQ ID NO: 522368 - DNA, 25 bp, Mus musculus
actggattgaggagcccgtgcgcca

SEQ ID NO: 522369 - DNA, 25 bp, Mus musculus
actggattgaggtgcccgtgcgcca

SEQ ID NO: 522370 - DNA, 25 bp, Mus musculus
actggcaaggccatggcaggtcttg

SEQ ID NO: 522371 - DNA, 25 bp, Mus musculus
actggcaaggccttggcaggtcttg

SEQ ID NO: 522372 - DNA, 25 bp, Mus musculus
actggcaccatgcagccaaaggtgc

SEQ ID NO: 522373 - DNA, 25 bp, Mus musculus
actggcaccatggagccaaaggtgc

SEQ ID NO: 522374 - DNA, 25 bp, Mus musculus
actggcactgccaccaatagccggg

SEQ ID NO: 522375 - DNA, 25 bp, Mus musculus
actggcactgcctccaatagccggg

SEQ ID NO: 522376 - DNA, 25 bp, Mus musculus
actggcagagccaaggctgccagag

SEQ ID NO: 522377 - DNA, 25 bp, Mus musculus
actggcagagcctaggctgccagag

SEQ ID NO: 522378 - DNA, 25 bp, Mus musculus
actggcagcagcagtagcggtcgac

SEQ ID NO: 522379 - DNA, 25 bp, Mus musculus
actggcagcagctgtagcggtcgac

SEQ ID NO: 522380 - DNA, 25 bp, Mus musculus
actggcatagttcgagacaaaggag

SEQ ID NO: 522381 - DNA, 25 bp, Mus musculus
actggcatagttggagacaaaggag

SEQ ID NO: 522382 - DNA, 25 bp, Mus musculus
actggcatcgtgatctacgcacctg

SEQ ID NO: 522383 - DNA, 25 bp, Mus musculus
actggcatcgtgttctacgcacctg

SEQ ID NO: 522384 - DNA, 25 bp, Mus musculus
actggcatgaacctggagttggcct

SEQ ID NO: 522385 - DNA, 25 bp, Mus musculus
actggcatgaacgtggagttggcct

SEQ ID NO: 522386 - DNA, 25 bp, Mus musculus
actggcatgaccctatcaaggagag

SEQ ID NO: 522387 - DNA, 25 bp, Mus musculus
actggcatgaccgtatcaaggagag

SEQ ID NO: 522388 - DNA, 25 bp, Mus musculus
actggcattgctaaagcaggaactg

SEQ ID NO: 522389 - DNA, 25 bp, Mus musculus
actggcattgctcgtgtgcctcttg

SEQ ID NO: 522390 - DNA, 25 bp, Mus musculus
actggcattgctggtgtgcctcttg

SEQ ID NO: 522391 - DNA, 25 bp, Mus musculus
actggcattgcttaagcaggaactg

SEQ ID NO: 522392 - DNA, 25 bp, Mus musculus
actggccaagaacaaatctattatg

SEQ ID NO: 522393 - DNA, 25 bp, Mus musculus
actggccaagaagaaatctattatg

SEQ ID NO: 522394 - DNA, 25 bp, Mus musculus
actggccacagaccccatggcagtg

SEQ ID NO: 522395 - DNA, 25 bp, Mus musculus
actggccacagagcccatggcagtg

SEQ ID NO: 522396 - DNA, 25 bp, Mus musculus
actggcccggtacagccgagccttt

SEQ ID NO: 522397 - DNA, 25 bp, Mus musculus
actggcccggtagagccgagccttt

SEQ ID NO: 522398 - DNA, 25 bp, Mus musculus
actggccgaggtaaggccccagagc

SEQ ID NO: 522399 - DNA, 25 bp, Mus musculus
actggccgaggttaggccccagagc

SEQ ID NO: 522400 - DNA, 25 bp, Mus musculus
actggccggcctcctgaaaccagga

SEQ ID NO: 522401 - DNA, 25 bp, Mus musculus
actggccggcctgctgaaaccagga

SEQ ID NO: 522402 - DNA, 25 bp, Mus musculus
actggcctctctccagcgattgctg

SEQ ID NO: 522403 - DNA, 25 bp, Mus musculus
actggcctctctgcagcgattgctg

SEQ ID NO: 522404 - DNA, 25 bp, Mus musculus
actggcctctggagtgagggataac

SEQ ID NO: 522405 - DNA, 25 bp, Mus musculus
actggcctctggtgtgagggataac

SEQ ID NO: 522406 - DNA, 25 bp, Mus musculus
actggcctgggtctgctgagcccct

SEQ ID NO: 522407 - DNA, 25 bp, Mus musculus
actggcctgggtgtgctgagcccct

SEQ ID NO: 522408 - DNA, 25 bp, Mus musculus
actggcctgtgcaggtggtcatgaa

SEQ ID NO: 522409 - DNA, 25 bp, Mus musculus
actggcctgtgctggtggtcatgaa

SEQ ID NO: 522410 - DNA, 25 bp, Mus musculus
actggccttacgacttccattccgg

SEQ ID NO: 522411 - DNA, 25 bp, Mus musculus
actggccttacgtcttccattccgg

SEQ ID NO: 522412 - DNA, 25 bp, Mus musculus
actggccttagcagagcgggcctgt

SEQ ID NO: 522413 - DNA, 25 bp, Mus musculus
actggccttagctgagcgggcctgt

SEQ ID NO: 522414 - DNA, 25 bp, Mus musculus
actggcctttcgctaccgaaaagtg

SEQ ID NO: 522415 - DNA, 25 bp, Mus musculus
actggcctttcggtaccgaaaagtg

SEQ ID NO: 522416 - DNA, 25 bp, Mus musculus
actggcgcagagctctcgggctcct

SEQ ID NO: 522417 - DNA, 25 bp, Mus musculus
actggcgcagaggtctcgggctcct

SEQ ID NO: 522418 - DNA, 25 bp, Mus musculus
actggcggaaccaacgcgtagcgga

SEQ ID NO: 522419 - DNA, 25 bp, Mus musculus
actggcggaacctacgcgtagcgga

SEQ ID NO: 522420 - DNA, 25 bp, Mus musculus
actggcgggcatcattgagtccatc

SEQ ID NO: 522421 - DNA, 25 bp, Mus musculus
actggcgggcatgattgagtccatc

SEQ ID NO: 522422 - DNA, 25 bp, Mus musculus
actggcgtctgcagcacggcgttac

SEQ ID NO: 522423 - DNA, 25 bp, Mus musculus
actggcgtctgctgcacggcgttac

SEQ ID NO: 522424 - DNA, 25 bp, Mus musculus
actggcgtgtgactaactgaataaa

SEQ ID NO: 522425 - DNA, 25 bp, Mus musculus
actggcgtgtgagtaactgaataaa

SEQ ID NO: 522426 - DNA, 25 bp, Mus musculus
actggctaatcaagagtgaaaaacc

SEQ ID NO: 522427 - DNA, 25 bp, Mus musculus
actggctaatcatgagtgaaaaacc

SEQ ID NO: 522428 - DNA, 25 bp, Mus musculus
actggctatccccagcatgctcatg

SEQ ID NO: 522429 - DNA, 25 bp, Mus musculus
actggctatcccgagcatgctcatg

SEQ ID NO: 522430 - DNA, 25 bp, Mus musculus
actggctcaacaaggttcgggctgg

SEQ ID NO: 522431 - DNA, 25 bp, Mus musculus
actggctcaacatggttcgggctgg

SEQ ID NO: 522432 - DNA, 25 bp, Mus musculus
actggctcaccccttctaacatgtg

SEQ ID NO: 522433 - DNA, 25 bp, Mus musculus
actggctcacccgttctaacatgtg

SEQ ID NO: 522434 - DNA, 25 bp, Mus musculus
actggctcattaccgcgttcgtctg

SEQ ID NO: 522435 - DNA, 25 bp, Mus musculus
actggctcattagcgcgttcgtctg

SEQ ID NO: 522436 - DNA, 25 bp, Mus musculus
actggctcgtggagtctttgcgatt

SEQ ID NO: 522437 - DNA, 25 bp, Mus musculus
actggctcgtggtgtctttgcgatt

SEQ ID NO: 522438 - DNA, 25 bp, Mus musculus
actggctctatgacctctaaatagg

SEQ ID NO: 522439 - DNA, 25 bp, Mus musculus
actggctctatgtcctctaaatagg

SEQ ID NO: 522440 - DNA, 25 bp, Mus musculus
actggctctcggcacaatagcctgc

SEQ ID NO: 522441 - DNA, 25 bp, Mus musculus
actggctctcgggacaatagcctgc

SEQ ID NO: 522442 - DNA, 25 bp, Mus musculus
actggctctgcgagagacccctgct

SEQ ID NO: 522443 - DNA, 25 bp, Mus musculus
actggctctgcgtgagacccctgct

SEQ ID NO: 522444 - DNA, 25 bp, Mus musculus
actggctgagccagctgaaggccaa

SEQ ID NO: 522445 - DNA, 25 bp, Mus musculus
actggctgagcctgctgaaggccaa

SEQ ID NO: 522446 - DNA, 25 bp, Mus musculus
actggctgaggacctccgaacatct

SEQ ID NO: 522447 - DNA, 25 bp, Mus musculus
actggctgaggagctccgaacatct

SEQ ID NO: 522448 - DNA, 25 bp, Mus musculus
actggctggagtctccgtcaggtca

SEQ ID NO: 522449 - DNA, 25 bp, Mus musculus
actggctggagtgtccgtcaggtca

SEQ ID NO: 522450 - DNA, 25 bp, Mus musculus
actggctgggcaatggttccttcat

SEQ ID NO: 522451 - DNA, 25 bp, Mus musculus
actggctgggcattggttccttcat

SEQ ID NO: 522452 - DNA, 25 bp, Mus musculus
actggctgtgcacataggcaaggcg

SEQ ID NO: 522453 - DNA, 25 bp, Mus musculus
actggctgtgcagataggcaaggcg

SEQ ID NO: 522454 - DNA, 25 bp, Mus musculus
actggctgtggcactggctctgacg

SEQ ID NO: 522455 - DNA, 25 bp, Mus musculus
actggctgtggctctggctctgacg

SEQ ID NO: 522456 - DNA, 25 bp, Mus musculus
actggctgttggagacatctcctcc

SEQ ID NO: 522457 - DNA, 25 bp, Mus musculus
actggctgttggtgacatctcctcc

SEQ ID NO: 522458 - DNA, 25 bp, Mus musculus
actggcttcacgcaagagtctacca

SEQ ID NO: 522459 - DNA, 25 bp, Mus musculus
actggcttcacggaagagtctacca

SEQ ID NO: 522460 - DNA, 25 bp, Mus musculus
actggctttagaagtccacatttga

SEQ ID NO: 522461 - DNA, 25 bp, Mus musculus
actggctttagatgtccacatttga

SEQ ID NO: 522462 - DNA, 25 bp, Mus musculus
actgggaaaagcacaaagagttggc

SEQ ID NO: 522463 - DNA, 25 bp, Mus musculus
actgggaaaagctcaaagagttggc

SEQ ID NO: 522464 - DNA, 25 bp, Mus musculus
actgggaaagctacaatattcactg

SEQ ID NO: 522465 - DNA, 25 bp, Mus musculus
actgggaaagcttcaatattcactg

SEQ ID NO: 522466 - DNA, 25 bp, Mus musculus
actgggaaaggccacaataccggag

SEQ ID NO: 522467 - DNA, 25 bp, Mus musculus
actgggaaaggcgacaataccggag

SEQ ID NO: 522468 - DNA, 25 bp, Mus musculus
actgggaaccagaaggttggagcca

SEQ ID NO: 522469 - DNA, 25 bp, Mus musculus
actgggaaccagtaggttggagcca

SEQ ID NO: 522470 - DNA, 25 bp, Mus musculus
actgggaagtacatgtgccggatca

SEQ ID NO: 522471 - DNA, 25 bp, Mus musculus
actgggaagtacttgtgccggatca

SEQ ID NO: 522472 - DNA, 25 bp, Mus musculus
actgggacagagcagaccctggaaa

SEQ ID NO: 522473 - DNA, 25 bp, Mus musculus
actgggacagaggagaccctggaaa

SEQ ID NO: 522474 - DNA, 25 bp, Mus musculus
actgggacagtgcagactttgtatt

SEQ ID NO: 522475 - DNA, 25 bp, Mus musculus
actgggacagtggagactttgtatt

SEQ ID NO: 522476 - DNA, 25 bp, Mus musculus
actgggacctacctctgcaatgtta

SEQ ID NO: 522477 - DNA, 25 bp, Mus musculus
actgggacctacgtctgcaatgtta

SEQ ID NO: 522478 - DNA, 25 bp, Mus musculus
actgggacgcctcgcatctattgtt

SEQ ID NO: 522479 - DNA, 25 bp, Mus musculus
actgggacgcctggcatctattgtt

SEQ ID NO: 522480 - DNA, 25 bp, Mus musculus
actgggagcaaaatgagctcgtcag

SEQ ID NO: 522481 - DNA, 25 bp, Mus musculus
actgggagcaaattgagctcgtcag

SEQ ID NO: 522482 - DNA, 25 bp, Mus musculus
actgggatgtgcaccatggtcaagg

SEQ ID NO: 522483 - DNA, 25 bp, Mus musculus
actgggatgtgctccatggtcaagg

SEQ ID NO: 522484 - DNA, 25 bp, Mus musculus
actgggattgagcttcaacagcatc

SEQ ID NO: 522485 - DNA, 25 bp, Mus musculus
actgggattgaggttcaacagcatc

SEQ ID NO: 522486 - DNA, 25 bp, Mus musculus
actgggcactgcacgaggcagaatt

SEQ ID NO: 522487 - DNA, 25 bp, Mus musculus
actgggcactgctcgaggcagaatt

SEQ ID NO: 522488 - DNA, 25 bp, Mus musculus
actgggcagccgagcagggacatct

SEQ ID NO: 522489 - DNA, 25 bp, Mus musculus
actgggcagccgtgcagggacatct

SEQ ID NO: 522490 - DNA, 25 bp, Mus musculus
actgggccagctcatccaggctgtg

SEQ ID NO: 522491 - DNA, 25 bp, Mus musculus
actgggccagctgatccaggctgtg

SEQ ID NO: 522492 - DNA, 25 bp, Mus musculus
actgggcccaggagagtttgagtcc

SEQ ID NO: 522493 - DNA, 25 bp, Mus musculus
actgggcccaggtgagtttgagtcc

SEQ ID NO: 522494 - DNA, 25 bp, Mus musculus
actgggcccagtcaggagagtccac

SEQ ID NO: 522495 - DNA, 25 bp, Mus musculus
actgggcccagtgaggagagtccac

SEQ ID NO: 522496 - DNA, 25 bp, Mus musculus
actgggccctcaacatggaaatctg

SEQ ID NO: 522497 - DNA, 25 bp, Mus musculus
actgggccctcatcatggaaatctg

SEQ ID NO: 522498 - DNA, 25 bp, Mus musculus
actgggccggtgctctacatcatgc

SEQ ID NO: 522499 - DNA, 25 bp, Mus musculus
actgggccggtggtctacatcatgc

SEQ ID NO: 522500 - DNA, 25 bp, Mus musculus
actgggcgtatgctgaaaaggttca

SEQ ID NO: 522501 - DNA, 25 bp, Mus musculus
actgggcgtatggtgaaaaggttca

SEQ ID NO: 522502 - DNA, 25 bp, Mus musculus
actgggcgtctgaaatgggcagcct

SEQ ID NO: 522503 - DNA, 25 bp, Mus musculus
actgggcgtctgtaatgggcagcct

SEQ ID NO: 522504 - DNA, 25 bp, Mus musculus
actgggctgcagctctcaggactga

SEQ ID NO: 522505 - DNA, 25 bp, Mus musculus
actgggctgcaggtctcaggactga

SEQ ID NO: 522506 - DNA, 25 bp, Mus musculus
actgggctgctcagctggaactgtg

SEQ ID NO: 522507 - DNA, 25 bp, Mus musculus
actgggctgctcagtaccgcgaggc

SEQ ID NO: 522508 - DNA, 25 bp, Mus musculus
actgggctgctctgctggaactgtg

SEQ ID NO: 522509 - DNA, 25 bp, Mus musculus
actgggctgctctgtaccgcgaggc

SEQ ID NO: 522510 - DNA, 25 bp, Mus musculus
actgggctggccactacgggcgtct

SEQ ID NO: 522511 - DNA, 25 bp, Mus musculus
actgggctggcctctacgggcgtct

SEQ ID NO: 522512 - DNA, 25 bp, Mus musculus
actgggctggtcaatgatgagaaga

SEQ ID NO: 522513 - DNA, 25 bp, Mus musculus
actgggctggtctatgatgagaaga

SEQ ID NO: 522514 - DNA, 25 bp, Mus musculus
actgggcttgctagtccacttcctc

SEQ ID NO: 522515 - DNA, 25 bp, Mus musculus
actgggcttgcttgtccacttcctc

SEQ ID NO: 522516 - DNA, 25 bp, Mus musculus
actgggtaagagagactgcaagcta

SEQ ID NO: 522517 - DNA, 25 bp, Mus musculus
actgggtaagagtgactgcaagcta

SEQ ID NO: 522518 - DNA, 25 bp, Mus musculus
actgggtaagcgcacgcactgaagc

SEQ ID NO: 522519 - DNA, 25 bp, Mus musculus
actgggtaagcggacgcactgaagc

SEQ ID NO: 522520 - DNA, 25 bp, Mus musculus
actgggtagatgcttcacctctgac

SEQ ID NO: 522521 - DNA, 25 bp, Mus musculus
actgggtagatggttcacctctgac

SEQ ID NO: 522522 - DNA, 25 bp, Mus musculus
actgggtcagttatgcagatactcc

SEQ ID NO: 522523 - DNA, 25 bp, Mus musculus
actgggtcagttttgcagatactcc

SEQ ID NO: 522524 - DNA, 25 bp, Mus musculus
actgggtcctggcagagatcagcac

SEQ ID NO: 522525 - DNA, 25 bp, Mus musculus
actgggtcctgggagagatcagcac

SEQ ID NO: 522526 - DNA, 25 bp, Mus musculus
actgggtctacaaccaggctgcagg

SEQ ID NO: 522527 - DNA, 25 bp, Mus musculus
actgggtctacatccaggctgcagg

SEQ ID NO: 522528 - DNA, 25 bp, Mus musculus
actgggtctgctcatgttaggactg

SEQ ID NO: 522529 - DNA, 25 bp, Mus musculus
actgggtctgctgatgttaggactg

SEQ ID NO: 522530 - DNA, 25 bp, Mus musculus
actgggtctggcaggtgcccgaaac

SEQ ID NO: 522531 - DNA, 25 bp, Mus musculus
actgggtctggctggtgcccgaaac

SEQ ID NO: 522532 - DNA, 25 bp, Mus musculus
actgggtgacacctcaactctgcca

SEQ ID NO: 522533 - DNA, 25 bp, Mus musculus
actgggtgacacgtcaactctgcca

SEQ ID NO: 522534 - DNA, 25 bp, Mus musculus
actgggttcggacgcaactgctgca

SEQ ID NO: 522535 - DNA, 25 bp, Mus musculus
actgggttcggaggcaactgctgca

SEQ ID NO: 522536 - DNA, 25 bp, Mus musculus
actgggtttgtcatgtgtcgacgga

SEQ ID NO: 522537 - DNA, 25 bp, Mus musculus
actgggtttgtcttgtgtcgacgga

SEQ ID NO: 522538 - DNA, 25 bp, Mus musculus
actggtaaggagaaatgctgtgtcc

SEQ ID NO: 522539 - DNA, 25 bp, Mus musculus
actggtaaggagtaatgctgtgtcc

SEQ ID NO: 522540 - DNA, 25 bp, Mus musculus
actggtaatttgctgtaggactttg

SEQ ID NO: 522541 - DNA, 25 bp, Mus musculus
actggtaatttggtgtaggactttg

SEQ ID NO: 522542 - DNA, 25 bp, Mus musculus
actggtacccgacgtctcctatggc

SEQ ID NO: 522543 - DNA, 25 bp, Mus musculus
actggtacccgaggtctcctatggc

SEQ ID NO: 522544 - DNA, 25 bp, Mus musculus
actggtatagtgagtatggtctaca

SEQ ID NO: 522545 - DNA, 25 bp, Mus musculus
actggtatagtgtgtatggtctaca

SEQ ID NO: 522546 - DNA, 25 bp, Mus musculus
actggtcctctgagacaccgcacaa

SEQ ID NO: 522547 - DNA, 25 bp, Mus musculus
actggtcctctgtgacaccgcacaa

SEQ ID NO: 522548 - DNA, 25 bp, Mus musculus
actggtcttggtcgccgctggattt

SEQ ID NO: 522549 - DNA, 25 bp, Mus musculus
actggtcttggtggccgctggattt

SEQ ID NO: 522550 - DNA, 25 bp, Mus musculus
actggtgaagcacggattaaagtgt

SEQ ID NO: 522551 - DNA, 25 bp, Mus musculus
actggtgaagcactcgtagcgccga

SEQ ID NO: 522552 - DNA, 25 bp, Mus musculus
actggtgaagcagggattaaagtgt

SEQ ID NO: 522553 - DNA, 25 bp, Mus musculus
actggtgaagcagtcgtagcgccga

SEQ ID NO: 522554 - DNA, 25 bp, Mus musculus
actggtgaccggatatgccgcctat

SEQ ID NO: 522555 - DNA, 25 bp, Mus musculus
actggtgaccggttatgccgcctat

SEQ ID NO: 522556 - DNA, 25 bp, Mus musculus
actggtgactctccagcgctctgga

SEQ ID NO: 522557 - DNA, 25 bp, Mus musculus
actggtgactctgcagcgctctgga

SEQ ID NO: 522558 - DNA, 25 bp, Mus musculus
actggtgagcagactactccatttg

SEQ ID NO: 522559 - DNA, 25 bp, Mus musculus
actggtgagcagtctactccatttg

SEQ ID NO: 522560 - DNA, 25 bp, Mus musculus
actggtgatggtctgaatgatgctc

SEQ ID NO: 522561 - DNA, 25 bp, Mus musculus
actggtgatggtgtgaatgatgctc

SEQ ID NO: 522562 - DNA, 25 bp, Mus musculus
actggtgcagagcaatgcccttgga

SEQ ID NO: 522563 - DNA, 25 bp, Mus musculus
actggtgcagaggaatgcccttgga

SEQ ID NO: 522564 - DNA, 25 bp, Mus musculus
actggtgcatcaagcgacggtcaca

SEQ ID NO: 522565 - DNA, 25 bp, Mus musculus
actggtgcatcatgcgacggtcaca

SEQ ID NO: 522566 - DNA, 25 bp, Mus musculus
actggtgcatctctcggcagctgtg

SEQ ID NO: 522567 - DNA, 25 bp, Mus musculus
actggtgcatctgtcggcagctgtg

SEQ ID NO: 522568 - DNA, 25 bp, Mus musculus
actggtgcccatattgatgtggata

SEQ ID NO: 522569 - DNA, 25 bp, Mus musculus
actggtgcccattttgatgtggata

SEQ ID NO: 522570 - DNA, 25 bp, Mus musculus
actggtgcccttctggtgaatgcag

SEQ ID NO: 522571 - DNA, 25 bp, Mus musculus
actggtgcccttgtggtgaatgcag

SEQ ID NO: 522572 - DNA, 25 bp, Mus musculus
actggtgctcccagccgttcagagc

SEQ ID NO: 522573 - DNA, 25 bp, Mus musculus
actggtgctccctgccgttcagagc

SEQ ID NO: 522574 - DNA, 25 bp, Mus musculus
actggtgctgaactggattatctgg

SEQ ID NO: 522575 - DNA, 25 bp, Mus musculus
actggtgctgaagtggattatctgg

SEQ ID NO: 522576 - DNA, 25 bp, Mus musculus
actggtgcttgaaaatgagggcgcc

SEQ ID NO: 522577 - DNA, 25 bp, Mus musculus
actggtgcttgataatgagggcgcc

SEQ ID NO: 522578 - DNA, 25 bp, Mus musculus
actggtggaacgcagacaagtacct

SEQ ID NO: 522579 - DNA, 25 bp, Mus musculus
actggtggaacggagacaagtacct

SEQ ID NO: 522580 - DNA, 25 bp, Mus musculus
actggtggacccaccccaggagcag

SEQ ID NO: 522581 - DNA, 25 bp, Mus musculus
actggtggaccctccccaggagcag

SEQ ID NO: 522582 - DNA, 25 bp, Mus musculus
actggtgggctcacggagtcctcat

SEQ ID NO: 522583 - DNA, 25 bp, Mus musculus
actggtgggctctcggagtcctcat

SEQ ID NO: 522584 - DNA, 25 bp, Mus musculus
actggtggttgaactatgatctgaa

SEQ ID NO: 522585 - DNA, 25 bp, Mus musculus
actggtggttgatctatgatctgaa

SEQ ID NO: 522586 - DNA, 25 bp, Mus musculus
actggtgtgcctacgtggtgactcg

SEQ ID NO: 522587 - DNA, 25 bp, Mus musculus
actggtgtgccttcgtggtgactcg

SEQ ID NO: 522588 - DNA, 25 bp, Mus musculus
actggtgtgcgtcttcttgttcgct

SEQ ID NO: 522589 - DNA, 25 bp, Mus musculus
actggtgtgcgtgttcttgttcgct

SEQ ID NO: 522590 - DNA, 25 bp, Mus musculus
actggtgttaccagctatgcggccc

SEQ ID NO: 522591 - DNA, 25 bp, Mus musculus
actggtgttacctgctatgcggccc

SEQ ID NO: 522592 - DNA, 25 bp, Mus musculus
actggttccatgacaaagtactgaa

SEQ ID NO: 522593 - DNA, 25 bp, Mus musculus
actggttccatgtcaaagtactgaa

SEQ ID NO: 522594 - DNA, 25 bp, Mus musculus
actggttccccaacttcacggaggc

SEQ ID NO: 522595 - DNA, 25 bp, Mus musculus
actggttccccatcttcacggaggc

SEQ ID NO: 522596 - DNA, 25 bp, Mus musculus
actggttgggttacaccaagaagag

SEQ ID NO: 522597 - DNA, 25 bp, Mus musculus
actggttgggtttcaccaagaagag

SEQ ID NO: 522598 - DNA, 25 bp, Mus musculus
actggttgtatgcagacaaaattct

SEQ ID NO: 522599 - DNA, 25 bp, Mus musculus
actggttgtatggagacaaaattct

SEQ ID NO: 522600 - DNA, 25 bp, Mus musculus
actggttgtcataggccagtctaca

SEQ ID NO: 522601 - DNA, 25 bp, Mus musculus
actggttgtcattggccagtctaca

SEQ ID NO: 522602 - DNA, 25 bp, Mus musculus
actggtttacctcaggccctgagga

SEQ ID NO: 522603 - DNA, 25 bp, Mus musculus
actggtttacctgaggccctgagga

SEQ ID NO: 522604 - DNA, 25 bp, Mus musculus
actggttttggcaggcctctgctgc

SEQ ID NO: 522605 - DNA, 25 bp, Mus musculus
actggttttggctggcctctgctgc

SEQ ID NO: 522606 - DNA, 25 bp, Mus musculus
actgtaacaagcaccgctcccaaga

SEQ ID NO: 522607 - DNA, 25 bp, Mus musculus
actgtaacaagctccgctcccaaga

SEQ ID NO: 522608 - DNA, 25 bp, Mus musculus
actgtaacctaaaatggcagagcct

SEQ ID NO: 522609 - DNA, 25 bp, Mus musculus
actgtaacctaatatggcagagcct

SEQ ID NO: 522610 - DNA, 25 bp, Mus musculus
actgtaagaaaaagacgacttttcg

SEQ ID NO: 522611 - DNA, 25 bp, Mus musculus
actgtaagaaaatgacgacttttcg

SEQ ID NO: 522612 - DNA, 25 bp, Mus musculus
actgtaagctccacaagggcaagaa

SEQ ID NO: 522613 - DNA, 25 bp, Mus musculus
actgtaagctcctcaagggcaagaa

SEQ ID NO: 522614 - DNA, 25 bp, Mus musculus
actgtaagtgctctgagccctgcac

SEQ ID NO: 522615 - DNA, 25 bp, Mus musculus
actgtaagtgctgtgagccctgcac

SEQ ID NO: 522616 - DNA, 25 bp, Mus musculus
actgtaatatggacctcgtgacaaa

SEQ ID NO: 522617 - DNA, 25 bp, Mus musculus
actgtaatatggtcctcgtgacaaa

SEQ ID NO: 522618 - DNA, 25 bp, Mus musculus
actgtaatccctcccaataagctac

SEQ ID NO: 522619 - DNA, 25 bp, Mus musculus
actgtaatccctgccaataagctac

SEQ ID NO: 522620 - DNA, 25 bp, Mus musculus
actgtaatggaaacggtaactatgg

SEQ ID NO: 522621 - DNA, 25 bp, Mus musculus
actgtaatggaatcggtaactatgg

SEQ ID NO: 522622 - DNA, 25 bp, Mus musculus
actgtacactggctgtcccccagga

SEQ ID NO: 522623 - DNA, 25 bp, Mus musculus
actgtacactgggtgtcccccagga

SEQ ID NO: 522624 - DNA, 25 bp, Mus musculus
actgtacacttccacggccacagct

SEQ ID NO: 522625 - DNA, 25 bp, Mus musculus
actgtacacttcgacggccacagct

SEQ ID NO: 522626 - DNA, 25 bp, Mus musculus
actgtaccgaggctataaaagcaca

SEQ ID NO: 522627 - DNA, 25 bp, Mus musculus
actgtaccgagggtataaaagcaca

SEQ ID NO: 522628 - DNA, 25 bp, Mus musculus
actgtactacctagcagagctgata

SEQ ID NO: 522629 - DNA, 25 bp, Mus musculus
actgtactaccttgcagagctgata

SEQ ID NO: 522630 - DNA, 25 bp, Mus musculus
actgtactgactcggccagaggtcc

SEQ ID NO: 522631 - DNA, 25 bp, Mus musculus
actgtactgactgggccagaggtcc

SEQ ID NO: 522632 - DNA, 25 bp, Mus musculus
actgtactgttacaacgtagctggg

SEQ ID NO: 522633 - DNA, 25 bp, Mus musculus
actgtactgttagaacgtagctggg

SEQ ID NO: 522634 - DNA, 25 bp, Mus musculus
actgtacttacgcttcctcaggaag

SEQ ID NO: 522635 - DNA, 25 bp, Mus musculus
actgtacttacggttcctcaggaag

SEQ ID NO: 522636 - DNA, 25 bp, Mus musculus
actgtagcatgcagtgctctgcagc

SEQ ID NO: 522637 - DNA, 25 bp, Mus musculus
actgtagcatgctgtgctctgcagc

SEQ ID NO: 522638 - DNA, 25 bp, Mus musculus
actgtagctttaagggacctgcgta

SEQ ID NO: 522639 - DNA, 25 bp, Mus musculus
actgtagctttatgggacctgcgta

SEQ ID NO: 522640 - DNA, 25 bp, Mus musculus
actgtaggagcacgttcagaggact

SEQ ID NO: 522641 - DNA, 25 bp, Mus musculus
actgtaggagcaggttcagaggact

SEQ ID NO: 522642 - DNA, 25 bp, Mus musculus
actgtatgcctgctagatgctgaca

SEQ ID NO: 522643 - DNA, 25 bp, Mus musculus
actgtatgcctggtagatgctgaca

SEQ ID NO: 522644 - DNA, 25 bp, Mus musculus
actgtcaaacgccagagccagtgga

SEQ ID NO: 522645 - DNA, 25 bp, Mus musculus
actgtcaaacgcgagagccagtgga

SEQ ID NO: 522646 - DNA, 25 bp, Mus musculus
actgtcaacacaatagattgggtta

SEQ ID NO: 522647 - DNA, 25 bp, Mus musculus
actgtcaacacattagattgggtta

SEQ ID NO: 522648 - DNA, 25 bp, Mus musculus
actgtcacttgccagtatgggtggc

SEQ ID NO: 522649 - DNA, 25 bp, Mus musculus
actgtcacttgcgagtatgggtggc

SEQ ID NO: 522650 - DNA, 25 bp, Mus musculus
actgtcagaccccaagctggccgtg

SEQ ID NO: 522651 - DNA, 25 bp, Mus musculus
actgtcagacccgaagctggccgtg

SEQ ID NO: 522652 - DNA, 25 bp, Mus musculus
actgtcagcttgatagagttgggac

SEQ ID NO: 522653 - DNA, 25 bp, Mus musculus
actgtcagcttgttagagttgggac

SEQ ID NO: 522654 - DNA, 25 bp, Mus musculus
actgtcatcctgaatttctgccacc

SEQ ID NO: 522655 - DNA, 25 bp, Mus musculus
actgtcatcctgtatttctgccacc

SEQ ID NO: 522656 - DNA, 25 bp, Mus musculus
actgtcatggcacctgcctctactt

SEQ ID NO: 522657 - DNA, 25 bp, Mus musculus
actgtcatggcagctgcctctactt

SEQ ID NO: 522658 - DNA, 25 bp, Mus musculus
actgtcattcaccaccgtgtgccaa

SEQ ID NO: 522659 - DNA, 25 bp, Mus musculus
actgtcattcacgaccgtgtgccaa

SEQ ID NO: 522660 - DNA, 25 bp, Mus musculus
actgtcccagaacgcaggcccgtga

SEQ ID NO: 522661 - DNA, 25 bp, Mus musculus
actgtcccagaaggcaggcccgtga

SEQ ID NO: 522662 - DNA, 25 bp, Mus musculus
actgtcccgactcggtcctggcaga

SEQ ID NO: 522663 - DNA, 25 bp, Mus musculus
actgtcccgactgggtcctggcaga

SEQ ID NO: 522664 - DNA, 25 bp, Mus musculus
actgtccctcaactgagtgacttta

SEQ ID NO: 522665 - DNA, 25 bp, Mus musculus
actgtccctcaagtgagtgacttta

SEQ ID NO: 522666 - DNA, 25 bp, Mus musculus
actgtcctatgtcgcccagcggcaa

SEQ ID NO: 522667 - DNA, 25 bp, Mus musculus
actgtcctatgtggcccagcggcaa

SEQ ID NO: 522668 - DNA, 25 bp, Mus musculus
actgtcctgccacaaggccgcgatg

SEQ ID NO: 522669 - DNA, 25 bp, Mus musculus
actgtcctgccagaaggccgcgatg

SEQ ID NO: 522670 - DNA, 25 bp, Mus musculus
actgtccttggacaggtacatcctt

SEQ ID NO: 522671 - DNA, 25 bp, Mus musculus
actgtccttggagaggtacatcctt

SEQ ID NO: 522672 - DNA, 25 bp, Mus musculus
actgtcgctaaccatggcgtctgga

SEQ ID NO: 522673 - DNA, 25 bp, Mus musculus
actgtcgctaacgatggcgtctgga

SEQ ID NO: 522674 - DNA, 25 bp, Mus musculus
actgtcgctcatccagggcctggtg

SEQ ID NO: 522675 - DNA, 25 bp, Mus musculus
actgtcgctcatgcagggcctggtg

SEQ ID NO: 522676 - DNA, 25 bp, Mus musculus
actgtcggaaggctctgcaccgagc

SEQ ID NO: 522677 - DNA, 25 bp, Mus musculus
actgtcggaagggtctgcaccgagc

SEQ ID NO: 522678 - DNA, 25 bp, Mus musculus
actgtctgcctgagggatataaatg

SEQ ID NO: 522679 - DNA, 25 bp, Mus musculus
actgtctgcctgtgggatataaatg

SEQ ID NO: 522680 - DNA, 25 bp, Mus musculus
actgtctgcgcacaggagacaaggc

SEQ ID NO: 522681 - DNA, 25 bp, Mus musculus
actgtctgcgcagaggagacaaggc

SEQ ID NO: 522682 - DNA, 25 bp, Mus musculus
actgtctggcctatagcgcttcatc

SEQ ID NO: 522683 - DNA, 25 bp, Mus musculus
actgtctggcctttagcgcttcatc

SEQ ID NO: 522684 - DNA, 25 bp, Mus musculus
actgtctgtactcattgcatctaat

SEQ ID NO: 522685 - DNA, 25 bp, Mus musculus
actgtctgtactgattgcatctaat

SEQ ID NO: 522686 - DNA, 25 bp, Mus musculus
actgtcttatacacaggagacttca

SEQ ID NO: 522687 - DNA, 25 bp, Mus musculus
actgtcttatactcaggagacttca

SEQ ID NO: 522688 - DNA, 25 bp, Mus musculus
actgtctttgatcgcctgatctttc

SEQ ID NO: 522689 - DNA, 25 bp, Mus musculus
actgtctttgatggcctgatctttc

SEQ ID NO: 522690 - DNA, 25 bp, Mus musculus
actgtgaaatccctctaacctgcat

SEQ ID NO: 522691 - DNA, 25 bp, Mus musculus
actgtgaaatccgtctaacctgcat

SEQ ID NO: 522692 - DNA, 25 bp, Mus musculus
actgtgaaccaactggcccatgccc

SEQ ID NO: 522693 - DNA, 25 bp, Mus musculus
actgtgaaccaagtggcccatgccc

SEQ ID NO: 522694 - DNA, 25 bp, Mus musculus
actgtgaaccccaagggtgagctgg

SEQ ID NO: 522695 - DNA, 25 bp, Mus musculus
actgtgaacccctagggtgagctgg

SEQ ID NO: 522696 - DNA, 25 bp, Mus musculus
actgtgaagattcgccggaggcaca

SEQ ID NO: 522697 - DNA, 25 bp, Mus musculus
actgtgaagattggccggaggcaca

SEQ ID NO: 522698 - DNA, 25 bp, Mus musculus
actgtgaagcccaaggcgagagtga

SEQ ID NO: 522699 - DNA, 25 bp, Mus musculus
actgtgaagccctaggcgagagtga

SEQ ID NO: 522700 - DNA, 25 bp, Mus musculus
actgtgaatgacatagacatctttg

SEQ ID NO: 522701 - DNA, 25 bp, Mus musculus
actgtgaatgacttagacatctttg

SEQ ID NO: 522702 - DNA, 25 bp, Mus musculus
actgtgaatgcaagagaggtttccg

SEQ ID NO: 522703 - DNA, 25 bp, Mus musculus
actgtgaatgcatgagaggtttccg

SEQ ID NO: 522704 - DNA, 25 bp, Mus musculus
actgtgacaccaaccctgtcaacgg

SEQ ID NO: 522705 - DNA, 25 bp, Mus musculus
actgtgacaccatccctgtcaacgg

SEQ ID NO: 522706 - DNA, 25 bp, Mus musculus
actgtgacagccagtgcaactcggc

SEQ ID NO: 522707 - DNA, 25 bp, Mus musculus
actgtgacagcctgtgcaactcggc

SEQ ID NO: 522708 - DNA, 25 bp, Mus musculus
actgtgaccgcaacggcaacttcca

SEQ ID NO: 522709 - DNA, 25 bp, Mus musculus
actgtgaccgcatcggcaacttcca

SEQ ID NO: 522710 - DNA, 25 bp, Mus musculus
actgtgaccgcgcgccaggcatcgt

SEQ ID NO: 522711 - DNA, 25 bp, Mus musculus
actgtgaccgcgggccaggcatcgt

SEQ ID NO: 522712 - DNA, 25 bp, Mus musculus
actgtgactactaccggcctcggtt

SEQ ID NO: 522713 - DNA, 25 bp, Mus musculus
actgtgactacttccggcctcggtt

SEQ ID NO: 522714 - DNA, 25 bp, Mus musculus
actgtgacttgtcagttcttcgaat

SEQ ID NO: 522715 - DNA, 25 bp, Mus musculus
actgtgacttgtgagttcttcgaat

SEQ ID NO: 522716 - DNA, 25 bp, Mus musculus
actgtgagtgatctgccaagtggca

SEQ ID NO: 522717 - DNA, 25 bp, Mus musculus
actgtgagtgatgtgccaagtggca

SEQ ID NO: 522718 - DNA, 25 bp, Mus musculus
actgtgatacaacgctttgagaggc

SEQ ID NO: 522719 - DNA, 25 bp, Mus musculus
actgtgatacaaggctttgagaggc

SEQ ID NO: 522720 - DNA, 25 bp, Mus musculus
actgtgatgagaacgctgggacaga

SEQ ID NO: 522721 - DNA, 25 bp, Mus musculus
actgtgatgagatcgctgggacaga

SEQ ID NO: 522722 - DNA, 25 bp, Mus musculus
actgtgatgttgcacaggcaatggc

SEQ ID NO: 522723 - DNA, 25 bp, Mus musculus
actgtgatgttggacaggcaatggc

SEQ ID NO: 522724 - DNA, 25 bp, Mus musculus
actgtgcaaatcaaacatcatggcc

SEQ ID NO: 522725 - DNA, 25 bp, Mus musculus
actgtgcaaatctaacatcatggcc

SEQ ID NO: 522726 - DNA, 25 bp, Mus musculus
actgtgcaactgcatgactacctga

SEQ ID NO: 522727 - DNA, 25 bp, Mus musculus
actgtgcaactggatgactacctga

SEQ ID NO: 522728 - DNA, 25 bp, Mus musculus
actgtgcagaccatcgtcattcttg

SEQ ID NO: 522729 - DNA, 25 bp, Mus musculus
actgtgcagaccttcgtcattcttg

SEQ ID NO: 522730 - DNA, 25 bp, Mus musculus
actgtgcagttgatgctcctggtga

SEQ ID NO: 522731 - DNA, 25 bp, Mus musculus
actgtgcagttgttgctcctggtga

SEQ ID NO: 522732 - DNA, 25 bp, Mus musculus
actgtgccaagtcgtgccctatcaa

SEQ ID NO: 522733 - DNA, 25 bp, Mus musculus
actgtgccaagtggtgccctatcaa

SEQ ID NO: 522734 - DNA, 25 bp, Mus musculus
actgtgccagctactcatagctctg

SEQ ID NO: 522735 - DNA, 25 bp, Mus musculus
actgtgccagcttctcatagctctg

SEQ ID NO: 522736 - DNA, 25 bp, Mus musculus
actgtgccaggtataatttcatttg

SEQ ID NO: 522737 - DNA, 25 bp, Mus musculus
actgtgccaggtttaatttcatttg

SEQ ID NO: 522738 - DNA, 25 bp, Mus musculus
actgtgccatgaagtcagcttctgg

SEQ ID NO: 522739 - DNA, 25 bp, Mus musculus
actgtgccatgatgtcagcttctgg

SEQ ID NO: 522740 - DNA, 25 bp, Mus musculus
actgtgcccgtgcagatgccaaagg

SEQ ID NO: 522741 - DNA, 25 bp, Mus musculus
actgtgcccgtggagatgccaaagg

SEQ ID NO: 522742 - DNA, 25 bp, Mus musculus
actgtgccgagaagccgcaatgacc

SEQ ID NO: 522743 - DNA, 25 bp, Mus musculus
actgtgccgagatgccgcaatgacc

SEQ ID NO: 522744 - DNA, 25 bp, Mus musculus
actgtgcctcagactttcactacga

SEQ ID NO: 522745 - DNA, 25 bp, Mus musculus
actgtgcctcagtctttcactacga

SEQ ID NO: 522746 - DNA, 25 bp, Mus musculus
actgtgctagcgaaagttgtcgctt

SEQ ID NO: 522747 - DNA, 25 bp, Mus musculus
actgtgctagcgtaagttgtcgctt

SEQ ID NO: 522748 - DNA, 25 bp, Mus musculus
actgtgctcaacatggcttatgccc

SEQ ID NO: 522749 - DNA, 25 bp, Mus musculus
actgtgctcaacttggcttatgccc

SEQ ID NO: 522750 - DNA, 25 bp, Mus musculus
actgtgctgtcccagagcctgttta

SEQ ID NO: 522751 - DNA, 25 bp, Mus musculus
actgtgctgtccgagagcctgttta

SEQ ID NO: 522752 - DNA, 25 bp, Mus musculus
actgtgctgtttctccattgtaata

SEQ ID NO: 522753 - DNA, 25 bp, Mus musculus
actgtgctgtttgtccattgtaata

SEQ ID NO: 522754 - DNA, 25 bp, Mus musculus
actgtggaaacacccagtagagagt

SEQ ID NO: 522755 - DNA, 25 bp, Mus musculus
actgtggaaacagccagtagagagt

SEQ ID NO: 522756 - DNA, 25 bp, Mus musculus
actgtggaagtcatcgtggtcaacc

SEQ ID NO: 522757 - DNA, 25 bp, Mus musculus
actgtggaagtcttcgtggtcaacc

SEQ ID NO: 522758 - DNA, 25 bp, Mus musculus
actgtggaggacctggagactctca

SEQ ID NO: 522759 - DNA, 25 bp, Mus musculus
actgtggaggacgtggagactctca

SEQ ID NO: 522760 - DNA, 25 bp, Mus musculus
actgtggagtccacccaggagcaga

SEQ ID NO: 522761 - DNA, 25 bp, Mus musculus
actgtggagtcctcccaggagcaga

SEQ ID NO: 522762 - DNA, 25 bp, Mus musculus
actgtggagtgcacggtcacctatg

SEQ ID NO: 522763 - DNA, 25 bp, Mus musculus
actgtggagtgctcggtcacctatg

SEQ ID NO: 522764 - DNA, 25 bp, Mus musculus
actgtggagtgtctagaccggtacc

SEQ ID NO: 522765 - DNA, 25 bp, Mus musculus
actgtggagtgtgtagaccggtacc

SEQ ID NO: 522766 - DNA, 25 bp, Mus musculus
actgtggcccctcgttcagctgaca

SEQ ID NO: 522767 - DNA, 25 bp, Mus musculus
actgtggcccctggttcagctgaca

SEQ ID NO: 522768 - DNA, 25 bp, Mus musculus
actgtggccctcatggctctcctgg

SEQ ID NO: 522769 - DNA, 25 bp, Mus musculus
actgtggccctcctccttgtgatgc

SEQ ID NO: 522770 - DNA, 25 bp, Mus musculus
actgtggccctcgtccttgtgatgc

SEQ ID NO: 522771 - DNA, 25 bp, Mus musculus
actgtggccctcttggctctcctgg

SEQ ID NO: 522772 - DNA, 25 bp, Mus musculus
actgtggctgggatgaacacttctc

SEQ ID NO: 522773 - DNA, 25 bp, Mus musculus
actgtggctgggttgaacacttctc

SEQ ID NO: 522774 - DNA, 25 bp, Mus musculus
actgtgggaacgcttctgtgctaac

SEQ ID NO: 522775 - DNA, 25 bp, Mus musculus
actgtgggaacggttctgtgctaac

SEQ ID NO: 522776 - DNA, 25 bp, Mus musculus
actgtgggtgatacctccctgagga

SEQ ID NO: 522777 - DNA, 25 bp, Mus musculus
actgtgggtgattcctccctgagga

SEQ ID NO: 522778 - DNA, 25 bp, Mus musculus
actgtggtgccaacaagcctggccc

SEQ ID NO: 522779 - DNA, 25 bp, Mus musculus
actgtggtgccatcaagcctggccc

SEQ ID NO: 522780 - DNA, 25 bp, Mus musculus
actgtggtgtccatgctgtgtctcc

SEQ ID NO: 522781 - DNA, 25 bp, Mus musculus
actgtggtgtccttgctgtgtctcc

SEQ ID NO: 522782 - DNA, 25 bp, Mus musculus
actgtgtacggtatggttttgcaga

SEQ ID NO: 522783 - DNA, 25 bp, Mus musculus
actgtgtacggtttggttttgcaga

SEQ ID NO: 522784 - DNA, 25 bp, Mus musculus
actgtgtcccaacatcaggattggc

SEQ ID NO: 522785 - DNA, 25 bp, Mus musculus
actgtgtcccaagatcaggattggc

SEQ ID NO: 522786 - DNA, 25 bp, Mus musculus
actgtgtcctggacagcccgaggaa

SEQ ID NO: 522787 - DNA, 25 bp, Mus musculus
actgtgtcctggtcagcccgaggaa

SEQ ID NO: 522788 - DNA, 25 bp, Mus musculus
actgtgtccttccacaaatacggaa

SEQ ID NO: 522789 - DNA, 25 bp, Mus musculus
actgtgtccttcgacaaatacggaa

SEQ ID NO: 522790 - DNA, 25 bp, Mus musculus
actgtgtcgggcagctgcaggccct

SEQ ID NO: 522791 - DNA, 25 bp, Mus musculus
actgtgtcgggctgctgcaggccct

SEQ ID NO: 522792 - DNA, 25 bp, Mus musculus
actgtgtctcagcatgagggtgtcc

SEQ ID NO: 522793 - DNA, 25 bp, Mus musculus
actgtgtctcaggatgagggtgtcc

SEQ ID NO: 522794 - DNA, 25 bp, Mus musculus
actgtgtgcagtacatctgtttcaa

SEQ ID NO: 522795 - DNA, 25 bp, Mus musculus
actgtgtgcagttcatctgtttcaa

SEQ ID NO: 522796 - DNA, 25 bp, Mus musculus
actgtgtggccacgagtatggacct

SEQ ID NO: 522797 - DNA, 25 bp, Mus musculus
actgtgtggccaggagtatggacct

SEQ ID NO: 522798 - DNA, 25 bp, Mus musculus
actgtgtgtgtgaccaagccctgaa

SEQ ID NO: 522799 - DNA, 25 bp, Mus musculus
actgtgtgtgtgtccaagccctgaa

SEQ ID NO: 522800 - DNA, 25 bp, Mus musculus
actgtgtgttagaaagtggtaaatc

SEQ ID NO: 522801 - DNA, 25 bp, Mus musculus
actgtgtgttagtaagtggtaaatc

SEQ ID NO: 522802 - DNA, 25 bp, Mus musculus
actgtgtgtttccaaaatggcggcg

SEQ ID NO: 522803 - DNA, 25 bp, Mus musculus
actgtgtgtttcgaaaatggcggcg

SEQ ID NO: 522804 - DNA, 25 bp, Mus musculus
actgtgttcacactccctgcaggga

SEQ ID NO: 522805 - DNA, 25 bp, Mus musculus
actgtgttcacagtccctgcaggga

SEQ ID NO: 522806 - DNA, 25 bp, Mus musculus
actgtgttcatactgtccagtcagc

SEQ ID NO: 522807 - DNA, 25 bp, Mus musculus
actgtgttcatagtgtccagtcagc

SEQ ID NO: 522808 - DNA, 25 bp, Mus musculus
actgtgttccctactctaggcactt

SEQ ID NO: 522809 - DNA, 25 bp, Mus musculus
actgtgttcccttctctaggcactt

SEQ ID NO: 522810 - DNA, 25 bp, Mus musculus
actgtgttgtggaatcactgggccc

SEQ ID NO: 522811 - DNA, 25 bp, Mus musculus
actgtgttgtggtatcactgggccc

SEQ ID NO: 522812 - DNA, 25 bp, Mus musculus
actgtgttttggctggctcacagcc

SEQ ID NO: 522813 - DNA, 25 bp, Mus musculus
actgtgttttgggtggctcacagcc

SEQ ID NO: 522814 - DNA, 25 bp, Mus musculus
actgttaatggtcgtggctgctccc

SEQ ID NO: 522815 - DNA, 25 bp, Mus musculus
actgttaatggtggtggctgctccc

SEQ ID NO: 522816 - DNA, 25 bp, Mus musculus
actgttaccatcatggcactctggc

SEQ ID NO: 522817 - DNA, 25 bp, Mus musculus
actgttaccatcttggcactctggc

SEQ ID NO: 522818 - DNA, 25 bp, Mus musculus
actgttcagcggcatcgatgatcat

SEQ ID NO: 522819 - DNA, 25 bp, Mus musculus
actgttcagcgggatcgatgatcat

SEQ ID NO: 522820 - DNA, 25 bp, Mus musculus
actgttcagtttcttattagcaaag

SEQ ID NO: 522821 - DNA, 25 bp, Mus musculus
actgttcagtttgttattagcaaag

SEQ ID NO: 522822 - DNA, 25 bp, Mus musculus
actgttcattggactgtgtgtgcac

SEQ ID NO: 522823 - DNA, 25 bp, Mus musculus
actgttcattggtctgtgtgtgcac

SEQ ID NO: 522824 - DNA, 25 bp, Mus musculus
actgttccaggtctccacactggat

SEQ ID NO: 522825 - DNA, 25 bp, Mus musculus
actgttccaggtgtccacactggat

SEQ ID NO: 522826 - DNA, 25 bp, Mus musculus
actgttcccaagctcagctgtctga

SEQ ID NO: 522827 - DNA, 25 bp, Mus musculus
actgttcccaaggtcagctgtctga

SEQ ID NO: 522828 - DNA, 25 bp, Mus musculus
actgttctccggctgccttggcagc

SEQ ID NO: 522829 - DNA, 25 bp, Mus musculus
actgttctccgggtgccttggcagc

SEQ ID NO: 522830 - DNA, 25 bp, Mus musculus
actgttcttcttcggctggacagat

SEQ ID NO: 522831 - DNA, 25 bp, Mus musculus
actgttcttcttgggctggacagat

SEQ ID NO: 522832 - DNA, 25 bp, Mus musculus
actgttgctcttcagggctgtctgg

SEQ ID NO: 522833 - DNA, 25 bp, Mus musculus
actgttgctcttgagggctgtctgg

SEQ ID NO: 522834 - DNA, 25 bp, Mus musculus
actgttggagcgcacacagcgcaga

SEQ ID NO: 522835 - DNA, 25 bp, Mus musculus
actgttggagcggacacagcgcaga

SEQ ID NO: 522836 - DNA, 25 bp, Mus musculus
actgttgggatacaatgtctaggga

SEQ ID NO: 522837 - DNA, 25 bp, Mus musculus
actgttgggatagaatgtctaggga

SEQ ID NO: 522838 - DNA, 25 bp, Mus musculus
actgtttacaggagataagatgctg

SEQ ID NO: 522839 - DNA, 25 bp, Mus musculus
actgtttacaggtgataagatgctg

SEQ ID NO: 522840 - DNA, 25 bp, Mus musculus
actgtttagccaactcccattccta

SEQ ID NO: 522841 - DNA, 25 bp, Mus musculus
actgtttagccatctcccattccta

SEQ ID NO: 522842 - DNA, 25 bp, Mus musculus
actgtttcactgctttagaggccca

SEQ ID NO: 522843 - DNA, 25 bp, Mus musculus
actgtttcactggtttagaggccca

SEQ ID NO: 522844 - DNA, 25 bp, Mus musculus
actgtttctcaacagcctgtcccag

SEQ ID NO: 522845 - DNA, 25 bp, Mus musculus
actgtttctcaagagcctgtcccag

SEQ ID NO: 522846 - DNA, 25 bp, Mus musculus
actgtttctgaaagagcatgaccac

SEQ ID NO: 522847 - DNA, 25 bp, Mus musculus
actgtttctgaatgagcatgaccac

SEQ ID NO: 522848 - DNA, 25 bp, Mus musculus
actgtttgaaaccagagttgctaat

SEQ ID NO: 522849 - DNA, 25 bp, Mus musculus
actgtttgaaacgagagttgctaat

SEQ ID NO: 522850 - DNA, 25 bp, Mus musculus
actgtttggagaccattatgatact

SEQ ID NO: 522851 - DNA, 25 bp, Mus musculus
actgtttggagagcattatgatact

SEQ ID NO: 522852 - DNA, 25 bp, Mus musculus
actgtttggatgctgcaacggattt

SEQ ID NO: 522853 - DNA, 25 bp, Mus musculus
actgtttggatggtgcaacggattt

SEQ ID NO: 522854 - DNA, 25 bp, Mus musculus
acttaaacgggccaactggctggca

SEQ ID NO: 522855 - DNA, 25 bp, Mus musculus
acttaaacgggcgaactggctggca

SEQ ID NO: 522856 - DNA, 25 bp, Mus musculus
acttaaagagatagtggctgactct

SEQ ID NO: 522857 - DNA, 25 bp, Mus musculus
acttaaagagattgtggctgactct

SEQ ID NO: 522858 - DNA, 25 bp, Mus musculus
acttaaagccatcgctacacctgag

SEQ ID NO: 522859 - DNA, 25 bp, Mus musculus
acttaaagccatggctacacctgag

SEQ ID NO: 522860 - DNA, 25 bp, Mus musculus
acttaaagcgcgaagccagaaccca

SEQ ID NO: 522861 - DNA, 25 bp, Mus musculus
acttaaagcgcgtagccagaaccca

SEQ ID NO: 522862 - DNA, 25 bp, Mus musculus
acttaacagtgactaaccacgtgta

SEQ ID NO: 522863 - DNA, 25 bp, Mus musculus
acttaacagtgagtaaccacgtgta

SEQ ID NO: 522864 - DNA, 25 bp, Mus musculus
acttaagaatcaagtctctgcatca

SEQ ID NO: 522865 - DNA, 25 bp, Mus musculus
acttaagaatcatgtctctgcatca

SEQ ID NO: 522866 - DNA, 25 bp, Mus musculus
acttaagccaggagtattgaattta

SEQ ID NO: 522867 - DNA, 25 bp, Mus musculus
acttaagccaggtgtattgaattta

SEQ ID NO: 522868 - DNA, 25 bp, Mus musculus
acttaaggccttcatacctcagctg

SEQ ID NO: 522869 - DNA, 25 bp, Mus musculus
acttaaggccttgatacctcagctg

SEQ ID NO: 522870 - DNA, 25 bp, Mus musculus
acttaatgccaaaacgagaatcgta

SEQ ID NO: 522871 - DNA, 25 bp, Mus musculus
acttaatgccaatacgagaatcgta

SEQ ID NO: 522872 - DNA, 25 bp, Mus musculus
acttacaaggacaccggagtagaca

SEQ ID NO: 522873 - DNA, 25 bp, Mus musculus
acttacaaggactccggagtagaca

SEQ ID NO: 522874 - DNA, 25 bp, Mus musculus
acttacagatgtagatcctaactcc

SEQ ID NO: 522875 - DNA, 25 bp, Mus musculus
acttacagatgttgatcctaactcc

SEQ ID NO: 522876 - DNA, 25 bp, Mus musculus
acttacagcaagcatgttaatagcc

SEQ ID NO: 522877 - DNA, 25 bp, Mus musculus
acttacagcaaggatgttaatagcc

SEQ ID NO: 522878 - DNA, 25 bp, Mus musculus
acttacaggcatcggacctgctggc

SEQ ID NO: 522879 - DNA, 25 bp, Mus musculus
acttacaggcatgggacctgctggc

SEQ ID NO: 522880 - DNA, 25 bp, Mus musculus
acttacagtccacagatctcctggc

SEQ ID NO: 522881 - DNA, 25 bp, Mus musculus
acttacagtccagagatctcctggc

SEQ ID NO: 522882 - DNA, 25 bp, Mus musculus
acttaccaaggacgatatcatcaga

SEQ ID NO: 522883 - DNA, 25 bp, Mus musculus
acttaccaaggaggatatcatcaga

SEQ ID NO: 522884 - DNA, 25 bp, Mus musculus
acttaccactggcacacatgtatga

SEQ ID NO: 522885 - DNA, 25 bp, Mus musculus
acttaccactgggacacatgtatga

SEQ ID NO: 522886 - DNA, 25 bp, Mus musculus
acttacctgactccggtgggtgtca

SEQ ID NO: 522887 - DNA, 25 bp, Mus musculus
acttacctgactgcggtgggtgtca

SEQ ID NO: 522888 - DNA, 25 bp, Mus musculus
acttacctggaaccccactggattg

SEQ ID NO: 522889 - DNA, 25 bp, Mus musculus
acttacctggaagcccactggattg

SEQ ID NO: 522890 - DNA, 25 bp, Mus musculus
acttacctggtcctggagttgctgc

SEQ ID NO: 522891 - DNA, 25 bp, Mus musculus
acttacctggtcgtggagttgctgc

SEQ ID NO: 522892 - DNA, 25 bp, Mus musculus
acttacctgtcaacagctccgggct

SEQ ID NO: 522893 - DNA, 25 bp, Mus musculus
acttacctgtcatcagctccgggct

SEQ ID NO: 522894 - DNA, 25 bp, Mus musculus
acttacctgtggcataccatggccg

SEQ ID NO: 522895 - DNA, 25 bp, Mus musculus
acttacctgtgggataccatggccg

SEQ ID NO: 522896 - DNA, 25 bp, Mus musculus
acttaccttagcactgccttcaggg

SEQ ID NO: 522897 - DNA, 25 bp, Mus musculus
acttaccttagctctgccttcaggg

SEQ ID NO: 522898 - DNA, 25 bp, Mus musculus
acttacggagagatggtgttctgtg

SEQ ID NO: 522899 - DNA, 25 bp, Mus musculus
acttacggagagttggtgttctgtg

SEQ ID NO: 522900 - DNA, 25 bp, Mus musculus
acttacgttggtcccttgttcaatg

SEQ ID NO: 522901 - DNA, 25 bp, Mus musculus
acttacgttggtgccttgttcaatg

SEQ ID NO: 522902 - DNA, 25 bp, Mus musculus
acttactacagccacatcatttctg

SEQ ID NO: 522903 - DNA, 25 bp, Mus musculus
acttactacagcgacatcatttctg

SEQ ID NO: 522904 - DNA, 25 bp, Mus musculus
acttactacgtcaacagcctccagg

SEQ ID NO: 522905 - DNA, 25 bp, Mus musculus
acttactacgtctacagcctccagg

SEQ ID NO: 522906 - DNA, 25 bp, Mus musculus
acttactgaacgactctgaggccag

SEQ ID NO: 522907 - DNA, 25 bp, Mus musculus
acttactgaacgtctctgaggccag

SEQ ID NO: 522908 - DNA, 25 bp, Mus musculus
acttactgtatgagaggcccaccct

SEQ ID NO: 522909 - DNA, 25 bp, Mus musculus
acttactgtatgtgaggcccaccct

SEQ ID NO: 522910 - DNA, 25 bp, Mus musculus
acttactgtgtcaccaaggatgacc

SEQ ID NO: 522911 - DNA, 25 bp, Mus musculus
acttactgtgtctccaaggatgacc

SEQ ID NO: 522912 - DNA, 25 bp, Mus musculus
acttagaagatcaaacctctccaga

SEQ ID NO: 522913 - DNA, 25 bp, Mus musculus
acttagaagatctaacctctccaga

SEQ ID NO: 522914 - DNA, 25 bp, Mus musculus
acttagacacttagcacctaaaatg

SEQ ID NO: 522915 - DNA, 25 bp, Mus musculus
acttagacactttgcacctaaaatg

SEQ ID NO: 522916 - DNA, 25 bp, Mus musculus
acttagacatctaggacactgctgg

SEQ ID NO: 522917 - DNA, 25 bp, Mus musculus
acttagacatcttggacactgctgg

SEQ ID NO: 522918 - DNA, 25 bp, Mus musculus
acttagagaaaaccagttgaaaatg

SEQ ID NO: 522919 - DNA, 25 bp, Mus musculus
acttagagaaaagcagttgaaaatg

SEQ ID NO: 522920 - DNA, 25 bp, Mus musculus
acttagagacctccgggctgagatc

SEQ ID NO: 522921 - DNA, 25 bp, Mus musculus
acttagagacctgcgggctgagatc

SEQ ID NO: 522922 - DNA, 25 bp, Mus musculus
acttagatttctagggagatttgga

SEQ ID NO: 522923 - DNA, 25 bp, Mus musculus
acttagatttcttgggagatttgga

SEQ ID NO: 522924 - DNA, 25 bp, Mus musculus
acttagctgggaagtgcgttgctcc

SEQ ID NO: 522925 - DNA, 25 bp, Mus musculus
acttagctgggatgtgcgttgctcc

SEQ ID NO: 522926 - DNA, 25 bp, Mus musculus
acttagctgtgcaatctgagaagga

SEQ ID NO: 522927 - DNA, 25 bp, Mus musculus
acttagctgtgctatctgagaagga

SEQ ID NO: 522928 - DNA, 25 bp, Mus musculus
acttaggccacaccagtgagaagtc

SEQ ID NO: 522929 - DNA, 25 bp, Mus musculus
acttaggccacagcagtgagaagtc

SEQ ID NO: 522930 - DNA, 25 bp, Mus musculus
acttagggcggtctcagccaggctt

SEQ ID NO: 522931 - DNA, 25 bp, Mus musculus
acttagggcggtgtcagccaggctt

SEQ ID NO: 522932 - DNA, 25 bp, Mus musculus
acttatccaaacctgtggctggtac

SEQ ID NO: 522933 - DNA, 25 bp, Mus musculus
acttatccaaacgtgtggctggtac

SEQ ID NO: 522934 - DNA, 25 bp, Mus musculus
acttatctacaacgaggtaatgaac

SEQ ID NO: 522935 - DNA, 25 bp, Mus musculus
acttatctacaaggaggtaatgaac

SEQ ID NO: 522936 - DNA, 25 bp, Mus musculus
acttatctacagagagacatacccc

SEQ ID NO: 522937 - DNA, 25 bp, Mus musculus
acttatctacagtgagacatacccc

SEQ ID NO: 522938 - DNA, 25 bp, Mus musculus
acttatctactgctcacggaccgtg

SEQ ID NO: 522939 - DNA, 25 bp, Mus musculus
acttatctactggtcacggaccgtg

SEQ ID NO: 522940 - DNA, 25 bp, Mus musculus
acttatctatggcaattacttgcag

SEQ ID NO: 522941 - DNA, 25 bp, Mus musculus
acttatctatgggaattacttgcag

SEQ ID NO: 522942 - DNA, 25 bp, Mus musculus
acttatctgaaacagatgtcatttc

SEQ ID NO: 522943 - DNA, 25 bp, Mus musculus
acttatctgaaagagatgtcatttc

SEQ ID NO: 522944 - DNA, 25 bp, Mus musculus
acttatgacccgactacagctgctc

SEQ ID NO: 522945 - DNA, 25 bp, Mus musculus
acttatgacccgtctacagctgctc

SEQ ID NO: 522946 - DNA, 25 bp, Mus musculus
acttatgagacaaacattttcacca

SEQ ID NO: 522947 - DNA, 25 bp, Mus musculus
acttatgagacatacattttcacca

SEQ ID NO: 522948 - DNA, 25 bp, Mus musculus
acttatggacatagacacgctcatg

SEQ ID NO: 522949 - DNA, 25 bp, Mus musculus
acttatggacattgacacgctcatg

SEQ ID NO: 522950 - DNA, 25 bp, Mus musculus
acttatgggacacgtcagattgtgc

SEQ ID NO: 522951 - DNA, 25 bp, Mus musculus
acttatgggacaggtcagattgtgc

SEQ ID NO: 522952 - DNA, 25 bp, Mus musculus
acttcaaaatggagctgtcccgcct

SEQ ID NO: 522953 - DNA, 25 bp, Mus musculus
acttcaaaatggtgctgtcccgcct

SEQ ID NO: 522954 - DNA, 25 bp, Mus musculus
acttcaagaagaatacggtggtgcc

SEQ ID NO: 522955 - DNA, 25 bp, Mus musculus
acttcaagaagattacggtggtgcc

SEQ ID NO: 522956 - DNA, 25 bp, Mus musculus
acttcaaggatgacctgttgaggcc

SEQ ID NO: 522957 - DNA, 25 bp, Mus musculus
acttcaaggatgtcctgttgaggcc

SEQ ID NO: 522958 - DNA, 25 bp, Mus musculus
acttcaaggcccacccagattggaa

SEQ ID NO: 522959 - DNA, 25 bp, Mus musculus
acttcaaggccctcccagattggaa

SEQ ID NO: 522960 - DNA, 25 bp, Mus musculus
acttcaatctgccaatgtgcaaagc

SEQ ID NO: 522961 - DNA, 25 bp, Mus musculus
acttcaatctgcgaatgtgcaaagc

SEQ ID NO: 522962 - DNA, 25 bp, Mus musculus
acttcaatggggaaatggagcagga

SEQ ID NO: 522963 - DNA, 25 bp, Mus musculus
acttcaatggggtaatggagcagga

SEQ ID NO: 522964 - DNA, 25 bp, Mus musculus
acttcacagaggaacgcctggccaa

SEQ ID NO: 522965 - DNA, 25 bp, Mus musculus
acttcacagaggtacgcctggccaa

SEQ ID NO: 522966 - DNA, 25 bp, Mus musculus
acttcacccacccaggcaataaaat

SEQ ID NO: 522967 - DNA, 25 bp, Mus musculus
acttcacccaccgaggcaataaaat

SEQ ID NO: 522968 - DNA, 25 bp, Mus musculus
acttcacctagtaccgtggctacga

SEQ ID NO: 522969 - DNA, 25 bp, Mus musculus
acttcacctagttccgtggctacga

SEQ ID NO: 522970 - DNA, 25 bp, Mus musculus
acttcacgcatcaatgtggccctgg

SEQ ID NO: 522971 - DNA, 25 bp, Mus musculus
acttcacgcatctatgtggccctgg

SEQ ID NO: 522972 - DNA, 25 bp, Mus musculus
acttcactgcaacggccttgggagt

SEQ ID NO: 522973 - DNA, 25 bp, Mus musculus
acttcactgcaagggccttgggagt

SEQ ID NO: 522974 - DNA, 25 bp, Mus musculus
acttcagaagcacccaagcctattc

SEQ ID NO: 522975 - DNA, 25 bp, Mus musculus
acttcagaagcagccaagcctattc

SEQ ID NO: 522976 - DNA, 25 bp, Mus musculus
acttcagactggcaaaaggagaagc

SEQ ID NO: 522977 - DNA, 25 bp, Mus musculus
acttcagactgggaaaaggagaagc

SEQ ID NO: 522978 - DNA, 25 bp, Mus musculus
acttcagatacaaaggtatcccttt

SEQ ID NO: 522979 - DNA, 25 bp, Mus musculus
acttcagatacataggtatcccttt

SEQ ID NO: 522980 - DNA, 25 bp, Mus musculus
acttcagccaagcagcctgtccatc

SEQ ID NO: 522981 - DNA, 25 bp, Mus musculus
acttcagccaaggagcctgtccatc

SEQ ID NO: 522982 - DNA, 25 bp, Mus musculus
acttcagccccaaactacagatgct

SEQ ID NO: 522983 - DNA, 25 bp, Mus musculus
acttcagccccatactacagatgct

SEQ ID NO: 522984 - DNA, 25 bp, Mus musculus
acttcagctcttcttgttcgttgac

SEQ ID NO: 522985 - DNA, 25 bp, Mus musculus
acttcagctcttgttgttcgttgac

SEQ ID NO: 522986 - DNA, 25 bp, Mus musculus
acttcaggacagacatcatggcctg

SEQ ID NO: 522987 - DNA, 25 bp, Mus musculus
acttcaggacagtcatcatggcctg

SEQ ID NO: 522988 - DNA, 25 bp, Mus musculus
acttcaggaggtccagatcaccgag

SEQ ID NO: 522989 - DNA, 25 bp, Mus musculus
acttcaggaggtgcagatcaccgag

SEQ ID NO: 522990 - DNA, 25 bp, Mus musculus
acttcaggatgtacaactcacagag

SEQ ID NO: 522991 - DNA, 25 bp, Mus musculus
acttcaggatgttcaactcacagag

SEQ ID NO: 522992 - DNA, 25 bp, Mus musculus
acttcaggctgaaggcaagagctgt

SEQ ID NO: 522993 - DNA, 25 bp, Mus musculus
acttcaggctgatggcaagagctgt

SEQ ID NO: 522994 - DNA, 25 bp, Mus musculus
acttcagtactaagagtgggtgccc

SEQ ID NO: 522995 - DNA, 25 bp, Mus musculus
acttcagtactatgagtgggtgccc

SEQ ID NO: 522996 - DNA, 25 bp, Mus musculus
acttcagtcagtaacagcccggatt

SEQ ID NO: 522997 - DNA, 25 bp, Mus musculus
acttcagtcagttacagcccggatt

SEQ ID NO: 522998 - DNA, 25 bp, Mus musculus
acttcagtggtgacccaggccagtg

SEQ ID NO: 522999 - DNA, 25 bp, Mus musculus
acttcagtggtgtcccaggccagtg

SEQ ID NO: 523000 - DNA, 25 bp, Mus musculus
acttcagtgttaagagaatgtctcc

SEQ ID NO: 523001 - DNA, 25 bp, Mus musculus
acttcagtgttatgagaatgtctcc

SEQ ID NO: 523002 - DNA, 25 bp, Mus musculus
acttcatagtagaaatgcagttagc

SEQ ID NO: 523003 - DNA, 25 bp, Mus musculus
acttcatagtagtaatgcagttagc

SEQ ID NO: 523004 - DNA, 25 bp, Mus musculus
acttcatcaacacaccctcttagga

SEQ ID NO: 523005 - DNA, 25 bp, Mus musculus
acttcatcaacagaccctcttagga

SEQ ID NO: 523006 - DNA, 25 bp, Mus musculus
acttcatcaagtctgtcatcggcca

SEQ ID NO: 523007 - DNA, 25 bp, Mus musculus
acttcatcaagtgtgtcatcggcca

SEQ ID NO: 523008 - DNA, 25 bp, Mus musculus
acttcatctaccagggcgccagctt

SEQ ID NO: 523009 - DNA, 25 bp, Mus musculus
acttcatctacctgggcgccagctt

SEQ ID NO: 523010 - DNA, 25 bp, Mus musculus
acttcatctccaagcagtgccggga

SEQ ID NO: 523011 - DNA, 25 bp, Mus musculus
acttcatctccatgcagtgccggga

SEQ ID NO: 523012 - DNA, 25 bp, Mus musculus
acttcatctgtcatccccaaaggaa

SEQ ID NO: 523013 - DNA, 25 bp, Mus musculus
acttcatctgtcttccccaaaggaa

SEQ ID NO: 523014 - DNA, 25 bp, Mus musculus
acttcatgatggacatccattatgc

SEQ ID NO: 523015 - DNA, 25 bp, Mus musculus
acttcatgatggtcatccattatgc

SEQ ID NO: 523016 - DNA, 25 bp, Mus musculus
acttcatgtccccaaaatgactcct

SEQ ID NO: 523017 - DNA, 25 bp, Mus musculus
acttcatgtcccgaaaatgactcct

SEQ ID NO: 523018 - DNA, 25 bp, Mus musculus
acttcattctccctaggaggcgctt

SEQ ID NO: 523019 - DNA, 25 bp, Mus musculus
acttcattctccgtaggaggcgctt

SEQ ID NO: 523020 - DNA, 25 bp, Mus musculus
acttcattcttgagagtcatttaaa

SEQ ID NO: 523021 - DNA, 25 bp, Mus musculus
acttcattcttgtgagtcatttaaa

SEQ ID NO: 523022 - DNA, 25 bp, Mus musculus
acttccaacgttagagaggagggcg

SEQ ID NO: 523023 - DNA, 25 bp, Mus musculus
acttccaacgtttgagaggagggcg

SEQ ID NO: 523024 - DNA, 25 bp, Mus musculus
acttccaactgaatatgagaggaac

SEQ ID NO: 523025 - DNA, 25 bp, Mus musculus
acttccaactgattatgagaggaac

SEQ ID NO: 523026 - DNA, 25 bp, Mus musculus
acttccaagagacgtggctcgcaga

SEQ ID NO: 523027 - DNA, 25 bp, Mus musculus
acttccaagagaggtggctcgcaga

SEQ ID NO: 523028 - DNA, 25 bp, Mus musculus
acttccaagccaacggaatggtcag

SEQ ID NO: 523029 - DNA, 25 bp, Mus musculus
acttccaagccatcggaatggtcag

SEQ ID NO: 523030 - DNA, 25 bp, Mus musculus
acttccaagtttcccagagacactg

SEQ ID NO: 523031 - DNA, 25 bp, Mus musculus
acttccaagtttgccagagacactg

SEQ ID NO: 523032 - DNA, 25 bp, Mus musculus
acttccaccaggcagtggacgggct

SEQ ID NO: 523033 - DNA, 25 bp, Mus musculus
acttccaccagggagtggacgggct

SEQ ID NO: 523034 - DNA, 25 bp, Mus musculus
acttccacctccatgtaaaggctgc

SEQ ID NO: 523035 - DNA, 25 bp, Mus musculus
acttccacctccttgtaaaggctgc

SEQ ID NO: 523036 - DNA, 25 bp, Mus musculus
acttccactaccaacacagttatag

SEQ ID NO: 523037 - DNA, 25 bp, Mus musculus
acttccactacctacacagttatag

SEQ ID NO: 523038 - DNA, 25 bp, Mus musculus
acttccactccaaatcgggcaaatg

SEQ ID NO: 523039 - DNA, 25 bp, Mus musculus
acttccactccatatcgggcaaatg

SEQ ID NO: 523040 - DNA, 25 bp, Mus musculus
acttccactgcgagtgccgggctgg

SEQ ID NO: 523041 - DNA, 25 bp, Mus musculus
acttccactgcgtgtgccgggctgg

SEQ ID NO: 523042 - DNA, 25 bp, Mus musculus
acttccaggccccaaatggcagcga

SEQ ID NO: 523043 - DNA, 25 bp, Mus musculus
acttccaggcccgaaatggcagcga

SEQ ID NO: 523044 - DNA, 25 bp, Mus musculus
acttccaggcctccgtactgcaggt

SEQ ID NO: 523045 - DNA, 25 bp, Mus musculus
acttccaggcctgcgtactgcaggt

SEQ ID NO: 523046 - DNA, 25 bp, Mus musculus
acttccaggtatagaaagggtgatg

SEQ ID NO: 523047 - DNA, 25 bp, Mus musculus
acttccaggtattgaaagggtgatg

SEQ ID NO: 523048 - DNA, 25 bp, Mus musculus
acttccagtcaactggatggctcct

SEQ ID NO: 523049 - DNA, 25 bp, Mus musculus
acttccagtcaagtggatggctcct

SEQ ID NO: 523050 - DNA, 25 bp, Mus musculus
acttccagtgcgaggactgcagccc

SEQ ID NO: 523051 - DNA, 25 bp, Mus musculus
acttccagtgcgtggactgcagccc

SEQ ID NO: 523052 - DNA, 25 bp, Mus musculus
acttccataaatactctgtggcggg

SEQ ID NO: 523053 - DNA, 25 bp, Mus musculus
acttccataaattctctgtggcggg

SEQ ID NO: 523054 - DNA, 25 bp, Mus musculus
acttccatgaagagtgtgatgctga

SEQ ID NO: 523055 - DNA, 25 bp, Mus musculus
acttccatgaagtgtgtgatgctga

SEQ ID NO: 523056 - DNA, 25 bp, Mus musculus
acttccatgtctcaactgaagaatg

SEQ ID NO: 523057 - DNA, 25 bp, Mus musculus
acttccatgtctgaactgaagaatg

SEQ ID NO: 523058 - DNA, 25 bp, Mus musculus
acttccatgtgtactatcagctgct

SEQ ID NO: 523059 - DNA, 25 bp, Mus musculus
acttccatgtgttctatcagctgct

SEQ ID NO: 523060 - DNA, 25 bp, Mus musculus
acttccatttgtccccacgtatgca

SEQ ID NO: 523061 - DNA, 25 bp, Mus musculus
acttccatttgtgcccacgtatgca

SEQ ID NO: 523062 - DNA, 25 bp, Mus musculus
acttcccagcaaactccagcttatg

SEQ ID NO: 523063 - DNA, 25 bp, Mus musculus
acttcccagcaatctccagcttatg

SEQ ID NO: 523064 - DNA, 25 bp, Mus musculus
acttccccaagcagccgggctggag

SEQ ID NO: 523065 - DNA, 25 bp, Mus musculus
acttccccaagctgccgggctggag

SEQ ID NO: 523066 - DNA, 25 bp, Mus musculus
acttccccagggacatgccgttatc

SEQ ID NO: 523067 - DNA, 25 bp, Mus musculus
acttccccagggtcatgccgttatc

SEQ ID NO: 523068 - DNA, 25 bp, Mus musculus
acttcccgacagagcccaagctgat

SEQ ID NO: 523069 - DNA, 25 bp, Mus musculus
acttcccgacagtgcccaagctgat

SEQ ID NO: 523070 - DNA, 25 bp, Mus musculus
acttccctaagccatgctcagcagt

SEQ ID NO: 523071 - DNA, 25 bp, Mus musculus
acttccctaagcgatgctcagcagt

SEQ ID NO: 523072 - DNA, 25 bp, Mus musculus
acttccctctcgctgtatttgatag

SEQ ID NO: 523073 - DNA, 25 bp, Mus musculus
acttccctctcggtgtatttgatag

SEQ ID NO: 523074 - DNA, 25 bp, Mus musculus
acttccctgtgcagctgctagagag

SEQ ID NO: 523075 - DNA, 25 bp, Mus musculus
acttccctgtgctgctgctagagag

SEQ ID NO: 523076 - DNA, 25 bp, Mus musculus
acttccgcaaaccaaggcggcctgg

SEQ ID NO: 523077 - DNA, 25 bp, Mus musculus
acttccgcaaacgaaggcggcctgg

SEQ ID NO: 523078 - DNA, 25 bp, Mus musculus
acttccgcctgactggtggacgagt

SEQ ID NO: 523079 - DNA, 25 bp, Mus musculus
acttccgcctgagtggtggacgagt

SEQ ID NO: 523080 - DNA, 25 bp, Mus musculus
acttccgggccgagcagtgtgcaga

SEQ ID NO: 523081 - DNA, 25 bp, Mus musculus
acttccgggccgtgcagtgtgcaga

SEQ ID NO: 523082 - DNA, 25 bp, Mus musculus
acttccgttgggaggcttagtcaca

SEQ ID NO: 523083 - DNA, 25 bp, Mus musculus
acttccgttgggtggcttagtcaca

SEQ ID NO: 523084 - DNA, 25 bp, Mus musculus
acttcctcccacaagaagcagagag

SEQ ID NO: 523085 - DNA, 25 bp, Mus musculus
acttcctcccactagaagcagagag

SEQ ID NO: 523086 - DNA, 25 bp, Mus musculus
acttcctcgacaatctcctgggtgc

SEQ ID NO: 523087 - DNA, 25 bp, Mus musculus
acttcctcgacattctcctgggtgc

SEQ ID NO: 523088 - DNA, 25 bp, Mus musculus
acttcctgcaggctggctacgatgt

SEQ ID NO: 523089 - DNA, 25 bp, Mus musculus
acttcctgcagggtggctacgatgt

SEQ ID NO: 523090 - DNA, 25 bp, Mus musculus
acttcctgccagagattgggttggt

SEQ ID NO: 523091 - DNA, 25 bp, Mus musculus
acttcctgccagtgattgggttggt

SEQ ID NO: 523092 - DNA, 25 bp, Mus musculus
acttcctgggccaggagttggcgat

SEQ ID NO: 523093 - DNA, 25 bp, Mus musculus
acttcctgggcctggagttggcgat

SEQ ID NO: 523094 - DNA, 25 bp, Mus musculus
acttcctgggctatctgcggcggct

SEQ ID NO: 523095 - DNA, 25 bp, Mus musculus
acttcctgggctttctgcggcggct

SEQ ID NO: 523096 - DNA, 25 bp, Mus musculus
acttcctgtagccatggctgcggcg

SEQ ID NO: 523097 - DNA, 25 bp, Mus musculus
acttcctgtagcgatggctgcggcg

SEQ ID NO: 523098 - DNA, 25 bp, Mus musculus
acttcctgtgcacccggcggagaca

SEQ ID NO: 523099 - DNA, 25 bp, Mus musculus
acttcctgtgcagccggcggagaca

SEQ ID NO: 523100 - DNA, 25 bp, Mus musculus
acttccttctagcagtggaatgtga

SEQ ID NO: 523101 - DNA, 25 bp, Mus musculus
acttccttctaggagtggaatgtga

SEQ ID NO: 523102 - DNA, 25 bp, Mus musculus
acttcgaagctcagcagcacgtgcc

SEQ ID NO: 523103 - DNA, 25 bp, Mus musculus
acttcgaagctctgcagcacgtgcc

SEQ ID NO: 523104 - DNA, 25 bp, Mus musculus
acttcgaatgcacatcattgacaag

SEQ ID NO: 523105 - DNA, 25 bp, Mus musculus
acttcgaatgcagatcattgacaag

SEQ ID NO: 523106 - DNA, 25 bp, Mus musculus
acttcgactgccaccagagcgtcgg

SEQ ID NO: 523107 - DNA, 25 bp, Mus musculus
acttcgactgcctccagagcgtcgg

SEQ ID NO: 523108 - DNA, 25 bp, Mus musculus
acttcgagaagtaccaggctacttc

SEQ ID NO: 523109 - DNA, 25 bp, Mus musculus
acttcgagaagttccaggctacttc

SEQ ID NO: 523110 - DNA, 25 bp, Mus musculus
acttcgaggcttcatgattgtctac

SEQ ID NO: 523111 - DNA, 25 bp, Mus musculus
acttcgaggcttgatgattgtctac

SEQ ID NO: 523112 - DNA, 25 bp, Mus musculus
acttcgagtcccctggagcgccgtg

SEQ ID NO: 523113 - DNA, 25 bp, Mus musculus
acttcgagtcccgtggagcgccgtg

SEQ ID NO: 523114 - DNA, 25 bp, Mus musculus
acttcgatgaatatccagagtctga

SEQ ID NO: 523115 - DNA, 25 bp, Mus musculus
acttcgatgaatttccagagtctga

SEQ ID NO: 523116 - DNA, 25 bp, Mus musculus
acttcgcagagacttttcccggaca

SEQ ID NO: 523117 - DNA, 25 bp, Mus musculus
acttcgcagagagttttcccggaca

SEQ ID NO: 523118 - DNA, 25 bp, Mus musculus
acttcgcctgagacgtgttgcgggc

SEQ ID NO: 523119 - DNA, 25 bp, Mus musculus
acttcgcctgagtcgtgttgcgggc

SEQ ID NO: 523120 - DNA, 25 bp, Mus musculus
acttcgcctgtcagacgactggaga

SEQ ID NO: 523121 - DNA, 25 bp, Mus musculus
acttcgcctgtctgacgactggaga

SEQ ID NO: 523122 - DNA, 25 bp, Mus musculus
acttcggaatggctgctgataagaa

SEQ ID NO: 523123 - DNA, 25 bp, Mus musculus
acttcggaatgggtgctgataagaa

SEQ ID NO: 523124 - DNA, 25 bp, Mus musculus
acttcggagcctctatggcacacct

SEQ ID NO: 523125 - DNA, 25 bp, Mus musculus
acttcggagcctgtatggcacacct

SEQ ID NO: 523126 - DNA, 25 bp, Mus musculus
acttcggaggccaaagattcatggg

SEQ ID NO: 523127 - DNA, 25 bp, Mus musculus
acttcggaggcctaagattcatggg

SEQ ID NO: 523128 - DNA, 25 bp, Mus musculus
acttcggctcctagaggagttggcg

SEQ ID NO: 523129 - DNA, 25 bp, Mus musculus
acttcggctccttgaggagttggcg

SEQ ID NO: 523130 - DNA, 25 bp, Mus musculus
acttcgggatcgaggaagggctaat

SEQ ID NO: 523131 - DNA, 25 bp, Mus musculus
acttcgggatcgtggaagggctaat

SEQ ID NO: 523132 - DNA, 25 bp, Mus musculus
acttcggtgatcaacttcagttcag

SEQ ID NO: 523133 - DNA, 25 bp, Mus musculus
acttcggtgatctacttcagttcag

SEQ ID NO: 523134 - DNA, 25 bp, Mus musculus
acttcggtgtgccttcgagcacatg

SEQ ID NO: 523135 - DNA, 25 bp, Mus musculus
acttcggtgtgcgttcgagcacatg

SEQ ID NO: 523136 - DNA, 25 bp, Mus musculus
acttcggtgttgcagtcttgtgtcc

SEQ ID NO: 523137 - DNA, 25 bp, Mus musculus
acttcggtgttggagtcttgtgtcc

SEQ ID NO: 523138 - DNA, 25 bp, Mus musculus
acttcgtacctgacctataatgact

SEQ ID NO: 523139 - DNA, 25 bp, Mus musculus
acttcgtacctgtcctataatgact

SEQ ID NO: 523140 - DNA, 25 bp, Mus musculus
acttcgtaggccagactggacttga

SEQ ID NO: 523141 - DNA, 25 bp, Mus musculus
acttcgtaggcctgactggacttga

SEQ ID NO: 523142 - DNA, 25 bp, Mus musculus
acttcgtgatgacaaagctgaagga

SEQ ID NO: 523143 - DNA, 25 bp, Mus musculus
acttcgtgatgagaaagctgaagga

SEQ ID NO: 523144 - DNA, 25 bp, Mus musculus
acttcgtggtgtccggctgctttca

SEQ ID NO: 523145 - DNA, 25 bp, Mus musculus
acttcgtggtgtgcggctgctttca

SEQ ID NO: 523146 - DNA, 25 bp, Mus musculus
acttctactacaaaagcaccaaggg

SEQ ID NO: 523147 - DNA, 25 bp, Mus musculus
acttctactacataagcaccaaggg

SEQ ID NO: 523148 - DNA, 25 bp, Mus musculus
acttctactgcaaacatggtcaacg

SEQ ID NO: 523149 - DNA, 25 bp, Mus musculus
acttctactgcatacatggtcaacg

SEQ ID NO: 523150 - DNA, 25 bp, Mus musculus
acttctagagtcagtgaagcctcag

SEQ ID NO: 523151 - DNA, 25 bp, Mus musculus
acttctagagtctgtgaagcctcag

SEQ ID NO: 523152 - DNA, 25 bp, Mus musculus
acttctatgtccagggtagaggcca

SEQ ID NO: 523153 - DNA, 25 bp, Mus musculus
acttctatgtcctgggtagaggcca

SEQ ID NO: 523154 - DNA, 25 bp, Mus musculus
acttctcaatgaccgctgccacgtt

SEQ ID NO: 523155 - DNA, 25 bp, Mus musculus
acttctcaatgagcgctgccacgtt

SEQ ID NO: 523156 - DNA, 25 bp, Mus musculus
acttctcacggaccagtcggagagc

SEQ ID NO: 523157 - DNA, 25 bp, Mus musculus
acttctcacggagcagtcggagagc

SEQ ID NO: 523158 - DNA, 25 bp, Mus musculus
acttctcattctcgatcgctgcgat

SEQ ID NO: 523159 - DNA, 25 bp, Mus musculus
acttctcattctggatcgctgcgat

SEQ ID NO: 523160 - DNA, 25 bp, Mus musculus
acttctcatttacaccgagtttggc

SEQ ID NO: 523161 - DNA, 25 bp, Mus musculus
acttctcatttagaccgagtttggc

SEQ ID NO: 523162 - DNA, 25 bp, Mus musculus
acttctccagagattcagtgaccac

SEQ ID NO: 523163 - DNA, 25 bp, Mus musculus
acttctccagagtttcagtgaccac

SEQ ID NO: 523164 - DNA, 25 bp, Mus musculus
acttctccaggtcattgtcaaagga

SEQ ID NO: 523165 - DNA, 25 bp, Mus musculus
acttctccaggtgattgtcaaagga

SEQ ID NO: 523166 - DNA, 25 bp, Mus musculus
acttctcggacaatgaggcagaccg

SEQ ID NO: 523167 - DNA, 25 bp, Mus musculus
acttctcggacattgaggcagaccg

SEQ ID NO: 523168 - DNA, 25 bp, Mus musculus
acttctctccgaagagcgtagcgac

SEQ ID NO: 523169 - DNA, 25 bp, Mus musculus
acttctctccgatgagcgtagcgac

SEQ ID NO: 523170 - DNA, 25 bp, Mus musculus
acttctctccggatgagtgggaatg

SEQ ID NO: 523171 - DNA, 25 bp, Mus musculus
acttctctccggttgagtgggaatg

SEQ ID NO: 523172 - DNA, 25 bp, Mus musculus
acttctctgaaaatgccgccaggca

SEQ ID NO: 523173 - DNA, 25 bp, Mus musculus
acttctctgaaattgccgccaggca

SEQ ID NO: 523174 - DNA, 25 bp, Mus musculus
acttctctgatgagatccccgtgga

SEQ ID NO: 523175 - DNA, 25 bp, Mus musculus
acttctctgatgtgatccccgtgga

SEQ ID NO: 523176 - DNA, 25 bp, Mus musculus
acttctctgattcgtccagctttaa

SEQ ID NO: 523177 - DNA, 25 bp, Mus musculus
acttctctgattggtccagctttaa

SEQ ID NO: 523178 - DNA, 25 bp, Mus musculus
acttctctgtcccttgcgcaagtgg

SEQ ID NO: 523179 - DNA, 25 bp, Mus musculus
acttctctgtccgttgcgcaagtgg

SEQ ID NO: 523180 - DNA, 25 bp, Mus musculus
acttctctttctacatcctgaggac

SEQ ID NO: 523181 - DNA, 25 bp, Mus musculus
acttctctttcttcatcctgaggac

SEQ ID NO: 523182 - DNA, 25 bp, Mus musculus
acttctgacagaacagaacgatgaa

SEQ ID NO: 523183 - DNA, 25 bp, Mus musculus
acttctgacagatcagaacgatgaa

SEQ ID NO: 523184 - DNA, 25 bp, Mus musculus
acttctgcaaaaagggtacggcttg

SEQ ID NO: 523185 - DNA, 25 bp, Mus musculus
acttctgcaaaatgggtacggcttg

SEQ ID NO: 523186 - DNA, 25 bp, Mus musculus
acttctgcagttcaaagggtccatg

SEQ ID NO: 523187 - DNA, 25 bp, Mus musculus
acttctgcagttgaaagggtccatg

SEQ ID NO: 523188 - DNA, 25 bp, Mus musculus
acttctgccgcaatccagacagcag

SEQ ID NO: 523189 - DNA, 25 bp, Mus musculus
acttctgccgcattccagacagcag

SEQ ID NO: 523190 - DNA, 25 bp, Mus musculus
acttctgcctgaaaccgaccctttg

SEQ ID NO: 523191 - DNA, 25 bp, Mus musculus
acttctgcctgataccgaccctttg

SEQ ID NO: 523192 - DNA, 25 bp, Mus musculus
acttctgctgcaccgatgacgtgtt

SEQ ID NO: 523193 - DNA, 25 bp, Mus musculus
acttctgctgcagcgatgacgtgtt

SEQ ID NO: 523194 - DNA, 25 bp, Mus musculus
acttctggagggagagtggcacaca

SEQ ID NO: 523195 - DNA, 25 bp, Mus musculus
acttctggagggtgagtggcacaca

SEQ ID NO: 523196 - DNA, 25 bp, Mus musculus
acttctggcgatccaggctttccag

SEQ ID NO: 523197 - DNA, 25 bp, Mus musculus
acttctggcgatgcaggctttccag

SEQ ID NO: 523198 - DNA, 25 bp, Mus musculus
acttctggctgtacattgaaggcct

SEQ ID NO: 523199 - DNA, 25 bp, Mus musculus
acttctggctgttcattgaaggcct

SEQ ID NO: 523200 - DNA, 25 bp, Mus musculus
acttctgggttgctgggctacctgc

SEQ ID NO: 523201 - DNA, 25 bp, Mus musculus
acttctgggttggtgggctacctgc

SEQ ID NO: 523202 - DNA, 25 bp, Mus musculus
acttctggtctcaccacatgctgct

SEQ ID NO: 523203 - DNA, 25 bp, Mus musculus
acttctggtctctccacatgctgct

SEQ ID NO: 523204 - DNA, 25 bp, Mus musculus
acttctggtggcagatgaagtatgg

SEQ ID NO: 523205 - DNA, 25 bp, Mus musculus
acttctggtggctgatgaagtatgg

SEQ ID NO: 523206 - DNA, 25 bp, Mus musculus
acttctgtctttaaggtgtctgcct

SEQ ID NO: 523207 - DNA, 25 bp, Mus musculus
acttctgtcttttaggtgtctgcct

SEQ ID NO: 523208 - DNA, 25 bp, Mus musculus
acttctgtgggcagacgctgacatt

SEQ ID NO: 523209 - DNA, 25 bp, Mus musculus
acttctgtgggctgacgctgacatt

SEQ ID NO: 523210 - DNA, 25 bp, Mus musculus
acttctgtgtttaaggattctgccc

SEQ ID NO: 523211 - DNA, 25 bp, Mus musculus
acttctgtgttttaggattctgccc

SEQ ID NO: 523212 - DNA, 25 bp, Mus musculus
acttctgtttcccagtctatgttca

SEQ ID NO: 523213 - DNA, 25 bp, Mus musculus
acttctgtttccgagtctatgttca

SEQ ID NO: 523214 - DNA, 25 bp, Mus musculus
acttcttcaccaactggctggattt

SEQ ID NO: 523215 - DNA, 25 bp, Mus musculus
acttcttcaccatctggctggattt

SEQ ID NO: 523216 - DNA, 25 bp, Mus musculus
acttcttcagcaactttgtgtcctg

SEQ ID NO: 523217 - DNA, 25 bp, Mus musculus
acttcttcagcatctttgtgtcctg

SEQ ID NO: 523218 - DNA, 25 bp, Mus musculus
acttcttcagggagagagtcctcag

SEQ ID NO: 523219 - DNA, 25 bp, Mus musculus
acttcttcagggtgagagtcctcag

SEQ ID NO: 523220 - DNA, 25 bp, Mus musculus
acttcttcatgtagctaacactggg

SEQ ID NO: 523221 - DNA, 25 bp, Mus musculus
acttcttcatgttgctaacactggg

SEQ ID NO: 523222 - DNA, 25 bp, Mus musculus
acttcttcgtgaagagtgattacag

SEQ ID NO: 523223 - DNA, 25 bp, Mus musculus
acttcttcgtgatgagtgattacag

SEQ ID NO: 523224 - DNA, 25 bp, Mus musculus
acttcttggacacctgagaaatcca

SEQ ID NO: 523225 - DNA, 25 bp, Mus musculus
acttcttggacagctgagaaatcca

SEQ ID NO: 523226 - DNA, 25 bp, Mus musculus
acttcttggagaactatggtgacgc

SEQ ID NO: 523227 - DNA, 25 bp, Mus musculus
acttcttggagatctatggtgacgc

SEQ ID NO: 523228 - DNA, 25 bp, Mus musculus
acttcttggctgatgtcctgtggca

SEQ ID NO: 523229 - DNA, 25 bp, Mus musculus
acttcttggctgttgtcctgtggca

SEQ ID NO: 523230 - DNA, 25 bp, Mus musculus
acttcttggtgccagagagcacgac

SEQ ID NO: 523231 - DNA, 25 bp, Mus musculus
acttcttggtgcgagagagcacgac

SEQ ID NO: 523232 - DNA, 25 bp, Mus musculus
acttcttgtctcctgataaccctct

SEQ ID NO: 523233 - DNA, 25 bp, Mus musculus
acttcttgtctcgtgataaccctct

SEQ ID NO: 523234 - DNA, 25 bp, Mus musculus
acttcttgtgcgcagctagccgcct

SEQ ID NO: 523235 - DNA, 25 bp, Mus musculus
acttcttgtgcggagctagccgcct

SEQ ID NO: 523236 - DNA, 25 bp, Mus musculus
acttgaaacccaccaggaaggtctt

SEQ ID NO: 523237 - DNA, 25 bp, Mus musculus
acttgaaacccagcaggaaggtctt

SEQ ID NO: 523238 - DNA, 25 bp, Mus musculus
acttgaaaggctcgacctgaagaag

SEQ ID NO: 523239 - DNA, 25 bp, Mus musculus
acttgaaaggctggacctgaagaag

SEQ ID NO: 523240 - DNA, 25 bp, Mus musculus
acttgaacaagaatagacttgactg

SEQ ID NO: 523241 - DNA, 25 bp, Mus musculus
acttgaacaagattagacttgactg

SEQ ID NO: 523242 - DNA, 25 bp, Mus musculus
acttgaacaataaggtagtagttgc

SEQ ID NO: 523243 - DNA, 25 bp, Mus musculus
acttgaacaatatggtagtagttgc

SEQ ID NO: 523244 - DNA, 25 bp, Mus musculus
acttgaaccccaaattgcttcagca

SEQ ID NO: 523245 - DNA, 25 bp, Mus musculus
acttgaaccccatattgcttcagca

SEQ ID NO: 523246 - DNA, 25 bp, Mus musculus
acttgaagagcaaggcagatgggca

SEQ ID NO: 523247 - DNA, 25 bp, Mus musculus
acttgaagagcatggcagatgggca

SEQ ID NO: 523248 - DNA, 25 bp, Mus musculus
acttgaatacagaagaggttctagg

SEQ ID NO: 523249 - DNA, 25 bp, Mus musculus
acttgaatacagtagaggttctagg

SEQ ID NO: 523250 - DNA, 25 bp, Mus musculus
acttgaatgtagaatcggtgagcac

SEQ ID NO: 523251 - DNA, 25 bp, Mus musculus
acttgaatgtagtatcggtgagcac

SEQ ID NO: 523252 - DNA, 25 bp, Mus musculus
acttgaattggtagctctcccaggc

SEQ ID NO: 523253 - DNA, 25 bp, Mus musculus
acttgaattggttgctctcccaggc

SEQ ID NO: 523254 - DNA, 25 bp, Mus musculus
acttgacacaagctttggtgaagaa

SEQ ID NO: 523255 - DNA, 25 bp, Mus musculus
acttgacacaaggtttggtgaagaa

SEQ ID NO: 523256 - DNA, 25 bp, Mus musculus
acttgaccagctccggcaggaggcc

SEQ ID NO: 523257 - DNA, 25 bp, Mus musculus
acttgaccagctgcggcaggaggcc

SEQ ID NO: 523258 - DNA, 25 bp, Mus musculus
acttgaccggctccttctggaatga

SEQ ID NO: 523259 - DNA, 25 bp, Mus musculus
acttgaccggctgcttctggaatga

SEQ ID NO: 523260 - DNA, 25 bp, Mus musculus
acttgactgacccatctgtaataaa

SEQ ID NO: 523261 - DNA, 25 bp, Mus musculus
acttgactgaccgatctgtaataaa

SEQ ID NO: 523262 - DNA, 25 bp, Mus musculus
acttgaggccagagataaagcagga

SEQ ID NO: 523263 - DNA, 25 bp, Mus musculus
acttgaggccagtgataaagcagga

SEQ ID NO: 523264 - DNA, 25 bp, Mus musculus
acttgaggcgttacaatgaagccat

SEQ ID NO: 523265 - DNA, 25 bp, Mus musculus
acttgaggcgtttcaatgaagccat

SEQ ID NO: 523266 - DNA, 25 bp, Mus musculus
acttgagtggccaatacgagagggc

SEQ ID NO: 523267 - DNA, 25 bp, Mus musculus
acttgagtggcctatacgagagggc

SEQ ID NO: 523268 - DNA, 25 bp, Mus musculus
acttgatcctaaccatggcagatgg

SEQ ID NO: 523269 - DNA, 25 bp, Mus musculus
acttgatcctaagcatggcagatgg

SEQ ID NO: 523270 - DNA, 25 bp, Mus musculus
acttgatgaatcaagcaaggctcaa

SEQ ID NO: 523271 - DNA, 25 bp, Mus musculus
acttgatgaatctagcaaggctcaa

SEQ ID NO: 523272 - DNA, 25 bp, Mus musculus
acttgatgcatcagaagaagccagg

SEQ ID NO: 523273 - DNA, 25 bp, Mus musculus
acttgatgcatctgaagaagccagg

SEQ ID NO: 523274 - DNA, 25 bp, Mus musculus
acttgatgtgacaagatgtgggcac

SEQ ID NO: 523275 - DNA, 25 bp, Mus musculus
acttgatgtgactagatgtgggcac

SEQ ID NO: 523276 - DNA, 25 bp, Mus musculus
acttgattgaagagttccgtccttg

SEQ ID NO: 523277 - DNA, 25 bp, Mus musculus
acttgattgaagtgttccgtccttg

SEQ ID NO: 523278 - DNA, 25 bp, Mus musculus
acttgcaaacataactgctatggac

SEQ ID NO: 523279 - DNA, 25 bp, Mus musculus
acttgcaaacattactgctatggac

SEQ ID NO: 523280 - DNA, 25 bp, Mus musculus
acttgcaatgatctggacgcgtctg

SEQ ID NO: 523281 - DNA, 25 bp, Mus musculus
acttgcaatgatgtggacgcgtctg

SEQ ID NO: 523282 - DNA, 25 bp, Mus musculus
acttgcaccagacgatagataggtt

SEQ ID NO: 523283 - DNA, 25 bp, Mus musculus
acttgcaccagaggatagataggtt

SEQ ID NO: 523284 - DNA, 25 bp, Mus musculus
acttgcacttttcatagttactata

SEQ ID NO: 523285 - DNA, 25 bp, Mus musculus
acttgcacttttgatagttactata

SEQ ID NO: 523286 - DNA, 25 bp, Mus musculus
acttgcagagctatggccttgacaa

SEQ ID NO: 523287 - DNA, 25 bp, Mus musculus
acttgcagagctttggccttgacaa

SEQ ID NO: 523288 - DNA, 25 bp, Mus musculus
acttgcagcagcatttcatgaagaa

SEQ ID NO: 523289 - DNA, 25 bp, Mus musculus
acttgcagcagcttttcatgaagaa

SEQ ID NO: 523290 - DNA, 25 bp, Mus musculus
acttgcataaacagccggccgagca

SEQ ID NO: 523291 - DNA, 25 bp, Mus musculus
acttgcataaactgccggccgagca

SEQ ID NO: 523292 - DNA, 25 bp, Mus musculus
acttgccacggtcaggaaacagcag

SEQ ID NO: 523293 - DNA, 25 bp, Mus musculus
acttgccacggtgaggaaacagcag

SEQ ID NO: 523294 - DNA, 25 bp, Mus musculus
acttgccaggagctccaaggagctg

SEQ ID NO: 523295 - DNA, 25 bp, Mus musculus
acttgccaggaggtccaaggagctg

SEQ ID NO: 523296 - DNA, 25 bp, Mus musculus
acttgccatggtagtgcctccccag

SEQ ID NO: 523297 - DNA, 25 bp, Mus musculus
acttgccatggttgtgcctccccag

SEQ ID NO: 523298 - DNA, 25 bp, Mus musculus
acttgccctgtgccacctcagagtt

SEQ ID NO: 523299 - DNA, 25 bp, Mus musculus
acttgccctgtggcacctcagagtt

SEQ ID NO: 523300 - DNA, 25 bp, Mus musculus
acttgccgaaaaacagccagagcta

SEQ ID NO: 523301 - DNA, 25 bp, Mus musculus
acttgccgaaaatcagccagagcta

SEQ ID NO: 523302 - DNA, 25 bp, Mus musculus
acttgccgagagcatccgtgccggt

SEQ ID NO: 523303 - DNA, 25 bp, Mus musculus
acttgccgagaggatccgtgccggt

SEQ ID NO: 523304 - DNA, 25 bp, Mus musculus
acttgccgtatgaccagatcctgaa

SEQ ID NO: 523305 - DNA, 25 bp, Mus musculus
acttgccgtatgtccagatcctgaa

SEQ ID NO: 523306 - DNA, 25 bp, Mus musculus
acttgcctgtaaacctcataaccaa

SEQ ID NO: 523307 - DNA, 25 bp, Mus musculus
acttgcctgtaatcctcataaccaa

SEQ ID NO: 523308 - DNA, 25 bp, Mus musculus
acttgcctttatccagaatgggaga

SEQ ID NO: 523309 - DNA, 25 bp, Mus musculus
acttgcctttatgcagaatgggaga

SEQ ID NO: 523310 - DNA, 25 bp, Mus musculus
acttgcctttgcagactcagttcaa

SEQ ID NO: 523311 - DNA, 25 bp, Mus musculus
acttgcctttgctgactcagttcaa

SEQ ID NO: 523312 - DNA, 25 bp, Mus musculus
acttgcgatgtacctaagggatggc

SEQ ID NO: 523313 - DNA, 25 bp, Mus musculus
acttgcgatgtagctaagggatggc

SEQ ID NO: 523314 - DNA, 25 bp, Mus musculus
acttgcgggctgagggagacgagtt

SEQ ID NO: 523315 - DNA, 25 bp, Mus musculus
acttgcgggctgtgggagacgagtt

SEQ ID NO: 523316 - DNA, 25 bp, Mus musculus
acttgctcaacacggtgaagcagaa

SEQ ID NO: 523317 - DNA, 25 bp, Mus musculus
acttgctcaacagggtgaagcagaa

SEQ ID NO: 523318 - DNA, 25 bp, Mus musculus
acttgctctgcaagggcccagagct

SEQ ID NO: 523319 - DNA, 25 bp, Mus musculus
acttgctctgcatgggcccagagct

SEQ ID NO: 523320 - DNA, 25 bp, Mus musculus
acttgctctggaagggagagctatg

SEQ ID NO: 523321 - DNA, 25 bp, Mus musculus
acttgctctggatgggagagctatg

SEQ ID NO: 523322 - DNA, 25 bp, Mus musculus
acttgctgaattcgctagactagcc

SEQ ID NO: 523323 - DNA, 25 bp, Mus musculus
acttgctgaattggctagactagcc

SEQ ID NO: 523324 - DNA, 25 bp, Mus musculus
acttgctgagtacaccagtatggac

SEQ ID NO: 523325 - DNA, 25 bp, Mus musculus
acttgctgagtagaccagtatggac

SEQ ID NO: 523326 - DNA, 25 bp, Mus musculus
acttgctgccgacaacattggctgg

SEQ ID NO: 523327 - DNA, 25 bp, Mus musculus
acttgctgccgagaacattggctgg

SEQ ID NO: 523328 - DNA, 25 bp, Mus musculus
acttgctgcgctctgggatttgctt

SEQ ID NO: 523329 - DNA, 25 bp, Mus musculus
acttgctgcgctgtgggatttgctt

SEQ ID NO: 523330 - DNA, 25 bp, Mus musculus
acttgctggaacacatctgctcttg

SEQ ID NO: 523331 - DNA, 25 bp, Mus musculus
acttgctggaactcatctgctcttg

SEQ ID NO: 523332 - DNA, 25 bp, Mus musculus
acttgctgggcaaccctcttggcca

SEQ ID NO: 523333 - DNA, 25 bp, Mus musculus
acttgctgggcatccctcttggcca

SEQ ID NO: 523334 - DNA, 25 bp, Mus musculus
acttgcttgcaactcatcatgacca

SEQ ID NO: 523335 - DNA, 25 bp, Mus musculus
acttgcttgcaagtcatcatgacca

SEQ ID NO: 523336 - DNA, 25 bp, Mus musculus
acttgcttggacaatacgacactgc

SEQ ID NO: 523337 - DNA, 25 bp, Mus musculus
acttgcttggactatacgacactgc

SEQ ID NO: 523338 - DNA, 25 bp, Mus musculus
acttgcttgggcaggacccaacgca

SEQ ID NO: 523339 - DNA, 25 bp, Mus musculus
acttgcttgggctggacccaacgca

SEQ ID NO: 523340 - DNA, 25 bp, Mus musculus
acttggaactctcggacaaatagag

SEQ ID NO: 523341 - DNA, 25 bp, Mus musculus
acttggaactctgggacaaatagag

SEQ ID NO: 523342 - DNA, 25 bp, Mus musculus
acttggaattcacggtcagaatggc

SEQ ID NO: 523343 - DNA, 25 bp, Mus musculus
acttggaattcagggtcagaatggc

SEQ ID NO: 523344 - DNA, 25 bp, Mus musculus
acttggacggcaacccttgcggctc

SEQ ID NO: 523345 - DNA, 25 bp, Mus musculus
acttggacggcatcccttgcggctc

SEQ ID NO: 523346 - DNA, 25 bp, Mus musculus
acttggacgtatagccttgggctct

SEQ ID NO: 523347 - DNA, 25 bp, Mus musculus
acttggacgtattgccttgggctct

SEQ ID NO: 523348 - DNA, 25 bp, Mus musculus
acttggagaaccacctgcttctgcc

SEQ ID NO: 523349 - DNA, 25 bp, Mus musculus
acttggagaacctcctgcttctgcc

SEQ ID NO: 523350 - DNA, 25 bp, Mus musculus
acttggagaggactgtcttggatca

SEQ ID NO: 523351 - DNA, 25 bp, Mus musculus
acttggagaggagtgtcttggatca

SEQ ID NO: 523352 - DNA, 25 bp, Mus musculus
acttggagagtgagcttgatgaccc

SEQ ID NO: 523353 - DNA, 25 bp, Mus musculus
acttggagagtgtgcttgatgaccc

SEQ ID NO: 523354 - DNA, 25 bp, Mus musculus
acttggagcggacgtttgaactgct

SEQ ID NO: 523355 - DNA, 25 bp, Mus musculus
acttggagcggaggtttgaactgct

SEQ ID NO: 523356 - DNA, 25 bp, Mus musculus
acttggaggagtactactttgagca

SEQ ID NO: 523357 - DNA, 25 bp, Mus musculus
acttggaggagttctactttgagca

SEQ ID NO: 523358 - DNA, 25 bp, Mus musculus
acttggaggcccatggtttctgacc

SEQ ID NO: 523359 - DNA, 25 bp, Mus musculus
acttggaggcccttggtttctgacc

SEQ ID NO: 523360 - DNA, 25 bp, Mus musculus
acttggaggcttcctgtcaccggca

SEQ ID NO: 523361 - DNA, 25 bp, Mus musculus
acttggaggcttgctgtcaccggca

SEQ ID NO: 523362 - DNA, 25 bp, Mus musculus
acttggataagcctggcgttcgctc

SEQ ID NO: 523363 - DNA, 25 bp, Mus musculus
acttggataagcgtggcgttcgctc

SEQ ID NO: 523364 - DNA, 25 bp, Mus musculus
acttggatatggaaagggacataac

SEQ ID NO: 523365 - DNA, 25 bp, Mus musculus
acttggatatggtaagggacataac

SEQ ID NO: 523366 - DNA, 25 bp, Mus musculus
acttggcagaagaagctgagcacgt

SEQ ID NO: 523367 - DNA, 25 bp, Mus musculus
acttggcagaagtagctgagcacgt

SEQ ID NO: 523368 - DNA, 25 bp, Mus musculus
acttggccccaaacatagaagcctt

SEQ ID NO: 523369 - DNA, 25 bp, Mus musculus
acttggccccaatcatagaagcctt

SEQ ID NO: 523370 - DNA, 25 bp, Mus musculus
acttggcctcctcgccttgatcaat

SEQ ID NO: 523371 - DNA, 25 bp, Mus musculus
acttggcctcctggccttgatcaat

SEQ ID NO: 523372 - DNA, 25 bp, Mus musculus
acttggcggcgaaggctcgagctcc

SEQ ID NO: 523373 - DNA, 25 bp, Mus musculus
acttggcggcgatggctcgagctcc

SEQ ID NO: 523374 - DNA, 25 bp, Mus musculus
acttggcttagtcagattgtagaca

SEQ ID NO: 523375 - DNA, 25 bp, Mus musculus
acttggcttagtgagattgtagaca

SEQ ID NO: 523376 - DNA, 25 bp, Mus musculus
acttgggatccaaccagtggcctga

SEQ ID NO: 523377 - DNA, 25 bp, Mus musculus
acttgggatccatccagtggcctga

SEQ ID NO: 523378 - DNA, 25 bp, Mus musculus
acttgggctgtgatcagattttgct

SEQ ID NO: 523379 - DNA, 25 bp, Mus musculus
acttgggctgtgttcagattttgct

SEQ ID NO: 523380 - DNA, 25 bp, Mus musculus
acttgggtatggacttgctctttga

SEQ ID NO: 523381 - DNA, 25 bp, Mus musculus
acttgggtatggtcttgctctttga

SEQ ID NO: 523382 - DNA, 25 bp, Mus musculus
acttgggtgtctactcggagcttca

SEQ ID NO: 523383 - DNA, 25 bp, Mus musculus
acttgggtgtcttctcggagcttca

SEQ ID NO: 523384 - DNA, 25 bp, Mus musculus
acttgggtgttaacacattggtgag

SEQ ID NO: 523385 - DNA, 25 bp, Mus musculus
acttgggtgttatcacattggtgag

SEQ ID NO: 523386 - DNA, 25 bp, Mus musculus
acttggtacattagacttgcatgtc

SEQ ID NO: 523387 - DNA, 25 bp, Mus musculus
acttggtacatttgacttgcatgtc

SEQ ID NO: 523388 - DNA, 25 bp, Mus musculus
acttggtcgcccaaggccagacctg

SEQ ID NO: 523389 - DNA, 25 bp, Mus musculus
acttggtcgccctaggccagacctg

SEQ ID NO: 523390 - DNA, 25 bp, Mus musculus
acttggtgagtgactgtccgagccc

SEQ ID NO: 523391 - DNA, 25 bp, Mus musculus
acttggtgagtgtctgtccgagccc

SEQ ID NO: 523392 - DNA, 25 bp, Mus musculus
acttggtgcgacaaaacctttgtgg

SEQ ID NO: 523393 - DNA, 25 bp, Mus musculus
acttggtgcgactaaacctttgtgg

SEQ ID NO: 523394 - DNA, 25 bp, Mus musculus
acttggtgtcgtccctggatgagct

SEQ ID NO: 523395 - DNA, 25 bp, Mus musculus
acttggtgtcgtgcctggatgagct

SEQ ID NO: 523396 - DNA, 25 bp, Mus musculus
acttgtacctacagctcgctctggg

SEQ ID NO: 523397 - DNA, 25 bp, Mus musculus
acttgtacctactgctcgctctggg

SEQ ID NO: 523398 - DNA, 25 bp, Mus musculus
acttgtcacacaagccggtcaccgg

SEQ ID NO: 523399 - DNA, 25 bp, Mus musculus
acttgtcacacatgccggtcaccgg

SEQ ID NO: 523400 - DNA, 25 bp, Mus musculus
acttgtccggccagggcaagcacgg

SEQ ID NO: 523401 - DNA, 25 bp, Mus musculus
acttgtccggcctgggcaagcacgg

SEQ ID NO: 523402 - DNA, 25 bp, Mus musculus
acttgtctaggccactccccaggaa

SEQ ID NO: 523403 - DNA, 25 bp, Mus musculus
acttgtctaggcgactccccaggaa

SEQ ID NO: 523404 - DNA, 25 bp, Mus musculus
acttgtgattgaccagtttgaagac

SEQ ID NO: 523405 - DNA, 25 bp, Mus musculus
acttgtgattgagcagtttgaagac

SEQ ID NO: 523406 - DNA, 25 bp, Mus musculus
acttgtgcaagaacggtgagtgcag

SEQ ID NO: 523407 - DNA, 25 bp, Mus musculus
acttgtgcaagatcggtgagtgcag

SEQ ID NO: 523408 - DNA, 25 bp, Mus musculus
acttgtgctgcaatgcaggagagct

SEQ ID NO: 523409 - DNA, 25 bp, Mus musculus
acttgtgctgcattgcaggagagct

SEQ ID NO: 523410 - DNA, 25 bp, Mus musculus
acttgtggcccaaatgaggccatgg

SEQ ID NO: 523411 - DNA, 25 bp, Mus musculus
acttgtggcccatatgaggccatgg

SEQ ID NO: 523412 - DNA, 25 bp, Mus musculus
acttgtgggaccactgttttgtggg

SEQ ID NO: 523413 - DNA, 25 bp, Mus musculus
acttgtgggacctctgttttgtggg

SEQ ID NO: 523414 - DNA, 25 bp, Mus musculus
acttgtgtctcccagttgtggccag

SEQ ID NO: 523415 - DNA, 25 bp, Mus musculus
acttgtgtctccgagttgtggccag

SEQ ID NO: 523416 - DNA, 25 bp, Mus musculus
acttgttaatccagaagatgttgcc

SEQ ID NO: 523417 - DNA, 25 bp, Mus musculus
acttgttaatcctgaagatgttgcc

SEQ ID NO: 523418 - DNA, 25 bp, Mus musculus
acttgttatatgaacgcggcgctgc

SEQ ID NO: 523419 - DNA, 25 bp, Mus musculus
acttgttatatgtacgcggcgctgc

SEQ ID NO: 523420 - DNA, 25 bp, Mus musculus
acttgttgatctcgcgcaggcagcc

SEQ ID NO: 523421 - DNA, 25 bp, Mus musculus
acttgttgatctggcgcaggcagcc

SEQ ID NO: 523422 - DNA, 25 bp, Mus musculus
acttgttggcttactgaacactgag

SEQ ID NO: 523423 - DNA, 25 bp, Mus musculus
acttgttggctttctgaacactgag

SEQ ID NO: 523424 - DNA, 25 bp, Mus musculus
actttaaaggcgatccgctgggagg

SEQ ID NO: 523425 - DNA, 25 bp, Mus musculus
actttaaaggcgttccgctgggagg

SEQ ID NO: 523426 - DNA, 25 bp, Mus musculus
actttaatagtgaggaagatgccaa

SEQ ID NO: 523427 - DNA, 25 bp, Mus musculus
actttaatagtgtggaagatgccaa

SEQ ID NO: 523428 - DNA, 25 bp, Mus musculus
actttacccgccaacctgtctatgt

SEQ ID NO: 523429 - DNA, 25 bp, Mus musculus
actttacccgcctacctgtctatgt

SEQ ID NO: 523430 - DNA, 25 bp, Mus musculus
actttactccgcctcagtcggtgct

SEQ ID NO: 523431 - DNA, 25 bp, Mus musculus
actttactccgcgtcagtcggtgct

SEQ ID NO: 523432 - DNA, 25 bp, Mus musculus
actttactgagaaacgctgtggtgc

SEQ ID NO: 523433 - DNA, 25 bp, Mus musculus
actttactgagatacgctgtggtgc

SEQ ID NO: 523434 - DNA, 25 bp, Mus musculus
actttactttgcctctctgaaggac

SEQ ID NO: 523435 - DNA, 25 bp, Mus musculus
actttactttgcgtctctgaaggac

SEQ ID NO: 523436 - DNA, 25 bp, Mus musculus
actttagtctgaacttcgtgtagcc

SEQ ID NO: 523437 - DNA, 25 bp, Mus musculus
actttagtctgatcttcgtgtagcc

SEQ ID NO: 523438 - DNA, 25 bp, Mus musculus
actttatactttagagccagactta

SEQ ID NO: 523439 - DNA, 25 bp, Mus musculus
actttatacttttgagccagactta

SEQ ID NO: 523440 - DNA, 25 bp, Mus musculus
actttatgaggaagtatgatgccta

SEQ ID NO: 523441 - DNA, 25 bp, Mus musculus
actttatgaggatgtatgatgccta

SEQ ID NO: 523442 - DNA, 25 bp, Mus musculus
actttatgcacaatgcccagcccgg

SEQ ID NO: 523443 - DNA, 25 bp, Mus musculus
actttatgcacattgcccagcccgg

SEQ ID NO: 523444 - DNA, 25 bp, Mus musculus
actttatgcagaatggctcctgtga

SEQ ID NO: 523445 - DNA, 25 bp, Mus musculus
actttatgcagattggctcctgtga

SEQ ID NO: 523446 - DNA, 25 bp, Mus musculus
actttcaacacgagcctccctgatg

SEQ ID NO: 523447 - DNA, 25 bp, Mus musculus
actttcaacacgtgcctccctgatg

SEQ ID NO: 523448 - DNA, 25 bp, Mus musculus
actttcaagtgacctgttgcgtact

SEQ ID NO: 523449 - DNA, 25 bp, Mus musculus
actttcaagtgagctgttgcgtact

SEQ ID NO: 523450 - DNA, 25 bp, Mus musculus
actttcacctctcaaactccttata

SEQ ID NO: 523451 - DNA, 25 bp, Mus musculus
actttcacctctgaaactccttata

SEQ ID NO: 523452 - DNA, 25 bp, Mus musculus
actttcatccagcagcacctagtgt

SEQ ID NO: 523453 - DNA, 25 bp, Mus musculus
actttcatccaggagcacctagtgt

SEQ ID NO: 523454 - DNA, 25 bp, Mus musculus
actttccagcagatctgtaaggatg

SEQ ID NO: 523455 - DNA, 25 bp, Mus musculus
actttccagcagttctgtaaggatg

SEQ ID NO: 523456 - DNA, 25 bp, Mus musculus
actttccatggccaacctcgggagc

SEQ ID NO: 523457 - DNA, 25 bp, Mus musculus
actttccatggcgaacctcgggagc

SEQ ID NO: 523458 - DNA, 25 bp, Mus musculus
actttcccagttacgtcaacagagg

SEQ ID NO: 523459 - DNA, 25 bp, Mus musculus
actttcccagtttcgtcaacagagg

SEQ ID NO: 523460 - DNA, 25 bp, Mus musculus
actttccctatcagtgacctgtctt

SEQ ID NO: 523461 - DNA, 25 bp, Mus musculus
actttccctatctgtgacctgtctt

SEQ ID NO: 523462 - DNA, 25 bp, Mus musculus
actttcctaaacatgcagcctatag

SEQ ID NO: 523463 - DNA, 25 bp, Mus musculus
actttcctaaacttgcagcctatag

SEQ ID NO: 523464 - DNA, 25 bp, Mus musculus
actttcctctaccagctcgtgttcg

SEQ ID NO: 523465 - DNA, 25 bp, Mus musculus
actttcctctacgagctcgtgttcg

SEQ ID NO: 523466 - DNA, 25 bp, Mus musculus
actttcctctccctgtctagctgag

SEQ ID NO: 523467 - DNA, 25 bp, Mus musculus
actttcctctccgtgtctagctgag

SEQ ID NO: 523468 - DNA, 25 bp, Mus musculus
actttcctgaggctgagctatggcc

SEQ ID NO: 523469 - DNA, 25 bp, Mus musculus
actttcctgagggtgagctatggcc

SEQ ID NO: 523470 - DNA, 25 bp, Mus musculus
actttcgcggacagaaattgggagc

SEQ ID NO: 523471 - DNA, 25 bp, Mus musculus
actttcgcggactgaaattgggagc

SEQ ID NO: 523472 - DNA, 25 bp, Mus musculus
actttcgtcggcagtgtgggcatgc

SEQ ID NO: 523473 - DNA, 25 bp, Mus musculus
actttcgtcggctgtgtgggcatgc

SEQ ID NO: 523474 - DNA, 25 bp, Mus musculus
actttcgttcgtcgatcagctctgg

SEQ ID NO: 523475 - DNA, 25 bp, Mus musculus
actttcgttcgtggatcagctctgg

SEQ ID NO: 523476 - DNA, 25 bp, Mus musculus
actttctaaagccacttcatatagg

SEQ ID NO: 523477 - DNA, 25 bp, Mus musculus
actttctaaagcgacttcatatagg

SEQ ID NO: 523478 - DNA, 25 bp, Mus musculus
actttctacacaatgagcagcaatg

SEQ ID NO: 523479 - DNA, 25 bp, Mus musculus
actttctacacattgagcagcaatg

SEQ ID NO: 523480 - DNA, 25 bp, Mus musculus
actttctagcgcatgagaagatctg

SEQ ID NO: 523481 - DNA, 25 bp, Mus musculus
actttctagcgcttgagaagatctg

SEQ ID NO: 523482 - DNA, 25 bp, Mus musculus
actttctcaagtcctgacccagcgc

SEQ ID NO: 523483 - DNA, 25 bp, Mus musculus
actttctcaagtgctgacccagcgc

SEQ ID NO: 523484 - DNA, 25 bp, Mus musculus
actttctcggagactggaatgctga

SEQ ID NO: 523485 - DNA, 25 bp, Mus musculus
actttctcggagtctggaatgctga

SEQ ID NO: 523486 - DNA, 25 bp, Mus musculus
actttctctttgacggaggagctct

SEQ ID NO: 523487 - DNA, 25 bp, Mus musculus
actttctctttgtcggaggagctct

SEQ ID NO: 523488 - DNA, 25 bp, Mus musculus
actttctgacagctgtgtgcgccat

SEQ ID NO: 523489 - DNA, 25 bp, Mus musculus
actttctgacaggtgtgtgcgccat

SEQ ID NO: 523490 - DNA, 25 bp, Mus musculus
actttctgtgccagtcttgggcctg

SEQ ID NO: 523491 - DNA, 25 bp, Mus musculus
actttctgtgcctgtcttgggcctg

SEQ ID NO: 523492 - DNA, 25 bp, Mus musculus
actttctgtgctactactattatgg

SEQ ID NO: 523493 - DNA, 25 bp, Mus musculus
actttctgtgcttctactattatgg

SEQ ID NO: 523494 - DNA, 25 bp, Mus musculus
actttcttctctaccgacagatgtc

SEQ ID NO: 523495 - DNA, 25 bp, Mus musculus
actttcttctcttccgacagatgtc

SEQ ID NO: 523496 - DNA, 25 bp, Mus musculus
actttcttgagcaatagtttagacc

SEQ ID NO: 523497 - DNA, 25 bp, Mus musculus
actttcttgagctatagtttagacc

SEQ ID NO: 523498 - DNA, 25 bp, Mus musculus
actttgaagaacaaactatatggac

SEQ ID NO: 523499 - DNA, 25 bp, Mus musculus
actttgaagaactaactatatggac

SEQ ID NO: 523500 - DNA, 25 bp, Mus musculus
actttgaagaatcggatctggtggc

SEQ ID NO: 523501 - DNA, 25 bp, Mus musculus
actttgaagaatgggatctggtggc

SEQ ID NO: 523502 - DNA, 25 bp, Mus musculus
actttgaagacccaccaaaccatgc

SEQ ID NO: 523503 - DNA, 25 bp, Mus musculus
actttgaagaccgaccaaaccatgc

SEQ ID NO: 523504 - DNA, 25 bp, Mus musculus
actttgaagtttctacattagtggg

SEQ ID NO: 523505 - DNA, 25 bp, Mus musculus
actttgaagtttgtacattagtggg

SEQ ID NO: 523506 - DNA, 25 bp, Mus musculus
actttgactcctatgcccactttgg

SEQ ID NO: 523507 - DNA, 25 bp, Mus musculus
actttgactcctttgcccactttgg

SEQ ID NO: 523508 - DNA, 25 bp, Mus musculus
actttgactgccatgagtgtagacc

SEQ ID NO: 523509 - DNA, 25 bp, Mus musculus
actttgactgccttgagtgtagacc

SEQ ID NO: 523510 - DNA, 25 bp, Mus musculus
actttgagaagcaggatgtctatgc

SEQ ID NO: 523511 - DNA, 25 bp, Mus musculus
actttgagaagctggatgtctatgc

SEQ ID NO: 523512 - DNA, 25 bp, Mus musculus
actttgagccaacaaaacacacagg

SEQ ID NO: 523513 - DNA, 25 bp, Mus musculus
actttgagccaagaaaacacacagg

SEQ ID NO: 523514 - DNA, 25 bp, Mus musculus
actttgagccgtctcagaaccacag

SEQ ID NO: 523515 - DNA, 25 bp, Mus musculus
actttgagccgtgtcagaaccacag

SEQ ID NO: 523516 - DNA, 25 bp, Mus musculus
actttgagcggcacgatgatgatga

SEQ ID NO: 523517 - DNA, 25 bp, Mus musculus
actttgagcggctcgatgatgatga

SEQ ID NO: 523518 - DNA, 25 bp, Mus musculus
actttgagcttgatgtcctggagga

SEQ ID NO: 523519 - DNA, 25 bp, Mus musculus
actttgagcttgttgtcctggagga

SEQ ID NO: 523520 - DNA, 25 bp, Mus musculus
actttgatgctcatgaatgtctccc

SEQ ID NO: 523521 - DNA, 25 bp, Mus musculus
actttgatgctcttgaatgtctccc

SEQ ID NO: 523522 - DNA, 25 bp, Mus musculus
actttgcaaaagagaaattggcgag

SEQ ID NO: 523523 - DNA, 25 bp, Mus musculus
actttgcaaaagtgaaattggcgag

SEQ ID NO: 523524 - DNA, 25 bp, Mus musculus
actttgcaaagtagtagccagcggg

SEQ ID NO: 523525 - DNA, 25 bp, Mus musculus
actttgcaaagttgtagccagcggg

SEQ ID NO: 523526 - DNA, 25 bp, Mus musculus
actttgcagcggagttggccccgaa

SEQ ID NO: 523527 - DNA, 25 bp, Mus musculus
actttgcagcggtgttggccccgaa

SEQ ID NO: 523528 - DNA, 25 bp, Mus musculus
actttgcagctaagagggactctcc

SEQ ID NO: 523529 - DNA, 25 bp, Mus musculus
actttgcagctatgagggactctcc

SEQ ID NO: 523530 - DNA, 25 bp, Mus musculus
actttgcaggcgcagacctgttggt

SEQ ID NO: 523531 - DNA, 25 bp, Mus musculus
actttgcaggcggagacctgttggt

SEQ ID NO: 523532 - DNA, 25 bp, Mus musculus
actttgccaaggcatcggaggagca

SEQ ID NO: 523533 - DNA, 25 bp, Mus musculus
actttgccaagggatcggaggagca

SEQ ID NO: 523534 - DNA, 25 bp, Mus musculus
actttgccagataaagattgtctgg

SEQ ID NO: 523535 - DNA, 25 bp, Mus musculus
actttgccagattaagattgtctgg

SEQ ID NO: 523536 - DNA, 25 bp, Mus musculus
actttgccattcagcccagctgttg

SEQ ID NO: 523537 - DNA, 25 bp, Mus musculus
actttgccattctgcccagctgttg

SEQ ID NO: 523538 - DNA, 25 bp, Mus musculus
actttgccctcgctgcctgacaggt

SEQ ID NO: 523539 - DNA, 25 bp, Mus musculus
actttgccctcggtgcctgacaggt

SEQ ID NO: 523540 - DNA, 25 bp, Mus musculus
actttgcccttcagttaaacaggat

SEQ ID NO: 523541 - DNA, 25 bp, Mus musculus
actttgcccttctgttaaacaggat

SEQ ID NO: 523542 - DNA, 25 bp, Mus musculus
actttgcggcagagccacagtcagc

SEQ ID NO: 523543 - DNA, 25 bp, Mus musculus
actttgcggcagtgccacagtcagc

SEQ ID NO: 523544 - DNA, 25 bp, Mus musculus
actttgctatcaactttgacccaga

SEQ ID NO: 523545 - DNA, 25 bp, Mus musculus
actttgctatcatctttgacccaga

SEQ ID NO: 523546 - DNA, 25 bp, Mus musculus
actttgctgaagatgaacagatggc

SEQ ID NO: 523547 - DNA, 25 bp, Mus musculus
actttgctgaagttgaacagatggc

SEQ ID NO: 523548 - DNA, 25 bp, Mus musculus
actttggagctcagcattttctggg

SEQ ID NO: 523549 - DNA, 25 bp, Mus musculus
actttggagctctgcattttctggg

SEQ ID NO: 523550 - DNA, 25 bp, Mus musculus
actttggaggacactgatgggaccc

SEQ ID NO: 523551 - DNA, 25 bp, Mus musculus
actttggaggactctgatgggaccc

SEQ ID NO: 523552 - DNA, 25 bp, Mus musculus
actttggatatacaggtcgatggcg

SEQ ID NO: 523553 - DNA, 25 bp, Mus musculus
actttggatatagaggtcgatggcg

SEQ ID NO: 523554 - DNA, 25 bp, Mus musculus
actttggatgccaatgaccctgaaa

SEQ ID NO: 523555 - DNA, 25 bp, Mus musculus
actttggatgcctatgaccctgaaa

SEQ ID NO: 523556 - DNA, 25 bp, Mus musculus
actttggcagcgagggagccacaga

SEQ ID NO: 523557 - DNA, 25 bp, Mus musculus
actttggcagcgtgggagccacaga

SEQ ID NO: 523558 - DNA, 25 bp, Mus musculus
actttggcatgtcagggtcctctca

SEQ ID NO: 523559 - DNA, 25 bp, Mus musculus
actttggcatgtgagggtcctctca

SEQ ID NO: 523560 - DNA, 25 bp, Mus musculus
actttggcgacaccatggtccacca

SEQ ID NO: 523561 - DNA, 25 bp, Mus musculus
actttggcgacagcatggtccacca

SEQ ID NO: 523562 - DNA, 25 bp, Mus musculus
actttggtcactctacttgggtgac

SEQ ID NO: 523563 - DNA, 25 bp, Mus musculus
actttggtcactgtacttgggtgac

SEQ ID NO: 523564 - DNA, 25 bp, Mus musculus
actttggtcctgcatcccagcactt

SEQ ID NO: 523565 - DNA, 25 bp, Mus musculus
actttggtcctggatcccagcactt

SEQ ID NO: 523566 - DNA, 25 bp, Mus musculus
actttggtggacaaatggcctgatt

SEQ ID NO: 523567 - DNA, 25 bp, Mus musculus
actttggtggactaatggcctgatt

SEQ ID NO: 523568 - DNA, 25 bp, Mus musculus
actttgtagcgtccggtcctttgac

SEQ ID NO: 523569 - DNA, 25 bp, Mus musculus
actttgtagcgtgcggtcctttgac

SEQ ID NO: 523570 - DNA, 25 bp, Mus musculus
actttgtagggacaagtaactctgg

SEQ ID NO: 523571 - DNA, 25 bp, Mus musculus
actttgtagggagaagtaactctgg

SEQ ID NO: 523572 - DNA, 25 bp, Mus musculus
actttgtcacggcagacaccttcca

SEQ ID NO: 523573 - DNA, 25 bp, Mus musculus
actttgtcacgggagacaccttcca

SEQ ID NO: 523574 - DNA, 25 bp, Mus musculus
actttgtctataagaggataaaggc

SEQ ID NO: 523575 - DNA, 25 bp, Mus musculus
actttgtctatatgaggataaaggc

SEQ ID NO: 523576 - DNA, 25 bp, Mus musculus
actttgtgatgtagggtggcatgct

SEQ ID NO: 523577 - DNA, 25 bp, Mus musculus
actttgtgatgttgggtggcatgct

SEQ ID NO: 523578 - DNA, 25 bp, Mus musculus
actttgtgcagacgtttgagcggca

SEQ ID NO: 523579 - DNA, 25 bp, Mus musculus
actttgtgcagaggtttgagcggca

SEQ ID NO: 523580 - DNA, 25 bp, Mus musculus
actttgtgcgtcaggagatgagtca

SEQ ID NO: 523581 - DNA, 25 bp, Mus musculus
actttgtgcgtctggagatgagtca

SEQ ID NO: 523582 - DNA, 25 bp, Mus musculus
actttgtgctgaagccccagagaga

SEQ ID NO: 523583 - DNA, 25 bp, Mus musculus
actttgtgctgatgccccagagaga

SEQ ID NO: 523584 - DNA, 25 bp, Mus musculus
actttgtggactatggcagcaccga

SEQ ID NO: 523585 - DNA, 25 bp, Mus musculus
actttgtggactttggcagcaccga

SEQ ID NO: 523586 - DNA, 25 bp, Mus musculus
actttgtgtctgactgcaggaagcg

SEQ ID NO: 523587 - DNA, 25 bp, Mus musculus
actttgtgtctgtctgcaggaagcg

SEQ ID NO: 523588 - DNA, 25 bp, Mus musculus
actttgttggaaagtggatgaagaa

SEQ ID NO: 523589 - DNA, 25 bp, Mus musculus
actttgttggaatgtggatgaagaa

SEQ ID NO: 523590 - DNA, 25 bp, Mus musculus
actttgttgtcccaggaaagatcta

SEQ ID NO: 523591 - DNA, 25 bp, Mus musculus
actttgttgtccgaggaaagatcta

SEQ ID NO: 523592 - DNA, 25 bp, Mus musculus
acttttaagcagctggtggaagctc

SEQ ID NO: 523593 - DNA, 25 bp, Mus musculus
acttttaagcaggtggtggaagctc

SEQ ID NO: 523594 - DNA, 25 bp, Mus musculus
acttttccgagaaaccagcaagatg

SEQ ID NO: 523595 - DNA, 25 bp, Mus musculus
acttttccgagataccagcaagatg

SEQ ID NO: 523596 - DNA, 25 bp, Mus musculus
acttttctgagcagcccctagacga

SEQ ID NO: 523597 - DNA, 25 bp, Mus musculus
acttttctgagctgcccctagacga

SEQ ID NO: 523598 - DNA, 25 bp, Mus musculus
acttttcttacacagtagctgcttg

SEQ ID NO: 523599 - DNA, 25 bp, Mus musculus
acttttcttacagagtagctgcttg

SEQ ID NO: 523600 - DNA, 25 bp, Mus musculus
acttttgaacgtcttcaaccatgac

SEQ ID NO: 523601 - DNA, 25 bp, Mus musculus
acttttgaacgtgttcaaccatgac

SEQ ID NO: 523602 - DNA, 25 bp, Mus musculus
acttttgaagtgacgatgttgggac

SEQ ID NO: 523603 - DNA, 25 bp, Mus musculus
acttttgaagtgtcgatgttgggac

SEQ ID NO: 523604 - DNA, 25 bp, Mus musculus
acttttgcatagagacaattgtggc

SEQ ID NO: 523605 - DNA, 25 bp, Mus musculus
acttttgcatagtgacaattgtggc

SEQ ID NO: 523606 - DNA, 25 bp, Mus musculus
acttttggaccaaccctgcttgaag

SEQ ID NO: 523607 - DNA, 25 bp, Mus musculus
acttttggaccatccctgcttgaag

SEQ ID NO: 523608 - DNA, 25 bp, Mus musculus
acttttggcaaaagcggatgtcgcc

SEQ ID NO: 523609 - DNA, 25 bp, Mus musculus
acttttggcaaatgcggatgtcgcc

SEQ ID NO: 523610 - DNA, 25 bp, Mus musculus
acttttgtcccactgtcgaaggtga

SEQ ID NO: 523611 - DNA, 25 bp, Mus musculus
acttttgtcccagtgtcgaaggtga

SEQ ID NO: 523612 - DNA, 25 bp, Mus musculus
acttttgttaaaccctgagactcag

SEQ ID NO: 523613 - DNA, 25 bp, Mus musculus
acttttgttaaagcctgagactcag

SEQ ID NO: 523614 - DNA, 25 bp, Mus musculus
actttttatctcaccaaggcttgtg

SEQ ID NO: 523615 - DNA, 25 bp, Mus musculus
actttttatctctccaaggcttgtg

SEQ ID NO: 523616 - DNA, 25 bp, Mus musculus
actttttcctgcctgtggaccttgg

SEQ ID NO: 523617 - DNA, 25 bp, Mus musculus
actttttcctgcgtgtggaccttgg

SEQ ID NO: 523618 - DNA, 25 bp, Mus musculus
actttttcttctaccgcacagcggg

SEQ ID NO: 523619 - DNA, 25 bp, Mus musculus
actttttcttcttccgcacagcggg

SEQ ID NO: 523620 - DNA, 25 bp, Mus musculus
actttttgccaccaattattgcacg

SEQ ID NO: 523621 - DNA, 25 bp, Mus musculus
actttttgccacgaattattgcacg

SEQ ID NO: 523622 - DNA, 25 bp, Mus musculus
actttttgccatctccgacatgttg

SEQ ID NO: 523623 - DNA, 25 bp, Mus musculus
actttttgccatgtccgacatgttg

SEQ ID NO: 523624 - DNA, 25 bp, Mus musculus
actttttggaacatctggctttcaa

SEQ ID NO: 523625 - DNA, 25 bp, Mus musculus
actttttggaacttctggctttcaa

SEQ ID NO: 523626 - DNA, 25 bp, Mus musculus
agaaaaacatggctcggaccttgga

SEQ ID NO: 523627 - DNA, 25 bp, Mus musculus
agaaaaacatgggtcggaccttgga

SEQ ID NO: 523628 - DNA, 25 bp, Mus musculus
agaaaaacattacgagggtatatca

SEQ ID NO: 523629 - DNA, 25 bp, Mus musculus
agaaaaacattaggagggtatatca

SEQ ID NO: 523630 - DNA, 25 bp, Mus musculus
agaaaaaccgaaaggagcaagaggg

SEQ ID NO: 523631 - DNA, 25 bp, Mus musculus
agaaaaaccgaatggagcaagaggg

SEQ ID NO: 523632 - DNA, 25 bp, Mus musculus
agaaaaactggacactattgctaag

SEQ ID NO: 523633 - DNA, 25 bp, Mus musculus
agaaaaactggagactattgctaag

SEQ ID NO: 523634 - DNA, 25 bp, Mus musculus
agaaaaactgtaccggtgagcgaga

SEQ ID NO: 523635 - DNA, 25 bp, Mus musculus
agaaaaactgtagcggtgagcgaga

SEQ ID NO: 523636 - DNA, 25 bp, Mus musculus
agaaaaagaagtccgggcagcagct

SEQ ID NO: 523637 - DNA, 25 bp, Mus musculus
agaaaaagaagtgcgggcagcagct

SEQ ID NO: 523638 - DNA, 25 bp, Mus musculus
agaaaaagctgccacagccagagag

SEQ ID NO: 523639 - DNA, 25 bp, Mus musculus
agaaaaagctgcgacagccagagag

SEQ ID NO: 523640 - DNA, 25 bp, Mus musculus
agaaaaagttgaagtgagcctgact

SEQ ID NO: 523641 - DNA, 25 bp, Mus musculus
agaaaaagttgatgtgagcctgact

SEQ ID NO: 523642 - DNA, 25 bp, Mus musculus
agaaaacaagctcgcgtaagaactt

SEQ ID NO: 523643 - DNA, 25 bp, Mus musculus
agaaaacaagctggcgtaagaactt

SEQ ID NO: 523644 - DNA, 25 bp, Mus musculus
agaaaacacaatatggcctcaaggg

SEQ ID NO: 523645 - DNA, 25 bp, Mus musculus
agaaaacacaatttggcctcaaggg

SEQ ID NO: 523646 - DNA, 25 bp, Mus musculus
agaaaacagactcgccaacttagaa

SEQ ID NO: 523647 - DNA, 25 bp, Mus musculus
agaaaacagactggccaacttagaa

SEQ ID NO: 523648 - DNA, 25 bp, Mus musculus
agaaaacagccaacaacaatgtggt

SEQ ID NO: 523649 - DNA, 25 bp, Mus musculus
agaaaacagccatcaacaatgtggt

SEQ ID NO: 523650 - DNA, 25 bp, Mus musculus
agaaaacattctcttggactgccag

SEQ ID NO: 523651 - DNA, 25 bp, Mus musculus
agaaaacattctgttggactgccag

SEQ ID NO: 523652 - DNA, 25 bp, Mus musculus
agaaaaccagacatgctgggaccag

SEQ ID NO: 523653 - DNA, 25 bp, Mus musculus
agaaaaccagacttgctgggaccag

SEQ ID NO: 523654 - DNA, 25 bp, Mus musculus
agaaaacccatacgcctacgtcctg

SEQ ID NO: 523655 - DNA, 25 bp, Mus musculus
agaaaacccataggcctacgtcctg

SEQ ID NO: 523656 - DNA, 25 bp, Mus musculus
agaaaacctatgacctcacccgcta

SEQ ID NO: 523657 - DNA, 25 bp, Mus musculus
agaaaacctatgtcctcacccgcta

SEQ ID NO: 523658 - DNA, 25 bp, Mus musculus
agaaaacgaagtcctcagagttcca

SEQ ID NO: 523659 - DNA, 25 bp, Mus musculus
agaaaacgaagtgctcagagttcca

SEQ ID NO: 523660 - DNA, 25 bp, Mus musculus
agaaaacgcacgaaaccctgagcca

SEQ ID NO: 523661 - DNA, 25 bp, Mus musculus
agaaaacgcacgtaaccctgagcca

SEQ ID NO: 523662 - DNA, 25 bp, Mus musculus
agaaaacgcagacaggacgggctct

SEQ ID NO: 523663 - DNA, 25 bp, Mus musculus
agaaaacgcagagaggacgggctct

SEQ ID NO: 523664 - DNA, 25 bp, Mus musculus
agaaaacgcgagctgccgacaagcg

SEQ ID NO: 523665 - DNA, 25 bp, Mus musculus
agaaaacgcgaggtgccgacaagcg

SEQ ID NO: 523666 - DNA, 25 bp, Mus musculus
agaaaactaaggcacactctggacg

SEQ ID NO: 523667 - DNA, 25 bp, Mus musculus
agaaaactaagggacactctggacg

SEQ ID NO: 523668 - DNA, 25 bp, Mus musculus
agaaaacttcacacactggaagatg

SEQ ID NO: 523669 - DNA, 25 bp, Mus musculus
agaaaacttcactcactggaagatg

SEQ ID NO: 523670 - DNA, 25 bp, Mus musculus
agaaaagaaaccagctgttggcgta

SEQ ID NO: 523671 - DNA, 25 bp, Mus musculus
agaaaagaaacctgctgttggcgta

SEQ ID NO: 523672 - DNA, 25 bp, Mus musculus
agaaaagaagccagtatcctgaaat

SEQ ID NO: 523673 - DNA, 25 bp, Mus musculus
agaaaagaagcctgtatcctgaaat

SEQ ID NO: 523674 - DNA, 25 bp, Mus musculus
agaaaagaatggcagcgtcctccct

SEQ ID NO: 523675 - DNA, 25 bp, Mus musculus
agaaaagaatgggagcgtcctccct

SEQ ID NO: 523676 - DNA, 25 bp, Mus musculus
agaaaagactcacgcactgtgcaag

SEQ ID NO: 523677 - DNA, 25 bp, Mus musculus
agaaaagactcaggcactgtgcaag

SEQ ID NO: 523678 - DNA, 25 bp, Mus musculus
agaaaagactggcttccctggcaga

SEQ ID NO: 523679 - DNA, 25 bp, Mus musculus
agaaaagactgggttccctggcaga

SEQ ID NO: 523680 - DNA, 25 bp, Mus musculus
agaaaagaggatcaagtgtctggaa

SEQ ID NO: 523681 - DNA, 25 bp, Mus musculus
agaaaagaggatgaagtgtctggaa

SEQ ID NO: 523682 - DNA, 25 bp, Mus musculus
agaaaagaggcacctaggatagcag

SEQ ID NO: 523683 - DNA, 25 bp, Mus musculus
agaaaagaggcagctaggatagcag

SEQ ID NO: 523684 - DNA, 25 bp, Mus musculus
agaaaagatacaccgggcacgtgac

SEQ ID NO: 523685 - DNA, 25 bp, Mus musculus
agaaaagatacagcgggcacgtgac

SEQ ID NO: 523686 - DNA, 25 bp, Mus musculus
agaaaagcccctccttactgtgaca

SEQ ID NO: 523687 - DNA, 25 bp, Mus musculus
agaaaagcccctgcttactgtgaca

SEQ ID NO: 523688 - DNA, 25 bp, Mus musculus
agaaaagctgcacgcatgaagtaga

SEQ ID NO: 523689 - DNA, 25 bp, Mus musculus
agaaaagctgcaggcatgaagtaga

SEQ ID NO: 523690 - DNA, 25 bp, Mus musculus
agaaaaggaagcaggcgcgtagcct

SEQ ID NO: 523691 - DNA, 25 bp, Mus musculus
agaaaaggaagctggcgcgtagcct

SEQ ID NO: 523692 - DNA, 25 bp, Mus musculus
agaaaaggacatactgcgcgtgcgc

SEQ ID NO: 523693 - DNA, 25 bp, Mus musculus
agaaaaggacattctgcgcgtgcgc

SEQ ID NO: 523694 - DNA, 25 bp, Mus musculus
agaaaaggagttcgtggcatcagcc

SEQ ID NO: 523695 - DNA, 25 bp, Mus musculus
agaaaaggagttggtggcatcagcc

SEQ ID NO: 523696 - DNA, 25 bp, Mus musculus
agaaaaggatatcgctgtacgggac

SEQ ID NO: 523697 - DNA, 25 bp, Mus musculus
agaaaaggatatggctgtacgggac

SEQ ID NO: 523698 - DNA, 25 bp, Mus musculus
agaaaagtgcaacgcaccaacttgg

SEQ ID NO: 523699 - DNA, 25 bp, Mus musculus
agaaaagtgcaaggcaccaacttgg

SEQ ID NO: 523700 - DNA, 25 bp, Mus musculus
agaaaataaagtcttgtgagaactc

SEQ ID NO: 523701 - DNA, 25 bp, Mus musculus
agaaaataaagtgttgtgagaactc

SEQ ID NO: 523702 - DNA, 25 bp, Mus musculus
agaaaatcctgtccaagggcctgcc

SEQ ID NO: 523703 - DNA, 25 bp, Mus musculus
agaaaatcctgtgcaagggcctgcc

SEQ ID NO: 523704 - DNA, 25 bp, Mus musculus
agaaaatcgatgagctcttctctgg

SEQ ID NO: 523705 - DNA, 25 bp, Mus musculus
agaaaatcgatgtgctcttctctgg

SEQ ID NO: 523706 - DNA, 25 bp, Mus musculus
agaaaatctctccaacttcatcaag

SEQ ID NO: 523707 - DNA, 25 bp, Mus musculus
agaaaatctctcgaacttcatcaag

SEQ ID NO: 523708 - DNA, 25 bp, Mus musculus
agaaaatgaggtacccactccagcc

SEQ ID NO: 523709 - DNA, 25 bp, Mus musculus
agaaaatgaggttcccactccagcc

SEQ ID NO: 523710 - DNA, 25 bp, Mus musculus
agaaaatgcagaatttgagcgacag

SEQ ID NO: 523711 - DNA, 25 bp, Mus musculus
agaaaatgcagattttgagcgacag

SEQ ID NO: 523712 - DNA, 25 bp, Mus musculus
agaaaatgccatacagcagatgggt

SEQ ID NO: 523713 - DNA, 25 bp, Mus musculus
agaaaatgccattcagcagatgggt

SEQ ID NO: 523714 - DNA, 25 bp, Mus musculus
agaaaatgggctcacctcccctctg

SEQ ID NO: 523715 - DNA, 25 bp, Mus musculus
agaaaatgggctgacctcccctctg

SEQ ID NO: 523716 - DNA, 25 bp, Mus musculus
agaaaatgtgctcgcccatccttgc

SEQ ID NO: 523717 - DNA, 25 bp, Mus musculus
agaaaatgtgctggcccatccttgc

SEQ ID NO: 523718 - DNA, 25 bp, Mus musculus
agaaacaaaaccagactgagcttaa

SEQ ID NO: 523719 - DNA, 25 bp, Mus musculus
agaaacaaaacctgactgagcttaa

SEQ ID NO: 523720 - DNA, 25 bp, Mus musculus
agaaacaacacgaatgctgaacccc

SEQ ID NO: 523721 - DNA, 25 bp, Mus musculus
agaaacaacacgtatgctgaacccc

SEQ ID NO: 523722 - DNA, 25 bp, Mus musculus
agaaacaactaacccagtcccacag

SEQ ID NO: 523723 - DNA, 25 bp, Mus musculus
agaaacaactaagccagtcccacag

SEQ ID NO: 523724 - DNA, 25 bp, Mus musculus
agaaacaagttcagtgggccgagaa

SEQ ID NO: 523725 - DNA, 25 bp, Mus musculus
agaaacaagttctgtgggccgagaa

SEQ ID NO: 523726 - DNA, 25 bp, Mus musculus
agaaacagcatccaccattacagcc

SEQ ID NO: 523727 - DNA, 25 bp, Mus musculus
agaaacagcatcgaccattacagcc

SEQ ID NO: 523728 - DNA, 25 bp, Mus musculus
agaaacagctagagaccatcgacca

SEQ ID NO: 523729 - DNA, 25 bp, Mus musculus
agaaacagctagtgaccatcgacca

SEQ ID NO: 523730 - DNA, 25 bp, Mus musculus
agaaacattcgcacgtgcacacgag

SEQ ID NO: 523731 - DNA, 25 bp, Mus musculus
agaaacattcgctcgtgcacacgag

SEQ ID NO: 523732 - DNA, 25 bp, Mus musculus
agaaaccaacagcttgccagcccgg

SEQ ID NO: 523733 - DNA, 25 bp, Mus musculus
agaaaccaacaggttgccagcccgg

SEQ ID NO: 523734 - DNA, 25 bp, Mus musculus
agaaaccagggcaggaacagcgaac

SEQ ID NO: 523735 - DNA, 25 bp, Mus musculus
agaaaccagggctggaacagcgaac

SEQ ID NO: 523736 - DNA, 25 bp, Mus musculus
agaaaccctggacgatgggctcccg

SEQ ID NO: 523737 - DNA, 25 bp, Mus musculus
agaaaccctggaggatgggctcccg

SEQ ID NO: 523738 - DNA, 25 bp, Mus musculus
agaaacctaaggagaggctatcatc

SEQ ID NO: 523739 - DNA, 25 bp, Mus musculus
agaaacctaaggtgaggctatcatc

SEQ ID NO: 523740 - DNA, 25 bp, Mus musculus
agaaacctcctcagtcgtggctagc

SEQ ID NO: 523741 - DNA, 25 bp, Mus musculus
agaaacctcctctgtcgtggctagc

SEQ ID NO: 523742 - DNA, 25 bp, Mus musculus
agaaacctgaggcaagcaccgcaag

SEQ ID NO: 523743 - DNA, 25 bp, Mus musculus
agaaacctgagggaagcaccgcaag

SEQ ID NO: 523744 - DNA, 25 bp, Mus musculus
agaaacctgctgatggcgtatttgg

SEQ ID NO: 523745 - DNA, 25 bp, Mus musculus
agaaacctgctgttggcgtatttgg

SEQ ID NO: 523746 - DNA, 25 bp, Mus musculus
agaaacctgggtcttccgcaggatt

SEQ ID NO: 523747 - DNA, 25 bp, Mus musculus
agaaacctgggtgttccgcaggatt

SEQ ID NO: 523748 - DNA, 25 bp, Mus musculus
agaaaccttttcagagcctgcaaga

SEQ ID NO: 523749 - DNA, 25 bp, Mus musculus
agaaaccttttctgagcctgcaaga

SEQ ID NO: 523750 - DNA, 25 bp, Mus musculus
agaaacgatggcagccctggcacag

SEQ ID NO: 523751 - DNA, 25 bp, Mus musculus
agaaacgatggctgccctggcacag

SEQ ID NO: 523752 - DNA, 25 bp, Mus musculus
agaaacgcagagatgtagacacaga

SEQ ID NO: 523753 - DNA, 25 bp, Mus musculus
agaaacgcagagttgtagacacaga

SEQ ID NO: 523754 - DNA, 25 bp, Mus musculus
agaaacgccataacgggcgaggtac

SEQ ID NO: 523755 - DNA, 25 bp, Mus musculus
agaaacgccatatcgggcgaggtac

SEQ ID NO: 523756 - DNA, 25 bp, Mus musculus
agaaacgcctcgattaacaacgtat

SEQ ID NO: 523757 - DNA, 25 bp, Mus musculus
agaaacgcctcgtttaacaacgtat

SEQ ID NO: 523758 - DNA, 25 bp, Mus musculus
agaaacggaagcctgcccgcaagga

SEQ ID NO: 523759 - DNA, 25 bp, Mus musculus
agaaacggaagcgtgcccgcaagga

SEQ ID NO: 523760 - DNA, 25 bp, Mus musculus
agaaacggaggacggacagcgaggg

SEQ ID NO: 523761 - DNA, 25 bp, Mus musculus
agaaacggaggagggacagcgaggg

SEQ ID NO: 523762 - DNA, 25 bp, Mus musculus
agaaacggtgccagccttttccgag

SEQ ID NO: 523763 - DNA, 25 bp, Mus musculus
agaaacggtgcctgccttttccgag

SEQ ID NO: 523764 - DNA, 25 bp, Mus musculus
agaaactccctgaaagcctgatgcc

SEQ ID NO: 523765 - DNA, 25 bp, Mus musculus
agaaactccctgtaagcctgatgcc

SEQ ID NO: 523766 - DNA, 25 bp, Mus musculus
agaaactccggacgcagctgacaga

SEQ ID NO: 523767 - DNA, 25 bp, Mus musculus
agaaactccggaggcagctgacaga

SEQ ID NO: 523768 - DNA, 25 bp, Mus musculus
agaaactcctccaccatcattgctt

SEQ ID NO: 523769 - DNA, 25 bp, Mus musculus
agaaactcctcctccatcattgctt

SEQ ID NO: 523770 - DNA, 25 bp, Mus musculus
agaaactcttctatataccctggcg

SEQ ID NO: 523771 - DNA, 25 bp, Mus musculus
agaaactcttctttataccctggcg

SEQ ID NO: 523772 - DNA, 25 bp, Mus musculus
agaaactctttcacaggctggacag

SEQ ID NO: 523773 - DNA, 25 bp, Mus musculus
agaaactctttctcaggctggacag

SEQ ID NO: 523774 - DNA, 25 bp, Mus musculus
agaaactgagatacctaattaagac

SEQ ID NO: 523775 - DNA, 25 bp, Mus musculus
agaaactgagattcctaattaagac

SEQ ID NO: 523776 - DNA, 25 bp, Mus musculus
agaaactgtcgccccacagcaaaag

SEQ ID NO: 523777 - DNA, 25 bp, Mus musculus
agaaactgtcgcgccacagcaaaag

SEQ ID NO: 523778 - DNA, 25 bp, Mus musculus
agaaactgttagaaagcagatacca

SEQ ID NO: 523779 - DNA, 25 bp, Mus musculus
agaaactgttagtaagcagatacca

SEQ ID NO: 523780 - DNA, 25 bp, Mus musculus
agaaacttacctcgaagcccactgg

SEQ ID NO: 523781 - DNA, 25 bp, Mus musculus
agaaacttacctggaagcccactgg

SEQ ID NO: 523782 - DNA, 25 bp, Mus musculus
agaaacttcaaactgccagggcggt

SEQ ID NO: 523783 - DNA, 25 bp, Mus musculus
agaaacttcaaagtgccagggcggt

SEQ ID NO: 523784 - DNA, 25 bp, Mus musculus
agaaacttcaatctgccaatgtgca

SEQ ID NO: 523785 - DNA, 25 bp, Mus musculus
agaaacttcaatgtgccaatgtgca

SEQ ID NO: 523786 - DNA, 25 bp, Mus musculus
agaaacttggtccactgagttacaa

SEQ ID NO: 523787 - DNA, 25 bp, Mus musculus
agaaacttggtcgactgagttacaa

SEQ ID NO: 523788 - DNA, 25 bp, Mus musculus
agaaagaaatacagaccaggtctgc

SEQ ID NO: 523789 - DNA, 25 bp, Mus musculus
agaaagaaatactgaccaggtctgc

SEQ ID NO: 523790 - DNA, 25 bp, Mus musculus
agaaagacacagaagactcgtgtgg

SEQ ID NO: 523791 - DNA, 25 bp, Mus musculus
agaaagacacagtagactcgtgtgg

SEQ ID NO: 523792 - DNA, 25 bp, Mus musculus
agaaagaccccgctcagttcctgca

SEQ ID NO: 523793 - DNA, 25 bp, Mus musculus
agaaagaccccggtcagttcctgca

SEQ ID NO: 523794 - DNA, 25 bp, Mus musculus
agaaagactcctaccagcctgtgtg

SEQ ID NO: 523795 - DNA, 25 bp, Mus musculus
agaaagactccttccagcctgtgtg

SEQ ID NO: 523796 - DNA, 25 bp, Mus musculus
agaaagactggacggccacctctag

SEQ ID NO: 523797 - DNA, 25 bp, Mus musculus
agaaagactggagggccacctctag

SEQ ID NO: 523798 - DNA, 25 bp, Mus musculus
agaaagactgggagccccgagctct

SEQ ID NO: 523799 - DNA, 25 bp, Mus musculus
agaaagactgggtgccccgagctct

SEQ ID NO: 523800 - DNA, 25 bp, Mus musculus
agaaagagaagaattcccctgctgg

SEQ ID NO: 523801 - DNA, 25 bp, Mus musculus
agaaagagaagatttcccctgctgg

SEQ ID NO: 523802 - DNA, 25 bp, Mus musculus
agaaagagactacacatatgaggag

SEQ ID NO: 523803 - DNA, 25 bp, Mus musculus
agaaagagactagacatatgaggag

SEQ ID NO: 523804 - DNA, 25 bp, Mus musculus
agaaagagatcactcagctgcaggc

SEQ ID NO: 523805 - DNA, 25 bp, Mus musculus
agaaagagatcagtcagctgcaggc

SEQ ID NO: 523806 - DNA, 25 bp, Mus musculus
agaaagagccacagtaacccctggg

SEQ ID NO: 523807 - DNA, 25 bp, Mus musculus
agaaagagccactgtaacccctggg

SEQ ID NO: 523808 - DNA, 25 bp, Mus musculus
agaaagagctgtctgcaaaggagaa

SEQ ID NO: 523809 - DNA, 25 bp, Mus musculus
agaaagagctgtgtgcaaaggagaa

SEQ ID NO: 523810 - DNA, 25 bp, Mus musculus
agaaagaggagcaagcagacgcgta

SEQ ID NO: 523811 - DNA, 25 bp, Mus musculus
agaaagaggagctagcagacgcgta

SEQ ID NO: 523812 - DNA, 25 bp, Mus musculus
agaaagaggttcaatgtcgtctgga

SEQ ID NO: 523813 - DNA, 25 bp, Mus musculus
agaaagaggttctatgtcgtctgga

SEQ ID NO: 523814 - DNA, 25 bp, Mus musculus
agaaagataacacagacccaggaca

SEQ ID NO: 523815 - DNA, 25 bp, Mus musculus
agaaagataacagagacccaggaca

SEQ ID NO: 523816 - DNA, 25 bp, Mus musculus
agaaagatgctgatttgcgctatct

SEQ ID NO: 523817 - DNA, 25 bp, Mus musculus
agaaagatgctgttttgcgctatct

SEQ ID NO: 523818 - DNA, 25 bp, Mus musculus
agaaagcaacggcagatcctccgac

SEQ ID NO: 523819 - DNA, 25 bp, Mus musculus
agaaagcaacgggagatcctccgac

SEQ ID NO: 523820 - DNA, 25 bp, Mus musculus
agaaagcagagcaaagtggaagcta

SEQ ID NO: 523821 - DNA, 25 bp, Mus musculus
agaaagcagagctaagtggaagcta

SEQ ID NO: 523822 - DNA, 25 bp, Mus musculus
agaaagcagatgagtacctgcggga

SEQ ID NO: 523823 - DNA, 25 bp, Mus musculus
agaaagcagatgtgtacctgcggga

SEQ ID NO: 523824 - DNA, 25 bp, Mus musculus
agaaagcagcagaggagaaaaagac

SEQ ID NO: 523825 - DNA, 25 bp, Mus musculus
agaaagcagcagtggagaaaaagac

SEQ ID NO: 523826 - DNA, 25 bp, Mus musculus
agaaagcaggatcgaccatagttac

SEQ ID NO: 523827 - DNA, 25 bp, Mus musculus
agaaagcaggatggaccatagttac

SEQ ID NO: 523828 - DNA, 25 bp, Mus musculus
agaaagcagtcactgtagcctccca

SEQ ID NO: 523829 - DNA, 25 bp, Mus musculus
agaaagcagtcagtgtagcctccca

SEQ ID NO: 523830 - DNA, 25 bp, Mus musculus
agaaagcagtccagtggagccacag

SEQ ID NO: 523831 - DNA, 25 bp, Mus musculus
agaaagcagtcctgtggagccacag

SEQ ID NO: 523832 - DNA, 25 bp, Mus musculus
agaaagccaagtcccatgtgtgtgg

SEQ ID NO: 523833 - DNA, 25 bp, Mus musculus
agaaagccaagtgccatgtgtgtgg

SEQ ID NO: 523834 - DNA, 25 bp, Mus musculus
agaaagcccgggagtccaaagacat

SEQ ID NO: 523835 - DNA, 25 bp, Mus musculus
agaaagcccgggtgtccaaagacat

SEQ ID NO: 523836 - DNA, 25 bp, Mus musculus
agaaagccctatcaaggtcgagtgg

SEQ ID NO: 523837 - DNA, 25 bp, Mus musculus
agaaagccctatgaaggtcgagtgg

SEQ ID NO: 523838 - DNA, 25 bp, Mus musculus
agaaagcgacttagcctccaccttc

SEQ ID NO: 523839 - DNA, 25 bp, Mus musculus
agaaagcgactttgcctccaccttc

SEQ ID NO: 523840 - DNA, 25 bp, Mus musculus
agaaagcggccaccctctaaatgaa

SEQ ID NO: 523841 - DNA, 25 bp, Mus musculus
agaaagcggccagcctctaaatgaa

SEQ ID NO: 523842 - DNA, 25 bp, Mus musculus
agaaagcggtgcagtcgtggttcca

SEQ ID NO: 523843 - DNA, 25 bp, Mus musculus
agaaagcggtgctgtcgtggttcca

SEQ ID NO: 523844 - DNA, 25 bp, Mus musculus
agaaagctgcacagctgaggaacaa

SEQ ID NO: 523845 - DNA, 25 bp, Mus musculus
agaaagctgcactgctgaggaacaa

SEQ ID NO: 523846 - DNA, 25 bp, Mus musculus
agaaaggaatccaagaagccaccag

SEQ ID NO: 523847 - DNA, 25 bp, Mus musculus
agaaaggaatcctagaagccaccag

SEQ ID NO: 523848 - DNA, 25 bp, Mus musculus
agaaaggcaaggacaacgaggcaga

SEQ ID NO: 523849 - DNA, 25 bp, Mus musculus
agaaaggcaaggtcaacgaggcaga

SEQ ID NO: 523850 - DNA, 25 bp, Mus musculus
agaaaggccacaacccaagcggctt

SEQ ID NO: 523851 - DNA, 25 bp, Mus musculus
agaaaggccacatcccaagcggctt

SEQ ID NO: 523852 - DNA, 25 bp, Mus musculus
agaaaggcggcacctgagctgctcc

SEQ ID NO: 523853 - DNA, 25 bp, Mus musculus
agaaaggcggcagctgagctgctcc

SEQ ID NO: 523854 - DNA, 25 bp, Mus musculus
agaaagggaccgagcgatcctggct

SEQ ID NO: 523855 - DNA, 25 bp, Mus musculus
agaaagggaccgtgcgatcctggct

SEQ ID NO: 523856 - DNA, 25 bp, Mus musculus
agaaagggttgacatacactcctgt

SEQ ID NO: 523857 - DNA, 25 bp, Mus musculus
agaaagggttgagatacactcctgt

SEQ ID NO: 523858 - DNA, 25 bp, Mus musculus
agaaaggtccctatgcccgggccat

SEQ ID NO: 523859 - DNA, 25 bp, Mus musculus
agaaaggtccctttgcccgggccat

SEQ ID NO: 523860 - DNA, 25 bp, Mus musculus
agaaagtcagggatcagaggacgca

SEQ ID NO: 523861 - DNA, 25 bp, Mus musculus
agaaagtcagggttcagaggacgca

SEQ ID NO: 523862 - DNA, 25 bp, Mus musculus
agaaagtgggaaacctggtgacaag

SEQ ID NO: 523863 - DNA, 25 bp, Mus musculus
agaaagtgggaatcctggtgacaag

SEQ ID NO: 523864 - DNA, 25 bp, Mus musculus
agaaagtgggtcagcacctcaggga

SEQ ID NO: 523865 - DNA, 25 bp, Mus musculus
agaaagtgggtctgcacctcaggga

SEQ ID NO: 523866 - DNA, 25 bp, Mus musculus
agaaagtgtgaacatccggtggtcc

SEQ ID NO: 523867 - DNA, 25 bp, Mus musculus
agaaagtgtgaagatccggtggtcc

SEQ ID NO: 523868 - DNA, 25 bp, Mus musculus
agaaagtgtgccattcgcacccaca

SEQ ID NO: 523869 - DNA, 25 bp, Mus musculus
agaaagtgtgcctttcgcacccaca

SEQ ID NO: 523870 - DNA, 25 bp, Mus musculus
agaaagttcgagctgtggacatcgt

SEQ ID NO: 523871 - DNA, 25 bp, Mus musculus
agaaagttcgaggtgtggacatcgt

SEQ ID NO: 523872 - DNA, 25 bp, Mus musculus
agaaataaaggccacagaaccacaa

SEQ ID NO: 523873 - DNA, 25 bp, Mus musculus
agaaataaaggcgacagaaccacaa

SEQ ID NO: 523874 - DNA, 25 bp, Mus musculus
agaaataaataacgctcgagaggaa

SEQ ID NO: 523875 - DNA, 25 bp, Mus musculus
agaaataaataaggctcgagaggaa

SEQ ID NO: 523876 - DNA, 25 bp, Mus musculus
agaaataatcgcctcttagatgaac

SEQ ID NO: 523877 - DNA, 25 bp, Mus musculus
agaaataatcgcgtcttagatgaac

SEQ ID NO: 523878 - DNA, 25 bp, Mus musculus
agaaatacaccaagccctacgaagc

SEQ ID NO: 523879 - DNA, 25 bp, Mus musculus
agaaatacaccatgccctacgaagc

SEQ ID NO: 523880 - DNA, 25 bp, Mus musculus
agaaatagaacaacttttacccaag

SEQ ID NO: 523881 - DNA, 25 bp, Mus musculus
agaaatagaacatcttttacccaag

SEQ ID NO: 523882 - DNA, 25 bp, Mus musculus
agaaatcaaatgctctggaatccga

SEQ ID NO: 523883 - DNA, 25 bp, Mus musculus
agaaatcaaatggtctggaatccga

SEQ ID NO: 523884 - DNA, 25 bp, Mus musculus
agaaatcagggacatctatggcgag

SEQ ID NO: 523885 - DNA, 25 bp, Mus musculus
agaaatcagggagatctatggcgag

SEQ ID NO: 523886 - DNA, 25 bp, Mus musculus
agaaatccagaaattggcagagcag

SEQ ID NO: 523887 - DNA, 25 bp, Mus musculus
agaaatccagaatttggcagagcag

SEQ ID NO: 523888 - DNA, 25 bp, Mus musculus
agaaatcgaagcaatggcagccatt

SEQ ID NO: 523889 - DNA, 25 bp, Mus musculus
agaaatcgaagctatggcagccatt

SEQ ID NO: 523890 - DNA, 25 bp, Mus musculus
agaaatcgctgtctttagccctcgc

SEQ ID NO: 523891 - DNA, 25 bp, Mus musculus
agaaatcgctgtgtttagccctcgc

SEQ ID NO: 523892 - DNA, 25 bp, Mus musculus
agaaatcggactcgcctcgttccca

SEQ ID NO: 523893 - DNA, 25 bp, Mus musculus
agaaatcggactggcctcgttccca

SEQ ID NO: 523894 - DNA, 25 bp, Mus musculus
agaaatcggcgacccaggaagacaa

SEQ ID NO: 523895 - DNA, 25 bp, Mus musculus
agaaatcggcgagccaggaagacaa

SEQ ID NO: 523896 - DNA, 25 bp, Mus musculus
agaaatctatgacgacatcgctgat

SEQ ID NO: 523897 - DNA, 25 bp, Mus musculus
agaaatctatgaggacatcgctgat

SEQ ID NO: 523898 - DNA, 25 bp, Mus musculus
agaaatctccacacgtccattccag

SEQ ID NO: 523899 - DNA, 25 bp, Mus musculus
agaaatctccactcgtccattccag

SEQ ID NO: 523900 - DNA, 25 bp, Mus musculus
agaaatctccttatgggcttctggt

SEQ ID NO: 523901 - DNA, 25 bp, Mus musculus
agaaatctccttttgggcttctggt

SEQ ID NO: 523902 - DNA, 25 bp, Mus musculus
agaaatcttggtagaagagagcaac

SEQ ID NO: 523903 - DNA, 25 bp, Mus musculus
agaaatcttggttgaagagagcaac

SEQ ID NO: 523904 - DNA, 25 bp, Mus musculus
agaaatgctttgatgaaacacgcta

SEQ ID NO: 523905 - DNA, 25 bp, Mus musculus
agaaatgctttgttgaaacacgcta

SEQ ID NO: 523906 - DNA, 25 bp, Mus musculus
agaaatgcttttcagtgtgccttct

SEQ ID NO: 523907 - DNA, 25 bp, Mus musculus
agaaatgcttttgagtgtgccttct

SEQ ID NO: 523908 - DNA, 25 bp, Mus musculus
agaaatggtcatcaggtaagcagtc

SEQ ID NO: 523909 - DNA, 25 bp, Mus musculus
agaaatggtcatgaggtaagcagtc

SEQ ID NO: 523910 - DNA, 25 bp, Mus musculus
agaaattatattagcttcagagcag

SEQ ID NO: 523911 - DNA, 25 bp, Mus musculus
agaaattatatttgcttcagagcag

SEQ ID NO: 523912 - DNA, 25 bp, Mus musculus
agaaattctctgaggactttggaca

SEQ ID NO: 523913 - DNA, 25 bp, Mus musculus
agaaattctctgtggactttggaca

SEQ ID NO: 523914 - DNA, 25 bp, Mus musculus
agaaattctgtacggcaccaatgag

SEQ ID NO: 523915 - DNA, 25 bp, Mus musculus
agaaattctgtagggcaccaatgag

SEQ ID NO: 523916 - DNA, 25 bp, Mus musculus
agaaattcttctcccgagagtgaga

SEQ ID NO: 523917 - DNA, 25 bp, Mus musculus
agaaattcttctgccgagagtgaga

SEQ ID NO: 523918 - DNA, 25 bp, Mus musculus
agaaattggtgtctcagatccggaa

SEQ ID NO: 523919 - DNA, 25 bp, Mus musculus
agaaattggtgtgtcagatccggaa

SEQ ID NO: 523920 - DNA, 25 bp, Mus musculus
agaaatttggagactacgtgcgctc

SEQ ID NO: 523921 - DNA, 25 bp, Mus musculus
agaaatttggagtctacgtgcgctc

SEQ ID NO: 523922 - DNA, 25 bp, Mus musculus
agaacaaaaggaacgcacccctctg

SEQ ID NO: 523923 - DNA, 25 bp, Mus musculus
agaacaaaaggatcgcacccctctg

SEQ ID NO: 523924 - DNA, 25 bp, Mus musculus
agaacaaaggcaacctgcgtgtgag

SEQ ID NO: 523925 - DNA, 25 bp, Mus musculus
agaacaaaggcatcctgcgtgtgag

SEQ ID NO: 523926 - DNA, 25 bp, Mus musculus
agaacaacctaaactggtataccag

SEQ ID NO: 523927 - DNA, 25 bp, Mus musculus
agaacaacctaatctggtataccag

SEQ ID NO: 523928 - DNA, 25 bp, Mus musculus
agaacaagcattcggagcagccaga

SEQ ID NO: 523929 - DNA, 25 bp, Mus musculus
agaacaagcattgggagcagccaga

SEQ ID NO: 523930 - DNA, 25 bp, Mus musculus
agaacaagcgccaggatgctgtgag

SEQ ID NO: 523931 - DNA, 25 bp, Mus musculus
agaacaagcgcctggatgctgtgag

SEQ ID NO: 523932 - DNA, 25 bp, Mus musculus
agaacaatatttcgaagctcacgat

SEQ ID NO: 523933 - DNA, 25 bp, Mus musculus
agaacaatatttggaagctcacgat

SEQ ID NO: 523934 - DNA, 25 bp, Mus musculus
agaacaatcaggctggagttgcaag

SEQ ID NO: 523935 - DNA, 25 bp, Mus musculus
agaacaatcagggtggagttgcaag

SEQ ID NO: 523936 - DNA, 25 bp, Mus musculus
agaacaatgtctcccctgtctcgag

SEQ ID NO: 523937 - DNA, 25 bp, Mus musculus
agaacaatgtctgccctgtctcgag

SEQ ID NO: 523938 - DNA, 25 bp, Mus musculus
agaacaatttaaagacagcaggcta

SEQ ID NO: 523939 - DNA, 25 bp, Mus musculus
agaacaatttaatgacagcaggcta

SEQ ID NO: 523940 - DNA, 25 bp, Mus musculus
agaacacaaactcgatggcaaattg

SEQ ID NO: 523941 - DNA, 25 bp, Mus musculus
agaacacaaactggatggcaaattg

SEQ ID NO: 523942 - DNA, 25 bp, Mus musculus
agaacacaggtacagaacgagtgga

SEQ ID NO: 523943 - DNA, 25 bp, Mus musculus
agaacacaggtagagaacgagtgga

SEQ ID NO: 523944 - DNA, 25 bp, Mus musculus
agaacacgcccaagattgctggcct

SEQ ID NO: 523945 - DNA, 25 bp, Mus musculus
agaacacgcccatgattgctggcct

SEQ ID NO: 523946 - DNA, 25 bp, Mus musculus
agaacacgctgtcggccggcaccgt

SEQ ID NO: 523947 - DNA, 25 bp, Mus musculus
agaacacgctgtgggccggcaccgt

SEQ ID NO: 523948 - DNA, 25 bp, Mus musculus
agaacacggagcacgtcaagtcacc

SEQ ID NO: 523949 - DNA, 25 bp, Mus musculus
agaacacggagctcgtcaagtcacc

SEQ ID NO: 523950 - DNA, 25 bp, Mus musculus
agaacacggtgtcgtcggcccgctt

SEQ ID NO: 523951 - DNA, 25 bp, Mus musculus
agaacacggtgtggtcggcccgctt

SEQ ID NO: 523952 - DNA, 25 bp, Mus musculus
agaacactagcaacgtgcgggacga

SEQ ID NO: 523953 - DNA, 25 bp, Mus musculus
agaacactagcatcgtgcgggacga

SEQ ID NO: 523954 - DNA, 25 bp, Mus musculus
agaacactattcatcagagagcagt

SEQ ID NO: 523955 - DNA, 25 bp, Mus musculus
agaacactattcttcagagagcagt

SEQ ID NO: 523956 - DNA, 25 bp, Mus musculus
agaacactgaagaacggcaccacca

SEQ ID NO: 523957 - DNA, 25 bp, Mus musculus
agaacactgaagtacggcaccacca

SEQ ID NO: 523958 - DNA, 25 bp, Mus musculus
agaacacttgtgaggacatcgccca

SEQ ID NO: 523959 - DNA, 25 bp, Mus musculus
agaacacttgtgtggacatcgccca

SEQ ID NO: 523960 - DNA, 25 bp, Mus musculus
agaacagaaactattagaacaggct

SEQ ID NO: 523961 - DNA, 25 bp, Mus musculus
agaacagaaacttttagaacaggct

SEQ ID NO: 523962 - DNA, 25 bp, Mus musculus
agaacagaatctatgcacattggat

SEQ ID NO: 523963 - DNA, 25 bp, Mus musculus
agaacagaatctttgcacattggat

SEQ ID NO: 523964 - DNA, 25 bp, Mus musculus
agaacagatcagaggaggacaggaa

SEQ ID NO: 523965 - DNA, 25 bp, Mus musculus
agaacagatcagtggaggacaggaa

SEQ ID NO: 523966 - DNA, 25 bp, Mus musculus
agaacagcacttcagcagataaaga

SEQ ID NO: 523967 - DNA, 25 bp, Mus musculus
agaacagcacttgagcagataaaga

SEQ ID NO: 523968 - DNA, 25 bp, Mus musculus
agaacagcagttaccgaagccagcg

SEQ ID NO: 523969 - DNA, 25 bp, Mus musculus
agaacagcagtttccgaagccagcg

SEQ ID NO: 523970 - DNA, 25 bp, Mus musculus
agaacagcgacaaacacctagccgg

SEQ ID NO: 523971 - DNA, 25 bp, Mus musculus
agaacagcgacatacacctagccgg

SEQ ID NO: 523972 - DNA, 25 bp, Mus musculus
agaacaggacccacacaacaccata

SEQ ID NO: 523973 - DNA, 25 bp, Mus musculus
agaacaggaccctcacaacaccata

SEQ ID NO: 523974 - DNA, 25 bp, Mus musculus
agaacaggctatacgtaccgccacc

SEQ ID NO: 523975 - DNA, 25 bp, Mus musculus
agaacaggctattcgtaccgccacc

SEQ ID NO: 523976 - DNA, 25 bp, Mus musculus
agaacaggtagcaggtttcgtgaag

SEQ ID NO: 523977 - DNA, 25 bp, Mus musculus
agaacaggtagctggtttcgtgaag

SEQ ID NO: 523978 - DNA, 25 bp, Mus musculus
agaacaggtccaagtcggaagagga

SEQ ID NO: 523979 - DNA, 25 bp, Mus musculus
agaacaggtccatgtcggaagagga

SEQ ID NO: 523980 - DNA, 25 bp, Mus musculus
agaacagtctatatactccaaagga

SEQ ID NO: 523981 - DNA, 25 bp, Mus musculus
agaacagtctatttactccaaagga

SEQ ID NO: 523982 - DNA, 25 bp, Mus musculus
agaacagtctcaagtccgggaaggg

SEQ ID NO: 523983 - DNA, 25 bp, Mus musculus
agaacagtctcatgtccgggaaggg

SEQ ID NO: 523984 - DNA, 25 bp, Mus musculus
agaacagtgctcacaccaaccactg

SEQ ID NO: 523985 - DNA, 25 bp, Mus musculus
agaacagtgctctcaccaaccactg

SEQ ID NO: 523986 - DNA, 25 bp, Mus musculus
agaacataacatcccggttgtcatt

SEQ ID NO: 523987 - DNA, 25 bp, Mus musculus
agaacataacatgccggttgtcatt

SEQ ID NO: 523988 - DNA, 25 bp, Mus musculus
agaacatagtgtcgtcgtttctttc

SEQ ID NO: 523989 - DNA, 25 bp, Mus musculus
agaacatagtgtggtcgtttctttc

SEQ ID NO: 523990 - DNA, 25 bp, Mus musculus
agaacatcacatagggtgagcctcc

SEQ ID NO: 523991 - DNA, 25 bp, Mus musculus
agaacatcacattgggtgagcctcc

SEQ ID NO: 523992 - DNA, 25 bp, Mus musculus
agaacatcagatacaagtcagacct

SEQ ID NO: 523993 - DNA, 25 bp, Mus musculus
agaacatcagattcaagtcagacct

SEQ ID NO: 523994 - DNA, 25 bp, Mus musculus
agaacatcagtcacccggtggcatt

SEQ ID NO: 523995 - DNA, 25 bp, Mus musculus
agaacatcagtctcccggtggcatt

SEQ ID NO: 523996 - DNA, 25 bp, Mus musculus
agaacatcatctcggctaacctgcg

SEQ ID NO: 523997 - DNA, 25 bp, Mus musculus
agaacatcatctgggctaacctgcg

SEQ ID NO: 523998 - DNA, 25 bp, Mus musculus
agaacatccataagtctctacaagg

SEQ ID NO: 523999 - DNA, 25 bp, Mus musculus
agaacatccatatgtctctacaagg

SEQ ID NO: 524000 - DNA, 25 bp, Mus musculus
agaacatcccgcagccaaagttctg

SEQ ID NO: 524001 - DNA, 25 bp, Mus musculus
agaacatcccgctgccaaagttctg

SEQ ID NO: 524002 - DNA, 25 bp, Mus musculus
agaacatcctatctgagcaccccaa

SEQ ID NO: 524003 - DNA, 25 bp, Mus musculus
agaacatcctatgtgagcaccccaa

SEQ ID NO: 524004 - DNA, 25 bp, Mus musculus
agaacatgccacatcccttaatggg

SEQ ID NO: 524005 - DNA, 25 bp, Mus musculus
agaacatgccacttcccttaatggg

SEQ ID NO: 524006 - DNA, 25 bp, Mus musculus
agaacatgctgtccgccccatacat

SEQ ID NO: 524007 - DNA, 25 bp, Mus musculus
agaacatgctgtgcgccccatacat

SEQ ID NO: 524008 - DNA, 25 bp, Mus musculus
agaacatggacaattccaaggcagt

SEQ ID NO: 524009 - DNA, 25 bp, Mus musculus
agaacatggacatttccaaggcagt

SEQ ID NO: 524010 - DNA, 25 bp, Mus musculus
agaacatggagtcgcctctcaggct

SEQ ID NO: 524011 - DNA, 25 bp, Mus musculus
agaacatggagtggcctctcaggct

SEQ ID NO: 524012 - DNA, 25 bp, Mus musculus
agaacatgggataattttaccaagg

SEQ ID NO: 524013 - DNA, 25 bp, Mus musculus
agaacatgggattattttaccaagg

SEQ ID NO: 524014 - DNA, 25 bp, Mus musculus
agaacatgtcgcagcgcatcggagg

SEQ ID NO: 524015 - DNA, 25 bp, Mus musculus
agaacatgtcgctgcgcatcggagg

SEQ ID NO: 524016 - DNA, 25 bp, Mus musculus
agaacatgtgtaactgaaggctggc

SEQ ID NO: 524017 - DNA, 25 bp, Mus musculus
agaacatgtgtatctgaaggctggc

SEQ ID NO: 524018 - DNA, 25 bp, Mus musculus
agaacattggctccccacccttaga

SEQ ID NO: 524019 - DNA, 25 bp, Mus musculus
agaacattggctgcccacccttaga

SEQ ID NO: 524020 - DNA, 25 bp, Mus musculus
agaaccaaatgacagaggcacacaa

SEQ ID NO: 524021 - DNA, 25 bp, Mus musculus
agaaccaaatgagagaggcacacaa

SEQ ID NO: 524022 - DNA, 25 bp, Mus musculus
agaaccaagtcaccgtctcggccag

SEQ ID NO: 524023 - DNA, 25 bp, Mus musculus
agaaccaagtcagcgtctcggccag

SEQ ID NO: 524024 - DNA, 25 bp, Mus musculus
agaaccaatcccatgtattcagtta

SEQ ID NO: 524025 - DNA, 25 bp, Mus musculus
agaaccaatcccttgtattcagtta

SEQ ID NO: 524026 - DNA, 25 bp, Mus musculus
agaaccacacttcggagccagcgaa

SEQ ID NO: 524027 - DNA, 25 bp, Mus musculus
agaaccacacttgggagccagcgaa

SEQ ID NO: 524028 - DNA, 25 bp, Mus musculus
agaaccaccaccagagtgcagccta

SEQ ID NO: 524029 - DNA, 25 bp, Mus musculus
agaaccaccacctgagtgcagccta

SEQ ID NO: 524030 - DNA, 25 bp, Mus musculus
agaaccaccagaaccgagcaaagcg

SEQ ID NO: 524031 - DNA, 25 bp, Mus musculus
agaaccaccagatccgagcaaagcg

SEQ ID NO: 524032 - DNA, 25 bp, Mus musculus
agaaccactgttcactatcgtcatc

SEQ ID NO: 524033 - DNA, 25 bp, Mus musculus
agaaccactgttgactatcgtcatc

SEQ ID NO: 524034 - DNA, 25 bp, Mus musculus
agaaccagaagtactccgagcactt

SEQ ID NO: 524035 - DNA, 25 bp, Mus musculus
agaaccagaagttctccgagcactt

SEQ ID NO: 524036 - DNA, 25 bp, Mus musculus
agaaccagagcgcagagccaggcac

SEQ ID NO: 524037 - DNA, 25 bp, Mus musculus
agaaccagagcggagagccaggcac

SEQ ID NO: 524038 - DNA, 25 bp, Mus musculus
agaaccagccttcggaacagccctg

SEQ ID NO: 524039 - DNA, 25 bp, Mus musculus
agaaccagccttgggaacagccctg

SEQ ID NO: 524040 - DNA, 25 bp, Mus musculus
agaaccagcttcaggcaccaaccag

SEQ ID NO: 524041 - DNA, 25 bp, Mus musculus
agaaccagcttctggcaccaaccag

SEQ ID NO: 524042 - DNA, 25 bp, Mus musculus
agaaccatgcccctgagctggtgca

SEQ ID NO: 524043 - DNA, 25 bp, Mus musculus
agaaccatgcccgtgagctggtgca

SEQ ID NO: 524044 - DNA, 25 bp, Mus musculus
agaaccattgcaactcctgtccggg

SEQ ID NO: 524045 - DNA, 25 bp, Mus musculus
agaaccattgcatctcctgtccggg

SEQ ID NO: 524046 - DNA, 25 bp, Mus musculus
agaacccaagcaccgagcgctggaa

SEQ ID NO: 524047 - DNA, 25 bp, Mus musculus
agaacccaagcagcgagcgctggaa

SEQ ID NO: 524048 - DNA, 25 bp, Mus musculus
agaacccacgtacctggtgtggatg

SEQ ID NO: 524049 - DNA, 25 bp, Mus musculus
agaacccacgtagctggtgtggatg

SEQ ID NO: 524050 - DNA, 25 bp, Mus musculus
agaacccccagaaggccattcctgt

SEQ ID NO: 524051 - DNA, 25 bp, Mus musculus
agaacccccagatggccattcctgt

SEQ ID NO: 524052 - DNA, 25 bp, Mus musculus
agaaccccgaccacagtatcatctg

SEQ ID NO: 524053 - DNA, 25 bp, Mus musculus
agaaccccgacctcagtatcatctg

SEQ ID NO: 524054 - DNA, 25 bp, Mus musculus
agaacccctgaaatcagcaaagcca

SEQ ID NO: 524055 - DNA, 25 bp, Mus musculus
agaacccctgaattcagcaaagcca

SEQ ID NO: 524056 - DNA, 25 bp, Mus musculus
agaacccctggtcggctctctgtgg

SEQ ID NO: 524057 - DNA, 25 bp, Mus musculus
agaacccctggtgggctctctgtgg

SEQ ID NO: 524058 - DNA, 25 bp, Mus musculus
agaaccccttctcctgggcttgagg

SEQ ID NO: 524059 - DNA, 25 bp, Mus musculus
agaaccccttctgctgggcttgagg

SEQ ID NO: 524060 - DNA, 25 bp, Mus musculus
agaacccggatgcagccctgcgaac

SEQ ID NO: 524061 - DNA, 25 bp, Mus musculus
agaacccggatggagccctgcgaac

SEQ ID NO: 524062 - DNA, 25 bp, Mus musculus
agaacccggttgacagatctgctac

SEQ ID NO: 524063 - DNA, 25 bp, Mus musculus
agaacccggttgtcagatctgctac

SEQ ID NO: 524064 - DNA, 25 bp, Mus musculus
agaacccgttctctcgcgtcaggaa

SEQ ID NO: 524065 - DNA, 25 bp, Mus musculus
agaacccgttctgtcgcgtcaggaa

SEQ ID NO: 524066 - DNA, 25 bp, Mus musculus
agaaccctgaggcaaaaccagtgtg

SEQ ID NO: 524067 - DNA, 25 bp, Mus musculus
agaaccctgagggaaaaccagtgtg

SEQ ID NO: 524068 - DNA, 25 bp, Mus musculus
agaaccctgctgagtatgcccgcat

SEQ ID NO: 524069 - DNA, 25 bp, Mus musculus
agaaccctgctgtgtatgcccgcat

SEQ ID NO: 524070 - DNA, 25 bp, Mus musculus
agaaccctgggcagtgccgccatgg

SEQ ID NO: 524071 - DNA, 25 bp, Mus musculus
agaaccctgggctgtgccgccatgg

SEQ ID NO: 524072 - DNA, 25 bp, Mus musculus
agaaccgccaagctcgccagggctg

SEQ ID NO: 524073 - DNA, 25 bp, Mus musculus
agaaccgccaaggtcgccagggctg

SEQ ID NO: 524074 - DNA, 25 bp, Mus musculus
agaaccggcacgagggtgtgttcaa

SEQ ID NO: 524075 - DNA, 25 bp, Mus musculus
agaaccggcacgtgggtgtgttcaa

SEQ ID NO: 524076 - DNA, 25 bp, Mus musculus
agaaccgggtacaagatgtttgtgc

SEQ ID NO: 524077 - DNA, 25 bp, Mus musculus
agaaccgggtactagatgtttgtgc

SEQ ID NO: 524078 - DNA, 25 bp, Mus musculus
agaaccgtgcggatggctacaccct

SEQ ID NO: 524079 - DNA, 25 bp, Mus musculus
agaaccgtgcggttggctacaccct

SEQ ID NO: 524080 - DNA, 25 bp, Mus musculus
agaacctaaggacgctgtgaaccgc

SEQ ID NO: 524081 - DNA, 25 bp, Mus musculus
agaacctaaggaggctgtgaaccgc

SEQ ID NO: 524082 - DNA, 25 bp, Mus musculus
agaacctacaggaggaagagaagca

SEQ ID NO: 524083 - DNA, 25 bp, Mus musculus
agaacctacaggtggaagagaagca

SEQ ID NO: 524084 - DNA, 25 bp, Mus musculus
agaacctacctcagatatactgagg

SEQ ID NO: 524085 - DNA, 25 bp, Mus musculus
agaacctacctctgatatactgagg

SEQ ID NO: 524086 - DNA, 25 bp, Mus musculus
agaacctccaccagactccaggaaa

SEQ ID NO: 524087 - DNA, 25 bp, Mus musculus
agaacctccacctgactccaggaaa

SEQ ID NO: 524088 - DNA, 25 bp, Mus musculus
agaacctgaagaaccacaaccgctc

SEQ ID NO: 524089 - DNA, 25 bp, Mus musculus
agaacctgaagatccacaaccgctc

SEQ ID NO: 524090 - DNA, 25 bp, Mus musculus
agaacctgagtaaccgagaagtgga

SEQ ID NO: 524091 - DNA, 25 bp, Mus musculus
agaacctgagtatccgagaagtgga

SEQ ID NO: 524092 - DNA, 25 bp, Mus musculus
agaacctgcaccagctacccaatgg

SEQ ID NO: 524093 - DNA, 25 bp, Mus musculus
agaacctgcacctgctacccaatgg

SEQ ID NO: 524094 - DNA, 25 bp, Mus musculus
agaacctggcacctgatcactggga

SEQ ID NO: 524095 - DNA, 25 bp, Mus musculus
agaacctggcacgtgatcactggga

SEQ ID NO: 524096 - DNA, 25 bp, Mus musculus
agaacctggcttcaatgtctttagg

SEQ ID NO: 524097 - DNA, 25 bp, Mus musculus
agaacctggcttgaatgtctttagg

SEQ ID NO: 524098 - DNA, 25 bp, Mus musculus
agaacctggtgtacctgggtctcgt

SEQ ID NO: 524099 - DNA, 25 bp, Mus musculus
agaacctggtgttcctgggtctcgt

SEQ ID NO: 524100 - DNA, 25 bp, Mus musculus
agaacgaattcgcttgcagaaaaaa

SEQ ID NO: 524101 - DNA, 25 bp, Mus musculus
agaacgaattcggttgcagaaaaaa

SEQ ID NO: 524102 - DNA, 25 bp, Mus musculus
agaacgacctgaagggcacggccga

SEQ ID NO: 524103 - DNA, 25 bp, Mus musculus
agaacgacctgatgggcacggccga

SEQ ID NO: 524104 - DNA, 25 bp, Mus musculus
agaacgacttcgagatgcgtgcccg

SEQ ID NO: 524105 - DNA, 25 bp, Mus musculus
agaacgacttcgtgatgcgtgcccg

SEQ ID NO: 524106 - DNA, 25 bp, Mus musculus
agaacgagaagcagaagcattgaaa

SEQ ID NO: 524107 - DNA, 25 bp, Mus musculus
agaacgagaagctgaagcattgaaa

SEQ ID NO: 524108 - DNA, 25 bp, Mus musculus
agaacgagggccacaaggtccaaag

SEQ ID NO: 524109 - DNA, 25 bp, Mus musculus
agaacgagggcctcaaggtccaaag

SEQ ID NO: 524110 - DNA, 25 bp, Mus musculus
agaacgagtacgacgccagctggtc

SEQ ID NO: 524111 - DNA, 25 bp, Mus musculus
agaacgagtacgtcgccagctggtc

SEQ ID NO: 524112 - DNA, 25 bp, Mus musculus
agaacgatcaacaagaaaaagctca

SEQ ID NO: 524113 - DNA, 25 bp, Mus musculus
agaacgatcaactagaaaaagctca

SEQ ID NO: 524114 - DNA, 25 bp, Mus musculus
agaacgatggcgactgcaccgacat

SEQ ID NO: 524115 - DNA, 25 bp, Mus musculus
agaacgatggcgtctgcaccgacat

SEQ ID NO: 524116 - DNA, 25 bp, Mus musculus
agaacgattgagaaggacttaggag

SEQ ID NO: 524117 - DNA, 25 bp, Mus musculus
agaacgattgagtaggacttaggag

SEQ ID NO: 524118 - DNA, 25 bp, Mus musculus
agaacgcacgcaacgtccgcttggt

SEQ ID NO: 524119 - DNA, 25 bp, Mus musculus
agaacgcacgcatcgtccgcttggt

SEQ ID NO: 524120 - DNA, 25 bp, Mus musculus
agaacgcatcagaccaaaagacaga

SEQ ID NO: 524121 - DNA, 25 bp, Mus musculus
agaacgcatcagtccaaaagacaga

SEQ ID NO: 524122 - DNA, 25 bp, Mus musculus
agaacgccattgaagccaagatgga

SEQ ID NO: 524123 - DNA, 25 bp, Mus musculus
agaacgccattgtagccaagatgga

SEQ ID NO: 524124 - DNA, 25 bp, Mus musculus
agaacgcggaagaggacttgtcaga

SEQ ID NO: 524125 - DNA, 25 bp, Mus musculus
agaacgcggaagtggacttgtcaga

SEQ ID NO: 524126 - DNA, 25 bp, Mus musculus
agaacgctgaagatgatccagcctt

SEQ ID NO: 524127 - DNA, 25 bp, Mus musculus
agaacgctgaagttgatccagcctt

SEQ ID NO: 524128 - DNA, 25 bp, Mus musculus
agaacggaacacaaacctggatcac

SEQ ID NO: 524129 - DNA, 25 bp, Mus musculus
agaacggaacactaacctggatcac

SEQ ID NO: 524130 - DNA, 25 bp, Mus musculus
agaacggatctcctcgcctgaatcg

SEQ ID NO: 524131 - DNA, 25 bp, Mus musculus
agaacggatctcgtcgcctgaatcg

SEQ ID NO: 524132 - DNA, 25 bp, Mus musculus
agaacggcaccaccacggcttgcta

SEQ ID NO: 524133 - DNA, 25 bp, Mus musculus
agaacggcaccagcacggcttgcta

SEQ ID NO: 524134 - DNA, 25 bp, Mus musculus
agaacggtaagaatgccaagaagga

SEQ ID NO: 524135 - DNA, 25 bp, Mus musculus
agaacggtaagattgccaagaagga

SEQ ID NO: 524136 - DNA, 25 bp, Mus musculus
agaacggtctttctctacccatggt

SEQ ID NO: 524137 - DNA, 25 bp, Mus musculus
agaacggtctttgtctacccatggt

SEQ ID NO: 524138 - DNA, 25 bp, Mus musculus
agaacggtgaccatcagaagacaga

SEQ ID NO: 524139 - DNA, 25 bp, Mus musculus
agaacggtgaccttcagaagacaga

SEQ ID NO: 524140 - DNA, 25 bp, Mus musculus
agaacgtgagcccttgtgacgcgca

SEQ ID NO: 524141 - DNA, 25 bp, Mus musculus
agaacgtgagccgttgtgacgcgca

SEQ ID NO: 524142 - DNA, 25 bp, Mus musculus
agaacgtgccccaggtctgcggcca

SEQ ID NO: 524143 - DNA, 25 bp, Mus musculus
agaacgtgcccctggtctgcggcca

SEQ ID NO: 524144 - DNA, 25 bp, Mus musculus
agaacgtgggccacatgcagcagca

SEQ ID NO: 524145 - DNA, 25 bp, Mus musculus
agaacgtgggcctcatgcagcagca

SEQ ID NO: 524146 - DNA, 25 bp, Mus musculus
agaacgtggtccaccaggaagaggt

SEQ ID NO: 524147 - DNA, 25 bp, Mus musculus
agaacgtggtcctccaggaagaggt

SEQ ID NO: 524148 - DNA, 25 bp, Mus musculus
agaacgttccgcaggcacatctgcc

SEQ ID NO: 524149 - DNA, 25 bp, Mus musculus
agaacgttccgctggcacatctgcc

SEQ ID NO: 524150 - DNA, 25 bp, Mus musculus
agaactacccctccgacagtgatgg

SEQ ID NO: 524151 - DNA, 25 bp, Mus musculus
agaactacccctgcgacagtgatgg

SEQ ID NO: 524152 - DNA, 25 bp, Mus musculus
agaactaccgctccggacgtggaga

SEQ ID NO: 524153 - DNA, 25 bp, Mus musculus
agaactaccgctgcggacgtggaga

SEQ ID NO: 524154 - DNA, 25 bp, Mus musculus
agaactacctgacctacctgacggc

SEQ ID NO: 524155 - DNA, 25 bp, Mus musculus
agaactacctgagctacctgacggc

SEQ ID NO: 524156 - DNA, 25 bp, Mus musculus
agaactactttgcacaagtcgactg

SEQ ID NO: 524157 - DNA, 25 bp, Mus musculus
agaactactttggacaagtcgactg

SEQ ID NO: 524158 - DNA, 25 bp, Mus musculus
agaactagacctcggagtttccagt

SEQ ID NO: 524159 - DNA, 25 bp, Mus musculus
agaactagacctgggagtttccagt

SEQ ID NO: 524160 - DNA, 25 bp, Mus musculus
agaactatggtgacgcgctcgcggc

SEQ ID NO: 524161 - DNA, 25 bp, Mus musculus
agaactatggtgtcgcgctcgcggc

SEQ ID NO: 524162 - DNA, 25 bp, Mus musculus
agaactcaagaccagaggctaatga

SEQ ID NO: 524163 - DNA, 25 bp, Mus musculus
agaactcaagacgagaggctaatga

SEQ ID NO: 524164 - DNA, 25 bp, Mus musculus
agaactcacaaaataatcgcacccg

SEQ ID NO: 524165 - DNA, 25 bp, Mus musculus
agaactcacaaattaatcgcacccg

SEQ ID NO: 524166 - DNA, 25 bp, Mus musculus
agaactcagaggctagctcacacac

SEQ ID NO: 524167 - DNA, 25 bp, Mus musculus
agaactcagagggtagctcacacac

SEQ ID NO: 524168 - DNA, 25 bp, Mus musculus
agaactccaagcaacacttacctca

SEQ ID NO: 524169 - DNA, 25 bp, Mus musculus
agaactccaagctacacttacctca

SEQ ID NO: 524170 - DNA, 25 bp, Mus musculus
agaactccaggcagtgcgcatgttt

SEQ ID NO: 524171 - DNA, 25 bp, Mus musculus
agaactccaggctgtgcgcatgttt

SEQ ID NO: 524172 - DNA, 25 bp, Mus musculus
agaactccgccaccaatactgtctg

SEQ ID NO: 524173 - DNA, 25 bp, Mus musculus
agaactccgccagcaatactgtctg

SEQ ID NO: 524174 - DNA, 25 bp, Mus musculus
agaactcctggaaggcaatcacgaa

SEQ ID NO: 524175 - DNA, 25 bp, Mus musculus
agaactcctggatggcaatcacgaa

SEQ ID NO: 524176 - DNA, 25 bp, Mus musculus
agaactccttccagcttcagctcaa

SEQ ID NO: 524177 - DNA, 25 bp, Mus musculus
agaactccttcctgcttcagctcaa

SEQ ID NO: 524178 - DNA, 25 bp, Mus musculus
agaactcgaggcctctgcttaaccc

SEQ ID NO: 524179 - DNA, 25 bp, Mus musculus
agaactcgaggcgtctgcttaaccc

SEQ ID NO: 524180 - DNA, 25 bp, Mus musculus
agaactctaggtcggcctttctgct

SEQ ID NO: 524181 - DNA, 25 bp, Mus musculus
agaactctaggtgggcctttctgct

SEQ ID NO: 524182 - DNA, 25 bp, Mus musculus
agaactctgaaacgcggaagctgat

SEQ ID NO: 524183 - DNA, 25 bp, Mus musculus
agaactctgaaaggcggaagctgat

SEQ ID NO: 524184 - DNA, 25 bp, Mus musculus
agaactctgagtagtcctaccgtga

SEQ ID NO: 524185 - DNA, 25 bp, Mus musculus
agaactctgagttgtcctaccgtga

SEQ ID NO: 524186 - DNA, 25 bp, Mus musculus
agaactctggttcgcctagtgagag

SEQ ID NO: 524187 - DNA, 25 bp, Mus musculus
agaactctggttggcctagtgagag

SEQ ID NO: 524188 - DNA, 25 bp, Mus musculus
agaactcttccacgaaatgaacata

SEQ ID NO: 524189 - DNA, 25 bp, Mus musculus
agaactcttccaggaaatgaacata

SEQ ID NO: 524190 - DNA, 25 bp, Mus musculus
agaactcttggacctgcgagcccaa

SEQ ID NO: 524191 - DNA, 25 bp, Mus musculus
agaactcttggagctgcgagcccaa

SEQ ID NO: 524192 - DNA, 25 bp, Mus musculus
agaactgacatgagactgcctggat

SEQ ID NO: 524193 - DNA, 25 bp, Mus musculus
agaactgacatgtgactgcctggat

SEQ ID NO: 524194 - DNA, 25 bp, Mus musculus
agaactgagccccaccctacgaagt

SEQ ID NO: 524195 - DNA, 25 bp, Mus musculus
agaactgagcccgaccctacgaagt

SEQ ID NO: 524196 - DNA, 25 bp, Mus musculus
agaactgatgtgcaatacgaactgg

SEQ ID NO: 524197 - DNA, 25 bp, Mus musculus
agaactgatgtggaatacgaactgg

SEQ ID NO: 524198 - DNA, 25 bp, Mus musculus
agaactgattgaagagtggcagcca

SEQ ID NO: 524199 - DNA, 25 bp, Mus musculus
agaactgattgatgagtggcagcca

SEQ ID NO: 524200 - DNA, 25 bp, Mus musculus
agaactgcccttcaatgaaatcgag

SEQ ID NO: 524201 - DNA, 25 bp, Mus musculus
agaactgcccttgaatgaaatcgag

SEQ ID NO: 524202 - DNA, 25 bp, Mus musculus
agaactgcctgtccaagtctcccaa

SEQ ID NO: 524203 - DNA, 25 bp, Mus musculus
agaactgcctgtgcaagtctcccaa

SEQ ID NO: 524204 - DNA, 25 bp, Mus musculus
agaactgcgcttcagccgagcggtc

SEQ ID NO: 524205 - DNA, 25 bp, Mus musculus
agaactgcgcttgagccgagcggtc

SEQ ID NO: 524206 - DNA, 25 bp, Mus musculus
agaactggaaatacagagaaagaag

SEQ ID NO: 524207 - DNA, 25 bp, Mus musculus
agaactggaaattcagagaaagaag

SEQ ID NO: 524208 - DNA, 25 bp, Mus musculus
agaactggaacgacagcaagccgga

SEQ ID NO: 524209 - DNA, 25 bp, Mus musculus
agaactggaacgtcagcaagccgga

SEQ ID NO: 524210 - DNA, 25 bp, Mus musculus
agaactggagagactggaactgctg

SEQ ID NO: 524211 - DNA, 25 bp, Mus musculus
agaactggagagtctggaactgctg

SEQ ID NO: 524212 - DNA, 25 bp, Mus musculus
agaactggatctctttctacagcaa

SEQ ID NO: 524213 - DNA, 25 bp, Mus musculus
agaactggatctgtttctacagcaa

SEQ ID NO: 524214 - DNA, 25 bp, Mus musculus
agaactggcaaacctccgacaggag

SEQ ID NO: 524215 - DNA, 25 bp, Mus musculus
agaactggcaaagctccgacaggag

SEQ ID NO: 524216 - DNA, 25 bp, Mus musculus
agaactgtccttagtttctgtgacg

SEQ ID NO: 524217 - DNA, 25 bp, Mus musculus
agaactgtcctttgtttctgtgacg

SEQ ID NO: 524218 - DNA, 25 bp, Mus musculus
agaactgtggttccaggagtcagcc

SEQ ID NO: 524219 - DNA, 25 bp, Mus musculus
agaactgtggttgcaggagtcagcc

SEQ ID NO: 524220 - DNA, 25 bp, Mus musculus
agaacttacagacgtctgcaaattg

SEQ ID NO: 524221 - DNA, 25 bp, Mus musculus
agaacttacagaggtctgcaaattg

SEQ ID NO: 524222 - DNA, 25 bp, Mus musculus
agaacttaccaaccagtatgaaaag

SEQ ID NO: 524223 - DNA, 25 bp, Mus musculus
agaacttaccaagcagtatgaaaag

SEQ ID NO: 524224 - DNA, 25 bp, Mus musculus
agaacttatagacagcggccaccgt

SEQ ID NO: 524225 - DNA, 25 bp, Mus musculus
agaacttatagagagcggccaccgt

SEQ ID NO: 524226 - DNA, 25 bp, Mus musculus
agaacttcagcgatccttcccctgg

SEQ ID NO: 524227 - DNA, 25 bp, Mus musculus
agaacttcagcgttccttcccctgg

SEQ ID NO: 524228 - DNA, 25 bp, Mus musculus
agaacttcgcgcagctcaaggtgct

SEQ ID NO: 524229 - DNA, 25 bp, Mus musculus
agaacttcgcgctgctcaaggtgct

SEQ ID NO: 524230 - DNA, 25 bp, Mus musculus
agaacttgccccagagaagaaggga

SEQ ID NO: 524231 - DNA, 25 bp, Mus musculus
agaacttgcccctgagaagaaggga

SEQ ID NO: 524232 - DNA, 25 bp, Mus musculus
agaacttggccgagtaggccctatt

SEQ ID NO: 524233 - DNA, 25 bp, Mus musculus
agaacttggccgtgtaggccctatt

SEQ ID NO: 524234 - DNA, 25 bp, Mus musculus
agaacttggtgcctaagcctgcacc

SEQ ID NO: 524235 - DNA, 25 bp, Mus musculus
agaacttggtgcgtaagcctgcacc

SEQ ID NO: 524236 - DNA, 25 bp, Mus musculus
agaactttctgcaattttgacttca

SEQ ID NO: 524237 - DNA, 25 bp, Mus musculus
agaactttctgctattttgacttca

SEQ ID NO: 524238 - DNA, 25 bp, Mus musculus
agaactttgccacgaccgtggcccg

SEQ ID NO: 524239 - DNA, 25 bp, Mus musculus
agaactttgccaggaccgtggcccg

SEQ ID NO: 524240 - DNA, 25 bp, Mus musculus
agaagaaaacgccaggtgccgacaa

SEQ ID NO: 524241 - DNA, 25 bp, Mus musculus
agaagaaaacgcgaggtgccgacaa

SEQ ID NO: 524242 - DNA, 25 bp, Mus musculus
agaagaaaactgaaggcgcctatga

SEQ ID NO: 524243 - DNA, 25 bp, Mus musculus
agaagaaaactgtaggcgcctatga

SEQ ID NO: 524244 - DNA, 25 bp, Mus musculus
agaagaaacttgctccactgagtta

SEQ ID NO: 524245 - DNA, 25 bp, Mus musculus
agaagaaacttggtccactgagtta

SEQ ID NO: 524246 - DNA, 25 bp, Mus musculus
agaagaaagaggagctgaatgcagt

SEQ ID NO: 524247 - DNA, 25 bp, Mus musculus
agaagaaagaggtgctgaatgcagt

SEQ ID NO: 524248 - DNA, 25 bp, Mus musculus
agaagaacaaaccatcccacggctc

SEQ ID NO: 524249 - DNA, 25 bp, Mus musculus
agaagaacaaacgatcccacggctc

SEQ ID NO: 524250 - DNA, 25 bp, Mus musculus
agaagaaccggcacttttggagccg

SEQ ID NO: 524251 - DNA, 25 bp, Mus musculus
agaagaaccggctcttttggagccg

SEQ ID NO: 524252 - DNA, 25 bp, Mus musculus
agaagaacggagcagtttcctggct

SEQ ID NO: 524253 - DNA, 25 bp, Mus musculus
agaagaacggaggagtttcctggct

SEQ ID NO: 524254 - DNA, 25 bp, Mus musculus
agaagaactgggatctcagattgag

SEQ ID NO: 524255 - DNA, 25 bp, Mus musculus
agaagaactgggttctcagattgag

SEQ ID NO: 524256 - DNA, 25 bp, Mus musculus
agaagaagaaaacacggcgcattaa

SEQ ID NO: 524257 - DNA, 25 bp, Mus musculus
agaagaagaaaagacggcgcattaa

SEQ ID NO: 524258 - DNA, 25 bp, Mus musculus
agaagaagacgtaaagcagatcacg

SEQ ID NO: 524259 - DNA, 25 bp, Mus musculus
agaagaagacgttaagcagatcacg

SEQ ID NO: 524260 - DNA, 25 bp, Mus musculus
agaagaagaggtaggatccacggat

SEQ ID NO: 524261 - DNA, 25 bp, Mus musculus
agaagaagaggttggatccacggat

SEQ ID NO: 524262 - DNA, 25 bp, Mus musculus
agaagaagatggagcatcccccagg

SEQ ID NO: 524263 - DNA, 25 bp, Mus musculus
agaagaagatggtgcatcccccagg

SEQ ID NO: 524264 - DNA, 25 bp, Mus musculus
agaagaagcaaaaggttgccaatgt

SEQ ID NO: 524265 - DNA, 25 bp, Mus musculus
agaagaagcaaatggttgccaatgt

SEQ ID NO: 524266 - DNA, 25 bp, Mus musculus
agaagaagccaccaagaagcttggc

SEQ ID NO: 524267 - DNA, 25 bp, Mus musculus
agaagaagccacgaagaagcttggc

SEQ ID NO: 524268 - DNA, 25 bp, Mus musculus
agaagaaggcctcaaagacgaagag

SEQ ID NO: 524269 - DNA, 25 bp, Mus musculus
agaagaaggcctgaaagacgaagag

SEQ ID NO: 524270 - DNA, 25 bp, Mus musculus
agaagaaggcttccatcggctacac

SEQ ID NO: 524271 - DNA, 25 bp, Mus musculus
agaagaaggcttgcatcggctacac

SEQ ID NO: 524272 - DNA, 25 bp, Mus musculus
agaagaaggtgtccatctggccact

SEQ ID NO: 524273 - DNA, 25 bp, Mus musculus
agaagaaggtgtgcatctggccact

SEQ ID NO: 524274 - DNA, 25 bp, Mus musculus
agaagaagtttgacgagttccagag

SEQ ID NO: 524275 - DNA, 25 bp, Mus musculus
agaagaagtttgtcgagttccagag

SEQ ID NO: 524276 - DNA, 25 bp, Mus musculus
agaagaatactgaaaacggcacggg

SEQ ID NO: 524277 - DNA, 25 bp, Mus musculus
agaagaatactgtaaacggcacggg

SEQ ID NO: 524278 - DNA, 25 bp, Mus musculus
agaagaatggcgctcacgagcagcc

SEQ ID NO: 524279 - DNA, 25 bp, Mus musculus
agaagaatggcggtcacgagcagcc

SEQ ID NO: 524280 - DNA, 25 bp, Mus musculus
agaagaattacaagagctcagggac

SEQ ID NO: 524281 - DNA, 25 bp, Mus musculus
agaagaattacatgagctcagggac

SEQ ID NO: 524282 - DNA, 25 bp, Mus musculus
agaagaatttagaaggcatagttgc

SEQ ID NO: 524283 - DNA, 25 bp, Mus musculus
agaagaatttagtaggcatagttgc

SEQ ID NO: 524284 - DNA, 25 bp, Mus musculus
agaagacaccgaaggaccagttcag

SEQ ID NO: 524285 - DNA, 25 bp, Mus musculus
agaagacaccgatggaccagttcag

SEQ ID NO: 524286 - DNA, 25 bp, Mus musculus
agaagacactggcttcgtcggagag

SEQ ID NO: 524287 - DNA, 25 bp, Mus musculus
agaagacactgggttcgtcggagag

SEQ ID NO: 524288 - DNA, 25 bp, Mus musculus
agaagacagctcacacccggcctgt

SEQ ID NO: 524289 - DNA, 25 bp, Mus musculus
agaagacagctctcacccggcctgt

SEQ ID NO: 524290 - DNA, 25 bp, Mus musculus
agaagacagtggatgggccatcaaa

SEQ ID NO: 524291 - DNA, 25 bp, Mus musculus
agaagacagtggttgggccatcaaa

SEQ ID NO: 524292 - DNA, 25 bp, Mus musculus
agaagacatgttccttgaagtcaac

SEQ ID NO: 524293 - DNA, 25 bp, Mus musculus
agaagacatgttcgccaagctgaag

SEQ ID NO: 524294 - DNA, 25 bp, Mus musculus
agaagacatgttgcttgaagtcaac

SEQ ID NO: 524295 - DNA, 25 bp, Mus musculus
agaagacatgttggccaagctgaag

SEQ ID NO: 524296 - DNA, 25 bp, Mus musculus
agaagaccaaacacccaccactgtg

SEQ ID NO: 524297 - DNA, 25 bp, Mus musculus
agaagaccaaactcccaccactgtg

SEQ ID NO: 524298 - DNA, 25 bp, Mus musculus
agaagaccaccccagtgcggactgt

SEQ ID NO: 524299 - DNA, 25 bp, Mus musculus
agaagaccacccgagtgcggactgt

SEQ ID NO: 524300 - DNA, 25 bp, Mus musculus
agaagacccagaaacttaaccatct

SEQ ID NO: 524301 - DNA, 25 bp, Mus musculus
agaagacccagatacttaaccatct

SEQ ID NO: 524302 - DNA, 25 bp, Mus musculus
agaagaccctccagtccctgtggtg

SEQ ID NO: 524303 - DNA, 25 bp, Mus musculus
agaagaccctcctgtccctgtggtg

SEQ ID NO: 524304 - DNA, 25 bp, Mus musculus
agaagaccctgaccctggagagaag

SEQ ID NO: 524305 - DNA, 25 bp, Mus musculus
agaagaccctgagcctggagagaag

SEQ ID NO: 524306 - DNA, 25 bp, Mus musculus
agaagacctcagagtgttctaccct

SEQ ID NO: 524307 - DNA, 25 bp, Mus musculus
agaagacctcagtgtgttctaccct

SEQ ID NO: 524308 - DNA, 25 bp, Mus musculus
agaagacctgaaaagattctacagc

SEQ ID NO: 524309 - DNA, 25 bp, Mus musculus
agaagacctgaatagattctacagc

SEQ ID NO: 524310 - DNA, 25 bp, Mus musculus
agaagacgccctattcgcttgtggg

SEQ ID NO: 524311 - DNA, 25 bp, Mus musculus
agaagacgcccttttcgcttgtggg

SEQ ID NO: 524312 - DNA, 25 bp, Mus musculus
agaagacgctaaagatggagcagag

SEQ ID NO: 524313 - DNA, 25 bp, Mus musculus
agaagacgctaatgatggagcagag

SEQ ID NO: 524314 - DNA, 25 bp, Mus musculus
agaagacgctggagctcagagaccg

SEQ ID NO: 524315 - DNA, 25 bp, Mus musculus
agaagacgctggtgctcagagaccg

SEQ ID NO: 524316 - DNA, 25 bp, Mus musculus
agaagacgcttgaggccaagatggt

SEQ ID NO: 524317 - DNA, 25 bp, Mus musculus
agaagacgcttgtggccaagatggt

SEQ ID NO: 524318 - DNA, 25 bp, Mus musculus
agaagacggacgaggctccagactt

SEQ ID NO: 524319 - DNA, 25 bp, Mus musculus
agaagacggacgtggctccagactt

SEQ ID NO: 524320 - DNA, 25 bp, Mus musculus
agaagacgggaacccgcttcactgc

SEQ ID NO: 524321 - DNA, 25 bp, Mus musculus
agaagacgggaagccgcttcactgc

SEQ ID NO: 524322 - DNA, 25 bp, Mus musculus
agaagactcaacacgcattgggcgg

SEQ ID NO: 524323 - DNA, 25 bp, Mus musculus
agaagactcaactcgcattgggcgg

SEQ ID NO: 524324 - DNA, 25 bp, Mus musculus
agaagactctgaacatctgattcgg

SEQ ID NO: 524325 - DNA, 25 bp, Mus musculus
agaagactctgatcatctgattcgg

SEQ ID NO: 524326 - DNA, 25 bp, Mus musculus
agaagacttggacccattccaggag

SEQ ID NO: 524327 - DNA, 25 bp, Mus musculus
agaagacttggagccattccaggag

SEQ ID NO: 524328 - DNA, 25 bp, Mus musculus
agaagacttggtagactccttgaag

SEQ ID NO: 524329 - DNA, 25 bp, Mus musculus
agaagacttggttgactccttgaag

SEQ ID NO: 524330 - DNA, 25 bp, Mus musculus
agaagagaaacccacagactcacct

SEQ ID NO: 524331 - DNA, 25 bp, Mus musculus
agaagagaaaccgacagactcacct

SEQ ID NO: 524332 - DNA, 25 bp, Mus musculus
agaagagagaccattgtttccccag

SEQ ID NO: 524333 - DNA, 25 bp, Mus musculus
agaagagagacctttgtttccccag

SEQ ID NO: 524334 - DNA, 25 bp, Mus musculus
agaagagagactcggtcatcccgcc

SEQ ID NO: 524335 - DNA, 25 bp, Mus musculus
agaagagagactgggtcatcccgcc

SEQ ID NO: 524336 - DNA, 25 bp, Mus musculus
agaagagcagaaccacccatcaggt

SEQ ID NO: 524337 - DNA, 25 bp, Mus musculus
agaagagcagaagcacccatcaggt

SEQ ID NO: 524338 - DNA, 25 bp, Mus musculus
agaagagccactccacatgggccaa

SEQ ID NO: 524339 - DNA, 25 bp, Mus musculus
agaagagccactgcacatgggccaa

SEQ ID NO: 524340 - DNA, 25 bp, Mus musculus
agaagagccggcagggagagcatga

SEQ ID NO: 524341 - DNA, 25 bp, Mus musculus
agaagagccggctgggagagcatga

SEQ ID NO: 524342 - DNA, 25 bp, Mus musculus
agaagagcgtcaagaactggagaac

SEQ ID NO: 524343 - DNA, 25 bp, Mus musculus
agaagagcgtcatgaactggagaac

SEQ ID NO: 524344 - DNA, 25 bp, Mus musculus
agaagagctccaacactcgctgagg

SEQ ID NO: 524345 - DNA, 25 bp, Mus musculus
agaagagctccatcactcgctgagg

SEQ ID NO: 524346 - DNA, 25 bp, Mus musculus
agaagaggagtcatgcaggaagttc

SEQ ID NO: 524347 - DNA, 25 bp, Mus musculus
agaagaggagtcttgcaggaagttc

SEQ ID NO: 524348 - DNA, 25 bp, Mus musculus
agaagaggcgccacctttcgtagca

SEQ ID NO: 524349 - DNA, 25 bp, Mus musculus
agaagaggcgcctcctttcgtagca

SEQ ID NO: 524350 - DNA, 25 bp, Mus musculus
agaagaggctgaagcatggcctgtc

SEQ ID NO: 524351 - DNA, 25 bp, Mus musculus
agaagaggctgatgcatggcctgtc

SEQ ID NO: 524352 - DNA, 25 bp, Mus musculus
agaagagggcacacagaaggagact

SEQ ID NO: 524353 - DNA, 25 bp, Mus musculus
agaagagggcactcagaaggagact

SEQ ID NO: 524354 - DNA, 25 bp, Mus musculus
agaagagtcagacaggaagcttctt

SEQ ID NO: 524355 - DNA, 25 bp, Mus musculus
agaagagtcagagaggaagcttctt

SEQ ID NO: 524356 - DNA, 25 bp, Mus musculus
agaagagtctggctcaccctcaggt

SEQ ID NO: 524357 - DNA, 25 bp, Mus musculus
agaagagtctgggtcaccctcaggt

SEQ ID NO: 524358 - DNA, 25 bp, Mus musculus
agaagataacccatcgggagccggg

SEQ ID NO: 524359 - DNA, 25 bp, Mus musculus
agaagataacccttcgggagccggg

SEQ ID NO: 524360 - DNA, 25 bp, Mus musculus
agaagataaggacgctgcccgacta

SEQ ID NO: 524361 - DNA, 25 bp, Mus musculus
agaagataaggaggctgcccgacta

SEQ ID NO: 524362 - DNA, 25 bp, Mus musculus
agaagatacagtcctcgcccactca

SEQ ID NO: 524363 - DNA, 25 bp, Mus musculus
agaagatacagtgctcgcccactca

SEQ ID NO: 524364 - DNA, 25 bp, Mus musculus
agaagatcaaggaaaatggctgtgg

SEQ ID NO: 524365 - DNA, 25 bp, Mus musculus
agaagatcaaggtaaatggctgtgg

SEQ ID NO: 524366 - DNA, 25 bp, Mus musculus
agaagatcctgacgcccatgctgaa

SEQ ID NO: 524367 - DNA, 25 bp, Mus musculus
agaagatcctgaggcccatgctgaa

SEQ ID NO: 524368 - DNA, 25 bp, Mus musculus
agaagatcgcctcggagattgccca

SEQ ID NO: 524369 - DNA, 25 bp, Mus musculus
agaagatcgcctgggagattgccca

SEQ ID NO: 524370 - DNA, 25 bp, Mus musculus
agaagatcgtggctcccatcagtga

SEQ ID NO: 524371 - DNA, 25 bp, Mus musculus
agaagatcgtgggtcccatcagtga

SEQ ID NO: 524372 - DNA, 25 bp, Mus musculus
agaagatgacccagtcatacaggag

SEQ ID NO: 524373 - DNA, 25 bp, Mus musculus
agaagatgaccctgtcatacaggag

SEQ ID NO: 524374 - DNA, 25 bp, Mus musculus
agaagatgacttctcccaccatttc

SEQ ID NO: 524375 - DNA, 25 bp, Mus musculus
agaagatgacttgtcccaccatttc

SEQ ID NO: 524376 - DNA, 25 bp, Mus musculus
agaagatgcacccaaccctggagat

SEQ ID NO: 524377 - DNA, 25 bp, Mus musculus
agaagatgcaccgaaccctggagat

SEQ ID NO: 524378 - DNA, 25 bp, Mus musculus
agaagatgcaggaccaagatgagga

SEQ ID NO: 524379 - DNA, 25 bp, Mus musculus
agaagatgcaggtccaagatgagga

SEQ ID NO: 524380 - DNA, 25 bp, Mus musculus
agaagatggatgcacagagttcagc

SEQ ID NO: 524381 - DNA, 25 bp, Mus musculus
agaagatggatggacagagttcagc

SEQ ID NO: 524382 - DNA, 25 bp, Mus musculus
agaagatgggcaccccgagttgcaa

SEQ ID NO: 524383 - DNA, 25 bp, Mus musculus
agaagatgggcagcccgagttgcaa

SEQ ID NO: 524384 - DNA, 25 bp, Mus musculus
agaagatggtggacgtggctctcca

SEQ ID NO: 524385 - DNA, 25 bp, Mus musculus
agaagatggtggtcgtggctctcca

SEQ ID NO: 524386 - DNA, 25 bp, Mus musculus
agaagatgtagtatcggccatggac

SEQ ID NO: 524387 - DNA, 25 bp, Mus musculus
agaagatgtagtttcggccatggac

SEQ ID NO: 524388 - DNA, 25 bp, Mus musculus
agaagattccaaataatacacagtg

SEQ ID NO: 524389 - DNA, 25 bp, Mus musculus
agaagattccaattaatacacagtg

SEQ ID NO: 524390 - DNA, 25 bp, Mus musculus
agaagatttgcgcagttttatcagc

SEQ ID NO: 524391 - DNA, 25 bp, Mus musculus
agaagatttgcggagttttatcagc

SEQ ID NO: 524392 - DNA, 25 bp, Mus musculus
agaagcaaagctcaacctcgggcca

SEQ ID NO: 524393 - DNA, 25 bp, Mus musculus
agaagcaaagctgaacctcgggcca

SEQ ID NO: 524394 - DNA, 25 bp, Mus musculus
agaagcaaatggatgccaatgtgga

SEQ ID NO: 524395 - DNA, 25 bp, Mus musculus
agaagcaaatggttgccaatgtgga

SEQ ID NO: 524396 - DNA, 25 bp, Mus musculus
agaagcaaccagagataggcagcca

SEQ ID NO: 524397 - DNA, 25 bp, Mus musculus
agaagcaaccagtgataggcagcca

SEQ ID NO: 524398 - DNA, 25 bp, Mus musculus
agaagcaactcaaggaatccaaatc

SEQ ID NO: 524399 - DNA, 25 bp, Mus musculus
agaagcaactcactcaaccagaaac

SEQ ID NO: 524400 - DNA, 25 bp, Mus musculus
agaagcaactcagtcaaccagaaac

SEQ ID NO: 524401 - DNA, 25 bp, Mus musculus
agaagcaactcatggaatccaaatc

SEQ ID NO: 524402 - DNA, 25 bp, Mus musculus
agaagcaccctgagccagtcccagg

SEQ ID NO: 524403 - DNA, 25 bp, Mus musculus
agaagcaccctgtgccagtcccagg

SEQ ID NO: 524404 - DNA, 25 bp, Mus musculus
agaagcaccttgacctggagcggaa

SEQ ID NO: 524405 - DNA, 25 bp, Mus musculus
agaagcaccttgtcctggagcggaa

SEQ ID NO: 524406 - DNA, 25 bp, Mus musculus
agaagcagatgaatatgagtccacc

SEQ ID NO: 524407 - DNA, 25 bp, Mus musculus
agaagcagatgattatgagtccacc

SEQ ID NO: 524408 - DNA, 25 bp, Mus musculus
agaagcagatgcaggtctccctcgc

SEQ ID NO: 524409 - DNA, 25 bp, Mus musculus
agaagcagatgctggtctccctcgc

SEQ ID NO: 524410 - DNA, 25 bp, Mus musculus
agaagcagcaacactctaagcctca

SEQ ID NO: 524411 - DNA, 25 bp, Mus musculus
agaagcagcaactctctaagcctca

SEQ ID NO: 524412 - DNA, 25 bp, Mus musculus
agaagcagcacgaccacttgacgcg

SEQ ID NO: 524413 - DNA, 25 bp, Mus musculus
agaagcagcacgtccacttgacgcg

SEQ ID NO: 524414 - DNA, 25 bp, Mus musculus
agaagcagcgaaactgacagaggag

SEQ ID NO: 524415 - DNA, 25 bp, Mus musculus
agaagcagcgaatctgacagaggag

SEQ ID NO: 524416 - DNA, 25 bp, Mus musculus
agaagcagctccagttcgccgagtt

SEQ ID NO: 524417 - DNA, 25 bp, Mus musculus
agaagcagctcctgttcgccgagtt

SEQ ID NO: 524418 - DNA, 25 bp, Mus musculus
agaagcaggtcaagatgttcagtgc

SEQ ID NO: 524419 - DNA, 25 bp, Mus musculus
agaagcaggtcatgatgttcagtgc

SEQ ID NO: 524420 - DNA, 25 bp, Mus musculus
agaagcagtatcaggtgcaccccgc

SEQ ID NO: 524421 - DNA, 25 bp, Mus musculus
agaagcagtatctggtgcaccccgc

SEQ ID NO: 524422 - DNA, 25 bp, Mus musculus
agaagcattgtgagggtacgacccc

SEQ ID NO: 524423 - DNA, 25 bp, Mus musculus
agaagcattgtgtgggtacgacccc

SEQ ID NO: 524424 - DNA, 25 bp, Mus musculus
agaagccaaacgcacgaccaagatc

SEQ ID NO: 524425 - DNA, 25 bp, Mus musculus
agaagccaaacggacgaccaagatc

SEQ ID NO: 524426 - DNA, 25 bp, Mus musculus
agaagccaccctcggttcctgtagc

SEQ ID NO: 524427 - DNA, 25 bp, Mus musculus
agaagccaccctgggttcctgtagc

SEQ ID NO: 524428 - DNA, 25 bp, Mus musculus
agaagccacgccagggctctgatgc

SEQ ID NO: 524429 - DNA, 25 bp, Mus musculus
agaagccacgcctgggctctgatgc

SEQ ID NO: 524430 - DNA, 25 bp, Mus musculus
agaagccagactacgtgacgacagg

SEQ ID NO: 524431 - DNA, 25 bp, Mus musculus
agaagccagacttcgtgacgacagg

SEQ ID NO: 524432 - DNA, 25 bp, Mus musculus
agaagccatccgcaagtgccagcgg

SEQ ID NO: 524433 - DNA, 25 bp, Mus musculus
agaagccatccggaagtgccagcgg

SEQ ID NO: 524434 - DNA, 25 bp, Mus musculus
agaagccatgggattcactggacct

SEQ ID NO: 524435 - DNA, 25 bp, Mus musculus
agaagccatgggtttcactggacct

SEQ ID NO: 524436 - DNA, 25 bp, Mus musculus
agaagccattctacctgtacacagg

SEQ ID NO: 524437 - DNA, 25 bp, Mus musculus
agaagccattcttcctgtacacagg

SEQ ID NO: 524438 - DNA, 25 bp, Mus musculus
agaagcccacgtcctacgactctgg

SEQ ID NO: 524439 - DNA, 25 bp, Mus musculus
agaagcccacgtgctacgactctgg

SEQ ID NO: 524440 - DNA, 25 bp, Mus musculus
agaagcccagttcccagtggataaa

SEQ ID NO: 524441 - DNA, 25 bp, Mus musculus
agaagcccagttgccagtggataaa

SEQ ID NO: 524442 - DNA, 25 bp, Mus musculus
agaagccccactagttgtcccagga

SEQ ID NO: 524443 - DNA, 25 bp, Mus musculus
agaagccccacttgttgtcccagga

SEQ ID NO: 524444 - DNA, 25 bp, Mus musculus
agaagccccgtcaccgtagaggaat

SEQ ID NO: 524445 - DNA, 25 bp, Mus musculus
agaagccccgtctccgtagaggaat

SEQ ID NO: 524446 - DNA, 25 bp, Mus musculus
agaagcccctcacctatgagcacgg

SEQ ID NO: 524447 - DNA, 25 bp, Mus musculus
agaagcccctcagctatgagcacgg

SEQ ID NO: 524448 - DNA, 25 bp, Mus musculus
agaagcccgggcagtacttgaccta

SEQ ID NO: 524449 - DNA, 25 bp, Mus musculus
agaagcccgggctgtacttgaccta

SEQ ID NO: 524450 - DNA, 25 bp, Mus musculus
agaagccctcaacctggatgggaag

SEQ ID NO: 524451 - DNA, 25 bp, Mus musculus
agaagccctcaagctggatgggaag

SEQ ID NO: 524452 - DNA, 25 bp, Mus musculus
agaagccctcctccctacaaagaga

SEQ ID NO: 524453 - DNA, 25 bp, Mus musculus
agaagccctcctgcctacaaagaga

SEQ ID NO: 524454 - DNA, 25 bp, Mus musculus
agaagccctcgaccggtacgtgcaa

SEQ ID NO: 524455 - DNA, 25 bp, Mus musculus
agaagccctcgagcggtacgtgcaa

SEQ ID NO: 524456 - DNA, 25 bp, Mus musculus
agaagcccttggatatcgccaggat

SEQ ID NO: 524457 - DNA, 25 bp, Mus musculus
agaagcccttggttatcgccaggat

SEQ ID NO: 524458 - DNA, 25 bp, Mus musculus
agaagccgccaaagaccgagagaca

SEQ ID NO: 524459 - DNA, 25 bp, Mus musculus
agaagccgccaatgaccgagagaca

SEQ ID NO: 524460 - DNA, 25 bp, Mus musculus
agaagcctaaggatgctgcagggtt

SEQ ID NO: 524461 - DNA, 25 bp, Mus musculus
agaagcctaaggttgctgcagggtt

SEQ ID NO: 524462 - DNA, 25 bp, Mus musculus
agaagcctcagactgccgtgtacag

SEQ ID NO: 524463 - DNA, 25 bp, Mus musculus
agaagcctcagagtgccgtgtacag

SEQ ID NO: 524464 - DNA, 25 bp, Mus musculus
agaagcctgatgatgaattatgcca

SEQ ID NO: 524465 - DNA, 25 bp, Mus musculus
agaagcctgatgttgaattatgcca

SEQ ID NO: 524466 - DNA, 25 bp, Mus musculus
agaagcctggagacagagcagacgc

SEQ ID NO: 524467 - DNA, 25 bp, Mus musculus
agaagcctggagtcagagcagacgc

SEQ ID NO: 524468 - DNA, 25 bp, Mus musculus
agaagccttctcatcccaggcagct

SEQ ID NO: 524469 - DNA, 25 bp, Mus musculus
agaagccttctcttcccaggcagct

SEQ ID NO: 524470 - DNA, 25 bp, Mus musculus
agaagcgagtccatggtctggtgtt

SEQ ID NO: 524471 - DNA, 25 bp, Mus musculus
agaagcgagtccctaatgcctacga

SEQ ID NO: 524472 - DNA, 25 bp, Mus musculus
agaagcgagtccgtaatgcctacga

SEQ ID NO: 524473 - DNA, 25 bp, Mus musculus
agaagcgagtccttggtctggtgtt

SEQ ID NO: 524474 - DNA, 25 bp, Mus musculus
agaagcgccagaacctaactcaggg

SEQ ID NO: 524475 - DNA, 25 bp, Mus musculus
agaagcgccagatcctaactcaggg

SEQ ID NO: 524476 - DNA, 25 bp, Mus musculus
agaagcgctactaccggcagcgcgc

SEQ ID NO: 524477 - DNA, 25 bp, Mus musculus
agaagcgctacttccggcagcgcgc

SEQ ID NO: 524478 - DNA, 25 bp, Mus musculus
agaagcggaggcacctcggcggtca

SEQ ID NO: 524479 - DNA, 25 bp, Mus musculus
agaagcggaggctcctcggcggtca

SEQ ID NO: 524480 - DNA, 25 bp, Mus musculus
agaagcggagtgagaccttcaaggc

SEQ ID NO: 524481 - DNA, 25 bp, Mus musculus
agaagcggagtgtgaccttcaaggc

SEQ ID NO: 524482 - DNA, 25 bp, Mus musculus
agaagcggctccatgacagcgtggt

SEQ ID NO: 524483 - DNA, 25 bp, Mus musculus
agaagcggctccttgacagcgtggt

SEQ ID NO: 524484 - DNA, 25 bp, Mus musculus
agaagcgggcccacacagatgaacc

SEQ ID NO: 524485 - DNA, 25 bp, Mus musculus
agaagcgggccctcacagatgaacc

SEQ ID NO: 524486 - DNA, 25 bp, Mus musculus
agaagcgtctcaacatctctgaccg

SEQ ID NO: 524487 - DNA, 25 bp, Mus musculus
agaagcgtctcatcatctctgaccg

SEQ ID NO: 524488 - DNA, 25 bp, Mus musculus
agaagctacggcactctcctaactg

SEQ ID NO: 524489 - DNA, 25 bp, Mus musculus
agaagctacggctctctcctaactg

SEQ ID NO: 524490 - DNA, 25 bp, Mus musculus
agaagctacgtgcagaaggacctca

SEQ ID NO: 524491 - DNA, 25 bp, Mus musculus
agaagctacgtggagaaggacctca

SEQ ID NO: 524492 - DNA, 25 bp, Mus musculus
agaagctcacgtacttggaggagga

SEQ ID NO: 524493 - DNA, 25 bp, Mus musculus
agaagctcacgttcttggaggagga

SEQ ID NO: 524494 - DNA, 25 bp, Mus musculus
agaagctcgagccaaatttcgccag

SEQ ID NO: 524495 - DNA, 25 bp, Mus musculus
agaagctcgagcgaaatttcgccag

SEQ ID NO: 524496 - DNA, 25 bp, Mus musculus
agaagctctgcgctcgttcaaccgg

SEQ ID NO: 524497 - DNA, 25 bp, Mus musculus
agaagctctgcggtcgttcaaccgg

SEQ ID NO: 524498 - DNA, 25 bp, Mus musculus
agaagctgaaggcatgtcaaagtca

SEQ ID NO: 524499 - DNA, 25 bp, Mus musculus
agaagctgaagggatgtcaaagtca

SEQ ID NO: 524500 - DNA, 25 bp, Mus musculus
agaagctgaccacgccggcagcgtc

SEQ ID NO: 524501 - DNA, 25 bp, Mus musculus
agaagctgaccaggccggcagcgtc

SEQ ID NO: 524502 - DNA, 25 bp, Mus musculus
agaagctgaccgacgaccacgttca

SEQ ID NO: 524503 - DNA, 25 bp, Mus musculus
agaagctgaccgtcgaccacgttca

SEQ ID NO: 524504 - DNA, 25 bp, Mus musculus
agaagctgacggagctgatgttcga

SEQ ID NO: 524505 - DNA, 25 bp, Mus musculus
agaagctgacggtgctgatgttcga

SEQ ID NO: 524506 - DNA, 25 bp, Mus musculus
agaagctgcccacttggatgaaacg

SEQ ID NO: 524507 - DNA, 25 bp, Mus musculus
agaagctgcccagttggatgaaacg

SEQ ID NO: 524508 - DNA, 25 bp, Mus musculus
agaagctgcggtcctcaccatgagt

SEQ ID NO: 524509 - DNA, 25 bp, Mus musculus
agaagctgcggtgctcaccatgagt

SEQ ID NO: 524510 - DNA, 25 bp, Mus musculus
agaagctgcgttccctaacccaggc

SEQ ID NO: 524511 - DNA, 25 bp, Mus musculus
agaagctgcgttgcctaacccaggc

SEQ ID NO: 524512 - DNA, 25 bp, Mus musculus
agaagctgctaacaaactggagcag

SEQ ID NO: 524513 - DNA, 25 bp, Mus musculus
agaagctgctaagaaactggagcag

SEQ ID NO: 524514 - DNA, 25 bp, Mus musculus
agaagctggagcatgcgaaccggca

SEQ ID NO: 524515 - DNA, 25 bp, Mus musculus
agaagctggagcttgcgaaccggca

SEQ ID NO: 524516 - DNA, 25 bp, Mus musculus
agaagctggatcatagcaacgtcca

SEQ ID NO: 524517 - DNA, 25 bp, Mus musculus
agaagctggatcttagcaacgtcca

SEQ ID NO: 524518 - DNA, 25 bp, Mus musculus
agaagctggccgaggcggaaggcct

SEQ ID NO: 524519 - DNA, 25 bp, Mus musculus
agaagctggccgtggcggaaggcct

SEQ ID NO: 524520 - DNA, 25 bp, Mus musculus
agaagctgggctagagccactggcc

SEQ ID NO: 524521 - DNA, 25 bp, Mus musculus
agaagctgggcttgagccactggcc

SEQ ID NO: 524522 - DNA, 25 bp, Mus musculus
agaagctggtttacctggtcgccct

SEQ ID NO: 524523 - DNA, 25 bp, Mus musculus
agaagctggttttcctggtcgccct

SEQ ID NO: 524524 - DNA, 25 bp, Mus musculus
agaagctgtgtgagttcaactgcaa

SEQ ID NO: 524525 - DNA, 25 bp, Mus musculus
agaagctgtgtgtgttcaactgcaa

SEQ ID NO: 524526 - DNA, 25 bp, Mus musculus
agaagcttccggccataatagcaag

SEQ ID NO: 524527 - DNA, 25 bp, Mus musculus
agaagcttccgggcataatagcaag

SEQ ID NO: 524528 - DNA, 25 bp, Mus musculus
agaagcttgcaacccgcggctgccg

SEQ ID NO: 524529 - DNA, 25 bp, Mus musculus
agaagcttgcaagccgcggctgccg

SEQ ID NO: 524530 - DNA, 25 bp, Mus musculus
agaagcttgtctcccagtatcagca

SEQ ID NO: 524531 - DNA, 25 bp, Mus musculus
agaagcttgtctgccagtatcagca

SEQ ID NO: 524532 - DNA, 25 bp, Mus musculus
agaaggaacggccaccaccatgggc

SEQ ID NO: 524533 - DNA, 25 bp, Mus musculus
agaaggaacggcgaccaccatgggc

SEQ ID NO: 524534 - DNA, 25 bp, Mus musculus
agaaggaacttaccagtcatcttgg

SEQ ID NO: 524535 - DNA, 25 bp, Mus musculus
agaaggaacttagcagtcatcttgg

SEQ ID NO: 524536 - DNA, 25 bp, Mus musculus
agaaggaaggcgaggcttccgccca

SEQ ID NO: 524537 - DNA, 25 bp, Mus musculus
agaaggaaggcgtggcttccgccca

SEQ ID NO: 524538 - DNA, 25 bp, Mus musculus
agaaggaatctccactgaaaaatga

SEQ ID NO: 524539 - DNA, 25 bp, Mus musculus
agaaggaatctcgactgaaaaatga

SEQ ID NO: 524540 - DNA, 25 bp, Mus musculus
agaaggaccaccacatctggagctt

SEQ ID NO: 524541 - DNA, 25 bp, Mus musculus
agaaggaccacctcatctggagctt

SEQ ID NO: 524542 - DNA, 25 bp, Mus musculus
agaaggaccagcaaggcatcattcc

SEQ ID NO: 524543 - DNA, 25 bp, Mus musculus
agaaggaccagctaggcatcattcc

SEQ ID NO: 524544 - DNA, 25 bp, Mus musculus
agaaggacccacactctcagacaag

SEQ ID NO: 524545 - DNA, 25 bp, Mus musculus
agaaggacccactctctcagacaag

SEQ ID NO: 524546 - DNA, 25 bp, Mus musculus
agaaggactcttcgagcgctcgccc

SEQ ID NO: 524547 - DNA, 25 bp, Mus musculus
agaaggactcttggagcgctcgccc

SEQ ID NO: 524548 - DNA, 25 bp, Mus musculus
agaaggagaaaaacctgaggaagga

SEQ ID NO: 524549 - DNA, 25 bp, Mus musculus
agaaggagaaaatcctgaggaagga

SEQ ID NO: 524550 - DNA, 25 bp, Mus musculus
agaaggagacaaagactacttcact

SEQ ID NO: 524551 - DNA, 25 bp, Mus musculus
agaaggagacaatgactacttcact

SEQ ID NO: 524552 - DNA, 25 bp, Mus musculus
agaaggagatccctccacgctcaga

SEQ ID NO: 524553 - DNA, 25 bp, Mus musculus
agaaggagatccgtccacgctcaga

SEQ ID NO: 524554 - DNA, 25 bp, Mus musculus
agaaggagctaacggctccctggtt

SEQ ID NO: 524555 - DNA, 25 bp, Mus musculus
agaaggagctaagggctccctggtt

SEQ ID NO: 524556 - DNA, 25 bp, Mus musculus
agaaggagctgacaggccgcaccct

SEQ ID NO: 524557 - DNA, 25 bp, Mus musculus
agaaggagctgagaggccgcaccct

SEQ ID NO: 524558 - DNA, 25 bp, Mus musculus
agaaggcaatagagatacgatctgt

SEQ ID NO: 524559 - DNA, 25 bp, Mus musculus
agaaggcaatagtgatacgatctgt

SEQ ID NO: 524560 - DNA, 25 bp, Mus musculus
agaaggcaatgtccccaatatcatc

SEQ ID NO: 524561 - DNA, 25 bp, Mus musculus
agaaggcaatgtgcccaatatcatc

SEQ ID NO: 524562 - DNA, 25 bp, Mus musculus
agaaggcagagactgtgtcaattgt

SEQ ID NO: 524563 - DNA, 25 bp, Mus musculus
agaaggcagagagtgtgtcaattgt

SEQ ID NO: 524564 - DNA, 25 bp, Mus musculus
agaaggcagctccacggcaacggga

SEQ ID NO: 524565 - DNA, 25 bp, Mus musculus
agaaggcagctcgacggcaacggga

SEQ ID NO: 524566 - DNA, 25 bp, Mus musculus
agaaggcattatacctggagcaaaa

SEQ ID NO: 524567 - DNA, 25 bp, Mus musculus
agaaggcattattcctggagcaaaa

SEQ ID NO: 524568 - DNA, 25 bp, Mus musculus
agaaggccaagtccagacgctgtgt

SEQ ID NO: 524569 - DNA, 25 bp, Mus musculus
agaaggccaagtgcagacgctgtgt

SEQ ID NO: 524570 - DNA, 25 bp, Mus musculus
agaaggccaccaaggtgaacttcaa

SEQ ID NO: 524571 - DNA, 25 bp, Mus musculus
agaaggccaccatggtgaacttcaa

SEQ ID NO: 524572 - DNA, 25 bp, Mus musculus
agaaggccgaatacttctaaattga

SEQ ID NO: 524573 - DNA, 25 bp, Mus musculus
agaaggccgaattcttctaaattga

SEQ ID NO: 524574 - DNA, 25 bp, Mus musculus
agaaggcctcggcagtggccaccaa

SEQ ID NO: 524575 - DNA, 25 bp, Mus musculus
agaaggcctcgggagtggccaccaa

SEQ ID NO: 524576 - DNA, 25 bp, Mus musculus
agaaggcgaaggactccttctccag

SEQ ID NO: 524577 - DNA, 25 bp, Mus musculus
agaaggcgaaggtctccttctccag

SEQ ID NO: 524578 - DNA, 25 bp, Mus musculus
agaaggcgcaggcaaccttgaccac

SEQ ID NO: 524579 - DNA, 25 bp, Mus musculus
agaaggcgcagggaaccttgaccac

SEQ ID NO: 524580 - DNA, 25 bp, Mus musculus
agaaggcggcggaagaccggagcaa

SEQ ID NO: 524581 - DNA, 25 bp, Mus musculus
agaaggcggcggtagaccggagcaa

SEQ ID NO: 524582 - DNA, 25 bp, Mus musculus
agaaggcgtcgtcgtcttccagaca

SEQ ID NO: 524583 - DNA, 25 bp, Mus musculus
agaaggcgtcgtggtcttccagaca

SEQ ID NO: 524584 - DNA, 25 bp, Mus musculus
agaaggctactcaggagcagatatc

SEQ ID NO: 524585 - DNA, 25 bp, Mus musculus
agaaggctactctggagcagatatc

SEQ ID NO: 524586 - DNA, 25 bp, Mus musculus
agaaggctctgcagtggcacccaga

SEQ ID NO: 524587 - DNA, 25 bp, Mus musculus
agaaggctctgctgtggcacccaga

SEQ ID NO: 524588 - DNA, 25 bp, Mus musculus
agaaggctctttcttgtggatatat

SEQ ID NO: 524589 - DNA, 25 bp, Mus musculus
agaaggctctttgttgtggatatat

SEQ ID NO: 524590 - DNA, 25 bp, Mus musculus
agaaggctgagcagcctaaggctgc

SEQ ID NO: 524591 - DNA, 25 bp, Mus musculus
agaaggctgagctgcctaaggctgc

SEQ ID NO: 524592 - DNA, 25 bp, Mus musculus
agaaggctgccccatgggtcttcca

SEQ ID NO: 524593 - DNA, 25 bp, Mus musculus
agaaggctgcccgatgggtcttcca

SEQ ID NO: 524594 - DNA, 25 bp, Mus musculus
agaaggctgtcgaacccttgtatac

SEQ ID NO: 524595 - DNA, 25 bp, Mus musculus
agaaggctgtcgtacccttgtatac

SEQ ID NO: 524596 - DNA, 25 bp, Mus musculus
agaaggctttctcctggtgttctcc

SEQ ID NO: 524597 - DNA, 25 bp, Mus musculus
agaaggctttctgctggtgttctcc

SEQ ID NO: 524598 - DNA, 25 bp, Mus musculus
agaagggacttcatgtgaatggaca

SEQ ID NO: 524599 - DNA, 25 bp, Mus musculus
agaagggacttcttgtgaatggaca

SEQ ID NO: 524600 - DNA, 25 bp, Mus musculus
agaagggatacacagttgggtttca

SEQ ID NO: 524601 - DNA, 25 bp, Mus musculus
agaagggatacagagttgggtttca

SEQ ID NO: 524602 - DNA, 25 bp, Mus musculus
agaagggcgtgaagaccgtgacctc

SEQ ID NO: 524603 - DNA, 25 bp, Mus musculus
agaagggcgtgatgaccgtgacctc

SEQ ID NO: 524604 - DNA, 25 bp, Mus musculus
agaagggctcccaggtgaagaacct

SEQ ID NO: 524605 - DNA, 25 bp, Mus musculus
agaagggctccctggtgaagaacct

SEQ ID NO: 524606 - DNA, 25 bp, Mus musculus
agaaggggtgagactgtctgatcct

SEQ ID NO: 524607 - DNA, 25 bp, Mus musculus
agaaggggtgagtctgtctgatcct

SEQ ID NO: 524608 - DNA, 25 bp, Mus musculus
agaagggtaagtcagcccctgccgt

SEQ ID NO: 524609 - DNA, 25 bp, Mus musculus
agaagggtaagtgagcccctgccgt

SEQ ID NO: 524610 - DNA, 25 bp, Mus musculus
agaagggtctccaggcataccaggg

SEQ ID NO: 524611 - DNA, 25 bp, Mus musculus
agaagggtctcctggcataccaggg

SEQ ID NO: 524612 - DNA, 25 bp, Mus musculus
agaagggtgggcactacatcgtcac

SEQ ID NO: 524613 - DNA, 25 bp, Mus musculus
agaagggtgggctctacatcgtcac

SEQ ID NO: 524614 - DNA, 25 bp, Mus musculus
agaagggttagcaaggccagatttt

SEQ ID NO: 524615 - DNA, 25 bp, Mus musculus
agaagggttagctaggccagatttt

SEQ ID NO: 524616 - DNA, 25 bp, Mus musculus
agaaggtcatcgagctgcccaagga

SEQ ID NO: 524617 - DNA, 25 bp, Mus musculus
agaaggtcatcgtgctgcccaagga

SEQ ID NO: 524618 - DNA, 25 bp, Mus musculus
agaaggtcatggctgttctggacat

SEQ ID NO: 524619 - DNA, 25 bp, Mus musculus
agaaggtcatgggtgttctggacat

SEQ ID NO: 524620 - DNA, 25 bp, Mus musculus
agaaggtccgcgagctgctcatgct

SEQ ID NO: 524621 - DNA, 25 bp, Mus musculus
agaaggtccgcgtgctgctcatgct

SEQ ID NO: 524622 - DNA, 25 bp, Mus musculus
agaaggtccggacgttacagcttcg

SEQ ID NO: 524623 - DNA, 25 bp, Mus musculus
agaaggtccggaggttacagcttcg

SEQ ID NO: 524624 - DNA, 25 bp, Mus musculus
agaaggtctcttagcacaggacaga

SEQ ID NO: 524625 - DNA, 25 bp, Mus musculus
agaaggtctctttgcacaggacaga

SEQ ID NO: 524626 - DNA, 25 bp, Mus musculus
agaaggtgtacgacctggtgcgctc

SEQ ID NO: 524627 - DNA, 25 bp, Mus musculus
agaaggtgtacgtcctggtgcgctc

SEQ ID NO: 524628 - DNA, 25 bp, Mus musculus
agaaggtgtctgagacccggagacc

SEQ ID NO: 524629 - DNA, 25 bp, Mus musculus
agaaggtgtctgtgacccggagacc

SEQ ID NO: 524630 - DNA, 25 bp, Mus musculus
agaaggtgtgcaactggccactgtg

SEQ ID NO: 524631 - DNA, 25 bp, Mus musculus
agaaggtgtgcatctggccactgtg

SEQ ID NO: 524632 - DNA, 25 bp, Mus musculus
agaaggttatttcctgctgacccag

SEQ ID NO: 524633 - DNA, 25 bp, Mus musculus
agaaggttatttgctgctgacccag

SEQ ID NO: 524634 - DNA, 25 bp, Mus musculus
agaagtaagataccctgtccaggag

SEQ ID NO: 524635 - DNA, 25 bp, Mus musculus
agaagtaagatagcctgtccaggag

SEQ ID NO: 524636 - DNA, 25 bp, Mus musculus
agaagtacagctacccataaaggca

SEQ ID NO: 524637 - DNA, 25 bp, Mus musculus
agaagtacagcttcccataaaggca

SEQ ID NO: 524638 - DNA, 25 bp, Mus musculus
agaagtacatcactgcccacggact

SEQ ID NO: 524639 - DNA, 25 bp, Mus musculus
agaagtacatcagtgcccacggact

SEQ ID NO: 524640 - DNA, 25 bp, Mus musculus
agaagtacccgcaggccaagtacct

SEQ ID NO: 524641 - DNA, 25 bp, Mus musculus
agaagtacccgctggccaagtacct

SEQ ID NO: 524642 - DNA, 25 bp, Mus musculus
agaagtacgcaacggaagaggccct

SEQ ID NO: 524643 - DNA, 25 bp, Mus musculus
agaagtacgcaagggaagaggccct

SEQ ID NO: 524644 - DNA, 25 bp, Mus musculus
agaagtactcatccgcctggtactc

SEQ ID NO: 524645 - DNA, 25 bp, Mus musculus
agaagtactcatgcgcctggtactc

SEQ ID NO: 524646 - DNA, 25 bp, Mus musculus
agaagtactccaaggacaacactcc

SEQ ID NO: 524647 - DNA, 25 bp, Mus musculus
agaagtactccatggacaacactcc

SEQ ID NO: 524648 - DNA, 25 bp, Mus musculus
agaagtacttacagcagcgtccagc

SEQ ID NO: 524649 - DNA, 25 bp, Mus musculus
agaagtacttactgcagcgtccagc

SEQ ID NO: 524650 - DNA, 25 bp, Mus musculus
agaagtagaggtcgcagatgaaaca

SEQ ID NO: 524651 - DNA, 25 bp, Mus musculus
agaagtagaggtggcagatgaaaca

SEQ ID NO: 524652 - DNA, 25 bp, Mus musculus
agaagtatagccctcgccagggtga

SEQ ID NO: 524653 - DNA, 25 bp, Mus musculus
agaagtatagccgtcgccagggtga

SEQ ID NO: 524654 - DNA, 25 bp, Mus musculus
agaagtatgataaggaggacaagga

SEQ ID NO: 524655 - DNA, 25 bp, Mus musculus
agaagtatgataccgcggcggccat

SEQ ID NO: 524656 - DNA, 25 bp, Mus musculus
agaagtatgatagcgcggcggccat

SEQ ID NO: 524657 - DNA, 25 bp, Mus musculus
agaagtatgatatggaggacaagga

SEQ ID NO: 524658 - DNA, 25 bp, Mus musculus
agaagtatgccaagtacctgcccca

SEQ ID NO: 524659 - DNA, 25 bp, Mus musculus
agaagtatgccatgtacctgcccca

SEQ ID NO: 524660 - DNA, 25 bp, Mus musculus
agaagtatgcttcccgtgtgggccc

SEQ ID NO: 524661 - DNA, 25 bp, Mus musculus
agaagtatgcttgccgtgtgggccc

SEQ ID NO: 524662 - DNA, 25 bp, Mus musculus
agaagtatggagaaacggctaatga

SEQ ID NO: 524663 - DNA, 25 bp, Mus musculus
agaagtatggagtaacggctaatga

SEQ ID NO: 524664 - DNA, 25 bp, Mus musculus
agaagtattgggagctccggtgacc

SEQ ID NO: 524665 - DNA, 25 bp, Mus musculus
agaagtattgggtgctccggtgacc

SEQ ID NO: 524666 - DNA, 25 bp, Mus musculus
agaagtcaaaacagacatctatgtg

SEQ ID NO: 524667 - DNA, 25 bp, Mus musculus
agaagtcaaaactgacatctatgtg

SEQ ID NO: 524668 - DNA, 25 bp, Mus musculus
agaagtcaggaaccatgcagacgag

SEQ ID NO: 524669 - DNA, 25 bp, Mus musculus
agaagtcaggaagcatgcagacgag

SEQ ID NO: 524670 - DNA, 25 bp, Mus musculus
agaagtccgggcagcagctcttgtc

SEQ ID NO: 524671 - DNA, 25 bp, Mus musculus
agaagtccgggctgcagctcttgtc

SEQ ID NO: 524672 - DNA, 25 bp, Mus musculus
agaagtcctcagctaccccgagagg

SEQ ID NO: 524673 - DNA, 25 bp, Mus musculus
agaagtcctcaggtaccccgagagg

SEQ ID NO: 524674 - DNA, 25 bp, Mus musculus
agaagtcctgacatccaagcaaaag

SEQ ID NO: 524675 - DNA, 25 bp, Mus musculus
agaagtcctgacttccaagcaaaag

SEQ ID NO: 524676 - DNA, 25 bp, Mus musculus
agaagtcggacgaccctgccaggcg

SEQ ID NO: 524677 - DNA, 25 bp, Mus musculus
agaagtcggacgtccctgccaggcg

SEQ ID NO: 524678 - DNA, 25 bp, Mus musculus
agaagtcggcgcagaccttcctgtc

SEQ ID NO: 524679 - DNA, 25 bp, Mus musculus
agaagtcggcgctgaccttcctgtc

SEQ ID NO: 524680 - DNA, 25 bp, Mus musculus
agaagtctgatccaaattactgctg

SEQ ID NO: 524681 - DNA, 25 bp, Mus musculus
agaagtctgatcgaaattactgctg

SEQ ID NO: 524682 - DNA, 25 bp, Mus musculus
agaagtgaccgcctgtgtgctgctc

SEQ ID NO: 524683 - DNA, 25 bp, Mus musculus
agaagtgaccgcgtgtgtgctgctc

SEQ ID NO: 524684 - DNA, 25 bp, Mus musculus
agaagtgatgtgaccacctgggcat

SEQ ID NO: 524685 - DNA, 25 bp, Mus musculus
agaagtgatgtgtccacctgggcat

SEQ ID NO: 524686 - DNA, 25 bp, Mus musculus
agaagtgcagaaatgccatcagagc

SEQ ID NO: 524687 - DNA, 25 bp, Mus musculus
agaagtgcagaattgccatcagagc

SEQ ID NO: 524688 - DNA, 25 bp, Mus musculus
agaagtgcaggcctctggacctctg

SEQ ID NO: 524689 - DNA, 25 bp, Mus musculus
agaagtgcaggcgtctggacctctg

SEQ ID NO: 524690 - DNA, 25 bp, Mus musculus
agaagtgcatccaccacgtgaagcg

SEQ ID NO: 524691 - DNA, 25 bp, Mus musculus
agaagtgcatcctccacgtgaagcg

SEQ ID NO: 524692 - DNA, 25 bp, Mus musculus
agaagtggacatcgagtcgctcgtc

SEQ ID NO: 524693 - DNA, 25 bp, Mus musculus
agaagtggacatggagtcgctcgtc

SEQ ID NO: 524694 - DNA, 25 bp, Mus musculus
agaagtggccagcttcactctggag

SEQ ID NO: 524695 - DNA, 25 bp, Mus musculus
agaagtggccaggttcactctggag

SEQ ID NO: 524696 - DNA, 25 bp, Mus musculus
agaagtggccccaccaaaggctcat

SEQ ID NO: 524697 - DNA, 25 bp, Mus musculus
agaagtggcccctccaaaggctcat

SEQ ID NO: 524698 - DNA, 25 bp, Mus musculus
agaagtggctgtcaaacatgagtga

SEQ ID NO: 524699 - DNA, 25 bp, Mus musculus
agaagtggctgtgaaacatgagtga

SEQ ID NO: 524700 - DNA, 25 bp, Mus musculus
agaagtggggttactgtccagacca

SEQ ID NO: 524701 - DNA, 25 bp, Mus musculus
agaagtggggtttctgtccagacca

SEQ ID NO: 524702 - DNA, 25 bp, Mus musculus
agaagtgtgagtccatcatggaacc

SEQ ID NO: 524703 - DNA, 25 bp, Mus musculus
agaagtgtgagtgcatcatggaacc

SEQ ID NO: 524704 - DNA, 25 bp, Mus musculus
agaagtgttcctagccgtggagtgc

SEQ ID NO: 524705 - DNA, 25 bp, Mus musculus
agaagtgttccttgccgtggagtgc

SEQ ID NO: 524706 - DNA, 25 bp, Mus musculus
agaagttatcagagccccggaagtc

SEQ ID NO: 524707 - DNA, 25 bp, Mus musculus
agaagttatcagtgccccggaagtc

SEQ ID NO: 524708 - DNA, 25 bp, Mus musculus
agaagttcccttacatggtagagtg

SEQ ID NO: 524709 - DNA, 25 bp, Mus musculus
agaagttccctttcatggtagagtg

SEQ ID NO: 524710 - DNA, 25 bp, Mus musculus
agaagttcgcagagcgggacgcaaa

SEQ ID NO: 524711 - DNA, 25 bp, Mus musculus
agaagttcgcagtgcgggacgcaaa

SEQ ID NO: 524712 - DNA, 25 bp, Mus musculus
agaagttctaaaatacctgcgcagc

SEQ ID NO: 524713 - DNA, 25 bp, Mus musculus
agaagttctaaattacctgcgcagc

SEQ ID NO: 524714 - DNA, 25 bp, Mus musculus
agaagttgactgatggcccctggct

SEQ ID NO: 524715 - DNA, 25 bp, Mus musculus
agaagttgactgttggcccctggct

SEQ ID NO: 524716 - DNA, 25 bp, Mus musculus
agaagttgaggcctgcaatcaagca

SEQ ID NO: 524717 - DNA, 25 bp, Mus musculus
agaagttgaggcgtgcaatcaagca

SEQ ID NO: 524718 - DNA, 25 bp, Mus musculus
agaagttgctaaagccaaacctgaa

SEQ ID NO: 524719 - DNA, 25 bp, Mus musculus
agaagttgctaatgccaaacctgaa

SEQ ID NO: 524720 - DNA, 25 bp, Mus musculus
agaagttggcatcgctcaagctgga

SEQ ID NO: 524721 - DNA, 25 bp, Mus musculus
agaagttggcatggctcaagctgga

SEQ ID NO: 524722 - DNA, 25 bp, Mus musculus
agaagttggcgaacaaggacctcca

SEQ ID NO: 524723 - DNA, 25 bp, Mus musculus
agaagttggcgatcaaggacctcca

SEQ ID NO: 524724 - DNA, 25 bp, Mus musculus
agaagtttacgaagatgtggatgcc

SEQ ID NO: 524725 - DNA, 25 bp, Mus musculus
agaagtttacgatgatgtggatgcc

SEQ ID NO: 524726 - DNA, 25 bp, Mus musculus
agaagtttcagtcgcctgcaagtta

SEQ ID NO: 524727 - DNA, 25 bp, Mus musculus
agaagtttcagtggcctgcaagtta

SEQ ID NO: 524728 - DNA, 25 bp, Mus musculus
agaagtttgaaaccatgtatgccca

SEQ ID NO: 524729 - DNA, 25 bp, Mus musculus
agaagtttgaaagcatgtatgccca

SEQ ID NO: 524730 - DNA, 25 bp, Mus musculus
agaagtttgttaccaacataacgag

SEQ ID NO: 524731 - DNA, 25 bp, Mus musculus
agaagtttgttagcaacataacgag

SEQ ID NO: 524732 - DNA, 25 bp, Mus musculus
agaataaagactcggtgatcaccgc

SEQ ID NO: 524733 - DNA, 25 bp, Mus musculus
agaataaagactgggtgatcaccgc

SEQ ID NO: 524734 - DNA, 25 bp, Mus musculus
agaataagaagaatgccagcgccac

SEQ ID NO: 524735 - DNA, 25 bp, Mus musculus
agaataagaagattgccagcgccac

SEQ ID NO: 524736 - DNA, 25 bp, Mus musculus
agaatacagcaaacttacccatggg

SEQ ID NO: 524737 - DNA, 25 bp, Mus musculus
agaatacagcaatcttacccatggg

SEQ ID NO: 524738 - DNA, 25 bp, Mus musculus
agaatacaggatcccctcctccagg

SEQ ID NO: 524739 - DNA, 25 bp, Mus musculus
agaatacaggatgccctcctccagg

SEQ ID NO: 524740 - DNA, 25 bp, Mus musculus
agaatacagggtcagctacagaatt

SEQ ID NO: 524741 - DNA, 25 bp, Mus musculus
agaatacagggtgagctacagaatt

SEQ ID NO: 524742 - DNA, 25 bp, Mus musculus
agaatacatttgctaccctgtgaga

SEQ ID NO: 524743 - DNA, 25 bp, Mus musculus
agaatacatttggtaccctgtgaga

SEQ ID NO: 524744 - DNA, 25 bp, Mus musculus
agaataccagagaccttccgtgggt

SEQ ID NO: 524745 - DNA, 25 bp, Mus musculus
agaataccagagtccttccgtgggt

SEQ ID NO: 524746 - DNA, 25 bp, Mus musculus
agaataccgtgaactggaggatgga

SEQ ID NO: 524747 - DNA, 25 bp, Mus musculus
agaataccgtgatctggaggatgga

SEQ ID NO: 524748 - DNA, 25 bp, Mus musculus
agaatacggactatccaaccagctg

SEQ ID NO: 524749 - DNA, 25 bp, Mus musculus
agaatacggactttccaaccagctg

SEQ ID NO: 524750 - DNA, 25 bp, Mus musculus
agaatacggtgaaggaatgtgatgc

SEQ ID NO: 524751 - DNA, 25 bp, Mus musculus
agaatacggtgatggaatgtgatgc

SEQ ID NO: 524752 - DNA, 25 bp, Mus musculus
agaatactttatcaaccagggactt

SEQ ID NO: 524753 - DNA, 25 bp, Mus musculus
agaatactttatgaaccagggactt

SEQ ID NO: 524754 - DNA, 25 bp, Mus musculus
agaatagcccttcgcaggccatcct

SEQ ID NO: 524755 - DNA, 25 bp, Mus musculus
agaatagcccttggcaggccatcct

SEQ ID NO: 524756 - DNA, 25 bp, Mus musculus
agaatagcgtgacggcgccctcgcc

SEQ ID NO: 524757 - DNA, 25 bp, Mus musculus
agaatagcgtgagggcgccctcgcc

SEQ ID NO: 524758 - DNA, 25 bp, Mus musculus
agaatatcattaccgagttgcctgt

SEQ ID NO: 524759 - DNA, 25 bp, Mus musculus
agaatatcattagcgagttgcctgt

SEQ ID NO: 524760 - DNA, 25 bp, Mus musculus
agaatatctcttatggacgtgacca

SEQ ID NO: 524761 - DNA, 25 bp, Mus musculus
agaatatctcttttggacgtgacca

SEQ ID NO: 524762 - DNA, 25 bp, Mus musculus
agaatatgaacaagcagaagagggc

SEQ ID NO: 524763 - DNA, 25 bp, Mus musculus
agaatatgaacatgcagaagagggc

SEQ ID NO: 524764 - DNA, 25 bp, Mus musculus
agaatatgacagcacggcatccctt

SEQ ID NO: 524765 - DNA, 25 bp, Mus musculus
agaatatgacaggacggcatccctt

SEQ ID NO: 524766 - DNA, 25 bp, Mus musculus
agaatatgacttcccagagaggaat

SEQ ID NO: 524767 - DNA, 25 bp, Mus musculus
agaatatgacttgccagagaggaat

SEQ ID NO: 524768 - DNA, 25 bp, Mus musculus
agaatatgatgtagctgtggaagca

SEQ ID NO: 524769 - DNA, 25 bp, Mus musculus
agaatatgatgttgctgtggaagca

SEQ ID NO: 524770 - DNA, 25 bp, Mus musculus
agaatatgcttaaggctcggctggc

SEQ ID NO: 524771 - DNA, 25 bp, Mus musculus
agaatatgcttatggctcggctggc

SEQ ID NO: 524772 - DNA, 25 bp, Mus musculus
agaatattaagaatcctggaagcca

SEQ ID NO: 524773 - DNA, 25 bp, Mus musculus
agaatattaagattcctggaagcca

SEQ ID NO: 524774 - DNA, 25 bp, Mus musculus
agaatattcaggctgctggagccca

SEQ ID NO: 524775 - DNA, 25 bp, Mus musculus
agaatattcagggtgctggagccca

SEQ ID NO: 524776 - DNA, 25 bp, Mus musculus
agaatattggcacctcctccgagcc

SEQ ID NO: 524777 - DNA, 25 bp, Mus musculus
agaatattggcagctcctccgagcc

SEQ ID NO: 524778 - DNA, 25 bp, Mus musculus
agaatattttacatcagccgctaca

SEQ ID NO: 524779 - DNA, 25 bp, Mus musculus
agaatattttacttcagccgctaca

SEQ ID NO: 524780 - DNA, 25 bp, Mus musculus
agaatcaagcaaccaactgttctct

SEQ ID NO: 524781 - DNA, 25 bp, Mus musculus
agaatcaagcaagcaactgttctct

SEQ ID NO: 524782 - DNA, 25 bp, Mus musculus
agaatcaatctcatcccactgagga

SEQ ID NO: 524783 - DNA, 25 bp, Mus musculus
agaatcaatctcttcccactgagga

SEQ ID NO: 524784 - DNA, 25 bp, Mus musculus
agaatcacggctcctggctcacttg

SEQ ID NO: 524785 - DNA, 25 bp, Mus musculus
agaatcacggctgctggctcacttg

SEQ ID NO: 524786 - DNA, 25 bp, Mus musculus
agaatcagacccatgctaagcgcgc

SEQ ID NO: 524787 - DNA, 25 bp, Mus musculus
agaatcagacccttgctaagcgcgc

SEQ ID NO: 524788 - DNA, 25 bp, Mus musculus
agaatcagcagaaaatttgcatcag

SEQ ID NO: 524789 - DNA, 25 bp, Mus musculus
agaatcagcagataatttgcatcag

SEQ ID NO: 524790 - DNA, 25 bp, Mus musculus
agaatcagggcccagagatgatgct

SEQ ID NO: 524791 - DNA, 25 bp, Mus musculus
agaatcagggccgagagatgatgct

SEQ ID NO: 524792 - DNA, 25 bp, Mus musculus
agaatcagttctacatcttactctg

SEQ ID NO: 524793 - DNA, 25 bp, Mus musculus
agaatcagttcttcatcttactctg

SEQ ID NO: 524794 - DNA, 25 bp, Mus musculus
agaatcattatgacggcagcactgg

SEQ ID NO: 524795 - DNA, 25 bp, Mus musculus
agaatcattatgtcggcagcactgg

SEQ ID NO: 524796 - DNA, 25 bp, Mus musculus
agaatccaaatgaagaggcaggtcc

SEQ ID NO: 524797 - DNA, 25 bp, Mus musculus
agaatccaaatgtagaggcaggtcc

SEQ ID NO: 524798 - DNA, 25 bp, Mus musculus
agaatcccaggcagctcaccctgga

SEQ ID NO: 524799 - DNA, 25 bp, Mus musculus
agaatcccaggctgctcaccctgga

SEQ ID NO: 524800 - DNA, 25 bp, Mus musculus
agaatccctccaacatccactttat

SEQ ID NO: 524801 - DNA, 25 bp, Mus musculus
agaatccctccatcatccactttat

SEQ ID NO: 524802 - DNA, 25 bp, Mus musculus
agaatccctccgctgctctagcagc

SEQ ID NO: 524803 - DNA, 25 bp, Mus musculus
agaatccctccggtgctctagcagc

SEQ ID NO: 524804 - DNA, 25 bp, Mus musculus
agaatccgagctagcagggaccgga

SEQ ID NO: 524805 - DNA, 25 bp, Mus musculus
agaatccgagcttgcagggaccgga

SEQ ID NO: 524806 - DNA, 25 bp, Mus musculus
agaatccttcaacgctgtacaagat

SEQ ID NO: 524807 - DNA, 25 bp, Mus musculus
agaatccttcaaggctgtacaagat

SEQ ID NO: 524808 - DNA, 25 bp, Mus musculus
agaatcgcacgtccacaccggtgcg

SEQ ID NO: 524809 - DNA, 25 bp, Mus musculus
agaatcgcacgtgcacaccggtgcg

SEQ ID NO: 524810 - DNA, 25 bp, Mus musculus
agaatcggccagaaggccaccaaga

SEQ ID NO: 524811 - DNA, 25 bp, Mus musculus
agaatcggccagtaggccaccaaga

SEQ ID NO: 524812 - DNA, 25 bp, Mus musculus
agaatcggcccaagtacgcaggact

SEQ ID NO: 524813 - DNA, 25 bp, Mus musculus
agaatcggcccatgtacgcaggact

SEQ ID NO: 524814 - DNA, 25 bp, Mus musculus
agaatcggtttcaggtgctgggcct

SEQ ID NO: 524815 - DNA, 25 bp, Mus musculus
agaatcggtttctggtgctgggcct

SEQ ID NO: 524816 - DNA, 25 bp, Mus musculus
agaatctaagccagaaaaagtcaag

SEQ ID NO: 524817 - DNA, 25 bp, Mus musculus
agaatctaagcctgaaaaagtcaag

SEQ ID NO: 524818 - DNA, 25 bp, Mus musculus
agaatctacagtcggaagtgtcaca

SEQ ID NO: 524819 - DNA, 25 bp, Mus musculus
agaatctacagtgggaagtgtcaca

SEQ ID NO: 524820 - DNA, 25 bp, Mus musculus
agaatctggcctccgcgtgctgtct

SEQ ID NO: 524821 - DNA, 25 bp, Mus musculus
agaatctggcctgcgcgtgctgtct

SEQ ID NO: 524822 - DNA, 25 bp, Mus musculus
agaatctgtactcatcgacagcaga

SEQ ID NO: 524823 - DNA, 25 bp, Mus musculus
agaatctgtactgatcgacagcaga

SEQ ID NO: 524824 - DNA, 25 bp, Mus musculus
agaatcttccccactctggcgggca

SEQ ID NO: 524825 - DNA, 25 bp, Mus musculus
agaatcttcccctctctggcgggca

SEQ ID NO: 524826 - DNA, 25 bp, Mus musculus
agaatcttctcaacgaccagcaggg

SEQ ID NO: 524827 - DNA, 25 bp, Mus musculus
agaatcttctcatcgaccagcaggg

SEQ ID NO: 524828 - DNA, 25 bp, Mus musculus
agaatgaagccaaccagcctctcct

SEQ ID NO: 524829 - DNA, 25 bp, Mus musculus
agaatgaagccatccagcctctcct

SEQ ID NO: 524830 - DNA, 25 bp, Mus musculus
agaatgaagtggctgccctcacagc

SEQ ID NO: 524831 - DNA, 25 bp, Mus musculus
agaatgaagtgggtgccctcacagc

SEQ ID NO: 524832 - DNA, 25 bp, Mus musculus
agaatgacagttccaacgatgacaa

SEQ ID NO: 524833 - DNA, 25 bp, Mus musculus
agaatgacagttgcaacgatgacaa

SEQ ID NO: 524834 - DNA, 25 bp, Mus musculus
agaatgaccccgactgccggcatgt

SEQ ID NO: 524835 - DNA, 25 bp, Mus musculus
agaatgaccccgtctgccggcatgt

SEQ ID NO: 524836 - DNA, 25 bp, Mus musculus
agaatgacgcaactgcccaggcctt

SEQ ID NO: 524837 - DNA, 25 bp, Mus musculus
agaatgacgcaagtgcccaggcctt

SEQ ID NO: 524838 - DNA, 25 bp, Mus musculus
agaatgagatgcctagtcttggtgt

SEQ ID NO: 524839 - DNA, 25 bp, Mus musculus
agaatgagatgcgtagtcttggtgt

SEQ ID NO: 524840 - DNA, 25 bp, Mus musculus
agaatgagctatcgtttagaacggg

SEQ ID NO: 524841 - DNA, 25 bp, Mus musculus
agaatgagctatggtttagaacggg

SEQ ID NO: 524842 - DNA, 25 bp, Mus musculus
agaatgaggacccactggtacccga

SEQ ID NO: 524843 - DNA, 25 bp, Mus musculus
agaatgaggaccgactggtacccga

SEQ ID NO: 524844 - DNA, 25 bp, Mus musculus
agaatgaggccactgctttttggcg

SEQ ID NO: 524845 - DNA, 25 bp, Mus musculus
agaatgaggccagtgctttttggcg

SEQ ID NO: 524846 - DNA, 25 bp, Mus musculus
agaatgaggtgcaccatctcaggtc

SEQ ID NO: 524847 - DNA, 25 bp, Mus musculus
agaatgaggtgctccatctcaggtc

SEQ ID NO: 524848 - DNA, 25 bp, Mus musculus
agaatgcaacgcctgcctgaaccca

SEQ ID NO: 524849 - DNA, 25 bp, Mus musculus
agaatgcaacgcgtgcctgaaccca

SEQ ID NO: 524850 - DNA, 25 bp, Mus musculus
agaatgcaggtccacagggacacgc

SEQ ID NO: 524851 - DNA, 25 bp, Mus musculus
agaatgcaggtcgacagggacacgc

SEQ ID NO: 524852 - DNA, 25 bp, Mus musculus
agaatgcattccagcttctggtgga

SEQ ID NO: 524853 - DNA, 25 bp, Mus musculus
agaatgcattcctgcttctggtgga

SEQ ID NO: 524854 - DNA, 25 bp, Mus musculus
agaatgcattgccatttccacatag

SEQ ID NO: 524855 - DNA, 25 bp, Mus musculus
agaatgcattgcgatttccacatag

SEQ ID NO: 524856 - DNA, 25 bp, Mus musculus
agaatgccactgactcggggctcct

SEQ ID NO: 524857 - DNA, 25 bp, Mus musculus
agaatgccactgtctcggggctcct

SEQ ID NO: 524858 - DNA, 25 bp, Mus musculus
agaatgccagcaacatggagtacag

SEQ ID NO: 524859 - DNA, 25 bp, Mus musculus
agaatgccagcatcatggagtacag

SEQ ID NO: 524860 - DNA, 25 bp, Mus musculus
agaatgcctcgtagggtccccacgt

SEQ ID NO: 524861 - DNA, 25 bp, Mus musculus
agaatgcctcgttgggtccccacgt

SEQ ID NO: 524862 - DNA, 25 bp, Mus musculus
agaatgcgctcaaccggaggcagga

SEQ ID NO: 524863 - DNA, 25 bp, Mus musculus
agaatgcgctcatccggaggcagga

SEQ ID NO: 524864 - DNA, 25 bp, Mus musculus
agaatgcgtggtacctccctgctca

SEQ ID NO: 524865 - DNA, 25 bp, Mus musculus
agaatgcgtggttcctccctgctca

SEQ ID NO: 524866 - DNA, 25 bp, Mus musculus
agaatgctaccacgcctgagcatca

SEQ ID NO: 524867 - DNA, 25 bp, Mus musculus
agaatgctaccaggcctgagcatca

SEQ ID NO: 524868 - DNA, 25 bp, Mus musculus
agaatgctgaccaaatgctgatgcc

SEQ ID NO: 524869 - DNA, 25 bp, Mus musculus
agaatgctgacctaatgctgatgcc

SEQ ID NO: 524870 - DNA, 25 bp, Mus musculus
agaatgctgcttcgcccgtgatcct

SEQ ID NO: 524871 - DNA, 25 bp, Mus musculus
agaatgctgcttggcccgtgatcct

SEQ ID NO: 524872 - DNA, 25 bp, Mus musculus
agaatgcttactctgtgtcgggcgc

SEQ ID NO: 524873 - DNA, 25 bp, Mus musculus
agaatgcttactgtgtgtcgggcgc

SEQ ID NO: 524874 - DNA, 25 bp, Mus musculus
agaatgcttctgcacttggcctcat

SEQ ID NO: 524875 - DNA, 25 bp, Mus musculus
agaatgcttctggacttggcctcat

SEQ ID NO: 524876 - DNA, 25 bp, Mus musculus
agaatggaactcagcgcccaagaag

SEQ ID NO: 524877 - DNA, 25 bp, Mus musculus
agaatggaactctgcgcccaagaag

SEQ ID NO: 524878 - DNA, 25 bp, Mus musculus
agaatggacagaattgccctggcta

SEQ ID NO: 524879 - DNA, 25 bp, Mus musculus
agaatggacagatttgccctggcta

SEQ ID NO: 524880 - DNA, 25 bp, Mus musculus
agaatggagtcaaaagagggcagcc

SEQ ID NO: 524881 - DNA, 25 bp, Mus musculus
agaatggagtcataagagggcagcc

SEQ ID NO: 524882 - DNA, 25 bp, Mus musculus
agaatggccctaacacccagctggc

SEQ ID NO: 524883 - DNA, 25 bp, Mus musculus
agaatggccctatcacccagctggc

SEQ ID NO: 524884 - DNA, 25 bp, Mus musculus
agaatggccgctccgtgcgtgtgcg

SEQ ID NO: 524885 - DNA, 25 bp, Mus musculus
agaatggccgctgcgtgcgtgtgcg

SEQ ID NO: 524886 - DNA, 25 bp, Mus musculus
agaatggctgttcgtcatcacatcc

SEQ ID NO: 524887 - DNA, 25 bp, Mus musculus
agaatggctgttggtcatcacatcc

SEQ ID NO: 524888 - DNA, 25 bp, Mus musculus
agaatgggcagaagcgagccaagct

SEQ ID NO: 524889 - DNA, 25 bp, Mus musculus
agaatgggcagatgcgagccaagct

SEQ ID NO: 524890 - DNA, 25 bp, Mus musculus
agaatgggttttccaagagtgcaag

SEQ ID NO: 524891 - DNA, 25 bp, Mus musculus
agaatgggttttgcaagagtgcaag

SEQ ID NO: 524892 - DNA, 25 bp, Mus musculus
agaatggtgccaccgtgatcctccg

SEQ ID NO: 524893 - DNA, 25 bp, Mus musculus
agaatggtgccagcgtgatcctccg

SEQ ID NO: 524894 - DNA, 25 bp, Mus musculus
agaatggtgttgactaccgactggg

SEQ ID NO: 524895 - DNA, 25 bp, Mus musculus
agaatggtgttgtctaccgactggg

SEQ ID NO: 524896 - DNA, 25 bp, Mus musculus
agaatgtacacaacgctagctgccc

SEQ ID NO: 524897 - DNA, 25 bp, Mus musculus
agaatgtacacatcgctagctgccc

SEQ ID NO: 524898 - DNA, 25 bp, Mus musculus
agaatgtcaccaacaacctcaagtc

SEQ ID NO: 524899 - DNA, 25 bp, Mus musculus
agaatgtcaccatcaacctcaagtc

SEQ ID NO: 524900 - DNA, 25 bp, Mus musculus
agaatgtcactacaggagaccaagg

SEQ ID NO: 524901 - DNA, 25 bp, Mus musculus
agaatgtcactagaggagaccaagg

SEQ ID NO: 524902 - DNA, 25 bp, Mus musculus
agaatgtcctttcagaatcagcaag

SEQ ID NO: 524903 - DNA, 25 bp, Mus musculus
agaatgtcctttgagaatcagcaag

SEQ ID NO: 524904 - DNA, 25 bp, Mus musculus
agaatgtctagacctgatcgagaag

SEQ ID NO: 524905 - DNA, 25 bp, Mus musculus
agaatgtctagagctgatcgagaag

SEQ ID NO: 524906 - DNA, 25 bp, Mus musculus
agaatgtgacacagtatctacggta

SEQ ID NO: 524907 - DNA, 25 bp, Mus musculus
agaatgtgacactgtatctacggta

SEQ ID NO: 524908 - DNA, 25 bp, Mus musculus
agaatgtgcccgcatgcaccgtcct

SEQ ID NO: 524909 - DNA, 25 bp, Mus musculus
agaatgtgcccggatgcaccgtcct

SEQ ID NO: 524910 - DNA, 25 bp, Mus musculus
agaatgtggaccctgcagtggccac

SEQ ID NO: 524911 - DNA, 25 bp, Mus musculus
agaatgtggaccgtgcagtggccac

SEQ ID NO: 524912 - DNA, 25 bp, Mus musculus
agaatgtgtccgacatcctctgcgg

SEQ ID NO: 524913 - DNA, 25 bp, Mus musculus
agaatgtgtccgtcatcctctgcgg

SEQ ID NO: 524914 - DNA, 25 bp, Mus musculus
agaattacaccaaggccctggcggg

SEQ ID NO: 524915 - DNA, 25 bp, Mus musculus
agaattacaccatggccctggcggg

SEQ ID NO: 524916 - DNA, 25 bp, Mus musculus
agaattactcacactaacagggcag

SEQ ID NO: 524917 - DNA, 25 bp, Mus musculus
agaattactcactctaacagggcag

SEQ ID NO: 524918 - DNA, 25 bp, Mus musculus
agaattcagtgacccgtcgttggag

SEQ ID NO: 524919 - DNA, 25 bp, Mus musculus
agaattcagtgagccgtcgttggag

SEQ ID NO: 524920 - DNA, 25 bp, Mus musculus
agaattcatccacacagaggcccct

SEQ ID NO: 524921 - DNA, 25 bp, Mus musculus
agaattcatccagacagaggcccct

SEQ ID NO: 524922 - DNA, 25 bp, Mus musculus
agaattccatctcttcccctgactt

SEQ ID NO: 524923 - DNA, 25 bp, Mus musculus
agaattccatctgttcccctgactt

SEQ ID NO: 524924 - DNA, 25 bp, Mus musculus
agaattccttggagacggtgggcac

SEQ ID NO: 524925 - DNA, 25 bp, Mus musculus
agaattccttggtgacggtgggcac

SEQ ID NO: 524926 - DNA, 25 bp, Mus musculus
agaattctcgggaccggcagagccc

SEQ ID NO: 524927 - DNA, 25 bp, Mus musculus
agaattctcgggtccggcagagccc

SEQ ID NO: 524928 - DNA, 25 bp, Mus musculus
agaattctgcccaactgctccttca

SEQ ID NO: 524929 - DNA, 25 bp, Mus musculus
agaattctgccctactgctccttca

SEQ ID NO: 524930 - DNA, 25 bp, Mus musculus
agaattctggccaggccagtcggcg

SEQ ID NO: 524931 - DNA, 25 bp, Mus musculus
agaattctggcctggccagtcggcg

SEQ ID NO: 524932 - DNA, 25 bp, Mus musculus
agaattgtgtttccctcctccggaa

SEQ ID NO: 524933 - DNA, 25 bp, Mus musculus
agaattgtgtttgcctcctccggaa

SEQ ID NO: 524934 - DNA, 25 bp, Mus musculus
agaatttagcgcagcaccctttccc

SEQ ID NO: 524935 - DNA, 25 bp, Mus musculus
agaatttagcgctgcaccctttccc

SEQ ID NO: 524936 - DNA, 25 bp, Mus musculus
agaatttcactgacgtccaccctga

SEQ ID NO: 524937 - DNA, 25 bp, Mus musculus
agaatttcactgtcgtccaccctga

SEQ ID NO: 524938 - DNA, 25 bp, Mus musculus
agaatttcagctccctgactttctg

SEQ ID NO: 524939 - DNA, 25 bp, Mus musculus
agaatttcagctgcctgactttctg

SEQ ID NO: 524940 - DNA, 25 bp, Mus musculus
agaatttcccctagtgtgtcacatg

SEQ ID NO: 524941 - DNA, 25 bp, Mus musculus
agaatttccccttgtgtgtcacatg

SEQ ID NO: 524942 - DNA, 25 bp, Mus musculus
agaattttactgctggcagcatgta

SEQ ID NO: 524943 - DNA, 25 bp, Mus musculus
agaattttactggtggcagcatgta

SEQ ID NO: 524944 - DNA, 25 bp, Mus musculus
agacaaaatgtacggcacagcccct

SEQ ID NO: 524945 - DNA, 25 bp, Mus musculus
agacaaaatgtagggcacagcccct

SEQ ID NO: 524946 - DNA, 25 bp, Mus musculus
agacaaaccgacagcctgacaacct

SEQ ID NO: 524947 - DNA, 25 bp, Mus musculus
agacaaaccgactgcctgacaacct

SEQ ID NO: 524948 - DNA, 25 bp, Mus musculus
agacaaagctggaaaggagagtgaa

SEQ ID NO: 524949 - DNA, 25 bp, Mus musculus
agacaaagctggtaaggagagtgaa

SEQ ID NO: 524950 - DNA, 25 bp, Mus musculus
agacaaaggagaacctgctgaaggg

SEQ ID NO: 524951 - DNA, 25 bp, Mus musculus
agacaaaggagatcctgctgaaggg

SEQ ID NO: 524952 - DNA, 25 bp, Mus musculus
agacaaaggcaactacacctgcctg

SEQ ID NO: 524953 - DNA, 25 bp, Mus musculus
agacaaaggcaagtacacctgcctg

SEQ ID NO: 524954 - DNA, 25 bp, Mus musculus
agacaaaggtgcaccgagggacgct

SEQ ID NO: 524955 - DNA, 25 bp, Mus musculus
agacaaaggtgctccgagggacgct

SEQ ID NO: 524956 - DNA, 25 bp, Mus musculus
agacaaatctctcaacccttctaca

SEQ ID NO: 524957 - DNA, 25 bp, Mus musculus
agacaaatctctgaacccttctaca

SEQ ID NO: 524958 - DNA, 25 bp, Mus musculus
agacaacaccagagatggaggagct

SEQ ID NO: 524959 - DNA, 25 bp, Mus musculus
agacaacaccagtgatggaggagct

SEQ ID NO: 524960 - DNA, 25 bp, Mus musculus
agacaacaccatcgaacacctcttg

SEQ ID NO: 524961 - DNA, 25 bp, Mus musculus
agacaacaccatggaacacctcttg

SEQ ID NO: 524962 - DNA, 25 bp, Mus musculus
agacaacacgctcctgacctgaggg

SEQ ID NO: 524963 - DNA, 25 bp, Mus musculus
agacaacacgctgctgacctgaggg

SEQ ID NO: 524964 - DNA, 25 bp, Mus musculus
agacaaccagcgactgaggagccat

SEQ ID NO: 524965 - DNA, 25 bp, Mus musculus
agacaaccagcgtctgaggagccat

SEQ ID NO: 524966 - DNA, 25 bp, Mus musculus
agacaaccaggactggacccagtgg

SEQ ID NO: 524967 - DNA, 25 bp, Mus musculus
agacaaccaggagtggacccagtgg

SEQ ID NO: 524968 - DNA, 25 bp, Mus musculus
agacaaccgttgcatctgccaaaag

SEQ ID NO: 524969 - DNA, 25 bp, Mus musculus
agacaaccgttggatctgccaaaag

SEQ ID NO: 524970 - DNA, 25 bp, Mus musculus
agacaacgtagaaggacggagagaa

SEQ ID NO: 524971 - DNA, 25 bp, Mus musculus
agacaacgtagatggacggagagaa

SEQ ID NO: 524972 - DNA, 25 bp, Mus musculus
agacaactctgaatctttgaaaatg

SEQ ID NO: 524973 - DNA, 25 bp, Mus musculus
agacaactctgattctttgaaaatg

SEQ ID NO: 524974 - DNA, 25 bp, Mus musculus
agacaactgccaacgtcactgaggg

SEQ ID NO: 524975 - DNA, 25 bp, Mus musculus
agacaactgccatcgtcactgaggg

SEQ ID NO: 524976 - DNA, 25 bp, Mus musculus
agacaactggtacctctccctgcag

SEQ ID NO: 524977 - DNA, 25 bp, Mus musculus
agacaactggtagctctccctgcag

SEQ ID NO: 524978 - DNA, 25 bp, Mus musculus
agacaagaacctccgtttggccaca

SEQ ID NO: 524979 - DNA, 25 bp, Mus musculus
agacaagaacctgcgtttggccaca

SEQ ID NO: 524980 - DNA, 25 bp, Mus musculus
agacaagacaggaacgctgaccacc

SEQ ID NO: 524981 - DNA, 25 bp, Mus musculus
agacaagacaggtacgctgaccacc

SEQ ID NO: 524982 - DNA, 25 bp, Mus musculus
agacaagagccgcaacatccagttc

SEQ ID NO: 524983 - DNA, 25 bp, Mus musculus
agacaagagccggaacatccagttc

SEQ ID NO: 524984 - DNA, 25 bp, Mus musculus
agacaagatgtcaatgggccccagc

SEQ ID NO: 524985 - DNA, 25 bp, Mus musculus
agacaagatgtctatgggccccagc

SEQ ID NO: 524986 - DNA, 25 bp, Mus musculus
agacaagccaggatctaggcggcgc

SEQ ID NO: 524987 - DNA, 25 bp, Mus musculus
agacaagccaggttctaggcggcgc

SEQ ID NO: 524988 - DNA, 25 bp, Mus musculus
agacaagcggagaccagagttctgg

SEQ ID NO: 524989 - DNA, 25 bp, Mus musculus
agacaagcggagtccagagttctgg

SEQ ID NO: 524990 - DNA, 25 bp, Mus musculus
agacaaggagccctgctcgctgcac

SEQ ID NO: 524991 - DNA, 25 bp, Mus musculus
agacaaggagccgtgctcgctgcac

SEQ ID NO: 524992 - DNA, 25 bp, Mus musculus
agacaaggccccagtggtgaaggct

SEQ ID NO: 524993 - DNA, 25 bp, Mus musculus
agacaaggcccctgtggtgaaggct

SEQ ID NO: 524994 - DNA, 25 bp, Mus musculus
agacaaggtccgagcccttcgagag

SEQ ID NO: 524995 - DNA, 25 bp, Mus musculus
agacaaggtccgtgcccttcgagag

SEQ ID NO: 524996 - DNA, 25 bp, Mus musculus
agacaaggttgtcagggccattccc

SEQ ID NO: 524997 - DNA, 25 bp, Mus musculus
agacaaggttgtgagggccattccc

SEQ ID NO: 524998 - DNA, 25 bp, Mus musculus
agacaagtatgacctgtttgaaaag

SEQ ID NO: 524999 - DNA, 25 bp, Mus musculus
agacaagtatgagctgtttgaaaag

SEQ ID NO: 525000 - DNA, 25 bp, Mus musculus
agacaagtcccacacagcagcttgg

SEQ ID NO: 525001 - DNA, 25 bp, Mus musculus
agacaagtcccagacagcagcttgg

SEQ ID NO: 525002 - DNA, 25 bp, Mus musculus
agacaataaggtcctgctggctgcc

SEQ ID NO: 525003 - DNA, 25 bp, Mus musculus
agacaataaggtgctgctggctgcc

SEQ ID NO: 525004 - DNA, 25 bp, Mus musculus
agacaataccgacggcagaaccagc

SEQ ID NO: 525005 - DNA, 25 bp, Mus musculus
agacaataccgagggcagaaccagc

SEQ ID NO: 525006 - DNA, 25 bp, Mus musculus
agacaatccaatcggagaacaacgg

SEQ ID NO: 525007 - DNA, 25 bp, Mus musculus
agacaatccaatgggagaacaacgg

SEQ ID NO: 525008 - DNA, 25 bp, Mus musculus
agacaatccaggacacgctaaaccc

SEQ ID NO: 525009 - DNA, 25 bp, Mus musculus
agacaatccaggtcacgctaaaccc

SEQ ID NO: 525010 - DNA, 25 bp, Mus musculus
agacaatcctccaaccgcggaatcc

SEQ ID NO: 525011 - DNA, 25 bp, Mus musculus
agacaatcctcctaccgcggaatcc

SEQ ID NO: 525012 - DNA, 25 bp, Mus musculus
agacaatgaagccagtctcacctct

SEQ ID NO: 525013 - DNA, 25 bp, Mus musculus
agacaatgaagcgagtctcacctct

SEQ ID NO: 525014 - DNA, 25 bp, Mus musculus
agacaatgagacctacctgcaccgc

SEQ ID NO: 525015 - DNA, 25 bp, Mus musculus
agacaatgagacgtacctgcaccgc

SEQ ID NO: 525016 - DNA, 25 bp, Mus musculus
agacacaaacttcgctggacagcac

SEQ ID NO: 525017 - DNA, 25 bp, Mus musculus
agacacaaacttggctggacagcac

SEQ ID NO: 525018 - DNA, 25 bp, Mus musculus
agacacacatatctccccatacaag

SEQ ID NO: 525019 - DNA, 25 bp, Mus musculus
agacacacatatgtccccatacaag

SEQ ID NO: 525020 - DNA, 25 bp, Mus musculus
agacacagaagtagggaaattcaaa

SEQ ID NO: 525021 - DNA, 25 bp, Mus musculus
agacacagaagttgggaaattcaaa

SEQ ID NO: 525022 - DNA, 25 bp, Mus musculus
agacacatacaacctgccaaagtta

SEQ ID NO: 525023 - DNA, 25 bp, Mus musculus
agacacatacaagctgccaaagtta

SEQ ID NO: 525024 - DNA, 25 bp, Mus musculus
agacacatgtcaaccctgagccaca

SEQ ID NO: 525025 - DNA, 25 bp, Mus musculus
agacacatgtcatccctgagccaca

SEQ ID NO: 525026 - DNA, 25 bp, Mus musculus
agacaccaaaaaagcccacatccat

SEQ ID NO: 525027 - DNA, 25 bp, Mus musculus
agacaccaaaaatgcccacatccat

SEQ ID NO: 525028 - DNA, 25 bp, Mus musculus
agacaccaacataactgcgatccct

SEQ ID NO: 525029 - DNA, 25 bp, Mus musculus
agacaccaacattactgcgatccct

SEQ ID NO: 525030 - DNA, 25 bp, Mus musculus
agacaccagaacagtctggagacct

SEQ ID NO: 525031 - DNA, 25 bp, Mus musculus
agacaccagaactgtctggagacct

SEQ ID NO: 525032 - DNA, 25 bp, Mus musculus
agacaccagccgaagcccagcaggt

SEQ ID NO: 525033 - DNA, 25 bp, Mus musculus
agacaccagccgtagcccagcaggt

SEQ ID NO: 525034 - DNA, 25 bp, Mus musculus
agacaccatgctaagtacctgaatg

SEQ ID NO: 525035 - DNA, 25 bp, Mus musculus
agacaccatgcttagtacctgaatg

SEQ ID NO: 525036 - DNA, 25 bp, Mus musculus
agacacccaagaccttcagctttga

SEQ ID NO: 525037 - DNA, 25 bp, Mus musculus
agacacccaagagcttcagctttga

SEQ ID NO: 525038 - DNA, 25 bp, Mus musculus
agacaccctggccaactgtaccaag

SEQ ID NO: 525039 - DNA, 25 bp, Mus musculus
agacaccctggcgaactgtaccaag

SEQ ID NO: 525040 - DNA, 25 bp, Mus musculus
agacaccgacccacgggacgctgga

SEQ ID NO: 525041 - DNA, 25 bp, Mus musculus
agacaccgaccctcgggacgctgga

SEQ ID NO: 525042 - DNA, 25 bp, Mus musculus
agacaccgaggtactgccggccctt

SEQ ID NO: 525043 - DNA, 25 bp, Mus musculus
agacaccgaggttctgccggccctt

SEQ ID NO: 525044 - DNA, 25 bp, Mus musculus
agacaccttctgagagcagagaggt

SEQ ID NO: 525045 - DNA, 25 bp, Mus musculus
agacaccttctgtgagcagagaggt

SEQ ID NO: 525046 - DNA, 25 bp, Mus musculus
agacacgctggtccttcatggcaag

SEQ ID NO: 525047 - DNA, 25 bp, Mus musculus
agacacgctggtgcttcatggcaag

SEQ ID NO: 525048 - DNA, 25 bp, Mus musculus
agacacggaagtcgcaaagccaaga

SEQ ID NO: 525049 - DNA, 25 bp, Mus musculus
agacacggaagtggcaaagccaaga

SEQ ID NO: 525050 - DNA, 25 bp, Mus musculus
agacacggcggcagaagctcacagc

SEQ ID NO: 525051 - DNA, 25 bp, Mus musculus
agacacggcggctgaagctcacagc

SEQ ID NO: 525052 - DNA, 25 bp, Mus musculus
agacactgacatcgaataagcccag

SEQ ID NO: 525053 - DNA, 25 bp, Mus musculus
agacactgacatggaataagcccag

SEQ ID NO: 525054 - DNA, 25 bp, Mus musculus
agacactgcagcaatctcaacccta

SEQ ID NO: 525055 - DNA, 25 bp, Mus musculus
agacactgcagcacctcaatgacct

SEQ ID NO: 525056 - DNA, 25 bp, Mus musculus
agacactgcagctatctcaacccta

SEQ ID NO: 525057 - DNA, 25 bp, Mus musculus
agacactgcagctcctcaatgacct

SEQ ID NO: 525058 - DNA, 25 bp, Mus musculus
agacactgctcaaggtaaagtcctg

SEQ ID NO: 525059 - DNA, 25 bp, Mus musculus
agacactgctcatggtaaagtcctg

SEQ ID NO: 525060 - DNA, 25 bp, Mus musculus
agacactggttcagcctccgagcaa

SEQ ID NO: 525061 - DNA, 25 bp, Mus musculus
agacactggttctgcctccgagcaa

SEQ ID NO: 525062 - DNA, 25 bp, Mus musculus
agacacttggctaccttacctgacc

SEQ ID NO: 525063 - DNA, 25 bp, Mus musculus
agacacttggcttccttacctgacc

SEQ ID NO: 525064 - DNA, 25 bp, Mus musculus
agacagaactggaggatgtagagaa

SEQ ID NO: 525065 - DNA, 25 bp, Mus musculus
agacagaactggtggatgtagagaa

SEQ ID NO: 525066 - DNA, 25 bp, Mus musculus
agacagaagattcaaatgtgggaca

SEQ ID NO: 525067 - DNA, 25 bp, Mus musculus
agacagaagattgaaatgtgggaca

SEQ ID NO: 525068 - DNA, 25 bp, Mus musculus
agacagaagccaaacaggaggagga

SEQ ID NO: 525069 - DNA, 25 bp, Mus musculus
agacagaagccatacaggaggagga

SEQ ID NO: 525070 - DNA, 25 bp, Mus musculus
agacagacaccactggatccgccag

SEQ ID NO: 525071 - DNA, 25 bp, Mus musculus
agacagacaccagtggatccgccag

SEQ ID NO: 525072 - DNA, 25 bp, Mus musculus
agacagacagctccagtaagtgctg

SEQ ID NO: 525073 - DNA, 25 bp, Mus musculus
agacagacagctgcagtaagtgctg

SEQ ID NO: 525074 - DNA, 25 bp, Mus musculus
agacagacatcaactttgaggtggg

SEQ ID NO: 525075 - DNA, 25 bp, Mus musculus
agacagacatcatctttgaggtggg

SEQ ID NO: 525076 - DNA, 25 bp, Mus musculus
agacagacctggcaaacacagtgct

SEQ ID NO: 525077 - DNA, 25 bp, Mus musculus
agacagacctgggaaacacagtgct

SEQ ID NO: 525078 - DNA, 25 bp, Mus musculus
agacagacgggtatcgcgctcctga

SEQ ID NO: 525079 - DNA, 25 bp, Mus musculus
agacagacgggtttcgcgctcctga

SEQ ID NO: 525080 - DNA, 25 bp, Mus musculus
agacagactacgctggacgcccgca

SEQ ID NO: 525081 - DNA, 25 bp, Mus musculus
agacagactacggtggacgcccgca

SEQ ID NO: 525082 - DNA, 25 bp, Mus musculus
agacagactggaagcttcggctccc

SEQ ID NO: 525083 - DNA, 25 bp, Mus musculus
agacagactggatgcttcggctccc

SEQ ID NO: 525084 - DNA, 25 bp, Mus musculus
agacagacttctcgcatcatacaag

SEQ ID NO: 525085 - DNA, 25 bp, Mus musculus
agacagacttctggcatcatacaag

SEQ ID NO: 525086 - DNA, 25 bp, Mus musculus
agacagagaaccactgactccatct

SEQ ID NO: 525087 - DNA, 25 bp, Mus musculus
agacagagaacctctgactccatct

SEQ ID NO: 525088 - DNA, 25 bp, Mus musculus
agacagagaatgaccacatcaacct

SEQ ID NO: 525089 - DNA, 25 bp, Mus musculus
agacagagaatgtccacatcaacct

SEQ ID NO: 525090 - DNA, 25 bp, Mus musculus
agacagagatacagccagccgccac

SEQ ID NO: 525091 - DNA, 25 bp, Mus musculus
agacagagatactgccagccgccac

SEQ ID NO: 525092 - DNA, 25 bp, Mus musculus
agacagagcaggctcgcgaaggagc

SEQ ID NO: 525093 - DNA, 25 bp, Mus musculus
agacagagcagggtcgcgaaggagc

SEQ ID NO: 525094 - DNA, 25 bp, Mus musculus
agacagagcggccaaggcccaacac

SEQ ID NO: 525095 - DNA, 25 bp, Mus musculus
agacagagcggcgaaggcccaacac

SEQ ID NO: 525096 - DNA, 25 bp, Mus musculus
agacagaggagaacaccagcctgtg

SEQ ID NO: 525097 - DNA, 25 bp, Mus musculus
agacagaggagatcaccagcctgtg

SEQ ID NO: 525098 - DNA, 25 bp, Mus musculus
agacagaggcagataaacgctacaa

SEQ ID NO: 525099 - DNA, 25 bp, Mus musculus
agacagaggcagttaaacgctacaa

SEQ ID NO: 525100 - DNA, 25 bp, Mus musculus
agacagataaacatggatgcccacc

SEQ ID NO: 525101 - DNA, 25 bp, Mus musculus
agacagataaacttggatgcccacc

SEQ ID NO: 525102 - DNA, 25 bp, Mus musculus
agacagatgcacacaccccgtctaa

SEQ ID NO: 525103 - DNA, 25 bp, Mus musculus
agacagatgcactcaccccgtctaa

SEQ ID NO: 525104 - DNA, 25 bp, Mus musculus
agacagcaaagcaaccagaacagac

SEQ ID NO: 525105 - DNA, 25 bp, Mus musculus
agacagcaaagctaccagaacagac

SEQ ID NO: 525106 - DNA, 25 bp, Mus musculus
agacagcagcctagcaaagtgccac

SEQ ID NO: 525107 - DNA, 25 bp, Mus musculus
agacagcagccttgcaaagtgccac

SEQ ID NO: 525108 - DNA, 25 bp, Mus musculus
agacagcaggcccttctcaatgtgc

SEQ ID NO: 525109 - DNA, 25 bp, Mus musculus
agacagcaggccgttctcaatgtgc

SEQ ID NO: 525110 - DNA, 25 bp, Mus musculus
agacagcagtaccacgggaccctgg

SEQ ID NO: 525111 - DNA, 25 bp, Mus musculus
agacagcagtacgacgggaccctgg

SEQ ID NO: 525112 - DNA, 25 bp, Mus musculus
agacagcagtgacagaacgccaggc

SEQ ID NO: 525113 - DNA, 25 bp, Mus musculus
agacagcagtgagagaacgccaggc

SEQ ID NO: 525114 - DNA, 25 bp, Mus musculus
agacagccaggtccttaccatcaat

SEQ ID NO: 525115 - DNA, 25 bp, Mus musculus
agacagccaggtgcttaccatcaat

SEQ ID NO: 525116 - DNA, 25 bp, Mus musculus
agacagccatcacaactttgccctg

SEQ ID NO: 525117 - DNA, 25 bp, Mus musculus
agacagccatcagaactttgccctg

SEQ ID NO: 525118 - DNA, 25 bp, Mus musculus
agacagccatccaggcagccggtta

SEQ ID NO: 525119 - DNA, 25 bp, Mus musculus
agacagccatcctggcagccggtta

SEQ ID NO: 525120 - DNA, 25 bp, Mus musculus
agacagccctgcagcaaccagaagc

SEQ ID NO: 525121 - DNA, 25 bp, Mus musculus
agacagccctgctgcaaccagaagc

SEQ ID NO: 525122 - DNA, 25 bp, Mus musculus
agacagccgaccagctaaatggtag

SEQ ID NO: 525123 - DNA, 25 bp, Mus musculus
agacagccgacctgctaaatggtag

SEQ ID NO: 525124 - DNA, 25 bp, Mus musculus
agacagcctgccaggagtatactgt

SEQ ID NO: 525125 - DNA, 25 bp, Mus musculus
agacagcctgcctggagtatactgt

SEQ ID NO: 525126 - DNA, 25 bp, Mus musculus
agacagcctggtcggtagaacatgc

SEQ ID NO: 525127 - DNA, 25 bp, Mus musculus
agacagcctggtgggtagaacatgc

SEQ ID NO: 525128 - DNA, 25 bp, Mus musculus
agacagctagctatccagcgcctgc

SEQ ID NO: 525129 - DNA, 25 bp, Mus musculus
agacagctagctttccagcgcctgc

SEQ ID NO: 525130 - DNA, 25 bp, Mus musculus
agacagctccggatcttgcaggcca

SEQ ID NO: 525131 - DNA, 25 bp, Mus musculus
agacagctccggttcttgcaggcca

SEQ ID NO: 525132 - DNA, 25 bp, Mus musculus
agacaggaagccacatccgctggaa

SEQ ID NO: 525133 - DNA, 25 bp, Mus musculus
agacaggaagcctcatccgctggaa

SEQ ID NO: 525134 - DNA, 25 bp, Mus musculus
agacaggaagtcagtgagagccaga

SEQ ID NO: 525135 - DNA, 25 bp, Mus musculus
agacaggaagtctgtgagagccaga

SEQ ID NO: 525136 - DNA, 25 bp, Mus musculus
agacaggacaggaaatgacgagaag

SEQ ID NO: 525137 - DNA, 25 bp, Mus musculus
agacaggacaggtaatgacgagaag

SEQ ID NO: 525138 - DNA, 25 bp, Mus musculus
agacaggagtgaaggatagtctgct

SEQ ID NO: 525139 - DNA, 25 bp, Mus musculus
agacaggagtgatggatagtctgct

SEQ ID NO: 525140 - DNA, 25 bp, Mus musculus
agacaggcctgtctggtcttgagat

SEQ ID NO: 525141 - DNA, 25 bp, Mus musculus
agacaggcctgtgtggtcttgagat

SEQ ID NO: 525142 - DNA, 25 bp, Mus musculus
agacagggcccaccagtacaggagc

SEQ ID NO: 525143 - DNA, 25 bp, Mus musculus
agacagggcccagcagtacaggagc

SEQ ID NO: 525144 - DNA, 25 bp, Mus musculus
agacaggttgggatctacatgatgg

SEQ ID NO: 525145 - DNA, 25 bp, Mus musculus
agacaggttgggttctacatgatgg

SEQ ID NO: 525146 - DNA, 25 bp, Mus musculus
agacagtaagagcatcgccgtggtc

SEQ ID NO: 525147 - DNA, 25 bp, Mus musculus
agacagtaagaggatcgccgtggtc

SEQ ID NO: 525148 - DNA, 25 bp, Mus musculus
agacagtcgccaccatttctgcaag

SEQ ID NO: 525149 - DNA, 25 bp, Mus musculus
agacagtcgccagcatttctgcaag

SEQ ID NO: 525150 - DNA, 25 bp, Mus musculus
agacagtctttccagtagacctggg

SEQ ID NO: 525151 - DNA, 25 bp, Mus musculus
agacagtctttcgagtagacctggg

SEQ ID NO: 525152 - DNA, 25 bp, Mus musculus
agacagtgaaggactctgtgtctgc

SEQ ID NO: 525153 - DNA, 25 bp, Mus musculus
agacagtgaaggtctctgtgtctgc

SEQ ID NO: 525154 - DNA, 25 bp, Mus musculus
agacagtgacagacaacggcagtcc

SEQ ID NO: 525155 - DNA, 25 bp, Mus musculus
agacagtgacagtcaacggcagtcc

SEQ ID NO: 525156 - DNA, 25 bp, Mus musculus
agacagtgaccccagtagcagaacc

SEQ ID NO: 525157 - DNA, 25 bp, Mus musculus
agacagtgacccgagtagcagaacc

SEQ ID NO: 525158 - DNA, 25 bp, Mus musculus
agacagtgatcccaatctggacccg

SEQ ID NO: 525159 - DNA, 25 bp, Mus musculus
agacagtgatccgaatctggacccg

SEQ ID NO: 525160 - DNA, 25 bp, Mus musculus
agacagtggtccatacgggcctcag

SEQ ID NO: 525161 - DNA, 25 bp, Mus musculus
agacagtggtccttacgggcctcag

SEQ ID NO: 525162 - DNA, 25 bp, Mus musculus
agacagtggtgcacctcacgctgtg

SEQ ID NO: 525163 - DNA, 25 bp, Mus musculus
agacagtggtgctcctcacgctgtg

SEQ ID NO: 525164 - DNA, 25 bp, Mus musculus
agacagttgattcccaagtctgctg

SEQ ID NO: 525165 - DNA, 25 bp, Mus musculus
agacagttgattgccaagtctgctg

SEQ ID NO: 525166 - DNA, 25 bp, Mus musculus
agacatacgtggaggcaaacatggg

SEQ ID NO: 525167 - DNA, 25 bp, Mus musculus
agacatacgtggtggcaaacatggg

SEQ ID NO: 525168 - DNA, 25 bp, Mus musculus
agacatatctgcagctgtccctagg

SEQ ID NO: 525169 - DNA, 25 bp, Mus musculus
agacatatctgctgctgtccctagg

SEQ ID NO: 525170 - DNA, 25 bp, Mus musculus
agacatcatggtccacctgactgat

SEQ ID NO: 525171 - DNA, 25 bp, Mus musculus
agacatcatggtgcacctgactgat

SEQ ID NO: 525172 - DNA, 25 bp, Mus musculus
agacatccacacagccaacgagcgg

SEQ ID NO: 525173 - DNA, 25 bp, Mus musculus
agacatccacactgccaacgagcgg

SEQ ID NO: 525174 - DNA, 25 bp, Mus musculus
agacatccagccatgcgtcaaatct

SEQ ID NO: 525175 - DNA, 25 bp, Mus musculus
agacatccagccttgcgtcaaatct

SEQ ID NO: 525176 - DNA, 25 bp, Mus musculus
agacatccagcgacgagcaagccat

SEQ ID NO: 525177 - DNA, 25 bp, Mus musculus
agacatccagcgtcgagcaagccat

SEQ ID NO: 525178 - DNA, 25 bp, Mus musculus
agacatcctatgagtgtagtggatc

SEQ ID NO: 525179 - DNA, 25 bp, Mus musculus
agacatcctatgtgtgtagtggatc

SEQ ID NO: 525180 - DNA, 25 bp, Mus musculus
agacatcgtctgacttgcagggttc

SEQ ID NO: 525181 - DNA, 25 bp, Mus musculus
agacatcgtctgtcttgcagggttc

SEQ ID NO: 525182 - DNA, 25 bp, Mus musculus
agacatctactgagaaggcccaccg

SEQ ID NO: 525183 - DNA, 25 bp, Mus musculus
agacatctactgtgaaggcccaccg

SEQ ID NO: 525184 - DNA, 25 bp, Mus musculus
agacatctgacacgctggagacagt

SEQ ID NO: 525185 - DNA, 25 bp, Mus musculus
agacatctgacaggctggagacagt

SEQ ID NO: 525186 - DNA, 25 bp, Mus musculus
agacatctttaaacactacatgaag

SEQ ID NO: 525187 - DNA, 25 bp, Mus musculus
agacatctttaatcactacatgaag

SEQ ID NO: 525188 - DNA, 25 bp, Mus musculus
agacatgaaggcatacctggaggga

SEQ ID NO: 525189 - DNA, 25 bp, Mus musculus
agacatgaaggcttacctggaggga

SEQ ID NO: 525190 - DNA, 25 bp, Mus musculus
agacatgacaagacggcagctggag

SEQ ID NO: 525191 - DNA, 25 bp, Mus musculus
agacatgacaagtcggcagctggag

SEQ ID NO: 525192 - DNA, 25 bp, Mus musculus
agacatgaggtaagcagtgggaaac

SEQ ID NO: 525193 - DNA, 25 bp, Mus musculus
agacatgaggtatgcagtgggaaac

SEQ ID NO: 525194 - DNA, 25 bp, Mus musculus
agacatgcaaaacagtctgctcagg

SEQ ID NO: 525195 - DNA, 25 bp, Mus musculus
agacatgcaaaagagtctgctcagg

SEQ ID NO: 525196 - DNA, 25 bp, Mus musculus
agacatgcctcaaagcagccgctac

SEQ ID NO: 525197 - DNA, 25 bp, Mus musculus
agacatgcctcatagcagccgctac

SEQ ID NO: 525198 - DNA, 25 bp, Mus musculus
agacatgcgcaaaaaggagaagaac

SEQ ID NO: 525199 - DNA, 25 bp, Mus musculus
agacatgcgcaataaggagaagaac

SEQ ID NO: 525200 - DNA, 25 bp, Mus musculus
agacatgggaaaactgctgtggaga

SEQ ID NO: 525201 - DNA, 25 bp, Mus musculus
agacatgggaaatctgctgtggaga

SEQ ID NO: 525202 - DNA, 25 bp, Mus musculus
agacatgggcgacctcgcacttgag

SEQ ID NO: 525203 - DNA, 25 bp, Mus musculus
agacatgggcgagctcgcacttgag

SEQ ID NO: 525204 - DNA, 25 bp, Mus musculus
agacatgtcgatccctctggaaagt

SEQ ID NO: 525205 - DNA, 25 bp, Mus musculus
agacatgtcgatgcctctggaaagt

SEQ ID NO: 525206 - DNA, 25 bp, Mus musculus
agacatgtgagtagcttcttccctg

SEQ ID NO: 525207 - DNA, 25 bp, Mus musculus
agacatgtgagttgcttcttccctg

SEQ ID NO: 525208 - DNA, 25 bp, Mus musculus
agacatgttaatcttcgcagttcag

SEQ ID NO: 525209 - DNA, 25 bp, Mus musculus
agacatgttaatgttcgcagttcag

SEQ ID NO: 525210 - DNA, 25 bp, Mus musculus
agacattaacagaactgtcagtgat

SEQ ID NO: 525211 - DNA, 25 bp, Mus musculus
agacattaacagtactgtcagtgat

SEQ ID NO: 525212 - DNA, 25 bp, Mus musculus
agacattccaagattggcatgaaag

SEQ ID NO: 525213 - DNA, 25 bp, Mus musculus
agacattccaagtttggcatgaaag

SEQ ID NO: 525214 - DNA, 25 bp, Mus musculus
agacattccccgaagggtgcctgga

SEQ ID NO: 525215 - DNA, 25 bp, Mus musculus
agacattccccgtagggtgcctgga

SEQ ID NO: 525216 - DNA, 25 bp, Mus musculus
agacattcccctactcggagtgcct

SEQ ID NO: 525217 - DNA, 25 bp, Mus musculus
agacattccccttctcggagtgcct

SEQ ID NO: 525218 - DNA, 25 bp, Mus musculus
agacatttccagcagtttgccaggg

SEQ ID NO: 525219 - DNA, 25 bp, Mus musculus
agacatttccaggagtttgccaggg

SEQ ID NO: 525220 - DNA, 25 bp, Mus musculus
agacatttccgccaccttgacttgt

SEQ ID NO: 525221 - DNA, 25 bp, Mus musculus
agacatttccgcgaccttgacttgt

SEQ ID NO: 525222 - DNA, 25 bp, Mus musculus
agacatttgggcagtcagcttcggg

SEQ ID NO: 525223 - DNA, 25 bp, Mus musculus
agacatttgggctgtcagcttcggg

SEQ ID NO: 525224 - DNA, 25 bp, Mus musculus
agaccaaagaaaaagggatatatat

SEQ ID NO: 525225 - DNA, 25 bp, Mus musculus
agaccaaagaaatagggatatatat

SEQ ID NO: 525226 - DNA, 25 bp, Mus musculus
agaccaacacgaagggctgcggaca

SEQ ID NO: 525227 - DNA, 25 bp, Mus musculus
agaccaacacgatgggctgcggaca

SEQ ID NO: 525228 - DNA, 25 bp, Mus musculus
agaccaacccacagtggtgaagcac

SEQ ID NO: 525229 - DNA, 25 bp, Mus musculus
agaccaacccactgtggtgaagcac

SEQ ID NO: 525230 - DNA, 25 bp, Mus musculus
agaccaaccgataatctctcctggg

SEQ ID NO: 525231 - DNA, 25 bp, Mus musculus
agaccaaccgattatctctcctggg

SEQ ID NO: 525232 - DNA, 25 bp, Mus musculus
agaccaactcagctgtccggacctg

SEQ ID NO: 525233 - DNA, 25 bp, Mus musculus
agaccaactcaggtgtccggacctg

SEQ ID NO: 525234 - DNA, 25 bp, Mus musculus
agaccaagaattcatgagatgactc

SEQ ID NO: 525235 - DNA, 25 bp, Mus musculus
agaccaagaattgatgagatgactc

SEQ ID NO: 525236 - DNA, 25 bp, Mus musculus
agaccaagacccacatccaggagtg

SEQ ID NO: 525237 - DNA, 25 bp, Mus musculus
agaccaagaccctcatccaggagtg

SEQ ID NO: 525238 - DNA, 25 bp, Mus musculus
agaccaagatggagcgtaagacgca

SEQ ID NO: 525239 - DNA, 25 bp, Mus musculus
agaccaagatggtgcgtaagacgca

SEQ ID NO: 525240 - DNA, 25 bp, Mus musculus
agaccaaggagacgctccgaggcat

SEQ ID NO: 525241 - DNA, 25 bp, Mus musculus
agaccaaggagaggctccgaggcat

SEQ ID NO: 525242 - DNA, 25 bp, Mus musculus
agaccaaggttgaacagattcgctg

SEQ ID NO: 525243 - DNA, 25 bp, Mus musculus
agaccaaggttgtacagattcgctg

SEQ ID NO: 525244 - DNA, 25 bp, Mus musculus
agaccaagtcagcttccttatcagg

SEQ ID NO: 525245 - DNA, 25 bp, Mus musculus
agaccaagtcaggttccttatcagg

SEQ ID NO: 525246 - DNA, 25 bp, Mus musculus
agaccaatgaggaccccgagactga

SEQ ID NO: 525247 - DNA, 25 bp, Mus musculus
agaccaatgaggtccccgagactga

SEQ ID NO: 525248 - DNA, 25 bp, Mus musculus
agaccaatggaacagtgaatgggaa

SEQ ID NO: 525249 - DNA, 25 bp, Mus musculus
agaccaatggaagagtgaatgggaa

SEQ ID NO: 525250 - DNA, 25 bp, Mus musculus
agaccacacgaaaggagatagtcat

SEQ ID NO: 525251 - DNA, 25 bp, Mus musculus
agaccacacgaatggagatagtcat

SEQ ID NO: 525252 - DNA, 25 bp, Mus musculus
agaccacagaggctcagcatcctat

SEQ ID NO: 525253 - DNA, 25 bp, Mus musculus
agaccacagagggtcagcatcctat

SEQ ID NO: 525254 - DNA, 25 bp, Mus musculus
agaccacagtgacccatcaagaagc

SEQ ID NO: 525255 - DNA, 25 bp, Mus musculus
agaccacagtgagccatcaagaagc

SEQ ID NO: 525256 - DNA, 25 bp, Mus musculus
agaccacatggtccagtgccgcatc

SEQ ID NO: 525257 - DNA, 25 bp, Mus musculus
agaccacatggtgcagtgccgcatc

SEQ ID NO: 525258 - DNA, 25 bp, Mus musculus
agaccaccagccaggtggccaagca

SEQ ID NO: 525259 - DNA, 25 bp, Mus musculus
agaccaccagcctggtggccaagca

SEQ ID NO: 525260 - DNA, 25 bp, Mus musculus
agaccagaaggcaacttcgccggct

SEQ ID NO: 525261 - DNA, 25 bp, Mus musculus
agaccagaaggcactaggcgtgatg

SEQ ID NO: 525262 - DNA, 25 bp, Mus musculus
agaccagaaggctacttcgccggct

SEQ ID NO: 525263 - DNA, 25 bp, Mus musculus
agaccagaaggctctaggcgtgatg

SEQ ID NO: 525264 - DNA, 25 bp, Mus musculus
agaccagaggagctgctgccctcac

SEQ ID NO: 525265 - DNA, 25 bp, Mus musculus
agaccagaggaggtgctgccctcac

SEQ ID NO: 525266 - DNA, 25 bp, Mus musculus
agaccagcaacaaaggctacatggg

SEQ ID NO: 525267 - DNA, 25 bp, Mus musculus
agaccagcaacataggctacatggg

SEQ ID NO: 525268 - DNA, 25 bp, Mus musculus
agaccagcctgacaggtaaggacag

SEQ ID NO: 525269 - DNA, 25 bp, Mus musculus
agaccagcctgagaggtaaggacag

SEQ ID NO: 525270 - DNA, 25 bp, Mus musculus
agaccagctcagaaatcagggagat

SEQ ID NO: 525271 - DNA, 25 bp, Mus musculus
agaccagctcagtaatcagggagat

SEQ ID NO: 525272 - DNA, 25 bp, Mus musculus
agaccagcttctacatgggcctgaa

SEQ ID NO: 525273 - DNA, 25 bp, Mus musculus
agaccagcttcttcatgggcctgaa

SEQ ID NO: 525274 - DNA, 25 bp, Mus musculus
agaccaggcaggctcacttggaaga

SEQ ID NO: 525275 - DNA, 25 bp, Mus musculus
agaccaggcagggtcacttggaaga

SEQ ID NO: 525276 - DNA, 25 bp, Mus musculus
agaccaggtcaaagctgcaggagat

SEQ ID NO: 525277 - DNA, 25 bp, Mus musculus
agaccaggtcaatgctgcaggagat

SEQ ID NO: 525278 - DNA, 25 bp, Mus musculus
agaccaggttctcgacagtgctgcg

SEQ ID NO: 525279 - DNA, 25 bp, Mus musculus
agaccaggttctggacagtgctgcg

SEQ ID NO: 525280 - DNA, 25 bp, Mus musculus
agaccagtacccagactgaggaagg

SEQ ID NO: 525281 - DNA, 25 bp, Mus musculus
agaccagtaccctgactgaggaagg

SEQ ID NO: 525282 - DNA, 25 bp, Mus musculus
agaccatatatgacattgggcaggg

SEQ ID NO: 525283 - DNA, 25 bp, Mus musculus
agaccatatatgtcattgggcaggg

SEQ ID NO: 525284 - DNA, 25 bp, Mus musculus
agaccatcaggtcggctactggccg

SEQ ID NO: 525285 - DNA, 25 bp, Mus musculus
agaccatcaggtgggctactggccg

SEQ ID NO: 525286 - DNA, 25 bp, Mus musculus
agaccatgaacactgaccctggcct

SEQ ID NO: 525287 - DNA, 25 bp, Mus musculus
agaccatgaacagtgaccctggcct

SEQ ID NO: 525288 - DNA, 25 bp, Mus musculus
agaccatgatctactgggcaccgag

SEQ ID NO: 525289 - DNA, 25 bp, Mus musculus
agaccatgatcttctgggcaccgag

SEQ ID NO: 525290 - DNA, 25 bp, Mus musculus
agaccatggacaccggcaagccatt

SEQ ID NO: 525291 - DNA, 25 bp, Mus musculus
agaccatggacagcggcaagccatt

SEQ ID NO: 525292 - DNA, 25 bp, Mus musculus
agaccatggctgagcccacatctgc

SEQ ID NO: 525293 - DNA, 25 bp, Mus musculus
agaccatggctgtgcccacatctgc

SEQ ID NO: 525294 - DNA, 25 bp, Mus musculus
agaccatttactacagggacttcag

SEQ ID NO: 525295 - DNA, 25 bp, Mus musculus
agaccatttacttcagggacttcag

SEQ ID NO: 525296 - DNA, 25 bp, Mus musculus
agacccaatgcacttgctgttcagc

SEQ ID NO: 525297 - DNA, 25 bp, Mus musculus
agacccaatgcagttgctgttcagc

SEQ ID NO: 525298 - DNA, 25 bp, Mus musculus
agacccagacgcacgggatcagcgt

SEQ ID NO: 525299 - DNA, 25 bp, Mus musculus
agacccagacgctcgggatcagcgt

SEQ ID NO: 525300 - DNA, 25 bp, Mus musculus
agacccagaggcacctcggagctga

SEQ ID NO: 525301 - DNA, 25 bp, Mus musculus
agacccagaggctcctcggagctga

SEQ ID NO: 525302 - DNA, 25 bp, Mus musculus
agacccagagtcatttcaaggatga

SEQ ID NO: 525303 - DNA, 25 bp, Mus musculus
agacccagagtcttttcaaggatga

SEQ ID NO: 525304 - DNA, 25 bp, Mus musculus
agacccagcaacaacagacactaca

SEQ ID NO: 525305 - DNA, 25 bp, Mus musculus
agacccagcaactacagacactaca

SEQ ID NO: 525306 - DNA, 25 bp, Mus musculus
agacccagcacacatacgccatgca

SEQ ID NO: 525307 - DNA, 25 bp, Mus musculus
agacccagcacagatacgccatgca

SEQ ID NO: 525308 - DNA, 25 bp, Mus musculus
agacccaggacgacaggaacccagt

SEQ ID NO: 525309 - DNA, 25 bp, Mus musculus
agacccaggacgtcaggaacccagt

SEQ ID NO: 525310 - DNA, 25 bp, Mus musculus
agacccaggctgataagttccagag

SEQ ID NO: 525311 - DNA, 25 bp, Mus musculus
agacccaggctgttaagttccagag

SEQ ID NO: 525312 - DNA, 25 bp, Mus musculus
agacccagggacctgtcaccagact

SEQ ID NO: 525313 - DNA, 25 bp, Mus musculus
agacccagggacgtgtcaccagact

SEQ ID NO: 525314 - DNA, 25 bp, Mus musculus
agacccattcctctgaaagcagtgg

SEQ ID NO: 525315 - DNA, 25 bp, Mus musculus
agacccattcctgtgaaagcagtgg

SEQ ID NO: 525316 - DNA, 25 bp, Mus musculus
agaccccaaaagcagagcctctctg

SEQ ID NO: 525317 - DNA, 25 bp, Mus musculus
agaccccaaaaggagagcctctctg

SEQ ID NO: 525318 - DNA, 25 bp, Mus musculus
agaccccacaggaccccgagttgtg

SEQ ID NO: 525319 - DNA, 25 bp, Mus musculus
agaccccacaggtccccgagttgtg

SEQ ID NO: 525320 - DNA, 25 bp, Mus musculus
agaccccatggacacatcacctgtg

SEQ ID NO: 525321 - DNA, 25 bp, Mus musculus
agaccccatggagacatcacctgtg

SEQ ID NO: 525322 - DNA, 25 bp, Mus musculus
agaccccgaagaactacctgaagaa

SEQ ID NO: 525323 - DNA, 25 bp, Mus musculus
agaccccgaagatctacctgaagaa

SEQ ID NO: 525324 - DNA, 25 bp, Mus musculus
agaccccgaggcaagctgaaaagct

SEQ ID NO: 525325 - DNA, 25 bp, Mus musculus
agaccccgaggctagctgaaaagct

SEQ ID NO: 525326 - DNA, 25 bp, Mus musculus
agacccctacgcctgggtcagtgtg

SEQ ID NO: 525327 - DNA, 25 bp, Mus musculus
agacccctacgcgtgggtcagtgtg

SEQ ID NO: 525328 - DNA, 25 bp, Mus musculus
agacccgagatgagcggcagcagct

SEQ ID NO: 525329 - DNA, 25 bp, Mus musculus
agacccgagatgtgcggcagcagct

SEQ ID NO: 525330 - DNA, 25 bp, Mus musculus
agacccgtcagtccctttctttctg

SEQ ID NO: 525331 - DNA, 25 bp, Mus musculus
agacccgtcagtgcctttctttctg

SEQ ID NO: 525332 - DNA, 25 bp, Mus musculus
agaccctaactacctgcaccgaatg

SEQ ID NO: 525333 - DNA, 25 bp, Mus musculus
agaccctaactagctgcaccgaatg

SEQ ID NO: 525334 - DNA, 25 bp, Mus musculus
agaccctaagtgacaaggtgatgag

SEQ ID NO: 525335 - DNA, 25 bp, Mus musculus
agaccctaagtgtcaaggtgatgag

SEQ ID NO: 525336 - DNA, 25 bp, Mus musculus
agaccctacgctactacgactgcag

SEQ ID NO: 525337 - DNA, 25 bp, Mus musculus
agaccctacgcttctacgactgcag

SEQ ID NO: 525338 - DNA, 25 bp, Mus musculus
agaccctcctaacctaaaagagtgc

SEQ ID NO: 525339 - DNA, 25 bp, Mus musculus
agaccctcctaagctaaaagagtgc

SEQ ID NO: 525340 - DNA, 25 bp, Mus musculus
agaccctcctggattatattatgga

SEQ ID NO: 525341 - DNA, 25 bp, Mus musculus
agaccctcctggtttatattatgga

SEQ ID NO: 525342 - DNA, 25 bp, Mus musculus
agaccctcgagtcgctgtccctgaa

SEQ ID NO: 525343 - DNA, 25 bp, Mus musculus
agaccctcgagtggctgtccctgaa

SEQ ID NO: 525344 - DNA, 25 bp, Mus musculus
agaccctctggacacgacaccaagg

SEQ ID NO: 525345 - DNA, 25 bp, Mus musculus
agaccctctggagacgacaccaagg

SEQ ID NO: 525346 - DNA, 25 bp, Mus musculus
agaccctgaacaactaccttttgga

SEQ ID NO: 525347 - DNA, 25 bp, Mus musculus
agaccctgaacatctaccttttgga

SEQ ID NO: 525348 - DNA, 25 bp, Mus musculus
agaccctgaacgaacttcacctgga

SEQ ID NO: 525349 - DNA, 25 bp, Mus musculus
agaccctgaacgtacttcacctgga

SEQ ID NO: 525350 - DNA, 25 bp, Mus musculus
agaccctgcggcagcaggtccagga

SEQ ID NO: 525351 - DNA, 25 bp, Mus musculus
agaccctgcggctgcaggtccagga

SEQ ID NO: 525352 - DNA, 25 bp, Mus musculus
agaccctggaggaatgtgctctgcg

SEQ ID NO: 525353 - DNA, 25 bp, Mus musculus
agaccctggaggctaaggacttgtt

SEQ ID NO: 525354 - DNA, 25 bp, Mus musculus
agaccctggagggtaaggacttgtt

SEQ ID NO: 525355 - DNA, 25 bp, Mus musculus
agaccctggaggtatgtgctctgcg

SEQ ID NO: 525356 - DNA, 25 bp, Mus musculus
agaccctggcgcctgggcattaatg

SEQ ID NO: 525357 - DNA, 25 bp, Mus musculus
agaccctggcgcgtgggcattaatg

SEQ ID NO: 525358 - DNA, 25 bp, Mus musculus
agaccctggtacagccaagtctcag

SEQ ID NO: 525359 - DNA, 25 bp, Mus musculus
agaccctggtactgccaagtctcag

SEQ ID NO: 525360 - DNA, 25 bp, Mus musculus
agaccctggtgtcgccaaatctcag

SEQ ID NO: 525361 - DNA, 25 bp, Mus musculus
agaccctggtgtggccaaatctcag

SEQ ID NO: 525362 - DNA, 25 bp, Mus musculus
agaccctgtgctcgttcccgagcga

SEQ ID NO: 525363 - DNA, 25 bp, Mus musculus
agaccctgtgctggttcccgagcga

SEQ ID NO: 525364 - DNA, 25 bp, Mus musculus
agaccctgtggtcctgagcccttca

SEQ ID NO: 525365 - DNA, 25 bp, Mus musculus
agaccctgtggtgctgagcccttca

SEQ ID NO: 525366 - DNA, 25 bp, Mus musculus
agaccctttgctcttccaagaacgt

SEQ ID NO: 525367 - DNA, 25 bp, Mus musculus
agaccctttgctgttccaagaacgt

SEQ ID NO: 525368 - DNA, 25 bp, Mus musculus
agaccgagagccagcgattcctgca

SEQ ID NO: 525369 - DNA, 25 bp, Mus musculus
agaccgagagcctgcgattcctgca

SEQ ID NO: 525370 - DNA, 25 bp, Mus musculus
agaccgagagtgatcatgatgatgc

SEQ ID NO: 525371 - DNA, 25 bp, Mus musculus
agaccgagagtgttcatgatgatgc

SEQ ID NO: 525372 - DNA, 25 bp, Mus musculus
agaccgagcgtactcctggtatcag

SEQ ID NO: 525373 - DNA, 25 bp, Mus musculus
agaccgagcgtagtcctggtatcag

SEQ ID NO: 525374 - DNA, 25 bp, Mus musculus
agaccgatgagtcccgattgaacca

SEQ ID NO: 525375 - DNA, 25 bp, Mus musculus
agaccgatgagtgccgattgaacca

SEQ ID NO: 525376 - DNA, 25 bp, Mus musculus
agaccgatgtggatcacccgctgtg

SEQ ID NO: 525377 - DNA, 25 bp, Mus musculus
agaccgatgtggttcacccgctgtg

SEQ ID NO: 525378 - DNA, 25 bp, Mus musculus
agaccgcacaggaactcgaggctgg

SEQ ID NO: 525379 - DNA, 25 bp, Mus musculus
agaccgcacaggtactcgaggctgg

SEQ ID NO: 525380 - DNA, 25 bp, Mus musculus
agaccgcagagacaaccagggtgat

SEQ ID NO: 525381 - DNA, 25 bp, Mus musculus
agaccgcagagagaaccagggtgat

SEQ ID NO: 525382 - DNA, 25 bp, Mus musculus
agaccgccagtcagccctgtcgaag

SEQ ID NO: 525383 - DNA, 25 bp, Mus musculus
agaccgccagtctgccctgtcgaag

SEQ ID NO: 525384 - DNA, 25 bp, Mus musculus
agaccgcctaccagcggaaccggat

SEQ ID NO: 525385 - DNA, 25 bp, Mus musculus
agaccgcctacctgcggaaccggat

SEQ ID NO: 525386 - DNA, 25 bp, Mus musculus
agaccgctcagtaactgtttaccat

SEQ ID NO: 525387 - DNA, 25 bp, Mus musculus
agaccgctcagttactgtttaccat

SEQ ID NO: 525388 - DNA, 25 bp, Mus musculus
agaccgctgcccaaggacgcgtcga

SEQ ID NO: 525389 - DNA, 25 bp, Mus musculus
agaccgctgccctaggacgcgtcga

SEQ ID NO: 525390 - DNA, 25 bp, Mus musculus
agaccggacggtcactctgggcatt

SEQ ID NO: 525391 - DNA, 25 bp, Mus musculus
agaccggacggtgactctgggcatt

SEQ ID NO: 525392 - DNA, 25 bp, Mus musculus
agaccggagatgatcatcattggcg

SEQ ID NO: 525393 - DNA, 25 bp, Mus musculus
agaccggagatgttcatcattggcg

SEQ ID NO: 525394 - DNA, 25 bp, Mus musculus
agaccggcctgaagtcggacaagca

SEQ ID NO: 525395 - DNA, 25 bp, Mus musculus
agaccggcctgatgtcggacaagca

SEQ ID NO: 525396 - DNA, 25 bp, Mus musculus
agaccggcgcccaggagcttctgaa

SEQ ID NO: 525397 - DNA, 25 bp, Mus musculus
agaccggcgccctggagcttctgaa

SEQ ID NO: 525398 - DNA, 25 bp, Mus musculus
agaccgggcagcacaattgcgttcc

SEQ ID NO: 525399 - DNA, 25 bp, Mus musculus
agaccgggcagctcaattgcgttcc

SEQ ID NO: 525400 - DNA, 25 bp, Mus musculus
agaccgggctctattgatggctgca

SEQ ID NO: 525401 - DNA, 25 bp, Mus musculus
agaccgggctcttttgatggctgca

SEQ ID NO: 525402 - DNA, 25 bp, Mus musculus
agaccgggtacgagccgcctgccta

SEQ ID NO: 525403 - DNA, 25 bp, Mus musculus
agaccgggtacgtgccgcctgccta

SEQ ID NO: 525404 - DNA, 25 bp, Mus musculus
agaccgggtcacagctttcttcctc

SEQ ID NO: 525405 - DNA, 25 bp, Mus musculus
agaccgggtcactgctttcttcctc

SEQ ID NO: 525406 - DNA, 25 bp, Mus musculus
agaccggtccgcagcggctaggctc

SEQ ID NO: 525407 - DNA, 25 bp, Mus musculus
agaccggtccgctgcggctaggctc

SEQ ID NO: 525408 - DNA, 25 bp, Mus musculus
agaccgtgcagcagaggaacccacc

SEQ ID NO: 525409 - DNA, 25 bp, Mus musculus
agaccgtgcagctgaggaacccacc

SEQ ID NO: 525410 - DNA, 25 bp, Mus musculus
agacctaagtccattgacctgcaag

SEQ ID NO: 525411 - DNA, 25 bp, Mus musculus
agacctaagtcctttgacctgcaag

SEQ ID NO: 525412 - DNA, 25 bp, Mus musculus
agacctaatcaacaaatggaaactg

SEQ ID NO: 525413 - DNA, 25 bp, Mus musculus
agacctaatcaagaaatggaaactg

SEQ ID NO: 525414 - DNA, 25 bp, Mus musculus
agacctatgaaacgctggaggctga

SEQ ID NO: 525415 - DNA, 25 bp, Mus musculus
agacctatgaaaggctggaggctga

SEQ ID NO: 525416 - DNA, 25 bp, Mus musculus
agacctatggggctagtgaccttcg

SEQ ID NO: 525417 - DNA, 25 bp, Mus musculus
agacctatgggggtagtgaccttcg

SEQ ID NO: 525418 - DNA, 25 bp, Mus musculus
agacctcagtgtcttctaccctggg

SEQ ID NO: 525419 - DNA, 25 bp, Mus musculus
agacctcagtgtgttctaccctggg

SEQ ID NO: 525420 - DNA, 25 bp, Mus musculus
agacctccatggagcatgagctcaa

SEQ ID NO: 525421 - DNA, 25 bp, Mus musculus
agacctccatggtgcatgagctcaa

SEQ ID NO: 525422 - DNA, 25 bp, Mus musculus
agacctcctggaccagagagacaac

SEQ ID NO: 525423 - DNA, 25 bp, Mus musculus
agacctcctggagcagagagacaac

SEQ ID NO: 525424 - DNA, 25 bp, Mus musculus
agacctcggcttccgatctcctgga

SEQ ID NO: 525425 - DNA, 25 bp, Mus musculus
agacctcggcttgcgatctcctgga

SEQ ID NO: 525426 - DNA, 25 bp, Mus musculus
agacctcgtgcgaggaaccctctgc

SEQ ID NO: 525427 - DNA, 25 bp, Mus musculus
agacctcgtgcgtggaaccctctgc

SEQ ID NO: 525428 - DNA, 25 bp, Mus musculus
agacctctgctaaggaaggactcct

SEQ ID NO: 525429 - DNA, 25 bp, Mus musculus
agacctctgctatggaaggactcct

SEQ ID NO: 525430 - DNA, 25 bp, Mus musculus
agacctctgcttcacgctaaccgga

SEQ ID NO: 525431 - DNA, 25 bp, Mus musculus
agacctctgcttgacgctaaccgga

SEQ ID NO: 525432 - DNA, 25 bp, Mus musculus
agacctctggtgcaagctggcctgc

SEQ ID NO: 525433 - DNA, 25 bp, Mus musculus
agacctctggtggaagctggcctgc

SEQ ID NO: 525434 - DNA, 25 bp, Mus musculus
agacctctgtggatgccggatgcct

SEQ ID NO: 525435 - DNA, 25 bp, Mus musculus
agacctctgtggttgccggatgcct

SEQ ID NO: 525436 - DNA, 25 bp, Mus musculus
agacctcttccgaaatgcgggatgt

SEQ ID NO: 525437 - DNA, 25 bp, Mus musculus
agacctcttccgtaatgcgggatgt

SEQ ID NO: 525438 - DNA, 25 bp, Mus musculus
agacctcttctcacgaatcaacgac

SEQ ID NO: 525439 - DNA, 25 bp, Mus musculus
agacctcttctctcgaatcaacgac

SEQ ID NO: 525440 - DNA, 25 bp, Mus musculus
agacctgaacttagagcgaggtggt

SEQ ID NO: 525441 - DNA, 25 bp, Mus musculus
agacctgaactttgagcgaggtggt

SEQ ID NO: 525442 - DNA, 25 bp, Mus musculus
agacctgaagagactaacgcctgcc

SEQ ID NO: 525443 - DNA, 25 bp, Mus musculus
agacctgaagagtctaacgcctgcc

SEQ ID NO: 525444 - DNA, 25 bp, Mus musculus
agacctgagaggcatagcctttgcc

SEQ ID NO: 525445 - DNA, 25 bp, Mus musculus
agacctgagagggatagcctttgcc

SEQ ID NO: 525446 - DNA, 25 bp, Mus musculus
agacctgcctctcgatccgctttgg

SEQ ID NO: 525447 - DNA, 25 bp, Mus musculus
agacctgcctctggatccgctttgg

SEQ ID NO: 525448 - DNA, 25 bp, Mus musculus
agacctgcctggaacggcactgcaa

SEQ ID NO: 525449 - DNA, 25 bp, Mus musculus
agacctgcctggtacggcactgcaa

SEQ ID NO: 525450 - DNA, 25 bp, Mus musculus
agacctgcgaagaggacgggctacc

SEQ ID NO: 525451 - DNA, 25 bp, Mus musculus
agacctgcgaagtggacgggctacc

SEQ ID NO: 525452 - DNA, 25 bp, Mus musculus
agacctgctgcgctcctcttggaat

SEQ ID NO: 525453 - DNA, 25 bp, Mus musculus
agacctgctgcggtcctcttggaat

SEQ ID NO: 525454 - DNA, 25 bp, Mus musculus
agacctgctgttcggcccatgtgtg

SEQ ID NO: 525455 - DNA, 25 bp, Mus musculus
agacctgctgttgggcccatgtgtg

SEQ ID NO: 525456 - DNA, 25 bp, Mus musculus
agacctggaaccaccggatgccggg

SEQ ID NO: 525457 - DNA, 25 bp, Mus musculus
agacctggaacctccggatgccggg

SEQ ID NO: 525458 - DNA, 25 bp, Mus musculus
agacctggaaggaccatgcagctgc

SEQ ID NO: 525459 - DNA, 25 bp, Mus musculus
agacctggaaggtccatgcagctgc

SEQ ID NO: 525460 - DNA, 25 bp, Mus musculus
agacctggacagcaccatccgtgtc

SEQ ID NO: 525461 - DNA, 25 bp, Mus musculus
agacctggacaggaccatccgtgtc

SEQ ID NO: 525462 - DNA, 25 bp, Mus musculus
agacctggatgcagtcctcttgctt

SEQ ID NO: 525463 - DNA, 25 bp, Mus musculus
agacctggatgctgtcctcttgctt

SEQ ID NO: 525464 - DNA, 25 bp, Mus musculus
agacctggcgcaccgattacgcgag

SEQ ID NO: 525465 - DNA, 25 bp, Mus musculus
agacctggcgcagcgattacgcgag

SEQ ID NO: 525466 - DNA, 25 bp, Mus musculus
agacctggtactcggactcagggaa

SEQ ID NO: 525467 - DNA, 25 bp, Mus musculus
agacctggtactgggactcagggaa

SEQ ID NO: 525468 - DNA, 25 bp, Mus musculus
agacctgtccctactgccgttgtga

SEQ ID NO: 525469 - DNA, 25 bp, Mus musculus
agacctgtcccttctgccgttgtga

SEQ ID NO: 525470 - DNA, 25 bp, Mus musculus
agacctgtgtcaatctcatcaccaa

SEQ ID NO: 525471 - DNA, 25 bp, Mus musculus
agacctgtgtcattctcatcaccaa

SEQ ID NO: 525472 - DNA, 25 bp, Mus musculus
agacctgttggaagaaagaattcga

SEQ ID NO: 525473 - DNA, 25 bp, Mus musculus
agacctgttggaagagtcctcatca

SEQ ID NO: 525474 - DNA, 25 bp, Mus musculus
agacctgttggatgaaagaattcga

SEQ ID NO: 525475 - DNA, 25 bp, Mus musculus
agacctgttggatgagtcctcatca

SEQ ID NO: 525476 - DNA, 25 bp, Mus musculus
agaccttcaaggctgctgtccaggg

SEQ ID NO: 525477 - DNA, 25 bp, Mus musculus
agaccttcaagggtgctgtccaggg

SEQ ID NO: 525478 - DNA, 25 bp, Mus musculus
agaccttcatctagacaggccccta

SEQ ID NO: 525479 - DNA, 25 bp, Mus musculus
agaccttcatctcctttgtagtggg

SEQ ID NO: 525480 - DNA, 25 bp, Mus musculus
agaccttcatctgctttgtagtggg

SEQ ID NO: 525481 - DNA, 25 bp, Mus musculus
agaccttcatcttgacaggccccta

SEQ ID NO: 525482 - DNA, 25 bp, Mus musculus
agaccttccggaattatgacaacat

SEQ ID NO: 525483 - DNA, 25 bp, Mus musculus
agaccttccggatttatgacaacat

SEQ ID NO: 525484 - DNA, 25 bp, Mus musculus
agaccttctggaaccagacccaggg

SEQ ID NO: 525485 - DNA, 25 bp, Mus musculus
agaccttctggatccagacccaggg

SEQ ID NO: 525486 - DNA, 25 bp, Mus musculus
agaccttgggttatggagcagagaa

SEQ ID NO: 525487 - DNA, 25 bp, Mus musculus
agaccttgggttttggagcagagaa

SEQ ID NO: 525488 - DNA, 25 bp, Mus musculus
agaccttggtgtagccgcagcctcc

SEQ ID NO: 525489 - DNA, 25 bp, Mus musculus
agaccttggtgttgccgcagcctcc

SEQ ID NO: 525490 - DNA, 25 bp, Mus musculus
agaccttgtgtcctggctctcacca

SEQ ID NO: 525491 - DNA, 25 bp, Mus musculus
agaccttgtgtcgtggctctcacca

SEQ ID NO: 525492 - DNA, 25 bp, Mus musculus
agaccttttaatccgttgaagacaa

SEQ ID NO: 525493 - DNA, 25 bp, Mus musculus
agaccttttaatgcgttgaagacaa

SEQ ID NO: 525494 - DNA, 25 bp, Mus musculus
agacgaacacttcccagaggacgaa

SEQ ID NO: 525495 - DNA, 25 bp, Mus musculus
agacgaacacttgccagaggacgaa

SEQ ID NO: 525496 - DNA, 25 bp, Mus musculus
agacgaagatggcaattctcagctc

SEQ ID NO: 525497 - DNA, 25 bp, Mus musculus
agacgaagatgggaattctcagctc

SEQ ID NO: 525498 - DNA, 25 bp, Mus musculus
agacgacagaggagattcggcagat

SEQ ID NO: 525499 - DNA, 25 bp, Mus musculus
agacgacagaggtgattcggcagat

SEQ ID NO: 525500 - DNA, 25 bp, Mus musculus
agacgaccctaacctgaagtaccag

SEQ ID NO: 525501 - DNA, 25 bp, Mus musculus
agacgaccctaagctgaagtaccag

SEQ ID NO: 525502 - DNA, 25 bp, Mus musculus
agacgactcctaagtgtccgctggg

SEQ ID NO: 525503 - DNA, 25 bp, Mus musculus
agacgactcctatgtgtccgctggg

SEQ ID NO: 525504 - DNA, 25 bp, Mus musculus
agacgacttgagaggtgctgtctac

SEQ ID NO: 525505 - DNA, 25 bp, Mus musculus
agacgacttgagtggtgctgtctac

SEQ ID NO: 525506 - DNA, 25 bp, Mus musculus
agacgagacgtgcagcgagcactca

SEQ ID NO: 525507 - DNA, 25 bp, Mus musculus
agacgagacgtggagcgagcactca

SEQ ID NO: 525508 - DNA, 25 bp, Mus musculus
agacgagtacaacagcggcacggtc

SEQ ID NO: 525509 - DNA, 25 bp, Mus musculus
agacgagtacaagagcggcacggtc

SEQ ID NO: 525510 - DNA, 25 bp, Mus musculus
agacgagtttctcggacggatcaat

SEQ ID NO: 525511 - DNA, 25 bp, Mus musculus
agacgagtttctgggacggatcaat

SEQ ID NO: 525512 - DNA, 25 bp, Mus musculus
agacgatacattccacacagctggg

SEQ ID NO: 525513 - DNA, 25 bp, Mus musculus
agacgatacattgcacacagctggg

SEQ ID NO: 525514 - DNA, 25 bp, Mus musculus
agacgatggatcacaaccgaaaccg

SEQ ID NO: 525515 - DNA, 25 bp, Mus musculus
agacgatggatctcaaccgaaaccg

SEQ ID NO: 525516 - DNA, 25 bp, Mus musculus
agacgatgggagaaccgctgtccac

SEQ ID NO: 525517 - DNA, 25 bp, Mus musculus
agacgatgggagtaccgctgtccac

SEQ ID NO: 525518 - DNA, 25 bp, Mus musculus
agacgattgaggaggagaacaaagt

SEQ ID NO: 525519 - DNA, 25 bp, Mus musculus
agacgattgaggtggagaacaaagt

SEQ ID NO: 525520 - DNA, 25 bp, Mus musculus
agacgcagaattcgcaaactctgtg

SEQ ID NO: 525521 - DNA, 25 bp, Mus musculus
agacgcagaattggcaaactctgtg

SEQ ID NO: 525522 - DNA, 25 bp, Mus musculus
agacgcagatggaattttttaacct

SEQ ID NO: 525523 - DNA, 25 bp, Mus musculus
agacgcagatggtattttttaacct

SEQ ID NO: 525524 - DNA, 25 bp, Mus musculus
agacgcaggtgtctcgggctactca

SEQ ID NO: 525525 - DNA, 25 bp, Mus musculus
agacgcaggtgtgtcgggctactca

SEQ ID NO: 525526 - DNA, 25 bp, Mus musculus
agacgcattcagaggaccaaacggg

SEQ ID NO: 525527 - DNA, 25 bp, Mus musculus
agacgcattcagtggaccaaacggg

SEQ ID NO: 525528 - DNA, 25 bp, Mus musculus
agacgccagcaaccgtttcgggtgt

SEQ ID NO: 525529 - DNA, 25 bp, Mus musculus
agacgccagcaagcgtttcgggtgt

SEQ ID NO: 525530 - DNA, 25 bp, Mus musculus
agacgccgggacagtccagcgaacg

SEQ ID NO: 525531 - DNA, 25 bp, Mus musculus
agacgccgggactgtccagcgaacg

SEQ ID NO: 525532 - DNA, 25 bp, Mus musculus
agacgcggagacagactgacctgcg

SEQ ID NO: 525533 - DNA, 25 bp, Mus musculus
agacgcggagactgactgacctgcg

SEQ ID NO: 525534 - DNA, 25 bp, Mus musculus
agacgctcctgaaccagtctcatca

SEQ ID NO: 525535 - DNA, 25 bp, Mus musculus
agacgctcctgatccagtctcatca

SEQ ID NO: 525536 - DNA, 25 bp, Mus musculus
agacgctgaaggaccacaggccccg

SEQ ID NO: 525537 - DNA, 25 bp, Mus musculus
agacgctgaaggtccacaggccccg

SEQ ID NO: 525538 - DNA, 25 bp, Mus musculus
agacgctgctgaccagaactttgac

SEQ ID NO: 525539 - DNA, 25 bp, Mus musculus
agacgctgctgagcagaactttgac

SEQ ID NO: 525540 - DNA, 25 bp, Mus musculus
agacggaaaaccctctgcccggatg

SEQ ID NO: 525541 - DNA, 25 bp, Mus musculus
agacggaaaaccgtctgcccggatg

SEQ ID NO: 525542 - DNA, 25 bp, Mus musculus
agacggaaccgcaacaaggaagaga

SEQ ID NO: 525543 - DNA, 25 bp, Mus musculus
agacggaaccgctacaaggaagaga

SEQ ID NO: 525544 - DNA, 25 bp, Mus musculus
agacggaatgggacctgtgaatatc

SEQ ID NO: 525545 - DNA, 25 bp, Mus musculus
agacggaatgggtcctgtgaatatc

SEQ ID NO: 525546 - DNA, 25 bp, Mus musculus
agacggagctgcctgacatctgcaa

SEQ ID NO: 525547 - DNA, 25 bp, Mus musculus
agacggagctgcgtgacatctgcaa

SEQ ID NO: 525548 - DNA, 25 bp, Mus musculus
agacggagggcaagtcctgccctac

SEQ ID NO: 525549 - DNA, 25 bp, Mus musculus
agacggagggcatgtcctgccctac

SEQ ID NO: 525550 - DNA, 25 bp, Mus musculus
agacggcaatgtactgcttcatgag

SEQ ID NO: 525551 - DNA, 25 bp, Mus musculus
agacggcaatgttctgcttcatgag

SEQ ID NO: 525552 - DNA, 25 bp, Mus musculus
agacggccctcgctacactgtgagg

SEQ ID NO: 525553 - DNA, 25 bp, Mus musculus
agacggccctcggtacactgtgagg

SEQ ID NO: 525554 - DNA, 25 bp, Mus musculus
agacggccgagacacctatgaggaa

SEQ ID NO: 525555 - DNA, 25 bp, Mus musculus
agacggccgagagacctatgaggaa

SEQ ID NO: 525556 - DNA, 25 bp, Mus musculus
agacgggacagccaaccctagccta

SEQ ID NO: 525557 - DNA, 25 bp, Mus musculus
agacgggacagcgaaccctagccta

SEQ ID NO: 525558 - DNA, 25 bp, Mus musculus
agacgggcaactccttatccacctg

SEQ ID NO: 525559 - DNA, 25 bp, Mus musculus
agacgggcaactgcttatccacctg

SEQ ID NO: 525560 - DNA, 25 bp, Mus musculus
agacgggcccggacatgctgcagat

SEQ ID NO: 525561 - DNA, 25 bp, Mus musculus
agacgggcccggtcatgctgcagat

SEQ ID NO: 525562 - DNA, 25 bp, Mus musculus
agacgggctaccacatccagagcac

SEQ ID NO: 525563 - DNA, 25 bp, Mus musculus
agacgggctacctcatccagagcac

SEQ ID NO: 525564 - DNA, 25 bp, Mus musculus
agacgggtatcccttcgacggcaag

SEQ ID NO: 525565 - DNA, 25 bp, Mus musculus
agacgggtatccgttcgacggcaag

SEQ ID NO: 525566 - DNA, 25 bp, Mus musculus
agacgggtgctgaagacttagagat

SEQ ID NO: 525567 - DNA, 25 bp, Mus musculus
agacgggtgctgtagacttagagat

SEQ ID NO: 525568 - DNA, 25 bp, Mus musculus
agacggtcgggcaccttgcacatac

SEQ ID NO: 525569 - DNA, 25 bp, Mus musculus
agacggtcgggctccttgcacatac

SEQ ID NO: 525570 - DNA, 25 bp, Mus musculus
agacggtgcagacgctcatcccagc

SEQ ID NO: 525571 - DNA, 25 bp, Mus musculus
agacggtgcagaggctcatcccagc

SEQ ID NO: 525572 - DNA, 25 bp, Mus musculus
agacgtaaggctacaggcccttccg

SEQ ID NO: 525573 - DNA, 25 bp, Mus musculus
agacgtaaggcttcaggcccttccg

SEQ ID NO: 525574 - DNA, 25 bp, Mus musculus
agacgtaccttcctcaccacagtat

SEQ ID NO: 525575 - DNA, 25 bp, Mus musculus
agacgtaccttcgtcaccacagtat

SEQ ID NO: 525576 - DNA, 25 bp, Mus musculus
agacgtacgaggaggatctgaataa

SEQ ID NO: 525577 - DNA, 25 bp, Mus musculus
agacgtacgaggtggatctgaataa

SEQ ID NO: 525578 - DNA, 25 bp, Mus musculus
agacgtacgtgcagctcaccatgct

SEQ ID NO: 525579 - DNA, 25 bp, Mus musculus
agacgtacgtgctgctcaccatgct

SEQ ID NO: 525580 - DNA, 25 bp, Mus musculus
agacgtatgcacacacgcctaggct

SEQ ID NO: 525581 - DNA, 25 bp, Mus musculus
agacgtatgcactcacgcctaggct

SEQ ID NO: 525582 - DNA, 25 bp, Mus musculus
agacgtgacaggcaatcgacctcca

SEQ ID NO: 525583 - DNA, 25 bp, Mus musculus
agacgtgacagggaatcgacctcca

SEQ ID NO: 525584 - DNA, 25 bp, Mus musculus
agacgtgcacgtccttcgtgagaga

SEQ ID NO: 525585 - DNA, 25 bp, Mus musculus
agacgtgcacgtgcttcgtgagaga

SEQ ID NO: 525586 - DNA, 25 bp, Mus musculus
agacgtgcgactacgcggcggcgga

SEQ ID NO: 525587 - DNA, 25 bp, Mus musculus
agacgtgcgacttcgcggcggcgga

SEQ ID NO: 525588 - DNA, 25 bp, Mus musculus
agacgtgtttcacaacggatggcag

SEQ ID NO: 525589 - DNA, 25 bp, Mus musculus
agacgtgtttcagaacggatggcag

SEQ ID NO: 525590 - DNA, 25 bp, Mus musculus
agactaaaggagaggctctcaacct

SEQ ID NO: 525591 - DNA, 25 bp, Mus musculus
agactaaaggagtggctctcaacct

SEQ ID NO: 525592 - DNA, 25 bp, Mus musculus
agactacagcatcgagagccaccag

SEQ ID NO: 525593 - DNA, 25 bp, Mus musculus
agactacagcatggagagccaccag

SEQ ID NO: 525594 - DNA, 25 bp, Mus musculus
agactacgaactatgaggagaggaa

SEQ ID NO: 525595 - DNA, 25 bp, Mus musculus
agactacgaactttgaggagaggaa

SEQ ID NO: 525596 - DNA, 25 bp, Mus musculus
agactacgaccgctaagttatccac

SEQ ID NO: 525597 - DNA, 25 bp, Mus musculus
agactacgaccggtaagttatccac

SEQ ID NO: 525598 - DNA, 25 bp, Mus musculus
agactactatatccgcagtggccac

SEQ ID NO: 525599 - DNA, 25 bp, Mus musculus
agactactatatgcgcagtggccac

SEQ ID NO: 525600 - DNA, 25 bp, Mus musculus
agactagcatctctcagtgggttcc

SEQ ID NO: 525601 - DNA, 25 bp, Mus musculus
agactagcatctgtcagtgggttcc

SEQ ID NO: 525602 - DNA, 25 bp, Mus musculus
agactaggaggccatccttgaatcc

SEQ ID NO: 525603 - DNA, 25 bp, Mus musculus
agactaggaggcgatccttgaatcc

SEQ ID NO: 525604 - DNA, 25 bp, Mus musculus
agactagtccctcgcatgctacaga

SEQ ID NO: 525605 - DNA, 25 bp, Mus musculus
agactagtccctggcatgctacaga

SEQ ID NO: 525606 - DNA, 25 bp, Mus musculus
agactataggcgagtgcacaagccg

SEQ ID NO: 525607 - DNA, 25 bp, Mus musculus
agactataggcgtgtgcacaagccg

SEQ ID NO: 525608 - DNA, 25 bp, Mus musculus
agactatgacaacgacgggattggc

SEQ ID NO: 525609 - DNA, 25 bp, Mus musculus
agactatgacaaggacgggattggc

SEQ ID NO: 525610 - DNA, 25 bp, Mus musculus
agactatgacttctggacagattga

SEQ ID NO: 525611 - DNA, 25 bp, Mus musculus
agactatgacttgtggacagattga

SEQ ID NO: 525612 - DNA, 25 bp, Mus musculus
agactatgatgaagaaagctcagaa

SEQ ID NO: 525613 - DNA, 25 bp, Mus musculus
agactatgatgatgaaagctcagaa

SEQ ID NO: 525614 - DNA, 25 bp, Mus musculus
agactcaacacgcattgggcgggcc

SEQ ID NO: 525615 - DNA, 25 bp, Mus musculus
agactcaacacggattgggcgggcc

SEQ ID NO: 525616 - DNA, 25 bp, Mus musculus
agactcactggacattcctttcaaa

SEQ ID NO: 525617 - DNA, 25 bp, Mus musculus
agactcactggagattcctttcaaa

SEQ ID NO: 525618 - DNA, 25 bp, Mus musculus
agactcagatctcaagcagaggagg

SEQ ID NO: 525619 - DNA, 25 bp, Mus musculus
agactcagatctgaagcagaggagg

SEQ ID NO: 525620 - DNA, 25 bp, Mus musculus
agactcagcacaaagtcatccagtg

SEQ ID NO: 525621 - DNA, 25 bp, Mus musculus
agactcagcacatagtcatccagtg

SEQ ID NO: 525622 - DNA, 25 bp, Mus musculus
agactcagccccaaggagatgaaga

SEQ ID NO: 525623 - DNA, 25 bp, Mus musculus
agactcagcccctaggagatgaaga

SEQ ID NO: 525624 - DNA, 25 bp, Mus musculus
agactcagccggagtctccgcggcg

SEQ ID NO: 525625 - DNA, 25 bp, Mus musculus
agactcagccggtgtctccgcggcg

SEQ ID NO: 525626 - DNA, 25 bp, Mus musculus
agactcagcctcactctcagcctct

SEQ ID NO: 525627 - DNA, 25 bp, Mus musculus
agactcagcctctctctcagcctct

SEQ ID NO: 525628 - DNA, 25 bp, Mus musculus
agactcagcgtgatcgtcacccaca

SEQ ID NO: 525629 - DNA, 25 bp, Mus musculus
agactcagcgtgttcgtcacccaca

SEQ ID NO: 525630 - DNA, 25 bp, Mus musculus
agactcagctgacccgttctactgg

SEQ ID NO: 525631 - DNA, 25 bp, Mus musculus
agactcagctgagccgttctactgg

SEQ ID NO: 525632 - DNA, 25 bp, Mus musculus
agactcagtcgccttcatggaacgc

SEQ ID NO: 525633 - DNA, 25 bp, Mus musculus
agactcagtcgcgttcatggaacgc

SEQ ID NO: 525634 - DNA, 25 bp, Mus musculus
agactcagttgacttgacaacctta

SEQ ID NO: 525635 - DNA, 25 bp, Mus musculus
agactcagttgagttgacaacctta

SEQ ID NO: 525636 - DNA, 25 bp, Mus musculus
agactcatggtcatgttggtgctga

SEQ ID NO: 525637 - DNA, 25 bp, Mus musculus
agactcatggtcttgttggtgctga

SEQ ID NO: 525638 - DNA, 25 bp, Mus musculus
agactccaaattagtggagcggaca

SEQ ID NO: 525639 - DNA, 25 bp, Mus musculus
agactccaaatttgtggagcggaca

SEQ ID NO: 525640 - DNA, 25 bp, Mus musculus
agactccacacaaggccattctggg

SEQ ID NO: 525641 - DNA, 25 bp, Mus musculus
agactccacacatggccattctggg

SEQ ID NO: 525642 - DNA, 25 bp, Mus musculus
agactccattgacggtggcccagaa

SEQ ID NO: 525643 - DNA, 25 bp, Mus musculus
agactccattgagggtggcccagaa

SEQ ID NO: 525644 - DNA, 25 bp, Mus musculus
agactccccagaagatgagaatgca

SEQ ID NO: 525645 - DNA, 25 bp, Mus musculus
agactccccagatgatgagaatgca

SEQ ID NO: 525646 - DNA, 25 bp, Mus musculus
agactcccgaggacagagacgagga

SEQ ID NO: 525647 - DNA, 25 bp, Mus musculus
agactcccgaggtcagagacgagga

SEQ ID NO: 525648 - DNA, 25 bp, Mus musculus
agactccctcaacatgcggaaccga

SEQ ID NO: 525649 - DNA, 25 bp, Mus musculus
agactccctcaagatgcggaaccga

SEQ ID NO: 525650 - DNA, 25 bp, Mus musculus
agactcccttcgaggcgcttcctgt

SEQ ID NO: 525651 - DNA, 25 bp, Mus musculus
agactcccttcgtggcgcttcctgt

SEQ ID NO: 525652 - DNA, 25 bp, Mus musculus
agactccgaggaaggcaccctggct

SEQ ID NO: 525653 - DNA, 25 bp, Mus musculus
agactccgaggatggcaccctggct

SEQ ID NO: 525654 - DNA, 25 bp, Mus musculus
agactccgggacacacctgatggta

SEQ ID NO: 525655 - DNA, 25 bp, Mus musculus
agactccgggactcacctgatggta

SEQ ID NO: 525656 - DNA, 25 bp, Mus musculus
agactcctccaaccaaagtgaataa

SEQ ID NO: 525657 - DNA, 25 bp, Mus musculus
agactcctccaagcaaagtgaataa

SEQ ID NO: 525658 - DNA, 25 bp, Mus musculus
agactcctgtgcattcggctctgag

SEQ ID NO: 525659 - DNA, 25 bp, Mus musculus
agactcctgtgctttcggctctgag

SEQ ID NO: 525660 - DNA, 25 bp, Mus musculus
agactcctttctagcttgttgggac

SEQ ID NO: 525661 - DNA, 25 bp, Mus musculus
agactcctttcttgcttgttgggac

SEQ ID NO: 525662 - DNA, 25 bp, Mus musculus
agactcgccttcaatccagagccgt

SEQ ID NO: 525663 - DNA, 25 bp, Mus musculus
agactcgccttctatccagagccgt

SEQ ID NO: 525664 - DNA, 25 bp, Mus musculus
agactcggcccaaccaagaaggcat

SEQ ID NO: 525665 - DNA, 25 bp, Mus musculus
agactcggcccatccaagaaggcat

SEQ ID NO: 525666 - DNA, 25 bp, Mus musculus
agactcggcgctccagccaggaatg

SEQ ID NO: 525667 - DNA, 25 bp, Mus musculus
agactcggcgctgcagccaggaatg

SEQ ID NO: 525668 - DNA, 25 bp, Mus musculus
agactcgtgttcagcgtggctagca

SEQ ID NO: 525669 - DNA, 25 bp, Mus musculus
agactcgtgttctgcgtggctagca

SEQ ID NO: 525670 - DNA, 25 bp, Mus musculus
agactctacttgcttcagggaatcc

SEQ ID NO: 525671 - DNA, 25 bp, Mus musculus
agactctacttggttcagggaatcc

SEQ ID NO: 525672 - DNA, 25 bp, Mus musculus
agactctagcaacactgttgtggat

SEQ ID NO: 525673 - DNA, 25 bp, Mus musculus
agactctagcaagactgttgtggat

SEQ ID NO: 525674 - DNA, 25 bp, Mus musculus
agactctcgcccagaggcgctgggc

SEQ ID NO: 525675 - DNA, 25 bp, Mus musculus
agactctcgccctgaggcgctgggc

SEQ ID NO: 525676 - DNA, 25 bp, Mus musculus
agactctgacttagacattgatgaa

SEQ ID NO: 525677 - DNA, 25 bp, Mus musculus
agactctgactttgacattgatgaa

SEQ ID NO: 525678 - DNA, 25 bp, Mus musculus
agactctggcacaatggtcatggcg

SEQ ID NO: 525679 - DNA, 25 bp, Mus musculus
agactctggcactatggtcatggcg

SEQ ID NO: 525680 - DNA, 25 bp, Mus musculus
agactctggctgagcgctcctaccg

SEQ ID NO: 525681 - DNA, 25 bp, Mus musculus
agactctggctgtgcgctcctaccg

SEQ ID NO: 525682 - DNA, 25 bp, Mus musculus
agactctgtcaaaatttctgggcag

SEQ ID NO: 525683 - DNA, 25 bp, Mus musculus
agactctgtcaatatttctgggcag

SEQ ID NO: 525684 - DNA, 25 bp, Mus musculus
agactctgtcccagggcacccagtg

SEQ ID NO: 525685 - DNA, 25 bp, Mus musculus
agactctgtccctgggcacccagtg

SEQ ID NO: 525686 - DNA, 25 bp, Mus musculus
agactctgtgaaagcccgcccgggt

SEQ ID NO: 525687 - DNA, 25 bp, Mus musculus
agactctgtgaatgcccgcccgggt

SEQ ID NO: 525688 - DNA, 25 bp, Mus musculus
agactcttcaatcagctcatcaagt

SEQ ID NO: 525689 - DNA, 25 bp, Mus musculus
agactcttcaatgagctcatcaagt

SEQ ID NO: 525690 - DNA, 25 bp, Mus musculus
agactcttcagaatccacgggtgtg

SEQ ID NO: 525691 - DNA, 25 bp, Mus musculus
agactcttcagattccacgggtgtg

SEQ ID NO: 525692 - DNA, 25 bp, Mus musculus
agactctttcaacgcgggaggctca

SEQ ID NO: 525693 - DNA, 25 bp, Mus musculus
agactctttcaaggcgggaggctca

SEQ ID NO: 525694 - DNA, 25 bp, Mus musculus
agactgaactttctcctcggcccgg

SEQ ID NO: 525695 - DNA, 25 bp, Mus musculus
agactgaactttgtcctcggcccgg

SEQ ID NO: 525696 - DNA, 25 bp, Mus musculus
agactgacaccacctccttctatga

SEQ ID NO: 525697 - DNA, 25 bp, Mus musculus
agactgacaccagctccttctatga

SEQ ID NO: 525698 - DNA, 25 bp, Mus musculus
agactgagaccacgataccgggaga

SEQ ID NO: 525699 - DNA, 25 bp, Mus musculus
agactgagaccaggataccgggaga

SEQ ID NO: 525700 - DNA, 25 bp, Mus musculus
agactgagatgcaggagcttgccat

SEQ ID NO: 525701 - DNA, 25 bp, Mus musculus
agactgagatgctggagcttgccat

SEQ ID NO: 525702 - DNA, 25 bp, Mus musculus
agactgagcggccagctccaggact

SEQ ID NO: 525703 - DNA, 25 bp, Mus musculus
agactgagcggcgagctccaggact

SEQ ID NO: 525704 - DNA, 25 bp, Mus musculus
agactgaggcatctagcagacagac

SEQ ID NO: 525705 - DNA, 25 bp, Mus musculus
agactgaggcatgtagcagacagac

SEQ ID NO: 525706 - DNA, 25 bp, Mus musculus
agactgattaaaagggccctttgat

SEQ ID NO: 525707 - DNA, 25 bp, Mus musculus
agactgattaaatgggccctttgat

SEQ ID NO: 525708 - DNA, 25 bp, Mus musculus
agactgcaggccacaagcccactgt

SEQ ID NO: 525709 - DNA, 25 bp, Mus musculus
agactgcaggcctcaagcccactgt

SEQ ID NO: 525710 - DNA, 25 bp, Mus musculus
agactgcagttcatcttgagccatc

SEQ ID NO: 525711 - DNA, 25 bp, Mus musculus
agactgcagttcttcttgagccatc

SEQ ID NO: 525712 - DNA, 25 bp, Mus musculus
agactgcatgagctgcaccgaggcc

SEQ ID NO: 525713 - DNA, 25 bp, Mus musculus
agactgcatgaggtgcaccgaggcc

SEQ ID NO: 525714 - DNA, 25 bp, Mus musculus
agactgcccaagctcatcgggaacc

SEQ ID NO: 525715 - DNA, 25 bp, Mus musculus
agactgcccaaggtcatcgggaacc

SEQ ID NO: 525716 - DNA, 25 bp, Mus musculus
agactgccgaggatgacatcagcga

SEQ ID NO: 525717 - DNA, 25 bp, Mus musculus
agactgccgaggttgacatcagcga

SEQ ID NO: 525718 - DNA, 25 bp, Mus musculus
agactgcgccatccaggaagcgcca

SEQ ID NO: 525719 - DNA, 25 bp, Mus musculus
agactgcgccatgcaggaagcgcca

SEQ ID NO: 525720 - DNA, 25 bp, Mus musculus
agactgctgggcagggcgccactca

SEQ ID NO: 525721 - DNA, 25 bp, Mus musculus
agactgctgggctgggcgccactca

SEQ ID NO: 525722 - DNA, 25 bp, Mus musculus
agactggaagctacggctcccggtg

SEQ ID NO: 525723 - DNA, 25 bp, Mus musculus
agactggaagcttcggctcccggtg

SEQ ID NO: 525724 - DNA, 25 bp, Mus musculus
agactggatgccagggaccggttcc

SEQ ID NO: 525725 - DNA, 25 bp, Mus musculus
agactggatgcctgggaccggttcc

SEQ ID NO: 525726 - DNA, 25 bp, Mus musculus
agactggcaatgcaccctcggtgca

SEQ ID NO: 525727 - DNA, 25 bp, Mus musculus
agactggcaatggaccctcggtgca

SEQ ID NO: 525728 - DNA, 25 bp, Mus musculus
agactggcgtcgacagcccggaaca

SEQ ID NO: 525729 - DNA, 25 bp, Mus musculus
agactggcgtcgtcagcccggaaca

SEQ ID NO: 525730 - DNA, 25 bp, Mus musculus
agactggctgtcactgcttgatcga

SEQ ID NO: 525731 - DNA, 25 bp, Mus musculus
agactggctgtctctgcttgatcga

SEQ ID NO: 525732 - DNA, 25 bp, Mus musculus
agactgggtcatcccgccaatcaac

SEQ ID NO: 525733 - DNA, 25 bp, Mus musculus
agactgggtcatgccgccaatcaac

SEQ ID NO: 525734 - DNA, 25 bp, Mus musculus
agactgggtcctccctgtactcgga

SEQ ID NO: 525735 - DNA, 25 bp, Mus musculus
agactgggtcctgcctgtactcgga

SEQ ID NO: 525736 - DNA, 25 bp, Mus musculus
agactggtgacaccctctatatatt

SEQ ID NO: 525737 - DNA, 25 bp, Mus musculus
agactggtgacagcctctatatatt

SEQ ID NO: 525738 - DNA, 25 bp, Mus musculus
agactggtgcatctctcggcagctg

SEQ ID NO: 525739 - DNA, 25 bp, Mus musculus
agactggtgcatgtctcggcagctg

SEQ ID NO: 525740 - DNA, 25 bp, Mus musculus
agactggtgggaagcccgctccttg

SEQ ID NO: 525741 - DNA, 25 bp, Mus musculus
agactggtgggacccagactgactt

SEQ ID NO: 525742 - DNA, 25 bp, Mus musculus
agactggtgggagccagactgactt

SEQ ID NO: 525743 - DNA, 25 bp, Mus musculus
agactggtgggatgcccgctccttg

SEQ ID NO: 525744 - DNA, 25 bp, Mus musculus
agactggtgtttcctccctggctct

SEQ ID NO: 525745 - DNA, 25 bp, Mus musculus
agactggtgtttgctccctggctct

SEQ ID NO: 525746 - DNA, 25 bp, Mus musculus
agactgtaaagccaatccgggaaca

SEQ ID NO: 525747 - DNA, 25 bp, Mus musculus
agactgtaaagcgaatccgggaaca

SEQ ID NO: 525748 - DNA, 25 bp, Mus musculus
agactgtagtgtccagaggcgacat

SEQ ID NO: 525749 - DNA, 25 bp, Mus musculus
agactgtagtgtgcagaggcgacat

SEQ ID NO: 525750 - DNA, 25 bp, Mus musculus
agactgtctgtactgattgcatcta

SEQ ID NO: 525751 - DNA, 25 bp, Mus musculus
agactgtctgtagtgattgcatcta

SEQ ID NO: 525752 - DNA, 25 bp, Mus musculus
agactgtgcgacagtgtttgctctg

SEQ ID NO: 525753 - DNA, 25 bp, Mus musculus
agactgtgcgactgtgtttgctctg

SEQ ID NO: 525754 - DNA, 25 bp, Mus musculus
agactgtgcgccatggctccaaggc

SEQ ID NO: 525755 - DNA, 25 bp, Mus musculus
agactgtgcgccttggctccaaggc

SEQ ID NO: 525756 - DNA, 25 bp, Mus musculus
agactgtggactacgtcagcaggaa

SEQ ID NO: 525757 - DNA, 25 bp, Mus musculus
agactgtggacttcgtcagcaggaa

SEQ ID NO: 525758 - DNA, 25 bp, Mus musculus
agactgtggccgagctcagtgacca

SEQ ID NO: 525759 - DNA, 25 bp, Mus musculus
agactgtggccgtgctcagtgacca

SEQ ID NO: 525760 - DNA, 25 bp, Mus musculus
agactgtgggcccaccaggtactgc

SEQ ID NO: 525761 - DNA, 25 bp, Mus musculus
agactgtgggccgaccaggtactgc

SEQ ID NO: 525762 - DNA, 25 bp, Mus musculus
agactgtgtgttaccaaaatggcgg

SEQ ID NO: 525763 - DNA, 25 bp, Mus musculus
agactgtgtgtttccaaaatggcgg

SEQ ID NO: 525764 - DNA, 25 bp, Mus musculus
agacttaagcttactgcagactggc

SEQ ID NO: 525765 - DNA, 25 bp, Mus musculus
agacttaagctttctgcagactggc

SEQ ID NO: 525766 - DNA, 25 bp, Mus musculus
agacttattcctcgaaagagattcc

SEQ ID NO: 525767 - DNA, 25 bp, Mus musculus
agacttattcctggaaagagattcc

SEQ ID NO: 525768 - DNA, 25 bp, Mus musculus
agacttattggtctacggaggctgc

SEQ ID NO: 525769 - DNA, 25 bp, Mus musculus
agacttattggtgtacggaggctgc

SEQ ID NO: 525770 - DNA, 25 bp, Mus musculus
agacttcaatttcccacgagacaag

SEQ ID NO: 525771 - DNA, 25 bp, Mus musculus
agacttcaatttgccacgagacaag

SEQ ID NO: 525772 - DNA, 25 bp, Mus musculus
agacttccaggaaagcaacaggatg

SEQ ID NO: 525773 - DNA, 25 bp, Mus musculus
agacttccaggatagcaacaggatg

SEQ ID NO: 525774 - DNA, 25 bp, Mus musculus
agacttcgacggagctgcctgggat

SEQ ID NO: 525775 - DNA, 25 bp, Mus musculus
agacttcgacggtgctgcctgggat

SEQ ID NO: 525776 - DNA, 25 bp, Mus musculus
agacttcgaggcagacatccctcct

SEQ ID NO: 525777 - DNA, 25 bp, Mus musculus
agacttcgaggctgacatccctcct

SEQ ID NO: 525778 - DNA, 25 bp, Mus musculus
agacttctacccatataaccatgga

SEQ ID NO: 525779 - DNA, 25 bp, Mus musculus
agacttctacccttataaccatgga

SEQ ID NO: 525780 - DNA, 25 bp, Mus musculus
agacttctctgaatggtccagcttt

SEQ ID NO: 525781 - DNA, 25 bp, Mus musculus
agacttctctgattggtccagcttt

SEQ ID NO: 525782 - DNA, 25 bp, Mus musculus
agacttgacactacttcgccgggcc

SEQ ID NO: 525783 - DNA, 25 bp, Mus musculus
agacttgacacttcttcgccgggcc

SEQ ID NO: 525784 - DNA, 25 bp, Mus musculus
agacttgtcagcagggaggcccaag

SEQ ID NO: 525785 - DNA, 25 bp, Mus musculus
agacttgtcagctgggaggcccaag

SEQ ID NO: 525786 - DNA, 25 bp, Mus musculus
agactttaaccaagggcggtgagca

SEQ ID NO: 525787 - DNA, 25 bp, Mus musculus
agactttaaccatgggcggtgagca

SEQ ID NO: 525788 - DNA, 25 bp, Mus musculus
agactttaatagagaggaagatgcc

SEQ ID NO: 525789 - DNA, 25 bp, Mus musculus
agactttaatagtgaggaagatgcc

SEQ ID NO: 525790 - DNA, 25 bp, Mus musculus
agactttccaagatgtccatctctt

SEQ ID NO: 525791 - DNA, 25 bp, Mus musculus
agactttccaagttgtccatctctt

SEQ ID NO: 525792 - DNA, 25 bp, Mus musculus
agactttctggaaggcttcttcaga

SEQ ID NO: 525793 - DNA, 25 bp, Mus musculus
agactttctggatggcttcttcaga

SEQ ID NO: 525794 - DNA, 25 bp, Mus musculus
agactttgaatccttttcttagagc

SEQ ID NO: 525795 - DNA, 25 bp, Mus musculus
agactttgaatcgttttcttagagc

SEQ ID NO: 525796 - DNA, 25 bp, Mus musculus
agactttggaccagggcctgcagga

SEQ ID NO: 525797 - DNA, 25 bp, Mus musculus
agactttggacctgggcctgcagga

SEQ ID NO: 525798 - DNA, 25 bp, Mus musculus
agactttttataaggccttgtatga

SEQ ID NO: 525799 - DNA, 25 bp, Mus musculus
agactttttatatggccttgtatga

SEQ ID NO: 525800 - DNA, 25 bp, Mus musculus
agagaaaaagatcactaagcctttg

SEQ ID NO: 525801 - DNA, 25 bp, Mus musculus
agagaaaaagatgactaagcctttg

SEQ ID NO: 525802 - DNA, 25 bp, Mus musculus
agagaaaaccctcaagtgcccacgg

SEQ ID NO: 525803 - DNA, 25 bp, Mus musculus
agagaaaaccctgaagtgcccacgg

SEQ ID NO: 525804 - DNA, 25 bp, Mus musculus
agagaaaacggtccccttgctgtca

SEQ ID NO: 525805 - DNA, 25 bp, Mus musculus
agagaaaacggtgcccttgctgtca

SEQ ID NO: 525806 - DNA, 25 bp, Mus musculus
agagaaacagcacctctccctgtcc

SEQ ID NO: 525807 - DNA, 25 bp, Mus musculus
agagaaacagcagctctccctgtcc

SEQ ID NO: 525808 - DNA, 25 bp, Mus musculus
agagaaaccctgcaggatgggctcc

SEQ ID NO: 525809 - DNA, 25 bp, Mus musculus
agagaaaccctggaggatgggctcc

SEQ ID NO: 525810 - DNA, 25 bp, Mus musculus
agagaaagaggtctttgcccatgaa

SEQ ID NO: 525811 - DNA, 25 bp, Mus musculus
agagaaagaggtgtttgcccatgaa

SEQ ID NO: 525812 - DNA, 25 bp, Mus musculus
agagaaaggacgcattcatttgcag

SEQ ID NO: 525813 - DNA, 25 bp, Mus musculus
agagaaaggacggattcatttgcag

SEQ ID NO: 525814 - DNA, 25 bp, Mus musculus
agagaaagtgagagcgtcccttgca

SEQ ID NO: 525815 - DNA, 25 bp, Mus musculus
agagaaagtgagtgcgtcccttgca

SEQ ID NO: 525816 - DNA, 25 bp, Mus musculus
agagaaatgctcctaaggaacaatc

SEQ ID NO: 525817 - DNA, 25 bp, Mus musculus
agagaaatgctcgtaaggaacaatc

SEQ ID NO: 525818 - DNA, 25 bp, Mus musculus
agagaacaaggaagtgcccaccggc

SEQ ID NO: 525819 - DNA, 25 bp, Mus musculus
agagaacaaggatgtgcccaccggc

SEQ ID NO: 525820 - DNA, 25 bp, Mus musculus
agagaacaccatagccttccgacat

SEQ ID NO: 525821 - DNA, 25 bp, Mus musculus
agagaacaccattgccttccgacat

SEQ ID NO: 525822 - DNA, 25 bp, Mus musculus
agagaacacggacctcgtcaagtca

SEQ ID NO: 525823 - DNA, 25 bp, Mus musculus
agagaacacggagctcgtcaagtca

SEQ ID NO: 525824 - DNA, 25 bp, Mus musculus
agagaacatcctatgtgagcacccc

SEQ ID NO: 525825 - DNA, 25 bp, Mus musculus
agagaacatcctttgtgagcacccc

SEQ ID NO: 525826 - DNA, 25 bp, Mus musculus
agagaacattataagcttgattggc

SEQ ID NO: 525827 - DNA, 25 bp, Mus musculus
agagaacattattagcttgattggc

SEQ ID NO: 525828 - DNA, 25 bp, Mus musculus
agagaacggccacccttggagaaag

SEQ ID NO: 525829 - DNA, 25 bp, Mus musculus
agagaacggccagccttggagaaag

SEQ ID NO: 525830 - DNA, 25 bp, Mus musculus
agagaactgactcctcctgctcctg

SEQ ID NO: 525831 - DNA, 25 bp, Mus musculus
agagaactgactgctcctgctcctg

SEQ ID NO: 525832 - DNA, 25 bp, Mus musculus
agagaactggaaccatggaccctag

SEQ ID NO: 525833 - DNA, 25 bp, Mus musculus
agagaactggaagcatggaccctag

SEQ ID NO: 525834 - DNA, 25 bp, Mus musculus
agagaacttcgcactgtcaccccat

SEQ ID NO: 525835 - DNA, 25 bp, Mus musculus
agagaacttcgctctgtcaccccat

SEQ ID NO: 525836 - DNA, 25 bp, Mus musculus
agagaacttctcacagggcatatgg

SEQ ID NO: 525837 - DNA, 25 bp, Mus musculus
agagaacttctctcagggcatatgg

SEQ ID NO: 525838 - DNA, 25 bp, Mus musculus
agagaagaacgcactgaaactgggc

SEQ ID NO: 525839 - DNA, 25 bp, Mus musculus
agagaagaacgctctgaaactgggc

SEQ ID NO: 525840 - DNA, 25 bp, Mus musculus
agagaagaagccacggcagcatagc

SEQ ID NO: 525841 - DNA, 25 bp, Mus musculus
agagaagaagcctcggcagcatagc

SEQ ID NO: 525842 - DNA, 25 bp, Mus musculus
agagaagacaataccgacggcagaa

SEQ ID NO: 525843 - DNA, 25 bp, Mus musculus
agagaagacaattccgacggcagaa

SEQ ID NO: 525844 - DNA, 25 bp, Mus musculus
agagaagacctgatgttgttgagag

SEQ ID NO: 525845 - DNA, 25 bp, Mus musculus
agagaagacctgttgttgttgagag

SEQ ID NO: 525846 - DNA, 25 bp, Mus musculus
agagaagaggtacttaagaaatgtc

SEQ ID NO: 525847 - DNA, 25 bp, Mus musculus
agagaagaggtagttaagaaatgtc

SEQ ID NO: 525848 - DNA, 25 bp, Mus musculus
agagaagatggtcgccaagcagcac

SEQ ID NO: 525849 - DNA, 25 bp, Mus musculus
agagaagatggtggccaagcagcac

SEQ ID NO: 525850 - DNA, 25 bp, Mus musculus
agagaagattccaaataatacacag

SEQ ID NO: 525851 - DNA, 25 bp, Mus musculus
agagaagattcctaataatacacag

SEQ ID NO: 525852 - DNA, 25 bp, Mus musculus
agagaagcgggactccgggtgccgc

SEQ ID NO: 525853 - DNA, 25 bp, Mus musculus
agagaagcgggagtccgggtgccgc

SEQ ID NO: 525854 - DNA, 25 bp, Mus musculus
agagaaggcaaccttacaagaccta

SEQ ID NO: 525855 - DNA, 25 bp, Mus musculus
agagaaggcaacgttacaagaccta

SEQ ID NO: 525856 - DNA, 25 bp, Mus musculus
agagaaggcaatctgcccaatatca

SEQ ID NO: 525857 - DNA, 25 bp, Mus musculus
agagaaggcaatgtgcccaatatca

SEQ ID NO: 525858 - DNA, 25 bp, Mus musculus
agagaagggaacagtgtacttcaag

SEQ ID NO: 525859 - DNA, 25 bp, Mus musculus
agagaagggaactgtgtacttcaag

SEQ ID NO: 525860 - DNA, 25 bp, Mus musculus
agagaagggtggactcctatgtgac

SEQ ID NO: 525861 - DNA, 25 bp, Mus musculus
agagaagggtggtctcctatgtgac

SEQ ID NO: 525862 - DNA, 25 bp, Mus musculus
agagaaggtcggacccttcacgaag

SEQ ID NO: 525863 - DNA, 25 bp, Mus musculus
agagaaggtcggtcccttcacgaag

SEQ ID NO: 525864 - DNA, 25 bp, Mus musculus
agagaagtgttgcagaagtacttac

SEQ ID NO: 525865 - DNA, 25 bp, Mus musculus
agagaagtgttggagaagtacttac

SEQ ID NO: 525866 - DNA, 25 bp, Mus musculus
agagaagttcccatacatggtagag

SEQ ID NO: 525867 - DNA, 25 bp, Mus musculus
agagaagttcccttacatggtagag

SEQ ID NO: 525868 - DNA, 25 bp, Mus musculus
agagaatacaagaggagcatacaag

SEQ ID NO: 525869 - DNA, 25 bp, Mus musculus
agagaatacaagtggagcatacaag

SEQ ID NO: 525870 - DNA, 25 bp, Mus musculus
agagaatattctagctaagtcttca

SEQ ID NO: 525871 - DNA, 25 bp, Mus musculus
agagaatattcttgctaagtcttca

SEQ ID NO: 525872 - DNA, 25 bp, Mus musculus
agagaatcaagcaagcaactgttct

SEQ ID NO: 525873 - DNA, 25 bp, Mus musculus
agagaatcaagctagcaactgttct

SEQ ID NO: 525874 - DNA, 25 bp, Mus musculus
agagaatccgggacacttttgaaag

SEQ ID NO: 525875 - DNA, 25 bp, Mus musculus
agagaatccgggtcacttttgaaag

SEQ ID NO: 525876 - DNA, 25 bp, Mus musculus
agagaatcgtgacgtcaggcctcgc

SEQ ID NO: 525877 - DNA, 25 bp, Mus musculus
agagaatcgtgaggtcaggcctcgc

SEQ ID NO: 525878 - DNA, 25 bp, Mus musculus
agagaatgccataatttatagcaac

SEQ ID NO: 525879 - DNA, 25 bp, Mus musculus
agagaatgccattatttatagcaac

SEQ ID NO: 525880 - DNA, 25 bp, Mus musculus
agagaatgcctcaggaaatcacaaa

SEQ ID NO: 525881 - DNA, 25 bp, Mus musculus
agagaatgcctctggaaatcacaaa

SEQ ID NO: 525882 - DNA, 25 bp, Mus musculus
agagaatgctaccaggcctgagcat

SEQ ID NO: 525883 - DNA, 25 bp, Mus musculus
agagaatgctacgaggcctgagcat

SEQ ID NO: 525884 - DNA, 25 bp, Mus musculus
agagaatgtcacaagaggagaccaa

SEQ ID NO: 525885 - DNA, 25 bp, Mus musculus
agagaatgtcactagaggagaccaa

SEQ ID NO: 525886 - DNA, 25 bp, Mus musculus
agagaattggccctctctgccctgg

SEQ ID NO: 525887 - DNA, 25 bp, Mus musculus
agagaattggccgtctctgccctgg

SEQ ID NO: 525888 - DNA, 25 bp, Mus musculus
agagaatttatcagttgctaaagcg

SEQ ID NO: 525889 - DNA, 25 bp, Mus musculus
agagaatttatctgttgctaaagcg

SEQ ID NO: 525890 - DNA, 25 bp, Mus musculus
agagaattttctatcactgatgtgg

SEQ ID NO: 525891 - DNA, 25 bp, Mus musculus
agagaattttctttcactgatgtgg

SEQ ID NO: 525892 - DNA, 25 bp, Mus musculus
agagacaaaatgagcagagctgcta

SEQ ID NO: 525893 - DNA, 25 bp, Mus musculus
agagacaaaatgtgcagagctgcta

SEQ ID NO: 525894 - DNA, 25 bp, Mus musculus
agagacagacctcggaaacacagtg

SEQ ID NO: 525895 - DNA, 25 bp, Mus musculus
agagacagacctgggaaacacagtg

SEQ ID NO: 525896 - DNA, 25 bp, Mus musculus
agagacagccctaccccagagatgt

SEQ ID NO: 525897 - DNA, 25 bp, Mus musculus
agagacagcccttccccagagatgt

SEQ ID NO: 525898 - DNA, 25 bp, Mus musculus
agagacagcggaaccggtgtcagta

SEQ ID NO: 525899 - DNA, 25 bp, Mus musculus
agagacagcggatccggtgtcagta

SEQ ID NO: 525900 - DNA, 25 bp, Mus musculus
agagacaggagaagacagccaattg

SEQ ID NO: 525901 - DNA, 25 bp, Mus musculus
agagacaggagatgacagccaattg

SEQ ID NO: 525902 - DNA, 25 bp, Mus musculus
agagacagtttaagtacaaccaact

SEQ ID NO: 525903 - DNA, 25 bp, Mus musculus
agagacagtttatgtacaaccaact

SEQ ID NO: 525904 - DNA, 25 bp, Mus musculus
agagacatcggccagcactgagagc

SEQ ID NO: 525905 - DNA, 25 bp, Mus musculus
agagacatcggcgagcactgagagc

SEQ ID NO: 525906 - DNA, 25 bp, Mus musculus
agagacatgatgctggtttacaggc

SEQ ID NO: 525907 - DNA, 25 bp, Mus musculus
agagacatgatggtggtttacaggc

SEQ ID NO: 525908 - DNA, 25 bp, Mus musculus
agagacatggccaacatcgcggtgc

SEQ ID NO: 525909 - DNA, 25 bp, Mus musculus
agagacatggcctacatcgcggtgc

SEQ ID NO: 525910 - DNA, 25 bp, Mus musculus
agagaccaaaagagcagcaaaagct

SEQ ID NO: 525911 - DNA, 25 bp, Mus musculus
agagaccaaaagtgcagcaaaagct

SEQ ID NO: 525912 - DNA, 25 bp, Mus musculus
agagaccaggccagggttgacgcca

SEQ ID NO: 525913 - DNA, 25 bp, Mus musculus
agagaccaggcctgggttgacgcca

SEQ ID NO: 525914 - DNA, 25 bp, Mus musculus
agagaccaggtcaaagctgcaggag

SEQ ID NO: 525915 - DNA, 25 bp, Mus musculus
agagaccaggtctaagctgcaggag

SEQ ID NO: 525916 - DNA, 25 bp, Mus musculus
agagaccagtccagccgaactcggg

SEQ ID NO: 525917 - DNA, 25 bp, Mus musculus
agagaccagtcctgccgaactcggg

SEQ ID NO: 525918 - DNA, 25 bp, Mus musculus
agagaccagtgaagccaccgagatc

SEQ ID NO: 525919 - DNA, 25 bp, Mus musculus
agagaccagtgatgccaccgagatc

SEQ ID NO: 525920 - DNA, 25 bp, Mus musculus
agagacccaaggacctcaatgtcgg

SEQ ID NO: 525921 - DNA, 25 bp, Mus musculus
agagacccaaggtcctcaatgtcgg

SEQ ID NO: 525922 - DNA, 25 bp, Mus musculus
agagacccaagtctttgtggccaca

SEQ ID NO: 525923 - DNA, 25 bp, Mus musculus
agagacccaagtgtttgtggccaca

SEQ ID NO: 525924 - DNA, 25 bp, Mus musculus
agagacccactgctcacagattctg

SEQ ID NO: 525925 - DNA, 25 bp, Mus musculus
agagacccactggtcacagattctg

SEQ ID NO: 525926 - DNA, 25 bp, Mus musculus
agagacccagcgaggatgagaagaa

SEQ ID NO: 525927 - DNA, 25 bp, Mus musculus
agagacccagcgtggatgagaagaa

SEQ ID NO: 525928 - DNA, 25 bp, Mus musculus
agagacccatgcctggtgcagagac

SEQ ID NO: 525929 - DNA, 25 bp, Mus musculus
agagacccatgcgtggtgcagagac

SEQ ID NO: 525930 - DNA, 25 bp, Mus musculus
agagaccctcagcacctatcgactt

SEQ ID NO: 525931 - DNA, 25 bp, Mus musculus
agagaccctcaggacctatcgactt

SEQ ID NO: 525932 - DNA, 25 bp, Mus musculus
agagaccgtcctatcttgacaaagt

SEQ ID NO: 525933 - DNA, 25 bp, Mus musculus
agagaccgtcctttcttgacaaagt

SEQ ID NO: 525934 - DNA, 25 bp, Mus musculus
agagacctactacttgcctgatggg

SEQ ID NO: 525935 - DNA, 25 bp, Mus musculus
agagacctactagttgcctgatggg

SEQ ID NO: 525936 - DNA, 25 bp, Mus musculus
agagacctctgacattggctggctc

SEQ ID NO: 525937 - DNA, 25 bp, Mus musculus
agagacctctgagattggctggctc

SEQ ID NO: 525938 - DNA, 25 bp, Mus musculus
agagacctctggcagtgctagctca

SEQ ID NO: 525939 - DNA, 25 bp, Mus musculus
agagacctctgggagtgctagctca

SEQ ID NO: 525940 - DNA, 25 bp, Mus musculus
agagacctgttgatgctacaggagc

SEQ ID NO: 525941 - DNA, 25 bp, Mus musculus
agagacctgttgttgctacaggagc

SEQ ID NO: 525942 - DNA, 25 bp, Mus musculus
agagacgaaggcatgcccattgtct

SEQ ID NO: 525943 - DNA, 25 bp, Mus musculus
agagacgaaggcttgcccattgtct

SEQ ID NO: 525944 - DNA, 25 bp, Mus musculus
agagacgagccgaagacgagcactt

SEQ ID NO: 525945 - DNA, 25 bp, Mus musculus
agagacgagccgtagacgagcactt

SEQ ID NO: 525946 - DNA, 25 bp, Mus musculus
agagacgaggcacttctgggcacct

SEQ ID NO: 525947 - DNA, 25 bp, Mus musculus
agagacgaggcagttctgggcacct

SEQ ID NO: 525948 - DNA, 25 bp, Mus musculus
agagacgtcactacccccatcaatg

SEQ ID NO: 525949 - DNA, 25 bp, Mus musculus
agagacgtcacttcccccatcaatg

SEQ ID NO: 525950 - DNA, 25 bp, Mus musculus
agagacgtctcaagatgtgggagca

SEQ ID NO: 525951 - DNA, 25 bp, Mus musculus
agagacgtctcatgatgtgggagca

SEQ ID NO: 525952 - DNA, 25 bp, Mus musculus
agagactactatcagtgcactggaa

SEQ ID NO: 525953 - DNA, 25 bp, Mus musculus
agagactactatgagtgcactggaa

SEQ ID NO: 525954 - DNA, 25 bp, Mus musculus
agagactcagaaaatggtgcttact

SEQ ID NO: 525955 - DNA, 25 bp, Mus musculus
agagactcagaatatggtgcttact

SEQ ID NO: 525956 - DNA, 25 bp, Mus musculus
agagactcccgacgacagagacgag

SEQ ID NO: 525957 - DNA, 25 bp, Mus musculus
agagactcccgaggacagagacgag

SEQ ID NO: 525958 - DNA, 25 bp, Mus musculus
agagactctaagctgcgagcagacg

SEQ ID NO: 525959 - DNA, 25 bp, Mus musculus
agagactctaaggtgcgagcagacg

SEQ ID NO: 525960 - DNA, 25 bp, Mus musculus
agagactctggaaccgggcctcgag

SEQ ID NO: 525961 - DNA, 25 bp, Mus musculus
agagactctggatccgggcctcgag

SEQ ID NO: 525962 - DNA, 25 bp, Mus musculus
agagactctttcaaggcgggaggct

SEQ ID NO: 525963 - DNA, 25 bp, Mus musculus
agagactctttctaggcgggaggct

SEQ ID NO: 525964 - DNA, 25 bp, Mus musculus
agagactgagagagcgagacataga

SEQ ID NO: 525965 - DNA, 25 bp, Mus musculus
agagactgagagtgcgagacataga

SEQ ID NO: 525966 - DNA, 25 bp, Mus musculus
agagactgcggcaggccattgctgt

SEQ ID NO: 525967 - DNA, 25 bp, Mus musculus
agagactgcggctggccattgctgt

SEQ ID NO: 525968 - DNA, 25 bp, Mus musculus
agagactgtaaaccgaatccgggaa

SEQ ID NO: 525969 - DNA, 25 bp, Mus musculus
agagactgtaaagcgaatccgggaa

SEQ ID NO: 525970 - DNA, 25 bp, Mus musculus
agagactgtctgaactgattgcatc

SEQ ID NO: 525971 - DNA, 25 bp, Mus musculus
agagactgtctgtactgattgcatc

SEQ ID NO: 525972 - DNA, 25 bp, Mus musculus
agagactgtgctagcgtaagttgtc

SEQ ID NO: 525973 - DNA, 25 bp, Mus musculus
agagactgtgcttgcgtaagttgtc

SEQ ID NO: 525974 - DNA, 25 bp, Mus musculus
agagacttctctatccggtccctcg

SEQ ID NO: 525975 - DNA, 25 bp, Mus musculus
agagacttctctttccggtccctcg

SEQ ID NO: 525976 - DNA, 25 bp, Mus musculus
agagacttgtgtcgcgttgaatgac

SEQ ID NO: 525977 - DNA, 25 bp, Mus musculus
agagacttgtgtggcgttgaatgac

SEQ ID NO: 525978 - DNA, 25 bp, Mus musculus
agagacttttcaaggtttcctattg

SEQ ID NO: 525979 - DNA, 25 bp, Mus musculus
agagacttttcatggtttcctattg

SEQ ID NO: 525980 - DNA, 25 bp, Mus musculus
agagagaactggaaagaccagcact

SEQ ID NO: 525981 - DNA, 25 bp, Mus musculus
agagagaactggtaagaccagcact

SEQ ID NO: 525982 - DNA, 25 bp, Mus musculus
agagagaagaaacaagccgaggacc

SEQ ID NO: 525983 - DNA, 25 bp, Mus musculus
agagagaagaaagaagccgaggacc

SEQ ID NO: 525984 - DNA, 25 bp, Mus musculus
agagagaagaatcggaacgccaata

SEQ ID NO: 525985 - DNA, 25 bp, Mus musculus
agagagaagaatgggaacgccaata

SEQ ID NO: 525986 - DNA, 25 bp, Mus musculus
agagagaaggcaacgttacaagacc

SEQ ID NO: 525987 - DNA, 25 bp, Mus musculus
agagagaaggcatcgttacaagacc

SEQ ID NO: 525988 - DNA, 25 bp, Mus musculus
agagagaccaggacaaagctgcagg

SEQ ID NO: 525989 - DNA, 25 bp, Mus musculus
agagagaccaggtcaaagctgcagg

SEQ ID NO: 525990 - DNA, 25 bp, Mus musculus
agagagacctgcagtacgtggagaa

SEQ ID NO: 525991 - DNA, 25 bp, Mus musculus
agagagacctgctgtacgtggagaa

SEQ ID NO: 525992 - DNA, 25 bp, Mus musculus
agagagacttgcctgaccccttgga

SEQ ID NO: 525993 - DNA, 25 bp, Mus musculus
agagagacttgcgtgaccccttgga

SEQ ID NO: 525994 - DNA, 25 bp, Mus musculus
agagagagaaacagacagagttgat

SEQ ID NO: 525995 - DNA, 25 bp, Mus musculus
agagagagaaactgacagagttgat

SEQ ID NO: 525996 - DNA, 25 bp, Mus musculus
agagagagaccccagttactggcga

SEQ ID NO: 525997 - DNA, 25 bp, Mus musculus
agagagagacccgagttactggcga

SEQ ID NO: 525998 - DNA, 25 bp, Mus musculus
agagagagcagcatgaatgtcagct

SEQ ID NO: 525999 - DNA, 25 bp, Mus musculus
agagagagcagcttgaatgtcagct

SEQ ID NO: 526000 - DNA, 25 bp, Mus musculus
agagagagtgcccttcgtcctaacc

SEQ ID NO: 526001 - DNA, 25 bp, Mus musculus
agagagagtgccgttcgtcctaacc

SEQ ID NO: 526002 - DNA, 25 bp, Mus musculus
agagagatctgtctgtactagggcc

SEQ ID NO: 526003 - DNA, 25 bp, Mus musculus
agagagatctgtgtgtactagggcc

SEQ ID NO: 526004 - DNA, 25 bp, Mus musculus
agagagatggccatggtcacttaga

SEQ ID NO: 526005 - DNA, 25 bp, Mus musculus
agagagatggccttggtcacttaga

SEQ ID NO: 526006 - DNA, 25 bp, Mus musculus
agagagcaaccgcagggacacttgc

SEQ ID NO: 526007 - DNA, 25 bp, Mus musculus
agagagcaaccggagggacacttgc

SEQ ID NO: 526008 - DNA, 25 bp, Mus musculus
agagagcaagtccagcatcaagcgg

SEQ ID NO: 526009 - DNA, 25 bp, Mus musculus
agagagcaagtcgagcatcaagcgg

SEQ ID NO: 526010 - DNA, 25 bp, Mus musculus
agagagcagacgacctctcggctca

SEQ ID NO: 526011 - DNA, 25 bp, Mus musculus
agagagcagacgtcctctcggctca

SEQ ID NO: 526012 - DNA, 25 bp, Mus musculus
agagagcagcgtcaacctgggtcct

SEQ ID NO: 526013 - DNA, 25 bp, Mus musculus
agagagcagcgtgaacctgggtcct

SEQ ID NO: 526014 - DNA, 25 bp, Mus musculus
agagagcattggactccccaggact

SEQ ID NO: 526015 - DNA, 25 bp, Mus musculus
agagagcattggtctccccaggact

SEQ ID NO: 526016 - DNA, 25 bp, Mus musculus
agagagccatctccaggaacacagc

SEQ ID NO: 526017 - DNA, 25 bp, Mus musculus
agagagccatctgcaggaacacagc

SEQ ID NO: 526018 - DNA, 25 bp, Mus musculus
agagagcccagcaatagcccagggc

SEQ ID NO: 526019 - DNA, 25 bp, Mus musculus
agagagcccagctatagcccagggc

SEQ ID NO: 526020 - DNA, 25 bp, Mus musculus
agagagccgcagctctctgctgccg

SEQ ID NO: 526021 - DNA, 25 bp, Mus musculus
agagagccgcaggtctctgctgccg

SEQ ID NO: 526022 - DNA, 25 bp, Mus musculus
agagagctccgtcacgtgatcacca

SEQ ID NO: 526023 - DNA, 25 bp, Mus musculus
agagagctccgtgacgtgatcacca

SEQ ID NO: 526024 - DNA, 25 bp, Mus musculus
agagagctgacactgggtatcaatg

SEQ ID NO: 526025 - DNA, 25 bp, Mus musculus
agagagctgacagtgggtatcaatg

SEQ ID NO: 526026 - DNA, 25 bp, Mus musculus
agagagctgatgaccagggagctct

SEQ ID NO: 526027 - DNA, 25 bp, Mus musculus
agagagctgatgtccagggagctct

SEQ ID NO: 526028 - DNA, 25 bp, Mus musculus
agagaggacccaccggacagactgc

SEQ ID NO: 526029 - DNA, 25 bp, Mus musculus
agagaggacccagcggacagactgc

SEQ ID NO: 526030 - DNA, 25 bp, Mus musculus
agagaggagcagatccctcccagcg

SEQ ID NO: 526031 - DNA, 25 bp, Mus musculus
agagaggagcagttccctcccagcg

SEQ ID NO: 526032 - DNA, 25 bp, Mus musculus
agagaggatcagcatccagccggca

SEQ ID NO: 526033 - DNA, 25 bp, Mus musculus
agagaggatcaggatccagccggca

SEQ ID NO: 526034 - DNA, 25 bp, Mus musculus
agagaggatccgatccatcgaagcc

SEQ ID NO: 526035 - DNA, 25 bp, Mus musculus
agagaggatccgttccatcgaagcc

SEQ ID NO: 526036 - DNA, 25 bp, Mus musculus
agagaggatctgctccacagtgtgc

SEQ ID NO: 526037 - DNA, 25 bp, Mus musculus
agagaggatctggtccacagtgtgc

SEQ ID NO: 526038 - DNA, 25 bp, Mus musculus
agagaggccacccaccatttgctgt

SEQ ID NO: 526039 - DNA, 25 bp, Mus musculus
agagaggccaccgaccatttgctgt

SEQ ID NO: 526040 - DNA, 25 bp, Mus musculus
agagaggcccttagaggcttcctcg

SEQ ID NO: 526041 - DNA, 25 bp, Mus musculus
agagaggccctttgaggcttcctcg

SEQ ID NO: 526042 - DNA, 25 bp, Mus musculus
agagagggaaccatgggaatatttc

SEQ ID NO: 526043 - DNA, 25 bp, Mus musculus
agagagggaaccttgggaatatttc

SEQ ID NO: 526044 - DNA, 25 bp, Mus musculus
agagagggccagatgctaagtctta

SEQ ID NO: 526045 - DNA, 25 bp, Mus musculus
agagagggccagttgctaagtctta

SEQ ID NO: 526046 - DNA, 25 bp, Mus musculus
agagaggtacccatgaggagctgat

SEQ ID NO: 526047 - DNA, 25 bp, Mus musculus
agagaggtacccttgaggagctgat

SEQ ID NO: 526048 - DNA, 25 bp, Mus musculus
agagaggtcacaaggcttgctcgag

SEQ ID NO: 526049 - DNA, 25 bp, Mus musculus
agagaggtcacatggcttgctcgag

SEQ ID NO: 526050 - DNA, 25 bp, Mus musculus
agagaggtcctaacaaaaccaaaca

SEQ ID NO: 526051 - DNA, 25 bp, Mus musculus
agagaggtcctatcaaaaccaaaca

SEQ ID NO: 526052 - DNA, 25 bp, Mus musculus
agagaggtctccctaggcactgctg

SEQ ID NO: 526053 - DNA, 25 bp, Mus musculus
agagaggtctccgtaggcactgctg

SEQ ID NO: 526054 - DNA, 25 bp, Mus musculus
agagagtcagctcgactggagaacc

SEQ ID NO: 526055 - DNA, 25 bp, Mus musculus
agagagtcagctggactggagaacc

SEQ ID NO: 526056 - DNA, 25 bp, Mus musculus
agagagtccccgcaaggatgatgca

SEQ ID NO: 526057 - DNA, 25 bp, Mus musculus
agagagtccccggaaggatgatgca

SEQ ID NO: 526058 - DNA, 25 bp, Mus musculus
agagagtgacctaatgagagcccac

SEQ ID NO: 526059 - DNA, 25 bp, Mus musculus
agagagtgaccttatgagagcccac

SEQ ID NO: 526060 - DNA, 25 bp, Mus musculus
agagagtgcattccaagctctggca

SEQ ID NO: 526061 - DNA, 25 bp, Mus musculus
agagagtgcattgcaagctctggca

SEQ ID NO: 526062 - DNA, 25 bp, Mus musculus
agagagtggtacacgcaaaaggagc

SEQ ID NO: 526063 - DNA, 25 bp, Mus musculus
agagagtggtactcgcaaaaggagc

SEQ ID NO: 526064 - DNA, 25 bp, Mus musculus
agagagtgtctcaatatgctgtcca

SEQ ID NO: 526065 - DNA, 25 bp, Mus musculus
agagagtgtctctatatgctgtcca

SEQ ID NO: 526066 - DNA, 25 bp, Mus musculus
agagataaggcaccctctagacccc

SEQ ID NO: 526067 - DNA, 25 bp, Mus musculus
agagataaggcagcctctagacccc

SEQ ID NO: 526068 - DNA, 25 bp, Mus musculus
agagataaggcgcttcaggactatc

SEQ ID NO: 526069 - DNA, 25 bp, Mus musculus
agagataaggcggttcaggactatc

SEQ ID NO: 526070 - DNA, 25 bp, Mus musculus
agagataccgccagcaacagccgct

SEQ ID NO: 526071 - DNA, 25 bp, Mus musculus
agagataccgcctgcaacagccgct

SEQ ID NO: 526072 - DNA, 25 bp, Mus musculus
agagatagatcacctacaagaggag

SEQ ID NO: 526073 - DNA, 25 bp, Mus musculus
agagatagatcagctacaagaggag

SEQ ID NO: 526074 - DNA, 25 bp, Mus musculus
agagatagtgacactcgcgcctccg

SEQ ID NO: 526075 - DNA, 25 bp, Mus musculus
agagatagtgactctcgcgcctccg

SEQ ID NO: 526076 - DNA, 25 bp, Mus musculus
agagatcacactagccctgggccat

SEQ ID NO: 526077 - DNA, 25 bp, Mus musculus
agagatcacacttgccctgggccat

SEQ ID NO: 526078 - DNA, 25 bp, Mus musculus
agagatcaccgtcctggagacagga

SEQ ID NO: 526079 - DNA, 25 bp, Mus musculus
agagatcaccgtgctggagacagga

SEQ ID NO: 526080 - DNA, 25 bp, Mus musculus
agagatccgagtcgccgacatcaag

SEQ ID NO: 526081 - DNA, 25 bp, Mus musculus
agagatccgagtggccgacatcaag

SEQ ID NO: 526082 - DNA, 25 bp, Mus musculus
agagatcctgacctgtgcccatgtg

SEQ ID NO: 526083 - DNA, 25 bp, Mus musculus
agagatcctgacgtgtgcccatgtg

SEQ ID NO: 526084 - DNA, 25 bp, Mus musculus
agagatcggcctagcagtttgcaat

SEQ ID NO: 526085 - DNA, 25 bp, Mus musculus
agagatcggccttgcagtttgcaat

SEQ ID NO: 526086 - DNA, 25 bp, Mus musculus
agagatctgccaacctgtgcgcctg

SEQ ID NO: 526087 - DNA, 25 bp, Mus musculus
agagatctgccatcctgtgcgcctg

SEQ ID NO: 526088 - DNA, 25 bp, Mus musculus
agagatgaagggactcctcacactg

SEQ ID NO: 526089 - DNA, 25 bp, Mus musculus
agagatgaagggtctcctcacactg

SEQ ID NO: 526090 - DNA, 25 bp, Mus musculus
agagatgaagtgctgtactacgaca

SEQ ID NO: 526091 - DNA, 25 bp, Mus musculus
agagatgaagtggtgtactacgaca

SEQ ID NO: 526092 - DNA, 25 bp, Mus musculus
agagatgacaagcagcttcggcagc

SEQ ID NO: 526093 - DNA, 25 bp, Mus musculus
agagatgacaaggagcttcggcagc

SEQ ID NO: 526094 - DNA, 25 bp, Mus musculus
agagatgagactaacaagccccacc

SEQ ID NO: 526095 - DNA, 25 bp, Mus musculus
agagatgagacttacaagccccacc

SEQ ID NO: 526096 - DNA, 25 bp, Mus musculus
agagatgatcgacgagatgtaccag

SEQ ID NO: 526097 - DNA, 25 bp, Mus musculus
agagatgatcgaggagatgtaccag

SEQ ID NO: 526098 - DNA, 25 bp, Mus musculus
agagatgcagcaattgcaatgcctt

SEQ ID NO: 526099 - DNA, 25 bp, Mus musculus
agagatgcagcatttgcaatgcctt

SEQ ID NO: 526100 - DNA, 25 bp, Mus musculus
agagatgcagctcttccctctcctg

SEQ ID NO: 526101 - DNA, 25 bp, Mus musculus
agagatgcagctgttccctctcctg

SEQ ID NO: 526102 - DNA, 25 bp, Mus musculus
agagatgccaagagccatctccagc

SEQ ID NO: 526103 - DNA, 25 bp, Mus musculus
agagatgccaagtgccatctccagc

SEQ ID NO: 526104 - DNA, 25 bp, Mus musculus
agagatgcccaacaatgtcgtggca

SEQ ID NO: 526105 - DNA, 25 bp, Mus musculus
agagatgcccaacacctcccatgat

SEQ ID NO: 526106 - DNA, 25 bp, Mus musculus
agagatgcccaagaatgtcgtggca

SEQ ID NO: 526107 - DNA, 25 bp, Mus musculus
agagatgcccaagacctcccatgat

SEQ ID NO: 526108 - DNA, 25 bp, Mus musculus
agagatgccctcaatattccccgaa

SEQ ID NO: 526109 - DNA, 25 bp, Mus musculus
agagatgccctctatattccccgaa

SEQ ID NO: 526110 - DNA, 25 bp, Mus musculus
agagatgctctacctggctactcgt

SEQ ID NO: 526111 - DNA, 25 bp, Mus musculus
agagatgctctagctggctactcgt

SEQ ID NO: 526112 - DNA, 25 bp, Mus musculus
agagatgctcttagcaggcagctac

SEQ ID NO: 526113 - DNA, 25 bp, Mus musculus
agagatgctctttgcaggcagctac

SEQ ID NO: 526114 - DNA, 25 bp, Mus musculus
agagatgctggcaaacccgcgcaag

SEQ ID NO: 526115 - DNA, 25 bp, Mus musculus
agagatgctggctaacccgcgcaag

SEQ ID NO: 526116 - DNA, 25 bp, Mus musculus
agagatggacatcgaacacatcatg

SEQ ID NO: 526117 - DNA, 25 bp, Mus musculus
agagatggacatggaacacatcatg

SEQ ID NO: 526118 - DNA, 25 bp, Mus musculus
agagatggagcaattggagctgtac

SEQ ID NO: 526119 - DNA, 25 bp, Mus musculus
agagatggagcatttggagctgtac

SEQ ID NO: 526120 - DNA, 25 bp, Mus musculus
agagatggcacaaactggcccagca

SEQ ID NO: 526121 - DNA, 25 bp, Mus musculus
agagatggcacatactggcccagca

SEQ ID NO: 526122 - DNA, 25 bp, Mus musculus
agagatggcagcctctgtgcacgcc

SEQ ID NO: 526123 - DNA, 25 bp, Mus musculus
agagatggcagcgtctgtgcacgcc

SEQ ID NO: 526124 - DNA, 25 bp, Mus musculus
agagatggcgacagcaatccggctg

SEQ ID NO: 526125 - DNA, 25 bp, Mus musculus
agagatggcgactgcaatccggctg

SEQ ID NO: 526126 - DNA, 25 bp, Mus musculus
agagatggcggacatgcgggcgagg

SEQ ID NO: 526127 - DNA, 25 bp, Mus musculus
agagatggcggagatgcgggcgagg

SEQ ID NO: 526128 - DNA, 25 bp, Mus musculus
agagatggcttccagctctaataga

SEQ ID NO: 526129 - DNA, 25 bp, Mus musculus
agagatggcttcgagctctaataga

SEQ ID NO: 526130 - DNA, 25 bp, Mus musculus
agagatgtcgatccaaattcaacca

SEQ ID NO: 526131 - DNA, 25 bp, Mus musculus
agagatgtcgatgcaaattcaacca

SEQ ID NO: 526132 - DNA, 25 bp, Mus musculus
agagattagccacacagccaagcag

SEQ ID NO: 526133 - DNA, 25 bp, Mus musculus
agagattagccagacagccaagcag

SEQ ID NO: 526134 - DNA, 25 bp, Mus musculus
agagattcaggcacagaggccctaa

SEQ ID NO: 526135 - DNA, 25 bp, Mus musculus
agagattcaggctcagaggccctaa

SEQ ID NO: 526136 - DNA, 25 bp, Mus musculus
agagattccaaacaagctccaggag

SEQ ID NO: 526137 - DNA, 25 bp, Mus musculus
agagattccaaagaagctccaggag

SEQ ID NO: 526138 - DNA, 25 bp, Mus musculus
agagattcccttagtgtccactgca

SEQ ID NO: 526139 - DNA, 25 bp, Mus musculus
agagattccctttgtgtccactgca

SEQ ID NO: 526140 - DNA, 25 bp, Mus musculus
agagattctagtccgcactggtcac

SEQ ID NO: 526141 - DNA, 25 bp, Mus musculus
agagattctagtgcgcactggtcac

SEQ ID NO: 526142 - DNA, 25 bp, Mus musculus
agagattggctcaggaggccgcaat

SEQ ID NO: 526143 - DNA, 25 bp, Mus musculus
agagattggctctggaggccgcaat

SEQ ID NO: 526144 - DNA, 25 bp, Mus musculus
agagattggtttactttctctcagc

SEQ ID NO: 526145 - DNA, 25 bp, Mus musculus
agagattggttttctttctctcagc

SEQ ID NO: 526146 - DNA, 25 bp, Mus musculus
agagcaaaattgattccgaaatcag

SEQ ID NO: 526147 - DNA, 25 bp, Mus musculus
agagcaaaattgtttccgaaatcag

SEQ ID NO: 526148 - DNA, 25 bp, Mus musculus
agagcaaacgaaccttcatgggaaa

SEQ ID NO: 526149 - DNA, 25 bp, Mus musculus
agagcaaacgaagcttcatgggaaa

SEQ ID NO: 526150 - DNA, 25 bp, Mus musculus
agagcaaagaagagtggcatccgga

SEQ ID NO: 526151 - DNA, 25 bp, Mus musculus
agagcaaagaagtgtggcatccgga

SEQ ID NO: 526152 - DNA, 25 bp, Mus musculus
agagcaaatattcagccatctggag

SEQ ID NO: 526153 - DNA, 25 bp, Mus musculus
agagcaaatattgagccatctggag

SEQ ID NO: 526154 - DNA, 25 bp, Mus musculus
agagcaacaaaccacaacagacatg

SEQ ID NO: 526155 - DNA, 25 bp, Mus musculus
agagcaacaaacgacaacagacatg

SEQ ID NO: 526156 - DNA, 25 bp, Mus musculus
agagcaacgtctcagagccagccaa

SEQ ID NO: 526157 - DNA, 25 bp, Mus musculus
agagcaacgtctgagagccagccaa

SEQ ID NO: 526158 - DNA, 25 bp, Mus musculus
agagcaactcggatgaagatgaggt

SEQ ID NO: 526159 - DNA, 25 bp, Mus musculus
agagcaactcggttgaagatgaggt

SEQ ID NO: 526160 - DNA, 25 bp, Mus musculus
agagcaacttcacgccttcaggaac

SEQ ID NO: 526161 - DNA, 25 bp, Mus musculus
agagcaacttcaggccttcaggaac

SEQ ID NO: 526162 - DNA, 25 bp, Mus musculus
agagcaagacaaccggagaccagag

SEQ ID NO: 526163 - DNA, 25 bp, Mus musculus
agagcaagacaagcggagaccagag

SEQ ID NO: 526164 - DNA, 25 bp, Mus musculus
agagcaagacctaccagagcaaccg

SEQ ID NO: 526165 - DNA, 25 bp, Mus musculus
agagcaagaccttccagagcaaccg

SEQ ID NO: 526166 - DNA, 25 bp, Mus musculus
agagcaagaggaacaacggcggttt

SEQ ID NO: 526167 - DNA, 25 bp, Mus musculus
agagcaagaggatcaacggcggttt

SEQ ID NO: 526168 - DNA, 25 bp, Mus musculus
agagcaagcccaaggagtccttgga

SEQ ID NO: 526169 - DNA, 25 bp, Mus musculus
agagcaagcccatggagtccttgga

SEQ ID NO: 526170 - DNA, 25 bp, Mus musculus
agagcaaggatgaccaagtgacagt

SEQ ID NO: 526171 - DNA, 25 bp, Mus musculus
agagcaaggatgtccaagtgacagt

SEQ ID NO: 526172 - DNA, 25 bp, Mus musculus
agagcaagggaacgctaagaaccct

SEQ ID NO: 526173 - DNA, 25 bp, Mus musculus
agagcaagggaaggctaagaaccct

SEQ ID NO: 526174 - DNA, 25 bp, Mus musculus
agagcaagtccaccatcaagcgggt

SEQ ID NO: 526175 - DNA, 25 bp, Mus musculus
agagcaagtccagcatcaagcgggt

SEQ ID NO: 526176 - DNA, 25 bp, Mus musculus
agagcaatcagcagagccggcccgg

SEQ ID NO: 526177 - DNA, 25 bp, Mus musculus
agagcaatcagctgagccggcccgg

SEQ ID NO: 526178 - DNA, 25 bp, Mus musculus
agagcaatctcaacgtgcaccggcg

SEQ ID NO: 526179 - DNA, 25 bp, Mus musculus
agagcaatctcatcgtgcaccggcg

SEQ ID NO: 526180 - DNA, 25 bp, Mus musculus
agagcacaaacaagtcaacagagac

SEQ ID NO: 526181 - DNA, 25 bp, Mus musculus
agagcacaaacatgtcaacagagac

SEQ ID NO: 526182 - DNA, 25 bp, Mus musculus
agagcacattgtcggctatcatgaa

SEQ ID NO: 526183 - DNA, 25 bp, Mus musculus
agagcacattgtgggctatcatgaa

SEQ ID NO: 526184 - DNA, 25 bp, Mus musculus
agagcaccaagaagtcctttgcagg

SEQ ID NO: 526185 - DNA, 25 bp, Mus musculus
agagcaccaagatgtcctttgcagg

SEQ ID NO: 526186 - DNA, 25 bp, Mus musculus
agagcaccagagctcattctcggca

SEQ ID NO: 526187 - DNA, 25 bp, Mus musculus
agagcaccagaggtcattctcggca

SEQ ID NO: 526188 - DNA, 25 bp, Mus musculus
agagcaccatccacggcgtcctgag

SEQ ID NO: 526189 - DNA, 25 bp, Mus musculus
agagcaccatcctcggcgtcctgag

SEQ ID NO: 526190 - DNA, 25 bp, Mus musculus
agagcacccaggcagctacagcttc

SEQ ID NO: 526191 - DNA, 25 bp, Mus musculus
agagcacccagggagctacagcttc

SEQ ID NO: 526192 - DNA, 25 bp, Mus musculus
agagcacctcatcttgccaccatga

SEQ ID NO: 526193 - DNA, 25 bp, Mus musculus
agagcacctcatgttgccaccatga

SEQ ID NO: 526194 - DNA, 25 bp, Mus musculus
agagcacgctggagagccagaacgc

SEQ ID NO: 526195 - DNA, 25 bp, Mus musculus
agagcacgctggtgagccagaacgc

SEQ ID NO: 526196 - DNA, 25 bp, Mus musculus
agagcacggccccttggatatgagt

SEQ ID NO: 526197 - DNA, 25 bp, Mus musculus
agagcacggcccgttggatatgagt

SEQ ID NO: 526198 - DNA, 25 bp, Mus musculus
agagcacgggcaactgctgcatcca

SEQ ID NO: 526199 - DNA, 25 bp, Mus musculus
agagcacgggcatctgctgcatcca

SEQ ID NO: 526200 - DNA, 25 bp, Mus musculus
agagcactacctctggtacggcaag

SEQ ID NO: 526201 - DNA, 25 bp, Mus musculus
agagcactacctgtggtacggcaag

SEQ ID NO: 526202 - DNA, 25 bp, Mus musculus
agagcactatggacaccgggaaaag

SEQ ID NO: 526203 - DNA, 25 bp, Mus musculus
agagcactatggtcaccgggaaaag

SEQ ID NO: 526204 - DNA, 25 bp, Mus musculus
agagcactgaccccatctattgagg

SEQ ID NO: 526205 - DNA, 25 bp, Mus musculus
agagcactgaccgcatctattgagg

SEQ ID NO: 526206 - DNA, 25 bp, Mus musculus
agagcacttctgacagaacagaacg

SEQ ID NO: 526207 - DNA, 25 bp, Mus musculus
agagcacttctgtcagaacagaacg

SEQ ID NO: 526208 - DNA, 25 bp, Mus musculus
agagcagaaccacccatcaggtgca

SEQ ID NO: 526209 - DNA, 25 bp, Mus musculus
agagcagaaccagccatcaggtgca

SEQ ID NO: 526210 - DNA, 25 bp, Mus musculus
agagcagacgtcctctcggctcacg

SEQ ID NO: 526211 - DNA, 25 bp, Mus musculus
agagcagacgtcgtctcggctcacg

SEQ ID NO: 526212 - DNA, 25 bp, Mus musculus
agagcagactcgcattccagccaga

SEQ ID NO: 526213 - DNA, 25 bp, Mus musculus
agagcagactcggattccagccaga

SEQ ID NO: 526214 - DNA, 25 bp, Mus musculus
agagcagagagacacagtgcccatc

SEQ ID NO: 526215 - DNA, 25 bp, Mus musculus
agagcagagagagacagtgcccatc

SEQ ID NO: 526216 - DNA, 25 bp, Mus musculus
agagcagagcagaagattggcaaaa

SEQ ID NO: 526217 - DNA, 25 bp, Mus musculus
agagcagagcagtagattggcaaaa

SEQ ID NO: 526218 - DNA, 25 bp, Mus musculus
agagcagagcatacacagaggactt

SEQ ID NO: 526219 - DNA, 25 bp, Mus musculus
agagcagagcattcacagaggactt

SEQ ID NO: 526220 - DNA, 25 bp, Mus musculus
agagcagaggagatatgttatacct

SEQ ID NO: 526221 - DNA, 25 bp, Mus musculus
agagcagaggagttatgttatacct

SEQ ID NO: 526222 - DNA, 25 bp, Mus musculus
agagcagagggccttgttcctcttg

SEQ ID NO: 526223 - DNA, 25 bp, Mus musculus
agagcagagggcgttgttcctcttg

SEQ ID NO: 526224 - DNA, 25 bp, Mus musculus
agagcagatgccacatttgtaagga

SEQ ID NO: 526225 - DNA, 25 bp, Mus musculus
agagcagatgcctcatttgtaagga

SEQ ID NO: 526226 - DNA, 25 bp, Mus musculus
agagcagcccgcaagaacaggtcca

SEQ ID NO: 526227 - DNA, 25 bp, Mus musculus
agagcagcccgctagaacaggtcca

SEQ ID NO: 526228 - DNA, 25 bp, Mus musculus
agagcagccttgaccagtctcactg

SEQ ID NO: 526229 - DNA, 25 bp, Mus musculus
agagcagccttgtccagtctcactg

SEQ ID NO: 526230 - DNA, 25 bp, Mus musculus
agagcagctagtagagatgaccggc

SEQ ID NO: 526231 - DNA, 25 bp, Mus musculus
agagcagctagttgagatgaccggc

SEQ ID NO: 526232 - DNA, 25 bp, Mus musculus
agagcagctccgagttcacctcagc

SEQ ID NO: 526233 - DNA, 25 bp, Mus musculus
agagcagctccgtgttcacctcagc

SEQ ID NO: 526234 - DNA, 25 bp, Mus musculus
agagcagctgcacgcatcgtctcct

SEQ ID NO: 526235 - DNA, 25 bp, Mus musculus
agagcagctgcaggcatcgtctcct

SEQ ID NO: 526236 - DNA, 25 bp, Mus musculus
agagcaggacaacccatctaccagt

SEQ ID NO: 526237 - DNA, 25 bp, Mus musculus
agagcaggacaagccatctaccagt

SEQ ID NO: 526238 - DNA, 25 bp, Mus musculus
agagcaggacttctccttcacatca

SEQ ID NO: 526239 - DNA, 25 bp, Mus musculus
agagcaggacttgtccttcacatca

SEQ ID NO: 526240 - DNA, 25 bp, Mus musculus
agagcaggcctgaagccaaagaaaa

SEQ ID NO: 526241 - DNA, 25 bp, Mus musculus
agagcaggcctgtagccaaagaaaa

SEQ ID NO: 526242 - DNA, 25 bp, Mus musculus
agagcagggcctatgagaccacgca

SEQ ID NO: 526243 - DNA, 25 bp, Mus musculus
agagcagggcctttgagaccacgca

SEQ ID NO: 526244 - DNA, 25 bp, Mus musculus
agagcagtcaccattgccaagcagg

SEQ ID NO: 526245 - DNA, 25 bp, Mus musculus
agagcagtcacctttgccaagcagg

SEQ ID NO: 526246 - DNA, 25 bp, Mus musculus
agagcagtgtggaccttgtccatgt

SEQ ID NO: 526247 - DNA, 25 bp, Mus musculus
agagcagtgtggtccttgtccatgt

SEQ ID NO: 526248 - DNA, 25 bp, Mus musculus
agagcagttgagatcaccggcacgg

SEQ ID NO: 526249 - DNA, 25 bp, Mus musculus
agagcagttgagttcaccggcacgg

SEQ ID NO: 526250 - DNA, 25 bp, Mus musculus
agagcatccctgacccctgttgata

SEQ ID NO: 526251 - DNA, 25 bp, Mus musculus
agagcatccctgtcccctgttgata

SEQ ID NO: 526252 - DNA, 25 bp, Mus musculus
agagcatcctgcctgacacgcagct

SEQ ID NO: 526253 - DNA, 25 bp, Mus musculus
agagcatcctgcgtgacacgcagct

SEQ ID NO: 526254 - DNA, 25 bp, Mus musculus
agagcatcctttactttacttatac

SEQ ID NO: 526255 - DNA, 25 bp, Mus musculus
agagcatccttttctttacttatac

SEQ ID NO: 526256 - DNA, 25 bp, Mus musculus
agagcatcgagcatgtccttccgcc

SEQ ID NO: 526257 - DNA, 25 bp, Mus musculus
agagcatcgagcttgtccttccgcc

SEQ ID NO: 526258 - DNA, 25 bp, Mus musculus
agagcatcgtggatgcaggccctgt

SEQ ID NO: 526259 - DNA, 25 bp, Mus musculus
agagcatcgtggttgcaggccctgt

SEQ ID NO: 526260 - DNA, 25 bp, Mus musculus
agagcatctagccatgatggaaagg

SEQ ID NO: 526261 - DNA, 25 bp, Mus musculus
agagcatctagcgatgatggaaagg

SEQ ID NO: 526262 - DNA, 25 bp, Mus musculus
agagcatctcccatatgtctgtggg

SEQ ID NO: 526263 - DNA, 25 bp, Mus musculus
agagcatctcccttatgtctgtggg

SEQ ID NO: 526264 - DNA, 25 bp, Mus musculus
agagcatggcagatgggcagcttca

SEQ ID NO: 526265 - DNA, 25 bp, Mus musculus
agagcatggcagttgggcagcttca

SEQ ID NO: 526266 - DNA, 25 bp, Mus musculus
agagcatggtccactgtcgagaggc

SEQ ID NO: 526267 - DNA, 25 bp, Mus musculus
agagcatggtcctctgtcgagaggc

SEQ ID NO: 526268 - DNA, 25 bp, Mus musculus
agagcattacctcgacctgctggca

SEQ ID NO: 526269 - DNA, 25 bp, Mus musculus
agagcattacctggacctgctggca

SEQ ID NO: 526270 - DNA, 25 bp, Mus musculus
agagcattgccacggacccagggct

SEQ ID NO: 526271 - DNA, 25 bp, Mus musculus
agagcattgccagggacccagggct

SEQ ID NO: 526272 - DNA, 25 bp, Mus musculus
agagcattggacaccccaggactgg

SEQ ID NO: 526273 - DNA, 25 bp, Mus musculus
agagcattggactccccaggactgg

SEQ ID NO: 526274 - DNA, 25 bp, Mus musculus
agagcattgggccagtgctggcaca

SEQ ID NO: 526275 - DNA, 25 bp, Mus musculus
agagcattgggcgagtgctggcaca

SEQ ID NO: 526276 - DNA, 25 bp, Mus musculus
agagcatttcaacaggaggactccc

SEQ ID NO: 526277 - DNA, 25 bp, Mus musculus
agagcatttcaagaggaggactccc

SEQ ID NO: 526278 - DNA, 25 bp, Mus musculus
agagccaacccactgatgattacgt

SEQ ID NO: 526279 - DNA, 25 bp, Mus musculus
agagccaacccagtgatgattacgt

SEQ ID NO: 526280 - DNA, 25 bp, Mus musculus
agagccaccagaatgtgttgtggac

SEQ ID NO: 526281 - DNA, 25 bp, Mus musculus
agagccaccagattgtgttgtggac

SEQ ID NO: 526282 - DNA, 25 bp, Mus musculus
agagccaccatgacccgctggacgt

SEQ ID NO: 526283 - DNA, 25 bp, Mus musculus
agagccaccatgtcccgctggacgt

SEQ ID NO: 526284 - DNA, 25 bp, Mus musculus
agagccactatcaggagcggtgcca

SEQ ID NO: 526285 - DNA, 25 bp, Mus musculus
agagccactatctggagcggtgcca

SEQ ID NO: 526286 - DNA, 25 bp, Mus musculus
agagccagactgctttcctatctcc

SEQ ID NO: 526287 - DNA, 25 bp, Mus musculus
agagccagactggtttcctatctcc

SEQ ID NO: 526288 - DNA, 25 bp, Mus musculus
agagccagagtcactcaccatcgcc

SEQ ID NO: 526289 - DNA, 25 bp, Mus musculus
agagccagagtctctcaccatcgcc

SEQ ID NO: 526290 - DNA, 25 bp, Mus musculus
agagccagctgcatcgatccagagg

SEQ ID NO: 526291 - DNA, 25 bp, Mus musculus
agagccagctgcttcgatccagagg

SEQ ID NO: 526292 - DNA, 25 bp, Mus musculus
agagccaggaggcaccaaagcaaga

SEQ ID NO: 526293 - DNA, 25 bp, Mus musculus
agagccaggagggaccaaagcaaga

SEQ ID NO: 526294 - DNA, 25 bp, Mus musculus
agagccaggatgaggtaaaacaggc

SEQ ID NO: 526295 - DNA, 25 bp, Mus musculus
agagccaggatgtggtaaaacaggc

SEQ ID NO: 526296 - DNA, 25 bp, Mus musculus
agagccaggtggacttctccgcaga

SEQ ID NO: 526297 - DNA, 25 bp, Mus musculus
agagccaggtggtcttctccgcaga

SEQ ID NO: 526298 - DNA, 25 bp, Mus musculus
agagccatagctcccaaggtgcaaa

SEQ ID NO: 526299 - DNA, 25 bp, Mus musculus
agagccatagctgccaaggtgcaaa

SEQ ID NO: 526300 - DNA, 25 bp, Mus musculus
agagccatgatgatccaaaggatga

SEQ ID NO: 526301 - DNA, 25 bp, Mus musculus
agagccatgatgttccaaaggatga

SEQ ID NO: 526302 - DNA, 25 bp, Mus musculus
agagccatggacagtcaccctttgg

SEQ ID NO: 526303 - DNA, 25 bp, Mus musculus
agagccatggactgtcaccctttgg

SEQ ID NO: 526304 - DNA, 25 bp, Mus musculus
agagccatttgaacgccatgcaccc

SEQ ID NO: 526305 - DNA, 25 bp, Mus musculus
agagccatttgatcgccatgcaccc

SEQ ID NO: 526306 - DNA, 25 bp, Mus musculus
agagcccagaagaccagaaagccct

SEQ ID NO: 526307 - DNA, 25 bp, Mus musculus
agagcccagaagtccagaaagccct

SEQ ID NO: 526308 - DNA, 25 bp, Mus musculus
agagcccagactacctggatattac

SEQ ID NO: 526309 - DNA, 25 bp, Mus musculus
agagcccagacttcctggatattac

SEQ ID NO: 526310 - DNA, 25 bp, Mus musculus
agagcccagcccatcaggtcagcgt

SEQ ID NO: 526311 - DNA, 25 bp, Mus musculus
agagcccagcccttcaggtcagcgt

SEQ ID NO: 526312 - DNA, 25 bp, Mus musculus
agagcccagctaaagcccagggccg

SEQ ID NO: 526313 - DNA, 25 bp, Mus musculus
agagcccagctatagcccagggccg

SEQ ID NO: 526314 - DNA, 25 bp, Mus musculus
agagccccggctcgacagtgagacc

SEQ ID NO: 526315 - DNA, 25 bp, Mus musculus
agagccccggctggacagtgagacc

SEQ ID NO: 526316 - DNA, 25 bp, Mus musculus
agagccccgtctctgtgcagctggc

SEQ ID NO: 526317 - DNA, 25 bp, Mus musculus
agagccccgtctgtgtgcagctggc

SEQ ID NO: 526318 - DNA, 25 bp, Mus musculus
agagcccgaggcagctcctcgcaga

SEQ ID NO: 526319 - DNA, 25 bp, Mus musculus
agagcccgaggctgctcctcgcaga

SEQ ID NO: 526320 - DNA, 25 bp, Mus musculus
agagcccgagtacagtctacctgga

SEQ ID NO: 526321 - DNA, 25 bp, Mus musculus
agagcccgagtagagtctacctgga

SEQ ID NO: 526322 - DNA, 25 bp, Mus musculus
agagcccggcagagcccatgcagac

SEQ ID NO: 526323 - DNA, 25 bp, Mus musculus
agagcccggcagtgcccatgcagac

SEQ ID NO: 526324 - DNA, 25 bp, Mus musculus
agagcccgggctactacaggaacgt

SEQ ID NO: 526325 - DNA, 25 bp, Mus musculus
agagcccgggcttctacaggaacgt

SEQ ID NO: 526326 - DNA, 25 bp, Mus musculus
agagccctatgcactggtgagaagg

SEQ ID NO: 526327 - DNA, 25 bp, Mus musculus
agagccctatgctctggtgagaagg

SEQ ID NO: 526328 - DNA, 25 bp, Mus musculus
agagccctcaaccaactttctgtgc

SEQ ID NO: 526329 - DNA, 25 bp, Mus musculus
agagccctcaacgaactttctgtgc

SEQ ID NO: 526330 - DNA, 25 bp, Mus musculus
agagccctcagtcgtcattgtgtcc

SEQ ID NO: 526331 - DNA, 25 bp, Mus musculus
agagccctcagtggtcattgtgtcc

SEQ ID NO: 526332 - DNA, 25 bp, Mus musculus
agagcccttccgactgtttccagac

SEQ ID NO: 526333 - DNA, 25 bp, Mus musculus
agagcccttccgtctgtttccagac

SEQ ID NO: 526334 - DNA, 25 bp, Mus musculus
agagcccttctgacagcccgtaaga

SEQ ID NO: 526335 - DNA, 25 bp, Mus musculus
agagcccttctgtcagcccgtaaga

SEQ ID NO: 526336 - DNA, 25 bp, Mus musculus
agagccgattgcctcgcgggacaac

SEQ ID NO: 526337 - DNA, 25 bp, Mus musculus
agagccgattgcgtcgcgggacaac

SEQ ID NO: 526338 - DNA, 25 bp, Mus musculus
agagccgccagcaggtgtgtgacct

SEQ ID NO: 526339 - DNA, 25 bp, Mus musculus
agagccgccagctggtgtgtgacct

SEQ ID NO: 526340 - DNA, 25 bp, Mus musculus
agagccgccctacgacggaaaaatg

SEQ ID NO: 526341 - DNA, 25 bp, Mus musculus
agagccgccctaggacggaaaaatg

SEQ ID NO: 526342 - DNA, 25 bp, Mus musculus
agagccgcctacctgacagcagggt

SEQ ID NO: 526343 - DNA, 25 bp, Mus musculus
agagccgcctacgtgacagcagggt

SEQ ID NO: 526344 - DNA, 25 bp, Mus musculus
agagccgcgagcagtccaactccgg

SEQ ID NO: 526345 - DNA, 25 bp, Mus musculus
agagccgcgagctgtccaactccgg

SEQ ID NO: 526346 - DNA, 25 bp, Mus musculus
agagccggcctgctggattgccata

SEQ ID NO: 526347 - DNA, 25 bp, Mus musculus
agagccggcctggtggattgccata

SEQ ID NO: 526348 - DNA, 25 bp, Mus musculus
agagccgggctacctcacactcgga

SEQ ID NO: 526349 - DNA, 25 bp, Mus musculus
agagccgggctagctcacactcgga

SEQ ID NO: 526350 - DNA, 25 bp, Mus musculus
agagccgtacccacgaagacctctt

SEQ ID NO: 526351 - DNA, 25 bp, Mus musculus
agagccgtaccctcgaagacctctt

SEQ ID NO: 526352 - DNA, 25 bp, Mus musculus
agagccgtattcctttacactttgg

SEQ ID NO: 526353 - DNA, 25 bp, Mus musculus
agagccgtattcgtttacactttgg

SEQ ID NO: 526354 - DNA, 25 bp, Mus musculus
agagccgtccctcagtgctacgagg

SEQ ID NO: 526355 - DNA, 25 bp, Mus musculus
agagccgtccctgagtgctacgagg

SEQ ID NO: 526356 - DNA, 25 bp, Mus musculus
agagccgtttggaggctgccaccaa

SEQ ID NO: 526357 - DNA, 25 bp, Mus musculus
agagccgtttggtggctgccaccaa

SEQ ID NO: 526358 - DNA, 25 bp, Mus musculus
agagccgtttttctattctaagcag

SEQ ID NO: 526359 - DNA, 25 bp, Mus musculus
agagccgtttttgtattctaagcag

SEQ ID NO: 526360 - DNA, 25 bp, Mus musculus
agagcctacctgatcacagctccag

SEQ ID NO: 526361 - DNA, 25 bp, Mus musculus
agagcctacctgttcacagctccag

SEQ ID NO: 526362 - DNA, 25 bp, Mus musculus
agagcctcaaagcactgccatggca

SEQ ID NO: 526363 - DNA, 25 bp, Mus musculus
agagcctcaaaggactgccatggca

SEQ ID NO: 526364 - DNA, 25 bp, Mus musculus
agagcctcaagacatgtgagtagct

SEQ ID NO: 526365 - DNA, 25 bp, Mus musculus
agagcctcaagagatgtgagtagct

SEQ ID NO: 526366 - DNA, 25 bp, Mus musculus
agagcctcaggcaccggcttggagc

SEQ ID NO: 526367 - DNA, 25 bp, Mus musculus
agagcctcaggctccggcttggagc

SEQ ID NO: 526368 - DNA, 25 bp, Mus musculus
agagcctcccatcaaatcagaacag

SEQ ID NO: 526369 - DNA, 25 bp, Mus musculus
agagcctcccatgaaatcagaacag

SEQ ID NO: 526370 - DNA, 25 bp, Mus musculus
agagcctccggcaggagtacctgca

SEQ ID NO: 526371 - DNA, 25 bp, Mus musculus
agagcctccggctggagtacctgca

SEQ ID NO: 526372 - DNA, 25 bp, Mus musculus
agagcctcgaggaattgggcacccc

SEQ ID NO: 526373 - DNA, 25 bp, Mus musculus
agagcctcgaggtattgggcacccc

SEQ ID NO: 526374 - DNA, 25 bp, Mus musculus
agagcctcggcaagtctccatgcag

SEQ ID NO: 526375 - DNA, 25 bp, Mus musculus
agagcctcggcatgtctccatgcag

SEQ ID NO: 526376 - DNA, 25 bp, Mus musculus
agagcctctaaacctccctcagcaa

SEQ ID NO: 526377 - DNA, 25 bp, Mus musculus
agagcctctaaagctccctcagcaa

SEQ ID NO: 526378 - DNA, 25 bp, Mus musculus
agagcctctgcaagtgtttgcgccc

SEQ ID NO: 526379 - DNA, 25 bp, Mus musculus
agagcctctgcatgtgtttgcgccc

SEQ ID NO: 526380 - DNA, 25 bp, Mus musculus
agagcctgacctaggctttgttgtg

SEQ ID NO: 526381 - DNA, 25 bp, Mus musculus
agagcctgaccttggctttgttgtg

SEQ ID NO: 526382 - DNA, 25 bp, Mus musculus
agagcctgaggcagccatcaaactg

SEQ ID NO: 526383 - DNA, 25 bp, Mus musculus
agagcctgaggctgccatcaaactg

SEQ ID NO: 526384 - DNA, 25 bp, Mus musculus
agagcctgcaaacaagtttgcccag

SEQ ID NO: 526385 - DNA, 25 bp, Mus musculus
agagcctgcaaagaagtttgcccag

SEQ ID NO: 526386 - DNA, 25 bp, Mus musculus
agagcctgcatgagtttgtccttgg

SEQ ID NO: 526387 - DNA, 25 bp, Mus musculus
agagcctgcatgtgtttgtccttgg

SEQ ID NO: 526388 - DNA, 25 bp, Mus musculus
agagcctggaacacccctagtcctt

SEQ ID NO: 526389 - DNA, 25 bp, Mus musculus
agagcctggaactcccctagtcctt

SEQ ID NO: 526390 - DNA, 25 bp, Mus musculus
agagcctggacaagaaggtccccga

SEQ ID NO: 526391 - DNA, 25 bp, Mus musculus
agagcctggacatgaaggtccccga

SEQ ID NO: 526392 - DNA, 25 bp, Mus musculus
agagcctggatacgagaccctgccc

SEQ ID NO: 526393 - DNA, 25 bp, Mus musculus
agagcctggataggagaccctgccc

SEQ ID NO: 526394 - DNA, 25 bp, Mus musculus
agagcctggcgcagcaggtcagctc

SEQ ID NO: 526395 - DNA, 25 bp, Mus musculus
agagcctggcgctgcaggtcagctc

SEQ ID NO: 526396 - DNA, 25 bp, Mus musculus
agagcctgggcacccggaacttcat

SEQ ID NO: 526397 - DNA, 25 bp, Mus musculus
agagcctgggcagccggaacttcat

SEQ ID NO: 526398 - DNA, 25 bp, Mus musculus
agagcctggtcgacctggttcccca

SEQ ID NO: 526399 - DNA, 25 bp, Mus musculus
agagcctggtcgtcctggttcccca

SEQ ID NO: 526400 - DNA, 25 bp, Mus musculus
agagcctggtgcagaccatccggga

SEQ ID NO: 526401 - DNA, 25 bp, Mus musculus
agagcctggtgccaaccttcaggga

SEQ ID NO: 526402 - DNA, 25 bp, Mus musculus
agagcctggtgcgaaccttcaggga

SEQ ID NO: 526403 - DNA, 25 bp, Mus musculus
agagcctggtgctgaccatccggga

SEQ ID NO: 526404 - DNA, 25 bp, Mus musculus
agagcctgtatgaggcagaatacca

SEQ ID NO: 526405 - DNA, 25 bp, Mus musculus
agagcctgtatgtggcagaatacca

SEQ ID NO: 526406 - DNA, 25 bp, Mus musculus
agagcctgtcccacaccattgagtg

SEQ ID NO: 526407 - DNA, 25 bp, Mus musculus
agagcctgtccctcaccattgagtg

SEQ ID NO: 526408 - DNA, 25 bp, Mus musculus
agagccttccgcagctgctcaacca

SEQ ID NO: 526409 - DNA, 25 bp, Mus musculus
agagccttccgctgctgctcaacca

SEQ ID NO: 526410 - DNA, 25 bp, Mus musculus
agagccttcgagatcttctccgcct

SEQ ID NO: 526411 - DNA, 25 bp, Mus musculus
agagccttcgagcacgtgtttgaga

SEQ ID NO: 526412 - DNA, 25 bp, Mus musculus
agagccttcgaggacgtgtttgaga

SEQ ID NO: 526413 - DNA, 25 bp, Mus musculus
agagccttcgagttcttctccgcct

SEQ ID NO: 526414 - DNA, 25 bp, Mus musculus
agagccttttggacaggaaggaagt

SEQ ID NO: 526415 - DNA, 25 bp, Mus musculus
agagccttttggtcaggaaggaagt

SEQ ID NO: 526416 - DNA, 25 bp, Mus musculus
agagcgaagtcaaggccctgtgcgc

SEQ ID NO: 526417 - DNA, 25 bp, Mus musculus
agagcgaagtcatggccctgtgcgc

SEQ ID NO: 526418 - DNA, 25 bp, Mus musculus
agagcgacctgtcaggcccttggcc

SEQ ID NO: 526419 - DNA, 25 bp, Mus musculus
agagcgacctgtgaggcccttggcc

SEQ ID NO: 526420 - DNA, 25 bp, Mus musculus
agagcgagagcccaggaccttaagt

SEQ ID NO: 526421 - DNA, 25 bp, Mus musculus
agagcgagagccgaggaccttaagt

SEQ ID NO: 526422 - DNA, 25 bp, Mus musculus
agagcgagcgagaacccgaacgctc

SEQ ID NO: 526423 - DNA, 25 bp, Mus musculus
agagcgagcgagtacccgaacgctc

SEQ ID NO: 526424 - DNA, 25 bp, Mus musculus
agagcgagcgcaaagagaagctgac

SEQ ID NO: 526425 - DNA, 25 bp, Mus musculus
agagcgagcgcatagagaagctgac

SEQ ID NO: 526426 - DNA, 25 bp, Mus musculus
agagcgaggactcggccctcaacat

SEQ ID NO: 526427 - DNA, 25 bp, Mus musculus
agagcgaggactgggccctcaacat

SEQ ID NO: 526428 - DNA, 25 bp, Mus musculus
agagcgatatggcagaagaacatga

SEQ ID NO: 526429 - DNA, 25 bp, Mus musculus
agagcgatatgggagaagaacatga

SEQ ID NO: 526430 - DNA, 25 bp, Mus musculus
agagcgcaagttagtccaccgggac

SEQ ID NO: 526431 - DNA, 25 bp, Mus musculus
agagcgcaagtttgtccaccgggac

SEQ ID NO: 526432 - DNA, 25 bp, Mus musculus
agagcgcagtgtactaagggccaca

SEQ ID NO: 526433 - DNA, 25 bp, Mus musculus
agagcgcagtgttctaagggccaca

SEQ ID NO: 526434 - DNA, 25 bp, Mus musculus
agagcgcccactccctaacggagag

SEQ ID NO: 526435 - DNA, 25 bp, Mus musculus
agagcgcccactgcctaacggagag

SEQ ID NO: 526436 - DNA, 25 bp, Mus musculus
agagcgccgactagctgcccagttg

SEQ ID NO: 526437 - DNA, 25 bp, Mus musculus
agagcgccgacttgctgcccagttg

SEQ ID NO: 526438 - DNA, 25 bp, Mus musculus
agagcgcctctgaggtggagacaca

SEQ ID NO: 526439 - DNA, 25 bp, Mus musculus
agagcgcctctgtggtggagacaca

SEQ ID NO: 526440 - DNA, 25 bp, Mus musculus
agagcgcgagcgacactggtgtctc

SEQ ID NO: 526441 - DNA, 25 bp, Mus musculus
agagcgcgagcgtcactggtgtctc

SEQ ID NO: 526442 - DNA, 25 bp, Mus musculus
agagcgcggagcagggatccacttc

SEQ ID NO: 526443 - DNA, 25 bp, Mus musculus
agagcgcggagctgggatccacttc

SEQ ID NO: 526444 - DNA, 25 bp, Mus musculus
agagcgctgccaacaaccagatcct

SEQ ID NO: 526445 - DNA, 25 bp, Mus musculus
agagcgctgccatcaaccagatcct

SEQ ID NO: 526446 - DNA, 25 bp, Mus musculus
agagcgctgtttctcatccccagaa

SEQ ID NO: 526447 - DNA, 25 bp, Mus musculus
agagcgctgtttgtcatccccagaa

SEQ ID NO: 526448 - DNA, 25 bp, Mus musculus
agagcggaagtcactccgtgaggca

SEQ ID NO: 526449 - DNA, 25 bp, Mus musculus
agagcggaagtctctccgtgaggca

SEQ ID NO: 526450 - DNA, 25 bp, Mus musculus
agagcggaccacagcctagcgccga

SEQ ID NO: 526451 - DNA, 25 bp, Mus musculus
agagcggaccactgcctagcgccga

SEQ ID NO: 526452 - DNA, 25 bp, Mus musculus
agagcggcgaacatgttcaagatgg

SEQ ID NO: 526453 - DNA, 25 bp, Mus musculus
agagcggcgaacttgttcaagatgg

SEQ ID NO: 526454 - DNA, 25 bp, Mus musculus
agagcggcgcggatggatccaacat

SEQ ID NO: 526455 - DNA, 25 bp, Mus musculus
agagcggcgcggttggatccaacat

SEQ ID NO: 526456 - DNA, 25 bp, Mus musculus
agagcggctgccagctgactaccac

SEQ ID NO: 526457 - DNA, 25 bp, Mus musculus
agagcggctgcctgctgactaccac

SEQ ID NO: 526458 - DNA, 25 bp, Mus musculus
agagcggctgctactctcgcgagga

SEQ ID NO: 526459 - DNA, 25 bp, Mus musculus
agagcggctgcttctctcgcgagga

SEQ ID NO: 526460 - DNA, 25 bp, Mus musculus
agagcgggactacggcccgcccatt

SEQ ID NO: 526461 - DNA, 25 bp, Mus musculus
agagcgggactagggcccgcccatt

SEQ ID NO: 526462 - DNA, 25 bp, Mus musculus
agagcgggtcatatgtgcactgttc

SEQ ID NO: 526463 - DNA, 25 bp, Mus musculus
agagcgggtcatttgtgcactgttc

SEQ ID NO: 526464 - DNA, 25 bp, Mus musculus
agagcgtgggaccaagcctccctta

SEQ ID NO: 526465 - DNA, 25 bp, Mus musculus
agagcgtgggacgaagcctccctta

SEQ ID NO: 526466 - DNA, 25 bp, Mus musculus
agagcgtgggccacgtacagcagca

SEQ ID NO: 526467 - DNA, 25 bp, Mus musculus
agagcgtgggcctcgtacagcagca

SEQ ID NO: 526468 - DNA, 25 bp, Mus musculus
agagcgttacatcggtctcccaatt

SEQ ID NO: 526469 - DNA, 25 bp, Mus musculus
agagcgttacatgggtctcccaatt

SEQ ID NO: 526470 - DNA, 25 bp, Mus musculus
agagcgttcactcagacagcggaga

SEQ ID NO: 526471 - DNA, 25 bp, Mus musculus
agagcgttcactgagacagcggaga

SEQ ID NO: 526472 - DNA, 25 bp, Mus musculus
agagcgttgggcatacctcactgct

SEQ ID NO: 526473 - DNA, 25 bp, Mus musculus
agagcgttgggcttacctcactgct

SEQ ID NO: 526474 - DNA, 25 bp, Mus musculus
agagctaaaggcagagttaattcag

SEQ ID NO: 526475 - DNA, 25 bp, Mus musculus
agagctaaaggctgagttaattcag

SEQ ID NO: 526476 - DNA, 25 bp, Mus musculus
agagctacacatcacttccagtcca

SEQ ID NO: 526477 - DNA, 25 bp, Mus musculus
agagctacacatgacttccagtcca

SEQ ID NO: 526478 - DNA, 25 bp, Mus musculus
agagctacagctcgcgcagcacact

SEQ ID NO: 526479 - DNA, 25 bp, Mus musculus
agagctacagctggcgcagcacact

SEQ ID NO: 526480 - DNA, 25 bp, Mus musculus
agagctaccgtgacccctttggctc

SEQ ID NO: 526481 - DNA, 25 bp, Mus musculus
agagctaccgtgtcccctttggctc

SEQ ID NO: 526482 - DNA, 25 bp, Mus musculus
agagctacggaaccactagtgtgca

SEQ ID NO: 526483 - DNA, 25 bp, Mus musculus
agagctacggaagcactagtgtgca

SEQ ID NO: 526484 - DNA, 25 bp, Mus musculus
agagctacgggacagcagcatgtaa

SEQ ID NO: 526485 - DNA, 25 bp, Mus musculus
agagctacgggagagcagcatgtaa

SEQ ID NO: 526486 - DNA, 25 bp, Mus musculus
agagctaggaatccattctatgcgt

SEQ ID NO: 526487 - DNA, 25 bp, Mus musculus
agagctaggaatgcattctatgcgt

SEQ ID NO: 526488 - DNA, 25 bp, Mus musculus
agagctagggcgcacctaagtcaaa

SEQ ID NO: 526489 - DNA, 25 bp, Mus musculus
agagctagggcggacctaagtcaaa

SEQ ID NO: 526490 - DNA, 25 bp, Mus musculus
agagctatcacacgttcattttaac

SEQ ID NO: 526491 - DNA, 25 bp, Mus musculus
agagctatcacaggttcattttaac

SEQ ID NO: 526492 - DNA, 25 bp, Mus musculus
agagctatcgacattggcccgagta

SEQ ID NO: 526493 - DNA, 25 bp, Mus musculus
agagctatcgactttggcccgagta

SEQ ID NO: 526494 - DNA, 25 bp, Mus musculus
agagctatgccgcaaagactcccag

SEQ ID NO: 526495 - DNA, 25 bp, Mus musculus
agagctatgccggaaagactcccag

SEQ ID NO: 526496 - DNA, 25 bp, Mus musculus
agagctatgcgactctgttttcaaa

SEQ ID NO: 526497 - DNA, 25 bp, Mus musculus
agagctatgcgagtctgttttcaaa

SEQ ID NO: 526498 - DNA, 25 bp, Mus musculus
agagctatgcgtatgatggttctca

SEQ ID NO: 526499 - DNA, 25 bp, Mus musculus
agagctatgcgtttgatggttctca

SEQ ID NO: 526500 - DNA, 25 bp, Mus musculus
agagctcaaggacaccaccatgtgc

SEQ ID NO: 526501 - DNA, 25 bp, Mus musculus
agagctcaaggagaccaccatgtgc

SEQ ID NO: 526502 - DNA, 25 bp, Mus musculus
agagctcacgggagacgcgactccc

SEQ ID NO: 526503 - DNA, 25 bp, Mus musculus
agagctcacgggtgacgcgactccc

SEQ ID NO: 526504 - DNA, 25 bp, Mus musculus
agagctcagggcaagcacaggcctt

SEQ ID NO: 526505 - DNA, 25 bp, Mus musculus
agagctcagggctagcacaggcctt

SEQ ID NO: 526506 - DNA, 25 bp, Mus musculus
agagctccaagcacccttgggccaa

SEQ ID NO: 526507 - DNA, 25 bp, Mus musculus
agagctccaagctcccttgggccaa

SEQ ID NO: 526508 - DNA, 25 bp, Mus musculus
agagctcccgacaagcaggccgctg

SEQ ID NO: 526509 - DNA, 25 bp, Mus musculus
agagctcccgactagcaggccgctg

SEQ ID NO: 526510 - DNA, 25 bp, Mus musculus
agagctccctgaaccgagcagcaaa

SEQ ID NO: 526511 - DNA, 25 bp, Mus musculus
agagctccctgatccgagcagcaaa

SEQ ID NO: 526512 - DNA, 25 bp, Mus musculus
agagctccgtacaaccaggttcgca

SEQ ID NO: 526513 - DNA, 25 bp, Mus musculus
agagctccgtactaccaggttcgca

SEQ ID NO: 526514 - DNA, 25 bp, Mus musculus
agagctcctgaacttcgtgaaccgg

SEQ ID NO: 526515 - DNA, 25 bp, Mus musculus
agagctcctgaagttcgtgaaccgg

SEQ ID NO: 526516 - DNA, 25 bp, Mus musculus
agagctcctgtgaccaaggtcaggt

SEQ ID NO: 526517 - DNA, 25 bp, Mus musculus
agagctcctgtgactacaaccccat

SEQ ID NO: 526518 - DNA, 25 bp, Mus musculus
agagctcctgtgtccaaggtcaggt

SEQ ID NO: 526519 - DNA, 25 bp, Mus musculus
agagctcctgtgtctacaaccccat

SEQ ID NO: 526520 - DNA, 25 bp, Mus musculus
agagctccttgcacagggctcgcgg

SEQ ID NO: 526521 - DNA, 25 bp, Mus musculus
agagctccttgctcagggctcgcgg

SEQ ID NO: 526522 - DNA, 25 bp, Mus musculus
agagctcggagcaccggcctgcagt

SEQ ID NO: 526523 - DNA, 25 bp, Mus musculus
agagctcggagctccggcctgcagt

SEQ ID NO: 526524 - DNA, 25 bp, Mus musculus
agagctctacatcccagatgtgtgg

SEQ ID NO: 526525 - DNA, 25 bp, Mus musculus
agagctctacatgccagatgtgtgg

SEQ ID NO: 526526 - DNA, 25 bp, Mus musculus
agagctctgccgagggcacgtctgc

SEQ ID NO: 526527 - DNA, 25 bp, Mus musculus
agagctctgccgtgggcacgtctgc

SEQ ID NO: 526528 - DNA, 25 bp, Mus musculus
agagctctgcggataaagagagact

SEQ ID NO: 526529 - DNA, 25 bp, Mus musculus
agagctctgcggatgctcgaactcc

SEQ ID NO: 526530 - DNA, 25 bp, Mus musculus
agagctctgcggttaaagagagact

SEQ ID NO: 526531 - DNA, 25 bp, Mus musculus
agagctctgcggttgctcgaactcc

SEQ ID NO: 526532 - DNA, 25 bp, Mus musculus
agagctctgggacaggaagtatccc

SEQ ID NO: 526533 - DNA, 25 bp, Mus musculus
agagctctgggagaggaagtatccc

SEQ ID NO: 526534 - DNA, 25 bp, Mus musculus
agagctctgtaaagtgccgatggca

SEQ ID NO: 526535 - DNA, 25 bp, Mus musculus
agagctctgtaatgtgccgatggca

SEQ ID NO: 526536 - DNA, 25 bp, Mus musculus
agagctctgtgtcggatgtctatca

SEQ ID NO: 526537 - DNA, 25 bp, Mus musculus
agagctctgtgtgggatgtctatca

SEQ ID NO: 526538 - DNA, 25 bp, Mus musculus
agagctcttctaccggaagctgacg

SEQ ID NO: 526539 - DNA, 25 bp, Mus musculus
agagctcttctagcggaagctgacg

SEQ ID NO: 526540 - DNA, 25 bp, Mus musculus
agagctgaaaatccctgtgtgccac

SEQ ID NO: 526541 - DNA, 25 bp, Mus musculus
agagctgaaaatgcctgtgtgccac

SEQ ID NO: 526542 - DNA, 25 bp, Mus musculus
agagctgaaatgacggtgttcgtgc

SEQ ID NO: 526543 - DNA, 25 bp, Mus musculus
agagctgaaatgtcggtgttcgtgc

SEQ ID NO: 526544 - DNA, 25 bp, Mus musculus
agagctgaagataagagagcaggaa

SEQ ID NO: 526545 - DNA, 25 bp, Mus musculus
agagctgaagattagagagcaggaa

SEQ ID NO: 526546 - DNA, 25 bp, Mus musculus
agagctgaagcacacggtctggcaa

SEQ ID NO: 526547 - DNA, 25 bp, Mus musculus
agagctgaagcagacggtctggcaa

SEQ ID NO: 526548 - DNA, 25 bp, Mus musculus
agagctgaaggaaaccgatctgggc

SEQ ID NO: 526549 - DNA, 25 bp, Mus musculus
agagctgaaggataccgatctgggc

SEQ ID NO: 526550 - DNA, 25 bp, Mus musculus
agagctgagcatatctctctggcag

SEQ ID NO: 526551 - DNA, 25 bp, Mus musculus
agagctgagcatttctctctggcag

SEQ ID NO: 526552 - DNA, 25 bp, Mus musculus
agagctgaggttcagtgaatactgg

SEQ ID NO: 526553 - DNA, 25 bp, Mus musculus
agagctgaggttgagtgaatactgg

SEQ ID NO: 526554 - DNA, 25 bp, Mus musculus
agagctgagtgcacaggcgcccaca

SEQ ID NO: 526555 - DNA, 25 bp, Mus musculus
agagctgagtgctcaggcgcccaca

SEQ ID NO: 526556 - DNA, 25 bp, Mus musculus
agagctgatgtaatccagggcctgg

SEQ ID NO: 526557 - DNA, 25 bp, Mus musculus
agagctgatgtattccagggcctgg

SEQ ID NO: 526558 - DNA, 25 bp, Mus musculus
agagctgccagaattccagcttaac

SEQ ID NO: 526559 - DNA, 25 bp, Mus musculus
agagctgccagatttccagcttaac

SEQ ID NO: 526560 - DNA, 25 bp, Mus musculus
agagctgcgagaagattccatcaga

SEQ ID NO: 526561 - DNA, 25 bp, Mus musculus
agagctgcgagatgattccatcaga

SEQ ID NO: 526562 - DNA, 25 bp, Mus musculus
agagctgcgagtcgtgccagactct

SEQ ID NO: 526563 - DNA, 25 bp, Mus musculus
agagctgcgagtggtgccagactct

SEQ ID NO: 526564 - DNA, 25 bp, Mus musculus
agagctgcgggcagtatggcttccc

SEQ ID NO: 526565 - DNA, 25 bp, Mus musculus
agagctgcgggctgtatggcttccc

SEQ ID NO: 526566 - DNA, 25 bp, Mus musculus
agagctgcggtcatctttgcggata

SEQ ID NO: 526567 - DNA, 25 bp, Mus musculus
agagctgcggtcttctttgcggata

SEQ ID NO: 526568 - DNA, 25 bp, Mus musculus
agagctgcgtcaacacctacctggc

SEQ ID NO: 526569 - DNA, 25 bp, Mus musculus
agagctgcgtcatcacctacctggc

SEQ ID NO: 526570 - DNA, 25 bp, Mus musculus
agagctgctgacaacgtcgtgggat

SEQ ID NO: 526571 - DNA, 25 bp, Mus musculus
agagctgctgactacgtcgtgggat

SEQ ID NO: 526572 - DNA, 25 bp, Mus musculus
agagctgcttttcaatatgattccg

SEQ ID NO: 526573 - DNA, 25 bp, Mus musculus
agagctgcttttgaatatgattccg

SEQ ID NO: 526574 - DNA, 25 bp, Mus musculus
agagctggaagaagccatagaaagg

SEQ ID NO: 526575 - DNA, 25 bp, Mus musculus
agagctggaagatgccatagaaagg

SEQ ID NO: 526576 - DNA, 25 bp, Mus musculus
agagctggacgtagacggaagaaaa

SEQ ID NO: 526577 - DNA, 25 bp, Mus musculus
agagctggacgttgacggaagaaaa

SEQ ID NO: 526578 - DNA, 25 bp, Mus musculus
agagctggagaaactccgtgctgct

SEQ ID NO: 526579 - DNA, 25 bp, Mus musculus
agagctggagaatctccgtgctgct

SEQ ID NO: 526580 - DNA, 25 bp, Mus musculus
agagctggcagactacacggccaag

SEQ ID NO: 526581 - DNA, 25 bp, Mus musculus
agagctggcagagtacacggccaag

SEQ ID NO: 526582 - DNA, 25 bp, Mus musculus
agagctggctacagcaagaaggatg

SEQ ID NO: 526583 - DNA, 25 bp, Mus musculus
agagctggctactgcaagaaggatg

SEQ ID NO: 526584 - DNA, 25 bp, Mus musculus
agagctgtcagtctgtggtattgct

SEQ ID NO: 526585 - DNA, 25 bp, Mus musculus
agagctgtcagtgtgtggtattgct

SEQ ID NO: 526586 - DNA, 25 bp, Mus musculus
agagctgtcggcatggatccaaaga

SEQ ID NO: 526587 - DNA, 25 bp, Mus musculus
agagctgtcggcttggatccaaaga

SEQ ID NO: 526588 - DNA, 25 bp, Mus musculus
agagctgtgatgagtccaaatccaa

SEQ ID NO: 526589 - DNA, 25 bp, Mus musculus
agagctgtgatgtgtccaaatccaa

SEQ ID NO: 526590 - DNA, 25 bp, Mus musculus
agagctgtgcagctgggatccctcc

SEQ ID NO: 526591 - DNA, 25 bp, Mus musculus
agagctgtgcaggtgggatccctcc

SEQ ID NO: 526592 - DNA, 25 bp, Mus musculus
agagctgtgcccacacctaaagcag

SEQ ID NO: 526593 - DNA, 25 bp, Mus musculus
agagctgtgccctcacctaaagcag

SEQ ID NO: 526594 - DNA, 25 bp, Mus musculus
agagctgtgccgattgttacactac

SEQ ID NO: 526595 - DNA, 25 bp, Mus musculus
agagctgtgccgtttgttacactac

SEQ ID NO: 526596 - DNA, 25 bp, Mus musculus
agagctgtgcgtcttccccttcgtc

SEQ ID NO: 526597 - DNA, 25 bp, Mus musculus
agagctgtgcgtgttccccttcgtc

SEQ ID NO: 526598 - DNA, 25 bp, Mus musculus
agagctgtggatatttgtgcaggct

SEQ ID NO: 526599 - DNA, 25 bp, Mus musculus
agagctgtggatttttgtgcaggct

SEQ ID NO: 526600 - DNA, 25 bp, Mus musculus
agagctgtggcacacatgacagact

SEQ ID NO: 526601 - DNA, 25 bp, Mus musculus
agagctgtggcagacatgacagact

SEQ ID NO: 526602 - DNA, 25 bp, Mus musculus
agagctgtgtgcatcccctggagga

SEQ ID NO: 526603 - DNA, 25 bp, Mus musculus
agagctgtgtgcttcccctggagga

SEQ ID NO: 526604 - DNA, 25 bp, Mus musculus
agagcttcgggcagagcttgctaag

SEQ ID NO: 526605 - DNA, 25 bp, Mus musculus
agagcttcgggctgagcttgctaag

SEQ ID NO: 526606 - DNA, 25 bp, Mus musculus
agagcttctagaccgcatggccagg

SEQ ID NO: 526607 - DNA, 25 bp, Mus musculus
agagcttctagagcgcatggccagg

SEQ ID NO: 526608 - DNA, 25 bp, Mus musculus
agagcttggacgaggcgcaagcaaa

SEQ ID NO: 526609 - DNA, 25 bp, Mus musculus
agagcttggacgtggcgcaagcaaa

SEQ ID NO: 526610 - DNA, 25 bp, Mus musculus
agagcttggcagctgcacaccacga

SEQ ID NO: 526611 - DNA, 25 bp, Mus musculus
agagcttggcaggtgcacaccacga

SEQ ID NO: 526612 - DNA, 25 bp, Mus musculus
agagcttgggaacgtccaatttcgg

SEQ ID NO: 526613 - DNA, 25 bp, Mus musculus
agagcttgggaaggtccaatttcgg

SEQ ID NO: 526614 - DNA, 25 bp, Mus musculus
agagcttgggacagacttctcttcc

SEQ ID NO: 526615 - DNA, 25 bp, Mus musculus
agagcttgggactgacttctcttcc

SEQ ID NO: 526616 - DNA, 25 bp, Mus musculus
agagcttgtctgagtggcgcatgca

SEQ ID NO: 526617 - DNA, 25 bp, Mus musculus
agagcttgtctgtgtggcgcatgca

SEQ ID NO: 526618 - DNA, 25 bp, Mus musculus
agagctttagaacgcccgattggaa

SEQ ID NO: 526619 - DNA, 25 bp, Mus musculus
agagctttagaaggcccgattggaa

SEQ ID NO: 526620 - DNA, 25 bp, Mus musculus
agagctttccttccgaggaagaaat

SEQ ID NO: 526621 - DNA, 25 bp, Mus musculus
agagctttccttgcgaggaagaaat

SEQ ID NO: 526622 - DNA, 25 bp, Mus musculus
agagcttttgctcggaagacggcca

SEQ ID NO: 526623 - DNA, 25 bp, Mus musculus
agagcttttgctgggaagacggcca

SEQ ID NO: 526624 - DNA, 25 bp, Mus musculus
agaggaaaaagcagttaggacaggc

SEQ ID NO: 526625 - DNA, 25 bp, Mus musculus
agaggaaaaagctgttaggacaggc

SEQ ID NO: 526626 - DNA, 25 bp, Mus musculus
agaggaaaagatctcagatgtgtac

SEQ ID NO: 526627 - DNA, 25 bp, Mus musculus
agaggaaaagatgtcagatgtgtac

SEQ ID NO: 526628 - DNA, 25 bp, Mus musculus
agaggaaaccaaccagtgcgcctgc

SEQ ID NO: 526629 - DNA, 25 bp, Mus musculus
agaggaaaccaagcagtgcgcctgc

SEQ ID NO: 526630 - DNA, 25 bp, Mus musculus
agaggaaacctacgagctcaggctg

SEQ ID NO: 526631 - DNA, 25 bp, Mus musculus
agaggaaacctaggagctcaggctg

SEQ ID NO: 526632 - DNA, 25 bp, Mus musculus
agaggaaagctgatgccagctcttc

SEQ ID NO: 526633 - DNA, 25 bp, Mus musculus
agaggaaagctgttgccagctcttc

SEQ ID NO: 526634 - DNA, 25 bp, Mus musculus
agaggaacagggagcaccaaggccc

SEQ ID NO: 526635 - DNA, 25 bp, Mus musculus
agaggaacagggtgcaccaaggccc

SEQ ID NO: 526636 - DNA, 25 bp, Mus musculus
agaggaacccagctgtggatcgcct

SEQ ID NO: 526637 - DNA, 25 bp, Mus musculus
agaggaacccaggtgtggatcgcct

SEQ ID NO: 526638 - DNA, 25 bp, Mus musculus
agaggaacgactacgtgcacgcgct

SEQ ID NO: 526639 - DNA, 25 bp, Mus musculus
agaggaacgacttcgtgcacgcgct

SEQ ID NO: 526640 - DNA, 25 bp, Mus musculus
agaggaacgcctcgccaagctgcag

SEQ ID NO: 526641 - DNA, 25 bp, Mus musculus
agaggaacgcctggccaagctgcag

SEQ ID NO: 526642 - DNA, 25 bp, Mus musculus
agaggaactccacgtctcaccaggg

SEQ ID NO: 526643 - DNA, 25 bp, Mus musculus
agaggaactccaggtctcaccaggg

SEQ ID NO: 526644 - DNA, 25 bp, Mus musculus
agaggaagacgtccccatccggtac

SEQ ID NO: 526645 - DNA, 25 bp, Mus musculus
agaggaagacgtgcccatccggtac

SEQ ID NO: 526646 - DNA, 25 bp, Mus musculus
agaggaaggactcctgtacatccag

SEQ ID NO: 526647 - DNA, 25 bp, Mus musculus
agaggaaggactgctgtacatccag

SEQ ID NO: 526648 - DNA, 25 bp, Mus musculus
agaggaaggcgtcacacccaagaag

SEQ ID NO: 526649 - DNA, 25 bp, Mus musculus
agaggaaggcgtgacacccaagaag

SEQ ID NO: 526650 - DNA, 25 bp, Mus musculus
agaggaagtatcatgcagtggtcct

SEQ ID NO: 526651 - DNA, 25 bp, Mus musculus
agaggaagtatcttgcagtggtcct

SEQ ID NO: 526652 - DNA, 25 bp, Mus musculus
agaggaatttcccaccctgcaggcg

SEQ ID NO: 526653 - DNA, 25 bp, Mus musculus
agaggaatttccgaccctgcaggcg

SEQ ID NO: 526654 - DNA, 25 bp, Mus musculus
agaggacaaccacctcattgtgaag

SEQ ID NO: 526655 - DNA, 25 bp, Mus musculus
agaggacaaccagctcattgtgaag

SEQ ID NO: 526656 - DNA, 25 bp, Mus musculus
agaggacagaagctatctccacatc

SEQ ID NO: 526657 - DNA, 25 bp, Mus musculus
agaggacagaaggtatctccacatc

SEQ ID NO: 526658 - DNA, 25 bp, Mus musculus
agaggacaggatcgtgctcatgtct

SEQ ID NO: 526659 - DNA, 25 bp, Mus musculus
agaggacaggatggtgctcatgtct

SEQ ID NO: 526660 - DNA, 25 bp, Mus musculus
agaggacaggcaacctttgttcccg

SEQ ID NO: 526661 - DNA, 25 bp, Mus musculus
agaggacaggcatcctttgttcccg

SEQ ID NO: 526662 - DNA, 25 bp, Mus musculus
agaggacatcacagcatatcgtaca

SEQ ID NO: 526663 - DNA, 25 bp, Mus musculus
agaggacatcactgcatatcgtaca

SEQ ID NO: 526664 - DNA, 25 bp, Mus musculus
agaggaccagcacaatgccccaagg

SEQ ID NO: 526665 - DNA, 25 bp, Mus musculus
agaggaccagcagaatgccccaagg

SEQ ID NO: 526666 - DNA, 25 bp, Mus musculus
agaggaccccagcatctcgggcatc

SEQ ID NO: 526667 - DNA, 25 bp, Mus musculus
agaggaccccaggatctcgggcatc

SEQ ID NO: 526668 - DNA, 25 bp, Mus musculus
agaggaccgtcgatagcagcaaagc

SEQ ID NO: 526669 - DNA, 25 bp, Mus musculus
agaggaccgtcgttagcagcaaagc

SEQ ID NO: 526670 - DNA, 25 bp, Mus musculus
agaggaccttcgacctggaggtgat

SEQ ID NO: 526671 - DNA, 25 bp, Mus musculus
agaggaccttcgtcctggaggtgat

SEQ ID NO: 526672 - DNA, 25 bp, Mus musculus
agaggacgatgaagactacgttgat

SEQ ID NO: 526673 - DNA, 25 bp, Mus musculus
agaggacgatgatgactacgttgat

SEQ ID NO: 526674 - DNA, 25 bp, Mus musculus
agaggacgcagcagcccttgcccag

SEQ ID NO: 526675 - DNA, 25 bp, Mus musculus
agaggacgcagctgcccttgcccag

SEQ ID NO: 526676 - DNA, 25 bp, Mus musculus
agaggacggcgacgactatgacact

SEQ ID NO: 526677 - DNA, 25 bp, Mus musculus
agaggacggcgaggactatgacact

SEQ ID NO: 526678 - DNA, 25 bp, Mus musculus
agaggacggtctactagccccaaga

SEQ ID NO: 526679 - DNA, 25 bp, Mus musculus
agaggacggtcttctagccccaaga

SEQ ID NO: 526680 - DNA, 25 bp, Mus musculus
agaggacgttccctggctgtacgat

SEQ ID NO: 526681 - DNA, 25 bp, Mus musculus
agaggacgttccgtggctgtacgat

SEQ ID NO: 526682 - DNA, 25 bp, Mus musculus
agaggactccagcacatttcggcca

SEQ ID NO: 526683 - DNA, 25 bp, Mus musculus
agaggactccaggacatttcggcca

SEQ ID NO: 526684 - DNA, 25 bp, Mus musculus
agaggactccgacccactgtggaag

SEQ ID NO: 526685 - DNA, 25 bp, Mus musculus
agaggactccgagccactgtggaag

SEQ ID NO: 526686 - DNA, 25 bp, Mus musculus
agaggacttcataaaagaagccatg

SEQ ID NO: 526687 - DNA, 25 bp, Mus musculus
agaggacttcattaaagaagccatg

SEQ ID NO: 526688 - DNA, 25 bp, Mus musculus
agaggagacactccactcaaagttc

SEQ ID NO: 526689 - DNA, 25 bp, Mus musculus
agaggagacactgcactcaaagttc

SEQ ID NO: 526690 - DNA, 25 bp, Mus musculus
agaggagatctaaggtggactgtca

SEQ ID NO: 526691 - DNA, 25 bp, Mus musculus
agaggagatctatggtggactgtca

SEQ ID NO: 526692 - DNA, 25 bp, Mus musculus
agaggagatctgaactttgcaaatg

SEQ ID NO: 526693 - DNA, 25 bp, Mus musculus
agaggagatctgtactttgcaaatg

SEQ ID NO: 526694 - DNA, 25 bp, Mus musculus
agaggagcaccgagcctcagctcct

SEQ ID NO: 526695 - DNA, 25 bp, Mus musculus
agaggagcaccgtgcctcagctcct

SEQ ID NO: 526696 - DNA, 25 bp, Mus musculus
agaggagcagttctgcagccaagcc

SEQ ID NO: 526697 - DNA, 25 bp, Mus musculus
agaggagcagttgtgcagccaagcc

SEQ ID NO: 526698 - DNA, 25 bp, Mus musculus
agaggagcctgtcgagtacaagtcc

SEQ ID NO: 526699 - DNA, 25 bp, Mus musculus
agaggagcctgtggagtacaagtcc

SEQ ID NO: 526700 - DNA, 25 bp, Mus musculus
agaggagctgctaggccccacctca

SEQ ID NO: 526701 - DNA, 25 bp, Mus musculus
agaggagctgcttggccccacctca

SEQ ID NO: 526702 - DNA, 25 bp, Mus musculus
agaggagcttatacagggatgtcat

SEQ ID NO: 526703 - DNA, 25 bp, Mus musculus
agaggagcttattcagggatgtcat

SEQ ID NO: 526704 - DNA, 25 bp, Mus musculus
agaggaggcagtaagcatgcatgat

SEQ ID NO: 526705 - DNA, 25 bp, Mus musculus
agaggaggcagttagcatgcatgat

SEQ ID NO: 526706 - DNA, 25 bp, Mus musculus
agaggaggcctgactacccttgcct

SEQ ID NO: 526707 - DNA, 25 bp, Mus musculus
agaggaggcctgtctacccttgcct

SEQ ID NO: 526708 - DNA, 25 bp, Mus musculus
agaggagggaacattccgcagctcc

SEQ ID NO: 526709 - DNA, 25 bp, Mus musculus
agaggagggaactttccgcagctcc

SEQ ID NO: 526710 - DNA, 25 bp, Mus musculus
agaggagggcaaaggagtgtttgac

SEQ ID NO: 526711 - DNA, 25 bp, Mus musculus
agaggagggcaatggagtgtttgac

SEQ ID NO: 526712 - DNA, 25 bp, Mus musculus
agaggagtctcactgaggtccagta

SEQ ID NO: 526713 - DNA, 25 bp, Mus musculus
agaggagtctcagtgaggtccagta

SEQ ID NO: 526714 - DNA, 25 bp, Mus musculus
agaggagtctttctggcttttggac

SEQ ID NO: 526715 - DNA, 25 bp, Mus musculus
agaggagtctttgtggcttttggac

SEQ ID NO: 526716 - DNA, 25 bp, Mus musculus
agaggagttcacagttagagatggc

SEQ ID NO: 526717 - DNA, 25 bp, Mus musculus
agaggagttcactgttagagatggc

SEQ ID NO: 526718 - DNA, 25 bp, Mus musculus
agaggataccacctgctataaagtc

SEQ ID NO: 526719 - DNA, 25 bp, Mus musculus
agaggataccacgtgctataaagtc

SEQ ID NO: 526720 - DNA, 25 bp, Mus musculus
agaggatcaaagaggaccggcccat

SEQ ID NO: 526721 - DNA, 25 bp, Mus musculus
agaggatcaaagtggaccggcccat

SEQ ID NO: 526722 - DNA, 25 bp, Mus musculus
agaggatcagcaaccagccggcagg

SEQ ID NO: 526723 - DNA, 25 bp, Mus musculus
agaggatcagcatccagccggcagg

SEQ ID NO: 526724 - DNA, 25 bp, Mus musculus
agaggatcatggctctacgggcact

SEQ ID NO: 526725 - DNA, 25 bp, Mus musculus
agaggatcatgggtctacgggcact

SEQ ID NO: 526726 - DNA, 25 bp, Mus musculus
agaggatccagacggccaacgacct

SEQ ID NO: 526727 - DNA, 25 bp, Mus musculus
agaggatccagagggccaacgacct

SEQ ID NO: 526728 - DNA, 25 bp, Mus musculus
agaggatgaacaacaagttcgacgc

SEQ ID NO: 526729 - DNA, 25 bp, Mus musculus
agaggatgaacatcaagttcgacgc

SEQ ID NO: 526730 - DNA, 25 bp, Mus musculus
agaggatgagaacatgccgccctat

SEQ ID NO: 526731 - DNA, 25 bp, Mus musculus
agaggatgagaagatgccgccctat

SEQ ID NO: 526732 - DNA, 25 bp, Mus musculus
agaggatgctgaccgtatttcacac

SEQ ID NO: 526733 - DNA, 25 bp, Mus musculus
agaggatgctgagcgtatttcacac

SEQ ID NO: 526734 - DNA, 25 bp, Mus musculus
agaggatggacaactgaagtcagtg

SEQ ID NO: 526735 - DNA, 25 bp, Mus musculus
agaggatggacatctgaagtcagtg

SEQ ID NO: 526736 - DNA, 25 bp, Mus musculus
agaggatggcacagttgcagctgca

SEQ ID NO: 526737 - DNA, 25 bp, Mus musculus
agaggatggcactgttgcagctgca

SEQ ID NO: 526738 - DNA, 25 bp, Mus musculus
agaggattcggacaccgagaatctg

SEQ ID NO: 526739 - DNA, 25 bp, Mus musculus
agaggattcggagaccgagaatctg

SEQ ID NO: 526740 - DNA, 25 bp, Mus musculus
agaggattctgtattatcacataca

SEQ ID NO: 526741 - DNA, 25 bp, Mus musculus
agaggattctgttttatcacataca

SEQ ID NO: 526742 - DNA, 25 bp, Mus musculus
agaggatttctaccgctccacggcg

SEQ ID NO: 526743 - DNA, 25 bp, Mus musculus
agaggatttctagcgctccacggcg

SEQ ID NO: 526744 - DNA, 25 bp, Mus musculus
agaggatttcttaacggatgcaatt

SEQ ID NO: 526745 - DNA, 25 bp, Mus musculus
agaggatttctttacggatgcaatt

SEQ ID NO: 526746 - DNA, 25 bp, Mus musculus
agaggcaaccggaagctcctctgcc

SEQ ID NO: 526747 - DNA, 25 bp, Mus musculus
agaggcaaccggtagctcctctgcc

SEQ ID NO: 526748 - DNA, 25 bp, Mus musculus
agaggcacaacaacacactactgtg

SEQ ID NO: 526749 - DNA, 25 bp, Mus musculus
agaggcacaacatcacactactgtg

SEQ ID NO: 526750 - DNA, 25 bp, Mus musculus
agaggcacaccccactgagcaagct

SEQ ID NO: 526751 - DNA, 25 bp, Mus musculus
agaggcacacccgactgagcaagct

SEQ ID NO: 526752 - DNA, 25 bp, Mus musculus
agaggcagagaacaacgagaagaaa

SEQ ID NO: 526753 - DNA, 25 bp, Mus musculus
agaggcagagaagaacgagaagaaa

SEQ ID NO: 526754 - DNA, 25 bp, Mus musculus
agaggcagaggtcaacgtccactcc

SEQ ID NO: 526755 - DNA, 25 bp, Mus musculus
agaggcagaggtccgattcttccac

SEQ ID NO: 526756 - DNA, 25 bp, Mus musculus
agaggcagaggtgaacgtccactcc

SEQ ID NO: 526757 - DNA, 25 bp, Mus musculus
agaggcagaggtgcgattcttccac

SEQ ID NO: 526758 - DNA, 25 bp, Mus musculus
agaggcagctgccaggatcacacta

SEQ ID NO: 526759 - DNA, 25 bp, Mus musculus
agaggcagctgcgaggatcacacta

SEQ ID NO: 526760 - DNA, 25 bp, Mus musculus
agaggcaggcaaacatgcctctcac

SEQ ID NO: 526761 - DNA, 25 bp, Mus musculus
agaggcaggcaatcatgcctctcac

SEQ ID NO: 526762 - DNA, 25 bp, Mus musculus
agaggcaggtgtcccgttgccaccc

SEQ ID NO: 526763 - DNA, 25 bp, Mus musculus
agaggcaggtgtgccgttgccaccc

SEQ ID NO: 526764 - DNA, 25 bp, Mus musculus
agaggcattagaagccctgaaatgg

SEQ ID NO: 526765 - DNA, 25 bp, Mus musculus
agaggcattagatgccctgaaatgg

SEQ ID NO: 526766 - DNA, 25 bp, Mus musculus
agaggccaagcaacaggtccatgat

SEQ ID NO: 526767 - DNA, 25 bp, Mus musculus
agaggccaagcatcaggtccatgat

SEQ ID NO: 526768 - DNA, 25 bp, Mus musculus
agaggccaaggcactacaggtgcga

SEQ ID NO: 526769 - DNA, 25 bp, Mus musculus
agaggccaaggctctacaggtgcga

SEQ ID NO: 526770 - DNA, 25 bp, Mus musculus
agaggccacaaactacaggaacctg

SEQ ID NO: 526771 - DNA, 25 bp, Mus musculus
agaggccacaaagtacaggaacctg

SEQ ID NO: 526772 - DNA, 25 bp, Mus musculus
agaggccaccaaagattctctggat

SEQ ID NO: 526773 - DNA, 25 bp, Mus musculus
agaggccaccaatgattctctggat

SEQ ID NO: 526774 - DNA, 25 bp, Mus musculus
agaggccagaggatcgcttcaatgg

SEQ ID NO: 526775 - DNA, 25 bp, Mus musculus
agaggccagaggttcgcttcaatgg

SEQ ID NO: 526776 - DNA, 25 bp, Mus musculus
agaggccaggtcaggcgattttcct

SEQ ID NO: 526777 - DNA, 25 bp, Mus musculus
agaggccaggtctggcgattttcct

SEQ ID NO: 526778 - DNA, 25 bp, Mus musculus
agaggccatagcagaagttgagcaa

SEQ ID NO: 526779 - DNA, 25 bp, Mus musculus
agaggccatagctgaagttgagcaa

SEQ ID NO: 526780 - DNA, 25 bp, Mus musculus
agaggccattgcatttcactgtgac

SEQ ID NO: 526781 - DNA, 25 bp, Mus musculus
agaggccattgcttttcactgtgac

SEQ ID NO: 526782 - DNA, 25 bp, Mus musculus
agaggcccaaggattgcccgtctgg

SEQ ID NO: 526783 - DNA, 25 bp, Mus musculus
agaggcccaaggtttgcccgtctgg

SEQ ID NO: 526784 - DNA, 25 bp, Mus musculus
agaggcccatgaagccaggccagaa

SEQ ID NO: 526785 - DNA, 25 bp, Mus musculus
agaggcccatgatgccaggccagaa

SEQ ID NO: 526786 - DNA, 25 bp, Mus musculus
agaggcccgaggacctaaatctgcc

SEQ ID NO: 526787 - DNA, 25 bp, Mus musculus
agaggcccgaggtcctaaatctgcc

SEQ ID NO: 526788 - DNA, 25 bp, Mus musculus
agaggcccggcacccaggaaagtct

SEQ ID NO: 526789 - DNA, 25 bp, Mus musculus
agaggcccggcagccaggaaagtct

SEQ ID NO: 526790 - DNA, 25 bp, Mus musculus
agaggccctcgacgctttgggttca

SEQ ID NO: 526791 - DNA, 25 bp, Mus musculus
agaggccctcgaggctttgggttca

SEQ ID NO: 526792 - DNA, 25 bp, Mus musculus
agaggccctggcacaagcagaagtc

SEQ ID NO: 526793 - DNA, 25 bp, Mus musculus
agaggccctggctcaagcagaagtc

SEQ ID NO: 526794 - DNA, 25 bp, Mus musculus
agaggccctttgaggcttcctcgca

SEQ ID NO: 526795 - DNA, 25 bp, Mus musculus
agaggccctttgtggcttcctcgca

SEQ ID NO: 526796 - DNA, 25 bp, Mus musculus
agaggccggaaaaagaagcgctgtc

SEQ ID NO: 526797 - DNA, 25 bp, Mus musculus
agaggccggaaatagaagcgctgtc

SEQ ID NO: 526798 - DNA, 25 bp, Mus musculus
agaggccggctcagtgctataggaa

SEQ ID NO: 526799 - DNA, 25 bp, Mus musculus
agaggccggctctgtgctataggaa

SEQ ID NO: 526800 - DNA, 25 bp, Mus musculus
agaggccgggcaaaccctactgcca

SEQ ID NO: 526801 - DNA, 25 bp, Mus musculus
agaggccgggcataccctactgcca

SEQ ID NO: 526802 - DNA, 25 bp, Mus musculus
agaggcctatgaagtactatctgac

SEQ ID NO: 526803 - DNA, 25 bp, Mus musculus
agaggcctatgatgtactatctgac

SEQ ID NO: 526804 - DNA, 25 bp, Mus musculus
agaggcctcagcagcacccgagcag

SEQ ID NO: 526805 - DNA, 25 bp, Mus musculus
agaggcctcagctgcacccgagcag

SEQ ID NO: 526806 - DNA, 25 bp, Mus musculus
agaggcctttcccttgtccccagtg

SEQ ID NO: 526807 - DNA, 25 bp, Mus musculus
agaggcctttccgttgtccccagtg

SEQ ID NO: 526808 - DNA, 25 bp, Mus musculus
agaggcctttggaatggatccctcc

SEQ ID NO: 526809 - DNA, 25 bp, Mus musculus
agaggcctttggtatggatccctcc

SEQ ID NO: 526810 - DNA, 25 bp, Mus musculus
agaggcgagagacggtggagagaga

SEQ ID NO: 526811 - DNA, 25 bp, Mus musculus
agaggcgagagagggtggagagaga

SEQ ID NO: 526812 - DNA, 25 bp, Mus musculus
agaggcgaggccagagcagccccaa

SEQ ID NO: 526813 - DNA, 25 bp, Mus musculus
agaggcgaggcctgagcagccccaa

SEQ ID NO: 526814 - DNA, 25 bp, Mus musculus
agaggcgatctcaggacatccgaaa

SEQ ID NO: 526815 - DNA, 25 bp, Mus musculus
agaggcgatctctggacatccgaaa

SEQ ID NO: 526816 - DNA, 25 bp, Mus musculus
agaggcgcatctctttctccaccag

SEQ ID NO: 526817 - DNA, 25 bp, Mus musculus
agaggcgcatctgtttctccaccag

SEQ ID NO: 526818 - DNA, 25 bp, Mus musculus
agaggcgccacactagccagtctct

SEQ ID NO: 526819 - DNA, 25 bp, Mus musculus
agaggcgccacagtagccagtctct

SEQ ID NO: 526820 - DNA, 25 bp, Mus musculus
agaggcgggaacagattcgcacccg

SEQ ID NO: 526821 - DNA, 25 bp, Mus musculus
agaggcgggaactgattcgcacccg

SEQ ID NO: 526822 - DNA, 25 bp, Mus musculus
agaggcggtaccctacgcacactat

SEQ ID NO: 526823 - DNA, 25 bp, Mus musculus
agaggcggtaccgtacgcacactat

SEQ ID NO: 526824 - DNA, 25 bp, Mus musculus
agaggcggtcaacggaaaaacatca

SEQ ID NO: 526825 - DNA, 25 bp, Mus musculus
agaggcggtcaagggaaaaacatca

SEQ ID NO: 526826 - DNA, 25 bp, Mus musculus
agaggctaagaaccagcttcaggat

SEQ ID NO: 526827 - DNA, 25 bp, Mus musculus
agaggctaagaagcagcttcaggat

SEQ ID NO: 526828 - DNA, 25 bp, Mus musculus
agaggctacgccagtacgcagagaa

SEQ ID NO: 526829 - DNA, 25 bp, Mus musculus
agaggctacgcctgtacgcagagaa

SEQ ID NO: 526830 - DNA, 25 bp, Mus musculus
agaggctaggcacctacatgggcca

SEQ ID NO: 526831 - DNA, 25 bp, Mus musculus
agaggctaggcagctacatgggcca

SEQ ID NO: 526832 - DNA, 25 bp, Mus musculus
agaggctcatcacccggctggagaa

SEQ ID NO: 526833 - DNA, 25 bp, Mus musculus
agaggctcatcagccggctggagaa

SEQ ID NO: 526834 - DNA, 25 bp, Mus musculus
agaggctcatccaggtgacaaggaa

SEQ ID NO: 526835 - DNA, 25 bp, Mus musculus
agaggctcatcctggtgacaaggaa

SEQ ID NO: 526836 - DNA, 25 bp, Mus musculus
agaggctcccagcacaactcgagat

SEQ ID NO: 526837 - DNA, 25 bp, Mus musculus
agaggctcccaggacaactcgagat

SEQ ID NO: 526838 - DNA, 25 bp, Mus musculus
agaggctcccgaaggcgagattatg

SEQ ID NO: 526839 - DNA, 25 bp, Mus musculus
agaggctcccgatggcgagattatg

SEQ ID NO: 526840 - DNA, 25 bp, Mus musculus
agaggctcctcgcagctgagccctg

SEQ ID NO: 526841 - DNA, 25 bp, Mus musculus
agaggctcctcggagctgagccctg

SEQ ID NO: 526842 - DNA, 25 bp, Mus musculus
agaggctctcagatgaatggcttgg

SEQ ID NO: 526843 - DNA, 25 bp, Mus musculus
agaggctctcagttgaatggcttgg

SEQ ID NO: 526844 - DNA, 25 bp, Mus musculus
agaggctctcgaagaggatgcgtta

SEQ ID NO: 526845 - DNA, 25 bp, Mus musculus
agaggctctcgatgaggatgcgtta

SEQ ID NO: 526846 - DNA, 25 bp, Mus musculus
agaggctgaagcatcggatgcagaa

SEQ ID NO: 526847 - DNA, 25 bp, Mus musculus
agaggctgaagcttcggatgcagaa

SEQ ID NO: 526848 - DNA, 25 bp, Mus musculus
agaggctgacatacaagccacacct

SEQ ID NO: 526849 - DNA, 25 bp, Mus musculus
agaggctgacattcaagccacacct

SEQ ID NO: 526850 - DNA, 25 bp, Mus musculus
agaggctgagtgctgcccaagtcct

SEQ ID NO: 526851 - DNA, 25 bp, Mus musculus
agaggctgagtggtgcccaagtcct

SEQ ID NO: 526852 - DNA, 25 bp, Mus musculus
agaggctgatgcatggcctgtctga

SEQ ID NO: 526853 - DNA, 25 bp, Mus musculus
agaggctgatgcttggcctgtctga

SEQ ID NO: 526854 - DNA, 25 bp, Mus musculus
agaggctgcccaagctgaaccggcg

SEQ ID NO: 526855 - DNA, 25 bp, Mus musculus
agaggctgcccatgctgaaccggcg

SEQ ID NO: 526856 - DNA, 25 bp, Mus musculus
agaggctgcgccaatagctgccatg

SEQ ID NO: 526857 - DNA, 25 bp, Mus musculus
agaggctgcgcctatagctgccatg

SEQ ID NO: 526858 - DNA, 25 bp, Mus musculus
agaggctgggcgctcgaccctggtc

SEQ ID NO: 526859 - DNA, 25 bp, Mus musculus
agaggctgggcggtcgaccctggtc

SEQ ID NO: 526860 - DNA, 25 bp, Mus musculus
agaggctgtgaaagaggcccctccc

SEQ ID NO: 526861 - DNA, 25 bp, Mus musculus
agaggctgtgaatgaggcccctccc

SEQ ID NO: 526862 - DNA, 25 bp, Mus musculus
agaggctgtttcagggtccctacaa

SEQ ID NO: 526863 - DNA, 25 bp, Mus musculus
agaggctgtttctgggtccctacaa

SEQ ID NO: 526864 - DNA, 25 bp, Mus musculus
agaggcttcagtcggcttctagaca

SEQ ID NO: 526865 - DNA, 25 bp, Mus musculus
agaggcttcagtgggcttctagaca

SEQ ID NO: 526866 - DNA, 25 bp, Mus musculus
agaggcttctccaacactaagagag

SEQ ID NO: 526867 - DNA, 25 bp, Mus musculus
agaggcttctcctacactaagagag

SEQ ID NO: 526868 - DNA, 25 bp, Mus musculus
agaggcttgcaacgccctcctggaa

SEQ ID NO: 526869 - DNA, 25 bp, Mus musculus
agaggcttgcaaggccctcctggaa

SEQ ID NO: 526870 - DNA, 25 bp, Mus musculus
agaggctttctacccgcggtctcca

SEQ ID NO: 526871 - DNA, 25 bp, Mus musculus
agaggctttctagccgcggtctcca

SEQ ID NO: 526872 - DNA, 25 bp, Mus musculus
agagggaaccatcggaatatttctt

SEQ ID NO: 526873 - DNA, 25 bp, Mus musculus
agagggaaccatgggaatatttctt

SEQ ID NO: 526874 - DNA, 25 bp, Mus musculus
agagggaacctcaaaccaaggcaag

SEQ ID NO: 526875 - DNA, 25 bp, Mus musculus
agagggaacctctaaccaaggcaag

SEQ ID NO: 526876 - DNA, 25 bp, Mus musculus
agagggactcttagactcagaaact

SEQ ID NO: 526877 - DNA, 25 bp, Mus musculus
agagggactctttgactcagaaact

SEQ ID NO: 526878 - DNA, 25 bp, Mus musculus
agagggatcctacacccggcagcca

SEQ ID NO: 526879 - DNA, 25 bp, Mus musculus
agagggatcctagacccggcagcca

SEQ ID NO: 526880 - DNA, 25 bp, Mus musculus
agagggatttcaaaactgcactgcc

SEQ ID NO: 526881 - DNA, 25 bp, Mus musculus
agagggatttcataactgcactgcc

SEQ ID NO: 526882 - DNA, 25 bp, Mus musculus
agagggcagacaagcagtctgtgca

SEQ ID NO: 526883 - DNA, 25 bp, Mus musculus
agagggcagacatgcagtctgtgca

SEQ ID NO: 526884 - DNA, 25 bp, Mus musculus
agagggccaagtccatgaagtttgt

SEQ ID NO: 526885 - DNA, 25 bp, Mus musculus
agagggccaagtgcatgaagtttgt

SEQ ID NO: 526886 - DNA, 25 bp, Mus musculus
agagggccacctaagcggcccgcag

SEQ ID NO: 526887 - DNA, 25 bp, Mus musculus
agagggccaccttagcggcccgcag

SEQ ID NO: 526888 - DNA, 25 bp, Mus musculus
agagggccagttcctaagtcttaag

SEQ ID NO: 526889 - DNA, 25 bp, Mus musculus
agagggccagttgctaagtcttaag

SEQ ID NO: 526890 - DNA, 25 bp, Mus musculus
agagggccctgcatccgttctgggc

SEQ ID NO: 526891 - DNA, 25 bp, Mus musculus
agagggccctgcttccgttctgggc

SEQ ID NO: 526892 - DNA, 25 bp, Mus musculus
agagggcgagccagcttccaggcct

SEQ ID NO: 526893 - DNA, 25 bp, Mus musculus
agagggcgagcctgcttccaggcct

SEQ ID NO: 526894 - DNA, 25 bp, Mus musculus
agagggcgtcacacagcactaaagg

SEQ ID NO: 526895 - DNA, 25 bp, Mus musculus
agagggcgtcactcagcactaaagg

SEQ ID NO: 526896 - DNA, 25 bp, Mus musculus
agagggctacacagcccacttcctg

SEQ ID NO: 526897 - DNA, 25 bp, Mus musculus
agagggctacacctgcaggtcaatc

SEQ ID NO: 526898 - DNA, 25 bp, Mus musculus
agagggctacacgtgcaggtcaatc

SEQ ID NO: 526899 - DNA, 25 bp, Mus musculus
agagggctacactgcccacttcctg

SEQ ID NO: 526900 - DNA, 25 bp, Mus musculus
agagggctccttcagctgtctgtgt

SEQ ID NO: 526901 - DNA, 25 bp, Mus musculus
agagggctccttgagctgtctgtgt

SEQ ID NO: 526902 - DNA, 25 bp, Mus musculus
agagggctgagcaggcccatagtcc

SEQ ID NO: 526903 - DNA, 25 bp, Mus musculus
agagggctgagctggcccatagtcc

SEQ ID NO: 526904 - DNA, 25 bp, Mus musculus
agagggctgtgaccagtacagcctc

SEQ ID NO: 526905 - DNA, 25 bp, Mus musculus
agagggctgtgagcagtacagcctc

SEQ ID NO: 526906 - DNA, 25 bp, Mus musculus
agagggcttcggagatgccgcactc

SEQ ID NO: 526907 - DNA, 25 bp, Mus musculus
agagggcttcggtgatgccgcactc

SEQ ID NO: 526908 - DNA, 25 bp, Mus musculus
agagggtcgggcaccatctggaaac

SEQ ID NO: 526909 - DNA, 25 bp, Mus musculus
agagggtcgggctccatctggaaac

SEQ ID NO: 526910 - DNA, 25 bp, Mus musculus
agagggtgctgactgacagcaaaac

SEQ ID NO: 526911 - DNA, 25 bp, Mus musculus
agagggtgctgagtgacagcaaaac

SEQ ID NO: 526912 - DNA, 25 bp, Mus musculus
agagggttcacacctacctgtggtg

SEQ ID NO: 526913 - DNA, 25 bp, Mus musculus
agagggttcacagctacctgtggtg

SEQ ID NO: 526914 - DNA, 25 bp, Mus musculus
agagggttgagcaccagcagacaga

SEQ ID NO: 526915 - DNA, 25 bp, Mus musculus
agagggttgagctccagcagacaga

SEQ ID NO: 526916 - DNA, 25 bp, Mus musculus
agaggtaactggcaatttggctatg

SEQ ID NO: 526917 - DNA, 25 bp, Mus musculus
agaggtaactgggaatttggctatg

SEQ ID NO: 526918 - DNA, 25 bp, Mus musculus
agaggtaagactcgccttctatcca

SEQ ID NO: 526919 - DNA, 25 bp, Mus musculus
agaggtaagactggccttctatcca

SEQ ID NO: 526920 - DNA, 25 bp, Mus musculus
agaggtacccatcaggagctgatga

SEQ ID NO: 526921 - DNA, 25 bp, Mus musculus
agaggtacccatgaggagctgatga

SEQ ID NO: 526922 - DNA, 25 bp, Mus musculus
agaggtactactagatcttccagta

SEQ ID NO: 526923 - DNA, 25 bp, Mus musculus
agaggtactacttgatcttccagta

SEQ ID NO: 526924 - DNA, 25 bp, Mus musculus
agaggtactggaccaggcccagatc

SEQ ID NO: 526925 - DNA, 25 bp, Mus musculus
agaggtactggagcaggcccagatc

SEQ ID NO: 526926 - DNA, 25 bp, Mus musculus
agaggtagacagagaagtagagcta

SEQ ID NO: 526927 - DNA, 25 bp, Mus musculus
agaggtagacagtgaagtagagcta

SEQ ID NO: 526928 - DNA, 25 bp, Mus musculus
agaggtatcatccaacacgcaccca

SEQ ID NO: 526929 - DNA, 25 bp, Mus musculus
agaggtatcatcgaacacgcaccca

SEQ ID NO: 526930 - DNA, 25 bp, Mus musculus
agaggtcaacgtccactcccaatgt

SEQ ID NO: 526931 - DNA, 25 bp, Mus musculus
agaggtcaacgtgcactcccaatgt

SEQ ID NO: 526932 - DNA, 25 bp, Mus musculus
agaggtcacaggaagactgagactg

SEQ ID NO: 526933 - DNA, 25 bp, Mus musculus
agaggtcacaggtagactgagactg

SEQ ID NO: 526934 - DNA, 25 bp, Mus musculus
agaggtcaccaacggctaccgtggt

SEQ ID NO: 526935 - DNA, 25 bp, Mus musculus
agaggtcaccaagggctaccgtggt

SEQ ID NO: 526936 - DNA, 25 bp, Mus musculus
agaggtcatcgcctgtgatgagaac

SEQ ID NO: 526937 - DNA, 25 bp, Mus musculus
agaggtcatcgcgtgtgatgagaac

SEQ ID NO: 526938 - DNA, 25 bp, Mus musculus
agaggtcccaggattctgtgaagct

SEQ ID NO: 526939 - DNA, 25 bp, Mus musculus
agaggtcccaggtttctgtgaagct

SEQ ID NO: 526940 - DNA, 25 bp, Mus musculus
agaggtcctaggctacgtcactcca

SEQ ID NO: 526941 - DNA, 25 bp, Mus musculus
agaggtcctagggtacgtcactcca

SEQ ID NO: 526942 - DNA, 25 bp, Mus musculus
agaggtctgcatacctcaaggtgaa

SEQ ID NO: 526943 - DNA, 25 bp, Mus musculus
agaggtctgcattcctcaaggtgaa

SEQ ID NO: 526944 - DNA, 25 bp, Mus musculus
agaggtctgtgtcccattgcccagg

SEQ ID NO: 526945 - DNA, 25 bp, Mus musculus
agaggtctgtgtgccattgcccagg

SEQ ID NO: 526946 - DNA, 25 bp, Mus musculus
agaggtcttaccctgcctggagcaa

SEQ ID NO: 526947 - DNA, 25 bp, Mus musculus
agaggtcttaccgtgcctggagcaa

SEQ ID NO: 526948 - DNA, 25 bp, Mus musculus
agaggtcttgccaagaacttgtgtt

SEQ ID NO: 526949 - DNA, 25 bp, Mus musculus
agaggtcttgcctagaacttgtgtt

SEQ ID NO: 526950 - DNA, 25 bp, Mus musculus
agaggtctttgaatccttcgaagga

SEQ ID NO: 526951 - DNA, 25 bp, Mus musculus
agaggtctttgattccttcgaagga

SEQ ID NO: 526952 - DNA, 25 bp, Mus musculus
agaggtgaaagaaacttccatgtgt

SEQ ID NO: 526953 - DNA, 25 bp, Mus musculus
agaggtgaaagatacttccatgtgt

SEQ ID NO: 526954 - DNA, 25 bp, Mus musculus
agaggtgcaactcgccatcgagcag

SEQ ID NO: 526955 - DNA, 25 bp, Mus musculus
agaggtgcaactggccatcgagcag

SEQ ID NO: 526956 - DNA, 25 bp, Mus musculus
agaggtgcacctcgctgagcttcac

SEQ ID NO: 526957 - DNA, 25 bp, Mus musculus
agaggtgcacctggctgagcttcac

SEQ ID NO: 526958 - DNA, 25 bp, Mus musculus
agaggtgcagaaaacagaggcctca

SEQ ID NO: 526959 - DNA, 25 bp, Mus musculus
agaggtgcagaatacagaggcctca

SEQ ID NO: 526960 - DNA, 25 bp, Mus musculus
agaggtgccccacagttggacactg

SEQ ID NO: 526961 - DNA, 25 bp, Mus musculus
agaggtgccccagagttggacactg

SEQ ID NO: 526962 - DNA, 25 bp, Mus musculus
agaggtggcaacaaggcccctggtc

SEQ ID NO: 526963 - DNA, 25 bp, Mus musculus
agaggtggcaactaggcccctggtc

SEQ ID NO: 526964 - DNA, 25 bp, Mus musculus
agaggtggcactcgcctatgccaag

SEQ ID NO: 526965 - DNA, 25 bp, Mus musculus
agaggtggcactggcctatgccaag

SEQ ID NO: 526966 - DNA, 25 bp, Mus musculus
agaggtggctctcatgtgctttcga

SEQ ID NO: 526967 - DNA, 25 bp, Mus musculus
agaggtggctctgatgtgctttcga

SEQ ID NO: 526968 - DNA, 25 bp, Mus musculus
agaggtgggcagagtcttcccactc

SEQ ID NO: 526969 - DNA, 25 bp, Mus musculus
agaggtgggcagtgtcttcccactc

SEQ ID NO: 526970 - DNA, 25 bp, Mus musculus
agaggtgttggacaccctctcccag

SEQ ID NO: 526971 - DNA, 25 bp, Mus musculus
agaggtgttggagaccctctcccag

SEQ ID NO: 526972 - DNA, 25 bp, Mus musculus
agaggtgtttgaatacctagtggcc

SEQ ID NO: 526973 - DNA, 25 bp, Mus musculus
agaggtgtttgattacctagtggcc

SEQ ID NO: 526974 - DNA, 25 bp, Mus musculus
agaggttcaaggatcgcgttgccga

SEQ ID NO: 526975 - DNA, 25 bp, Mus musculus
agaggttcaaggttcgcgttgccga

SEQ ID NO: 526976 - DNA, 25 bp, Mus musculus
agaggttcccctccccatggagaga

SEQ ID NO: 526977 - DNA, 25 bp, Mus musculus
agaggttcccctcggacacgtctga

SEQ ID NO: 526978 - DNA, 25 bp, Mus musculus
agaggttcccctgcccatggagaga

SEQ ID NO: 526979 - DNA, 25 bp, Mus musculus
agaggttcccctgggacacgtctga

SEQ ID NO: 526980 - DNA, 25 bp, Mus musculus
agaggttccctccagcgtcgttgag

SEQ ID NO: 526981 - DNA, 25 bp, Mus musculus
agaggttccctcgagcgtcgttgag

SEQ ID NO: 526982 - DNA, 25 bp, Mus musculus
agaggttctgatagaagatacagac

SEQ ID NO: 526983 - DNA, 25 bp, Mus musculus
agaggttctgattgaagatacagac

SEQ ID NO: 526984 - DNA, 25 bp, Mus musculus
agaggttgtgagacccgcggtccct

SEQ ID NO: 526985 - DNA, 25 bp, Mus musculus
agaggttgtgagtcccgcggtccct

SEQ ID NO: 526986 - DNA, 25 bp, Mus musculus
agagtaactgtgaggtgcctcggcc

SEQ ID NO: 526987 - DNA, 25 bp, Mus musculus
agagtaactgtgtggtgcctcggcc

SEQ ID NO: 526988 - DNA, 25 bp, Mus musculus
agagtaaggcatatttctggtgtac

SEQ ID NO: 526989 - DNA, 25 bp, Mus musculus
agagtaaggcatttttctggtgtac

SEQ ID NO: 526990 - DNA, 25 bp, Mus musculus
agagtaatgcggagcagcacgcaga

SEQ ID NO: 526991 - DNA, 25 bp, Mus musculus
agagtaatgcggtgcagcacgcaga

SEQ ID NO: 526992 - DNA, 25 bp, Mus musculus
agagtacacggccaagatcgcactg

SEQ ID NO: 526993 - DNA, 25 bp, Mus musculus
agagtacacggcgaagatcgcactg

SEQ ID NO: 526994 - DNA, 25 bp, Mus musculus
agagtactggaaacttactggatga

SEQ ID NO: 526995 - DNA, 25 bp, Mus musculus
agagtactggaaatgggcctgcatg

SEQ ID NO: 526996 - DNA, 25 bp, Mus musculus
agagtactggaatcttactggatga

SEQ ID NO: 526997 - DNA, 25 bp, Mus musculus
agagtactggaattgggcctgcatg

SEQ ID NO: 526998 - DNA, 25 bp, Mus musculus
agagtacttaatcgccccttgctgg

SEQ ID NO: 526999 - DNA, 25 bp, Mus musculus
agagtacttaatggccccttgctgg

SEQ ID NO: 527000 - DNA, 25 bp, Mus musculus
agagtacttcatcatccagtaccag

SEQ ID NO: 527001 - DNA, 25 bp, Mus musculus
agagtacttcatgatccagtaccag

SEQ ID NO: 527002 - DNA, 25 bp, Mus musculus
agagtagaaaatccgtatcacatgg

SEQ ID NO: 527003 - DNA, 25 bp, Mus musculus
agagtagaaaatgcgtatcacatgg

SEQ ID NO: 527004 - DNA, 25 bp, Mus musculus
agagtagaagatctcgtcgttagtg

SEQ ID NO: 527005 - DNA, 25 bp, Mus musculus
agagtagaagatgtcgtcgttagtg

SEQ ID NO: 527006 - DNA, 25 bp, Mus musculus
agagtaggaacaagggcagctctgc

SEQ ID NO: 527007 - DNA, 25 bp, Mus musculus
agagtaggaacatgggcagctctgc

SEQ ID NO: 527008 - DNA, 25 bp, Mus musculus
agagtatcacatcgcttacttaaag

SEQ ID NO: 527009 - DNA, 25 bp, Mus musculus
agagtatcacatggcttacttaaag

SEQ ID NO: 527010 - DNA, 25 bp, Mus musculus
agagtatgatttaggaagccaggag

SEQ ID NO: 527011 - DNA, 25 bp, Mus musculus
agagtatgattttggaagccaggag

SEQ ID NO: 527012 - DNA, 25 bp, Mus musculus
agagtatggaagacttgcaatggaa

SEQ ID NO: 527013 - DNA, 25 bp, Mus musculus
agagtatggaagtcttgcaatggaa

SEQ ID NO: 527014 - DNA, 25 bp, Mus musculus
agagtatgttaacctaaagaaccag

SEQ ID NO: 527015 - DNA, 25 bp, Mus musculus
agagtatgttaagctaaagaaccag

SEQ ID NO: 527016 - DNA, 25 bp, Mus musculus
agagtattggcgagcccttggagaa

SEQ ID NO: 527017 - DNA, 25 bp, Mus musculus
agagtattggcgtgcccttggagaa

SEQ ID NO: 527018 - DNA, 25 bp, Mus musculus
agagtcaccagacagccgtggctgc

SEQ ID NO: 527019 - DNA, 25 bp, Mus musculus
agagtcaccagagagccgtggctgc

SEQ ID NO: 527020 - DNA, 25 bp, Mus musculus
agagtcaccggcagcagagagtcta

SEQ ID NO: 527021 - DNA, 25 bp, Mus musculus
agagtcaccggctgcagagagtcta

SEQ ID NO: 527022 - DNA, 25 bp, Mus musculus
agagtcagagagcaagcttcttgat

SEQ ID NO: 527023 - DNA, 25 bp, Mus musculus
agagtcagagaggaagcttcttgat

SEQ ID NO: 527024 - DNA, 25 bp, Mus musculus
agagtcagcactcggcctttaacga

SEQ ID NO: 527025 - DNA, 25 bp, Mus musculus
agagtcagcactgggcctttaacga

SEQ ID NO: 527026 - DNA, 25 bp, Mus musculus
agagtcagccccaccaatatgcagg

SEQ ID NO: 527027 - DNA, 25 bp, Mus musculus
agagtcagcccctccaatatgcagg

SEQ ID NO: 527028 - DNA, 25 bp, Mus musculus
agagtcagtgtcacaaaaccattta

SEQ ID NO: 527029 - DNA, 25 bp, Mus musculus
agagtcagtgtctcaaaaccattta

SEQ ID NO: 527030 - DNA, 25 bp, Mus musculus
agagtcatggagctcaacttcctca

SEQ ID NO: 527031 - DNA, 25 bp, Mus musculus
agagtcatggaggtcaacttcctca

SEQ ID NO: 527032 - DNA, 25 bp, Mus musculus
agagtccaattgaagtggtgctcag

SEQ ID NO: 527033 - DNA, 25 bp, Mus musculus
agagtccaattgtagtggtgctcag

SEQ ID NO: 527034 - DNA, 25 bp, Mus musculus
agagtccagagtccctgagactgag

SEQ ID NO: 527035 - DNA, 25 bp, Mus musculus
agagtccagagtgcctgagactgag

SEQ ID NO: 527036 - DNA, 25 bp, Mus musculus
agagtccatcagatctgtggaagga

SEQ ID NO: 527037 - DNA, 25 bp, Mus musculus
agagtccatcagttctgtggaagga

SEQ ID NO: 527038 - DNA, 25 bp, Mus musculus
agagtccatccacgccgaggatgag

SEQ ID NO: 527039 - DNA, 25 bp, Mus musculus
agagtccatccaggccgaggatgag

SEQ ID NO: 527040 - DNA, 25 bp, Mus musculus
agagtccatcgtcgttatttcagtg

SEQ ID NO: 527041 - DNA, 25 bp, Mus musculus
agagtccatcgtggttatttcagtg

SEQ ID NO: 527042 - DNA, 25 bp, Mus musculus
agagtcccaagtccgcccaggctgt

SEQ ID NO: 527043 - DNA, 25 bp, Mus musculus
agagtcccaagtgcgcccaggctgt

SEQ ID NO: 527044 - DNA, 25 bp, Mus musculus
agagtccctcggagcggcgcttgca

SEQ ID NO: 527045 - DNA, 25 bp, Mus musculus
agagtccctcggtgcggcgcttgca

SEQ ID NO: 527046 - DNA, 25 bp, Mus musculus
agagtcctagagacagaaggaagat

SEQ ID NO: 527047 - DNA, 25 bp, Mus musculus
agagtcctagagtcagaaggaagat

SEQ ID NO: 527048 - DNA, 25 bp, Mus musculus
agagtcctgcaacatcaccgtggca

SEQ ID NO: 527049 - DNA, 25 bp, Mus musculus
agagtcctgcaagatcaccgtggca

SEQ ID NO: 527050 - DNA, 25 bp, Mus musculus
agagtccttgtacgcatatctgcta

SEQ ID NO: 527051 - DNA, 25 bp, Mus musculus
agagtccttgtaggcatatctgcta

SEQ ID NO: 527052 - DNA, 25 bp, Mus musculus
agagtcctttgacgcagatgagccg

SEQ ID NO: 527053 - DNA, 25 bp, Mus musculus
agagtcctttgaggcagatgagccg

SEQ ID NO: 527054 - DNA, 25 bp, Mus musculus
agagtcgaccagacaattcttacag

SEQ ID NO: 527055 - DNA, 25 bp, Mus musculus
agagtcgaccagtcaattcttacag

SEQ ID NO: 527056 - DNA, 25 bp, Mus musculus
agagtcgctagtagcagaaggcttg

SEQ ID NO: 527057 - DNA, 25 bp, Mus musculus
agagtcgctagttgcagaaggcttg

SEQ ID NO: 527058 - DNA, 25 bp, Mus musculus
agagtcggaataagaagcggactgc

SEQ ID NO: 527059 - DNA, 25 bp, Mus musculus
agagtcggaatatgaagcggactgc

SEQ ID NO: 527060 - DNA, 25 bp, Mus musculus
agagtcgggccgctcgttctctcgc

SEQ ID NO: 527061 - DNA, 25 bp, Mus musculus
agagtcgggccggtcgttctctcgc

SEQ ID NO: 527062 - DNA, 25 bp, Mus musculus
agagtcgtcggtacccgctactgca

SEQ ID NO: 527063 - DNA, 25 bp, Mus musculus
agagtcgtcggttcccgctactgca

SEQ ID NO: 527064 - DNA, 25 bp, Mus musculus
agagtctagtgactgtgcaccctgg

SEQ ID NO: 527065 - DNA, 25 bp, Mus musculus
agagtctagtgagtgtgcaccctgg

SEQ ID NO: 527066 - DNA, 25 bp, Mus musculus
agagtctctcaacgctgtcctccta

SEQ ID NO: 527067 - DNA, 25 bp, Mus musculus
agagtctctcaaggctgtcctccta

SEQ ID NO: 527068 - DNA, 25 bp, Mus musculus
agagtctggtgtcaaaatgacaaag

SEQ ID NO: 527069 - DNA, 25 bp, Mus musculus
agagtctggtgtgaaaatgacaaag

SEQ ID NO: 527070 - DNA, 25 bp, Mus musculus
agagtgaacttcatcgggacaggag

SEQ ID NO: 527071 - DNA, 25 bp, Mus musculus
agagtgaacttcttcgggacaggag

SEQ ID NO: 527072 - DNA, 25 bp, Mus musculus
agagtgaagggcattgtccaaccca

SEQ ID NO: 527073 - DNA, 25 bp, Mus musculus
agagtgaagggctttgtccaaccca

SEQ ID NO: 527074 - DNA, 25 bp, Mus musculus
agagtgacaacaccgcagactcctg

SEQ ID NO: 527075 - DNA, 25 bp, Mus musculus
agagtgacaacagcgcagactcctg

SEQ ID NO: 527076 - DNA, 25 bp, Mus musculus
agagtgaccaacaggtctggaggac

SEQ ID NO: 527077 - DNA, 25 bp, Mus musculus
agagtgaccaactggtctggaggac

SEQ ID NO: 527078 - DNA, 25 bp, Mus musculus
agagtgacgcgcagactcggctccc

SEQ ID NO: 527079 - DNA, 25 bp, Mus musculus
agagtgacgcgctgactcggctccc

SEQ ID NO: 527080 - DNA, 25 bp, Mus musculus
agagtgacgtgaagtcactggctga

SEQ ID NO: 527081 - DNA, 25 bp, Mus musculus
agagtgacgtgatgtcactggctga

SEQ ID NO: 527082 - DNA, 25 bp, Mus musculus
agagtgagacttcctgccccataac

SEQ ID NO: 527083 - DNA, 25 bp, Mus musculus
agagtgagacttgctgccccataac

SEQ ID NO: 527084 - DNA, 25 bp, Mus musculus
agagtgagatatccacccagggact

SEQ ID NO: 527085 - DNA, 25 bp, Mus musculus
agagtgagatatgcacccagggact

SEQ ID NO: 527086 - DNA, 25 bp, Mus musculus
agagtgagcaagcagcaggaccact

SEQ ID NO: 527087 - DNA, 25 bp, Mus musculus
agagtgagcaaggagcaggaccact

SEQ ID NO: 527088 - DNA, 25 bp, Mus musculus
agagtgagcctaacatcgctgtgga

SEQ ID NO: 527089 - DNA, 25 bp, Mus musculus
agagtgagcctatcatcgctgtgga

SEQ ID NO: 527090 - DNA, 25 bp, Mus musculus
agagtgagctctaggagatttcagg

SEQ ID NO: 527091 - DNA, 25 bp, Mus musculus
agagtgagctcttggagatttcagg

SEQ ID NO: 527092 - DNA, 25 bp, Mus musculus
agagtgagctgcattcatatctcac

SEQ ID NO: 527093 - DNA, 25 bp, Mus musculus
agagtgagctgctttcatatctcac

SEQ ID NO: 527094 - DNA, 25 bp, Mus musculus
agagtgagtgctctcatcggttgcc

SEQ ID NO: 527095 - DNA, 25 bp, Mus musculus
agagtgagtgctgtcatcggttgcc

SEQ ID NO: 527096 - DNA, 25 bp, Mus musculus
agagtgatgcccagagacatggagc

SEQ ID NO: 527097 - DNA, 25 bp, Mus musculus
agagtgatgccctgagacatggagc

SEQ ID NO: 527098 - DNA, 25 bp, Mus musculus
agagtgcaatgcaggtaatcttcac

SEQ ID NO: 527099 - DNA, 25 bp, Mus musculus
agagtgcaatgctggtaatcttcac

SEQ ID NO: 527100 - DNA, 25 bp, Mus musculus
agagtgcccataacacagaacccct

SEQ ID NO: 527101 - DNA, 25 bp, Mus musculus
agagtgcccatatcacagaacccct

SEQ ID NO: 527102 - DNA, 25 bp, Mus musculus
agagtgccgactatatgccccgctg

SEQ ID NO: 527103 - DNA, 25 bp, Mus musculus
agagtgccgactttatgccccgctg

SEQ ID NO: 527104 - DNA, 25 bp, Mus musculus
agagtgccttgtctgcccatgtgcc

SEQ ID NO: 527105 - DNA, 25 bp, Mus musculus
agagtgccttgtgtgcccatgtgcc

SEQ ID NO: 527106 - DNA, 25 bp, Mus musculus
agagtggaacagctgacaagaaaaa

SEQ ID NO: 527107 - DNA, 25 bp, Mus musculus
agagtggaacaggtgacaagaaaaa

SEQ ID NO: 527108 - DNA, 25 bp, Mus musculus
agagtggaccaactgctttaatgca

SEQ ID NO: 527109 - DNA, 25 bp, Mus musculus
agagtggaccaagtgctttaatgca

SEQ ID NO: 527110 - DNA, 25 bp, Mus musculus
agagtggactgtccagatgctcttc

SEQ ID NO: 527111 - DNA, 25 bp, Mus musculus
agagtggactgtgcagatgctcttc

SEQ ID NO: 527112 - DNA, 25 bp, Mus musculus
agagtggaggaactgcacaccagcc

SEQ ID NO: 527113 - DNA, 25 bp, Mus musculus
agagtggaggaagtgcacaccagcc

SEQ ID NO: 527114 - DNA, 25 bp, Mus musculus
agagtggccagaaccgcttagcaga

SEQ ID NO: 527115 - DNA, 25 bp, Mus musculus
agagtggccagatccgcttagcaga

SEQ ID NO: 527116 - DNA, 25 bp, Mus musculus
agagtggccgccctgcaaggcatcc

SEQ ID NO: 527117 - DNA, 25 bp, Mus musculus
agagtggccgccgtgcaaggcatcc

SEQ ID NO: 527118 - DNA, 25 bp, Mus musculus
agagtggccgctactattgtctcaa

SEQ ID NO: 527119 - DNA, 25 bp, Mus musculus
agagtggccgcttctattgtctcaa

SEQ ID NO: 527120 - DNA, 25 bp, Mus musculus
agagtggccgtgagtcagacaccag

SEQ ID NO: 527121 - DNA, 25 bp, Mus musculus
agagtggccgtgtgtcagacaccag

SEQ ID NO: 527122 - DNA, 25 bp, Mus musculus
agagtggcgatacctacagaggaac

SEQ ID NO: 527123 - DNA, 25 bp, Mus musculus
agagtggcgatagctacagaggaac

SEQ ID NO: 527124 - DNA, 25 bp, Mus musculus
agagtggcgatgacagcttcgatga

SEQ ID NO: 527125 - DNA, 25 bp, Mus musculus
agagtggcgatgtcagcttcgatga

SEQ ID NO: 527126 - DNA, 25 bp, Mus musculus
agagtggctgtgacccatccgagag

SEQ ID NO: 527127 - DNA, 25 bp, Mus musculus
agagtggctgtgtcccatccgagag

SEQ ID NO: 527128 - DNA, 25 bp, Mus musculus
agagtggcttccatccttcgggagc

SEQ ID NO: 527129 - DNA, 25 bp, Mus musculus
agagtggcttccttccttcgggagc

SEQ ID NO: 527130 - DNA, 25 bp, Mus musculus
agagtgggaaccactacgccatgaa

SEQ ID NO: 527131 - DNA, 25 bp, Mus musculus
agagtgggaacctctacgccatgaa

SEQ ID NO: 527132 - DNA, 25 bp, Mus musculus
agagtgggaagaacaagcatagcgc

SEQ ID NO: 527133 - DNA, 25 bp, Mus musculus
agagtgggaagatcaagcatagcgc

SEQ ID NO: 527134 - DNA, 25 bp, Mus musculus
agagtggtacgtcgccctgaacaag

SEQ ID NO: 527135 - DNA, 25 bp, Mus musculus
agagtggtacgtggccctgaacaag

SEQ ID NO: 527136 - DNA, 25 bp, Mus musculus
agagtggtgtatacaacaacactgc

SEQ ID NO: 527137 - DNA, 25 bp, Mus musculus
agagtggtgtattcaacaacactgc

SEQ ID NO: 527138 - DNA, 25 bp, Mus musculus
agagtggttttcagctgcagtcgca

SEQ ID NO: 527139 - DNA, 25 bp, Mus musculus
agagtggttttctgctgcagtcgca

SEQ ID NO: 527140 - DNA, 25 bp, Mus musculus
agagtgtacagcctccaactccctg

SEQ ID NO: 527141 - DNA, 25 bp, Mus musculus
agagtgtacagcgtccaactccctg

SEQ ID NO: 527142 - DNA, 25 bp, Mus musculus
agagtgtatttgaagcctttggcaa

SEQ ID NO: 527143 - DNA, 25 bp, Mus musculus
agagtgtatttgtagcctttggcaa

SEQ ID NO: 527144 - DNA, 25 bp, Mus musculus
agagtgtcagaaatatgccaaggag

SEQ ID NO: 527145 - DNA, 25 bp, Mus musculus
agagtgtcagaattatgccaaggag

SEQ ID NO: 527146 - DNA, 25 bp, Mus musculus
agagtgtgtatgagaccagcactag

SEQ ID NO: 527147 - DNA, 25 bp, Mus musculus
agagtgtgtatgtgaccagcactag

SEQ ID NO: 527148 - DNA, 25 bp, Mus musculus
agagtgtgtgcaaggccatgttgcc

SEQ ID NO: 527149 - DNA, 25 bp, Mus musculus
agagtgtgtgcatggccatgttgcc

SEQ ID NO: 527150 - DNA, 25 bp, Mus musculus
agagttaagcaacctggctgagacc

SEQ ID NO: 527151 - DNA, 25 bp, Mus musculus
agagttaagcaagctggctgagacc

SEQ ID NO: 527152 - DNA, 25 bp, Mus musculus
agagttaccgaacgcttcaccccag

SEQ ID NO: 527153 - DNA, 25 bp, Mus musculus
agagttaccgaaggcttcaccccag

SEQ ID NO: 527154 - DNA, 25 bp, Mus musculus
agagttactatcatggcccttgtgc

SEQ ID NO: 527155 - DNA, 25 bp, Mus musculus
agagttactatcttggcccttgtgc

SEQ ID NO: 527156 - DNA, 25 bp, Mus musculus
agagttagaccccacttgccagagg

SEQ ID NO: 527157 - DNA, 25 bp, Mus musculus
agagttagacccgacttgccagagg

SEQ ID NO: 527158 - DNA, 25 bp, Mus musculus
agagttcacagtcccgtgatttcca

SEQ ID NO: 527159 - DNA, 25 bp, Mus musculus
agagttcacagtgccgtgatttcca

SEQ ID NO: 527160 - DNA, 25 bp, Mus musculus
agagttcacggaccattacattgag

SEQ ID NO: 527161 - DNA, 25 bp, Mus musculus
agagttcacggagcattacattgag

SEQ ID NO: 527162 - DNA, 25 bp, Mus musculus
agagttcatcttcgctcctcgactg

SEQ ID NO: 527163 - DNA, 25 bp, Mus musculus
agagttcatcttggctcctcgactg

SEQ ID NO: 527164 - DNA, 25 bp, Mus musculus
agagttcccatgcttctgactccgg

SEQ ID NO: 527165 - DNA, 25 bp, Mus musculus
agagttcccatggttctgactccgg

SEQ ID NO: 527166 - DNA, 25 bp, Mus musculus
agagttcctctaagacctgttgcag

SEQ ID NO: 527167 - DNA, 25 bp, Mus musculus
agagttcctctatgacctgttgcag

SEQ ID NO: 527168 - DNA, 25 bp, Mus musculus
agagttcctggaagaccttttcagc

SEQ ID NO: 527169 - DNA, 25 bp, Mus musculus
agagttcctggatgaccttttcagc

SEQ ID NO: 527170 - DNA, 25 bp, Mus musculus
agagttctgtccactgtctagggca

SEQ ID NO: 527171 - DNA, 25 bp, Mus musculus
agagttctgtcctctgtctagggca

SEQ ID NO: 527172 - DNA, 25 bp, Mus musculus
agagttctgtcgcacctatgtcctg

SEQ ID NO: 527173 - DNA, 25 bp, Mus musculus
agagttctgtcggacctatgtcctg

SEQ ID NO: 527174 - DNA, 25 bp, Mus musculus
agagttctgtgaaccctgaccggga

SEQ ID NO: 527175 - DNA, 25 bp, Mus musculus
agagttctgtgatccctgaccggga

SEQ ID NO: 527176 - DNA, 25 bp, Mus musculus
agagttgaatccaagtttaccgcca

SEQ ID NO: 527177 - DNA, 25 bp, Mus musculus
agagttgaatcctagtttaccgcca

SEQ ID NO: 527178 - DNA, 25 bp, Mus musculus
agagttgactccctgaaaagtgcag

SEQ ID NO: 527179 - DNA, 25 bp, Mus musculus
agagttgactccgtgaaaagtgcag

SEQ ID NO: 527180 - DNA, 25 bp, Mus musculus
agagttgagttgcaattttagcccc

SEQ ID NO: 527181 - DNA, 25 bp, Mus musculus
agagttgagttggaattttagcccc

SEQ ID NO: 527182 - DNA, 25 bp, Mus musculus
agagttgcttgcagtgagtctgttg

SEQ ID NO: 527183 - DNA, 25 bp, Mus musculus
agagttgcttgctgtgagtctgttg

SEQ ID NO: 527184 - DNA, 25 bp, Mus musculus
agagttggcccactaccgccactgg

SEQ ID NO: 527185 - DNA, 25 bp, Mus musculus
agagttggcccagtaccgccactgg

SEQ ID NO: 527186 - DNA, 25 bp, Mus musculus
agagttggcctacctgtgcgcgcac

SEQ ID NO: 527187 - DNA, 25 bp, Mus musculus
agagttggcctagctgtgcgcgcac

SEQ ID NO: 527188 - DNA, 25 bp, Mus musculus
agagttgttgtcactgcgctatgac

SEQ ID NO: 527189 - DNA, 25 bp, Mus musculus
agagttgttgtctctgcgctatgac

SEQ ID NO: 527190 - DNA, 25 bp, Mus musculus
agagtttatgatcctcaaggccctg

SEQ ID NO: 527191 - DNA, 25 bp, Mus musculus
agagtttatgatgctcaaggccctg

SEQ ID NO: 527192 - DNA, 25 bp, Mus musculus
agagtttccgcaacggccagtacgc

SEQ ID NO: 527193 - DNA, 25 bp, Mus musculus
agagtttccgcatcggccagtacgc

SEQ ID NO: 527194 - DNA, 25 bp, Mus musculus
agagtttcttaaatttcaccgagca

SEQ ID NO: 527195 - DNA, 25 bp, Mus musculus
agagtttcttaattttcaccgagca

SEQ ID NO: 527196 - DNA, 25 bp, Mus musculus
agagtttcttcaagcgcagcatccg

SEQ ID NO: 527197 - DNA, 25 bp, Mus musculus
agagtttcttcatgcgcagcatccg

SEQ ID NO: 527198 - DNA, 25 bp, Mus musculus
agagtttggcatcttggacaaggtc

SEQ ID NO: 527199 - DNA, 25 bp, Mus musculus
agagtttggcatgttggacaaggtc

SEQ ID NO: 527200 - DNA, 25 bp, Mus musculus
agagtttttacgctggtgatcgaga

SEQ ID NO: 527201 - DNA, 25 bp, Mus musculus
agagtttttacggtggtgatcgaga

SEQ ID NO: 527202 - DNA, 25 bp, Mus musculus
agagtttttactctgttgtggctga

SEQ ID NO: 527203 - DNA, 25 bp, Mus musculus
agagtttttactgtgttgtggctga

SEQ ID NO: 527204 - DNA, 25 bp, Mus musculus
agataaaaacttccgccagagaaac

SEQ ID NO: 527205 - DNA, 25 bp, Mus musculus
agataaaaacttgcgccagagaaac

SEQ ID NO: 527206 - DNA, 25 bp, Mus musculus
agataaaagctcagagccgggcgtg

SEQ ID NO: 527207 - DNA, 25 bp, Mus musculus
agataaaagctctgagccgggcgtg

SEQ ID NO: 527208 - DNA, 25 bp, Mus musculus
agataaaccactagctgagtggctg

SEQ ID NO: 527209 - DNA, 25 bp, Mus musculus
agataaaccacttgctgagtggctg

SEQ ID NO: 527210 - DNA, 25 bp, Mus musculus
agataacactgcaggatgtccggcg

SEQ ID NO: 527211 - DNA, 25 bp, Mus musculus
agataacactgctggatgtccggcg

SEQ ID NO: 527212 - DNA, 25 bp, Mus musculus
agataacagcgtcgtgtccttgtcc

SEQ ID NO: 527213 - DNA, 25 bp, Mus musculus
agataacagcgtggtgtccttgtcc

SEQ ID NO: 527214 - DNA, 25 bp, Mus musculus
agataacaggcaccgcacccgtctt

SEQ ID NO: 527215 - DNA, 25 bp, Mus musculus
agataacaggcagcgcacccgtctt

SEQ ID NO: 527216 - DNA, 25 bp, Mus musculus
agataaccaaatctgccgtgatgta

SEQ ID NO: 527217 - DNA, 25 bp, Mus musculus
agataaccaaatgtgccgtgatgta

SEQ ID NO: 527218 - DNA, 25 bp, Mus musculus
agataacctagtctcccgtcagctc

SEQ ID NO: 527219 - DNA, 25 bp, Mus musculus
agataacctagtgtcccgtcagctc

SEQ ID NO: 527220 - DNA, 25 bp, Mus musculus
agataacggactacgggctgtgcaa

SEQ ID NO: 527221 - DNA, 25 bp, Mus musculus
agataacggacttcgggctgtgcaa

SEQ ID NO: 527222 - DNA, 25 bp, Mus musculus
agataaggacgccatgctgaatgca

SEQ ID NO: 527223 - DNA, 25 bp, Mus musculus
agataaggacgcgatgctgaatgca

SEQ ID NO: 527224 - DNA, 25 bp, Mus musculus
agataaggaggcagcccgactacgg

SEQ ID NO: 527225 - DNA, 25 bp, Mus musculus
agataaggaggctgcccgactacgg

SEQ ID NO: 527226 - DNA, 25 bp, Mus musculus
agataaggattcatcagattggacc

SEQ ID NO: 527227 - DNA, 25 bp, Mus musculus
agataaggattcttcagattggacc

SEQ ID NO: 527228 - DNA, 25 bp, Mus musculus
agataaggcaccctctagacccctg

SEQ ID NO: 527229 - DNA, 25 bp, Mus musculus
agataaggcaccgtctagacccctg

SEQ ID NO: 527230 - DNA, 25 bp, Mus musculus
agataaggcgctacaggactatcgc

SEQ ID NO: 527231 - DNA, 25 bp, Mus musculus
agataaggcgcttcaggactatcgc

SEQ ID NO: 527232 - DNA, 25 bp, Mus musculus
agataagtttctcgacagcctaggc

SEQ ID NO: 527233 - DNA, 25 bp, Mus musculus
agataagtttctggacagcctaggc

SEQ ID NO: 527234 - DNA, 25 bp, Mus musculus
agataatcagcacgcgcacacaaag

SEQ ID NO: 527235 - DNA, 25 bp, Mus musculus
agataatcagcaggcgcacacaaag

SEQ ID NO: 527236 - DNA, 25 bp, Mus musculus
agataatcggacattcacactgaga

SEQ ID NO: 527237 - DNA, 25 bp, Mus musculus
agataatcggactttcacactgaga

SEQ ID NO: 527238 - DNA, 25 bp, Mus musculus
agataatgagcaccccttggttgca

SEQ ID NO: 527239 - DNA, 25 bp, Mus musculus
agataatgagcagcccttggttgca

SEQ ID NO: 527240 - DNA, 25 bp, Mus musculus
agataatgttctcgccaatgaggac

SEQ ID NO: 527241 - DNA, 25 bp, Mus musculus
agataatgttctggccaatgaggac

SEQ ID NO: 527242 - DNA, 25 bp, Mus musculus
agatacaaccacacgactgcaggca

SEQ ID NO: 527243 - DNA, 25 bp, Mus musculus
agatacaaccactcgactgcaggca

SEQ ID NO: 527244 - DNA, 25 bp, Mus musculus
agatacagccaacaccacggagagc

SEQ ID NO: 527245 - DNA, 25 bp, Mus musculus
agatacagccaagaccacggagagc

SEQ ID NO: 527246 - DNA, 25 bp, Mus musculus
agatacagctgtccatgcactggcc

SEQ ID NO: 527247 - DNA, 25 bp, Mus musculus
agatacagctgtgcatgcactggcc

SEQ ID NO: 527248 - DNA, 25 bp, Mus musculus
agatacatagcaaacagcaactcca

SEQ ID NO: 527249 - DNA, 25 bp, Mus musculus
agatacatagcatacagcaactcca

SEQ ID NO: 527250 - DNA, 25 bp, Mus musculus
agataccagtgccaggcctgtgccc

SEQ ID NO: 527251 - DNA, 25 bp, Mus musculus
agataccagtgcgaggcctgtgccc

SEQ ID NO: 527252 - DNA, 25 bp, Mus musculus
agataccagtgtctcaggtgccaga

SEQ ID NO: 527253 - DNA, 25 bp, Mus musculus
agataccagtgtgtcaggtgccaga

SEQ ID NO: 527254 - DNA, 25 bp, Mus musculus
agatacccgactcctgatgggccca

SEQ ID NO: 527255 - DNA, 25 bp, Mus musculus
agatacccgactgctgatgggccca

SEQ ID NO: 527256 - DNA, 25 bp, Mus musculus
agataccggcgccatgtccagcgct

SEQ ID NO: 527257 - DNA, 25 bp, Mus musculus
agataccggcgcgatgtccagcgct

SEQ ID NO: 527258 - DNA, 25 bp, Mus musculus
agatacctcggacccaggtggaccc

SEQ ID NO: 527259 - DNA, 25 bp, Mus musculus
agatacctcggagccaggtggaccc

SEQ ID NO: 527260 - DNA, 25 bp, Mus musculus
agatacctggacatcttctctggga

SEQ ID NO: 527261 - DNA, 25 bp, Mus musculus
agatacctggacttcttctctggga

SEQ ID NO: 527262 - DNA, 25 bp, Mus musculus
agatacctggttagggctgcctcct

SEQ ID NO: 527263 - DNA, 25 bp, Mus musculus
agatacctggtttgggctgcctcct

SEQ ID NO: 527264 - DNA, 25 bp, Mus musculus
agatacgaaacacattgaagcaaag

SEQ ID NO: 527265 - DNA, 25 bp, Mus musculus
agatacgaaacagattgaagcaaag

SEQ ID NO: 527266 - DNA, 25 bp, Mus musculus
agatacgacccgataccaagtgctg

SEQ ID NO: 527267 - DNA, 25 bp, Mus musculus
agatacgacccgttaccaagtgctg

SEQ ID NO: 527268 - DNA, 25 bp, Mus musculus
agatacggctcaagagcttccttcc

SEQ ID NO: 527269 - DNA, 25 bp, Mus musculus
agatacggctcatgagcttccttcc

SEQ ID NO: 527270 - DNA, 25 bp, Mus musculus
agatacgtcactcttctcctggacc

SEQ ID NO: 527271 - DNA, 25 bp, Mus musculus
agatacgtcactgttctcctggacc

SEQ ID NO: 527272 - DNA, 25 bp, Mus musculus
agatacgtgcgaccctgtcacctga

SEQ ID NO: 527273 - DNA, 25 bp, Mus musculus
agatacgtgcgagcctgtcacctga

SEQ ID NO: 527274 - DNA, 25 bp, Mus musculus
agatacgttcctcctccgctcaaag

SEQ ID NO: 527275 - DNA, 25 bp, Mus musculus
agatacgttcctgctccgctcaaag

SEQ ID NO: 527276 - DNA, 25 bp, Mus musculus
agatactcaatgagcgagaagcctc

SEQ ID NO: 527277 - DNA, 25 bp, Mus musculus
agatactcaatgtgcgagaagcctc

SEQ ID NO: 527278 - DNA, 25 bp, Mus musculus
agatactgtgccacgagctgcggaa

SEQ ID NO: 527279 - DNA, 25 bp, Mus musculus
agatactgtgcctcgagctgcggaa

SEQ ID NO: 527280 - DNA, 25 bp, Mus musculus
agatagaattcacctgccaggaagg

SEQ ID NO: 527281 - DNA, 25 bp, Mus musculus
agatagaattcagctgccaggaagg

SEQ ID NO: 527282 - DNA, 25 bp, Mus musculus
agatagacacgtacctcaacgccgc

SEQ ID NO: 527283 - DNA, 25 bp, Mus musculus
agatagacacgttcctcaacgccgc

SEQ ID NO: 527284 - DNA, 25 bp, Mus musculus
agatagacatcgaacccacagacaa

SEQ ID NO: 527285 - DNA, 25 bp, Mus musculus
agatagacatcgtacccacagacaa

SEQ ID NO: 527286 - DNA, 25 bp, Mus musculus
agatagagtaccaggacctgagtca

SEQ ID NO: 527287 - DNA, 25 bp, Mus musculus
agatagagtacctggacctgagtca

SEQ ID NO: 527288 - DNA, 25 bp, Mus musculus
agatagagtcgtagcccctgggcca

SEQ ID NO: 527289 - DNA, 25 bp, Mus musculus
agatagagtcgttgcccctgggcca

SEQ ID NO: 527290 - DNA, 25 bp, Mus musculus
agatagcctgccattaactgaaaat

SEQ ID NO: 527291 - DNA, 25 bp, Mus musculus
agatagcctgcctttaactgaaaat

SEQ ID NO: 527292 - DNA, 25 bp, Mus musculus
agatagcgaagaagagatccgcgag

SEQ ID NO: 527293 - DNA, 25 bp, Mus musculus
agatagcgaagatgagatccgcgag

SEQ ID NO: 527294 - DNA, 25 bp, Mus musculus
agatagctgtccctttgaactgaaa

SEQ ID NO: 527295 - DNA, 25 bp, Mus musculus
agatagctgtccgtttgaactgaaa

SEQ ID NO: 527296 - DNA, 25 bp, Mus musculus
agataggaaaaaagaagcgacagaa

SEQ ID NO: 527297 - DNA, 25 bp, Mus musculus
agataggaaaaatgaagcgacagaa

SEQ ID NO: 527298 - DNA, 25 bp, Mus musculus
agataggagccaatggttgggataa

SEQ ID NO: 527299 - DNA, 25 bp, Mus musculus
agataggagccattggttgggataa

SEQ ID NO: 527300 - DNA, 25 bp, Mus musculus
agataggctagacctccaggctgga

SEQ ID NO: 527301 - DNA, 25 bp, Mus musculus
agataggctagagctccaggctgga

SEQ ID NO: 527302 - DNA, 25 bp, Mus musculus
agataggctggtatgatgtgcatga

SEQ ID NO: 527303 - DNA, 25 bp, Mus musculus
agataggctggtttgatgtgcatga

SEQ ID NO: 527304 - DNA, 25 bp, Mus musculus
agatagtttaaccaagcagcccgag

SEQ ID NO: 527305 - DNA, 25 bp, Mus musculus
agatagtttaacgaagcagcccgag

SEQ ID NO: 527306 - DNA, 25 bp, Mus musculus
agatatagatgcagtctctaaacag

SEQ ID NO: 527307 - DNA, 25 bp, Mus musculus
agatatagatgctgtctctaaacag

SEQ ID NO: 527308 - DNA, 25 bp, Mus musculus
agatatatttcccaatcagcctggt

SEQ ID NO: 527309 - DNA, 25 bp, Mus musculus
agatatatttccgaatcagcctggt

SEQ ID NO: 527310 - DNA, 25 bp, Mus musculus
agatatcaaccaagaaaacctccag

SEQ ID NO: 527311 - DNA, 25 bp, Mus musculus
agatatcaaccatgaaaacctccag

SEQ ID NO: 527312 - DNA, 25 bp, Mus musculus
agatatccctgaaagccctctcggt

SEQ ID NO: 527313 - DNA, 25 bp, Mus musculus
agatatccctgatagccctctcggt

SEQ ID NO: 527314 - DNA, 25 bp, Mus musculus
agatatgcacccagggactggtggt

SEQ ID NO: 527315 - DNA, 25 bp, Mus musculus
agatatgcaccctgggactggtggt

SEQ ID NO: 527316 - DNA, 25 bp, Mus musculus
agatatgcagctctgaggaccctga

SEQ ID NO: 527317 - DNA, 25 bp, Mus musculus
agatatgcagctgtgaggaccctga

SEQ ID NO: 527318 - DNA, 25 bp, Mus musculus
agatatgcgagtacctgcgccttcc

SEQ ID NO: 527319 - DNA, 25 bp, Mus musculus
agatatgcgagttcctgcgccttcc

SEQ ID NO: 527320 - DNA, 25 bp, Mus musculus
agatatgggcttcgctgctgatgta

SEQ ID NO: 527321 - DNA, 25 bp, Mus musculus
agatatgggcttggctgctgatgta

SEQ ID NO: 527322 - DNA, 25 bp, Mus musculus
agatatgggtctccttctgactgtc

SEQ ID NO: 527323 - DNA, 25 bp, Mus musculus
agatatgggtctgcttctgactgtc

SEQ ID NO: 527324 - DNA, 25 bp, Mus musculus
agatatgtctgtctgctttaccatg

SEQ ID NO: 527325 - DNA, 25 bp, Mus musculus
agatatgtctgtgtgctttaccatg

SEQ ID NO: 527326 - DNA, 25 bp, Mus musculus
agatattaagacatctctcaggaac

SEQ ID NO: 527327 - DNA, 25 bp, Mus musculus
agatattaagacttctctcaggaac

SEQ ID NO: 527328 - DNA, 25 bp, Mus musculus
agatattactcgagagggcctcccg

SEQ ID NO: 527329 - DNA, 25 bp, Mus musculus
agatattactcgtgagggcctcccg

SEQ ID NO: 527330 - DNA, 25 bp, Mus musculus
agatattcagcacgtactcccaccg

SEQ ID NO: 527331 - DNA, 25 bp, Mus musculus
agatattcagcaggtactcccaccg

SEQ ID NO: 527332 - DNA, 25 bp, Mus musculus
agatattcctcaccaacagcgccat

SEQ ID NO: 527333 - DNA, 25 bp, Mus musculus
agatattcctcagcaacagcgccat

SEQ ID NO: 527334 - DNA, 25 bp, Mus musculus
agatcaaaacctattcctgggacaa

SEQ ID NO: 527335 - DNA, 25 bp, Mus musculus
agatcaaaaccttttcctgggacaa

SEQ ID NO: 527336 - DNA, 25 bp, Mus musculus
agatcaacttccacaagacccttca

SEQ ID NO: 527337 - DNA, 25 bp, Mus musculus
agatcaacttcctcaagacccttca

SEQ ID NO: 527338 - DNA, 25 bp, Mus musculus
agatcaacttcgcagggtctgggaa

SEQ ID NO: 527339 - DNA, 25 bp, Mus musculus
agatcaacttcggagggtctgggaa

SEQ ID NO: 527340 - DNA, 25 bp, Mus musculus
agatcaagaagtccccactcaccat

SEQ ID NO: 527341 - DNA, 25 bp, Mus musculus
agatcaagaagtgcccactcaccat

SEQ ID NO: 527342 - DNA, 25 bp, Mus musculus
agatcaagccccagtcggtgtgcgc

SEQ ID NO: 527343 - DNA, 25 bp, Mus musculus
agatcaagcccctgtcggtgtgcgc

SEQ ID NO: 527344 - DNA, 25 bp, Mus musculus
agatcaaggacaagggctcgtatga

SEQ ID NO: 527345 - DNA, 25 bp, Mus musculus
agatcaaggacatgggctcgtatga

SEQ ID NO: 527346 - DNA, 25 bp, Mus musculus
agatcaaggcgcaggaacagatgct

SEQ ID NO: 527347 - DNA, 25 bp, Mus musculus
agatcaaggcgctggaacagatgct

SEQ ID NO: 527348 - DNA, 25 bp, Mus musculus
agatcaaggtcaacaatcacttttt

SEQ ID NO: 527349 - DNA, 25 bp, Mus musculus
agatcaaggtcatcaatcacttttt

SEQ ID NO: 527350 - DNA, 25 bp, Mus musculus
agatcaaggttcactctgacaagct

SEQ ID NO: 527351 - DNA, 25 bp, Mus musculus
agatcaaggttctctctgacaagct

SEQ ID NO: 527352 - DNA, 25 bp, Mus musculus
agatcaagtcttctacgctggcccg

SEQ ID NO: 527353 - DNA, 25 bp, Mus musculus
agatcaagtcttgtacgctggcccg

SEQ ID NO: 527354 - DNA, 25 bp, Mus musculus
agatcaagttctcgttggagatgaa

SEQ ID NO: 527355 - DNA, 25 bp, Mus musculus
agatcaagttctggttggagatgaa

SEQ ID NO: 527356 - DNA, 25 bp, Mus musculus
agatcaatgcatactcattactggg

SEQ ID NO: 527357 - DNA, 25 bp, Mus musculus
agatcaatgcattctcattactggg

SEQ ID NO: 527358 - DNA, 25 bp, Mus musculus
agatcaatgttgatgactgccatcc

SEQ ID NO: 527359 - DNA, 25 bp, Mus musculus
agatcaatgttgttgactgccatcc

SEQ ID NO: 527360 - DNA, 25 bp, Mus musculus
agatcacagaccagagacggaccct

SEQ ID NO: 527361 - DNA, 25 bp, Mus musculus
agatcacagacctgagacggaccct

SEQ ID NO: 527362 - DNA, 25 bp, Mus musculus
agatcacagggaattctgggaagag

SEQ ID NO: 527363 - DNA, 25 bp, Mus musculus
agatcacagggatttctgggaagag

SEQ ID NO: 527364 - DNA, 25 bp, Mus musculus
agatcacaggtgagtcttgccggga

SEQ ID NO: 527365 - DNA, 25 bp, Mus musculus
agatcacaggtgtgtcttgccggga

SEQ ID NO: 527366 - DNA, 25 bp, Mus musculus
agatcacatttccttcttgagcaag

SEQ ID NO: 527367 - DNA, 25 bp, Mus musculus
agatcacatttcgttcttgagcaag

SEQ ID NO: 527368 - DNA, 25 bp, Mus musculus
agatcaccctggagtcggagcggat

SEQ ID NO: 527369 - DNA, 25 bp, Mus musculus
agatcaccctggtgtcggagcggat

SEQ ID NO: 527370 - DNA, 25 bp, Mus musculus
agatcaccgaggagaagccgctgtt

SEQ ID NO: 527371 - DNA, 25 bp, Mus musculus
agatcaccgaggtgaagccgctgtt

SEQ ID NO: 527372 - DNA, 25 bp, Mus musculus
agatcacctgatctctggcaccctg

SEQ ID NO: 527373 - DNA, 25 bp, Mus musculus
agatcacctgatgtctggcaccctg

SEQ ID NO: 527374 - DNA, 25 bp, Mus musculus
agatcaccttccatcatgtctatca

SEQ ID NO: 527375 - DNA, 25 bp, Mus musculus
agatcaccttccttcatgtctatca

SEQ ID NO: 527376 - DNA, 25 bp, Mus musculus
agatcactcagcagcaggccgagat

SEQ ID NO: 527377 - DNA, 25 bp, Mus musculus
agatcactcagctgcaggccgagat

SEQ ID NO: 527378 - DNA, 25 bp, Mus musculus
agatcagactacagctgaggtgaca

SEQ ID NO: 527379 - DNA, 25 bp, Mus musculus
agatcagactactgctgaggtgaca

SEQ ID NO: 527380 - DNA, 25 bp, Mus musculus
agatcagactccactaccgctctgg

SEQ ID NO: 527381 - DNA, 25 bp, Mus musculus
agatcagactcctctaccgctctgg

SEQ ID NO: 527382 - DNA, 25 bp, Mus musculus
agatcagaggcacaactctcctgca

SEQ ID NO: 527383 - DNA, 25 bp, Mus musculus
agatcagaggcagaactctcctgca

SEQ ID NO: 527384 - DNA, 25 bp, Mus musculus
agatcagcaaccacatcgacataat

SEQ ID NO: 527385 - DNA, 25 bp, Mus musculus
agatcagcaacctcatcgacataat

SEQ ID NO: 527386 - DNA, 25 bp, Mus musculus
agatcagcagagaaaccttccaggg

SEQ ID NO: 527387 - DNA, 25 bp, Mus musculus
agatcagcagagtaaccttccaggg

SEQ ID NO: 527388 - DNA, 25 bp, Mus musculus
agatcagcaggacgctgcgcacaac

SEQ ID NO: 527389 - DNA, 25 bp, Mus musculus
agatcagcaggaggctgcgcacaac

SEQ ID NO: 527390 - DNA, 25 bp, Mus musculus
agatcagccatcctcgtggagccgc

SEQ ID NO: 527391 - DNA, 25 bp, Mus musculus
agatcagccatcgtcgtggagccgc

SEQ ID NO: 527392 - DNA, 25 bp, Mus musculus
agatcagcctgcatttcagcaactg

SEQ ID NO: 527393 - DNA, 25 bp, Mus musculus
agatcagcctgcttttcagcaactg

SEQ ID NO: 527394 - DNA, 25 bp, Mus musculus
agatcagcgaccaggaccggcagat

SEQ ID NO: 527395 - DNA, 25 bp, Mus musculus
agatcagcgacctggaccggcagat

SEQ ID NO: 527396 - DNA, 25 bp, Mus musculus
agatcagcgagaaccggcagatgtc

SEQ ID NO: 527397 - DNA, 25 bp, Mus musculus
agatcagcgagatccggcagatgtc

SEQ ID NO: 527398 - DNA, 25 bp, Mus musculus
agatcagctacaccgggccttcagc

SEQ ID NO: 527399 - DNA, 25 bp, Mus musculus
agatcagctacagcgggccttcagc

SEQ ID NO: 527400 - DNA, 25 bp, Mus musculus
agatcagctgaaactctactcggag

SEQ ID NO: 527401 - DNA, 25 bp, Mus musculus
agatcagctgaatctctactcggag

SEQ ID NO: 527402 - DNA, 25 bp, Mus musculus
agatcaggacctactgccacctttt

SEQ ID NO: 527403 - DNA, 25 bp, Mus musculus
agatcaggaccttctgccacctttt

SEQ ID NO: 527404 - DNA, 25 bp, Mus musculus
agatcaggtcgccacctagacccgg

SEQ ID NO: 527405 - DNA, 25 bp, Mus musculus
agatcaggtcgcgacctagacccgg

SEQ ID NO: 527406 - DNA, 25 bp, Mus musculus
agatcatccactcggtacgggagga

SEQ ID NO: 527407 - DNA, 25 bp, Mus musculus
agatcatccactgggtacgggagga

SEQ ID NO: 527408 - DNA, 25 bp, Mus musculus
agatcatgaagcagacagggtacct

SEQ ID NO: 527409 - DNA, 25 bp, Mus musculus
agatcatgaagctgacagggtacct

SEQ ID NO: 527410 - DNA, 25 bp, Mus musculus
agatcatgtccaagggctacgagcg

SEQ ID NO: 527411 - DNA, 25 bp, Mus musculus
agatcatgtccatgggctacgagcg

SEQ ID NO: 527412 - DNA, 25 bp, Mus musculus
agatcattacctcggaaacggttca

SEQ ID NO: 527413 - DNA, 25 bp, Mus musculus
agatcattacctgggaaacggttca

SEQ ID NO: 527414 - DNA, 25 bp, Mus musculus
agatcattgcgccttccccagtgaa

SEQ ID NO: 527415 - DNA, 25 bp, Mus musculus
agatcattgcgcgttccccagtgaa

SEQ ID NO: 527416 - DNA, 25 bp, Mus musculus
agatcattgctgcacgtgccctgcg

SEQ ID NO: 527417 - DNA, 25 bp, Mus musculus
agatcattgctggacgtgccctgcg

SEQ ID NO: 527418 - DNA, 25 bp, Mus musculus
agatccacagcaaggatcctcgcta

SEQ ID NO: 527419 - DNA, 25 bp, Mus musculus
agatccacagcatggatcctcgcta

SEQ ID NO: 527420 - DNA, 25 bp, Mus musculus
agatccacttcaagatgccaccaca

SEQ ID NO: 527421 - DNA, 25 bp, Mus musculus
agatccacttcatgatgccaccaca

SEQ ID NO: 527422 - DNA, 25 bp, Mus musculus
agatccagctatagacacacctctt

SEQ ID NO: 527423 - DNA, 25 bp, Mus musculus
agatccagctattgacacacctctt

SEQ ID NO: 527424 - DNA, 25 bp, Mus musculus
agatccagtctcacatgggacgcct

SEQ ID NO: 527425 - DNA, 25 bp, Mus musculus
agatccagtctctcatgggacgcct

SEQ ID NO: 527426 - DNA, 25 bp, Mus musculus
agatccatgctgagcgctacctcga

SEQ ID NO: 527427 - DNA, 25 bp, Mus musculus
agatccatgctgtgcgctacctcga

SEQ ID NO: 527428 - DNA, 25 bp, Mus musculus
agatccatgtcaaccgtggaagatt

SEQ ID NO: 527429 - DNA, 25 bp, Mus musculus
agatccatgtcatccgtggaagatt

SEQ ID NO: 527430 - DNA, 25 bp, Mus musculus
agatcccaacccctggatcaagagc

SEQ ID NO: 527431 - DNA, 25 bp, Mus musculus
agatcccaacccgtggatcaagagc

SEQ ID NO: 527432 - DNA, 25 bp, Mus musculus
agatcccagacacaagctaccatcg

SEQ ID NO: 527433 - DNA, 25 bp, Mus musculus
agatcccagacagaagctaccatcg

SEQ ID NO: 527434 - DNA, 25 bp, Mus musculus
agatcccagaccagcggtgacacca

SEQ ID NO: 527435 - DNA, 25 bp, Mus musculus
agatcccagacctgcggtgacacca

SEQ ID NO: 527436 - DNA, 25 bp, Mus musculus
agatcccagcagcatccatagccat

SEQ ID NO: 527437 - DNA, 25 bp, Mus musculus
agatcccagcaggatccatagccat

SEQ ID NO: 527438 - DNA, 25 bp, Mus musculus
agatcccagtgaacggcgccgtgag

SEQ ID NO: 527439 - DNA, 25 bp, Mus musculus
agatcccagtgatcggcgccgtgag

SEQ ID NO: 527440 - DNA, 25 bp, Mus musculus
agatcccggcgcaacggcgtccgag

SEQ ID NO: 527441 - DNA, 25 bp, Mus musculus
agatcccggcgctacggcgtccgag

SEQ ID NO: 527442 - DNA, 25 bp, Mus musculus
agatccctctcacaggcttcgtggc

SEQ ID NO: 527443 - DNA, 25 bp, Mus musculus
agatccctctcagaggcttcgtggc

SEQ ID NO: 527444 - DNA, 25 bp, Mus musculus
agatccgattgcacctggcttacag

SEQ ID NO: 527445 - DNA, 25 bp, Mus musculus
agatccgattgctcctggcttacag

SEQ ID NO: 527446 - DNA, 25 bp, Mus musculus
agatccgccaggaaaccttcacttg

SEQ ID NO: 527447 - DNA, 25 bp, Mus musculus
agatccgccaggtaaccttcacttg

SEQ ID NO: 527448 - DNA, 25 bp, Mus musculus
agatccgccggcagcttgcagcctt

SEQ ID NO: 527449 - DNA, 25 bp, Mus musculus
agatccgccggctgcttgcagcctt

SEQ ID NO: 527450 - DNA, 25 bp, Mus musculus
agatccgcgggaacccgggcctcga

SEQ ID NO: 527451 - DNA, 25 bp, Mus musculus
agatccgcgggatcccgggcctcga

SEQ ID NO: 527452 - DNA, 25 bp, Mus musculus
agatccggttctccgctcctagcga

SEQ ID NO: 527453 - DNA, 25 bp, Mus musculus
agatccggttctgcgctcctagcga

SEQ ID NO: 527454 - DNA, 25 bp, Mus musculus
agatcctaaaatagctcagaacctt

SEQ ID NO: 527455 - DNA, 25 bp, Mus musculus
agatcctaaaattgctcagaacctt

SEQ ID NO: 527456 - DNA, 25 bp, Mus musculus
agatcctacaagacatcaagaccag

SEQ ID NO: 527457 - DNA, 25 bp, Mus musculus
agatcctacaagtcatcaagaccag

SEQ ID NO: 527458 - DNA, 25 bp, Mus musculus
agatcctagagcagatgaatgagga

SEQ ID NO: 527459 - DNA, 25 bp, Mus musculus
agatcctagagctgatgaatgagga

SEQ ID NO: 527460 - DNA, 25 bp, Mus musculus
agatcctcaaacacttcaaacacga

SEQ ID NO: 527461 - DNA, 25 bp, Mus musculus
agatcctcaaactcttcaaacacga

SEQ ID NO: 527462 - DNA, 25 bp, Mus musculus
agatcctcagaacgttctctgtcca

SEQ ID NO: 527463 - DNA, 25 bp, Mus musculus
agatcctcagaaggttctctgtcca

SEQ ID NO: 527464 - DNA, 25 bp, Mus musculus
agatcctccgcaccgacaaggagct

SEQ ID NO: 527465 - DNA, 25 bp, Mus musculus
agatcctccgcagcgacaaggagct

SEQ ID NO: 527466 - DNA, 25 bp, Mus musculus
agatcctctctcacctttgcaatcg

SEQ ID NO: 527467 - DNA, 25 bp, Mus musculus
agatcctctctctcctttgcaatcg

SEQ ID NO: 527468 - DNA, 25 bp, Mus musculus
agatcctgacctctgcccatgtgca

SEQ ID NO: 527469 - DNA, 25 bp, Mus musculus
agatcctgacctgtgcccatgtgca

SEQ ID NO: 527470 - DNA, 25 bp, Mus musculus
agatcctgagcacaaatgtccgccg

SEQ ID NO: 527471 - DNA, 25 bp, Mus musculus
agatcctgagcagaaatgtccgccg

SEQ ID NO: 527472 - DNA, 25 bp, Mus musculus
agatcctgcttgcagcccgctgtct

SEQ ID NO: 527473 - DNA, 25 bp, Mus musculus
agatcctgcttggagcccgctgtct

SEQ ID NO: 527474 - DNA, 25 bp, Mus musculus
agatcctgggtgcacccttcccgag

SEQ ID NO: 527475 - DNA, 25 bp, Mus musculus
agatcctgggtggacccttcccgag

SEQ ID NO: 527476 - DNA, 25 bp, Mus musculus
agatcctgtggtaccggggcctgaa

SEQ ID NO: 527477 - DNA, 25 bp, Mus musculus
agatcctgtggttccggggcctgaa

SEQ ID NO: 527478 - DNA, 25 bp, Mus musculus
agatccttggaaagctaactacaga

SEQ ID NO: 527479 - DNA, 25 bp, Mus musculus
agatccttggaatgctaactacaga

SEQ ID NO: 527480 - DNA, 25 bp, Mus musculus
agatccttttgtaggacgaggccac

SEQ ID NO: 527481 - DNA, 25 bp, Mus musculus
agatccttttgttggacgaggccac

SEQ ID NO: 527482 - DNA, 25 bp, Mus musculus
agatcgaaaggaaggtgggcatcat

SEQ ID NO: 527483 - DNA, 25 bp, Mus musculus
agatcgaaaggatggtgggcatcat

SEQ ID NO: 527484 - DNA, 25 bp, Mus musculus
agatcgacagcaccatgtacccggg

SEQ ID NO: 527485 - DNA, 25 bp, Mus musculus
agatcgacagcagcatgtacccggg

SEQ ID NO: 527486 - DNA, 25 bp, Mus musculus
agatcgacgggaagaaactggtgca

SEQ ID NO: 527487 - DNA, 25 bp, Mus musculus
agatcgacgggatgaaactggtgca

SEQ ID NO: 527488 - DNA, 25 bp, Mus musculus
agatcgagcagcaacggcgctgcga

SEQ ID NO: 527489 - DNA, 25 bp, Mus musculus
agatcgagcagctacggcgctgcga

SEQ ID NO: 527490 - DNA, 25 bp, Mus musculus
agatcgcagaccagtcacctggaga

SEQ ID NO: 527491 - DNA, 25 bp, Mus musculus
agatcgcagacctgtcacctggaga

SEQ ID NO: 527492 - DNA, 25 bp, Mus musculus
agatcgcagagcagatgcattccca

SEQ ID NO: 527493 - DNA, 25 bp, Mus musculus
agatcgcagagctgatgcattccca

SEQ ID NO: 527494 - DNA, 25 bp, Mus musculus
agatcgcagcctcctcacaagagag

SEQ ID NO: 527495 - DNA, 25 bp, Mus musculus
agatcgcagcctgctcacaagagag

SEQ ID NO: 527496 - DNA, 25 bp, Mus musculus
agatcgcaggctcgggtgaatccat

SEQ ID NO: 527497 - DNA, 25 bp, Mus musculus
agatcgcaggctggggtgaatccat

SEQ ID NO: 527498 - DNA, 25 bp, Mus musculus
agatcgccacttaccggaacctgct

SEQ ID NO: 527499 - DNA, 25 bp, Mus musculus
agatcgccactttccggaacctgct

SEQ ID NO: 527500 - DNA, 25 bp, Mus musculus
agatcgcttcatcgccccggacatt

SEQ ID NO: 527501 - DNA, 25 bp, Mus musculus
agatcgcttcatggccccggacatt

SEQ ID NO: 527502 - DNA, 25 bp, Mus musculus
agatcggaccctctaaaagctgtaa

SEQ ID NO: 527503 - DNA, 25 bp, Mus musculus
agatcggaccctgtaaaagctgtaa

SEQ ID NO: 527504 - DNA, 25 bp, Mus musculus
agatcggatgccagagctctgtgag

SEQ ID NO: 527505 - DNA, 25 bp, Mus musculus
agatcggatgcctgagctctgtgag

SEQ ID NO: 527506 - DNA, 25 bp, Mus musculus
agatcggatgtcaagaggcggctca

SEQ ID NO: 527507 - DNA, 25 bp, Mus musculus
agatcggatgtctagaggcggctca

SEQ ID NO: 527508 - DNA, 25 bp, Mus musculus
agatcggccttgcagtttgcaataa

SEQ ID NO: 527509 - DNA, 25 bp, Mus musculus
agatcggccttggagtttgcaataa

SEQ ID NO: 527510 - DNA, 25 bp, Mus musculus
agatcggcttttagggcatgtggac

SEQ ID NO: 527511 - DNA, 25 bp, Mus musculus
agatcggctttttgggcatgtggac

SEQ ID NO: 527512 - DNA, 25 bp, Mus musculus
agatcgggccatccttctccacgat

SEQ ID NO: 527513 - DNA, 25 bp, Mus musculus
agatcgggccatgcttctccacgat

SEQ ID NO: 527514 - DNA, 25 bp, Mus musculus
agatcgtacgagaaatgatcccggg

SEQ ID NO: 527515 - DNA, 25 bp, Mus musculus
agatcgtacgagtaatgatcccggg

SEQ ID NO: 527516 - DNA, 25 bp, Mus musculus
agatcgtgcgcaccaaggcgtgctc

SEQ ID NO: 527517 - DNA, 25 bp, Mus musculus
agatcgtgcgcagcaaggcgtgctc

SEQ ID NO: 527518 - DNA, 25 bp, Mus musculus
agatcgttaccacaaaacacttgtg

SEQ ID NO: 527519 - DNA, 25 bp, Mus musculus
agatcgttaccagaaaacacttgtg

SEQ ID NO: 527520 - DNA, 25 bp, Mus musculus
agatcgttacgaccagaggagattg

SEQ ID NO: 527521 - DNA, 25 bp, Mus musculus
agatcgttacgagcagaggagattg

SEQ ID NO: 527522 - DNA, 25 bp, Mus musculus
agatctaacaagagccacccagcct

SEQ ID NO: 527523 - DNA, 25 bp, Mus musculus
agatctaacaagtgccacccagcct

SEQ ID NO: 527524 - DNA, 25 bp, Mus musculus
agatctacgtgtcgaaaggcaaagg

SEQ ID NO: 527525 - DNA, 25 bp, Mus musculus
agatctacgtgtggaaaggcaaagg

SEQ ID NO: 527526 - DNA, 25 bp, Mus musculus
agatctatcaccaaagctacctcca

SEQ ID NO: 527527 - DNA, 25 bp, Mus musculus
agatctatcacctaagctacctcca

SEQ ID NO: 527528 - DNA, 25 bp, Mus musculus
agatctcactgtcttgccaacacag

SEQ ID NO: 527529 - DNA, 25 bp, Mus musculus
agatctcactgtgttgccaacacag

SEQ ID NO: 527530 - DNA, 25 bp, Mus musculus
agatctcagactacggcatggcgag

SEQ ID NO: 527531 - DNA, 25 bp, Mus musculus
agatctcagacttcggcatggcgag

SEQ ID NO: 527532 - DNA, 25 bp, Mus musculus
agatctcagtacagtagaagcgctg

SEQ ID NO: 527533 - DNA, 25 bp, Mus musculus
agatctcagtactgtagaagcgctg

SEQ ID NO: 527534 - DNA, 25 bp, Mus musculus
agatctccacgcctgccaggagcga

SEQ ID NO: 527535 - DNA, 25 bp, Mus musculus
agatctccacgcgtgccaggagcga

SEQ ID NO: 527536 - DNA, 25 bp, Mus musculus
agatctctcaagaatgacagcctgg

SEQ ID NO: 527537 - DNA, 25 bp, Mus musculus
agatctctcaagtatgacagcctgg

SEQ ID NO: 527538 - DNA, 25 bp, Mus musculus
agatctctcctgatgccagctgttc

SEQ ID NO: 527539 - DNA, 25 bp, Mus musculus
agatctctcctgttgccagctgttc

SEQ ID NO: 527540 - DNA, 25 bp, Mus musculus
agatctgaaactcaacggaccccag

SEQ ID NO: 527541 - DNA, 25 bp, Mus musculus
agatctgaaactgaacggaccccag

SEQ ID NO: 527542 - DNA, 25 bp, Mus musculus
agatctgaaagaagcccagaagtct

SEQ ID NO: 527543 - DNA, 25 bp, Mus musculus
agatctgaaagatgcccagaagtct

SEQ ID NO: 527544 - DNA, 25 bp, Mus musculus
agatctgacagacctggtccagcgg

SEQ ID NO: 527545 - DNA, 25 bp, Mus musculus
agatctgacagagctggtccagcgg

SEQ ID NO: 527546 - DNA, 25 bp, Mus musculus
agatctgagacccatttcccgcctt

SEQ ID NO: 527547 - DNA, 25 bp, Mus musculus
agatctgagaccgatttcccgcctt

SEQ ID NO: 527548 - DNA, 25 bp, Mus musculus
agatctgccaacctgtgcgcctggg

SEQ ID NO: 527549 - DNA, 25 bp, Mus musculus
agatctgccaacgtgtgcgcctggg

SEQ ID NO: 527550 - DNA, 25 bp, Mus musculus
agatctgcgaccagatccgtcaggg

SEQ ID NO: 527551 - DNA, 25 bp, Mus musculus
agatctgcgacctgatccgtcaggg

SEQ ID NO: 527552 - DNA, 25 bp, Mus musculus
agatctgctgcacaaccgtggccat

SEQ ID NO: 527553 - DNA, 25 bp, Mus musculus
agatctgctgcagaaccgtggccat

SEQ ID NO: 527554 - DNA, 25 bp, Mus musculus
agatctgctgctccactcggcactg

SEQ ID NO: 527555 - DNA, 25 bp, Mus musculus
agatctgctgctgcactcggcactg

SEQ ID NO: 527556 - DNA, 25 bp, Mus musculus
agatctggccaaagctgagggtgct

SEQ ID NO: 527557 - DNA, 25 bp, Mus musculus
agatctggccaatgctgagggtgct

SEQ ID NO: 527558 - DNA, 25 bp, Mus musculus
agatctggctctcccatccacatag

SEQ ID NO: 527559 - DNA, 25 bp, Mus musculus
agatctggctctgccatccacatag

SEQ ID NO: 527560 - DNA, 25 bp, Mus musculus
agatctgggcaaagtccgggctgaa

SEQ ID NO: 527561 - DNA, 25 bp, Mus musculus
agatctgggcaatgtccgggctgaa

SEQ ID NO: 527562 - DNA, 25 bp, Mus musculus
agatctggtccacgcgtctcaggct

SEQ ID NO: 527563 - DNA, 25 bp, Mus musculus
agatctggtccaggcgtctcaggct

SEQ ID NO: 527564 - DNA, 25 bp, Mus musculus
agatctgttgttaatggtggatacc

SEQ ID NO: 527565 - DNA, 25 bp, Mus musculus
agatctgttgtttatggtggatacc

SEQ ID NO: 527566 - DNA, 25 bp, Mus musculus
agatcttcaggtacatcaaggtcaa

SEQ ID NO: 527567 - DNA, 25 bp, Mus musculus
agatcttcaggttcatcaaggtcaa

SEQ ID NO: 527568 - DNA, 25 bp, Mus musculus
agatcttccccgagcaaatcactgc

SEQ ID NO: 527569 - DNA, 25 bp, Mus musculus
agatcttccccgagggtcggccagt

SEQ ID NO: 527570 - DNA, 25 bp, Mus musculus
agatcttccccgtgcaaatcactgc

SEQ ID NO: 527571 - DNA, 25 bp, Mus musculus
agatcttccccgtgggtcggccagt

SEQ ID NO: 527572 - DNA, 25 bp, Mus musculus
agatcttccggccctgcgacctgat

SEQ ID NO: 527573 - DNA, 25 bp, Mus musculus
agatcttccggcgctgcgacctgat

SEQ ID NO: 527574 - DNA, 25 bp, Mus musculus
agatcttcgatgacaatgccaagtt

SEQ ID NO: 527575 - DNA, 25 bp, Mus musculus
agatcttcgatgtcaatgccaagtt

SEQ ID NO: 527576 - DNA, 25 bp, Mus musculus
agatcttcgggcagcagcagagcaa

SEQ ID NO: 527577 - DNA, 25 bp, Mus musculus
agatcttcgggctgcagcagagcaa

SEQ ID NO: 527578 - DNA, 25 bp, Mus musculus
agatcttctgagacctccccaggac

SEQ ID NO: 527579 - DNA, 25 bp, Mus musculus
agatcttctgagtcctccccaggac

SEQ ID NO: 527580 - DNA, 25 bp, Mus musculus
agatcttctgcgactcctgcgggca

SEQ ID NO: 527581 - DNA, 25 bp, Mus musculus
agatcttctgcgtctcctgcgggca

SEQ ID NO: 527582 - DNA, 25 bp, Mus musculus
agatcttcttgtctcagagagcagt

SEQ ID NO: 527583 - DNA, 25 bp, Mus musculus
agatcttcttgtgtcagagagcagt

SEQ ID NO: 527584 - DNA, 25 bp, Mus musculus
agatcttgagctcgaaatgggagat

SEQ ID NO: 527585 - DNA, 25 bp, Mus musculus
agatcttgagctggaaatgggagat

SEQ ID NO: 527586 - DNA, 25 bp, Mus musculus
agatcttgcgataatttgtttcaca

SEQ ID NO: 527587 - DNA, 25 bp, Mus musculus
agatcttgcgattatttgtttcaca

SEQ ID NO: 527588 - DNA, 25 bp, Mus musculus
agatcttggactcgacattggtgcc

SEQ ID NO: 527589 - DNA, 25 bp, Mus musculus
agatcttggactggacattggtgcc

SEQ ID NO: 527590 - DNA, 25 bp, Mus musculus
agatctttctatccaacttccccgg

SEQ ID NO: 527591 - DNA, 25 bp, Mus musculus
agatctttctatgcaacttccccgg

SEQ ID NO: 527592 - DNA, 25 bp, Mus musculus
agatctttgatgaactttacaggca

SEQ ID NO: 527593 - DNA, 25 bp, Mus musculus
agatctttgatgtactttacaggca

SEQ ID NO: 527594 - DNA, 25 bp, Mus musculus
agatctttgcccagctggaccgcat

SEQ ID NO: 527595 - DNA, 25 bp, Mus musculus
agatctttgccctgctggaccgcat

SEQ ID NO: 527596 - DNA, 25 bp, Mus musculus
agatctttgtgaaaaccttaactgg

SEQ ID NO: 527597 - DNA, 25 bp, Mus musculus
agatctttgtgataaccttaactgg

SEQ ID NO: 527598 - DNA, 25 bp, Mus musculus
agatctttgtgcctgactacgaccc

SEQ ID NO: 527599 - DNA, 25 bp, Mus musculus
agatctttgtgcgtgactacgaccc

SEQ ID NO: 527600 - DNA, 25 bp, Mus musculus
agatcttttcgcaggtaattgtcat

SEQ ID NO: 527601 - DNA, 25 bp, Mus musculus
agatcttttcgctggtaattgtcat

SEQ ID NO: 527602 - DNA, 25 bp, Mus musculus
agatgaaaacgtctcacttggtcag

SEQ ID NO: 527603 - DNA, 25 bp, Mus musculus
agatgaaaacgtgtcacttggtcag

SEQ ID NO: 527604 - DNA, 25 bp, Mus musculus
agatgaaaggttatcctcattggcc

SEQ ID NO: 527605 - DNA, 25 bp, Mus musculus
agatgaaaggttttcctcattggcc

SEQ ID NO: 527606 - DNA, 25 bp, Mus musculus
agatgaaatggtatcctggatgcag

SEQ ID NO: 527607 - DNA, 25 bp, Mus musculus
agatgaaatggtttcctggatgcag

SEQ ID NO: 527608 - DNA, 25 bp, Mus musculus
agatgaacagttctgggcctcgccc

SEQ ID NO: 527609 - DNA, 25 bp, Mus musculus
agatgaacagttgtgggcctcgccc

SEQ ID NO: 527610 - DNA, 25 bp, Mus musculus
agatgaacgaatctctaagcaagaa

SEQ ID NO: 527611 - DNA, 25 bp, Mus musculus
agatgaacgaatgtctaagcaagaa

SEQ ID NO: 527612 - DNA, 25 bp, Mus musculus
agatgaacggcaacaaccggcccct

SEQ ID NO: 527613 - DNA, 25 bp, Mus musculus
agatgaacggcatcaaccggcccct

SEQ ID NO: 527614 - DNA, 25 bp, Mus musculus
agatgaacgggtccctgtctcggtc

SEQ ID NO: 527615 - DNA, 25 bp, Mus musculus
agatgaacgggtgcctgtctcggtc

SEQ ID NO: 527616 - DNA, 25 bp, Mus musculus
agatgaactcccaggtctacagccg

SEQ ID NO: 527617 - DNA, 25 bp, Mus musculus
agatgaactccctggtctacagccg

SEQ ID NO: 527618 - DNA, 25 bp, Mus musculus
agatgaagaagtcaaccaagagttc

SEQ ID NO: 527619 - DNA, 25 bp, Mus musculus
agatgaagaagtgaaccaagagttc

SEQ ID NO: 527620 - DNA, 25 bp, Mus musculus
agatgaagcaagataggatcaccag

SEQ ID NO: 527621 - DNA, 25 bp, Mus musculus
agatgaagcaagttaggatcaccag

SEQ ID NO: 527622 - DNA, 25 bp, Mus musculus
agatgaagctttcgcgccagggctc

SEQ ID NO: 527623 - DNA, 25 bp, Mus musculus
agatgaagctttggcgccagggctc

SEQ ID NO: 527624 - DNA, 25 bp, Mus musculus
agatgaagggataccccagcagcac

SEQ ID NO: 527625 - DNA, 25 bp, Mus musculus
agatgaagggattccccagcagcac

SEQ ID NO: 527626 - DNA, 25 bp, Mus musculus
agatgaagttgaaggactaaaacgc

SEQ ID NO: 527627 - DNA, 25 bp, Mus musculus
agatgaagttgatggactaaaacgc

SEQ ID NO: 527628 - DNA, 25 bp, Mus musculus
agatgaatcacacactcccgaggga

SEQ ID NO: 527629 - DNA, 25 bp, Mus musculus
agatgaatcacagactcccgaggga

SEQ ID NO: 527630 - DNA, 25 bp, Mus musculus
agatgaatgccaagctagagacccc

SEQ ID NO: 527631 - DNA, 25 bp, Mus musculus
agatgaatgccatgctagagacccc

SEQ ID NO: 527632 - DNA, 25 bp, Mus musculus
agatgacaacagcagtcttcgacgt

SEQ ID NO: 527633 - DNA, 25 bp, Mus musculus
agatgacaacaggagtcttcgacgt

SEQ ID NO: 527634 - DNA, 25 bp, Mus musculus
agatgacaccttcctcttcccaaag

SEQ ID NO: 527635 - DNA, 25 bp, Mus musculus
agatgacaccttgctcttcccaaag

SEQ ID NO: 527636 - DNA, 25 bp, Mus musculus
agatgacagcaactgaacaatggat

SEQ ID NO: 527637 - DNA, 25 bp, Mus musculus
agatgacagcaagtgaacaatggat

SEQ ID NO: 527638 - DNA, 25 bp, Mus musculus
agatgacattaacaaaaaggctttt

SEQ ID NO: 527639 - DNA, 25 bp, Mus musculus
agatgacattaagaaaaaggctttt

SEQ ID NO: 527640 - DNA, 25 bp, Mus musculus
agatgacattgcctccatgccctgc

SEQ ID NO: 527641 - DNA, 25 bp, Mus musculus
agatgacattgcgtccatgccctgc

SEQ ID NO: 527642 - DNA, 25 bp, Mus musculus
agatgaccaacgcttgctgctaccc

SEQ ID NO: 527643 - DNA, 25 bp, Mus musculus
agatgaccaacggttgctgctaccc

SEQ ID NO: 527644 - DNA, 25 bp, Mus musculus
agatgaccaggacgacacagccaat

SEQ ID NO: 527645 - DNA, 25 bp, Mus musculus
agatgaccaggaggacacagccaat

SEQ ID NO: 527646 - DNA, 25 bp, Mus musculus
agatgaccttctcaacctgctcagg

SEQ ID NO: 527647 - DNA, 25 bp, Mus musculus
agatgaccttctgaacctgctcagg

SEQ ID NO: 527648 - DNA, 25 bp, Mus musculus
agatgacgcggcaggtagaccactt

SEQ ID NO: 527649 - DNA, 25 bp, Mus musculus
agatgacgcggctggtagaccactt

SEQ ID NO: 527650 - DNA, 25 bp, Mus musculus
agatgactagtgaagaggaagaaca

SEQ ID NO: 527651 - DNA, 25 bp, Mus musculus
agatgactagtgtagaggaagaaca

SEQ ID NO: 527652 - DNA, 25 bp, Mus musculus
agatgactccatccggtacccatac

SEQ ID NO: 527653 - DNA, 25 bp, Mus musculus
agatgactccatgcggtacccatac

SEQ ID NO: 527654 - DNA, 25 bp, Mus musculus
agatgacttgctccgctgtgggatt

SEQ ID NO: 527655 - DNA, 25 bp, Mus musculus
agatgacttgctgcgctgtgggatt

SEQ ID NO: 527656 - DNA, 25 bp, Mus musculus
agatgagacaacaccagagatggag

SEQ ID NO: 527657 - DNA, 25 bp, Mus musculus
agatgagacaactccagagatggag

SEQ ID NO: 527658 - DNA, 25 bp, Mus musculus
agatgagaccatccatttgatgggt

SEQ ID NO: 527659 - DNA, 25 bp, Mus musculus
agatgagaccatgcatttgatgggt

SEQ ID NO: 527660 - DNA, 25 bp, Mus musculus
agatgagacttacaagccccacctt

SEQ ID NO: 527661 - DNA, 25 bp, Mus musculus
agatgagacttagaagccccacctt

SEQ ID NO: 527662 - DNA, 25 bp, Mus musculus
agatgagcgaggaggccgacatcct

SEQ ID NO: 527663 - DNA, 25 bp, Mus musculus
agatgagcgaggtggccgacatcct

SEQ ID NO: 527664 - DNA, 25 bp, Mus musculus
agatgagcgcagagtaaagagcaca

SEQ ID NO: 527665 - DNA, 25 bp, Mus musculus
agatgagcgcagtgtaaagagcaca

SEQ ID NO: 527666 - DNA, 25 bp, Mus musculus
agatgagcgcctagaacgaggcctg

SEQ ID NO: 527667 - DNA, 25 bp, Mus musculus
agatgagcgccttgaacgaggcctg

SEQ ID NO: 527668 - DNA, 25 bp, Mus musculus
agatgagctttgcaatgaattcaga

SEQ ID NO: 527669 - DNA, 25 bp, Mus musculus
agatgagctttggaatgaattcaga

SEQ ID NO: 527670 - DNA, 25 bp, Mus musculus
agatgaggacgccacccttacccag

SEQ ID NO: 527671 - DNA, 25 bp, Mus musculus
agatgaggacgcgacccttacccag

SEQ ID NO: 527672 - DNA, 25 bp, Mus musculus
agatgaggatcccaattacaaccca

SEQ ID NO: 527673 - DNA, 25 bp, Mus musculus
agatgaggatccgaattacaaccca

SEQ ID NO: 527674 - DNA, 25 bp, Mus musculus
agatgagtgcacattgcacactctg

SEQ ID NO: 527675 - DNA, 25 bp, Mus musculus
agatgagtgcactttgcacactctg

SEQ ID NO: 527676 - DNA, 25 bp, Mus musculus
agatgatccagaagtctgtgacctc

SEQ ID NO: 527677 - DNA, 25 bp, Mus musculus
agatgatccagatgtctgtgacctc

SEQ ID NO: 527678 - DNA, 25 bp, Mus musculus
agatgatcgcgaccggagccctcct

SEQ ID NO: 527679 - DNA, 25 bp, Mus musculus
agatgatcgcgagcggagccctcct

SEQ ID NO: 527680 - DNA, 25 bp, Mus musculus
agatgatgacccagaggctggccag

SEQ ID NO: 527681 - DNA, 25 bp, Mus musculus
agatgatgaccctgaggctggccag

SEQ ID NO: 527682 - DNA, 25 bp, Mus musculus
agatgatgacgtacagcctgcagga

SEQ ID NO: 527683 - DNA, 25 bp, Mus musculus
agatgatgacgttcagcctgcagga

SEQ ID NO: 527684 - DNA, 25 bp, Mus musculus
agatgatgggaaagacctcacacac

SEQ ID NO: 527685 - DNA, 25 bp, Mus musculus
agatgatgggaatgacctcacacac

SEQ ID NO: 527686 - DNA, 25 bp, Mus musculus
agatgatgtcgcaaccacagagaaa

SEQ ID NO: 527687 - DNA, 25 bp, Mus musculus
agatgatgtcgctaccacagagaaa

SEQ ID NO: 527688 - DNA, 25 bp, Mus musculus
agatgcaaagacactccttcgcccg

SEQ ID NO: 527689 - DNA, 25 bp, Mus musculus
agatgcaaagactctccttcgcccg

SEQ ID NO: 527690 - DNA, 25 bp, Mus musculus
agatgcaatatcacagcccattctt

SEQ ID NO: 527691 - DNA, 25 bp, Mus musculus
agatgcaatatctcagcccattctt

SEQ ID NO: 527692 - DNA, 25 bp, Mus musculus
agatgcacatcaaggccaagcacag

SEQ ID NO: 527693 - DNA, 25 bp, Mus musculus
agatgcacatcatggccaagcacag

SEQ ID NO: 527694 - DNA, 25 bp, Mus musculus
agatgcagaggacgcgttccctcgc

SEQ ID NO: 527695 - DNA, 25 bp, Mus musculus
agatgcagaggaggcgttccctcgc

SEQ ID NO: 527696 - DNA, 25 bp, Mus musculus
agatgcagccaaccgaaggctggcc

SEQ ID NO: 527697 - DNA, 25 bp, Mus musculus
agatgcagccaagcgaaggctggcc

SEQ ID NO: 527698 - DNA, 25 bp, Mus musculus
agatgcagctgtaccctctcctgtt

SEQ ID NO: 527699 - DNA, 25 bp, Mus musculus
agatgcagctgttccctctcctgtt

SEQ ID NO: 527700 - DNA, 25 bp, Mus musculus
agatgcagttggaatgtatcaaagc

SEQ ID NO: 527701 - DNA, 25 bp, Mus musculus
agatgcagttggtatgtatcaaagc

SEQ ID NO: 527702 - DNA, 25 bp, Mus musculus
agatgcattgaccagaacttgaggg

SEQ ID NO: 527703 - DNA, 25 bp, Mus musculus
agatgcattgacgagaacttgaggg

SEQ ID NO: 527704 - DNA, 25 bp, Mus musculus
agatgccaaccgaccactacgaatt

SEQ ID NO: 527705 - DNA, 25 bp, Mus musculus
agatgccaaccgtccactacgaatt

SEQ ID NO: 527706 - DNA, 25 bp, Mus musculus
agatgccaccctcctgatacatgaa

SEQ ID NO: 527707 - DNA, 25 bp, Mus musculus
agatgccaccctgctgatacatgaa

SEQ ID NO: 527708 - DNA, 25 bp, Mus musculus
agatgccagcagatcagctcaggcc

SEQ ID NO: 527709 - DNA, 25 bp, Mus musculus
agatgccagcagttcagctcaggcc

SEQ ID NO: 527710 - DNA, 25 bp, Mus musculus
agatgccattccctcagtggaggta

SEQ ID NO: 527711 - DNA, 25 bp, Mus musculus
agatgccattccgtcagtggaggta

SEQ ID NO: 527712 - DNA, 25 bp, Mus musculus
agatgcccaaaaagggaggaagatg

SEQ ID NO: 527713 - DNA, 25 bp, Mus musculus
agatgcccaaaatgggaggaagatg

SEQ ID NO: 527714 - DNA, 25 bp, Mus musculus
agatgcccctgaagccacggtggca

SEQ ID NO: 527715 - DNA, 25 bp, Mus musculus
agatgcccctgatgccacggtggca

SEQ ID NO: 527716 - DNA, 25 bp, Mus musculus
agatgcccggcaccagagcaccgga

SEQ ID NO: 527717 - DNA, 25 bp, Mus musculus
agatgcccggcagcagagcaccgga

SEQ ID NO: 527718 - DNA, 25 bp, Mus musculus
agatgcccggccagctgagattgac

SEQ ID NO: 527719 - DNA, 25 bp, Mus musculus
agatgcccggcctgctgagattgac

SEQ ID NO: 527720 - DNA, 25 bp, Mus musculus
agatgcccgggtcactgcggccatc

SEQ ID NO: 527721 - DNA, 25 bp, Mus musculus
agatgcccgggtgactgcggccatc

SEQ ID NO: 527722 - DNA, 25 bp, Mus musculus
agatgccgatggactctgcactcgc

SEQ ID NO: 527723 - DNA, 25 bp, Mus musculus
agatgccgatggtctctgcactcgc

SEQ ID NO: 527724 - DNA, 25 bp, Mus musculus
agatgccgccctatgatgaggagac

SEQ ID NO: 527725 - DNA, 25 bp, Mus musculus
agatgccgccctttgatgaggagac

SEQ ID NO: 527726 - DNA, 25 bp, Mus musculus
agatgccgtcggctttccagcagat

SEQ ID NO: 527727 - DNA, 25 bp, Mus musculus
agatgccgtcgggtttccagcagat

SEQ ID NO: 527728 - DNA, 25 bp, Mus musculus
agatgcctgctcagcccaactctgt

SEQ ID NO: 527729 - DNA, 25 bp, Mus musculus
agatgcctgctctgcccaactctgt

SEQ ID NO: 527730 - DNA, 25 bp, Mus musculus
agatgccttaagacctagcactcag

SEQ ID NO: 527731 - DNA, 25 bp, Mus musculus
agatgccttaagtcctagcactcag

SEQ ID NO: 527732 - DNA, 25 bp, Mus musculus
agatgccttgttcatcgccagagaa

SEQ ID NO: 527733 - DNA, 25 bp, Mus musculus
agatgccttgttgatcgccagagaa

SEQ ID NO: 527734 - DNA, 25 bp, Mus musculus
agatgcgcatccagatggtgggcct

SEQ ID NO: 527735 - DNA, 25 bp, Mus musculus
agatgcgcatcctgatggtgggcct

SEQ ID NO: 527736 - DNA, 25 bp, Mus musculus
agatgcgctcccaaaccacgtgtgt

SEQ ID NO: 527737 - DNA, 25 bp, Mus musculus
agatgcgctccctaaccacgtgtgt

SEQ ID NO: 527738 - DNA, 25 bp, Mus musculus
agatgcgtgtggctacaacgacccc

SEQ ID NO: 527739 - DNA, 25 bp, Mus musculus
agatgcgtgtgggtacaacgacccc

SEQ ID NO: 527740 - DNA, 25 bp, Mus musculus
agatgctaacaacggaggtcccctt

SEQ ID NO: 527741 - DNA, 25 bp, Mus musculus
agatgctaacaagggaggtcccctt

SEQ ID NO: 527742 - DNA, 25 bp, Mus musculus
agatgctaagctcgcccaggacttt

SEQ ID NO: 527743 - DNA, 25 bp, Mus musculus
agatgctaagctggcccaggacttt

SEQ ID NO: 527744 - DNA, 25 bp, Mus musculus
agatgctacgagctaagacaacccc

SEQ ID NO: 527745 - DNA, 25 bp, Mus musculus
agatgctacgaggtaagacaacccc

SEQ ID NO: 527746 - DNA, 25 bp, Mus musculus
agatgctcaagccagacccagtgag

SEQ ID NO: 527747 - DNA, 25 bp, Mus musculus
agatgctcaagcgagacccagtgag

SEQ ID NO: 527748 - DNA, 25 bp, Mus musculus
agatgctcattcacatccggacaca

SEQ ID NO: 527749 - DNA, 25 bp, Mus musculus
agatgctcattctcatccggacaca

SEQ ID NO: 527750 - DNA, 25 bp, Mus musculus
agatgctccaccagacactcctggg

SEQ ID NO: 527751 - DNA, 25 bp, Mus musculus
agatgctccacctgacactcctggg

SEQ ID NO: 527752 - DNA, 25 bp, Mus musculus
agatgctctaccaggctactcgtat

SEQ ID NO: 527753 - DNA, 25 bp, Mus musculus
agatgctctacctggctactcgtat

SEQ ID NO: 527754 - DNA, 25 bp, Mus musculus
agatgctgacagcttgccttttggc

SEQ ID NO: 527755 - DNA, 25 bp, Mus musculus
agatgctgacaggttgccttttggc

SEQ ID NO: 527756 - DNA, 25 bp, Mus musculus
agatgctgaccgcaagtatgaagag

SEQ ID NO: 527757 - DNA, 25 bp, Mus musculus
agatgctgaccggaagtatgaagag

SEQ ID NO: 527758 - DNA, 25 bp, Mus musculus
agatgctgataccttccatcaccag

SEQ ID NO: 527759 - DNA, 25 bp, Mus musculus
agatgctgatacgttccatcaccag

SEQ ID NO: 527760 - DNA, 25 bp, Mus musculus
agatgctgatgaacaggccaggaaa

SEQ ID NO: 527761 - DNA, 25 bp, Mus musculus
agatgctgatgatcaggccaggaaa

SEQ ID NO: 527762 - DNA, 25 bp, Mus musculus
agatgctgcaaaacgtgactcccca

SEQ ID NO: 527763 - DNA, 25 bp, Mus musculus
agatgctgcaaatcgtgactcccca

SEQ ID NO: 527764 - DNA, 25 bp, Mus musculus
agatgctgcaggagccttctttctc

SEQ ID NO: 527765 - DNA, 25 bp, Mus musculus
agatgctgcaggtgccttctttctc

SEQ ID NO: 527766 - DNA, 25 bp, Mus musculus
agatgctgccctcccatcgagtgga

SEQ ID NO: 527767 - DNA, 25 bp, Mus musculus
agatgctgccctgccatcgagtgga

SEQ ID NO: 527768 - DNA, 25 bp, Mus musculus
agatgctgcgtgacatttgctccaa

SEQ ID NO: 527769 - DNA, 25 bp, Mus musculus
agatgctgcgtgtcatttgctccaa

SEQ ID NO: 527770 - DNA, 25 bp, Mus musculus
agatgctgggagaggcgccacctac

SEQ ID NO: 527771 - DNA, 25 bp, Mus musculus
agatgctgggagtggcgccacctac

SEQ ID NO: 527772 - DNA, 25 bp, Mus musculus
agatgctgttgtcatatcctgtgca

SEQ ID NO: 527773 - DNA, 25 bp, Mus musculus
agatgctgttgtgatatcctgtgca

SEQ ID NO: 527774 - DNA, 25 bp, Mus musculus
agatgcttggagaggaagcagaact

SEQ ID NO: 527775 - DNA, 25 bp, Mus musculus
agatgcttggagtggaagcagaact

SEQ ID NO: 527776 - DNA, 25 bp, Mus musculus
agatggaaagtaaagactggctgga

SEQ ID NO: 527777 - DNA, 25 bp, Mus musculus
agatggaaagtatagactggctgga

SEQ ID NO: 527778 - DNA, 25 bp, Mus musculus
agatggaagagaccgactcctcgga

SEQ ID NO: 527779 - DNA, 25 bp, Mus musculus
agatggaagagagcgactcctcgga

SEQ ID NO: 527780 - DNA, 25 bp, Mus musculus
agatggacaactagcccctggaacc

SEQ ID NO: 527781 - DNA, 25 bp, Mus musculus
agatggacaacttgcccctggaacc

SEQ ID NO: 527782 - DNA, 25 bp, Mus musculus
agatggacatgtccccagatgaggc

SEQ ID NO: 527783 - DNA, 25 bp, Mus musculus
agatggacatgtgcccagatgaggc

SEQ ID NO: 527784 - DNA, 25 bp, Mus musculus
agatggacattcaggctgcagctgt

SEQ ID NO: 527785 - DNA, 25 bp, Mus musculus
agatggacattctggctgcagctgt

SEQ ID NO: 527786 - DNA, 25 bp, Mus musculus
agatggacggccacaatcaggacca

SEQ ID NO: 527787 - DNA, 25 bp, Mus musculus
agatggacggcctcaatcaggacca

SEQ ID NO: 527788 - DNA, 25 bp, Mus musculus
agatggactgatcggctgctgtact

SEQ ID NO: 527789 - DNA, 25 bp, Mus musculus
agatggactgatgggctgctgtact

SEQ ID NO: 527790 - DNA, 25 bp, Mus musculus
agatggacttccctcagctgatgaa

SEQ ID NO: 527791 - DNA, 25 bp, Mus musculus
agatggacttccgtcagctgatgaa

SEQ ID NO: 527792 - DNA, 25 bp, Mus musculus
agatggagctgaccagtaccccttc

SEQ ID NO: 527793 - DNA, 25 bp, Mus musculus
agatggagctgagcagtaccccttc

SEQ ID NO: 527794 - DNA, 25 bp, Mus musculus
agatggaggcgcatagatttgagat

SEQ ID NO: 527795 - DNA, 25 bp, Mus musculus
agatggaggcgcttagatttgagat

SEQ ID NO: 527796 - DNA, 25 bp, Mus musculus
agatggagtcagaggaaaagaccac

SEQ ID NO: 527797 - DNA, 25 bp, Mus musculus
agatggagtcagtggaaaagaccac

SEQ ID NO: 527798 - DNA, 25 bp, Mus musculus
agatggagtccaaggcttctcggat

SEQ ID NO: 527799 - DNA, 25 bp, Mus musculus
agatggagtccatggcttctcggat

SEQ ID NO: 527800 - DNA, 25 bp, Mus musculus
agatggagtcctccaagactgggtc

SEQ ID NO: 527801 - DNA, 25 bp, Mus musculus
agatggagtcctgcaagactgggtc

SEQ ID NO: 527802 - DNA, 25 bp, Mus musculus
agatggataggccttctgttgagcc

SEQ ID NO: 527803 - DNA, 25 bp, Mus musculus
agatggataggcgttctgttgagcc

SEQ ID NO: 527804 - DNA, 25 bp, Mus musculus
agatggatcgaactctgcacaagat

SEQ ID NO: 527805 - DNA, 25 bp, Mus musculus
agatggatcgaagtctgcacaagat

SEQ ID NO: 527806 - DNA, 25 bp, Mus musculus
agatggatgcccatcctcctcgact

SEQ ID NO: 527807 - DNA, 25 bp, Mus musculus
agatggatgcccttcctcctcgact

SEQ ID NO: 527808 - DNA, 25 bp, Mus musculus
agatggcaaaaacggcacctcccct

SEQ ID NO: 527809 - DNA, 25 bp, Mus musculus
agatggcaaaaagggcacctcccct

SEQ ID NO: 527810 - DNA, 25 bp, Mus musculus
agatggcaaagaaataaagcaactg

SEQ ID NO: 527811 - DNA, 25 bp, Mus musculus
agatggcaaagatataaagcaactg

SEQ ID NO: 527812 - DNA, 25 bp, Mus musculus
agatggcaaagtcctgacccctgaa

SEQ ID NO: 527813 - DNA, 25 bp, Mus musculus
agatggcaaagtgctgacccctgaa

SEQ ID NO: 527814 - DNA, 25 bp, Mus musculus
agatggcaacgtcgatgacacagga

SEQ ID NO: 527815 - DNA, 25 bp, Mus musculus
agatggcaacgtggatgacacagga

SEQ ID NO: 527816 - DNA, 25 bp, Mus musculus
agatggcacctaagagttcaacccc

SEQ ID NO: 527817 - DNA, 25 bp, Mus musculus
agatggcacctatgagttcaacccc

SEQ ID NO: 527818 - DNA, 25 bp, Mus musculus
agatggcacttaaaaccaaagcctg

SEQ ID NO: 527819 - DNA, 25 bp, Mus musculus
agatggcacttataaccaaagcctg

SEQ ID NO: 527820 - DNA, 25 bp, Mus musculus
agatggcagagcaatcggaagtgct

SEQ ID NO: 527821 - DNA, 25 bp, Mus musculus
agatggcagagctatcggaagtgct

SEQ ID NO: 527822 - DNA, 25 bp, Mus musculus
agatggcatctcctagccggagacc

SEQ ID NO: 527823 - DNA, 25 bp, Mus musculus
agatggcatctcgtagccggagacc

SEQ ID NO: 527824 - DNA, 25 bp, Mus musculus
agatggccacatctacgcagtcggg

SEQ ID NO: 527825 - DNA, 25 bp, Mus musculus
agatggccacatgtacgcagtcggg

SEQ ID NO: 527826 - DNA, 25 bp, Mus musculus
agatggccacgaaggagaagctgca

SEQ ID NO: 527827 - DNA, 25 bp, Mus musculus
agatggccacgatggagaagctgca

SEQ ID NO: 527828 - DNA, 25 bp, Mus musculus
agatggccatccaccctgagtacag

SEQ ID NO: 527829 - DNA, 25 bp, Mus musculus
agatggccatcctccctgagtacag

SEQ ID NO: 527830 - DNA, 25 bp, Mus musculus
agatggccatcgacaccctgaatcc

SEQ ID NO: 527831 - DNA, 25 bp, Mus musculus
agatggccatcgtcaccctgaatcc

SEQ ID NO: 527832 - DNA, 25 bp, Mus musculus
agatggccctctcggctatcatggc

SEQ ID NO: 527833 - DNA, 25 bp, Mus musculus
agatggccctctgggctatcatggc

SEQ ID NO: 527834 - DNA, 25 bp, Mus musculus
agatggccgacaagtacacccgcct

SEQ ID NO: 527835 - DNA, 25 bp, Mus musculus
agatggccgacatgtacacccgcct

SEQ ID NO: 527836 - DNA, 25 bp, Mus musculus
agatggccgcctacctgcatcgagc

SEQ ID NO: 527837 - DNA, 25 bp, Mus musculus
agatggccgccttcctgcatcgagc

SEQ ID NO: 527838 - DNA, 25 bp, Mus musculus
agatggccttgcatgggaatcctgc

SEQ ID NO: 527839 - DNA, 25 bp, Mus musculus
agatggccttgcttgggaatcctgc

SEQ ID NO: 527840 - DNA, 25 bp, Mus musculus
agatggcgcaagactcattcctcca

SEQ ID NO: 527841 - DNA, 25 bp, Mus musculus
agatggcgcaagtctcattcctcca

SEQ ID NO: 527842 - DNA, 25 bp, Mus musculus
agatggcgccaacctggtccgtgat

SEQ ID NO: 527843 - DNA, 25 bp, Mus musculus
agatggcgccaagctggtccgtgat

SEQ ID NO: 527844 - DNA, 25 bp, Mus musculus
agatggcggaggcaatcataagaac

SEQ ID NO: 527845 - DNA, 25 bp, Mus musculus
agatggcggagggaatcataagaac

SEQ ID NO: 527846 - DNA, 25 bp, Mus musculus
agatggcggcagcaaccagcaatta

SEQ ID NO: 527847 - DNA, 25 bp, Mus musculus
agatggcggcaggaaccagcaatta

SEQ ID NO: 527848 - DNA, 25 bp, Mus musculus
agatggcggtgcagatttccaagaa

SEQ ID NO: 527849 - DNA, 25 bp, Mus musculus
agatggcggtgctgatttccaagaa

SEQ ID NO: 527850 - DNA, 25 bp, Mus musculus
agatggcgtaccagagcctccggct

SEQ ID NO: 527851 - DNA, 25 bp, Mus musculus
agatggcgtacctgagcctccggct

SEQ ID NO: 527852 - DNA, 25 bp, Mus musculus
agatggcgtcccagctgcagtcgga

SEQ ID NO: 527853 - DNA, 25 bp, Mus musculus
agatggcgtccctgctgcagtcgga

SEQ ID NO: 527854 - DNA, 25 bp, Mus musculus
agatggcgtctcagccacaggccaa

SEQ ID NO: 527855 - DNA, 25 bp, Mus musculus
agatggcgtctctgccacaggccaa

SEQ ID NO: 527856 - DNA, 25 bp, Mus musculus
agatggctgacgacttgctggcagc

SEQ ID NO: 527857 - DNA, 25 bp, Mus musculus
agatggctgacgtcttgctggcagc

SEQ ID NO: 527858 - DNA, 25 bp, Mus musculus
agatggctgaggaccctgattcaat

SEQ ID NO: 527859 - DNA, 25 bp, Mus musculus
agatggctgaggtccctgattcaat

SEQ ID NO: 527860 - DNA, 25 bp, Mus musculus
agatggctgccacgccagcaggatt

SEQ ID NO: 527861 - DNA, 25 bp, Mus musculus
agatggctgccaggccagcaggatt

SEQ ID NO: 527862 - DNA, 25 bp, Mus musculus
agatggctgggcagaatgctatcca

SEQ ID NO: 527863 - DNA, 25 bp, Mus musculus
agatggctgggctgaatgctatcca

SEQ ID NO: 527864 - DNA, 25 bp, Mus musculus
agatggcttccacctctaatagaac

SEQ ID NO: 527865 - DNA, 25 bp, Mus musculus
agatggcttccagctctaatagaac

SEQ ID NO: 527866 - DNA, 25 bp, Mus musculus
agatgggaacagatacagagaccca

SEQ ID NO: 527867 - DNA, 25 bp, Mus musculus
agatgggaacagttacagagaccca

SEQ ID NO: 527868 - DNA, 25 bp, Mus musculus
agatgggaagctcatgtcctctacc

SEQ ID NO: 527869 - DNA, 25 bp, Mus musculus
agatgggaagctgatgtcctctacc

SEQ ID NO: 527870 - DNA, 25 bp, Mus musculus
agatgggaccgacgctcccgccaag

SEQ ID NO: 527871 - DNA, 25 bp, Mus musculus
agatgggaccgaggctcccgccaag

SEQ ID NO: 527872 - DNA, 25 bp, Mus musculus
agatgggacgcaccagcctgacgcc

SEQ ID NO: 527873 - DNA, 25 bp, Mus musculus
agatgggacgcagcagcctgacgcc

SEQ ID NO: 527874 - DNA, 25 bp, Mus musculus
agatgggagaatcttcattggcacc

SEQ ID NO: 527875 - DNA, 25 bp, Mus musculus
agatgggagaatgttcattggcacc

SEQ ID NO: 527876 - DNA, 25 bp, Mus musculus
agatgggagggaagccctctgtcct

SEQ ID NO: 527877 - DNA, 25 bp, Mus musculus
agatgggagggatgccctctgtcct

SEQ ID NO: 527878 - DNA, 25 bp, Mus musculus
agatgggcagaacgatcctgcatct

SEQ ID NO: 527879 - DNA, 25 bp, Mus musculus
agatgggcagaaggatcctgcatct

SEQ ID NO: 527880 - DNA, 25 bp, Mus musculus
agatgggcatatactgctcagtaat

SEQ ID NO: 527881 - DNA, 25 bp, Mus musculus
agatgggcatattctgctcagtaat

SEQ ID NO: 527882 - DNA, 25 bp, Mus musculus
agatgggcccacatcctccttgggt

SEQ ID NO: 527883 - DNA, 25 bp, Mus musculus
agatgggcccacttcctccttgggt

SEQ ID NO: 527884 - DNA, 25 bp, Mus musculus
agatgggctcctatcccttgttcca

SEQ ID NO: 527885 - DNA, 25 bp, Mus musculus
agatgggctcctttcccttgttcca

SEQ ID NO: 527886 - DNA, 25 bp, Mus musculus
agatggggccctagctcccaaggag

SEQ ID NO: 527887 - DNA, 25 bp, Mus musculus
agatggggcccttgctcccaaggag

SEQ ID NO: 527888 - DNA, 25 bp, Mus musculus
agatgggtactacgcccgctcagag

SEQ ID NO: 527889 - DNA, 25 bp, Mus musculus
agatgggtactaggcccgctcagag

SEQ ID NO: 527890 - DNA, 25 bp, Mus musculus
agatgggtccagatcatgaaagaag

SEQ ID NO: 527891 - DNA, 25 bp, Mus musculus
agatgggtccagttcatgaaagaag

SEQ ID NO: 527892 - DNA, 25 bp, Mus musculus
agatgggtccccagaactgcctctg

SEQ ID NO: 527893 - DNA, 25 bp, Mus musculus
agatgggtcccctgaactgcctctg

SEQ ID NO: 527894 - DNA, 25 bp, Mus musculus
agatgggttactcgctcttgtgcaa

SEQ ID NO: 527895 - DNA, 25 bp, Mus musculus
agatgggttactggctcttgtgcaa

SEQ ID NO: 527896 - DNA, 25 bp, Mus musculus
agatggtagaagagttaatcctttc

SEQ ID NO: 527897 - DNA, 25 bp, Mus musculus
agatggtagaagtgttaatcctttc

SEQ ID NO: 527898 - DNA, 25 bp, Mus musculus
agatggtcactcaccacaggatggg

SEQ ID NO: 527899 - DNA, 25 bp, Mus musculus
agatggtcactctccacaggatggg

SEQ ID NO: 527900 - DNA, 25 bp, Mus musculus
agatggtccaatctcctctgctggc

SEQ ID NO: 527901 - DNA, 25 bp, Mus musculus
agatggtccaatgtcctctgctggc

SEQ ID NO: 527902 - DNA, 25 bp, Mus musculus
agatggtcgccaagcagcacgggaa

SEQ ID NO: 527903 - DNA, 25 bp, Mus musculus
agatggtcgccatgcagcacgggaa

SEQ ID NO: 527904 - DNA, 25 bp, Mus musculus
agatggtcggcaaccagtacttcag

SEQ ID NO: 527905 - DNA, 25 bp, Mus musculus
agatggtcggcatccagtacttcag

SEQ ID NO: 527906 - DNA, 25 bp, Mus musculus
agatggtgctccacggcgccaagta

SEQ ID NO: 527907 - DNA, 25 bp, Mus musculus
agatggtgctcctcggcgccaagta

SEQ ID NO: 527908 - DNA, 25 bp, Mus musculus
agatggtggaagatttctctgagaa

SEQ ID NO: 527909 - DNA, 25 bp, Mus musculus
agatggtggaagttttctctgagaa

SEQ ID NO: 527910 - DNA, 25 bp, Mus musculus
agatggtggagcagccactgagaca

SEQ ID NO: 527911 - DNA, 25 bp, Mus musculus
agatggtggagctgccactgagaca

SEQ ID NO: 527912 - DNA, 25 bp, Mus musculus
agatggttcccaccagacaggcctt

SEQ ID NO: 527913 - DNA, 25 bp, Mus musculus
agatggttcccagcagacaggcctt

SEQ ID NO: 527914 - DNA, 25 bp, Mus musculus
agatgtaccaggaggccgcccagct

SEQ ID NO: 527915 - DNA, 25 bp, Mus musculus
agatgtaccaggtggccgcccagct

SEQ ID NO: 527916 - DNA, 25 bp, Mus musculus
agatgtagtaaaccagtcaagtcca

SEQ ID NO: 527917 - DNA, 25 bp, Mus musculus
agatgtagtaaagcagtcaagtcca

SEQ ID NO: 527918 - DNA, 25 bp, Mus musculus
agatgtatggtgatgacctccatcc

SEQ ID NO: 527919 - DNA, 25 bp, Mus musculus
agatgtatggtgttgacctccatcc

SEQ ID NO: 527920 - DNA, 25 bp, Mus musculus
agatgtattggacccagaagaactc

SEQ ID NO: 527921 - DNA, 25 bp, Mus musculus
agatgtattggagccagaagaactc

SEQ ID NO: 527922 - DNA, 25 bp, Mus musculus
agatgtcaacccagaggactccggc

SEQ ID NO: 527923 - DNA, 25 bp, Mus musculus
agatgtcaaccctgaggactccggc

SEQ ID NO: 527924 - DNA, 25 bp, Mus musculus
agatgtcagtgcacagccccacagt

SEQ ID NO: 527925 - DNA, 25 bp, Mus musculus
agatgtcagtgctcagccccacagt

SEQ ID NO: 527926 - DNA, 25 bp, Mus musculus
agatgtccacgaagactccctcaca

SEQ ID NO: 527927 - DNA, 25 bp, Mus musculus
agatgtccacgatgactccctcaca

SEQ ID NO: 527928 - DNA, 25 bp, Mus musculus
agatgtccgccgaggtcccagatgg

SEQ ID NO: 527929 - DNA, 25 bp, Mus musculus
agatgtccgccgtggtcccagatgg

SEQ ID NO: 527930 - DNA, 25 bp, Mus musculus
agatgtcctcaccagcacgtacggc

SEQ ID NO: 527931 - DNA, 25 bp, Mus musculus
agatgtcctcacgagcacgtacggc

SEQ ID NO: 527932 - DNA, 25 bp, Mus musculus
agatgtcctgtaatccttcctttgg

SEQ ID NO: 527933 - DNA, 25 bp, Mus musculus
agatgtcctgtattccttcctttgg

SEQ ID NO: 527934 - DNA, 25 bp, Mus musculus
agatgtcgaaggactcccttctagg

SEQ ID NO: 527935 - DNA, 25 bp, Mus musculus
agatgtcgaaggactgcttgagcat

SEQ ID NO: 527936 - DNA, 25 bp, Mus musculus
agatgtcgaaggtctcccttctagg

SEQ ID NO: 527937 - DNA, 25 bp, Mus musculus
agatgtcgaaggtctgcttgagcat

SEQ ID NO: 527938 - DNA, 25 bp, Mus musculus
agatgtcgatgcaaattcaaccaac

SEQ ID NO: 527939 - DNA, 25 bp, Mus musculus
agatgtcgatgctaattcaaccaac

SEQ ID NO: 527940 - DNA, 25 bp, Mus musculus
agatgtcgcaggagaggcccacgtt

SEQ ID NO: 527941 - DNA, 25 bp, Mus musculus
agatgtcgcaggtgaggcccacgtt

SEQ ID NO: 527942 - DNA, 25 bp, Mus musculus
agatgtcgtccaagaccatccccga

SEQ ID NO: 527943 - DNA, 25 bp, Mus musculus
agatgtcgtccatgaccatccccga

SEQ ID NO: 527944 - DNA, 25 bp, Mus musculus
agatgtctgtggcagtgactcaaat

SEQ ID NO: 527945 - DNA, 25 bp, Mus musculus
agatgtctgtgggagtgactcaaat

SEQ ID NO: 527946 - DNA, 25 bp, Mus musculus
agatgtgaaccgcatgtctccggga

SEQ ID NO: 527947 - DNA, 25 bp, Mus musculus
agatgtgaaccggatgtctccggga

SEQ ID NO: 527948 - DNA, 25 bp, Mus musculus
agatgtgacacgagggaccagtccc

SEQ ID NO: 527949 - DNA, 25 bp, Mus musculus
agatgtgacacgtgggaccagtccc

SEQ ID NO: 527950 - DNA, 25 bp, Mus musculus
agatgtgatgccagtgtgctccaga

SEQ ID NO: 527951 - DNA, 25 bp, Mus musculus
agatgtgatgcctgtgtgctccaga

SEQ ID NO: 527952 - DNA, 25 bp, Mus musculus
agatgtgcaacaactgccacggcct

SEQ ID NO: 527953 - DNA, 25 bp, Mus musculus
agatgtgcaacatctgccacggcct

SEQ ID NO: 527954 - DNA, 25 bp, Mus musculus
agatgtggacgtacaaccctatgca

SEQ ID NO: 527955 - DNA, 25 bp, Mus musculus
agatgtggacgttcaaccctatgca

SEQ ID NO: 527956 - DNA, 25 bp, Mus musculus
agatgtggccatattgcaggaaagg

SEQ ID NO: 527957 - DNA, 25 bp, Mus musculus
agatgtggccattttgcaggaaagg

SEQ ID NO: 527958 - DNA, 25 bp, Mus musculus
agatgtggccgcagccaagtggaat

SEQ ID NO: 527959 - DNA, 25 bp, Mus musculus
agatgtggccgctgccaagtggaat

SEQ ID NO: 527960 - DNA, 25 bp, Mus musculus
agatgtgggacgcaagcctcctact

SEQ ID NO: 527961 - DNA, 25 bp, Mus musculus
agatgtgggacggaagcctcctact

SEQ ID NO: 527962 - DNA, 25 bp, Mus musculus
agatgtggtcctagtccgctttggc

SEQ ID NO: 527963 - DNA, 25 bp, Mus musculus
agatgtggtccttgtccgctttggc

SEQ ID NO: 527964 - DNA, 25 bp, Mus musculus
agatgtggtgggacctgtctgtcac

SEQ ID NO: 527965 - DNA, 25 bp, Mus musculus
agatgtggtgggtcctgtctgtcac

SEQ ID NO: 527966 - DNA, 25 bp, Mus musculus
agatgtgtcctcaacctgctgtcct

SEQ ID NO: 527967 - DNA, 25 bp, Mus musculus
agatgtgtcctctacctgctgtcct

SEQ ID NO: 527968 - DNA, 25 bp, Mus musculus
agatgtgtctatctgcgttctgcca

SEQ ID NO: 527969 - DNA, 25 bp, Mus musculus
agatgtgtctatgtgcgttctgcca

SEQ ID NO: 527970 - DNA, 25 bp, Mus musculus
agatgtgtgagtcgccccgacccag

SEQ ID NO: 527971 - DNA, 25 bp, Mus musculus
agatgtgtgagtggccccgacccag

SEQ ID NO: 527972 - DNA, 25 bp, Mus musculus
agatgtgtgatcactaggacaggag

SEQ ID NO: 527973 - DNA, 25 bp, Mus musculus
agatgtgtgatctctaggacaggag

SEQ ID NO: 527974 - DNA, 25 bp, Mus musculus
agatgtgttaccctgagtggaacag

SEQ ID NO: 527975 - DNA, 25 bp, Mus musculus
agatgtgttaccgtgagtggaacag

SEQ ID NO: 527976 - DNA, 25 bp, Mus musculus
agatgttcactcacctctaccagcg

SEQ ID NO: 527977 - DNA, 25 bp, Mus musculus
agatgttcactctcctctaccagcg

SEQ ID NO: 527978 - DNA, 25 bp, Mus musculus
agatgttctcccacctacggcggat

SEQ ID NO: 527979 - DNA, 25 bp, Mus musculus
agatgttctccctcctacggcggat

SEQ ID NO: 527980 - DNA, 25 bp, Mus musculus
agatgttctgcaagactaagagaag

SEQ ID NO: 527981 - DNA, 25 bp, Mus musculus
agatgttctgcatgactaagagaag

SEQ ID NO: 527982 - DNA, 25 bp, Mus musculus
agatgttgccaacggtgggtacctc

SEQ ID NO: 527983 - DNA, 25 bp, Mus musculus
agatgttgccaagggtgggtacctc

SEQ ID NO: 527984 - DNA, 25 bp, Mus musculus
agatgttgtggtacctgggctgcaa

SEQ ID NO: 527985 - DNA, 25 bp, Mus musculus
agatgttgtggttcctgggctgcaa

SEQ ID NO: 527986 - DNA, 25 bp, Mus musculus
agatgttgttcacgcccttgccctg

SEQ ID NO: 527987 - DNA, 25 bp, Mus musculus
agatgttgttcaggcccttgccctg

SEQ ID NO: 527988 - DNA, 25 bp, Mus musculus
agatgtttgactcgtttgactacca

SEQ ID NO: 527989 - DNA, 25 bp, Mus musculus
agatgtttgactggtttgactacca

SEQ ID NO: 527990 - DNA, 25 bp, Mus musculus
agatgtttggtcatggctggaattc

SEQ ID NO: 527991 - DNA, 25 bp, Mus musculus
agatgtttggtcttggctggaattc

SEQ ID NO: 527992 - DNA, 25 bp, Mus musculus
agatgtttggttatcacaagccaaa

SEQ ID NO: 527993 - DNA, 25 bp, Mus musculus
agatgtttggttttcacaagccaaa

SEQ ID NO: 527994 - DNA, 25 bp, Mus musculus
agattaagctctccctgctgtccag

SEQ ID NO: 527995 - DNA, 25 bp, Mus musculus
agattaagctctgcctgctgtccag

SEQ ID NO: 527996 - DNA, 25 bp, Mus musculus
agattaccacggacacaacccatac

SEQ ID NO: 527997 - DNA, 25 bp, Mus musculus
agattaccacggtcacaacccatac

SEQ ID NO: 527998 - DNA, 25 bp, Mus musculus
agattacttcatactcattctgcag

SEQ ID NO: 527999 - DNA, 25 bp, Mus musculus
agattacttcattctcattctgcag

SEQ ID NO: 528000 - DNA, 25 bp, Mus musculus
agattaggaagtcgctgtctgactt

SEQ ID NO: 528001 - DNA, 25 bp, Mus musculus
agattaggaagtggctgtctgactt

SEQ ID NO: 528002 - DNA, 25 bp, Mus musculus
agattagtcagccaggatgggaaaa

SEQ ID NO: 528003 - DNA, 25 bp, Mus musculus
agattagtcagcgaggatgggaaaa

SEQ ID NO: 528004 - DNA, 25 bp, Mus musculus
agattatcatctacagcagtggagg

SEQ ID NO: 528005 - DNA, 25 bp, Mus musculus
agattatcatcttcagcagtggagg

SEQ ID NO: 528006 - DNA, 25 bp, Mus musculus
agattatcctgaccaacccaccagg

SEQ ID NO: 528007 - DNA, 25 bp, Mus musculus
agattatcctgagcaacccaccagg

SEQ ID NO: 528008 - DNA, 25 bp, Mus musculus
agattatctcggagccttgcttcaa

SEQ ID NO: 528009 - DNA, 25 bp, Mus musculus
agattatctcggtgccttgcttcaa

SEQ ID NO: 528010 - DNA, 25 bp, Mus musculus
agattcagactcctgaggattcctt

SEQ ID NO: 528011 - DNA, 25 bp, Mus musculus
agattcagactcgtgaggattcctt

SEQ ID NO: 528012 - DNA, 25 bp, Mus musculus
agattcaggaggaattcaaccagtt

SEQ ID NO: 528013 - DNA, 25 bp, Mus musculus
agattcaggaggtattcaaccagtt

SEQ ID NO: 528014 - DNA, 25 bp, Mus musculus
agattcagtcggaaaccccggcgca

SEQ ID NO: 528015 - DNA, 25 bp, Mus musculus
agattcagtcggtaaccccggcgca

SEQ ID NO: 528016 - DNA, 25 bp, Mus musculus
agattcatcgccatgaaccgaggca

SEQ ID NO: 528017 - DNA, 25 bp, Mus musculus
agattcatcgccttgaaccgaggca

SEQ ID NO: 528018 - DNA, 25 bp, Mus musculus
agattcatctaacgaacgagacaag

SEQ ID NO: 528019 - DNA, 25 bp, Mus musculus
agattcatctaaggaacgagacaag

SEQ ID NO: 528020 - DNA, 25 bp, Mus musculus
agattccctaacatacactgtgcag

SEQ ID NO: 528021 - DNA, 25 bp, Mus musculus
agattccctaacttacactgtgcag

SEQ ID NO: 528022 - DNA, 25 bp, Mus musculus
agattcctgctgaagcgtggcttga

SEQ ID NO: 528023 - DNA, 25 bp, Mus musculus
agattcctgctgtagcgtggcttga

SEQ ID NO: 528024 - DNA, 25 bp, Mus musculus
agattcctttgcagctcaccattgg

SEQ ID NO: 528025 - DNA, 25 bp, Mus musculus
agattcctttgctgctcaccattgg

SEQ ID NO: 528026 - DNA, 25 bp, Mus musculus
agattcgcagcactcgagccagcct

SEQ ID NO: 528027 - DNA, 25 bp, Mus musculus
agattcgcagcagtcgagccagcct

SEQ ID NO: 528028 - DNA, 25 bp, Mus musculus
agattcgcagcccagacaccgtggg

SEQ ID NO: 528029 - DNA, 25 bp, Mus musculus
agattcgcagccgagacaccgtggg

SEQ ID NO: 528030 - DNA, 25 bp, Mus musculus
agattcgcaggacgtcaccgtggtc

SEQ ID NO: 528031 - DNA, 25 bp, Mus musculus
agattcgcaggaggtcaccgtggtc

SEQ ID NO: 528032 - DNA, 25 bp, Mus musculus
agattcggccccactggagacacta

SEQ ID NO: 528033 - DNA, 25 bp, Mus musculus
agattcggcccctctggagacacta

SEQ ID NO: 528034 - DNA, 25 bp, Mus musculus
agattcggtcctatgtgtacgctga

SEQ ID NO: 528035 - DNA, 25 bp, Mus musculus
agattcggtcctttgtgtacgctga

SEQ ID NO: 528036 - DNA, 25 bp, Mus musculus
agattcgttcagacctgactgctct

SEQ ID NO: 528037 - DNA, 25 bp, Mus musculus
agattcgttcagtcctgactgctct

SEQ ID NO: 528038 - DNA, 25 bp, Mus musculus
agattctagaacatagagaaaacca

SEQ ID NO: 528039 - DNA, 25 bp, Mus musculus
agattctagaacttagagaaaacca

SEQ ID NO: 528040 - DNA, 25 bp, Mus musculus
agattctatcacaagtaaccaccag

SEQ ID NO: 528041 - DNA, 25 bp, Mus musculus
agattctatcactagtaaccaccag

SEQ ID NO: 528042 - DNA, 25 bp, Mus musculus
agattctcctcaagggcgttccacc

SEQ ID NO: 528043 - DNA, 25 bp, Mus musculus
agattctcctcatgggcgttccacc

SEQ ID NO: 528044 - DNA, 25 bp, Mus musculus
agattctggtcactggatcctctgg

SEQ ID NO: 528045 - DNA, 25 bp, Mus musculus
agattctggtcagtggatcctctgg

SEQ ID NO: 528046 - DNA, 25 bp, Mus musculus
agattcttaaagcatgcctcctgga

SEQ ID NO: 528047 - DNA, 25 bp, Mus musculus
agattcttaaaggatgcctcctgga

SEQ ID NO: 528048 - DNA, 25 bp, Mus musculus
agattgacatcgacgtggacgaccc

SEQ ID NO: 528049 - DNA, 25 bp, Mus musculus
agattgacatcgtcgtggacgaccc

SEQ ID NO: 528050 - DNA, 25 bp, Mus musculus
agattgacggccctggtgaccacca

SEQ ID NO: 528051 - DNA, 25 bp, Mus musculus
agattgacggccgtggtgaccacca

SEQ ID NO: 528052 - DNA, 25 bp, Mus musculus
agattgagatagacatcgaacccac

SEQ ID NO: 528053 - DNA, 25 bp, Mus musculus
agattgagatagtcatcgaacccac

SEQ ID NO: 528054 - DNA, 25 bp, Mus musculus
agattgagcggacccaacgggacat

SEQ ID NO: 528055 - DNA, 25 bp, Mus musculus
agattgagcggagccaacgggacat

SEQ ID NO: 528056 - DNA, 25 bp, Mus musculus
agattgaggttcactatattcggaa

SEQ ID NO: 528057 - DNA, 25 bp, Mus musculus
agattgaggttctctatattcggaa

SEQ ID NO: 528058 - DNA, 25 bp, Mus musculus
agattgcaggcacccgcaggccaga

SEQ ID NO: 528059 - DNA, 25 bp, Mus musculus
agattgcaggcagccgcaggccaga

SEQ ID NO: 528060 - DNA, 25 bp, Mus musculus
agattgccaaatcccagatactgat

SEQ ID NO: 528061 - DNA, 25 bp, Mus musculus
agattgccaaatgccagatactgat

SEQ ID NO: 528062 - DNA, 25 bp, Mus musculus
agattgcccacaatgccctggagac

SEQ ID NO: 528063 - DNA, 25 bp, Mus musculus
agattgcccacattgccctggagac

SEQ ID NO: 528064 - DNA, 25 bp, Mus musculus
agattgccctgcagcacggtgaccg

SEQ ID NO: 528065 - DNA, 25 bp, Mus musculus
agattgccctgctgcacggtgaccg

SEQ ID NO: 528066 - DNA, 25 bp, Mus musculus
agattgccgaccaggccgacttctc

SEQ ID NO: 528067 - DNA, 25 bp, Mus musculus
agattgccgacctggccgacttctc

SEQ ID NO: 528068 - DNA, 25 bp, Mus musculus
agattgcctcggaaactttactaag

SEQ ID NO: 528069 - DNA, 25 bp, Mus musculus
agattgcctcggtaactttactaag

SEQ ID NO: 528070 - DNA, 25 bp, Mus musculus
agattgcgacggccctctcttcctg

SEQ ID NO: 528071 - DNA, 25 bp, Mus musculus
agattgcgacgggcctctcttcctg

SEQ ID NO: 528072 - DNA, 25 bp, Mus musculus
agattgcgggcaacgagaacgatga

SEQ ID NO: 528073 - DNA, 25 bp, Mus musculus
agattgcgggcatcgagaacgatga

SEQ ID NO: 528074 - DNA, 25 bp, Mus musculus
agattgctgcttctagggtctaggc

SEQ ID NO: 528075 - DNA, 25 bp, Mus musculus
agattgctgcttgtagggtctaggc

SEQ ID NO: 528076 - DNA, 25 bp, Mus musculus
agattggaaatgctgcaacaaggac

SEQ ID NO: 528077 - DNA, 25 bp, Mus musculus
agattggaaatggtgcaacaaggac

SEQ ID NO: 528078 - DNA, 25 bp, Mus musculus
agattggagcccaggtccttgagtg

SEQ ID NO: 528079 - DNA, 25 bp, Mus musculus
agattggagccctggtccttgagtg

SEQ ID NO: 528080 - DNA, 25 bp, Mus musculus
agattggagttaaccttatgagcac

SEQ ID NO: 528081 - DNA, 25 bp, Mus musculus
agattggagttatccttatgagcac

SEQ ID NO: 528082 - DNA, 25 bp, Mus musculus
agattggatctaccagcaaatgagg

SEQ ID NO: 528083 - DNA, 25 bp, Mus musculus
agattggatctagcagcaaatgagg

SEQ ID NO: 528084 - DNA, 25 bp, Mus musculus
agattggccgagcacagttcagtga

SEQ ID NO: 528085 - DNA, 25 bp, Mus musculus
agattggccgaggacagttcagtga

SEQ ID NO: 528086 - DNA, 25 bp, Mus musculus
agattgggaggaaaatatgtgcctc

SEQ ID NO: 528087 - DNA, 25 bp, Mus musculus
agattgggaggataatatgtgcctc

SEQ ID NO: 528088 - DNA, 25 bp, Mus musculus
agattgtacccgacagggatgggtc

SEQ ID NO: 528089 - DNA, 25 bp, Mus musculus
agattgtacccgtcagggatgggtc

SEQ ID NO: 528090 - DNA, 25 bp, Mus musculus
agattgtcaataaccccggcatcca

SEQ ID NO: 528091 - DNA, 25 bp, Mus musculus
agattgtcaatatccccggcatcca

SEQ ID NO: 528092 - DNA, 25 bp, Mus musculus
agatttacacccagatccagaagtt

SEQ ID NO: 528093 - DNA, 25 bp, Mus musculus
agatttacaccctgatccagaagtt

SEQ ID NO: 528094 - DNA, 25 bp, Mus musculus
agatttacaccgagctctgacttcc

SEQ ID NO: 528095 - DNA, 25 bp, Mus musculus
agatttacaccgtgctctgacttcc

SEQ ID NO: 528096 - DNA, 25 bp, Mus musculus
agatttacacgtcaagcaccctcgc

SEQ ID NO: 528097 - DNA, 25 bp, Mus musculus
agatttacacgtgaagcaccctcgc

SEQ ID NO: 528098 - DNA, 25 bp, Mus musculus
agatttcagcgcatgagggaggaat

SEQ ID NO: 528099 - DNA, 25 bp, Mus musculus
agatttcagcgcttgagggaggaat

SEQ ID NO: 528100 - DNA, 25 bp, Mus musculus
agatttcctttcagatcatccaaag

SEQ ID NO: 528101 - DNA, 25 bp, Mus musculus
agatttcctttctgatcatccaaag

SEQ ID NO: 528102 - DNA, 25 bp, Mus musculus
agatttctaagacctctgcggttgc

SEQ ID NO: 528103 - DNA, 25 bp, Mus musculus
agatttctaagagctctgcggttgc

SEQ ID NO: 528104 - DNA, 25 bp, Mus musculus
agatttctgactacagctggaatcc

SEQ ID NO: 528105 - DNA, 25 bp, Mus musculus
agatttctgacttcagctggaatcc

SEQ ID NO: 528106 - DNA, 25 bp, Mus musculus
agatttggactcatagtttcttcca

SEQ ID NO: 528107 - DNA, 25 bp, Mus musculus
agatttggactcttagtttcttcca

SEQ ID NO: 528108 - DNA, 25 bp, Mus musculus
agatttggtcaaaagctggtgcgga

SEQ ID NO: 528109 - DNA, 25 bp, Mus musculus
agatttggtcaatagctggtgcgga

SEQ ID NO: 528110 - DNA, 25 bp, Mus musculus
agatttgtcccaagctgcatgactg

SEQ ID NO: 528111 - DNA, 25 bp, Mus musculus
agatttgtcccatgctgcatgactg

SEQ ID NO: 528112 - DNA, 25 bp, Mus musculus
agatttgtgggcattggctggaaca

SEQ ID NO: 528113 - DNA, 25 bp, Mus musculus
agatttgtgggctttggctggaaca

SEQ ID NO: 528114 - DNA, 25 bp, Mus musculus
agattttatcatcccgcgggagaag

SEQ ID NO: 528115 - DNA, 25 bp, Mus musculus
agattttatcatgccgcgggagaag

SEQ ID NO: 528116 - DNA, 25 bp, Mus musculus
agattttattcaagttcccaggaat

SEQ ID NO: 528117 - DNA, 25 bp, Mus musculus
agattttattcatgttcccaggaat

SEQ ID NO: 528118 - DNA, 25 bp, Mus musculus
agattttcaccgactccctaatgag

SEQ ID NO: 528119 - DNA, 25 bp, Mus musculus
agattttcaccgtctccctaatgag

SEQ ID NO: 528120 - DNA, 25 bp, Mus musculus
agattttgaggcaccagaggagttg

SEQ ID NO: 528121 - DNA, 25 bp, Mus musculus
agattttgaggctccagaggagttg

SEQ ID NO: 528122 - DNA, 25 bp, Mus musculus
agattttggccacctcgctgtggag

SEQ ID NO: 528123 - DNA, 25 bp, Mus musculus
agattttggccagctcgctgtggag

SEQ ID NO: 528124 - DNA, 25 bp, Mus musculus
agcaaaaaagagaggctttgccttc

SEQ ID NO: 528125 - DNA, 25 bp, Mus musculus
agcaaaaaagagtggctttgccttc

SEQ ID NO: 528126 - DNA, 25 bp, Mus musculus
agcaaaaagaagatcctggccacgc

SEQ ID NO: 528127 - DNA, 25 bp, Mus musculus
agcaaaaagaagttcctggccacgc

SEQ ID NO: 528128 - DNA, 25 bp, Mus musculus
agcaaaagcaagctggacaaccagt

SEQ ID NO: 528129 - DNA, 25 bp, Mus musculus
agcaaaagcaaggtggacaaccagt

SEQ ID NO: 528130 - DNA, 25 bp, Mus musculus
agcaaaagcccaccgtcaatgcggt

SEQ ID NO: 528131 - DNA, 25 bp, Mus musculus
agcaaaagcccagcgtcaatgcggt

SEQ ID NO: 528132 - DNA, 25 bp, Mus musculus
agcaaaagtgacaagggcgttcagc

SEQ ID NO: 528133 - DNA, 25 bp, Mus musculus
agcaaaagtgactagggcgttcagc

SEQ ID NO: 528134 - DNA, 25 bp, Mus musculus
agcaaaatccacatgcaggaaatgg

SEQ ID NO: 528135 - DNA, 25 bp, Mus musculus
agcaaaatccacttgcaggaaatgg

SEQ ID NO: 528136 - DNA, 25 bp, Mus musculus
agcaaaattactcggcactagaaag

SEQ ID NO: 528137 - DNA, 25 bp, Mus musculus
agcaaaattactgggcactagaaag

SEQ ID NO: 528138 - DNA, 25 bp, Mus musculus
agcaaaattcctcctctaccttggc

SEQ ID NO: 528139 - DNA, 25 bp, Mus musculus
agcaaaattcctgctctaccttggc

SEQ ID NO: 528140 - DNA, 25 bp, Mus musculus
agcaaacagcaactccagaagcaga

SEQ ID NO: 528141 - DNA, 25 bp, Mus musculus
agcaaacagcaagtccagaagcaga

SEQ ID NO: 528142 - DNA, 25 bp, Mus musculus
agcaaacatctcagctgactcagac

SEQ ID NO: 528143 - DNA, 25 bp, Mus musculus
agcaaacatctctgctgactcagac

SEQ ID NO: 528144 - DNA, 25 bp, Mus musculus
agcaaacgaagcatcatgggaaaca

SEQ ID NO: 528145 - DNA, 25 bp, Mus musculus
agcaaacgaagcttcatgggaaaca

SEQ ID NO: 528146 - DNA, 25 bp, Mus musculus
agcaaacgctataccatgtcccgca

SEQ ID NO: 528147 - DNA, 25 bp, Mus musculus
agcaaacgctattccatgtcccgca

SEQ ID NO: 528148 - DNA, 25 bp, Mus musculus
agcaaactgggcagcaggacagttt

SEQ ID NO: 528149 - DNA, 25 bp, Mus musculus
agcaaactgggctgcaggacagttt

SEQ ID NO: 528150 - DNA, 25 bp, Mus musculus
agcaaagaaggtcgttgtttcacaa

SEQ ID NO: 528151 - DNA, 25 bp, Mus musculus
agcaaagaaggtggttgtttcacaa

SEQ ID NO: 528152 - DNA, 25 bp, Mus musculus
agcaaagagcttactcaaagaccta

SEQ ID NO: 528153 - DNA, 25 bp, Mus musculus
agcaaagagctttctcaaagaccta

SEQ ID NO: 528154 - DNA, 25 bp, Mus musculus
agcaaagatactcctggtggtgcac

SEQ ID NO: 528155 - DNA, 25 bp, Mus musculus
agcaaagatactgctggtggtgcac

SEQ ID NO: 528156 - DNA, 25 bp, Mus musculus
agcaaagccatccttctacagaaga

SEQ ID NO: 528157 - DNA, 25 bp, Mus musculus
agcaaagccatcgttctacagaaga

SEQ ID NO: 528158 - DNA, 25 bp, Mus musculus
agcaaagccccacatcaggtcgcga

SEQ ID NO: 528159 - DNA, 25 bp, Mus musculus
agcaaagccccagatcaggtcgcga

SEQ ID NO: 528160 - DNA, 25 bp, Mus musculus
agcaaaggacaccagggagtccacg

SEQ ID NO: 528161 - DNA, 25 bp, Mus musculus
agcaaaggacacgagggagtccacg

SEQ ID NO: 528162 - DNA, 25 bp, Mus musculus
agcaaaggagggaatgtggacataa

SEQ ID NO: 528163 - DNA, 25 bp, Mus musculus
agcaaaggagggtatgtggacataa

SEQ ID NO: 528164 - DNA, 25 bp, Mus musculus
agcaaaggcacaacacctctggctc

SEQ ID NO: 528165 - DNA, 25 bp, Mus musculus
agcaaaggcacacatcaattcctca

SEQ ID NO: 528166 - DNA, 25 bp, Mus musculus
agcaaaggcacagatcaattcctca

SEQ ID NO: 528167 - DNA, 25 bp, Mus musculus
agcaaaggcacatcacctctggctc

SEQ ID NO: 528168 - DNA, 25 bp, Mus musculus
agcaaatatttacatgttggttaca

SEQ ID NO: 528169 - DNA, 25 bp, Mus musculus
agcaaatatttagatgttggttaca

SEQ ID NO: 528170 - DNA, 25 bp, Mus musculus
agcaaatcttttccctgggctcctt

SEQ ID NO: 528171 - DNA, 25 bp, Mus musculus
agcaaatcttttgcctgggctcctt

SEQ ID NO: 528172 - DNA, 25 bp, Mus musculus
agcaaatgccataacttagtggatt

SEQ ID NO: 528173 - DNA, 25 bp, Mus musculus
agcaaatgccattacttagtggatt

SEQ ID NO: 528174 - DNA, 25 bp, Mus musculus
agcaaatgctggctcagtacgtgga

SEQ ID NO: 528175 - DNA, 25 bp, Mus musculus
agcaaatgctgggtcagtacgtgga

SEQ ID NO: 528176 - DNA, 25 bp, Mus musculus
agcaaattcattctactacccacgc

SEQ ID NO: 528177 - DNA, 25 bp, Mus musculus
agcaaattcattgtactacccacgc

SEQ ID NO: 528178 - DNA, 25 bp, Mus musculus
agcaaattccccagctcatcttcag

SEQ ID NO: 528179 - DNA, 25 bp, Mus musculus
agcaaattcccctgctcatcttcag

SEQ ID NO: 528180 - DNA, 25 bp, Mus musculus
agcaacaagagaatagtgggctgca

SEQ ID NO: 528181 - DNA, 25 bp, Mus musculus
agcaacaagagattagtgggctgca

SEQ ID NO: 528182 - DNA, 25 bp, Mus musculus
agcaacagaagaaccggcaggaaga

SEQ ID NO: 528183 - DNA, 25 bp, Mus musculus
agcaacagaagatccggcaggaaga

SEQ ID NO: 528184 - DNA, 25 bp, Mus musculus
agcaacagaagcagccgcgccgctg

SEQ ID NO: 528185 - DNA, 25 bp, Mus musculus
agcaacagaagctgccgcgccgctg

SEQ ID NO: 528186 - DNA, 25 bp, Mus musculus
agcaacagatgaatgagatagttac

SEQ ID NO: 528187 - DNA, 25 bp, Mus musculus
agcaacagatgattgagatagttac

SEQ ID NO: 528188 - DNA, 25 bp, Mus musculus
agcaacagcaccatggaacgcaagt

SEQ ID NO: 528189 - DNA, 25 bp, Mus musculus
agcaacagcaccttggaacgcaagt

SEQ ID NO: 528190 - DNA, 25 bp, Mus musculus
agcaacaggaatcgcctgggctgcc

SEQ ID NO: 528191 - DNA, 25 bp, Mus musculus
agcaacaggaatggcctgggctgcc

SEQ ID NO: 528192 - DNA, 25 bp, Mus musculus
agcaacatagagcagttcgcagagg

SEQ ID NO: 528193 - DNA, 25 bp, Mus musculus
agcaacatagaggagttcgcagagg

SEQ ID NO: 528194 - DNA, 25 bp, Mus musculus
agcaacatcattatctccaacggtg

SEQ ID NO: 528195 - DNA, 25 bp, Mus musculus
agcaacatcattttctccaacggtg

SEQ ID NO: 528196 - DNA, 25 bp, Mus musculus
agcaacatccccattatcacggtac

SEQ ID NO: 528197 - DNA, 25 bp, Mus musculus
agcaacatcccctttatcacggtac

SEQ ID NO: 528198 - DNA, 25 bp, Mus musculus
agcaaccctgaacccaccaagatga

SEQ ID NO: 528199 - DNA, 25 bp, Mus musculus
agcaaccctgaagccaccaagatga

SEQ ID NO: 528200 - DNA, 25 bp, Mus musculus
agcaaccggatgcattggctgtttt

SEQ ID NO: 528201 - DNA, 25 bp, Mus musculus
agcaaccggatggattggctgtttt

SEQ ID NO: 528202 - DNA, 25 bp, Mus musculus
agcaacctaacgacttcaacctgag

SEQ ID NO: 528203 - DNA, 25 bp, Mus musculus
agcaacctaacgtcttcaacctgag

SEQ ID NO: 528204 - DNA, 25 bp, Mus musculus
agcaacctagctctgaacgaagact

SEQ ID NO: 528205 - DNA, 25 bp, Mus musculus
agcaacctagctgtgaacgaagact

SEQ ID NO: 528206 - DNA, 25 bp, Mus musculus
agcaacctcaagagagtaaccctgg

SEQ ID NO: 528207 - DNA, 25 bp, Mus musculus
agcaacctcaagtgagtaaccctgg

SEQ ID NO: 528208 - DNA, 25 bp, Mus musculus
agcaacctcctgatcctgacctaga

SEQ ID NO: 528209 - DNA, 25 bp, Mus musculus
agcaacctcctgttcctgacctaga

SEQ ID NO: 528210 - DNA, 25 bp, Mus musculus
agcaacctcgtccagctgctgggtg

SEQ ID NO: 528211 - DNA, 25 bp, Mus musculus
agcaacctcgtcgagctgctgggtg

SEQ ID NO: 528212 - DNA, 25 bp, Mus musculus
agcaaccttgctcgtttagcccagg

SEQ ID NO: 528213 - DNA, 25 bp, Mus musculus
agcaaccttgctggtttagcccagg

SEQ ID NO: 528214 - DNA, 25 bp, Mus musculus
agcaacgacagcatgggcagcccaa

SEQ ID NO: 528215 - DNA, 25 bp, Mus musculus
agcaacgacagcttgggcagcccaa

SEQ ID NO: 528216 - DNA, 25 bp, Mus musculus
agcaacgcgccgctgcctattcggg

SEQ ID NO: 528217 - DNA, 25 bp, Mus musculus
agcaacgcgccggtgcctattcggg

SEQ ID NO: 528218 - DNA, 25 bp, Mus musculus
agcaacgtagccaacatctccactt

SEQ ID NO: 528219 - DNA, 25 bp, Mus musculus
agcaacgtagcctacatctccactt

SEQ ID NO: 528220 - DNA, 25 bp, Mus musculus
agcaactcacacaccactctgttaa

SEQ ID NO: 528221 - DNA, 25 bp, Mus musculus
agcaactcacactccactctgttaa

SEQ ID NO: 528222 - DNA, 25 bp, Mus musculus
agcaactcctgtaggaggagctggt

SEQ ID NO: 528223 - DNA, 25 bp, Mus musculus
agcaactcctgttggaggagctggt

SEQ ID NO: 528224 - DNA, 25 bp, Mus musculus
agcaactgactgcccacagcagagc

SEQ ID NO: 528225 - DNA, 25 bp, Mus musculus
agcaactgactggccacagcagagc

SEQ ID NO: 528226 - DNA, 25 bp, Mus musculus
agcaactgcaatctagccgtcatca

SEQ ID NO: 528227 - DNA, 25 bp, Mus musculus
agcaactgcaatgtagccgtcatca

SEQ ID NO: 528228 - DNA, 25 bp, Mus musculus
agcaactgtgacagaggcctttgtt

SEQ ID NO: 528229 - DNA, 25 bp, Mus musculus
agcaactgtgactgaggcctttgtt

SEQ ID NO: 528230 - DNA, 25 bp, Mus musculus
agcaactgttctactccgtcccgaa

SEQ ID NO: 528231 - DNA, 25 bp, Mus musculus
agcaactgttcttctccgtcccgaa

SEQ ID NO: 528232 - DNA, 25 bp, Mus musculus
agcaacttctgtaccagtagcctag

SEQ ID NO: 528233 - DNA, 25 bp, Mus musculus
agcaacttctgttccagtagcctag

SEQ ID NO: 528234 - DNA, 25 bp, Mus musculus
agcaagaaagccaccaagggcaagg

SEQ ID NO: 528235 - DNA, 25 bp, Mus musculus
agcaagaaagcctccaagggcaagg

SEQ ID NO: 528236 - DNA, 25 bp, Mus musculus
agcaagaaatcaccgattggttacc

SEQ ID NO: 528237 - DNA, 25 bp, Mus musculus
agcaagaaatcagcgattggttacc

SEQ ID NO: 528238 - DNA, 25 bp, Mus musculus
agcaagaatacacccgcaaggagga

SEQ ID NO: 528239 - DNA, 25 bp, Mus musculus
agcaagaatacagccgcaaggagga

SEQ ID NO: 528240 - DNA, 25 bp, Mus musculus
agcaagaccaccctgtaaagtccca

SEQ ID NO: 528241 - DNA, 25 bp, Mus musculus
agcaagaccaccgtgtaaagtccca

SEQ ID NO: 528242 - DNA, 25 bp, Mus musculus
agcaagaggaggacctatgctggcc

SEQ ID NO: 528243 - DNA, 25 bp, Mus musculus
agcaagaggaggtcctatgctggcc

SEQ ID NO: 528244 - DNA, 25 bp, Mus musculus
agcaagaggtgcaagcctgataacc

SEQ ID NO: 528245 - DNA, 25 bp, Mus musculus
agcaagaggtgctagcctgataacc

SEQ ID NO: 528246 - DNA, 25 bp, Mus musculus
agcaagagtcatcgcggaggcccaa

SEQ ID NO: 528247 - DNA, 25 bp, Mus musculus
agcaagagtcatggcggaggcccaa

SEQ ID NO: 528248 - DNA, 25 bp, Mus musculus
agcaagagtggaaggcaggatttca

SEQ ID NO: 528249 - DNA, 25 bp, Mus musculus
agcaagagtggatggcaggatttca

SEQ ID NO: 528250 - DNA, 25 bp, Mus musculus
agcaagattcgactgcaccctcggg

SEQ ID NO: 528251 - DNA, 25 bp, Mus musculus
agcaagattcgagtgcaccctcggg

SEQ ID NO: 528252 - DNA, 25 bp, Mus musculus
agcaagcagcgcaacgcctctaatg

SEQ ID NO: 528253 - DNA, 25 bp, Mus musculus
agcaagcagcgctacgcctctaatg

SEQ ID NO: 528254 - DNA, 25 bp, Mus musculus
agcaagcaggccagagtccacccgt

SEQ ID NO: 528255 - DNA, 25 bp, Mus musculus
agcaagcaggcctgagtccacccgt

SEQ ID NO: 528256 - DNA, 25 bp, Mus musculus
agcaagcagtgaccgctggcctact

SEQ ID NO: 528257 - DNA, 25 bp, Mus musculus
agcaagcagtgagcgctggcctact

SEQ ID NO: 528258 - DNA, 25 bp, Mus musculus
agcaagccagcccagagaggacgct

SEQ ID NO: 528259 - DNA, 25 bp, Mus musculus
agcaagccagccgagagaggacgct

SEQ ID NO: 528260 - DNA, 25 bp, Mus musculus
agcaagccagcgaatcgggaggctt

SEQ ID NO: 528261 - DNA, 25 bp, Mus musculus
agcaagccagcgtatcgggaggctt

SEQ ID NO: 528262 - DNA, 25 bp, Mus musculus
agcaagcccgataagcatgaagctg

SEQ ID NO: 528263 - DNA, 25 bp, Mus musculus
agcaagcccgattagcatgaagctg

SEQ ID NO: 528264 - DNA, 25 bp, Mus musculus
agcaagcccttacctgccttcggaa

SEQ ID NO: 528265 - DNA, 25 bp, Mus musculus
agcaagcccttagctgccttcggaa

SEQ ID NO: 528266 - DNA, 25 bp, Mus musculus
agcaagcctcccatccgaaaaaggg

SEQ ID NO: 528267 - DNA, 25 bp, Mus musculus
agcaagcctcccttccgaaaaaggg

SEQ ID NO: 528268 - DNA, 25 bp, Mus musculus
agcaagcgaacacgcaggcaagctc

SEQ ID NO: 528269 - DNA, 25 bp, Mus musculus
agcaagcgaacaggcaggcaagctc

SEQ ID NO: 528270 - DNA, 25 bp, Mus musculus
agcaagcgctgtccaaggtccactt

SEQ ID NO: 528271 - DNA, 25 bp, Mus musculus
agcaagcgctgtgcaaggtccactt

SEQ ID NO: 528272 - DNA, 25 bp, Mus musculus
agcaagcggcccatgtcgtctccag

SEQ ID NO: 528273 - DNA, 25 bp, Mus musculus
agcaagcggcccttgtcgtctccag

SEQ ID NO: 528274 - DNA, 25 bp, Mus musculus
agcaagcgggcaactcctgggcgcc

SEQ ID NO: 528275 - DNA, 25 bp, Mus musculus
agcaagcgggcatctcctgggcgcc

SEQ ID NO: 528276 - DNA, 25 bp, Mus musculus
agcaagctcacccatgccctgaaag

SEQ ID NO: 528277 - DNA, 25 bp, Mus musculus
agcaagctcaccgatgccctgaaag

SEQ ID NO: 528278 - DNA, 25 bp, Mus musculus
agcaagctctttagtcatctctttg

SEQ ID NO: 528279 - DNA, 25 bp, Mus musculus
agcaagctcttttgtcatctctttg

SEQ ID NO: 528280 - DNA, 25 bp, Mus musculus
agcaagcttcccagcatgcaccggg

SEQ ID NO: 528281 - DNA, 25 bp, Mus musculus
agcaagcttccctgcatgcaccggg

SEQ ID NO: 528282 - DNA, 25 bp, Mus musculus
agcaagctttgcaggaggcacggaa

SEQ ID NO: 528283 - DNA, 25 bp, Mus musculus
agcaagctttgctggaggcacggaa

SEQ ID NO: 528284 - DNA, 25 bp, Mus musculus
agcaaggagacaagggtcaagctct

SEQ ID NO: 528285 - DNA, 25 bp, Mus musculus
agcaaggagacatgggtcaagctct

SEQ ID NO: 528286 - DNA, 25 bp, Mus musculus
agcaaggcattgacatgaagcagga

SEQ ID NO: 528287 - DNA, 25 bp, Mus musculus
agcaaggcattgtcatgaagcagga

SEQ ID NO: 528288 - DNA, 25 bp, Mus musculus
agcaaggccgccagaactctcagag

SEQ ID NO: 528289 - DNA, 25 bp, Mus musculus
agcaaggccgcctgaactctcagag

SEQ ID NO: 528290 - DNA, 25 bp, Mus musculus
agcaaggccgttccagcccagtgag

SEQ ID NO: 528291 - DNA, 25 bp, Mus musculus
agcaaggccgttgcagcccagtgag

SEQ ID NO: 528292 - DNA, 25 bp, Mus musculus
agcaaggcctgcagaatgcctaccg

SEQ ID NO: 528293 - DNA, 25 bp, Mus musculus
agcaaggcctgctgaatgcctaccg

SEQ ID NO: 528294 - DNA, 25 bp, Mus musculus
agcaaggctcaaagtcctcagagca

SEQ ID NO: 528295 - DNA, 25 bp, Mus musculus
agcaaggctcaatgtcctcagagca

SEQ ID NO: 528296 - DNA, 25 bp, Mus musculus
agcaagtaggctccattaaggagag

SEQ ID NO: 528297 - DNA, 25 bp, Mus musculus
agcaagtaggctgcattaaggagag

SEQ ID NO: 528298 - DNA, 25 bp, Mus musculus
agcaagtgcctcatcagtctctaga

SEQ ID NO: 528299 - DNA, 25 bp, Mus musculus
agcaagtgcctcttcagtctctaga

SEQ ID NO: 528300 - DNA, 25 bp, Mus musculus
agcaagtttgctctggatgggttct

SEQ ID NO: 528301 - DNA, 25 bp, Mus musculus
agcaagtttgctgtggatgggttct

SEQ ID NO: 528302 - DNA, 25 bp, Mus musculus
agcaatagaatgatcccgggctctc

SEQ ID NO: 528303 - DNA, 25 bp, Mus musculus
agcaatagaatgttcccgggctctc

SEQ ID NO: 528304 - DNA, 25 bp, Mus musculus
agcaatatagaaaggtcctctgtgg

SEQ ID NO: 528305 - DNA, 25 bp, Mus musculus
agcaatatagaatggtcctctgtgg

SEQ ID NO: 528306 - DNA, 25 bp, Mus musculus
agcaatcagcacactgaacggcttg

SEQ ID NO: 528307 - DNA, 25 bp, Mus musculus
agcaatcagcactctgaacggcttg

SEQ ID NO: 528308 - DNA, 25 bp, Mus musculus
agcaatccaatgagcaccttcgccg

SEQ ID NO: 528309 - DNA, 25 bp, Mus musculus
agcaatccaatgtgcaccttcgccg

SEQ ID NO: 528310 - DNA, 25 bp, Mus musculus
agcaatccatacagcttacttgata

SEQ ID NO: 528311 - DNA, 25 bp, Mus musculus
agcaatccatactgcttacttgata

SEQ ID NO: 528312 - DNA, 25 bp, Mus musculus
agcaatccttggcagagcccttcag

SEQ ID NO: 528313 - DNA, 25 bp, Mus musculus
agcaatccttgggagagcccttcag

SEQ ID NO: 528314 - DNA, 25 bp, Mus musculus
agcaatctgctacggtgccgctctc

SEQ ID NO: 528315 - DNA, 25 bp, Mus musculus
agcaatctgctagggtgccgctctc

SEQ ID NO: 528316 - DNA, 25 bp, Mus musculus
agcaatctgctgagagctgagaccc

SEQ ID NO: 528317 - DNA, 25 bp, Mus musculus
agcaatctgctgtgagctgagaccc

SEQ ID NO: 528318 - DNA, 25 bp, Mus musculus
agcaatgacccaaattgctttgtgg

SEQ ID NO: 528319 - DNA, 25 bp, Mus musculus
agcaatgacccatattgctttgtgg

SEQ ID NO: 528320 - DNA, 25 bp, Mus musculus
agcaatgacctgatgttactacgcc

SEQ ID NO: 528321 - DNA, 25 bp, Mus musculus
agcaatgacctgttgttactacgcc

SEQ ID NO: 528322 - DNA, 25 bp, Mus musculus
agcaatgactggagcctcagtgata

SEQ ID NO: 528323 - DNA, 25 bp, Mus musculus
agcaatgactggtgcctcagtgata

SEQ ID NO: 528324 - DNA, 25 bp, Mus musculus
agcaatgccagtaccggtggctgag

SEQ ID NO: 528325 - DNA, 25 bp, Mus musculus
agcaatgccagttccggtggctgag

SEQ ID NO: 528326 - DNA, 25 bp, Mus musculus
agcaatgctgtaccccgtgtgacca

SEQ ID NO: 528327 - DNA, 25 bp, Mus musculus
agcaatgctgtagcccgtgtgacca

SEQ ID NO: 528328 - DNA, 25 bp, Mus musculus
agcaattcaagcagttctaccgcgc

SEQ ID NO: 528329 - DNA, 25 bp, Mus musculus
agcaattcaagctgttctaccgcgc

SEQ ID NO: 528330 - DNA, 25 bp, Mus musculus
agcaattgagatctatacagacatg

SEQ ID NO: 528331 - DNA, 25 bp, Mus musculus
agcaattgagatgtatacagacatg

SEQ ID NO: 528332 - DNA, 25 bp, Mus musculus
agcaattgagctcattcaggctggt

SEQ ID NO: 528333 - DNA, 25 bp, Mus musculus
agcaattgagctgattcaggctggt

SEQ ID NO: 528334 - DNA, 25 bp, Mus musculus
agcaatttgtttccttcgacccaca

SEQ ID NO: 528335 - DNA, 25 bp, Mus musculus
agcaatttgtttgcttcgacccaca

SEQ ID NO: 528336 - DNA, 25 bp, Mus musculus
agcacaaaccgaagcaggaactccc

SEQ ID NO: 528337 - DNA, 25 bp, Mus musculus
agcacaaaccgatgcaggaactccc

SEQ ID NO: 528338 - DNA, 25 bp, Mus musculus
agcacaaatcagagaacgaggagga

SEQ ID NO: 528339 - DNA, 25 bp, Mus musculus
agcacaaatcagtgaacgaggagga

SEQ ID NO: 528340 - DNA, 25 bp, Mus musculus
agcacaaatgccctcgtcggaagca

SEQ ID NO: 528341 - DNA, 25 bp, Mus musculus
agcacaaatgccgtcgtcggaagca

SEQ ID NO: 528342 - DNA, 25 bp, Mus musculus
agcacaacagacagtcttcaccatc

SEQ ID NO: 528343 - DNA, 25 bp, Mus musculus
agcacaacagactgtcttcaccatc

SEQ ID NO: 528344 - DNA, 25 bp, Mus musculus
agcacaacattgaggcaccgtataa

SEQ ID NO: 528345 - DNA, 25 bp, Mus musculus
agcacaacattgtggcaccgtataa

SEQ ID NO: 528346 - DNA, 25 bp, Mus musculus
agcacaacttcaaagctgggagttg

SEQ ID NO: 528347 - DNA, 25 bp, Mus musculus
agcacaacttcatagctgggagttg

SEQ ID NO: 528348 - DNA, 25 bp, Mus musculus
agcacaactttcctcggcgtttcct

SEQ ID NO: 528349 - DNA, 25 bp, Mus musculus
agcacaactttcgtcggcgtttcct

SEQ ID NO: 528350 - DNA, 25 bp, Mus musculus
agcacaagagcgctcatgcgggcac

SEQ ID NO: 528351 - DNA, 25 bp, Mus musculus
agcacaagagcggtcatgcgggcac

SEQ ID NO: 528352 - DNA, 25 bp, Mus musculus
agcacaagatgtacacactaaagag

SEQ ID NO: 528353 - DNA, 25 bp, Mus musculus
agcacaagatgttcacactaaagag

SEQ ID NO: 528354 - DNA, 25 bp, Mus musculus
agcacaagccaaccacatacctggg

SEQ ID NO: 528355 - DNA, 25 bp, Mus musculus
agcacaagccaagcacatacctggg

SEQ ID NO: 528356 - DNA, 25 bp, Mus musculus
agcacaaggagaatgacggccgtct

SEQ ID NO: 528357 - DNA, 25 bp, Mus musculus
agcacaaggagattgacggccgtct

SEQ ID NO: 528358 - DNA, 25 bp, Mus musculus
agcacacacaagaacttcagaacat

SEQ ID NO: 528359 - DNA, 25 bp, Mus musculus
agcacacacaagtacttcagaacat

SEQ ID NO: 528360 - DNA, 25 bp, Mus musculus
agcacacacattcgaccctggtaag

SEQ ID NO: 528361 - DNA, 25 bp, Mus musculus
agcacacacattggaccctggtaag

SEQ ID NO: 528362 - DNA, 25 bp, Mus musculus
agcacacagaacaggatatggtacc

SEQ ID NO: 528363 - DNA, 25 bp, Mus musculus
agcacacagaactggatatggtacc

SEQ ID NO: 528364 - DNA, 25 bp, Mus musculus
agcacacagaccagctcacaggagt

SEQ ID NO: 528365 - DNA, 25 bp, Mus musculus
agcacacagacctgctcacaggagt

SEQ ID NO: 528366 - DNA, 25 bp, Mus musculus
agcacacagctgcactgagccgtcg

SEQ ID NO: 528367 - DNA, 25 bp, Mus musculus
agcacacagctggactgagccgtcg

SEQ ID NO: 528368 - DNA, 25 bp, Mus musculus
agcacacagcttcgccatcatgact

SEQ ID NO: 528369 - DNA, 25 bp, Mus musculus
agcacacagcttggccatcatgact

SEQ ID NO: 528370 - DNA, 25 bp, Mus musculus
agcacaccaggtaggaaggaggaca

SEQ ID NO: 528371 - DNA, 25 bp, Mus musculus
agcacaccaggttggaaggaggaca

SEQ ID NO: 528372 - DNA, 25 bp, Mus musculus
agcacaccctacattctatgttggg

SEQ ID NO: 528373 - DNA, 25 bp, Mus musculus
agcacaccctactttctatgttggg

SEQ ID NO: 528374 - DNA, 25 bp, Mus musculus
agcacaccgagaagccggaacctgc

SEQ ID NO: 528375 - DNA, 25 bp, Mus musculus
agcacaccgagatgccggaacctgc

SEQ ID NO: 528376 - DNA, 25 bp, Mus musculus
agcacacctcttagatagcagccag

SEQ ID NO: 528377 - DNA, 25 bp, Mus musculus
agcacacctctttgatagcagccag

SEQ ID NO: 528378 - DNA, 25 bp, Mus musculus
agcacaccttcacccaacatgttta

SEQ ID NO: 528379 - DNA, 25 bp, Mus musculus
agcacaccttcagccaacatgttta

SEQ ID NO: 528380 - DNA, 25 bp, Mus musculus
agcacacgcccactgactccatgct

SEQ ID NO: 528381 - DNA, 25 bp, Mus musculus
agcacacgcccagtgactccatgct

SEQ ID NO: 528382 - DNA, 25 bp, Mus musculus
agcacacgtcgtcgctgggatgaca

SEQ ID NO: 528383 - DNA, 25 bp, Mus musculus
agcacacgtcgtggctgggatgaca

SEQ ID NO: 528384 - DNA, 25 bp, Mus musculus
agcacactcaggatgtgaccatcag

SEQ ID NO: 528385 - DNA, 25 bp, Mus musculus
agcacactcaggttgtgaccatcag

SEQ ID NO: 528386 - DNA, 25 bp, Mus musculus
agcacactcgaacgaaggactcccg

SEQ ID NO: 528387 - DNA, 25 bp, Mus musculus
agcacactcgaaggaaggactcccg

SEQ ID NO: 528388 - DNA, 25 bp, Mus musculus
agcacactgtgaccggactctccat

SEQ ID NO: 528389 - DNA, 25 bp, Mus musculus
agcacactgtgagcggactctccat

SEQ ID NO: 528390 - DNA, 25 bp, Mus musculus
agcacacttcataggcccgagggtg

SEQ ID NO: 528391 - DNA, 25 bp, Mus musculus
agcacacttcattggcccgagggtg

SEQ ID NO: 528392 - DNA, 25 bp, Mus musculus
agcacacttgcgctggcatacaggg

SEQ ID NO: 528393 - DNA, 25 bp, Mus musculus
agcacacttgcggtggcatacaggg

SEQ ID NO: 528394 - DNA, 25 bp, Mus musculus
agcacagaagatcggcaccccgagt

SEQ ID NO: 528395 - DNA, 25 bp, Mus musculus
agcacagaagatgggcaccccgagt

SEQ ID NO: 528396 - DNA, 25 bp, Mus musculus
agcacagaggatctggtcaacctgg

SEQ ID NO: 528397 - DNA, 25 bp, Mus musculus
agcacagaggatgtggtcaacctgg

SEQ ID NO: 528398 - DNA, 25 bp, Mus musculus
agcacagccattaccgcatctccat

SEQ ID NO: 528399 - DNA, 25 bp, Mus musculus
agcacagccatttccgcatctccat

SEQ ID NO: 528400 - DNA, 25 bp, Mus musculus
agcacagccgccacagagctttggc

SEQ ID NO: 528401 - DNA, 25 bp, Mus musculus
agcacagccgcctcagagctttggc

SEQ ID NO: 528402 - DNA, 25 bp, Mus musculus
agcacaggacacctggtgtgcacaa

SEQ ID NO: 528403 - DNA, 25 bp, Mus musculus
agcacaggacacgtggtgtgcacaa

SEQ ID NO: 528404 - DNA, 25 bp, Mus musculus
agcacaggacgtcctggctctcaga

SEQ ID NO: 528405 - DNA, 25 bp, Mus musculus
agcacaggacgtgctggctctcaga

SEQ ID NO: 528406 - DNA, 25 bp, Mus musculus
agcacaggctggatggtcgtgtcat

SEQ ID NO: 528407 - DNA, 25 bp, Mus musculus
agcacaggctggttggtcgtgtcat

SEQ ID NO: 528408 - DNA, 25 bp, Mus musculus
agcacagggaaccaggagtcctgcc

SEQ ID NO: 528409 - DNA, 25 bp, Mus musculus
agcacagggaacgaggagtcctgcc

SEQ ID NO: 528410 - DNA, 25 bp, Mus musculus
agcacagggtatcggactctggtac

SEQ ID NO: 528411 - DNA, 25 bp, Mus musculus
agcacagggtatgggactctggtac

SEQ ID NO: 528412 - DNA, 25 bp, Mus musculus
agcacaggtggaagagttttctcct

SEQ ID NO: 528413 - DNA, 25 bp, Mus musculus
agcacaggtggatgagttttctcct

SEQ ID NO: 528414 - DNA, 25 bp, Mus musculus
agcacagtcctacagtacgaacggg

SEQ ID NO: 528415 - DNA, 25 bp, Mus musculus
agcacagtcctagagtacgaacggg

SEQ ID NO: 528416 - DNA, 25 bp, Mus musculus
agcacatatttgaggatgaccctag

SEQ ID NO: 528417 - DNA, 25 bp, Mus musculus
agcacatatttgtggatgaccctag

SEQ ID NO: 528418 - DNA, 25 bp, Mus musculus
agcacatcaagcaggtttgcatgag

SEQ ID NO: 528419 - DNA, 25 bp, Mus musculus
agcacatcaagctggtttgcatgag

SEQ ID NO: 528420 - DNA, 25 bp, Mus musculus
agcacatcaggaacccagccagatg

SEQ ID NO: 528421 - DNA, 25 bp, Mus musculus
agcacatcaggatcccagccagatg

SEQ ID NO: 528422 - DNA, 25 bp, Mus musculus
agcacatcgtggaccgcagcctgga

SEQ ID NO: 528423 - DNA, 25 bp, Mus musculus
agcacatcgtggtccgcagcctgga

SEQ ID NO: 528424 - DNA, 25 bp, Mus musculus
agcacatctttgagttccaagccag

SEQ ID NO: 528425 - DNA, 25 bp, Mus musculus
agcacatctttgtgttccaagccag

SEQ ID NO: 528426 - DNA, 25 bp, Mus musculus
agcacatgatggctttcattgaaca

SEQ ID NO: 528427 - DNA, 25 bp, Mus musculus
agcacatgatgggtttcattgaaca

SEQ ID NO: 528428 - DNA, 25 bp, Mus musculus
agcacatgcagtcgacatcaatggc

SEQ ID NO: 528429 - DNA, 25 bp, Mus musculus
agcacatgcagtggacatcaatggc

SEQ ID NO: 528430 - DNA, 25 bp, Mus musculus
agcacatgctggctgcctctacagg

SEQ ID NO: 528431 - DNA, 25 bp, Mus musculus
agcacatgctgggtgcctctacagg

SEQ ID NO: 528432 - DNA, 25 bp, Mus musculus
agcacatggacgcacggacacgatc

SEQ ID NO: 528433 - DNA, 25 bp, Mus musculus
agcacatggacggacggacacgatc

SEQ ID NO: 528434 - DNA, 25 bp, Mus musculus
agcacatggagaccccattgctctg

SEQ ID NO: 528435 - DNA, 25 bp, Mus musculus
agcacatggagagcccattgctctg

SEQ ID NO: 528436 - DNA, 25 bp, Mus musculus
agcacatggttccaccgggacctga

SEQ ID NO: 528437 - DNA, 25 bp, Mus musculus
agcacatggttcgaccgggacctga

SEQ ID NO: 528438 - DNA, 25 bp, Mus musculus
agcacattaagaagccgatccgctc

SEQ ID NO: 528439 - DNA, 25 bp, Mus musculus
agcacattaagatgccgatccgctc

SEQ ID NO: 528440 - DNA, 25 bp, Mus musculus
agcaccaagaggagccatcacagaa

SEQ ID NO: 528441 - DNA, 25 bp, Mus musculus
agcaccaagaggtgccatcacagaa

SEQ ID NO: 528442 - DNA, 25 bp, Mus musculus
agcaccaagctgaggattatcatgg

SEQ ID NO: 528443 - DNA, 25 bp, Mus musculus
agcaccaagctgtggattatcatgg

SEQ ID NO: 528444 - DNA, 25 bp, Mus musculus
agcaccacagatcaatgaccactct

SEQ ID NO: 528445 - DNA, 25 bp, Mus musculus
agcaccacagatgaatgaccactct

SEQ ID NO: 528446 - DNA, 25 bp, Mus musculus
agcaccaccagccaggttgttaaga

SEQ ID NO: 528447 - DNA, 25 bp, Mus musculus
agcaccaccagcgaggttgttaaga

SEQ ID NO: 528448 - DNA, 25 bp, Mus musculus
agcaccagaaatccatgtctgcctc

SEQ ID NO: 528449 - DNA, 25 bp, Mus musculus
agcaccagaaatgcatgtctgcctc

SEQ ID NO: 528450 - DNA, 25 bp, Mus musculus
agcaccagctagactccattttggg

SEQ ID NO: 528451 - DNA, 25 bp, Mus musculus
agcaccagctagtctccattttggg

SEQ ID NO: 528452 - DNA, 25 bp, Mus musculus
agcaccagggagcttgttagttccg

SEQ ID NO: 528453 - DNA, 25 bp, Mus musculus
agcaccagggaggttgttagttccg

SEQ ID NO: 528454 - DNA, 25 bp, Mus musculus
agcaccaggtggacatctaccagaa

SEQ ID NO: 528455 - DNA, 25 bp, Mus musculus
agcaccaggtggtcatctaccagaa

SEQ ID NO: 528456 - DNA, 25 bp, Mus musculus
agcaccagtctaacccatgcctagt

SEQ ID NO: 528457 - DNA, 25 bp, Mus musculus
agcaccagtctatcccatgcctagt

SEQ ID NO: 528458 - DNA, 25 bp, Mus musculus
agcaccagtgtaagtgcggaaacac

SEQ ID NO: 528459 - DNA, 25 bp, Mus musculus
agcaccagtgtatgtgcggaaacac

SEQ ID NO: 528460 - DNA, 25 bp, Mus musculus
agcaccatagccactgtgagggagg

SEQ ID NO: 528461 - DNA, 25 bp, Mus musculus
agcaccatagcctctgtgagggagg

SEQ ID NO: 528462 - DNA, 25 bp, Mus musculus
agcacccaagccaagaaaagtggag

SEQ ID NO: 528463 - DNA, 25 bp, Mus musculus
agcacccaagcctagaaaagtggag

SEQ ID NO: 528464 - DNA, 25 bp, Mus musculus
agcacccagacaagcgagttcctca

SEQ ID NO: 528465 - DNA, 25 bp, Mus musculus
agcacccagacatgcgagttcctca

SEQ ID NO: 528466 - DNA, 25 bp, Mus musculus
agcacccagtccagacacagctaag

SEQ ID NO: 528467 - DNA, 25 bp, Mus musculus
agcacccagtcctgacacagctaag

SEQ ID NO: 528468 - DNA, 25 bp, Mus musculus
agcaccccaataacctgcggctgga

SEQ ID NO: 528469 - DNA, 25 bp, Mus musculus
agcaccccaatatcctgcggctgga

SEQ ID NO: 528470 - DNA, 25 bp, Mus musculus
agcaccccgcatctcctggatgaaa

SEQ ID NO: 528471 - DNA, 25 bp, Mus musculus
agcaccccgcatgtcctggatgaaa

SEQ ID NO: 528472 - DNA, 25 bp, Mus musculus
agcacccgcccacgatacaggagat

SEQ ID NO: 528473 - DNA, 25 bp, Mus musculus
agcacccgcccaggatacaggagat

SEQ ID NO: 528474 - DNA, 25 bp, Mus musculus
agcaccctgggccataagggagccc

SEQ ID NO: 528475 - DNA, 25 bp, Mus musculus
agcaccctgggcgataagggagccc

SEQ ID NO: 528476 - DNA, 25 bp, Mus musculus
agcaccctggtcacaatggcgcagt

SEQ ID NO: 528477 - DNA, 25 bp, Mus musculus
agcaccctggtctcaatggcgcagt

SEQ ID NO: 528478 - DNA, 25 bp, Mus musculus
agcaccctgtgcctgtccttggaca

SEQ ID NO: 528479 - DNA, 25 bp, Mus musculus
agcaccctgtgcgtgtccttggaca

SEQ ID NO: 528480 - DNA, 25 bp, Mus musculus
agcacccttgggaaaggagagtcta

SEQ ID NO: 528481 - DNA, 25 bp, Mus musculus
agcacccttgggtaaggagagtcta

SEQ ID NO: 528482 - DNA, 25 bp, Mus musculus
agcaccgaaaagcagatcctgcctc

SEQ ID NO: 528483 - DNA, 25 bp, Mus musculus
agcaccgaaaaggagatcctgcctc

SEQ ID NO: 528484 - DNA, 25 bp, Mus musculus
agcaccgaggcaacctgctgcaggc

SEQ ID NO: 528485 - DNA, 25 bp, Mus musculus
agcaccgaggcatcctgctgcaggc

SEQ ID NO: 528486 - DNA, 25 bp, Mus musculus
agcaccgccgcacgtggctaaggct

SEQ ID NO: 528487 - DNA, 25 bp, Mus musculus
agcaccgccgcaggtggctaaggct

SEQ ID NO: 528488 - DNA, 25 bp, Mus musculus
agcaccgcgaggctgagtactacgt

SEQ ID NO: 528489 - DNA, 25 bp, Mus musculus
agcaccgcgagggtgagtactacgt

SEQ ID NO: 528490 - DNA, 25 bp, Mus musculus
agcaccgcgggtctcagttttccca

SEQ ID NO: 528491 - DNA, 25 bp, Mus musculus
agcaccgcgggtgtcagttttccca

SEQ ID NO: 528492 - DNA, 25 bp, Mus musculus
agcaccggcgccaagtcagggagca

SEQ ID NO: 528493 - DNA, 25 bp, Mus musculus
agcaccggcgcctagtcagggagca

SEQ ID NO: 528494 - DNA, 25 bp, Mus musculus
agcaccggtctcaggctcccgggag

SEQ ID NO: 528495 - DNA, 25 bp, Mus musculus
agcaccggtctctggctcccgggag

SEQ ID NO: 528496 - DNA, 25 bp, Mus musculus
agcaccgtcggaacccgtgcagctg

SEQ ID NO: 528497 - DNA, 25 bp, Mus musculus
agcaccgtcggatcccgtgcagctg

SEQ ID NO: 528498 - DNA, 25 bp, Mus musculus
agcaccgtgagcaacctcagccatt

SEQ ID NO: 528499 - DNA, 25 bp, Mus musculus
agcaccgtgagctacctcagccatt

SEQ ID NO: 528500 - DNA, 25 bp, Mus musculus
agcaccgtgaggaccagtaccacga

SEQ ID NO: 528501 - DNA, 25 bp, Mus musculus
agcaccgtgaggtccagtaccacga

SEQ ID NO: 528502 - DNA, 25 bp, Mus musculus
agcaccgtgctgagactttttgaga

SEQ ID NO: 528503 - DNA, 25 bp, Mus musculus
agcaccgtgctgtgactttttgaga

SEQ ID NO: 528504 - DNA, 25 bp, Mus musculus
agcacctacttcaggtgactcacga

SEQ ID NO: 528505 - DNA, 25 bp, Mus musculus
agcacctacttctggtgactcacga

SEQ ID NO: 528506 - DNA, 25 bp, Mus musculus
agcacctagacgaccctaacctgaa

SEQ ID NO: 528507 - DNA, 25 bp, Mus musculus
agcacctagacgtccctaacctgaa

SEQ ID NO: 528508 - DNA, 25 bp, Mus musculus
agcacctagccaccctgaggtcttt

SEQ ID NO: 528509 - DNA, 25 bp, Mus musculus
agcacctagccagcctgaggtcttt

SEQ ID NO: 528510 - DNA, 25 bp, Mus musculus
agcacctcagcgatgcgtttgcccg

SEQ ID NO: 528511 - DNA, 25 bp, Mus musculus
agcacctcagcgttgcgtttgcccg

SEQ ID NO: 528512 - DNA, 25 bp, Mus musculus
agcacctccactccgctgggatcat

SEQ ID NO: 528513 - DNA, 25 bp, Mus musculus
agcacctccactgcgctgggatcat

SEQ ID NO: 528514 - DNA, 25 bp, Mus musculus
agcacctctggcagaggacatcgac

SEQ ID NO: 528515 - DNA, 25 bp, Mus musculus
agcacctctggctgaggacatcgac

SEQ ID NO: 528516 - DNA, 25 bp, Mus musculus
agcacctgctctacatccgccactt

SEQ ID NO: 528517 - DNA, 25 bp, Mus musculus
agcacctgctcttcatccgccactt

SEQ ID NO: 528518 - DNA, 25 bp, Mus musculus
agcacctggcgcctctggactcaaa

SEQ ID NO: 528519 - DNA, 25 bp, Mus musculus
agcacctggcgcgtctggactcaaa

SEQ ID NO: 528520 - DNA, 25 bp, Mus musculus
agcacctggtggcttagctactgga

SEQ ID NO: 528521 - DNA, 25 bp, Mus musculus
agcacctggtgggttagctactgga

SEQ ID NO: 528522 - DNA, 25 bp, Mus musculus
agcaccttcaggacgctcgctgtcg

SEQ ID NO: 528523 - DNA, 25 bp, Mus musculus
agcaccttcaggtcgctcgctgtcg

SEQ ID NO: 528524 - DNA, 25 bp, Mus musculus
agcaccttgaccaggagcggaactg

SEQ ID NO: 528525 - DNA, 25 bp, Mus musculus
agcaccttgacctggagcggaactg

SEQ ID NO: 528526 - DNA, 25 bp, Mus musculus
agcaccttggccctcgggaaatgac

SEQ ID NO: 528527 - DNA, 25 bp, Mus musculus
agcaccttggccgtcgggaaatgac

SEQ ID NO: 528528 - DNA, 25 bp, Mus musculus
agcacgacgtgcagtctgagctcca

SEQ ID NO: 528529 - DNA, 25 bp, Mus musculus
agcacgacgtgctgtctgagctcca

SEQ ID NO: 528530 - DNA, 25 bp, Mus musculus
agcacgactccgaagccatcatcag

SEQ ID NO: 528531 - DNA, 25 bp, Mus musculus
agcacgactccgtagccatcatcag

SEQ ID NO: 528532 - DNA, 25 bp, Mus musculus
agcacgcactctccgggtgaattcc

SEQ ID NO: 528533 - DNA, 25 bp, Mus musculus
agcacgcactctgcgggtgaattcc

SEQ ID NO: 528534 - DNA, 25 bp, Mus musculus
agcacgccccagagagacgtgaagt

SEQ ID NO: 528535 - DNA, 25 bp, Mus musculus
agcacgccccagtgagacgtgaagt

SEQ ID NO: 528536 - DNA, 25 bp, Mus musculus
agcacgccctccatgtgcaagaact

SEQ ID NO: 528537 - DNA, 25 bp, Mus musculus
agcacgccctccttgtgcaagaact

SEQ ID NO: 528538 - DNA, 25 bp, Mus musculus
agcacgcggcagagcagacagcagt

SEQ ID NO: 528539 - DNA, 25 bp, Mus musculus
agcacgcggcagtgcagacagcagt

SEQ ID NO: 528540 - DNA, 25 bp, Mus musculus
agcacgcgggccagtcaatggaccg

SEQ ID NO: 528541 - DNA, 25 bp, Mus musculus
agcacgcgggcctgtcaatggaccg

SEQ ID NO: 528542 - DNA, 25 bp, Mus musculus
agcacgcgtgtaatgccagctcaag

SEQ ID NO: 528543 - DNA, 25 bp, Mus musculus
agcacgcgtgtattgccagctcaag

SEQ ID NO: 528544 - DNA, 25 bp, Mus musculus
agcacggagccacagaacgaagatg

SEQ ID NO: 528545 - DNA, 25 bp, Mus musculus
agcacggagccagagaacgaagatg

SEQ ID NO: 528546 - DNA, 25 bp, Mus musculus
agcacggcgtggcagcctccagtct

SEQ ID NO: 528547 - DNA, 25 bp, Mus musculus
agcacggcgtgggagcctccagtct

SEQ ID NO: 528548 - DNA, 25 bp, Mus musculus
agcacggctccacatacggcggaaa

SEQ ID NO: 528549 - DNA, 25 bp, Mus musculus
agcacggctccagatacggcggaaa

SEQ ID NO: 528550 - DNA, 25 bp, Mus musculus
agcacggcttctcaacctggctcgg

SEQ ID NO: 528551 - DNA, 25 bp, Mus musculus
agcacggcttctgaacctggctcgg

SEQ ID NO: 528552 - DNA, 25 bp, Mus musculus
agcacggcttgcaggcagattctag

SEQ ID NO: 528553 - DNA, 25 bp, Mus musculus
agcacggcttgctggcagattctag

SEQ ID NO: 528554 - DNA, 25 bp, Mus musculus
agcacggcttttccatggagatgaa

SEQ ID NO: 528555 - DNA, 25 bp, Mus musculus
agcacggcttttgcatggagatgaa

SEQ ID NO: 528556 - DNA, 25 bp, Mus musculus
agcacgggaagccatatttctacaa

SEQ ID NO: 528557 - DNA, 25 bp, Mus musculus
agcacgggaagcgatatttctacaa

SEQ ID NO: 528558 - DNA, 25 bp, Mus musculus
agcacgggcaacagctgcatccagc

SEQ ID NO: 528559 - DNA, 25 bp, Mus musculus
agcacgggcaactgctgcatccagc

SEQ ID NO: 528560 - DNA, 25 bp, Mus musculus
agcacgtggaagagaacggcagcaa

SEQ ID NO: 528561 - DNA, 25 bp, Mus musculus
agcacgtggaagtgaacggcagcaa

SEQ ID NO: 528562 - DNA, 25 bp, Mus musculus
agcacgtgtatgctggtggttcttt

SEQ ID NO: 528563 - DNA, 25 bp, Mus musculus
agcacgtgtatggtggtggttcttt

SEQ ID NO: 528564 - DNA, 25 bp, Mus musculus
agcacgttctcacagtattgtccag

SEQ ID NO: 528565 - DNA, 25 bp, Mus musculus
agcacgttctcagagtattgtccag

SEQ ID NO: 528566 - DNA, 25 bp, Mus musculus
agcacgttgcctagtggaggaactt

SEQ ID NO: 528567 - DNA, 25 bp, Mus musculus
agcacgttgccttgtggaggaactt

SEQ ID NO: 528568 - DNA, 25 bp, Mus musculus
agcactaaaatgcaaccctgtatat

SEQ ID NO: 528569 - DNA, 25 bp, Mus musculus
agcactaaaatggaaccctgtatat

SEQ ID NO: 528570 - DNA, 25 bp, Mus musculus
agcactaaccacacttcctgtttgg

SEQ ID NO: 528571 - DNA, 25 bp, Mus musculus
agcactaaccactcttcctgtttgg

SEQ ID NO: 528572 - DNA, 25 bp, Mus musculus
agcactaagcctcccgtttaaaaga

SEQ ID NO: 528573 - DNA, 25 bp, Mus musculus
agcactaagcctgccgtttaaaaga

SEQ ID NO: 528574 - DNA, 25 bp, Mus musculus
agcactaccgggacctacagaggaa

SEQ ID NO: 528575 - DNA, 25 bp, Mus musculus
agcactaccgggtcctacagaggaa

SEQ ID NO: 528576 - DNA, 25 bp, Mus musculus
agcactacggccagttcacgtgcga

SEQ ID NO: 528577 - DNA, 25 bp, Mus musculus
agcactacggcctgttcacgtgcga

SEQ ID NO: 528578 - DNA, 25 bp, Mus musculus
agcactagcacacacgatttccctg

SEQ ID NO: 528579 - DNA, 25 bp, Mus musculus
agcactagcacagacgatttccctg

SEQ ID NO: 528580 - DNA, 25 bp, Mus musculus
agcactagcggcacttctagaagac

SEQ ID NO: 528581 - DNA, 25 bp, Mus musculus
agcactagcggctcttctagaagac

SEQ ID NO: 528582 - DNA, 25 bp, Mus musculus
agcactatatgaaacgttttctgcg

SEQ ID NO: 528583 - DNA, 25 bp, Mus musculus
agcactatatgatacgttttctgcg

SEQ ID NO: 528584 - DNA, 25 bp, Mus musculus
agcactcaagttctcatcccactgt

SEQ ID NO: 528585 - DNA, 25 bp, Mus musculus
agcactcaagttgtcatcccactgt

SEQ ID NO: 528586 - DNA, 25 bp, Mus musculus
agcactcagccacccaaagactgga

SEQ ID NO: 528587 - DNA, 25 bp, Mus musculus
agcactcagccagccaaagactgga

SEQ ID NO: 528588 - DNA, 25 bp, Mus musculus
agcactcagtctacatcagcaacca

SEQ ID NO: 528589 - DNA, 25 bp, Mus musculus
agcactcagtctcgactggacaacg

SEQ ID NO: 528590 - DNA, 25 bp, Mus musculus
agcactcagtctggactggacaacg

SEQ ID NO: 528591 - DNA, 25 bp, Mus musculus
agcactcagtcttcatcagcaacca

SEQ ID NO: 528592 - DNA, 25 bp, Mus musculus
agcactcctgaaccctctctcatgg

SEQ ID NO: 528593 - DNA, 25 bp, Mus musculus
agcactcctgaagcctctctcatgg

SEQ ID NO: 528594 - DNA, 25 bp, Mus musculus
agcactccttgacgctgcgatggga

SEQ ID NO: 528595 - DNA, 25 bp, Mus musculus
agcactccttgaggctgcgatggga

SEQ ID NO: 528596 - DNA, 25 bp, Mus musculus
agcactcgggagacctgggtctgcc

SEQ ID NO: 528597 - DNA, 25 bp, Mus musculus
agcactcgggagtcctgggtctgcc

SEQ ID NO: 528598 - DNA, 25 bp, Mus musculus
agcactctccacacccaccaggagt

SEQ ID NO: 528599 - DNA, 25 bp, Mus musculus
agcactctccactcccaccaggagt

SEQ ID NO: 528600 - DNA, 25 bp, Mus musculus
agcactctcctgatctaatgagttt

SEQ ID NO: 528601 - DNA, 25 bp, Mus musculus
agcactctcctgttctaatgagttt

SEQ ID NO: 528602 - DNA, 25 bp, Mus musculus
agcactctgtgaatacctgcccagg

SEQ ID NO: 528603 - DNA, 25 bp, Mus musculus
agcactctgtgattacctgcccagg

SEQ ID NO: 528604 - DNA, 25 bp, Mus musculus
agcactgaaacgctacgaaggccct

SEQ ID NO: 528605 - DNA, 25 bp, Mus musculus
agcactgaaacggtacgaaggccct

SEQ ID NO: 528606 - DNA, 25 bp, Mus musculus
agcactgaaggaccctgcagcgctc

SEQ ID NO: 528607 - DNA, 25 bp, Mus musculus
agcactgaaggagcctgcagcgctc

SEQ ID NO: 528608 - DNA, 25 bp, Mus musculus
agcactgacgttcgctttgccaaca

SEQ ID NO: 528609 - DNA, 25 bp, Mus musculus
agcactgacgttggctttgccaaca

SEQ ID NO: 528610 - DNA, 25 bp, Mus musculus
agcactgactacactagacctgagc

SEQ ID NO: 528611 - DNA, 25 bp, Mus musculus
agcactgactactctagacctgagc

SEQ ID NO: 528612 - DNA, 25 bp, Mus musculus
agcactgatgagcaagatgcaatgg

SEQ ID NO: 528613 - DNA, 25 bp, Mus musculus
agcactgatgaggaagatgcaatgg

SEQ ID NO: 528614 - DNA, 25 bp, Mus musculus
agcactgcaactcatctctccatat

SEQ ID NO: 528615 - DNA, 25 bp, Mus musculus
agcactgcaactgatctctccatat

SEQ ID NO: 528616 - DNA, 25 bp, Mus musculus
agcactgccgcgacacagaagaaac

SEQ ID NO: 528617 - DNA, 25 bp, Mus musculus
agcactgccgcgtcacagaagaaac

SEQ ID NO: 528618 - DNA, 25 bp, Mus musculus
agcactgccgctacgtggacgaggt

SEQ ID NO: 528619 - DNA, 25 bp, Mus musculus
agcactgccgcttcgtggacgaggt

SEQ ID NO: 528620 - DNA, 25 bp, Mus musculus
agcactgcctgccacttctggagga

SEQ ID NO: 528621 - DNA, 25 bp, Mus musculus
agcactgcctgcgacttctggagga

SEQ ID NO: 528622 - DNA, 25 bp, Mus musculus
agcactgcgtggacgccaacattga

SEQ ID NO: 528623 - DNA, 25 bp, Mus musculus
agcactgcgtggtcgccaacattga

SEQ ID NO: 528624 - DNA, 25 bp, Mus musculus
agcactgctggacaaaccacctcag

SEQ ID NO: 528625 - DNA, 25 bp, Mus musculus
agcactgctggagaaaccacctcag

SEQ ID NO: 528626 - DNA, 25 bp, Mus musculus
agcactggcactacatcagctttgg

SEQ ID NO: 528627 - DNA, 25 bp, Mus musculus
agcactggcacttcatcagctttgg

SEQ ID NO: 528628 - DNA, 25 bp, Mus musculus
agcactggcccactggtcaaggagt

SEQ ID NO: 528629 - DNA, 25 bp, Mus musculus
agcactggcccagtggtcaaggagt

SEQ ID NO: 528630 - DNA, 25 bp, Mus musculus
agcactggccggcaaagttatattc

SEQ ID NO: 528631 - DNA, 25 bp, Mus musculus
agcactggccgggaaagttatattc

SEQ ID NO: 528632 - DNA, 25 bp, Mus musculus
agcactgtgcaactgaattatgtca

SEQ ID NO: 528633 - DNA, 25 bp, Mus musculus
agcactgtgcaagtgaattatgtca

SEQ ID NO: 528634 - DNA, 25 bp, Mus musculus
agcactgtgtttaggctggctcaca

SEQ ID NO: 528635 - DNA, 25 bp, Mus musculus
agcactgtgttttggctggctcaca

SEQ ID NO: 528636 - DNA, 25 bp, Mus musculus
agcactgtttcgagcgccctgcagg

SEQ ID NO: 528637 - DNA, 25 bp, Mus musculus
agcactgtttcgtgcgccctgcagg

SEQ ID NO: 528638 - DNA, 25 bp, Mus musculus
agcacttcggagacaggctctgccg

SEQ ID NO: 528639 - DNA, 25 bp, Mus musculus
agcacttcggagtcaggctctgccg

SEQ ID NO: 528640 - DNA, 25 bp, Mus musculus
agcacttctgacagaacagaacgat

SEQ ID NO: 528641 - DNA, 25 bp, Mus musculus
agcacttctgactgaacagaacgat

SEQ ID NO: 528642 - DNA, 25 bp, Mus musculus
agcactttgagaaggcccacctgga

SEQ ID NO: 528643 - DNA, 25 bp, Mus musculus
agcactttgagatggcccacctgga

SEQ ID NO: 528644 - DNA, 25 bp, Mus musculus
agcactttgtcactgccaagaaaaa

SEQ ID NO: 528645 - DNA, 25 bp, Mus musculus
agcactttgtcagtgccaagaaaaa

SEQ ID NO: 528646 - DNA, 25 bp, Mus musculus
agcagaaaacaacgcggagtctgag

SEQ ID NO: 528647 - DNA, 25 bp, Mus musculus
agcagaaaacaaggcggagtctgag

SEQ ID NO: 528648 - DNA, 25 bp, Mus musculus
agcagaaaatttccatcagttatca

SEQ ID NO: 528649 - DNA, 25 bp, Mus musculus
agcagaaaatttgcatcagttatca

SEQ ID NO: 528650 - DNA, 25 bp, Mus musculus
agcagaaagtcacccttcccaaggg

SEQ ID NO: 528651 - DNA, 25 bp, Mus musculus
agcagaaagtcagccttcccaaggg

SEQ ID NO: 528652 - DNA, 25 bp, Mus musculus
agcagaacggctacacgcagttggg

SEQ ID NO: 528653 - DNA, 25 bp, Mus musculus
agcagaacggcttcacgcagttggg

SEQ ID NO: 528654 - DNA, 25 bp, Mus musculus
agcagaacgggacccctctaggaag

SEQ ID NO: 528655 - DNA, 25 bp, Mus musculus
agcagaacgggagccctctaggaag

SEQ ID NO: 528656 - DNA, 25 bp, Mus musculus
agcagaagacatcagccacgctcct

SEQ ID NO: 528657 - DNA, 25 bp, Mus musculus
agcagaagacatgagccacgctcct

SEQ ID NO: 528658 - DNA, 25 bp, Mus musculus
agcagaagatgcagtcctacaagat

SEQ ID NO: 528659 - DNA, 25 bp, Mus musculus
agcagaagatgctgtcctacaagat

SEQ ID NO: 528660 - DNA, 25 bp, Mus musculus
agcagaagcagcagctacccagcag

SEQ ID NO: 528661 - DNA, 25 bp, Mus musculus
agcagaagcagctgctacccagcag

SEQ ID NO: 528662 - DNA, 25 bp, Mus musculus
agcagaagccagacgtgttttcaac

SEQ ID NO: 528663 - DNA, 25 bp, Mus musculus
agcagaagccagtcgtgttttcaac

SEQ ID NO: 528664 - DNA, 25 bp, Mus musculus
agcagaagctgccagcccaagtgcg

SEQ ID NO: 528665 - DNA, 25 bp, Mus musculus
agcagaagctgcgagcccaagtgcg

SEQ ID NO: 528666 - DNA, 25 bp, Mus musculus
agcagaagctgtataccgaggtgga

SEQ ID NO: 528667 - DNA, 25 bp, Mus musculus
agcagaagctgtttaccgaggtgga

SEQ ID NO: 528668 - DNA, 25 bp, Mus musculus
agcagaatacggactttccaaccag

SEQ ID NO: 528669 - DNA, 25 bp, Mus musculus
agcagaatacggtctttccaaccag

SEQ ID NO: 528670 - DNA, 25 bp, Mus musculus
agcagaatcaacaggcagtggagcc

SEQ ID NO: 528671 - DNA, 25 bp, Mus musculus
agcagaatcaactggcagtggagcc

SEQ ID NO: 528672 - DNA, 25 bp, Mus musculus
agcagaatctttccaggctggttca

SEQ ID NO: 528673 - DNA, 25 bp, Mus musculus
agcagaatctttgcaggctggttca

SEQ ID NO: 528674 - DNA, 25 bp, Mus musculus
agcagaatgccccaaggaaggtccc

SEQ ID NO: 528675 - DNA, 25 bp, Mus musculus
agcagaatgcccgaaggaaggtccc

SEQ ID NO: 528676 - DNA, 25 bp, Mus musculus
agcagaatgcggagctgcagcgcca

SEQ ID NO: 528677 - DNA, 25 bp, Mus musculus
agcagaatgcggtgctgcagcgcca

SEQ ID NO: 528678 - DNA, 25 bp, Mus musculus
agcagacagcggaacctgggactga

SEQ ID NO: 528679 - DNA, 25 bp, Mus musculus
agcagacagcggtacctgggactga

SEQ ID NO: 528680 - DNA, 25 bp, Mus musculus
agcagacagggtacctgactatcgg

SEQ ID NO: 528681 - DNA, 25 bp, Mus musculus
agcagacagggttcctgactatcgg

SEQ ID NO: 528682 - DNA, 25 bp, Mus musculus
agcagacagtgactcagccatccac

SEQ ID NO: 528683 - DNA, 25 bp, Mus musculus
agcagacagtgagtcagccatccac

SEQ ID NO: 528684 - DNA, 25 bp, Mus musculus
agcagaccatcaacctggacgacga

SEQ ID NO: 528685 - DNA, 25 bp, Mus musculus
agcagaccatcatcctggacgacga

SEQ ID NO: 528686 - DNA, 25 bp, Mus musculus
agcagacccagcaactacagacact

SEQ ID NO: 528687 - DNA, 25 bp, Mus musculus
agcagacccagctactacagacact

SEQ ID NO: 528688 - DNA, 25 bp, Mus musculus
agcagacccaggacgtcaggaaccc

SEQ ID NO: 528689 - DNA, 25 bp, Mus musculus
agcagacccaggtcgtcaggaaccc

SEQ ID NO: 528690 - DNA, 25 bp, Mus musculus
agcagacctagcagctcagtacacc

SEQ ID NO: 528691 - DNA, 25 bp, Mus musculus
agcagacctagctgctcagtacacc

SEQ ID NO: 528692 - DNA, 25 bp, Mus musculus
agcagacgtactcgcaggccaatcc

SEQ ID NO: 528693 - DNA, 25 bp, Mus musculus
agcagacgtactggcaggccaatcc

SEQ ID NO: 528694 - DNA, 25 bp, Mus musculus
agcagacgtcctctcggctcacgag

SEQ ID NO: 528695 - DNA, 25 bp, Mus musculus
agcagacgtcctgtcggctcacgag

SEQ ID NO: 528696 - DNA, 25 bp, Mus musculus
agcagacgtcgtcatggctggcatt

SEQ ID NO: 528697 - DNA, 25 bp, Mus musculus
agcagacgtcgtgatggctggcatt

SEQ ID NO: 528698 - DNA, 25 bp, Mus musculus
agcagactcggaatccagccagaag

SEQ ID NO: 528699 - DNA, 25 bp, Mus musculus
agcagactcggattccagccagaag

SEQ ID NO: 528700 - DNA, 25 bp, Mus musculus
agcagactctgaacccgacctcaga

SEQ ID NO: 528701 - DNA, 25 bp, Mus musculus
agcagactctgatcccgacctcaga

SEQ ID NO: 528702 - DNA, 25 bp, Mus musculus
agcagagagcctatgtggccccaga

SEQ ID NO: 528703 - DNA, 25 bp, Mus musculus
agcagagagcctttgtggccccaga

SEQ ID NO: 528704 - DNA, 25 bp, Mus musculus
agcagagatgcccaacatgtaccct

SEQ ID NO: 528705 - DNA, 25 bp, Mus musculus
agcagagatgccgaacatgtaccct

SEQ ID NO: 528706 - DNA, 25 bp, Mus musculus
agcagagcagtacattggcaaaata

SEQ ID NO: 528707 - DNA, 25 bp, Mus musculus
agcagagcagtagattggcaaaata

SEQ ID NO: 528708 - DNA, 25 bp, Mus musculus
agcagagccgttctcctgtggcacc

SEQ ID NO: 528709 - DNA, 25 bp, Mus musculus
agcagagccgttgtcctgtggcacc

SEQ ID NO: 528710 - DNA, 25 bp, Mus musculus
agcagagcgagtccctgagcccagc

SEQ ID NO: 528711 - DNA, 25 bp, Mus musculus
agcagagcgagtgcctgagcccagc

SEQ ID NO: 528712 - DNA, 25 bp, Mus musculus
agcagagctacccacaggaggtgca

SEQ ID NO: 528713 - DNA, 25 bp, Mus musculus
agcagagctaccgacaggaggtgca

SEQ ID NO: 528714 - DNA, 25 bp, Mus musculus
agcagagctactcaaggtccccatc

SEQ ID NO: 528715 - DNA, 25 bp, Mus musculus
agcagagctactgaaggtccccatc

SEQ ID NO: 528716 - DNA, 25 bp, Mus musculus
agcagagctcctccttgtccggcag

SEQ ID NO: 528717 - DNA, 25 bp, Mus musculus
agcagagctcctgcttgtccggcag

SEQ ID NO: 528718 - DNA, 25 bp, Mus musculus
agcagaggacaacatgaactgtcag

SEQ ID NO: 528719 - DNA, 25 bp, Mus musculus
agcagaggacaagatgaactgtcag

SEQ ID NO: 528720 - DNA, 25 bp, Mus musculus
agcagaggagttatgttatacctcc

SEQ ID NO: 528721 - DNA, 25 bp, Mus musculus
agcagaggagttttgttatacctcc

SEQ ID NO: 528722 - DNA, 25 bp, Mus musculus
agcagaggccagatgctgcatcagc

SEQ ID NO: 528723 - DNA, 25 bp, Mus musculus
agcagaggccagttgctgcatcagc

SEQ ID NO: 528724 - DNA, 25 bp, Mus musculus
agcagaggctgactgctgcccaagt

SEQ ID NO: 528725 - DNA, 25 bp, Mus musculus
agcagaggctgagtgctgcccaagt

SEQ ID NO: 528726 - DNA, 25 bp, Mus musculus
agcagagggcagctccagttcctgt

SEQ ID NO: 528727 - DNA, 25 bp, Mus musculus
agcagagggcaggtccagttcctgt

SEQ ID NO: 528728 - DNA, 25 bp, Mus musculus
agcagagggcctagttcctcttgaa

SEQ ID NO: 528729 - DNA, 25 bp, Mus musculus
agcagagggccttgttcctcttgaa

SEQ ID NO: 528730 - DNA, 25 bp, Mus musculus
agcagaggtactcgctttgcaggca

SEQ ID NO: 528731 - DNA, 25 bp, Mus musculus
agcagaggtactggctttgcaggca

SEQ ID NO: 528732 - DNA, 25 bp, Mus musculus
agcagaggtgggatccgccatgact

SEQ ID NO: 528733 - DNA, 25 bp, Mus musculus
agcagaggtgggttccgccatgact

SEQ ID NO: 528734 - DNA, 25 bp, Mus musculus
agcagagtcggcatttccatccgca

SEQ ID NO: 528735 - DNA, 25 bp, Mus musculus
agcagagtcggcttttccatccgca

SEQ ID NO: 528736 - DNA, 25 bp, Mus musculus
agcagagtctaacggagccatgccc

SEQ ID NO: 528737 - DNA, 25 bp, Mus musculus
agcagagtctaagggagccatgccc

SEQ ID NO: 528738 - DNA, 25 bp, Mus musculus
agcagagtctggagtgcagcttcct

SEQ ID NO: 528739 - DNA, 25 bp, Mus musculus
agcagagtctggtgtgcagcttcct

SEQ ID NO: 528740 - DNA, 25 bp, Mus musculus
agcagagttcgacttgaacccagag

SEQ ID NO: 528741 - DNA, 25 bp, Mus musculus
agcagagttcgagttgaacccagag

SEQ ID NO: 528742 - DNA, 25 bp, Mus musculus
agcagatagcacaggtgtggtagct

SEQ ID NO: 528743 - DNA, 25 bp, Mus musculus
agcagatagcactggtgtggtagct

SEQ ID NO: 528744 - DNA, 25 bp, Mus musculus
agcagatattctctgtgcagaaggg

SEQ ID NO: 528745 - DNA, 25 bp, Mus musculus
agcagatattctgtgtgcagaaggg

SEQ ID NO: 528746 - DNA, 25 bp, Mus musculus
agcagatcaagaccctcaacaacaa

SEQ ID NO: 528747 - DNA, 25 bp, Mus musculus
agcagatcaagagcctcaacaacaa

SEQ ID NO: 528748 - DNA, 25 bp, Mus musculus
agcagatccgacatgcccagaaaga

SEQ ID NO: 528749 - DNA, 25 bp, Mus musculus
agcagatccgacttgcccagaaaga

SEQ ID NO: 528750 - DNA, 25 bp, Mus musculus
agcagatccgccagatcaaagagca

SEQ ID NO: 528751 - DNA, 25 bp, Mus musculus
agcagatccgcctgatcaaagagca

SEQ ID NO: 528752 - DNA, 25 bp, Mus musculus
agcagatcctttcatggaccttcgg

SEQ ID NO: 528753 - DNA, 25 bp, Mus musculus
agcagatcctttgatggaccttcgg

SEQ ID NO: 528754 - DNA, 25 bp, Mus musculus
agcagatctgtaaggatgtgcatct

SEQ ID NO: 528755 - DNA, 25 bp, Mus musculus
agcagatctgtatggatgtgcatct

SEQ ID NO: 528756 - DNA, 25 bp, Mus musculus
agcagatgaagcaagataggatcac

SEQ ID NO: 528757 - DNA, 25 bp, Mus musculus
agcagatgaagctagataggatcac

SEQ ID NO: 528758 - DNA, 25 bp, Mus musculus
agcagatgaatgaggatgacagtga

SEQ ID NO: 528759 - DNA, 25 bp, Mus musculus
agcagatgaatgtggatgacagtga

SEQ ID NO: 528760 - DNA, 25 bp, Mus musculus
agcagatgatggagaactccgcaga

SEQ ID NO: 528761 - DNA, 25 bp, Mus musculus
agcagatgatggtgaactccgcaga

SEQ ID NO: 528762 - DNA, 25 bp, Mus musculus
agcagatggaagagaccgactcctc

SEQ ID NO: 528763 - DNA, 25 bp, Mus musculus
agcagatggaagtgaccgactcctc

SEQ ID NO: 528764 - DNA, 25 bp, Mus musculus
agcagatgtaggagccagggataaa

SEQ ID NO: 528765 - DNA, 25 bp, Mus musculus
agcagatgtaggtgccagggataaa

SEQ ID NO: 528766 - DNA, 25 bp, Mus musculus
agcagatgtggacactgacagcaga

SEQ ID NO: 528767 - DNA, 25 bp, Mus musculus
agcagatgtggagactgacagcaga

SEQ ID NO: 528768 - DNA, 25 bp, Mus musculus
agcagatgtgtgagatcttctattc

SEQ ID NO: 528769 - DNA, 25 bp, Mus musculus
agcagatgtgtgtgatcttctattc

SEQ ID NO: 528770 - DNA, 25 bp, Mus musculus
agcagattgcagaggccgttcgtct

SEQ ID NO: 528771 - DNA, 25 bp, Mus musculus
agcagattgcagtggccgttcgtct

SEQ ID NO: 528772 - DNA, 25 bp, Mus musculus
agcagattgggaccagtgtaactcg

SEQ ID NO: 528773 - DNA, 25 bp, Mus musculus
agcagattgggagcagtgtaactcg

SEQ ID NO: 528774 - DNA, 25 bp, Mus musculus
agcagcaaacacatcgtcaggaagt

SEQ ID NO: 528775 - DNA, 25 bp, Mus musculus
agcagcaaacacttcgtcaggaagt

SEQ ID NO: 528776 - DNA, 25 bp, Mus musculus
agcagcaaatccaattgagtctcag

SEQ ID NO: 528777 - DNA, 25 bp, Mus musculus
agcagcaaatcctattgagtctcag

SEQ ID NO: 528778 - DNA, 25 bp, Mus musculus
agcagcaaccacctcgaggactaca

SEQ ID NO: 528779 - DNA, 25 bp, Mus musculus
agcagcaaccacgtcgaggactaca

SEQ ID NO: 528780 - DNA, 25 bp, Mus musculus
agcagcaactttcagcaggtgatcc

SEQ ID NO: 528781 - DNA, 25 bp, Mus musculus
agcagcaactttgagcaggtgatcc

SEQ ID NO: 528782 - DNA, 25 bp, Mus musculus
agcagcaatccaatgagcaccttcg

SEQ ID NO: 528783 - DNA, 25 bp, Mus musculus
agcagcaatccattgagcaccttcg

SEQ ID NO: 528784 - DNA, 25 bp, Mus musculus
agcagcacacagaactggatatggt

SEQ ID NO: 528785 - DNA, 25 bp, Mus musculus
agcagcacacagtactggatatggt

SEQ ID NO: 528786 - DNA, 25 bp, Mus musculus
agcagcacagcgaccaggtggacca

SEQ ID NO: 528787 - DNA, 25 bp, Mus musculus
agcagcacagcgtccaggtggacca

SEQ ID NO: 528788 - DNA, 25 bp, Mus musculus
agcagcaccaggcactgtgtggcca

SEQ ID NO: 528789 - DNA, 25 bp, Mus musculus
agcagcaccagggactgtgtggcca

SEQ ID NO: 528790 - DNA, 25 bp, Mus musculus
agcagcacccgaccagagtctggtg

SEQ ID NO: 528791 - DNA, 25 bp, Mus musculus
agcagcacccgagcagagtctggtg

SEQ ID NO: 528792 - DNA, 25 bp, Mus musculus
agcagcaccgccaaagtgcctgcca

SEQ ID NO: 528793 - DNA, 25 bp, Mus musculus
agcagcaccgccataccacaggtga

SEQ ID NO: 528794 - DNA, 25 bp, Mus musculus
agcagcaccgcctaagtgcctgcca

SEQ ID NO: 528795 - DNA, 25 bp, Mus musculus
agcagcaccgccttaccacaggtga

SEQ ID NO: 528796 - DNA, 25 bp, Mus musculus
agcagcaccgcgagcaactcctgtt

SEQ ID NO: 528797 - DNA, 25 bp, Mus musculus
agcagcaccgcgtgcaactcctgtt

SEQ ID NO: 528798 - DNA, 25 bp, Mus musculus
agcagcacctgaataagttgcatca

SEQ ID NO: 528799 - DNA, 25 bp, Mus musculus
agcagcacctgattaagttgcatca

SEQ ID NO: 528800 - DNA, 25 bp, Mus musculus
agcagcactcttccaagatgtcaga

SEQ ID NO: 528801 - DNA, 25 bp, Mus musculus
agcagcactcttgcaagatgtcaga

SEQ ID NO: 528802 - DNA, 25 bp, Mus musculus
agcagcacttgcatggactatacga

SEQ ID NO: 528803 - DNA, 25 bp, Mus musculus
agcagcacttgcttggactatacga

SEQ ID NO: 528804 - DNA, 25 bp, Mus musculus
agcagcagacccagcggagtgcctt

SEQ ID NO: 528805 - DNA, 25 bp, Mus musculus
agcagcagaccctgcggagtgcctt

SEQ ID NO: 528806 - DNA, 25 bp, Mus musculus
agcagcagcaatatccatatcagtg

SEQ ID NO: 528807 - DNA, 25 bp, Mus musculus
agcagcagcaatttccatatcagtg

SEQ ID NO: 528808 - DNA, 25 bp, Mus musculus
agcagcagcactcatccaggcaggc

SEQ ID NO: 528809 - DNA, 25 bp, Mus musculus
agcagcagcactgatccaggcaggc

SEQ ID NO: 528810 - DNA, 25 bp, Mus musculus
agcagcagccagcacggactactac

SEQ ID NO: 528811 - DNA, 25 bp, Mus musculus
agcagcagccaggacggactactac

SEQ ID NO: 528812 - DNA, 25 bp, Mus musculus
agcagcagcgctcagccctggagca

SEQ ID NO: 528813 - DNA, 25 bp, Mus musculus
agcagcagcgctgagccctggagca

SEQ ID NO: 528814 - DNA, 25 bp, Mus musculus
agcagcagctccctagagagctcag

SEQ ID NO: 528815 - DNA, 25 bp, Mus musculus
agcagcagctccgtagagagctcag

SEQ ID NO: 528816 - DNA, 25 bp, Mus musculus
agcagcaggacgaacagggcatgtc

SEQ ID NO: 528817 - DNA, 25 bp, Mus musculus
agcagcaggacgtacagggcatgtc

SEQ ID NO: 528818 - DNA, 25 bp, Mus musculus
agcagcagtcgacggcttggtattc

SEQ ID NO: 528819 - DNA, 25 bp, Mus musculus
agcagcagtcgagggcttggtattc

SEQ ID NO: 528820 - DNA, 25 bp, Mus musculus
agcagcagttgtaggtcaggaatgt

SEQ ID NO: 528821 - DNA, 25 bp, Mus musculus
agcagcagttgttggtcaggaatgt

SEQ ID NO: 528822 - DNA, 25 bp, Mus musculus
agcagcatgaagatcagcaagttgt

SEQ ID NO: 528823 - DNA, 25 bp, Mus musculus
agcagcatgaagttcagcaagttgt

SEQ ID NO: 528824 - DNA, 25 bp, Mus musculus
agcagcatgccgagtgacctgtcca

SEQ ID NO: 528825 - DNA, 25 bp, Mus musculus
agcagcatgccgtgtgacctgtcca

SEQ ID NO: 528826 - DNA, 25 bp, Mus musculus
agcagcatgtgcctggagcacaact

SEQ ID NO: 528827 - DNA, 25 bp, Mus musculus
agcagcatgtgcgtggagcacaact

SEQ ID NO: 528828 - DNA, 25 bp, Mus musculus
agcagccaaacgcagaatcagagag

SEQ ID NO: 528829 - DNA, 25 bp, Mus musculus
agcagccaaacggagaatcagagag

SEQ ID NO: 528830 - DNA, 25 bp, Mus musculus
agcagccacgcgagaccgaggccga

SEQ ID NO: 528831 - DNA, 25 bp, Mus musculus
agcagccacgcgtgaccgaggccga

SEQ ID NO: 528832 - DNA, 25 bp, Mus musculus
agcagccaggagctgtgaaagtccc

SEQ ID NO: 528833 - DNA, 25 bp, Mus musculus
agcagccaggaggtgtgaaagtccc

SEQ ID NO: 528834 - DNA, 25 bp, Mus musculus
agcagccaggcacacccctgacttt

SEQ ID NO: 528835 - DNA, 25 bp, Mus musculus
agcagccaggcagacccctgacttt

SEQ ID NO: 528836 - DNA, 25 bp, Mus musculus
agcagccaggtgaggtaggttactc

SEQ ID NO: 528837 - DNA, 25 bp, Mus musculus
agcagccaggtgtggtaggttactc

SEQ ID NO: 528838 - DNA, 25 bp, Mus musculus
agcagccatgagatctgaggccaca

SEQ ID NO: 528839 - DNA, 25 bp, Mus musculus
agcagccatgagcaatccccggatc

SEQ ID NO: 528840 - DNA, 25 bp, Mus musculus
agcagccatgaggaatccccggatc

SEQ ID NO: 528841 - DNA, 25 bp, Mus musculus
agcagccatgagttctgaggccaca

SEQ ID NO: 528842 - DNA, 25 bp, Mus musculus
agcagccatgtaaattcttggtgcc

SEQ ID NO: 528843 - DNA, 25 bp, Mus musculus
agcagccatgtatattcttggtgcc

SEQ ID NO: 528844 - DNA, 25 bp, Mus musculus
agcagcccaagaccatgtcacaggg

SEQ ID NO: 528845 - DNA, 25 bp, Mus musculus
agcagcccaagagcatgtcacaggg

SEQ ID NO: 528846 - DNA, 25 bp, Mus musculus
agcagcccgagcagacctagctgct

SEQ ID NO: 528847 - DNA, 25 bp, Mus musculus
agcagcccgagctgacctagctgct

SEQ ID NO: 528848 - DNA, 25 bp, Mus musculus
agcagcccgggaacctaatggcttt

SEQ ID NO: 528849 - DNA, 25 bp, Mus musculus
agcagcccgggatcctaatggcttt

SEQ ID NO: 528850 - DNA, 25 bp, Mus musculus
agcagcccgtggacatgtgccactc

SEQ ID NO: 528851 - DNA, 25 bp, Mus musculus
agcagcccgtggtcatgtgccactc

SEQ ID NO: 528852 - DNA, 25 bp, Mus musculus
agcagccctcacagacgggctcgag

SEQ ID NO: 528853 - DNA, 25 bp, Mus musculus
agcagccctcactgacgggctcgag

SEQ ID NO: 528854 - DNA, 25 bp, Mus musculus
agcagccctggtatcagctatcgaa

SEQ ID NO: 528855 - DNA, 25 bp, Mus musculus
agcagccctggtttcagctatcgaa

SEQ ID NO: 528856 - DNA, 25 bp, Mus musculus
agcagccgcaagagcagccccaggt

SEQ ID NO: 528857 - DNA, 25 bp, Mus musculus
agcagccgcaagtgcagccccaggt

SEQ ID NO: 528858 - DNA, 25 bp, Mus musculus
agcagccggttactcccctcggtag

SEQ ID NO: 528859 - DNA, 25 bp, Mus musculus
agcagccggttagtcccctcggtag

SEQ ID NO: 528860 - DNA, 25 bp, Mus musculus
agcagcctcaccagcatgccatgta

SEQ ID NO: 528861 - DNA, 25 bp, Mus musculus
agcagcctcacctgcatgccatgta

SEQ ID NO: 528862 - DNA, 25 bp, Mus musculus
agcagcctggtgctaccctagacct

SEQ ID NO: 528863 - DNA, 25 bp, Mus musculus
agcagcctggtggtaccctagacct

SEQ ID NO: 528864 - DNA, 25 bp, Mus musculus
agcagcctgtctccttctatgaccg

SEQ ID NO: 528865 - DNA, 25 bp, Mus musculus
agcagcctgtctgcttctatgaccg

SEQ ID NO: 528866 - DNA, 25 bp, Mus musculus
agcagccttggtctcctgcggacac

SEQ ID NO: 528867 - DNA, 25 bp, Mus musculus
agcagccttggtgtcctgcggacac

SEQ ID NO: 528868 - DNA, 25 bp, Mus musculus
agcagcctttggaaggactagagaa

SEQ ID NO: 528869 - DNA, 25 bp, Mus musculus
agcagcctttggtaggactagagaa

SEQ ID NO: 528870 - DNA, 25 bp, Mus musculus
agcagcgacaccatcctcgggtcta

SEQ ID NO: 528871 - DNA, 25 bp, Mus musculus
agcagcgacaccttcctcgggtcta

SEQ ID NO: 528872 - DNA, 25 bp, Mus musculus
agcagcgatcggcatctcctggcag

SEQ ID NO: 528873 - DNA, 25 bp, Mus musculus
agcagcgatcgggatctcctggcag

SEQ ID NO: 528874 - DNA, 25 bp, Mus musculus
agcagcgccagtagcacgtgtagca

SEQ ID NO: 528875 - DNA, 25 bp, Mus musculus
agcagcgccagttgcacgtgtagca

SEQ ID NO: 528876 - DNA, 25 bp, Mus musculus
agcagcgccgttaccgactggaacg

SEQ ID NO: 528877 - DNA, 25 bp, Mus musculus
agcagcgccgtttccgactggaacg

SEQ ID NO: 528878 - DNA, 25 bp, Mus musculus
agcagcgccttcagctcatgtttca

SEQ ID NO: 528879 - DNA, 25 bp, Mus musculus
agcagcgccttctgctcatgtttca

SEQ ID NO: 528880 - DNA, 25 bp, Mus musculus
agcagcgctaccaggaacagcacag

SEQ ID NO: 528881 - DNA, 25 bp, Mus musculus
agcagcgctacctggaacagcacag

SEQ ID NO: 528882 - DNA, 25 bp, Mus musculus
agcagcgctgccaaattgcaccggg

SEQ ID NO: 528883 - DNA, 25 bp, Mus musculus
agcagcgctgcctaattgcaccggg

SEQ ID NO: 528884 - DNA, 25 bp, Mus musculus
agcagcgctgtccacaagctgcagc

SEQ ID NO: 528885 - DNA, 25 bp, Mus musculus
agcagcgctgtcgacaagctgcagc

SEQ ID NO: 528886 - DNA, 25 bp, Mus musculus
agcagcggaggaaagctctctacga

SEQ ID NO: 528887 - DNA, 25 bp, Mus musculus
agcagcggaggatagctctctacga

SEQ ID NO: 528888 - DNA, 25 bp, Mus musculus
agcagcggctcaactacagtggcaa

SEQ ID NO: 528889 - DNA, 25 bp, Mus musculus
agcagcggctcatctacagtggcaa

SEQ ID NO: 528890 - DNA, 25 bp, Mus musculus
agcagcgtccttcgtacgtgagcag

SEQ ID NO: 528891 - DNA, 25 bp, Mus musculus
agcagcgtccttggtacgtgagcag

SEQ ID NO: 528892 - DNA, 25 bp, Mus musculus
agcagctaccagaacccagtcagga

SEQ ID NO: 528893 - DNA, 25 bp, Mus musculus
agcagctaccagtacccagtcagga

SEQ ID NO: 528894 - DNA, 25 bp, Mus musculus
agcagctagccgacacactggcaga

SEQ ID NO: 528895 - DNA, 25 bp, Mus musculus
agcagctagccgtcacactggcaga

SEQ ID NO: 528896 - DNA, 25 bp, Mus musculus
agcagctatactcggacagcattta

SEQ ID NO: 528897 - DNA, 25 bp, Mus musculus
agcagctatactgggacagcattta

SEQ ID NO: 528898 - DNA, 25 bp, Mus musculus
agcagctcagagcattcggacaccg

SEQ ID NO: 528899 - DNA, 25 bp, Mus musculus
agcagctcagaggattcggacaccg

SEQ ID NO: 528900 - DNA, 25 bp, Mus musculus
agcagctccatcaggcccttagaca

SEQ ID NO: 528901 - DNA, 25 bp, Mus musculus
agcagctccatctggcccttagaca

SEQ ID NO: 528902 - DNA, 25 bp, Mus musculus
agcagctcccagactacaaccggat

SEQ ID NO: 528903 - DNA, 25 bp, Mus musculus
agcagctcccagtctacaaccggat

SEQ ID NO: 528904 - DNA, 25 bp, Mus musculus
agcagctcctgtacgccgagttcca

SEQ ID NO: 528905 - DNA, 25 bp, Mus musculus
agcagctcctgttcgccgagttcca

SEQ ID NO: 528906 - DNA, 25 bp, Mus musculus
agcagctcgcacagaagctccacag

SEQ ID NO: 528907 - DNA, 25 bp, Mus musculus
agcagctcgcactgaagctccacag

SEQ ID NO: 528908 - DNA, 25 bp, Mus musculus
agcagctcttcaaggcctttcagaa

SEQ ID NO: 528909 - DNA, 25 bp, Mus musculus
agcagctcttcatggcctttcagaa

SEQ ID NO: 528910 - DNA, 25 bp, Mus musculus
agcagctggacgagtaccaggagct

SEQ ID NO: 528911 - DNA, 25 bp, Mus musculus
agcagctggacgtgtaccaggagct

SEQ ID NO: 528912 - DNA, 25 bp, Mus musculus
agcagctggactccgccttggacct

SEQ ID NO: 528913 - DNA, 25 bp, Mus musculus
agcagctggactgcgccttggacct

SEQ ID NO: 528914 - DNA, 25 bp, Mus musculus
agcagctggagaccttgcaggccaa

SEQ ID NO: 528915 - DNA, 25 bp, Mus musculus
agcagctggagagcttgcaggccaa

SEQ ID NO: 528916 - DNA, 25 bp, Mus musculus
agcagctggatgaaagggagcacac

SEQ ID NO: 528917 - DNA, 25 bp, Mus musculus
agcagctggatgtaagggagcacac

SEQ ID NO: 528918 - DNA, 25 bp, Mus musculus
agcagctggcctaccatcaccatga

SEQ ID NO: 528919 - DNA, 25 bp, Mus musculus
agcagctggccttccatcaccatga

SEQ ID NO: 528920 - DNA, 25 bp, Mus musculus
agcagctgggccacatccgcagcag

SEQ ID NO: 528921 - DNA, 25 bp, Mus musculus
agcagctgggcctcatccgcagcag

SEQ ID NO: 528922 - DNA, 25 bp, Mus musculus
agcagctggtcaccaatgcctgcct

SEQ ID NO: 528923 - DNA, 25 bp, Mus musculus
agcagctggtcagcaatgcctgcct

SEQ ID NO: 528924 - DNA, 25 bp, Mus musculus
agcagctgtccgaatatcttcaact

SEQ ID NO: 528925 - DNA, 25 bp, Mus musculus
agcagctgtccgtatatcttcaact

SEQ ID NO: 528926 - DNA, 25 bp, Mus musculus
agcagcttagatatagaagtcttct

SEQ ID NO: 528927 - DNA, 25 bp, Mus musculus
agcagcttagatttagaagtcttct

SEQ ID NO: 528928 - DNA, 25 bp, Mus musculus
agcagcttcacaaagggtggcaaag

SEQ ID NO: 528929 - DNA, 25 bp, Mus musculus
agcagcttcacatagggtggcaaag

SEQ ID NO: 528930 - DNA, 25 bp, Mus musculus
agcagcttccgacgctgcttcggga

SEQ ID NO: 528931 - DNA, 25 bp, Mus musculus
agcagcttccgaggctgcttcggga

SEQ ID NO: 528932 - DNA, 25 bp, Mus musculus
agcagcttgcctactatcaccacga

SEQ ID NO: 528933 - DNA, 25 bp, Mus musculus
agcagcttgccttctatcaccacga

SEQ ID NO: 528934 - DNA, 25 bp, Mus musculus
agcagcttgggcagaatatgaagca

SEQ ID NO: 528935 - DNA, 25 bp, Mus musculus
agcagcttgggctgaatatgaagca

SEQ ID NO: 528936 - DNA, 25 bp, Mus musculus
agcaggaaaccacgccacgacacaa

SEQ ID NO: 528937 - DNA, 25 bp, Mus musculus
agcaggaaaccaggccacgacacaa

SEQ ID NO: 528938 - DNA, 25 bp, Mus musculus
agcaggaaatgacccatactgtttt

SEQ ID NO: 528939 - DNA, 25 bp, Mus musculus
agcaggaaatgagccatactgtttt

SEQ ID NO: 528940 - DNA, 25 bp, Mus musculus
agcaggaacttcctgcagtatgcct

SEQ ID NO: 528941 - DNA, 25 bp, Mus musculus
agcaggaacttcgtgcagtatgcct

SEQ ID NO: 528942 - DNA, 25 bp, Mus musculus
agcaggaagccgattcaaggaccag

SEQ ID NO: 528943 - DNA, 25 bp, Mus musculus
agcaggaagccgtttcaaggaccag

SEQ ID NO: 528944 - DNA, 25 bp, Mus musculus
agcaggaagttgaggctgaagttca

SEQ ID NO: 528945 - DNA, 25 bp, Mus musculus
agcaggaagttgtggctgaagttca

SEQ ID NO: 528946 - DNA, 25 bp, Mus musculus
agcaggacaacccatctaccagtgg

SEQ ID NO: 528947 - DNA, 25 bp, Mus musculus
agcaggacaaccgatctaccagtgg

SEQ ID NO: 528948 - DNA, 25 bp, Mus musculus
agcaggacaggaccaaaccgagctt

SEQ ID NO: 528949 - DNA, 25 bp, Mus musculus
agcaggacaggagcaaaccgagctt

SEQ ID NO: 528950 - DNA, 25 bp, Mus musculus
agcaggacagtgacagtaaggactc

SEQ ID NO: 528951 - DNA, 25 bp, Mus musculus
agcaggacagtgtcagtaaggactc

SEQ ID NO: 528952 - DNA, 25 bp, Mus musculus
agcaggaccacgagcctgcacctgg

SEQ ID NO: 528953 - DNA, 25 bp, Mus musculus
agcaggaccacgtgcctgcacctgg

SEQ ID NO: 528954 - DNA, 25 bp, Mus musculus
agcaggaccaggagctcgacatcag

SEQ ID NO: 528955 - DNA, 25 bp, Mus musculus
agcaggaccaggtgctcgacatcag

SEQ ID NO: 528956 - DNA, 25 bp, Mus musculus
agcaggaccgcacggcactgagcat

SEQ ID NO: 528957 - DNA, 25 bp, Mus musculus
agcaggaccgcagggcactgagcat

SEQ ID NO: 528958 - DNA, 25 bp, Mus musculus
agcaggacctttagtactcagtgag

SEQ ID NO: 528959 - DNA, 25 bp, Mus musculus
agcaggaccttttgtactcagtgag

SEQ ID NO: 528960 - DNA, 25 bp, Mus musculus
agcaggacgcaacccctagcaaaca

SEQ ID NO: 528961 - DNA, 25 bp, Mus musculus
agcaggacgcaagccctagcaaaca

SEQ ID NO: 528962 - DNA, 25 bp, Mus musculus
agcaggacgccgaggcagcacacaa

SEQ ID NO: 528963 - DNA, 25 bp, Mus musculus
agcaggacgccgtggcagcacacaa

SEQ ID NO: 528964 - DNA, 25 bp, Mus musculus
agcaggactcctcgcagactttata

SEQ ID NO: 528965 - DNA, 25 bp, Mus musculus
agcaggactcctggcagactttata

SEQ ID NO: 528966 - DNA, 25 bp, Mus musculus
agcaggagaggaatagccggtacca

SEQ ID NO: 528967 - DNA, 25 bp, Mus musculus
agcaggagaggattagccggtacca

SEQ ID NO: 528968 - DNA, 25 bp, Mus musculus
agcaggagccatcacggatgtgcac

SEQ ID NO: 528969 - DNA, 25 bp, Mus musculus
agcaggagccatgacggatgtgcac

SEQ ID NO: 528970 - DNA, 25 bp, Mus musculus
agcaggagcctacattctcagcaga

SEQ ID NO: 528971 - DNA, 25 bp, Mus musculus
agcaggagcctagattctcagcaga

SEQ ID NO: 528972 - DNA, 25 bp, Mus musculus
agcaggagctagcagccattcccag

SEQ ID NO: 528973 - DNA, 25 bp, Mus musculus
agcaggagctaggagccattcccag

SEQ ID NO: 528974 - DNA, 25 bp, Mus musculus
agcaggaggcccagtactgtaatcc

SEQ ID NO: 528975 - DNA, 25 bp, Mus musculus
agcaggaggccctgtactgtaatcc

SEQ ID NO: 528976 - DNA, 25 bp, Mus musculus
agcaggagggtgcaaacatttcaac

SEQ ID NO: 528977 - DNA, 25 bp, Mus musculus
agcaggagggtggaaacatttcaac

SEQ ID NO: 528978 - DNA, 25 bp, Mus musculus
agcaggagtcctacaaggagtccta

SEQ ID NO: 528979 - DNA, 25 bp, Mus musculus
agcaggagtccttcaaggagtccta

SEQ ID NO: 528980 - DNA, 25 bp, Mus musculus
agcaggataagaacctggtggctgt

SEQ ID NO: 528981 - DNA, 25 bp, Mus musculus
agcaggataagatcctggtggctgt

SEQ ID NO: 528982 - DNA, 25 bp, Mus musculus
agcaggatacaaagcagccatagtt

SEQ ID NO: 528983 - DNA, 25 bp, Mus musculus
agcaggatacaatgcagccatagtt

SEQ ID NO: 528984 - DNA, 25 bp, Mus musculus
agcaggatgtgcctcttcgaggccc

SEQ ID NO: 528985 - DNA, 25 bp, Mus musculus
agcaggatgtgcgtcttcgaggccc

SEQ ID NO: 528986 - DNA, 25 bp, Mus musculus
agcaggatttctccattggctccca

SEQ ID NO: 528987 - DNA, 25 bp, Mus musculus
agcaggatttctgcattggctccca

SEQ ID NO: 528988 - DNA, 25 bp, Mus musculus
agcaggcaaggacccagagcacctc

SEQ ID NO: 528989 - DNA, 25 bp, Mus musculus
agcaggcaaggagccagagcacctc

SEQ ID NO: 528990 - DNA, 25 bp, Mus musculus
agcaggcatgccacggctcctgacg

SEQ ID NO: 528991 - DNA, 25 bp, Mus musculus
agcaggcatgcctcggctcctgacg

SEQ ID NO: 528992 - DNA, 25 bp, Mus musculus
agcaggcattgcagttctggaagca

SEQ ID NO: 528993 - DNA, 25 bp, Mus musculus
agcaggcattgctgttctggaagca

SEQ ID NO: 528994 - DNA, 25 bp, Mus musculus
agcaggcccaggctgttgccactca

SEQ ID NO: 528995 - DNA, 25 bp, Mus musculus
agcaggcccagggtgttgccactca

SEQ ID NO: 528996 - DNA, 25 bp, Mus musculus
agcaggcccggaaggagttccagca

SEQ ID NO: 528997 - DNA, 25 bp, Mus musculus
agcaggcccggatggagttccagca

SEQ ID NO: 528998 - DNA, 25 bp, Mus musculus
agcaggccctcacgagaaccatgga

SEQ ID NO: 528999 - DNA, 25 bp, Mus musculus
agcaggccctcaggagaaccatgga

SEQ ID NO: 529000 - DNA, 25 bp, Mus musculus
agcaggcccttcacaatgtgctgag

SEQ ID NO: 529001 - DNA, 25 bp, Mus musculus
agcaggcccttctcaatgtgctgag

SEQ ID NO: 529002 - DNA, 25 bp, Mus musculus
agcaggcgcgtacccttttggaaga

SEQ ID NO: 529003 - DNA, 25 bp, Mus musculus
agcaggcgcgtagccttttggaaga

SEQ ID NO: 529004 - DNA, 25 bp, Mus musculus
agcaggctcgagaggacaaaggccc

SEQ ID NO: 529005 - DNA, 25 bp, Mus musculus
agcaggctcgagtggacaaaggccc

SEQ ID NO: 529006 - DNA, 25 bp, Mus musculus
agcaggctggctacagtgcccagca

SEQ ID NO: 529007 - DNA, 25 bp, Mus musculus
agcaggctggcttcagtgcccagca

SEQ ID NO: 529008 - DNA, 25 bp, Mus musculus
agcaggctgtaactgagacagacag

SEQ ID NO: 529009 - DNA, 25 bp, Mus musculus
agcaggctgtaagtgagacagacag

SEQ ID NO: 529010 - DNA, 25 bp, Mus musculus
agcaggcttctgaggacagtgtcac

SEQ ID NO: 529011 - DNA, 25 bp, Mus musculus
agcaggcttctgtggacagtgtcac

SEQ ID NO: 529012 - DNA, 25 bp, Mus musculus
agcagggaaagccacgcctgaagcc

SEQ ID NO: 529013 - DNA, 25 bp, Mus musculus
agcagggaaagcgacgcctgaagcc

SEQ ID NO: 529014 - DNA, 25 bp, Mus musculus
agcagggacgagatcaccaacacct

SEQ ID NO: 529015 - DNA, 25 bp, Mus musculus
agcagggacgagttcaccaacacct

SEQ ID NO: 529016 - DNA, 25 bp, Mus musculus
agcagggagaacctatcagccgcct

SEQ ID NO: 529017 - DNA, 25 bp, Mus musculus
agcagggagaacgtatcagccgcct

SEQ ID NO: 529018 - DNA, 25 bp, Mus musculus
agcagggagataactttaagatcac

SEQ ID NO: 529019 - DNA, 25 bp, Mus musculus
agcagggagatatctttaagatcac

SEQ ID NO: 529020 - DNA, 25 bp, Mus musculus
agcagggcaagtactctgaggccga

SEQ ID NO: 529021 - DNA, 25 bp, Mus musculus
agcagggcaagttctctgaggccga

SEQ ID NO: 529022 - DNA, 25 bp, Mus musculus
agcagggcagcaaccgcagcctcaa

SEQ ID NO: 529023 - DNA, 25 bp, Mus musculus
agcagggcagcatccgcagcctcaa

SEQ ID NO: 529024 - DNA, 25 bp, Mus musculus
agcagggcagttcttcctatggatg

SEQ ID NO: 529025 - DNA, 25 bp, Mus musculus
agcagggcagttgttcctatggatg

SEQ ID NO: 529026 - DNA, 25 bp, Mus musculus
agcagggccacacaactcccaagaa

SEQ ID NO: 529027 - DNA, 25 bp, Mus musculus
agcagggccacagaactcccaagaa

SEQ ID NO: 529028 - DNA, 25 bp, Mus musculus
agcagggcctttcagaccacgcaga

SEQ ID NO: 529029 - DNA, 25 bp, Mus musculus
agcagggcctttgagaccacgcaga

SEQ ID NO: 529030 - DNA, 25 bp, Mus musculus
agcagggctagtcgccacagagcca

SEQ ID NO: 529031 - DNA, 25 bp, Mus musculus
agcagggctagtggccacagagcca

SEQ ID NO: 529032 - DNA, 25 bp, Mus musculus
agcagggtgatgagaagctggcaga

SEQ ID NO: 529033 - DNA, 25 bp, Mus musculus
agcagggtgatgtgaagctggcaga

SEQ ID NO: 529034 - DNA, 25 bp, Mus musculus
agcaggtagagcaagcccgcagctc

SEQ ID NO: 529035 - DNA, 25 bp, Mus musculus
agcaggtagagctagcccgcagctc

SEQ ID NO: 529036 - DNA, 25 bp, Mus musculus
agcaggtcacggctcctgagctgaa

SEQ ID NO: 529037 - DNA, 25 bp, Mus musculus
agcaggtcacgggtcctgagctgaa

SEQ ID NO: 529038 - DNA, 25 bp, Mus musculus
agcaggtcagggacaactcgctcac

SEQ ID NO: 529039 - DNA, 25 bp, Mus musculus
agcaggtcagggtcaactcgctcac

SEQ ID NO: 529040 - DNA, 25 bp, Mus musculus
agcaggtccagaaccaccagattgg

SEQ ID NO: 529041 - DNA, 25 bp, Mus musculus
agcaggtccagatccaccagattgg

SEQ ID NO: 529042 - DNA, 25 bp, Mus musculus
agcaggtgatttcccctccggcctt

SEQ ID NO: 529043 - DNA, 25 bp, Mus musculus
agcaggtgatttgccctccggcctt

SEQ ID NO: 529044 - DNA, 25 bp, Mus musculus
agcaggtggagaacctcaaccaata

SEQ ID NO: 529045 - DNA, 25 bp, Mus musculus
agcaggtggagatcctcaaccaata

SEQ ID NO: 529046 - DNA, 25 bp, Mus musculus
agcaggtggtggatttggctcaccc

SEQ ID NO: 529047 - DNA, 25 bp, Mus musculus
agcaggtggtggttttggctcaccc

SEQ ID NO: 529048 - DNA, 25 bp, Mus musculus
agcaggttgaacagcccactggctc

SEQ ID NO: 529049 - DNA, 25 bp, Mus musculus
agcaggttgaactgcccactggctc

SEQ ID NO: 529050 - DNA, 25 bp, Mus musculus
agcagtagagaaatgacctgctaga

SEQ ID NO: 529051 - DNA, 25 bp, Mus musculus
agcagtagagaattgacctgctaga

SEQ ID NO: 529052 - DNA, 25 bp, Mus musculus
agcagtagcagtccctctaacacag

SEQ ID NO: 529053 - DNA, 25 bp, Mus musculus
agcagtagcagtgcctctaacacag

SEQ ID NO: 529054 - DNA, 25 bp, Mus musculus
agcagtaggattaggccttgtcgcc

SEQ ID NO: 529055 - DNA, 25 bp, Mus musculus
agcagtaggatttggccttgtcgcc

SEQ ID NO: 529056 - DNA, 25 bp, Mus musculus
agcagtatcaggagcaccccgcctt

SEQ ID NO: 529057 - DNA, 25 bp, Mus musculus
agcagtatcaggtgcaccccgcctt

SEQ ID NO: 529058 - DNA, 25 bp, Mus musculus
agcagtatgcacatgcagcagccca

SEQ ID NO: 529059 - DNA, 25 bp, Mus musculus
agcagtatgcacttgcagcagccca

SEQ ID NO: 529060 - DNA, 25 bp, Mus musculus
agcagtatgcataagcagcagctca

SEQ ID NO: 529061 - DNA, 25 bp, Mus musculus
agcagtatgcattagcagcagctca

SEQ ID NO: 529062 - DNA, 25 bp, Mus musculus
agcagtcaaaagaaggatacgagca

SEQ ID NO: 529063 - DNA, 25 bp, Mus musculus
agcagtcaaaagtaggatacgagca

SEQ ID NO: 529064 - DNA, 25 bp, Mus musculus
agcagtcactgtctttccgcgttgt

SEQ ID NO: 529065 - DNA, 25 bp, Mus musculus
agcagtcactgtgtttccgcgttgt

SEQ ID NO: 529066 - DNA, 25 bp, Mus musculus
agcagtcagcggagtcagtgtccaa

SEQ ID NO: 529067 - DNA, 25 bp, Mus musculus
agcagtcagcggtgtcagtgtccaa

SEQ ID NO: 529068 - DNA, 25 bp, Mus musculus
agcagtcagctcagatctccaaagc

SEQ ID NO: 529069 - DNA, 25 bp, Mus musculus
agcagtcagctctgatctccaaagc

SEQ ID NO: 529070 - DNA, 25 bp, Mus musculus
agcagtcagtcacggcatcttggaa

SEQ ID NO: 529071 - DNA, 25 bp, Mus musculus
agcagtcagtcagggcatcttggaa

SEQ ID NO: 529072 - DNA, 25 bp, Mus musculus
agcagtcagtgacaggtgtgacctc

SEQ ID NO: 529073 - DNA, 25 bp, Mus musculus
agcagtcagtgagaggtgtgacctc

SEQ ID NO: 529074 - DNA, 25 bp, Mus musculus
agcagtccagatcagaaggcagagc

SEQ ID NO: 529075 - DNA, 25 bp, Mus musculus
agcagtccagatgagaaggcagagc

SEQ ID NO: 529076 - DNA, 25 bp, Mus musculus
agcagtccagcgatggtacccagca

SEQ ID NO: 529077 - DNA, 25 bp, Mus musculus
agcagtccagcgttggtacccagca

SEQ ID NO: 529078 - DNA, 25 bp, Mus musculus
agcagtcccgggaggtcatcgacag

SEQ ID NO: 529079 - DNA, 25 bp, Mus musculus
agcagtcccgggtggtcatcgacag

SEQ ID NO: 529080 - DNA, 25 bp, Mus musculus
agcagtcgcagcagttggctttgaa

SEQ ID NO: 529081 - DNA, 25 bp, Mus musculus
agcagtcgcagctgttggctttgaa

SEQ ID NO: 529082 - DNA, 25 bp, Mus musculus
agcagtcgcggcacaatgggtctgc

SEQ ID NO: 529083 - DNA, 25 bp, Mus musculus
agcagtcgcggctcaatgggtctgc

SEQ ID NO: 529084 - DNA, 25 bp, Mus musculus
agcagtcggccaattatcatgcggg

SEQ ID NO: 529085 - DNA, 25 bp, Mus musculus
agcagtcggccatttatcatgcggg

SEQ ID NO: 529086 - DNA, 25 bp, Mus musculus
agcagtcgggtcaaggcgtgcttct

SEQ ID NO: 529087 - DNA, 25 bp, Mus musculus
agcagtcgggtctaggcgtgcttct

SEQ ID NO: 529088 - DNA, 25 bp, Mus musculus
agcagtctcgaaaccgcattgacag

SEQ ID NO: 529089 - DNA, 25 bp, Mus musculus
agcagtctcgaatccgcattgacag

SEQ ID NO: 529090 - DNA, 25 bp, Mus musculus
agcagtctctggagcggtctcgagc

SEQ ID NO: 529091 - DNA, 25 bp, Mus musculus
agcagtctctggtgcggtctcgagc

SEQ ID NO: 529092 - DNA, 25 bp, Mus musculus
agcagtctgcccagctgtggccttc

SEQ ID NO: 529093 - DNA, 25 bp, Mus musculus
agcagtctgccctgctgtggccttc

SEQ ID NO: 529094 - DNA, 25 bp, Mus musculus
agcagtcttcagatgggccatctca

SEQ ID NO: 529095 - DNA, 25 bp, Mus musculus
agcagtcttcagttgggccatctca

SEQ ID NO: 529096 - DNA, 25 bp, Mus musculus
agcagtcttcatctggtatggacaa

SEQ ID NO: 529097 - DNA, 25 bp, Mus musculus
agcagtcttcatgtggtatggacaa

SEQ ID NO: 529098 - DNA, 25 bp, Mus musculus
agcagtgaccggacctgatgcagga

SEQ ID NO: 529099 - DNA, 25 bp, Mus musculus
agcagtgaccggtcctgatgcagga

SEQ ID NO: 529100 - DNA, 25 bp, Mus musculus
agcagtgaccttatccagtccgcac

SEQ ID NO: 529101 - DNA, 25 bp, Mus musculus
agcagtgaccttttccagtccgcac

SEQ ID NO: 529102 - DNA, 25 bp, Mus musculus
agcagtgatcctccctttgaagtgc

SEQ ID NO: 529103 - DNA, 25 bp, Mus musculus
agcagtgatcctgcctttgaagtgc

SEQ ID NO: 529104 - DNA, 25 bp, Mus musculus
agcagtgatggcctagcaagagccc

SEQ ID NO: 529105 - DNA, 25 bp, Mus musculus
agcagtgatggcgtagcaagagccc

SEQ ID NO: 529106 - DNA, 25 bp, Mus musculus
agcagtgcccggatcaccatctcgg

SEQ ID NO: 529107 - DNA, 25 bp, Mus musculus
agcagtgcccggttcaccatctcgg

SEQ ID NO: 529108 - DNA, 25 bp, Mus musculus
agcagtgcggccagctgcagaagct

SEQ ID NO: 529109 - DNA, 25 bp, Mus musculus
agcagtgcggcctgctgcagaagct

SEQ ID NO: 529110 - DNA, 25 bp, Mus musculus
agcagtgctgatatcgggtccagtg

SEQ ID NO: 529111 - DNA, 25 bp, Mus musculus
agcagtgctgatttcgggtccagtg

SEQ ID NO: 529112 - DNA, 25 bp, Mus musculus
agcagtgctgcgacccgtgtcagtt

SEQ ID NO: 529113 - DNA, 25 bp, Mus musculus
agcagtgctgcgtcccgtgtcagtt

SEQ ID NO: 529114 - DNA, 25 bp, Mus musculus
agcagtggcagcaaagcccctgcat

SEQ ID NO: 529115 - DNA, 25 bp, Mus musculus
agcagtggcagctaagcccctgcat

SEQ ID NO: 529116 - DNA, 25 bp, Mus musculus
agcagtggccgcacatctggatgga

SEQ ID NO: 529117 - DNA, 25 bp, Mus musculus
agcagtggccgctcatctggatgga

SEQ ID NO: 529118 - DNA, 25 bp, Mus musculus
agcagtggcggcaacaggtcaaccg

SEQ ID NO: 529119 - DNA, 25 bp, Mus musculus
agcagtggcggctacaggtcaaccg

SEQ ID NO: 529120 - DNA, 25 bp, Mus musculus
agcagtgggactaccccaatgcctg

SEQ ID NO: 529121 - DNA, 25 bp, Mus musculus
agcagtgggacttccccaatgcctg

SEQ ID NO: 529122 - DNA, 25 bp, Mus musculus
agcagtgggtacagactgcccggca

SEQ ID NO: 529123 - DNA, 25 bp, Mus musculus
agcagtgggtactgactgcccggca

SEQ ID NO: 529124 - DNA, 25 bp, Mus musculus
agcagtgtcactccctcaggttcca

SEQ ID NO: 529125 - DNA, 25 bp, Mus musculus
agcagtgtcactgcctcaggttcca

SEQ ID NO: 529126 - DNA, 25 bp, Mus musculus
agcagtgtccagagctgggcccggt

SEQ ID NO: 529127 - DNA, 25 bp, Mus musculus
agcagtgtccagtgctgggcccggt

SEQ ID NO: 529128 - DNA, 25 bp, Mus musculus
agcagtgtgttgagatgtactttga

SEQ ID NO: 529129 - DNA, 25 bp, Mus musculus
agcagtgtgttgtgatgtactttga

SEQ ID NO: 529130 - DNA, 25 bp, Mus musculus
agcagttaggaactgaataacccac

SEQ ID NO: 529131 - DNA, 25 bp, Mus musculus
agcagttaggaagtgaataacccac

SEQ ID NO: 529132 - DNA, 25 bp, Mus musculus
agcagttagtgaccaggtcagacag

SEQ ID NO: 529133 - DNA, 25 bp, Mus musculus
agcagttagtgagcaggtcagacag

SEQ ID NO: 529134 - DNA, 25 bp, Mus musculus
agcagttccagaagccttgtcagaa

SEQ ID NO: 529135 - DNA, 25 bp, Mus musculus
agcagttccagatgccttgtcagaa

SEQ ID NO: 529136 - DNA, 25 bp, Mus musculus
agcagttccaggcacaacagaatgc

SEQ ID NO: 529137 - DNA, 25 bp, Mus musculus
agcagttccagggacaacagaatgc

SEQ ID NO: 529138 - DNA, 25 bp, Mus musculus
agcagttcccatatcctccgaacta

SEQ ID NO: 529139 - DNA, 25 bp, Mus musculus
agcagttcccatttcctccgaacta

SEQ ID NO: 529140 - DNA, 25 bp, Mus musculus
agcagttcgttgagtctcaccccag

SEQ ID NO: 529141 - DNA, 25 bp, Mus musculus
agcagttcgttgtgtctcaccccag

SEQ ID NO: 529142 - DNA, 25 bp, Mus musculus
agcagttgtgcacccaagccaaggg

SEQ ID NO: 529143 - DNA, 25 bp, Mus musculus
agcagttgtgcagccaagccaaggg

SEQ ID NO: 529144 - DNA, 25 bp, Mus musculus
agcataccccttcctggaccatgag

SEQ ID NO: 529145 - DNA, 25 bp, Mus musculus
agcataccccttgctggaccatgag

SEQ ID NO: 529146 - DNA, 25 bp, Mus musculus
agcataccgtgacgaaccgtattaa

SEQ ID NO: 529147 - DNA, 25 bp, Mus musculus
agcataccgtgaggaaccgtattaa

SEQ ID NO: 529148 - DNA, 25 bp, Mus musculus
agcatacgagttcggttcctggtcc

SEQ ID NO: 529149 - DNA, 25 bp, Mus musculus
agcatacgagttgggttcctggtcc

SEQ ID NO: 529150 - DNA, 25 bp, Mus musculus
agcatactccatctcttccagcaga

SEQ ID NO: 529151 - DNA, 25 bp, Mus musculus
agcatactccatgtcttccagcaga

SEQ ID NO: 529152 - DNA, 25 bp, Mus musculus
agcatatctgggattttctggaaca

SEQ ID NO: 529153 - DNA, 25 bp, Mus musculus
agcatatctgggtttttctggaaca

SEQ ID NO: 529154 - DNA, 25 bp, Mus musculus
agcatatggccccaggagatcctgg

SEQ ID NO: 529155 - DNA, 25 bp, Mus musculus
agcatatggcccgaggagatcctgg

SEQ ID NO: 529156 - DNA, 25 bp, Mus musculus
agcatcaagcgcatctttcacaccg

SEQ ID NO: 529157 - DNA, 25 bp, Mus musculus
agcatcaagcgcttctttcacaccg

SEQ ID NO: 529158 - DNA, 25 bp, Mus musculus
agcatcaatgaaatcaagaggacct

SEQ ID NO: 529159 - DNA, 25 bp, Mus musculus
agcatcaatgaattcaagaggacct

SEQ ID NO: 529160 - DNA, 25 bp, Mus musculus
agcatcacagtgcttctagaaggtg

SEQ ID NO: 529161 - DNA, 25 bp, Mus musculus
agcatcacagtggttctagaaggtg

SEQ ID NO: 529162 - DNA, 25 bp, Mus musculus
agcatcaccgacctgtcattacagg

SEQ ID NO: 529163 - DNA, 25 bp, Mus musculus
agcatcaccgacgtgtcattacagg

SEQ ID NO: 529164 - DNA, 25 bp, Mus musculus
agcatcactgttcgagtggctccta

SEQ ID NO: 529165 - DNA, 25 bp, Mus musculus
agcatcactgttggagtggctccta

SEQ ID NO: 529166 - DNA, 25 bp, Mus musculus
agcatcagactcacccattgatctg

SEQ ID NO: 529167 - DNA, 25 bp, Mus musculus
agcatcagactctcccattgatctg

SEQ ID NO: 529168 - DNA, 25 bp, Mus musculus
agcatcagttggacaccatcctggt

SEQ ID NO: 529169 - DNA, 25 bp, Mus musculus
agcatcagttggtcaccatcctggt

SEQ ID NO: 529170 - DNA, 25 bp, Mus musculus
agcatcatggtccaccatcaggaac

SEQ ID NO: 529171 - DNA, 25 bp, Mus musculus
agcatcatggtcgaccatcaggaac

SEQ ID NO: 529172 - DNA, 25 bp, Mus musculus
agcatcatgtctatggaaccacttg

SEQ ID NO: 529173 - DNA, 25 bp, Mus musculus
agcatcatgtctttggaaccacttg

SEQ ID NO: 529174 - DNA, 25 bp, Mus musculus
agcatccaatatcagtgagccccac

SEQ ID NO: 529175 - DNA, 25 bp, Mus musculus
agcatccaatatgagtgagccccac

SEQ ID NO: 529176 - DNA, 25 bp, Mus musculus
agcatccacatccaccaaaaatctg

SEQ ID NO: 529177 - DNA, 25 bp, Mus musculus
agcatccacatcgaccaaaaatctg

SEQ ID NO: 529178 - DNA, 25 bp, Mus musculus
agcatccagcagctaccctacggga

SEQ ID NO: 529179 - DNA, 25 bp, Mus musculus
agcatccagcaggtaccctacggga

SEQ ID NO: 529180 - DNA, 25 bp, Mus musculus
agcatccatgagctgtctgtggagc

SEQ ID NO: 529181 - DNA, 25 bp, Mus musculus
agcatccatgaggtgtctgtggagc

SEQ ID NO: 529182 - DNA, 25 bp, Mus musculus
agcatcccacgtcggatgatgagca

SEQ ID NO: 529183 - DNA, 25 bp, Mus musculus
agcatcccacgtgggatgatgagca

SEQ ID NO: 529184 - DNA, 25 bp, Mus musculus
agcatccctgtcctagacatcaaga

SEQ ID NO: 529185 - DNA, 25 bp, Mus musculus
agcatccctgtcgtagacatcaaga

SEQ ID NO: 529186 - DNA, 25 bp, Mus musculus
agcatccgcttcaactccaagcatg

SEQ ID NO: 529187 - DNA, 25 bp, Mus musculus
agcatccgcttctactccaagcatg

SEQ ID NO: 529188 - DNA, 25 bp, Mus musculus
agcatccggcagacatacacactgg

SEQ ID NO: 529189 - DNA, 25 bp, Mus musculus
agcatccggcagtcatacacactgg

SEQ ID NO: 529190 - DNA, 25 bp, Mus musculus
agcatccgtcggctaccgaagccat

SEQ ID NO: 529191 - DNA, 25 bp, Mus musculus
agcatccgtcgggtaccgaagccat

SEQ ID NO: 529192 - DNA, 25 bp, Mus musculus
agcatcctctctctgggctattcac

SEQ ID NO: 529193 - DNA, 25 bp, Mus musculus
agcatcctctctgtgggctattcac

SEQ ID NO: 529194 - DNA, 25 bp, Mus musculus
agcatcctctgacagctccgttctg

SEQ ID NO: 529195 - DNA, 25 bp, Mus musculus
agcatcctctgagagctccgttctg

SEQ ID NO: 529196 - DNA, 25 bp, Mus musculus
agcatcgatgccatggacgtggccg

SEQ ID NO: 529197 - DNA, 25 bp, Mus musculus
agcatcgatgccttggacgtggccg

SEQ ID NO: 529198 - DNA, 25 bp, Mus musculus
agcatcgcatcaccatggaggtggc

SEQ ID NO: 529199 - DNA, 25 bp, Mus musculus
agcatcgcatcagcatggaggtggc

SEQ ID NO: 529200 - DNA, 25 bp, Mus musculus
agcatcgccaggacaagcctctctt

SEQ ID NO: 529201 - DNA, 25 bp, Mus musculus
agcatcgccaggtcaagcctctctt

SEQ ID NO: 529202 - DNA, 25 bp, Mus musculus
agcatcgcgactaccttcggcccga

SEQ ID NO: 529203 - DNA, 25 bp, Mus musculus
agcatcgcgacttccttcggcccga

SEQ ID NO: 529204 - DNA, 25 bp, Mus musculus
agcatcggccatctattcccctggg

SEQ ID NO: 529205 - DNA, 25 bp, Mus musculus
agcatcggccatgtattcccctggg

SEQ ID NO: 529206 - DNA, 25 bp, Mus musculus
agcatcgggtctcttgtgatctatt

SEQ ID NO: 529207 - DNA, 25 bp, Mus musculus
agcatcgggtctgttgtgatctatt

SEQ ID NO: 529208 - DNA, 25 bp, Mus musculus
agcatcgtgggccagagcaacgacc

SEQ ID NO: 529209 - DNA, 25 bp, Mus musculus
agcatcgtgggcgagagcaacgacc

SEQ ID NO: 529210 - DNA, 25 bp, Mus musculus
agcatctacgacaagcgctgcgacc

SEQ ID NO: 529211 - DNA, 25 bp, Mus musculus
agcatctacgactagcgctgcgacc

SEQ ID NO: 529212 - DNA, 25 bp, Mus musculus
agcatctctcagagggttccagtat

SEQ ID NO: 529213 - DNA, 25 bp, Mus musculus
agcatctctcagtgggttccagtat

SEQ ID NO: 529214 - DNA, 25 bp, Mus musculus
agcatcttaggccttgcctcctcga

SEQ ID NO: 529215 - DNA, 25 bp, Mus musculus
agcatcttaggcgttgcctcctcga

SEQ ID NO: 529216 - DNA, 25 bp, Mus musculus
agcatcttccctaacagccggctga

SEQ ID NO: 529217 - DNA, 25 bp, Mus musculus
agcatcttcccttacagccggctga

SEQ ID NO: 529218 - DNA, 25 bp, Mus musculus
agcatcttcggcatcagcgtgtctc

SEQ ID NO: 529219 - DNA, 25 bp, Mus musculus
agcatcttcggcttcagcgtgtctc

SEQ ID NO: 529220 - DNA, 25 bp, Mus musculus
agcatcttgaacctggtgcccctgg

SEQ ID NO: 529221 - DNA, 25 bp, Mus musculus
agcatcttgaacgtggtgcccctgg

SEQ ID NO: 529222 - DNA, 25 bp, Mus musculus
agcatctttgcaacaacaccgtcgg

SEQ ID NO: 529223 - DNA, 25 bp, Mus musculus
agcatctttgcatcaacaccgtcgg

SEQ ID NO: 529224 - DNA, 25 bp, Mus musculus
agcatgaacaagctgccttccgtga

SEQ ID NO: 529225 - DNA, 25 bp, Mus musculus
agcatgaacaaggtgccttccgtga

SEQ ID NO: 529226 - DNA, 25 bp, Mus musculus
agcatgaacgatctgcgccgagcct

SEQ ID NO: 529227 - DNA, 25 bp, Mus musculus
agcatgaacgatgtgcgccgagcct

SEQ ID NO: 529228 - DNA, 25 bp, Mus musculus
agcatgaagaaaaccaccggccttt

SEQ ID NO: 529229 - DNA, 25 bp, Mus musculus
agcatgaagaaatccaccggccttt

SEQ ID NO: 529230 - DNA, 25 bp, Mus musculus
agcatgaagcgcctccagaccgcgg

SEQ ID NO: 529231 - DNA, 25 bp, Mus musculus
agcatgaagcgcgtccagaccgcgg

SEQ ID NO: 529232 - DNA, 25 bp, Mus musculus
agcatgagaagacgccactgttccg

SEQ ID NO: 529233 - DNA, 25 bp, Mus musculus
agcatgagaagaggccactgttccg

SEQ ID NO: 529234 - DNA, 25 bp, Mus musculus
agcatgagccacaggtcctaccagc

SEQ ID NO: 529235 - DNA, 25 bp, Mus musculus
agcatgagccactggtcctaccagc

SEQ ID NO: 529236 - DNA, 25 bp, Mus musculus
agcatgagcgtaaccactggagaag

SEQ ID NO: 529237 - DNA, 25 bp, Mus musculus
agcatgagcgtatccactggagaag

SEQ ID NO: 529238 - DNA, 25 bp, Mus musculus
agcatgaggaagcaaataaaaccaa

SEQ ID NO: 529239 - DNA, 25 bp, Mus musculus
agcatgaggaaggaaataaaaccaa

SEQ ID NO: 529240 - DNA, 25 bp, Mus musculus
agcatgagtgcaacccgcaggccat

SEQ ID NO: 529241 - DNA, 25 bp, Mus musculus
agcatgagtgcatcccgcaggccat

SEQ ID NO: 529242 - DNA, 25 bp, Mus musculus
agcatgatccagcaatccgactgcg

SEQ ID NO: 529243 - DNA, 25 bp, Mus musculus
agcatgatccaggaatccgactgcg

SEQ ID NO: 529244 - DNA, 25 bp, Mus musculus
agcatgatctccaccattgtgaaca

SEQ ID NO: 529245 - DNA, 25 bp, Mus musculus
agcatgatctcctccattgtgaaca

SEQ ID NO: 529246 - DNA, 25 bp, Mus musculus
agcatgcagttgctgtcatttgggc

SEQ ID NO: 529247 - DNA, 25 bp, Mus musculus
agcatgcagttggtgtcatttgggc

SEQ ID NO: 529248 - DNA, 25 bp, Mus musculus
agcatgcattcaagtggagggctct

SEQ ID NO: 529249 - DNA, 25 bp, Mus musculus
agcatgcattcatgtggagggctct

SEQ ID NO: 529250 - DNA, 25 bp, Mus musculus
agcatgccaccgagtgacttctcac

SEQ ID NO: 529251 - DNA, 25 bp, Mus musculus
agcatgccaccgtgtgacttctcac

SEQ ID NO: 529252 - DNA, 25 bp, Mus musculus
agcatgcctttgagggctacaatgt

SEQ ID NO: 529253 - DNA, 25 bp, Mus musculus
agcatgcctttgtgggctacaatgt

SEQ ID NO: 529254 - DNA, 25 bp, Mus musculus
agcatgcggtcaacctacagcgacg

SEQ ID NO: 529255 - DNA, 25 bp, Mus musculus
agcatgcggtcatcctacagcgacg

SEQ ID NO: 529256 - DNA, 25 bp, Mus musculus
agcatgcggtccaacacactaatcc

SEQ ID NO: 529257 - DNA, 25 bp, Mus musculus
agcatgcggtcctacacactaatcc

SEQ ID NO: 529258 - DNA, 25 bp, Mus musculus
agcatgctaagtcggcggctaccag

SEQ ID NO: 529259 - DNA, 25 bp, Mus musculus
agcatgctaagtgggcggctaccag

SEQ ID NO: 529260 - DNA, 25 bp, Mus musculus
agcatgctaattcgactttaacacc

SEQ ID NO: 529261 - DNA, 25 bp, Mus musculus
agcatgctaattggactttaacacc

SEQ ID NO: 529262 - DNA, 25 bp, Mus musculus
agcatgctagtgattcaagttcatc

SEQ ID NO: 529263 - DNA, 25 bp, Mus musculus
agcatgctagtgtttcaagttcatc

SEQ ID NO: 529264 - DNA, 25 bp, Mus musculus
agcatgctcagtcgcccggactttt

SEQ ID NO: 529265 - DNA, 25 bp, Mus musculus
agcatgctcagtggcccggactttt

SEQ ID NO: 529266 - DNA, 25 bp, Mus musculus
agcatgctccgtcatgttcagtggg

SEQ ID NO: 529267 - DNA, 25 bp, Mus musculus
agcatgctccgtgatgttcagtggg

SEQ ID NO: 529268 - DNA, 25 bp, Mus musculus
agcatgctgcagcagaccatgaagt

SEQ ID NO: 529269 - DNA, 25 bp, Mus musculus
agcatgctgcaggagaccatgaagt

SEQ ID NO: 529270 - DNA, 25 bp, Mus musculus
agcatgcttggaaacacagcggcca

SEQ ID NO: 529271 - DNA, 25 bp, Mus musculus
agcatgcttggatacacagcggcca

SEQ ID NO: 529272 - DNA, 25 bp, Mus musculus
agcatggacagtcccctggaccttt

SEQ ID NO: 529273 - DNA, 25 bp, Mus musculus
agcatggacagtgccctggaccttt

SEQ ID NO: 529274 - DNA, 25 bp, Mus musculus
agcatggccatgattagacaacacg

SEQ ID NO: 529275 - DNA, 25 bp, Mus musculus
agcatggccatgtttagacaacacg

SEQ ID NO: 529276 - DNA, 25 bp, Mus musculus
agcatggctgacatccgggcactgg

SEQ ID NO: 529277 - DNA, 25 bp, Mus musculus
agcatggctgacttccgggcactgg

SEQ ID NO: 529278 - DNA, 25 bp, Mus musculus
agcatggtggatcatgtcttctaca

SEQ ID NO: 529279 - DNA, 25 bp, Mus musculus
agcatggtggatgatgtcttctaca

SEQ ID NO: 529280 - DNA, 25 bp, Mus musculus
agcatgtcaacaccctgggccaatt

SEQ ID NO: 529281 - DNA, 25 bp, Mus musculus
agcatgtcaacagcctgggccaatt

SEQ ID NO: 529282 - DNA, 25 bp, Mus musculus
agcatgtcatctcgcgctcaccaga

SEQ ID NO: 529283 - DNA, 25 bp, Mus musculus
agcatgtcatctggcgctcaccaga

SEQ ID NO: 529284 - DNA, 25 bp, Mus musculus
agcatgtctgtgctgccgcccaatc

SEQ ID NO: 529285 - DNA, 25 bp, Mus musculus
agcatgtctgtggtgccgcccaatc

SEQ ID NO: 529286 - DNA, 25 bp, Mus musculus
agcattaagtagacaagccagccag

SEQ ID NO: 529287 - DNA, 25 bp, Mus musculus
agcattaagtagtcaagccagccag

SEQ ID NO: 529288 - DNA, 25 bp, Mus musculus
agcattaatggcagcagaggataag

SEQ ID NO: 529289 - DNA, 25 bp, Mus musculus
agcattaatggctgcagaggataag

SEQ ID NO: 529290 - DNA, 25 bp, Mus musculus
agcattactgggacgggacgtctgc

SEQ ID NO: 529291 - DNA, 25 bp, Mus musculus
agcattactgggtcgggacgtctgc

SEQ ID NO: 529292 - DNA, 25 bp, Mus musculus
agcattcccatgaccaggaacacgg

SEQ ID NO: 529293 - DNA, 25 bp, Mus musculus
agcattcccatgtccaggaacacgg

SEQ ID NO: 529294 - DNA, 25 bp, Mus musculus
agcattcgaagtatgctggccacca

SEQ ID NO: 529295 - DNA, 25 bp, Mus musculus
agcattcgaagtttgctggccacca

SEQ ID NO: 529296 - DNA, 25 bp, Mus musculus
agcattcggatgatgtcctgccctc

SEQ ID NO: 529297 - DNA, 25 bp, Mus musculus
agcattcggatgttgtcctgccctc

SEQ ID NO: 529298 - DNA, 25 bp, Mus musculus
agcattctacaacgatccctctgtg

SEQ ID NO: 529299 - DNA, 25 bp, Mus musculus
agcattctacaaggatccctctgtg

SEQ ID NO: 529300 - DNA, 25 bp, Mus musculus
agcattctcctaaaagagctggatc

SEQ ID NO: 529301 - DNA, 25 bp, Mus musculus
agcattctcctataagagctggatc

SEQ ID NO: 529302 - DNA, 25 bp, Mus musculus
agcattctgaggaaaggaggtatcc

SEQ ID NO: 529303 - DNA, 25 bp, Mus musculus
agcattctgaggtaaggaggtatcc

SEQ ID NO: 529304 - DNA, 25 bp, Mus musculus
agcattgaaccccttatctcagact

SEQ ID NO: 529305 - DNA, 25 bp, Mus musculus
agcattgaacccgttatctcagact

SEQ ID NO: 529306 - DNA, 25 bp, Mus musculus
agcattgagaacacgctgtgggccg

SEQ ID NO: 529307 - DNA, 25 bp, Mus musculus
agcattgagaactcgctgtgggccg

SEQ ID NO: 529308 - DNA, 25 bp, Mus musculus
agcattgcttctacctcctcagcag

SEQ ID NO: 529309 - DNA, 25 bp, Mus musculus
agcattgcttcttcctcctcagcag

SEQ ID NO: 529310 - DNA, 25 bp, Mus musculus
agcattggattactgggcccggcca

SEQ ID NO: 529311 - DNA, 25 bp, Mus musculus
agcattggattagtgggcccggcca

SEQ ID NO: 529312 - DNA, 25 bp, Mus musculus
agcattgtgtgtcgttttgtccagg

SEQ ID NO: 529313 - DNA, 25 bp, Mus musculus
agcattgtgtgtggttttgtccagg

SEQ ID NO: 529314 - DNA, 25 bp, Mus musculus
agcatttagacacttgtttatcacg

SEQ ID NO: 529315 - DNA, 25 bp, Mus musculus
agcatttagacagttgtttatcacg

SEQ ID NO: 529316 - DNA, 25 bp, Mus musculus
agcatttaggtgagatccggaacct

SEQ ID NO: 529317 - DNA, 25 bp, Mus musculus
agcatttaggtgtgatccggaacct

SEQ ID NO: 529318 - DNA, 25 bp, Mus musculus
agcatttcaaaacggaagaaggagc

SEQ ID NO: 529319 - DNA, 25 bp, Mus musculus
agcatttcaaaagggaagaaggagc

SEQ ID NO: 529320 - DNA, 25 bp, Mus musculus
agcatttgcttcacgggtgttcccc

SEQ ID NO: 529321 - DNA, 25 bp, Mus musculus
agcatttgcttctcgggtgttcccc

SEQ ID NO: 529322 - DNA, 25 bp, Mus musculus
agcattttgacgcttttgtggtgga

SEQ ID NO: 529323 - DNA, 25 bp, Mus musculus
agcattttgacggttttgtggtgga

SEQ ID NO: 529324 - DNA, 25 bp, Mus musculus
agcattttgtgaagaaggtagaggc

SEQ ID NO: 529325 - DNA, 25 bp, Mus musculus
agcattttgtgatgaaggtagaggc

SEQ ID NO: 529326 - DNA, 25 bp, Mus musculus
agcattttgtggcacttgaagtttc

SEQ ID NO: 529327 - DNA, 25 bp, Mus musculus
agcattttgtgggacttgaagtttc

SEQ ID NO: 529328 - DNA, 25 bp, Mus musculus
agccaaacaccaccgggaagcagct

SEQ ID NO: 529329 - DNA, 25 bp, Mus musculus
agccaaacaccagcgggaagcagct

SEQ ID NO: 529330 - DNA, 25 bp, Mus musculus
agccaaacactcacgtgattggata

SEQ ID NO: 529331 - DNA, 25 bp, Mus musculus
agccaaacactctcgtgattggata

SEQ ID NO: 529332 - DNA, 25 bp, Mus musculus
agccaaacgttcacgggctcgagta

SEQ ID NO: 529333 - DNA, 25 bp, Mus musculus
agccaaacgttctcgggctcgagta

SEQ ID NO: 529334 - DNA, 25 bp, Mus musculus
agccaaactacgctgagagtgtgaa

SEQ ID NO: 529335 - DNA, 25 bp, Mus musculus
agccaaactacggtgagagtgtgaa

SEQ ID NO: 529336 - DNA, 25 bp, Mus musculus
agccaaagagctcgactgcctgcct

SEQ ID NO: 529337 - DNA, 25 bp, Mus musculus
agccaaagagctggactgcctgcct

SEQ ID NO: 529338 - DNA, 25 bp, Mus musculus
agccaaagcagcctcaccatgctgt

SEQ ID NO: 529339 - DNA, 25 bp, Mus musculus
agccaaagcagcgtcaccatgctgt

SEQ ID NO: 529340 - DNA, 25 bp, Mus musculus
agccaaagccagcaggcgccagaga

SEQ ID NO: 529341 - DNA, 25 bp, Mus musculus
agccaaagccaggaggcgccagaga

SEQ ID NO: 529342 - DNA, 25 bp, Mus musculus
agccaaagccatagaggagcagcat

SEQ ID NO: 529343 - DNA, 25 bp, Mus musculus
agccaaagccattgaggagcagcat

SEQ ID NO: 529344 - DNA, 25 bp, Mus musculus
agccaaagctgacatccaggacatc

SEQ ID NO: 529345 - DNA, 25 bp, Mus musculus
agccaaagctgagatccaggacatc

SEQ ID NO: 529346 - DNA, 25 bp, Mus musculus
agccaaaggtgaccgaggactgcct

SEQ ID NO: 529347 - DNA, 25 bp, Mus musculus
agccaaaggtgagcgaggactgcct

SEQ ID NO: 529348 - DNA, 25 bp, Mus musculus
agccaaatcaagagtccttcctgag

SEQ ID NO: 529349 - DNA, 25 bp, Mus musculus
agccaaatcaagtgtccttcctgag

SEQ ID NO: 529350 - DNA, 25 bp, Mus musculus
agccaacatcccagaggtggaggct

SEQ ID NO: 529351 - DNA, 25 bp, Mus musculus
agccaacatccctgaggtggaggct

SEQ ID NO: 529352 - DNA, 25 bp, Mus musculus
agccaaccagcaagcagcatcacaa

SEQ ID NO: 529353 - DNA, 25 bp, Mus musculus
agccaaccagcatgcagcatcacaa

SEQ ID NO: 529354 - DNA, 25 bp, Mus musculus
agccaaccctgcaccaatggaggat

SEQ ID NO: 529355 - DNA, 25 bp, Mus musculus
agccaaccctgctccaatggaggat

SEQ ID NO: 529356 - DNA, 25 bp, Mus musculus
agccaacctcgcaggcccagtggct

SEQ ID NO: 529357 - DNA, 25 bp, Mus musculus
agccaacctcgctggcccagtggct

SEQ ID NO: 529358 - DNA, 25 bp, Mus musculus
agccaacgagacaggagactgggct

SEQ ID NO: 529359 - DNA, 25 bp, Mus musculus
agccaacgagactggagactgggct

SEQ ID NO: 529360 - DNA, 25 bp, Mus musculus
agccaactgaagcatcatctgcgga

SEQ ID NO: 529361 - DNA, 25 bp, Mus musculus
agccaactgaaggatcatctgcgga

SEQ ID NO: 529362 - DNA, 25 bp, Mus musculus
agccaactggccacaagaaagtgga

SEQ ID NO: 529363 - DNA, 25 bp, Mus musculus
agccaactggcctcaagaaagtgga

SEQ ID NO: 529364 - DNA, 25 bp, Mus musculus
agccaagaatgaatttgcagccaag

SEQ ID NO: 529365 - DNA, 25 bp, Mus musculus
agccaagaatgattttgcagccaag

SEQ ID NO: 529366 - DNA, 25 bp, Mus musculus
agccaagagtgaagcccagaaacaa

SEQ ID NO: 529367 - DNA, 25 bp, Mus musculus
agccaagagtgatgcccagaaacaa

SEQ ID NO: 529368 - DNA, 25 bp, Mus musculus
agccaagcaccgacagacgggccag

SEQ ID NO: 529369 - DNA, 25 bp, Mus musculus
agccaagcaccgtcagacgggccag

SEQ ID NO: 529370 - DNA, 25 bp, Mus musculus
agccaagcccaacgtacctgagctg

SEQ ID NO: 529371 - DNA, 25 bp, Mus musculus
agccaagcccaaggtacctgagctg

SEQ ID NO: 529372 - DNA, 25 bp, Mus musculus
agccaagccgctagcattatctccg

SEQ ID NO: 529373 - DNA, 25 bp, Mus musculus
agccaagccgcttgcattatctccg

SEQ ID NO: 529374 - DNA, 25 bp, Mus musculus
agccaagcctttatctaccgcccag

SEQ ID NO: 529375 - DNA, 25 bp, Mus musculus
agccaagcctttttctaccgcccag

SEQ ID NO: 529376 - DNA, 25 bp, Mus musculus
agccaagcgcttcagctgtcactga

SEQ ID NO: 529377 - DNA, 25 bp, Mus musculus
agccaagcgcttgagctgtcactga

SEQ ID NO: 529378 - DNA, 25 bp, Mus musculus
agccaagctgctcaacgtgggcttc

SEQ ID NO: 529379 - DNA, 25 bp, Mus musculus
agccaagctgctgaacgtgggcttc

SEQ ID NO: 529380 - DNA, 25 bp, Mus musculus
agccaaggactcaacgcttttcgag

SEQ ID NO: 529381 - DNA, 25 bp, Mus musculus
agccaaggactctacgcttttcgag

SEQ ID NO: 529382 - DNA, 25 bp, Mus musculus
agccaaggccgcaggactcggatac

SEQ ID NO: 529383 - DNA, 25 bp, Mus musculus
agccaaggccgctggactcggatac

SEQ ID NO: 529384 - DNA, 25 bp, Mus musculus
agccaaggcttcacccagtcctaag

SEQ ID NO: 529385 - DNA, 25 bp, Mus musculus
agccaaggcttctcccagtcctaag

SEQ ID NO: 529386 - DNA, 25 bp, Mus musculus
agccaagggttaaccagcacacaca

SEQ ID NO: 529387 - DNA, 25 bp, Mus musculus
agccaagggttatccagcacacaca

SEQ ID NO: 529388 - DNA, 25 bp, Mus musculus
agccaagtctctcatcaaatcctgg

SEQ ID NO: 529389 - DNA, 25 bp, Mus musculus
agccaagtctctgatcaaatcctgg

SEQ ID NO: 529390 - DNA, 25 bp, Mus musculus
agccaatgataacgatgagaagaaa

SEQ ID NO: 529391 - DNA, 25 bp, Mus musculus
agccaatgataaggatgagaagaaa

SEQ ID NO: 529392 - DNA, 25 bp, Mus musculus
agccacacaataccccaggctgagg

SEQ ID NO: 529393 - DNA, 25 bp, Mus musculus
agccacacaatagcccaggctgagg

SEQ ID NO: 529394 - DNA, 25 bp, Mus musculus
agccacacctagagtccgactgtca

SEQ ID NO: 529395 - DNA, 25 bp, Mus musculus
agccacacctagtgtccgactgtca

SEQ ID NO: 529396 - DNA, 25 bp, Mus musculus
agccacagacatcgaaggcaatccc

SEQ ID NO: 529397 - DNA, 25 bp, Mus musculus
agccacagacatggaaggcaatccc

SEQ ID NO: 529398 - DNA, 25 bp, Mus musculus
agccacagacccctgtccgggagga

SEQ ID NO: 529399 - DNA, 25 bp, Mus musculus
agccacagacccgtgtccgggagga

SEQ ID NO: 529400 - DNA, 25 bp, Mus musculus
agccacagagcgcacgcgatgcaac

SEQ ID NO: 529401 - DNA, 25 bp, Mus musculus
agccacagagcggacgcgatgcaac

SEQ ID NO: 529402 - DNA, 25 bp, Mus musculus
agccacagcagtcccagaagctggg

SEQ ID NO: 529403 - DNA, 25 bp, Mus musculus
agccacagcagtgccagaagctggg

SEQ ID NO: 529404 - DNA, 25 bp, Mus musculus
agccacagccagaattgcaggagcc

SEQ ID NO: 529405 - DNA, 25 bp, Mus musculus
agccacagccagtattgcaggagcc

SEQ ID NO: 529406 - DNA, 25 bp, Mus musculus
agccacaggaccagtgtactgcccg

SEQ ID NO: 529407 - DNA, 25 bp, Mus musculus
agccacaggacctgtgtactgcccg

SEQ ID NO: 529408 - DNA, 25 bp, Mus musculus
agccacagtcagcagcaccgggtca

SEQ ID NO: 529409 - DNA, 25 bp, Mus musculus
agccacagtcaggagcaccgggtca

SEQ ID NO: 529410 - DNA, 25 bp, Mus musculus
agccacagtgtgagcgctggaaatc

SEQ ID NO: 529411 - DNA, 25 bp, Mus musculus
agccacagtgtgtgcgctggaaatc

SEQ ID NO: 529412 - DNA, 25 bp, Mus musculus
agccacatctccattgccaattcaa

SEQ ID NO: 529413 - DNA, 25 bp, Mus musculus
agccacatctcctttgccaattcaa

SEQ ID NO: 529414 - DNA, 25 bp, Mus musculus
agccacatgatcaagctgcacggag

SEQ ID NO: 529415 - DNA, 25 bp, Mus musculus
agccacatgatctagctgcacggag

SEQ ID NO: 529416 - DNA, 25 bp, Mus musculus
agccacatggtaagaggttcctgtc

SEQ ID NO: 529417 - DNA, 25 bp, Mus musculus
agccacatggtatgaggttcctgtc

SEQ ID NO: 529418 - DNA, 25 bp, Mus musculus
agccaccatgctcctactcttgttg

SEQ ID NO: 529419 - DNA, 25 bp, Mus musculus
agccaccatgctgctactcttgttg

SEQ ID NO: 529420 - DNA, 25 bp, Mus musculus
agccaccattgcagtgctcttcttt

SEQ ID NO: 529421 - DNA, 25 bp, Mus musculus
agccaccattgctgtgctcttcttt

SEQ ID NO: 529422 - DNA, 25 bp, Mus musculus
agccacccactgaggctgagtacac

SEQ ID NO: 529423 - DNA, 25 bp, Mus musculus
agccacccactgtggctgagtacac

SEQ ID NO: 529424 - DNA, 25 bp, Mus musculus
agccacccagagaccaattccaatg

SEQ ID NO: 529425 - DNA, 25 bp, Mus musculus
agccacccagagtccaattccaatg

SEQ ID NO: 529426 - DNA, 25 bp, Mus musculus
agccacccataaccccaagaggaga

SEQ ID NO: 529427 - DNA, 25 bp, Mus musculus
agccacccataagcccaagaggaga

SEQ ID NO: 529428 - DNA, 25 bp, Mus musculus
agccacccatgacgaacatcacgga

SEQ ID NO: 529429 - DNA, 25 bp, Mus musculus
agccacccatgaggaacatcacgga

SEQ ID NO: 529430 - DNA, 25 bp, Mus musculus
agccacccggaacgcctatggactg

SEQ ID NO: 529431 - DNA, 25 bp, Mus musculus
agccacccggaaggcctatggactg

SEQ ID NO: 529432 - DNA, 25 bp, Mus musculus
agccaccctgggatcctgtagccaa

SEQ ID NO: 529433 - DNA, 25 bp, Mus musculus
agccaccctgggttcctgtagccaa

SEQ ID NO: 529434 - DNA, 25 bp, Mus musculus
agccaccgtcggcatagacttcagg

SEQ ID NO: 529435 - DNA, 25 bp, Mus musculus
agccaccgtcgggatagacttcagg

SEQ ID NO: 529436 - DNA, 25 bp, Mus musculus
agccaccgtgggaatcggattcaca

SEQ ID NO: 529437 - DNA, 25 bp, Mus musculus
agccaccgtgggtatcggattcaca

SEQ ID NO: 529438 - DNA, 25 bp, Mus musculus
agccacctgaagcatgccctggaaa

SEQ ID NO: 529439 - DNA, 25 bp, Mus musculus
agccacctgaaggatgccctggaaa

SEQ ID NO: 529440 - DNA, 25 bp, Mus musculus
agccacctgtccagactcggagaag

SEQ ID NO: 529441 - DNA, 25 bp, Mus musculus
agccacctgtcctgactcggagaag

SEQ ID NO: 529442 - DNA, 25 bp, Mus musculus
agccaccttggtattgccttggaga

SEQ ID NO: 529443 - DNA, 25 bp, Mus musculus
agccaccttggttttgccttggaga

SEQ ID NO: 529444 - DNA, 25 bp, Mus musculus
agccacctttgacaaacacggagag

SEQ ID NO: 529445 - DNA, 25 bp, Mus musculus
agccacctttgagaaacacggagag

SEQ ID NO: 529446 - DNA, 25 bp, Mus musculus
agccacgctggacgcccacaagaga

SEQ ID NO: 529447 - DNA, 25 bp, Mus musculus
agccacgctggaggcccacaagaga

SEQ ID NO: 529448 - DNA, 25 bp, Mus musculus
agccacggtgtgatcgccgagcgct

SEQ ID NO: 529449 - DNA, 25 bp, Mus musculus
agccacggtgtgttcgccgagcgct

SEQ ID NO: 529450 - DNA, 25 bp, Mus musculus
agccacgtctccagtctgagtcact

SEQ ID NO: 529451 - DNA, 25 bp, Mus musculus
agccacgtctcctgtctgagtcact

SEQ ID NO: 529452 - DNA, 25 bp, Mus musculus
agccacgtctgtatcagcgccagcg

SEQ ID NO: 529453 - DNA, 25 bp, Mus musculus
agccacgtctgtttcagcgccagcg

SEQ ID NO: 529454 - DNA, 25 bp, Mus musculus
agccacgtgcacagccaagaacgca

SEQ ID NO: 529455 - DNA, 25 bp, Mus musculus
agccacgtgcactgccaagaacgca

SEQ ID NO: 529456 - DNA, 25 bp, Mus musculus
agccacgtggcgcaccaaatgattg

SEQ ID NO: 529457 - DNA, 25 bp, Mus musculus
agccacgtggcggaccaaatgattg

SEQ ID NO: 529458 - DNA, 25 bp, Mus musculus
agccacgtgggaagcaagaaatgcc

SEQ ID NO: 529459 - DNA, 25 bp, Mus musculus
agccacgtgggatgcaagaaatgcc

SEQ ID NO: 529460 - DNA, 25 bp, Mus musculus
agccactcagcacgcatgcatgttg

SEQ ID NO: 529461 - DNA, 25 bp, Mus musculus
agccactcagcaggcatgcatgttg

SEQ ID NO: 529462 - DNA, 25 bp, Mus musculus
agccactcggacctgaccagtacaa

SEQ ID NO: 529463 - DNA, 25 bp, Mus musculus
agccactcggacgtgaccagtacaa

SEQ ID NO: 529464 - DNA, 25 bp, Mus musculus
agccactgcccactgagcaatacgg

SEQ ID NO: 529465 - DNA, 25 bp, Mus musculus
agccactgcccagtgagcaatacgg

SEQ ID NO: 529466 - DNA, 25 bp, Mus musculus
agccactgcccgaagcaagaaaaat

SEQ ID NO: 529467 - DNA, 25 bp, Mus musculus
agccactgcccgtagcaagaaaaat

SEQ ID NO: 529468 - DNA, 25 bp, Mus musculus
agccactggagacggcacacgctag

SEQ ID NO: 529469 - DNA, 25 bp, Mus musculus
agccactggagagggcacacgctag

SEQ ID NO: 529470 - DNA, 25 bp, Mus musculus
agccactgtgccagcgggcactgga

SEQ ID NO: 529471 - DNA, 25 bp, Mus musculus
agccactgtgcctgcgggcactgga

SEQ ID NO: 529472 - DNA, 25 bp, Mus musculus
agccactttctacactgcagccagg

SEQ ID NO: 529473 - DNA, 25 bp, Mus musculus
agccactttctagactgcagccagg

SEQ ID NO: 529474 - DNA, 25 bp, Mus musculus
agccactttctgcagctcttcgatc

SEQ ID NO: 529475 - DNA, 25 bp, Mus musculus
agccactttctggagctcttcgatc

SEQ ID NO: 529476 - DNA, 25 bp, Mus musculus
agccactttgtgctgaagccccaga

SEQ ID NO: 529477 - DNA, 25 bp, Mus musculus
agccactttgtggtgaagccccaga

SEQ ID NO: 529478 - DNA, 25 bp, Mus musculus
agccagaaaacaatctcttggactg

SEQ ID NO: 529479 - DNA, 25 bp, Mus musculus
agccagaaaacattctcttggactg

SEQ ID NO: 529480 - DNA, 25 bp, Mus musculus
agccagaaatcaatcttcaagatcc

SEQ ID NO: 529481 - DNA, 25 bp, Mus musculus
agccagaaatcattcttcaagatcc

SEQ ID NO: 529482 - DNA, 25 bp, Mus musculus
agccagaacaagaactacaattgtg

SEQ ID NO: 529483 - DNA, 25 bp, Mus musculus
agccagaacaagtactacaattgtg

SEQ ID NO: 529484 - DNA, 25 bp, Mus musculus
agccagaatggccaccctggtccaa

SEQ ID NO: 529485 - DNA, 25 bp, Mus musculus
agccagaatggcgaccctggtccaa

SEQ ID NO: 529486 - DNA, 25 bp, Mus musculus
agccagaattctcggctcattaacc

SEQ ID NO: 529487 - DNA, 25 bp, Mus musculus
agccagaattctgggctcattaacc

SEQ ID NO: 529488 - DNA, 25 bp, Mus musculus
agccagacacctaactcgacaactt

SEQ ID NO: 529489 - DNA, 25 bp, Mus musculus
agccagacaccttactcgacaactt

SEQ ID NO: 529490 - DNA, 25 bp, Mus musculus
agccagacagcaaagctaccagaac

SEQ ID NO: 529491 - DNA, 25 bp, Mus musculus
agccagacagcatagctaccagaac

SEQ ID NO: 529492 - DNA, 25 bp, Mus musculus
agccagagaaacctccccggagtgc

SEQ ID NO: 529493 - DNA, 25 bp, Mus musculus
agccagagaaacgtccccggagtgc

SEQ ID NO: 529494 - DNA, 25 bp, Mus musculus
agccagagacagaagcccggaggac

SEQ ID NO: 529495 - DNA, 25 bp, Mus musculus
agccagagacagtagcccggaggac

SEQ ID NO: 529496 - DNA, 25 bp, Mus musculus
agccagagcagccattcatatgatg

SEQ ID NO: 529497 - DNA, 25 bp, Mus musculus
agccagagcagcgattcatatgatg

SEQ ID NO: 529498 - DNA, 25 bp, Mus musculus
agccagagcaggaagccgtttcaag

SEQ ID NO: 529499 - DNA, 25 bp, Mus musculus
agccagagcaggtagccgtttcaag

SEQ ID NO: 529500 - DNA, 25 bp, Mus musculus
agccagagccgtatggaggctgcca

SEQ ID NO: 529501 - DNA, 25 bp, Mus musculus
agccagagccgtttggaggctgcca

SEQ ID NO: 529502 - DNA, 25 bp, Mus musculus
agccagagcctgacatgatcaccat

SEQ ID NO: 529503 - DNA, 25 bp, Mus musculus
agccagagcctgtcatgatcaccat

SEQ ID NO: 529504 - DNA, 25 bp, Mus musculus
agccagatataaattactgaagggc

SEQ ID NO: 529505 - DNA, 25 bp, Mus musculus
agccagatataatttactgaagggc

SEQ ID NO: 529506 - DNA, 25 bp, Mus musculus
agccagatatggaagttcacacctg

SEQ ID NO: 529507 - DNA, 25 bp, Mus musculus
agccagatatggtagttcacacctg

SEQ ID NO: 529508 - DNA, 25 bp, Mus musculus
agccagatgttcatcatgatgacac

SEQ ID NO: 529509 - DNA, 25 bp, Mus musculus
agccagatgttcttcatgatgacac

SEQ ID NO: 529510 - DNA, 25 bp, Mus musculus
agccagcagactatggacctgggcc

SEQ ID NO: 529511 - DNA, 25 bp, Mus musculus
agccagcagactttggacctgggcc

SEQ ID NO: 529512 - DNA, 25 bp, Mus musculus
agccagcagaggaatgacagccact

SEQ ID NO: 529513 - DNA, 25 bp, Mus musculus
agccagcagaggtatgacagccact

SEQ ID NO: 529514 - DNA, 25 bp, Mus musculus
agccagcagagtaggctgtgtctgt

SEQ ID NO: 529515 - DNA, 25 bp, Mus musculus
agccagcagagttggctgtgtctgt

SEQ ID NO: 529516 - DNA, 25 bp, Mus musculus
agccagcagctccacgagagctagg

SEQ ID NO: 529517 - DNA, 25 bp, Mus musculus
agccagcagctcgacgagagctagg

SEQ ID NO: 529518 - DNA, 25 bp, Mus musculus
agccagcagtttctaatgtcaccga

SEQ ID NO: 529519 - DNA, 25 bp, Mus musculus
agccagcagtttgtaatgtcaccga

SEQ ID NO: 529520 - DNA, 25 bp, Mus musculus
agccagccaatgaccatgggctacc

SEQ ID NO: 529521 - DNA, 25 bp, Mus musculus
agccagccaatgtccatgggctacc

SEQ ID NO: 529522 - DNA, 25 bp, Mus musculus
agccagccatacaagagctgttcag

SEQ ID NO: 529523 - DNA, 25 bp, Mus musculus
agccagccatactagagctgttcag

SEQ ID NO: 529524 - DNA, 25 bp, Mus musculus
agccagcccacactctctccttttg

SEQ ID NO: 529525 - DNA, 25 bp, Mus musculus
agccagcccacagtctctccttttg

SEQ ID NO: 529526 - DNA, 25 bp, Mus musculus
agccagcccagacaggacgctgagt

SEQ ID NO: 529527 - DNA, 25 bp, Mus musculus
agccagcccagagaggacgctgagt

SEQ ID NO: 529528 - DNA, 25 bp, Mus musculus
agccagcccagccacagaaacggtg

SEQ ID NO: 529529 - DNA, 25 bp, Mus musculus
agccagcccagcgacagaaacggtg

SEQ ID NO: 529530 - DNA, 25 bp, Mus musculus
agccagccctacacatttgatatca

SEQ ID NO: 529531 - DNA, 25 bp, Mus musculus
agccagccctactcatttgatatca

SEQ ID NO: 529532 - DNA, 25 bp, Mus musculus
agccagccctggctgcgggttctct

SEQ ID NO: 529533 - DNA, 25 bp, Mus musculus
agccagccctgggtgcgggttctct

SEQ ID NO: 529534 - DNA, 25 bp, Mus musculus
agccagcgaacaacctgctggatgc

SEQ ID NO: 529535 - DNA, 25 bp, Mus musculus
agccagcgaacatcctgctggatgc

SEQ ID NO: 529536 - DNA, 25 bp, Mus musculus
agccagcgagcgagacagacacgga

SEQ ID NO: 529537 - DNA, 25 bp, Mus musculus
agccagcgagcgtgacagacacgga

SEQ ID NO: 529538 - DNA, 25 bp, Mus musculus
agccagcgttcaacctgagctccat

SEQ ID NO: 529539 - DNA, 25 bp, Mus musculus
agccagcgttcatcctgagctccat

SEQ ID NO: 529540 - DNA, 25 bp, Mus musculus
agccagctacccatactaatttatg

SEQ ID NO: 529541 - DNA, 25 bp, Mus musculus
agccagctacccttactaatttatg

SEQ ID NO: 529542 - DNA, 25 bp, Mus musculus
agccagctataaccagcgctcttct

SEQ ID NO: 529543 - DNA, 25 bp, Mus musculus
agccagctataagcagcgctcttct

SEQ ID NO: 529544 - DNA, 25 bp, Mus musculus
agccagctataccagagaatccacc

SEQ ID NO: 529545 - DNA, 25 bp, Mus musculus
agccagctatacgagagaatccacc

SEQ ID NO: 529546 - DNA, 25 bp, Mus musculus
agccagctctgcctgaaggtaccga

SEQ ID NO: 529547 - DNA, 25 bp, Mus musculus
agccagctctgcgtgaaggtaccga

SEQ ID NO: 529548 - DNA, 25 bp, Mus musculus
agccagctgctcaccctttatgact

SEQ ID NO: 529549 - DNA, 25 bp, Mus musculus
agccagctgctcaggcagctggacc

SEQ ID NO: 529550 - DNA, 25 bp, Mus musculus
agccagctgctctccctttatgact

SEQ ID NO: 529551 - DNA, 25 bp, Mus musculus
agccagctgctctggcagctggacc

SEQ ID NO: 529552 - DNA, 25 bp, Mus musculus
agccagctgggcatcattcagacac

SEQ ID NO: 529553 - DNA, 25 bp, Mus musculus
agccagctgggcttcattcagacac

SEQ ID NO: 529554 - DNA, 25 bp, Mus musculus
agccaggaacttctacagcaccagg

SEQ ID NO: 529555 - DNA, 25 bp, Mus musculus
agccaggaacttgtacagcaccagg

SEQ ID NO: 529556 - DNA, 25 bp, Mus musculus
agccaggaagcaccaaggtcttgag

SEQ ID NO: 529557 - DNA, 25 bp, Mus musculus
agccaggaagcagcaaggtcttgag

SEQ ID NO: 529558 - DNA, 25 bp, Mus musculus
agccaggaagtgccacacaggcccg

SEQ ID NO: 529559 - DNA, 25 bp, Mus musculus
agccaggaagtggcacacaggcccg

SEQ ID NO: 529560 - DNA, 25 bp, Mus musculus
agccaggacaacaatgccacagcca

SEQ ID NO: 529561 - DNA, 25 bp, Mus musculus
agccaggacaactatgccacagcca

SEQ ID NO: 529562 - DNA, 25 bp, Mus musculus
agccaggactccagcatgccttatg

SEQ ID NO: 529563 - DNA, 25 bp, Mus musculus
agccaggactcctgcatgccttatg

SEQ ID NO: 529564 - DNA, 25 bp, Mus musculus
agccaggagccaagccctgtgggtt

SEQ ID NO: 529565 - DNA, 25 bp, Mus musculus
agccaggagccatgccctgtgggtt

SEQ ID NO: 529566 - DNA, 25 bp, Mus musculus
agccaggagcgacccaaggataccc

SEQ ID NO: 529567 - DNA, 25 bp, Mus musculus
agccaggagcgagccaaggataccc

SEQ ID NO: 529568 - DNA, 25 bp, Mus musculus
agccaggagctgagaaagtcccagc

SEQ ID NO: 529569 - DNA, 25 bp, Mus musculus
agccaggagctgtgaaagtcccagc

SEQ ID NO: 529570 - DNA, 25 bp, Mus musculus
agccaggaggccacgctcactgtgg

SEQ ID NO: 529571 - DNA, 25 bp, Mus musculus
agccaggaggcctcgctcactgtgg

SEQ ID NO: 529572 - DNA, 25 bp, Mus musculus
agccaggagtgccagaccaatcgct

SEQ ID NO: 529573 - DNA, 25 bp, Mus musculus
agccaggagtgcgagaccaatcgct

SEQ ID NO: 529574 - DNA, 25 bp, Mus musculus
agccaggatggcaatacctacccct

SEQ ID NO: 529575 - DNA, 25 bp, Mus musculus
agccaggatggctatacctacccct

SEQ ID NO: 529576 - DNA, 25 bp, Mus musculus
agccaggcaccaaggacactcctgt

SEQ ID NO: 529577 - DNA, 25 bp, Mus musculus
agccaggcaccatggacactcctgt

SEQ ID NO: 529578 - DNA, 25 bp, Mus musculus
agccaggcactgagtaccgtctcac

SEQ ID NO: 529579 - DNA, 25 bp, Mus musculus
agccaggcactgtgtaccgtctcac

SEQ ID NO: 529580 - DNA, 25 bp, Mus musculus
agccaggcccggatctgccatggcg

SEQ ID NO: 529581 - DNA, 25 bp, Mus musculus
agccaggcccggttctgccatggcg

SEQ ID NO: 529582 - DNA, 25 bp, Mus musculus
agccaggcggctaccatctgcaggt

SEQ ID NO: 529583 - DNA, 25 bp, Mus musculus
agccaggcggcttccatctgcaggt

SEQ ID NO: 529584 - DNA, 25 bp, Mus musculus
agccaggctgcgcagcacttctttg

SEQ ID NO: 529585 - DNA, 25 bp, Mus musculus
agccaggctgcgcttgttgcgccac

SEQ ID NO: 529586 - DNA, 25 bp, Mus musculus
agccaggctgcggagcacttctttg

SEQ ID NO: 529587 - DNA, 25 bp, Mus musculus
agccaggctgcggttgttgcgccac

SEQ ID NO: 529588 - DNA, 25 bp, Mus musculus
agccaggcttctcggtaccaccggg

SEQ ID NO: 529589 - DNA, 25 bp, Mus musculus
agccaggcttctgggtaccaccggg

SEQ ID NO: 529590 - DNA, 25 bp, Mus musculus
agccagggagcgcatcagtcttctg

SEQ ID NO: 529591 - DNA, 25 bp, Mus musculus
agccagggagcggatcagtcttctg

SEQ ID NO: 529592 - DNA, 25 bp, Mus musculus
agccagggcagaccatataaggtga

SEQ ID NO: 529593 - DNA, 25 bp, Mus musculus
agccagggcagagcatataaggtga

SEQ ID NO: 529594 - DNA, 25 bp, Mus musculus
agccagggcctgctttgtcagcctg

SEQ ID NO: 529595 - DNA, 25 bp, Mus musculus
agccagggcctggtttgtcagcctg

SEQ ID NO: 529596 - DNA, 25 bp, Mus musculus
agccagggctgacatggcaattcac

SEQ ID NO: 529597 - DNA, 25 bp, Mus musculus
agccagggctgagatggcaattcac

SEQ ID NO: 529598 - DNA, 25 bp, Mus musculus
agccaggtccttaccatcaatcctg

SEQ ID NO: 529599 - DNA, 25 bp, Mus musculus
agccaggtcctttccatcaatcctg

SEQ ID NO: 529600 - DNA, 25 bp, Mus musculus
agccaggtgacaaaggctcagctgg

SEQ ID NO: 529601 - DNA, 25 bp, Mus musculus
agccaggtgacataggctcagctgg

SEQ ID NO: 529602 - DNA, 25 bp, Mus musculus
agccagtacctgcacgagacgtgca

SEQ ID NO: 529603 - DNA, 25 bp, Mus musculus
agccagtacctggacgagacgtgca

SEQ ID NO: 529604 - DNA, 25 bp, Mus musculus
agccagtcatcaagaaacccctcaa

SEQ ID NO: 529605 - DNA, 25 bp, Mus musculus
agccagtcatcatgaaacccctcaa

SEQ ID NO: 529606 - DNA, 25 bp, Mus musculus
agccagtcgctacctctgggcactg

SEQ ID NO: 529607 - DNA, 25 bp, Mus musculus
agccagtcgctagctctgggcactg

SEQ ID NO: 529608 - DNA, 25 bp, Mus musculus
agccagtgatgacatcgcccagcat

SEQ ID NO: 529609 - DNA, 25 bp, Mus musculus
agccagtgatgagatcgcccagcat

SEQ ID NO: 529610 - DNA, 25 bp, Mus musculus
agccagtgcaccctacacataaaat

SEQ ID NO: 529611 - DNA, 25 bp, Mus musculus
agccagtgcaccgtacacataaaat

SEQ ID NO: 529612 - DNA, 25 bp, Mus musculus
agccagtgccccattattgaccctg

SEQ ID NO: 529613 - DNA, 25 bp, Mus musculus
agccagtgcccctttattgaccctg

SEQ ID NO: 529614 - DNA, 25 bp, Mus musculus
agccagtggtggcaggcaccctgag

SEQ ID NO: 529615 - DNA, 25 bp, Mus musculus
agccagtggtgggaggcaccctgag

SEQ ID NO: 529616 - DNA, 25 bp, Mus musculus
agccagttcgcgacgactgaccaga

SEQ ID NO: 529617 - DNA, 25 bp, Mus musculus
agccagttcgcgtcgactgaccaga

SEQ ID NO: 529618 - DNA, 25 bp, Mus musculus
agccagttgagtatagcggttcaca

SEQ ID NO: 529619 - DNA, 25 bp, Mus musculus
agccagttgagtttagcggttcaca

SEQ ID NO: 529620 - DNA, 25 bp, Mus musculus
agccagttgctgagccagaaacatg

SEQ ID NO: 529621 - DNA, 25 bp, Mus musculus
agccagttgctgtgccagaaacatg

SEQ ID NO: 529622 - DNA, 25 bp, Mus musculus
agccatataagtcaaaatcgtgaag

SEQ ID NO: 529623 - DNA, 25 bp, Mus musculus
agccatataagtgaaaatcgtgaag

SEQ ID NO: 529624 - DNA, 25 bp, Mus musculus
agccatatgggcagctcccaggcac

SEQ ID NO: 529625 - DNA, 25 bp, Mus musculus
agccatatgggctgctcccaggcac

SEQ ID NO: 529626 - DNA, 25 bp, Mus musculus
agccatcagctgacaccgtaggaga

SEQ ID NO: 529627 - DNA, 25 bp, Mus musculus
agccatcagctgtcaccgtaggaga

SEQ ID NO: 529628 - DNA, 25 bp, Mus musculus
agccatcaggaaagcagccctgcca

SEQ ID NO: 529629 - DNA, 25 bp, Mus musculus
agccatcaggaatgcagccctgcca

SEQ ID NO: 529630 - DNA, 25 bp, Mus musculus
agccatcagggcactctgcagaatc

SEQ ID NO: 529631 - DNA, 25 bp, Mus musculus
agccatcagggctctctgcagaatc

SEQ ID NO: 529632 - DNA, 25 bp, Mus musculus
agccatcatccacgaagcccttgag

SEQ ID NO: 529633 - DNA, 25 bp, Mus musculus
agccatcatccaggaagcccttgag

SEQ ID NO: 529634 - DNA, 25 bp, Mus musculus
agccatcatgctccgggaggaagcc

SEQ ID NO: 529635 - DNA, 25 bp, Mus musculus
agccatcatgctgcgggaggaagcc

SEQ ID NO: 529636 - DNA, 25 bp, Mus musculus
agccatcgagagagccaagcaggtc

SEQ ID NO: 529637 - DNA, 25 bp, Mus musculus
agccatcgagagtgccaagcaggtc

SEQ ID NO: 529638 - DNA, 25 bp, Mus musculus
agccatcgcacgcaggagaattcgc

SEQ ID NO: 529639 - DNA, 25 bp, Mus musculus
agccatcgcacggaggagaattcgc

SEQ ID NO: 529640 - DNA, 25 bp, Mus musculus
agccatcgggatcccagcggaaaag

SEQ ID NO: 529641 - DNA, 25 bp, Mus musculus
agccatcgggatgccagcggaaaag

SEQ ID NO: 529642 - DNA, 25 bp, Mus musculus
agccatcgtgttctccagcgcgaac

SEQ ID NO: 529643 - DNA, 25 bp, Mus musculus
agccatcgtgttgtccagcgcgaac

SEQ ID NO: 529644 - DNA, 25 bp, Mus musculus
agccatcgttacaagtccttgcaga

SEQ ID NO: 529645 - DNA, 25 bp, Mus musculus
agccatcgttactagtccttgcaga

SEQ ID NO: 529646 - DNA, 25 bp, Mus musculus
agccatcttctaagctgtggaccag

SEQ ID NO: 529647 - DNA, 25 bp, Mus musculus
agccatcttctatgctgtggaccag

SEQ ID NO: 529648 - DNA, 25 bp, Mus musculus
agccatgaccagccgcagacagtat

SEQ ID NO: 529649 - DNA, 25 bp, Mus musculus
agccatgaccaggcgcagacagtat

SEQ ID NO: 529650 - DNA, 25 bp, Mus musculus
agccatgacgagcactctggacctg

SEQ ID NO: 529651 - DNA, 25 bp, Mus musculus
agccatgacgaggactctggacctg

SEQ ID NO: 529652 - DNA, 25 bp, Mus musculus
agccatgacggaagtgcaccggcgc

SEQ ID NO: 529653 - DNA, 25 bp, Mus musculus
agccatgacggatgtgcaccggcgc

SEQ ID NO: 529654 - DNA, 25 bp, Mus musculus
agccatgagttaagccgtgtagcca

SEQ ID NO: 529655 - DNA, 25 bp, Mus musculus
agccatgagttatgccgtgtagcca

SEQ ID NO: 529656 - DNA, 25 bp, Mus musculus
agccatgatctgagccggcttcctc

SEQ ID NO: 529657 - DNA, 25 bp, Mus musculus
agccatgatctgtgccggcttcctc

SEQ ID NO: 529658 - DNA, 25 bp, Mus musculus
agccatgcacagactgtggttcttt

SEQ ID NO: 529659 - DNA, 25 bp, Mus musculus
agccatgcacagtctgtggttcttt

SEQ ID NO: 529660 - DNA, 25 bp, Mus musculus
agccatggactgacaccctttggga

SEQ ID NO: 529661 - DNA, 25 bp, Mus musculus
agccatggactgtcaccctttggga

SEQ ID NO: 529662 - DNA, 25 bp, Mus musculus
agccatggcactcaaggtcctacct

SEQ ID NO: 529663 - DNA, 25 bp, Mus musculus
agccatggcactgaaggtcctacct

SEQ ID NO: 529664 - DNA, 25 bp, Mus musculus
agccatggcccgaaagatccgaatg

SEQ ID NO: 529665 - DNA, 25 bp, Mus musculus
agccatggcccgtaagatccgaatg

SEQ ID NO: 529666 - DNA, 25 bp, Mus musculus
agccatggctgccatccgaaagaag

SEQ ID NO: 529667 - DNA, 25 bp, Mus musculus
agccatggctgcgatccgaaagaag

SEQ ID NO: 529668 - DNA, 25 bp, Mus musculus
agccatgggcctcggttgagatcag

SEQ ID NO: 529669 - DNA, 25 bp, Mus musculus
agccatgggcctgggttgagatcag

SEQ ID NO: 529670 - DNA, 25 bp, Mus musculus
agccatgtctggagaccctaactac

SEQ ID NO: 529671 - DNA, 25 bp, Mus musculus
agccatgtctggtgaccctaactac

SEQ ID NO: 529672 - DNA, 25 bp, Mus musculus
agccatgtgagtacccctctgacct

SEQ ID NO: 529673 - DNA, 25 bp, Mus musculus
agccatgtgagttcccctctgacct

SEQ ID NO: 529674 - DNA, 25 bp, Mus musculus
agccatgttcataaactatgagcag

SEQ ID NO: 529675 - DNA, 25 bp, Mus musculus
agccatgttcattaactatgagcag

SEQ ID NO: 529676 - DNA, 25 bp, Mus musculus
agccattaccatcggcgggcacggt

SEQ ID NO: 529677 - DNA, 25 bp, Mus musculus
agccattaccatgggcgggcacggt

SEQ ID NO: 529678 - DNA, 25 bp, Mus musculus
agccattactgcagaagaatgggaa

SEQ ID NO: 529679 - DNA, 25 bp, Mus musculus
agccattactgctgaagaatgggaa

SEQ ID NO: 529680 - DNA, 25 bp, Mus musculus
agccattagttccacacctgcagag

SEQ ID NO: 529681 - DNA, 25 bp, Mus musculus
agccattagttcgacacctgcagag

SEQ ID NO: 529682 - DNA, 25 bp, Mus musculus
agccattcagcgaggaggccacact

SEQ ID NO: 529683 - DNA, 25 bp, Mus musculus
agccattcagcgtggaggccacact

SEQ ID NO: 529684 - DNA, 25 bp, Mus musculus
agccattcggcaaccagcctgacaa

SEQ ID NO: 529685 - DNA, 25 bp, Mus musculus
agccattcggcatccagcctgacaa

SEQ ID NO: 529686 - DNA, 25 bp, Mus musculus
agccattgagaacctgctgtccagt

SEQ ID NO: 529687 - DNA, 25 bp, Mus musculus
agccattgagaagctgctgtccagt

SEQ ID NO: 529688 - DNA, 25 bp, Mus musculus
agccattgccgaaggcatctcagag

SEQ ID NO: 529689 - DNA, 25 bp, Mus musculus
agccattgccgatggcatctcagag

SEQ ID NO: 529690 - DNA, 25 bp, Mus musculus
agccattgtggtagctgtcattatg

SEQ ID NO: 529691 - DNA, 25 bp, Mus musculus
agccattgtggttgctgtcattatg

SEQ ID NO: 529692 - DNA, 25 bp, Mus musculus
agccattgttcaaaagataaaacca

SEQ ID NO: 529693 - DNA, 25 bp, Mus musculus
agccattgttcataagataaaacca

SEQ ID NO: 529694 - DNA, 25 bp, Mus musculus
agccatttattgaaactcgccagga

SEQ ID NO: 529695 - DNA, 25 bp, Mus musculus
agccatttattgtaactcgccagga

SEQ ID NO: 529696 - DNA, 25 bp, Mus musculus
agccatttctctcagcactggccgg

SEQ ID NO: 529697 - DNA, 25 bp, Mus musculus
agccatttctctgagcactggccgg

SEQ ID NO: 529698 - DNA, 25 bp, Mus musculus
agcccaaaccaccatggctgggtgg

SEQ ID NO: 529699 - DNA, 25 bp, Mus musculus
agcccaaaccacgatggctgggtgg

SEQ ID NO: 529700 - DNA, 25 bp, Mus musculus
agcccaacaggaagcaaagcaaagg

SEQ ID NO: 529701 - DNA, 25 bp, Mus musculus
agcccaacaggatgcaaagcaaagg

SEQ ID NO: 529702 - DNA, 25 bp, Mus musculus
agcccaactataccgagctgcagga

SEQ ID NO: 529703 - DNA, 25 bp, Mus musculus
agcccaactatagcgagctgcagga

SEQ ID NO: 529704 - DNA, 25 bp, Mus musculus
agcccaagagccagggttctgggca

SEQ ID NO: 529705 - DNA, 25 bp, Mus musculus
agcccaagagcctgggttctgggca

SEQ ID NO: 529706 - DNA, 25 bp, Mus musculus
agcccaagctccaagaggcctgttc

SEQ ID NO: 529707 - DNA, 25 bp, Mus musculus
agcccaagctcctagaggcctgttc

SEQ ID NO: 529708 - DNA, 25 bp, Mus musculus
agcccaagctgcacctgaggtctct

SEQ ID NO: 529709 - DNA, 25 bp, Mus musculus
agcccaagctgctcctgaggtctct

SEQ ID NO: 529710 - DNA, 25 bp, Mus musculus
agcccaaggaggatcccctgatcca

SEQ ID NO: 529711 - DNA, 25 bp, Mus musculus
agcccaaggaggttcccctgatcca

SEQ ID NO: 529712 - DNA, 25 bp, Mus musculus
agcccaaggccaatggccatcgaaa

SEQ ID NO: 529713 - DNA, 25 bp, Mus musculus
agcccaaggccattggccatcgaaa

SEQ ID NO: 529714 - DNA, 25 bp, Mus musculus
agcccaaggtacctgagctgcccaa

SEQ ID NO: 529715 - DNA, 25 bp, Mus musculus
agcccaaggtacgtgagctgcccaa

SEQ ID NO: 529716 - DNA, 25 bp, Mus musculus
agcccacagacgcttttgtgagctg

SEQ ID NO: 529717 - DNA, 25 bp, Mus musculus
agcccacagacggttttgtgagctg

SEQ ID NO: 529718 - DNA, 25 bp, Mus musculus
agcccaccatctcctggaatgtcaa

SEQ ID NO: 529719 - DNA, 25 bp, Mus musculus
agcccaccatctgctggaatgtcaa

SEQ ID NO: 529720 - DNA, 25 bp, Mus musculus
agcccacctcagacatgaatggatg

SEQ ID NO: 529721 - DNA, 25 bp, Mus musculus
agcccacctcagtcatgaatggatg

SEQ ID NO: 529722 - DNA, 25 bp, Mus musculus
agcccacctcggctagtctgtgctg

SEQ ID NO: 529723 - DNA, 25 bp, Mus musculus
agcccacctcgggtagtctgtgctg

SEQ ID NO: 529724 - DNA, 25 bp, Mus musculus
agcccacgcctcagtgactcggcga

SEQ ID NO: 529725 - DNA, 25 bp, Mus musculus
agcccacgcctctgtgactcggcga

SEQ ID NO: 529726 - DNA, 25 bp, Mus musculus
agcccactatgccagacactttcga

SEQ ID NO: 529727 - DNA, 25 bp, Mus musculus
agcccactatgcgagacactttcga

SEQ ID NO: 529728 - DNA, 25 bp, Mus musculus
agcccactccatagggccaagaacg

SEQ ID NO: 529729 - DNA, 25 bp, Mus musculus
agcccactccattgggccaagaacg

SEQ ID NO: 529730 - DNA, 25 bp, Mus musculus
agcccagaccctccctggtggctag

SEQ ID NO: 529731 - DNA, 25 bp, Mus musculus
agcccagaccctgcctggtggctag

SEQ ID NO: 529732 - DNA, 25 bp, Mus musculus
agcccagagctgctagaattcttag

SEQ ID NO: 529733 - DNA, 25 bp, Mus musculus
agcccagagctggtagaattcttag

SEQ ID NO: 529734 - DNA, 25 bp, Mus musculus
agcccagagggacctgacaacctga

SEQ ID NO: 529735 - DNA, 25 bp, Mus musculus
agcccagagggagctgacaacctga

SEQ ID NO: 529736 - DNA, 25 bp, Mus musculus
agcccagcaagaaagcctccaaggg

SEQ ID NO: 529737 - DNA, 25 bp, Mus musculus
agcccagcaagatagcctccaaggg

SEQ ID NO: 529738 - DNA, 25 bp, Mus musculus
agcccagcataaccgacaacatctg

SEQ ID NO: 529739 - DNA, 25 bp, Mus musculus
agcccagcataagcgacaacatctg

SEQ ID NO: 529740 - DNA, 25 bp, Mus musculus
agcccagccacaagcctcatggagg

SEQ ID NO: 529741 - DNA, 25 bp, Mus musculus
agcccagccacatgcctcatggagg

SEQ ID NO: 529742 - DNA, 25 bp, Mus musculus
agcccagcctggaccgtggcaaaag

SEQ ID NO: 529743 - DNA, 25 bp, Mus musculus
agcccagcctggtccgtggcaaaag

SEQ ID NO: 529744 - DNA, 25 bp, Mus musculus
agcccagcggctacttctgtgattg

SEQ ID NO: 529745 - DNA, 25 bp, Mus musculus
agcccagcggcttcttctgtgattg

SEQ ID NO: 529746 - DNA, 25 bp, Mus musculus
agcccagctcctattaggtcccagg

SEQ ID NO: 529747 - DNA, 25 bp, Mus musculus
agcccagctccttttaggtcccagg

SEQ ID NO: 529748 - DNA, 25 bp, Mus musculus
agcccagctgaacaacccacaggtt

SEQ ID NO: 529749 - DNA, 25 bp, Mus musculus
agcccagctgaagaacccacaggtt

SEQ ID NO: 529750 - DNA, 25 bp, Mus musculus
agcccagcttttcgagaccgacgct

SEQ ID NO: 529751 - DNA, 25 bp, Mus musculus
agcccagcttttggagaccgacgct

SEQ ID NO: 529752 - DNA, 25 bp, Mus musculus
agcccaggccgccaggaaaaaatca

SEQ ID NO: 529753 - DNA, 25 bp, Mus musculus
agcccaggccgcgaggaaaaaatca

SEQ ID NO: 529754 - DNA, 25 bp, Mus musculus
agcccaggcgaaaccaggagagacc

SEQ ID NO: 529755 - DNA, 25 bp, Mus musculus
agcccaggcgaatccaggagagacc

SEQ ID NO: 529756 - DNA, 25 bp, Mus musculus
agcccagggcctccatctggactgg

SEQ ID NO: 529757 - DNA, 25 bp, Mus musculus
agcccagggcctgcatctggactgg

SEQ ID NO: 529758 - DNA, 25 bp, Mus musculus
agcccagggcggcatacagtctgca

SEQ ID NO: 529759 - DNA, 25 bp, Mus musculus
agcccagggcgggatacagtctgca

SEQ ID NO: 529760 - DNA, 25 bp, Mus musculus
agcccagggtttcttctctagccaa

SEQ ID NO: 529761 - DNA, 25 bp, Mus musculus
agcccagggtttgttctctagccaa

SEQ ID NO: 529762 - DNA, 25 bp, Mus musculus
agcccaggtgcaccggcgtatcagt

SEQ ID NO: 529763 - DNA, 25 bp, Mus musculus
agcccaggtgcagcggcgtatcagt

SEQ ID NO: 529764 - DNA, 25 bp, Mus musculus
agcccaggttcaagagcatcgtcca

SEQ ID NO: 529765 - DNA, 25 bp, Mus musculus
agcccaggttcatgagcatcgtcca

SEQ ID NO: 529766 - DNA, 25 bp, Mus musculus
agcccagtaactctaccaatgagct

SEQ ID NO: 529767 - DNA, 25 bp, Mus musculus
agcccagtaactgtaccaatgagct

SEQ ID NO: 529768 - DNA, 25 bp, Mus musculus
agcccagtacccaagccggatgatt

SEQ ID NO: 529769 - DNA, 25 bp, Mus musculus
agcccagtaccctagccggatgatt

SEQ ID NO: 529770 - DNA, 25 bp, Mus musculus
agcccagtgactccggccgaagaac

SEQ ID NO: 529771 - DNA, 25 bp, Mus musculus
agcccagtgactgcggccgaagaac

SEQ ID NO: 529772 - DNA, 25 bp, Mus musculus
agcccagtgagtctcgaagctctag

SEQ ID NO: 529773 - DNA, 25 bp, Mus musculus
agcccagtgagtgtcgaagctctag

SEQ ID NO: 529774 - DNA, 25 bp, Mus musculus
agcccagtgccgacactagcggaga

SEQ ID NO: 529775 - DNA, 25 bp, Mus musculus
agcccagtgccgtcactagcggaga

SEQ ID NO: 529776 - DNA, 25 bp, Mus musculus
agcccataaccacgaaaggagaact

SEQ ID NO: 529777 - DNA, 25 bp, Mus musculus
agcccataaccaggaaaggagaact

SEQ ID NO: 529778 - DNA, 25 bp, Mus musculus
agcccatcaaaacccgggaccaaga

SEQ ID NO: 529779 - DNA, 25 bp, Mus musculus
agcccatcaaaagccgggaccaaga

SEQ ID NO: 529780 - DNA, 25 bp, Mus musculus
agcccatcaaacaggagctcatctg

SEQ ID NO: 529781 - DNA, 25 bp, Mus musculus
agcccatcaaactggagctcatctg

SEQ ID NO: 529782 - DNA, 25 bp, Mus musculus
agcccatcagtgctgacattgctga

SEQ ID NO: 529783 - DNA, 25 bp, Mus musculus
agcccatcagtggtgacattgctga

SEQ ID NO: 529784 - DNA, 25 bp, Mus musculus
agcccatcgtggacacaatacctcg

SEQ ID NO: 529785 - DNA, 25 bp, Mus musculus
agcccatcgtggtcacaatacctcg

SEQ ID NO: 529786 - DNA, 25 bp, Mus musculus
agcccatggagaacgtgcgcagcaa

SEQ ID NO: 529787 - DNA, 25 bp, Mus musculus
agcccatggagatcgtgcgcagcaa

SEQ ID NO: 529788 - DNA, 25 bp, Mus musculus
agcccattatctctgaccccgagta

SEQ ID NO: 529789 - DNA, 25 bp, Mus musculus
agcccattatctgtgaccccgagta

SEQ ID NO: 529790 - DNA, 25 bp, Mus musculus
agccccaaggctcctgtgagcatgg

SEQ ID NO: 529791 - DNA, 25 bp, Mus musculus
agccccaaggctgctgtgagcatgg

SEQ ID NO: 529792 - DNA, 25 bp, Mus musculus
agccccaaggttcgcagcggacctg

SEQ ID NO: 529793 - DNA, 25 bp, Mus musculus
agccccaaggttggcagcggacctg

SEQ ID NO: 529794 - DNA, 25 bp, Mus musculus
agccccacatccagtggatcaagca

SEQ ID NO: 529795 - DNA, 25 bp, Mus musculus
agccccacatcctgtggatcaagca

SEQ ID NO: 529796 - DNA, 25 bp, Mus musculus
agccccaccaccaggatcaagaagg

SEQ ID NO: 529797 - DNA, 25 bp, Mus musculus
agccccaccacctggatcaagaagg

SEQ ID NO: 529798 - DNA, 25 bp, Mus musculus
agccccactggaaaccatcaacgtg

SEQ ID NO: 529799 - DNA, 25 bp, Mus musculus
agccccactggataccatcaacgtg

SEQ ID NO: 529800 - DNA, 25 bp, Mus musculus
agccccagagaacaccacggtagtg

SEQ ID NO: 529801 - DNA, 25 bp, Mus musculus
agccccagagaagaccacggtagtg

SEQ ID NO: 529802 - DNA, 25 bp, Mus musculus
agccccagatctcggttgtggattg

SEQ ID NO: 529803 - DNA, 25 bp, Mus musculus
agccccagatctgggttgtggattg

SEQ ID NO: 529804 - DNA, 25 bp, Mus musculus
agccccagcaagaaccgcgggcttt

SEQ ID NO: 529805 - DNA, 25 bp, Mus musculus
agccccagcaagtaccgcgggcttt

SEQ ID NO: 529806 - DNA, 25 bp, Mus musculus
agccccagcatgcactgtaatcctg

SEQ ID NO: 529807 - DNA, 25 bp, Mus musculus
agccccagcatggactgtaatcctg

SEQ ID NO: 529808 - DNA, 25 bp, Mus musculus
agccccattcgtcaggcccagactt

SEQ ID NO: 529809 - DNA, 25 bp, Mus musculus
agccccattcgtgaggcccagactt

SEQ ID NO: 529810 - DNA, 25 bp, Mus musculus
agcccccggagaccttgtgcaaata

SEQ ID NO: 529811 - DNA, 25 bp, Mus musculus
agcccccggagagcttgtgcaaata

SEQ ID NO: 529812 - DNA, 25 bp, Mus musculus
agccccgacttgctgaactcaacag

SEQ ID NO: 529813 - DNA, 25 bp, Mus musculus
agccccgacttggtgaactcaacag

SEQ ID NO: 529814 - DNA, 25 bp, Mus musculus
agccccgagggaatgccctcttcgt

SEQ ID NO: 529815 - DNA, 25 bp, Mus musculus
agccccgagggattgccctcttcgt

SEQ ID NO: 529816 - DNA, 25 bp, Mus musculus
agccccgcagtgacccgctatgaag

SEQ ID NO: 529817 - DNA, 25 bp, Mus musculus
agccccgcagtgtcccgctatgaag

SEQ ID NO: 529818 - DNA, 25 bp, Mus musculus
agccccgccctgattgccaatatag

SEQ ID NO: 529819 - DNA, 25 bp, Mus musculus
agccccgccctgtttgccaatatag

SEQ ID NO: 529820 - DNA, 25 bp, Mus musculus
agccccgctctgctgagatgctgcg

SEQ ID NO: 529821 - DNA, 25 bp, Mus musculus
agccccgctctggtgagatgctgcg

SEQ ID NO: 529822 - DNA, 25 bp, Mus musculus
agccccgctgcaaccaaaacattaa

SEQ ID NO: 529823 - DNA, 25 bp, Mus musculus
agccccgctgcatccaaaacattaa

SEQ ID NO: 529824 - DNA, 25 bp, Mus musculus
agccccgctgtgaggacgtagagac

SEQ ID NO: 529825 - DNA, 25 bp, Mus musculus
agccccgctgtgtggacgtagagac

SEQ ID NO: 529826 - DNA, 25 bp, Mus musculus
agccccggaggcagattccgagtgc

SEQ ID NO: 529827 - DNA, 25 bp, Mus musculus
agccccggaggctgattccgagtgc

SEQ ID NO: 529828 - DNA, 25 bp, Mus musculus
agccccgggcagatgcggatgcctt

SEQ ID NO: 529829 - DNA, 25 bp, Mus musculus
agccccgggcagttgcggatgcctt

SEQ ID NO: 529830 - DNA, 25 bp, Mus musculus
agcccctacctgaacctgccgattt

SEQ ID NO: 529831 - DNA, 25 bp, Mus musculus
agcccctacctgtacctgccgattt

SEQ ID NO: 529832 - DNA, 25 bp, Mus musculus
agcccctatgccaccctatgttcag

SEQ ID NO: 529833 - DNA, 25 bp, Mus musculus
agcccctatgcctccctatgttcag

SEQ ID NO: 529834 - DNA, 25 bp, Mus musculus
agcccctccctgctagtcagagata

SEQ ID NO: 529835 - DNA, 25 bp, Mus musculus
agcccctccctggtagtcagagata

SEQ ID NO: 529836 - DNA, 25 bp, Mus musculus
agcccctcggcgaggactcagtcgg

SEQ ID NO: 529837 - DNA, 25 bp, Mus musculus
agcccctcggcgtggactcagtcgg

SEQ ID NO: 529838 - DNA, 25 bp, Mus musculus
agcccctcggctccggaaaggctct

SEQ ID NO: 529839 - DNA, 25 bp, Mus musculus
agcccctcggctgcggaaaggctct

SEQ ID NO: 529840 - DNA, 25 bp, Mus musculus
agcccctcgtgcagttctgtgagag

SEQ ID NO: 529841 - DNA, 25 bp, Mus musculus
agcccctcgtgctgttctgtgagag

SEQ ID NO: 529842 - DNA, 25 bp, Mus musculus
agcccctgaaaaatgccagagacaa

SEQ ID NO: 529843 - DNA, 25 bp, Mus musculus
agcccctgaaaattgccagagacaa

SEQ ID NO: 529844 - DNA, 25 bp, Mus musculus
agcccctgactgaccgtgttggcag

SEQ ID NO: 529845 - DNA, 25 bp, Mus musculus
agcccctgactgtccgtgttggcag

SEQ ID NO: 529846 - DNA, 25 bp, Mus musculus
agcccctgcagcaggacctgtggag

SEQ ID NO: 529847 - DNA, 25 bp, Mus musculus
agcccctgcagctggacctgtggag

SEQ ID NO: 529848 - DNA, 25 bp, Mus musculus
agcccctgcctaatgaaaattgtgc

SEQ ID NO: 529849 - DNA, 25 bp, Mus musculus
agcccctgcctattgaaaattgtgc

SEQ ID NO: 529850 - DNA, 25 bp, Mus musculus
agcccctgcgggaagctagccttct

SEQ ID NO: 529851 - DNA, 25 bp, Mus musculus
agcccctgcgggtagctagccttct

SEQ ID NO: 529852 - DNA, 25 bp, Mus musculus
agcccctgcgtgagaagcctcagag

SEQ ID NO: 529853 - DNA, 25 bp, Mus musculus
agcccctgcgtgtgaagcctcagag

SEQ ID NO: 529854 - DNA, 25 bp, Mus musculus
agcccctgctccagtgcagaacggg

SEQ ID NO: 529855 - DNA, 25 bp, Mus musculus
agcccctgctcctgtgcagaacggg

SEQ ID NO: 529856 - DNA, 25 bp, Mus musculus
agcccctggaacattgccttcacag

SEQ ID NO: 529857 - DNA, 25 bp, Mus musculus
agcccctggaactttgccttcacag

SEQ ID NO: 529858 - DNA, 25 bp, Mus musculus
agccccttctcaatggtagtacctt

SEQ ID NO: 529859 - DNA, 25 bp, Mus musculus
agccccttctcattggtagtacctt

SEQ ID NO: 529860 - DNA, 25 bp, Mus musculus
agcccgaacaccagtggacactgct

SEQ ID NO: 529861 - DNA, 25 bp, Mus musculus
agcccgaacacctgtggacactgct

SEQ ID NO: 529862 - DNA, 25 bp, Mus musculus
agcccgagcaacacatcctgaaggt

SEQ ID NO: 529863 - DNA, 25 bp, Mus musculus
agcccgagcaactcatcctgaaggt

SEQ ID NO: 529864 - DNA, 25 bp, Mus musculus
agcccgatccagagtccgcgcatgg

SEQ ID NO: 529865 - DNA, 25 bp, Mus musculus
agcccgatccagtgtccgcgcatgg

SEQ ID NO: 529866 - DNA, 25 bp, Mus musculus
agcccgcaagaacaggtccaagtcg

SEQ ID NO: 529867 - DNA, 25 bp, Mus musculus
agcccgcaagaagaggtccaagtcg

SEQ ID NO: 529868 - DNA, 25 bp, Mus musculus
agcccgccaacgattcagccaggag

SEQ ID NO: 529869 - DNA, 25 bp, Mus musculus
agcccgccaacgtttcagccaggag

SEQ ID NO: 529870 - DNA, 25 bp, Mus musculus
agcccgccgagaaacagatgcccgg

SEQ ID NO: 529871 - DNA, 25 bp, Mus musculus
agcccgccgagatacagatgcccgg

SEQ ID NO: 529872 - DNA, 25 bp, Mus musculus
agcccgccggagagcacagctgcgt

SEQ ID NO: 529873 - DNA, 25 bp, Mus musculus
agcccgccggagtgcacagctgcgt

SEQ ID NO: 529874 - DNA, 25 bp, Mus musculus
agcccgctgctgcactccgatttga

SEQ ID NO: 529875 - DNA, 25 bp, Mus musculus
agcccgctgctggactccgatttga

SEQ ID NO: 529876 - DNA, 25 bp, Mus musculus
agcccggaagtgctgcaccaacggc

SEQ ID NO: 529877 - DNA, 25 bp, Mus musculus
agcccggaagtggtgcaccaacggc

SEQ ID NO: 529878 - DNA, 25 bp, Mus musculus
agcccggacaggaacaggaaagaca

SEQ ID NO: 529879 - DNA, 25 bp, Mus musculus
agcccggacaggtacaggaaagaca

SEQ ID NO: 529880 - DNA, 25 bp, Mus musculus
agcccggacgttaggctgcccgcag

SEQ ID NO: 529881 - DNA, 25 bp, Mus musculus
agcccggacgtttggctgcccgcag

SEQ ID NO: 529882 - DNA, 25 bp, Mus musculus
agcccggattcacgatccccaagaa

SEQ ID NO: 529883 - DNA, 25 bp, Mus musculus
agcccggattcaggatccccaagaa

SEQ ID NO: 529884 - DNA, 25 bp, Mus musculus
agcccggcaatgaggagaacaacgg

SEQ ID NO: 529885 - DNA, 25 bp, Mus musculus
agcccggcaatgtggagaacaacgg

SEQ ID NO: 529886 - DNA, 25 bp, Mus musculus
agcccggcccaaaagagaatcctca

SEQ ID NO: 529887 - DNA, 25 bp, Mus musculus
agcccggcccaatagagaatcctca

SEQ ID NO: 529888 - DNA, 25 bp, Mus musculus
agcccggctacgagtgctactgcaa

SEQ ID NO: 529889 - DNA, 25 bp, Mus musculus
agcccggctacgtgtgctactgcaa

SEQ ID NO: 529890 - DNA, 25 bp, Mus musculus
agcccggctggtcgcagacatctgc

SEQ ID NO: 529891 - DNA, 25 bp, Mus musculus
agcccggctggtggcagacatctgc

SEQ ID NO: 529892 - DNA, 25 bp, Mus musculus
agcccgggaaatcgccaatgccaaa

SEQ ID NO: 529893 - DNA, 25 bp, Mus musculus
agcccgggaaatggccaatgccaaa

SEQ ID NO: 529894 - DNA, 25 bp, Mus musculus
agcccgggaatgcactagaaccaag

SEQ ID NO: 529895 - DNA, 25 bp, Mus musculus
agcccgggaatggactagaaccaag

SEQ ID NO: 529896 - DNA, 25 bp, Mus musculus
agcccgtgagtgacaaggtgtatga

SEQ ID NO: 529897 - DNA, 25 bp, Mus musculus
agcccgtgagtgtcaaggtgtatga

SEQ ID NO: 529898 - DNA, 25 bp, Mus musculus
agcccgtgatgcaggcctgctacgt

SEQ ID NO: 529899 - DNA, 25 bp, Mus musculus
agcccgtgatgctggcctgctacgt

SEQ ID NO: 529900 - DNA, 25 bp, Mus musculus
agcccgtgcattaggtccccgatgg

SEQ ID NO: 529901 - DNA, 25 bp, Mus musculus
agcccgtgcatttggtccccgatgg

SEQ ID NO: 529902 - DNA, 25 bp, Mus musculus
agcccgtgcgccacaagaagcgggt

SEQ ID NO: 529903 - DNA, 25 bp, Mus musculus
agcccgtgcgcctcaagaagcgggt

SEQ ID NO: 529904 - DNA, 25 bp, Mus musculus
agcccgtggttcactatgatatctg

SEQ ID NO: 529905 - DNA, 25 bp, Mus musculus
agcccgtggttctctatgatatctg

SEQ ID NO: 529906 - DNA, 25 bp, Mus musculus
agcccgttgagaccgctgtgctgcc

SEQ ID NO: 529907 - DNA, 25 bp, Mus musculus
agcccgttgagagcgctgtgctgcc

SEQ ID NO: 529908 - DNA, 25 bp, Mus musculus
agcccgttggctctggtgcctatgg

SEQ ID NO: 529909 - DNA, 25 bp, Mus musculus
agcccgttggctgtggtgcctatgg

SEQ ID NO: 529910 - DNA, 25 bp, Mus musculus
agccctaggttcaatccatatcaca

SEQ ID NO: 529911 - DNA, 25 bp, Mus musculus
agccctaggttctatccatatcaca

SEQ ID NO: 529912 - DNA, 25 bp, Mus musculus
agccctatccgtctttctgttctgg

SEQ ID NO: 529913 - DNA, 25 bp, Mus musculus
agccctatccgtgtttctgttctgg

SEQ ID NO: 529914 - DNA, 25 bp, Mus musculus
agccctatgtcacggtgactatgga

SEQ ID NO: 529915 - DNA, 25 bp, Mus musculus
agccctatgtcagggtgactatgga

SEQ ID NO: 529916 - DNA, 25 bp, Mus musculus
agccctcagcagattcccaatcagc

SEQ ID NO: 529917 - DNA, 25 bp, Mus musculus
agccctcagcagtttcccaatcagc

SEQ ID NO: 529918 - DNA, 25 bp, Mus musculus
agccctcaggcaacacgtgcggaga

SEQ ID NO: 529919 - DNA, 25 bp, Mus musculus
agccctcaggcatcacgtgcggaga

SEQ ID NO: 529920 - DNA, 25 bp, Mus musculus
agccctcagtgacagtgccaaccaa

SEQ ID NO: 529921 - DNA, 25 bp, Mus musculus
agccctcagtgacccagaaccgagg

SEQ ID NO: 529922 - DNA, 25 bp, Mus musculus
agccctcagtgagagtgccaaccaa

SEQ ID NO: 529923 - DNA, 25 bp, Mus musculus
agccctcagtgagccagaaccgagg

SEQ ID NO: 529924 - DNA, 25 bp, Mus musculus
agccctccacctagcagctcaaaag

SEQ ID NO: 529925 - DNA, 25 bp, Mus musculus
agccctccaccttgcagctcaaaag

SEQ ID NO: 529926 - DNA, 25 bp, Mus musculus
agccctccatgacctgcactaaaga

SEQ ID NO: 529927 - DNA, 25 bp, Mus musculus
agccctccatgagctgcactaaaga

SEQ ID NO: 529928 - DNA, 25 bp, Mus musculus
agccctcctcagatgcattctttag

SEQ ID NO: 529929 - DNA, 25 bp, Mus musculus
agccctcctcagttgcattctttag

SEQ ID NO: 529930 - DNA, 25 bp, Mus musculus
agccctccttcacaagcatgatgac

SEQ ID NO: 529931 - DNA, 25 bp, Mus musculus
agccctccttcagaagcatgatgac

SEQ ID NO: 529932 - DNA, 25 bp, Mus musculus
agccctcgactccaccaatgttgag

SEQ ID NO: 529933 - DNA, 25 bp, Mus musculus
agccctcgactcgaccaatgttgag

SEQ ID NO: 529934 - DNA, 25 bp, Mus musculus
agccctctgcttactagtgatgccg

SEQ ID NO: 529935 - DNA, 25 bp, Mus musculus
agccctctgctttctagtgatgccg

SEQ ID NO: 529936 - DNA, 25 bp, Mus musculus
agccctgaacagcattttgccaacg

SEQ ID NO: 529937 - DNA, 25 bp, Mus musculus
agccctgaacaggattttgccaacg

SEQ ID NO: 529938 - DNA, 25 bp, Mus musculus
agccctgagcctcaacatggttctg

SEQ ID NO: 529939 - DNA, 25 bp, Mus musculus
agccctgagcctgaacatggttctg

SEQ ID NO: 529940 - DNA, 25 bp, Mus musculus
agccctgagctcagctggtcgggaa

SEQ ID NO: 529941 - DNA, 25 bp, Mus musculus
agccctgagctctgctggtcgggaa

SEQ ID NO: 529942 - DNA, 25 bp, Mus musculus
agccctgatgcacacgctgcagcga

SEQ ID NO: 529943 - DNA, 25 bp, Mus musculus
agccctgatgcagacgctgcagcga

SEQ ID NO: 529944 - DNA, 25 bp, Mus musculus
agccctgattttcagcaccgatgac

SEQ ID NO: 529945 - DNA, 25 bp, Mus musculus
agccctgattttgagcaccgatgac

SEQ ID NO: 529946 - DNA, 25 bp, Mus musculus
agccctgccactcgaagtcacatgg

SEQ ID NO: 529947 - DNA, 25 bp, Mus musculus
agccctgccactggaagtcacatgg

SEQ ID NO: 529948 - DNA, 25 bp, Mus musculus
agccctgccttgactcaaagagaag

SEQ ID NO: 529949 - DNA, 25 bp, Mus musculus
agccctgccttgtctcaaagagaag

SEQ ID NO: 529950 - DNA, 25 bp, Mus musculus
agccctgcgaggacccgagtccgga

SEQ ID NO: 529951 - DNA, 25 bp, Mus musculus
agccctgcgaggtcccgagtccgga

SEQ ID NO: 529952 - DNA, 25 bp, Mus musculus
agccctgctctgagcgagtgcccta

SEQ ID NO: 529953 - DNA, 25 bp, Mus musculus
agccctgctctgtgcgagtgcccta

SEQ ID NO: 529954 - DNA, 25 bp, Mus musculus
agccctgcttagagctgtcccgtgc

SEQ ID NO: 529955 - DNA, 25 bp, Mus musculus
agccctgcttagctccgaactagtg

SEQ ID NO: 529956 - DNA, 25 bp, Mus musculus
agccctgcttaggtccgaactagtg

SEQ ID NO: 529957 - DNA, 25 bp, Mus musculus
agccctgcttagtgctgtcccgtgc

SEQ ID NO: 529958 - DNA, 25 bp, Mus musculus
agccctgcttgacaaggctgctctg

SEQ ID NO: 529959 - DNA, 25 bp, Mus musculus
agccctgcttgagaaggctgctctg

SEQ ID NO: 529960 - DNA, 25 bp, Mus musculus
agccctgcttttatggcggcccagc

SEQ ID NO: 529961 - DNA, 25 bp, Mus musculus
agccctgcttttttggcggcccagc

SEQ ID NO: 529962 - DNA, 25 bp, Mus musculus
agccctggaagtctgcggaagcaca

SEQ ID NO: 529963 - DNA, 25 bp, Mus musculus
agccctggaagtgtgcggaagcaca

SEQ ID NO: 529964 - DNA, 25 bp, Mus musculus
agccctggacatctactctgccgtg

SEQ ID NO: 529965 - DNA, 25 bp, Mus musculus
agccctggacatgtactctgccgtg

SEQ ID NO: 529966 - DNA, 25 bp, Mus musculus
agccctggacttcatcgccagcaag

SEQ ID NO: 529967 - DNA, 25 bp, Mus musculus
agccctggacttgatcgccagcaag

SEQ ID NO: 529968 - DNA, 25 bp, Mus musculus
agccctggagaaagaccccgactgc

SEQ ID NO: 529969 - DNA, 25 bp, Mus musculus
agccctggagaatgaccccgactgc

SEQ ID NO: 529970 - DNA, 25 bp, Mus musculus
agccctggcactaggagcctctaca

SEQ ID NO: 529971 - DNA, 25 bp, Mus musculus
agccctggcacttggagcctctaca

SEQ ID NO: 529972 - DNA, 25 bp, Mus musculus
agccctggtataagacgccataaag

SEQ ID NO: 529973 - DNA, 25 bp, Mus musculus
agccctggtatatgacgccataaag

SEQ ID NO: 529974 - DNA, 25 bp, Mus musculus
agccctggtctgcacagtgggatcc

SEQ ID NO: 529975 - DNA, 25 bp, Mus musculus
agccctggtctggacagtgggatcc

SEQ ID NO: 529976 - DNA, 25 bp, Mus musculus
agccctggtggcagccttcacactg

SEQ ID NO: 529977 - DNA, 25 bp, Mus musculus
agccctggtggctgccttcacactg

SEQ ID NO: 529978 - DNA, 25 bp, Mus musculus
agccctgtccacctgatttctgaag

SEQ ID NO: 529979 - DNA, 25 bp, Mus musculus
agccctgtccacgtgatttctgaag

SEQ ID NO: 529980 - DNA, 25 bp, Mus musculus
agccctgtgcccagtgaggagcagt

SEQ ID NO: 529981 - DNA, 25 bp, Mus musculus
agccctgtgccctgtgaggagcagt

SEQ ID NO: 529982 - DNA, 25 bp, Mus musculus
agccctgtgcggactgttctacctg

SEQ ID NO: 529983 - DNA, 25 bp, Mus musculus
agccctgtgcggtctgttctacctg

SEQ ID NO: 529984 - DNA, 25 bp, Mus musculus
agccctgtgggtacaagacgtggcc

SEQ ID NO: 529985 - DNA, 25 bp, Mus musculus
agccctgtgggttcaagacgtggcc

SEQ ID NO: 529986 - DNA, 25 bp, Mus musculus
agcccttcaggaccaggtggcctca

SEQ ID NO: 529987 - DNA, 25 bp, Mus musculus
agcccttcaggagcaggtggcctca

SEQ ID NO: 529988 - DNA, 25 bp, Mus musculus
agcccttccaggaggtggtcacccg

SEQ ID NO: 529989 - DNA, 25 bp, Mus musculus
agcccttccaggtggtggtcacccg

SEQ ID NO: 529990 - DNA, 25 bp, Mus musculus
agcccttcggcccaggtgtcgaaca

SEQ ID NO: 529991 - DNA, 25 bp, Mus musculus
agcccttcggccgaggtgtcgaaca

SEQ ID NO: 529992 - DNA, 25 bp, Mus musculus
agcccttcgggacaacgagatccgc

SEQ ID NO: 529993 - DNA, 25 bp, Mus musculus
agcccttcgggagaacgagatccgc

SEQ ID NO: 529994 - DNA, 25 bp, Mus musculus
agcccttcggtgatggtaagcactg

SEQ ID NO: 529995 - DNA, 25 bp, Mus musculus
agcccttcggtgttggtaagcactg

SEQ ID NO: 529996 - DNA, 25 bp, Mus musculus
agcccttgaggcagcccacaaaggc

SEQ ID NO: 529997 - DNA, 25 bp, Mus musculus
agcccttgaggctgcccacaaaggc

SEQ ID NO: 529998 - DNA, 25 bp, Mus musculus
agcccttgcaatctcaggccatgat

SEQ ID NO: 529999 - DNA, 25 bp, Mus musculus
agcccttgcaatgtcaggccatgat

SEQ ID NO: 530000 - DNA, 25 bp, Mus musculus
agcccttggagcagtgacagcaagt

SEQ ID NO: 530001 - DNA, 25 bp, Mus musculus
agcccttggagctgtgacagcaagt

SEQ ID NO: 530002 - DNA, 25 bp, Mus musculus
agccctttctgcacagctggtgttg

SEQ ID NO: 530003 - DNA, 25 bp, Mus musculus
agccctttctgctcagctggtgttg

SEQ ID NO: 530004 - DNA, 25 bp, Mus musculus
agccgaactggaagcagaccaccca

SEQ ID NO: 530005 - DNA, 25 bp, Mus musculus
agccgaactggatgcagaccaccca

SEQ ID NO: 530006 - DNA, 25 bp, Mus musculus
agccgaagcagcaagaatgacccaa

SEQ ID NO: 530007 - DNA, 25 bp, Mus musculus
agccgaagcagctagaatgacccaa

SEQ ID NO: 530008 - DNA, 25 bp, Mus musculus
agccgaagctcaccccgacttgttg

SEQ ID NO: 530009 - DNA, 25 bp, Mus musculus
agccgaagctcagcccgacttgttg

SEQ ID NO: 530010 - DNA, 25 bp, Mus musculus
agccgacagctcctttaacttcatg

SEQ ID NO: 530011 - DNA, 25 bp, Mus musculus
agccgacagctcgtttaacttcatg

SEQ ID NO: 530012 - DNA, 25 bp, Mus musculus
agccgaccgaggacaacaagcacaa

SEQ ID NO: 530013 - DNA, 25 bp, Mus musculus
agccgaccgaggtcaacaagcacaa

SEQ ID NO: 530014 - DNA, 25 bp, Mus musculus
agccgagagaacctgggccgaatcc

SEQ ID NO: 530015 - DNA, 25 bp, Mus musculus
agccgagagaacgtgggccgaatcc

SEQ ID NO: 530016 - DNA, 25 bp, Mus musculus
agccgagcagggacatctacctggg

SEQ ID NO: 530017 - DNA, 25 bp, Mus musculus
agccgagcagggtcatctacctggg

SEQ ID NO: 530018 - DNA, 25 bp, Mus musculus
agccgagcccaacagtgatcttcag

SEQ ID NO: 530019 - DNA, 25 bp, Mus musculus
agccgagcccaagagtgatcttcag

SEQ ID NO: 530020 - DNA, 25 bp, Mus musculus
agccgagccgaaaggccgccatgcg

SEQ ID NO: 530021 - DNA, 25 bp, Mus musculus
agccgagccgaatggccgccatgcg

SEQ ID NO: 530022 - DNA, 25 bp, Mus musculus
agccgagcgcctacagtgagaacga

SEQ ID NO: 530023 - DNA, 25 bp, Mus musculus
agccgagcgccttcagtgagaacga

SEQ ID NO: 530024 - DNA, 25 bp, Mus musculus
agccgagctgcacgatatgatcaac

SEQ ID NO: 530025 - DNA, 25 bp, Mus musculus
agccgagctgcaggatatgatcaac

SEQ ID NO: 530026 - DNA, 25 bp, Mus musculus
agccgaggcattaccctgagcccag

SEQ ID NO: 530027 - DNA, 25 bp, Mus musculus
agccgaggcatttccctgagcccag

SEQ ID NO: 530028 - DNA, 25 bp, Mus musculus
agccgagggcctcctcagtgttcca

SEQ ID NO: 530029 - DNA, 25 bp, Mus musculus
agccgagggcctgctcagtgttcca

SEQ ID NO: 530030 - DNA, 25 bp, Mus musculus
agccgatgcactctactaaggaagc

SEQ ID NO: 530031 - DNA, 25 bp, Mus musculus
agccgatgcactgtactaaggaagc

SEQ ID NO: 530032 - DNA, 25 bp, Mus musculus
agccgcaacaaccaggacaccttga

SEQ ID NO: 530033 - DNA, 25 bp, Mus musculus
agccgcaacaacgaggacaccttga

SEQ ID NO: 530034 - DNA, 25 bp, Mus musculus
agccgcacttatctgaagcctcaag

SEQ ID NO: 530035 - DNA, 25 bp, Mus musculus
agccgcacttatgtgaagcctcaag

SEQ ID NO: 530036 - DNA, 25 bp, Mus musculus
agccgcagccaacacacggtttgca

SEQ ID NO: 530037 - DNA, 25 bp, Mus musculus
agccgcagccaagacacggtttgca

SEQ ID NO: 530038 - DNA, 25 bp, Mus musculus
agccgcagttgcagctccgcggact

SEQ ID NO: 530039 - DNA, 25 bp, Mus musculus
agccgcagttgctgctccgcggact

SEQ ID NO: 530040 - DNA, 25 bp, Mus musculus
agccgcatgtatcaggcatgaagcg

SEQ ID NO: 530041 - DNA, 25 bp, Mus musculus
agccgcatgtatgaggcatgaagcg

SEQ ID NO: 530042 - DNA, 25 bp, Mus musculus
agccgccaaagaccgagagacacga

SEQ ID NO: 530043 - DNA, 25 bp, Mus musculus
agccgccaaagagcgagagacacga

SEQ ID NO: 530044 - DNA, 25 bp, Mus musculus
agccgccaagccatcaggttcgagc

SEQ ID NO: 530045 - DNA, 25 bp, Mus musculus
agccgccaagccttcaggttcgagc

SEQ ID NO: 530046 - DNA, 25 bp, Mus musculus
agccgccagcgccaagaatcttctt

SEQ ID NO: 530047 - DNA, 25 bp, Mus musculus
agccgccagcgcgaagaatcttctt

SEQ ID NO: 530048 - DNA, 25 bp, Mus musculus
agccgccatcccagtggggggaata

SEQ ID NO: 530049 - DNA, 25 bp, Mus musculus
agccgccatccctgtggggggaata

SEQ ID NO: 530050 - DNA, 25 bp, Mus musculus
agccgccatggcagtcgctggtttc

SEQ ID NO: 530051 - DNA, 25 bp, Mus musculus
agccgccatggctgtcgctggtttc

SEQ ID NO: 530052 - DNA, 25 bp, Mus musculus
agccgcccagacactggcactatgg

SEQ ID NO: 530053 - DNA, 25 bp, Mus musculus
agccgcccagactctggcactatgg

SEQ ID NO: 530054 - DNA, 25 bp, Mus musculus
agccgcccagagaatgccattattt

SEQ ID NO: 530055 - DNA, 25 bp, Mus musculus
agccgcccagagtatgccattattt

SEQ ID NO: 530056 - DNA, 25 bp, Mus musculus
agccgccctcggaactcctgggagt

SEQ ID NO: 530057 - DNA, 25 bp, Mus musculus
agccgccctcggtactcctgggagt

SEQ ID NO: 530058 - DNA, 25 bp, Mus musculus
agccgccgcctcctgaaggatctgg

SEQ ID NO: 530059 - DNA, 25 bp, Mus musculus
agccgccgcctcgtgaaggatctgg

SEQ ID NO: 530060 - DNA, 25 bp, Mus musculus
agccgccgtccgagaagttctacag

SEQ ID NO: 530061 - DNA, 25 bp, Mus musculus
agccgccgtccgtgaagttctacag

SEQ ID NO: 530062 - DNA, 25 bp, Mus musculus
agccgcctagaacgcttgtagcatt

SEQ ID NO: 530063 - DNA, 25 bp, Mus musculus
agccgcctagaaggcttgtagcatt

SEQ ID NO: 530064 - DNA, 25 bp, Mus musculus
agccgcctagctacctacagtgtca

SEQ ID NO: 530065 - DNA, 25 bp, Mus musculus
agccgcctagcttcctacagtgtca

SEQ ID NO: 530066 - DNA, 25 bp, Mus musculus
agccgccttcagagcagtcagccat

SEQ ID NO: 530067 - DNA, 25 bp, Mus musculus
agccgccttcagtgcagtcagccat

SEQ ID NO: 530068 - DNA, 25 bp, Mus musculus
agccgcggagtgaagccatggcacc

SEQ ID NO: 530069 - DNA, 25 bp, Mus musculus
agccgcggagtgtagccatggcacc

SEQ ID NO: 530070 - DNA, 25 bp, Mus musculus
agccgcgggctgaaggctcccttgt

SEQ ID NO: 530071 - DNA, 25 bp, Mus musculus
agccgcgggctgtaggctcccttgt

SEQ ID NO: 530072 - DNA, 25 bp, Mus musculus
agccgcgtttcccaaggtgtgccca

SEQ ID NO: 530073 - DNA, 25 bp, Mus musculus
agccgcgtttccgaaggtgtgccca

SEQ ID NO: 530074 - DNA, 25 bp, Mus musculus
agccgctcatctacagtgagtgcca

SEQ ID NO: 530075 - DNA, 25 bp, Mus musculus
agccgctcatcttcagtgagtgcca

SEQ ID NO: 530076 - DNA, 25 bp, Mus musculus
agccgctccggcagaggctagagcc

SEQ ID NO: 530077 - DNA, 25 bp, Mus musculus
agccgctccggctgaggctagagcc

SEQ ID NO: 530078 - DNA, 25 bp, Mus musculus
agccgctgtggaagcagatccctgg

SEQ ID NO: 530079 - DNA, 25 bp, Mus musculus
agccgctgtggatgcagatccctgg

SEQ ID NO: 530080 - DNA, 25 bp, Mus musculus
agccggagcctacattctgtcgcga

SEQ ID NO: 530081 - DNA, 25 bp, Mus musculus
agccggagcctagattctgtcgcga

SEQ ID NO: 530082 - DNA, 25 bp, Mus musculus
agccggagctgaccccggaggtcgg

SEQ ID NO: 530083 - DNA, 25 bp, Mus musculus
agccggagctgagcccggaggtcgg

SEQ ID NO: 530084 - DNA, 25 bp, Mus musculus
agccggattgccagctacctggaag

SEQ ID NO: 530085 - DNA, 25 bp, Mus musculus
agccggattgccagggtgagtaatc

SEQ ID NO: 530086 - DNA, 25 bp, Mus musculus
agccggattgcctgctacctggaag

SEQ ID NO: 530087 - DNA, 25 bp, Mus musculus
agccggattgcctgggtgagtaatc

SEQ ID NO: 530088 - DNA, 25 bp, Mus musculus
agccggcaggcaattatctccaaag

SEQ ID NO: 530089 - DNA, 25 bp, Mus musculus
agccggcaggcatttatctccaaag

SEQ ID NO: 530090 - DNA, 25 bp, Mus musculus
agccggccgatcctgatcagtctga

SEQ ID NO: 530091 - DNA, 25 bp, Mus musculus
agccggccgatcgtgatcagtctga

SEQ ID NO: 530092 - DNA, 25 bp, Mus musculus
agccggcgcaacctgctatcagaca

SEQ ID NO: 530093 - DNA, 25 bp, Mus musculus
agccggcgcaacgtgctatcagaca

SEQ ID NO: 530094 - DNA, 25 bp, Mus musculus
agccgggacactaccagaacacttc

SEQ ID NO: 530095 - DNA, 25 bp, Mus musculus
agccgggacacttccagaacacttc

SEQ ID NO: 530096 - DNA, 25 bp, Mus musculus
agccgggatccgacggtcacgttgt

SEQ ID NO: 530097 - DNA, 25 bp, Mus musculus
agccgggatccgtcggtcacgttgt

SEQ ID NO: 530098 - DNA, 25 bp, Mus musculus
agccgggcggcaaagcttgatgccc

SEQ ID NO: 530099 - DNA, 25 bp, Mus musculus
agccgggcggcatagcttgatgccc

SEQ ID NO: 530100 - DNA, 25 bp, Mus musculus
agccgggctcatacttctgctcgtg

SEQ ID NO: 530101 - DNA, 25 bp, Mus musculus
agccgggctcattcttctgctcgtg

SEQ ID NO: 530102 - DNA, 25 bp, Mus musculus
agccggtcatctccgtgttcttaga

SEQ ID NO: 530103 - DNA, 25 bp, Mus musculus
agccggtcatctgcgtgttcttaga

SEQ ID NO: 530104 - DNA, 25 bp, Mus musculus
agccggtgactaccagcccactgag

SEQ ID NO: 530105 - DNA, 25 bp, Mus musculus
agccggtgactagcagcccactgag

SEQ ID NO: 530106 - DNA, 25 bp, Mus musculus
agccgtcgtcagaggatgagcagca

SEQ ID NO: 530107 - DNA, 25 bp, Mus musculus
agccgtcgtcagtggatgagcagca

SEQ ID NO: 530108 - DNA, 25 bp, Mus musculus
agccgtgacagccgcacatgcagtg

SEQ ID NO: 530109 - DNA, 25 bp, Mus musculus
agccgtgacagcggcacatgcagtg

SEQ ID NO: 530110 - DNA, 25 bp, Mus musculus
agccgtgcagtgcaccaaggcagaa

SEQ ID NO: 530111 - DNA, 25 bp, Mus musculus
agccgtgcagtggaccaaggcagaa

SEQ ID NO: 530112 - DNA, 25 bp, Mus musculus
agccgtggacgtcgatgaatgctca

SEQ ID NO: 530113 - DNA, 25 bp, Mus musculus
agccgtggacgtggatgaatgctca

SEQ ID NO: 530114 - DNA, 25 bp, Mus musculus
agccgttaggaaaaaacgatggcag

SEQ ID NO: 530115 - DNA, 25 bp, Mus musculus
agccgttaggaataaacgatggcag

SEQ ID NO: 530116 - DNA, 25 bp, Mus musculus
agccgttctctcaggaggaacagga

SEQ ID NO: 530117 - DNA, 25 bp, Mus musculus
agccgttctctctggaggaacagga

SEQ ID NO: 530118 - DNA, 25 bp, Mus musculus
agccgttctgcacgagcgtttccct

SEQ ID NO: 530119 - DNA, 25 bp, Mus musculus
agccgttctgcaggagcgtttccct

SEQ ID NO: 530120 - DNA, 25 bp, Mus musculus
agccgttggcatagcacatccatcc

SEQ ID NO: 530121 - DNA, 25 bp, Mus musculus
agccgttggcattgcacatccatcc

SEQ ID NO: 530122 - DNA, 25 bp, Mus musculus
agccgttgttggattagtccgtcca

SEQ ID NO: 530123 - DNA, 25 bp, Mus musculus
agccgttgttggtttagtccgtcca

SEQ ID NO: 530124 - DNA, 25 bp, Mus musculus
agcctaaggtaacaagagaattcct

SEQ ID NO: 530125 - DNA, 25 bp, Mus musculus
agcctaaggtaagaagagaattcct

SEQ ID NO: 530126 - DNA, 25 bp, Mus musculus
agcctacagagtcatcaacatgaaa

SEQ ID NO: 530127 - DNA, 25 bp, Mus musculus
agcctacagagtgatcaacatgaaa

SEQ ID NO: 530128 - DNA, 25 bp, Mus musculus
agcctacattctcagcagatttgca

SEQ ID NO: 530129 - DNA, 25 bp, Mus musculus
agcctacattctctcgcgatatgct

SEQ ID NO: 530130 - DNA, 25 bp, Mus musculus
agcctacattctgagcagatttgca

SEQ ID NO: 530131 - DNA, 25 bp, Mus musculus
agcctacattctgtcgcgatatgct

SEQ ID NO: 530132 - DNA, 25 bp, Mus musculus
agcctaccacaacgcaaggaaggga

SEQ ID NO: 530133 - DNA, 25 bp, Mus musculus
agcctaccacaaggcaaggaaggga

SEQ ID NO: 530134 - DNA, 25 bp, Mus musculus
agcctaccgtccagggcacagaaga

SEQ ID NO: 530135 - DNA, 25 bp, Mus musculus
agcctaccgtcctgggcacagaaga

SEQ ID NO: 530136 - DNA, 25 bp, Mus musculus
agcctacctgaacccagagatgaaa

SEQ ID NO: 530137 - DNA, 25 bp, Mus musculus
agcctacctgaagccagagatgaaa

SEQ ID NO: 530138 - DNA, 25 bp, Mus musculus
agcctacggaagcttattttgtcca

SEQ ID NO: 530139 - DNA, 25 bp, Mus musculus
agcctacggaaggttattttgtcca

SEQ ID NO: 530140 - DNA, 25 bp, Mus musculus
agcctacgggacactggctctcaag

SEQ ID NO: 530141 - DNA, 25 bp, Mus musculus
agcctacgggactctggctctcaag

SEQ ID NO: 530142 - DNA, 25 bp, Mus musculus
agcctagaaaagaggagctgtctga

SEQ ID NO: 530143 - DNA, 25 bp, Mus musculus
agcctagaaaagtggagctgtctga

SEQ ID NO: 530144 - DNA, 25 bp, Mus musculus
agcctagacaagaacctccgtttgg

SEQ ID NO: 530145 - DNA, 25 bp, Mus musculus
agcctagacaagtacctccgtttgg

SEQ ID NO: 530146 - DNA, 25 bp, Mus musculus
agcctagaccccaggctttgtccaa

SEQ ID NO: 530147 - DNA, 25 bp, Mus musculus
agcctagacccctggctttgtccaa

SEQ ID NO: 530148 - DNA, 25 bp, Mus musculus
agcctagaggtaagctcggccctgt

SEQ ID NO: 530149 - DNA, 25 bp, Mus musculus
agcctagaggtatgctcggccctgt

SEQ ID NO: 530150 - DNA, 25 bp, Mus musculus
agcctagtagatagtggtgcctgag

SEQ ID NO: 530151 - DNA, 25 bp, Mus musculus
agcctagtagattgtggtgcctgag

SEQ ID NO: 530152 - DNA, 25 bp, Mus musculus
agcctatatcacatcccgcttggaa

SEQ ID NO: 530153 - DNA, 25 bp, Mus musculus
agcctatatcacttcccgcttggaa

SEQ ID NO: 530154 - DNA, 25 bp, Mus musculus
agcctatcctatagcggcgcgccag

SEQ ID NO: 530155 - DNA, 25 bp, Mus musculus
agcctatcctattgcggcgcgccag

SEQ ID NO: 530156 - DNA, 25 bp, Mus musculus
agcctatcgaagaatcacctaccac

SEQ ID NO: 530157 - DNA, 25 bp, Mus musculus
agcctatcgaagtatcacctaccac

SEQ ID NO: 530158 - DNA, 25 bp, Mus musculus
agcctatgcagtcctccttgggctc

SEQ ID NO: 530159 - DNA, 25 bp, Mus musculus
agcctatgcagtgctccttgggctc

SEQ ID NO: 530160 - DNA, 25 bp, Mus musculus
agcctcaaacctcagagactcagat

SEQ ID NO: 530161 - DNA, 25 bp, Mus musculus
agcctcaaacctgagagactcagat

SEQ ID NO: 530162 - DNA, 25 bp, Mus musculus
agcctcaagtaccaactggccttca

SEQ ID NO: 530163 - DNA, 25 bp, Mus musculus
agcctcaagtacgaactggccttca

SEQ ID NO: 530164 - DNA, 25 bp, Mus musculus
agcctcaatgagatgatcaatccaa

SEQ ID NO: 530165 - DNA, 25 bp, Mus musculus
agcctcaatgagttgatcaatccaa

SEQ ID NO: 530166 - DNA, 25 bp, Mus musculus
agcctcacggctctgtttgtgtccc

SEQ ID NO: 530167 - DNA, 25 bp, Mus musculus
agcctcacggctgtgtttgtgtccc

SEQ ID NO: 530168 - DNA, 25 bp, Mus musculus
agcctcacgtccatgtccgtggcgg

SEQ ID NO: 530169 - DNA, 25 bp, Mus musculus
agcctcacgtccttgtccgtggcgg

SEQ ID NO: 530170 - DNA, 25 bp, Mus musculus
agcctcactgaaccggatctgagaa

SEQ ID NO: 530171 - DNA, 25 bp, Mus musculus
agcctcactgaagcggatctgagaa

SEQ ID NO: 530172 - DNA, 25 bp, Mus musculus
agcctcagccgtacattctgcagca

SEQ ID NO: 530173 - DNA, 25 bp, Mus musculus
agcctcagccgttcattctgcagca

SEQ ID NO: 530174 - DNA, 25 bp, Mus musculus
agcctcagcctaacgggcagtggag

SEQ ID NO: 530175 - DNA, 25 bp, Mus musculus
agcctcagcctatcgggcagtggag

SEQ ID NO: 530176 - DNA, 25 bp, Mus musculus
agcctcatggtgagatgaagtttca

SEQ ID NO: 530177 - DNA, 25 bp, Mus musculus
agcctcatggtgtgatgaagtttca

SEQ ID NO: 530178 - DNA, 25 bp, Mus musculus
agcctccaaccaagatgaatcctat

SEQ ID NO: 530179 - DNA, 25 bp, Mus musculus
agcctccaaccatgatgaatcctat

SEQ ID NO: 530180 - DNA, 25 bp, Mus musculus
agcctccaagacacaaaggaaaaca

SEQ ID NO: 530181 - DNA, 25 bp, Mus musculus
agcctccaagactcaaaggaaaaca

SEQ ID NO: 530182 - DNA, 25 bp, Mus musculus
agcctccagactcctaagagcagag

SEQ ID NO: 530183 - DNA, 25 bp, Mus musculus
agcctccagactgctaagagcagag

SEQ ID NO: 530184 - DNA, 25 bp, Mus musculus
agcctccccgtgatggacctgacgg

SEQ ID NO: 530185 - DNA, 25 bp, Mus musculus
agcctccccgtgttggacctgacgg

SEQ ID NO: 530186 - DNA, 25 bp, Mus musculus
agcctcccttacaatcagccaggaa

SEQ ID NO: 530187 - DNA, 25 bp, Mus musculus
agcctcccttactatcagccaggaa

SEQ ID NO: 530188 - DNA, 25 bp, Mus musculus
agcctccggagcaccaagagctgcg

SEQ ID NO: 530189 - DNA, 25 bp, Mus musculus
agcctccggagctccaagagctgcg

SEQ ID NO: 530190 - DNA, 25 bp, Mus musculus
agcctccggccactgatccacaggg

SEQ ID NO: 530191 - DNA, 25 bp, Mus musculus
agcctccggccagtgatccacaggg

SEQ ID NO: 530192 - DNA, 25 bp, Mus musculus
agcctccgggaacgcgtggctggct

SEQ ID NO: 530193 - DNA, 25 bp, Mus musculus
agcctccgggaaggcgtggctggct

SEQ ID NO: 530194 - DNA, 25 bp, Mus musculus
agcctccgttggacctgggcagcat

SEQ ID NO: 530195 - DNA, 25 bp, Mus musculus
agcctccgttggtcctgggcagcat

SEQ ID NO: 530196 - DNA, 25 bp, Mus musculus
agcctcctggagatgaagtgattca

SEQ ID NO: 530197 - DNA, 25 bp, Mus musculus
agcctcctggagttgaagtgattca

SEQ ID NO: 530198 - DNA, 25 bp, Mus musculus
agcctcctgttgatattggtcctcg

SEQ ID NO: 530199 - DNA, 25 bp, Mus musculus
agcctcctgttgttattggtcctcg

SEQ ID NO: 530200 - DNA, 25 bp, Mus musculus
agcctcgagctgagacggctgcaag

SEQ ID NO: 530201 - DNA, 25 bp, Mus musculus
agcctcgagctgtgacggctgcaag

SEQ ID NO: 530202 - DNA, 25 bp, Mus musculus
agcctcgaggaaatgggcacccctc

SEQ ID NO: 530203 - DNA, 25 bp, Mus musculus
agcctcgaggaattgggcacccctc

SEQ ID NO: 530204 - DNA, 25 bp, Mus musculus
agcctcggaggcacaaggtcagcca

SEQ ID NO: 530205 - DNA, 25 bp, Mus musculus
agcctcggaggctcaaggtcagcca

SEQ ID NO: 530206 - DNA, 25 bp, Mus musculus
agcctcggcccaacaaaatggcgtc

SEQ ID NO: 530207 - DNA, 25 bp, Mus musculus
agcctcggcccatcaaaatggcgtc

SEQ ID NO: 530208 - DNA, 25 bp, Mus musculus
agcctcgttagccttggcccctgag

SEQ ID NO: 530209 - DNA, 25 bp, Mus musculus
agcctcgttagcgttggcccctgag

SEQ ID NO: 530210 - DNA, 25 bp, Mus musculus
agcctctacctgcaaagcccgagtg

SEQ ID NO: 530211 - DNA, 25 bp, Mus musculus
agcctctacctggaaagcccgagtg

SEQ ID NO: 530212 - DNA, 25 bp, Mus musculus
agcctctcatccacggatagtctgc

SEQ ID NO: 530213 - DNA, 25 bp, Mus musculus
agcctctcatcctcggatagtctgc

SEQ ID NO: 530214 - DNA, 25 bp, Mus musculus
agcctctctgaacctctggacttga

SEQ ID NO: 530215 - DNA, 25 bp, Mus musculus
agcctctctgaagctctggacttga

SEQ ID NO: 530216 - DNA, 25 bp, Mus musculus
agcctctgcatgagcttcgggccca

SEQ ID NO: 530217 - DNA, 25 bp, Mus musculus
agcctctgcatgtgcttcgggccca

SEQ ID NO: 530218 - DNA, 25 bp, Mus musculus
agcctctgcctcaagattggttgga

SEQ ID NO: 530219 - DNA, 25 bp, Mus musculus
agcctctgcctctagattggttgga

SEQ ID NO: 530220 - DNA, 25 bp, Mus musculus
agcctctgctcaccacggtcaaggg

SEQ ID NO: 530221 - DNA, 25 bp, Mus musculus
agcctctgctcagcacggtcaaggg

SEQ ID NO: 530222 - DNA, 25 bp, Mus musculus
agcctctggctcaagctgcagtgaa

SEQ ID NO: 530223 - DNA, 25 bp, Mus musculus
agcctctggctctagctgcagtgaa

SEQ ID NO: 530224 - DNA, 25 bp, Mus musculus
agcctcttagcacgatgcaggccaa

SEQ ID NO: 530225 - DNA, 25 bp, Mus musculus
agcctcttagcaggatgcaggccaa

SEQ ID NO: 530226 - DNA, 25 bp, Mus musculus
agcctcttcaggaccgtcaccatgg

SEQ ID NO: 530227 - DNA, 25 bp, Mus musculus
agcctcttcaggtccgtcaccatgg

SEQ ID NO: 530228 - DNA, 25 bp, Mus musculus
agcctcttctctagaccgcaggcgg

SEQ ID NO: 530229 - DNA, 25 bp, Mus musculus
agcctcttctcttgaccgcaggcgg

SEQ ID NO: 530230 - DNA, 25 bp, Mus musculus
agcctcttggccaacctctggcagt

SEQ ID NO: 530231 - DNA, 25 bp, Mus musculus
agcctcttggcctacctctggcagt

SEQ ID NO: 530232 - DNA, 25 bp, Mus musculus
agcctgaaaccccaggtggcccaga

SEQ ID NO: 530233 - DNA, 25 bp, Mus musculus
agcctgaaacccgaggtggcccaga

SEQ ID NO: 530234 - DNA, 25 bp, Mus musculus
agcctgaaagcaatgcttgtgcctg

SEQ ID NO: 530235 - DNA, 25 bp, Mus musculus
agcctgaaagcattgcttgtgcctg

SEQ ID NO: 530236 - DNA, 25 bp, Mus musculus
agcctgaacatgcttctgtccagga

SEQ ID NO: 530237 - DNA, 25 bp, Mus musculus
agcctgaacatggttctgtccagga

SEQ ID NO: 530238 - DNA, 25 bp, Mus musculus
agcctgaagctaccgtggactctgc

SEQ ID NO: 530239 - DNA, 25 bp, Mus musculus
agcctgaagctagcgtggactctgc

SEQ ID NO: 530240 - DNA, 25 bp, Mus musculus
agcctgacaggtaaggacaggagca

SEQ ID NO: 530241 - DNA, 25 bp, Mus musculus
agcctgacaggttaggacaggagca

SEQ ID NO: 530242 - DNA, 25 bp, Mus musculus
agcctgaccattcccaggaactcaa

SEQ ID NO: 530243 - DNA, 25 bp, Mus musculus
agcctgaccattgccaggaactcaa

SEQ ID NO: 530244 - DNA, 25 bp, Mus musculus
agcctgacggttcatacaggaaccc

SEQ ID NO: 530245 - DNA, 25 bp, Mus musculus
agcctgacggttgatacaggaaccc

SEQ ID NO: 530246 - DNA, 25 bp, Mus musculus
agcctgactgagaagaggacgctcc

SEQ ID NO: 530247 - DNA, 25 bp, Mus musculus
agcctgactgagtagaggacgctcc

SEQ ID NO: 530248 - DNA, 25 bp, Mus musculus
agcctgagcgcgatgccatctatga

SEQ ID NO: 530249 - DNA, 25 bp, Mus musculus
agcctgagcgcgttgccatctatga

SEQ ID NO: 530250 - DNA, 25 bp, Mus musculus
agcctgaggaaacggctgggacccg

SEQ ID NO: 530251 - DNA, 25 bp, Mus musculus
agcctgaggaaagggctgggacccg

SEQ ID NO: 530252 - DNA, 25 bp, Mus musculus
agcctgaggtgtataaggagatgat

SEQ ID NO: 530253 - DNA, 25 bp, Mus musculus
agcctgaggtgtttaaggagatgat

SEQ ID NO: 530254 - DNA, 25 bp, Mus musculus
agcctgagtgcaacatggagaaggt

SEQ ID NO: 530255 - DNA, 25 bp, Mus musculus
agcctgagtgcatcatggagaaggt

SEQ ID NO: 530256 - DNA, 25 bp, Mus musculus
agcctgataaccactgctcttcaag

SEQ ID NO: 530257 - DNA, 25 bp, Mus musculus
agcctgataacctctgctcttcaag

SEQ ID NO: 530258 - DNA, 25 bp, Mus musculus
agcctgatatgcaggtaatgagggt

SEQ ID NO: 530259 - DNA, 25 bp, Mus musculus
agcctgatatgctggtaatgagggt

SEQ ID NO: 530260 - DNA, 25 bp, Mus musculus
agcctgatcctacatcaccagtggg

SEQ ID NO: 530261 - DNA, 25 bp, Mus musculus
agcctgatcctagatcaccagtggg

SEQ ID NO: 530262 - DNA, 25 bp, Mus musculus
agcctgatctggcatcagtgagaga

SEQ ID NO: 530263 - DNA, 25 bp, Mus musculus
agcctgatctgggatcagtgagaga

SEQ ID NO: 530264 - DNA, 25 bp, Mus musculus
agcctgatggatatggtggagttcc

SEQ ID NO: 530265 - DNA, 25 bp, Mus musculus
agcctgatggatttggtggagttcc

SEQ ID NO: 530266 - DNA, 25 bp, Mus musculus
agcctgatgggcagatgcccagcga

SEQ ID NO: 530267 - DNA, 25 bp, Mus musculus
agcctgatgggctgatgcccagcga

SEQ ID NO: 530268 - DNA, 25 bp, Mus musculus
agcctgcaactgacagtctgcctgg

SEQ ID NO: 530269 - DNA, 25 bp, Mus musculus
agcctgcaactgtcagtctgcctgg

SEQ ID NO: 530270 - DNA, 25 bp, Mus musculus
agcctgcaagcccaagtcgggctgc

SEQ ID NO: 530271 - DNA, 25 bp, Mus musculus
agcctgcaagccgaagtcgggctgc

SEQ ID NO: 530272 - DNA, 25 bp, Mus musculus
agcctgcaccgcaggctggccgtgt

SEQ ID NO: 530273 - DNA, 25 bp, Mus musculus
agcctgcaccgctggctggccgtgt

SEQ ID NO: 530274 - DNA, 25 bp, Mus musculus
agcctgcagagcagtgtccggcagc

SEQ ID NO: 530275 - DNA, 25 bp, Mus musculus
agcctgcagagctgtgtccggcagc

SEQ ID NO: 530276 - DNA, 25 bp, Mus musculus
agcctgcagcgaaccagtctctggc

SEQ ID NO: 530277 - DNA, 25 bp, Mus musculus
agcctgcagcgatccagtctctggc

SEQ ID NO: 530278 - DNA, 25 bp, Mus musculus
agcctgcaggctctattccgggtcc

SEQ ID NO: 530279 - DNA, 25 bp, Mus musculus
agcctgcaggctgtattccgggtcc

SEQ ID NO: 530280 - DNA, 25 bp, Mus musculus
agcctgcatgctccgcgatgtgacc

SEQ ID NO: 530281 - DNA, 25 bp, Mus musculus
agcctgcatgctgcgcgatgtgacc

SEQ ID NO: 530282 - DNA, 25 bp, Mus musculus
agcctgcatggtaccaaaagccttg

SEQ ID NO: 530283 - DNA, 25 bp, Mus musculus
agcctgcatggttccaaaagccttg

SEQ ID NO: 530284 - DNA, 25 bp, Mus musculus
agcctgccgctgctaaagagacagg

SEQ ID NO: 530285 - DNA, 25 bp, Mus musculus
agcctgccgctggtaaagagacagg

SEQ ID NO: 530286 - DNA, 25 bp, Mus musculus
agcctgccgcttctgactcttctgg

SEQ ID NO: 530287 - DNA, 25 bp, Mus musculus
agcctgccgcttgtgactcttctgg

SEQ ID NO: 530288 - DNA, 25 bp, Mus musculus
agcctgcctgtcaagcattagtgac

SEQ ID NO: 530289 - DNA, 25 bp, Mus musculus
agcctgcctgtctagcattagtgac

SEQ ID NO: 530290 - DNA, 25 bp, Mus musculus
agcctgcgagatctgataaggagaa

SEQ ID NO: 530291 - DNA, 25 bp, Mus musculus
agcctgcgagatgtgataaggagaa

SEQ ID NO: 530292 - DNA, 25 bp, Mus musculus
agcctgcgattcctgcacgtgacag

SEQ ID NO: 530293 - DNA, 25 bp, Mus musculus
agcctgcgattcgtgcacgtgacag

SEQ ID NO: 530294 - DNA, 25 bp, Mus musculus
agcctgcgcacccaggacagtgtac

SEQ ID NO: 530295 - DNA, 25 bp, Mus musculus
agcctgcgcaccgaggacagtgtac

SEQ ID NO: 530296 - DNA, 25 bp, Mus musculus
agcctgcgggagaactgcccttgaa

SEQ ID NO: 530297 - DNA, 25 bp, Mus musculus
agcctgcgggagtactgcccttgaa

SEQ ID NO: 530298 - DNA, 25 bp, Mus musculus
agcctgctgtacctggaactgggaa

SEQ ID NO: 530299 - DNA, 25 bp, Mus musculus
agcctgctgtacgtggaactgggaa

SEQ ID NO: 530300 - DNA, 25 bp, Mus musculus
agcctgcttttcacccaggcaggaa

SEQ ID NO: 530301 - DNA, 25 bp, Mus musculus
agcctgcttttctcccaggcaggaa

SEQ ID NO: 530302 - DNA, 25 bp, Mus musculus
agcctggacaagaaggtccccgagg

SEQ ID NO: 530303 - DNA, 25 bp, Mus musculus
agcctggacaagctgtaccccgagt

SEQ ID NO: 530304 - DNA, 25 bp, Mus musculus
agcctggacaaggtgtaccccgagt

SEQ ID NO: 530305 - DNA, 25 bp, Mus musculus
agcctggacaagtaggtccccgagg

SEQ ID NO: 530306 - DNA, 25 bp, Mus musculus
agcctggaccatcgctgccgaatct

SEQ ID NO: 530307 - DNA, 25 bp, Mus musculus
agcctggaccatggctgccgaatct

SEQ ID NO: 530308 - DNA, 25 bp, Mus musculus
agcctggagaagctgaacatgcaag

SEQ ID NO: 530309 - DNA, 25 bp, Mus musculus
agcctggagaaggtgaacatgcaag

SEQ ID NO: 530310 - DNA, 25 bp, Mus musculus
agcctggaggacacggacttgagcc

SEQ ID NO: 530311 - DNA, 25 bp, Mus musculus
agcctggaggactcggacttgagcc

SEQ ID NO: 530312 - DNA, 25 bp, Mus musculus
agcctggaggtgagagaacagtcct

SEQ ID NO: 530313 - DNA, 25 bp, Mus musculus
agcctggaggtgtgagaacagtcct

SEQ ID NO: 530314 - DNA, 25 bp, Mus musculus
agcctggagtcacagcagacgccag

SEQ ID NO: 530315 - DNA, 25 bp, Mus musculus
agcctggagtcagagcagacgccag

SEQ ID NO: 530316 - DNA, 25 bp, Mus musculus
agcctggagtcgcaggttccccaat

SEQ ID NO: 530317 - DNA, 25 bp, Mus musculus
agcctggagtcggaggttccccaat

SEQ ID NO: 530318 - DNA, 25 bp, Mus musculus
agcctggatcagatacctggacata

SEQ ID NO: 530319 - DNA, 25 bp, Mus musculus
agcctggatcagttacctggacata

SEQ ID NO: 530320 - DNA, 25 bp, Mus musculus
agcctggatctgattacaaaagaag

SEQ ID NO: 530321 - DNA, 25 bp, Mus musculus
agcctggatctgtttacaaaagaag

SEQ ID NO: 530322 - DNA, 25 bp, Mus musculus
agcctggcacagaagccgaggtcac

SEQ ID NO: 530323 - DNA, 25 bp, Mus musculus
agcctggcacagtagccgaggtcac

SEQ ID NO: 530324 - DNA, 25 bp, Mus musculus
agcctggcacggactatgaggtgac

SEQ ID NO: 530325 - DNA, 25 bp, Mus musculus
agcctggcacggtctatgaggtgac

SEQ ID NO: 530326 - DNA, 25 bp, Mus musculus
agcctggccaaaacggtgagtaagg

SEQ ID NO: 530327 - DNA, 25 bp, Mus musculus
agcctggccaaatcggtgagtaagg

SEQ ID NO: 530328 - DNA, 25 bp, Mus musculus
agcctggcccctatgtcctctttgt

SEQ ID NO: 530329 - DNA, 25 bp, Mus musculus
agcctggcccctttgtcctctttgt

SEQ ID NO: 530330 - DNA, 25 bp, Mus musculus
agcctggctacccaggaagtagcac

SEQ ID NO: 530331 - DNA, 25 bp, Mus musculus
agcctggctaccgaggaagtagcac

SEQ ID NO: 530332 - DNA, 25 bp, Mus musculus
agcctggctcacagaccattcctgg

SEQ ID NO: 530333 - DNA, 25 bp, Mus musculus
agcctggctcactgaccattcctgg

SEQ ID NO: 530334 - DNA, 25 bp, Mus musculus
agcctggctggaacggtccatgcga

SEQ ID NO: 530335 - DNA, 25 bp, Mus musculus
agcctggctggatcggtccatgcga

SEQ ID NO: 530336 - DNA, 25 bp, Mus musculus
agcctgggaaagaatctcaatagag

SEQ ID NO: 530337 - DNA, 25 bp, Mus musculus
agcctgggaaagtatctcaatagag

SEQ ID NO: 530338 - DNA, 25 bp, Mus musculus
agcctgggaacaagggcaagttctt

SEQ ID NO: 530339 - DNA, 25 bp, Mus musculus
agcctgggaacatgggcaagttctt

SEQ ID NO: 530340 - DNA, 25 bp, Mus musculus
agcctgggaagtaggtctagcccaa

SEQ ID NO: 530341 - DNA, 25 bp, Mus musculus
agcctgggaagttggtctagcccaa

SEQ ID NO: 530342 - DNA, 25 bp, Mus musculus
agcctgggagccctgatgtacgaca

SEQ ID NO: 530343 - DNA, 25 bp, Mus musculus
agcctgggagccgtgatgtacgaca

SEQ ID NO: 530344 - DNA, 25 bp, Mus musculus
agcctgggggcgactccttgtccaa

SEQ ID NO: 530345 - DNA, 25 bp, Mus musculus
agcctgggggcgtctccttgtccaa

SEQ ID NO: 530346 - DNA, 25 bp, Mus musculus
agcctggtgcaactctcatcttcgg

SEQ ID NO: 530347 - DNA, 25 bp, Mus musculus
agcctggtgcaagtctcatcttcgg

SEQ ID NO: 530348 - DNA, 25 bp, Mus musculus
agcctgtaccacacctgtgctcaag

SEQ ID NO: 530349 - DNA, 25 bp, Mus musculus
agcctgtaccactcctgtgctcaag

SEQ ID NO: 530350 - DNA, 25 bp, Mus musculus
agcctgtcagaacttatcgatatca

SEQ ID NO: 530351 - DNA, 25 bp, Mus musculus
agcctgtcagaagttatcgatatca

SEQ ID NO: 530352 - DNA, 25 bp, Mus musculus
agcctgtccatgaggcacgggcttg

SEQ ID NO: 530353 - DNA, 25 bp, Mus musculus
agcctgtccatgtggcacgggcttg

SEQ ID NO: 530354 - DNA, 25 bp, Mus musculus
agcctgtccttcctgcagggctgca

SEQ ID NO: 530355 - DNA, 25 bp, Mus musculus
agcctgtccttcgtgcagggctgca

SEQ ID NO: 530356 - DNA, 25 bp, Mus musculus
agcctgtcgccaagccggcttgctg

SEQ ID NO: 530357 - DNA, 25 bp, Mus musculus
agcctgtcgccatgccggcttgctg

SEQ ID NO: 530358 - DNA, 25 bp, Mus musculus
agcctgtcgcctatgaggagcccaa

SEQ ID NO: 530359 - DNA, 25 bp, Mus musculus
agcctgtcgcctccaaatcaggacg

SEQ ID NO: 530360 - DNA, 25 bp, Mus musculus
agcctgtcgcctgcaaatcaggacg

SEQ ID NO: 530361 - DNA, 25 bp, Mus musculus
agcctgtcgcctttgaggagcccaa

SEQ ID NO: 530362 - DNA, 25 bp, Mus musculus
agcctgtgaattagggcggctcaag

SEQ ID NO: 530363 - DNA, 25 bp, Mus musculus
agcctgtgaatttgggcggctcaag

SEQ ID NO: 530364 - DNA, 25 bp, Mus musculus
agcctgtgacgacggccacatcatt

SEQ ID NO: 530365 - DNA, 25 bp, Mus musculus
agcctgtgacgagggccacatcatt

SEQ ID NO: 530366 - DNA, 25 bp, Mus musculus
agcctgtgctcaagtggagaaatgt

SEQ ID NO: 530367 - DNA, 25 bp, Mus musculus
agcctgtgctcatgtggagaaatgt

SEQ ID NO: 530368 - DNA, 25 bp, Mus musculus
agcctgtgggcactgtgtcgaaact

SEQ ID NO: 530369 - DNA, 25 bp, Mus musculus
agcctgtgggcagtgtgtcgaaact

SEQ ID NO: 530370 - DNA, 25 bp, Mus musculus
agcctgttggtcacgaacactcaac

SEQ ID NO: 530371 - DNA, 25 bp, Mus musculus
agcctgttggtctcgaacactcaac

SEQ ID NO: 530372 - DNA, 25 bp, Mus musculus
agccttaaacctccacagtcagaag

SEQ ID NO: 530373 - DNA, 25 bp, Mus musculus
agccttaaacctgcacagtcagaag

SEQ ID NO: 530374 - DNA, 25 bp, Mus musculus
agccttaagtgacttcctcctcagt

SEQ ID NO: 530375 - DNA, 25 bp, Mus musculus
agccttaagtgagttcctcctcagt

SEQ ID NO: 530376 - DNA, 25 bp, Mus musculus
agccttacagaaagaatgcatacag

SEQ ID NO: 530377 - DNA, 25 bp, Mus musculus
agccttacagaatgaatgcatacag

SEQ ID NO: 530378 - DNA, 25 bp, Mus musculus
agccttactactacaacaaccagag

SEQ ID NO: 530379 - DNA, 25 bp, Mus musculus
agccttactacttcaacaaccagag

SEQ ID NO: 530380 - DNA, 25 bp, Mus musculus
agccttatcagtcaccgatgggtcc

SEQ ID NO: 530381 - DNA, 25 bp, Mus musculus
agccttatcagtgaccgatgggtcc

SEQ ID NO: 530382 - DNA, 25 bp, Mus musculus
agccttcaccgaagtggccactggc

SEQ ID NO: 530383 - DNA, 25 bp, Mus musculus
agccttcaccgatgtggccactggc

SEQ ID NO: 530384 - DNA, 25 bp, Mus musculus
agccttcagcgacgaagtcaacatc

SEQ ID NO: 530385 - DNA, 25 bp, Mus musculus
agccttcagcgaggaagtcaacatc

SEQ ID NO: 530386 - DNA, 25 bp, Mus musculus
agccttcctgcgctcatcggagggc

SEQ ID NO: 530387 - DNA, 25 bp, Mus musculus
agccttcctgcggtcatcggagggc

SEQ ID NO: 530388 - DNA, 25 bp, Mus musculus
agccttctgcatattccaggctggc

SEQ ID NO: 530389 - DNA, 25 bp, Mus musculus
agccttctgcattttccaggctggc

SEQ ID NO: 530390 - DNA, 25 bp, Mus musculus
agccttcttaccagttagacattgg

SEQ ID NO: 530391 - DNA, 25 bp, Mus musculus
agccttcttacctgttagacattgg

SEQ ID NO: 530392 - DNA, 25 bp, Mus musculus
agccttgcaaggatatgccaggcct

SEQ ID NO: 530393 - DNA, 25 bp, Mus musculus
agccttgcaaggttatgccaggcct

SEQ ID NO: 530394 - DNA, 25 bp, Mus musculus
agccttggcccaaggcgggatgcac

SEQ ID NO: 530395 - DNA, 25 bp, Mus musculus
agccttggcccatggcgggatgcac

SEQ ID NO: 530396 - DNA, 25 bp, Mus musculus
agccttggccttcgtcatgggcaga

SEQ ID NO: 530397 - DNA, 25 bp, Mus musculus
agccttggccttggtcatgggcaga

SEQ ID NO: 530398 - DNA, 25 bp, Mus musculus
agccttggctgtaaccctgtggagc

SEQ ID NO: 530399 - DNA, 25 bp, Mus musculus
agccttggctgttaccctgtggagc

SEQ ID NO: 530400 - DNA, 25 bp, Mus musculus
agccttggcttcagggatgtcttcc

SEQ ID NO: 530401 - DNA, 25 bp, Mus musculus
agccttggcttctgggatgtcttcc

SEQ ID NO: 530402 - DNA, 25 bp, Mus musculus
agccttgggccaaaacgagccactc

SEQ ID NO: 530403 - DNA, 25 bp, Mus musculus
agccttgggccataacgagccactc

SEQ ID NO: 530404 - DNA, 25 bp, Mus musculus
agccttggtgaacggccggccactt

SEQ ID NO: 530405 - DNA, 25 bp, Mus musculus
agccttggtgaagggccggccactt

SEQ ID NO: 530406 - DNA, 25 bp, Mus musculus
agccttggtggcctattaccaaatg

SEQ ID NO: 530407 - DNA, 25 bp, Mus musculus
agccttggtggcgtattaccaaatg

SEQ ID NO: 530408 - DNA, 25 bp, Mus musculus
agccttgttgctcttgaactggaaa

SEQ ID NO: 530409 - DNA, 25 bp, Mus musculus
agccttgttgctgttgaactggaaa

SEQ ID NO: 530410 - DNA, 25 bp, Mus musculus
agcctttacctaagaccacagctgt

SEQ ID NO: 530411 - DNA, 25 bp, Mus musculus
agcctttacctatgaccacagctgt

SEQ ID NO: 530412 - DNA, 25 bp, Mus musculus
agcctttcagcacagagcctatgtg

SEQ ID NO: 530413 - DNA, 25 bp, Mus musculus
agcctttcagcagagagcctatgtg

SEQ ID NO: 530414 - DNA, 25 bp, Mus musculus
agcctttctctgactcggacccttt

SEQ ID NO: 530415 - DNA, 25 bp, Mus musculus
agcctttctctgtctcggacccttt

SEQ ID NO: 530416 - DNA, 25 bp, Mus musculus
agcctttgagaaccacagagtgtgc

SEQ ID NO: 530417 - DNA, 25 bp, Mus musculus
agcctttgagaagcacagagtgtgc

SEQ ID NO: 530418 - DNA, 25 bp, Mus musculus
agcctttggactatccctggcaggg

SEQ ID NO: 530419 - DNA, 25 bp, Mus musculus
agcctttggactttccctggcaggg

SEQ ID NO: 530420 - DNA, 25 bp, Mus musculus
agcctttggcttaggatgcgaaagc

SEQ ID NO: 530421 - DNA, 25 bp, Mus musculus
agcctttggctttggatgcgaaagc

SEQ ID NO: 530422 - DNA, 25 bp, Mus musculus
agccttttatgcagagtgttttaac

SEQ ID NO: 530423 - DNA, 25 bp, Mus musculus
agccttttatgctgagtgttttaac

SEQ ID NO: 530424 - DNA, 25 bp, Mus musculus
agccttttcaacagcaggatcttca

SEQ ID NO: 530425 - DNA, 25 bp, Mus musculus
agccttttcaactgcaggatcttca

SEQ ID NO: 530426 - DNA, 25 bp, Mus musculus
agcgaaaaattgagctgctcatggc

SEQ ID NO: 530427 - DNA, 25 bp, Mus musculus
agcgaaaaattgtgctgctcatggc

SEQ ID NO: 530428 - DNA, 25 bp, Mus musculus
agcgaaaaatttcgcctcagccagc

SEQ ID NO: 530429 - DNA, 25 bp, Mus musculus
agcgaaaaatttggcctcagccagc

SEQ ID NO: 530430 - DNA, 25 bp, Mus musculus
agcgaaaaccatatgcagtaaaagc

SEQ ID NO: 530431 - DNA, 25 bp, Mus musculus
agcgaaaaccatttgcagtaaaagc

SEQ ID NO: 530432 - DNA, 25 bp, Mus musculus
agcgaaaatgtcattttggtctcca

SEQ ID NO: 530433 - DNA, 25 bp, Mus musculus
agcgaaaatgtctttttggtctcca

SEQ ID NO: 530434 - DNA, 25 bp, Mus musculus
agcgaaagcgtaagcgcctgcgtcg

SEQ ID NO: 530435 - DNA, 25 bp, Mus musculus
agcgaaagcgtatgcgcctgcgtcg

SEQ ID NO: 530436 - DNA, 25 bp, Mus musculus
agcgaacaatacaggtacgactcgc

SEQ ID NO: 530437 - DNA, 25 bp, Mus musculus
agcgaacaatactggtacgactcgc

SEQ ID NO: 530438 - DNA, 25 bp, Mus musculus
agcgaacaggcacgcaagctccgag

SEQ ID NO: 530439 - DNA, 25 bp, Mus musculus
agcgaacaggcaggcaagctccgag

SEQ ID NO: 530440 - DNA, 25 bp, Mus musculus
agcgaaccaggcctaccagtacggc

SEQ ID NO: 530441 - DNA, 25 bp, Mus musculus
agcgaaccaggcgtaccagtacggc

SEQ ID NO: 530442 - DNA, 25 bp, Mus musculus
agcgaacgagcaagccagcgagtga

SEQ ID NO: 530443 - DNA, 25 bp, Mus musculus
agcgaacgagcatgccagcgagtga

SEQ ID NO: 530444 - DNA, 25 bp, Mus musculus
agcgaacgctgacccctggctatat

SEQ ID NO: 530445 - DNA, 25 bp, Mus musculus
agcgaacgctgagccctggctatat

SEQ ID NO: 530446 - DNA, 25 bp, Mus musculus
agcgaagcacggatgtggcagaatt

SEQ ID NO: 530447 - DNA, 25 bp, Mus musculus
agcgaagcacggttgtggcagaatt

SEQ ID NO: 530448 - DNA, 25 bp, Mus musculus
agcgaagtcaagacggatgtgaata

SEQ ID NO: 530449 - DNA, 25 bp, Mus musculus
agcgaagtcaagtcggatgtgaata

SEQ ID NO: 530450 - DNA, 25 bp, Mus musculus
agcgacaccaagacagaagctgatg

SEQ ID NO: 530451 - DNA, 25 bp, Mus musculus
agcgacaccaagtcagaagctgatg

SEQ ID NO: 530452 - DNA, 25 bp, Mus musculus
agcgacacggctaggatctcctcca

SEQ ID NO: 530453 - DNA, 25 bp, Mus musculus
agcgacacggcttggatctcctcca

SEQ ID NO: 530454 - DNA, 25 bp, Mus musculus
agcgacataagccagagcatcgttc

SEQ ID NO: 530455 - DNA, 25 bp, Mus musculus
agcgacataagcgagagcatcgttc

SEQ ID NO: 530456 - DNA, 25 bp, Mus musculus
agcgacatgtttctggaacacagat

SEQ ID NO: 530457 - DNA, 25 bp, Mus musculus
agcgacatgtttgtggaacacagat

SEQ ID NO: 530458 - DNA, 25 bp, Mus musculus
agcgacattaacagctcggtgatgg

SEQ ID NO: 530459 - DNA, 25 bp, Mus musculus
agcgacattaactgctcggtgatgg

SEQ ID NO: 530460 - DNA, 25 bp, Mus musculus
agcgacccgtggctacgtcctgaac

SEQ ID NO: 530461 - DNA, 25 bp, Mus musculus
agcgacccgtgggtacgtcctgaac

SEQ ID NO: 530462 - DNA, 25 bp, Mus musculus
agcgacctgcttatatgccttcgtg

SEQ ID NO: 530463 - DNA, 25 bp, Mus musculus
agcgacctgcttttatgccttcgtg

SEQ ID NO: 530464 - DNA, 25 bp, Mus musculus
agcgacgaccggatcctccagtgtg

SEQ ID NO: 530465 - DNA, 25 bp, Mus musculus
agcgacgaccggttcctccagtgtg

SEQ ID NO: 530466 - DNA, 25 bp, Mus musculus
agcgacgcagacatggagcccgagc

SEQ ID NO: 530467 - DNA, 25 bp, Mus musculus
agcgacgcagacttggagcccgagc

SEQ ID NO: 530468 - DNA, 25 bp, Mus musculus
agcgacgcctacctgagccttctag

SEQ ID NO: 530469 - DNA, 25 bp, Mus musculus
agcgacgcctacgtgagccttctag

SEQ ID NO: 530470 - DNA, 25 bp, Mus musculus
agcgacggaagccacagttgctatg

SEQ ID NO: 530471 - DNA, 25 bp, Mus musculus
agcgacggaagcgacagttgctatg

SEQ ID NO: 530472 - DNA, 25 bp, Mus musculus
agcgacggcttcacatcatggcgga

SEQ ID NO: 530473 - DNA, 25 bp, Mus musculus
agcgacggcttctcatcatggcgga

SEQ ID NO: 530474 - DNA, 25 bp, Mus musculus
agcgacggtataaagccggccacgg

SEQ ID NO: 530475 - DNA, 25 bp, Mus musculus
agcgacggtatatagccggccacgg

SEQ ID NO: 530476 - DNA, 25 bp, Mus musculus
agcgacggtcacagtccatctacct

SEQ ID NO: 530477 - DNA, 25 bp, Mus musculus
agcgacggtcactgtccatctacct

SEQ ID NO: 530478 - DNA, 25 bp, Mus musculus
agcgacgtttttctgagcagcctca

SEQ ID NO: 530479 - DNA, 25 bp, Mus musculus
agcgacgtttttgtgagcagcctca

SEQ ID NO: 530480 - DNA, 25 bp, Mus musculus
agcgactggtcaaccctgtggactg

SEQ ID NO: 530481 - DNA, 25 bp, Mus musculus
agcgactggtcatccctgtggactg

SEQ ID NO: 530482 - DNA, 25 bp, Mus musculus
agcgagaacccgaacgctccgcggg

SEQ ID NO: 530483 - DNA, 25 bp, Mus musculus
agcgagaacccgtacgctccgcggg

SEQ ID NO: 530484 - DNA, 25 bp, Mus musculus
agcgagaagctacagaccgggaacc

SEQ ID NO: 530485 - DNA, 25 bp, Mus musculus
agcgagaagctagagaccgggaacc

SEQ ID NO: 530486 - DNA, 25 bp, Mus musculus
agcgagacaacccagcgcatcaacg

SEQ ID NO: 530487 - DNA, 25 bp, Mus musculus
agcgagacaaccgagcgcatcaacg

SEQ ID NO: 530488 - DNA, 25 bp, Mus musculus
agcgagaccccaaagcagagacccg

SEQ ID NO: 530489 - DNA, 25 bp, Mus musculus
agcgagaccccatagcagagacccg

SEQ ID NO: 530490 - DNA, 25 bp, Mus musculus
agcgagaccttcaggcggcgctagc

SEQ ID NO: 530491 - DNA, 25 bp, Mus musculus
agcgagaccttctggcggcgctagc

SEQ ID NO: 530492 - DNA, 25 bp, Mus musculus
agcgagagcagaccaccggccaagc

SEQ ID NO: 530493 - DNA, 25 bp, Mus musculus
agcgagagcagagcaccggccaagc

SEQ ID NO: 530494 - DNA, 25 bp, Mus musculus
agcgagagtgacaacagcgcagact

SEQ ID NO: 530495 - DNA, 25 bp, Mus musculus
agcgagagtgactacagcgcagact

SEQ ID NO: 530496 - DNA, 25 bp, Mus musculus
agcgagcactttacatttttgggta

SEQ ID NO: 530497 - DNA, 25 bp, Mus musculus
agcgagcacttttcatttttgggta

SEQ ID NO: 530498 - DNA, 25 bp, Mus musculus
agcgagcctccaccgatcagggaga

SEQ ID NO: 530499 - DNA, 25 bp, Mus musculus
agcgagcctccagcgatcagggaga

SEQ ID NO: 530500 - DNA, 25 bp, Mus musculus
agcgagcgagaacccgaacgctccg

SEQ ID NO: 530501 - DNA, 25 bp, Mus musculus
agcgagcgagaagccgaacgctccg

SEQ ID NO: 530502 - DNA, 25 bp, Mus musculus
agcgagctcctgagcatagtctgtc

SEQ ID NO: 530503 - DNA, 25 bp, Mus musculus
agcgagctcctgtgcatagtctgtc

SEQ ID NO: 530504 - DNA, 25 bp, Mus musculus
agcgagctgagacaattgaagaaac

SEQ ID NO: 530505 - DNA, 25 bp, Mus musculus
agcgagctgagagaattgaagaaac

SEQ ID NO: 530506 - DNA, 25 bp, Mus musculus
agcgagctgccccatgagattgaca

SEQ ID NO: 530507 - DNA, 25 bp, Mus musculus
agcgagctgcccgatgagattgaca

SEQ ID NO: 530508 - DNA, 25 bp, Mus musculus
agcgaggacaacacaccagagcacc

SEQ ID NO: 530509 - DNA, 25 bp, Mus musculus
agcgaggacaactcaccagagcacc

SEQ ID NO: 530510 - DNA, 25 bp, Mus musculus
agcgaggacggccaggcgctcaacg

SEQ ID NO: 530511 - DNA, 25 bp, Mus musculus
agcgaggacggcgaggcgctcaacg

SEQ ID NO: 530512 - DNA, 25 bp, Mus musculus
agcgaggcagccatggaacgtgctc

SEQ ID NO: 530513 - DNA, 25 bp, Mus musculus
agcgaggcagccttggaacgtgctc

SEQ ID NO: 530514 - DNA, 25 bp, Mus musculus
agcgagggcaccattccaactacca

SEQ ID NO: 530515 - DNA, 25 bp, Mus musculus
agcgagggcacctttccaactacca

SEQ ID NO: 530516 - DNA, 25 bp, Mus musculus
agcgaggtggtgagacgaccctcaa

SEQ ID NO: 530517 - DNA, 25 bp, Mus musculus
agcgaggtggtgtgacgaccctcaa

SEQ ID NO: 530518 - DNA, 25 bp, Mus musculus
agcgagtactggagtccctgtcggc

SEQ ID NO: 530519 - DNA, 25 bp, Mus musculus
agcgagtactggtgtccctgtcggc

SEQ ID NO: 530520 - DNA, 25 bp, Mus musculus
agcgagtactttccgctgttcctcg

SEQ ID NO: 530521 - DNA, 25 bp, Mus musculus
agcgagtactttgcgctgttcctcg

SEQ ID NO: 530522 - DNA, 25 bp, Mus musculus
agcgagtgccctacaccttctgcag

SEQ ID NO: 530523 - DNA, 25 bp, Mus musculus
agcgagtgcccttcaccttctgcag

SEQ ID NO: 530524 - DNA, 25 bp, Mus musculus
agcgagtgcctcaagttcatgacca

SEQ ID NO: 530525 - DNA, 25 bp, Mus musculus
agcgagtgcctctagttcatgacca

SEQ ID NO: 530526 - DNA, 25 bp, Mus musculus
agcgagtggacaccaccaccttact

SEQ ID NO: 530527 - DNA, 25 bp, Mus musculus
agcgagtggacagcaccaccttact

SEQ ID NO: 530528 - DNA, 25 bp, Mus musculus
agcgagtgtgcgacgccagcgtcct

SEQ ID NO: 530529 - DNA, 25 bp, Mus musculus
agcgagtgtgcgtcgccagcgtcct

SEQ ID NO: 530530 - DNA, 25 bp, Mus musculus
agcgatcaaagcacgagtcagggag

SEQ ID NO: 530531 - DNA, 25 bp, Mus musculus
agcgatcaaagctcgagtcagggag

SEQ ID NO: 530532 - DNA, 25 bp, Mus musculus
agcgatcggtgcagcagagccaccc

SEQ ID NO: 530533 - DNA, 25 bp, Mus musculus
agcgatcggtgctgcagagccaccc

SEQ ID NO: 530534 - DNA, 25 bp, Mus musculus
agcgatctggacaaaggccaagaag

SEQ ID NO: 530535 - DNA, 25 bp, Mus musculus
agcgatctggactaaggccaagaag

SEQ ID NO: 530536 - DNA, 25 bp, Mus musculus
agcgatgattccatttgtgtcctgg

SEQ ID NO: 530537 - DNA, 25 bp, Mus musculus
agcgatgattccttttgtgtcctgg

SEQ ID NO: 530538 - DNA, 25 bp, Mus musculus
agcgatgcaactaagttaaggccaa

SEQ ID NO: 530539 - DNA, 25 bp, Mus musculus
agcgatgcaacttagttaaggccaa

SEQ ID NO: 530540 - DNA, 25 bp, Mus musculus
agcgatgcgtttccccgggtgaacc

SEQ ID NO: 530541 - DNA, 25 bp, Mus musculus
agcgatgcgtttgcccgggtgaacc

SEQ ID NO: 530542 - DNA, 25 bp, Mus musculus
agcgatggcagtcaccagtgactaa

SEQ ID NO: 530543 - DNA, 25 bp, Mus musculus
agcgatggcagtgaccagtgactaa

SEQ ID NO: 530544 - DNA, 25 bp, Mus musculus
agcgcaaacgcacacaggtcaagat

SEQ ID NO: 530545 - DNA, 25 bp, Mus musculus
agcgcaaacgcagacaggtcaagat

SEQ ID NO: 530546 - DNA, 25 bp, Mus musculus
agcgcaacctctcctgcggcagtga

SEQ ID NO: 530547 - DNA, 25 bp, Mus musculus
agcgcaacctctgctgcggcagtga

SEQ ID NO: 530548 - DNA, 25 bp, Mus musculus
agcgcaagaagcagatcgccgtgga

SEQ ID NO: 530549 - DNA, 25 bp, Mus musculus
agcgcaagaagctgatcgccgtgga

SEQ ID NO: 530550 - DNA, 25 bp, Mus musculus
agcgcaagtcggacggagccttcta

SEQ ID NO: 530551 - DNA, 25 bp, Mus musculus
agcgcaagtcggtcggagccttcta

SEQ ID NO: 530552 - DNA, 25 bp, Mus musculus
agcgcacagcggagccgcctagaag

SEQ ID NO: 530553 - DNA, 25 bp, Mus musculus
agcgcacagcggtgccgcctagaag

SEQ ID NO: 530554 - DNA, 25 bp, Mus musculus
agcgcaccctgaagatggagcagag

SEQ ID NO: 530555 - DNA, 25 bp, Mus musculus
agcgcaccctgatgatggagcagag

SEQ ID NO: 530556 - DNA, 25 bp, Mus musculus
agcgcacgagttcggccatgcactg

SEQ ID NO: 530557 - DNA, 25 bp, Mus musculus
agcgcacgagttgggccatgcactg

SEQ ID NO: 530558 - DNA, 25 bp, Mus musculus
agcgcactccagcagtctctttctg

SEQ ID NO: 530559 - DNA, 25 bp, Mus musculus
agcgcactccaggagtctctttctg

SEQ ID NO: 530560 - DNA, 25 bp, Mus musculus
agcgcactgccaacctaggcgctgg

SEQ ID NO: 530561 - DNA, 25 bp, Mus musculus
agcgcactgccatcctaggcgctgg

SEQ ID NO: 530562 - DNA, 25 bp, Mus musculus
agcgcagagtccagacctacaccat

SEQ ID NO: 530563 - DNA, 25 bp, Mus musculus
agcgcagagtcctgacctacaccat

SEQ ID NO: 530564 - DNA, 25 bp, Mus musculus
agcgcagcccttccattttgccctg

SEQ ID NO: 530565 - DNA, 25 bp, Mus musculus
agcgcagcccttgcattttgccctg

SEQ ID NO: 530566 - DNA, 25 bp, Mus musculus
agcgcagcctggagcagtttctgct

SEQ ID NO: 530567 - DNA, 25 bp, Mus musculus
agcgcagcctggtgcagtttctgct

SEQ ID NO: 530568 - DNA, 25 bp, Mus musculus
agcgcagtcggcaaccgttgaggaa

SEQ ID NO: 530569 - DNA, 25 bp, Mus musculus
agcgcagtcggctaccgttgaggaa

SEQ ID NO: 530570 - DNA, 25 bp, Mus musculus
agcgcagtgtgcatctgatggaccc

SEQ ID NO: 530571 - DNA, 25 bp, Mus musculus
agcgcagtgtgcttctgatggaccc

SEQ ID NO: 530572 - DNA, 25 bp, Mus musculus
agcgcatcctaactggtggcaaaga

SEQ ID NO: 530573 - DNA, 25 bp, Mus musculus
agcgcatcctaagtggtggcaaaga

SEQ ID NO: 530574 - DNA, 25 bp, Mus musculus
agcgcatcctctatgccacctggta

SEQ ID NO: 530575 - DNA, 25 bp, Mus musculus
agcgcatcctctttgccacctggta

SEQ ID NO: 530576 - DNA, 25 bp, Mus musculus
agcgcatcgcacactttgacctgaa

SEQ ID NO: 530577 - DNA, 25 bp, Mus musculus
agcgcatcgcactctttgacctgaa

SEQ ID NO: 530578 - DNA, 25 bp, Mus musculus
agcgcatctccgcagcggtacagga

SEQ ID NO: 530579 - DNA, 25 bp, Mus musculus
agcgcatctccggagcggtacagga

SEQ ID NO: 530580 - DNA, 25 bp, Mus musculus
agcgcattcaggaggagacccatca

SEQ ID NO: 530581 - DNA, 25 bp, Mus musculus
agcgcattcaggtggagacccatca

SEQ ID NO: 530582 - DNA, 25 bp, Mus musculus
agcgccaagggcaatacctcagagc

SEQ ID NO: 530583 - DNA, 25 bp, Mus musculus
agcgccaagggctatacctcagagc

SEQ ID NO: 530584 - DNA, 25 bp, Mus musculus
agcgccaagtcgaaagtcgcccggg

SEQ ID NO: 530585 - DNA, 25 bp, Mus musculus
agcgccaagtcgtaagtcgcccggg

SEQ ID NO: 530586 - DNA, 25 bp, Mus musculus
agcgccactcgtccacagcgaagaa

SEQ ID NO: 530587 - DNA, 25 bp, Mus musculus
agcgccactcgtgcacagcgaagaa

SEQ ID NO: 530588 - DNA, 25 bp, Mus musculus
agcgccaggtctacatccagcctga

SEQ ID NO: 530589 - DNA, 25 bp, Mus musculus
agcgccaggtcttcatccagcctga

SEQ ID NO: 530590 - DNA, 25 bp, Mus musculus
agcgccagtaccagctgtgtcaggg

SEQ ID NO: 530591 - DNA, 25 bp, Mus musculus
agcgccagtacctgctgtgtcaggg

SEQ ID NO: 530592 - DNA, 25 bp, Mus musculus
agcgccagtgtaatcgccattattg

SEQ ID NO: 530593 - DNA, 25 bp, Mus musculus
agcgccagtgtattcgccattattg

SEQ ID NO: 530594 - DNA, 25 bp, Mus musculus
agcgccatcgatccccaaggagaat

SEQ ID NO: 530595 - DNA, 25 bp, Mus musculus
agcgccatcgatgcccaaggagaat

SEQ ID NO: 530596 - DNA, 25 bp, Mus musculus
agcgccatcgcacacggtccaaagg

SEQ ID NO: 530597 - DNA, 25 bp, Mus musculus
agcgccatcgcagacggtccaaagg

SEQ ID NO: 530598 - DNA, 25 bp, Mus musculus
agcgccatcgccactaacggagtgg

SEQ ID NO: 530599 - DNA, 25 bp, Mus musculus
agcgccatcgcctctaacggagtgg

SEQ ID NO: 530600 - DNA, 25 bp, Mus musculus
agcgcccacgatccacgtgtacgag

SEQ ID NO: 530601 - DNA, 25 bp, Mus musculus
agcgcccacgatgcacgtgtacgag

SEQ ID NO: 530602 - DNA, 25 bp, Mus musculus
agcgcccactgcctaacggagagac

SEQ ID NO: 530603 - DNA, 25 bp, Mus musculus
agcgcccactgcgtaacggagagac

SEQ ID NO: 530604 - DNA, 25 bp, Mus musculus
agcgcccgagagagaagttatcagt

SEQ ID NO: 530605 - DNA, 25 bp, Mus musculus
agcgcccgagagtgaagttatcagt

SEQ ID NO: 530606 - DNA, 25 bp, Mus musculus
agcgcccgagtcaatgagaacgtgg

SEQ ID NO: 530607 - DNA, 25 bp, Mus musculus
agcgcccgagtctatgagaacgtgg

SEQ ID NO: 530608 - DNA, 25 bp, Mus musculus
agcgccctatttcgccacagcgtgg

SEQ ID NO: 530609 - DNA, 25 bp, Mus musculus
agcgccctatttggccacagcgtgg

SEQ ID NO: 530610 - DNA, 25 bp, Mus musculus
agcgccgcggtcaccggcatggatc

SEQ ID NO: 530611 - DNA, 25 bp, Mus musculus
agcgccgcggtctccggcatggatc

SEQ ID NO: 530612 - DNA, 25 bp, Mus musculus
agcgccgcgtgcagtcctatgagtt

SEQ ID NO: 530613 - DNA, 25 bp, Mus musculus
agcgccgcgtgctgtcctatgagtt

SEQ ID NO: 530614 - DNA, 25 bp, Mus musculus
agcgccggcatgatgaagttcactg

SEQ ID NO: 530615 - DNA, 25 bp, Mus musculus
agcgccggcatgttgaagttcactg

SEQ ID NO: 530616 - DNA, 25 bp, Mus musculus
agcgccggcgcaacgtgagactctt

SEQ ID NO: 530617 - DNA, 25 bp, Mus musculus
agcgccggcgcatcgtgagactctt

SEQ ID NO: 530618 - DNA, 25 bp, Mus musculus
agcgccgtgggcaacgctgcctgct

SEQ ID NO: 530619 - DNA, 25 bp, Mus musculus
agcgccgtgggctacgctgcctgct

SEQ ID NO: 530620 - DNA, 25 bp, Mus musculus
agcgccgtttcccactggaacgtgg

SEQ ID NO: 530621 - DNA, 25 bp, Mus musculus
agcgccgtttccgactggaacgtgg

SEQ ID NO: 530622 - DNA, 25 bp, Mus musculus
agcgcctacatgaacccaacaggtg

SEQ ID NO: 530623 - DNA, 25 bp, Mus musculus
agcgcctacatgtacccaacaggtg

SEQ ID NO: 530624 - DNA, 25 bp, Mus musculus
agcgcctagaaccaggcctggagca

SEQ ID NO: 530625 - DNA, 25 bp, Mus musculus
agcgcctagaacgaggcctggagca

SEQ ID NO: 530626 - DNA, 25 bp, Mus musculus
agcgcctcacggcaaccgtggagtc

SEQ ID NO: 530627 - DNA, 25 bp, Mus musculus
agcgcctcacgggaaccgtggagtc

SEQ ID NO: 530628 - DNA, 25 bp, Mus musculus
agcgcctcggctcttcctagggtta

SEQ ID NO: 530629 - DNA, 25 bp, Mus musculus
agcgcctcggctgttcctagggtta

SEQ ID NO: 530630 - DNA, 25 bp, Mus musculus
agcgcctctcagcatggaaaactca

SEQ ID NO: 530631 - DNA, 25 bp, Mus musculus
agcgcctctcaggatggaaaactca

SEQ ID NO: 530632 - DNA, 25 bp, Mus musculus
agcgcctctctaacgacttcgtggg

SEQ ID NO: 530633 - DNA, 25 bp, Mus musculus
agcgcctctctatcgacttcgtggg

SEQ ID NO: 530634 - DNA, 25 bp, Mus musculus
agcgcctgacggagccacagcttgg

SEQ ID NO: 530635 - DNA, 25 bp, Mus musculus
agcgcctgacggtgccacagcttgg

SEQ ID NO: 530636 - DNA, 25 bp, Mus musculus
agcgcctgcttcatcaccgttagga

SEQ ID NO: 530637 - DNA, 25 bp, Mus musculus
agcgcctgcttcttcaccgttagga

SEQ ID NO: 530638 - DNA, 25 bp, Mus musculus
agcgccttctccagcgtcctaggtg

SEQ ID NO: 530639 - DNA, 25 bp, Mus musculus
agcgccttctcctgcgtcctaggtg

SEQ ID NO: 530640 - DNA, 25 bp, Mus musculus
agcgccttggccctagtactaatcc

SEQ ID NO: 530641 - DNA, 25 bp, Mus musculus
agcgccttggccgtagtactaatcc

SEQ ID NO: 530642 - DNA, 25 bp, Mus musculus
agcgcctttctacccaagctgatga

SEQ ID NO: 530643 - DNA, 25 bp, Mus musculus
agcgcctttctagccaagctgatga

SEQ ID NO: 530644 - DNA, 25 bp, Mus musculus
agcgcctttggcaacttcatcacag

SEQ ID NO: 530645 - DNA, 25 bp, Mus musculus
agcgcctttggctacttcatcacag

SEQ ID NO: 530646 - DNA, 25 bp, Mus musculus
agcgcgaacttcagcgcgctgcacg

SEQ ID NO: 530647 - DNA, 25 bp, Mus musculus
agcgcgaacttctgcgcgctgcacg

SEQ ID NO: 530648 - DNA, 25 bp, Mus musculus
agcgcgactaccattctgcagccga

SEQ ID NO: 530649 - DNA, 25 bp, Mus musculus
agcgcgactacctttctgcagccga

SEQ ID NO: 530650 - DNA, 25 bp, Mus musculus
agcgcgagcgacactggtgtctccg

SEQ ID NO: 530651 - DNA, 25 bp, Mus musculus
agcgcgagcgactctggtgtctccg

SEQ ID NO: 530652 - DNA, 25 bp, Mus musculus
agcgcgagctggaccaggagcggaa

SEQ ID NO: 530653 - DNA, 25 bp, Mus musculus
agcgcgagctggtccaggagcggaa

SEQ ID NO: 530654 - DNA, 25 bp, Mus musculus
agcgcgcagcccctcttggaataag

SEQ ID NO: 530655 - DNA, 25 bp, Mus musculus
agcgcgcagcccgtcttggaataag

SEQ ID NO: 530656 - DNA, 25 bp, Mus musculus
agcgcgcaggctctgcacgcttgac

SEQ ID NO: 530657 - DNA, 25 bp, Mus musculus
agcgcgcaggctgtgcacgcttgac

SEQ ID NO: 530658 - DNA, 25 bp, Mus musculus
agcgcgccaccaaggaggagtacag

SEQ ID NO: 530659 - DNA, 25 bp, Mus musculus
agcgcgccaccatggaggagtacag

SEQ ID NO: 530660 - DNA, 25 bp, Mus musculus
agcgcgcgaagacacaggagcatac

SEQ ID NO: 530661 - DNA, 25 bp, Mus musculus
agcgcgcgaagagacaggagcatac

SEQ ID NO: 530662 - DNA, 25 bp, Mus musculus
agcgcggacattccaaacctgcctg

SEQ ID NO: 530663 - DNA, 25 bp, Mus musculus
agcgcggacattgcaaacctgcctg

SEQ ID NO: 530664 - DNA, 25 bp, Mus musculus
agcgcggcgagtacccttacctggg

SEQ ID NO: 530665 - DNA, 25 bp, Mus musculus
agcgcggcgagttcccttacctggg

SEQ ID NO: 530666 - DNA, 25 bp, Mus musculus
agcgcggctccaagttttccccggg

SEQ ID NO: 530667 - DNA, 25 bp, Mus musculus
agcgcggctccatgttttccccggg

SEQ ID NO: 530668 - DNA, 25 bp, Mus musculus
agcgcggtccctagtgcagtacgca

SEQ ID NO: 530669 - DNA, 25 bp, Mus musculus
agcgcggtcccttgtgcagtacgca

SEQ ID NO: 530670 - DNA, 25 bp, Mus musculus
agcgcgtcgtcactcccgctgggaa

SEQ ID NO: 530671 - DNA, 25 bp, Mus musculus
agcgcgtcgtcagtcccgctgggaa

SEQ ID NO: 530672 - DNA, 25 bp, Mus musculus
agcgcgtgggcaatatcacctggca

SEQ ID NO: 530673 - DNA, 25 bp, Mus musculus
agcgcgtgggcattatcacctggca

SEQ ID NO: 530674 - DNA, 25 bp, Mus musculus
agcgctaccagaagattggagacac

SEQ ID NO: 530675 - DNA, 25 bp, Mus musculus
agcgctaccagatgattggagacac

SEQ ID NO: 530676 - DNA, 25 bp, Mus musculus
agcgctagcgctcggcaactttgaa

SEQ ID NO: 530677 - DNA, 25 bp, Mus musculus
agcgctagcgctgggcaactttgaa

SEQ ID NO: 530678 - DNA, 25 bp, Mus musculus
agcgctagtgggagattttctctga

SEQ ID NO: 530679 - DNA, 25 bp, Mus musculus
agcgctagtgggtgattttctctga

SEQ ID NO: 530680 - DNA, 25 bp, Mus musculus
agcgctcaccacagaatgacttcca

SEQ ID NO: 530681 - DNA, 25 bp, Mus musculus
agcgctcaccactgaatgacttcca

SEQ ID NO: 530682 - DNA, 25 bp, Mus musculus
agcgctcatgagctgtgactatctg

SEQ ID NO: 530683 - DNA, 25 bp, Mus musculus
agcgctcatgaggtgtgactatctg

SEQ ID NO: 530684 - DNA, 25 bp, Mus musculus
agcgctccctgcctgggagtctagt

SEQ ID NO: 530685 - DNA, 25 bp, Mus musculus
agcgctccctgcgtgggagtctagt

SEQ ID NO: 530686 - DNA, 25 bp, Mus musculus
agcgctcctgttctagctgttgcag

SEQ ID NO: 530687 - DNA, 25 bp, Mus musculus
agcgctcctgttgtagctgttgcag

SEQ ID NO: 530688 - DNA, 25 bp, Mus musculus
agcgctcggcagaggcgccacagaa

SEQ ID NO: 530689 - DNA, 25 bp, Mus musculus
agcgctcggcagtggcgccacagaa

SEQ ID NO: 530690 - DNA, 25 bp, Mus musculus
agcgctctcacacagaatcttctgg

SEQ ID NO: 530691 - DNA, 25 bp, Mus musculus
agcgctctcacagagaatcttctgg

SEQ ID NO: 530692 - DNA, 25 bp, Mus musculus
agcgctctgtcacctggtcctgaag

SEQ ID NO: 530693 - DNA, 25 bp, Mus musculus
agcgctctgtcagctggtcctgaag

SEQ ID NO: 530694 - DNA, 25 bp, Mus musculus
agcgctcttctgactgtctacccat

SEQ ID NO: 530695 - DNA, 25 bp, Mus musculus
agcgctcttctgtctgtctacccat

SEQ ID NO: 530696 - DNA, 25 bp, Mus musculus
agcgctgaggagaagcactccagag

SEQ ID NO: 530697 - DNA, 25 bp, Mus musculus
agcgctgaggagtagcactccagag

SEQ ID NO: 530698 - DNA, 25 bp, Mus musculus
agcgctgccgccctgtcctttacga

SEQ ID NO: 530699 - DNA, 25 bp, Mus musculus
agcgctgccgccgtgtcctttacga

SEQ ID NO: 530700 - DNA, 25 bp, Mus musculus
agcgctgccttcatggaccgtctgg

SEQ ID NO: 530701 - DNA, 25 bp, Mus musculus
agcgctgccttcttggaccgtctgg

SEQ ID NO: 530702 - DNA, 25 bp, Mus musculus
agcgctgctttgaacacacccattt

SEQ ID NO: 530703 - DNA, 25 bp, Mus musculus
agcgctgctttgtacacacccattt

SEQ ID NO: 530704 - DNA, 25 bp, Mus musculus
agcgctggcaaaacggtgggaccca

SEQ ID NO: 530705 - DNA, 25 bp, Mus musculus
agcgctggcaaatcggtgggaccca

SEQ ID NO: 530706 - DNA, 25 bp, Mus musculus
agcgctgggacaatgggatctttgc

SEQ ID NO: 530707 - DNA, 25 bp, Mus musculus
agcgctgggacattgggatctttgc

SEQ ID NO: 530708 - DNA, 25 bp, Mus musculus
agcgctgtcgacaagctgcagcaag

SEQ ID NO: 530709 - DNA, 25 bp, Mus musculus
agcgctgtcgactagctgcagcaag

SEQ ID NO: 530710 - DNA, 25 bp, Mus musculus
agcgctgtgtgaacagcaccagcag

SEQ ID NO: 530711 - DNA, 25 bp, Mus musculus
agcgctgtgtgatcagcaccagcag

SEQ ID NO: 530712 - DNA, 25 bp, Mus musculus
agcgcttattggctgccggcagtac

SEQ ID NO: 530713 - DNA, 25 bp, Mus musculus
agcgcttattgggtgccggcagtac

SEQ ID NO: 530714 - DNA, 25 bp, Mus musculus
agcgcttcagctagagcttcaacct

SEQ ID NO: 530715 - DNA, 25 bp, Mus musculus
agcgcttcagcttgagcttcaacct

SEQ ID NO: 530716 - DNA, 25 bp, Mus musculus
agcgcttcgggtactagaggctgaa

SEQ ID NO: 530717 - DNA, 25 bp, Mus musculus
agcgcttcgggttctagaggctgaa

SEQ ID NO: 530718 - DNA, 25 bp, Mus musculus
agcgcttcgtacagaccatggccga

SEQ ID NO: 530719 - DNA, 25 bp, Mus musculus
agcgcttcgtactgaccatggccga

SEQ ID NO: 530720 - DNA, 25 bp, Mus musculus
agcgctttacgtaaacagcgctcgg

SEQ ID NO: 530721 - DNA, 25 bp, Mus musculus
agcgctttacgttaacagcgctcgg

SEQ ID NO: 530722 - DNA, 25 bp, Mus musculus
agcgctttccttatcctcttaatga

SEQ ID NO: 530723 - DNA, 25 bp, Mus musculus
agcgctttccttttcctcttaatga

SEQ ID NO: 530724 - DNA, 25 bp, Mus musculus
agcgctttgggaacctcaagaacgg

SEQ ID NO: 530725 - DNA, 25 bp, Mus musculus
agcgctttgggatcctcaagaacgg

SEQ ID NO: 530726 - DNA, 25 bp, Mus musculus
agcgcttttaaactccacactcaag

SEQ ID NO: 530727 - DNA, 25 bp, Mus musculus
agcgcttttaaagtccacactcaag

SEQ ID NO: 530728 - DNA, 25 bp, Mus musculus
agcggaaacttccaggcatgatggt

SEQ ID NO: 530729 - DNA, 25 bp, Mus musculus
agcggaaacttcgaggcatgatggt

SEQ ID NO: 530730 - DNA, 25 bp, Mus musculus
agcggaaccccactcagcgaattgg

SEQ ID NO: 530731 - DNA, 25 bp, Mus musculus
agcggaaccccagtcagcgaattgg

SEQ ID NO: 530732 - DNA, 25 bp, Mus musculus
agcggaaccggtctcagtactgccg

SEQ ID NO: 530733 - DNA, 25 bp, Mus musculus
agcggaaccggtgtcagtactgccg

SEQ ID NO: 530734 - DNA, 25 bp, Mus musculus
agcggaagtcacaccgtgaggcagt

SEQ ID NO: 530735 - DNA, 25 bp, Mus musculus
agcggaagtcactccgtgaggcagt

SEQ ID NO: 530736 - DNA, 25 bp, Mus musculus
agcggaatttttactctctcagcag

SEQ ID NO: 530737 - DNA, 25 bp, Mus musculus
agcggaattttttctctctcagcag

SEQ ID NO: 530738 - DNA, 25 bp, Mus musculus
agcggacacgtcagtgccgccagcg

SEQ ID NO: 530739 - DNA, 25 bp, Mus musculus
agcggacacgtctgtgccgccagcg

SEQ ID NO: 530740 - DNA, 25 bp, Mus musculus
agcggacagactcccagcctaagac

SEQ ID NO: 530741 - DNA, 25 bp, Mus musculus
agcggacagactgccagcctaagac

SEQ ID NO: 530742 - DNA, 25 bp, Mus musculus
agcggacagctgatgggagacctca

SEQ ID NO: 530743 - DNA, 25 bp, Mus musculus
agcggacagctgttgggagacctca

SEQ ID NO: 530744 - DNA, 25 bp, Mus musculus
agcggacccaagacgaagcgagcga

SEQ ID NO: 530745 - DNA, 25 bp, Mus musculus
agcggacccaagtcgaagcgagcga

SEQ ID NO: 530746 - DNA, 25 bp, Mus musculus
agcggacgccatccggaccagaaaa

SEQ ID NO: 530747 - DNA, 25 bp, Mus musculus
agcggacgccatgcggaccagaaaa

SEQ ID NO: 530748 - DNA, 25 bp, Mus musculus
agcggactctctagcccttgtgggt

SEQ ID NO: 530749 - DNA, 25 bp, Mus musculus
agcggactctcttgcccttgtgggt

SEQ ID NO: 530750 - DNA, 25 bp, Mus musculus
agcggacttcatacccgtcttgtga

SEQ ID NO: 530751 - DNA, 25 bp, Mus musculus
agcggacttcattcccgtcttgtga

SEQ ID NO: 530752 - DNA, 25 bp, Mus musculus
agcggagacaccaggacttcctcga

SEQ ID NO: 530753 - DNA, 25 bp, Mus musculus
agcggagacacctggacttcctcga

SEQ ID NO: 530754 - DNA, 25 bp, Mus musculus
agcggagagccacgcaccatggaca

SEQ ID NO: 530755 - DNA, 25 bp, Mus musculus
agcggagagccaggcaccatggaca

SEQ ID NO: 530756 - DNA, 25 bp, Mus musculus
agcggagcccggctcatctctgtct

SEQ ID NO: 530757 - DNA, 25 bp, Mus musculus
agcggagcccgggtcatctctgtct

SEQ ID NO: 530758 - DNA, 25 bp, Mus musculus
agcggagccgccaagaaggcttgta

SEQ ID NO: 530759 - DNA, 25 bp, Mus musculus
agcggagccgcctagaaggcttgta

SEQ ID NO: 530760 - DNA, 25 bp, Mus musculus
agcggagctcctcaatcacttcaag

SEQ ID NO: 530761 - DNA, 25 bp, Mus musculus
agcggagctcctgaatcacttcaag

SEQ ID NO: 530762 - DNA, 25 bp, Mus musculus
agcggagttcttcctccagcacgtg

SEQ ID NO: 530763 - DNA, 25 bp, Mus musculus
agcggagttcttgctccagcacgtg

SEQ ID NO: 530764 - DNA, 25 bp, Mus musculus
agcggagttgacaaccgaccttgcg

SEQ ID NO: 530765 - DNA, 25 bp, Mus musculus
agcggagttgactaccgaccttgcg

SEQ ID NO: 530766 - DNA, 25 bp, Mus musculus
agcggagtttcacccagagccatca

SEQ ID NO: 530767 - DNA, 25 bp, Mus musculus
agcggagtttcagccagagccatca

SEQ ID NO: 530768 - DNA, 25 bp, Mus musculus
agcggatagaggagcacaatgccaa

SEQ ID NO: 530769 - DNA, 25 bp, Mus musculus
agcggatagaggtgcacaatgccaa

SEQ ID NO: 530770 - DNA, 25 bp, Mus musculus
agcggatcaatgacttgccactggg

SEQ ID NO: 530771 - DNA, 25 bp, Mus musculus
agcggatcaatgtcttgccactggg

SEQ ID NO: 530772 - DNA, 25 bp, Mus musculus
agcggatccgtcaagcccgacagat

SEQ ID NO: 530773 - DNA, 25 bp, Mus musculus
agcggatccgtctagcccgacagat

SEQ ID NO: 530774 - DNA, 25 bp, Mus musculus
agcggatccttgactccagaagacc

SEQ ID NO: 530775 - DNA, 25 bp, Mus musculus
agcggatccttgtctccagaagacc

SEQ ID NO: 530776 - DNA, 25 bp, Mus musculus
agcggatcgactattcactgtactg

SEQ ID NO: 530777 - DNA, 25 bp, Mus musculus
agcggatcgacttttcactgtactg

SEQ ID NO: 530778 - DNA, 25 bp, Mus musculus
agcggatggaatagctctaaggcaa

SEQ ID NO: 530779 - DNA, 25 bp, Mus musculus
agcggatggaattgctctaaggcaa

SEQ ID NO: 530780 - DNA, 25 bp, Mus musculus
agcggatggtcaactgtgaggaaga

SEQ ID NO: 530781 - DNA, 25 bp, Mus musculus
agcggatggtcatctgtgaggaaga

SEQ ID NO: 530782 - DNA, 25 bp, Mus musculus
agcggatgtagtcgccttcattctg

SEQ ID NO: 530783 - DNA, 25 bp, Mus musculus
agcggatgtagtggccttcattctg

SEQ ID NO: 530784 - DNA, 25 bp, Mus musculus
agcggattctacattgcttctggag

SEQ ID NO: 530785 - DNA, 25 bp, Mus musculus
agcggattctactttgcttctggag

SEQ ID NO: 530786 - DNA, 25 bp, Mus musculus
agcggcaagcacaacggccagttca

SEQ ID NO: 530787 - DNA, 25 bp, Mus musculus
agcggcaagcactacggccagttca

SEQ ID NO: 530788 - DNA, 25 bp, Mus musculus
agcggcaccactacgtctttaagca

SEQ ID NO: 530789 - DNA, 25 bp, Mus musculus
agcggcaccacttcgtctttaagca

SEQ ID NO: 530790 - DNA, 25 bp, Mus musculus
agcggcacggtcagcgagaacacct

SEQ ID NO: 530791 - DNA, 25 bp, Mus musculus
agcggcacggtctgcgagaacacct

SEQ ID NO: 530792 - DNA, 25 bp, Mus musculus
agcggcatctccaataacctggcag

SEQ ID NO: 530793 - DNA, 25 bp, Mus musculus
agcggcatctcctataacctggcag

SEQ ID NO: 530794 - DNA, 25 bp, Mus musculus
agcggcatgtagagactccccagcc

SEQ ID NO: 530795 - DNA, 25 bp, Mus musculus
agcggcatgtagtgactccccagcc

SEQ ID NO: 530796 - DNA, 25 bp, Mus musculus
agcggccatcttcggtttccacaca

SEQ ID NO: 530797 - DNA, 25 bp, Mus musculus
agcggccatcttgggtttccacaca

SEQ ID NO: 530798 - DNA, 25 bp, Mus musculus
agcggcccacggagcaatacagtga

SEQ ID NO: 530799 - DNA, 25 bp, Mus musculus
agcggcccacggtgcaatacagtga

SEQ ID NO: 530800 - DNA, 25 bp, Mus musculus
agcggcccatgtcgtctccagaaat

SEQ ID NO: 530801 - DNA, 25 bp, Mus musculus
agcggcccatgtggtctccagaaat

SEQ ID NO: 530802 - DNA, 25 bp, Mus musculus
agcggcccgcatcgagagcgagcgg

SEQ ID NO: 530803 - DNA, 25 bp, Mus musculus
agcggcccgcatggagagcgagcgg

SEQ ID NO: 530804 - DNA, 25 bp, Mus musculus
agcggccctgtaaggaaggttcaca

SEQ ID NO: 530805 - DNA, 25 bp, Mus musculus
agcggccctgtatggaaggttcaca

SEQ ID NO: 530806 - DNA, 25 bp, Mus musculus
agcggccggccgagatttcagagcc

SEQ ID NO: 530807 - DNA, 25 bp, Mus musculus
agcggccggccgtgatttcagagcc

SEQ ID NO: 530808 - DNA, 25 bp, Mus musculus
agcggcctctacagctgtctagtga

SEQ ID NO: 530809 - DNA, 25 bp, Mus musculus
agcggcctctactgctgtctagtga

SEQ ID NO: 530810 - DNA, 25 bp, Mus musculus
agcggcctgaacaccatcaagcagg

SEQ ID NO: 530811 - DNA, 25 bp, Mus musculus
agcggcctgaactccatcaagcagg

SEQ ID NO: 530812 - DNA, 25 bp, Mus musculus
agcggcgacaccagggtccaggatt

SEQ ID NO: 530813 - DNA, 25 bp, Mus musculus
agcggcgacacctgggtccaggatt

SEQ ID NO: 530814 - DNA, 25 bp, Mus musculus
agcggcgattctcgttgtgcgcata

SEQ ID NO: 530815 - DNA, 25 bp, Mus musculus
agcggcgattctggttgtgcgcata

SEQ ID NO: 530816 - DNA, 25 bp, Mus musculus
agcggcgcacacaggcattgcagca

SEQ ID NO: 530817 - DNA, 25 bp, Mus musculus
agcggcgcacactggcattgcagca

SEQ ID NO: 530818 - DNA, 25 bp, Mus musculus
agcggcgcctctccaagtgtctgtg

SEQ ID NO: 530819 - DNA, 25 bp, Mus musculus
agcggcgcctctgcaagtgtctgtg

SEQ ID NO: 530820 - DNA, 25 bp, Mus musculus
agcggcgctacgcacacaccatggt

SEQ ID NO: 530821 - DNA, 25 bp, Mus musculus
agcggcgctacggacacaccatggt

SEQ ID NO: 530822 - DNA, 25 bp, Mus musculus
agcggcggctgaaccaagcggacta

SEQ ID NO: 530823 - DNA, 25 bp, Mus musculus
agcggcggctgatccaagcggacta

SEQ ID NO: 530824 - DNA, 25 bp, Mus musculus
agcggcgtgcttaccagcggcgcct

SEQ ID NO: 530825 - DNA, 25 bp, Mus musculus
agcggcgtgctttccagcggcgcct

SEQ ID NO: 530826 - DNA, 25 bp, Mus musculus
agcggcgtgtacagccggctccctg

SEQ ID NO: 530827 - DNA, 25 bp, Mus musculus
agcggcgtgtactgccggctccctg

SEQ ID NO: 530828 - DNA, 25 bp, Mus musculus
agcggctcaagtaccgggcccacga

SEQ ID NO: 530829 - DNA, 25 bp, Mus musculus
agcggctcaagttccgggcccacga

SEQ ID NO: 530830 - DNA, 25 bp, Mus musculus
agcggctcccgacggttcgtgtcca

SEQ ID NO: 530831 - DNA, 25 bp, Mus musculus
agcggctcccgagggttcgtgtcca

SEQ ID NO: 530832 - DNA, 25 bp, Mus musculus
agcggctccggtcaacgcttcagag

SEQ ID NO: 530833 - DNA, 25 bp, Mus musculus
agcggctccggtgaacgcttcagag

SEQ ID NO: 530834 - DNA, 25 bp, Mus musculus
agcggctcgtgtcattgcccctgtc

SEQ ID NO: 530835 - DNA, 25 bp, Mus musculus
agcggctcgtgtgattgcccctgtc

SEQ ID NO: 530836 - DNA, 25 bp, Mus musculus
agcggctctcataaagatctggcgg

SEQ ID NO: 530837 - DNA, 25 bp, Mus musculus
agcggctctcattaagatctggcgg

SEQ ID NO: 530838 - DNA, 25 bp, Mus musculus
agcggctgcaccagggtacggtggc

SEQ ID NO: 530839 - DNA, 25 bp, Mus musculus
agcggctgcacctgggtacggtggc

SEQ ID NO: 530840 - DNA, 25 bp, Mus musculus
agcggctggctccaagtcagatcca

SEQ ID NO: 530841 - DNA, 25 bp, Mus musculus
agcggctggctcgaagtcagatcca

SEQ ID NO: 530842 - DNA, 25 bp, Mus musculus
agcggctggtccagtccaccctgag

SEQ ID NO: 530843 - DNA, 25 bp, Mus musculus
agcggctggtcctgtccaccctgag

SEQ ID NO: 530844 - DNA, 25 bp, Mus musculus
agcgggaacctgaagcggctagtca

SEQ ID NO: 530845 - DNA, 25 bp, Mus musculus
agcgggaacctgtagcggctagtca

SEQ ID NO: 530846 - DNA, 25 bp, Mus musculus
agcgggaagtggaccaggacgacga

SEQ ID NO: 530847 - DNA, 25 bp, Mus musculus
agcgggaagtggtccaggacgacga

SEQ ID NO: 530848 - DNA, 25 bp, Mus musculus
agcgggagaagcacacgttcttgga

SEQ ID NO: 530849 - DNA, 25 bp, Mus musculus
agcgggagaagctcacgttcttgga

SEQ ID NO: 530850 - DNA, 25 bp, Mus musculus
agcgggaggctcatccatgctgccg

SEQ ID NO: 530851 - DNA, 25 bp, Mus musculus
agcgggaggctcttccatgctgccg

SEQ ID NO: 530852 - DNA, 25 bp, Mus musculus
agcgggatagtaacgctgacagaga

SEQ ID NO: 530853 - DNA, 25 bp, Mus musculus
agcgggatagtatcgctgacagaga

SEQ ID NO: 530854 - DNA, 25 bp, Mus musculus
agcgggatcctgaccccgcgttcgt

SEQ ID NO: 530855 - DNA, 25 bp, Mus musculus
agcgggatcctgtccccgcgttcgt

SEQ ID NO: 530856 - DNA, 25 bp, Mus musculus
agcgggcaccagcatctgggaccca

SEQ ID NO: 530857 - DNA, 25 bp, Mus musculus
agcgggcaccaggatctgggaccca

SEQ ID NO: 530858 - DNA, 25 bp, Mus musculus
agcgggcacctcaatttccagattg

SEQ ID NO: 530859 - DNA, 25 bp, Mus musculus
agcgggcacctctatttccagattg

SEQ ID NO: 530860 - DNA, 25 bp, Mus musculus
agcgggcgctggacatcacgcactt

SEQ ID NO: 530861 - DNA, 25 bp, Mus musculus
agcgggcgctggtcatcacgcactt

SEQ ID NO: 530862 - DNA, 25 bp, Mus musculus
agcgggctcaccaggcaacacagat

SEQ ID NO: 530863 - DNA, 25 bp, Mus musculus
agcgggctcacctggcaacacagat

SEQ ID NO: 530864 - DNA, 25 bp, Mus musculus
agcgggctcagcagcactcttgcaa

SEQ ID NO: 530865 - DNA, 25 bp, Mus musculus
agcgggctcagctgcactcttgcaa

SEQ ID NO: 530866 - DNA, 25 bp, Mus musculus
agcgggtcaccgaccagggctgtcc

SEQ ID NO: 530867 - DNA, 25 bp, Mus musculus
agcgggtcaccgtccagggctgtcc

SEQ ID NO: 530868 - DNA, 25 bp, Mus musculus
agcgggtcacctccggcaccaagat

SEQ ID NO: 530869 - DNA, 25 bp, Mus musculus
agcgggtcacctgcggcaccaagat

SEQ ID NO: 530870 - DNA, 25 bp, Mus musculus
agcgggtccgccacaatagcatgga

SEQ ID NO: 530871 - DNA, 25 bp, Mus musculus
agcgggtccgcctcaatagcatgga

SEQ ID NO: 530872 - DNA, 25 bp, Mus musculus
agcgggtctgcaaggctgtgctcct

SEQ ID NO: 530873 - DNA, 25 bp, Mus musculus
agcgggtctgcatggctgtgctcct

SEQ ID NO: 530874 - DNA, 25 bp, Mus musculus
agcgggtgctagacctggagcctaa

SEQ ID NO: 530875 - DNA, 25 bp, Mus musculus
agcgggtgctagtcctggagcctaa

SEQ ID NO: 530876 - DNA, 25 bp, Mus musculus
agcgggtgtgcaaccagcgcaagcc

SEQ ID NO: 530877 - DNA, 25 bp, Mus musculus
agcgggtgtgcatccagcgcaagcc

SEQ ID NO: 530878 - DNA, 25 bp, Mus musculus
agcggtaacctgcagtaactatgag

SEQ ID NO: 530879 - DNA, 25 bp, Mus musculus
agcggtaacctggagtaactatgag

SEQ ID NO: 530880 - DNA, 25 bp, Mus musculus
agcggtacaggacaatgcaggtcca

SEQ ID NO: 530881 - DNA, 25 bp, Mus musculus
agcggtacaggagaatgcaggtcca

SEQ ID NO: 530882 - DNA, 25 bp, Mus musculus
agcggtaccgcgacctgatcgaggc

SEQ ID NO: 530883 - DNA, 25 bp, Mus musculus
agcggtaccgcgtcctgatcgaggc

SEQ ID NO: 530884 - DNA, 25 bp, Mus musculus
agcggtacgcagatgagcgcaagaa

SEQ ID NO: 530885 - DNA, 25 bp, Mus musculus
agcggtacgcagttgagcgcaagaa

SEQ ID NO: 530886 - DNA, 25 bp, Mus musculus
agcggtagacacagacccatctggc

SEQ ID NO: 530887 - DNA, 25 bp, Mus musculus
agcggtagacactgacccatctggc

SEQ ID NO: 530888 - DNA, 25 bp, Mus musculus
agcggtcaggatcaataaagagcag

SEQ ID NO: 530889 - DNA, 25 bp, Mus musculus
agcggtcaggatcctaatccaatcc

SEQ ID NO: 530890 - DNA, 25 bp, Mus musculus
agcggtcaggatgaataaagagcag

SEQ ID NO: 530891 - DNA, 25 bp, Mus musculus
agcggtcaggatgctaatccaatcc

SEQ ID NO: 530892 - DNA, 25 bp, Mus musculus
agcggtcaggcaccttgcagagcaa

SEQ ID NO: 530893 - DNA, 25 bp, Mus musculus
agcggtcaggcagcttgcagagcaa

SEQ ID NO: 530894 - DNA, 25 bp, Mus musculus
agcggtgagcacatcagtgaccagg

SEQ ID NO: 530895 - DNA, 25 bp, Mus musculus
agcggtgagcacttcagtgaccagg

SEQ ID NO: 530896 - DNA, 25 bp, Mus musculus
agcggtgccagcagctgcgctctga

SEQ ID NO: 530897 - DNA, 25 bp, Mus musculus
agcggtgccagctgctgcgctctga

SEQ ID NO: 530898 - DNA, 25 bp, Mus musculus
agcggtgccatcatccacaccatcg

SEQ ID NO: 530899 - DNA, 25 bp, Mus musculus
agcggtgccatcttccacaccatcg

SEQ ID NO: 530900 - DNA, 25 bp, Mus musculus
agcggtgctaccattttatagggtg

SEQ ID NO: 530901 - DNA, 25 bp, Mus musculus
agcggtgctacctttttatagggtg

SEQ ID NO: 530902 - DNA, 25 bp, Mus musculus
agcggtgctgttatccttatcatcc

SEQ ID NO: 530903 - DNA, 25 bp, Mus musculus
agcggtgctgttttccttatcatcc

SEQ ID NO: 530904 - DNA, 25 bp, Mus musculus
agcgtaaagcgacttcgagcacacc

SEQ ID NO: 530905 - DNA, 25 bp, Mus musculus
agcgtaaagcgagttcgagcacacc

SEQ ID NO: 530906 - DNA, 25 bp, Mus musculus
agcgtaaccactcgagaagatacta

SEQ ID NO: 530907 - DNA, 25 bp, Mus musculus
agcgtaaccactggagaagatacta

SEQ ID NO: 530908 - DNA, 25 bp, Mus musculus
agcgtaagacgcacttgagggcacc

SEQ ID NO: 530909 - DNA, 25 bp, Mus musculus
agcgtaagacgctcttgagggcacc

SEQ ID NO: 530910 - DNA, 25 bp, Mus musculus
agcgtaagtggccatcccagccttg

SEQ ID NO: 530911 - DNA, 25 bp, Mus musculus
agcgtaagtggcgatcccagccttg

SEQ ID NO: 530912 - DNA, 25 bp, Mus musculus
agcgtagaccctcccacttttgatg

SEQ ID NO: 530913 - DNA, 25 bp, Mus musculus
agcgtagaccctgccacttttgatg

SEQ ID NO: 530914 - DNA, 25 bp, Mus musculus
agcgtatttttgattccattcagaa

SEQ ID NO: 530915 - DNA, 25 bp, Mus musculus
agcgtatttttgtttccattcagaa

SEQ ID NO: 530916 - DNA, 25 bp, Mus musculus
agcgtcagacttaacaggaagcttc

SEQ ID NO: 530917 - DNA, 25 bp, Mus musculus
agcgtcagactttacaggaagcttc

SEQ ID NO: 530918 - DNA, 25 bp, Mus musculus
agcgtcattcgcctggataaggagt

SEQ ID NO: 530919 - DNA, 25 bp, Mus musculus
agcgtcattcgcgtggataaggagt

SEQ ID NO: 530920 - DNA, 25 bp, Mus musculus
agcgtcctgggcagacctctgcagg

SEQ ID NO: 530921 - DNA, 25 bp, Mus musculus
agcgtcctgggctgacctctgcagg

SEQ ID NO: 530922 - DNA, 25 bp, Mus musculus
agcgtccttgtcacaggcttgcggg

SEQ ID NO: 530923 - DNA, 25 bp, Mus musculus
agcgtccttgtctcaggcttgcggg

SEQ ID NO: 530924 - DNA, 25 bp, Mus musculus
agcgtctaccggattccgccgcggg

SEQ ID NO: 530925 - DNA, 25 bp, Mus musculus
agcgtctaccggtttccgccgcggg

SEQ ID NO: 530926 - DNA, 25 bp, Mus musculus
agcgtctcatcaactctgaccgggc

SEQ ID NO: 530927 - DNA, 25 bp, Mus musculus
agcgtctcatcatctctgaccgggc

SEQ ID NO: 530928 - DNA, 25 bp, Mus musculus
agcgtctgcaccagcccgttgggct

SEQ ID NO: 530929 - DNA, 25 bp, Mus musculus
agcgtctgcacctgcccgttgggct

SEQ ID NO: 530930 - DNA, 25 bp, Mus musculus
agcgtctgccacctctacttcaggg

SEQ ID NO: 530931 - DNA, 25 bp, Mus musculus
agcgtctgccacgtctacttcaggg

SEQ ID NO: 530932 - DNA, 25 bp, Mus musculus
agcgtctgggctctcagaagttctt

SEQ ID NO: 530933 - DNA, 25 bp, Mus musculus
agcgtctgggctgtcagaagttctt

SEQ ID NO: 530934 - DNA, 25 bp, Mus musculus
agcgtcttcctgagccacaggatgt

SEQ ID NO: 530935 - DNA, 25 bp, Mus musculus
agcgtcttcctgtgccacaggatgt

SEQ ID NO: 530936 - DNA, 25 bp, Mus musculus
agcgtctttgctaggctagagacag

SEQ ID NO: 530937 - DNA, 25 bp, Mus musculus
agcgtctttgcttggctagagacag

SEQ ID NO: 530938 - DNA, 25 bp, Mus musculus
agcgtgactgtgcaagaattctgtg

SEQ ID NO: 530939 - DNA, 25 bp, Mus musculus
agcgtgactgtggaagaattctgtg

SEQ ID NO: 530940 - DNA, 25 bp, Mus musculus
agcgtgcatcgcaatggccagtcca

SEQ ID NO: 530941 - DNA, 25 bp, Mus musculus
agcgtgcatcgctatggccagtcca

SEQ ID NO: 530942 - DNA, 25 bp, Mus musculus
agcgtgcccggcactcttctgtcgg

SEQ ID NO: 530943 - DNA, 25 bp, Mus musculus
agcgtgcccggctctcttctgtcgg

SEQ ID NO: 530944 - DNA, 25 bp, Mus musculus
agcgtgccgagtactatcctttccc

SEQ ID NO: 530945 - DNA, 25 bp, Mus musculus
agcgtgccgagttctatcctttccc

SEQ ID NO: 530946 - DNA, 25 bp, Mus musculus
agcgtgcgccccatcgagtttgaga

SEQ ID NO: 530947 - DNA, 25 bp, Mus musculus
agcgtgcgccccttcgagtttgaga

SEQ ID NO: 530948 - DNA, 25 bp, Mus musculus
agcgtgctacacctcaaagctgttg

SEQ ID NO: 530949 - DNA, 25 bp, Mus musculus
agcgtgctacacgtcaaagctgttg

SEQ ID NO: 530950 - DNA, 25 bp, Mus musculus
agcgtgctctacaccagctcaggtc

SEQ ID NO: 530951 - DNA, 25 bp, Mus musculus
agcgtgctctactccagctcaggtc

SEQ ID NO: 530952 - DNA, 25 bp, Mus musculus
agcgtggaacagaacagtgccttgg

SEQ ID NO: 530953 - DNA, 25 bp, Mus musculus
agcgtggaacagtacagtgccttgg

SEQ ID NO: 530954 - DNA, 25 bp, Mus musculus
agcgtggacaagctcacccgactcg

SEQ ID NO: 530955 - DNA, 25 bp, Mus musculus
agcgtggacaaggtcacccgactcg

SEQ ID NO: 530956 - DNA, 25 bp, Mus musculus
agcgtggagaacatcgcgctgctca

SEQ ID NO: 530957 - DNA, 25 bp, Mus musculus
agcgtggagaacttcgcgctgctca

SEQ ID NO: 530958 - DNA, 25 bp, Mus musculus
agcgtggaggcaacgcatccaactc

SEQ ID NO: 530959 - DNA, 25 bp, Mus musculus
agcgtggaggcatcgcatccaactc

SEQ ID NO: 530960 - DNA, 25 bp, Mus musculus
agcgtggccttcctgggtaccgcca

SEQ ID NO: 530961 - DNA, 25 bp, Mus musculus
agcgtggccttcgtgggtaccgcca

SEQ ID NO: 530962 - DNA, 25 bp, Mus musculus
agcgtggcgctgaggacctgataac

SEQ ID NO: 530963 - DNA, 25 bp, Mus musculus
agcgtggcgctgtggacctgataac

SEQ ID NO: 530964 - DNA, 25 bp, Mus musculus
agcgtggcttctcaggccccacaga

SEQ ID NO: 530965 - DNA, 25 bp, Mus musculus
agcgtggcttctgaggccccacaga

SEQ ID NO: 530966 - DNA, 25 bp, Mus musculus
agcgtgtaccttcatcaagtccaac

SEQ ID NO: 530967 - DNA, 25 bp, Mus musculus
agcgtgtaccttgatcaagtccaac

SEQ ID NO: 530968 - DNA, 25 bp, Mus musculus
agcgtgtagcccaccatcagggccg

SEQ ID NO: 530969 - DNA, 25 bp, Mus musculus
agcgtgtagccctccatcagggccg

SEQ ID NO: 530970 - DNA, 25 bp, Mus musculus
agcgtgtcacgtccttgtttctcag

SEQ ID NO: 530971 - DNA, 25 bp, Mus musculus
agcgtgtcacgtgcttgtttctcag

SEQ ID NO: 530972 - DNA, 25 bp, Mus musculus
agcgtgtccagtcccaaggccgacg

SEQ ID NO: 530973 - DNA, 25 bp, Mus musculus
agcgtgtccagtgccaaggccgacg

SEQ ID NO: 530974 - DNA, 25 bp, Mus musculus
agcgtgtgctacagaccccaaatga

SEQ ID NO: 530975 - DNA, 25 bp, Mus musculus
agcgtgtgctactgaccccaaatga

SEQ ID NO: 530976 - DNA, 25 bp, Mus musculus
agcgtgttatccctcctgcccgtga

SEQ ID NO: 530977 - DNA, 25 bp, Mus musculus
agcgtgttatccgtcctgcccgtga

SEQ ID NO: 530978 - DNA, 25 bp, Mus musculus
agcgttccgcgacccttctgtgtgc

SEQ ID NO: 530979 - DNA, 25 bp, Mus musculus
agcgttccgcgagccttctgtgtgc

SEQ ID NO: 530980 - DNA, 25 bp, Mus musculus
agcgttctcctaacccactggaatg

SEQ ID NO: 530981 - DNA, 25 bp, Mus musculus
agcgttctcctatcccactggaatg

SEQ ID NO: 530982 - DNA, 25 bp, Mus musculus
agcgttgggaaccacggctgttaca

SEQ ID NO: 530983 - DNA, 25 bp, Mus musculus
agcgttgggaacgacggctgttaca

SEQ ID NO: 530984 - DNA, 25 bp, Mus musculus
agcgttggtgggacccaatggatca

SEQ ID NO: 530985 - DNA, 25 bp, Mus musculus
agcgttggtgggtcccaatggatca

SEQ ID NO: 530986 - DNA, 25 bp, Mus musculus
agcgtttccccaccagcatgattgg

SEQ ID NO: 530987 - DNA, 25 bp, Mus musculus
agcgtttccccagcagcatgattgg

SEQ ID NO: 530988 - DNA, 25 bp, Mus musculus
agcgtttgcaaaacgggcttctgga

SEQ ID NO: 530989 - DNA, 25 bp, Mus musculus
agcgtttgcaaatcgggcttctgga

SEQ ID NO: 530990 - DNA, 25 bp, Mus musculus
agcgtttgcatcattctcttcagga

SEQ ID NO: 530991 - DNA, 25 bp, Mus musculus
agcgtttgcatctttctcttcagga

SEQ ID NO: 530992 - DNA, 25 bp, Mus musculus
agcgtttgctggaaactgctggcat

SEQ ID NO: 530993 - DNA, 25 bp, Mus musculus
agcgtttgctggtaactgctggcat

SEQ ID NO: 530994 - DNA, 25 bp, Mus musculus
agctaagaactacccctgcgacagt

SEQ ID NO: 530995 - DNA, 25 bp, Mus musculus
agctaagaactagccctgcgacagt

SEQ ID NO: 530996 - DNA, 25 bp, Mus musculus
agctaagagacactgtatggaaata

SEQ ID NO: 530997 - DNA, 25 bp, Mus musculus
agctaagagacagtgtatggaaata

SEQ ID NO: 530998 - DNA, 25 bp, Mus musculus
agctaagagcgcagcctgagcaaca

SEQ ID NO: 530999 - DNA, 25 bp, Mus musculus
agctaagagcgctgcctgagcaaca

SEQ ID NO: 531000 - DNA, 25 bp, Mus musculus
agctaagagcggacctctcacctcg

SEQ ID NO: 531001 - DNA, 25 bp, Mus musculus
agctaagagcggtcctctcacctcg

SEQ ID NO: 531002 - DNA, 25 bp, Mus musculus
agctaagcagtgacgaggacctgga

SEQ ID NO: 531003 - DNA, 25 bp, Mus musculus
agctaagcagtgtcgaggacctgga

SEQ ID NO: 531004 - DNA, 25 bp, Mus musculus
agctaagcccatataacatcaccca

SEQ ID NO: 531005 - DNA, 25 bp, Mus musculus
agctaagcccatttaacatcaccca

SEQ ID NO: 531006 - DNA, 25 bp, Mus musculus
agctaagcttaacgcggcgctgaca

SEQ ID NO: 531007 - DNA, 25 bp, Mus musculus
agctaagcttaaggcggcgctgaca

SEQ ID NO: 531008 - DNA, 25 bp, Mus musculus
agctaagctttcataaccctgctgc

SEQ ID NO: 531009 - DNA, 25 bp, Mus musculus
agctaagctttcttaaccctgctgc

SEQ ID NO: 531010 - DNA, 25 bp, Mus musculus
agctaaggatgcctgctacccgtgc

SEQ ID NO: 531011 - DNA, 25 bp, Mus musculus
agctaaggatgcgtgctacccgtgc

SEQ ID NO: 531012 - DNA, 25 bp, Mus musculus
agctaagggagtcccagggcctcct

SEQ ID NO: 531013 - DNA, 25 bp, Mus musculus
agctaagggagtgccagggcctcct

SEQ ID NO: 531014 - DNA, 25 bp, Mus musculus
agctaatcaccaagtcctgcacaga

SEQ ID NO: 531015 - DNA, 25 bp, Mus musculus
agctaatcaccatgtcctgcacaga

SEQ ID NO: 531016 - DNA, 25 bp, Mus musculus
agctaatccgacagttcccacaaca

SEQ ID NO: 531017 - DNA, 25 bp, Mus musculus
agctaatccgactgttcccacaaca

SEQ ID NO: 531018 - DNA, 25 bp, Mus musculus
agctaatgagatatgtgtgggagac

SEQ ID NO: 531019 - DNA, 25 bp, Mus musculus
agctaatgagatttgtgtgggagac

SEQ ID NO: 531020 - DNA, 25 bp, Mus musculus
agctaattgaagaatcgtgtcctca

SEQ ID NO: 531021 - DNA, 25 bp, Mus musculus
agctaattgaagtatcgtgtcctca

SEQ ID NO: 531022 - DNA, 25 bp, Mus musculus
agctaatttcccaaggtccttcgcg

SEQ ID NO: 531023 - DNA, 25 bp, Mus musculus
agctaatttccctaggtccttcgcg

SEQ ID NO: 531024 - DNA, 25 bp, Mus musculus
agctacaacacgagaagcggcgcag

SEQ ID NO: 531025 - DNA, 25 bp, Mus musculus
agctacaacacgtgaagcggcgcag

SEQ ID NO: 531026 - DNA, 25 bp, Mus musculus
agctacaaggaacagtacctttttg

SEQ ID NO: 531027 - DNA, 25 bp, Mus musculus
agctacaaggaagagtacctttttg

SEQ ID NO: 531028 - DNA, 25 bp, Mus musculus
agctacacaaggctgactcccgtct

SEQ ID NO: 531029 - DNA, 25 bp, Mus musculus
agctacacaagggtgactcccgtct

SEQ ID NO: 531030 - DNA, 25 bp, Mus musculus
agctacacatgacttccagtccaaa

SEQ ID NO: 531031 - DNA, 25 bp, Mus musculus
agctacacatgagttccagtccaaa

SEQ ID NO: 531032 - DNA, 25 bp, Mus musculus
agctacacatgtacctgccccgtgg

SEQ ID NO: 531033 - DNA, 25 bp, Mus musculus
agctacacatgttcctgccccgtgg

SEQ ID NO: 531034 - DNA, 25 bp, Mus musculus
agctacagctggctctggccctatc

SEQ ID NO: 531035 - DNA, 25 bp, Mus musculus
agctacagctgggtctggccctatc

SEQ ID NO: 531036 - DNA, 25 bp, Mus musculus
agctacattcgcagggaaggtgttt

SEQ ID NO: 531037 - DNA, 25 bp, Mus musculus
agctacattcgctgggaaggtgttt

SEQ ID NO: 531038 - DNA, 25 bp, Mus musculus
agctaccagataagccggccaggaa

SEQ ID NO: 531039 - DNA, 25 bp, Mus musculus
agctaccagatatgccggccaggaa

SEQ ID NO: 531040 - DNA, 25 bp, Mus musculus
agctaccgcagtcccaacttcatgg

SEQ ID NO: 531041 - DNA, 25 bp, Mus musculus
agctaccgcagtgccaacttcatgg

SEQ ID NO: 531042 - DNA, 25 bp, Mus musculus
agctaccggtcgagaccagatccag

SEQ ID NO: 531043 - DNA, 25 bp, Mus musculus
agctaccggtcgtgaccagatccag

SEQ ID NO: 531044 - DNA, 25 bp, Mus musculus
agctacctggagcagatcgagaaag

SEQ ID NO: 531045 - DNA, 25 bp, Mus musculus
agctacctggaggagatcgagaaag

SEQ ID NO: 531046 - DNA, 25 bp, Mus musculus
agctaccttccgcatagaggataaa

SEQ ID NO: 531047 - DNA, 25 bp, Mus musculus
agctaccttccggatagaggataaa

SEQ ID NO: 531048 - DNA, 25 bp, Mus musculus
agctacgacggcacgccaagctgaa

SEQ ID NO: 531049 - DNA, 25 bp, Mus musculus
agctacgacggctcgccaagctgaa

SEQ ID NO: 531050 - DNA, 25 bp, Mus musculus
agctacgcaatcagaccgggcaggt

SEQ ID NO: 531051 - DNA, 25 bp, Mus musculus
agctacgcaatctgaccgggcaggt

SEQ ID NO: 531052 - DNA, 25 bp, Mus musculus
agctacgctgacaccgggccgtgaa

SEQ ID NO: 531053 - DNA, 25 bp, Mus musculus
agctacgctgactccgggccgtgaa

SEQ ID NO: 531054 - DNA, 25 bp, Mus musculus
agctacggcgggaccgatgcccatg

SEQ ID NO: 531055 - DNA, 25 bp, Mus musculus
agctacggcgggtccgatgcccatg

SEQ ID NO: 531056 - DNA, 25 bp, Mus musculus
agctacggctggagcgagcagccct

SEQ ID NO: 531057 - DNA, 25 bp, Mus musculus
agctacggctggtgcgagcagccct

SEQ ID NO: 531058 - DNA, 25 bp, Mus musculus
agctacgtcactacctcccagtggt

SEQ ID NO: 531059 - DNA, 25 bp, Mus musculus
agctacgtcacttcctcccagtggt

SEQ ID NO: 531060 - DNA, 25 bp, Mus musculus
agctactaatgtacctgccaatgtg

SEQ ID NO: 531061 - DNA, 25 bp, Mus musculus
agctactaatgttcctgccaatgtg

SEQ ID NO: 531062 - DNA, 25 bp, Mus musculus
agctactcaaggaccccatcacggt

SEQ ID NO: 531063 - DNA, 25 bp, Mus musculus
agctactcaaggtccccatcacggt

SEQ ID NO: 531064 - DNA, 25 bp, Mus musculus
agctactcgggtcaacaagcgggca

SEQ ID NO: 531065 - DNA, 25 bp, Mus musculus
agctactcgggtgaacaagcgggca

SEQ ID NO: 531066 - DNA, 25 bp, Mus musculus
agctactggagcccgtgcgccgcaa

SEQ ID NO: 531067 - DNA, 25 bp, Mus musculus
agctactggagcgcgtgcgccgcaa

SEQ ID NO: 531068 - DNA, 25 bp, Mus musculus
agctactggtggaacggagacaagt

SEQ ID NO: 531069 - DNA, 25 bp, Mus musculus
agctactggtggtacggagacaagt

SEQ ID NO: 531070 - DNA, 25 bp, Mus musculus
agctactggtgtcgacctgggcctc

SEQ ID NO: 531071 - DNA, 25 bp, Mus musculus
agctactggtgtggacctgggcctc

SEQ ID NO: 531072 - DNA, 25 bp, Mus musculus
agctacttcattcccgtggcctgtt

SEQ ID NO: 531073 - DNA, 25 bp, Mus musculus
agctacttcattgccgtggcctgtt

SEQ ID NO: 531074 - DNA, 25 bp, Mus musculus
agctactttgtaccgtgcggtcctt

SEQ ID NO: 531075 - DNA, 25 bp, Mus musculus
agctactttgtagcgtgcggtcctt

SEQ ID NO: 531076 - DNA, 25 bp, Mus musculus
agctagaacagaaccgagcggcaca

SEQ ID NO: 531077 - DNA, 25 bp, Mus musculus
agctagaacagatccgagcggcaca

SEQ ID NO: 531078 - DNA, 25 bp, Mus musculus
agctagagcaccagctagacccaaa

SEQ ID NO: 531079 - DNA, 25 bp, Mus musculus
agctagagcacctgctagacccaaa

SEQ ID NO: 531080 - DNA, 25 bp, Mus musculus
agctagagcgccagggcctgtctgt

SEQ ID NO: 531081 - DNA, 25 bp, Mus musculus
agctagagcgcctgggcctgtctgt

SEQ ID NO: 531082 - DNA, 25 bp, Mus musculus
agctagagtacactccccaggaagg

SEQ ID NO: 531083 - DNA, 25 bp, Mus musculus
agctagagtacagtccccaggaagg

SEQ ID NO: 531084 - DNA, 25 bp, Mus musculus
agctagatcatcaaagcctccttca

SEQ ID NO: 531085 - DNA, 25 bp, Mus musculus
agctagatcatctaagcctccttca

SEQ ID NO: 531086 - DNA, 25 bp, Mus musculus
agctagcctgagctctgtgctagcc

SEQ ID NO: 531087 - DNA, 25 bp, Mus musculus
agctagcctgaggtctgtgctagcc

SEQ ID NO: 531088 - DNA, 25 bp, Mus musculus
agctagccttccagactgtcctcaa

SEQ ID NO: 531089 - DNA, 25 bp, Mus musculus
agctagccttcctgactgtcctcaa

SEQ ID NO: 531090 - DNA, 25 bp, Mus musculus
agctagcgggccactgccctaacag

SEQ ID NO: 531091 - DNA, 25 bp, Mus musculus
agctagcgggcctctgccctaacag

SEQ ID NO: 531092 - DNA, 25 bp, Mus musculus
agctagctcacgagctggccactgc

SEQ ID NO: 531093 - DNA, 25 bp, Mus musculus
agctagctcacgtgctggccactgc

SEQ ID NO: 531094 - DNA, 25 bp, Mus musculus
agctagctcggcacctgccagagga

SEQ ID NO: 531095 - DNA, 25 bp, Mus musculus
agctagctcggctcctgccagagga

SEQ ID NO: 531096 - DNA, 25 bp, Mus musculus
agctagctcgggagagcagccatca

SEQ ID NO: 531097 - DNA, 25 bp, Mus musculus
agctagctcgggtgagcagccatca

SEQ ID NO: 531098 - DNA, 25 bp, Mus musculus
agctagcttatgctgttcgaggcaa

SEQ ID NO: 531099 - DNA, 25 bp, Mus musculus
agctagcttatggtgttcgaggcaa

SEQ ID NO: 531100 - DNA, 25 bp, Mus musculus
agctaggaagacacggcgctggaac

SEQ ID NO: 531101 - DNA, 25 bp, Mus musculus
agctaggaagactcggcgctggaac

SEQ ID NO: 531102 - DNA, 25 bp, Mus musculus
agctaggaatccattctatgcgtgc

SEQ ID NO: 531103 - DNA, 25 bp, Mus musculus
agctaggaatcctttctatgcgtgc

SEQ ID NO: 531104 - DNA, 25 bp, Mus musculus
agctaggccccaagagcgcctctgt

SEQ ID NO: 531105 - DNA, 25 bp, Mus musculus
agctaggccccatgagcgcctctgt

SEQ ID NO: 531106 - DNA, 25 bp, Mus musculus
agctaggctgctcggtgcacatctc

SEQ ID NO: 531107 - DNA, 25 bp, Mus musculus
agctaggctgctgggtgcacatctc

SEQ ID NO: 531108 - DNA, 25 bp, Mus musculus
agctagggattcctcttcatgggaa

SEQ ID NO: 531109 - DNA, 25 bp, Mus musculus
agctagggattcgtcttcatgggaa

SEQ ID NO: 531110 - DNA, 25 bp, Mus musculus
agctagggtttaatgttgtcaacaa

SEQ ID NO: 531111 - DNA, 25 bp, Mus musculus
agctagggtttattgttgtcaacaa

SEQ ID NO: 531112 - DNA, 25 bp, Mus musculus
agctaggtgccaagctgcgcaggac

SEQ ID NO: 531113 - DNA, 25 bp, Mus musculus
agctaggtgccatgctgcgcaggac

SEQ ID NO: 531114 - DNA, 25 bp, Mus musculus
agctagttcctgcttcagataccct

SEQ ID NO: 531115 - DNA, 25 bp, Mus musculus
agctagttcctggttcagataccct

SEQ ID NO: 531116 - DNA, 25 bp, Mus musculus
agctataagagacctagacaatctt

SEQ ID NO: 531117 - DNA, 25 bp, Mus musculus
agctataagagagctagacaatctt

SEQ ID NO: 531118 - DNA, 25 bp, Mus musculus
agctataccaccatcagcacgctgg

SEQ ID NO: 531119 - DNA, 25 bp, Mus musculus
agctataccaccttcagcacgctgg

SEQ ID NO: 531120 - DNA, 25 bp, Mus musculus
agctatcagaaaccgctggggcagc

SEQ ID NO: 531121 - DNA, 25 bp, Mus musculus
agctatcagaaagcgctggggcagc

SEQ ID NO: 531122 - DNA, 25 bp, Mus musculus
agctatcatcttagcaccctgcctg

SEQ ID NO: 531123 - DNA, 25 bp, Mus musculus
agctatcatctttgcaccctgcctg

SEQ ID NO: 531124 - DNA, 25 bp, Mus musculus
agctatcccagacgacatcattcag

SEQ ID NO: 531125 - DNA, 25 bp, Mus musculus
agctatcccagaggacatcattcag

SEQ ID NO: 531126 - DNA, 25 bp, Mus musculus
agctatcctgcaaagcgcagccctt

SEQ ID NO: 531127 - DNA, 25 bp, Mus musculus
agctatcctgcatagcgcagccctt

SEQ ID NO: 531128 - DNA, 25 bp, Mus musculus
agctatcgaatcaggaggagacact

SEQ ID NO: 531129 - DNA, 25 bp, Mus musculus
agctatcgaatctggaggagacact

SEQ ID NO: 531130 - DNA, 25 bp, Mus musculus
agctatcgacataggcccgagtacc

SEQ ID NO: 531131 - DNA, 25 bp, Mus musculus
agctatcgacattggcccgagtacc

SEQ ID NO: 531132 - DNA, 25 bp, Mus musculus
agctatcggattctgcactggagac

SEQ ID NO: 531133 - DNA, 25 bp, Mus musculus
agctatcggattgtgcactggagac

SEQ ID NO: 531134 - DNA, 25 bp, Mus musculus
agctatcttgctcagttcagggcca

SEQ ID NO: 531135 - DNA, 25 bp, Mus musculus
agctatcttgctgagttcagggcca

SEQ ID NO: 531136 - DNA, 25 bp, Mus musculus
agctatgaagttccggaatttgtgt

SEQ ID NO: 531137 - DNA, 25 bp, Mus musculus
agctatgaagttgcggaatttgtgt

SEQ ID NO: 531138 - DNA, 25 bp, Mus musculus
agctatgacagcaataacaacggag

SEQ ID NO: 531139 - DNA, 25 bp, Mus musculus
agctatgacagctataacaacggag

SEQ ID NO: 531140 - DNA, 25 bp, Mus musculus
agctatgctaacaccaagaccaggg

SEQ ID NO: 531141 - DNA, 25 bp, Mus musculus
agctatgctaactccaagaccaggg

SEQ ID NO: 531142 - DNA, 25 bp, Mus musculus
agctatgctgaccttttttgctgcg

SEQ ID NO: 531143 - DNA, 25 bp, Mus musculus
agctatgctgacgttttttgctgcg

SEQ ID NO: 531144 - DNA, 25 bp, Mus musculus
agctatggctacacacggtcgcggt

SEQ ID NO: 531145 - DNA, 25 bp, Mus musculus
agctatggctactcacggtcgcggt

SEQ ID NO: 531146 - DNA, 25 bp, Mus musculus
agctatgggactcgttcaatccaaa

SEQ ID NO: 531147 - DNA, 25 bp, Mus musculus
agctatgggactggttcaatccaaa

SEQ ID NO: 531148 - DNA, 25 bp, Mus musculus
agctatgggagccttccaggagttt

SEQ ID NO: 531149 - DNA, 25 bp, Mus musculus
agctatgggagcgttccaggagttt

SEQ ID NO: 531150 - DNA, 25 bp, Mus musculus
agctatgggataacacgagaagggc

SEQ ID NO: 531151 - DNA, 25 bp, Mus musculus
agctatgggatatcacgagaagggc

SEQ ID NO: 531152 - DNA, 25 bp, Mus musculus
agctatgtgagcatgaccctgcttg

SEQ ID NO: 531153 - DNA, 25 bp, Mus musculus
agctatgtgagcttgaccctgcttg

SEQ ID NO: 531154 - DNA, 25 bp, Mus musculus
agctattacgttcttgaaaactggg

SEQ ID NO: 531155 - DNA, 25 bp, Mus musculus
agctattacgttgttgaaaactggg

SEQ ID NO: 531156 - DNA, 25 bp, Mus musculus
agctattagaccagcttggcaaaga

SEQ ID NO: 531157 - DNA, 25 bp, Mus musculus
agctattagacctgcttggcaaaga

SEQ ID NO: 531158 - DNA, 25 bp, Mus musculus
agctattgaccgagccattgaggct

SEQ ID NO: 531159 - DNA, 25 bp, Mus musculus
agctattgaccgtgccattgaggct

SEQ ID NO: 531160 - DNA, 25 bp, Mus musculus
agctattgctcacgagattggtcgg

SEQ ID NO: 531161 - DNA, 25 bp, Mus musculus
agctattgctcaggagattggtcgg

SEQ ID NO: 531162 - DNA, 25 bp, Mus musculus
agctattttaagaactctgtttcag

SEQ ID NO: 531163 - DNA, 25 bp, Mus musculus
agctattttaagtactctgtttcag

SEQ ID NO: 531164 - DNA, 25 bp, Mus musculus
agctcaaaagtgaaagtcaaggtcc

SEQ ID NO: 531165 - DNA, 25 bp, Mus musculus
agctcaaaagtgtaagtcaaggtcc

SEQ ID NO: 531166 - DNA, 25 bp, Mus musculus
agctcaaagagtaggcgaagacccg

SEQ ID NO: 531167 - DNA, 25 bp, Mus musculus
agctcaaagagttggcgaagacccg

SEQ ID NO: 531168 - DNA, 25 bp, Mus musculus
agctcaaccgccagctgaagggaca

SEQ ID NO: 531169 - DNA, 25 bp, Mus musculus
agctcaaccgcctgctgaagggaca

SEQ ID NO: 531170 - DNA, 25 bp, Mus musculus
agctcaagacttaggtggacaaatg

SEQ ID NO: 531171 - DNA, 25 bp, Mus musculus
agctcaagactttggtggacaaatg

SEQ ID NO: 531172 - DNA, 25 bp, Mus musculus
agctcaagcgcacgctggacgccaa

SEQ ID NO: 531173 - DNA, 25 bp, Mus musculus
agctcaagcgcaggctggacgccaa

SEQ ID NO: 531174 - DNA, 25 bp, Mus musculus
agctcaaggattccctggtggctgc

SEQ ID NO: 531175 - DNA, 25 bp, Mus musculus
agctcaaggattgcctggtggctgc

SEQ ID NO: 531176 - DNA, 25 bp, Mus musculus
agctcaagggacctcacacgtctgg

SEQ ID NO: 531177 - DNA, 25 bp, Mus musculus
agctcaagggacgtcacacgtctgg

SEQ ID NO: 531178 - DNA, 25 bp, Mus musculus
agctcaaggtcgaccaatgggtcca

SEQ ID NO: 531179 - DNA, 25 bp, Mus musculus
agctcaaggtcgtccaatgggtcca

SEQ ID NO: 531180 - DNA, 25 bp, Mus musculus
agctcacacctcctgcggactgtag

SEQ ID NO: 531181 - DNA, 25 bp, Mus musculus
agctcacacctcgtgcggactgtag

SEQ ID NO: 531182 - DNA, 25 bp, Mus musculus
agctcacactggatgctctgctgga

SEQ ID NO: 531183 - DNA, 25 bp, Mus musculus
agctcacactggttgctctgctgga

SEQ ID NO: 531184 - DNA, 25 bp, Mus musculus
agctcacagagaagggctttcctga

SEQ ID NO: 531185 - DNA, 25 bp, Mus musculus
agctcacagagatgggctttcctga

SEQ ID NO: 531186 - DNA, 25 bp, Mus musculus
agctcaccagctcccgatagcaacc

SEQ ID NO: 531187 - DNA, 25 bp, Mus musculus
agctcaccagctgccgatagcaacc

SEQ ID NO: 531188 - DNA, 25 bp, Mus musculus
agctcaccatccaggtgctgctaga

SEQ ID NO: 531189 - DNA, 25 bp, Mus musculus
agctcaccatcctggtgctgctaga

SEQ ID NO: 531190 - DNA, 25 bp, Mus musculus
agctcaccgccgagcgtgcgagaga

SEQ ID NO: 531191 - DNA, 25 bp, Mus musculus
agctcaccgccgtgcgtgcgagaga

SEQ ID NO: 531192 - DNA, 25 bp, Mus musculus
agctcactaccactgacattgacta

SEQ ID NO: 531193 - DNA, 25 bp, Mus musculus
agctcactaccagtgacattgacta

SEQ ID NO: 531194 - DNA, 25 bp, Mus musculus
agctcactcttcatacaaagcacag

SEQ ID NO: 531195 - DNA, 25 bp, Mus musculus
agctcactcttcttacaaagcacag

SEQ ID NO: 531196 - DNA, 25 bp, Mus musculus
agctcagaaatacatctcagaaagt

SEQ ID NO: 531197 - DNA, 25 bp, Mus musculus
agctcagaaatagatctcagaaagt

SEQ ID NO: 531198 - DNA, 25 bp, Mus musculus
agctcagagaggcttttgccaaagt

SEQ ID NO: 531199 - DNA, 25 bp, Mus musculus
agctcagagagggttttgccaaagt

SEQ ID NO: 531200 - DNA, 25 bp, Mus musculus
agctcagaggatacggacaccgaga

SEQ ID NO: 531201 - DNA, 25 bp, Mus musculus
agctcagaggattcggacaccgaga

SEQ ID NO: 531202 - DNA, 25 bp, Mus musculus
agctcagatgatcaccatcacgccg

SEQ ID NO: 531203 - DNA, 25 bp, Mus musculus
agctcagatgatgaccatcacgccg

SEQ ID NO: 531204 - DNA, 25 bp, Mus musculus
agctcagcagcacgcaaagaggctc

SEQ ID NO: 531205 - DNA, 25 bp, Mus musculus
agctcagcagcaggcaaagaggctc

SEQ ID NO: 531206 - DNA, 25 bp, Mus musculus
agctcagcgtctctggaagtggcca

SEQ ID NO: 531207 - DNA, 25 bp, Mus musculus
agctcagcgtctgtggaagtggcca

SEQ ID NO: 531208 - DNA, 25 bp, Mus musculus
agctcagctgatccaacccgacggg

SEQ ID NO: 531209 - DNA, 25 bp, Mus musculus
agctcagctgatgcaacccgacggg

SEQ ID NO: 531210 - DNA, 25 bp, Mus musculus
agctcagggacactcgtgctggccc

SEQ ID NO: 531211 - DNA, 25 bp, Mus musculus
agctcagggacagtcgtgctggccc

SEQ ID NO: 531212 - DNA, 25 bp, Mus musculus
agctcagggaccaaggtgctggcca

SEQ ID NO: 531213 - DNA, 25 bp, Mus musculus
agctcagggacctaggtgctggcca

SEQ ID NO: 531214 - DNA, 25 bp, Mus musculus
agctcagggtcacagagacccggcc

SEQ ID NO: 531215 - DNA, 25 bp, Mus musculus
agctcagggtcagagagacccggcc

SEQ ID NO: 531216 - DNA, 25 bp, Mus musculus
agctcagggtctacatttcactcaa

SEQ ID NO: 531217 - DNA, 25 bp, Mus musculus
agctcagggtcttcatttcactcaa

SEQ ID NO: 531218 - DNA, 25 bp, Mus musculus
agctcaggtctactgcgctgccacg

SEQ ID NO: 531219 - DNA, 25 bp, Mus musculus
agctcaggtctagtgcgctgccacg

SEQ ID NO: 531220 - DNA, 25 bp, Mus musculus
agctcaggttggactgagtcactgg

SEQ ID NO: 531221 - DNA, 25 bp, Mus musculus
agctcaggttggtctgagtcactgg

SEQ ID NO: 531222 - DNA, 25 bp, Mus musculus
agctcagtatcaccagcatggccgg

SEQ ID NO: 531223 - DNA, 25 bp, Mus musculus
agctcagtatcagcagcatggccgg

SEQ ID NO: 531224 - DNA, 25 bp, Mus musculus
agctcagtgtgcagcgcctgagcct

SEQ ID NO: 531225 - DNA, 25 bp, Mus musculus
agctcagtgtgctgcgcctgagcct

SEQ ID NO: 531226 - DNA, 25 bp, Mus musculus
agctcagtgtggaccccgtcgttcc

SEQ ID NO: 531227 - DNA, 25 bp, Mus musculus
agctcagtgtggtccccgtcgttcc

SEQ ID NO: 531228 - DNA, 25 bp, Mus musculus
agctcatagaatcgctgcctcaaaa

SEQ ID NO: 531229 - DNA, 25 bp, Mus musculus
agctcatagaatggctgcctcaaaa

SEQ ID NO: 531230 - DNA, 25 bp, Mus musculus
agctcatagccgaggcctcttcaga

SEQ ID NO: 531231 - DNA, 25 bp, Mus musculus
agctcatagccgtggcctcttcaga

SEQ ID NO: 531232 - DNA, 25 bp, Mus musculus
agctcatcccggcagacgaattcgc

SEQ ID NO: 531233 - DNA, 25 bp, Mus musculus
agctcatcccgggagacgaattcgc

SEQ ID NO: 531234 - DNA, 25 bp, Mus musculus
agctcatccgcccagcagcagtgga

SEQ ID NO: 531235 - DNA, 25 bp, Mus musculus
agctcatccgccgagcagcagtgga

SEQ ID NO: 531236 - DNA, 25 bp, Mus musculus
agctcatcggctcctgctggtatgg

SEQ ID NO: 531237 - DNA, 25 bp, Mus musculus
agctcatcggctgctgctggtatgg

SEQ ID NO: 531238 - DNA, 25 bp, Mus musculus
agctcatgaattcaagcggctctca

SEQ ID NO: 531239 - DNA, 25 bp, Mus musculus
agctcatgaattgaagcggctctca

SEQ ID NO: 531240 - DNA, 25 bp, Mus musculus
agctcatgcgccattactgcctgtg

SEQ ID NO: 531241 - DNA, 25 bp, Mus musculus
agctcatgcgcctttactgcctgtg

SEQ ID NO: 531242 - DNA, 25 bp, Mus musculus
agctcatgctgaagggccttttgaa

SEQ ID NO: 531243 - DNA, 25 bp, Mus musculus
agctcatgctgatgggccttttgaa

SEQ ID NO: 531244 - DNA, 25 bp, Mus musculus
agctcatggaccacgtggggaccga

SEQ ID NO: 531245 - DNA, 25 bp, Mus musculus
agctcatggacctcgtggggaccga

SEQ ID NO: 531246 - DNA, 25 bp, Mus musculus
agctcatggctgaaggcgaactgaa

SEQ ID NO: 531247 - DNA, 25 bp, Mus musculus
agctcatggctgtaggcgaactgaa

SEQ ID NO: 531248 - DNA, 25 bp, Mus musculus
agctcatggcttctacccaccagaa

SEQ ID NO: 531249 - DNA, 25 bp, Mus musculus
agctcatggcttgtacccaccagaa

SEQ ID NO: 531250 - DNA, 25 bp, Mus musculus
agctcatggtgtccagtcctcccta

SEQ ID NO: 531251 - DNA, 25 bp, Mus musculus
agctcatggtgtgcagtcctcccta

SEQ ID NO: 531252 - DNA, 25 bp, Mus musculus
agctcattcggccacggcgacgaga

SEQ ID NO: 531253 - DNA, 25 bp, Mus musculus
agctcattcggcgacggcgacgaga

SEQ ID NO: 531254 - DNA, 25 bp, Mus musculus
agctcattgagaaccgaggccctgc

SEQ ID NO: 531255 - DNA, 25 bp, Mus musculus
agctcattgagatccgaggccctgc

SEQ ID NO: 531256 - DNA, 25 bp, Mus musculus
agctccacaagcacttggtctggag

SEQ ID NO: 531257 - DNA, 25 bp, Mus musculus
agctccacaagctcttggtctggag

SEQ ID NO: 531258 - DNA, 25 bp, Mus musculus
agctccacaggaaccggatccattc

SEQ ID NO: 531259 - DNA, 25 bp, Mus musculus
agctccacaggatccggatccattc

SEQ ID NO: 531260 - DNA, 25 bp, Mus musculus
agctccatctcacgcgcagacgccg

SEQ ID NO: 531261 - DNA, 25 bp, Mus musculus
agctccatctcaggcgcagacgccg

SEQ ID NO: 531262 - DNA, 25 bp, Mus musculus
agctccattaagcagctcacagatg

SEQ ID NO: 531263 - DNA, 25 bp, Mus musculus
agctccattaaggagctcacagatg

SEQ ID NO: 531264 - DNA, 25 bp, Mus musculus
agctccattcagcaaaggtggcctt

SEQ ID NO: 531265 - DNA, 25 bp, Mus musculus
agctccattcaggaaaggtggcctt

SEQ ID NO: 531266 - DNA, 25 bp, Mus musculus
agctcccaaaggaggtagctcagcc

SEQ ID NO: 531267 - DNA, 25 bp, Mus musculus
agctcccaaaggtggtagctcagcc

SEQ ID NO: 531268 - DNA, 25 bp, Mus musculus
agctcccagacactacatgggcagc

SEQ ID NO: 531269 - DNA, 25 bp, Mus musculus
agctcccagacagtacatgggcagc

SEQ ID NO: 531270 - DNA, 25 bp, Mus musculus
agctccccaagaatacatccctgtt

SEQ ID NO: 531271 - DNA, 25 bp, Mus musculus
agctccccaagattacatccctgtt

SEQ ID NO: 531272 - DNA, 25 bp, Mus musculus
agctccccacatactgttgttcgtc

SEQ ID NO: 531273 - DNA, 25 bp, Mus musculus
agctccccacattctgttgttcgtc

SEQ ID NO: 531274 - DNA, 25 bp, Mus musculus
agctccccgctcaactcagtgaagt

SEQ ID NO: 531275 - DNA, 25 bp, Mus musculus
agctccccgctctactcagtgaagt

SEQ ID NO: 531276 - DNA, 25 bp, Mus musculus
agctcccgaggtcgccgatcgaatt

SEQ ID NO: 531277 - DNA, 25 bp, Mus musculus
agctcccgaggtggccgatcgaatt

SEQ ID NO: 531278 - DNA, 25 bp, Mus musculus
agctcccgatctcgattctacagtg

SEQ ID NO: 531279 - DNA, 25 bp, Mus musculus
agctcccgatctggattctacagtg

SEQ ID NO: 531280 - DNA, 25 bp, Mus musculus
agctcccgcctgagctgctcgtgga

SEQ ID NO: 531281 - DNA, 25 bp, Mus musculus
agctcccgcctgtgctgctcgtgga

SEQ ID NO: 531282 - DNA, 25 bp, Mus musculus
agctcccggactccggttcgagcga

SEQ ID NO: 531283 - DNA, 25 bp, Mus musculus
agctcccggactgcggttcgagcga

SEQ ID NO: 531284 - DNA, 25 bp, Mus musculus
agctccctagagagctcagccagcg

SEQ ID NO: 531285 - DNA, 25 bp, Mus musculus
agctccctagagtgctcagccagcg

SEQ ID NO: 531286 - DNA, 25 bp, Mus musculus
agctccctccgaagacctggaagct

SEQ ID NO: 531287 - DNA, 25 bp, Mus musculus
agctccctccgatgacctggaagct

SEQ ID NO: 531288 - DNA, 25 bp, Mus musculus
agctccctggagcaaggttcggtca

SEQ ID NO: 531289 - DNA, 25 bp, Mus musculus
agctccctggaggaaggttcggtca

SEQ ID NO: 531290 - DNA, 25 bp, Mus musculus
agctccctggtaaccccaatgctgt

SEQ ID NO: 531291 - DNA, 25 bp, Mus musculus
agctccctggtatccccaatgctgt

SEQ ID NO: 531292 - DNA, 25 bp, Mus musculus
agctccctgtggctagacatttcag

SEQ ID NO: 531293 - DNA, 25 bp, Mus musculus
agctccctgtgggtagacatttcag

SEQ ID NO: 531294 - DNA, 25 bp, Mus musculus
agctccgaaagacggagcgactgca

SEQ ID NO: 531295 - DNA, 25 bp, Mus musculus
agctccgaaagagggagcgactgca

SEQ ID NO: 531296 - DNA, 25 bp, Mus musculus
agctccgacaggagcgggaccagca

SEQ ID NO: 531297 - DNA, 25 bp, Mus musculus
agctccgacaggtgcgggaccagca

SEQ ID NO: 531298 - DNA, 25 bp, Mus musculus
agctccgcggctatgctgaggccca

SEQ ID NO: 531299 - DNA, 25 bp, Mus musculus
agctccgcggctttgctgaggccca

SEQ ID NO: 531300 - DNA, 25 bp, Mus musculus
agctccgcgggacagccgaaatgcc

SEQ ID NO: 531301 - DNA, 25 bp, Mus musculus
agctccgcgggagagccgaaatgcc

SEQ ID NO: 531302 - DNA, 25 bp, Mus musculus
agctccgctcacatatctgcgtggg

SEQ ID NO: 531303 - DNA, 25 bp, Mus musculus
agctccgctcacttatctgcgtggg

SEQ ID NO: 531304 - DNA, 25 bp, Mus musculus
agctccgctgtgctctcaacaaaag

SEQ ID NO: 531305 - DNA, 25 bp, Mus musculus
agctccgctgtggtctcaacaaaag

SEQ ID NO: 531306 - DNA, 25 bp, Mus musculus
agctccgggatgctgtgctccttgt

SEQ ID NO: 531307 - DNA, 25 bp, Mus musculus
agctccgggatggtgtgctccttgt

SEQ ID NO: 531308 - DNA, 25 bp, Mus musculus
agctccgggcacaccggatgctggt

SEQ ID NO: 531309 - DNA, 25 bp, Mus musculus
agctccgggcactccggatgctggt

SEQ ID NO: 531310 - DNA, 25 bp, Mus musculus
agctccgtcacgagatcaccacagt

SEQ ID NO: 531311 - DNA, 25 bp, Mus musculus
agctccgtcacgtgatcaccacagt

SEQ ID NO: 531312 - DNA, 25 bp, Mus musculus
agctccgtgcccaacatcacgtggt

SEQ ID NO: 531313 - DNA, 25 bp, Mus musculus
agctccgtgccctacatcacgtggt

SEQ ID NO: 531314 - DNA, 25 bp, Mus musculus
agctccgtgtacagctccgggctca

SEQ ID NO: 531315 - DNA, 25 bp, Mus musculus
agctccgtgtacatttcccatttga

SEQ ID NO: 531316 - DNA, 25 bp, Mus musculus
agctccgtgtactgctccgggctca

SEQ ID NO: 531317 - DNA, 25 bp, Mus musculus
agctccgtgtacttttcccatttga

SEQ ID NO: 531318 - DNA, 25 bp, Mus musculus
agctccgttctgaacctggtcaggg

SEQ ID NO: 531319 - DNA, 25 bp, Mus musculus
agctccgttctgtacctggtcaggg

SEQ ID NO: 531320 - DNA, 25 bp, Mus musculus
agctcctacccacgttggactctca

SEQ ID NO: 531321 - DNA, 25 bp, Mus musculus
agctcctacccaggttggactctca

SEQ ID NO: 531322 - DNA, 25 bp, Mus musculus
agctcctcatcgagttggtggcggc

SEQ ID NO: 531323 - DNA, 25 bp, Mus musculus
agctcctcatcgtgttggtggcggc

SEQ ID NO: 531324 - DNA, 25 bp, Mus musculus
agctcctcgagtcgtcatgtctacc

SEQ ID NO: 531325 - DNA, 25 bp, Mus musculus
agctcctcgagtggtcatgtctacc

SEQ ID NO: 531326 - DNA, 25 bp, Mus musculus
agctcctctactactggcgatgcag

SEQ ID NO: 531327 - DNA, 25 bp, Mus musculus
agctcctctacttctggcgatgcag

SEQ ID NO: 531328 - DNA, 25 bp, Mus musculus
agctcctctctcagcgcttctgagt

SEQ ID NO: 531329 - DNA, 25 bp, Mus musculus
agctcctctctctgcgcttctgagt

SEQ ID NO: 531330 - DNA, 25 bp, Mus musculus
agctcctgaaggaagggaccaagga

SEQ ID NO: 531331 - DNA, 25 bp, Mus musculus
agctcctgaaggtagggaccaagga

SEQ ID NO: 531332 - DNA, 25 bp, Mus musculus
agctcctgccagaacttgactctaa

SEQ ID NO: 531333 - DNA, 25 bp, Mus musculus
agctcctgccagtacttgactctaa

SEQ ID NO: 531334 - DNA, 25 bp, Mus musculus
agctcctgctggataggctccatcc

SEQ ID NO: 531335 - DNA, 25 bp, Mus musculus
agctcctgctggttaggctccatcc

SEQ ID NO: 531336 - DNA, 25 bp, Mus musculus
agctcctgctttcgtatactgatgg

SEQ ID NO: 531337 - DNA, 25 bp, Mus musculus
agctcctgctttggtatactgatgg

SEQ ID NO: 531338 - DNA, 25 bp, Mus musculus
agctcctggaatcactgggcccaaa

SEQ ID NO: 531339 - DNA, 25 bp, Mus musculus
agctcctggaatgactgggcccaaa

SEQ ID NO: 531340 - DNA, 25 bp, Mus musculus
agctcctggccgctgcagtgcagca

SEQ ID NO: 531341 - DNA, 25 bp, Mus musculus
agctcctggccggtgcagtgcagca

SEQ ID NO: 531342 - DNA, 25 bp, Mus musculus
agctcctgggtcacacaggctacgg

SEQ ID NO: 531343 - DNA, 25 bp, Mus musculus
agctcctgggtctcacaggctacgg

SEQ ID NO: 531344 - DNA, 25 bp, Mus musculus
agctcctgtcctatggaaacccaag

SEQ ID NO: 531345 - DNA, 25 bp, Mus musculus
agctcctgtcctttggaaacccaag

SEQ ID NO: 531346 - DNA, 25 bp, Mus musculus
agctcctgtgtccaaggtcaggtgc

SEQ ID NO: 531347 - DNA, 25 bp, Mus musculus
agctcctgtgtcgaaggtcaggtgc

SEQ ID NO: 531348 - DNA, 25 bp, Mus musculus
agctccttcacgacagccgaacaga

SEQ ID NO: 531349 - DNA, 25 bp, Mus musculus
agctccttcacgtcagccgaacaga

SEQ ID NO: 531350 - DNA, 25 bp, Mus musculus
agctcgaaaaacctctgcagtagac

SEQ ID NO: 531351 - DNA, 25 bp, Mus musculus
agctcgaaaaacgtctgcagtagac

SEQ ID NO: 531352 - DNA, 25 bp, Mus musculus
agctcgacatcacgaagaacgagcg

SEQ ID NO: 531353 - DNA, 25 bp, Mus musculus
agctcgacatcaggaagaacgagcg

SEQ ID NO: 531354 - DNA, 25 bp, Mus musculus
agctcgacccggcagggcttgttta

SEQ ID NO: 531355 - DNA, 25 bp, Mus musculus
agctcgacccgggagggcttgttta

SEQ ID NO: 531356 - DNA, 25 bp, Mus musculus
agctcgactgtcagggtcacaacta

SEQ ID NO: 531357 - DNA, 25 bp, Mus musculus
agctcgactgtctgggtcacaacta

SEQ ID NO: 531358 - DNA, 25 bp, Mus musculus
agctcgagatctcccacaaactatg

SEQ ID NO: 531359 - DNA, 25 bp, Mus musculus
agctcgagatctgccacaaactatg

SEQ ID NO: 531360 - DNA, 25 bp, Mus musculus
agctcgagcagccaccacaagcaac

SEQ ID NO: 531361 - DNA, 25 bp, Mus musculus
agctcgagcagcgaccacaagcaac

SEQ ID NO: 531362 - DNA, 25 bp, Mus musculus
agctcgaggctacaccatcatggga

SEQ ID NO: 531363 - DNA, 25 bp, Mus musculus
agctcgaggctagaccatcatggga

SEQ ID NO: 531364 - DNA, 25 bp, Mus musculus
agctcgagtcctaggcccgccgtgg

SEQ ID NO: 531365 - DNA, 25 bp, Mus musculus
agctcgagtccttggcccgccgtgg

SEQ ID NO: 531366 - DNA, 25 bp, Mus musculus
agctcgcaggcaaggctccggcagc

SEQ ID NO: 531367 - DNA, 25 bp, Mus musculus
agctcgcaggcatggctccggcagc

SEQ ID NO: 531368 - DNA, 25 bp, Mus musculus
agctcgcagtccaccgggcgggtct

SEQ ID NO: 531369 - DNA, 25 bp, Mus musculus
agctcgcagtcctccgggcgggtct

SEQ ID NO: 531370 - DNA, 25 bp, Mus musculus
agctcgcagttccaggttttggttg

SEQ ID NO: 531371 - DNA, 25 bp, Mus musculus
agctcgcagttcgaggttttggttg

SEQ ID NO: 531372 - DNA, 25 bp, Mus musculus
agctcgccagcaatgctccagctag

SEQ ID NO: 531373 - DNA, 25 bp, Mus musculus
agctcgccagcattgctccagctag

SEQ ID NO: 531374 - DNA, 25 bp, Mus musculus
agctcgccgctgaccaagaaacgtc

SEQ ID NO: 531375 - DNA, 25 bp, Mus musculus
agctcgccgctgtccaagaaacgtc

SEQ ID NO: 531376 - DNA, 25 bp, Mus musculus
agctcgcgtctgagctctcgcatct

SEQ ID NO: 531377 - DNA, 25 bp, Mus musculus
agctcgcgtctgtgctctcgcatct

SEQ ID NO: 531378 - DNA, 25 bp, Mus musculus
agctcgctcggcatctcgtgcttac

SEQ ID NO: 531379 - DNA, 25 bp, Mus musculus
agctcgctcggcttctcgtgcttac

SEQ ID NO: 531380 - DNA, 25 bp, Mus musculus
agctcgctggtgcacaagccctttg

SEQ ID NO: 531381 - DNA, 25 bp, Mus musculus
agctcgctggtggacaagccctttg

SEQ ID NO: 531382 - DNA, 25 bp, Mus musculus
agctcggccccgcactgaagaggct

SEQ ID NO: 531383 - DNA, 25 bp, Mus musculus
agctcggccccggactgaagaggct

SEQ ID NO: 531384 - DNA, 25 bp, Mus musculus
agctcggcgacactaccattttgaa

SEQ ID NO: 531385 - DNA, 25 bp, Mus musculus
agctcggcgacagtaccattttgaa

SEQ ID NO: 531386 - DNA, 25 bp, Mus musculus
agctcgggtgatctgtgccccacag

SEQ ID NO: 531387 - DNA, 25 bp, Mus musculus
agctcgggtgatgtgtgccccacag

SEQ ID NO: 531388 - DNA, 25 bp, Mus musculus
agctcggtacagagtctgacgtgcg

SEQ ID NO: 531389 - DNA, 25 bp, Mus musculus
agctcggtacagtgtctgacgtgcg

SEQ ID NO: 531390 - DNA, 25 bp, Mus musculus
agctcggtgaaaacgaccgcgcccg

SEQ ID NO: 531391 - DNA, 25 bp, Mus musculus
agctcggtgaaatcgaccgcgcccg

SEQ ID NO: 531392 - DNA, 25 bp, Mus musculus
agctcgtagtatcttggaagaatct

SEQ ID NO: 531393 - DNA, 25 bp, Mus musculus
agctcgtagtatgttggaagaatct

SEQ ID NO: 531394 - DNA, 25 bp, Mus musculus
agctcgtcatgacggcccaaggcaa

SEQ ID NO: 531395 - DNA, 25 bp, Mus musculus
agctcgtcatgagggcccaaggcaa

SEQ ID NO: 531396 - DNA, 25 bp, Mus musculus
agctcgttcggcatcgcgggttgtt

SEQ ID NO: 531397 - DNA, 25 bp, Mus musculus
agctcgttcggcttcgcgggttgtt

SEQ ID NO: 531398 - DNA, 25 bp, Mus musculus
agctctacaagaatgctcgggagcg

SEQ ID NO: 531399 - DNA, 25 bp, Mus musculus
agctctacaagattgctcgggagcg

SEQ ID NO: 531400 - DNA, 25 bp, Mus musculus
agctctaccaagatgacaagcagtt

SEQ ID NO: 531401 - DNA, 25 bp, Mus musculus
agctctaccaagttgacaagcagtt

SEQ ID NO: 531402 - DNA, 25 bp, Mus musculus
agctctagggaacgatgacttcact

SEQ ID NO: 531403 - DNA, 25 bp, Mus musculus
agctctagggaaggatgacttcact

SEQ ID NO: 531404 - DNA, 25 bp, Mus musculus
agctctcagagcagatccatcgatt

SEQ ID NO: 531405 - DNA, 25 bp, Mus musculus
agctctcagagctgatccatcgatt

SEQ ID NO: 531406 - DNA, 25 bp, Mus musculus
agctctcagctcaggtaagaaggct

SEQ ID NO: 531407 - DNA, 25 bp, Mus musculus
agctctcagctctggtaagaaggct

SEQ ID NO: 531408 - DNA, 25 bp, Mus musculus
agctctcaggcacagctatccagca

SEQ ID NO: 531409 - DNA, 25 bp, Mus musculus
agctctcaggcagagctatccagca

SEQ ID NO: 531410 - DNA, 25 bp, Mus musculus
agctctcgcttcacggaaccatctg

SEQ ID NO: 531411 - DNA, 25 bp, Mus musculus
agctctcgcttctcggaaccatctg

SEQ ID NO: 531412 - DNA, 25 bp, Mus musculus
agctctcggtgcagctgagcgatgc

SEQ ID NO: 531413 - DNA, 25 bp, Mus musculus
agctctcggtgctgctgagcgatgc

SEQ ID NO: 531414 - DNA, 25 bp, Mus musculus
agctctcgtaagagagtccctcgcg

SEQ ID NO: 531415 - DNA, 25 bp, Mus musculus
agctctcgtaagtgagtccctcgcg

SEQ ID NO: 531416 - DNA, 25 bp, Mus musculus
agctctctacgaagcgctgaaagag

SEQ ID NO: 531417 - DNA, 25 bp, Mus musculus
agctctctacgatgcgctgaaagag

SEQ ID NO: 531418 - DNA, 25 bp, Mus musculus
agctctctcgctagcatttgcctac

SEQ ID NO: 531419 - DNA, 25 bp, Mus musculus
agctctctcgcttgcatttgcctac

SEQ ID NO: 531420 - DNA, 25 bp, Mus musculus
agctctctgaacagccaaggctaga

SEQ ID NO: 531421 - DNA, 25 bp, Mus musculus
agctctctgaactgccaaggctaga

SEQ ID NO: 531422 - DNA, 25 bp, Mus musculus
agctctctgtgtcgatacggagtta

SEQ ID NO: 531423 - DNA, 25 bp, Mus musculus
agctctctgtgtggatacggagtta

SEQ ID NO: 531424 - DNA, 25 bp, Mus musculus
agctctcttatcactgggcgcggcg

SEQ ID NO: 531425 - DNA, 25 bp, Mus musculus
agctctcttatctctgggcgcggcg

SEQ ID NO: 531426 - DNA, 25 bp, Mus musculus
agctctcttcctagctgccacaaga

SEQ ID NO: 531427 - DNA, 25 bp, Mus musculus
agctctcttccttgctgccacaaga

SEQ ID NO: 531428 - DNA, 25 bp, Mus musculus
agctctgaagagaaacttcctggaa

SEQ ID NO: 531429 - DNA, 25 bp, Mus musculus
agctctgaagagtaacttcctggaa

SEQ ID NO: 531430 - DNA, 25 bp, Mus musculus
agctctgaaggcaccaacggccatg

SEQ ID NO: 531431 - DNA, 25 bp, Mus musculus
agctctgaaggctccaacggccatg

SEQ ID NO: 531432 - DNA, 25 bp, Mus musculus
agctctgacccaaaccacagtggct

SEQ ID NO: 531433 - DNA, 25 bp, Mus musculus
agctctgacccataccacagtggct

SEQ ID NO: 531434 - DNA, 25 bp, Mus musculus
agctctgagaggactaccccagtcc

SEQ ID NO: 531435 - DNA, 25 bp, Mus musculus
agctctgagaggtctaccccagtcc

SEQ ID NO: 531436 - DNA, 25 bp, Mus musculus
agctctgatccaccggcaggaaatg

SEQ ID NO: 531437 - DNA, 25 bp, Mus musculus
agctctgatccagcggcaggaaatg

SEQ ID NO: 531438 - DNA, 25 bp, Mus musculus
agctctgatcctcgcccgcttggtg

SEQ ID NO: 531439 - DNA, 25 bp, Mus musculus
agctctgatcctggcccgcttggtg

SEQ ID NO: 531440 - DNA, 25 bp, Mus musculus
agctctgatgttcatttcttcttgg

SEQ ID NO: 531441 - DNA, 25 bp, Mus musculus
agctctgatgttgatttcttcttgg

SEQ ID NO: 531442 - DNA, 25 bp, Mus musculus
agctctgattgaccccaacatcttg

SEQ ID NO: 531443 - DNA, 25 bp, Mus musculus
agctctgattgagcccaacatcttg

SEQ ID NO: 531444 - DNA, 25 bp, Mus musculus
agctctgcaccaattctgtgctctg

SEQ ID NO: 531445 - DNA, 25 bp, Mus musculus
agctctgcaccatttctgtgctctg

SEQ ID NO: 531446 - DNA, 25 bp, Mus musculus
agctctgcagagcattgccacggac

SEQ ID NO: 531447 - DNA, 25 bp, Mus musculus
agctctgcagaggattgccacggac

SEQ ID NO: 531448 - DNA, 25 bp, Mus musculus
agctctgcagcacgtgccagtgctg

SEQ ID NO: 531449 - DNA, 25 bp, Mus musculus
agctctgcagcaggtgccagtgctg

SEQ ID NO: 531450 - DNA, 25 bp, Mus musculus
agctctgcattcatgaccacgtcca

SEQ ID NO: 531451 - DNA, 25 bp, Mus musculus
agctctgcattcttgaccacgtcca

SEQ ID NO: 531452 - DNA, 25 bp, Mus musculus
agctctgcccgacgagcttcggcga

SEQ ID NO: 531453 - DNA, 25 bp, Mus musculus
agctctgcccgaggagcttcggcga

SEQ ID NO: 531454 - DNA, 25 bp, Mus musculus
agctctgccgggaagaaccctacca

SEQ ID NO: 531455 - DNA, 25 bp, Mus musculus
agctctgccgggtagaaccctacca

SEQ ID NO: 531456 - DNA, 25 bp, Mus musculus
agctctgcggataaagagagacttg

SEQ ID NO: 531457 - DNA, 25 bp, Mus musculus
agctctgcggattaagagagacttg

SEQ ID NO: 531458 - DNA, 25 bp, Mus musculus
agctctgcggtccttcaaccgggag

SEQ ID NO: 531459 - DNA, 25 bp, Mus musculus
agctctgcggtcgttcaaccgggag

SEQ ID NO: 531460 - DNA, 25 bp, Mus musculus
agctctggacaactacttcccatca

SEQ ID NO: 531461 - DNA, 25 bp, Mus musculus
agctctggacaagtacttcccatca

SEQ ID NO: 531462 - DNA, 25 bp, Mus musculus
agctctggacagcaccacagtggca

SEQ ID NO: 531463 - DNA, 25 bp, Mus musculus
agctctggacaggaccacagtggca

SEQ ID NO: 531464 - DNA, 25 bp, Mus musculus
agctctggatctatgctggttatga

SEQ ID NO: 531465 - DNA, 25 bp, Mus musculus
agctctggatctttgctggttatga

SEQ ID NO: 531466 - DNA, 25 bp, Mus musculus
agctctggcccgattcggagtcgcg

SEQ ID NO: 531467 - DNA, 25 bp, Mus musculus
agctctggcccgtttcggagtcgcg

SEQ ID NO: 531468 - DNA, 25 bp, Mus musculus
agctctgggcacaagaagtggatca

SEQ ID NO: 531469 - DNA, 25 bp, Mus musculus
agctctgggcactagaagtggatca

SEQ ID NO: 531470 - DNA, 25 bp, Mus musculus
agctctgtgagtatgccttcaacat

SEQ ID NO: 531471 - DNA, 25 bp, Mus musculus
agctctgtgagtttgccttcaacat

SEQ ID NO: 531472 - DNA, 25 bp, Mus musculus
agctctgtgcagaggctcgatagca

SEQ ID NO: 531473 - DNA, 25 bp, Mus musculus
agctctgtgcagtggctcgatagca

SEQ ID NO: 531474 - DNA, 25 bp, Mus musculus
agctctgttgccatctcacttcgtg

SEQ ID NO: 531475 - DNA, 25 bp, Mus musculus
agctctgttgccttctcacttcgtg

SEQ ID NO: 531476 - DNA, 25 bp, Mus musculus
agctctgtttttagagtcctgttgg

SEQ ID NO: 531477 - DNA, 25 bp, Mus musculus
agctctgttttttgagtcctgttgg

SEQ ID NO: 531478 - DNA, 25 bp, Mus musculus
agctcttagattcctatcactacca

SEQ ID NO: 531479 - DNA, 25 bp, Mus musculus
agctcttagattgctatcactacca

SEQ ID NO: 531480 - DNA, 25 bp, Mus musculus
agctcttcacacatcttgagcgaga

SEQ ID NO: 531481 - DNA, 25 bp, Mus musculus
agctcttcacacttcttgagcgaga

SEQ ID NO: 531482 - DNA, 25 bp, Mus musculus
agctcttcactcacaccaaaggcgg

SEQ ID NO: 531483 - DNA, 25 bp, Mus musculus
agctcttcactctcaccaaaggcgg

SEQ ID NO: 531484 - DNA, 25 bp, Mus musculus
agctcttcatccactacttctttaa

SEQ ID NO: 531485 - DNA, 25 bp, Mus musculus
agctcttcatcctctacttctttaa

SEQ ID NO: 531486 - DNA, 25 bp, Mus musculus
agctcttccaagactacgacagcca

SEQ ID NO: 531487 - DNA, 25 bp, Mus musculus
agctcttccaagtctacgacagcca

SEQ ID NO: 531488 - DNA, 25 bp, Mus musculus
agctcttcctggcttcctataatgg

SEQ ID NO: 531489 - DNA, 25 bp, Mus musculus
agctcttcctgggttcctataatgg

SEQ ID NO: 531490 - DNA, 25 bp, Mus musculus
agctcttcgagtccatccgggtgga

SEQ ID NO: 531491 - DNA, 25 bp, Mus musculus
agctcttcgagtgcatccgggtgga

SEQ ID NO: 531492 - DNA, 25 bp, Mus musculus
agctcttcgattacattcagtctgt

SEQ ID NO: 531493 - DNA, 25 bp, Mus musculus
agctcttcgatttcattcagtctgt

SEQ ID NO: 531494 - DNA, 25 bp, Mus musculus
agctcttctggacgcttatgagtgc

SEQ ID NO: 531495 - DNA, 25 bp, Mus musculus
agctcttctggaggcttatgagtgc

SEQ ID NO: 531496 - DNA, 25 bp, Mus musculus
agctcttggcaccttttgtcattga

SEQ ID NO: 531497 - DNA, 25 bp, Mus musculus
agctcttggcacgttttgtcattga

SEQ ID NO: 531498 - DNA, 25 bp, Mus musculus
agctcttgggagatcgcgtggccat

SEQ ID NO: 531499 - DNA, 25 bp, Mus musculus
agctcttgggagttcgcgtggccat

SEQ ID NO: 531500 - DNA, 25 bp, Mus musculus
agctcttggtctcgagagcgctcag

SEQ ID NO: 531501 - DNA, 25 bp, Mus musculus
agctcttggtctggagagcgctcag

SEQ ID NO: 531502 - DNA, 25 bp, Mus musculus
agctcttgttagaccctcatcctga

SEQ ID NO: 531503 - DNA, 25 bp, Mus musculus
agctcttgttagtccctcatcctga

SEQ ID NO: 531504 - DNA, 25 bp, Mus musculus
agctctttgagcacctccaagacct

SEQ ID NO: 531505 - DNA, 25 bp, Mus musculus
agctctttgagctcctccaagacct

SEQ ID NO: 531506 - DNA, 25 bp, Mus musculus
agctctttgtatatggtagaagaca

SEQ ID NO: 531507 - DNA, 25 bp, Mus musculus
agctctttgtatttggtagaagaca

SEQ ID NO: 531508 - DNA, 25 bp, Mus musculus
agctgaaactgaaggcccgctaggg

SEQ ID NO: 531509 - DNA, 25 bp, Mus musculus
agctgaaactgatggcccgctaggg

SEQ ID NO: 531510 - DNA, 25 bp, Mus musculus
agctgaacaatcatccacgctgcct

SEQ ID NO: 531511 - DNA, 25 bp, Mus musculus
agctgaacaatcttccacgctgcct

SEQ ID NO: 531512 - DNA, 25 bp, Mus musculus
agctgaacctcaccggctaccgaaa

SEQ ID NO: 531513 - DNA, 25 bp, Mus musculus
agctgaacctcagcggctaccgaaa

SEQ ID NO: 531514 - DNA, 25 bp, Mus musculus
agctgaacgtgacgagaccaccagc

SEQ ID NO: 531515 - DNA, 25 bp, Mus musculus
agctgaacgtgaggagaccaccagc

SEQ ID NO: 531516 - DNA, 25 bp, Mus musculus
agctgaagaacccacaggttctgag

SEQ ID NO: 531517 - DNA, 25 bp, Mus musculus
agctgaagaaccgacaggttctgag

SEQ ID NO: 531518 - DNA, 25 bp, Mus musculus
agctgaagagatatgagttccaggg

SEQ ID NO: 531519 - DNA, 25 bp, Mus musculus
agctgaagagatttgagttccaggg

SEQ ID NO: 531520 - DNA, 25 bp, Mus musculus
agctgaagatccacagacctcaggt

SEQ ID NO: 531521 - DNA, 25 bp, Mus musculus
agctgaagatcctcagacctcaggt

SEQ ID NO: 531522 - DNA, 25 bp, Mus musculus
agctgaagatgacctccgagatgct

SEQ ID NO: 531523 - DNA, 25 bp, Mus musculus
agctgaagatgagctccgagatgct

SEQ ID NO: 531524 - DNA, 25 bp, Mus musculus
agctgaagatgtcccagatccaagg

SEQ ID NO: 531525 - DNA, 25 bp, Mus musculus
agctgaagatgtgccagatccaagg

SEQ ID NO: 531526 - DNA, 25 bp, Mus musculus
agctgaagcatcataccatcgtgag

SEQ ID NO: 531527 - DNA, 25 bp, Mus musculus
agctgaagcatcttaccatcgtgag

SEQ ID NO: 531528 - DNA, 25 bp, Mus musculus
agctgaaggagaacccgtacactaa

SEQ ID NO: 531529 - DNA, 25 bp, Mus musculus
agctgaaggagatcccgtacactaa

SEQ ID NO: 531530 - DNA, 25 bp, Mus musculus
agctgaaggagcacggcccagaaaa

SEQ ID NO: 531531 - DNA, 25 bp, Mus musculus
agctgaaggagctcggcccagaaaa

SEQ ID NO: 531532 - DNA, 25 bp, Mus musculus
agctgaaggataccgatctgggcta

SEQ ID NO: 531533 - DNA, 25 bp, Mus musculus
agctgaaggatagcgatctgggcta

SEQ ID NO: 531534 - DNA, 25 bp, Mus musculus
agctgaaggcctatgataatgaagt

SEQ ID NO: 531535 - DNA, 25 bp, Mus musculus
agctgaaggcctttgataatgaagt

SEQ ID NO: 531536 - DNA, 25 bp, Mus musculus
agctgaaggttgaaataaatcattc

SEQ ID NO: 531537 - DNA, 25 bp, Mus musculus
agctgaaggttgtaataaatcattc

SEQ ID NO: 531538 - DNA, 25 bp, Mus musculus
agctgaagtggtattagggaacatc

SEQ ID NO: 531539 - DNA, 25 bp, Mus musculus
agctgaagtggttttagggaacatc

SEQ ID NO: 531540 - DNA, 25 bp, Mus musculus
agctgaatgagtaaggcctggaccc

SEQ ID NO: 531541 - DNA, 25 bp, Mus musculus
agctgaatgagttaggcctggaccc

SEQ ID NO: 531542 - DNA, 25 bp, Mus musculus
agctgaatgcagagcgcaggcaagc

SEQ ID NO: 531543 - DNA, 25 bp, Mus musculus
agctgaatgcagtgcgcaggcaagc

SEQ ID NO: 531544 - DNA, 25 bp, Mus musculus
agctgaatgtgcacatgaacccccc

SEQ ID NO: 531545 - DNA, 25 bp, Mus musculus
agctgaatgtgctcatgaacccccc

SEQ ID NO: 531546 - DNA, 25 bp, Mus musculus
agctgacaagccaccatctcacagg

SEQ ID NO: 531547 - DNA, 25 bp, Mus musculus
agctgacaagcctccatctcacagg

SEQ ID NO: 531548 - DNA, 25 bp, Mus musculus
agctgacaatctcaaaaaacgcgga

SEQ ID NO: 531549 - DNA, 25 bp, Mus musculus
agctgacaatctgaaaaaacgcgga

SEQ ID NO: 531550 - DNA, 25 bp, Mus musculus
agctgacagagaccagcgtgaacct

SEQ ID NO: 531551 - DNA, 25 bp, Mus musculus
agctgacagagagcagcgtgaacct

SEQ ID NO: 531552 - DNA, 25 bp, Mus musculus
agctgacagtccagatctcccagga

SEQ ID NO: 531553 - DNA, 25 bp, Mus musculus
agctgacagtcctgatctcccagga

SEQ ID NO: 531554 - DNA, 25 bp, Mus musculus
agctgacatactcaaggaattaggg

SEQ ID NO: 531555 - DNA, 25 bp, Mus musculus
agctgacatactgaaggaattaggg

SEQ ID NO: 531556 - DNA, 25 bp, Mus musculus
agctgacatgccactctgcagaggg

SEQ ID NO: 531557 - DNA, 25 bp, Mus musculus
agctgacatgcctctctgcagaggg

SEQ ID NO: 531558 - DNA, 25 bp, Mus musculus
agctgaccacagaggctatgccgga

SEQ ID NO: 531559 - DNA, 25 bp, Mus musculus
agctgaccacagtggctatgccgga

SEQ ID NO: 531560 - DNA, 25 bp, Mus musculus
agctgacccaagaagtggagtttgt

SEQ ID NO: 531561 - DNA, 25 bp, Mus musculus
agctgacccaagtagtggagtttgt

SEQ ID NO: 531562 - DNA, 25 bp, Mus musculus
agctgacccaccagcatctgtggtg

SEQ ID NO: 531563 - DNA, 25 bp, Mus musculus
agctgacccacctgcatctgtggtg

SEQ ID NO: 531564 - DNA, 25 bp, Mus musculus
agctgacccgttctactggatgcga

SEQ ID NO: 531565 - DNA, 25 bp, Mus musculus
agctgacccgttgtactggatgcga

SEQ ID NO: 531566 - DNA, 25 bp, Mus musculus
agctgaccctacacatcgactcaag

SEQ ID NO: 531567 - DNA, 25 bp, Mus musculus
agctgaccctactcatcgactcaag

SEQ ID NO: 531568 - DNA, 25 bp, Mus musculus
agctgaccgatgctgagttcccaca

SEQ ID NO: 531569 - DNA, 25 bp, Mus musculus
agctgaccgatggtgagttcccaca

SEQ ID NO: 531570 - DNA, 25 bp, Mus musculus
agctgaccttctctgcccgcaagat

SEQ ID NO: 531571 - DNA, 25 bp, Mus musculus
agctgaccttctgtgcccgcaagat

SEQ ID NO: 531572 - DNA, 25 bp, Mus musculus
agctgacgaccccttcttccgagtg

SEQ ID NO: 531573 - DNA, 25 bp, Mus musculus
agctgacgaccccttggtgcacgaa

SEQ ID NO: 531574 - DNA, 25 bp, Mus musculus
agctgacgacccgttcttccgagtg

SEQ ID NO: 531575 - DNA, 25 bp, Mus musculus
agctgacgacccgttggtgcacgaa

SEQ ID NO: 531576 - DNA, 25 bp, Mus musculus
agctgacggagcagatgttcgagca

SEQ ID NO: 531577 - DNA, 25 bp, Mus musculus
agctgacggagctgatgttcgagca

SEQ ID NO: 531578 - DNA, 25 bp, Mus musculus
agctgacggcccaacaggtgcagaa

SEQ ID NO: 531579 - DNA, 25 bp, Mus musculus
agctgacggccctacaggtgcagaa

SEQ ID NO: 531580 - DNA, 25 bp, Mus musculus
agctgacgtgatcagactccacagc

SEQ ID NO: 531581 - DNA, 25 bp, Mus musculus
agctgacgtgatgagactccacagc

SEQ ID NO: 531582 - DNA, 25 bp, Mus musculus
agctgactcaggaaacgaccaagac

SEQ ID NO: 531583 - DNA, 25 bp, Mus musculus
agctgactcaggtaacgaccaagac

SEQ ID NO: 531584 - DNA, 25 bp, Mus musculus
agctgactcatgctgtcctgcacac

SEQ ID NO: 531585 - DNA, 25 bp, Mus musculus
agctgactcatggtgtcctgcacac

SEQ ID NO: 531586 - DNA, 25 bp, Mus musculus
agctgactctctactgcacactggg

SEQ ID NO: 531587 - DNA, 25 bp, Mus musculus
agctgactctcttctgcacactggg

SEQ ID NO: 531588 - DNA, 25 bp, Mus musculus
agctgactctgaaaagccctgccta

SEQ ID NO: 531589 - DNA, 25 bp, Mus musculus
agctgactctgataagccctgccta

SEQ ID NO: 531590 - DNA, 25 bp, Mus musculus
agctgacttgcaaccccgagggatt

SEQ ID NO: 531591 - DNA, 25 bp, Mus musculus
agctgacttgcatccccgagggatt

SEQ ID NO: 531592 - DNA, 25 bp, Mus musculus
agctgagacagtagattcccaagtc

SEQ ID NO: 531593 - DNA, 25 bp, Mus musculus
agctgagacagttgattcccaagtc

SEQ ID NO: 531594 - DNA, 25 bp, Mus musculus
agctgagacccgctcaagcgctgga

SEQ ID NO: 531595 - DNA, 25 bp, Mus musculus
agctgagacccggtcaagcgctgga

SEQ ID NO: 531596 - DNA, 25 bp, Mus musculus
agctgagatttgagccagaattatg

SEQ ID NO: 531597 - DNA, 25 bp, Mus musculus
agctgagatttgtgccagaattatg

SEQ ID NO: 531598 - DNA, 25 bp, Mus musculus
agctgagcagcgacgtggtcaccag

SEQ ID NO: 531599 - DNA, 25 bp, Mus musculus
agctgagcagcgtcgtggtcaccag

SEQ ID NO: 531600 - DNA, 25 bp, Mus musculus
agctgagctgtcctactacagcagc

SEQ ID NO: 531601 - DNA, 25 bp, Mus musculus
agctgagctgtcgtactacagcagc

SEQ ID NO: 531602 - DNA, 25 bp, Mus musculus
agctgagggcttacgggtcacttac

SEQ ID NO: 531603 - DNA, 25 bp, Mus musculus
agctgagggctttcgggtcacttac

SEQ ID NO: 531604 - DNA, 25 bp, Mus musculus
agctgagggtgcaggctcgctcctc

SEQ ID NO: 531605 - DNA, 25 bp, Mus musculus
agctgagggtgctggctcgctcctc

SEQ ID NO: 531606 - DNA, 25 bp, Mus musculus
agctgaggtgacagaaaccttaccc

SEQ ID NO: 531607 - DNA, 25 bp, Mus musculus
agctgaggtgactgaaaccttaccc

SEQ ID NO: 531608 - DNA, 25 bp, Mus musculus
agctgagtgagcaccgctgtgagat

SEQ ID NO: 531609 - DNA, 25 bp, Mus musculus
agctgagtgagctccgctgtgagat

SEQ ID NO: 531610 - DNA, 25 bp, Mus musculus
agctgagtgatactcacgggatcgc

SEQ ID NO: 531611 - DNA, 25 bp, Mus musculus
agctgagtgatagtcacgggatcgc

SEQ ID NO: 531612 - DNA, 25 bp, Mus musculus
agctgagtgtacagagccctgcccc

SEQ ID NO: 531613 - DNA, 25 bp, Mus musculus
agctgagtgtactgagccctgcccc

SEQ ID NO: 531614 - DNA, 25 bp, Mus musculus
agctgagtgtctcccagggccctgt

SEQ ID NO: 531615 - DNA, 25 bp, Mus musculus
agctgagtgtctgccagggccctgt

SEQ ID NO: 531616 - DNA, 25 bp, Mus musculus
agctgagtgtgcatggtgtcaccta

SEQ ID NO: 531617 - DNA, 25 bp, Mus musculus
agctgagtgtgcttggtgtcaccta

SEQ ID NO: 531618 - DNA, 25 bp, Mus musculus
agctgatcatgcaggcagaagccga

SEQ ID NO: 531619 - DNA, 25 bp, Mus musculus
agctgatcatgctggcagaagccga

SEQ ID NO: 531620 - DNA, 25 bp, Mus musculus
agctgatctggtacccacttattcc

SEQ ID NO: 531621 - DNA, 25 bp, Mus musculus
agctgatctggttcccacttattcc

SEQ ID NO: 531622 - DNA, 25 bp, Mus musculus
agctgatgtccgaagccaagtgacc

SEQ ID NO: 531623 - DNA, 25 bp, Mus musculus
agctgatgtccgtagccaagtgacc

SEQ ID NO: 531624 - DNA, 25 bp, Mus musculus
agctgattctgcagcccttctgtcc

SEQ ID NO: 531625 - DNA, 25 bp, Mus musculus
agctgattctgctgcccttctgtcc

SEQ ID NO: 531626 - DNA, 25 bp, Mus musculus
agctgattgagcacaccgaggccag

SEQ ID NO: 531627 - DNA, 25 bp, Mus musculus
agctgattgagctcaccgaggccag

SEQ ID NO: 531628 - DNA, 25 bp, Mus musculus
agctgattggcgaccgatccaccat

SEQ ID NO: 531629 - DNA, 25 bp, Mus musculus
agctgattggcgtccgatccaccat

SEQ ID NO: 531630 - DNA, 25 bp, Mus musculus
agctgatttggccaatgaagacacc

SEQ ID NO: 531631 - DNA, 25 bp, Mus musculus
agctgatttggcgaatgaagacacc

SEQ ID NO: 531632 - DNA, 25 bp, Mus musculus
agctgcaaaagcaggcggagatgat

SEQ ID NO: 531633 - DNA, 25 bp, Mus musculus
agctgcaaaagctggcggagatgat

SEQ ID NO: 531634 - DNA, 25 bp, Mus musculus
agctgcaacacactgagcaccaggc

SEQ ID NO: 531635 - DNA, 25 bp, Mus musculus
agctgcaacacagtgagcaccaggc

SEQ ID NO: 531636 - DNA, 25 bp, Mus musculus
agctgcaagctcacgaggccacttg

SEQ ID NO: 531637 - DNA, 25 bp, Mus musculus
agctgcaagctctcgaggccacttg

SEQ ID NO: 531638 - DNA, 25 bp, Mus musculus
agctgcacaacaaggccccggtgtg

SEQ ID NO: 531639 - DNA, 25 bp, Mus musculus
agctgcacaacatggccccggtgtg

SEQ ID NO: 531640 - DNA, 25 bp, Mus musculus
agctgcacagtgcacccacactagg

SEQ ID NO: 531641 - DNA, 25 bp, Mus musculus
agctgcacagtggacccacactagg

SEQ ID NO: 531642 - DNA, 25 bp, Mus musculus
agctgcacatggagtgcaaagcaga

SEQ ID NO: 531643 - DNA, 25 bp, Mus musculus
agctgcacatggtgtgcaaagcaga

SEQ ID NO: 531644 - DNA, 25 bp, Mus musculus
agctgcaccgcgcagtccgtgaagt

SEQ ID NO: 531645 - DNA, 25 bp, Mus musculus
agctgcaccgcggagtccgtgaagt

SEQ ID NO: 531646 - DNA, 25 bp, Mus musculus
agctgcaccttgaggcccgatcact

SEQ ID NO: 531647 - DNA, 25 bp, Mus musculus
agctgcaccttgtggcccgatcact

SEQ ID NO: 531648 - DNA, 25 bp, Mus musculus
agctgcacggacagacatggagagc

SEQ ID NO: 531649 - DNA, 25 bp, Mus musculus
agctgcacggactgacatggagagc

SEQ ID NO: 531650 - DNA, 25 bp, Mus musculus
agctgcactccaagtccacctggat

SEQ ID NO: 531651 - DNA, 25 bp, Mus musculus
agctgcactccatgtccacctggat

SEQ ID NO: 531652 - DNA, 25 bp, Mus musculus
agctgcagaaatcctgaggctcaga

SEQ ID NO: 531653 - DNA, 25 bp, Mus musculus
agctgcagaaatgctgaggctcaga

SEQ ID NO: 531654 - DNA, 25 bp, Mus musculus
agctgcagaacgacaggaagcacat

SEQ ID NO: 531655 - DNA, 25 bp, Mus musculus
agctgcagaacgtcaggaagcacat

SEQ ID NO: 531656 - DNA, 25 bp, Mus musculus
agctgcagagggaactgaaagtgct

SEQ ID NO: 531657 - DNA, 25 bp, Mus musculus
agctgcagagggtactgaaagtgct

SEQ ID NO: 531658 - DNA, 25 bp, Mus musculus
agctgcagcagacccaagagtactt

SEQ ID NO: 531659 - DNA, 25 bp, Mus musculus
agctgcagcagagccaagagtactt

SEQ ID NO: 531660 - DNA, 25 bp, Mus musculus
agctgcagcagcaggttcgggccct

SEQ ID NO: 531661 - DNA, 25 bp, Mus musculus
agctgcagcagctggttcgggccct

SEQ ID NO: 531662 - DNA, 25 bp, Mus musculus
agctgcagctcactgcggaaagtgc

SEQ ID NO: 531663 - DNA, 25 bp, Mus musculus
agctgcagctcagtgcggaaagtgc

SEQ ID NO: 531664 - DNA, 25 bp, Mus musculus
agctgcaggagaaaggcgtgaacaa

SEQ ID NO: 531665 - DNA, 25 bp, Mus musculus
agctgcaggagataggcgtgaacaa

SEQ ID NO: 531666 - DNA, 25 bp, Mus musculus
agctgcaggcagatgtcaggcccac

SEQ ID NO: 531667 - DNA, 25 bp, Mus musculus
agctgcaggcagttgtcaggcccac

SEQ ID NO: 531668 - DNA, 25 bp, Mus musculus
agctgcaggccgagatcaccaagct

SEQ ID NO: 531669 - DNA, 25 bp, Mus musculus
agctgcaggccgtgatcaccaagct

SEQ ID NO: 531670 - DNA, 25 bp, Mus musculus
agctgcaggcctcggtcctagaaga

SEQ ID NO: 531671 - DNA, 25 bp, Mus musculus
agctgcaggcctgggtcctagaaga

SEQ ID NO: 531672 - DNA, 25 bp, Mus musculus
agctgcaggtcaactcagtactaca

SEQ ID NO: 531673 - DNA, 25 bp, Mus musculus
agctgcaggtcatctcagtactaca

SEQ ID NO: 531674 - DNA, 25 bp, Mus musculus
agctgcagtcctcgacccctgagga

SEQ ID NO: 531675 - DNA, 25 bp, Mus musculus
agctgcagtcctggacccctgagga

SEQ ID NO: 531676 - DNA, 25 bp, Mus musculus
agctgcagtggtcctctccctacag

SEQ ID NO: 531677 - DNA, 25 bp, Mus musculus
agctgcagtggtgctctccctacag

SEQ ID NO: 531678 - DNA, 25 bp, Mus musculus
agctgcagttccagggaacgtgcga

SEQ ID NO: 531679 - DNA, 25 bp, Mus musculus
agctgcagttcctgggaacgtgcga

SEQ ID NO: 531680 - DNA, 25 bp, Mus musculus
agctgcagttctacctgtaccactg

SEQ ID NO: 531681 - DNA, 25 bp, Mus musculus
agctgcagttcttcctgtaccactg

SEQ ID NO: 531682 - DNA, 25 bp, Mus musculus
agctgcatgagtcgatgtgcaccca

SEQ ID NO: 531683 - DNA, 25 bp, Mus musculus
agctgcatgagtggatgtgcaccca

SEQ ID NO: 531684 - DNA, 25 bp, Mus musculus
agctgcatgcctccacatcgaagcg

SEQ ID NO: 531685 - DNA, 25 bp, Mus musculus
agctgcatgcctgcacatcgaagcg

SEQ ID NO: 531686 - DNA, 25 bp, Mus musculus
agctgcatttccaggcgcctcattg

SEQ ID NO: 531687 - DNA, 25 bp, Mus musculus
agctgcatttcccagtctgggccaa

SEQ ID NO: 531688 - DNA, 25 bp, Mus musculus
agctgcatttccgagtctgggccaa

SEQ ID NO: 531689 - DNA, 25 bp, Mus musculus
agctgcatttcctggcgcctcattg

SEQ ID NO: 531690 - DNA, 25 bp, Mus musculus
agctgcatttgtcccaaatccatat

SEQ ID NO: 531691 - DNA, 25 bp, Mus musculus
agctgcatttgtgccaaatccatat

SEQ ID NO: 531692 - DNA, 25 bp, Mus musculus
agctgccaaacgcagacccaaggaa

SEQ ID NO: 531693 - DNA, 25 bp, Mus musculus
agctgccaaacggagacccaaggaa

SEQ ID NO: 531694 - DNA, 25 bp, Mus musculus
agctgccaaccgcacacgggaatta

SEQ ID NO: 531695 - DNA, 25 bp, Mus musculus
agctgccaaccggacacgggaatta

SEQ ID NO: 531696 - DNA, 25 bp, Mus musculus
agctgccactgactgtactgcaaaa

SEQ ID NO: 531697 - DNA, 25 bp, Mus musculus
agctgccactgagtgtactgcaaaa

SEQ ID NO: 531698 - DNA, 25 bp, Mus musculus
agctgccactttagctagagagcaa

SEQ ID NO: 531699 - DNA, 25 bp, Mus musculus
agctgccactttcgcgtctggcaaa

SEQ ID NO: 531700 - DNA, 25 bp, Mus musculus
agctgccactttggcgtctggcaaa

SEQ ID NO: 531701 - DNA, 25 bp, Mus musculus
agctgccacttttgctagagagcaa

SEQ ID NO: 531702 - DNA, 25 bp, Mus musculus
agctgccagaataccagcttaaccc

SEQ ID NO: 531703 - DNA, 25 bp, Mus musculus
agctgccagaattccagcttaaccc

SEQ ID NO: 531704 - DNA, 25 bp, Mus musculus
agctgccagctgatacaaaagatgc

SEQ ID NO: 531705 - DNA, 25 bp, Mus musculus
agctgccagctgttacaaaagatgc

SEQ ID NO: 531706 - DNA, 25 bp, Mus musculus
agctgcccaaccatgatctgctcaa

SEQ ID NO: 531707 - DNA, 25 bp, Mus musculus
agctgcccaaccttgatctgctcaa

SEQ ID NO: 531708 - DNA, 25 bp, Mus musculus
agctgcccctagacgaccaggtcat

SEQ ID NO: 531709 - DNA, 25 bp, Mus musculus
agctgcccctagtcgaccaggtcat

SEQ ID NO: 531710 - DNA, 25 bp, Mus musculus
agctgcccgatgagattgacatttc

SEQ ID NO: 531711 - DNA, 25 bp, Mus musculus
agctgcccgatgtgattgacatttc

SEQ ID NO: 531712 - DNA, 25 bp, Mus musculus
agctgccgcctgaacatggactctg

SEQ ID NO: 531713 - DNA, 25 bp, Mus musculus
agctgccgcctgtacatggactctg

SEQ ID NO: 531714 - DNA, 25 bp, Mus musculus
agctgccggagtatagaccagagga

SEQ ID NO: 531715 - DNA, 25 bp, Mus musculus
agctgccggagtttagaccagagga

SEQ ID NO: 531716 - DNA, 25 bp, Mus musculus
agctgcctcaacaccagcctggtaa

SEQ ID NO: 531717 - DNA, 25 bp, Mus musculus
agctgcctcaactccagcctggtaa

SEQ ID NO: 531718 - DNA, 25 bp, Mus musculus
agctgcctccataggccagcatgag

SEQ ID NO: 531719 - DNA, 25 bp, Mus musculus
agctgcctccattggccagcatgag

SEQ ID NO: 531720 - DNA, 25 bp, Mus musculus
agctgcctcgctcgatccaggagca

SEQ ID NO: 531721 - DNA, 25 bp, Mus musculus
agctgcctcgctggatccaggagca

SEQ ID NO: 531722 - DNA, 25 bp, Mus musculus
agctgcctgcctcataccgacaaaa

SEQ ID NO: 531723 - DNA, 25 bp, Mus musculus
agctgcctgcctgataccgacaaaa

SEQ ID NO: 531724 - DNA, 25 bp, Mus musculus
agctgcctgcttctttgtagagttc

SEQ ID NO: 531725 - DNA, 25 bp, Mus musculus
agctgcctgcttgtttgtagagttc

SEQ ID NO: 531726 - DNA, 25 bp, Mus musculus
agctgcctgtttccctagccagggc

SEQ ID NO: 531727 - DNA, 25 bp, Mus musculus
agctgcctgtttgcctagccagggc

SEQ ID NO: 531728 - DNA, 25 bp, Mus musculus
agctgccttgatctttactttgaca

SEQ ID NO: 531729 - DNA, 25 bp, Mus musculus
agctgccttgatgtttactttgaca

SEQ ID NO: 531730 - DNA, 25 bp, Mus musculus
agctgcctttcgaagcatgctgagg

SEQ ID NO: 531731 - DNA, 25 bp, Mus musculus
agctgcctttcgtagcatgctgagg

SEQ ID NO: 531732 - DNA, 25 bp, Mus musculus
agctgcgaaggcagtcaagtacgtg

SEQ ID NO: 531733 - DNA, 25 bp, Mus musculus
agctgcgaaggctgtcaagtacgtg

SEQ ID NO: 531734 - DNA, 25 bp, Mus musculus
agctgcgagtccaggaagacaattc

SEQ ID NO: 531735 - DNA, 25 bp, Mus musculus
agctgcgagtcctggaagacaattc

SEQ ID NO: 531736 - DNA, 25 bp, Mus musculus
agctgcgcagacagtatgaaacctg

SEQ ID NO: 531737 - DNA, 25 bp, Mus musculus
agctgcgcagactgtatgaaacctg

SEQ ID NO: 531738 - DNA, 25 bp, Mus musculus
agctgcgccaacatgccctggctga

SEQ ID NO: 531739 - DNA, 25 bp, Mus musculus
agctgcgccaacttgccctggctga

SEQ ID NO: 531740 - DNA, 25 bp, Mus musculus
agctgcggcagtagttggcaccccg

SEQ ID NO: 531741 - DNA, 25 bp, Mus musculus
agctgcggcagttgttggcaccccg

SEQ ID NO: 531742 - DNA, 25 bp, Mus musculus
agctgcgggaacagttcagcggcat

SEQ ID NO: 531743 - DNA, 25 bp, Mus musculus
agctgcgggaactgttcagcggcat

SEQ ID NO: 531744 - DNA, 25 bp, Mus musculus
agctgcgggatcaccacgagagcac

SEQ ID NO: 531745 - DNA, 25 bp, Mus musculus
agctgcgggatctccacgagagcac

SEQ ID NO: 531746 - DNA, 25 bp, Mus musculus
agctgcgggcacacttggtcctggc

SEQ ID NO: 531747 - DNA, 25 bp, Mus musculus
agctgcgggcactcttggtcctggc

SEQ ID NO: 531748 - DNA, 25 bp, Mus musculus
agctgcgggcccatgcttgtacagg

SEQ ID NO: 531749 - DNA, 25 bp, Mus musculus
agctgcgggcccttgcttgtacagg

SEQ ID NO: 531750 - DNA, 25 bp, Mus musculus
agctgcggtcacctcggcgtacaca

SEQ ID NO: 531751 - DNA, 25 bp, Mus musculus
agctgcggtcacgtcggcgtacaca

SEQ ID NO: 531752 - DNA, 25 bp, Mus musculus
agctgcggtgccactgtcggcctga

SEQ ID NO: 531753 - DNA, 25 bp, Mus musculus
agctgcggtgcctctgtcggcctga

SEQ ID NO: 531754 - DNA, 25 bp, Mus musculus
agctgcgtccccagtggtggtcaga

SEQ ID NO: 531755 - DNA, 25 bp, Mus musculus
agctgcgtcccctgtggtggtcaga

SEQ ID NO: 531756 - DNA, 25 bp, Mus musculus
agctgcgttgttacctggtgctatt

SEQ ID NO: 531757 - DNA, 25 bp, Mus musculus
agctgcgttgtttcctggtgctatt

SEQ ID NO: 531758 - DNA, 25 bp, Mus musculus
agctgctaaggaactactccaagca

SEQ ID NO: 531759 - DNA, 25 bp, Mus musculus
agctgctaaggatctactccaagca

SEQ ID NO: 531760 - DNA, 25 bp, Mus musculus
agctgctacacccaggccaacgtgt

SEQ ID NO: 531761 - DNA, 25 bp, Mus musculus
agctgctacaccgaggccaacgtgt

SEQ ID NO: 531762 - DNA, 25 bp, Mus musculus
agctgctagcctcacctgccgaggt

SEQ ID NO: 531763 - DNA, 25 bp, Mus musculus
agctgctagcctgacctgccgaggt

SEQ ID NO: 531764 - DNA, 25 bp, Mus musculus
agctgctcaatgcagaccctaagga

SEQ ID NO: 531765 - DNA, 25 bp, Mus musculus
agctgctcaatggagaccctaagga

SEQ ID NO: 531766 - DNA, 25 bp, Mus musculus
agctgctcagagagggtagctagcc

SEQ ID NO: 531767 - DNA, 25 bp, Mus musculus
agctgctcagagtgggtagctagcc

SEQ ID NO: 531768 - DNA, 25 bp, Mus musculus
agctgctcatgacccacggtgtgct

SEQ ID NO: 531769 - DNA, 25 bp, Mus musculus
agctgctcatgagccacggtgtgct

SEQ ID NO: 531770 - DNA, 25 bp, Mus musculus
agctgctccagtctcagggctctca

SEQ ID NO: 531771 - DNA, 25 bp, Mus musculus
agctgctccagtgtcagggctctca

SEQ ID NO: 531772 - DNA, 25 bp, Mus musculus
agctgctcctacagtacggtgttca

SEQ ID NO: 531773 - DNA, 25 bp, Mus musculus
agctgctcctactgtacggtgttca

SEQ ID NO: 531774 - DNA, 25 bp, Mus musculus
agctgctctcccattatgactctta

SEQ ID NO: 531775 - DNA, 25 bp, Mus musculus
agctgctctccctttatgactctta

SEQ ID NO: 531776 - DNA, 25 bp, Mus musculus
agctgctctcttcgaaggttctgag

SEQ ID NO: 531777 - DNA, 25 bp, Mus musculus
agctgctctcttggaaggttctgag

SEQ ID NO: 531778 - DNA, 25 bp, Mus musculus
agctgctcttgaactagctctgagc

SEQ ID NO: 531779 - DNA, 25 bp, Mus musculus
agctgctcttgatctagctctgagc

SEQ ID NO: 531780 - DNA, 25 bp, Mus musculus
agctgctgaaaaaggcgtggcaaaa

SEQ ID NO: 531781 - DNA, 25 bp, Mus musculus
agctgctgaaaatggcgtggcaaaa

SEQ ID NO: 531782 - DNA, 25 bp, Mus musculus
agctgctgaagaaaccacctaccct

SEQ ID NO: 531783 - DNA, 25 bp, Mus musculus
agctgctgaagataccacctaccct

SEQ ID NO: 531784 - DNA, 25 bp, Mus musculus
agctgctgactgacgccaactcctg

SEQ ID NO: 531785 - DNA, 25 bp, Mus musculus
agctgctgactgtcgccaactcctg

SEQ ID NO: 531786 - DNA, 25 bp, Mus musculus
agctgctgagcgcacaggctgccct

SEQ ID NO: 531787 - DNA, 25 bp, Mus musculus
agctgctgagcggacaggctgccct

SEQ ID NO: 531788 - DNA, 25 bp, Mus musculus
agctgctgctagagtccctcggagc

SEQ ID NO: 531789 - DNA, 25 bp, Mus musculus
agctgctgctagtgtccctcggagc

SEQ ID NO: 531790 - DNA, 25 bp, Mus musculus
agctgctgctcacctctgtgcacga

SEQ ID NO: 531791 - DNA, 25 bp, Mus musculus
agctgctgctcagctctgtgcacga

SEQ ID NO: 531792 - DNA, 25 bp, Mus musculus
agctgctgctgaccgagctgttaga

SEQ ID NO: 531793 - DNA, 25 bp, Mus musculus
agctgctgctgagcgagctgttaga

SEQ ID NO: 531794 - DNA, 25 bp, Mus musculus
agctgctgctgtctgcacatttggg

SEQ ID NO: 531795 - DNA, 25 bp, Mus musculus
agctgctgctgtgtgcacatttggg

SEQ ID NO: 531796 - DNA, 25 bp, Mus musculus
agctgctgctttagggcaccgccat

SEQ ID NO: 531797 - DNA, 25 bp, Mus musculus
agctgctgcttttgggcaccgccat

SEQ ID NO: 531798 - DNA, 25 bp, Mus musculus
agctgctggaagacggatggaacaa

SEQ ID NO: 531799 - DNA, 25 bp, Mus musculus
agctgctggaagtcggatggaacaa

SEQ ID NO: 531800 - DNA, 25 bp, Mus musculus
agctgctggaccctaggacagagca

SEQ ID NO: 531801 - DNA, 25 bp, Mus musculus
agctgctggaccgtaggacagagca

SEQ ID NO: 531802 - DNA, 25 bp, Mus musculus
agctgctggcagacctgtgcgagaa

SEQ ID NO: 531803 - DNA, 25 bp, Mus musculus
agctgctggcagtcctgtgcgagaa

SEQ ID NO: 531804 - DNA, 25 bp, Mus musculus
agctgctggcgcagaagggcatcta

SEQ ID NO: 531805 - DNA, 25 bp, Mus musculus
agctgctggcgctgaagggcatcta

SEQ ID NO: 531806 - DNA, 25 bp, Mus musculus
agctgctgggccacactgtagtggc

SEQ ID NO: 531807 - DNA, 25 bp, Mus musculus
agctgctgggcctcactgtagtggc

SEQ ID NO: 531808 - DNA, 25 bp, Mus musculus
agctgctggtagaccagtacttccc

SEQ ID NO: 531809 - DNA, 25 bp, Mus musculus
agctgctggtagtccagtacttccc

SEQ ID NO: 531810 - DNA, 25 bp, Mus musculus
agctgctggtgtcctacgaagacga

SEQ ID NO: 531811 - DNA, 25 bp, Mus musculus
agctgctggtgtgctacgaagacga

SEQ ID NO: 531812 - DNA, 25 bp, Mus musculus
agctgctgtcaaagttggacatggg

SEQ ID NO: 531813 - DNA, 25 bp, Mus musculus
agctgctgtcaatgttggacatggg

SEQ ID NO: 531814 - DNA, 25 bp, Mus musculus
agctgctgtcatcgcgggtgctctg

SEQ ID NO: 531815 - DNA, 25 bp, Mus musculus
agctgctgtcatggcgggtgctctg

SEQ ID NO: 531816 - DNA, 25 bp, Mus musculus
agctgctgtcctagctgcaccaggg

SEQ ID NO: 531817 - DNA, 25 bp, Mus musculus
agctgctgtccttgctgcaccaggg

SEQ ID NO: 531818 - DNA, 25 bp, Mus musculus
agctgctgtgacaccgctgcgtgga

SEQ ID NO: 531819 - DNA, 25 bp, Mus musculus
agctgctgtgactccgctgcgtgga

SEQ ID NO: 531820 - DNA, 25 bp, Mus musculus
agctgcttcccacgcaactggtaac

SEQ ID NO: 531821 - DNA, 25 bp, Mus musculus
agctgcttcccaggcaactggtaac

SEQ ID NO: 531822 - DNA, 25 bp, Mus musculus
agctgcttgcggcatggcatacaca

SEQ ID NO: 531823 - DNA, 25 bp, Mus musculus
agctgcttgcgggatggcatacaca

SEQ ID NO: 531824 - DNA, 25 bp, Mus musculus
agctgcttgcgtagcctgatgccca

SEQ ID NO: 531825 - DNA, 25 bp, Mus musculus
agctgcttgcgttgcctgatgccca

SEQ ID NO: 531826 - DNA, 25 bp, Mus musculus
agctgctttttgatcccttcctggc

SEQ ID NO: 531827 - DNA, 25 bp, Mus musculus
agctgctttttgttcccttcctggc

SEQ ID NO: 531828 - DNA, 25 bp, Mus musculus
agctggaaatatcggaggacctaaa

SEQ ID NO: 531829 - DNA, 25 bp, Mus musculus
agctggaaatatgggaggacctaaa

SEQ ID NO: 531830 - DNA, 25 bp, Mus musculus
agctggaaatggcagatgattacat

SEQ ID NO: 531831 - DNA, 25 bp, Mus musculus
agctggaaatgggagatgattacat

SEQ ID NO: 531832 - DNA, 25 bp, Mus musculus
agctggaacctcaaggccctcagga

SEQ ID NO: 531833 - DNA, 25 bp, Mus musculus
agctggaacctctaggccctcagga

SEQ ID NO: 531834 - DNA, 25 bp, Mus musculus
agctggaagagacgaccagcccctc

SEQ ID NO: 531835 - DNA, 25 bp, Mus musculus
agctggaagagaggaccagcccctc

SEQ ID NO: 531836 - DNA, 25 bp, Mus musculus
agctggaagagcagcggtccatgtt

SEQ ID NO: 531837 - DNA, 25 bp, Mus musculus
agctggaagagctgcggtccatgtt

SEQ ID NO: 531838 - DNA, 25 bp, Mus musculus
agctggaagcccattttcatggctg

SEQ ID NO: 531839 - DNA, 25 bp, Mus musculus
agctggaagccctttttcatggctg

SEQ ID NO: 531840 - DNA, 25 bp, Mus musculus
agctggaatatcaagtttttacaca

SEQ ID NO: 531841 - DNA, 25 bp, Mus musculus
agctggaatatctagtttttacaca

SEQ ID NO: 531842 - DNA, 25 bp, Mus musculus
agctggacacaacagagtctgtcgg

SEQ ID NO: 531843 - DNA, 25 bp, Mus musculus
agctggacacaagagagtctgtcgg

SEQ ID NO: 531844 - DNA, 25 bp, Mus musculus
agctggacagtgaatgctacagtaa

SEQ ID NO: 531845 - DNA, 25 bp, Mus musculus
agctggacagtgtatgctacagtaa

SEQ ID NO: 531846 - DNA, 25 bp, Mus musculus
agctggaccctgacttgactgaggt

SEQ ID NO: 531847 - DNA, 25 bp, Mus musculus
agctggaccctgtcttgactgaggt

SEQ ID NO: 531848 - DNA, 25 bp, Mus musculus
agctggacgagtaccaggagctgct

SEQ ID NO: 531849 - DNA, 25 bp, Mus musculus
agctggacgagttccaggagctgct

SEQ ID NO: 531850 - DNA, 25 bp, Mus musculus
agctggacgccacggtcgcctcgat

SEQ ID NO: 531851 - DNA, 25 bp, Mus musculus
agctggacgccagggtcgcctcgat

SEQ ID NO: 531852 - DNA, 25 bp, Mus musculus
agctggacgggaagacagcaaagat

SEQ ID NO: 531853 - DNA, 25 bp, Mus musculus
agctggacgggatgacagcaaagat

SEQ ID NO: 531854 - DNA, 25 bp, Mus musculus
agctggacgggcactggacgaccat

SEQ ID NO: 531855 - DNA, 25 bp, Mus musculus
agctggacgggcagtctgtgaaggc

SEQ ID NO: 531856 - DNA, 25 bp, Mus musculus
agctggacgggctctggacgaccat

SEQ ID NO: 531857 - DNA, 25 bp, Mus musculus
agctggacgggctgtctgtgaaggc

SEQ ID NO: 531858 - DNA, 25 bp, Mus musculus
agctggactgccagcaaatgcctcc

SEQ ID NO: 531859 - DNA, 25 bp, Mus musculus
agctggactgcctgcaaatgcctcc

SEQ ID NO: 531860 - DNA, 25 bp, Mus musculus
agctggactggaaggatgcccagac

SEQ ID NO: 531861 - DNA, 25 bp, Mus musculus
agctggactggatggatgcccagac

SEQ ID NO: 531862 - DNA, 25 bp, Mus musculus
agctggagagtcacatgaaggcccc

SEQ ID NO: 531863 - DNA, 25 bp, Mus musculus
agctggagagtctcatgaaggcccc

SEQ ID NO: 531864 - DNA, 25 bp, Mus musculus
agctggagcctgcaccttgagtctg

SEQ ID NO: 531865 - DNA, 25 bp, Mus musculus
agctggagcctggaccttgagtctg

SEQ ID NO: 531866 - DNA, 25 bp, Mus musculus
agctggagcgcaaaggccctcagca

SEQ ID NO: 531867 - DNA, 25 bp, Mus musculus
agctggagcgcataggccctcagca

SEQ ID NO: 531868 - DNA, 25 bp, Mus musculus
agctggagcggacagaagccaccct

SEQ ID NO: 531869 - DNA, 25 bp, Mus musculus
agctggagcggagagaagccaccct

SEQ ID NO: 531870 - DNA, 25 bp, Mus musculus
agctggagtcctagcccaatgagat

SEQ ID NO: 531871 - DNA, 25 bp, Mus musculus
agctggagtccttgcccaatgagat

SEQ ID NO: 531872 - DNA, 25 bp, Mus musculus
agctggagttacagcggctctttga

SEQ ID NO: 531873 - DNA, 25 bp, Mus musculus
agctggagttactgcggctctttga

SEQ ID NO: 531874 - DNA, 25 bp, Mus musculus
agctggagttcaacaaggcggagaa

SEQ ID NO: 531875 - DNA, 25 bp, Mus musculus
agctggagttcatcaaggcggagaa

SEQ ID NO: 531876 - DNA, 25 bp, Mus musculus
agctggatcagcaccctattgatgg

SEQ ID NO: 531877 - DNA, 25 bp, Mus musculus
agctggatcagctccctattgatgg

SEQ ID NO: 531878 - DNA, 25 bp, Mus musculus
agctggatcaggcaagctccagcac

SEQ ID NO: 531879 - DNA, 25 bp, Mus musculus
agctggatcagggaagctccagcac

SEQ ID NO: 531880 - DNA, 25 bp, Mus musculus
agctggatgtggaacacaacctgtt

SEQ ID NO: 531881 - DNA, 25 bp, Mus musculus
agctggatgtggtacacaacctgtt

SEQ ID NO: 531882 - DNA, 25 bp, Mus musculus
agctggcaaacgcactgttgcttcc

SEQ ID NO: 531883 - DNA, 25 bp, Mus musculus
agctggcaaacggactgttgcttcc

SEQ ID NO: 531884 - DNA, 25 bp, Mus musculus
agctggcaaaggactcatcgtgatt

SEQ ID NO: 531885 - DNA, 25 bp, Mus musculus
agctggcaaaggtctcatcgtgatt

SEQ ID NO: 531886 - DNA, 25 bp, Mus musculus
agctggcaggacctgaaagatcaca

SEQ ID NO: 531887 - DNA, 25 bp, Mus musculus
agctggcaggacgtgaaagatcaca

SEQ ID NO: 531888 - DNA, 25 bp, Mus musculus
agctggcaggcgaaggcatctccat

SEQ ID NO: 531889 - DNA, 25 bp, Mus musculus
agctggcaggcgtaggcatctccat

SEQ ID NO: 531890 - DNA, 25 bp, Mus musculus
agctggcattgtcggccttccggaa

SEQ ID NO: 531891 - DNA, 25 bp, Mus musculus
agctggcattgtgggccttccggaa

SEQ ID NO: 531892 - DNA, 25 bp, Mus musculus
agctggccaagactctgaaggtcga

SEQ ID NO: 531893 - DNA, 25 bp, Mus musculus
agctggccaagagtctgaaggtcga

SEQ ID NO: 531894 - DNA, 25 bp, Mus musculus
agctggccagagcatccaattggca

SEQ ID NO: 531895 - DNA, 25 bp, Mus musculus
agctggccagaggatccaattggca

SEQ ID NO: 531896 - DNA, 25 bp, Mus musculus
agctggccatagaagcgagcggcta

SEQ ID NO: 531897 - DNA, 25 bp, Mus musculus
agctggccatagtagcgagcggcta

SEQ ID NO: 531898 - DNA, 25 bp, Mus musculus
agctggcccagaattggatcaaaac

SEQ ID NO: 531899 - DNA, 25 bp, Mus musculus
agctggcccagatttggatcaaaac

SEQ ID NO: 531900 - DNA, 25 bp, Mus musculus
agctggcccagtccctgttcatggt

SEQ ID NO: 531901 - DNA, 25 bp, Mus musculus
agctggcccagtgcctgttcatggt

SEQ ID NO: 531902 - DNA, 25 bp, Mus musculus
agctggcccgccaacagcaggagaa

SEQ ID NO: 531903 - DNA, 25 bp, Mus musculus
agctggcccgcctacagcaggagaa

SEQ ID NO: 531904 - DNA, 25 bp, Mus musculus
agctggccgagcagatcttcgcaaa

SEQ ID NO: 531905 - DNA, 25 bp, Mus musculus
agctggccgagctgatcttcgcaaa

SEQ ID NO: 531906 - DNA, 25 bp, Mus musculus
agctggccgccaacaaggttatgga

SEQ ID NO: 531907 - DNA, 25 bp, Mus musculus
agctggccgccatcaaggttatgga

SEQ ID NO: 531908 - DNA, 25 bp, Mus musculus
agctggccgcctcggtggagacagc

SEQ ID NO: 531909 - DNA, 25 bp, Mus musculus
agctggccgcctgggtggagacagc

SEQ ID NO: 531910 - DNA, 25 bp, Mus musculus
agctggcgactacgagcctgtgacc

SEQ ID NO: 531911 - DNA, 25 bp, Mus musculus
agctggcgactaggagcctgtgacc

SEQ ID NO: 531912 - DNA, 25 bp, Mus musculus
agctggcgcctgagagtgaccacac

SEQ ID NO: 531913 - DNA, 25 bp, Mus musculus
agctggcgcctgtgagtgaccacac

SEQ ID NO: 531914 - DNA, 25 bp, Mus musculus
agctggcggaaccaagcctccagac

SEQ ID NO: 531915 - DNA, 25 bp, Mus musculus
agctggcggaacgaagcctccagac

SEQ ID NO: 531916 - DNA, 25 bp, Mus musculus
agctggcgtaagaacttcaaaacca

SEQ ID NO: 531917 - DNA, 25 bp, Mus musculus
agctggcgtaagtacttcaaaacca

SEQ ID NO: 531918 - DNA, 25 bp, Mus musculus
agctggctacgtccatgtgaacagg

SEQ ID NO: 531919 - DNA, 25 bp, Mus musculus
agctggctacgtgcatgtgaacagg

SEQ ID NO: 531920 - DNA, 25 bp, Mus musculus
agctggctataaccatccccaacga

SEQ ID NO: 531921 - DNA, 25 bp, Mus musculus
agctggctataagcatccccaacga

SEQ ID NO: 531922 - DNA, 25 bp, Mus musculus
agctggctatccacatctacttgag

SEQ ID NO: 531923 - DNA, 25 bp, Mus musculus
agctggctatcctcatctacttgag

SEQ ID NO: 531924 - DNA, 25 bp, Mus musculus
agctggctcagcaggccaaccctga

SEQ ID NO: 531925 - DNA, 25 bp, Mus musculus
agctggctcagctggccaaccctga

SEQ ID NO: 531926 - DNA, 25 bp, Mus musculus
agctggctccccacgagtctcttca

SEQ ID NO: 531927 - DNA, 25 bp, Mus musculus
agctggctcccctcgagtctcttca

SEQ ID NO: 531928 - DNA, 25 bp, Mus musculus
agctggctcgcacggaccgaattgt

SEQ ID NO: 531929 - DNA, 25 bp, Mus musculus
agctggctcgcagggaccgaattgt

SEQ ID NO: 531930 - DNA, 25 bp, Mus musculus
agctggctcgccagagtggcatcga

SEQ ID NO: 531931 - DNA, 25 bp, Mus musculus
agctggctcgcctgagtggcatcga

SEQ ID NO: 531932 - DNA, 25 bp, Mus musculus
agctggctgggactaagaaggtgca

SEQ ID NO: 531933 - DNA, 25 bp, Mus musculus
agctggctgggagtaagaaggtgca

SEQ ID NO: 531934 - DNA, 25 bp, Mus musculus
agctggcttcctacccgaggccgag

SEQ ID NO: 531935 - DNA, 25 bp, Mus musculus
agctggcttccttcccgaggccgag

SEQ ID NO: 531936 - DNA, 25 bp, Mus musculus
agctggctttacctattcagcccat

SEQ ID NO: 531937 - DNA, 25 bp, Mus musculus
agctggctttacgtattcagcccat

SEQ ID NO: 531938 - DNA, 25 bp, Mus musculus
agctggctttgaagctgcacaaggg

SEQ ID NO: 531939 - DNA, 25 bp, Mus musculus
agctggctttgatgctgcacaaggg

SEQ ID NO: 531940 - DNA, 25 bp, Mus musculus
agctgggaagtcaagctttgtgaac

SEQ ID NO: 531941 - DNA, 25 bp, Mus musculus
agctgggaagtctagctttgtgaac

SEQ ID NO: 531942 - DNA, 25 bp, Mus musculus
agctgggacttacgccgtttcctgt

SEQ ID NO: 531943 - DNA, 25 bp, Mus musculus
agctgggacttaggccgtttcctgt

SEQ ID NO: 531944 - DNA, 25 bp, Mus musculus
agctgggagccaatccgcctgtcct

SEQ ID NO: 531945 - DNA, 25 bp, Mus musculus
agctgggagccattccgcctgtcct

SEQ ID NO: 531946 - DNA, 25 bp, Mus musculus
agctgggatctacctaacttggagg

SEQ ID NO: 531947 - DNA, 25 bp, Mus musculus
agctgggatctagctaacttggagg

SEQ ID NO: 531948 - DNA, 25 bp, Mus musculus
agctgggatgagcataatggcttct

SEQ ID NO: 531949 - DNA, 25 bp, Mus musculus
agctgggatgaggataatggcttct

SEQ ID NO: 531950 - DNA, 25 bp, Mus musculus
agctgggcaaagagctaacgcccac

SEQ ID NO: 531951 - DNA, 25 bp, Mus musculus
agctgggcaaagtgctaacgcccac

SEQ ID NO: 531952 - DNA, 25 bp, Mus musculus
agctgggcaagcagtggtgctcttt

SEQ ID NO: 531953 - DNA, 25 bp, Mus musculus
agctgggcaagctgtggtgctcttt

SEQ ID NO: 531954 - DNA, 25 bp, Mus musculus
agctgggcacagcttgcaggaccct

SEQ ID NO: 531955 - DNA, 25 bp, Mus musculus
agctgggcacaggttgcaggaccct

SEQ ID NO: 531956 - DNA, 25 bp, Mus musculus
agctgggccacaaccgcagcagggt

SEQ ID NO: 531957 - DNA, 25 bp, Mus musculus
agctgggccacatccgcagcagggt

SEQ ID NO: 531958 - DNA, 25 bp, Mus musculus
agctgggccaccctgagggtcacat

SEQ ID NO: 531959 - DNA, 25 bp, Mus musculus
agctgggccaccgtgagggtcacat

SEQ ID NO: 531960 - DNA, 25 bp, Mus musculus
agctgggccgcgaggcctttcttga

SEQ ID NO: 531961 - DNA, 25 bp, Mus musculus
agctgggccgcgtggcctttcttga

SEQ ID NO: 531962 - DNA, 25 bp, Mus musculus
agctgggcgagaagttgcttatgct

SEQ ID NO: 531963 - DNA, 25 bp, Mus musculus
agctgggcgagatgttgcttatgct

SEQ ID NO: 531964 - DNA, 25 bp, Mus musculus
agctgggctagcattgaggtcccct

SEQ ID NO: 531965 - DNA, 25 bp, Mus musculus
agctgggctagctttgaggtcccct

SEQ ID NO: 531966 - DNA, 25 bp, Mus musculus
agctgggctgccagcgagccattgt

SEQ ID NO: 531967 - DNA, 25 bp, Mus musculus
agctgggctgcctgcgagccattgt

SEQ ID NO: 531968 - DNA, 25 bp, Mus musculus
agctgggtagttcctgctgtttgca

SEQ ID NO: 531969 - DNA, 25 bp, Mus musculus
agctgggtagttgctgctgtttgca

SEQ ID NO: 531970 - DNA, 25 bp, Mus musculus
agctgggtccagcaagtcacgcaca

SEQ ID NO: 531971 - DNA, 25 bp, Mus musculus
agctgggtccaggaagtcacgcaca

SEQ ID NO: 531972 - DNA, 25 bp, Mus musculus
agctgggtcgaccagaagactccat

SEQ ID NO: 531973 - DNA, 25 bp, Mus musculus
agctgggtcgacgagaagactccat

SEQ ID NO: 531974 - DNA, 25 bp, Mus musculus
agctgggtctcccagcgcctcagtg

SEQ ID NO: 531975 - DNA, 25 bp, Mus musculus
agctgggtctccgagcgcctcagtg

SEQ ID NO: 531976 - DNA, 25 bp, Mus musculus
agctgggtgctgacatctgaggatc

SEQ ID NO: 531977 - DNA, 25 bp, Mus musculus
agctgggtgctgtcatctgaggatc

SEQ ID NO: 531978 - DNA, 25 bp, Mus musculus
agctgggtgtggatactatcgccaa

SEQ ID NO: 531979 - DNA, 25 bp, Mus musculus
agctgggtgtggttactatcgccaa

SEQ ID NO: 531980 - DNA, 25 bp, Mus musculus
agctgggttgcaatgctctcctcaa

SEQ ID NO: 531981 - DNA, 25 bp, Mus musculus
agctgggttgcattgctctcctcaa

SEQ ID NO: 531982 - DNA, 25 bp, Mus musculus
agctgggtttcaagggacctggcca

SEQ ID NO: 531983 - DNA, 25 bp, Mus musculus
agctgggtttcatgggacctggcca

SEQ ID NO: 531984 - DNA, 25 bp, Mus musculus
agctggtagagtcagacatcaacgg

SEQ ID NO: 531985 - DNA, 25 bp, Mus musculus
agctggtagagtgagacatcaacgg

SEQ ID NO: 531986 - DNA, 25 bp, Mus musculus
agctggtagatgagaacaccggtgc

SEQ ID NO: 531987 - DNA, 25 bp, Mus musculus
agctggtagatgtgaacaccggtgc

SEQ ID NO: 531988 - DNA, 25 bp, Mus musculus
agctggtcaccaatgcctgcctcat

SEQ ID NO: 531989 - DNA, 25 bp, Mus musculus
agctggtcaccattgcctgcctcat

SEQ ID NO: 531990 - DNA, 25 bp, Mus musculus
agctggtcctcgaggccaatggaag

SEQ ID NO: 531991 - DNA, 25 bp, Mus musculus
agctggtcctcgtggccaatggaag

SEQ ID NO: 531992 - DNA, 25 bp, Mus musculus
agctggtcgaccatctctgtgatgg

SEQ ID NO: 531993 - DNA, 25 bp, Mus musculus
agctggtcgaccttctctgtgatgg

SEQ ID NO: 531994 - DNA, 25 bp, Mus musculus
agctggtcgtcgagggcttcagcct

SEQ ID NO: 531995 - DNA, 25 bp, Mus musculus
agctggtcgtcgtgggcttcagcct

SEQ ID NO: 531996 - DNA, 25 bp, Mus musculus
agctggtcgtggactcgtgttgccc

SEQ ID NO: 531997 - DNA, 25 bp, Mus musculus
agctggtcgtggtctcgtgttgccc

SEQ ID NO: 531998 - DNA, 25 bp, Mus musculus
agctggtgacttaagatcaggagat

SEQ ID NO: 531999 - DNA, 25 bp, Mus musculus
agctggtgactttagatcaggagat

SEQ ID NO: 532000 - DNA, 25 bp, Mus musculus
agctggtgagcaccggctacgactc

SEQ ID NO: 532001 - DNA, 25 bp, Mus musculus
agctggtgagcagcggctacgactc

SEQ ID NO: 532002 - DNA, 25 bp, Mus musculus
agctggtgccaaagagggaccatgc

SEQ ID NO: 532003 - DNA, 25 bp, Mus musculus
agctggtgccaatgagggaccatgc

SEQ ID NO: 532004 - DNA, 25 bp, Mus musculus
agctggtggaagctcttgtgctcat

SEQ ID NO: 532005 - DNA, 25 bp, Mus musculus
agctggtggaaggtcttgtgctcat

SEQ ID NO: 532006 - DNA, 25 bp, Mus musculus
agctggtggagcacaacgagaagct

SEQ ID NO: 532007 - DNA, 25 bp, Mus musculus
agctggtggagctcaacgagaagct

SEQ ID NO: 532008 - DNA, 25 bp, Mus musculus
agctggtggcgtagagatctataat

SEQ ID NO: 532009 - DNA, 25 bp, Mus musculus
agctggtggcgttgagatctataat

SEQ ID NO: 532010 - DNA, 25 bp, Mus musculus
agctggtgggcaacgtcacctcccg

SEQ ID NO: 532011 - DNA, 25 bp, Mus musculus
agctggtgggcatcgtcacctcccg

SEQ ID NO: 532012 - DNA, 25 bp, Mus musculus
agctggttagtcagctgcatatgtc

SEQ ID NO: 532013 - DNA, 25 bp, Mus musculus
agctggttagtctgctgcatatgtc

SEQ ID NO: 532014 - DNA, 25 bp, Mus musculus
agctggttccccacctgacgacggg

SEQ ID NO: 532015 - DNA, 25 bp, Mus musculus
agctggttcccctcctgacgacggg

SEQ ID NO: 532016 - DNA, 25 bp, Mus musculus
agctggtttcagaggtacaggctca

SEQ ID NO: 532017 - DNA, 25 bp, Mus musculus
agctggtttcagtggtacaggctca

SEQ ID NO: 532018 - DNA, 25 bp, Mus musculus
agctggtttcgtcaaggagtgttca

SEQ ID NO: 532019 - DNA, 25 bp, Mus musculus
agctggtttcgtgaaggagtgttca

SEQ ID NO: 532020 - DNA, 25 bp, Mus musculus
agctggttttccaggtcgccctggg

SEQ ID NO: 532021 - DNA, 25 bp, Mus musculus
agctggttttcctggtcgccctggg

SEQ ID NO: 532022 - DNA, 25 bp, Mus musculus
agctgtaactgtcgaagacctcatc

SEQ ID NO: 532023 - DNA, 25 bp, Mus musculus
agctgtaactgtggaagacctcatc

SEQ ID NO: 532024 - DNA, 25 bp, Mus musculus
agctgtacaataccgggctcctcgg

SEQ ID NO: 532025 - DNA, 25 bp, Mus musculus
agctgtacaatagcgggctcctcgg

SEQ ID NO: 532026 - DNA, 25 bp, Mus musculus
agctgtacagccaggcccggatctg

SEQ ID NO: 532027 - DNA, 25 bp, Mus musculus
agctgtacagcctggcccggatctg

SEQ ID NO: 532028 - DNA, 25 bp, Mus musculus
agctgtaccactcgcctgctaggcg

SEQ ID NO: 532029 - DNA, 25 bp, Mus musculus
agctgtaccactggcctgctaggcg

SEQ ID NO: 532030 - DNA, 25 bp, Mus musculus
agctgtaccccgagtccaagggcgc

SEQ ID NO: 532031 - DNA, 25 bp, Mus musculus
agctgtaccccgtgtccaagggcgc

SEQ ID NO: 532032 - DNA, 25 bp, Mus musculus
agctgtacccggcagtcagcactga

SEQ ID NO: 532033 - DNA, 25 bp, Mus musculus
agctgtacccgggagtcagcactga

SEQ ID NO: 532034 - DNA, 25 bp, Mus musculus
agctgtaccctgagaactcggagca

SEQ ID NO: 532035 - DNA, 25 bp, Mus musculus
agctgtaccctgtgaactcggagca

SEQ ID NO: 532036 - DNA, 25 bp, Mus musculus
agctgtacctctactccttcatcag

SEQ ID NO: 532037 - DNA, 25 bp, Mus musculus
agctgtacctcttctccttcatcag

SEQ ID NO: 532038 - DNA, 25 bp, Mus musculus
agctgtcacagcagcatcatccaca

SEQ ID NO: 532039 - DNA, 25 bp, Mus musculus
agctgtcacagctgcatcatccaca

SEQ ID NO: 532040 - DNA, 25 bp, Mus musculus
agctgtcacatcacatccgcacggg

SEQ ID NO: 532041 - DNA, 25 bp, Mus musculus
agctgtcacatctcatccgcacggg

SEQ ID NO: 532042 - DNA, 25 bp, Mus musculus
agctgtcagaaaccgcctttggcta

SEQ ID NO: 532043 - DNA, 25 bp, Mus musculus
agctgtcagaaagcgcctttggcta

SEQ ID NO: 532044 - DNA, 25 bp, Mus musculus
agctgtcagctccattgcggcagca

SEQ ID NO: 532045 - DNA, 25 bp, Mus musculus
agctgtcagctcgattgcggcagca

SEQ ID NO: 532046 - DNA, 25 bp, Mus musculus
agctgtccagagagaagccccaacc

SEQ ID NO: 532047 - DNA, 25 bp, Mus musculus
agctgtccagagtgaagccccaacc

SEQ ID NO: 532048 - DNA, 25 bp, Mus musculus
agctgtccagataggctgagcccaa

SEQ ID NO: 532049 - DNA, 25 bp, Mus musculus
agctgtccagattggctgagcccaa

SEQ ID NO: 532050 - DNA, 25 bp, Mus musculus
agctgtccagctagagcacccttgg

SEQ ID NO: 532051 - DNA, 25 bp, Mus musculus
agctgtccagcttgagcacccttgg

SEQ ID NO: 532052 - DNA, 25 bp, Mus musculus
agctgtccagtgcaatgtctgctgc

SEQ ID NO: 532053 - DNA, 25 bp, Mus musculus
agctgtccagtggaatgtctgctgc

SEQ ID NO: 532054 - DNA, 25 bp, Mus musculus
agctgtcccaggagcagtgcctgat

SEQ ID NO: 532055 - DNA, 25 bp, Mus musculus
agctgtcccaggtgcagtgcctgat

SEQ ID NO: 532056 - DNA, 25 bp, Mus musculus
agctgtcccgaccatgtagatgcca

SEQ ID NO: 532057 - DNA, 25 bp, Mus musculus
agctgtcccgacgatgtagatgcca

SEQ ID NO: 532058 - DNA, 25 bp, Mus musculus
agctgtccggcaaataccccaaggt

SEQ ID NO: 532059 - DNA, 25 bp, Mus musculus
agctgtccggcatataccccaaggt

SEQ ID NO: 532060 - DNA, 25 bp, Mus musculus
agctgtccgtatatcttcaactaag

SEQ ID NO: 532061 - DNA, 25 bp, Mus musculus
agctgtccgtatttcttcaactaag

SEQ ID NO: 532062 - DNA, 25 bp, Mus musculus
agctgtcctactacagcagctgctg

SEQ ID NO: 532063 - DNA, 25 bp, Mus musculus
agctgtcctacttcagcagctgctg

SEQ ID NO: 532064 - DNA, 25 bp, Mus musculus
agctgtctaagacccaacctgtggc

SEQ ID NO: 532065 - DNA, 25 bp, Mus musculus
agctgtctaagagccaacctgtggc

SEQ ID NO: 532066 - DNA, 25 bp, Mus musculus
agctgtctgccaactatgcagtcct

SEQ ID NO: 532067 - DNA, 25 bp, Mus musculus
agctgtctgccatctatgcagtcct

SEQ ID NO: 532068 - DNA, 25 bp, Mus musculus
agctgtctggctcaaggcctctcca

SEQ ID NO: 532069 - DNA, 25 bp, Mus musculus
agctgtctggctgaaggcctctcca

SEQ ID NO: 532070 - DNA, 25 bp, Mus musculus
agctgtctgtccatcgccgctctgt

SEQ ID NO: 532071 - DNA, 25 bp, Mus musculus
agctgtctgtccttcgccgctctgt

SEQ ID NO: 532072 - DNA, 25 bp, Mus musculus
agctgtcttttaaccgactgtgtga

SEQ ID NO: 532073 - DNA, 25 bp, Mus musculus
agctgtcttttatccgactgtgtga

SEQ ID NO: 532074 - DNA, 25 bp, Mus musculus
agctgtgaagatcatcgacaagacc

SEQ ID NO: 532075 - DNA, 25 bp, Mus musculus
agctgtgaagatgatcgacaagacc

SEQ ID NO: 532076 - DNA, 25 bp, Mus musculus
agctgtgacacactcacctgccgcg

SEQ ID NO: 532077 - DNA, 25 bp, Mus musculus
agctgtgacacagtcacctgccgcg

SEQ ID NO: 532078 - DNA, 25 bp, Mus musculus
agctgtgaccgacactggcaagatg

SEQ ID NO: 532079 - DNA, 25 bp, Mus musculus
agctgtgaccgagactggcaagatg

SEQ ID NO: 532080 - DNA, 25 bp, Mus musculus
agctgtgactacattgctgtgaacc

SEQ ID NO: 532081 - DNA, 25 bp, Mus musculus
agctgtgactactttgctgtgaacc

SEQ ID NO: 532082 - DNA, 25 bp, Mus musculus
agctgtgattggaggccgagtttct

SEQ ID NO: 532083 - DNA, 25 bp, Mus musculus
agctgtgattggtggccgagtttct

SEQ ID NO: 532084 - DNA, 25 bp, Mus musculus
agctgtgcaacgaggctcggattga

SEQ ID NO: 532085 - DNA, 25 bp, Mus musculus
agctgtgcaacgtggctcggattga

SEQ ID NO: 532086 - DNA, 25 bp, Mus musculus
agctgtgcaatcagagaaggatcta

SEQ ID NO: 532087 - DNA, 25 bp, Mus musculus
agctgtgcaatctgagaaggatcta

SEQ ID NO: 532088 - DNA, 25 bp, Mus musculus
agctgtgcacaacctgaccaagcgc

SEQ ID NO: 532089 - DNA, 25 bp, Mus musculus
agctgtgcacaagctgaccaagcgc

SEQ ID NO: 532090 - DNA, 25 bp, Mus musculus
agctgtgcagcacgacactcagaca

SEQ ID NO: 532091 - DNA, 25 bp, Mus musculus
agctgtgcagcaggacactcagaca

SEQ ID NO: 532092 - DNA, 25 bp, Mus musculus
agctgtgcaggcacgcatgcaggcc

SEQ ID NO: 532093 - DNA, 25 bp, Mus musculus
agctgtgcaggctcgcatgcaggcc

SEQ ID NO: 532094 - DNA, 25 bp, Mus musculus
agctgtgcctgaatgagcagaggca

SEQ ID NO: 532095 - DNA, 25 bp, Mus musculus
agctgtgcctgattgagcagaggca

SEQ ID NO: 532096 - DNA, 25 bp, Mus musculus
agctgtggatgcagagcagttctca

SEQ ID NO: 532097 - DNA, 25 bp, Mus musculus
agctgtggatgctgagcagttctca

SEQ ID NO: 532098 - DNA, 25 bp, Mus musculus
agctgtggattaacatggagtacct

SEQ ID NO: 532099 - DNA, 25 bp, Mus musculus
agctgtggattatcatggagtacct

SEQ ID NO: 532100 - DNA, 25 bp, Mus musculus
agctgtggccagagtaccccgtgcc

SEQ ID NO: 532101 - DNA, 25 bp, Mus musculus
agctgtggccagcatctcaaaccag

SEQ ID NO: 532102 - DNA, 25 bp, Mus musculus
agctgtggccaggatctcaaaccag

SEQ ID NO: 532103 - DNA, 25 bp, Mus musculus
agctgtggccagtgtaccccgtgcc

SEQ ID NO: 532104 - DNA, 25 bp, Mus musculus
agctgtggccccaggcatccgagcg

SEQ ID NO: 532105 - DNA, 25 bp, Mus musculus
agctgtggcccctggcatccgagcg

SEQ ID NO: 532106 - DNA, 25 bp, Mus musculus
agctgtggccctccacctaggcatg

SEQ ID NO: 532107 - DNA, 25 bp, Mus musculus
agctgtggccctgcacctaggcatg

SEQ ID NO: 532108 - DNA, 25 bp, Mus musculus
agctgtgggcataccagcagtcaga

SEQ ID NO: 532109 - DNA, 25 bp, Mus musculus
agctgtgggcattccagcagtcaga

SEQ ID NO: 532110 - DNA, 25 bp, Mus musculus
agctgtgggccacaccccttcaggg

SEQ ID NO: 532111 - DNA, 25 bp, Mus musculus
agctgtgggccagaccccttcaggg

SEQ ID NO: 532112 - DNA, 25 bp, Mus musculus
agctgtgtctctacgccatcaccga

SEQ ID NO: 532113 - DNA, 25 bp, Mus musculus
agctgtgtctcttcgccatcaccga

SEQ ID NO: 532114 - DNA, 25 bp, Mus musculus
agctgttagcacagaatcccgatgc

SEQ ID NO: 532115 - DNA, 25 bp, Mus musculus
agctgttagcactgaatcccgatgc

SEQ ID NO: 532116 - DNA, 25 bp, Mus musculus
agctgttcgactctcctgtgccaaa

SEQ ID NO: 532117 - DNA, 25 bp, Mus musculus
agctgttcgactgtcctgtgccaaa

SEQ ID NO: 532118 - DNA, 25 bp, Mus musculus
agctgttcggttcgctaaggagaaa

SEQ ID NO: 532119 - DNA, 25 bp, Mus musculus
agctgttcggttggctaaggagaaa

SEQ ID NO: 532120 - DNA, 25 bp, Mus musculus
agctgttcgtgtagaatgcggccca

SEQ ID NO: 532121 - DNA, 25 bp, Mus musculus
agctgttcgtgttgaatgcggccca

SEQ ID NO: 532122 - DNA, 25 bp, Mus musculus
agctgttctatgatggccctcggga

SEQ ID NO: 532123 - DNA, 25 bp, Mus musculus
agctgttctatgttggccctcggga

SEQ ID NO: 532124 - DNA, 25 bp, Mus musculus
agctgttctcccagggcagctcatt

SEQ ID NO: 532125 - DNA, 25 bp, Mus musculus
agctgttctccctgggcagctcatt

SEQ ID NO: 532126 - DNA, 25 bp, Mus musculus
agctgttctcctcccgggagcactt

SEQ ID NO: 532127 - DNA, 25 bp, Mus musculus
agctgttctcctgccgggagcactt

SEQ ID NO: 532128 - DNA, 25 bp, Mus musculus
agctgttcttctacctggtggagca

SEQ ID NO: 532129 - DNA, 25 bp, Mus musculus
agctgttcttcttcctggtggagca

SEQ ID NO: 532130 - DNA, 25 bp, Mus musculus
agctgttgcactatctgtttggacc

SEQ ID NO: 532131 - DNA, 25 bp, Mus musculus
agctgttgcactttctgtttggacc

SEQ ID NO: 532132 - DNA, 25 bp, Mus musculus
agctgttgcgtactgtatcatattg

SEQ ID NO: 532133 - DNA, 25 bp, Mus musculus
agctgttgcgtagtgtatcatattg

SEQ ID NO: 532134 - DNA, 25 bp, Mus musculus
agctgttggaccatgttgcaaggag

SEQ ID NO: 532135 - DNA, 25 bp, Mus musculus
agctgttggaccttgttgcaaggag

SEQ ID NO: 532136 - DNA, 25 bp, Mus musculus
agctgtttgccaagcgcgcctacag

SEQ ID NO: 532137 - DNA, 25 bp, Mus musculus
agctgtttgccatgcgcgcctacag

SEQ ID NO: 532138 - DNA, 25 bp, Mus musculus
agctgtttgtctaagaagtggatga

SEQ ID NO: 532139 - DNA, 25 bp, Mus musculus
agctgtttgtcttagaagtggatga

SEQ ID NO: 532140 - DNA, 25 bp, Mus musculus
agcttaagctggagcgggatttcag

SEQ ID NO: 532141 - DNA, 25 bp, Mus musculus
agcttaagctggtgcgggatttcag

SEQ ID NO: 532142 - DNA, 25 bp, Mus musculus
agcttaccagacatttgaagatacc

SEQ ID NO: 532143 - DNA, 25 bp, Mus musculus
agcttaccagacttttgaagatacc

SEQ ID NO: 532144 - DNA, 25 bp, Mus musculus
agcttaccccaaacaagacagacct

SEQ ID NO: 532145 - DNA, 25 bp, Mus musculus
agcttaccccaatcaagacagacct

SEQ ID NO: 532146 - DNA, 25 bp, Mus musculus
agcttacgctgcctcaacggtggta

SEQ ID NO: 532147 - DNA, 25 bp, Mus musculus
agcttacgctgcgtcaacggtggta

SEQ ID NO: 532148 - DNA, 25 bp, Mus musculus
agcttactcgctccaaacttgccag

SEQ ID NO: 532149 - DNA, 25 bp, Mus musculus
agcttactcgctgcaaacttgccag

SEQ ID NO: 532150 - DNA, 25 bp, Mus musculus
agcttactggccacgccatgccaag

SEQ ID NO: 532151 - DNA, 25 bp, Mus musculus
agcttactggcctcgccatgccaag

SEQ ID NO: 532152 - DNA, 25 bp, Mus musculus
agcttactttgcagcgaccgccaca

SEQ ID NO: 532153 - DNA, 25 bp, Mus musculus
agcttactttgctgcgaccgccaca

SEQ ID NO: 532154 - DNA, 25 bp, Mus musculus
agcttagcgctgaacagttcatgct

SEQ ID NO: 532155 - DNA, 25 bp, Mus musculus
agcttagcgctgtacagttcatgct

SEQ ID NO: 532156 - DNA, 25 bp, Mus musculus
agcttagtacttctgttcacatgag

SEQ ID NO: 532157 - DNA, 25 bp, Mus musculus
agcttagtacttgtgttcacatgag

SEQ ID NO: 532158 - DNA, 25 bp, Mus musculus
agcttatcctggacatgtttggaga

SEQ ID NO: 532159 - DNA, 25 bp, Mus musculus
agcttatcctggtcatgtttggaga

SEQ ID NO: 532160 - DNA, 25 bp, Mus musculus
agcttcaacactacactcaactgca

SEQ ID NO: 532161 - DNA, 25 bp, Mus musculus
agcttcaacacttcactcaactgca

SEQ ID NO: 532162 - DNA, 25 bp, Mus musculus
agcttcaagtcaacttagtccgttc

SEQ ID NO: 532163 - DNA, 25 bp, Mus musculus
agcttcaagtcatcttagtccgttc

SEQ ID NO: 532164 - DNA, 25 bp, Mus musculus
agcttcaagtgcatcgcctgccagc

SEQ ID NO: 532165 - DNA, 25 bp, Mus musculus
agcttcaagtgcttcgcctgccagc

SEQ ID NO: 532166 - DNA, 25 bp, Mus musculus
agcttcacgcaaaccccggaagagg

SEQ ID NO: 532167 - DNA, 25 bp, Mus musculus
agcttcacgcaatccccggaagagg

SEQ ID NO: 532168 - DNA, 25 bp, Mus musculus
agcttcacggccagcagccagagac

SEQ ID NO: 532169 - DNA, 25 bp, Mus musculus
agcttcacggcctgcagccagagac

SEQ ID NO: 532170 - DNA, 25 bp, Mus musculus
agcttcagaaccagggtccccgact

SEQ ID NO: 532171 - DNA, 25 bp, Mus musculus
agcttcagaacctgggtccccgact

SEQ ID NO: 532172 - DNA, 25 bp, Mus musculus
agcttcagaatcatggagaaacaga

SEQ ID NO: 532173 - DNA, 25 bp, Mus musculus
agcttcagaatcttggagaaacaga

SEQ ID NO: 532174 - DNA, 25 bp, Mus musculus
agcttcagactcaagcagagctggt

SEQ ID NO: 532175 - DNA, 25 bp, Mus musculus
agcttcagactctagcagagctggt

SEQ ID NO: 532176 - DNA, 25 bp, Mus musculus
agcttcagcccacagccgggaatgc

SEQ ID NO: 532177 - DNA, 25 bp, Mus musculus
agcttcagcccagagccgggaatgc

SEQ ID NO: 532178 - DNA, 25 bp, Mus musculus
agcttcaggaacaatacctcgccca

SEQ ID NO: 532179 - DNA, 25 bp, Mus musculus
agcttcaggaactatacctcgccca

SEQ ID NO: 532180 - DNA, 25 bp, Mus musculus
agcttcagttcacccaggctgttca

SEQ ID NO: 532181 - DNA, 25 bp, Mus musculus
agcttcagttcagccaggctgttca

SEQ ID NO: 532182 - DNA, 25 bp, Mus musculus
agcttcatgagcacggagccgctgt

SEQ ID NO: 532183 - DNA, 25 bp, Mus musculus
agcttcatgagctcggagccgctgt

SEQ ID NO: 532184 - DNA, 25 bp, Mus musculus
agcttcattctcaatgtgctgaaag

SEQ ID NO: 532185 - DNA, 25 bp, Mus musculus
agcttcattctctatgtgctgaaag

SEQ ID NO: 532186 - DNA, 25 bp, Mus musculus
agcttccacactaccttcatcgatg

SEQ ID NO: 532187 - DNA, 25 bp, Mus musculus
agcttccacacttccttcatcgatg

SEQ ID NO: 532188 - DNA, 25 bp, Mus musculus
agcttccactaacccgggtgtccga

SEQ ID NO: 532189 - DNA, 25 bp, Mus musculus
agcttccactaagccgggtgtccga

SEQ ID NO: 532190 - DNA, 25 bp, Mus musculus
agcttccagcgcctcgggacgcgat

SEQ ID NO: 532191 - DNA, 25 bp, Mus musculus
agcttccagcgcgtcgggacgcgat

SEQ ID NO: 532192 - DNA, 25 bp, Mus musculus
agcttccaggagctgtggccttctc

SEQ ID NO: 532193 - DNA, 25 bp, Mus musculus
agcttccaggaggtgtggccttctc

SEQ ID NO: 532194 - DNA, 25 bp, Mus musculus
agcttccatactacactgcttggga

SEQ ID NO: 532195 - DNA, 25 bp, Mus musculus
agcttccatacttcactgcttggga

SEQ ID NO: 532196 - DNA, 25 bp, Mus musculus
agcttcccacggcagtctgtcagag

SEQ ID NO: 532197 - DNA, 25 bp, Mus musculus
agcttcccacgggagtctgtcagag

SEQ ID NO: 532198 - DNA, 25 bp, Mus musculus
agcttcccagacaaggcagagccag

SEQ ID NO: 532199 - DNA, 25 bp, Mus musculus
agcttcccagactaggcagagccag

SEQ ID NO: 532200 - DNA, 25 bp, Mus musculus
agcttcccgtacagatacaagcagc

SEQ ID NO: 532201 - DNA, 25 bp, Mus musculus
agcttcccgtactgatacaagcagc

SEQ ID NO: 532202 - DNA, 25 bp, Mus musculus
agcttccgccgcctggatgacaaga

SEQ ID NO: 532203 - DNA, 25 bp, Mus musculus
agcttccgccgcgtggatgacaaga

SEQ ID NO: 532204 - DNA, 25 bp, Mus musculus
agcttccggaaactcagggactacg

SEQ ID NO: 532205 - DNA, 25 bp, Mus musculus
agcttccggaaagtcagggactacg

SEQ ID NO: 532206 - DNA, 25 bp, Mus musculus
agcttccggcagaccctcctgggtt

SEQ ID NO: 532207 - DNA, 25 bp, Mus musculus
agcttccggcagtccctcctgggtt

SEQ ID NO: 532208 - DNA, 25 bp, Mus musculus
agcttccgttctacaggtgtcagac

SEQ ID NO: 532209 - DNA, 25 bp, Mus musculus
agcttccgttcttcaggtgtcagac

SEQ ID NO: 532210 - DNA, 25 bp, Mus musculus
agcttcctaccgctgcctgagcgga

SEQ ID NO: 532211 - DNA, 25 bp, Mus musculus
agcttcctaccggtgcctgagcgga

SEQ ID NO: 532212 - DNA, 25 bp, Mus musculus
agcttcctgactcaagaccagatcc

SEQ ID NO: 532213 - DNA, 25 bp, Mus musculus
agcttcctgactgaagaccagatcc

SEQ ID NO: 532214 - DNA, 25 bp, Mus musculus
agcttcctggaccagctgcatgaga

SEQ ID NO: 532215 - DNA, 25 bp, Mus musculus
agcttcctggacgagctgcatgaga

SEQ ID NO: 532216 - DNA, 25 bp, Mus musculus
agcttcgagtgtctgtgcaagcccc

SEQ ID NO: 532217 - DNA, 25 bp, Mus musculus
agcttcgagtgtgtgtgcaagcccc

SEQ ID NO: 532218 - DNA, 25 bp, Mus musculus
agcttcgctcccaagacttgctgac

SEQ ID NO: 532219 - DNA, 25 bp, Mus musculus
agcttcgctccctagacttgctgac

SEQ ID NO: 532220 - DNA, 25 bp, Mus musculus
agcttcggaagccactggaaaaaga

SEQ ID NO: 532221 - DNA, 25 bp, Mus musculus
agcttcggaagcgactggaaaaaga

SEQ ID NO: 532222 - DNA, 25 bp, Mus musculus
agcttcggagcaccgccaaggctct

SEQ ID NO: 532223 - DNA, 25 bp, Mus musculus
agcttcggagcagcgccaaggctct

SEQ ID NO: 532224 - DNA, 25 bp, Mus musculus
agcttcggagggaggctgcttcttt

SEQ ID NO: 532225 - DNA, 25 bp, Mus musculus
agcttcggagggtggctgcttcttt

SEQ ID NO: 532226 - DNA, 25 bp, Mus musculus
agcttcggatgcagaaggctctgaa

SEQ ID NO: 532227 - DNA, 25 bp, Mus musculus
agcttcggatgctgaaggctctgaa

SEQ ID NO: 532228 - DNA, 25 bp, Mus musculus
agcttcgtgcgcagcagtcagtggt

SEQ ID NO: 532229 - DNA, 25 bp, Mus musculus
agcttcgtgcgctgcagtcagtggt

SEQ ID NO: 532230 - DNA, 25 bp, Mus musculus
agcttctaagtcacctgtctgtgtc

SEQ ID NO: 532231 - DNA, 25 bp, Mus musculus
agcttctaagtctcctgtctgtgtc

SEQ ID NO: 532232 - DNA, 25 bp, Mus musculus
agcttctagcatcttccacggatgg

SEQ ID NO: 532233 - DNA, 25 bp, Mus musculus
agcttctagcatgttccacggatgg

SEQ ID NO: 532234 - DNA, 25 bp, Mus musculus
agcttctcaagtacttccacgagaa

SEQ ID NO: 532235 - DNA, 25 bp, Mus musculus
agcttctcaagtcagcggccaggca

SEQ ID NO: 532236 - DNA, 25 bp, Mus musculus
agcttctcaagtgagcggccaggca

SEQ ID NO: 532237 - DNA, 25 bp, Mus musculus
agcttctcaagttcttccacgagaa

SEQ ID NO: 532238 - DNA, 25 bp, Mus musculus
agcttctcactgcagatggagcccc

SEQ ID NO: 532239 - DNA, 25 bp, Mus musculus
agcttctcactggagatggagcccc

SEQ ID NO: 532240 - DNA, 25 bp, Mus musculus
agcttctcaggaccccagtcaggcg

SEQ ID NO: 532241 - DNA, 25 bp, Mus musculus
agcttctcaggagcccagtcaggcg

SEQ ID NO: 532242 - DNA, 25 bp, Mus musculus
agcttctctgaacagacgcatccag

SEQ ID NO: 532243 - DNA, 25 bp, Mus musculus
agcttctctgaagagacgcatccag

SEQ ID NO: 532244 - DNA, 25 bp, Mus musculus
agcttctgagcccatagagccgagg

SEQ ID NO: 532245 - DNA, 25 bp, Mus musculus
agcttctgagccgatagagccgagg

SEQ ID NO: 532246 - DNA, 25 bp, Mus musculus
agcttctgcctcaatgcctctggaa

SEQ ID NO: 532247 - DNA, 25 bp, Mus musculus
agcttctgcctctatgcctctggaa

SEQ ID NO: 532248 - DNA, 25 bp, Mus musculus
agcttctgcggcctaacgcctgcga

SEQ ID NO: 532249 - DNA, 25 bp, Mus musculus
agcttctgcggcgtaacgcctgcga

SEQ ID NO: 532250 - DNA, 25 bp, Mus musculus
agcttctggaaaaggcccgcaaaag

SEQ ID NO: 532251 - DNA, 25 bp, Mus musculus
agcttctggaaatggcccgcaaaag

SEQ ID NO: 532252 - DNA, 25 bp, Mus musculus
agcttctgtggccaggtcacaccag

SEQ ID NO: 532253 - DNA, 25 bp, Mus musculus
agcttctgtggcgaggtcacaccag

SEQ ID NO: 532254 - DNA, 25 bp, Mus musculus
agcttcttagctagtgagacccccg

SEQ ID NO: 532255 - DNA, 25 bp, Mus musculus
agcttcttagcttgtgagacccccg

SEQ ID NO: 532256 - DNA, 25 bp, Mus musculus
agcttcttatcaacgggaccaccag

SEQ ID NO: 532257 - DNA, 25 bp, Mus musculus
agcttcttatcatcgggaccaccag

SEQ ID NO: 532258 - DNA, 25 bp, Mus musculus
agcttctttgcaccactcatctatg

SEQ ID NO: 532259 - DNA, 25 bp, Mus musculus
agcttctttgcagcactcatctatg

SEQ ID NO: 532260 - DNA, 25 bp, Mus musculus
agcttgaagttgaagaacggcccca

SEQ ID NO: 532261 - DNA, 25 bp, Mus musculus
agcttgaagttgtagaacggcccca

SEQ ID NO: 532262 - DNA, 25 bp, Mus musculus
agcttgacattcacaaagactggtg

SEQ ID NO: 532263 - DNA, 25 bp, Mus musculus
agcttgacattctcaaagactggtg

SEQ ID NO: 532264 - DNA, 25 bp, Mus musculus
agcttgacgagaccgtgcttggaca

SEQ ID NO: 532265 - DNA, 25 bp, Mus musculus
agcttgacgagagcgtgcttggaca

SEQ ID NO: 532266 - DNA, 25 bp, Mus musculus
agcttgaggagtcttaccactatca

SEQ ID NO: 532267 - DNA, 25 bp, Mus musculus
agcttgaggagtgttaccactatca

SEQ ID NO: 532268 - DNA, 25 bp, Mus musculus
agcttgaggcctcgcaaggtcagca

SEQ ID NO: 532269 - DNA, 25 bp, Mus musculus
agcttgaggcctggcaaggtcagca

SEQ ID NO: 532270 - DNA, 25 bp, Mus musculus
agcttgcacaaccagacagaccgca

SEQ ID NO: 532271 - DNA, 25 bp, Mus musculus
agcttgcacaacgagacagaccgca

SEQ ID NO: 532272 - DNA, 25 bp, Mus musculus
agcttgcagccaacagttctgcagg

SEQ ID NO: 532273 - DNA, 25 bp, Mus musculus
agcttgcagccatcagttctgcagg

SEQ ID NO: 532274 - DNA, 25 bp, Mus musculus
agcttggataatcggctgtgtgcaa

SEQ ID NO: 532275 - DNA, 25 bp, Mus musculus
agcttggataatgggctgtgtgcaa

SEQ ID NO: 532276 - DNA, 25 bp, Mus musculus
agcttggccaccacaacgagatgag

SEQ ID NO: 532277 - DNA, 25 bp, Mus musculus
agcttggccacctcaacgagatgag

SEQ ID NO: 532278 - DNA, 25 bp, Mus musculus
agcttggccatcatgactgatgccg

SEQ ID NO: 532279 - DNA, 25 bp, Mus musculus
agcttggccatcttgactgatgccg

SEQ ID NO: 532280 - DNA, 25 bp, Mus musculus
agcttggcctctacctgattgtggc

SEQ ID NO: 532281 - DNA, 25 bp, Mus musculus
agcttggcctcttcctgattgtggc

SEQ ID NO: 532282 - DNA, 25 bp, Mus musculus
agcttggcgagcagctggacaacga

SEQ ID NO: 532283 - DNA, 25 bp, Mus musculus
agcttggcgagctgctggacaacga

SEQ ID NO: 532284 - DNA, 25 bp, Mus musculus
agcttggcgtctccgccatggacgc

SEQ ID NO: 532285 - DNA, 25 bp, Mus musculus
agcttggcgtctgcgccatggacgc

SEQ ID NO: 532286 - DNA, 25 bp, Mus musculus
agcttgggctccaggtctccgctgc

SEQ ID NO: 532287 - DNA, 25 bp, Mus musculus
agcttgggctcctggtctccgctgc

SEQ ID NO: 532288 - DNA, 25 bp, Mus musculus
agcttgggctgaatatgaagcagaa

SEQ ID NO: 532289 - DNA, 25 bp, Mus musculus
agcttgggctgattatgaagcagaa

SEQ ID NO: 532290 - DNA, 25 bp, Mus musculus
agcttggtcatcactcagatcggcc

SEQ ID NO: 532291 - DNA, 25 bp, Mus musculus
agcttggtcatctctcagatcggcc

SEQ ID NO: 532292 - DNA, 25 bp, Mus musculus
agcttgtcaccaccctctggactgg

SEQ ID NO: 532293 - DNA, 25 bp, Mus musculus
agcttgtcaccagcctctggactgg

SEQ ID NO: 532294 - DNA, 25 bp, Mus musculus
agcttgtcgctacttcctcgtccgg

SEQ ID NO: 532295 - DNA, 25 bp, Mus musculus
agcttgtcgctagttcctcgtccgg

SEQ ID NO: 532296 - DNA, 25 bp, Mus musculus
agcttgtgaagtctgcatgtcccca

SEQ ID NO: 532297 - DNA, 25 bp, Mus musculus
agcttgtgaagtgtgcatgtcccca

SEQ ID NO: 532298 - DNA, 25 bp, Mus musculus
agcttgtgaattccctcacgggaga

SEQ ID NO: 532299 - DNA, 25 bp, Mus musculus
agcttgtgaattgcctcacgggaga

SEQ ID NO: 532300 - DNA, 25 bp, Mus musculus
agcttgtggacccatctggactgtc

SEQ ID NO: 532301 - DNA, 25 bp, Mus musculus
agcttgtggaccgatctggactgtc

SEQ ID NO: 532302 - DNA, 25 bp, Mus musculus
agcttgtgtgccacagcggacctca

SEQ ID NO: 532303 - DNA, 25 bp, Mus musculus
agcttgtgtgcctcagcggacctca

SEQ ID NO: 532304 - DNA, 25 bp, Mus musculus
agcttgttagttccgggtccttgag

SEQ ID NO: 532305 - DNA, 25 bp, Mus musculus
agcttgttagttgcgggtccttgag

SEQ ID NO: 532306 - DNA, 25 bp, Mus musculus
agctttaagaagaccagagatgtgt

SEQ ID NO: 532307 - DNA, 25 bp, Mus musculus
agctttaagaagtccagagatgtgt

SEQ ID NO: 532308 - DNA, 25 bp, Mus musculus
agctttagatgtcatagagtctgac

SEQ ID NO: 532309 - DNA, 25 bp, Mus musculus
agctttagatgtgatagagtctgac

SEQ ID NO: 532310 - DNA, 25 bp, Mus musculus
agctttcacgctccttcatttcatg

SEQ ID NO: 532311 - DNA, 25 bp, Mus musculus
agctttcacgctgcttcatttcatg

SEQ ID NO: 532312 - DNA, 25 bp, Mus musculus
agctttcatttccaagtctttgacc

SEQ ID NO: 532313 - DNA, 25 bp, Mus musculus
agctttcatttcgaagtctttgacc

SEQ ID NO: 532314 - DNA, 25 bp, Mus musculus
agctttcccaggctgcatcccagca

SEQ ID NO: 532315 - DNA, 25 bp, Mus musculus
agctttcccagggtgcatcccagca

SEQ ID NO: 532316 - DNA, 25 bp, Mus musculus
agctttcctggactatctatacaca

SEQ ID NO: 532317 - DNA, 25 bp, Mus musculus
agctttcctggagtatctatacaca

SEQ ID NO: 532318 - DNA, 25 bp, Mus musculus
agctttctacctacttagaccctgc

SEQ ID NO: 532319 - DNA, 25 bp, Mus musculus
agctttctaccttcttagaccctgc

SEQ ID NO: 532320 - DNA, 25 bp, Mus musculus
agctttcttcttagggactccaaca

SEQ ID NO: 532321 - DNA, 25 bp, Mus musculus
agctttcttctttgggactccaaca

SEQ ID NO: 532322 - DNA, 25 bp, Mus musculus
agctttgacaagagggctgctgcgc

SEQ ID NO: 532323 - DNA, 25 bp, Mus musculus
agctttgacaagtgggctgctgcgc

SEQ ID NO: 532324 - DNA, 25 bp, Mus musculus
agctttgaggccctccgaaacatcc

SEQ ID NO: 532325 - DNA, 25 bp, Mus musculus
agctttgaggccgtccgaaacatcc

SEQ ID NO: 532326 - DNA, 25 bp, Mus musculus
agctttgcccctatgctgcagtggg

SEQ ID NO: 532327 - DNA, 25 bp, Mus musculus
agctttgcccctttgctgcagtggg

SEQ ID NO: 532328 - DNA, 25 bp, Mus musculus
agctttgccgtaaagtgatggagat

SEQ ID NO: 532329 - DNA, 25 bp, Mus musculus
agctttgccgtatagtgatggagat

SEQ ID NO: 532330 - DNA, 25 bp, Mus musculus
agctttggaaaccacagctgccagc

SEQ ID NO: 532331 - DNA, 25 bp, Mus musculus
agctttggaaacgacagctgccagc

SEQ ID NO: 532332 - DNA, 25 bp, Mus musculus
agctttggcccacaccaggcagggc

SEQ ID NO: 532333 - DNA, 25 bp, Mus musculus
agctttggcccagaccaggcagggc

SEQ ID NO: 532334 - DNA, 25 bp, Mus musculus
agctttgtcatcatctctggcttca

SEQ ID NO: 532335 - DNA, 25 bp, Mus musculus
agctttgtcatcttctctggcttca

SEQ ID NO: 532336 - DNA, 25 bp, Mus musculus
agctttgtggagactgaaatcacca

SEQ ID NO: 532337 - DNA, 25 bp, Mus musculus
agctttgtggagtctgaaatcacca

SEQ ID NO: 532338 - DNA, 25 bp, Mus musculus
agctttgttagcaaccctcagaagg

SEQ ID NO: 532339 - DNA, 25 bp, Mus musculus
agctttgttagctaccctcagaagg

SEQ ID NO: 532340 - DNA, 25 bp, Mus musculus
agcttttacaacacggaggcagtca

SEQ ID NO: 532341 - DNA, 25 bp, Mus musculus
agcttttacaactcggaggcagtca

SEQ ID NO: 532342 - DNA, 25 bp, Mus musculus
agcttttacgagattatgacctggg

SEQ ID NO: 532343 - DNA, 25 bp, Mus musculus
agcttttacgagtttatgacctggg

SEQ ID NO: 532344 - DNA, 25 bp, Mus musculus
agcttttcaacgagatcaacgcccg

SEQ ID NO: 532345 - DNA, 25 bp, Mus musculus
agcttttcaacgtgatcaacgcccg

SEQ ID NO: 532346 - DNA, 25 bp, Mus musculus
agcttttcatatcccagaatctgaa

SEQ ID NO: 532347 - DNA, 25 bp, Mus musculus
agcttttcatatgccagaatctgaa

SEQ ID NO: 532348 - DNA, 25 bp, Mus musculus
agcttttgagatcaatggcacagaa

SEQ ID NO: 532349 - DNA, 25 bp, Mus musculus
agcttttgagatgaatggcacagaa

SEQ ID NO: 532350 - DNA, 25 bp, Mus musculus
agcttttgctggcaagacggccaac

SEQ ID NO: 532351 - DNA, 25 bp, Mus musculus
agcttttgctgggaagacggccaac

SEQ ID NO: 532352 - DNA, 25 bp, Mus musculus
agcttttggcaaagaagaacccaga

SEQ ID NO: 532353 - DNA, 25 bp, Mus musculus
agcttttggcaatgaagaacccaga

SEQ ID NO: 532354 - DNA, 25 bp, Mus musculus
agcttttggcagcactcaacacttg

SEQ ID NO: 532355 - DNA, 25 bp, Mus musculus
agcttttggcaggactcaacacttg

SEQ ID NO: 532356 - DNA, 25 bp, Mus musculus
agcttttggcttcggagctcgaatc

SEQ ID NO: 532357 - DNA, 25 bp, Mus musculus
agcttttggcttgggagctcgaatc

SEQ ID NO: 532358 - DNA, 25 bp, Mus musculus
agcttttgggcaaggagaatttcca

SEQ ID NO: 532359 - DNA, 25 bp, Mus musculus
agcttttgggcatggagaatttcca

SEQ ID NO: 532360 - DNA, 25 bp, Mus musculus
agcttttgtgagctgttgtgacagc

SEQ ID NO: 532361 - DNA, 25 bp, Mus musculus
agcttttgtgaggtgttgtgacagc

SEQ ID NO: 532362 - DNA, 25 bp, Mus musculus
agctttttctctctcgctcaaggct

SEQ ID NO: 532363 - DNA, 25 bp, Mus musculus
agctttttctctgtcgctcaaggct

SEQ ID NO: 532364 - DNA, 25 bp, Mus musculus
aggaaaaaagaaccgacagaagaag

SEQ ID NO: 532365 - DNA, 25 bp, Mus musculus
aggaaaaaagaagcgacagaagaag

SEQ ID NO: 532366 - DNA, 25 bp, Mus musculus
aggaaaacttcaccagctaaccaaa

SEQ ID NO: 532367 - DNA, 25 bp, Mus musculus
aggaaaacttcagcagctaaccaaa

SEQ ID NO: 532368 - DNA, 25 bp, Mus musculus
aggaaaagcagacaagatattccag

SEQ ID NO: 532369 - DNA, 25 bp, Mus musculus
aggaaaagcagagaagatattccag

SEQ ID NO: 532370 - DNA, 25 bp, Mus musculus
aggaaaagtctgacttctgccgaat

SEQ ID NO: 532371 - DNA, 25 bp, Mus musculus
aggaaaagtctgtcttctgccgaat

SEQ ID NO: 532372 - DNA, 25 bp, Mus musculus
aggaaaatttgcatggatccatcaa

SEQ ID NO: 532373 - DNA, 25 bp, Mus musculus
aggaaaatttgcttggatccatcaa

SEQ ID NO: 532374 - DNA, 25 bp, Mus musculus
aggaaacaggaactctggaatccca

SEQ ID NO: 532375 - DNA, 25 bp, Mus musculus
aggaaacaggaagtctggaatccca

SEQ ID NO: 532376 - DNA, 25 bp, Mus musculus
aggaaacatactagccctgtgcctg

SEQ ID NO: 532377 - DNA, 25 bp, Mus musculus
aggaaacatacttgccctgtgcctg

SEQ ID NO: 532378 - DNA, 25 bp, Mus musculus
aggaaaccaagcagtgcgcctgcca

SEQ ID NO: 532379 - DNA, 25 bp, Mus musculus
aggaaaccaagctgtgcgcctgcca

SEQ ID NO: 532380 - DNA, 25 bp, Mus musculus
aggaaaccacgccacgacacaagca

SEQ ID NO: 532381 - DNA, 25 bp, Mus musculus
aggaaaccacgcgacgacacaagca

SEQ ID NO: 532382 - DNA, 25 bp, Mus musculus
aggaaacccggacgtggcacgtgag

SEQ ID NO: 532383 - DNA, 25 bp, Mus musculus
aggaaacccggaggtggcacgtgag

SEQ ID NO: 532384 - DNA, 25 bp, Mus musculus
aggaaacctaggagctcaggctgcc

SEQ ID NO: 532385 - DNA, 25 bp, Mus musculus
aggaaacctaggtgctcaggctgcc

SEQ ID NO: 532386 - DNA, 25 bp, Mus musculus
aggaaacctccaaccctgcaaagga

SEQ ID NO: 532387 - DNA, 25 bp, Mus musculus
aggaaacctccatccctgcaaagga

SEQ ID NO: 532388 - DNA, 25 bp, Mus musculus
aggaaacctcgacagactttcatgg

SEQ ID NO: 532389 - DNA, 25 bp, Mus musculus
aggaaacctcgagagactttcatgg

SEQ ID NO: 532390 - DNA, 25 bp, Mus musculus
aggaaacgcggcagaccctgatgga

SEQ ID NO: 532391 - DNA, 25 bp, Mus musculus
aggaaacgcggctgaccctgatgga

SEQ ID NO: 532392 - DNA, 25 bp, Mus musculus
aggaaactgggcacacctggaccaa

SEQ ID NO: 532393 - DNA, 25 bp, Mus musculus
aggaaactgggctcacctggaccaa

SEQ ID NO: 532394 - DNA, 25 bp, Mus musculus
aggaaactgtaaaagctatgctggg

SEQ ID NO: 532395 - DNA, 25 bp, Mus musculus
aggaaactgtaatagctatgctggg

SEQ ID NO: 532396 - DNA, 25 bp, Mus musculus
aggaaagacccacagatggcccgat

SEQ ID NO: 532397 - DNA, 25 bp, Mus musculus
aggaaagacccagagatggcccgat

SEQ ID NO: 532398 - DNA, 25 bp, Mus musculus
aggaaagaccctatgctgttccaag

SEQ ID NO: 532399 - DNA, 25 bp, Mus musculus
aggaaagaccctttgctgttccaag

SEQ ID NO: 532400 - DNA, 25 bp, Mus musculus
aggaaagagcccctccaccgagcat

SEQ ID NO: 532401 - DNA, 25 bp, Mus musculus
aggaaagagcccgtccaccgagcat

SEQ ID NO: 532402 - DNA, 25 bp, Mus musculus
aggaaagatcaaacgtccccggacg

SEQ ID NO: 532403 - DNA, 25 bp, Mus musculus
aggaaagatcaatcgtccccggacg

SEQ ID NO: 532404 - DNA, 25 bp, Mus musculus
aggaaagattacacagcgctaacaa

SEQ ID NO: 532405 - DNA, 25 bp, Mus musculus
aggaaagattactcagcgctaacaa

SEQ ID NO: 532406 - DNA, 25 bp, Mus musculus
aggaaagctggtctggcccacagta

SEQ ID NO: 532407 - DNA, 25 bp, Mus musculus
aggaaagctggtgtggcccacagta

SEQ ID NO: 532408 - DNA, 25 bp, Mus musculus
aggaaataccaacgccgagaatcag

SEQ ID NO: 532409 - DNA, 25 bp, Mus musculus
aggaaataccaaggccgagaatcag

SEQ ID NO: 532410 - DNA, 25 bp, Mus musculus
aggaaatcatgcacttccagaactg

SEQ ID NO: 532411 - DNA, 25 bp, Mus musculus
aggaaatcatgctcttccagaactg

SEQ ID NO: 532412 - DNA, 25 bp, Mus musculus
aggaaatgaatcagctgccgacgcc

SEQ ID NO: 532413 - DNA, 25 bp, Mus musculus
aggaaatgaatctgctgccgacgcc

SEQ ID NO: 532414 - DNA, 25 bp, Mus musculus
aggaaatgctgaaagttcttcttct

SEQ ID NO: 532415 - DNA, 25 bp, Mus musculus
aggaaatgctgatagttcttcttct

SEQ ID NO: 532416 - DNA, 25 bp, Mus musculus
aggaaatggtccacacagattccaa

SEQ ID NO: 532417 - DNA, 25 bp, Mus musculus
aggaaatggtcctcacagattccaa

SEQ ID NO: 532418 - DNA, 25 bp, Mus musculus
aggaaattacctagatgatgctctt

SEQ ID NO: 532419 - DNA, 25 bp, Mus musculus
aggaaattaccttgatgatgctctt

SEQ ID NO: 532420 - DNA, 25 bp, Mus musculus
aggaaattcattcaggccgcccaga

SEQ ID NO: 532421 - DNA, 25 bp, Mus musculus
aggaaattcattgaggccgcccaga

SEQ ID NO: 532422 - DNA, 25 bp, Mus musculus
aggaaattgaggaagttcacagtga

SEQ ID NO: 532423 - DNA, 25 bp, Mus musculus
aggaaattgaggtagttcacagtga

SEQ ID NO: 532424 - DNA, 25 bp, Mus musculus
aggaacaaacagctagccatgggca

SEQ ID NO: 532425 - DNA, 25 bp, Mus musculus
aggaacaaacaggtagccatgggca

SEQ ID NO: 532426 - DNA, 25 bp, Mus musculus
aggaacaaggcaacctgccaagaca

SEQ ID NO: 532427 - DNA, 25 bp, Mus musculus
aggaacaaggcatcctgccaagaca

SEQ ID NO: 532428 - DNA, 25 bp, Mus musculus
aggaacacagccctcagatcatcac

SEQ ID NO: 532429 - DNA, 25 bp, Mus musculus
aggaacacagccgtcagatcatcac

SEQ ID NO: 532430 - DNA, 25 bp, Mus musculus
aggaacacatagcaggtaaatgaga

SEQ ID NO: 532431 - DNA, 25 bp, Mus musculus
aggaacacataggaggtaaatgaga

SEQ ID NO: 532432 - DNA, 25 bp, Mus musculus
aggaacaccactcctctacgctgtg

SEQ ID NO: 532433 - DNA, 25 bp, Mus musculus
aggaacaccactgctctacgctgtg

SEQ ID NO: 532434 - DNA, 25 bp, Mus musculus
aggaacacgcttcacagagaccaag

SEQ ID NO: 532435 - DNA, 25 bp, Mus musculus
aggaacacgcttgacagagaccaag

SEQ ID NO: 532436 - DNA, 25 bp, Mus musculus
aggaacagcaccagggtgtccagcc

SEQ ID NO: 532437 - DNA, 25 bp, Mus musculus
aggaacagcacctgggtgtccagcc

SEQ ID NO: 532438 - DNA, 25 bp, Mus musculus
aggaacagcgaaccgtccagtggct

SEQ ID NO: 532439 - DNA, 25 bp, Mus musculus
aggaacagcgaagcgtccagtggct

SEQ ID NO: 532440 - DNA, 25 bp, Mus musculus
aggaacagctcaaccccaacttggc

SEQ ID NO: 532441 - DNA, 25 bp, Mus musculus
aggaacagctcatccccaacttggc

SEQ ID NO: 532442 - DNA, 25 bp, Mus musculus
aggaacataattcggaaatgggcaa

SEQ ID NO: 532443 - DNA, 25 bp, Mus musculus
aggaacataattgggaaatgggcaa

SEQ ID NO: 532444 - DNA, 25 bp, Mus musculus
aggaacatgaagaggcagagaacat

SEQ ID NO: 532445 - DNA, 25 bp, Mus musculus
aggaacatgaagtggcagagaacat

SEQ ID NO: 532446 - DNA, 25 bp, Mus musculus
aggaaccaagagaacagactttaag

SEQ ID NO: 532447 - DNA, 25 bp, Mus musculus
aggaaccaagagtacagactttaag

SEQ ID NO: 532448 - DNA, 25 bp, Mus musculus
aggaaccacggcctacactgtccaa

SEQ ID NO: 532449 - DNA, 25 bp, Mus musculus
aggaaccacggcgtacactgtccaa

SEQ ID NO: 532450 - DNA, 25 bp, Mus musculus
aggaaccagactccactgccaagac

SEQ ID NO: 532451 - DNA, 25 bp, Mus musculus
aggaaccagactgcactgccaagac

SEQ ID NO: 532452 - DNA, 25 bp, Mus musculus
aggaaccagcacaggaaaccaaggg

SEQ ID NO: 532453 - DNA, 25 bp, Mus musculus
aggaaccagcactggaaaccaaggg

SEQ ID NO: 532454 - DNA, 25 bp, Mus musculus
aggaaccagccccttcttaggatgc

SEQ ID NO: 532455 - DNA, 25 bp, Mus musculus
aggaaccagcccgttcttaggatgc

SEQ ID NO: 532456 - DNA, 25 bp, Mus musculus
aggaaccatcaccttggagctttta

SEQ ID NO: 532457 - DNA, 25 bp, Mus musculus
aggaaccatcacgttggagctttta

SEQ ID NO: 532458 - DNA, 25 bp, Mus musculus
aggaacccacgacctggtgaagaag

SEQ ID NO: 532459 - DNA, 25 bp, Mus musculus
aggaacccacgagctggtgaagaag

SEQ ID NO: 532460 - DNA, 25 bp, Mus musculus
aggaacccagctctggatcgcctgt

SEQ ID NO: 532461 - DNA, 25 bp, Mus musculus
aggaacccagctgtggatcgcctgt

SEQ ID NO: 532462 - DNA, 25 bp, Mus musculus
aggaaccgcccaacatggcatcaga

SEQ ID NO: 532463 - DNA, 25 bp, Mus musculus
aggaaccgcccatcatggcatcaga

SEQ ID NO: 532464 - DNA, 25 bp, Mus musculus
aggaaccgggacctcttgtcagaga

SEQ ID NO: 532465 - DNA, 25 bp, Mus musculus
aggaaccgggacgtcttgtcagaga

SEQ ID NO: 532466 - DNA, 25 bp, Mus musculus
aggaacctcatcagcacccattgct

SEQ ID NO: 532467 - DNA, 25 bp, Mus musculus
aggaacctcatctgcacccattgct

SEQ ID NO: 532468 - DNA, 25 bp, Mus musculus
aggaaccttcatagtgattgacatc

SEQ ID NO: 532469 - DNA, 25 bp, Mus musculus
aggaaccttcattgtgattgacatc

SEQ ID NO: 532470 - DNA, 25 bp, Mus musculus
aggaacctttcacaacagccattac

SEQ ID NO: 532471 - DNA, 25 bp, Mus musculus
aggaacctttcagaacagccattac

SEQ ID NO: 532472 - DNA, 25 bp, Mus musculus
aggaacgctgaccaccaaccgcatg

SEQ ID NO: 532473 - DNA, 25 bp, Mus musculus
aggaacgctgacgaccaaccgcatg

SEQ ID NO: 532474 - DNA, 25 bp, Mus musculus
aggaacgtctggagcgccagcactg

SEQ ID NO: 532475 - DNA, 25 bp, Mus musculus
aggaacgtctggtgcgccagcactg

SEQ ID NO: 532476 - DNA, 25 bp, Mus musculus
aggaactataccacgcccacaagga

SEQ ID NO: 532477 - DNA, 25 bp, Mus musculus
aggaactatacctcgcccacaagga

SEQ ID NO: 532478 - DNA, 25 bp, Mus musculus
aggaactccacacttataacatttg

SEQ ID NO: 532479 - DNA, 25 bp, Mus musculus
aggaactccacagttataacatttg

SEQ ID NO: 532480 - DNA, 25 bp, Mus musculus
aggaactgactcaaaacaaaggcca

SEQ ID NO: 532481 - DNA, 25 bp, Mus musculus
aggaactgactctaaacaaaggcca

SEQ ID NO: 532482 - DNA, 25 bp, Mus musculus
aggaactggcaacacaaccagcatc

SEQ ID NO: 532483 - DNA, 25 bp, Mus musculus
aggaactggcaagacaaccagcatc

SEQ ID NO: 532484 - DNA, 25 bp, Mus musculus
aggaactggccgacgctgtcctggc

SEQ ID NO: 532485 - DNA, 25 bp, Mus musculus
aggaactggccgtcgctgtcctggc

SEQ ID NO: 532486 - DNA, 25 bp, Mus musculus
aggaacttcatccaaactgaagctg

SEQ ID NO: 532487 - DNA, 25 bp, Mus musculus
aggaacttcatcgaaactgaagctg

SEQ ID NO: 532488 - DNA, 25 bp, Mus musculus
aggaacttcgtgcagtatgcctgct

SEQ ID NO: 532489 - DNA, 25 bp, Mus musculus
aggaacttcgtggagtatgcctgct

SEQ ID NO: 532490 - DNA, 25 bp, Mus musculus
aggaagaaatgccacaatcaaagag

SEQ ID NO: 532491 - DNA, 25 bp, Mus musculus
aggaagaaatgcgacaatcaaagag

SEQ ID NO: 532492 - DNA, 25 bp, Mus musculus
aggaagaagaccaacccatccctgc

SEQ ID NO: 532493 - DNA, 25 bp, Mus musculus
aggaagaagacctacccatccctgc

SEQ ID NO: 532494 - DNA, 25 bp, Mus musculus
aggaagaagggcacgacctgaagct

SEQ ID NO: 532495 - DNA, 25 bp, Mus musculus
aggaagaagggctcgacctgaagct

SEQ ID NO: 532496 - DNA, 25 bp, Mus musculus
aggaagaatggaactcagcgcccaa

SEQ ID NO: 532497 - DNA, 25 bp, Mus musculus
aggaagaatggatctcagcgcccaa

SEQ ID NO: 532498 - DNA, 25 bp, Mus musculus
aggaagaatggcaccacgtgggccc

SEQ ID NO: 532499 - DNA, 25 bp, Mus musculus
aggaagaatggctccacgtgggccc

SEQ ID NO: 532500 - DNA, 25 bp, Mus musculus
aggaagacctcacgtggacaacagc

SEQ ID NO: 532501 - DNA, 25 bp, Mus musculus
aggaagacctcaggtggacaacagc

SEQ ID NO: 532502 - DNA, 25 bp, Mus musculus
aggaagacgactccacctgcacctt

SEQ ID NO: 532503 - DNA, 25 bp, Mus musculus
aggaagacgactcgagacatgagtt

SEQ ID NO: 532504 - DNA, 25 bp, Mus musculus
aggaagacgactgcacctgcacctt

SEQ ID NO: 532505 - DNA, 25 bp, Mus musculus
aggaagacgactggagacatgagtt

SEQ ID NO: 532506 - DNA, 25 bp, Mus musculus
aggaagacgtggaccagccatcggc

SEQ ID NO: 532507 - DNA, 25 bp, Mus musculus
aggaagacgtggtccagccatcggc

SEQ ID NO: 532508 - DNA, 25 bp, Mus musculus
aggaagactatgacaaggacgggat

SEQ ID NO: 532509 - DNA, 25 bp, Mus musculus
aggaagactatgtcaaggacgggat

SEQ ID NO: 532510 - DNA, 25 bp, Mus musculus
aggaagactgacaccctccacactt

SEQ ID NO: 532511 - DNA, 25 bp, Mus musculus
aggaagactgacagggagcccagga

SEQ ID NO: 532512 - DNA, 25 bp, Mus musculus
aggaagactgactccctccacactt

SEQ ID NO: 532513 - DNA, 25 bp, Mus musculus
aggaagactgactgggagcccagga

SEQ ID NO: 532514 - DNA, 25 bp, Mus musculus
aggaagactggaacaaatgcatcaa

SEQ ID NO: 532515 - DNA, 25 bp, Mus musculus
aggaagactggatcaaatgcatcaa

SEQ ID NO: 532516 - DNA, 25 bp, Mus musculus
aggaagagaacgaccacctgcgaga

SEQ ID NO: 532517 - DNA, 25 bp, Mus musculus
aggaagagaacgtccacctgcgaga

SEQ ID NO: 532518 - DNA, 25 bp, Mus musculus
aggaagagaattctgttgttctaca

SEQ ID NO: 532519 - DNA, 25 bp, Mus musculus
aggaagagaattgtgttgttctaca

SEQ ID NO: 532520 - DNA, 25 bp, Mus musculus
aggaagagactcaggaaccgggcct

SEQ ID NO: 532521 - DNA, 25 bp, Mus musculus
aggaagagactctggaaccgggcct

SEQ ID NO: 532522 - DNA, 25 bp, Mus musculus
aggaagagagatcagcccatgccgt

SEQ ID NO: 532523 - DNA, 25 bp, Mus musculus
aggaagagagatgagcccatgccgt

SEQ ID NO: 532524 - DNA, 25 bp, Mus musculus
aggaagagaggacgcgagcccagga

SEQ ID NO: 532525 - DNA, 25 bp, Mus musculus
aggaagagaggaggcgagcccagga

SEQ ID NO: 532526 - DNA, 25 bp, Mus musculus
aggaagagggcgctgtgtcaacagt

SEQ ID NO: 532527 - DNA, 25 bp, Mus musculus
aggaagagggcggtgtgtcaacagt

SEQ ID NO: 532528 - DNA, 25 bp, Mus musculus
aggaagatcccgaagctcacagtga

SEQ ID NO: 532529 - DNA, 25 bp, Mus musculus
aggaagatcccgtagctcacagtga

SEQ ID NO: 532530 - DNA, 25 bp, Mus musculus
aggaagatgaagactttcaggagtc

SEQ ID NO: 532531 - DNA, 25 bp, Mus musculus
aggaagatgaagtctttcaggagtc

SEQ ID NO: 532532 - DNA, 25 bp, Mus musculus
aggaagatgcacatatctgctttga

SEQ ID NO: 532533 - DNA, 25 bp, Mus musculus
aggaagatgcacttatctgctttga

SEQ ID NO: 532534 - DNA, 25 bp, Mus musculus
aggaagatgccaattattggacgta

SEQ ID NO: 532535 - DNA, 25 bp, Mus musculus
aggaagatgccatttattggacgta

SEQ ID NO: 532536 - DNA, 25 bp, Mus musculus
aggaagatggaccagactccgacga

SEQ ID NO: 532537 - DNA, 25 bp, Mus musculus
aggaagatggacgagactccgacga

SEQ ID NO: 532538 - DNA, 25 bp, Mus musculus
aggaagatgtataccgaggcccagc

SEQ ID NO: 532539 - DNA, 25 bp, Mus musculus
aggaagatgtattccgaggcccagc

SEQ ID NO: 532540 - DNA, 25 bp, Mus musculus
aggaagatttacacccagatccaga

SEQ ID NO: 532541 - DNA, 25 bp, Mus musculus
aggaagatttactcccagatccaga

SEQ ID NO: 532542 - DNA, 25 bp, Mus musculus
aggaagcacaggaggaagagttttc

SEQ ID NO: 532543 - DNA, 25 bp, Mus musculus
aggaagcacaggtggaagagttttc

SEQ ID NO: 532544 - DNA, 25 bp, Mus musculus
aggaagcacatccacaactgcttct

SEQ ID NO: 532545 - DNA, 25 bp, Mus musculus
aggaagcacatcgacaactgcttct

SEQ ID NO: 532546 - DNA, 25 bp, Mus musculus
aggaagcagggcattctctggagct

SEQ ID NO: 532547 - DNA, 25 bp, Mus musculus
aggaagcagggctttctctggagct

SEQ ID NO: 532548 - DNA, 25 bp, Mus musculus
aggaagcagtgcagggcccctgcct

SEQ ID NO: 532549 - DNA, 25 bp, Mus musculus
aggaagcagtgctgggcccctgcct

SEQ ID NO: 532550 - DNA, 25 bp, Mus musculus
aggaagcatcccagtttgaacaaga

SEQ ID NO: 532551 - DNA, 25 bp, Mus musculus
aggaagcatccctgtttgaacaaga

SEQ ID NO: 532552 - DNA, 25 bp, Mus musculus
aggaagccaaacaacagcatccaga

SEQ ID NO: 532553 - DNA, 25 bp, Mus musculus
aggaagccaaactacagcatccaga

SEQ ID NO: 532554 - DNA, 25 bp, Mus musculus
aggaagccaagcagcccaagaatga

SEQ ID NO: 532555 - DNA, 25 bp, Mus musculus
aggaagccaagctgcccaagaatga

SEQ ID NO: 532556 - DNA, 25 bp, Mus musculus
aggaagcccgacaccatcgaggtgc

SEQ ID NO: 532557 - DNA, 25 bp, Mus musculus
aggaagcccgactccatcgaggtgc

SEQ ID NO: 532558 - DNA, 25 bp, Mus musculus
aggaagcccgccagtccaagcagct

SEQ ID NO: 532559 - DNA, 25 bp, Mus musculus
aggaagcccgcctgtccaagcagct

SEQ ID NO: 532560 - DNA, 25 bp, Mus musculus
aggaagccctcaacacagtgaaagg

SEQ ID NO: 532561 - DNA, 25 bp, Mus musculus
aggaagccctcatcacagtgaaagg

SEQ ID NO: 532562 - DNA, 25 bp, Mus musculus
aggaagccgtttcaaggaccagaca

SEQ ID NO: 532563 - DNA, 25 bp, Mus musculus
aggaagccgtttgaaggaccagaca

SEQ ID NO: 532564 - DNA, 25 bp, Mus musculus
aggaagcctagactggagacaaaga

SEQ ID NO: 532565 - DNA, 25 bp, Mus musculus
aggaagcctagagtggagacaaaga

SEQ ID NO: 532566 - DNA, 25 bp, Mus musculus
aggaagcctggaattcttgcccgca

SEQ ID NO: 532567 - DNA, 25 bp, Mus musculus
aggaagcctggatttcttgcccgca

SEQ ID NO: 532568 - DNA, 25 bp, Mus musculus
aggaagcgcgctccggagctagcag

SEQ ID NO: 532569 - DNA, 25 bp, Mus musculus
aggaagcgcgctgcggagctagcag

SEQ ID NO: 532570 - DNA, 25 bp, Mus musculus
aggaagcggcatctagagactcccc

SEQ ID NO: 532571 - DNA, 25 bp, Mus musculus
aggaagcggcatgtagagactcccc

SEQ ID NO: 532572 - DNA, 25 bp, Mus musculus
aggaagcggctgcatttatgatgac

SEQ ID NO: 532573 - DNA, 25 bp, Mus musculus
aggaagcggctggatttatgatgac

SEQ ID NO: 532574 - DNA, 25 bp, Mus musculus
aggaagcggtgcagtctcatgctat

SEQ ID NO: 532575 - DNA, 25 bp, Mus musculus
aggaagcggtgctgtctcatgctat

SEQ ID NO: 532576 - DNA, 25 bp, Mus musculus
aggaagctccgcacatcaggctctc

SEQ ID NO: 532577 - DNA, 25 bp, Mus musculus
aggaagctccgctcatcaggctctc

SEQ ID NO: 532578 - DNA, 25 bp, Mus musculus
aggaagctctctctgtggatacgga

SEQ ID NO: 532579 - DNA, 25 bp, Mus musculus
aggaagctctctgtgtggatacgga

SEQ ID NO: 532580 - DNA, 25 bp, Mus musculus
aggaagcttgaaaccctgcatagag

SEQ ID NO: 532581 - DNA, 25 bp, Mus musculus
aggaagcttgaatccctgcatagag

SEQ ID NO: 532582 - DNA, 25 bp, Mus musculus
aggaaggaactgctgtagcctagct

SEQ ID NO: 532583 - DNA, 25 bp, Mus musculus
aggaaggaactggtgtagcctagct

SEQ ID NO: 532584 - DNA, 25 bp, Mus musculus
aggaaggaacttcaggccgaagcca

SEQ ID NO: 532585 - DNA, 25 bp, Mus musculus
aggaaggaacttgaggccgaagcca

SEQ ID NO: 532586 - DNA, 25 bp, Mus musculus
aggaaggaccagacatctgtgggaa

SEQ ID NO: 532587 - DNA, 25 bp, Mus musculus
aggaaggaccagtcatctgtgggaa

SEQ ID NO: 532588 - DNA, 25 bp, Mus musculus
aggaaggcgctcatgactctgctga

SEQ ID NO: 532589 - DNA, 25 bp, Mus musculus
aggaaggcgctcttgactctgctga

SEQ ID NO: 532590 - DNA, 25 bp, Mus musculus
aggaaggcgtgacacccaagaagca

SEQ ID NO: 532591 - DNA, 25 bp, Mus musculus
aggaaggcgtgagacccaagaagca

SEQ ID NO: 532592 - DNA, 25 bp, Mus musculus
aggaaggcttgcagtaccgagcccg

SEQ ID NO: 532593 - DNA, 25 bp, Mus musculus
aggaaggcttgctgtaccgagcccg

SEQ ID NO: 532594 - DNA, 25 bp, Mus musculus
aggaagggaccccatgagccagctt

SEQ ID NO: 532595 - DNA, 25 bp, Mus musculus
aggaagggacccgatgagccagctt

SEQ ID NO: 532596 - DNA, 25 bp, Mus musculus
aggaaggtccacatcgacacccagg

SEQ ID NO: 532597 - DNA, 25 bp, Mus musculus
aggaaggtccacttcgacacccagg

SEQ ID NO: 532598 - DNA, 25 bp, Mus musculus
aggaaggtccccaaccactacattg

SEQ ID NO: 532599 - DNA, 25 bp, Mus musculus
aggaaggtcccctaccactacattg

SEQ ID NO: 532600 - DNA, 25 bp, Mus musculus
aggaaggtgtcaaagtcggagatct

SEQ ID NO: 532601 - DNA, 25 bp, Mus musculus
aggaaggtgtcatagtcggagatct

SEQ ID NO: 532602 - DNA, 25 bp, Mus musculus
aggaagtatacccaggagcaggccc

SEQ ID NO: 532603 - DNA, 25 bp, Mus musculus
aggaagtataccgaggagcaggccc

SEQ ID NO: 532604 - DNA, 25 bp, Mus musculus
aggaagtcaagactcaccccttctt

SEQ ID NO: 532605 - DNA, 25 bp, Mus musculus
aggaagtcaagagtcaccccttctt

SEQ ID NO: 532606 - DNA, 25 bp, Mus musculus
aggaagtcagtcagtttccatctga

SEQ ID NO: 532607 - DNA, 25 bp, Mus musculus
aggaagtcagtctgtttccatctga

SEQ ID NO: 532608 - DNA, 25 bp, Mus musculus
aggaagtcgttcagggcaaaggcca

SEQ ID NO: 532609 - DNA, 25 bp, Mus musculus
aggaagtcgttctgggcaaaggcca

SEQ ID NO: 532610 - DNA, 25 bp, Mus musculus
aggaagtctcggctgggtagacatc

SEQ ID NO: 532611 - DNA, 25 bp, Mus musculus
aggaagtctcgggtgggtagacatc

SEQ ID NO: 532612 - DNA, 25 bp, Mus musculus
aggaagtgaaaaagtggtgccccga

SEQ ID NO: 532613 - DNA, 25 bp, Mus musculus
aggaagtgaaaatgtggtgccccga

SEQ ID NO: 532614 - DNA, 25 bp, Mus musculus
aggaagtgacataagccccaggagc

SEQ ID NO: 532615 - DNA, 25 bp, Mus musculus
aggaagtgacattagccccaggagc

SEQ ID NO: 532616 - DNA, 25 bp, Mus musculus
aggaatatagccaaccccacagcca

SEQ ID NO: 532617 - DNA, 25 bp, Mus musculus
aggaatatagcctaccccacagcca

SEQ ID NO: 532618 - DNA, 25 bp, Mus musculus
aggaatccaaaaagctacaaagaag

SEQ ID NO: 532619 - DNA, 25 bp, Mus musculus
aggaatccaaaatgctacaaagaag

SEQ ID NO: 532620 - DNA, 25 bp, Mus musculus
aggaatccattcaatgcgtgcctgg

SEQ ID NO: 532621 - DNA, 25 bp, Mus musculus
aggaatccattctatgcgtgcctgg

SEQ ID NO: 532622 - DNA, 25 bp, Mus musculus
aggaatcttggacgcggcccacgca

SEQ ID NO: 532623 - DNA, 25 bp, Mus musculus
aggaatcttggaggcggcccacgca

SEQ ID NO: 532624 - DNA, 25 bp, Mus musculus
aggaatgagccacgcggctaccatc

SEQ ID NO: 532625 - DNA, 25 bp, Mus musculus
aggaatgagccaggcggctaccatc

SEQ ID NO: 532626 - DNA, 25 bp, Mus musculus
aggaatggatcaatgagatgcttcc

SEQ ID NO: 532627 - DNA, 25 bp, Mus musculus
aggaatggatcattgagatgcttcc

SEQ ID NO: 532628 - DNA, 25 bp, Mus musculus
aggaatggttatcaatttgaccgac

SEQ ID NO: 532629 - DNA, 25 bp, Mus musculus
aggaatggttatgaatttgaccgac

SEQ ID NO: 532630 - DNA, 25 bp, Mus musculus
aggaatggttcaccctggtcaacaa

SEQ ID NO: 532631 - DNA, 25 bp, Mus musculus
aggaatggttcagcctggtcaacaa

SEQ ID NO: 532632 - DNA, 25 bp, Mus musculus
aggaatgtcacaccgtctggagtca

SEQ ID NO: 532633 - DNA, 25 bp, Mus musculus
aggaatgtcacagcgtctggagtca

SEQ ID NO: 532634 - DNA, 25 bp, Mus musculus
aggaatgtgctcagcgctcccggaa

SEQ ID NO: 532635 - DNA, 25 bp, Mus musculus
aggaatgtgctcatctgcgagggca

SEQ ID NO: 532636 - DNA, 25 bp, Mus musculus
aggaatgtgctctgcgctcccggaa

SEQ ID NO: 532637 - DNA, 25 bp, Mus musculus
aggaatgtgctcttctgcgagggca

SEQ ID NO: 532638 - DNA, 25 bp, Mus musculus
aggaattggatgaactccctgggcg

SEQ ID NO: 532639 - DNA, 25 bp, Mus musculus
aggaattggatgtactccctgggcg

SEQ ID NO: 532640 - DNA, 25 bp, Mus musculus
aggaatttccaccactccagccgat

SEQ ID NO: 532641 - DNA, 25 bp, Mus musculus
aggaatttccacgactccagccgat

SEQ ID NO: 532642 - DNA, 25 bp, Mus musculus
aggaatttgccaaacaaaatcacag

SEQ ID NO: 532643 - DNA, 25 bp, Mus musculus
aggaatttgccatacaaaatcacag

SEQ ID NO: 532644 - DNA, 25 bp, Mus musculus
aggaatttgtgcctactgtgactca

SEQ ID NO: 532645 - DNA, 25 bp, Mus musculus
aggaatttgtgcgtactgtgactca

SEQ ID NO: 532646 - DNA, 25 bp, Mus musculus
aggacaaatataaccatgccttcgt

SEQ ID NO: 532647 - DNA, 25 bp, Mus musculus
aggacaaatatatccatgccttcgt

SEQ ID NO: 532648 - DNA, 25 bp, Mus musculus
aggacaacaaacatttcctgacagg

SEQ ID NO: 532649 - DNA, 25 bp, Mus musculus
aggacaacaaacttttcctgacagg

SEQ ID NO: 532650 - DNA, 25 bp, Mus musculus
aggacaacatctacaaaggactgca

SEQ ID NO: 532651 - DNA, 25 bp, Mus musculus
aggacaacatcttcaaaggactgca

SEQ ID NO: 532652 - DNA, 25 bp, Mus musculus
aggacaacgactacggccgtgcagt

SEQ ID NO: 532653 - DNA, 25 bp, Mus musculus
aggacaacgacttcggccgtgcagt

SEQ ID NO: 532654 - DNA, 25 bp, Mus musculus
aggacaacgcacagtcgtgggagta

SEQ ID NO: 532655 - DNA, 25 bp, Mus musculus
aggacaacgcactgtcgtgggagta

SEQ ID NO: 532656 - DNA, 25 bp, Mus musculus
aggacaactatgagaggaccacgcc

SEQ ID NO: 532657 - DNA, 25 bp, Mus musculus
aggacaactatgtgaggaccacgcc

SEQ ID NO: 532658 - DNA, 25 bp, Mus musculus
aggacaactcgacatgagaaacgga

SEQ ID NO: 532659 - DNA, 25 bp, Mus musculus
aggacaactcgagatgagaaacgga

SEQ ID NO: 532660 - DNA, 25 bp, Mus musculus
aggacaactgcccctgtcaccatgg

SEQ ID NO: 532661 - DNA, 25 bp, Mus musculus
aggacaactgccgctgtcaccatgg

SEQ ID NO: 532662 - DNA, 25 bp, Mus musculus
aggacaagacctaggcaagggccag

SEQ ID NO: 532663 - DNA, 25 bp, Mus musculus
aggacaagaccttggcaagggccag

SEQ ID NO: 532664 - DNA, 25 bp, Mus musculus
aggacaagtacacagtgcaactttg

SEQ ID NO: 532665 - DNA, 25 bp, Mus musculus
aggacaagtacagagtgcaactttg

SEQ ID NO: 532666 - DNA, 25 bp, Mus musculus
aggacaatggagaccggagctcgcc

SEQ ID NO: 532667 - DNA, 25 bp, Mus musculus
aggacaatggagtccggagctcgcc

SEQ ID NO: 532668 - DNA, 25 bp, Mus musculus
aggacaatgtgacaagtgtcaccca

SEQ ID NO: 532669 - DNA, 25 bp, Mus musculus
aggacaatgtgagaagtgtcaccca

SEQ ID NO: 532670 - DNA, 25 bp, Mus musculus
aggacacacgtgacggaatggaatc

SEQ ID NO: 532671 - DNA, 25 bp, Mus musculus
aggacacacgtgtcggaatggaatc

SEQ ID NO: 532672 - DNA, 25 bp, Mus musculus
aggacacagaggaggtctttcgaag

SEQ ID NO: 532673 - DNA, 25 bp, Mus musculus
aggacacagaggtggtctttcgaag

SEQ ID NO: 532674 - DNA, 25 bp, Mus musculus
aggacacagccaatcgcctgcgcat

SEQ ID NO: 532675 - DNA, 25 bp, Mus musculus
aggacacagccattcgcctgcgcat

SEQ ID NO: 532676 - DNA, 25 bp, Mus musculus
aggacacaggctatctccctccggt

SEQ ID NO: 532677 - DNA, 25 bp, Mus musculus
aggacacaggctttctccctccggt

SEQ ID NO: 532678 - DNA, 25 bp, Mus musculus
aggacacatcggaggagaagctcaa

SEQ ID NO: 532679 - DNA, 25 bp, Mus musculus
aggacacatcggtggagaagctcaa

SEQ ID NO: 532680 - DNA, 25 bp, Mus musculus
aggacaccatgcagaggagtccaca

SEQ ID NO: 532681 - DNA, 25 bp, Mus musculus
aggacaccatgctgaggagtccaca

SEQ ID NO: 532682 - DNA, 25 bp, Mus musculus
aggacaccgggcatgctcggtcgcc

SEQ ID NO: 532683 - DNA, 25 bp, Mus musculus
aggacaccgggcttgctcggtcgcc

SEQ ID NO: 532684 - DNA, 25 bp, Mus musculus
aggacacgtccacaggcgtccactg

SEQ ID NO: 532685 - DNA, 25 bp, Mus musculus
aggacacgtccagaggcgtccactg

SEQ ID NO: 532686 - DNA, 25 bp, Mus musculus
aggacactaggaccccatcccagaa

SEQ ID NO: 532687 - DNA, 25 bp, Mus musculus
aggacactaggagcccatcccagaa

SEQ ID NO: 532688 - DNA, 25 bp, Mus musculus
aggacactctccaacaatagggacg

SEQ ID NO: 532689 - DNA, 25 bp, Mus musculus
aggacactctcctacaatagggacg

SEQ ID NO: 532690 - DNA, 25 bp, Mus musculus
aggacagacggtcttctatacctgt

SEQ ID NO: 532691 - DNA, 25 bp, Mus musculus
aggacagacggtgttctatacctgt

SEQ ID NO: 532692 - DNA, 25 bp, Mus musculus
aggacagaggcacctttgtcaccac

SEQ ID NO: 532693 - DNA, 25 bp, Mus musculus
aggacagaggcagctttgtcaccac

SEQ ID NO: 532694 - DNA, 25 bp, Mus musculus
aggacagagtgtcctccccagagcc

SEQ ID NO: 532695 - DNA, 25 bp, Mus musculus
aggacagagtgtgctccccagagcc

SEQ ID NO: 532696 - DNA, 25 bp, Mus musculus
aggacagcagacaggaagtggcctc

SEQ ID NO: 532697 - DNA, 25 bp, Mus musculus
aggacagcagactggaagtggcctc

SEQ ID NO: 532698 - DNA, 25 bp, Mus musculus
aggacagcatctaccagcacctgct

SEQ ID NO: 532699 - DNA, 25 bp, Mus musculus
aggacagcatcttccagcacctgct

SEQ ID NO: 532700 - DNA, 25 bp, Mus musculus
aggacagcctccaggctgccgacga

SEQ ID NO: 532701 - DNA, 25 bp, Mus musculus
aggacagcctcctggctgccgacga

SEQ ID NO: 532702 - DNA, 25 bp, Mus musculus
aggacagcgccccagtctatgagaa

SEQ ID NO: 532703 - DNA, 25 bp, Mus musculus
aggacagcgcccgagtctatgagaa

SEQ ID NO: 532704 - DNA, 25 bp, Mus musculus
aggacaggaggacccctgctaagtt

SEQ ID NO: 532705 - DNA, 25 bp, Mus musculus
aggacaggaggagccctgctaagtt

SEQ ID NO: 532706 - DNA, 25 bp, Mus musculus
aggacaggcaaccagaagccaggca

SEQ ID NO: 532707 - DNA, 25 bp, Mus musculus
aggacaggcaacgagaagccaggca

SEQ ID NO: 532708 - DNA, 25 bp, Mus musculus
aggacagggcctattgactatcacc

SEQ ID NO: 532709 - DNA, 25 bp, Mus musculus
aggacagggccttttgactatcacc

SEQ ID NO: 532710 - DNA, 25 bp, Mus musculus
aggacagggtcacggcagctcatct

SEQ ID NO: 532711 - DNA, 25 bp, Mus musculus
aggacagggtcagggcagctcatct

SEQ ID NO: 532712 - DNA, 25 bp, Mus musculus
aggacagtacctccatcttgttttc

SEQ ID NO: 532713 - DNA, 25 bp, Mus musculus
aggacagtacctgcatcttgttttc

SEQ ID NO: 532714 - DNA, 25 bp, Mus musculus
aggacagtctccctgctgccgacag

SEQ ID NO: 532715 - DNA, 25 bp, Mus musculus
aggacagtctccgtgctgccgacag

SEQ ID NO: 532716 - DNA, 25 bp, Mus musculus
aggacagtgacactaaggactctca

SEQ ID NO: 532717 - DNA, 25 bp, Mus musculus
aggacagtgacagtaaggactctca

SEQ ID NO: 532718 - DNA, 25 bp, Mus musculus
aggacagtgtaccacccctgcacag

SEQ ID NO: 532719 - DNA, 25 bp, Mus musculus
aggacagtgtacgacccctgcacag

SEQ ID NO: 532720 - DNA, 25 bp, Mus musculus
aggacagtgtgaacccggcagacag

SEQ ID NO: 532721 - DNA, 25 bp, Mus musculus
aggacagtgtgatcccggcagacag

SEQ ID NO: 532722 - DNA, 25 bp, Mus musculus
aggacagttccacgcccggacagca

SEQ ID NO: 532723 - DNA, 25 bp, Mus musculus
aggacagttccaggcccggacagca

SEQ ID NO: 532724 - DNA, 25 bp, Mus musculus
aggacagttggaccagagcattgaa

SEQ ID NO: 532725 - DNA, 25 bp, Mus musculus
aggacagttggagcagagcattgaa

SEQ ID NO: 532726 - DNA, 25 bp, Mus musculus
aggacagtttggaaccagtggaaat

SEQ ID NO: 532727 - DNA, 25 bp, Mus musculus
aggacagtttggtaccagtggaaat

SEQ ID NO: 532728 - DNA, 25 bp, Mus musculus
aggacagtttgtacaccgaaggaat

SEQ ID NO: 532729 - DNA, 25 bp, Mus musculus
aggacagtttgttcaccgaaggaat

SEQ ID NO: 532730 - DNA, 25 bp, Mus musculus
aggacatcagtgaggatccccgctg

SEQ ID NO: 532731 - DNA, 25 bp, Mus musculus
aggacatcagtgtggatccccgctg

SEQ ID NO: 532732 - DNA, 25 bp, Mus musculus
aggacatcatcaaatctgtaccagg

SEQ ID NO: 532733 - DNA, 25 bp, Mus musculus
aggacatcatcatatctgtaccagg

SEQ ID NO: 532734 - DNA, 25 bp, Mus musculus
aggacatgattaatgaggtggatgc

SEQ ID NO: 532735 - DNA, 25 bp, Mus musculus
aggacatgattattgaggtggatgc

SEQ ID NO: 532736 - DNA, 25 bp, Mus musculus
aggacatggaagacagagggcttaa

SEQ ID NO: 532737 - DNA, 25 bp, Mus musculus
aggacatggaagtcagagggcttaa

SEQ ID NO: 532738 - DNA, 25 bp, Mus musculus
aggacatggctaagtttccttcagg

SEQ ID NO: 532739 - DNA, 25 bp, Mus musculus
aggacatggctatgtttccttcagg

SEQ ID NO: 532740 - DNA, 25 bp, Mus musculus
aggacattaggactcttcccacaga

SEQ ID NO: 532741 - DNA, 25 bp, Mus musculus
aggacattaggagtcttcccacaga

SEQ ID NO: 532742 - DNA, 25 bp, Mus musculus
aggacattgaacagagcattaagtc

SEQ ID NO: 532743 - DNA, 25 bp, Mus musculus
aggacattgaactgagcattaagtc

SEQ ID NO: 532744 - DNA, 25 bp, Mus musculus
aggacattgagcagtggctgtccac

SEQ ID NO: 532745 - DNA, 25 bp, Mus musculus
aggacattgagctgtggctgtccac

SEQ ID NO: 532746 - DNA, 25 bp, Mus musculus
aggacatttcttcaccctggctgac

SEQ ID NO: 532747 - DNA, 25 bp, Mus musculus
aggacatttcttgaccctggctgac

SEQ ID NO: 532748 - DNA, 25 bp, Mus musculus
aggaccaaccgaccgccaagtcagg

SEQ ID NO: 532749 - DNA, 25 bp, Mus musculus
aggaccaaccgagcgccaagtcagg

SEQ ID NO: 532750 - DNA, 25 bp, Mus musculus
aggaccaagaggaacccaagccaga

SEQ ID NO: 532751 - DNA, 25 bp, Mus musculus
aggaccaagaggtacccaagccaga

SEQ ID NO: 532752 - DNA, 25 bp, Mus musculus
aggaccaagatgaggacgccaccct

SEQ ID NO: 532753 - DNA, 25 bp, Mus musculus
aggaccaagatgtggacgccaccct

SEQ ID NO: 532754 - DNA, 25 bp, Mus musculus
aggaccagggacagccaggcctgca

SEQ ID NO: 532755 - DNA, 25 bp, Mus musculus
aggaccagggactgccaggcctgca

SEQ ID NO: 532756 - DNA, 25 bp, Mus musculus
aggacccaaacgaccacaccgtgtg

SEQ ID NO: 532757 - DNA, 25 bp, Mus musculus
aggacccaaacgtccacaccgtgtg

SEQ ID NO: 532758 - DNA, 25 bp, Mus musculus
aggacccacactctcagacaagaag

SEQ ID NO: 532759 - DNA, 25 bp, Mus musculus
aggacccacactgtcagacaagaag

SEQ ID NO: 532760 - DNA, 25 bp, Mus musculus
aggacccagaaacagcctaccaggg

SEQ ID NO: 532761 - DNA, 25 bp, Mus musculus
aggacccagaaagagcctaccaggg

SEQ ID NO: 532762 - DNA, 25 bp, Mus musculus
aggacccattatccagatgtgtttg

SEQ ID NO: 532763 - DNA, 25 bp, Mus musculus
aggacccattatgcagatgtgtttg

SEQ ID NO: 532764 - DNA, 25 bp, Mus musculus
aggaccccagtgctccaagacctgg

SEQ ID NO: 532765 - DNA, 25 bp, Mus musculus
aggaccccagtggtccaagacctgg

SEQ ID NO: 532766 - DNA, 25 bp, Mus musculus
aggacccgcctcacaacgtggataa

SEQ ID NO: 532767 - DNA, 25 bp, Mus musculus
aggacccgcctctcaacgtggataa

SEQ ID NO: 532768 - DNA, 25 bp, Mus musculus
aggacccgtgcgagcgttcagaagc

SEQ ID NO: 532769 - DNA, 25 bp, Mus musculus
aggacccgtgcgtgcgttcagaagc

SEQ ID NO: 532770 - DNA, 25 bp, Mus musculus
aggacccgtggacggctgccaaaat

SEQ ID NO: 532771 - DNA, 25 bp, Mus musculus
aggacccgtggagggctgccaaaat

SEQ ID NO: 532772 - DNA, 25 bp, Mus musculus
aggaccctgcaactggttgtgagct

SEQ ID NO: 532773 - DNA, 25 bp, Mus musculus
aggaccctgcaagtggttgtgagct

SEQ ID NO: 532774 - DNA, 25 bp, Mus musculus
aggaccctggctacagctgcggcag

SEQ ID NO: 532775 - DNA, 25 bp, Mus musculus
aggaccctggcttcagctgcggcag

SEQ ID NO: 532776 - DNA, 25 bp, Mus musculus
aggaccctgtaaaatgcctaagcct

SEQ ID NO: 532777 - DNA, 25 bp, Mus musculus
aggaccctgtaatatgcctaagcct

SEQ ID NO: 532778 - DNA, 25 bp, Mus musculus
aggaccctgtaccagttgtactgca

SEQ ID NO: 532779 - DNA, 25 bp, Mus musculus
aggaccctgtacgagttgtactgca

SEQ ID NO: 532780 - DNA, 25 bp, Mus musculus
aggaccggcccaacactatcaaaga

SEQ ID NO: 532781 - DNA, 25 bp, Mus musculus
aggaccggcccatcactatcaaaga

SEQ ID NO: 532782 - DNA, 25 bp, Mus musculus
aggaccgggtgcctcagaagaccat

SEQ ID NO: 532783 - DNA, 25 bp, Mus musculus
aggaccgggtgcgtcagaagaccat

SEQ ID NO: 532784 - DNA, 25 bp, Mus musculus
aggaccgtgacaactcctacctctg

SEQ ID NO: 532785 - DNA, 25 bp, Mus musculus
aggaccgtgacatctcctacctctg

SEQ ID NO: 532786 - DNA, 25 bp, Mus musculus
aggaccgtgcctatgccctgctggt

SEQ ID NO: 532787 - DNA, 25 bp, Mus musculus
aggaccgtgcctttgccctgctggt

SEQ ID NO: 532788 - DNA, 25 bp, Mus musculus
aggacctaaatcagcccaacgccgt

SEQ ID NO: 532789 - DNA, 25 bp, Mus musculus
aggacctaaatctgcccaacgccgt

SEQ ID NO: 532790 - DNA, 25 bp, Mus musculus
aggacctaggccagtagtgctgagc

SEQ ID NO: 532791 - DNA, 25 bp, Mus musculus
aggacctaggcctgtagtgctgagc

SEQ ID NO: 532792 - DNA, 25 bp, Mus musculus
aggacctcaacaagctcagccagca

SEQ ID NO: 532793 - DNA, 25 bp, Mus musculus
aggacctcaacacaaaatatttgga

SEQ ID NO: 532794 - DNA, 25 bp, Mus musculus
aggacctcaacagaaaatatttgga

SEQ ID NO: 532795 - DNA, 25 bp, Mus musculus
aggacctcaacatgctcagccagca

SEQ ID NO: 532796 - DNA, 25 bp, Mus musculus
aggacctcgaggacttgttctacaa

SEQ ID NO: 532797 - DNA, 25 bp, Mus musculus
aggacctcgaggtcttgttctacaa

SEQ ID NO: 532798 - DNA, 25 bp, Mus musculus
aggacctctatcactcgccttcgag

SEQ ID NO: 532799 - DNA, 25 bp, Mus musculus
aggacctctatctctcgccttcgag

SEQ ID NO: 532800 - DNA, 25 bp, Mus musculus
aggacctctcccctaaatcctggag

SEQ ID NO: 532801 - DNA, 25 bp, Mus musculus
aggacctctcccgtaaatcctggag

SEQ ID NO: 532802 - DNA, 25 bp, Mus musculus
aggacctctctaaactcttcaagcc

SEQ ID NO: 532803 - DNA, 25 bp, Mus musculus
aggacctctctatactcttcaagcc

SEQ ID NO: 532804 - DNA, 25 bp, Mus musculus
aggacctgaaagagaggtactacca

SEQ ID NO: 532805 - DNA, 25 bp, Mus musculus
aggacctgaaagtgaggtactacca

SEQ ID NO: 532806 - DNA, 25 bp, Mus musculus
aggacctgatggatcccctggctct

SEQ ID NO: 532807 - DNA, 25 bp, Mus musculus
aggacctgatggttcccctggctct

SEQ ID NO: 532808 - DNA, 25 bp, Mus musculus
aggacctgcagaagttcctgtacca

SEQ ID NO: 532809 - DNA, 25 bp, Mus musculus
aggacctgcagatgttcctgtacca

SEQ ID NO: 532810 - DNA, 25 bp, Mus musculus
aggacctgcagcacgccatggctta

SEQ ID NO: 532811 - DNA, 25 bp, Mus musculus
aggacctgcagctcgccatggctta

SEQ ID NO: 532812 - DNA, 25 bp, Mus musculus
aggacctggacaacataggcatggg

SEQ ID NO: 532813 - DNA, 25 bp, Mus musculus
aggacctggacatcataggcatggg

SEQ ID NO: 532814 - DNA, 25 bp, Mus musculus
aggacctggccacttttgacgagga

SEQ ID NO: 532815 - DNA, 25 bp, Mus musculus
aggacctggccagttttgacgagga

SEQ ID NO: 532816 - DNA, 25 bp, Mus musculus
aggacctggcggcagctgacatact

SEQ ID NO: 532817 - DNA, 25 bp, Mus musculus
aggacctggcgggagctgacatact

SEQ ID NO: 532818 - DNA, 25 bp, Mus musculus
aggacctgtgtgagctgcaaaaggt

SEQ ID NO: 532819 - DNA, 25 bp, Mus musculus
aggacctgtgtgtgctgcaaaaggt

SEQ ID NO: 532820 - DNA, 25 bp, Mus musculus
aggaccttgtgcacgcggagcagca

SEQ ID NO: 532821 - DNA, 25 bp, Mus musculus
aggaccttgtgctcgcggagcagca

SEQ ID NO: 532822 - DNA, 25 bp, Mus musculus
aggaccttgtggaagaccagaactc

SEQ ID NO: 532823 - DNA, 25 bp, Mus musculus
aggaccttgtggtagaccagaactc

SEQ ID NO: 532824 - DNA, 25 bp, Mus musculus
aggacctttaacagccgctatccag

SEQ ID NO: 532825 - DNA, 25 bp, Mus musculus
aggacctttaactgccgctatccag

SEQ ID NO: 532826 - DNA, 25 bp, Mus musculus
aggacgaagcaacccagcctttctg

SEQ ID NO: 532827 - DNA, 25 bp, Mus musculus
aggacgaagcaagccagcctttctg

SEQ ID NO: 532828 - DNA, 25 bp, Mus musculus
aggacgacaatcaccaggagttggg

SEQ ID NO: 532829 - DNA, 25 bp, Mus musculus
aggacgacaatctccaggagttggg

SEQ ID NO: 532830 - DNA, 25 bp, Mus musculus
aggacgacagccacaacgaagatgg

SEQ ID NO: 532831 - DNA, 25 bp, Mus musculus
aggacgacagcctcaacgaagatgg

SEQ ID NO: 532832 - DNA, 25 bp, Mus musculus
aggacgacgctgagggccacctcat

SEQ ID NO: 532833 - DNA, 25 bp, Mus musculus
aggacgacgctgtgggccacctcat

SEQ ID NO: 532834 - DNA, 25 bp, Mus musculus
aggacgatgatgactacgttgatga

SEQ ID NO: 532835 - DNA, 25 bp, Mus musculus
aggacgatgatgtctacgttgatga

SEQ ID NO: 532836 - DNA, 25 bp, Mus musculus
aggacgcaggctcggcgcggtgtgg

SEQ ID NO: 532837 - DNA, 25 bp, Mus musculus
aggacgcaggctgggcgcggtgtgg

SEQ ID NO: 532838 - DNA, 25 bp, Mus musculus
aggacgccatccagttcatccgaca

SEQ ID NO: 532839 - DNA, 25 bp, Mus musculus
aggacgccatcctgttcatccgaca

SEQ ID NO: 532840 - DNA, 25 bp, Mus musculus
aggacgccttgaacatagatttgca

SEQ ID NO: 532841 - DNA, 25 bp, Mus musculus
aggacgccttgatcatagatttgca

SEQ ID NO: 532842 - DNA, 25 bp, Mus musculus
aggacgcctttgatgaattatttaa

SEQ ID NO: 532843 - DNA, 25 bp, Mus musculus
aggacgcctttgttgaattatttaa

SEQ ID NO: 532844 - DNA, 25 bp, Mus musculus
aggacgctgcgcacaacatgggaaa

SEQ ID NO: 532845 - DNA, 25 bp, Mus musculus
aggacgctgcgctcaacatgggaaa

SEQ ID NO: 532846 - DNA, 25 bp, Mus musculus
aggacggagccgatcattgctgctc

SEQ ID NO: 532847 - DNA, 25 bp, Mus musculus
aggacggagccgttcattgctgctc

SEQ ID NO: 532848 - DNA, 25 bp, Mus musculus
aggacggcgccgatctccgctacgg

SEQ ID NO: 532849 - DNA, 25 bp, Mus musculus
aggacggcgccgttctccgctacgg

SEQ ID NO: 532850 - DNA, 25 bp, Mus musculus
aggacgggaagactatcacttacga

SEQ ID NO: 532851 - DNA, 25 bp, Mus musculus
aggacgggaagagtatcacttacga

SEQ ID NO: 532852 - DNA, 25 bp, Mus musculus
aggacggtcaccagctgcacagggc

SEQ ID NO: 532853 - DNA, 25 bp, Mus musculus
aggacggtcacctgctgcacagggc

SEQ ID NO: 532854 - DNA, 25 bp, Mus musculus
aggacggtgctcatcgctgccattc

SEQ ID NO: 532855 - DNA, 25 bp, Mus musculus
aggacggtgctcttcgctgccattc

SEQ ID NO: 532856 - DNA, 25 bp, Mus musculus
aggacgtacagcctggtccccagtc

SEQ ID NO: 532857 - DNA, 25 bp, Mus musculus
aggacgtacagcgtggtccccagtc

SEQ ID NO: 532858 - DNA, 25 bp, Mus musculus
aggacgtcctgcacccgggactgct

SEQ ID NO: 532859 - DNA, 25 bp, Mus musculus
aggacgtcctgctcccgggactgct

SEQ ID NO: 532860 - DNA, 25 bp, Mus musculus
aggacgtctgtacccatcccggtga

SEQ ID NO: 532861 - DNA, 25 bp, Mus musculus
aggacgtctgtagccatcccggtga

SEQ ID NO: 532862 - DNA, 25 bp, Mus musculus
aggacgtcttcaccctggcccaggt

SEQ ID NO: 532863 - DNA, 25 bp, Mus musculus
aggacgtcttcagcctggcccaggt

SEQ ID NO: 532864 - DNA, 25 bp, Mus musculus
aggacgtggactcagacctcctgga

SEQ ID NO: 532865 - DNA, 25 bp, Mus musculus
aggacgtggactgagacctcctgga

SEQ ID NO: 532866 - DNA, 25 bp, Mus musculus
aggactaaaacgcttaatgacagag

SEQ ID NO: 532867 - DNA, 25 bp, Mus musculus
aggactaaaacggttaatgacagag

SEQ ID NO: 532868 - DNA, 25 bp, Mus musculus
aggactacagcacaggacaccttga

SEQ ID NO: 532869 - DNA, 25 bp, Mus musculus
aggactacagcagaggacaccttga

SEQ ID NO: 532870 - DNA, 25 bp, Mus musculus
aggactacgagaacctaccgaccag

SEQ ID NO: 532871 - DNA, 25 bp, Mus musculus
aggactacgagactcaccggctgca

SEQ ID NO: 532872 - DNA, 25 bp, Mus musculus
aggactacgagagtcaccggctgca

SEQ ID NO: 532873 - DNA, 25 bp, Mus musculus
aggactacgagatcctaccgaccag

SEQ ID NO: 532874 - DNA, 25 bp, Mus musculus
aggactagcatgctgcctgcctcag

SEQ ID NO: 532875 - DNA, 25 bp, Mus musculus
aggactagcatggtgcctgcctcag

SEQ ID NO: 532876 - DNA, 25 bp, Mus musculus
aggactagtgcactaacagttcagc

SEQ ID NO: 532877 - DNA, 25 bp, Mus musculus
aggactagtgcagtaacagttcagc

SEQ ID NO: 532878 - DNA, 25 bp, Mus musculus
aggactatataacgcaaagccctag

SEQ ID NO: 532879 - DNA, 25 bp, Mus musculus
aggactatataaggcaaagccctag

SEQ ID NO: 532880 - DNA, 25 bp, Mus musculus
aggactatctccagtgctgggcccc

SEQ ID NO: 532881 - DNA, 25 bp, Mus musculus
aggactatctcctgtgctgggcccc

SEQ ID NO: 532882 - DNA, 25 bp, Mus musculus
aggactatgccacgaaactgagaca

SEQ ID NO: 532883 - DNA, 25 bp, Mus musculus
aggactatgccaggaaactgagaca

SEQ ID NO: 532884 - DNA, 25 bp, Mus musculus
aggactatgtataccaactcatggg

SEQ ID NO: 532885 - DNA, 25 bp, Mus musculus
aggactatgtattccaactcatggg

SEQ ID NO: 532886 - DNA, 25 bp, Mus musculus
aggactcagaaacccaccatggagg

SEQ ID NO: 532887 - DNA, 25 bp, Mus musculus
aggactcagaaagccaccatggagg

SEQ ID NO: 532888 - DNA, 25 bp, Mus musculus
aggactcagcagcaaattgcaggga

SEQ ID NO: 532889 - DNA, 25 bp, Mus musculus
aggactcagcaggaaattgcaggga

SEQ ID NO: 532890 - DNA, 25 bp, Mus musculus
aggactcagccgagagtctcaccag

SEQ ID NO: 532891 - DNA, 25 bp, Mus musculus
aggactcagccgtgagtctcaccag

SEQ ID NO: 532892 - DNA, 25 bp, Mus musculus
aggactccatgaatatcaaggccca

SEQ ID NO: 532893 - DNA, 25 bp, Mus musculus
aggactccatgattatcaaggccca

SEQ ID NO: 532894 - DNA, 25 bp, Mus musculus
aggactccggtaactatcagtgtgt

SEQ ID NO: 532895 - DNA, 25 bp, Mus musculus
aggactccggtatctatcagtgtgt

SEQ ID NO: 532896 - DNA, 25 bp, Mus musculus
aggactcgcgtgctcagtctgctgt

SEQ ID NO: 532897 - DNA, 25 bp, Mus musculus
aggactcgcgtggtcagtctgctgt

SEQ ID NO: 532898 - DNA, 25 bp, Mus musculus
aggactcggacacctacctgcacag

SEQ ID NO: 532899 - DNA, 25 bp, Mus musculus
aggactcggacagctacctgcacag

SEQ ID NO: 532900 - DNA, 25 bp, Mus musculus
aggactctcctcaccacgttgggaa

SEQ ID NO: 532901 - DNA, 25 bp, Mus musculus
aggactctcctctccacgttgggaa

SEQ ID NO: 532902 - DNA, 25 bp, Mus musculus
aggactctgccaaccctggagtctc

SEQ ID NO: 532903 - DNA, 25 bp, Mus musculus
aggactctgccatccctggagtctc

SEQ ID NO: 532904 - DNA, 25 bp, Mus musculus
aggactcttggaccgctcgcccgga

SEQ ID NO: 532905 - DNA, 25 bp, Mus musculus
aggactcttggagcgctcgcccgga

SEQ ID NO: 532906 - DNA, 25 bp, Mus musculus
aggactgagcacaaaaccttcccag

SEQ ID NO: 532907 - DNA, 25 bp, Mus musculus
aggactgagcactaaaccttcccag

SEQ ID NO: 532908 - DNA, 25 bp, Mus musculus
aggactgagtagctaccacagccag

SEQ ID NO: 532909 - DNA, 25 bp, Mus musculus
aggactgagtaggtaccacagccag

SEQ ID NO: 532910 - DNA, 25 bp, Mus musculus
aggactgatgaccatctggacccag

SEQ ID NO: 532911 - DNA, 25 bp, Mus musculus
aggactgatgacgatctggacccag

SEQ ID NO: 532912 - DNA, 25 bp, Mus musculus
aggactggcaagacaaggtggcctc

SEQ ID NO: 532913 - DNA, 25 bp, Mus musculus
aggactggcaagtcaaggtggcctc

SEQ ID NO: 532914 - DNA, 25 bp, Mus musculus
aggactggcactcctttctcctgca

SEQ ID NO: 532915 - DNA, 25 bp, Mus musculus
aggactggcactgctttctcctgca

SEQ ID NO: 532916 - DNA, 25 bp, Mus musculus
aggactgggagtccttccgagccat

SEQ ID NO: 532917 - DNA, 25 bp, Mus musculus
aggactgggagtgcttccgagccat

SEQ ID NO: 532918 - DNA, 25 bp, Mus musculus
aggactgggcccacaacatggaaat

SEQ ID NO: 532919 - DNA, 25 bp, Mus musculus
aggactgggccctcaacatggaaat

SEQ ID NO: 532920 - DNA, 25 bp, Mus musculus
aggactgggcctccttcctgcgact

SEQ ID NO: 532921 - DNA, 25 bp, Mus musculus
aggactgggcctgcttcctgcgact

SEQ ID NO: 532922 - DNA, 25 bp, Mus musculus
aggactggtggtacccaagctggtt

SEQ ID NO: 532923 - DNA, 25 bp, Mus musculus
aggactggtggttcccaagctggtt

SEQ ID NO: 532924 - DNA, 25 bp, Mus musculus
aggactgtccgtctgttcctgctct

SEQ ID NO: 532925 - DNA, 25 bp, Mus musculus
aggactgtccgtgtgttcctgctct

SEQ ID NO: 532926 - DNA, 25 bp, Mus musculus
aggactgtcttgcatcaacagccca

SEQ ID NO: 532927 - DNA, 25 bp, Mus musculus
aggactgtcttggatcaacagccca

SEQ ID NO: 532928 - DNA, 25 bp, Mus musculus
aggactgttgtcctggctaaaggaa

SEQ ID NO: 532929 - DNA, 25 bp, Mus musculus
aggactgttgtcgtggctaaaggaa

SEQ ID NO: 532930 - DNA, 25 bp, Mus musculus
aggacttaagtaagatgaagagcct

SEQ ID NO: 532931 - DNA, 25 bp, Mus musculus
aggacttaagtatgatgaagagcct

SEQ ID NO: 532932 - DNA, 25 bp, Mus musculus
aggacttcaggacccgtctcagtca

SEQ ID NO: 532933 - DNA, 25 bp, Mus musculus
aggacttcaggagccgtctcagtca

SEQ ID NO: 532934 - DNA, 25 bp, Mus musculus
aggacttcataaaagaagccatgca

SEQ ID NO: 532935 - DNA, 25 bp, Mus musculus
aggacttcataatagaagccatgca

SEQ ID NO: 532936 - DNA, 25 bp, Mus musculus
aggacttccgcactttccggtcaga

SEQ ID NO: 532937 - DNA, 25 bp, Mus musculus
aggacttccgcagtttccggtcaga

SEQ ID NO: 532938 - DNA, 25 bp, Mus musculus
aggacttccgggacaagacctgcgg

SEQ ID NO: 532939 - DNA, 25 bp, Mus musculus
aggacttccgggtcaagacctgcgg

SEQ ID NO: 532940 - DNA, 25 bp, Mus musculus
aggacttcctgtagcagcgaagacc

SEQ ID NO: 532941 - DNA, 25 bp, Mus musculus
aggacttcctgttgcagcgaagacc

SEQ ID NO: 532942 - DNA, 25 bp, Mus musculus
aggacttcgagccttatttggagat

SEQ ID NO: 532943 - DNA, 25 bp, Mus musculus
aggacttcgagcgttatttggagat

SEQ ID NO: 532944 - DNA, 25 bp, Mus musculus
aggacttgaatgagacagagtacat

SEQ ID NO: 532945 - DNA, 25 bp, Mus musculus
aggacttgaatgtgacagagtacat

SEQ ID NO: 532946 - DNA, 25 bp, Mus musculus
aggacttggtttaatctgtacacag

SEQ ID NO: 532947 - DNA, 25 bp, Mus musculus
aggacttggttttatctgtacacag

SEQ ID NO: 532948 - DNA, 25 bp, Mus musculus
aggactttcctcagatcgagacaga

SEQ ID NO: 532949 - DNA, 25 bp, Mus musculus
aggactttcctctgatcgagacaga

SEQ ID NO: 532950 - DNA, 25 bp, Mus musculus
aggagaaaaagccacctcccaggct

SEQ ID NO: 532951 - DNA, 25 bp, Mus musculus
aggagaaaaagcgacctcccaggct

SEQ ID NO: 532952 - DNA, 25 bp, Mus musculus
aggagaaaagaaacaacccgcccag

SEQ ID NO: 532953 - DNA, 25 bp, Mus musculus
aggagaaaagaatcaacccgcccag

SEQ ID NO: 532954 - DNA, 25 bp, Mus musculus
aggagaaaatccatcttgaattttc

SEQ ID NO: 532955 - DNA, 25 bp, Mus musculus
aggagaaaatccttcttgaattttc

SEQ ID NO: 532956 - DNA, 25 bp, Mus musculus
aggagaaacagcagtacttgaagga

SEQ ID NO: 532957 - DNA, 25 bp, Mus musculus
aggagaaacagctgtacttgaagga

SEQ ID NO: 532958 - DNA, 25 bp, Mus musculus
aggagaaactgactccactgttgag

SEQ ID NO: 532959 - DNA, 25 bp, Mus musculus
aggagaaactgagtccactgttgag

SEQ ID NO: 532960 - DNA, 25 bp, Mus musculus
aggagaaatagcaggacctccagac

SEQ ID NO: 532961 - DNA, 25 bp, Mus musculus
aggagaaatagctggacctccagac

SEQ ID NO: 532962 - DNA, 25 bp, Mus musculus
aggagaacactgaagaacggcacca

SEQ ID NO: 532963 - DNA, 25 bp, Mus musculus
aggagaacactgtagaacggcacca

SEQ ID NO: 532964 - DNA, 25 bp, Mus musculus
aggagaacctgcaagctgtgggcat

SEQ ID NO: 532965 - DNA, 25 bp, Mus musculus
aggagaacctgctagctgtgggcat

SEQ ID NO: 532966 - DNA, 25 bp, Mus musculus
aggagaacgtggacctccaggaaga

SEQ ID NO: 532967 - DNA, 25 bp, Mus musculus
aggagaacgtggtcctccaggaaga

SEQ ID NO: 532968 - DNA, 25 bp, Mus musculus
aggagaactctgaaaggcggaagct

SEQ ID NO: 532969 - DNA, 25 bp, Mus musculus
aggagaactctgtaaggcggaagct

SEQ ID NO: 532970 - DNA, 25 bp, Mus musculus
aggagaacttctcccgcaatccaga

SEQ ID NO: 532971 - DNA, 25 bp, Mus musculus
aggagaacttctgccgcaatccaga

SEQ ID NO: 532972 - DNA, 25 bp, Mus musculus
aggagaagaaggagccttgccacga

SEQ ID NO: 532973 - DNA, 25 bp, Mus musculus
aggagaagaaggtgccttgccacga

SEQ ID NO: 532974 - DNA, 25 bp, Mus musculus
aggagaagagaccaaaaacgacacg

SEQ ID NO: 532975 - DNA, 25 bp, Mus musculus
aggagaagagacgaaaaacgacacg

SEQ ID NO: 532976 - DNA, 25 bp, Mus musculus
aggagaagcagcagacaacagatgc

SEQ ID NO: 532977 - DNA, 25 bp, Mus musculus
aggagaagcagctgacaacagatgc

SEQ ID NO: 532978 - DNA, 25 bp, Mus musculus
aggagaagcccgaccttgccgagag

SEQ ID NO: 532979 - DNA, 25 bp, Mus musculus
aggagaagcccgtccttgccgagag

SEQ ID NO: 532980 - DNA, 25 bp, Mus musculus
aggagaagccgcagttgccaggaca

SEQ ID NO: 532981 - DNA, 25 bp, Mus musculus
aggagaagccgctgttgccaggaca

SEQ ID NO: 532982 - DNA, 25 bp, Mus musculus
aggagaagcgccatcgcacacggtc

SEQ ID NO: 532983 - DNA, 25 bp, Mus musculus
aggagaagcgccttcgcacacggtc

SEQ ID NO: 532984 - DNA, 25 bp, Mus musculus
aggagaagctgccttccctaaccca

SEQ ID NO: 532985 - DNA, 25 bp, Mus musculus
aggagaagctgcgttccctaaccca

SEQ ID NO: 532986 - DNA, 25 bp, Mus musculus
aggagaaggaagctaaacacctcag

SEQ ID NO: 532987 - DNA, 25 bp, Mus musculus
aggagaaggaaggtaaacacctcag

SEQ ID NO: 532988 - DNA, 25 bp, Mus musculus
aggagaaggacaaagcacccacgaa

SEQ ID NO: 532989 - DNA, 25 bp, Mus musculus
aggagaaggacatagcacccacgaa

SEQ ID NO: 532990 - DNA, 25 bp, Mus musculus
aggagaagggccacctctcatcaca

SEQ ID NO: 532991 - DNA, 25 bp, Mus musculus
aggagaagggcctcctctcatcaca

SEQ ID NO: 532992 - DNA, 25 bp, Mus musculus
aggagaagggcgagcagatggacag

SEQ ID NO: 532993 - DNA, 25 bp, Mus musculus
aggagaagggcgtgcagatggacag

SEQ ID NO: 532994 - DNA, 25 bp, Mus musculus
aggagaagttgacgcgtgcaatcaa

SEQ ID NO: 532995 - DNA, 25 bp, Mus musculus
aggagaagttgaggcgtgcaatcaa

SEQ ID NO: 532996 - DNA, 25 bp, Mus musculus
aggagaatgcgcagttgccaaattg

SEQ ID NO: 532997 - DNA, 25 bp, Mus musculus
aggagaatgcgctgttgccaaattg

SEQ ID NO: 532998 - DNA, 25 bp, Mus musculus
aggagaattcagaacaaccagaggg

SEQ ID NO: 532999 - DNA, 25 bp, Mus musculus
aggagaattcagtacaaccagaggg

SEQ ID NO: 533000 - DNA, 25 bp, Mus musculus
aggagaatttcacctccctgacttt

SEQ ID NO: 533001 - DNA, 25 bp, Mus musculus
aggagaatttcagctccctgacttt

SEQ ID NO: 533002 - DNA, 25 bp, Mus musculus
aggagacaaccgcagatgccatcgc

SEQ ID NO: 533003 - DNA, 25 bp, Mus musculus
aggagacaaccggagatgccatcgc

SEQ ID NO: 533004 - DNA, 25 bp, Mus musculus
aggagacaactgatcctcccgtgtc

SEQ ID NO: 533005 - DNA, 25 bp, Mus musculus
aggagacaactgttcctcccgtgtc

SEQ ID NO: 533006 - DNA, 25 bp, Mus musculus
aggagacaagggacaagctctgtgc

SEQ ID NO: 533007 - DNA, 25 bp, Mus musculus
aggagacaagggtcaagctctgtgc

SEQ ID NO: 533008 - DNA, 25 bp, Mus musculus
aggagacaatgactacttcacttgc

SEQ ID NO: 533009 - DNA, 25 bp, Mus musculus
aggagacaatgagtacttcacttgc

SEQ ID NO: 533010 - DNA, 25 bp, Mus musculus
aggagacacactcgctgctactcag

SEQ ID NO: 533011 - DNA, 25 bp, Mus musculus
aggagacacactggctgctactcag

SEQ ID NO: 533012 - DNA, 25 bp, Mus musculus
aggagacaccaacgaacagtagggt

SEQ ID NO: 533013 - DNA, 25 bp, Mus musculus
aggagacaccaaggaacagtagggt

SEQ ID NO: 533014 - DNA, 25 bp, Mus musculus
aggagacacgtcagaagagctgtgt

SEQ ID NO: 533015 - DNA, 25 bp, Mus musculus
aggagacacgtctgaagagctgtgt

SEQ ID NO: 533016 - DNA, 25 bp, Mus musculus
aggagacactaaccagaagctacgg

SEQ ID NO: 533017 - DNA, 25 bp, Mus musculus
aggagacactaagcagaagctacgg

SEQ ID NO: 533018 - DNA, 25 bp, Mus musculus
aggagacacttacgaagcggtgctt

SEQ ID NO: 533019 - DNA, 25 bp, Mus musculus
aggagacacttaggaagcggtgctt

SEQ ID NO: 533020 - DNA, 25 bp, Mus musculus
aggagacatccgaaaagcgctggat

SEQ ID NO: 533021 - DNA, 25 bp, Mus musculus
aggagacatccgtaaagcgctggat

SEQ ID NO: 533022 - DNA, 25 bp, Mus musculus
aggagacatctactgcccttttagg

SEQ ID NO: 533023 - DNA, 25 bp, Mus musculus
aggagacatctagtgcccttttagg

SEQ ID NO: 533024 - DNA, 25 bp, Mus musculus
aggagaccaacaatcccggtgtccg

SEQ ID NO: 533025 - DNA, 25 bp, Mus musculus
aggagaccaacattcccggtgtccg

SEQ ID NO: 533026 - DNA, 25 bp, Mus musculus
aggagaccaccaagtgccgagccat

SEQ ID NO: 533027 - DNA, 25 bp, Mus musculus
aggagaccaccatgtgccgagccat

SEQ ID NO: 533028 - DNA, 25 bp, Mus musculus
aggagaccacgtccaccttctgcgg

SEQ ID NO: 533029 - DNA, 25 bp, Mus musculus
aggagaccacgtgcaccttctgcgg

SEQ ID NO: 533030 - DNA, 25 bp, Mus musculus
aggagaccagcaccccttgggtagc

SEQ ID NO: 533031 - DNA, 25 bp, Mus musculus
aggagaccagcagcccttgggtagc

SEQ ID NO: 533032 - DNA, 25 bp, Mus musculus
aggagaccagttctcccgtcctggt

SEQ ID NO: 533033 - DNA, 25 bp, Mus musculus
aggagaccagttgtcccgtcctggt

SEQ ID NO: 533034 - DNA, 25 bp, Mus musculus
aggagaccccatcgagacatcacct

SEQ ID NO: 533035 - DNA, 25 bp, Mus musculus
aggagaccccatggagacatcacct

SEQ ID NO: 533036 - DNA, 25 bp, Mus musculus
aggagaccgactcagagccccaggc

SEQ ID NO: 533037 - DNA, 25 bp, Mus musculus
aggagaccgactgagagccccaggc

SEQ ID NO: 533038 - DNA, 25 bp, Mus musculus
aggagaccggcaagaccctcggtga

SEQ ID NO: 533039 - DNA, 25 bp, Mus musculus
aggagaccggcatgaccctcggtga

SEQ ID NO: 533040 - DNA, 25 bp, Mus musculus
aggagacggagcatcctgcaaagag

SEQ ID NO: 533041 - DNA, 25 bp, Mus musculus
aggagacggagcttcctgcaaagag

SEQ ID NO: 533042 - DNA, 25 bp, Mus musculus
aggagactcagaacaccgtgtgtaa

SEQ ID NO: 533043 - DNA, 25 bp, Mus musculus
aggagactcagatcaccgtgtgtaa

SEQ ID NO: 533044 - DNA, 25 bp, Mus musculus
aggagactgcctcggcttcactgca

SEQ ID NO: 533045 - DNA, 25 bp, Mus musculus
aggagactgcctgggcttcactgca

SEQ ID NO: 533046 - DNA, 25 bp, Mus musculus
aggagagacagccagacgagcttct

SEQ ID NO: 533047 - DNA, 25 bp, Mus musculus
aggagagacagcgagacgagcttct

SEQ ID NO: 533048 - DNA, 25 bp, Mus musculus
aggagagccctgaacccttgctggg

SEQ ID NO: 533049 - DNA, 25 bp, Mus musculus
aggagagccctgtacccttgctggg

SEQ ID NO: 533050 - DNA, 25 bp, Mus musculus
aggagagcctggacgacctggttcc

SEQ ID NO: 533051 - DNA, 25 bp, Mus musculus
aggagagcctggtcgacctggttcc

SEQ ID NO: 533052 - DNA, 25 bp, Mus musculus
aggagagctgaacatccccgcctgg

SEQ ID NO: 533053 - DNA, 25 bp, Mus musculus
aggagagctgaagatccccgcctgg

SEQ ID NO: 533054 - DNA, 25 bp, Mus musculus
aggagagctgtgagcatcccctgga

SEQ ID NO: 533055 - DNA, 25 bp, Mus musculus
aggagagctgtgtgcatcccctgga

SEQ ID NO: 533056 - DNA, 25 bp, Mus musculus
aggagaggctatccaaatttgagtc

SEQ ID NO: 533057 - DNA, 25 bp, Mus musculus
aggagaggctatgcaaatttgagtc

SEQ ID NO: 533058 - DNA, 25 bp, Mus musculus
aggagagtgaccagccgaccagtca

SEQ ID NO: 533059 - DNA, 25 bp, Mus musculus
aggagagtgacctgccgaccagtca

SEQ ID NO: 533060 - DNA, 25 bp, Mus musculus
aggagagtgcatccggccctcacga

SEQ ID NO: 533061 - DNA, 25 bp, Mus musculus
aggagagtgcatgcggccctcacga

SEQ ID NO: 533062 - DNA, 25 bp, Mus musculus
aggagagtgctcaggagccagcccc

SEQ ID NO: 533063 - DNA, 25 bp, Mus musculus
aggagagtgctctggagccagcccc

SEQ ID NO: 533064 - DNA, 25 bp, Mus musculus
aggagagtggctctgacccatccga

SEQ ID NO: 533065 - DNA, 25 bp, Mus musculus
aggagagtggctgtgacccatccga

SEQ ID NO: 533066 - DNA, 25 bp, Mus musculus
aggagatagatccttctctcgggca

SEQ ID NO: 533067 - DNA, 25 bp, Mus musculus
aggagatagatcgttctctcgggca

SEQ ID NO: 533068 - DNA, 25 bp, Mus musculus
aggagatagggaatttggaacttgc

SEQ ID NO: 533069 - DNA, 25 bp, Mus musculus
aggagatagggattttggaacttgc

SEQ ID NO: 533070 - DNA, 25 bp, Mus musculus
aggagatcaacccacgcacggctgc

SEQ ID NO: 533071 - DNA, 25 bp, Mus musculus
aggagatcaaccgacgcacggctgc

SEQ ID NO: 533072 - DNA, 25 bp, Mus musculus
aggagatcaaggatctctctgacaa

SEQ ID NO: 533073 - DNA, 25 bp, Mus musculus
aggagatcaaggttctctctgacaa

SEQ ID NO: 533074 - DNA, 25 bp, Mus musculus
aggagatcactgagctcagccaatg

SEQ ID NO: 533075 - DNA, 25 bp, Mus musculus
aggagatcactgtgctcagccaatg

SEQ ID NO: 533076 - DNA, 25 bp, Mus musculus
aggagatcagaaccccaggagccca

SEQ ID NO: 533077 - DNA, 25 bp, Mus musculus
aggagatcagaagcccaggagccca

SEQ ID NO: 533078 - DNA, 25 bp, Mus musculus
aggagatcagttcaagagtgaccag

SEQ ID NO: 533079 - DNA, 25 bp, Mus musculus
aggagatcagttgaagagtgaccag

SEQ ID NO: 533080 - DNA, 25 bp, Mus musculus
aggagatccccgagaatggtgccca

SEQ ID NO: 533081 - DNA, 25 bp, Mus musculus
aggagatccccgtgaatggtgccca

SEQ ID NO: 533082 - DNA, 25 bp, Mus musculus
aggagatcccgtacactaaagtaga

SEQ ID NO: 533083 - DNA, 25 bp, Mus musculus
aggagatcccgttcactaaagtaga

SEQ ID NO: 533084 - DNA, 25 bp, Mus musculus
aggagatccggcagcagcgacagga

SEQ ID NO: 533085 - DNA, 25 bp, Mus musculus
aggagatccggctgcagcgacagga

SEQ ID NO: 533086 - DNA, 25 bp, Mus musculus
aggagatgccatacctgaaatgtcc

SEQ ID NO: 533087 - DNA, 25 bp, Mus musculus
aggagatgccattcctgaaatgtcc

SEQ ID NO: 533088 - DNA, 25 bp, Mus musculus
aggagatggactaccctcagctgat

SEQ ID NO: 533089 - DNA, 25 bp, Mus musculus
aggagatggacttccctcagctgat

SEQ ID NO: 533090 - DNA, 25 bp, Mus musculus
aggagatggcgcagattctgaacaa

SEQ ID NO: 533091 - DNA, 25 bp, Mus musculus
aggagatggcgctgattctgaacaa

SEQ ID NO: 533092 - DNA, 25 bp, Mus musculus
aggagatggtagaaaggccatccag

SEQ ID NO: 533093 - DNA, 25 bp, Mus musculus
aggagatggtagtaaggccatccag

SEQ ID NO: 533094 - DNA, 25 bp, Mus musculus
aggagatgtcatccctggaaaagcc

SEQ ID NO: 533095 - DNA, 25 bp, Mus musculus
aggagatgtcatgcctggaaaagcc

SEQ ID NO: 533096 - DNA, 25 bp, Mus musculus
aggagattgatgatttcaacaacca

SEQ ID NO: 533097 - DNA, 25 bp, Mus musculus
aggagattgatgttttcaacaacca

SEQ ID NO: 533098 - DNA, 25 bp, Mus musculus
aggagattgccaagcataaggggcc

SEQ ID NO: 533099 - DNA, 25 bp, Mus musculus
aggagattgccatgcataaggggcc

SEQ ID NO: 533100 - DNA, 25 bp, Mus musculus
aggagatttaacctttcagcaaggg

SEQ ID NO: 533101 - DNA, 25 bp, Mus musculus
aggagatttaacgtttcagcaaggg

SEQ ID NO: 533102 - DNA, 25 bp, Mus musculus
aggagcaacacacctaaacaacaag

SEQ ID NO: 533103 - DNA, 25 bp, Mus musculus
aggagcaacacagctaaacaacaag

SEQ ID NO: 533104 - DNA, 25 bp, Mus musculus
aggagcacactgaccaggtcctgca

SEQ ID NO: 533105 - DNA, 25 bp, Mus musculus
aggagcacactgtccaggtcctgca

SEQ ID NO: 533106 - DNA, 25 bp, Mus musculus
aggagcacatgaaaaagagtctgtg

SEQ ID NO: 533107 - DNA, 25 bp, Mus musculus
aggagcacatgataaagagtctgtg

SEQ ID NO: 533108 - DNA, 25 bp, Mus musculus
aggagcacctagagtcagctggcta

SEQ ID NO: 533109 - DNA, 25 bp, Mus musculus
aggagcacctagtgtcagctggcta

SEQ ID NO: 533110 - DNA, 25 bp, Mus musculus
aggagcacgcggaatttgtattggt

SEQ ID NO: 533111 - DNA, 25 bp, Mus musculus
aggagcacgcggtatttgtattggt

SEQ ID NO: 533112 - DNA, 25 bp, Mus musculus
aggagcacggcccagaaaacattgt

SEQ ID NO: 533113 - DNA, 25 bp, Mus musculus
aggagcacggccgagaaaacattgt

SEQ ID NO: 533114 - DNA, 25 bp, Mus musculus
aggagcacgggtcctacctgcatgt

SEQ ID NO: 533115 - DNA, 25 bp, Mus musculus
aggagcacgggtgctacctgcatgt

SEQ ID NO: 533116 - DNA, 25 bp, Mus musculus
aggagcagcctacacctgagtccag

SEQ ID NO: 533117 - DNA, 25 bp, Mus musculus
aggagcagcctagacctgagtccag

SEQ ID NO: 533118 - DNA, 25 bp, Mus musculus
aggagcagcgctcttccttgcaggc

SEQ ID NO: 533119 - DNA, 25 bp, Mus musculus
aggagcagcgctgttccttgcaggc

SEQ ID NO: 533120 - DNA, 25 bp, Mus musculus
aggagcagctatctgaagctacact

SEQ ID NO: 533121 - DNA, 25 bp, Mus musculus
aggagcagctatgtgaagctacact

SEQ ID NO: 533122 - DNA, 25 bp, Mus musculus
aggagcagtggactcgccgccatat

SEQ ID NO: 533123 - DNA, 25 bp, Mus musculus
aggagcagtggagtcgccgccatat

SEQ ID NO: 533124 - DNA, 25 bp, Mus musculus
aggagcatcatcagagcgaggtgca

SEQ ID NO: 533125 - DNA, 25 bp, Mus musculus
aggagcatcatctgagcgaggtgca

SEQ ID NO: 533126 - DNA, 25 bp, Mus musculus
aggagcatgtgccaaccacgtcagc

SEQ ID NO: 533127 - DNA, 25 bp, Mus musculus
aggagcatgtgcgaaccacgtcagc

SEQ ID NO: 533128 - DNA, 25 bp, Mus musculus
aggagccaaatgaggctccggccac

SEQ ID NO: 533129 - DNA, 25 bp, Mus musculus
aggagccaaatgtggctccggccac

SEQ ID NO: 533130 - DNA, 25 bp, Mus musculus
aggagccaactacggtggagacaaa

SEQ ID NO: 533131 - DNA, 25 bp, Mus musculus
aggagccaactagggtggagacaaa

SEQ ID NO: 533132 - DNA, 25 bp, Mus musculus
aggagccacaccagagctcgaggct

SEQ ID NO: 533133 - DNA, 25 bp, Mus musculus
aggagccacacctgagctcgaggct

SEQ ID NO: 533134 - DNA, 25 bp, Mus musculus
aggagccagcgcctagcactctgtc

SEQ ID NO: 533135 - DNA, 25 bp, Mus musculus
aggagccagcgcgtagcactctgtc

SEQ ID NO: 533136 - DNA, 25 bp, Mus musculus
aggagccattcccagccggagcaga

SEQ ID NO: 533137 - DNA, 25 bp, Mus musculus
aggagccattccgagccggagcaga

SEQ ID NO: 533138 - DNA, 25 bp, Mus musculus
aggagcccatggcatcatagttgtg

SEQ ID NO: 533139 - DNA, 25 bp, Mus musculus
aggagcccatgggatcatagttgtg

SEQ ID NO: 533140 - DNA, 25 bp, Mus musculus
aggagccccgcacgaagccggagct

SEQ ID NO: 533141 - DNA, 25 bp, Mus musculus
aggagccccgcaggaagccggagct

SEQ ID NO: 533142 - DNA, 25 bp, Mus musculus
aggagcccctctatgagaaggacag

SEQ ID NO: 533143 - DNA, 25 bp, Mus musculus
aggagcccctctttgagaaggacag

SEQ ID NO: 533144 - DNA, 25 bp, Mus musculus
aggagcccggctcgtcgcagacatc

SEQ ID NO: 533145 - DNA, 25 bp, Mus musculus
aggagcccggctggtcgcagacatc

SEQ ID NO: 533146 - DNA, 25 bp, Mus musculus
aggagccctactccaacgccttgag

SEQ ID NO: 533147 - DNA, 25 bp, Mus musculus
aggagccctactgcaacgccttgag

SEQ ID NO: 533148 - DNA, 25 bp, Mus musculus
aggagccctctgctgtcaccagtga

SEQ ID NO: 533149 - DNA, 25 bp, Mus musculus
aggagccctctggtgtcaccagtga

SEQ ID NO: 533150 - DNA, 25 bp, Mus musculus
aggagcccttcaatgccctgactcg

SEQ ID NO: 533151 - DNA, 25 bp, Mus musculus
aggagcccttcattgccctgactcg

SEQ ID NO: 533152 - DNA, 25 bp, Mus musculus
aggagccggaccctccagtaaggct

SEQ ID NO: 533153 - DNA, 25 bp, Mus musculus
aggagccggaccgtccagtaaggct

SEQ ID NO: 533154 - DNA, 25 bp, Mus musculus
aggagccggcaacacatacaccatg

SEQ ID NO: 533155 - DNA, 25 bp, Mus musculus
aggagccggcaagacatacaccatg

SEQ ID NO: 533156 - DNA, 25 bp, Mus musculus
aggagccgtcgccattatgactatg

SEQ ID NO: 533157 - DNA, 25 bp, Mus musculus
aggagccgtcgcgattatgactatg

SEQ ID NO: 533158 - DNA, 25 bp, Mus musculus
aggagcctacatactcagcagattt

SEQ ID NO: 533159 - DNA, 25 bp, Mus musculus
aggagcctacattctcagcagattt

SEQ ID NO: 533160 - DNA, 25 bp, Mus musculus
aggagcctaggacccacagtcatgg

SEQ ID NO: 533161 - DNA, 25 bp, Mus musculus
aggagcctaggagccacagtcatgg

SEQ ID NO: 533162 - DNA, 25 bp, Mus musculus
aggagcctcgataccaggtcccttt

SEQ ID NO: 533163 - DNA, 25 bp, Mus musculus
aggagcctcgattccaggtcccttt

SEQ ID NO: 533164 - DNA, 25 bp, Mus musculus
aggagcctcggaaccggctgcagaa

SEQ ID NO: 533165 - DNA, 25 bp, Mus musculus
aggagcctcggatccggctgcagaa

SEQ ID NO: 533166 - DNA, 25 bp, Mus musculus
aggagcctgcatcgaactgcgacgc

SEQ ID NO: 533167 - DNA, 25 bp, Mus musculus
aggagcctgcatggaactgcgacgc

SEQ ID NO: 533168 - DNA, 25 bp, Mus musculus
aggagcctgcccagtgacaccctgg

SEQ ID NO: 533169 - DNA, 25 bp, Mus musculus
aggagcctgccctgtgacaccctgg

SEQ ID NO: 533170 - DNA, 25 bp, Mus musculus
aggagcctgcctactcaaagtcata

SEQ ID NO: 533171 - DNA, 25 bp, Mus musculus
aggagcctgccttctcaaagtcata

SEQ ID NO: 533172 - DNA, 25 bp, Mus musculus
aggagcctgcggcagaactgccctt

SEQ ID NO: 533173 - DNA, 25 bp, Mus musculus
aggagcctgcgggagaactgccctt

SEQ ID NO: 533174 - DNA, 25 bp, Mus musculus
aggagcctgtcacagaaaaccacag

SEQ ID NO: 533175 - DNA, 25 bp, Mus musculus
aggagcctgtcagagaaaaccacag

SEQ ID NO: 533176 - DNA, 25 bp, Mus musculus
aggagcgcaagcagatcagagctgc

SEQ ID NO: 533177 - DNA, 25 bp, Mus musculus
aggagcgcaagctgatcagagctgc

SEQ ID NO: 533178 - DNA, 25 bp, Mus musculus
aggagcgcattcaggaggagaccca

SEQ ID NO: 533179 - DNA, 25 bp, Mus musculus
aggagcgcattctggaggagaccca

SEQ ID NO: 533180 - DNA, 25 bp, Mus musculus
aggagcgccaagaagcctcacggct

SEQ ID NO: 533181 - DNA, 25 bp, Mus musculus
aggagcgccaagtagcctcacggct

SEQ ID NO: 533182 - DNA, 25 bp, Mus musculus
aggagcgccagacacgcttccagaa

SEQ ID NO: 533183 - DNA, 25 bp, Mus musculus
aggagcgccagagacgcttccagaa

SEQ ID NO: 533184 - DNA, 25 bp, Mus musculus
aggagcgcctggacttcaaccgcaa

SEQ ID NO: 533185 - DNA, 25 bp, Mus musculus
aggagcgcctggtcttcaaccgcaa

SEQ ID NO: 533186 - DNA, 25 bp, Mus musculus
aggagcgcttccagagtgacagcag

SEQ ID NO: 533187 - DNA, 25 bp, Mus musculus
aggagcgcttcctgagtgacagcag

SEQ ID NO: 533188 - DNA, 25 bp, Mus musculus
aggagcgggaatatagagctgcccc

SEQ ID NO: 533189 - DNA, 25 bp, Mus musculus
aggagcgggaatttagagctgcccc

SEQ ID NO: 533190 - DNA, 25 bp, Mus musculus
aggagcgggcgcatcaccgtccgca

SEQ ID NO: 533191 - DNA, 25 bp, Mus musculus
aggagcgggcgcttcaccgtccgca

SEQ ID NO: 533192 - DNA, 25 bp, Mus musculus
aggagcgttctgatcttacagccaa

SEQ ID NO: 533193 - DNA, 25 bp, Mus musculus
aggagcgttctgttcttacagccaa

SEQ ID NO: 533194 - DNA, 25 bp, Mus musculus
aggagctaagccagcatgtccggga

SEQ ID NO: 533195 - DNA, 25 bp, Mus musculus
aggagctaagcctgcatgtccggga

SEQ ID NO: 533196 - DNA, 25 bp, Mus musculus
aggagctacagcaggctctggccct

SEQ ID NO: 533197 - DNA, 25 bp, Mus musculus
aggagctacagctggctctggccct

SEQ ID NO: 533198 - DNA, 25 bp, Mus musculus
aggagctatggaattggtgtccagt

SEQ ID NO: 533199 - DNA, 25 bp, Mus musculus
aggagctatggatttggtgtccagt

SEQ ID NO: 533200 - DNA, 25 bp, Mus musculus
aggagctcaccacatccctagtcaa

SEQ ID NO: 533201 - DNA, 25 bp, Mus musculus
aggagctcaccagatccctagtcaa

SEQ ID NO: 533202 - DNA, 25 bp, Mus musculus
aggagctcagcaaggtcaacaagga

SEQ ID NO: 533203 - DNA, 25 bp, Mus musculus
aggagctcagcatggtcaacaagga

SEQ ID NO: 533204 - DNA, 25 bp, Mus musculus
aggagctcatgcaactgaaggctga

SEQ ID NO: 533205 - DNA, 25 bp, Mus musculus
aggagctcatgctactgaaggctga

SEQ ID NO: 533206 - DNA, 25 bp, Mus musculus
aggagctctggtcggccttctccct

SEQ ID NO: 533207 - DNA, 25 bp, Mus musculus
aggagctctggtgggccttctccct

SEQ ID NO: 533208 - DNA, 25 bp, Mus musculus
aggagctgaagaccccataaccagg

SEQ ID NO: 533209 - DNA, 25 bp, Mus musculus
aggagctgaagagcccataaccagg

SEQ ID NO: 533210 - DNA, 25 bp, Mus musculus
aggagctgacacactatgtcgcacg

SEQ ID NO: 533211 - DNA, 25 bp, Mus musculus
aggagctgacactctatgtcgcacg

SEQ ID NO: 533212 - DNA, 25 bp, Mus musculus
aggagctgagagctgataagtctct

SEQ ID NO: 533213 - DNA, 25 bp, Mus musculus
aggagctgagaggtgataagtctct

SEQ ID NO: 533214 - DNA, 25 bp, Mus musculus
aggagctgcactcccatttcttcag

SEQ ID NO: 533215 - DNA, 25 bp, Mus musculus
aggagctgcactgccatttcttcag

SEQ ID NO: 533216 - DNA, 25 bp, Mus musculus
aggagctgcagccatatgatagaaa

SEQ ID NO: 533217 - DNA, 25 bp, Mus musculus
aggagctgcagcgatatgatagaaa

SEQ ID NO: 533218 - DNA, 25 bp, Mus musculus
aggagctgcgcaatgtagaaggcca

SEQ ID NO: 533219 - DNA, 25 bp, Mus musculus
aggagctgcgcattgtagaaggcca

SEQ ID NO: 533220 - DNA, 25 bp, Mus musculus
aggagctggtttccagacccaccca

SEQ ID NO: 533221 - DNA, 25 bp, Mus musculus
aggagctggtttgcagacccaccca

SEQ ID NO: 533222 - DNA, 25 bp, Mus musculus
aggagctgtacgctgacatcgatgc

SEQ ID NO: 533223 - DNA, 25 bp, Mus musculus
aggagctgtacggtgacatcgatgc

SEQ ID NO: 533224 - DNA, 25 bp, Mus musculus
aggagcttccgcacccggcaagggt

SEQ ID NO: 533225 - DNA, 25 bp, Mus musculus
aggagcttccgctcccggcaagggt

SEQ ID NO: 533226 - DNA, 25 bp, Mus musculus
aggagcttccggagtgacagcccag

SEQ ID NO: 533227 - DNA, 25 bp, Mus musculus
aggagcttccggtgtgacagcccag

SEQ ID NO: 533228 - DNA, 25 bp, Mus musculus
aggagcttctctctgcatcattggg

SEQ ID NO: 533229 - DNA, 25 bp, Mus musculus
aggagcttctctgtgcatcattggg

SEQ ID NO: 533230 - DNA, 25 bp, Mus musculus
aggagcttgtggacccatctggact

SEQ ID NO: 533231 - DNA, 25 bp, Mus musculus
aggagcttgtggtcccatctggact

SEQ ID NO: 533232 - DNA, 25 bp, Mus musculus
aggagctttggaccgatgcccctgc

SEQ ID NO: 533233 - DNA, 25 bp, Mus musculus
aggagctttggagcgatgcccctgc

SEQ ID NO: 533234 - DNA, 25 bp, Mus musculus
aggaggaagagaacaccttcgcccc

SEQ ID NO: 533235 - DNA, 25 bp, Mus musculus
aggaggaagagatcaccttcgcccc

SEQ ID NO: 533236 - DNA, 25 bp, Mus musculus
aggaggaagagtcaccagcagagga

SEQ ID NO: 533237 - DNA, 25 bp, Mus musculus
aggaggaagagtgaccagcagagga

SEQ ID NO: 533238 - DNA, 25 bp, Mus musculus
aggaggaatattcgaacagctccaa

SEQ ID NO: 533239 - DNA, 25 bp, Mus musculus
aggaggaatattggaacagctccaa

SEQ ID NO: 533240 - DNA, 25 bp, Mus musculus
aggaggaatttcagcgcacctatgc

SEQ ID NO: 533241 - DNA, 25 bp, Mus musculus
aggaggaatttctgcgcacctatgc

SEQ ID NO: 533242 - DNA, 25 bp, Mus musculus
aggaggacccctcagtgactcctac

SEQ ID NO: 533243 - DNA, 25 bp, Mus musculus
aggaggacccctgagtgactcctac

SEQ ID NO: 533244 - DNA, 25 bp, Mus musculus
aggaggacctgcaggtatccatgcg

SEQ ID NO: 533245 - DNA, 25 bp, Mus musculus
aggaggacctgctggtatccatgcg

SEQ ID NO: 533246 - DNA, 25 bp, Mus musculus
aggaggacctgtatccgcccactgc

SEQ ID NO: 533247 - DNA, 25 bp, Mus musculus
aggaggacctgtttccgcccactgc

SEQ ID NO: 533248 - DNA, 25 bp, Mus musculus
aggaggacctttctgtaaagcgact

SEQ ID NO: 533249 - DNA, 25 bp, Mus musculus
aggaggacctttgtgtaaagcgact

SEQ ID NO: 533250 - DNA, 25 bp, Mus musculus
aggaggacgtgaagaaaaagctgaa

SEQ ID NO: 533251 - DNA, 25 bp, Mus musculus
aggaggacgtgatgaaaaagctgaa

SEQ ID NO: 533252 - DNA, 25 bp, Mus musculus
aggaggactgctctccctcagcctg

SEQ ID NO: 533253 - DNA, 25 bp, Mus musculus
aggaggactgctgtccctcagcctg

SEQ ID NO: 533254 - DNA, 25 bp, Mus musculus
aggaggagatggacctgaccagtct

SEQ ID NO: 533255 - DNA, 25 bp, Mus musculus
aggaggagatggtcctgaccagtct

SEQ ID NO: 533256 - DNA, 25 bp, Mus musculus
aggaggagcttgacttccagaagaa

SEQ ID NO: 533257 - DNA, 25 bp, Mus musculus
aggaggagcttgtcttccagaagaa

SEQ ID NO: 533258 - DNA, 25 bp, Mus musculus
aggaggaggatcatcgactaccctc

SEQ ID NO: 533259 - DNA, 25 bp, Mus musculus
aggaggaggatcttcgactaccctc

SEQ ID NO: 533260 - DNA, 25 bp, Mus musculus
aggaggaggcacagcagtcatccca

SEQ ID NO: 533261 - DNA, 25 bp, Mus musculus
aggaggaggcactgcagtcatccca

SEQ ID NO: 533262 - DNA, 25 bp, Mus musculus
aggaggaggtgcagtcccacaatac

SEQ ID NO: 533263 - DNA, 25 bp, Mus musculus
aggaggaggtgctgtcccacaatac

SEQ ID NO: 533264 - DNA, 25 bp, Mus musculus
aggaggagtaccacctacaggagct

SEQ ID NO: 533265 - DNA, 25 bp, Mus musculus
aggaggagtacctcctacaggagct

SEQ ID NO: 533266 - DNA, 25 bp, Mus musculus
aggaggatgaaaaggattccggcac

SEQ ID NO: 533267 - DNA, 25 bp, Mus musculus
aggaggatgaaatggattccggcac

SEQ ID NO: 533268 - DNA, 25 bp, Mus musculus
aggaggatgaccatcgcacagagcc

SEQ ID NO: 533269 - DNA, 25 bp, Mus musculus
aggaggatgaccttcgcacagagcc

SEQ ID NO: 533270 - DNA, 25 bp, Mus musculus
aggaggatgatcaaggacgctgtcc

SEQ ID NO: 533271 - DNA, 25 bp, Mus musculus
aggaggatgatctaggacgctgtcc

SEQ ID NO: 533272 - DNA, 25 bp, Mus musculus
aggaggatgcacagaagacccaact

SEQ ID NO: 533273 - DNA, 25 bp, Mus musculus
aggaggatgcactgaagacccaact

SEQ ID NO: 533274 - DNA, 25 bp, Mus musculus
aggaggattcggattaagcataaag

SEQ ID NO: 533275 - DNA, 25 bp, Mus musculus
aggaggattcggtttaagcataaag

SEQ ID NO: 533276 - DNA, 25 bp, Mus musculus
aggaggcaaagacgctcatcccagg

SEQ ID NO: 533277 - DNA, 25 bp, Mus musculus
aggaggcaaagaggctcatcccagg

SEQ ID NO: 533278 - DNA, 25 bp, Mus musculus
aggaggcaaaggatgattcggctca

SEQ ID NO: 533279 - DNA, 25 bp, Mus musculus
aggaggcaaaggttgattcggctca

SEQ ID NO: 533280 - DNA, 25 bp, Mus musculus
aggaggcaacacatgtgtcctcgag

SEQ ID NO: 533281 - DNA, 25 bp, Mus musculus
aggaggcaacacttgtgtcctcgag

SEQ ID NO: 533282 - DNA, 25 bp, Mus musculus
aggaggcaagggagcagaaacacaa

SEQ ID NO: 533283 - DNA, 25 bp, Mus musculus
aggaggcaagggtgcagaaacacaa

SEQ ID NO: 533284 - DNA, 25 bp, Mus musculus
aggaggcaattacgattgcccagga

SEQ ID NO: 533285 - DNA, 25 bp, Mus musculus
aggaggcaattaggattgcccagga

SEQ ID NO: 533286 - DNA, 25 bp, Mus musculus
aggaggcacaggatccctttatcgc

SEQ ID NO: 533287 - DNA, 25 bp, Mus musculus
aggaggcacaggttccctttatcgc

SEQ ID NO: 533288 - DNA, 25 bp, Mus musculus
aggaggcatgaaacttgtgaactgt

SEQ ID NO: 533289 - DNA, 25 bp, Mus musculus
aggaggcatgaatcttgtgaactgt

SEQ ID NO: 533290 - DNA, 25 bp, Mus musculus
aggaggcatgctactgtcagtttca

SEQ ID NO: 533291 - DNA, 25 bp, Mus musculus
aggaggcatgcttctgtcagtttca

SEQ ID NO: 533292 - DNA, 25 bp, Mus musculus
aggaggccacataccttctggagca

SEQ ID NO: 533293 - DNA, 25 bp, Mus musculus
aggaggccacattccttctggagca

SEQ ID NO: 533294 - DNA, 25 bp, Mus musculus
aggaggccatgcatatcttaaggaa

SEQ ID NO: 533295 - DNA, 25 bp, Mus musculus
aggaggccatgcttatcttaaggaa

SEQ ID NO: 533296 - DNA, 25 bp, Mus musculus
aggaggccatggaccctgtctcggt

SEQ ID NO: 533297 - DNA, 25 bp, Mus musculus
aggaggccatggtccctgtctcggt

SEQ ID NO: 533298 - DNA, 25 bp, Mus musculus
aggaggcccctaagaaccgatggag

SEQ ID NO: 533299 - DNA, 25 bp, Mus musculus
aggaggcccctatgaaccgatggag

SEQ ID NO: 533300 - DNA, 25 bp, Mus musculus
aggaggcccggcagagagccaagga

SEQ ID NO: 533301 - DNA, 25 bp, Mus musculus
aggaggcccggctgagagccaagga

SEQ ID NO: 533302 - DNA, 25 bp, Mus musculus
aggaggccgaagaggtacacgaaca

SEQ ID NO: 533303 - DNA, 25 bp, Mus musculus
aggaggccgaagtggtacacgaaca

SEQ ID NO: 533304 - DNA, 25 bp, Mus musculus
aggaggccgcccagctggacatgct

SEQ ID NO: 533305 - DNA, 25 bp, Mus musculus
aggaggccgccctgctggacatgct

SEQ ID NO: 533306 - DNA, 25 bp, Mus musculus
aggaggccgtggacatcaccgaccg

SEQ ID NO: 533307 - DNA, 25 bp, Mus musculus
aggaggccgtggtcatcaccgaccg

SEQ ID NO: 533308 - DNA, 25 bp, Mus musculus
aggaggcctcgcacactgtggccct

SEQ ID NO: 533309 - DNA, 25 bp, Mus musculus
aggaggcctcgctcactgtggccct

SEQ ID NO: 533310 - DNA, 25 bp, Mus musculus
aggaggcgcagaacatgaagaagct

SEQ ID NO: 533311 - DNA, 25 bp, Mus musculus
aggaggcgcagatcatgaagaagct

SEQ ID NO: 533312 - DNA, 25 bp, Mus musculus
aggaggcgccagagagaaaccactc

SEQ ID NO: 533313 - DNA, 25 bp, Mus musculus
aggaggcgccagtgagaaaccactc

SEQ ID NO: 533314 - DNA, 25 bp, Mus musculus
aggaggcggtgtaaacatggcttcc

SEQ ID NO: 533315 - DNA, 25 bp, Mus musculus
aggaggcggtgttaacatggcttcc

SEQ ID NO: 533316 - DNA, 25 bp, Mus musculus
aggaggctaggcagcacccttcccg

SEQ ID NO: 533317 - DNA, 25 bp, Mus musculus
aggaggctaggctgcacccttcccg

SEQ ID NO: 533318 - DNA, 25 bp, Mus musculus
aggaggctcaagctcaagcccagca

SEQ ID NO: 533319 - DNA, 25 bp, Mus musculus
aggaggctcaaggtcaagcccagca

SEQ ID NO: 533320 - DNA, 25 bp, Mus musculus
aggaggctctgtatggaagttttca

SEQ ID NO: 533321 - DNA, 25 bp, Mus musculus
aggaggctctgtttggaagttttca

SEQ ID NO: 533322 - DNA, 25 bp, Mus musculus
aggaggctgaagagtgaacccaaga

SEQ ID NO: 533323 - DNA, 25 bp, Mus musculus
aggaggctgaagtgtgaacccaaga

SEQ ID NO: 533324 - DNA, 25 bp, Mus musculus
aggaggctgagcagcacaagattgt

SEQ ID NO: 533325 - DNA, 25 bp, Mus musculus
aggaggctgagctgcacaagattgt

SEQ ID NO: 533326 - DNA, 25 bp, Mus musculus
aggaggctgcccataccttagaagc

SEQ ID NO: 533327 - DNA, 25 bp, Mus musculus
aggaggctgcccttaccttagaagc

SEQ ID NO: 533328 - DNA, 25 bp, Mus musculus
aggaggctggccacaatttggagta

SEQ ID NO: 533329 - DNA, 25 bp, Mus musculus
aggaggctggcctcaatttggagta

SEQ ID NO: 533330 - DNA, 25 bp, Mus musculus
aggagggaacttaccgcagctccat

SEQ ID NO: 533331 - DNA, 25 bp, Mus musculus
aggagggaactttccgcagctccat

SEQ ID NO: 533332 - DNA, 25 bp, Mus musculus
aggagggaccccatctgcatttgac

SEQ ID NO: 533333 - DNA, 25 bp, Mus musculus
aggagggaccccttctgcatttgac

SEQ ID NO: 533334 - DNA, 25 bp, Mus musculus
aggagggacgccatcagccttcgac

SEQ ID NO: 533335 - DNA, 25 bp, Mus musculus
aggagggacgccttcagccttcgac

SEQ ID NO: 533336 - DNA, 25 bp, Mus musculus
aggagggaggacacctgtttgtcct

SEQ ID NO: 533337 - DNA, 25 bp, Mus musculus
aggagggaggactcctgtttgtcct

SEQ ID NO: 533338 - DNA, 25 bp, Mus musculus
aggagggcacgtagcccgccgcctt

SEQ ID NO: 533339 - DNA, 25 bp, Mus musculus
aggagggcacgttgcccgccgcctt

SEQ ID NO: 533340 - DNA, 25 bp, Mus musculus
aggagggcccgcagcagaccagtca

SEQ ID NO: 533341 - DNA, 25 bp, Mus musculus
aggagggcccgctgcagaccagtca

SEQ ID NO: 533342 - DNA, 25 bp, Mus musculus
aggagggcctgcagtcaaccatctc

SEQ ID NO: 533343 - DNA, 25 bp, Mus musculus
aggagggcctgctgtcaaccatctc

SEQ ID NO: 533344 - DNA, 25 bp, Mus musculus
aggagggcgccaaggccttctacaa

SEQ ID NO: 533345 - DNA, 25 bp, Mus musculus
aggagggcgccatggccttctacaa

SEQ ID NO: 533346 - DNA, 25 bp, Mus musculus
aggaggtccaccacaagcaggagag

SEQ ID NO: 533347 - DNA, 25 bp, Mus musculus
aggaggtccacctcaagcaggagag

SEQ ID NO: 533348 - DNA, 25 bp, Mus musculus
aggaggtctggaagtggaaagccga

SEQ ID NO: 533349 - DNA, 25 bp, Mus musculus
aggaggtctggatgtggaaagccga

SEQ ID NO: 533350 - DNA, 25 bp, Mus musculus
aggaggtgcccaaccaccgagttgc

SEQ ID NO: 533351 - DNA, 25 bp, Mus musculus
aggaggtgcccatccaccgagttgc

SEQ ID NO: 533352 - DNA, 25 bp, Mus musculus
aggaggttacagagtctcaattctt

SEQ ID NO: 533353 - DNA, 25 bp, Mus musculus
aggaggttacagtgtctcaattctt

SEQ ID NO: 533354 - DNA, 25 bp, Mus musculus
aggaggtttttcactgcaatataag

SEQ ID NO: 533355 - DNA, 25 bp, Mus musculus
aggaggtttttctctgcaatataag

SEQ ID NO: 533356 - DNA, 25 bp, Mus musculus
aggagtacatatcggccaccaaaga

SEQ ID NO: 533357 - DNA, 25 bp, Mus musculus
aggagtacatatgggccaccaaaga

SEQ ID NO: 533358 - DNA, 25 bp, Mus musculus
aggagtacgatgctttggccccaca

SEQ ID NO: 533359 - DNA, 25 bp, Mus musculus
aggagtacgatggtttggccccaca

SEQ ID NO: 533360 - DNA, 25 bp, Mus musculus
aggagtataagacgcagctgctggc

SEQ ID NO: 533361 - DNA, 25 bp, Mus musculus
aggagtataagaggcagctgctggc

SEQ ID NO: 533362 - DNA, 25 bp, Mus musculus
aggagtcagaaaagcagctgcacct

SEQ ID NO: 533363 - DNA, 25 bp, Mus musculus
aggagtcagaaatgcagctgcacct

SEQ ID NO: 533364 - DNA, 25 bp, Mus musculus
aggagtccctcgagtatctgcagtt

SEQ ID NO: 533365 - DNA, 25 bp, Mus musculus
aggagtccctcgtgtatctgcagtt

SEQ ID NO: 533366 - DNA, 25 bp, Mus musculus
aggagtcctacaaagaccggaggcg

SEQ ID NO: 533367 - DNA, 25 bp, Mus musculus
aggagtcctacatagaccggaggcg

SEQ ID NO: 533368 - DNA, 25 bp, Mus musculus
aggagtccttaaccacgaggagctg

SEQ ID NO: 533369 - DNA, 25 bp, Mus musculus
aggagtccttaagcacgaggagctg

SEQ ID NO: 533370 - DNA, 25 bp, Mus musculus
aggagtcgggctatgcaggcttcat

SEQ ID NO: 533371 - DNA, 25 bp, Mus musculus
aggagtcgggctttgcaggcttcat

SEQ ID NO: 533372 - DNA, 25 bp, Mus musculus
aggagtctcagtcaggtccagtact

SEQ ID NO: 533373 - DNA, 25 bp, Mus musculus
aggagtctcagtgaggtccagtact

SEQ ID NO: 533374 - DNA, 25 bp, Mus musculus
aggagtctctcgctctggtttcccc

SEQ ID NO: 533375 - DNA, 25 bp, Mus musculus
aggagtctctcggtctggtttcccc

SEQ ID NO: 533376 - DNA, 25 bp, Mus musculus
aggagtcttcgacgtcacaccagag

SEQ ID NO: 533377 - DNA, 25 bp, Mus musculus
aggagtcttcgaggtcacaccagag

SEQ ID NO: 533378 - DNA, 25 bp, Mus musculus
aggagtgcaaacaccccagtgtctc

SEQ ID NO: 533379 - DNA, 25 bp, Mus musculus
aggagtgcaaactccccagtgtctc

SEQ ID NO: 533380 - DNA, 25 bp, Mus musculus
aggagtgcagagacgcagccgactc

SEQ ID NO: 533381 - DNA, 25 bp, Mus musculus
aggagtgcagagtcgcagccgactc

SEQ ID NO: 533382 - DNA, 25 bp, Mus musculus
aggagtgcagtgacctcaggacaga

SEQ ID NO: 533383 - DNA, 25 bp, Mus musculus
aggagtgcagtgtcctcaggacaga

SEQ ID NO: 533384 - DNA, 25 bp, Mus musculus
aggagtgcatacagtcaggcaagga

SEQ ID NO: 533385 - DNA, 25 bp, Mus musculus
aggagtgcatactgtcaggcaagga

SEQ ID NO: 533386 - DNA, 25 bp, Mus musculus
aggagtgccacaccggtcctttgga

SEQ ID NO: 533387 - DNA, 25 bp, Mus musculus
aggagtgccacagcggtcctttgga

SEQ ID NO: 533388 - DNA, 25 bp, Mus musculus
aggagtgctcctccctagtcacggg

SEQ ID NO: 533389 - DNA, 25 bp, Mus musculus
aggagtgctcctgcctagtcacggg

SEQ ID NO: 533390 - DNA, 25 bp, Mus musculus
aggagtgcttcaaccgatctcggga

SEQ ID NO: 533391 - DNA, 25 bp, Mus musculus
aggagtgcttcatccgatctcggga

SEQ ID NO: 533392 - DNA, 25 bp, Mus musculus
aggagtggccttagccaagcccctg

SEQ ID NO: 533393 - DNA, 25 bp, Mus musculus
aggagtggcctttgccaagcccctg

SEQ ID NO: 533394 - DNA, 25 bp, Mus musculus
aggagttacgccaacgaatgttagt

SEQ ID NO: 533395 - DNA, 25 bp, Mus musculus
aggagttacgcctacgaatgttagt

SEQ ID NO: 533396 - DNA, 25 bp, Mus musculus
aggagttcatgacgccccggcagct

SEQ ID NO: 533397 - DNA, 25 bp, Mus musculus
aggagttcatgaggccccggcagct

SEQ ID NO: 533398 - DNA, 25 bp, Mus musculus
aggagttctcttacctggctggtga

SEQ ID NO: 533399 - DNA, 25 bp, Mus musculus
aggagttctctttcctggctggtga

SEQ ID NO: 533400 - DNA, 25 bp, Mus musculus
aggagttgaaggctcgattccacga

SEQ ID NO: 533401 - DNA, 25 bp, Mus musculus
aggagttgaagggtcgattccacga

SEQ ID NO: 533402 - DNA, 25 bp, Mus musculus
aggagttgaggacgtgccacccacc

SEQ ID NO: 533403 - DNA, 25 bp, Mus musculus
aggagttgaggaggtgccacccacc

SEQ ID NO: 533404 - DNA, 25 bp, Mus musculus
aggagtttcagaagagcccacggcg

SEQ ID NO: 533405 - DNA, 25 bp, Mus musculus
aggagtttcagatgagcccacggcg

SEQ ID NO: 533406 - DNA, 25 bp, Mus musculus
aggagtttctacctgtatgcaggca

SEQ ID NO: 533407 - DNA, 25 bp, Mus musculus
aggagtttctacgtgtatgcaggca

SEQ ID NO: 533408 - DNA, 25 bp, Mus musculus
aggataacgaacatttcatctgatg

SEQ ID NO: 533409 - DNA, 25 bp, Mus musculus
aggataacgaacttttcatctgatg

SEQ ID NO: 533410 - DNA, 25 bp, Mus musculus
aggataactgtacggcatggctcag

SEQ ID NO: 533411 - DNA, 25 bp, Mus musculus
aggataactgtagggcatggctcag

SEQ ID NO: 533412 - DNA, 25 bp, Mus musculus
aggataacttctcggccaaagctga

SEQ ID NO: 533413 - DNA, 25 bp, Mus musculus
aggataacttctgggccaaagctga

SEQ ID NO: 533414 - DNA, 25 bp, Mus musculus
aggatacagcctacaacaccaagag

SEQ ID NO: 533415 - DNA, 25 bp, Mus musculus
aggatacagccttcaacaccaagag

SEQ ID NO: 533416 - DNA, 25 bp, Mus musculus
aggatacagggtatcctggcactca

SEQ ID NO: 533417 - DNA, 25 bp, Mus musculus
aggatacagggtttcctggcactca

SEQ ID NO: 533418 - DNA, 25 bp, Mus musculus
aggatacggacacgagccagcttct

SEQ ID NO: 533419 - DNA, 25 bp, Mus musculus
aggatacggacaggagccagcttct

SEQ ID NO: 533420 - DNA, 25 bp, Mus musculus
aggatagagacacgtctcaccggga

SEQ ID NO: 533421 - DNA, 25 bp, Mus musculus
aggatagagacaggtctcaccggga

SEQ ID NO: 533422 - DNA, 25 bp, Mus musculus
aggatagccccacatctggcaagtt

SEQ ID NO: 533423 - DNA, 25 bp, Mus musculus
aggatagccccagatctggcaagtt

SEQ ID NO: 533424 - DNA, 25 bp, Mus musculus
aggatagcctccagatctgtgtggg

SEQ ID NO: 533425 - DNA, 25 bp, Mus musculus
aggatagcctcctgatctgtgtggg

SEQ ID NO: 533426 - DNA, 25 bp, Mus musculus
aggatataaattcacactcttggaa

SEQ ID NO: 533427 - DNA, 25 bp, Mus musculus
aggatataaattgacactcttggaa

SEQ ID NO: 533428 - DNA, 25 bp, Mus musculus
aggatatacactcctcacgtcccag

SEQ ID NO: 533429 - DNA, 25 bp, Mus musculus
aggatatacactgctcacgtcccag

SEQ ID NO: 533430 - DNA, 25 bp, Mus musculus
aggatatcggtgcacgacgcactgc

SEQ ID NO: 533431 - DNA, 25 bp, Mus musculus
aggatatcggtggacgacgcactgc

SEQ ID NO: 533432 - DNA, 25 bp, Mus musculus
aggatcaagaagcaaccccagagtc

SEQ ID NO: 533433 - DNA, 25 bp, Mus musculus
aggatcaagaaggaaccccagagtc

SEQ ID NO: 533434 - DNA, 25 bp, Mus musculus
aggatcacagcaccccaagctcttg

SEQ ID NO: 533435 - DNA, 25 bp, Mus musculus
aggatcacagcagcccaagctcttg

SEQ ID NO: 533436 - DNA, 25 bp, Mus musculus
aggatcaccgacaagggcctggcct

SEQ ID NO: 533437 - DNA, 25 bp, Mus musculus
aggatcaccgactagggcctggcct

SEQ ID NO: 533438 - DNA, 25 bp, Mus musculus
aggatcacgggcctcagactatcac

SEQ ID NO: 533439 - DNA, 25 bp, Mus musculus
aggatcacgggcgtcagactatcac

SEQ ID NO: 533440 - DNA, 25 bp, Mus musculus
aggatcactttgaccacaacatcag

SEQ ID NO: 533441 - DNA, 25 bp, Mus musculus
aggatcactttgtccacaacatcag

SEQ ID NO: 533442 - DNA, 25 bp, Mus musculus
aggatcagatcacccgtgttcatgc

SEQ ID NO: 533443 - DNA, 25 bp, Mus musculus
aggatcagatcagccgtgttcatgc

SEQ ID NO: 533444 - DNA, 25 bp, Mus musculus
aggatcagcatgctgacacggccct

SEQ ID NO: 533445 - DNA, 25 bp, Mus musculus
aggatcagcatggtgacacggccct

SEQ ID NO: 533446 - DNA, 25 bp, Mus musculus
aggatcagcctgatcttacgaggag

SEQ ID NO: 533447 - DNA, 25 bp, Mus musculus
aggatcagcctgttcttacgaggag

SEQ ID NO: 533448 - DNA, 25 bp, Mus musculus
aggatcaggtatcgaatagtaagca

SEQ ID NO: 533449 - DNA, 25 bp, Mus musculus
aggatcaggtatggaatagtaagca

SEQ ID NO: 533450 - DNA, 25 bp, Mus musculus
aggatcatacagctgacagtcgcag

SEQ ID NO: 533451 - DNA, 25 bp, Mus musculus
aggatcatacaggtgacagtcgcag

SEQ ID NO: 533452 - DNA, 25 bp, Mus musculus
aggatcatgggcagctgtgtgtcta

SEQ ID NO: 533453 - DNA, 25 bp, Mus musculus
aggatcatgggctgctgtgtgtcta

SEQ ID NO: 533454 - DNA, 25 bp, Mus musculus
aggatccactgtacatcgggctgcg

SEQ ID NO: 533455 - DNA, 25 bp, Mus musculus
aggatccactgttcatcgggctgcg

SEQ ID NO: 533456 - DNA, 25 bp, Mus musculus
aggatccagaagctactcgcccagc

SEQ ID NO: 533457 - DNA, 25 bp, Mus musculus
aggatccagaaggtactcgcccagc

SEQ ID NO: 533458 - DNA, 25 bp, Mus musculus
aggatccatgccagaaacaagcctg

SEQ ID NO: 533459 - DNA, 25 bp, Mus musculus
aggatccatgcctgaaacaagcctg

SEQ ID NO: 533460 - DNA, 25 bp, Mus musculus
aggatcctgctgcactcagcttccg

SEQ ID NO: 533461 - DNA, 25 bp, Mus musculus
aggatcctgctggactcagcttccg

SEQ ID NO: 533462 - DNA, 25 bp, Mus musculus
aggatccttaacaggatgggtgcag

SEQ ID NO: 533463 - DNA, 25 bp, Mus musculus
aggatccttaactggatgggtgcag

SEQ ID NO: 533464 - DNA, 25 bp, Mus musculus
aggatcgacacgcacctcagcaaag

SEQ ID NO: 533465 - DNA, 25 bp, Mus musculus
aggatcgacacggacctcagcaaag

SEQ ID NO: 533466 - DNA, 25 bp, Mus musculus
aggatcgcatctcccgtctgatggg

SEQ ID NO: 533467 - DNA, 25 bp, Mus musculus
aggatcgcatctgccgtctgatggg

SEQ ID NO: 533468 - DNA, 25 bp, Mus musculus
aggatctgttgtcccggctaatctg

SEQ ID NO: 533469 - DNA, 25 bp, Mus musculus
aggatctgttgtgccggctaatctg

SEQ ID NO: 533470 - DNA, 25 bp, Mus musculus
aggatcttatagaccgaggatggag

SEQ ID NO: 533471 - DNA, 25 bp, Mus musculus
aggatcttatagtccgaggatggag

SEQ ID NO: 533472 - DNA, 25 bp, Mus musculus
aggatgaaatggacagtcctggtga

SEQ ID NO: 533473 - DNA, 25 bp, Mus musculus
aggatgaaatggtcagtcctggtga

SEQ ID NO: 533474 - DNA, 25 bp, Mus musculus
aggatgaacgaaatggagactgctc

SEQ ID NO: 533475 - DNA, 25 bp, Mus musculus
aggatgaacgaattggagactgctc

SEQ ID NO: 533476 - DNA, 25 bp, Mus musculus
aggatgaacttgagcagtcacagca

SEQ ID NO: 533477 - DNA, 25 bp, Mus musculus
aggatgaacttgtgcagtcacagca

SEQ ID NO: 533478 - DNA, 25 bp, Mus musculus
aggatgaagaaaagagcacaaaggt

SEQ ID NO: 533479 - DNA, 25 bp, Mus musculus
aggatgaagaaatgagcacaaaggt

SEQ ID NO: 533480 - DNA, 25 bp, Mus musculus
aggatgaaggaaaagcacggtgaca

SEQ ID NO: 533481 - DNA, 25 bp, Mus musculus
aggatgaaggaatagcacggtgaca

SEQ ID NO: 533482 - DNA, 25 bp, Mus musculus
aggatgaaggcaccccgcttcgtga

SEQ ID NO: 533483 - DNA, 25 bp, Mus musculus
aggatgaaggcagcccgcttcgtga

SEQ ID NO: 533484 - DNA, 25 bp, Mus musculus
aggatgacagtgaattagacttttc

SEQ ID NO: 533485 - DNA, 25 bp, Mus musculus
aggatgacagtgtattagacttttc

SEQ ID NO: 533486 - DNA, 25 bp, Mus musculus
aggatgacatcgaggacccctccaa

SEQ ID NO: 533487 - DNA, 25 bp, Mus musculus
aggatgacatcgtggacccctccaa

SEQ ID NO: 533488 - DNA, 25 bp, Mus musculus
aggatgaccaagagacagtgatcgg

SEQ ID NO: 533489 - DNA, 25 bp, Mus musculus
aggatgaccaagtgacagtgatcgg

SEQ ID NO: 533490 - DNA, 25 bp, Mus musculus
aggatgacgcccagcagcgcagctg

SEQ ID NO: 533491 - DNA, 25 bp, Mus musculus
aggatgacgccctgcagcgcagctg

SEQ ID NO: 533492 - DNA, 25 bp, Mus musculus
aggatgactgagacgttatgggcca

SEQ ID NO: 533493 - DNA, 25 bp, Mus musculus
aggatgactgagtcgttatgggcca

SEQ ID NO: 533494 - DNA, 25 bp, Mus musculus
aggatgagaagaagccgccctatga

SEQ ID NO: 533495 - DNA, 25 bp, Mus musculus
aggatgagaagatgccgccctatga

SEQ ID NO: 533496 - DNA, 25 bp, Mus musculus
aggatgagagtgatcggatgtcaca

SEQ ID NO: 533497 - DNA, 25 bp, Mus musculus
aggatgagagtgttcggatgtcaca

SEQ ID NO: 533498 - DNA, 25 bp, Mus musculus
aggatgagcgctaaccctcccagca

SEQ ID NO: 533499 - DNA, 25 bp, Mus musculus
aggatgagcgcttaccctcccagca

SEQ ID NO: 533500 - DNA, 25 bp, Mus musculus
aggatgagctggacaagtattcgga

SEQ ID NO: 533501 - DNA, 25 bp, Mus musculus
aggatgagctggtcaagtattcgga

SEQ ID NO: 533502 - DNA, 25 bp, Mus musculus
aggatgaggccaccagtgccttcag

SEQ ID NO: 533503 - DNA, 25 bp, Mus musculus
aggatgaggccagcagtgccttcag

SEQ ID NO: 533504 - DNA, 25 bp, Mus musculus
aggatgaggcctccttccggtcaga

SEQ ID NO: 533505 - DNA, 25 bp, Mus musculus
aggatgaggcctgcttccggtcaga

SEQ ID NO: 533506 - DNA, 25 bp, Mus musculus
aggatgaggtggacgacctccccag

SEQ ID NO: 533507 - DNA, 25 bp, Mus musculus
aggatgaggtggtcgacctccccag

SEQ ID NO: 533508 - DNA, 25 bp, Mus musculus
aggatgagtacgacaccccacgcca

SEQ ID NO: 533509 - DNA, 25 bp, Mus musculus
aggatgagtacgtcaccccacgcca

SEQ ID NO: 533510 - DNA, 25 bp, Mus musculus
aggatgagtgccagatgctccctgg

SEQ ID NO: 533511 - DNA, 25 bp, Mus musculus
aggatgagtgcctgatgctccctgg

SEQ ID NO: 533512 - DNA, 25 bp, Mus musculus
aggatgatcctcacacctgccctgt

SEQ ID NO: 533513 - DNA, 25 bp, Mus musculus
aggatgatcctctcacctgccctgt

SEQ ID NO: 533514 - DNA, 25 bp, Mus musculus
aggatgatggcaccaccagcacatg

SEQ ID NO: 533515 - DNA, 25 bp, Mus musculus
aggatgatggcagcaccagcacatg

SEQ ID NO: 533516 - DNA, 25 bp, Mus musculus
aggatgcagaccaggcctccgagtc

SEQ ID NO: 533517 - DNA, 25 bp, Mus musculus
aggatgcagacctggcctccgagtc

SEQ ID NO: 533518 - DNA, 25 bp, Mus musculus
aggatgccacctatacttctgcccg

SEQ ID NO: 533519 - DNA, 25 bp, Mus musculus
aggatgccacctttacttctgcccg

SEQ ID NO: 533520 - DNA, 25 bp, Mus musculus
aggatgccccgcagaggatggacct

SEQ ID NO: 533521 - DNA, 25 bp, Mus musculus
aggatgccccgctgaggatggacct

SEQ ID NO: 533522 - DNA, 25 bp, Mus musculus
aggatgcctagcctggcaccccgga

SEQ ID NO: 533523 - DNA, 25 bp, Mus musculus
aggatgcctagcgtggcaccccgga

SEQ ID NO: 533524 - DNA, 25 bp, Mus musculus
aggatgcctgctacccgtgctttcg

SEQ ID NO: 533525 - DNA, 25 bp, Mus musculus
aggatgcctgcttcccgtgctttcg

SEQ ID NO: 533526 - DNA, 25 bp, Mus musculus
aggatgcctggtccatgggcacaaa

SEQ ID NO: 533527 - DNA, 25 bp, Mus musculus
aggatgcctggtgcatgggcacaaa

SEQ ID NO: 533528 - DNA, 25 bp, Mus musculus
aggatgcgaacgcagcactgctcag

SEQ ID NO: 533529 - DNA, 25 bp, Mus musculus
aggatgcgaacggagcactgctcag

SEQ ID NO: 533530 - DNA, 25 bp, Mus musculus
aggatgcggccgacgccaagagcaa

SEQ ID NO: 533531 - DNA, 25 bp, Mus musculus
aggatgcggccgtcgccaagagcaa

SEQ ID NO: 533532 - DNA, 25 bp, Mus musculus
aggatgcggtgtaggacacctatga

SEQ ID NO: 533533 - DNA, 25 bp, Mus musculus
aggatgcggtgttggacacctatga

SEQ ID NO: 533534 - DNA, 25 bp, Mus musculus
aggatgctgaccagtggaacggccc

SEQ ID NO: 533535 - DNA, 25 bp, Mus musculus
aggatgctgaccctatttcacacaa

SEQ ID NO: 533536 - DNA, 25 bp, Mus musculus
aggatgctgaccgtatttcacacaa

SEQ ID NO: 533537 - DNA, 25 bp, Mus musculus
aggatgctgacctgtggaacggccc

SEQ ID NO: 533538 - DNA, 25 bp, Mus musculus
aggatgctgatcaaatcgtggcaaa

SEQ ID NO: 533539 - DNA, 25 bp, Mus musculus
aggatgctgatctaatcgtggcaaa

SEQ ID NO: 533540 - DNA, 25 bp, Mus musculus
aggatgctgttgacggtgactttgc

SEQ ID NO: 533541 - DNA, 25 bp, Mus musculus
aggatgctgttgtcggtgactttgc

SEQ ID NO: 533542 - DNA, 25 bp, Mus musculus
aggatgctttcacgccctcgagtgt

SEQ ID NO: 533543 - DNA, 25 bp, Mus musculus
aggatgctttcaggccctcgagtgt

SEQ ID NO: 533544 - DNA, 25 bp, Mus musculus
aggatggagatcatgggctgcccac

SEQ ID NO: 533545 - DNA, 25 bp, Mus musculus
aggatggagatcttgggctgcccac

SEQ ID NO: 533546 - DNA, 25 bp, Mus musculus
aggatggaggaaagactgcctattc

SEQ ID NO: 533547 - DNA, 25 bp, Mus musculus
aggatggaggaatgactgcctattc

SEQ ID NO: 533548 - DNA, 25 bp, Mus musculus
aggatggattcactgctcattgcag

SEQ ID NO: 533549 - DNA, 25 bp, Mus musculus
aggatggattcagtgctcattgcag

SEQ ID NO: 533550 - DNA, 25 bp, Mus musculus
aggatggcaagacttacttcttcca

SEQ ID NO: 533551 - DNA, 25 bp, Mus musculus
aggatggcaagagttacttcttcca

SEQ ID NO: 533552 - DNA, 25 bp, Mus musculus
aggatggcagcgagtctctcggaac

SEQ ID NO: 533553 - DNA, 25 bp, Mus musculus
aggatggcagcgtgtctctcggaac

SEQ ID NO: 533554 - DNA, 25 bp, Mus musculus
aggatggccagtaccgggttgactc

SEQ ID NO: 533555 - DNA, 25 bp, Mus musculus
aggatggccagttccgggttgactc

SEQ ID NO: 533556 - DNA, 25 bp, Mus musculus
aggatggctcaccagcactgtgagc

SEQ ID NO: 533557 - DNA, 25 bp, Mus musculus
aggatggctcacgagcactgtgagc

SEQ ID NO: 533558 - DNA, 25 bp, Mus musculus
aggatggctcctacacaggcttcat

SEQ ID NO: 533559 - DNA, 25 bp, Mus musculus
aggatggctccttcacaggcttcat

SEQ ID NO: 533560 - DNA, 25 bp, Mus musculus
aggatggtgctcatgtctccagcga

SEQ ID NO: 533561 - DNA, 25 bp, Mus musculus
aggatggtgctcttgtctccagcga

SEQ ID NO: 533562 - DNA, 25 bp, Mus musculus
aggatggtgtctctcgaagattcat

SEQ ID NO: 533563 - DNA, 25 bp, Mus musculus
aggatggtgtctgtcgaagattcat

SEQ ID NO: 533564 - DNA, 25 bp, Mus musculus
aggatggttccccaggcgccagagg

SEQ ID NO: 533565 - DNA, 25 bp, Mus musculus
aggatggttcccgaggcgccagagg

SEQ ID NO: 533566 - DNA, 25 bp, Mus musculus
aggatgtagaacctgccctccggaa

SEQ ID NO: 533567 - DNA, 25 bp, Mus musculus
aggatgtagaacgtgccctccggaa

SEQ ID NO: 533568 - DNA, 25 bp, Mus musculus
aggatgtattctagcccactgcatg

SEQ ID NO: 533569 - DNA, 25 bp, Mus musculus
aggatgtattcttgcccactgcatg

SEQ ID NO: 533570 - DNA, 25 bp, Mus musculus
aggatgtcgggcacgtcgctccccg

SEQ ID NO: 533571 - DNA, 25 bp, Mus musculus
aggatgtcgggctcgtcgctccccg

SEQ ID NO: 533572 - DNA, 25 bp, Mus musculus
aggatgtgagccagtttgatgcacg

SEQ ID NO: 533573 - DNA, 25 bp, Mus musculus
aggatgtgagcctgtttgatgcacg

SEQ ID NO: 533574 - DNA, 25 bp, Mus musculus
aggatgtgcccgatggcccactgct

SEQ ID NO: 533575 - DNA, 25 bp, Mus musculus
aggatgtgcccgttggcccactgct

SEQ ID NO: 533576 - DNA, 25 bp, Mus musculus
aggatgtgttgaccgtggccttctc

SEQ ID NO: 533577 - DNA, 25 bp, Mus musculus
aggatgtgttgagcgtggccttctc

SEQ ID NO: 533578 - DNA, 25 bp, Mus musculus
aggatgtttcctaggcctgccgggc

SEQ ID NO: 533579 - DNA, 25 bp, Mus musculus
aggatgtttccttggcctgccgggc

SEQ ID NO: 533580 - DNA, 25 bp, Mus musculus
aggattacaaccagctgcggccact

SEQ ID NO: 533581 - DNA, 25 bp, Mus musculus
aggattacaacctgctgcggccact

SEQ ID NO: 533582 - DNA, 25 bp, Mus musculus
aggattacaatcaggaggtggatgc

SEQ ID NO: 533583 - DNA, 25 bp, Mus musculus
aggattacaatctggaggtggatgc

SEQ ID NO: 533584 - DNA, 25 bp, Mus musculus
aggattcaacgcaactgaagatgcc

SEQ ID NO: 533585 - DNA, 25 bp, Mus musculus
aggattcaacgctactgaagatgcc

SEQ ID NO: 533586 - DNA, 25 bp, Mus musculus
aggattcagatgagtgccgttgtgt

SEQ ID NO: 533587 - DNA, 25 bp, Mus musculus
aggattcagatgtgtgccgttgtgt

SEQ ID NO: 533588 - DNA, 25 bp, Mus musculus
aggattcatccccagtgtccaagac

SEQ ID NO: 533589 - DNA, 25 bp, Mus musculus
aggattcatcccgagtgtccaagac

SEQ ID NO: 533590 - DNA, 25 bp, Mus musculus
aggattcatcctccccatctgtgag

SEQ ID NO: 533591 - DNA, 25 bp, Mus musculus
aggattcatcctgcccatctgtgag

SEQ ID NO: 533592 - DNA, 25 bp, Mus musculus
aggattcctggaacatccacctatg

SEQ ID NO: 533593 - DNA, 25 bp, Mus musculus
aggattcctggatcatccacctatg

SEQ ID NO: 533594 - DNA, 25 bp, Mus musculus
aggattcgcgccagggacgacaacc

SEQ ID NO: 533595 - DNA, 25 bp, Mus musculus
aggattcgcgcctgggacgacaacc

SEQ ID NO: 533596 - DNA, 25 bp, Mus musculus
aggattctgtgacgctgataacagc

SEQ ID NO: 533597 - DNA, 25 bp, Mus musculus
aggattctgtgaggctgataacagc

SEQ ID NO: 533598 - DNA, 25 bp, Mus musculus
aggattcttccacccctcacagtgg

SEQ ID NO: 533599 - DNA, 25 bp, Mus musculus
aggattcttccagccctcacagtgg

SEQ ID NO: 533600 - DNA, 25 bp, Mus musculus
aggattctttctaccagccctggat

SEQ ID NO: 533601 - DNA, 25 bp, Mus musculus
aggattctttcttccagccctggat

SEQ ID NO: 533602 - DNA, 25 bp, Mus musculus
aggattgctgagatcctcctgtggt

SEQ ID NO: 533603 - DNA, 25 bp, Mus musculus
aggattgctgagttcctcctgtggt

SEQ ID NO: 533604 - DNA, 25 bp, Mus musculus
aggattggactcaccagggcattgc

SEQ ID NO: 533605 - DNA, 25 bp, Mus musculus
aggattggactctccagggcattgc

SEQ ID NO: 533606 - DNA, 25 bp, Mus musculus
aggattggccaacatgacttaccag

SEQ ID NO: 533607 - DNA, 25 bp, Mus musculus
aggattggccaagatgacttaccag

SEQ ID NO: 533608 - DNA, 25 bp, Mus musculus
aggattggctatcctgatgacatca

SEQ ID NO: 533609 - DNA, 25 bp, Mus musculus
aggattggctatgctgatgacatca

SEQ ID NO: 533610 - DNA, 25 bp, Mus musculus
aggatttagcacactcctctatcag

SEQ ID NO: 533611 - DNA, 25 bp, Mus musculus
aggatttagcactctcctctatcag

SEQ ID NO: 533612 - DNA, 25 bp, Mus musculus
aggatttcacatcactcaggctggc

SEQ ID NO: 533613 - DNA, 25 bp, Mus musculus
aggatttcacatgactcaggctggc

SEQ ID NO: 533614 - DNA, 25 bp, Mus musculus
aggatttcattgcacagccggctca

SEQ ID NO: 533615 - DNA, 25 bp, Mus musculus
aggatttcattggacagccggctca

SEQ ID NO: 533616 - DNA, 25 bp, Mus musculus
aggatttcgatgaggaccactttgt

SEQ ID NO: 533617 - DNA, 25 bp, Mus musculus
aggatttcgatgtggaccactttgt

SEQ ID NO: 533618 - DNA, 25 bp, Mus musculus
aggatttctcttctgcagaccgcct

SEQ ID NO: 533619 - DNA, 25 bp, Mus musculus
aggatttctcttgtgcagaccgcct

SEQ ID NO: 533620 - DNA, 25 bp, Mus musculus
aggattttgagaacggcattgggaa

SEQ ID NO: 533621 - DNA, 25 bp, Mus musculus
aggattttgagatcggcattgggaa

SEQ ID NO: 533622 - DNA, 25 bp, Mus musculus
aggcaaaaaggcagtagccacacca

SEQ ID NO: 533623 - DNA, 25 bp, Mus musculus
aggcaaaaaggctgtagccacacca

SEQ ID NO: 533624 - DNA, 25 bp, Mus musculus
aggcaaaagcggagcctacctcatc

SEQ ID NO: 533625 - DNA, 25 bp, Mus musculus
aggcaaaagcggtgcctacctcatc

SEQ ID NO: 533626 - DNA, 25 bp, Mus musculus
aggcaaacagagcaaaagtttctct

SEQ ID NO: 533627 - DNA, 25 bp, Mus musculus
aggcaaacagaggaaaagtttctct

SEQ ID NO: 533628 - DNA, 25 bp, Mus musculus
aggcaaacatctcttttacaggtag

SEQ ID NO: 533629 - DNA, 25 bp, Mus musculus
aggcaaacatctgttttacaggtag

SEQ ID NO: 533630 - DNA, 25 bp, Mus musculus
aggcaaactcttcgctgggtgacct

SEQ ID NO: 533631 - DNA, 25 bp, Mus musculus
aggcaaactcttggctgggtgacct

SEQ ID NO: 533632 - DNA, 25 bp, Mus musculus
aggcaaagagccagcacacctcatg

SEQ ID NO: 533633 - DNA, 25 bp, Mus musculus
aggcaaagagcctgcacacctcatg

SEQ ID NO: 533634 - DNA, 25 bp, Mus musculus
aggcaaagcagacactcagtaaggt

SEQ ID NO: 533635 - DNA, 25 bp, Mus musculus
aggcaaagcagagactcagtaaggt

SEQ ID NO: 533636 - DNA, 25 bp, Mus musculus
aggcaaagccctagaaccttctgca

SEQ ID NO: 533637 - DNA, 25 bp, Mus musculus
aggcaaagcccttgaaccttctgca

SEQ ID NO: 533638 - DNA, 25 bp, Mus musculus
aggcaaatgtccctatgaccccaag

SEQ ID NO: 533639 - DNA, 25 bp, Mus musculus
aggcaaatgtccgtatgaccccaag

SEQ ID NO: 533640 - DNA, 25 bp, Mus musculus
aggcaacgggtccacctcatccagt

SEQ ID NO: 533641 - DNA, 25 bp, Mus musculus
aggcaacgggtcgacctcatccagt

SEQ ID NO: 533642 - DNA, 25 bp, Mus musculus
aggcaagcgcgacggcttctttctc

SEQ ID NO: 533643 - DNA, 25 bp, Mus musculus
aggcaagcgcgagggcttctttctc

SEQ ID NO: 533644 - DNA, 25 bp, Mus musculus
aggcaaggagccagagcacctcagt

SEQ ID NO: 533645 - DNA, 25 bp, Mus musculus
aggcaaggagcctgagcacctcagt

SEQ ID NO: 533646 - DNA, 25 bp, Mus musculus
aggcaaggtgcacaacccattccct

SEQ ID NO: 533647 - DNA, 25 bp, Mus musculus
aggcaaggtgcagaacccattccct

SEQ ID NO: 533648 - DNA, 25 bp, Mus musculus
aggcaagtggaacttaatgttcgga

SEQ ID NO: 533649 - DNA, 25 bp, Mus musculus
aggcaagtggaagttaatgttcgga

SEQ ID NO: 533650 - DNA, 25 bp, Mus musculus
aggcaagtttctctctccccaaggg

SEQ ID NO: 533651 - DNA, 25 bp, Mus musculus
aggcaagtttctgtctccccaaggg

SEQ ID NO: 533652 - DNA, 25 bp, Mus musculus
aggcaatacagcactgttggcccag

SEQ ID NO: 533653 - DNA, 25 bp, Mus musculus
aggcaatacagctctgttggcccag

SEQ ID NO: 533654 - DNA, 25 bp, Mus musculus
aggcaatgaagaccccatctagcaa

SEQ ID NO: 533655 - DNA, 25 bp, Mus musculus
aggcaatgaagagcccatctagcaa

SEQ ID NO: 533656 - DNA, 25 bp, Mus musculus
aggcaattaggaatgcccaggagtc

SEQ ID NO: 533657 - DNA, 25 bp, Mus musculus
aggcaattaggattgcccaggagtc

SEQ ID NO: 533658 - DNA, 25 bp, Mus musculus
aggcacaagcagaaggacccctgac

SEQ ID NO: 533659 - DNA, 25 bp, Mus musculus
aggcacaagcagtaggacccctgac

SEQ ID NO: 533660 - DNA, 25 bp, Mus musculus
aggcacaatcatacgatgtcgccag

SEQ ID NO: 533661 - DNA, 25 bp, Mus musculus
aggcacaatcatcggcatactgcgg

SEQ ID NO: 533662 - DNA, 25 bp, Mus musculus
aggcacaatcatgggcatactgcgg

SEQ ID NO: 533663 - DNA, 25 bp, Mus musculus
aggcacaatcattcgatgtcgccag

SEQ ID NO: 533664 - DNA, 25 bp, Mus musculus
aggcacacctgccagaggcagacct

SEQ ID NO: 533665 - DNA, 25 bp, Mus musculus
aggcacacctgcgagaggcagacct

SEQ ID NO: 533666 - DNA, 25 bp, Mus musculus
aggcacagagggactatgagctgaa

SEQ ID NO: 533667 - DNA, 25 bp, Mus musculus
aggcacagagggtctatgagctgaa

SEQ ID NO: 533668 - DNA, 25 bp, Mus musculus
aggcacagcaacagagcaaggagga

SEQ ID NO: 533669 - DNA, 25 bp, Mus musculus
aggcacagcaactgagcaaggagga

SEQ ID NO: 533670 - DNA, 25 bp, Mus musculus
aggcacagccgacaacactggagcc

SEQ ID NO: 533671 - DNA, 25 bp, Mus musculus
aggcacagccgagaacactggagcc

SEQ ID NO: 533672 - DNA, 25 bp, Mus musculus
aggcacagtgcccagagcagcacca

SEQ ID NO: 533673 - DNA, 25 bp, Mus musculus
aggcacagtgccgagagcagcacca

SEQ ID NO: 533674 - DNA, 25 bp, Mus musculus
aggcaccctaccatgcttcctgagt

SEQ ID NO: 533675 - DNA, 25 bp, Mus musculus
aggcaccctaccttgcttcctgagt

SEQ ID NO: 533676 - DNA, 25 bp, Mus musculus
aggcacctacatcggccacactgga

SEQ ID NO: 533677 - DNA, 25 bp, Mus musculus
aggcacctacatgggccacactgga

SEQ ID NO: 533678 - DNA, 25 bp, Mus musculus
aggcacctcggtatgagtctatcat

SEQ ID NO: 533679 - DNA, 25 bp, Mus musculus
aggcacctcggtttgagtctatcat

SEQ ID NO: 533680 - DNA, 25 bp, Mus musculus
aggcacctgcctcaggctatctcgg

SEQ ID NO: 533681 - DNA, 25 bp, Mus musculus
aggcacctgcctgaggctatctcgg

SEQ ID NO: 533682 - DNA, 25 bp, Mus musculus
aggcacctggccctaatggagcaac

SEQ ID NO: 533683 - DNA, 25 bp, Mus musculus
aggcacctggccgtaatggagcaac

SEQ ID NO: 533684 - DNA, 25 bp, Mus musculus
aggcacgcatgcaggccagctatcg

SEQ ID NO: 533685 - DNA, 25 bp, Mus musculus
aggcacgcatgctggccagctatcg

SEQ ID NO: 533686 - DNA, 25 bp, Mus musculus
aggcacgttccgaggtctcgcccag

SEQ ID NO: 533687 - DNA, 25 bp, Mus musculus
aggcacgttccgtggtctcgcccag

SEQ ID NO: 533688 - DNA, 25 bp, Mus musculus
aggcactagtaaccatgagtgactc

SEQ ID NO: 533689 - DNA, 25 bp, Mus musculus
aggcactagtaagcatgagtgactc

SEQ ID NO: 533690 - DNA, 25 bp, Mus musculus
aggcactccgcacttgaactttggg

SEQ ID NO: 533691 - DNA, 25 bp, Mus musculus
aggcactccgcagttgaactttggg

SEQ ID NO: 533692 - DNA, 25 bp, Mus musculus
aggcactctgtaccttgcgccagga

SEQ ID NO: 533693 - DNA, 25 bp, Mus musculus
aggcactctgtagcttgcgccagga

SEQ ID NO: 533694 - DNA, 25 bp, Mus musculus
aggcactgcgcgctacatgagcatc

SEQ ID NO: 533695 - DNA, 25 bp, Mus musculus
aggcactgcgcggtacatgagcatc

SEQ ID NO: 533696 - DNA, 25 bp, Mus musculus
aggcactggcaccagccaaacacgg

SEQ ID NO: 533697 - DNA, 25 bp, Mus musculus
aggcactggcacgagccaaacacgg

SEQ ID NO: 533698 - DNA, 25 bp, Mus musculus
aggcactgtgcaagtgtccaagagc

SEQ ID NO: 533699 - DNA, 25 bp, Mus musculus
aggcactgtgcatgtgtccaagagc

SEQ ID NO: 533700 - DNA, 25 bp, Mus musculus
aggcactgtgttcctatggttagca

SEQ ID NO: 533701 - DNA, 25 bp, Mus musculus
aggcactgtgttgctatggttagca

SEQ ID NO: 533702 - DNA, 25 bp, Mus musculus
aggcactttttcagcgggacgccgc

SEQ ID NO: 533703 - DNA, 25 bp, Mus musculus
aggcactttttctgcgggacgccgc

SEQ ID NO: 533704 - DNA, 25 bp, Mus musculus
aggcagaagatgcaactgggtccaa

SEQ ID NO: 533705 - DNA, 25 bp, Mus musculus
aggcagaagatggaactgggtccaa

SEQ ID NO: 533706 - DNA, 25 bp, Mus musculus
aggcagaagccgaagctgagtctgt

SEQ ID NO: 533707 - DNA, 25 bp, Mus musculus
aggcagaagccgtagctgagtctgt

SEQ ID NO: 533708 - DNA, 25 bp, Mus musculus
aggcagaaggcaccaatggtgtccc

SEQ ID NO: 533709 - DNA, 25 bp, Mus musculus
aggcagaaggcagcaatggtgtccc

SEQ ID NO: 533710 - DNA, 25 bp, Mus musculus
aggcagaagggaaggcttcctctac

SEQ ID NO: 533711 - DNA, 25 bp, Mus musculus
aggcagaagggatggcttcctctac

SEQ ID NO: 533712 - DNA, 25 bp, Mus musculus
aggcagacacgcagtccgggaaatg

SEQ ID NO: 533713 - DNA, 25 bp, Mus musculus
aggcagacacgctgtccgggaaatg

SEQ ID NO: 533714 - DNA, 25 bp, Mus musculus
aggcagacacttaccagcagcgttt

SEQ ID NO: 533715 - DNA, 25 bp, Mus musculus
aggcagacactttccagcagcgttt

SEQ ID NO: 533716 - DNA, 25 bp, Mus musculus
aggcagacagctatctcatcccctg

SEQ ID NO: 533717 - DNA, 25 bp, Mus musculus
aggcagacagctttctcatcccctg

SEQ ID NO: 533718 - DNA, 25 bp, Mus musculus
aggcagacccgcaagaagaagcaaa

SEQ ID NO: 533719 - DNA, 25 bp, Mus musculus
aggcagacccgctagaagaagcaaa

SEQ ID NO: 533720 - DNA, 25 bp, Mus musculus
aggcagacctgcacaaaactctccg

SEQ ID NO: 533721 - DNA, 25 bp, Mus musculus
aggcagacctgctcaaaactctccg

SEQ ID NO: 533722 - DNA, 25 bp, Mus musculus
aggcagactcaaacaaaatttgcca

SEQ ID NO: 533723 - DNA, 25 bp, Mus musculus
aggcagactcaatcaaaatttgcca

SEQ ID NO: 533724 - DNA, 25 bp, Mus musculus
aggcagagatccacttcctggagaa

SEQ ID NO: 533725 - DNA, 25 bp, Mus musculus
aggcagagatcctcttcctggagaa

SEQ ID NO: 533726 - DNA, 25 bp, Mus musculus
aggcagagattcactttcttccatc

SEQ ID NO: 533727 - DNA, 25 bp, Mus musculus
aggcagagattctctttcttccatc

SEQ ID NO: 533728 - DNA, 25 bp, Mus musculus
aggcagagcctgactttgaagactg

SEQ ID NO: 533729 - DNA, 25 bp, Mus musculus
aggcagagcctgtctttgaagactg

SEQ ID NO: 533730 - DNA, 25 bp, Mus musculus
aggcagagtctcaacgctacaaact

SEQ ID NO: 533731 - DNA, 25 bp, Mus musculus
aggcagagtctctacgctacaaact

SEQ ID NO: 533732 - DNA, 25 bp, Mus musculus
aggcagatggctccctcatcatcag

SEQ ID NO: 533733 - DNA, 25 bp, Mus musculus
aggcagatggctgcctcatcatcag

SEQ ID NO: 533734 - DNA, 25 bp, Mus musculus
aggcagatgtcacgcccacgctgga

SEQ ID NO: 533735 - DNA, 25 bp, Mus musculus
aggcagatgtcaggcccacgctgga

SEQ ID NO: 533736 - DNA, 25 bp, Mus musculus
aggcagatgtcgagccaaagactgc

SEQ ID NO: 533737 - DNA, 25 bp, Mus musculus
aggcagatgtcgtgccaaagactgc

SEQ ID NO: 533738 - DNA, 25 bp, Mus musculus
aggcagatgtttctccagagagtca

SEQ ID NO: 533739 - DNA, 25 bp, Mus musculus
aggcagatgtttgtccagagagtca

SEQ ID NO: 533740 - DNA, 25 bp, Mus musculus
aggcagcaagccctgagggtccact

SEQ ID NO: 533741 - DNA, 25 bp, Mus musculus
aggcagcaagccgtgagggtccact

SEQ ID NO: 533742 - DNA, 25 bp, Mus musculus
aggcagcacacaaggctggcctggc

SEQ ID NO: 533743 - DNA, 25 bp, Mus musculus
aggcagcacacatggctggcctggc

SEQ ID NO: 533744 - DNA, 25 bp, Mus musculus
aggcagcacgctcagcccaagatga

SEQ ID NO: 533745 - DNA, 25 bp, Mus musculus
aggcagcacgctgagcccaagatga

SEQ ID NO: 533746 - DNA, 25 bp, Mus musculus
aggcagcactcaaatccaggtcaga

SEQ ID NO: 533747 - DNA, 25 bp, Mus musculus
aggcagcactcatatccaggtcaga

SEQ ID NO: 533748 - DNA, 25 bp, Mus musculus
aggcagcagccaacttgtcaccggt

SEQ ID NO: 533749 - DNA, 25 bp, Mus musculus
aggcagcagccatcttgtcaccggt

SEQ ID NO: 533750 - DNA, 25 bp, Mus musculus
aggcagcagctccagacactgcagc

SEQ ID NO: 533751 - DNA, 25 bp, Mus musculus
aggcagcagctcgagacactgcagc

SEQ ID NO: 533752 - DNA, 25 bp, Mus musculus
aggcagccatccacttgcaggtgga

SEQ ID NO: 533753 - DNA, 25 bp, Mus musculus
aggcagccatcctcttgcaggtgga

SEQ ID NO: 533754 - DNA, 25 bp, Mus musculus
aggcagccatgcagacccctcctca

SEQ ID NO: 533755 - DNA, 25 bp, Mus musculus
aggcagccatgctgacccctcctca

SEQ ID NO: 533756 - DNA, 25 bp, Mus musculus
aggcagcccgctacgtgatgcgcag

SEQ ID NO: 533757 - DNA, 25 bp, Mus musculus
aggcagcccgcttcgtgatgcgcag

SEQ ID NO: 533758 - DNA, 25 bp, Mus musculus
aggcagcctgacagtggttgtactg

SEQ ID NO: 533759 - DNA, 25 bp, Mus musculus
aggcagcctgactgtggttgtactg

SEQ ID NO: 533760 - DNA, 25 bp, Mus musculus
aggcagccttccagctaaccggtgc

SEQ ID NO: 533761 - DNA, 25 bp, Mus musculus
aggcagccttcctgctaaccggtgc

SEQ ID NO: 533762 - DNA, 25 bp, Mus musculus
aggcagcgcagcatccgcgttctcg

SEQ ID NO: 533763 - DNA, 25 bp, Mus musculus
aggcagcgcagcttccgcgttctcg

SEQ ID NO: 533764 - DNA, 25 bp, Mus musculus
aggcagcgcgacagaagcagaaaga

SEQ ID NO: 533765 - DNA, 25 bp, Mus musculus
aggcagcgcgactgaagcagaaaga

SEQ ID NO: 533766 - DNA, 25 bp, Mus musculus
aggcagcggcaccttcgagcgtctc

SEQ ID NO: 533767 - DNA, 25 bp, Mus musculus
aggcagcggcacgttcgagcgtctc

SEQ ID NO: 533768 - DNA, 25 bp, Mus musculus
aggcagctatccaggctgagcctta

SEQ ID NO: 533769 - DNA, 25 bp, Mus musculus
aggcagctatcctggctgagcctta

SEQ ID NO: 533770 - DNA, 25 bp, Mus musculus
aggcagctattgacgccctccagag

SEQ ID NO: 533771 - DNA, 25 bp, Mus musculus
aggcagctattgtcgccctccagag

SEQ ID NO: 533772 - DNA, 25 bp, Mus musculus
aggcagctctgcaccttgagcagtg

SEQ ID NO: 533773 - DNA, 25 bp, Mus musculus
aggcagctctgctccttgagcagtg

SEQ ID NO: 533774 - DNA, 25 bp, Mus musculus
aggcagctgaaacaagatctgtcca

SEQ ID NO: 533775 - DNA, 25 bp, Mus musculus
aggcagctgaaagaagatctgtcca

SEQ ID NO: 533776 - DNA, 25 bp, Mus musculus
aggcagctgagcagtcggcctcgtc

SEQ ID NO: 533777 - DNA, 25 bp, Mus musculus
aggcagctgagctgtcggcctcgtc

SEQ ID NO: 533778 - DNA, 25 bp, Mus musculus
aggcagctgcagaggtcctctccct

SEQ ID NO: 533779 - DNA, 25 bp, Mus musculus
aggcagctgcagtggtcctctccct

SEQ ID NO: 533780 - DNA, 25 bp, Mus musculus
aggcagctgtatcccgcctgcgctg

SEQ ID NO: 533781 - DNA, 25 bp, Mus musculus
aggcagctgtatgccgcctgcgctg

SEQ ID NO: 533782 - DNA, 25 bp, Mus musculus
aggcaggaaaggcactcacgattgt

SEQ ID NO: 533783 - DNA, 25 bp, Mus musculus
aggcaggaaagggactcacgattgt

SEQ ID NO: 533784 - DNA, 25 bp, Mus musculus
aggcaggagggcaagccacccatcc

SEQ ID NO: 533785 - DNA, 25 bp, Mus musculus
aggcaggagggctagccacccatcc

SEQ ID NO: 533786 - DNA, 25 bp, Mus musculus
aggcaggattctcgccctctctgaa

SEQ ID NO: 533787 - DNA, 25 bp, Mus musculus
aggcaggattctggccctctctgaa

SEQ ID NO: 533788 - DNA, 25 bp, Mus musculus
aggcaggcaaacatgcctctcacat

SEQ ID NO: 533789 - DNA, 25 bp, Mus musculus
aggcaggcaaacttgcctctcacat

SEQ ID NO: 533790 - DNA, 25 bp, Mus musculus
aggcaggcggccatctgcagcccag

SEQ ID NO: 533791 - DNA, 25 bp, Mus musculus
aggcaggcggccttctgcagcccag

SEQ ID NO: 533792 - DNA, 25 bp, Mus musculus
aggcagggcagaccgccgcaaccaa

SEQ ID NO: 533793 - DNA, 25 bp, Mus musculus
aggcagggcagagcgccgcaaccaa

SEQ ID NO: 533794 - DNA, 25 bp, Mus musculus
aggcaggtcggtacacccggagcca

SEQ ID NO: 533795 - DNA, 25 bp, Mus musculus
aggcaggtcggttcacccggagcca

SEQ ID NO: 533796 - DNA, 25 bp, Mus musculus
aggcaggtgcaaagctttttcaaga

SEQ ID NO: 533797 - DNA, 25 bp, Mus musculus
aggcaggtgcaatgctttttcaaga

SEQ ID NO: 533798 - DNA, 25 bp, Mus musculus
aggcagtgaacgagccgactccaca

SEQ ID NO: 533799 - DNA, 25 bp, Mus musculus
aggcagtgaacgtgccgactccaca

SEQ ID NO: 533800 - DNA, 25 bp, Mus musculus
aggcagtgatgcagccggcaatcca

SEQ ID NO: 533801 - DNA, 25 bp, Mus musculus
aggcagtgatgctgccggcaatcca

SEQ ID NO: 533802 - DNA, 25 bp, Mus musculus
aggcagtgctgccacctctctacat

SEQ ID NO: 533803 - DNA, 25 bp, Mus musculus
aggcagtgctgcgacctctctacat

SEQ ID NO: 533804 - DNA, 25 bp, Mus musculus
aggcagtgtactcgagtttggaacc

SEQ ID NO: 533805 - DNA, 25 bp, Mus musculus
aggcagtgtactggagtttggaacc

SEQ ID NO: 533806 - DNA, 25 bp, Mus musculus
aggcagtgtcgtagcgtgtcctgaa

SEQ ID NO: 533807 - DNA, 25 bp, Mus musculus
aggcagtgtcgttgcgtgtcctgaa

SEQ ID NO: 533808 - DNA, 25 bp, Mus musculus
aggcagtgtctacgctcctacgctg

SEQ ID NO: 533809 - DNA, 25 bp, Mus musculus
aggcagtgtctaggctcctacgctg

SEQ ID NO: 533810 - DNA, 25 bp, Mus musculus
aggcatattcagctccacgacctcg

SEQ ID NO: 533811 - DNA, 25 bp, Mus musculus
aggcatattcaggtccacgacctcg

SEQ ID NO: 533812 - DNA, 25 bp, Mus musculus
aggcatcaaggaacaccgctcccag

SEQ ID NO: 533813 - DNA, 25 bp, Mus musculus
aggcatcaaggatcaccgctcccag

SEQ ID NO: 533814 - DNA, 25 bp, Mus musculus
aggcatcacaagcatggccacagcc

SEQ ID NO: 533815 - DNA, 25 bp, Mus musculus
aggcatcacaaggatggccacagcc

SEQ ID NO: 533816 - DNA, 25 bp, Mus musculus
aggcatcactggacctgagggccat

SEQ ID NO: 533817 - DNA, 25 bp, Mus musculus
aggcatcactggtcctgagggccat

SEQ ID NO: 533818 - DNA, 25 bp, Mus musculus
aggcatcagtaacccctctgctgtg

SEQ ID NO: 533819 - DNA, 25 bp, Mus musculus
aggcatcagtaagccctctgctgtg

SEQ ID NO: 533820 - DNA, 25 bp, Mus musculus
aggcatccggctcccgaggaaattt

SEQ ID NO: 533821 - DNA, 25 bp, Mus musculus
aggcatccggctgccgaggaaattt

SEQ ID NO: 533822 - DNA, 25 bp, Mus musculus
aggcatcctgcacggccacgaactg

SEQ ID NO: 533823 - DNA, 25 bp, Mus musculus
aggcatcctgcagggccacgaactg

SEQ ID NO: 533824 - DNA, 25 bp, Mus musculus
aggcatcggagacaccccgaaccag

SEQ ID NO: 533825 - DNA, 25 bp, Mus musculus
aggcatcggagagaccccgaaccag

SEQ ID NO: 533826 - DNA, 25 bp, Mus musculus
aggcatctgatgctggcaccatgga

SEQ ID NO: 533827 - DNA, 25 bp, Mus musculus
aggcatctgatggtggcaccatgga

SEQ ID NO: 533828 - DNA, 25 bp, Mus musculus
aggcatctgtgcctccggaccaagg

SEQ ID NO: 533829 - DNA, 25 bp, Mus musculus
aggcatctgtgcgtccggaccaagg

SEQ ID NO: 533830 - DNA, 25 bp, Mus musculus
aggcatgaagaacgccatgaacatg

SEQ ID NO: 533831 - DNA, 25 bp, Mus musculus
aggcatgaagaaggccatgaacatg

SEQ ID NO: 533832 - DNA, 25 bp, Mus musculus
aggcatgccttacctggctcctctg

SEQ ID NO: 533833 - DNA, 25 bp, Mus musculus
aggcatgccttagctggctcctctg

SEQ ID NO: 533834 - DNA, 25 bp, Mus musculus
aggcatgggtttcaccgagttctct

SEQ ID NO: 533835 - DNA, 25 bp, Mus musculus
aggcatgggtttgaccgagttctct

SEQ ID NO: 533836 - DNA, 25 bp, Mus musculus
aggcatggtgccaagctgctctacg

SEQ ID NO: 533837 - DNA, 25 bp, Mus musculus
aggcatggtgcctagctgctctacg

SEQ ID NO: 533838 - DNA, 25 bp, Mus musculus
aggcatgtggccagccgccatcaag

SEQ ID NO: 533839 - DNA, 25 bp, Mus musculus
aggcatgtggcctgccgccatcaag

SEQ ID NO: 533840 - DNA, 25 bp, Mus musculus
aggcatttcggcagaacaaccccgg

SEQ ID NO: 533841 - DNA, 25 bp, Mus musculus
aggcatttcggctgaacaaccccgg

SEQ ID NO: 533842 - DNA, 25 bp, Mus musculus
aggccaagatcactgaagagctcaa

SEQ ID NO: 533843 - DNA, 25 bp, Mus musculus
aggccaagatcagtgaagagctcaa

SEQ ID NO: 533844 - DNA, 25 bp, Mus musculus
aggccaagcatgcagatcctggtga

SEQ ID NO: 533845 - DNA, 25 bp, Mus musculus
aggccaagcatggagatcctggtga

SEQ ID NO: 533846 - DNA, 25 bp, Mus musculus
aggccaagctggatacccggtctct

SEQ ID NO: 533847 - DNA, 25 bp, Mus musculus
aggccaagctggttacccggtctct

SEQ ID NO: 533848 - DNA, 25 bp, Mus musculus
aggccaagctgtctcccgagggtct

SEQ ID NO: 533849 - DNA, 25 bp, Mus musculus
aggccaagctgtgtcccgagggtct

SEQ ID NO: 533850 - DNA, 25 bp, Mus musculus
aggccaaggaatacaccaatgttta

SEQ ID NO: 533851 - DNA, 25 bp, Mus musculus
aggccaaggaattcaccaatgttta

SEQ ID NO: 533852 - DNA, 25 bp, Mus musculus
aggccaaggagaccattcgagcaaa

SEQ ID NO: 533853 - DNA, 25 bp, Mus musculus
aggccaaggagagcattcgagcaaa

SEQ ID NO: 533854 - DNA, 25 bp, Mus musculus
aggccaaggtcacccttaacacagg

SEQ ID NO: 533855 - DNA, 25 bp, Mus musculus
aggccaaggtcagccttaacacagg

SEQ ID NO: 533856 - DNA, 25 bp, Mus musculus
aggccaagtgctcacagttctgcac

SEQ ID NO: 533857 - DNA, 25 bp, Mus musculus
aggccaagtgctgacagttctgcac

SEQ ID NO: 533858 - DNA, 25 bp, Mus musculus
aggccaatgcccagcagttcccatt

SEQ ID NO: 533859 - DNA, 25 bp, Mus musculus
aggccaatgccctgcagttcccatt

SEQ ID NO: 533860 - DNA, 25 bp, Mus musculus
aggccacaacaaccgggcagagcag

SEQ ID NO: 533861 - DNA, 25 bp, Mus musculus
aggccacaacaagcgggcagagcag

SEQ ID NO: 533862 - DNA, 25 bp, Mus musculus
aggccacaatggaacgtgcgctgtg

SEQ ID NO: 533863 - DNA, 25 bp, Mus musculus
aggccacaatggtacgtgcgctgtg

SEQ ID NO: 533864 - DNA, 25 bp, Mus musculus
aggccacacccgcaatggctggcga

SEQ ID NO: 533865 - DNA, 25 bp, Mus musculus
aggccacacccggaatggctggcga

SEQ ID NO: 533866 - DNA, 25 bp, Mus musculus
aggccacatagcaacaggaccggag

SEQ ID NO: 533867 - DNA, 25 bp, Mus musculus
aggccacatagctacaggaccggag

SEQ ID NO: 533868 - DNA, 25 bp, Mus musculus
aggccaccaaagattctctggatga

SEQ ID NO: 533869 - DNA, 25 bp, Mus musculus
aggccaccaaagtttctctggatga

SEQ ID NO: 533870 - DNA, 25 bp, Mus musculus
aggccaccaaggagaacttcaagca

SEQ ID NO: 533871 - DNA, 25 bp, Mus musculus
aggccaccaaggtgaacttcaagca

SEQ ID NO: 533872 - DNA, 25 bp, Mus musculus
aggccaccctggagagaagaagcac

SEQ ID NO: 533873 - DNA, 25 bp, Mus musculus
aggccaccctggtgagaagaagcac

SEQ ID NO: 533874 - DNA, 25 bp, Mus musculus
aggccacctttgcagagtatgaaga

SEQ ID NO: 533875 - DNA, 25 bp, Mus musculus
aggccacctttggagagtatgaaga

SEQ ID NO: 533876 - DNA, 25 bp, Mus musculus
aggccacggctgagagcactgtgct

SEQ ID NO: 533877 - DNA, 25 bp, Mus musculus
aggccacggctgtgagcactgtgct

SEQ ID NO: 533878 - DNA, 25 bp, Mus musculus
aggccactcggcagaagatgcgcga

SEQ ID NO: 533879 - DNA, 25 bp, Mus musculus
aggccactcggctgaagatgcgcga

SEQ ID NO: 533880 - DNA, 25 bp, Mus musculus
aggccactttctccttgggtaacat

SEQ ID NO: 533881 - DNA, 25 bp, Mus musculus
aggccactttctgcttgggtaacat

SEQ ID NO: 533882 - DNA, 25 bp, Mus musculus
aggccagaaggcagtcgaacccttg

SEQ ID NO: 533883 - DNA, 25 bp, Mus musculus
aggccagaaggctgtcgaacccttg

SEQ ID NO: 533884 - DNA, 25 bp, Mus musculus
aggccagacttcattgactctgcag

SEQ ID NO: 533885 - DNA, 25 bp, Mus musculus
aggccagacttctttgactctgcag

SEQ ID NO: 533886 - DNA, 25 bp, Mus musculus
aggccagagaagcacattacgtgtc

SEQ ID NO: 533887 - DNA, 25 bp, Mus musculus
aggccagagaaggacattacgtgtc

SEQ ID NO: 533888 - DNA, 25 bp, Mus musculus
aggccagaggcaacctggacgatgc

SEQ ID NO: 533889 - DNA, 25 bp, Mus musculus
aggccagaggcatcctggacgatgc

SEQ ID NO: 533890 - DNA, 25 bp, Mus musculus
aggccagatgggaccagcttcaaca

SEQ ID NO: 533891 - DNA, 25 bp, Mus musculus
aggccagatgggtccagcttcaaca

SEQ ID NO: 533892 - DNA, 25 bp, Mus musculus
aggccagcagccagggtcgttctcc

SEQ ID NO: 533893 - DNA, 25 bp, Mus musculus
aggccagcagcctgggtcgttctcc

SEQ ID NO: 533894 - DNA, 25 bp, Mus musculus
aggccagcccttagaccattcccct

SEQ ID NO: 533895 - DNA, 25 bp, Mus musculus
aggccagccctttgaccattcccct

SEQ ID NO: 533896 - DNA, 25 bp, Mus musculus
aggccaggctgcaggtcattctggt

SEQ ID NO: 533897 - DNA, 25 bp, Mus musculus
aggccaggctgctggtcattctggt

SEQ ID NO: 533898 - DNA, 25 bp, Mus musculus
aggccagggcggagaactcacagct

SEQ ID NO: 533899 - DNA, 25 bp, Mus musculus
aggccagggcggtgaactcacagct

SEQ ID NO: 533900 - DNA, 25 bp, Mus musculus
aggccagtcccaacaccatggttgc

SEQ ID NO: 533901 - DNA, 25 bp, Mus musculus
aggccagtcccatcaccatggttgc

SEQ ID NO: 533902 - DNA, 25 bp, Mus musculus
aggccagttggacaccccttcgatg

SEQ ID NO: 533903 - DNA, 25 bp, Mus musculus
aggccagttggagaccccttcgatg

SEQ ID NO: 533904 - DNA, 25 bp, Mus musculus
aggccatatggcctcctgcttgcct

SEQ ID NO: 533905 - DNA, 25 bp, Mus musculus
aggccatatggcgtcctgcttgcct

SEQ ID NO: 533906 - DNA, 25 bp, Mus musculus
aggccatcagttaggtgtgtgaagc

SEQ ID NO: 533907 - DNA, 25 bp, Mus musculus
aggccatcagtttggtgtgtgaagc

SEQ ID NO: 533908 - DNA, 25 bp, Mus musculus
aggccatcatccagaagatcaagca

SEQ ID NO: 533909 - DNA, 25 bp, Mus musculus
aggccatcatcctgaagatcaagca

SEQ ID NO: 533910 - DNA, 25 bp, Mus musculus
aggccatccatgagccaccaggaaa

SEQ ID NO: 533911 - DNA, 25 bp, Mus musculus
aggccatccatgtgccaccaggaaa

SEQ ID NO: 533912 - DNA, 25 bp, Mus musculus
aggccatcgagtcccatctgctgaa

SEQ ID NO: 533913 - DNA, 25 bp, Mus musculus
aggccatcgagtgccatctgctgaa

SEQ ID NO: 533914 - DNA, 25 bp, Mus musculus
aggccatcgggcaggataaggacaa

SEQ ID NO: 533915 - DNA, 25 bp, Mus musculus
aggccatcgggctggataaggacaa

SEQ ID NO: 533916 - DNA, 25 bp, Mus musculus
aggccatctgctaccatgagtgttc

SEQ ID NO: 533917 - DNA, 25 bp, Mus musculus
aggccatctgcttccatgagtgttc

SEQ ID NO: 533918 - DNA, 25 bp, Mus musculus
aggccatgaactcgcaaagcaagag

SEQ ID NO: 533919 - DNA, 25 bp, Mus musculus
aggccatgaactggcaaagcaagag

SEQ ID NO: 533920 - DNA, 25 bp, Mus musculus
aggccatgaggcaggctggctccct

SEQ ID NO: 533921 - DNA, 25 bp, Mus musculus
aggccatgaggctggctggctccct

SEQ ID NO: 533922 - DNA, 25 bp, Mus musculus
aggccatgcataacttaaggaatgg

SEQ ID NO: 533923 - DNA, 25 bp, Mus musculus
aggccatgcatatcttaaggaatgg

SEQ ID NO: 533924 - DNA, 25 bp, Mus musculus
aggccatgggcaacctgcagatcga

SEQ ID NO: 533925 - DNA, 25 bp, Mus musculus
aggccatgggcatcctgcagatcga

SEQ ID NO: 533926 - DNA, 25 bp, Mus musculus
aggccattgccgaacgcctgggctg

SEQ ID NO: 533927 - DNA, 25 bp, Mus musculus
aggccattgccgtacgcctgggctg

SEQ ID NO: 533928 - DNA, 25 bp, Mus musculus
aggccattgcctccctgctttttgg

SEQ ID NO: 533929 - DNA, 25 bp, Mus musculus
aggccattgcctgcctgctttttgg

SEQ ID NO: 533930 - DNA, 25 bp, Mus musculus
aggcccaacggtagaactccgacag

SEQ ID NO: 533931 - DNA, 25 bp, Mus musculus
aggcccaacggttgaactccgacag

SEQ ID NO: 533932 - DNA, 25 bp, Mus musculus
aggcccacagtcagctgcagttttg

SEQ ID NO: 533933 - DNA, 25 bp, Mus musculus
aggcccacagtctgctgcagttttg

SEQ ID NO: 533934 - DNA, 25 bp, Mus musculus
aggcccacgaacacctgatggccgg

SEQ ID NO: 533935 - DNA, 25 bp, Mus musculus
aggcccacgaactcctgatggccgg

SEQ ID NO: 533936 - DNA, 25 bp, Mus musculus
aggcccacgcagatatgggacgcct

SEQ ID NO: 533937 - DNA, 25 bp, Mus musculus
aggcccacgcagttatgggacgcct

SEQ ID NO: 533938 - DNA, 25 bp, Mus musculus
aggcccacgttgagtcgcacggttt

SEQ ID NO: 533939 - DNA, 25 bp, Mus musculus
aggcccacgttgtgtcgcacggttt

SEQ ID NO: 533940 - DNA, 25 bp, Mus musculus
aggcccagaagcatgcaagccgcgg

SEQ ID NO: 533941 - DNA, 25 bp, Mus musculus
aggcccagaagcttgcaagccgcgg

SEQ ID NO: 533942 - DNA, 25 bp, Mus musculus
aggcccagatttcctctttggtgga

SEQ ID NO: 533943 - DNA, 25 bp, Mus musculus
aggcccagatttgctctttggtgga

SEQ ID NO: 533944 - DNA, 25 bp, Mus musculus
aggcccagcaggctactcgtaccag

SEQ ID NO: 533945 - DNA, 25 bp, Mus musculus
aggcccagcagggtactcgtaccag

SEQ ID NO: 533946 - DNA, 25 bp, Mus musculus
aggcccaggtaactacagcgccact

SEQ ID NO: 533947 - DNA, 25 bp, Mus musculus
aggcccaggtaagtacagcgccact

SEQ ID NO: 533948 - DNA, 25 bp, Mus musculus
aggcccatgggacaagcacaagcca

SEQ ID NO: 533949 - DNA, 25 bp, Mus musculus
aggcccatgggagaagcacaagcca

SEQ ID NO: 533950 - DNA, 25 bp, Mus musculus
aggcccatgtcaacccacaggagaa

SEQ ID NO: 533951 - DNA, 25 bp, Mus musculus
aggcccatgtcatcccacaggagaa

SEQ ID NO: 533952 - DNA, 25 bp, Mus musculus
aggccccaccttcagggaagcagac

SEQ ID NO: 533953 - DNA, 25 bp, Mus musculus
aggccccaccttgagggaagcagac

SEQ ID NO: 533954 - DNA, 25 bp, Mus musculus
aggccccatcgtcgagcgacgaaag

SEQ ID NO: 533955 - DNA, 25 bp, Mus musculus
aggccccatcgtggagcgacgaaag

SEQ ID NO: 533956 - DNA, 25 bp, Mus musculus
aggcccctggtgactacgtgtttgg

SEQ ID NO: 533957 - DNA, 25 bp, Mus musculus
aggcccctggtgtctacgtgtttgg

SEQ ID NO: 533958 - DNA, 25 bp, Mus musculus
aggcccgacgcaaggcggtcactga

SEQ ID NO: 533959 - DNA, 25 bp, Mus musculus
aggcccgacgcatggcggtcactga

SEQ ID NO: 533960 - DNA, 25 bp, Mus musculus
aggcccgacggcaccggtcactatg

SEQ ID NO: 533961 - DNA, 25 bp, Mus musculus
aggcccgacggctccggtcactatg

SEQ ID NO: 533962 - DNA, 25 bp, Mus musculus
aggcccgagaggaccctactgagga

SEQ ID NO: 533963 - DNA, 25 bp, Mus musculus
aggcccgagaggtccctactgagga

SEQ ID NO: 533964 - DNA, 25 bp, Mus musculus
aggcccgatgcacagggtgacccct

SEQ ID NO: 533965 - DNA, 25 bp, Mus musculus
aggcccgatgcagagggtgacccct

SEQ ID NO: 533966 - DNA, 25 bp, Mus musculus
aggcccgcaaggacctcctggaagt

SEQ ID NO: 533967 - DNA, 25 bp, Mus musculus
aggcccgcaaggtcctcctggaagt

SEQ ID NO: 533968 - DNA, 25 bp, Mus musculus
aggcccgcaagtcgcaactgcagag

SEQ ID NO: 533969 - DNA, 25 bp, Mus musculus
aggcccgcaagtggcaactgcagag

SEQ ID NO: 533970 - DNA, 25 bp, Mus musculus
aggcccgtgcccaagtccacgaata

SEQ ID NO: 533971 - DNA, 25 bp, Mus musculus
aggcccgtgccctagtccacgaata

SEQ ID NO: 533972 - DNA, 25 bp, Mus musculus
aggccctcactgcagcgaatatcca

SEQ ID NO: 533973 - DNA, 25 bp, Mus musculus
aggccctcactggagcgaatatcca

SEQ ID NO: 533974 - DNA, 25 bp, Mus musculus
aggccctcattgaccagtacttaag

SEQ ID NO: 533975 - DNA, 25 bp, Mus musculus
aggccctcattgtccagtacttaag

SEQ ID NO: 533976 - DNA, 25 bp, Mus musculus
aggccctccgaaacagcagaactgg

SEQ ID NO: 533977 - DNA, 25 bp, Mus musculus
aggccctccgaatcagcagaactgg

SEQ ID NO: 533978 - DNA, 25 bp, Mus musculus
aggccctctacacagtcggctacag

SEQ ID NO: 533979 - DNA, 25 bp, Mus musculus
aggccctctacagagtcggctacag

SEQ ID NO: 533980 - DNA, 25 bp, Mus musculus
aggccctgaaaaccgaccgcgctgt

SEQ ID NO: 533981 - DNA, 25 bp, Mus musculus
aggccctgaaaagcgaccgcgctgt

SEQ ID NO: 533982 - DNA, 25 bp, Mus musculus
aggccctgacctccagaatgagtca

SEQ ID NO: 533983 - DNA, 25 bp, Mus musculus
aggccctgacctgcagaatgagtca

SEQ ID NO: 533984 - DNA, 25 bp, Mus musculus
aggccctgagtgctgcccgcatggg

SEQ ID NO: 533985 - DNA, 25 bp, Mus musculus
aggccctgagtggtgcccgcatggg

SEQ ID NO: 533986 - DNA, 25 bp, Mus musculus
aggccctgctggcagttacaggccc

SEQ ID NO: 533987 - DNA, 25 bp, Mus musculus
aggccctgctgggagttacaggccc

SEQ ID NO: 533988 - DNA, 25 bp, Mus musculus
aggccctgggctcgaacatttacgc

SEQ ID NO: 533989 - DNA, 25 bp, Mus musculus
aggccctgggctggaacatttacgc

SEQ ID NO: 533990 - DNA, 25 bp, Mus musculus
aggccctggtgaagctctttgacaa

SEQ ID NO: 533991 - DNA, 25 bp, Mus musculus
aggccctggtgatgctctttgacaa

SEQ ID NO: 533992 - DNA, 25 bp, Mus musculus
aggccctgtagtaggctctataatg

SEQ ID NO: 533993 - DNA, 25 bp, Mus musculus
aggccctgtagttggctctataatg

SEQ ID NO: 533994 - DNA, 25 bp, Mus musculus
aggcccttgcccatcgaaacgtgcg

SEQ ID NO: 533995 - DNA, 25 bp, Mus musculus
aggcccttgcccttcgaaacgtgcg

SEQ ID NO: 533996 - DNA, 25 bp, Mus musculus
aggccgaatgacctggaagaagttc

SEQ ID NO: 533997 - DNA, 25 bp, Mus musculus
aggccgaatgacgtggaagaagttc

SEQ ID NO: 533998 - DNA, 25 bp, Mus musculus
aggccgacaccaaccgcaatgacat

SEQ ID NO: 533999 - DNA, 25 bp, Mus musculus
aggccgacaccatccgcaatgacat

SEQ ID NO: 534000 - DNA, 25 bp, Mus musculus
aggccgacagtaccaccaaatgaca

SEQ ID NO: 534001 - DNA, 25 bp, Mus musculus
aggccgacagtagcaccaaatgaca

SEQ ID NO: 534002 - DNA, 25 bp, Mus musculus
aggccgaccttgctggccatggaca

SEQ ID NO: 534003 - DNA, 25 bp, Mus musculus
aggccgaccttggtggccatggaca

SEQ ID NO: 534004 - DNA, 25 bp, Mus musculus
aggccgactccaccacaagaatggt

SEQ ID NO: 534005 - DNA, 25 bp, Mus musculus
aggccgactccagcacaagaatggt

SEQ ID NO: 534006 - DNA, 25 bp, Mus musculus
aggccgagaactacttccattcccg

SEQ ID NO: 534007 - DNA, 25 bp, Mus musculus
aggccgagaacttcttccattcccg

SEQ ID NO: 534008 - DNA, 25 bp, Mus musculus
aggccgagatcaccaagctacaaca

SEQ ID NO: 534009 - DNA, 25 bp, Mus musculus
aggccgagatcagcaagctacaaca

SEQ ID NO: 534010 - DNA, 25 bp, Mus musculus
aggccgagttagctgcccgcatcct

SEQ ID NO: 534011 - DNA, 25 bp, Mus musculus
aggccgagttaggtgcccgcatcct

SEQ ID NO: 534012 - DNA, 25 bp, Mus musculus
aggccgcaagccctgcaagctgatg

SEQ ID NO: 534013 - DNA, 25 bp, Mus musculus
aggccgcaagccgtgcaagctgatg

SEQ ID NO: 534014 - DNA, 25 bp, Mus musculus
aggccgcaagtaagcccctgggtac

SEQ ID NO: 534015 - DNA, 25 bp, Mus musculus
aggccgcaagtatgcccctgggtac

SEQ ID NO: 534016 - DNA, 25 bp, Mus musculus
aggccgcaccggatcaaggaagact

SEQ ID NO: 534017 - DNA, 25 bp, Mus musculus
aggccgcaccggttcaaggaagact

SEQ ID NO: 534018 - DNA, 25 bp, Mus musculus
aggccgcactcgcagaaggctaaag

SEQ ID NO: 534019 - DNA, 25 bp, Mus musculus
aggccgcactcggagaaggctaaag

SEQ ID NO: 534020 - DNA, 25 bp, Mus musculus
aggccgcaggacacgacgccgagct

SEQ ID NO: 534021 - DNA, 25 bp, Mus musculus
aggccgcaggactcgacgccgagct

SEQ ID NO: 534022 - DNA, 25 bp, Mus musculus
aggccgcgcgccctttcggagctaa

SEQ ID NO: 534023 - DNA, 25 bp, Mus musculus
aggccgcgcgccgtttcggagctaa

SEQ ID NO: 534024 - DNA, 25 bp, Mus musculus
aggccgcttgccatcctactgcaga

SEQ ID NO: 534025 - DNA, 25 bp, Mus musculus
aggccgcttgccttcctactgcaga

SEQ ID NO: 534026 - DNA, 25 bp, Mus musculus
aggccggagattacgcttcgggact

SEQ ID NO: 534027 - DNA, 25 bp, Mus musculus
aggccggagatttcgcttcgggact

SEQ ID NO: 534028 - DNA, 25 bp, Mus musculus
aggccggcagaaagctgaagctgct

SEQ ID NO: 534029 - DNA, 25 bp, Mus musculus
aggccggcagaatgctgaagctgct

SEQ ID NO: 534030 - DNA, 25 bp, Mus musculus
aggccggcgtcaaggagcccctata

SEQ ID NO: 534031 - DNA, 25 bp, Mus musculus
aggccggcgtcatggagcccctata

SEQ ID NO: 534032 - DNA, 25 bp, Mus musculus
aggccgtcaacaagctgctgcgcca

SEQ ID NO: 534033 - DNA, 25 bp, Mus musculus
aggccgtcaacatgctgctgcgcca

SEQ ID NO: 534034 - DNA, 25 bp, Mus musculus
aggccgtcaggtcgtgccagtccat

SEQ ID NO: 534035 - DNA, 25 bp, Mus musculus
aggccgtcaggtggtgccagtccat

SEQ ID NO: 534036 - DNA, 25 bp, Mus musculus
aggccgtggtacagaagctcaagag

SEQ ID NO: 534037 - DNA, 25 bp, Mus musculus
aggccgtggtactgaagctcaagag

SEQ ID NO: 534038 - DNA, 25 bp, Mus musculus
aggccgtgtgtcaccctgaccacgt

SEQ ID NO: 534039 - DNA, 25 bp, Mus musculus
aggccgtgtgtctccctgaccacgt

SEQ ID NO: 534040 - DNA, 25 bp, Mus musculus
aggccgttcgtcacatcatggattc

SEQ ID NO: 534041 - DNA, 25 bp, Mus musculus
aggccgttcgtctcatcatggattc

SEQ ID NO: 534042 - DNA, 25 bp, Mus musculus
aggcctacaaggactgcactgagaa

SEQ ID NO: 534043 - DNA, 25 bp, Mus musculus
aggcctacaaggtctgcactgagaa

SEQ ID NO: 534044 - DNA, 25 bp, Mus musculus
aggcctacacgacagcactggagat

SEQ ID NO: 534045 - DNA, 25 bp, Mus musculus
aggcctacacgagagcactggagat

SEQ ID NO: 534046 - DNA, 25 bp, Mus musculus
aggcctacagggacaaaccaggcag

SEQ ID NO: 534047 - DNA, 25 bp, Mus musculus
aggcctacagggtcaaaccaggcag

SEQ ID NO: 534048 - DNA, 25 bp, Mus musculus
aggcctacgtgaagatccagcttat

SEQ ID NO: 534049 - DNA, 25 bp, Mus musculus
aggcctacgtgatgatccagcttat

SEQ ID NO: 534050 - DNA, 25 bp, Mus musculus
aggcctactcggaggctcggcagtt

SEQ ID NO: 534051 - DNA, 25 bp, Mus musculus
aggcctactcggtggctcggcagtt

SEQ ID NO: 534052 - DNA, 25 bp, Mus musculus
aggcctactggtactggaagggcca

SEQ ID NO: 534053 - DNA, 25 bp, Mus musculus
aggcctactggttctggaagggcca

SEQ ID NO: 534054 - DNA, 25 bp, Mus musculus
aggcctagcagacctgggacatgat

SEQ ID NO: 534055 - DNA, 25 bp, Mus musculus
aggcctagcagagctgggacatgat

SEQ ID NO: 534056 - DNA, 25 bp, Mus musculus
aggcctatgtcgctgacgtccacta

SEQ ID NO: 534057 - DNA, 25 bp, Mus musculus
aggcctatgtcggtgacgtccacta

SEQ ID NO: 534058 - DNA, 25 bp, Mus musculus
aggcctcacacaatcagctggacag

SEQ ID NO: 534059 - DNA, 25 bp, Mus musculus
aggcctcacacattcagctggacag

SEQ ID NO: 534060 - DNA, 25 bp, Mus musculus
aggcctcaggacattgagaatacag

SEQ ID NO: 534061 - DNA, 25 bp, Mus musculus
aggcctcaggactttgagaatacag

SEQ ID NO: 534062 - DNA, 25 bp, Mus musculus
aggcctcagggaaggacccgcttgt

SEQ ID NO: 534063 - DNA, 25 bp, Mus musculus
aggcctcagggatggacccgcttgt

SEQ ID NO: 534064 - DNA, 25 bp, Mus musculus
aggcctcatggcaccctcacagttt

SEQ ID NO: 534065 - DNA, 25 bp, Mus musculus
aggcctcatggctccctcacagttt

SEQ ID NO: 534066 - DNA, 25 bp, Mus musculus
aggcctcattcacatgcttactcac

SEQ ID NO: 534067 - DNA, 25 bp, Mus musculus
aggcctcattcagatgcttactcac

SEQ ID NO: 534068 - DNA, 25 bp, Mus musculus
aggcctcatttcatccaaccatgaa

SEQ ID NO: 534069 - DNA, 25 bp, Mus musculus
aggcctcatttcttccaaccatgaa

SEQ ID NO: 534070 - DNA, 25 bp, Mus musculus
aggcctccacgcaggtaccatgctg

SEQ ID NO: 534071 - DNA, 25 bp, Mus musculus
aggcctccacgctggtaccatgctg

SEQ ID NO: 534072 - DNA, 25 bp, Mus musculus
aggcctccgtacagcaggtgtctga

SEQ ID NO: 534073 - DNA, 25 bp, Mus musculus
aggcctccgtactgcaggtgtctga

SEQ ID NO: 534074 - DNA, 25 bp, Mus musculus
aggcctcctcaactccagagcagag

SEQ ID NO: 534075 - DNA, 25 bp, Mus musculus
aggcctcctcaagtccagagcagag

SEQ ID NO: 534076 - DNA, 25 bp, Mus musculus
aggcctcgcatgcttcctgcctgtg

SEQ ID NO: 534077 - DNA, 25 bp, Mus musculus
aggcctcgcatggttcctgcctgtg

SEQ ID NO: 534078 - DNA, 25 bp, Mus musculus
aggcctctaggccacacaagcctgg

SEQ ID NO: 534079 - DNA, 25 bp, Mus musculus
aggcctctaggcgacacaagcctgg

SEQ ID NO: 534080 - DNA, 25 bp, Mus musculus
aggcctctcaaactccaggtgctgt

SEQ ID NO: 534081 - DNA, 25 bp, Mus musculus
aggcctctcaaagtccaggtgctgt

SEQ ID NO: 534082 - DNA, 25 bp, Mus musculus
aggcctctgcagatgaccgttcaag

SEQ ID NO: 534083 - DNA, 25 bp, Mus musculus
aggcctctgcagttgaccgttcaag

SEQ ID NO: 534084 - DNA, 25 bp, Mus musculus
aggcctctgccgaggtcactgacag

SEQ ID NO: 534085 - DNA, 25 bp, Mus musculus
aggcctctgccgtggtcactgacag

SEQ ID NO: 534086 - DNA, 25 bp, Mus musculus
aggcctctggacctctgtgcacaca

SEQ ID NO: 534087 - DNA, 25 bp, Mus musculus
aggcctctggacgtctgtgcacaca

SEQ ID NO: 534088 - DNA, 25 bp, Mus musculus
aggcctctttataagtatccatgac

SEQ ID NO: 534089 - DNA, 25 bp, Mus musculus
aggcctctttattagtatccatgac

SEQ ID NO: 534090 - DNA, 25 bp, Mus musculus
aggcctgagctgaatgaacaaggat

SEQ ID NO: 534091 - DNA, 25 bp, Mus musculus
aggcctgagctgtatgaacaaggat

SEQ ID NO: 534092 - DNA, 25 bp, Mus musculus
aggcctgcaattccctgctcctgaa

SEQ ID NO: 534093 - DNA, 25 bp, Mus musculus
aggcctgcaattgcctgctcctgaa

SEQ ID NO: 534094 - DNA, 25 bp, Mus musculus
aggcctgcccagctgccatcgatgg

SEQ ID NO: 534095 - DNA, 25 bp, Mus musculus
aggcctgcccaggtgccatcgatgg

SEQ ID NO: 534096 - DNA, 25 bp, Mus musculus
aggcctgcctggaaccacagatcac

SEQ ID NO: 534097 - DNA, 25 bp, Mus musculus
aggcctgcctggtaccacagatcac

SEQ ID NO: 534098 - DNA, 25 bp, Mus musculus
aggcctgctcggacaccctggagct

SEQ ID NO: 534099 - DNA, 25 bp, Mus musculus
aggcctgctcggtcaccctggagct

SEQ ID NO: 534100 - DNA, 25 bp, Mus musculus
aggcctggagccagcaatgcgctct

SEQ ID NO: 534101 - DNA, 25 bp, Mus musculus
aggcctggagcctgcaatgcgctct

SEQ ID NO: 534102 - DNA, 25 bp, Mus musculus
aggcctggagcgcactgtgtcacac

SEQ ID NO: 534103 - DNA, 25 bp, Mus musculus
aggcctggagcggactgtgtcacac

SEQ ID NO: 534104 - DNA, 25 bp, Mus musculus
aggcctggatcaatgcagccacgca

SEQ ID NO: 534105 - DNA, 25 bp, Mus musculus
aggcctggatcattgcagccacgca

SEQ ID NO: 534106 - DNA, 25 bp, Mus musculus
aggcctggctgtccatgcaagatca

SEQ ID NO: 534107 - DNA, 25 bp, Mus musculus
aggcctggctgtgcatgcaagatca

SEQ ID NO: 534108 - DNA, 25 bp, Mus musculus
aggcctgggcccaacatctgtgcag

SEQ ID NO: 534109 - DNA, 25 bp, Mus musculus
aggcctgggccctacatctgtgcag

SEQ ID NO: 534110 - DNA, 25 bp, Mus musculus
aggcctggtggcactgagtgccctc

SEQ ID NO: 534111 - DNA, 25 bp, Mus musculus
aggcctggtggctctgagtgccctc

SEQ ID NO: 534112 - DNA, 25 bp, Mus musculus
aggcctgtcccaactctgaatcctg

SEQ ID NO: 534113 - DNA, 25 bp, Mus musculus
aggcctgtcccatctctgaatcctg

SEQ ID NO: 534114 - DNA, 25 bp, Mus musculus
aggcctgtgaacactccagtgaggc

SEQ ID NO: 534115 - DNA, 25 bp, Mus musculus
aggcctgtgaactctccagtgaggc

SEQ ID NO: 534116 - DNA, 25 bp, Mus musculus
aggcctgtggaacaaatacggtgac

SEQ ID NO: 534117 - DNA, 25 bp, Mus musculus
aggcctgtggaagaaatacggtgac

SEQ ID NO: 534118 - DNA, 25 bp, Mus musculus
aggccttaccatcagcaactcctgt

SEQ ID NO: 534119 - DNA, 25 bp, Mus musculus
aggccttaccatgagcaactcctgt

SEQ ID NO: 534120 - DNA, 25 bp, Mus musculus
aggccttagtgaagcccaccttgcg

SEQ ID NO: 534121 - DNA, 25 bp, Mus musculus
aggccttagtgatgcccaccttgcg

SEQ ID NO: 534122 - DNA, 25 bp, Mus musculus
aggccttcagaaagtccttgaagca

SEQ ID NO: 534123 - DNA, 25 bp, Mus musculus
aggccttcagaatgtccttgaagca

SEQ ID NO: 534124 - DNA, 25 bp, Mus musculus
aggccttcgaggagaacatggcccc

SEQ ID NO: 534125 - DNA, 25 bp, Mus musculus
aggccttcgaggtgaacatggcccc

SEQ ID NO: 534126 - DNA, 25 bp, Mus musculus
aggccttcgccaacctggacggcgg

SEQ ID NO: 534127 - DNA, 25 bp, Mus musculus
aggccttcgccatcctggacggcgg

SEQ ID NO: 534128 - DNA, 25 bp, Mus musculus
aggccttgaagccattcagcatccg

SEQ ID NO: 534129 - DNA, 25 bp, Mus musculus
aggccttgaagcgattcagcatccg

SEQ ID NO: 534130 - DNA, 25 bp, Mus musculus
aggccttgctagaaaacggtgcaca

SEQ ID NO: 534131 - DNA, 25 bp, Mus musculus
aggccttgctagtaaacggtgcaca

SEQ ID NO: 534132 - DNA, 25 bp, Mus musculus
aggccttggagcacactggtttaaa

SEQ ID NO: 534133 - DNA, 25 bp, Mus musculus
aggccttggagctcactggtttaaa

SEQ ID NO: 534134 - DNA, 25 bp, Mus musculus
aggccttggcttacgtggctgaagt

SEQ ID NO: 534135 - DNA, 25 bp, Mus musculus
aggccttggctttcgtggctgaagt

SEQ ID NO: 534136 - DNA, 25 bp, Mus musculus
aggccttgggagcacaatgcctgct

SEQ ID NO: 534137 - DNA, 25 bp, Mus musculus
aggccttgggaggacaatgcctgct

SEQ ID NO: 534138 - DNA, 25 bp, Mus musculus
aggcctttgaggccctggagtctcc

SEQ ID NO: 534139 - DNA, 25 bp, Mus musculus
aggcctttgagggcctggagtctcc

SEQ ID NO: 534140 - DNA, 25 bp, Mus musculus
aggcctttgccacagccttcttaag

SEQ ID NO: 534141 - DNA, 25 bp, Mus musculus
aggcctttgccagagccttcttaag

SEQ ID NO: 534142 - DNA, 25 bp, Mus musculus
aggcctttggccagaagatcggcca

SEQ ID NO: 534143 - DNA, 25 bp, Mus musculus
aggcctttggcctgaagatcggcca

SEQ ID NO: 534144 - DNA, 25 bp, Mus musculus
aggccttttggcagcgtgttcacgg

SEQ ID NO: 534145 - DNA, 25 bp, Mus musculus
aggccttttggctgcgtgttcacgg

SEQ ID NO: 534146 - DNA, 25 bp, Mus musculus
aggcctttttccaatgccaagtctg

SEQ ID NO: 534147 - DNA, 25 bp, Mus musculus
aggcctttttcctatgccaagtctg

SEQ ID NO: 534148 - DNA, 25 bp, Mus musculus
aggcgaaaccagcagagacccagga

SEQ ID NO: 534149 - DNA, 25 bp, Mus musculus
aggcgaaaccaggagagacccagga

SEQ ID NO: 534150 - DNA, 25 bp, Mus musculus
aggcgaaagtacaacaaggagagag

SEQ ID NO: 534151 - DNA, 25 bp, Mus musculus
aggcgaaagtactacaaggagagag

SEQ ID NO: 534152 - DNA, 25 bp, Mus musculus
aggcgaaccttacgcactcctgtct

SEQ ID NO: 534153 - DNA, 25 bp, Mus musculus
aggcgaaccttaggcactcctgtct

SEQ ID NO: 534154 - DNA, 25 bp, Mus musculus
aggcgaagcactatcacgccaagct

SEQ ID NO: 534155 - DNA, 25 bp, Mus musculus
aggcgaagcactttcacgccaagct

SEQ ID NO: 534156 - DNA, 25 bp, Mus musculus
aggcgaagctgactcacgaaaccca

SEQ ID NO: 534157 - DNA, 25 bp, Mus musculus
aggcgaagctgagtcacgaaaccca

SEQ ID NO: 534158 - DNA, 25 bp, Mus musculus
aggcgaaggacccatgtgaccccaa

SEQ ID NO: 534159 - DNA, 25 bp, Mus musculus
aggcgaaggaccgatgtgaccccaa

SEQ ID NO: 534160 - DNA, 25 bp, Mus musculus
aggcgacacagcaaatgaaattgga

SEQ ID NO: 534161 - DNA, 25 bp, Mus musculus
aggcgacacagctaatgaaattgga

SEQ ID NO: 534162 - DNA, 25 bp, Mus musculus
aggcgactatctcgatgactggaca

SEQ ID NO: 534163 - DNA, 25 bp, Mus musculus
aggcgactatctggatgactggaca

SEQ ID NO: 534164 - DNA, 25 bp, Mus musculus
aggcgactcattattaccgtgggca

SEQ ID NO: 534165 - DNA, 25 bp, Mus musculus
aggcgactcatttttaccgtgggca

SEQ ID NO: 534166 - DNA, 25 bp, Mus musculus
aggcgactcgtaagccctgatggca

SEQ ID NO: 534167 - DNA, 25 bp, Mus musculus
aggcgactcgtatgccctgatggca

SEQ ID NO: 534168 - DNA, 25 bp, Mus musculus
aggcgagttcatattggctcacagt

SEQ ID NO: 534169 - DNA, 25 bp, Mus musculus
aggcgagttcattttggctcacagt

SEQ ID NO: 534170 - DNA, 25 bp, Mus musculus
aggcgatcagctcaaaaacagggtc

SEQ ID NO: 534171 - DNA, 25 bp, Mus musculus
aggcgatcagctgaaaaacagggtc

SEQ ID NO: 534172 - DNA, 25 bp, Mus musculus
aggcgatcggagaggacttccccgt

SEQ ID NO: 534173 - DNA, 25 bp, Mus musculus
aggcgatcggagtggacttccccgt

SEQ ID NO: 534174 - DNA, 25 bp, Mus musculus
aggcgatggtacaggagctgaaaca

SEQ ID NO: 534175 - DNA, 25 bp, Mus musculus
aggcgatggtactggagctgaaaca

SEQ ID NO: 534176 - DNA, 25 bp, Mus musculus
aggcgcaccgtgacacgcgtggctt

SEQ ID NO: 534177 - DNA, 25 bp, Mus musculus
aggcgcaccgtgtcacgcgtggctt

SEQ ID NO: 534178 - DNA, 25 bp, Mus musculus
aggcgcactcacacagctacgcggg

SEQ ID NO: 534179 - DNA, 25 bp, Mus musculus
aggcgcactcactcagctacgcggg

SEQ ID NO: 534180 - DNA, 25 bp, Mus musculus
aggcgcactggcctactggcctctg

SEQ ID NO: 534181 - DNA, 25 bp, Mus musculus
aggcgcactggcgtactggcctctg

SEQ ID NO: 534182 - DNA, 25 bp, Mus musculus
aggcgcaggaaaaccttcagctgga

SEQ ID NO: 534183 - DNA, 25 bp, Mus musculus
aggcgcaggaaatccttcagctgga

SEQ ID NO: 534184 - DNA, 25 bp, Mus musculus
aggcgcatctctatctccaccagtg

SEQ ID NO: 534185 - DNA, 25 bp, Mus musculus
aggcgcatctctttctccaccagtg

SEQ ID NO: 534186 - DNA, 25 bp, Mus musculus
aggcgcattaccaggccgtcgggaa

SEQ ID NO: 534187 - DNA, 25 bp, Mus musculus
aggcgcattacctggccgtcgggaa

SEQ ID NO: 534188 - DNA, 25 bp, Mus musculus
aggcgccagctgacaagtaaccacg

SEQ ID NO: 534189 - DNA, 25 bp, Mus musculus
aggcgccagctgtcaagtaaccacg

SEQ ID NO: 534190 - DNA, 25 bp, Mus musculus
aggcgccccactcaagatacacaag

SEQ ID NO: 534191 - DNA, 25 bp, Mus musculus
aggcgccccactgaagatacacaag

SEQ ID NO: 534192 - DNA, 25 bp, Mus musculus
aggcgccgcatcatgtcagccaagg

SEQ ID NO: 534193 - DNA, 25 bp, Mus musculus
aggcgccgcatcttgtcagccaagg

SEQ ID NO: 534194 - DNA, 25 bp, Mus musculus
aggcgcctatgaattaccccactgg

SEQ ID NO: 534195 - DNA, 25 bp, Mus musculus
aggcgcctatgatttaccccactgg

SEQ ID NO: 534196 - DNA, 25 bp, Mus musculus
aggcgcctgctgagctggacaagca

SEQ ID NO: 534197 - DNA, 25 bp, Mus musculus
aggcgcctgctgtgctggacaagca

SEQ ID NO: 534198 - DNA, 25 bp, Mus musculus
aggcgcggtcctccccttagagttg

SEQ ID NO: 534199 - DNA, 25 bp, Mus musculus
aggcgcggtcctgcccttagagttg

SEQ ID NO: 534200 - DNA, 25 bp, Mus musculus
aggcgcgtgataacccgcgtcttgg

SEQ ID NO: 534201 - DNA, 25 bp, Mus musculus
aggcgcgtgatatcccgcgtcttgg

SEQ ID NO: 534202 - DNA, 25 bp, Mus musculus
aggcgctcacagaagccatgtatac

SEQ ID NO: 534203 - DNA, 25 bp, Mus musculus
aggcgctcacagtagccatgtatac

SEQ ID NO: 534204 - DNA, 25 bp, Mus musculus
aggcgctcagccctgacatgctggc

SEQ ID NO: 534205 - DNA, 25 bp, Mus musculus
aggcgctcagccgtgacatgctggc

SEQ ID NO: 534206 - DNA, 25 bp, Mus musculus
aggcgctgccccacgatgtggtcca

SEQ ID NO: 534207 - DNA, 25 bp, Mus musculus
aggcgctgcccctcgatgtggtcca

SEQ ID NO: 534208 - DNA, 25 bp, Mus musculus
aggcgctgggacacatgttcatgta

SEQ ID NO: 534209 - DNA, 25 bp, Mus musculus
aggcgctgggactcatgttcatgta

SEQ ID NO: 534210 - DNA, 25 bp, Mus musculus
aggcgcttcaggactatcgcaagaa

SEQ ID NO: 534211 - DNA, 25 bp, Mus musculus
aggcgcttcaggagcaggcagctct

SEQ ID NO: 534212 - DNA, 25 bp, Mus musculus
aggcgcttcaggtctatcgcaagaa

SEQ ID NO: 534213 - DNA, 25 bp, Mus musculus
aggcgcttcaggtgcaggcagctct

SEQ ID NO: 534214 - DNA, 25 bp, Mus musculus
aggcggaaccccacagaatctggct

SEQ ID NO: 534215 - DNA, 25 bp, Mus musculus
aggcggaacccctcagaatctggct

SEQ ID NO: 534216 - DNA, 25 bp, Mus musculus
aggcggacgtgaagaacttgatttc

SEQ ID NO: 534217 - DNA, 25 bp, Mus musculus
aggcggacgtgatgaacttgatttc

SEQ ID NO: 534218 - DNA, 25 bp, Mus musculus
aggcggcaagggacaccacactaca

SEQ ID NO: 534219 - DNA, 25 bp, Mus musculus
aggcggcaagggtcaccacactaca

SEQ ID NO: 534220 - DNA, 25 bp, Mus musculus
aggcggcagccgagcgctctaaaat

SEQ ID NO: 534221 - DNA, 25 bp, Mus musculus
aggcggcagccgtgcgctctaaaat

SEQ ID NO: 534222 - DNA, 25 bp, Mus musculus
aggcggcaggtcaagtctgcccttc

SEQ ID NO: 534223 - DNA, 25 bp, Mus musculus
aggcggcaggtctagtctgcccttc

SEQ ID NO: 534224 - DNA, 25 bp, Mus musculus
aggcggcccagtcgctagctcttgc

SEQ ID NO: 534225 - DNA, 25 bp, Mus musculus
aggcggcccagtggctagctcttgc

SEQ ID NO: 534226 - DNA, 25 bp, Mus musculus
aggcggccgcacagttgaacaacat

SEQ ID NO: 534227 - DNA, 25 bp, Mus musculus
aggcggccgcactgttgaacaacat

SEQ ID NO: 534228 - DNA, 25 bp, Mus musculus
aggcggcgcccaagaaagaagtaaa

SEQ ID NO: 534229 - DNA, 25 bp, Mus musculus
aggcggcgcccatgaaagaagtaaa

SEQ ID NO: 534230 - DNA, 25 bp, Mus musculus
aggcggcgctcgacagttccgtctg

SEQ ID NO: 534231 - DNA, 25 bp, Mus musculus
aggcggcgctcgtcagttccgtctg

SEQ ID NO: 534232 - DNA, 25 bp, Mus musculus
aggcggctaccaactgcaggtctaa

SEQ ID NO: 534233 - DNA, 25 bp, Mus musculus
aggcggctaccatctgcaggtctaa

SEQ ID NO: 534234 - DNA, 25 bp, Mus musculus
aggcggctgacaagacgcaggcact

SEQ ID NO: 534235 - DNA, 25 bp, Mus musculus
aggcggctgacatgacgcaggcact

SEQ ID NO: 534236 - DNA, 25 bp, Mus musculus
aggcggctttctccacggccgtgac

SEQ ID NO: 534237 - DNA, 25 bp, Mus musculus
aggcggctttctgcacggccgtgac

SEQ ID NO: 534238 - DNA, 25 bp, Mus musculus
aggcgggagctgaccttctgtaaga

SEQ ID NO: 534239 - DNA, 25 bp, Mus musculus
aggcgggagctgtccttctgtaaga

SEQ ID NO: 534240 - DNA, 25 bp, Mus musculus
aggcggtagaacctccacctgactc

SEQ ID NO: 534241 - DNA, 25 bp, Mus musculus
aggcggtagaacgtccacctgactc

SEQ ID NO: 534242 - DNA, 25 bp, Mus musculus
aggcggtcagcaacaagctcccaac

SEQ ID NO: 534243 - DNA, 25 bp, Mus musculus
aggcggtcagcatcaagctcccaac

SEQ ID NO: 534244 - DNA, 25 bp, Mus musculus
aggcggtcccacacggaagtcatca

SEQ ID NO: 534245 - DNA, 25 bp, Mus musculus
aggcggtcccactcggaagtcatca

SEQ ID NO: 534246 - DNA, 25 bp, Mus musculus
aggcggtgcactacatcggctctcg

SEQ ID NO: 534247 - DNA, 25 bp, Mus musculus
aggcggtgcacttcatcggctctcg

SEQ ID NO: 534248 - DNA, 25 bp, Mus musculus
aggcggtgcagaagctccaggacct

SEQ ID NO: 534249 - DNA, 25 bp, Mus musculus
aggcggtgcagatgctccaggacct

SEQ ID NO: 534250 - DNA, 25 bp, Mus musculus
aggcggtgctcgatacggaagtccc

SEQ ID NO: 534251 - DNA, 25 bp, Mus musculus
aggcggtgctcgttacggaagtccc

SEQ ID NO: 534252 - DNA, 25 bp, Mus musculus
aggcgtacaagaccccacgtactgg

SEQ ID NO: 534253 - DNA, 25 bp, Mus musculus
aggcgtacaagagcccacgtactgg

SEQ ID NO: 534254 - DNA, 25 bp, Mus musculus
aggcgtaccagtacggcccgaacag

SEQ ID NO: 534255 - DNA, 25 bp, Mus musculus
aggcgtaccagttcggcccgaacag

SEQ ID NO: 534256 - DNA, 25 bp, Mus musculus
aggcgtatcgcacccggcggagttg

SEQ ID NO: 534257 - DNA, 25 bp, Mus musculus
aggcgtatcgcagccggcggagttg

SEQ ID NO: 534258 - DNA, 25 bp, Mus musculus
aggcgtcacttccatgcccaaggag

SEQ ID NO: 534259 - DNA, 25 bp, Mus musculus
aggcgtcacttcgatgcccaaggag

SEQ ID NO: 534260 - DNA, 25 bp, Mus musculus
aggcgtctatctctccatcgaggca

SEQ ID NO: 534261 - DNA, 25 bp, Mus musculus
aggcgtctatctgtccatcgaggca

SEQ ID NO: 534262 - DNA, 25 bp, Mus musculus
aggcgtgcttctccctcctggtgga

SEQ ID NO: 534263 - DNA, 25 bp, Mus musculus
aggcgtgcttctgcctcctggtgga

SEQ ID NO: 534264 - DNA, 25 bp, Mus musculus
aggcgtggagctcccaaagcattac

SEQ ID NO: 534265 - DNA, 25 bp, Mus musculus
aggcgtggagctgccaaagcattac

SEQ ID NO: 534266 - DNA, 25 bp, Mus musculus
aggcgtggcggaaccggaacccaca

SEQ ID NO: 534267 - DNA, 25 bp, Mus musculus
aggcgtggcggatccggaacccaca

SEQ ID NO: 534268 - DNA, 25 bp, Mus musculus
aggcgtgtgcacaagccgcccaggt

SEQ ID NO: 534269 - DNA, 25 bp, Mus musculus
aggcgtgtgcactagccgcccaggt

SEQ ID NO: 534270 - DNA, 25 bp, Mus musculus
aggcgttcctgaacatccctccgag

SEQ ID NO: 534271 - DNA, 25 bp, Mus musculus
aggcgttcctgatcatccctccgag

SEQ ID NO: 534272 - DNA, 25 bp, Mus musculus
aggcgttcgggaagatccggctttc

SEQ ID NO: 534273 - DNA, 25 bp, Mus musculus
aggcgttcgggatgatccggctttc

SEQ ID NO: 534274 - DNA, 25 bp, Mus musculus
aggcgtttctcactcatgacgctgc

SEQ ID NO: 534275 - DNA, 25 bp, Mus musculus
aggcgtttctcagtcatgacgctgc

SEQ ID NO: 534276 - DNA, 25 bp, Mus musculus
aggcgtttgcctaccaggcgagcca

SEQ ID NO: 534277 - DNA, 25 bp, Mus musculus
aggcgtttgccttccaggcgagcca

SEQ ID NO: 534278 - DNA, 25 bp, Mus musculus
aggctaagccttcctcccaggagtg

SEQ ID NO: 534279 - DNA, 25 bp, Mus musculus
aggctaagccttgctcccaggagtg

SEQ ID NO: 534280 - DNA, 25 bp, Mus musculus
aggctacaagtgcaacatcctgtca

SEQ ID NO: 534281 - DNA, 25 bp, Mus musculus
aggctacaagtggaacatcctgtca

SEQ ID NO: 534282 - DNA, 25 bp, Mus musculus
aggctacacactctacgggacaacc

SEQ ID NO: 534283 - DNA, 25 bp, Mus musculus
aggctacacactgtacgggacaacc

SEQ ID NO: 534284 - DNA, 25 bp, Mus musculus
aggctacgggatctcggacaccaac

SEQ ID NO: 534285 - DNA, 25 bp, Mus musculus
aggctacgggatgtcggacaccaac

SEQ ID NO: 534286 - DNA, 25 bp, Mus musculus
aggctacttgaaagacccagcaaga

SEQ ID NO: 534287 - DNA, 25 bp, Mus musculus
aggctacttgaatgacccagcaaga

SEQ ID NO: 534288 - DNA, 25 bp, Mus musculus
aggctaggcaccaacatgggccaca

SEQ ID NO: 534289 - DNA, 25 bp, Mus musculus
aggctaggcacctacatgggccaca

SEQ ID NO: 534290 - DNA, 25 bp, Mus musculus
aggctaggcgtaagcatgcagttgc

SEQ ID NO: 534291 - DNA, 25 bp, Mus musculus
aggctaggcgtatgcatgcagttgc

SEQ ID NO: 534292 - DNA, 25 bp, Mus musculus
aggctatcagcacaggccgccttga

SEQ ID NO: 534293 - DNA, 25 bp, Mus musculus
aggctatcagcagaggccgccttga

SEQ ID NO: 534294 - DNA, 25 bp, Mus musculus
aggctatggcaacctaagcagtgac

SEQ ID NO: 534295 - DNA, 25 bp, Mus musculus
aggctatggcaagctaagcagtgac

SEQ ID NO: 534296 - DNA, 25 bp, Mus musculus
aggctatggtgtaggcactcccatg

SEQ ID NO: 534297 - DNA, 25 bp, Mus musculus
aggctatggtgttggcactcccatg

SEQ ID NO: 534298 - DNA, 25 bp, Mus musculus
aggctattcctacctggagtccttg

SEQ ID NO: 534299 - DNA, 25 bp, Mus musculus
aggctattcctagctggagtccttg

SEQ ID NO: 534300 - DNA, 25 bp, Mus musculus
aggctattgtggacacagggacatc

SEQ ID NO: 534301 - DNA, 25 bp, Mus musculus
aggctattgtggtcacagggacatc

SEQ ID NO: 534302 - DNA, 25 bp, Mus musculus
aggctcaaagtcctcagagcaaggg

SEQ ID NO: 534303 - DNA, 25 bp, Mus musculus
aggctcaaagtcgtcagagcaaggg

SEQ ID NO: 534304 - DNA, 25 bp, Mus musculus
aggctcaccatgacagcatcatgaa

SEQ ID NO: 534305 - DNA, 25 bp, Mus musculus
aggctcaccatgtcagcatcatgaa

SEQ ID NO: 534306 - DNA, 25 bp, Mus musculus
aggctcagcagcaccagggcgatgc

SEQ ID NO: 534307 - DNA, 25 bp, Mus musculus
aggctcagcagctccagggcgatgc

SEQ ID NO: 534308 - DNA, 25 bp, Mus musculus
aggctcagcgcacaacgcaggtagc

SEQ ID NO: 534309 - DNA, 25 bp, Mus musculus
aggctcagcgcagaacgcaggtagc

SEQ ID NO: 534310 - DNA, 25 bp, Mus musculus
aggctcagctgacacagttcgtgac

SEQ ID NO: 534311 - DNA, 25 bp, Mus musculus
aggctcagctgagacagttcgtgac

SEQ ID NO: 534312 - DNA, 25 bp, Mus musculus
aggctcaggcccagtgtgcatgcag

SEQ ID NO: 534313 - DNA, 25 bp, Mus musculus
aggctcaggccctgtgtgcatgcag

SEQ ID NO: 534314 - DNA, 25 bp, Mus musculus
aggctcagtggtcaatgtgaacccc

SEQ ID NO: 534315 - DNA, 25 bp, Mus musculus
aggctcagtggtgaatgtgaacccc

SEQ ID NO: 534316 - DNA, 25 bp, Mus musculus
aggctcatgaggaacaattgctgca

SEQ ID NO: 534317 - DNA, 25 bp, Mus musculus
aggctcatgaggtacaattgctgca

SEQ ID NO: 534318 - DNA, 25 bp, Mus musculus
aggctcatgttaaaacacctccctc

SEQ ID NO: 534319 - DNA, 25 bp, Mus musculus
aggctcatgttataacacctccctc

SEQ ID NO: 534320 - DNA, 25 bp, Mus musculus
aggctcatttttcactgggaacaaa

SEQ ID NO: 534321 - DNA, 25 bp, Mus musculus
aggctcatttttgactgggaacaaa

SEQ ID NO: 534322 - DNA, 25 bp, Mus musculus
aggctccaccttccacagggtgatc

SEQ ID NO: 534323 - DNA, 25 bp, Mus musculus
aggctccaccttgcacagggtgatc

SEQ ID NO: 534324 - DNA, 25 bp, Mus musculus
aggctccagggacgagttctactgc

SEQ ID NO: 534325 - DNA, 25 bp, Mus musculus
aggctccagggaggagttctactgc

SEQ ID NO: 534326 - DNA, 25 bp, Mus musculus
aggctcccagggatgttctggtcag

SEQ ID NO: 534327 - DNA, 25 bp, Mus musculus
aggctcccagggttgttctggtcag

SEQ ID NO: 534328 - DNA, 25 bp, Mus musculus
aggctcccgccaagaaagacgtcaa

SEQ ID NO: 534329 - DNA, 25 bp, Mus musculus
aggctcccgccatgaaagacgtcaa

SEQ ID NO: 534330 - DNA, 25 bp, Mus musculus
aggctccgaggcatgcagcaagcag

SEQ ID NO: 534331 - DNA, 25 bp, Mus musculus
aggctccgaggcttgcagcaagcag

SEQ ID NO: 534332 - DNA, 25 bp, Mus musculus
aggctccgggccatgcagaaacagc

SEQ ID NO: 534333 - DNA, 25 bp, Mus musculus
aggctccgggccttgcagaaacagc

SEQ ID NO: 534334 - DNA, 25 bp, Mus musculus
aggctcctacgcagatgtgggacca

SEQ ID NO: 534335 - DNA, 25 bp, Mus musculus
aggctcctacgctgatgtgggacca

SEQ ID NO: 534336 - DNA, 25 bp, Mus musculus
aggctcctcctactacggtctcgtg

SEQ ID NO: 534337 - DNA, 25 bp, Mus musculus
aggctcctcctagtacggtctcgtg

SEQ ID NO: 534338 - DNA, 25 bp, Mus musculus
aggctcgagaggaaatggcaaaaag

SEQ ID NO: 534339 - DNA, 25 bp, Mus musculus
aggctcgagaggtaatggcaaaaag

SEQ ID NO: 534340 - DNA, 25 bp, Mus musculus
aggctcgagtggacaaaggcccaga

SEQ ID NO: 534341 - DNA, 25 bp, Mus musculus
aggctcgagtggtcaaaggcccaga

SEQ ID NO: 534342 - DNA, 25 bp, Mus musculus
aggctcggaagcatgagcggaaact

SEQ ID NO: 534343 - DNA, 25 bp, Mus musculus
aggctcggaagcttgagcggaaact

SEQ ID NO: 534344 - DNA, 25 bp, Mus musculus
aggctcggagttctgtgacatcaca

SEQ ID NO: 534345 - DNA, 25 bp, Mus musculus
aggctcggagttgtgtgacatcaca

SEQ ID NO: 534346 - DNA, 25 bp, Mus musculus
aggctcggcgtcaaggccagatacc

SEQ ID NO: 534347 - DNA, 25 bp, Mus musculus
aggctcggcgtctaggccagatacc

SEQ ID NO: 534348 - DNA, 25 bp, Mus musculus
aggctcgggatcagagtctccgctg

SEQ ID NO: 534349 - DNA, 25 bp, Mus musculus
aggctcgggatctgagtctccgctg

SEQ ID NO: 534350 - DNA, 25 bp, Mus musculus
aggctcgtgccgctttgcagacgcc

SEQ ID NO: 534351 - DNA, 25 bp, Mus musculus
aggctcgtgccggtttgcagacgcc

SEQ ID NO: 534352 - DNA, 25 bp, Mus musculus
aggctcgttggcagccccttcatag

SEQ ID NO: 534353 - DNA, 25 bp, Mus musculus
aggctcgttggctgccccttcatag

SEQ ID NO: 534354 - DNA, 25 bp, Mus musculus
aggctctacaagaactgccccaagg

SEQ ID NO: 534355 - DNA, 25 bp, Mus musculus
aggctctacaagtactgccccaagg

SEQ ID NO: 534356 - DNA, 25 bp, Mus musculus
aggctctagggcagcagataaggct

SEQ ID NO: 534357 - DNA, 25 bp, Mus musculus
aggctctagggctgcagataaggct

SEQ ID NO: 534358 - DNA, 25 bp, Mus musculus
aggctctatgccactgagaaccatc

SEQ ID NO: 534359 - DNA, 25 bp, Mus musculus
aggctctatgcctctgagaaccatc

SEQ ID NO: 534360 - DNA, 25 bp, Mus musculus
aggctctcaaagaagctgtgatttt

SEQ ID NO: 534361 - DNA, 25 bp, Mus musculus
aggctctcaaagtagctgtgatttt

SEQ ID NO: 534362 - DNA, 25 bp, Mus musculus
aggctctcagatcaatggcttggac

SEQ ID NO: 534363 - DNA, 25 bp, Mus musculus
aggctctcagatgaatggcttggac

SEQ ID NO: 534364 - DNA, 25 bp, Mus musculus
aggctctccagaaaagttctgggcc

SEQ ID NO: 534365 - DNA, 25 bp, Mus musculus
aggctctccagataagttctgggcc

SEQ ID NO: 534366 - DNA, 25 bp, Mus musculus
aggctctcgaagaggatgcgttaga

SEQ ID NO: 534367 - DNA, 25 bp, Mus musculus
aggctctcgaagtggatgcgttaga

SEQ ID NO: 534368 - DNA, 25 bp, Mus musculus
aggctctgcagtcgcacccagacaa

SEQ ID NO: 534369 - DNA, 25 bp, Mus musculus
aggctctgcagtggcacccagacaa

SEQ ID NO: 534370 - DNA, 25 bp, Mus musculus
aggctctgccgcatgctggacgaaa

SEQ ID NO: 534371 - DNA, 25 bp, Mus musculus
aggctctgccgcttgctggacgaaa

SEQ ID NO: 534372 - DNA, 25 bp, Mus musculus
aggctctggaagaaagacggtatcc

SEQ ID NO: 534373 - DNA, 25 bp, Mus musculus
aggctctggaagtaagacggtatcc

SEQ ID NO: 534374 - DNA, 25 bp, Mus musculus
aggctctggcccaacttagcagccg

SEQ ID NO: 534375 - DNA, 25 bp, Mus musculus
aggctctggccctacttagcagccg

SEQ ID NO: 534376 - DNA, 25 bp, Mus musculus
aggctctgggctaccagttccactc

SEQ ID NO: 534377 - DNA, 25 bp, Mus musculus
aggctctgggcttccagttccactc

SEQ ID NO: 534378 - DNA, 25 bp, Mus musculus
aggctctgtcctccggctggtagat

SEQ ID NO: 534379 - DNA, 25 bp, Mus musculus
aggctctgtcctgcggctggtagat

SEQ ID NO: 534380 - DNA, 25 bp, Mus musculus
aggctctgtgtaagcagttgctcag

SEQ ID NO: 534381 - DNA, 25 bp, Mus musculus
aggctctgtgtatgcagttgctcag

SEQ ID NO: 534382 - DNA, 25 bp, Mus musculus
aggctcttagaaacctaggcaggca

SEQ ID NO: 534383 - DNA, 25 bp, Mus musculus
aggctcttagaatcctaggcaggca

SEQ ID NO: 534384 - DNA, 25 bp, Mus musculus
aggctcttcatcaggccagtccaca

SEQ ID NO: 534385 - DNA, 25 bp, Mus musculus
aggctcttcatctggccagtccaca

SEQ ID NO: 534386 - DNA, 25 bp, Mus musculus
aggctcttccggaggccagcacagt

SEQ ID NO: 534387 - DNA, 25 bp, Mus musculus
aggctcttccggtggccagcacagt

SEQ ID NO: 534388 - DNA, 25 bp, Mus musculus
aggctcttctgtcgttctcaagtca

SEQ ID NO: 534389 - DNA, 25 bp, Mus musculus
aggctcttctgtggttctcaagtca

SEQ ID NO: 534390 - DNA, 25 bp, Mus musculus
aggctcttgtacaccctgcgcagct

SEQ ID NO: 534391 - DNA, 25 bp, Mus musculus
aggctcttgtactccctgcgcagct

SEQ ID NO: 534392 - DNA, 25 bp, Mus musculus
aggctctttccgaggtcggacagca

SEQ ID NO: 534393 - DNA, 25 bp, Mus musculus
aggctctttccgtggtcggacagca

SEQ ID NO: 534394 - DNA, 25 bp, Mus musculus
aggctctttcttctggatatatcac

SEQ ID NO: 534395 - DNA, 25 bp, Mus musculus
aggctctttcttgtggatatatcac

SEQ ID NO: 534396 - DNA, 25 bp, Mus musculus
aggctgaagcttcgtaccagaccaa

SEQ ID NO: 534397 - DNA, 25 bp, Mus musculus
aggctgaagcttggtaccagaccaa

SEQ ID NO: 534398 - DNA, 25 bp, Mus musculus
aggctgaaggccacatagtgacgtg

SEQ ID NO: 534399 - DNA, 25 bp, Mus musculus
aggctgaaggcctcatagtgacgtg

SEQ ID NO: 534400 - DNA, 25 bp, Mus musculus
aggctgacatacaagccacacctac

SEQ ID NO: 534401 - DNA, 25 bp, Mus musculus
aggctgacatactagccacacctac

SEQ ID NO: 534402 - DNA, 25 bp, Mus musculus
aggctgagagccatggactgtcacc

SEQ ID NO: 534403 - DNA, 25 bp, Mus musculus
aggctgagagccttggactgtcacc

SEQ ID NO: 534404 - DNA, 25 bp, Mus musculus
aggctgagaggcaggcccttcagtc

SEQ ID NO: 534405 - DNA, 25 bp, Mus musculus
aggctgagaggctggcccttcagtc

SEQ ID NO: 534406 - DNA, 25 bp, Mus musculus
aggctgagatccatgtcctccacca

SEQ ID NO: 534407 - DNA, 25 bp, Mus musculus
aggctgagatccttgtcctccacca

SEQ ID NO: 534408 - DNA, 25 bp, Mus musculus
aggctgaggcctaccagaagtatgg

SEQ ID NO: 534409 - DNA, 25 bp, Mus musculus
aggctgaggccttccagaagtatgg

SEQ ID NO: 534410 - DNA, 25 bp, Mus musculus
aggctgagtacaccgacgtgcttca

SEQ ID NO: 534411 - DNA, 25 bp, Mus musculus
aggctgagtacagcgacgtgcttca

SEQ ID NO: 534412 - DNA, 25 bp, Mus musculus
aggctgagtggacccgagctggtca

SEQ ID NO: 534413 - DNA, 25 bp, Mus musculus
aggctgagtggagccgagctggtca

SEQ ID NO: 534414 - DNA, 25 bp, Mus musculus
aggctgatggatactggacgagctc

SEQ ID NO: 534415 - DNA, 25 bp, Mus musculus
aggctgatggattctggacgagctc

SEQ ID NO: 534416 - DNA, 25 bp, Mus musculus
aggctgcacaaacgaattcctcaca

SEQ ID NO: 534417 - DNA, 25 bp, Mus musculus
aggctgcacaaaggaattcctcaca

SEQ ID NO: 534418 - DNA, 25 bp, Mus musculus
aggctgcagagaacaggacatggac

SEQ ID NO: 534419 - DNA, 25 bp, Mus musculus
aggctgcagagatcaggacatggac

SEQ ID NO: 534420 - DNA, 25 bp, Mus musculus
aggctgcagatcatccagggctgcc

SEQ ID NO: 534421 - DNA, 25 bp, Mus musculus
aggctgcagatcttccagggctgcc

SEQ ID NO: 534422 - DNA, 25 bp, Mus musculus
aggctgcatggcctccccagcaaaa

SEQ ID NO: 534423 - DNA, 25 bp, Mus musculus
aggctgcatggcgtccccagcaaaa

SEQ ID NO: 534424 - DNA, 25 bp, Mus musculus
aggctgccagcaagggctccctgct

SEQ ID NO: 534425 - DNA, 25 bp, Mus musculus
aggctgccagcatgggctccctgct

SEQ ID NO: 534426 - DNA, 25 bp, Mus musculus
aggctgcccagcctctcagtgagga

SEQ ID NO: 534427 - DNA, 25 bp, Mus musculus
aggctgcccagcgtctcagtgagga

SEQ ID NO: 534428 - DNA, 25 bp, Mus musculus
aggctgcccatgacctctgccggga

SEQ ID NO: 534429 - DNA, 25 bp, Mus musculus
aggctgcccatgtcctctgccggga

SEQ ID NO: 534430 - DNA, 25 bp, Mus musculus
aggctgccgacccacacggcagaga

SEQ ID NO: 534431 - DNA, 25 bp, Mus musculus
aggctgccgaccgacacggcagaga

SEQ ID NO: 534432 - DNA, 25 bp, Mus musculus
aggctgccttttctgtgaagcgaca

SEQ ID NO: 534433 - DNA, 25 bp, Mus musculus
aggctgccttttgtgtgaagcgaca

SEQ ID NO: 534434 - DNA, 25 bp, Mus musculus
aggctgcgaccgcacctgtaaggac

SEQ ID NO: 534435 - DNA, 25 bp, Mus musculus
aggctgcgaccggacctgtaaggac

SEQ ID NO: 534436 - DNA, 25 bp, Mus musculus
aggctgcgctgtatggcaagactga

SEQ ID NO: 534437 - DNA, 25 bp, Mus musculus
aggctgcgctgtttggcaagactga

SEQ ID NO: 534438 - DNA, 25 bp, Mus musculus
aggctgcggaacagctgcagacccc

SEQ ID NO: 534439 - DNA, 25 bp, Mus musculus
aggctgcggaactgctgcagacccc

SEQ ID NO: 534440 - DNA, 25 bp, Mus musculus
aggctgcggcttccgcttctcctgg

SEQ ID NO: 534441 - DNA, 25 bp, Mus musculus
aggctgcggcttgcgcttctcctgg

SEQ ID NO: 534442 - DNA, 25 bp, Mus musculus
aggctgctctgtagatctgaaggac

SEQ ID NO: 534443 - DNA, 25 bp, Mus musculus
aggctgctctgttgatctgaaggac

SEQ ID NO: 534444 - DNA, 25 bp, Mus musculus
aggctgctgctcagtctttaaatgt

SEQ ID NO: 534445 - DNA, 25 bp, Mus musculus
aggctgctgctctgtctttaaatgt

SEQ ID NO: 534446 - DNA, 25 bp, Mus musculus
aggctgctggtcattctggtcatcc

SEQ ID NO: 534447 - DNA, 25 bp, Mus musculus
aggctgctggtctttctggtcatcc

SEQ ID NO: 534448 - DNA, 25 bp, Mus musculus
aggctggaattgatcaccaaggtgg

SEQ ID NO: 534449 - DNA, 25 bp, Mus musculus
aggctggaattgttcaccaaggtgg

SEQ ID NO: 534450 - DNA, 25 bp, Mus musculus
aggctggaggccaagaggctcccca

SEQ ID NO: 534451 - DNA, 25 bp, Mus musculus
aggctggaggcctagaggctcccca

SEQ ID NO: 534452 - DNA, 25 bp, Mus musculus
aggctggcaagcaggcaaacggact

SEQ ID NO: 534453 - DNA, 25 bp, Mus musculus
aggctggcaagctggcaaacggact

SEQ ID NO: 534454 - DNA, 25 bp, Mus musculus
aggctggccacaatttggagtagga

SEQ ID NO: 534455 - DNA, 25 bp, Mus musculus
aggctggccacattttggagtagga

SEQ ID NO: 534456 - DNA, 25 bp, Mus musculus
aggctggccgctccgggcttccaat

SEQ ID NO: 534457 - DNA, 25 bp, Mus musculus
aggctggccgctgcgggcttccaat

SEQ ID NO: 534458 - DNA, 25 bp, Mus musculus
aggctggccgggaacggatgccaca

SEQ ID NO: 534459 - DNA, 25 bp, Mus musculus
aggctggccgggtacggatgccaca

SEQ ID NO: 534460 - DNA, 25 bp, Mus musculus
aggctggctgcaacccaacgacaaa

SEQ ID NO: 534461 - DNA, 25 bp, Mus musculus
aggctggctgcatcccaacgacaaa

SEQ ID NO: 534462 - DNA, 25 bp, Mus musculus
aggctggctgtgatgggctccctta

SEQ ID NO: 534463 - DNA, 25 bp, Mus musculus
aggctggctgtgttgggctccctta

SEQ ID NO: 534464 - DNA, 25 bp, Mus musculus
aggctgggcccgacgctctgtagcc

SEQ ID NO: 534465 - DNA, 25 bp, Mus musculus
aggctgggcccgtcgctctgtagcc

SEQ ID NO: 534466 - DNA, 25 bp, Mus musculus
aggctgggccgaccttcaactacct

SEQ ID NO: 534467 - DNA, 25 bp, Mus musculus
aggctgggccgagcttcaactacct

SEQ ID NO: 534468 - DNA, 25 bp, Mus musculus
aggctgggttttagctcttctcaca

SEQ ID NO: 534469 - DNA, 25 bp, Mus musculus
aggctgggtttttgctcttctcaca

SEQ ID NO: 534470 - DNA, 25 bp, Mus musculus
aggctgtaaagcagccatcagagag

SEQ ID NO: 534471 - DNA, 25 bp, Mus musculus
aggctgtaaagcaggcctgaggtcc

SEQ ID NO: 534472 - DNA, 25 bp, Mus musculus
aggctgtaaagctgccatcagagag

SEQ ID NO: 534473 - DNA, 25 bp, Mus musculus
aggctgtaaagctggcctgaggtcc

SEQ ID NO: 534474 - DNA, 25 bp, Mus musculus
aggctgtaaggaactcgtgggctac

SEQ ID NO: 534475 - DNA, 25 bp, Mus musculus
aggctgtaaggatctcgtgggctac

SEQ ID NO: 534476 - DNA, 25 bp, Mus musculus
aggctgtaaggcaatgctgctgtca

SEQ ID NO: 534477 - DNA, 25 bp, Mus musculus
aggctgtaaggctatgctgctgtca

SEQ ID NO: 534478 - DNA, 25 bp, Mus musculus
aggctgtcactccagaagaccatag

SEQ ID NO: 534479 - DNA, 25 bp, Mus musculus
aggctgtcactcgagaagaccatag

SEQ ID NO: 534480 - DNA, 25 bp, Mus musculus
aggctgtccagcagactttccaagg

SEQ ID NO: 534481 - DNA, 25 bp, Mus musculus
aggctgtccagctgactttccaagg

SEQ ID NO: 534482 - DNA, 25 bp, Mus musculus
aggctgtcgctgaagtggagcctct

SEQ ID NO: 534483 - DNA, 25 bp, Mus musculus
aggctgtcgctgtagtggagcctct

SEQ ID NO: 534484 - DNA, 25 bp, Mus musculus
aggctgtcggcgacctctcggaata

SEQ ID NO: 534485 - DNA, 25 bp, Mus musculus
aggctgtcggcgtcctctcggaata

SEQ ID NO: 534486 - DNA, 25 bp, Mus musculus
aggctgtgaggcaattgtggacaca

SEQ ID NO: 534487 - DNA, 25 bp, Mus musculus
aggctgtgaggctattgtggacaca

SEQ ID NO: 534488 - DNA, 25 bp, Mus musculus
aggctgtgcacgcttgaccaggctc

SEQ ID NO: 534489 - DNA, 25 bp, Mus musculus
aggctgtgcacggttgaccaggctc

SEQ ID NO: 534490 - DNA, 25 bp, Mus musculus
aggctgtggccgaagccctctgctc

SEQ ID NO: 534491 - DNA, 25 bp, Mus musculus
aggctgtggccgtagccctctgctc

SEQ ID NO: 534492 - DNA, 25 bp, Mus musculus
aggctgtgtactacatactgcatga

SEQ ID NO: 534493 - DNA, 25 bp, Mus musculus
aggctgtgtacttcatactgcatga

SEQ ID NO: 534494 - DNA, 25 bp, Mus musculus
aggctgtgtgctatatgccatgatg

SEQ ID NO: 534495 - DNA, 25 bp, Mus musculus
aggctgtgtgctccccagtcttggc

SEQ ID NO: 534496 - DNA, 25 bp, Mus musculus
aggctgtgtgctgcccagtcttggc

SEQ ID NO: 534497 - DNA, 25 bp, Mus musculus
aggctgtgtgctttatgccatgatg

SEQ ID NO: 534498 - DNA, 25 bp, Mus musculus
aggctgttccggcacagaagaagaa

SEQ ID NO: 534499 - DNA, 25 bp, Mus musculus
aggctgttccgggacagaagaagaa

SEQ ID NO: 534500 - DNA, 25 bp, Mus musculus
aggctgttcgagaaggttctccagc

SEQ ID NO: 534501 - DNA, 25 bp, Mus musculus
aggctgttcgagtaggttctccagc

SEQ ID NO: 534502 - DNA, 25 bp, Mus musculus
aggctgttgctacgtcccgagctcg

SEQ ID NO: 534503 - DNA, 25 bp, Mus musculus
aggctgttgctaggtcccgagctcg

SEQ ID NO: 534504 - DNA, 25 bp, Mus musculus
aggcttactcgaagcagaagacgag

SEQ ID NO: 534505 - DNA, 25 bp, Mus musculus
aggcttactcgatgcagaagacgag

SEQ ID NO: 534506 - DNA, 25 bp, Mus musculus
aggcttcaagggaaaagctgcagaa

SEQ ID NO: 534507 - DNA, 25 bp, Mus musculus
aggcttcaagggtaaagctgcagaa

SEQ ID NO: 534508 - DNA, 25 bp, Mus musculus
aggcttccggccagcccgtggatga

SEQ ID NO: 534509 - DNA, 25 bp, Mus musculus
aggcttccggcctgcccgtggatga

SEQ ID NO: 534510 - DNA, 25 bp, Mus musculus
aggcttcctcgcatggctgggccag

SEQ ID NO: 534511 - DNA, 25 bp, Mus musculus
aggcttcctcgcttggctgggccag

SEQ ID NO: 534512 - DNA, 25 bp, Mus musculus
aggcttcggaatcctcaaggctaag

SEQ ID NO: 534513 - DNA, 25 bp, Mus musculus
aggcttcggaatgctcaaggctaag

SEQ ID NO: 534514 - DNA, 25 bp, Mus musculus
aggcttctcgaaccgcccgctgaag

SEQ ID NO: 534515 - DNA, 25 bp, Mus musculus
aggcttctcgaagcgcccgctgaag

SEQ ID NO: 534516 - DNA, 25 bp, Mus musculus
aggcttctgcgacaatgcaccttcc

SEQ ID NO: 534517 - DNA, 25 bp, Mus musculus
aggcttctgcgagaatgcaccttcc

SEQ ID NO: 534518 - DNA, 25 bp, Mus musculus
aggcttctgtctctgaccctaaggc

SEQ ID NO: 534519 - DNA, 25 bp, Mus musculus
aggcttctgtctgtgaccctaaggc

SEQ ID NO: 534520 - DNA, 25 bp, Mus musculus
aggcttctgtgtatggccagcaagc

SEQ ID NO: 534521 - DNA, 25 bp, Mus musculus
aggcttctgtgtttggccagcaagc

SEQ ID NO: 534522 - DNA, 25 bp, Mus musculus
aggcttgcctaaccctgcaagaaca

SEQ ID NO: 534523 - DNA, 25 bp, Mus musculus
aggcttgcctaagcctgcaagaaca

SEQ ID NO: 534524 - DNA, 25 bp, Mus musculus
aggcttggagagagcagacgtcctc

SEQ ID NO: 534525 - DNA, 25 bp, Mus musculus
aggcttggagagtgcagacgtcctc

SEQ ID NO: 534526 - DNA, 25 bp, Mus musculus
aggcttggccagatcgggttccctg

SEQ ID NO: 534527 - DNA, 25 bp, Mus musculus
aggcttggccagatctcggacccat

SEQ ID NO: 534528 - DNA, 25 bp, Mus musculus
aggcttggccagttcgggttccctg

SEQ ID NO: 534529 - DNA, 25 bp, Mus musculus
aggcttggccagttctcggacccat

SEQ ID NO: 534530 - DNA, 25 bp, Mus musculus
aggctttatcccctggctatccaga

SEQ ID NO: 534531 - DNA, 25 bp, Mus musculus
aggctttatcccgtggctatccaga

SEQ ID NO: 534532 - DNA, 25 bp, Mus musculus
aggctttcgaggcacagttcgttat

SEQ ID NO: 534533 - DNA, 25 bp, Mus musculus
aggctttcgagggacagttcgttat

SEQ ID NO: 534534 - DNA, 25 bp, Mus musculus
aggctttctcccaccggtggttgca

SEQ ID NO: 534535 - DNA, 25 bp, Mus musculus
aggctttctccctccggtggttgca

SEQ ID NO: 534536 - DNA, 25 bp, Mus musculus
aggctttggcttctatctttttgaa

SEQ ID NO: 534537 - DNA, 25 bp, Mus musculus
aggctttggcttgtatctttttgaa

SEQ ID NO: 534538 - DNA, 25 bp, Mus musculus
agggaaaccaccaggcaggatgagc

SEQ ID NO: 534539 - DNA, 25 bp, Mus musculus
agggaaaccacctggcaggatgagc

SEQ ID NO: 534540 - DNA, 25 bp, Mus musculus
agggaaacccttacagctttcacat

SEQ ID NO: 534541 - DNA, 25 bp, Mus musculus
agggaaaccctttcagctttcacat

SEQ ID NO: 534542 - DNA, 25 bp, Mus musculus
agggaaagaaagagattgtcactgg

SEQ ID NO: 534543 - DNA, 25 bp, Mus musculus
agggaaagaaagtgattgtcactgg

SEQ ID NO: 534544 - DNA, 25 bp, Mus musculus
agggaaagctcaaggacccgggctc

SEQ ID NO: 534545 - DNA, 25 bp, Mus musculus
agggaaagctcatggacccgggctc

SEQ ID NO: 534546 - DNA, 25 bp, Mus musculus
agggaaattttgaagctgctgtgaa

SEQ ID NO: 534547 - DNA, 25 bp, Mus musculus
agggaaattttgtagctgctgtgaa

SEQ ID NO: 534548 - DNA, 25 bp, Mus musculus
agggaacactcaagggcagctggca

SEQ ID NO: 534549 - DNA, 25 bp, Mus musculus
agggaacactcatgggcagctggca

SEQ ID NO: 534550 - DNA, 25 bp, Mus musculus
agggaacagactccccatagtcgta

SEQ ID NO: 534551 - DNA, 25 bp, Mus musculus
agggaacagactgcccatagtcgta

SEQ ID NO: 534552 - DNA, 25 bp, Mus musculus
agggaaccacctaccgagagtctga

SEQ ID NO: 534553 - DNA, 25 bp, Mus musculus
agggaaccaccttccgagagtctga

SEQ ID NO: 534554 - DNA, 25 bp, Mus musculus
agggaaccttgaccacgcccaactg

SEQ ID NO: 534555 - DNA, 25 bp, Mus musculus
agggaaccttgagcacgcccaactg

SEQ ID NO: 534556 - DNA, 25 bp, Mus musculus
agggaactaaagcaaatagctgaag

SEQ ID NO: 534557 - DNA, 25 bp, Mus musculus
agggaactaaaggaaatagctgaag

SEQ ID NO: 534558 - DNA, 25 bp, Mus musculus
agggaactcctcctcactctacaag

SEQ ID NO: 534559 - DNA, 25 bp, Mus musculus
agggaactcctcgtcactctacaag

SEQ ID NO: 534560 - DNA, 25 bp, Mus musculus
agggaactgcatagatgcccagtat

SEQ ID NO: 534561 - DNA, 25 bp, Mus musculus
agggaactgcattgatgcccagtat

SEQ ID NO: 534562 - DNA, 25 bp, Mus musculus
agggaagagacaccaacttttctat

SEQ ID NO: 534563 - DNA, 25 bp, Mus musculus
agggaagagacagcaacttttctat

SEQ ID NO: 534564 - DNA, 25 bp, Mus musculus
agggaagagcagacaagaacttctc

SEQ ID NO: 534565 - DNA, 25 bp, Mus musculus
agggaagagcagtcaagaacttctc

SEQ ID NO: 534566 - DNA, 25 bp, Mus musculus
agggaagagcatcctttactttact

SEQ ID NO: 534567 - DNA, 25 bp, Mus musculus
agggaagagcatgctttactttact

SEQ ID NO: 534568 - DNA, 25 bp, Mus musculus
agggaagatcatcccagccattgcc

SEQ ID NO: 534569 - DNA, 25 bp, Mus musculus
agggaagatcatgccagccattgcc

SEQ ID NO: 534570 - DNA, 25 bp, Mus musculus
agggaagcggctccaagtcgcttca

SEQ ID NO: 534571 - DNA, 25 bp, Mus musculus
agggaagcggctgcaagtcgcttca

SEQ ID NO: 534572 - DNA, 25 bp, Mus musculus
agggaaggcaaacccggatgctgtc

SEQ ID NO: 534573 - DNA, 25 bp, Mus musculus
agggaaggcaaagccggatgctgtc

SEQ ID NO: 534574 - DNA, 25 bp, Mus musculus
agggaaggccgcacctgcattgtga

SEQ ID NO: 534575 - DNA, 25 bp, Mus musculus
agggaaggccgctcctgcattgtga

SEQ ID NO: 534576 - DNA, 25 bp, Mus musculus
agggaaggctgtaaagcagccatca

SEQ ID NO: 534577 - DNA, 25 bp, Mus musculus
agggaaggctgttaagcagccatca

SEQ ID NO: 534578 - DNA, 25 bp, Mus musculus
agggaaggcttcctctaccactgag

SEQ ID NO: 534579 - DNA, 25 bp, Mus musculus
agggaaggcttcgtctaccactgag

SEQ ID NO: 534580 - DNA, 25 bp, Mus musculus
agggaatacacccacagccacgtct

SEQ ID NO: 534581 - DNA, 25 bp, Mus musculus
agggaatacaccgacagccacgtct

SEQ ID NO: 534582 - DNA, 25 bp, Mus musculus
agggaatcaaccagccttccttgct

SEQ ID NO: 534583 - DNA, 25 bp, Mus musculus
agggaatcaacctgccttccttgct

SEQ ID NO: 534584 - DNA, 25 bp, Mus musculus
agggaatcttgacttcctcaagcct

SEQ ID NO: 534585 - DNA, 25 bp, Mus musculus
agggaatcttgagttcctcaagcct

SEQ ID NO: 534586 - DNA, 25 bp, Mus musculus
agggaatggcatatcacaccagaca

SEQ ID NO: 534587 - DNA, 25 bp, Mus musculus
agggaatggcatttcacaccagaca

SEQ ID NO: 534588 - DNA, 25 bp, Mus musculus
agggacaacagacgcactttccata

SEQ ID NO: 534589 - DNA, 25 bp, Mus musculus
agggacaacagaggcactttccata

SEQ ID NO: 534590 - DNA, 25 bp, Mus musculus
agggacaggactcatcctctggctg

SEQ ID NO: 534591 - DNA, 25 bp, Mus musculus
agggacaggactgatcctctggctg

SEQ ID NO: 534592 - DNA, 25 bp, Mus musculus
agggacagggccatctgaagcagcc

SEQ ID NO: 534593 - DNA, 25 bp, Mus musculus
agggacagggccttctgaagcagcc

SEQ ID NO: 534594 - DNA, 25 bp, Mus musculus
agggacagttgtcctttgctcagag

SEQ ID NO: 534595 - DNA, 25 bp, Mus musculus
agggacagttgtgctttgctcagag

SEQ ID NO: 534596 - DNA, 25 bp, Mus musculus
agggacatacatcgcctggtgttcc

SEQ ID NO: 534597 - DNA, 25 bp, Mus musculus
agggacatacatggcctggtgttcc

SEQ ID NO: 534598 - DNA, 25 bp, Mus musculus
agggacatcgcacttctggatttaa

SEQ ID NO: 534599 - DNA, 25 bp, Mus musculus
agggacatcgcagttctggatttaa

SEQ ID NO: 534600 - DNA, 25 bp, Mus musculus
agggaccacaccattccgagacctg

SEQ ID NO: 534601 - DNA, 25 bp, Mus musculus
agggaccacacctttccgagacctg

SEQ ID NO: 534602 - DNA, 25 bp, Mus musculus
agggaccacctcctatgcagaccag

SEQ ID NO: 534603 - DNA, 25 bp, Mus musculus
agggaccacctcgtatgcagaccag

SEQ ID NO: 534604 - DNA, 25 bp, Mus musculus
agggaccactgaacctgtgccagga

SEQ ID NO: 534605 - DNA, 25 bp, Mus musculus
agggaccactgatcctgtgccagga

SEQ ID NO: 534606 - DNA, 25 bp, Mus musculus
agggacccttgtacagactctggca

SEQ ID NO: 534607 - DNA, 25 bp, Mus musculus
agggacccttgttcagactctggca

SEQ ID NO: 534608 - DNA, 25 bp, Mus musculus
agggaccggactcctacaggcctgc

SEQ ID NO: 534609 - DNA, 25 bp, Mus musculus
agggaccggactgctacaggcctgc

SEQ ID NO: 534610 - DNA, 25 bp, Mus musculus
agggacctaaccacatgggccgact

SEQ ID NO: 534611 - DNA, 25 bp, Mus musculus
agggacctaacctcatgggccgact

SEQ ID NO: 534612 - DNA, 25 bp, Mus musculus
agggacctgaataacagggaccagt

SEQ ID NO: 534613 - DNA, 25 bp, Mus musculus
agggacctgaattacagggaccagt

SEQ ID NO: 534614 - DNA, 25 bp, Mus musculus
agggacctgcctcattttgttcgaa

SEQ ID NO: 534615 - DNA, 25 bp, Mus musculus
agggacctgcctgattttgttcgaa

SEQ ID NO: 534616 - DNA, 25 bp, Mus musculus
agggacctgtgacctgcctcgatcc

SEQ ID NO: 534617 - DNA, 25 bp, Mus musculus
agggacctgtgagctgcctcgatcc

SEQ ID NO: 534618 - DNA, 25 bp, Mus musculus
agggacctttggctggcatccttgc

SEQ ID NO: 534619 - DNA, 25 bp, Mus musculus
agggacctttgggtggcatccttgc

SEQ ID NO: 534620 - DNA, 25 bp, Mus musculus
agggacgacctcaatgtctccgacg

SEQ ID NO: 534621 - DNA, 25 bp, Mus musculus
agggacgacctctatgtctccgacg

SEQ ID NO: 534622 - DNA, 25 bp, Mus musculus
agggacgccttcagccttcgaccga

SEQ ID NO: 534623 - DNA, 25 bp, Mus musculus
agggacgccttctgccttcgaccga

SEQ ID NO: 534624 - DNA, 25 bp, Mus musculus
agggacggacccctacacagctgga

SEQ ID NO: 534625 - DNA, 25 bp, Mus musculus
agggacggacccgtacacagctgga

SEQ ID NO: 534626 - DNA, 25 bp, Mus musculus
agggacggtgccatctcgaccatgg

SEQ ID NO: 534627 - DNA, 25 bp, Mus musculus
agggacggtgccttctcgaccatgg

SEQ ID NO: 534628 - DNA, 25 bp, Mus musculus
agggacgttctcagacaccacatca

SEQ ID NO: 534629 - DNA, 25 bp, Mus musculus
agggacgttctctgacaccacatca

SEQ ID NO: 534630 - DNA, 25 bp, Mus musculus
agggactagaacctgtcttggacag

SEQ ID NO: 534631 - DNA, 25 bp, Mus musculus
agggactagaacgtgtcttggacag

SEQ ID NO: 534632 - DNA, 25 bp, Mus musculus
agggactatgctaccggtcactggg

SEQ ID NO: 534633 - DNA, 25 bp, Mus musculus
agggactatgcttccggtcactggg

SEQ ID NO: 534634 - DNA, 25 bp, Mus musculus
agggactcagctccgaattacgtat

SEQ ID NO: 534635 - DNA, 25 bp, Mus musculus
agggactcagctgcgaattacgtat

SEQ ID NO: 534636 - DNA, 25 bp, Mus musculus
agggactctgacatcagcccacagt

SEQ ID NO: 534637 - DNA, 25 bp, Mus musculus
agggactctgacttcagcccacagt

SEQ ID NO: 534638 - DNA, 25 bp, Mus musculus
agggactctggtcactgtctctgca

SEQ ID NO: 534639 - DNA, 25 bp, Mus musculus
agggactctggtgactgtctctgca

SEQ ID NO: 534640 - DNA, 25 bp, Mus musculus
agggactggaagatgcaggaaacct

SEQ ID NO: 534641 - DNA, 25 bp, Mus musculus
agggactggaagttgcaggaaacct

SEQ ID NO: 534642 - DNA, 25 bp, Mus musculus
agggactggcgcactcacagctttc

SEQ ID NO: 534643 - DNA, 25 bp, Mus musculus
agggactggcgctctcacagctttc

SEQ ID NO: 534644 - DNA, 25 bp, Mus musculus
agggactgggccatctaaatgcgga

SEQ ID NO: 534645 - DNA, 25 bp, Mus musculus
agggactgggccttctaaatgcgga

SEQ ID NO: 534646 - DNA, 25 bp, Mus musculus
agggacttcaggagaccctccaggg

SEQ ID NO: 534647 - DNA, 25 bp, Mus musculus
agggacttcaggtgaccctccaggg

SEQ ID NO: 534648 - DNA, 25 bp, Mus musculus
agggagaagcagaatcaggtgcacc

SEQ ID NO: 534649 - DNA, 25 bp, Mus musculus
agggagaagcagtatcaggtgcacc

SEQ ID NO: 534650 - DNA, 25 bp, Mus musculus
agggagaaggcgaaaagatgacaaa

SEQ ID NO: 534651 - DNA, 25 bp, Mus musculus
agggagaaggcgtaaagatgacaaa

SEQ ID NO: 534652 - DNA, 25 bp, Mus musculus
agggagacatgacaccggcttcaat

SEQ ID NO: 534653 - DNA, 25 bp, Mus musculus
agggagacatgagaccggcttcaat

SEQ ID NO: 534654 - DNA, 25 bp, Mus musculus
agggagacctccatggtgcatgagc

SEQ ID NO: 534655 - DNA, 25 bp, Mus musculus
agggagacctccttggtgcatgagc

SEQ ID NO: 534656 - DNA, 25 bp, Mus musculus
agggagacgaggacacccgaatcac

SEQ ID NO: 534657 - DNA, 25 bp, Mus musculus
agggagacgaggtcacccgaatcac

SEQ ID NO: 534658 - DNA, 25 bp, Mus musculus
agggagactgtgacttccacatcct

SEQ ID NO: 534659 - DNA, 25 bp, Mus musculus
agggagactgtgtcttccacatcct

SEQ ID NO: 534660 - DNA, 25 bp, Mus musculus
agggagagactgaaaagcgaatccg

SEQ ID NO: 534661 - DNA, 25 bp, Mus musculus
agggagagactgtaaagcgaatccg

SEQ ID NO: 534662 - DNA, 25 bp, Mus musculus
agggagagatccacagaagtctgga

SEQ ID NO: 534663 - DNA, 25 bp, Mus musculus
agggagagatcctcagaagtctgga

SEQ ID NO: 534664 - DNA, 25 bp, Mus musculus
agggagagatgcactacctggctac

SEQ ID NO: 534665 - DNA, 25 bp, Mus musculus
agggagagatgctctacctggctac

SEQ ID NO: 534666 - DNA, 25 bp, Mus musculus
agggagagcagtcgtatcatcaaaa

SEQ ID NO: 534667 - DNA, 25 bp, Mus musculus
agggagagcagtggtatcatcaaaa

SEQ ID NO: 534668 - DNA, 25 bp, Mus musculus
agggagagcgctcttcccagctcct

SEQ ID NO: 534669 - DNA, 25 bp, Mus musculus
agggagagcgctgttcccagctcct

SEQ ID NO: 534670 - DNA, 25 bp, Mus musculus
agggagagcgttcggcttacctcac

SEQ ID NO: 534671 - DNA, 25 bp, Mus musculus
agggagagcgttgggcttacctcac

SEQ ID NO: 534672 - DNA, 25 bp, Mus musculus
agggagaggccaccaaagattctct

SEQ ID NO: 534673 - DNA, 25 bp, Mus musculus
agggagaggccagcaaagattctct

SEQ ID NO: 534674 - DNA, 25 bp, Mus musculus
agggagagggtgaagattctctaca

SEQ ID NO: 534675 - DNA, 25 bp, Mus musculus
agggagagggtgtagattctctaca

SEQ ID NO: 534676 - DNA, 25 bp, Mus musculus
agggagatgtcgaccaagaccatcc

SEQ ID NO: 534677 - DNA, 25 bp, Mus musculus
agggagatgtcgtccaagaccatcc

SEQ ID NO: 534678 - DNA, 25 bp, Mus musculus
agggagcacgaacaacggccatgtt

SEQ ID NO: 534679 - DNA, 25 bp, Mus musculus
agggagcacgaagaacggccatgtt

SEQ ID NO: 534680 - DNA, 25 bp, Mus musculus
agggagcccgccctcgcttcaggat

SEQ ID NO: 534681 - DNA, 25 bp, Mus musculus
agggagcccgccgtcgcttcaggat

SEQ ID NO: 534682 - DNA, 25 bp, Mus musculus
agggagcccttacctcattggtcta

SEQ ID NO: 534683 - DNA, 25 bp, Mus musculus
agggagcccttagctcattggtcta

SEQ ID NO: 534684 - DNA, 25 bp, Mus musculus
agggagccttctcgtctgcctctga

SEQ ID NO: 534685 - DNA, 25 bp, Mus musculus
agggagccttctggtctgcctctga

SEQ ID NO: 534686 - DNA, 25 bp, Mus musculus
agggagctggtacctctactagcag

SEQ ID NO: 534687 - DNA, 25 bp, Mus musculus
agggagctggtagctctactagcag

SEQ ID NO: 534688 - DNA, 25 bp, Mus musculus
agggagctgtccacgcgttcggccc

SEQ ID NO: 534689 - DNA, 25 bp, Mus musculus
agggagctgtcctcgcgttcggccc

SEQ ID NO: 534690 - DNA, 25 bp, Mus musculus
agggagcttcgtaactcacttgaag

SEQ ID NO: 534691 - DNA, 25 bp, Mus musculus
agggagcttcgttactcacttgaag

SEQ ID NO: 534692 - DNA, 25 bp, Mus musculus
agggaggagttcaactgcctcagga

SEQ ID NO: 534693 - DNA, 25 bp, Mus musculus
agggaggagttctactgcctcagga

SEQ ID NO: 534694 - DNA, 25 bp, Mus musculus
agggaggcctgtcaacactccagtg

SEQ ID NO: 534695 - DNA, 25 bp, Mus musculus
agggaggcctgtgaacactccagtg

SEQ ID NO: 534696 - DNA, 25 bp, Mus musculus
agggaggctcagaccttctagacaa

SEQ ID NO: 534697 - DNA, 25 bp, Mus musculus
agggaggctcagtccttctagacaa

SEQ ID NO: 534698 - DNA, 25 bp, Mus musculus
agggaggctgtcctatgacaccacc

SEQ ID NO: 534699 - DNA, 25 bp, Mus musculus
agggaggctgtcgtatgacaccacc

SEQ ID NO: 534700 - DNA, 25 bp, Mus musculus
agggagggaagaacgccattaacat

SEQ ID NO: 534701 - DNA, 25 bp, Mus musculus
agggagggaagatcgccattaacat

SEQ ID NO: 534702 - DNA, 25 bp, Mus musculus
agggagtcatgtcctgcctagtagt

SEQ ID NO: 534703 - DNA, 25 bp, Mus musculus
agggagtcatgtgctgcctagtagt

SEQ ID NO: 534704 - DNA, 25 bp, Mus musculus
agggagtctgcgaccggacgcctct

SEQ ID NO: 534705 - DNA, 25 bp, Mus musculus
agggagtctgcgtccggacgcctct

SEQ ID NO: 534706 - DNA, 25 bp, Mus musculus
agggagtggacccatcaccagccac

SEQ ID NO: 534707 - DNA, 25 bp, Mus musculus
agggagtggaccgatcaccagccac

SEQ ID NO: 534708 - DNA, 25 bp, Mus musculus
agggagtggatcacacccgtgccat

SEQ ID NO: 534709 - DNA, 25 bp, Mus musculus
agggagtggatctcacccgtgccat

SEQ ID NO: 534710 - DNA, 25 bp, Mus musculus
agggatatgttacccacagtttctt

SEQ ID NO: 534711 - DNA, 25 bp, Mus musculus
agggatatgttagccacagtttctt

SEQ ID NO: 534712 - DNA, 25 bp, Mus musculus
agggatctgcgcaccaaagccatcc

SEQ ID NO: 534713 - DNA, 25 bp, Mus musculus
agggatctgcgctccaaagccatcc

SEQ ID NO: 534714 - DNA, 25 bp, Mus musculus
agggatgaaacccagtttatgcatg

SEQ ID NO: 534715 - DNA, 25 bp, Mus musculus
agggatgaaaccgagtttatgcatg

SEQ ID NO: 534716 - DNA, 25 bp, Mus musculus
agggatgattctcggcctagcctgc

SEQ ID NO: 534717 - DNA, 25 bp, Mus musculus
agggatgattctgggcctagcctgc

SEQ ID NO: 534718 - DNA, 25 bp, Mus musculus
agggatgccggcacagtcctggcca

SEQ ID NO: 534719 - DNA, 25 bp, Mus musculus
agggatgccggctcagtcctggcca

SEQ ID NO: 534720 - DNA, 25 bp, Mus musculus
agggattatctcagccaaacctctc

SEQ ID NO: 534721 - DNA, 25 bp, Mus musculus
agggattatctctgccaaacctctc

SEQ ID NO: 534722 - DNA, 25 bp, Mus musculus
agggattcccgaaggtcaccggcac

SEQ ID NO: 534723 - DNA, 25 bp, Mus musculus
agggattcccgatggtcaccggcac

SEQ ID NO: 534724 - DNA, 25 bp, Mus musculus
agggattgacttaggtgagtagacc

SEQ ID NO: 534725 - DNA, 25 bp, Mus musculus
agggattgactttggtgagtagacc

SEQ ID NO: 534726 - DNA, 25 bp, Mus musculus
agggattgtggtagtaagccttgca

SEQ ID NO: 534727 - DNA, 25 bp, Mus musculus
agggattgtggttgtaagccttgca

SEQ ID NO: 534728 - DNA, 25 bp, Mus musculus
agggcaaatgcgcaatatatgtctc

SEQ ID NO: 534729 - DNA, 25 bp, Mus musculus
agggcaaatgcggaatatatgtctc

SEQ ID NO: 534730 - DNA, 25 bp, Mus musculus
agggcaacacagagaccccgaggaa

SEQ ID NO: 534731 - DNA, 25 bp, Mus musculus
agggcaacacagtgaccccgaggaa

SEQ ID NO: 534732 - DNA, 25 bp, Mus musculus
agggcaacattcagggacccctctg

SEQ ID NO: 534733 - DNA, 25 bp, Mus musculus
agggcaacattctgggacccctctg

SEQ ID NO: 534734 - DNA, 25 bp, Mus musculus
agggcaacccggaggagaactaatg

SEQ ID NO: 534735 - DNA, 25 bp, Mus musculus
agggcaacccggtggagaactaatg

SEQ ID NO: 534736 - DNA, 25 bp, Mus musculus
agggcaagaactcctcatggaccag

SEQ ID NO: 534737 - DNA, 25 bp, Mus musculus
agggcaagaactgctcatggaccag

SEQ ID NO: 534738 - DNA, 25 bp, Mus musculus
agggcaagaagactccgcgactcca

SEQ ID NO: 534739 - DNA, 25 bp, Mus musculus
agggcaagaagagtccgcgactcca

SEQ ID NO: 534740 - DNA, 25 bp, Mus musculus
agggcaagctcaccaaactggctgt

SEQ ID NO: 534741 - DNA, 25 bp, Mus musculus
agggcaagctcagcaaactggctgt

SEQ ID NO: 534742 - DNA, 25 bp, Mus musculus
agggcaagtagcctcttggcccaga

SEQ ID NO: 534743 - DNA, 25 bp, Mus musculus
agggcaagtagcgtcttggcccaga

SEQ ID NO: 534744 - DNA, 25 bp, Mus musculus
agggcaatctctccattaggagcga

SEQ ID NO: 534745 - DNA, 25 bp, Mus musculus
agggcaatctctgcattaggagcga

SEQ ID NO: 534746 - DNA, 25 bp, Mus musculus
agggcaatgtccaccacctctgtca

SEQ ID NO: 534747 - DNA, 25 bp, Mus musculus
agggcaatgtcctccacctctgtca

SEQ ID NO: 534748 - DNA, 25 bp, Mus musculus
agggcaatgtgcagaccgctcggta

SEQ ID NO: 534749 - DNA, 25 bp, Mus musculus
agggcaatgtgctgaccgctcggta

SEQ ID NO: 534750 - DNA, 25 bp, Mus musculus
agggcacaaggacacgcgggaacgg

SEQ ID NO: 534751 - DNA, 25 bp, Mus musculus
agggcacaaggagacgcgggaacgg

SEQ ID NO: 534752 - DNA, 25 bp, Mus musculus
agggcacacctcaagcccaggctgt

SEQ ID NO: 534753 - DNA, 25 bp, Mus musculus
agggcacacctctagcccaggctgt

SEQ ID NO: 534754 - DNA, 25 bp, Mus musculus
agggcacatctgctggataacacgg

SEQ ID NO: 534755 - DNA, 25 bp, Mus musculus
agggcacatctggtggataacacgg

SEQ ID NO: 534756 - DNA, 25 bp, Mus musculus
agggcacatgagcacctcagcatca

SEQ ID NO: 534757 - DNA, 25 bp, Mus musculus
agggcacatgaggacctcagcatca

SEQ ID NO: 534758 - DNA, 25 bp, Mus musculus
agggcacattgcatcagttcttaat

SEQ ID NO: 534759 - DNA, 25 bp, Mus musculus
agggcacattgcttcagttcttaat

SEQ ID NO: 534760 - DNA, 25 bp, Mus musculus
agggcaccaagaagggccacaagct

SEQ ID NO: 534761 - DNA, 25 bp, Mus musculus
agggcaccaagatgggccacaagct

SEQ ID NO: 534762 - DNA, 25 bp, Mus musculus
agggcacccacaccaagacgacttt

SEQ ID NO: 534763 - DNA, 25 bp, Mus musculus
agggcacccacagcaagacgacttt

SEQ ID NO: 534764 - DNA, 25 bp, Mus musculus
agggcacgtccaacgccaccaggat

SEQ ID NO: 534765 - DNA, 25 bp, Mus musculus
agggcacgtccatcgccaccaggat

SEQ ID NO: 534766 - DNA, 25 bp, Mus musculus
agggcacgtgggagacatactccag

SEQ ID NO: 534767 - DNA, 25 bp, Mus musculus
agggcacgtgggtgacatactccag

SEQ ID NO: 534768 - DNA, 25 bp, Mus musculus
agggcactcctgagcgtttcgggaa

SEQ ID NO: 534769 - DNA, 25 bp, Mus musculus
agggcactcctgtgcgtttcgggaa

SEQ ID NO: 534770 - DNA, 25 bp, Mus musculus
agggcagaaggtcttgccttctcca

SEQ ID NO: 534771 - DNA, 25 bp, Mus musculus
agggcagaaggtgttgccttctcca

SEQ ID NO: 534772 - DNA, 25 bp, Mus musculus
agggcagacaagcagtctgtgcact

SEQ ID NO: 534773 - DNA, 25 bp, Mus musculus
agggcagacaaggagtctgtgcact

SEQ ID NO: 534774 - DNA, 25 bp, Mus musculus
agggcagcagtaacggagccattga

SEQ ID NO: 534775 - DNA, 25 bp, Mus musculus
agggcagcagtatcggagccattga

SEQ ID NO: 534776 - DNA, 25 bp, Mus musculus
agggcagccactcccaagtgagcga

SEQ ID NO: 534777 - DNA, 25 bp, Mus musculus
agggcagccactgccaagtgagcga

SEQ ID NO: 534778 - DNA, 25 bp, Mus musculus
agggcagcctctctgtatgaagcag

SEQ ID NO: 534779 - DNA, 25 bp, Mus musculus
agggcagcctctgtgtatgaagcag

SEQ ID NO: 534780 - DNA, 25 bp, Mus musculus
agggcagccttcatagcaagccagt

SEQ ID NO: 534781 - DNA, 25 bp, Mus musculus
agggcagccttcttagcaagccagt

SEQ ID NO: 534782 - DNA, 25 bp, Mus musculus
agggcaggctctaggtgaagtcatc

SEQ ID NO: 534783 - DNA, 25 bp, Mus musculus
agggcaggctcttggtgaagtcatc

SEQ ID NO: 534784 - DNA, 25 bp, Mus musculus
agggcaggtgttatataaagtcact

SEQ ID NO: 534785 - DNA, 25 bp, Mus musculus
agggcaggtgttttataaagtcact

SEQ ID NO: 534786 - DNA, 25 bp, Mus musculus
agggcagtcaataatcatggagaga

SEQ ID NO: 534787 - DNA, 25 bp, Mus musculus
agggcagtcaattatcatggagaga

SEQ ID NO: 534788 - DNA, 25 bp, Mus musculus
agggcagtgagcagtcccacagaat

SEQ ID NO: 534789 - DNA, 25 bp, Mus musculus
agggcagtgagctgtcccacagaat

SEQ ID NO: 534790 - DNA, 25 bp, Mus musculus
agggcagtgcctatttgaacatgtt

SEQ ID NO: 534791 - DNA, 25 bp, Mus musculus
agggcagtgcctttttgaacatgtt

SEQ ID NO: 534792 - DNA, 25 bp, Mus musculus
agggcatacctgcaaggtccttgcg

SEQ ID NO: 534793 - DNA, 25 bp, Mus musculus
agggcatacctggaaggtccttgcg

SEQ ID NO: 534794 - DNA, 25 bp, Mus musculus
agggcatcatctccggctctgtctg

SEQ ID NO: 534795 - DNA, 25 bp, Mus musculus
agggcatcatctgcggctctgtctg

SEQ ID NO: 534796 - DNA, 25 bp, Mus musculus
agggcatcatgacgaagttatcttc

SEQ ID NO: 534797 - DNA, 25 bp, Mus musculus
agggcatcatgaggaagttatcttc

SEQ ID NO: 534798 - DNA, 25 bp, Mus musculus
agggcatccccaactcggtagagga

SEQ ID NO: 534799 - DNA, 25 bp, Mus musculus
agggcatccccatctcggtagagga

SEQ ID NO: 534800 - DNA, 25 bp, Mus musculus
agggcatcccgtaccaggactactt

SEQ ID NO: 534801 - DNA, 25 bp, Mus musculus
agggcatcccgttccaggactactt

SEQ ID NO: 534802 - DNA, 25 bp, Mus musculus
agggcatgagtgcagacaagacctc

SEQ ID NO: 534803 - DNA, 25 bp, Mus musculus
agggcatgagtggagacaagacctc

SEQ ID NO: 534804 - DNA, 25 bp, Mus musculus
agggcattgttgagcaccttgatgc

SEQ ID NO: 534805 - DNA, 25 bp, Mus musculus
agggcattgttgtgcaccttgatgc

SEQ ID NO: 534806 - DNA, 25 bp, Mus musculus
agggccaagactcggtgcccttcca

SEQ ID NO: 534807 - DNA, 25 bp, Mus musculus
agggccaagactgggtgcccttcca

SEQ ID NO: 534808 - DNA, 25 bp, Mus musculus
agggccaaggccagagtacatggca

SEQ ID NO: 534809 - DNA, 25 bp, Mus musculus
agggccaaggcctgagtacatggca

SEQ ID NO: 534810 - DNA, 25 bp, Mus musculus
agggccaagggcctcactagtttga

SEQ ID NO: 534811 - DNA, 25 bp, Mus musculus
agggccaagggcgtcactagtttga

SEQ ID NO: 534812 - DNA, 25 bp, Mus musculus
agggccacaagcaccacctggacta

SEQ ID NO: 534813 - DNA, 25 bp, Mus musculus
agggccacaagctccacctggacta

SEQ ID NO: 534814 - DNA, 25 bp, Mus musculus
agggccacaccaagagggttggcat

SEQ ID NO: 534815 - DNA, 25 bp, Mus musculus
agggccacaccatgagggttggcat

SEQ ID NO: 534816 - DNA, 25 bp, Mus musculus
agggccacgaccagctacctgatgg

SEQ ID NO: 534817 - DNA, 25 bp, Mus musculus
agggccacgacctgctacctgatgg

SEQ ID NO: 534818 - DNA, 25 bp, Mus musculus
agggccactcctcatctggatgctg

SEQ ID NO: 534819 - DNA, 25 bp, Mus musculus
agggccactcctgatctggatgctg

SEQ ID NO: 534820 - DNA, 25 bp, Mus musculus
agggccagagctaccccttcggcta

SEQ ID NO: 534821 - DNA, 25 bp, Mus musculus
agggccagagcttccccttcggcta

SEQ ID NO: 534822 - DNA, 25 bp, Mus musculus
agggccagccgacgcatttccctga

SEQ ID NO: 534823 - DNA, 25 bp, Mus musculus
agggccagccgaggcatttccctga

SEQ ID NO: 534824 - DNA, 25 bp, Mus musculus
agggccagtttaatgcgtctggatc

SEQ ID NO: 534825 - DNA, 25 bp, Mus musculus
agggccagtttattgcgtctggatc

SEQ ID NO: 534826 - DNA, 25 bp, Mus musculus
agggcccaatggcatggccacacag

SEQ ID NO: 534827 - DNA, 25 bp, Mus musculus
agggcccaatgggatggccacacag

SEQ ID NO: 534828 - DNA, 25 bp, Mus musculus
agggcccagcagaacaggagccaag

SEQ ID NO: 534829 - DNA, 25 bp, Mus musculus
agggcccagcagtacaggagccaag

SEQ ID NO: 534830 - DNA, 25 bp, Mus musculus
agggcccagtgcagatcgttacctt

SEQ ID NO: 534831 - DNA, 25 bp, Mus musculus
agggcccagtgcaggacccgctctg

SEQ ID NO: 534832 - DNA, 25 bp, Mus musculus
agggcccagtgctgatcgttacctt

SEQ ID NO: 534833 - DNA, 25 bp, Mus musculus
agggcccagtgctggacccgctctg

SEQ ID NO: 534834 - DNA, 25 bp, Mus musculus
agggccccattccagagcgaatcct

SEQ ID NO: 534835 - DNA, 25 bp, Mus musculus
agggccccattcgagagcgaatcct

SEQ ID NO: 534836 - DNA, 25 bp, Mus musculus
agggccccgtggatcttggagcaaa

SEQ ID NO: 534837 - DNA, 25 bp, Mus musculus
agggccccgtggttcttggagcaaa

SEQ ID NO: 534838 - DNA, 25 bp, Mus musculus
agggcccgcagcagaccagtcacta

SEQ ID NO: 534839 - DNA, 25 bp, Mus musculus
agggcccgcagctgaccagtcacta

SEQ ID NO: 534840 - DNA, 25 bp, Mus musculus
agggcccgcgcacgccatgtatttt

SEQ ID NO: 534841 - DNA, 25 bp, Mus musculus
agggcccgcgcaggccatgtatttt

SEQ ID NO: 534842 - DNA, 25 bp, Mus musculus
agggcccgctatccacaggaacctt

SEQ ID NO: 534843 - DNA, 25 bp, Mus musculus
agggcccgctatgcacaggaacctt

SEQ ID NO: 534844 - DNA, 25 bp, Mus musculus
agggcccggactccaaacttcatca

SEQ ID NO: 534845 - DNA, 25 bp, Mus musculus
agggcccggactgcaaacttcatca

SEQ ID NO: 534846 - DNA, 25 bp, Mus musculus
agggccctgctacgtcatgcacgaa

SEQ ID NO: 534847 - DNA, 25 bp, Mus musculus
agggccctgctaggtcatgcacgaa

SEQ ID NO: 534848 - DNA, 25 bp, Mus musculus
agggccctggcgcttggactgggac

SEQ ID NO: 534849 - DNA, 25 bp, Mus musculus
agggccctggcggttggactgggac

SEQ ID NO: 534850 - DNA, 25 bp, Mus musculus
agggccgcctctacctctctgagaa

SEQ ID NO: 534851 - DNA, 25 bp, Mus musculus
agggccgcctcttcctctctgagaa

SEQ ID NO: 534852 - DNA, 25 bp, Mus musculus
agggccgttcacagaggacaaagtg

SEQ ID NO: 534853 - DNA, 25 bp, Mus musculus
agggccgttcactgaggacaaagtg

SEQ ID NO: 534854 - DNA, 25 bp, Mus musculus
agggcctcaggcactgcgaggcttc

SEQ ID NO: 534855 - DNA, 25 bp, Mus musculus
agggcctcaggctctgcgaggcttc

SEQ ID NO: 534856 - DNA, 25 bp, Mus musculus
agggcctcatgcatgttagttaggc

SEQ ID NO: 534857 - DNA, 25 bp, Mus musculus
agggcctcatgcttgttagttaggc

SEQ ID NO: 534858 - DNA, 25 bp, Mus musculus
agggcctcccagatcagctgaaact

SEQ ID NO: 534859 - DNA, 25 bp, Mus musculus
agggcctcccagttcagctgaaact

SEQ ID NO: 534860 - DNA, 25 bp, Mus musculus
agggcctcccatccagcaggctgga

SEQ ID NO: 534861 - DNA, 25 bp, Mus musculus
agggcctcccatgcagcaggctgga

SEQ ID NO: 534862 - DNA, 25 bp, Mus musculus
agggcctccggtcgacagaagctgg

SEQ ID NO: 534863 - DNA, 25 bp, Mus musculus
agggcctccggtggacagaagctgg

SEQ ID NO: 534864 - DNA, 25 bp, Mus musculus
agggcctcctagctttcacatgcag

SEQ ID NO: 534865 - DNA, 25 bp, Mus musculus
agggcctcctaggtttcacatgcag

SEQ ID NO: 534866 - DNA, 25 bp, Mus musculus
agggcctgccttagtcacgtggcac

SEQ ID NO: 534867 - DNA, 25 bp, Mus musculus
agggcctgcctttgtcacgtggcac

SEQ ID NO: 534868 - DNA, 25 bp, Mus musculus
agggcctgctggagatcatatcaca

SEQ ID NO: 534869 - DNA, 25 bp, Mus musculus
agggcctgctggtgatcatatcaca

SEQ ID NO: 534870 - DNA, 25 bp, Mus musculus
agggcctgtagcaactgaccctaaa

SEQ ID NO: 534871 - DNA, 25 bp, Mus musculus
agggcctgtagctactgaccctaaa

SEQ ID NO: 534872 - DNA, 25 bp, Mus musculus
agggccttcaggagcggcctgctct

SEQ ID NO: 534873 - DNA, 25 bp, Mus musculus
agggccttcaggtgcggcctgctct

SEQ ID NO: 534874 - DNA, 25 bp, Mus musculus
agggcgaaccggagttcagccctgc

SEQ ID NO: 534875 - DNA, 25 bp, Mus musculus
agggcgaaccggtgttcagccctgc

SEQ ID NO: 534876 - DNA, 25 bp, Mus musculus
agggcgatgcccatcaccagatgca

SEQ ID NO: 534877 - DNA, 25 bp, Mus musculus
agggcgatgcccttcaccagatgca

SEQ ID NO: 534878 - DNA, 25 bp, Mus musculus
agggcgcatcctcggtatgccgcca

SEQ ID NO: 534879 - DNA, 25 bp, Mus musculus
agggcgcatcctgggtatgccgcca

SEQ ID NO: 534880 - DNA, 25 bp, Mus musculus
agggcgccaggcacatccgcgtagc

SEQ ID NO: 534881 - DNA, 25 bp, Mus musculus
agggcgccaggctcatccgcgtagc

SEQ ID NO: 534882 - DNA, 25 bp, Mus musculus
agggcgctgagacagacttactgca

SEQ ID NO: 534883 - DNA, 25 bp, Mus musculus
agggcgctgagagagacttactgca

SEQ ID NO: 534884 - DNA, 25 bp, Mus musculus
agggcggcttccaggacatcgacgt

SEQ ID NO: 534885 - DNA, 25 bp, Mus musculus
agggcggcttcctggacatcgacgt

SEQ ID NO: 534886 - DNA, 25 bp, Mus musculus
agggcgtccctcaggtctactactt

SEQ ID NO: 534887 - DNA, 25 bp, Mus musculus
agggcgtccctctggtctactactt

SEQ ID NO: 534888 - DNA, 25 bp, Mus musculus
agggcgtggacgacatggcttccct

SEQ ID NO: 534889 - DNA, 25 bp, Mus musculus
agggcgtggacgtcatggcttccct

SEQ ID NO: 534890 - DNA, 25 bp, Mus musculus
agggcgtggagcactacttcctggt

SEQ ID NO: 534891 - DNA, 25 bp, Mus musculus
agggcgtggagcaggccggcagcct

SEQ ID NO: 534892 - DNA, 25 bp, Mus musculus
agggcgtggagctctacttcctggt

SEQ ID NO: 534893 - DNA, 25 bp, Mus musculus
agggcgtggagctggccggcagcct

SEQ ID NO: 534894 - DNA, 25 bp, Mus musculus
agggctaaattcatgggttccccag

SEQ ID NO: 534895 - DNA, 25 bp, Mus musculus
agggctaaattcttgggttccccag

SEQ ID NO: 534896 - DNA, 25 bp, Mus musculus
agggctacaagacgctcaacagcac

SEQ ID NO: 534897 - DNA, 25 bp, Mus musculus
agggctacaagaggctcaacagcac

SEQ ID NO: 534898 - DNA, 25 bp, Mus musculus
agggctacactgctctcaactgcca

SEQ ID NO: 534899 - DNA, 25 bp, Mus musculus
agggctacactggtctcaactgcca

SEQ ID NO: 534900 - DNA, 25 bp, Mus musculus
agggctacagctcctacaggacaga

SEQ ID NO: 534901 - DNA, 25 bp, Mus musculus
agggctacagctgctacaggacaga

SEQ ID NO: 534902 - DNA, 25 bp, Mus musculus
agggctacggctaccagcagggcta

SEQ ID NO: 534903 - DNA, 25 bp, Mus musculus
agggctacggcttccagcagggcta

SEQ ID NO: 534904 - DNA, 25 bp, Mus musculus
agggctatggatatgtacactttga

SEQ ID NO: 534905 - DNA, 25 bp, Mus musculus
agggctatggatttgtacactttga

SEQ ID NO: 534906 - DNA, 25 bp, Mus musculus
agggctatgtgtatgaggccgctca

SEQ ID NO: 534907 - DNA, 25 bp, Mus musculus
agggctatgtgtttgaggccgctca

SEQ ID NO: 534908 - DNA, 25 bp, Mus musculus
agggctcacggaatggaagccaagt

SEQ ID NO: 534909 - DNA, 25 bp, Mus musculus
agggctcacggattggaagccaagt

SEQ ID NO: 534910 - DNA, 25 bp, Mus musculus
agggctcagaatctaccaacaggcg

SEQ ID NO: 534911 - DNA, 25 bp, Mus musculus
agggctcagaatgtaccaacaggcg

SEQ ID NO: 534912 - DNA, 25 bp, Mus musculus
agggctcagagcaaccccagagagg

SEQ ID NO: 534913 - DNA, 25 bp, Mus musculus
agggctcagagctaccccagagagg

SEQ ID NO: 534914 - DNA, 25 bp, Mus musculus
agggctcaggtaaaacagagtcaca

SEQ ID NO: 534915 - DNA, 25 bp, Mus musculus
agggctcaggtataacagagtcaca

SEQ ID NO: 534916 - DNA, 25 bp, Mus musculus
agggctccacctcggatgatcacag

SEQ ID NO: 534917 - DNA, 25 bp, Mus musculus
agggctccacctgggatgatcacag

SEQ ID NO: 534918 - DNA, 25 bp, Mus musculus
agggctcccacaacagaggctccca

SEQ ID NO: 534919 - DNA, 25 bp, Mus musculus
agggctcccacatcagaggctccca

SEQ ID NO: 534920 - DNA, 25 bp, Mus musculus
agggctccgttgctagaactcttgc

SEQ ID NO: 534921 - DNA, 25 bp, Mus musculus
agggctccgttggtagaactcttgc

SEQ ID NO: 534922 - DNA, 25 bp, Mus musculus
agggctcggcttaggactcctgcat

SEQ ID NO: 534923 - DNA, 25 bp, Mus musculus
agggctcggctttggactcctgcat

SEQ ID NO: 534924 - DNA, 25 bp, Mus musculus
agggctcgtaccactgcgagtgtga

SEQ ID NO: 534925 - DNA, 25 bp, Mus musculus
agggctcgtacctctgcgagtgtga

SEQ ID NO: 534926 - DNA, 25 bp, Mus musculus
agggctctatcacatgctaccacgg

SEQ ID NO: 534927 - DNA, 25 bp, Mus musculus
agggctctatcagatgctaccacgg

SEQ ID NO: 534928 - DNA, 25 bp, Mus musculus
agggctctgaccactaacatcacag

SEQ ID NO: 534929 - DNA, 25 bp, Mus musculus
agggctctgacctctaacatcacag

SEQ ID NO: 534930 - DNA, 25 bp, Mus musculus
agggctgcagataaggctgttgcca

SEQ ID NO: 534931 - DNA, 25 bp, Mus musculus
agggctgcagattaggctgttgcca

SEQ ID NO: 534932 - DNA, 25 bp, Mus musculus
agggctgcaggcacacgcgcagtat

SEQ ID NO: 534933 - DNA, 25 bp, Mus musculus
agggctgcaggctcacgcgcagtat

SEQ ID NO: 534934 - DNA, 25 bp, Mus musculus
agggctgcccttcgcactgcctgag

SEQ ID NO: 534935 - DNA, 25 bp, Mus musculus
agggctgcccttggcactgcctgag

SEQ ID NO: 534936 - DNA, 25 bp, Mus musculus
agggctggaactccctctgcgtacc

SEQ ID NO: 534937 - DNA, 25 bp, Mus musculus
agggctggaactgcctctgcgtacc

SEQ ID NO: 534938 - DNA, 25 bp, Mus musculus
agggctggcggcactgatgtacaca

SEQ ID NO: 534939 - DNA, 25 bp, Mus musculus
agggctggcggctctgatgtacaca

SEQ ID NO: 534940 - DNA, 25 bp, Mus musculus
agggctggctttacccattgcaggt

SEQ ID NO: 534941 - DNA, 25 bp, Mus musculus
agggctggcttttcccattgcaggt

SEQ ID NO: 534942 - DNA, 25 bp, Mus musculus
agggctgtccacaggctcaccaaac

SEQ ID NO: 534943 - DNA, 25 bp, Mus musculus
agggctgtccactggctcaccaaac

SEQ ID NO: 534944 - DNA, 25 bp, Mus musculus
agggctgtccgcaggacaattggct

SEQ ID NO: 534945 - DNA, 25 bp, Mus musculus
agggctgtccgctggacaattggct

SEQ ID NO: 534946 - DNA, 25 bp, Mus musculus
agggctgtgaccagtacagcctcac

SEQ ID NO: 534947 - DNA, 25 bp, Mus musculus
agggctgtgacctgtacagcctcac

SEQ ID NO: 534948 - DNA, 25 bp, Mus musculus
agggctgtgactcaccattagacca

SEQ ID NO: 534949 - DNA, 25 bp, Mus musculus
agggctgtgactgaccattagacca

SEQ ID NO: 534950 - DNA, 25 bp, Mus musculus
agggctgtgggacaactctcgattc

SEQ ID NO: 534951 - DNA, 25 bp, Mus musculus
agggctgtgggagaactctcgattc

SEQ ID NO: 534952 - DNA, 25 bp, Mus musculus
agggctgttggtacttgactgacag

SEQ ID NO: 534953 - DNA, 25 bp, Mus musculus
agggctgttggttcttgactgacag

SEQ ID NO: 534954 - DNA, 25 bp, Mus musculus
agggcttattttcgctgctggtaac

SEQ ID NO: 534955 - DNA, 25 bp, Mus musculus
agggcttattttggctgctggtaac

SEQ ID NO: 534956 - DNA, 25 bp, Mus musculus
agggcttcaggcacactcatgcagg

SEQ ID NO: 534957 - DNA, 25 bp, Mus musculus
agggcttcaggctcactcatgcagg

SEQ ID NO: 534958 - DNA, 25 bp, Mus musculus
agggcttcagtcaggcctcacactt

SEQ ID NO: 534959 - DNA, 25 bp, Mus musculus
agggcttcagtctggcctcacactt

SEQ ID NO: 534960 - DNA, 25 bp, Mus musculus
agggcttccagcaggatgcggccca

SEQ ID NO: 534961 - DNA, 25 bp, Mus musculus
agggcttccagctggatgcggccca

SEQ ID NO: 534962 - DNA, 25 bp, Mus musculus
agggcttccggaacaccctggtgga

SEQ ID NO: 534963 - DNA, 25 bp, Mus musculus
agggcttccggatcaccctggtgga

SEQ ID NO: 534964 - DNA, 25 bp, Mus musculus
agggcttcggtgatgccgcactcat

SEQ ID NO: 534965 - DNA, 25 bp, Mus musculus
agggcttcggtgttgccgcactcat

SEQ ID NO: 534966 - DNA, 25 bp, Mus musculus
agggcttcgtttctatgccaacaaa

SEQ ID NO: 534967 - DNA, 25 bp, Mus musculus
agggcttcgtttgtatgccaacaaa

SEQ ID NO: 534968 - DNA, 25 bp, Mus musculus
agggcttctggacaatcctcggaga

SEQ ID NO: 534969 - DNA, 25 bp, Mus musculus
agggcttctggagaatcctcggaga

SEQ ID NO: 534970 - DNA, 25 bp, Mus musculus
agggcttgcctacctgtggcttaaa

SEQ ID NO: 534971 - DNA, 25 bp, Mus musculus
agggcttgcctagctgtggcttaaa

SEQ ID NO: 534972 - DNA, 25 bp, Mus musculus
agggcttggccaacacatttgtgtc

SEQ ID NO: 534973 - DNA, 25 bp, Mus musculus
agggcttggccatcacatttgtgtc

SEQ ID NO: 534974 - DNA, 25 bp, Mus musculus
agggcttggctaagtgtcctgtagc

SEQ ID NO: 534975 - DNA, 25 bp, Mus musculus
agggcttggctatgtgtcctgtagc

SEQ ID NO: 534976 - DNA, 25 bp, Mus musculus
agggctttcatcctgagggcaccca

SEQ ID NO: 534977 - DNA, 25 bp, Mus musculus
agggctttcatcgtgagggcaccca

SEQ ID NO: 534978 - DNA, 25 bp, Mus musculus
agggctttcggcaccttgcttttcg

SEQ ID NO: 534979 - DNA, 25 bp, Mus musculus
agggctttcggctccttgcttttcg

SEQ ID NO: 534980 - DNA, 25 bp, Mus musculus
agggtaagccgcctgctcagcttgc

SEQ ID NO: 534981 - DNA, 25 bp, Mus musculus
agggtaagccgcgtgctcagcttgc

SEQ ID NO: 534982 - DNA, 25 bp, Mus musculus
agggtaagcctcaatcaagctgact

SEQ ID NO: 534983 - DNA, 25 bp, Mus musculus
agggtaagcctctatcaagctgact

SEQ ID NO: 534984 - DNA, 25 bp, Mus musculus
agggtacacacacttgcagagagct

SEQ ID NO: 534985 - DNA, 25 bp, Mus musculus
agggtacacacagttgcagagagct

SEQ ID NO: 534986 - DNA, 25 bp, Mus musculus
agggtacaccatcagcagccagttg

SEQ ID NO: 534987 - DNA, 25 bp, Mus musculus
agggtacaccatgagcagccagttg

SEQ ID NO: 534988 - DNA, 25 bp, Mus musculus
agggtacagctcctgccccttcagt

SEQ ID NO: 534989 - DNA, 25 bp, Mus musculus
agggtacagctcgtgccccttcagt

SEQ ID NO: 534990 - DNA, 25 bp, Mus musculus
agggtaccagcaacaagacagccag

SEQ ID NO: 534991 - DNA, 25 bp, Mus musculus
agggtaccagcatcaagacagccag

SEQ ID NO: 534992 - DNA, 25 bp, Mus musculus
agggtacgcgggatcgcgctcacgg

SEQ ID NO: 534993 - DNA, 25 bp, Mus musculus
agggtacgcgggttcgcgctcacgg

SEQ ID NO: 534994 - DNA, 25 bp, Mus musculus
agggtactcctgagaccctccagcg

SEQ ID NO: 534995 - DNA, 25 bp, Mus musculus
agggtactcctgtgaccctccagcg

SEQ ID NO: 534996 - DNA, 25 bp, Mus musculus
agggtagagcatacgccgcggaaaa

SEQ ID NO: 534997 - DNA, 25 bp, Mus musculus
agggtagagcattcgccgcggaaaa

SEQ ID NO: 534998 - DNA, 25 bp, Mus musculus
agggtagcacagactcagcccactg

SEQ ID NO: 534999 - DNA, 25 bp, Mus musculus
agggtagcacagtctcagcccactg

SEQ ID NO: 535000 - DNA, 25 bp, Mus musculus
agggtatcagccaggagcagatgca

SEQ ID NO: 535001 - DNA, 25 bp, Mus musculus
agggtatcagcctggagcagatgca

SEQ ID NO: 535002 - DNA, 25 bp, Mus musculus
agggtcacttgcctcaccttagcgc

SEQ ID NO: 535003 - DNA, 25 bp, Mus musculus
agggtcacttgcgtcaccttagcgc

SEQ ID NO: 535004 - DNA, 25 bp, Mus musculus
agggtcagaactcgcctccgtggct

SEQ ID NO: 535005 - DNA, 25 bp, Mus musculus
agggtcagaactggcctccgtggct

SEQ ID NO: 535006 - DNA, 25 bp, Mus musculus
agggtcagcgctcgaccaactgtcc

SEQ ID NO: 535007 - DNA, 25 bp, Mus musculus
agggtcagcgctggaccaactgtcc

SEQ ID NO: 535008 - DNA, 25 bp, Mus musculus
agggtcagtgacaaagcttctggag

SEQ ID NO: 535009 - DNA, 25 bp, Mus musculus
agggtcagtgactaagcttctggag

SEQ ID NO: 535010 - DNA, 25 bp, Mus musculus
agggtcatgccgatatccaagccag

SEQ ID NO: 535011 - DNA, 25 bp, Mus musculus
agggtcatgccgttatccaagccag

SEQ ID NO: 535012 - DNA, 25 bp, Mus musculus
agggtccactccagtcctagtcctg

SEQ ID NO: 535013 - DNA, 25 bp, Mus musculus
agggtccactcctgtcctagtcctg

SEQ ID NO: 535014 - DNA, 25 bp, Mus musculus
agggtccagcaactcaggatcccag

SEQ ID NO: 535015 - DNA, 25 bp, Mus musculus
agggtccagcaagtcaggatcccag

SEQ ID NO: 535016 - DNA, 25 bp, Mus musculus
agggtccagggcagtagcttccaag

SEQ ID NO: 535017 - DNA, 25 bp, Mus musculus
agggtccagggctgtagcttccaag

SEQ ID NO: 535018 - DNA, 25 bp, Mus musculus
agggtcccgcctcaaaggcttgcga

SEQ ID NO: 535019 - DNA, 25 bp, Mus musculus
agggtcccgcctgaaaggcttgcga

SEQ ID NO: 535020 - DNA, 25 bp, Mus musculus
agggtccctgagctgacacttcgag

SEQ ID NO: 535021 - DNA, 25 bp, Mus musculus
agggtccctgaggtgacacttcgag

SEQ ID NO: 535022 - DNA, 25 bp, Mus musculus
agggtccctgcaagtgaagccagcg

SEQ ID NO: 535023 - DNA, 25 bp, Mus musculus
agggtccctgcatgtgaagccagcg

SEQ ID NO: 535024 - DNA, 25 bp, Mus musculus
agggtcctacctagcactccaaact

SEQ ID NO: 535025 - DNA, 25 bp, Mus musculus
agggtcctaccttgcactccaaact

SEQ ID NO: 535026 - DNA, 25 bp, Mus musculus
agggtcctgaccaatgctctgtgtc

SEQ ID NO: 535027 - DNA, 25 bp, Mus musculus
agggtcctgaccattgccctggatg

SEQ ID NO: 535028 - DNA, 25 bp, Mus musculus
agggtcctgacctatgctctgtgtc

SEQ ID NO: 535029 - DNA, 25 bp, Mus musculus
agggtcctgacctttgccctggatg

SEQ ID NO: 535030 - DNA, 25 bp, Mus musculus
agggtcgccgccaccaccgaggttg

SEQ ID NO: 535031 - DNA, 25 bp, Mus musculus
agggtcgccgcctccaccgaggttg

SEQ ID NO: 535032 - DNA, 25 bp, Mus musculus
agggtctccaggcataccagggaaa

SEQ ID NO: 535033 - DNA, 25 bp, Mus musculus
agggtctccagggataccagggaaa

SEQ ID NO: 535034 - DNA, 25 bp, Mus musculus
agggtctggctgaacctcggcttcc

SEQ ID NO: 535035 - DNA, 25 bp, Mus musculus
agggtctggctgtacctcggcttcc

SEQ ID NO: 535036 - DNA, 25 bp, Mus musculus
agggtgaacttaacaattgccagac

SEQ ID NO: 535037 - DNA, 25 bp, Mus musculus
agggtgaacttatcaattgccagac

SEQ ID NO: 535038 - DNA, 25 bp, Mus musculus
agggtgacccggaccgcatccggca

SEQ ID NO: 535039 - DNA, 25 bp, Mus musculus
agggtgacccggtccgcatccggca

SEQ ID NO: 535040 - DNA, 25 bp, Mus musculus
agggtgactgctccactccctggca

SEQ ID NO: 535041 - DNA, 25 bp, Mus musculus
agggtgactgctgcactccctggca

SEQ ID NO: 535042 - DNA, 25 bp, Mus musculus
agggtgagactcagcatggttagca

SEQ ID NO: 535043 - DNA, 25 bp, Mus musculus
agggtgagactctgcatggttagca

SEQ ID NO: 535044 - DNA, 25 bp, Mus musculus
agggtgagataaatgaaaagccatc

SEQ ID NO: 535045 - DNA, 25 bp, Mus musculus
agggtgagataattgaaaagccatc

SEQ ID NO: 535046 - DNA, 25 bp, Mus musculus
agggtgagatcgacctggccaagat

SEQ ID NO: 535047 - DNA, 25 bp, Mus musculus
agggtgagatcgtcctggccaagat

SEQ ID NO: 535048 - DNA, 25 bp, Mus musculus
agggtgagccttctgccatggacat

SEQ ID NO: 535049 - DNA, 25 bp, Mus musculus
agggtgagccttgtgccatggacat

SEQ ID NO: 535050 - DNA, 25 bp, Mus musculus
agggtgatcatcacaggctcctcag

SEQ ID NO: 535051 - DNA, 25 bp, Mus musculus
agggtgatcatctcaggctcctcag

SEQ ID NO: 535052 - DNA, 25 bp, Mus musculus
agggtgcaccggagtccattgtcat

SEQ ID NO: 535053 - DNA, 25 bp, Mus musculus
agggtgcaccggtgtccattgtcat

SEQ ID NO: 535054 - DNA, 25 bp, Mus musculus
agggtgccacttcccacgaccgtgt

SEQ ID NO: 535055 - DNA, 25 bp, Mus musculus
agggtgccacttgccacgaccgtgt

SEQ ID NO: 535056 - DNA, 25 bp, Mus musculus
agggtgccattgaccggcatggaaa

SEQ ID NO: 535057 - DNA, 25 bp, Mus musculus
agggtgccattgtccggcatggaaa

SEQ ID NO: 535058 - DNA, 25 bp, Mus musculus
agggtgcccgctccttgcgtgctct

SEQ ID NO: 535059 - DNA, 25 bp, Mus musculus
agggtgcccgctgcttgcgtgctct

SEQ ID NO: 535060 - DNA, 25 bp, Mus musculus
agggtgccctgtcgcctgtcaatca

SEQ ID NO: 535061 - DNA, 25 bp, Mus musculus
agggtgccctgtcggccctagcctt

SEQ ID NO: 535062 - DNA, 25 bp, Mus musculus
agggtgccctgtggcctgtcaatca

SEQ ID NO: 535063 - DNA, 25 bp, Mus musculus
agggtgccctgtgggccctagcctt

SEQ ID NO: 535064 - DNA, 25 bp, Mus musculus
agggtgcctttcctgtgaccatgct

SEQ ID NO: 535065 - DNA, 25 bp, Mus musculus
agggtgcctttcgtgtgaccatgct

SEQ ID NO: 535066 - DNA, 25 bp, Mus musculus
agggtgcgggagctcaccctcccat

SEQ ID NO: 535067 - DNA, 25 bp, Mus musculus
agggtgcgggaggtcaccctcccat

SEQ ID NO: 535068 - DNA, 25 bp, Mus musculus
agggtgctcagcacatagccgtggc

SEQ ID NO: 535069 - DNA, 25 bp, Mus musculus
agggtgctcagctcatagccgtggc

SEQ ID NO: 535070 - DNA, 25 bp, Mus musculus
agggtggcgtgcacggcctacactc

SEQ ID NO: 535071 - DNA, 25 bp, Mus musculus
agggtggcgtgctcggcctacactc

SEQ ID NO: 535072 - DNA, 25 bp, Mus musculus
agggtggtgactcactccccaaggc

SEQ ID NO: 535073 - DNA, 25 bp, Mus musculus
agggtggtgactgactccccaaggc

SEQ ID NO: 535074 - DNA, 25 bp, Mus musculus
agggtgtactgacggcagccacaca

SEQ ID NO: 535075 - DNA, 25 bp, Mus musculus
agggtgtactgagggcagccacaca

SEQ ID NO: 535076 - DNA, 25 bp, Mus musculus
agggtgtggcatacgccgtagtcta

SEQ ID NO: 535077 - DNA, 25 bp, Mus musculus
agggtgtggcattcgccgtagtcta

SEQ ID NO: 535078 - DNA, 25 bp, Mus musculus
agggtgttgcttactcacaaagccc

SEQ ID NO: 535079 - DNA, 25 bp, Mus musculus
agggtgttgctttctcacaaagccc

SEQ ID NO: 535080 - DNA, 25 bp, Mus musculus
agggtgttggctatgtgcccattgc

SEQ ID NO: 535081 - DNA, 25 bp, Mus musculus
agggtgttggctttgtgcccattgc

SEQ ID NO: 535082 - DNA, 25 bp, Mus musculus
agggtgtttactcctgttctgctca

SEQ ID NO: 535083 - DNA, 25 bp, Mus musculus
agggtgtttactgctgttctgctca

SEQ ID NO: 535084 - DNA, 25 bp, Mus musculus
agggttagtcctcgccgtagatcag

SEQ ID NO: 535085 - DNA, 25 bp, Mus musculus
agggttagtcctggccgtagatcag

SEQ ID NO: 535086 - DNA, 25 bp, Mus musculus
agggttcagctgactgataaataag

SEQ ID NO: 535087 - DNA, 25 bp, Mus musculus
agggttcagctgtctgataaataag

SEQ ID NO: 535088 - DNA, 25 bp, Mus musculus
agggttgagacaactgttgcaagcc

SEQ ID NO: 535089 - DNA, 25 bp, Mus musculus
agggttgagacatctgttgcaagcc

SEQ ID NO: 535090 - DNA, 25 bp, Mus musculus
agggtttcctggcactcaggccatg

SEQ ID NO: 535091 - DNA, 25 bp, Mus musculus
agggtttcctgggactcaggccatg

SEQ ID NO: 535092 - DNA, 25 bp, Mus musculus
agggtttctctcaccccatgaaagg

SEQ ID NO: 535093 - DNA, 25 bp, Mus musculus
agggtttctctctccccatgaaagg

SEQ ID NO: 535094 - DNA, 25 bp, Mus musculus
agggtttggtgcactcgtcgctgcc

SEQ ID NO: 535095 - DNA, 25 bp, Mus musculus
agggtttggtgctctcgtcgctgcc

SEQ ID NO: 535096 - DNA, 25 bp, Mus musculus
agggtttgttcgagttgaccgagat

SEQ ID NO: 535097 - DNA, 25 bp, Mus musculus
agggtttgttcgtgttgaccgagat

SEQ ID NO: 535098 - DNA, 25 bp, Mus musculus
aggtaaatttgactacctggagcgg

SEQ ID NO: 535099 - DNA, 25 bp, Mus musculus
aggtaaatttgagtacctggagcgg

SEQ ID NO: 535100 - DNA, 25 bp, Mus musculus
aggtaacctggtccctgagtgtctt

SEQ ID NO: 535101 - DNA, 25 bp, Mus musculus
aggtaacctggtgcctgagtgtctt

SEQ ID NO: 535102 - DNA, 25 bp, Mus musculus
aggtaactaactccgcaggcgtcgg

SEQ ID NO: 535103 - DNA, 25 bp, Mus musculus
aggtaactaactgcgcaggcgtcgg

SEQ ID NO: 535104 - DNA, 25 bp, Mus musculus
aggtaagaagtaaggagaaacggct

SEQ ID NO: 535105 - DNA, 25 bp, Mus musculus
aggtaagaagtatggagaaacggct

SEQ ID NO: 535106 - DNA, 25 bp, Mus musculus
aggtaagatggaccccattgtgtgt

SEQ ID NO: 535107 - DNA, 25 bp, Mus musculus
aggtaagatggagcccattgtgtgt

SEQ ID NO: 535108 - DNA, 25 bp, Mus musculus
aggtaatggcaaatggagttctctc

SEQ ID NO: 535109 - DNA, 25 bp, Mus musculus
aggtaatggcaattggagttctctc

SEQ ID NO: 535110 - DNA, 25 bp, Mus musculus
aggtacagcgccactccgggcgagc

SEQ ID NO: 535111 - DNA, 25 bp, Mus musculus
aggtacagcgcctctccgggcgagc

SEQ ID NO: 535112 - DNA, 25 bp, Mus musculus
aggtaccaacctctacgggtcacat

SEQ ID NO: 535113 - DNA, 25 bp, Mus musculus
aggtaccaacctgtacgggtcacat

SEQ ID NO: 535114 - DNA, 25 bp, Mus musculus
aggtaccagtggctccgctgcaaac

SEQ ID NO: 535115 - DNA, 25 bp, Mus musculus
aggtaccagtgggtccgctgcaaac

SEQ ID NO: 535116 - DNA, 25 bp, Mus musculus
aggtacgagctcactgccttgtttc

SEQ ID NO: 535117 - DNA, 25 bp, Mus musculus
aggtacgagctctctgccttgtttc

SEQ ID NO: 535118 - DNA, 25 bp, Mus musculus
aggtacgcttggatcctccctgcac

SEQ ID NO: 535119 - DNA, 25 bp, Mus musculus
aggtacgcttggttcctccctgcac

SEQ ID NO: 535120 - DNA, 25 bp, Mus musculus
aggtactgccatcccaaaagctggt

SEQ ID NO: 535121 - DNA, 25 bp, Mus musculus
aggtactgccatgccaaaagctggt

SEQ ID NO: 535122 - DNA, 25 bp, Mus musculus
aggtagaagaagaagggatacacag

SEQ ID NO: 535123 - DNA, 25 bp, Mus musculus
aggtagaagaagtagggatacacag

SEQ ID NO: 535124 - DNA, 25 bp, Mus musculus
aggtagaccactaactctttcagag

SEQ ID NO: 535125 - DNA, 25 bp, Mus musculus
aggtagaccacttactctttcagag

SEQ ID NO: 535126 - DNA, 25 bp, Mus musculus
aggtagacctggaagccgactgcgt

SEQ ID NO: 535127 - DNA, 25 bp, Mus musculus
aggtagacctggtagccgactgcgt

SEQ ID NO: 535128 - DNA, 25 bp, Mus musculus
aggtagacggcaccacgttccagag

SEQ ID NO: 535129 - DNA, 25 bp, Mus musculus
aggtagacggcagcacgttccagag

SEQ ID NO: 535130 - DNA, 25 bp, Mus musculus
aggtagatgccccaaaggcctggtc

SEQ ID NO: 535131 - DNA, 25 bp, Mus musculus
aggtagatgcccgaaaggcctggtc

SEQ ID NO: 535132 - DNA, 25 bp, Mus musculus
aggtagcctccgatcctcctgtgca

SEQ ID NO: 535133 - DNA, 25 bp, Mus musculus
aggtagcctccgttcctcctgtgca

SEQ ID NO: 535134 - DNA, 25 bp, Mus musculus
aggtagcgcgttagcagcagcagaa

SEQ ID NO: 535135 - DNA, 25 bp, Mus musculus
aggtagcgcgtttgcagcagcagaa

SEQ ID NO: 535136 - DNA, 25 bp, Mus musculus
aggtagctccatcccatcaacctgg

SEQ ID NO: 535137 - DNA, 25 bp, Mus musculus
aggtagctccatgccatcaacctgg

SEQ ID NO: 535138 - DNA, 25 bp, Mus musculus
aggtagtgaacacactccggcgcta

SEQ ID NO: 535139 - DNA, 25 bp, Mus musculus
aggtagtgaacagactccggcgcta

SEQ ID NO: 535140 - DNA, 25 bp, Mus musculus
aggtatactgggacttaagaggtag

SEQ ID NO: 535141 - DNA, 25 bp, Mus musculus
aggtatactgggtcttaagaggtag

SEQ ID NO: 535142 - DNA, 25 bp, Mus musculus
aggtatcaaaagaccccacatcaaa

SEQ ID NO: 535143 - DNA, 25 bp, Mus musculus
aggtatcaaaagtccccacatcaaa

SEQ ID NO: 535144 - DNA, 25 bp, Mus musculus
aggtatctttccacccagggctcca

SEQ ID NO: 535145 - DNA, 25 bp, Mus musculus
aggtatctttcctcccagggctcca

SEQ ID NO: 535146 - DNA, 25 bp, Mus musculus
aggtattagataacttggaactgga

SEQ ID NO: 535147 - DNA, 25 bp, Mus musculus
aggtattagatatcttggaactgga

SEQ ID NO: 535148 - DNA, 25 bp, Mus musculus
aggtatttctacaccgctgtgtccc

SEQ ID NO: 535149 - DNA, 25 bp, Mus musculus
aggtatttctactccgctgtgtccc

SEQ ID NO: 535150 - DNA, 25 bp, Mus musculus
aggtatttgagaaggccactcgggc

SEQ ID NO: 535151 - DNA, 25 bp, Mus musculus
aggtatttgagatggccactcgggc

SEQ ID NO: 535152 - DNA, 25 bp, Mus musculus
aggtcaacgccaccatcacggacat

SEQ ID NO: 535153 - DNA, 25 bp, Mus musculus
aggtcaacgccagcatcacggacat

SEQ ID NO: 535154 - DNA, 25 bp, Mus musculus
aggtcaactgccactcattcaatcc

SEQ ID NO: 535155 - DNA, 25 bp, Mus musculus
aggtcaactgcctctcattcaatcc

SEQ ID NO: 535156 - DNA, 25 bp, Mus musculus
aggtcaagacggactaccgacatga

SEQ ID NO: 535157 - DNA, 25 bp, Mus musculus
aggtcaagacggtctaccgacatga

SEQ ID NO: 535158 - DNA, 25 bp, Mus musculus
aggtcaagatggactccaggatcca

SEQ ID NO: 535159 - DNA, 25 bp, Mus musculus
aggtcaagatggtctccaggatcca

SEQ ID NO: 535160 - DNA, 25 bp, Mus musculus
aggtcaagcagaaggtgagctagat

SEQ ID NO: 535161 - DNA, 25 bp, Mus musculus
aggtcaagcagatggtgagctagat

SEQ ID NO: 535162 - DNA, 25 bp, Mus musculus
aggtcaattcccataccctgggctg

SEQ ID NO: 535163 - DNA, 25 bp, Mus musculus
aggtcaattcccttaccctgggctg

SEQ ID NO: 535164 - DNA, 25 bp, Mus musculus
aggtcacaggttacaggccctggag

SEQ ID NO: 535165 - DNA, 25 bp, Mus musculus
aggtcacaggtttcaggccctggag

SEQ ID NO: 535166 - DNA, 25 bp, Mus musculus
aggtcacatggcatgctcgaggccc

SEQ ID NO: 535167 - DNA, 25 bp, Mus musculus
aggtcacatggcttgctcgaggccc

SEQ ID NO: 535168 - DNA, 25 bp, Mus musculus
aggtcaccacctagtcaccgtcatg

SEQ ID NO: 535169 - DNA, 25 bp, Mus musculus
aggtcaccaccttgtcaccgtcatg

SEQ ID NO: 535170 - DNA, 25 bp, Mus musculus
aggtcaccacggcatgctgtggctt

SEQ ID NO: 535171 - DNA, 25 bp, Mus musculus
aggtcaccacgggatgctgtggctt

SEQ ID NO: 535172 - DNA, 25 bp, Mus musculus
aggtcacccggcagagtctctccga

SEQ ID NO: 535173 - DNA, 25 bp, Mus musculus
aggtcacccggctgagtctctccga

SEQ ID NO: 535174 - DNA, 25 bp, Mus musculus
aggtcagaggcgacctgatcggtcc

SEQ ID NO: 535175 - DNA, 25 bp, Mus musculus
aggtcagaggcgtcctgatcggtcc

SEQ ID NO: 535176 - DNA, 25 bp, Mus musculus
aggtcagaggttagctagctgacaa

SEQ ID NO: 535177 - DNA, 25 bp, Mus musculus
aggtcagaggtttgctagctgacaa

SEQ ID NO: 535178 - DNA, 25 bp, Mus musculus
aggtcagccaaccagtcaccacagt

SEQ ID NO: 535179 - DNA, 25 bp, Mus musculus
aggtcagccaacgagtcaccacagt

SEQ ID NO: 535180 - DNA, 25 bp, Mus musculus
aggtcagcctgcacgtccaaggcgt

SEQ ID NO: 535181 - DNA, 25 bp, Mus musculus
aggtcagcctgctcgtccaaggcgt

SEQ ID NO: 535182 - DNA, 25 bp, Mus musculus
aggtcagcgtccctaccctgaggtc

SEQ ID NO: 535183 - DNA, 25 bp, Mus musculus
aggtcagcgtccgtaccctgaggtc

SEQ ID NO: 535184 - DNA, 25 bp, Mus musculus
aggtcagtgggcagtcctcctccct

SEQ ID NO: 535185 - DNA, 25 bp, Mus musculus
aggtcagtgggctgtcctcctccct

SEQ ID NO: 535186 - DNA, 25 bp, Mus musculus
aggtcagttgtgctgccgtctgtcc

SEQ ID NO: 535187 - DNA, 25 bp, Mus musculus
aggtcagttgtggtgccgtctgtcc

SEQ ID NO: 535188 - DNA, 25 bp, Mus musculus
aggtcatccccacttgtttcaagag

SEQ ID NO: 535189 - DNA, 25 bp, Mus musculus
aggtcatccccagttgtttcaagag

SEQ ID NO: 535190 - DNA, 25 bp, Mus musculus
aggtcatcgtgcagcccaaggacga

SEQ ID NO: 535191 - DNA, 25 bp, Mus musculus
aggtcatcgtgctgcccaaggacga

SEQ ID NO: 535192 - DNA, 25 bp, Mus musculus
aggtcatctacaaagccccttctga

SEQ ID NO: 535193 - DNA, 25 bp, Mus musculus
aggtcatctacatagccccttctga

SEQ ID NO: 535194 - DNA, 25 bp, Mus musculus
aggtcatcttggctgtagttccaca

SEQ ID NO: 535195 - DNA, 25 bp, Mus musculus
aggtcatcttgggtgtagttccaca

SEQ ID NO: 535196 - DNA, 25 bp, Mus musculus
aggtcatgatgcaagatgagccaac

SEQ ID NO: 535197 - DNA, 25 bp, Mus musculus
aggtcatgatgctagatgagccaac

SEQ ID NO: 535198 - DNA, 25 bp, Mus musculus
aggtcatggccacttgtttttgttg

SEQ ID NO: 535199 - DNA, 25 bp, Mus musculus
aggtcatggccagttgtttttgttg

SEQ ID NO: 535200 - DNA, 25 bp, Mus musculus
aggtcatgggtgatctggacattta

SEQ ID NO: 535201 - DNA, 25 bp, Mus musculus
aggtcatgggtgttctggacattta

SEQ ID NO: 535202 - DNA, 25 bp, Mus musculus
aggtcatgtccacggccgagttagc

SEQ ID NO: 535203 - DNA, 25 bp, Mus musculus
aggtcatgtccagggccgagttagc

SEQ ID NO: 535204 - DNA, 25 bp, Mus musculus
aggtcatgtgaccttacagatccag

SEQ ID NO: 535205 - DNA, 25 bp, Mus musculus
aggtcatgtgacgttacagatccag

SEQ ID NO: 535206 - DNA, 25 bp, Mus musculus
aggtcattccaaatgctctatgtgg

SEQ ID NO: 535207 - DNA, 25 bp, Mus musculus
aggtcattccaattgctctatgtgg

SEQ ID NO: 535208 - DNA, 25 bp, Mus musculus
aggtccaaccaaaccaatgttgttc

SEQ ID NO: 535209 - DNA, 25 bp, Mus musculus
aggtccaaccaatccaatgttgttc

SEQ ID NO: 535210 - DNA, 25 bp, Mus musculus
aggtccaagaatatgcgatcgtgcc

SEQ ID NO: 535211 - DNA, 25 bp, Mus musculus
aggtccaagaatttgcgatcgtgcc

SEQ ID NO: 535212 - DNA, 25 bp, Mus musculus
aggtccacccacaactccacaatgg

SEQ ID NO: 535213 - DNA, 25 bp, Mus musculus
aggtccacccactactccacaatgg

SEQ ID NO: 535214 - DNA, 25 bp, Mus musculus
aggtccactcgtccacagaccagga

SEQ ID NO: 535215 - DNA, 25 bp, Mus musculus
aggtccactcgtgcacagaccagga

SEQ ID NO: 535216 - DNA, 25 bp, Mus musculus
aggtccacttcgacacccaggatca

SEQ ID NO: 535217 - DNA, 25 bp, Mus musculus
aggtccacttcgtcacccaggatca

SEQ ID NO: 535218 - DNA, 25 bp, Mus musculus
aggtccagatgaacccatcactgtg

SEQ ID NO: 535219 - DNA, 25 bp, Mus musculus
aggtccagatgatcccatcactgtg

SEQ ID NO: 535220 - DNA, 25 bp, Mus musculus
aggtcccagacacgctcctgagtgg

SEQ ID NO: 535221 - DNA, 25 bp, Mus musculus
aggtcccagacaggctcctgagtgg

SEQ ID NO: 535222 - DNA, 25 bp, Mus musculus
aggtccccgtttctgttggcgtgca

SEQ ID NO: 535223 - DNA, 25 bp, Mus musculus
aggtccccgtttgtgttggcgtgca

SEQ ID NO: 535224 - DNA, 25 bp, Mus musculus
aggtcccgattcagaggtgaagaag

SEQ ID NO: 535225 - DNA, 25 bp, Mus musculus
aggtcccgattctgaggtgaagaag

SEQ ID NO: 535226 - DNA, 25 bp, Mus musculus
aggtcccggagtatcgcccgccatg

SEQ ID NO: 535227 - DNA, 25 bp, Mus musculus
aggtcccggagtttcgcccgccatg

SEQ ID NO: 535228 - DNA, 25 bp, Mus musculus
aggtccgaccatctacacgcctgga

SEQ ID NO: 535229 - DNA, 25 bp, Mus musculus
aggtccgaccatgtacacgcctgga

SEQ ID NO: 535230 - DNA, 25 bp, Mus musculus
aggtccgagccgagatcgaacacaa

SEQ ID NO: 535231 - DNA, 25 bp, Mus musculus
aggtccgagccgtgatcgaacacaa

SEQ ID NO: 535232 - DNA, 25 bp, Mus musculus
aggtccgaggcaacattcctgaaga

SEQ ID NO: 535233 - DNA, 25 bp, Mus musculus
aggtccgaggcatcattcctgaaga

SEQ ID NO: 535234 - DNA, 25 bp, Mus musculus
aggtccgcaagtctctggctctcga

SEQ ID NO: 535235 - DNA, 25 bp, Mus musculus
aggtccgcaagtgtctggctctcga

SEQ ID NO: 535236 - DNA, 25 bp, Mus musculus
aggtccggaggtaacagcttcgctg

SEQ ID NO: 535237 - DNA, 25 bp, Mus musculus
aggtccggaggttacagcttcgctg

SEQ ID NO: 535238 - DNA, 25 bp, Mus musculus
aggtccgggccacagccactttctg

SEQ ID NO: 535239 - DNA, 25 bp, Mus musculus
aggtccgggccagagccactttctg

SEQ ID NO: 535240 - DNA, 25 bp, Mus musculus
aggtcctaacccctacagtggagca

SEQ ID NO: 535241 - DNA, 25 bp, Mus musculus
aggtcctaacccgtacagtggagca

SEQ ID NO: 535242 - DNA, 25 bp, Mus musculus
aggtcctcctggctgatgacctgtg

SEQ ID NO: 535243 - DNA, 25 bp, Mus musculus
aggtcctcctgggtgatgacctgtg

SEQ ID NO: 535244 - DNA, 25 bp, Mus musculus
aggtcctcggagcttctgtttccgg

SEQ ID NO: 535245 - DNA, 25 bp, Mus musculus
aggtcctcggaggttctgtttccgg

SEQ ID NO: 535246 - DNA, 25 bp, Mus musculus
aggtcctggatgagcgaagcaaaga

SEQ ID NO: 535247 - DNA, 25 bp, Mus musculus
aggtcctggatgaggcgctgcagca

SEQ ID NO: 535248 - DNA, 25 bp, Mus musculus
aggtcctggatgtgcgaagcaaaga

SEQ ID NO: 535249 - DNA, 25 bp, Mus musculus
aggtcctggatgtggcgctgcagca

SEQ ID NO: 535250 - DNA, 25 bp, Mus musculus
aggtcctggtgaatgctatcatcaa

SEQ ID NO: 535251 - DNA, 25 bp, Mus musculus
aggtcctggtgattgctatcatcaa

SEQ ID NO: 535252 - DNA, 25 bp, Mus musculus
aggtcctgtaataaagagggatccg

SEQ ID NO: 535253 - DNA, 25 bp, Mus musculus
aggtcctgtaattaagagggatccg

SEQ ID NO: 535254 - DNA, 25 bp, Mus musculus
aggtcctgtccgagtgccgcctgct

SEQ ID NO: 535255 - DNA, 25 bp, Mus musculus
aggtcctgtccgtgtgccgcctgct

SEQ ID NO: 535256 - DNA, 25 bp, Mus musculus
aggtcctgttgccctcttccacaag

SEQ ID NO: 535257 - DNA, 25 bp, Mus musculus
aggtcctgttgcgctcttccacaag

SEQ ID NO: 535258 - DNA, 25 bp, Mus musculus
aggtccttgtccatccctctacgtg

SEQ ID NO: 535259 - DNA, 25 bp, Mus musculus
aggtccttgtccttccctctacgtg

SEQ ID NO: 535260 - DNA, 25 bp, Mus musculus
aggtcctttccaacggcatccctgt

SEQ ID NO: 535261 - DNA, 25 bp, Mus musculus
aggtcctttccatcggcatccctgt

SEQ ID NO: 535262 - DNA, 25 bp, Mus musculus
aggtcgaaaggcagccccctatctg

SEQ ID NO: 535263 - DNA, 25 bp, Mus musculus
aggtcgaaaggctgccccctatctg

SEQ ID NO: 535264 - DNA, 25 bp, Mus musculus
aggtcgaaatacctccagcagcacc

SEQ ID NO: 535265 - DNA, 25 bp, Mus musculus
aggtcgaaatacgtccagcagcacc

SEQ ID NO: 535266 - DNA, 25 bp, Mus musculus
aggtcgagctgtactcccgctacag

SEQ ID NO: 535267 - DNA, 25 bp, Mus musculus
aggtcgagctgttctcccgctacag

SEQ ID NO: 535268 - DNA, 25 bp, Mus musculus
aggtcgccatgaaccgactccagga

SEQ ID NO: 535269 - DNA, 25 bp, Mus musculus
aggtcgccatgatccgactccagga

SEQ ID NO: 535270 - DNA, 25 bp, Mus musculus
aggtcgctcaggaactcgcgtcggc

SEQ ID NO: 535271 - DNA, 25 bp, Mus musculus
aggtcgctcaggtactcgcgtcggc

SEQ ID NO: 535272 - DNA, 25 bp, Mus musculus
aggtcgctctggatatccaggccta

SEQ ID NO: 535273 - DNA, 25 bp, Mus musculus
aggtcgctctggttatccaggccta

SEQ ID NO: 535274 - DNA, 25 bp, Mus musculus
aggtcgcttaccaggaaaagtggca

SEQ ID NO: 535275 - DNA, 25 bp, Mus musculus
aggtcgcttacctggaaaagtggca

SEQ ID NO: 535276 - DNA, 25 bp, Mus musculus
aggtcggacacccttgaggacagcc

SEQ ID NO: 535277 - DNA, 25 bp, Mus musculus
aggtcggacaccgttgaggacagcc

SEQ ID NO: 535278 - DNA, 25 bp, Mus musculus
aggtcggcctttctgcttctggcca

SEQ ID NO: 535279 - DNA, 25 bp, Mus musculus
aggtcggcctttgtgcttctggcca

SEQ ID NO: 535280 - DNA, 25 bp, Mus musculus
aggtcgggcccaacagagactggaa

SEQ ID NO: 535281 - DNA, 25 bp, Mus musculus
aggtcgggcccatcagagactggaa

SEQ ID NO: 535282 - DNA, 25 bp, Mus musculus
aggtcgtccaatcggtccacacagc

SEQ ID NO: 535283 - DNA, 25 bp, Mus musculus
aggtcgtccaatgggtccacacagc

SEQ ID NO: 535284 - DNA, 25 bp, Mus musculus
aggtcgtccttgagagctcgtgtcc

SEQ ID NO: 535285 - DNA, 25 bp, Mus musculus
aggtcgtccttgtgagctcgtgtcc

SEQ ID NO: 535286 - DNA, 25 bp, Mus musculus
aggtctaaaccgaaagccagtgagt

SEQ ID NO: 535287 - DNA, 25 bp, Mus musculus
aggtctaaaccgtaagccagtgagt

SEQ ID NO: 535288 - DNA, 25 bp, Mus musculus
aggtctactgcgctgccacgaccag

SEQ ID NO: 535289 - DNA, 25 bp, Mus musculus
aggtctactgcggtgccacgaccag

SEQ ID NO: 535290 - DNA, 25 bp, Mus musculus
aggtctagcccaagtccagcctgaa

SEQ ID NO: 535291 - DNA, 25 bp, Mus musculus
aggtctagcccatgtccagcctgaa

SEQ ID NO: 535292 - DNA, 25 bp, Mus musculus
aggtctagctacaggcggctctcca

SEQ ID NO: 535293 - DNA, 25 bp, Mus musculus
aggtctagctactggcggctctcca

SEQ ID NO: 535294 - DNA, 25 bp, Mus musculus
aggtctaggaatagctctggagtcc

SEQ ID NO: 535295 - DNA, 25 bp, Mus musculus
aggtctaggaattgctctggagtcc

SEQ ID NO: 535296 - DNA, 25 bp, Mus musculus
aggtctatcccaaccatggtagacg

SEQ ID NO: 535297 - DNA, 25 bp, Mus musculus
aggtctatcccatccatggtagacg

SEQ ID NO: 535298 - DNA, 25 bp, Mus musculus
aggtctcccagacacgaggttctgg

SEQ ID NO: 535299 - DNA, 25 bp, Mus musculus
aggtctcccagagacgaggttctgg

SEQ ID NO: 535300 - DNA, 25 bp, Mus musculus
aggtctcctcacaccggtccagtgg

SEQ ID NO: 535301 - DNA, 25 bp, Mus musculus
aggtctcctcactccggtccagtgg

SEQ ID NO: 535302 - DNA, 25 bp, Mus musculus
aggtctcgcggaagcgtctctgaaa

SEQ ID NO: 535303 - DNA, 25 bp, Mus musculus
aggtctcgcggatgcgtctctgaaa

SEQ ID NO: 535304 - DNA, 25 bp, Mus musculus
aggtctcggaacatctacggctcac

SEQ ID NO: 535305 - DNA, 25 bp, Mus musculus
aggtctcggaacttctacggctcac

SEQ ID NO: 535306 - DNA, 25 bp, Mus musculus
aggtctctgtagctttcctctctga

SEQ ID NO: 535307 - DNA, 25 bp, Mus musculus
aggtctctgtaggtttcctctctga

SEQ ID NO: 535308 - DNA, 25 bp, Mus musculus
aggtctgagcaaactcagcccctct

SEQ ID NO: 535309 - DNA, 25 bp, Mus musculus
aggtctgagcaatctcagcccctct

SEQ ID NO: 535310 - DNA, 25 bp, Mus musculus
aggtctgcagcacgttccgccgaat

SEQ ID NO: 535311 - DNA, 25 bp, Mus musculus
aggtctgcagcaggttccgccgaat

SEQ ID NO: 535312 - DNA, 25 bp, Mus musculus
aggtctgcatcgagcaccacacgtt

SEQ ID NO: 535313 - DNA, 25 bp, Mus musculus
aggtctgcatcgtgcaccacacgtt

SEQ ID NO: 535314 - DNA, 25 bp, Mus musculus
aggtctgccccacaggaggcctatg

SEQ ID NO: 535315 - DNA, 25 bp, Mus musculus
aggtctgccccagaggaggcctatg

SEQ ID NO: 535316 - DNA, 25 bp, Mus musculus
aggtctgctctgactcgaggagcac

SEQ ID NO: 535317 - DNA, 25 bp, Mus musculus
aggtctgctctgtctcgaggagcac

SEQ ID NO: 535318 - DNA, 25 bp, Mus musculus
aggtctggagccagttgctgagcca

SEQ ID NO: 535319 - DNA, 25 bp, Mus musculus
aggtctggagcctgttgctgagcca

SEQ ID NO: 535320 - DNA, 25 bp, Mus musculus
aggtctggcctgcaagcccacaagc

SEQ ID NO: 535321 - DNA, 25 bp, Mus musculus
aggtctggcctggaagcccacaagc

SEQ ID NO: 535322 - DNA, 25 bp, Mus musculus
aggtctgggccgcaacctgtctgac

SEQ ID NO: 535323 - DNA, 25 bp, Mus musculus
aggtctgggccggaacctgtctgac

SEQ ID NO: 535324 - DNA, 25 bp, Mus musculus
aggtcttccaagaacacacacaggg

SEQ ID NO: 535325 - DNA, 25 bp, Mus musculus
aggtcttccaagtacacacacaggg

SEQ ID NO: 535326 - DNA, 25 bp, Mus musculus
aggtcttccccactagccctagtga

SEQ ID NO: 535327 - DNA, 25 bp, Mus musculus
aggtcttccccagtagccctagtga

SEQ ID NO: 535328 - DNA, 25 bp, Mus musculus
aggtcttcgcggaggactccctcca

SEQ ID NO: 535329 - DNA, 25 bp, Mus musculus
aggtcttcgcggtggactccctcca

SEQ ID NO: 535330 - DNA, 25 bp, Mus musculus
aggtcttctttaacggcagtgtacg

SEQ ID NO: 535331 - DNA, 25 bp, Mus musculus
aggtcttctttatcggcagtgtacg

SEQ ID NO: 535332 - DNA, 25 bp, Mus musculus
aggtcttgactcctgtggatcctac

SEQ ID NO: 535333 - DNA, 25 bp, Mus musculus
aggtcttgactcgtgtggatcctac

SEQ ID NO: 535334 - DNA, 25 bp, Mus musculus
aggtcttgccgtcagcccttgtgtg

SEQ ID NO: 535335 - DNA, 25 bp, Mus musculus
aggtcttgccgtgagcccttgtgtg

SEQ ID NO: 535336 - DNA, 25 bp, Mus musculus
aggtctttgctaccaacctgttcaa

SEQ ID NO: 535337 - DNA, 25 bp, Mus musculus
aggtctttgctagcaacctgttcaa

SEQ ID NO: 535338 - DNA, 25 bp, Mus musculus
aggtctttgggcactaccagcagca

SEQ ID NO: 535339 - DNA, 25 bp, Mus musculus
aggtctttgggctctaccagcagca

SEQ ID NO: 535340 - DNA, 25 bp, Mus musculus
aggtcttttggaacccagagagtga

SEQ ID NO: 535341 - DNA, 25 bp, Mus musculus
aggtcttttggatcccagagagtga

SEQ ID NO: 535342 - DNA, 25 bp, Mus musculus
aggtgaaagaccaggctcatgagcc

SEQ ID NO: 535343 - DNA, 25 bp, Mus musculus
aggtgaaagacctggctcatgagcc

SEQ ID NO: 535344 - DNA, 25 bp, Mus musculus
aggtgaacagctcccagtacccagg

SEQ ID NO: 535345 - DNA, 25 bp, Mus musculus
aggtgaacagctgccagtacccagg

SEQ ID NO: 535346 - DNA, 25 bp, Mus musculus
aggtgaacatagacatagcttcccc

SEQ ID NO: 535347 - DNA, 25 bp, Mus musculus
aggtgaacatagtcatagcttcccc

SEQ ID NO: 535348 - DNA, 25 bp, Mus musculus
aggtgaaggaccctctgaaggccta

SEQ ID NO: 535349 - DNA, 25 bp, Mus musculus
aggtgaaggaccgtctgaaggccta

SEQ ID NO: 535350 - DNA, 25 bp, Mus musculus
aggtgaaggcggaccagcttgccat

SEQ ID NO: 535351 - DNA, 25 bp, Mus musculus
aggtgaaggcggtccagcttgccat

SEQ ID NO: 535352 - DNA, 25 bp, Mus musculus
aggtgaagtgctaaaacagttaaca

SEQ ID NO: 535353 - DNA, 25 bp, Mus musculus
aggtgaagtgcttaaacagttaaca

SEQ ID NO: 535354 - DNA, 25 bp, Mus musculus
aggtgacactgcagatgaaggagcc

SEQ ID NO: 535355 - DNA, 25 bp, Mus musculus
aggtgacactgctgatgaaggagcc

SEQ ID NO: 535356 - DNA, 25 bp, Mus musculus
aggtgacagtcaagcctcccgagac

SEQ ID NO: 535357 - DNA, 25 bp, Mus musculus
aggtgacagtcatgcctcccgagac

SEQ ID NO: 535358 - DNA, 25 bp, Mus musculus
aggtgacagtcccagccgcgagtcc

SEQ ID NO: 535359 - DNA, 25 bp, Mus musculus
aggtgacagtccgagccgcgagtcc

SEQ ID NO: 535360 - DNA, 25 bp, Mus musculus
aggtgaccaggcagagagacctgct

SEQ ID NO: 535361 - DNA, 25 bp, Mus musculus
aggtgaccaggctgagagacctgct

SEQ ID NO: 535362 - DNA, 25 bp, Mus musculus
aggtgacccagaccgacaacatggc

SEQ ID NO: 535363 - DNA, 25 bp, Mus musculus
aggtgacccagagcgacaacatggc

SEQ ID NO: 535364 - DNA, 25 bp, Mus musculus
aggtgaccctctcaagctcatctgc

SEQ ID NO: 535365 - DNA, 25 bp, Mus musculus
aggtgaccctctgaagctcatctgc

SEQ ID NO: 535366 - DNA, 25 bp, Mus musculus
aggtgaccctggacgcgacctccga

SEQ ID NO: 535367 - DNA, 25 bp, Mus musculus
aggtgaccctggtcgcgacctccga

SEQ ID NO: 535368 - DNA, 25 bp, Mus musculus
aggtgaccgcgcaagccagcactcg

SEQ ID NO: 535369 - DNA, 25 bp, Mus musculus
aggtgaccgcgctagccagcactcg

SEQ ID NO: 535370 - DNA, 25 bp, Mus musculus
aggtgacggccaaccaggagcagat

SEQ ID NO: 535371 - DNA, 25 bp, Mus musculus
aggtgacggccatccaggagcagat

SEQ ID NO: 535372 - DNA, 25 bp, Mus musculus
aggtgacggccgaagaccagtctga

SEQ ID NO: 535373 - DNA, 25 bp, Mus musculus
aggtgacggccgtagaccagtctga

SEQ ID NO: 535374 - DNA, 25 bp, Mus musculus
aggtgactccaacaatgtggcagag

SEQ ID NO: 535375 - DNA, 25 bp, Mus musculus
aggtgactccaagaatgtggcagag

SEQ ID NO: 535376 - DNA, 25 bp, Mus musculus
aggtgagaagctcagcctccagaaa

SEQ ID NO: 535377 - DNA, 25 bp, Mus musculus
aggtgagaagctgagcctccagaaa

SEQ ID NO: 535378 - DNA, 25 bp, Mus musculus
aggtgagactggcaaccagctgtca

SEQ ID NO: 535379 - DNA, 25 bp, Mus musculus
aggtgagactgggaaccagctgtca

SEQ ID NO: 535380 - DNA, 25 bp, Mus musculus
aggtgagagcttcgagcatcccgca

SEQ ID NO: 535381 - DNA, 25 bp, Mus musculus
aggtgagagcttggagcatcccgca

SEQ ID NO: 535382 - DNA, 25 bp, Mus musculus
aggtgagaggccagcagccagagtg

SEQ ID NO: 535383 - DNA, 25 bp, Mus musculus
aggtgagaggcctgcagccagagtg

SEQ ID NO: 535384 - DNA, 25 bp, Mus musculus
aggtgagccgtcacccagcggcctg

SEQ ID NO: 535385 - DNA, 25 bp, Mus musculus
aggtgagccgtctcccagcggcctg

SEQ ID NO: 535386 - DNA, 25 bp, Mus musculus
aggtgagcgttcctgcacccacgga

SEQ ID NO: 535387 - DNA, 25 bp, Mus musculus
aggtgagcgttcgtgcacccacgga

SEQ ID NO: 535388 - DNA, 25 bp, Mus musculus
aggtgagcttctaggaaactgagga

SEQ ID NO: 535389 - DNA, 25 bp, Mus musculus
aggtgagcttcttggaaactgagga

SEQ ID NO: 535390 - DNA, 25 bp, Mus musculus
aggtgaggaagaagaccgtcgccct

SEQ ID NO: 535391 - DNA, 25 bp, Mus musculus
aggtgaggaagatgaccgtcgccct

SEQ ID NO: 535392 - DNA, 25 bp, Mus musculus
aggtgaggactaagaaaaagagttc

SEQ ID NO: 535393 - DNA, 25 bp, Mus musculus
aggtgaggactatgaaaaagagttc

SEQ ID NO: 535394 - DNA, 25 bp, Mus musculus
aggtgaggtcctccacacttgatgg

SEQ ID NO: 535395 - DNA, 25 bp, Mus musculus
aggtgaggtcctgcacacttgatgg

SEQ ID NO: 535396 - DNA, 25 bp, Mus musculus
aggtgagtacagacagccctctggg

SEQ ID NO: 535397 - DNA, 25 bp, Mus musculus
aggtgagtacagtcagccctctggg

SEQ ID NO: 535398 - DNA, 25 bp, Mus musculus
aggtgatcattaatcaggcatgccg

SEQ ID NO: 535399 - DNA, 25 bp, Mus musculus
aggtgatcattattcaggcatgccg

SEQ ID NO: 535400 - DNA, 25 bp, Mus musculus
aggtgatcgcagatcctcccgggcc

SEQ ID NO: 535401 - DNA, 25 bp, Mus musculus
aggtgatcgcagttcctcccgggcc

SEQ ID NO: 535402 - DNA, 25 bp, Mus musculus
aggtgatgaactaccggcagacgcg

SEQ ID NO: 535403 - DNA, 25 bp, Mus musculus
aggtgatgaacttccggcagacgcg

SEQ ID NO: 535404 - DNA, 25 bp, Mus musculus
aggtgatgggcaaacattatgggat

SEQ ID NO: 535405 - DNA, 25 bp, Mus musculus
aggtgatgggcatacattatgggat

SEQ ID NO: 535406 - DNA, 25 bp, Mus musculus
aggtgattgaaaatcgggctctaaa

SEQ ID NO: 535407 - DNA, 25 bp, Mus musculus
aggtgattgaaattcgggctctaaa

SEQ ID NO: 535408 - DNA, 25 bp, Mus musculus
aggtgcaaaatgaggagcctgtgaa

SEQ ID NO: 535409 - DNA, 25 bp, Mus musculus
aggtgcaaaatgtggagcctgtgaa

SEQ ID NO: 535410 - DNA, 25 bp, Mus musculus
aggtgcacaagcaagccaagaggcc

SEQ ID NO: 535411 - DNA, 25 bp, Mus musculus
aggtgcacaagctagccaagaggcc

SEQ ID NO: 535412 - DNA, 25 bp, Mus musculus
aggtgcacggcacccgtctgcgctt

SEQ ID NO: 535413 - DNA, 25 bp, Mus musculus
aggtgcacggcagccgtctgcgctt

SEQ ID NO: 535414 - DNA, 25 bp, Mus musculus
aggtgcagaccccacagtcgatgcc

SEQ ID NO: 535415 - DNA, 25 bp, Mus musculus
aggtgcagacccgacagtcgatgcc

SEQ ID NO: 535416 - DNA, 25 bp, Mus musculus
aggtgcagacgtaccagccgccctg

SEQ ID NO: 535417 - DNA, 25 bp, Mus musculus
aggtgcagacgttccagccgccctg

SEQ ID NO: 535418 - DNA, 25 bp, Mus musculus
aggtgcagagacagctagctatcca

SEQ ID NO: 535419 - DNA, 25 bp, Mus musculus
aggtgcagagactgctagctatcca

SEQ ID NO: 535420 - DNA, 25 bp, Mus musculus
aggtgcagatcacacaggacagcga

SEQ ID NO: 535421 - DNA, 25 bp, Mus musculus
aggtgcagatcagacaggacagcga

SEQ ID NO: 535422 - DNA, 25 bp, Mus musculus
aggtgcagccccagcagtggagacc

SEQ ID NO: 535423 - DNA, 25 bp, Mus musculus
aggtgcagcccctgcagtggagacc

SEQ ID NO: 535424 - DNA, 25 bp, Mus musculus
aggtgccatgctccgcaggacctgt

SEQ ID NO: 535425 - DNA, 25 bp, Mus musculus
aggtgccatgctgcgcaggacctgt

SEQ ID NO: 535426 - DNA, 25 bp, Mus musculus
aggtgcccacgcaaatgtccttcct

SEQ ID NO: 535427 - DNA, 25 bp, Mus musculus
aggtgcccacgctaatgtccttcct

SEQ ID NO: 535428 - DNA, 25 bp, Mus musculus
aggtgccctgagacccgaactcgcg

SEQ ID NO: 535429 - DNA, 25 bp, Mus musculus
aggtgccctgagtcccgaactcgcg

SEQ ID NO: 535430 - DNA, 25 bp, Mus musculus
aggtgcctggctaactgaccgcaca

SEQ ID NO: 535431 - DNA, 25 bp, Mus musculus
aggtgcctggcttactgaccgcaca

SEQ ID NO: 535432 - DNA, 25 bp, Mus musculus
aggtgccttactcagtctcagtccg

SEQ ID NO: 535433 - DNA, 25 bp, Mus musculus
aggtgccttactgagtctcagtccg

SEQ ID NO: 535434 - DNA, 25 bp, Mus musculus
aggtgcgcgccgagtaccaagacct

SEQ ID NO: 535435 - DNA, 25 bp, Mus musculus
aggtgcgcgccgtgtaccaagacct

SEQ ID NO: 535436 - DNA, 25 bp, Mus musculus
aggtgcggatccaccccagtgagaa

SEQ ID NO: 535437 - DNA, 25 bp, Mus musculus
aggtgcggatcctccccagtgagaa

SEQ ID NO: 535438 - DNA, 25 bp, Mus musculus
aggtgcggcaacagctccgagtcct

SEQ ID NO: 535439 - DNA, 25 bp, Mus musculus
aggtgcggcaactgctccgagtcct

SEQ ID NO: 535440 - DNA, 25 bp, Mus musculus
aggtgcggctgactgacttcttgct

SEQ ID NO: 535441 - DNA, 25 bp, Mus musculus
aggtgcggctgagtgacttcttgct

SEQ ID NO: 535442 - DNA, 25 bp, Mus musculus
aggtgcgggactccatccccgctga

SEQ ID NO: 535443 - DNA, 25 bp, Mus musculus
aggtgcgggactgcatccccgctga

SEQ ID NO: 535444 - DNA, 25 bp, Mus musculus
aggtgctaaaggagcttctgggtca

SEQ ID NO: 535445 - DNA, 25 bp, Mus musculus
aggtgctaaaggtgcttctgggtca

SEQ ID NO: 535446 - DNA, 25 bp, Mus musculus
aggtgctcatgacccaggccatcca

SEQ ID NO: 535447 - DNA, 25 bp, Mus musculus
aggtgctcatgagccaggccatcca

SEQ ID NO: 535448 - DNA, 25 bp, Mus musculus
aggtgctccaccagtacgtgacata

SEQ ID NO: 535449 - DNA, 25 bp, Mus musculus
aggtgctccacctgtacgtgacata

SEQ ID NO: 535450 - DNA, 25 bp, Mus musculus
aggtgctccctaagattggcggcga

SEQ ID NO: 535451 - DNA, 25 bp, Mus musculus
aggtgctccctatgattggcggcga

SEQ ID NO: 535452 - DNA, 25 bp, Mus musculus
aggtgctcgagacatcctgctgcaa

SEQ ID NO: 535453 - DNA, 25 bp, Mus musculus
aggtgctcgagagatcctgctgcaa

SEQ ID NO: 535454 - DNA, 25 bp, Mus musculus
aggtgctctcacaccagcccagtga

SEQ ID NO: 535455 - DNA, 25 bp, Mus musculus
aggtgctctcactccagcccagtga

SEQ ID NO: 535456 - DNA, 25 bp, Mus musculus
aggtgctgaggaaaacggcacacag

SEQ ID NO: 535457 - DNA, 25 bp, Mus musculus
aggtgctgaggataacggcacacag

SEQ ID NO: 535458 - DNA, 25 bp, Mus musculus
aggtgctgctctccttgtttgatga

SEQ ID NO: 535459 - DNA, 25 bp, Mus musculus
aggtgctgctctgcttgtttgatga

SEQ ID NO: 535460 - DNA, 25 bp, Mus musculus
aggtgctgctggataccacaggaga

SEQ ID NO: 535461 - DNA, 25 bp, Mus musculus
aggtgctgctggttaccacaggaga

SEQ ID NO: 535462 - DNA, 25 bp, Mus musculus
aggtgctgtctgactgctctagcaa

SEQ ID NO: 535463 - DNA, 25 bp, Mus musculus
aggtgctgtctgtctgctctagcaa

SEQ ID NO: 535464 - DNA, 25 bp, Mus musculus
aggtgcttcccgcatagctgtgccc

SEQ ID NO: 535465 - DNA, 25 bp, Mus musculus
aggtgcttcccggatagctgtgccc

SEQ ID NO: 535466 - DNA, 25 bp, Mus musculus
aggtgcttctcacagccttttggac

SEQ ID NO: 535467 - DNA, 25 bp, Mus musculus
aggtgcttctcagagccttttggac

SEQ ID NO: 535468 - DNA, 25 bp, Mus musculus
aggtgcttgttgctcatactaactg

SEQ ID NO: 535469 - DNA, 25 bp, Mus musculus
aggtgcttgttggtcatactaactg

SEQ ID NO: 535470 - DNA, 25 bp, Mus musculus
aggtggaacccgagtctggagccct

SEQ ID NO: 535471 - DNA, 25 bp, Mus musculus
aggtggaacccgtgtctggagccct

SEQ ID NO: 535472 - DNA, 25 bp, Mus musculus
aggtggaactccaactggactggca

SEQ ID NO: 535473 - DNA, 25 bp, Mus musculus
aggtggaactcctactggactggca

SEQ ID NO: 535474 - DNA, 25 bp, Mus musculus
aggtggacacctatcaccggctgcc

SEQ ID NO: 535475 - DNA, 25 bp, Mus musculus
aggtggacacctttcaccggctgcc

SEQ ID NO: 535476 - DNA, 25 bp, Mus musculus
aggtggaccacccaaacacgtgcac

SEQ ID NO: 535477 - DNA, 25 bp, Mus musculus
aggtggaccaccctcaggacttgga

SEQ ID NO: 535478 - DNA, 25 bp, Mus musculus
aggtggaccaccgaaacacgtgcac

SEQ ID NO: 535479 - DNA, 25 bp, Mus musculus
aggtggaccaccgtcaggacttgga

SEQ ID NO: 535480 - DNA, 25 bp, Mus musculus
aggtggaccccacatcggccaactt

SEQ ID NO: 535481 - DNA, 25 bp, Mus musculus
aggtggaccccagatcggccaactt

SEQ ID NO: 535482 - DNA, 25 bp, Mus musculus
aggtggagtcagctcagcagccaaa

SEQ ID NO: 535483 - DNA, 25 bp, Mus musculus
aggtggagtcaggtcagcagccaaa

SEQ ID NO: 535484 - DNA, 25 bp, Mus musculus
aggtggatgtgtacagcccattgcg

SEQ ID NO: 535485 - DNA, 25 bp, Mus musculus
aggtggatgtgttcagcccattgcg

SEQ ID NO: 535486 - DNA, 25 bp, Mus musculus
aggtggcaacaacgcccctggtcca

SEQ ID NO: 535487 - DNA, 25 bp, Mus musculus
aggtggcaacaaggcccctggtcca

SEQ ID NO: 535488 - DNA, 25 bp, Mus musculus
aggtggcagaccactggtacccggc

SEQ ID NO: 535489 - DNA, 25 bp, Mus musculus
aggtggcagacctctggtacccggc

SEQ ID NO: 535490 - DNA, 25 bp, Mus musculus
aggtggcatgtccacgcctctccat

SEQ ID NO: 535491 - DNA, 25 bp, Mus musculus
aggtggcatgtcgacgcctctccat

SEQ ID NO: 535492 - DNA, 25 bp, Mus musculus
aggtggcggctaagggacccttcca

SEQ ID NO: 535493 - DNA, 25 bp, Mus musculus
aggtggcggctatgggacccttcca

SEQ ID NO: 535494 - DNA, 25 bp, Mus musculus
aggtggctggctacgccgcacagct

SEQ ID NO: 535495 - DNA, 25 bp, Mus musculus
aggtggctggcttcgccgcacagct

SEQ ID NO: 535496 - DNA, 25 bp, Mus musculus
aggtggctgtgcagtagactctgtt

SEQ ID NO: 535497 - DNA, 25 bp, Mus musculus
aggtggctgtgctgtagactctgtt

SEQ ID NO: 535498 - DNA, 25 bp, Mus musculus
aggtgggaccaaatttgcctattgg

SEQ ID NO: 535499 - DNA, 25 bp, Mus musculus
aggtgggaccaattttgcctattgg

SEQ ID NO: 535500 - DNA, 25 bp, Mus musculus
aggtgggcagggactacatctatct

SEQ ID NO: 535501 - DNA, 25 bp, Mus musculus
aggtgggcagggtctacatctatct

SEQ ID NO: 535502 - DNA, 25 bp, Mus musculus
aggtgggccctgacggcacgcccta

SEQ ID NO: 535503 - DNA, 25 bp, Mus musculus
aggtgggccctgtcggcacgcccta

SEQ ID NO: 535504 - DNA, 25 bp, Mus musculus
aggtgggctgctctaacatcgccta

SEQ ID NO: 535505 - DNA, 25 bp, Mus musculus
aggtgggctgctgtaacatcgccta

SEQ ID NO: 535506 - DNA, 25 bp, Mus musculus
aggtgggtcggcagcttgctctcat

SEQ ID NO: 535507 - DNA, 25 bp, Mus musculus
aggtgggtcggctgcttgctctcat

SEQ ID NO: 535508 - DNA, 25 bp, Mus musculus
aggtgggtgagtccctcctccctgt

SEQ ID NO: 535509 - DNA, 25 bp, Mus musculus
aggtgggtgagtgcctcctccctgt

SEQ ID NO: 535510 - DNA, 25 bp, Mus musculus
aggtggtcaagcactctacgttgat

SEQ ID NO: 535511 - DNA, 25 bp, Mus musculus
aggtggtcaagctctctacgttgat

SEQ ID NO: 535512 - DNA, 25 bp, Mus musculus
aggtggtcctgtccgctgaaaatga

SEQ ID NO: 535513 - DNA, 25 bp, Mus musculus
aggtggtcctgtgcgctgaaaatga

SEQ ID NO: 535514 - DNA, 25 bp, Mus musculus
aggtggtcgatgacacaggcctgaa

SEQ ID NO: 535515 - DNA, 25 bp, Mus musculus
aggtggtcgatgtcacaggcctgaa

SEQ ID NO: 535516 - DNA, 25 bp, Mus musculus
aggtggtctactagctctccctaag

SEQ ID NO: 535517 - DNA, 25 bp, Mus musculus
aggtggtctacttgctctccctaag

SEQ ID NO: 535518 - DNA, 25 bp, Mus musculus
aggtggtgcccacagtgtacatgaa

SEQ ID NO: 535519 - DNA, 25 bp, Mus musculus
aggtggtgcccagagtgtacatgaa

SEQ ID NO: 535520 - DNA, 25 bp, Mus musculus
aggtggtggactactaccagccgac

SEQ ID NO: 535521 - DNA, 25 bp, Mus musculus
aggtggtggacttctaccagccgac

SEQ ID NO: 535522 - DNA, 25 bp, Mus musculus
aggtgtactgctaacccctactggc

SEQ ID NO: 535523 - DNA, 25 bp, Mus musculus
aggtgtactgcttacccctactggc

SEQ ID NO: 535524 - DNA, 25 bp, Mus musculus
aggtgtagctgcacagcactcgcaa

SEQ ID NO: 535525 - DNA, 25 bp, Mus musculus
aggtgtagctgctcagcactcgcaa

SEQ ID NO: 535526 - DNA, 25 bp, Mus musculus
aggtgtcagatgacactgtcactca

SEQ ID NO: 535527 - DNA, 25 bp, Mus musculus
aggtgtcagatgtcactgtcactca

SEQ ID NO: 535528 - DNA, 25 bp, Mus musculus
aggtgtcatcaacctccgttccgtg

SEQ ID NO: 535529 - DNA, 25 bp, Mus musculus
aggtgtcatcaagctccgttccgtg

SEQ ID NO: 535530 - DNA, 25 bp, Mus musculus
aggtgtcattcaagttaaaacagag

SEQ ID NO: 535531 - DNA, 25 bp, Mus musculus
aggtgtcattcatgttaaaacagag

SEQ ID NO: 535532 - DNA, 25 bp, Mus musculus
aggtgtcccaccatatctcatccta

SEQ ID NO: 535533 - DNA, 25 bp, Mus musculus
aggtgtcccaccttatctcatccta

SEQ ID NO: 535534 - DNA, 25 bp, Mus musculus
aggtgtcctgccagccaactacaca

SEQ ID NO: 535535 - DNA, 25 bp, Mus musculus
aggtgtcctgcctgccaactacaca

SEQ ID NO: 535536 - DNA, 25 bp, Mus musculus
aggtgtctgattccccttacgatga

SEQ ID NO: 535537 - DNA, 25 bp, Mus musculus
aggtgtctgattgcccttacgatga

SEQ ID NO: 535538 - DNA, 25 bp, Mus musculus
aggtgtgactgaactctgaacgtga

SEQ ID NO: 535539 - DNA, 25 bp, Mus musculus
aggtgtgactgatctctgaacgtga

SEQ ID NO: 535540 - DNA, 25 bp, Mus musculus
aggtgtgatcgccatccaggccagc

SEQ ID NO: 535541 - DNA, 25 bp, Mus musculus
aggtgtgatcgcgatccaggccagc

SEQ ID NO: 535542 - DNA, 25 bp, Mus musculus
aggtgtggatggcaactttctgata

SEQ ID NO: 535543 - DNA, 25 bp, Mus musculus
aggtgtggatgggaactttctgata

SEQ ID NO: 535544 - DNA, 25 bp, Mus musculus
aggtgtggtactcctgccctgctga

SEQ ID NO: 535545 - DNA, 25 bp, Mus musculus
aggtgtggtactgctgccctgctga

SEQ ID NO: 535546 - DNA, 25 bp, Mus musculus
aggtgtgtccgtaggacaacagaga

SEQ ID NO: 535547 - DNA, 25 bp, Mus musculus
aggtgtgtccgttggacaacagaga

SEQ ID NO: 535548 - DNA, 25 bp, Mus musculus
aggtgtgtgcccatggagaaagcaa

SEQ ID NO: 535549 - DNA, 25 bp, Mus musculus
aggtgtgtgcccttggagaaagcaa

SEQ ID NO: 535550 - DNA, 25 bp, Mus musculus
aggtgttcagtcagctgagcctcgg

SEQ ID NO: 535551 - DNA, 25 bp, Mus musculus
aggtgttcagtctgctgagcctcgg

SEQ ID NO: 535552 - DNA, 25 bp, Mus musculus
aggtgttctcttaggcaactgtgca

SEQ ID NO: 535553 - DNA, 25 bp, Mus musculus
aggtgttctctttggcaactgtgca

SEQ ID NO: 535554 - DNA, 25 bp, Mus musculus
aggtgtttctaaatggttacagcac

SEQ ID NO: 535555 - DNA, 25 bp, Mus musculus
aggtgtttctaattggttacagcac

SEQ ID NO: 535556 - DNA, 25 bp, Mus musculus
aggtgtttgacaccttggagcagca

SEQ ID NO: 535557 - DNA, 25 bp, Mus musculus
aggtgtttgacagcttggagcagca

SEQ ID NO: 535558 - DNA, 25 bp, Mus musculus
aggtgtttgattacctagtggccca

SEQ ID NO: 535559 - DNA, 25 bp, Mus musculus
aggtgtttgatttcctagtggccca

SEQ ID NO: 535560 - DNA, 25 bp, Mus musculus
aggtgttttccgctgtgtccccatc

SEQ ID NO: 535561 - DNA, 25 bp, Mus musculus
aggtgttttccggtgtgtccccatc

SEQ ID NO: 535562 - DNA, 25 bp, Mus musculus
aggttaaaaccaacagccccgcatc

SEQ ID NO: 535563 - DNA, 25 bp, Mus musculus
aggttaaaaccatcagccccgcatc

SEQ ID NO: 535564 - DNA, 25 bp, Mus musculus
aggttaatcattagcagctggctgc

SEQ ID NO: 535565 - DNA, 25 bp, Mus musculus
aggttaatcatttgcagctggctgc

SEQ ID NO: 535566 - DNA, 25 bp, Mus musculus
aggttaatttatactgggaagctgc

SEQ ID NO: 535567 - DNA, 25 bp, Mus musculus
aggttaatttattctgggaagctgc

SEQ ID NO: 535568 - DNA, 25 bp, Mus musculus
aggttacatcccagtggaaggagcc

SEQ ID NO: 535569 - DNA, 25 bp, Mus musculus
aggttacatccctgtggaaggagcc

SEQ ID NO: 535570 - DNA, 25 bp, Mus musculus
aggttaccataacccagatcagcag

SEQ ID NO: 535571 - DNA, 25 bp, Mus musculus
aggttaccataagccagatcagcag

SEQ ID NO: 535572 - DNA, 25 bp, Mus musculus
aggttaccgctaacgtcaagtactg

SEQ ID NO: 535573 - DNA, 25 bp, Mus musculus
aggttaccgctatcgtcaagtactg

SEQ ID NO: 535574 - DNA, 25 bp, Mus musculus
aggttagtcagcatgggcccactca

SEQ ID NO: 535575 - DNA, 25 bp, Mus musculus
aggttagtcagcttgggcccactca

SEQ ID NO: 535576 - DNA, 25 bp, Mus musculus
aggttataccaacctttgacatggc

SEQ ID NO: 535577 - DNA, 25 bp, Mus musculus
aggttataccaagctttgacatggc

SEQ ID NO: 535578 - DNA, 25 bp, Mus musculus
aggttatcctcaatggccagctcga

SEQ ID NO: 535579 - DNA, 25 bp, Mus musculus
aggttatcctcattggccagctcga

SEQ ID NO: 535580 - DNA, 25 bp, Mus musculus
aggttcaagaggattcctccagtga

SEQ ID NO: 535581 - DNA, 25 bp, Mus musculus
aggttcaagaggtttcctccagtga

SEQ ID NO: 535582 - DNA, 25 bp, Mus musculus
aggttcagcgcaccgtctctgccaa

SEQ ID NO: 535583 - DNA, 25 bp, Mus musculus
aggttcagcgcagcgtctctgccaa

SEQ ID NO: 535584 - DNA, 25 bp, Mus musculus
aggttccacgagacatgtcaacaca

SEQ ID NO: 535585 - DNA, 25 bp, Mus musculus
aggttccacgagtcatgtcaacaca

SEQ ID NO: 535586 - DNA, 25 bp, Mus musculus
aggttccactcgagcgcagcgccgt

SEQ ID NO: 535587 - DNA, 25 bp, Mus musculus
aggttccactcgtgcgcagcgccgt

SEQ ID NO: 535588 - DNA, 25 bp, Mus musculus
aggttccatgttcggccgaacagac

SEQ ID NO: 535589 - DNA, 25 bp, Mus musculus
aggttccatgttgggccgaacagac

SEQ ID NO: 535590 - DNA, 25 bp, Mus musculus
aggttcccggcacagaaccctgctg

SEQ ID NO: 535591 - DNA, 25 bp, Mus musculus
aggttcccggcagagaaccctgctg

SEQ ID NO: 535592 - DNA, 25 bp, Mus musculus
aggttccctttaacgccctggatcg

SEQ ID NO: 535593 - DNA, 25 bp, Mus musculus
aggttccctttatcgccctggatcg

SEQ ID NO: 535594 - DNA, 25 bp, Mus musculus
aggttccggcggacagccatgtgtt

SEQ ID NO: 535595 - DNA, 25 bp, Mus musculus
aggttccggcggtcagccatgtgtt

SEQ ID NO: 535596 - DNA, 25 bp, Mus musculus
aggttcctggcgagcttatgcagga

SEQ ID NO: 535597 - DNA, 25 bp, Mus musculus
aggttcctggcgtgcttatgcagga

SEQ ID NO: 535598 - DNA, 25 bp, Mus musculus
aggttcgcatcgctgtgagcaaacc

SEQ ID NO: 535599 - DNA, 25 bp, Mus musculus
aggttcgcatcggtgtgagcaaacc

SEQ ID NO: 535600 - DNA, 25 bp, Mus musculus
aggttcggcgtcagcagaaccactg

SEQ ID NO: 535601 - DNA, 25 bp, Mus musculus
aggttcggcgtctgcagaaccactg

SEQ ID NO: 535602 - DNA, 25 bp, Mus musculus
aggttcgggaccatcagggacaaga

SEQ ID NO: 535603 - DNA, 25 bp, Mus musculus
aggttcgggaccttcagggacaaga

SEQ ID NO: 535604 - DNA, 25 bp, Mus musculus
aggttctcaccacttatgtcaggag

SEQ ID NO: 535605 - DNA, 25 bp, Mus musculus
aggttctcaccagttatgtcaggag

SEQ ID NO: 535606 - DNA, 25 bp, Mus musculus
aggttctgaagaagttattaacaag

SEQ ID NO: 535607 - DNA, 25 bp, Mus musculus
aggttctgaagatgttattaacaag

SEQ ID NO: 535608 - DNA, 25 bp, Mus musculus
aggttctgccctatttgtcacagga

SEQ ID NO: 535609 - DNA, 25 bp, Mus musculus
aggttctgccctttttgtcacagga

SEQ ID NO: 535610 - DNA, 25 bp, Mus musculus
aggttctgctgcactgggatgccgc

SEQ ID NO: 535611 - DNA, 25 bp, Mus musculus
aggttctgctgctctgggatgccgc

SEQ ID NO: 535612 - DNA, 25 bp, Mus musculus
aggttctggacactgctgcgatcca

SEQ ID NO: 535613 - DNA, 25 bp, Mus musculus
aggttctggacagtgctgcgatcca

SEQ ID NO: 535614 - DNA, 25 bp, Mus musculus
aggttctggccgcaatgcacgacca

SEQ ID NO: 535615 - DNA, 25 bp, Mus musculus
aggttctggccggaatgcacgacca

SEQ ID NO: 535616 - DNA, 25 bp, Mus musculus
aggttctgggaccagaactgctgct

SEQ ID NO: 535617 - DNA, 25 bp, Mus musculus
aggttctgggacgagaactgctgct

SEQ ID NO: 535618 - DNA, 25 bp, Mus musculus
aggttcttcagcagcttcaggcact

SEQ ID NO: 535619 - DNA, 25 bp, Mus musculus
aggttcttcagctgcttcaggcact

SEQ ID NO: 535620 - DNA, 25 bp, Mus musculus
aggttgaagccaaaaagaaaagact

SEQ ID NO: 535621 - DNA, 25 bp, Mus musculus
aggttgaagccataaagaaaagact

SEQ ID NO: 535622 - DNA, 25 bp, Mus musculus
aggttgacgactcaagaatcacaga

SEQ ID NO: 535623 - DNA, 25 bp, Mus musculus
aggttgacgactgaagaatcacaga

SEQ ID NO: 535624 - DNA, 25 bp, Mus musculus
aggttgaggaagactttggctttga

SEQ ID NO: 535625 - DNA, 25 bp, Mus musculus
aggttgaggaagtctttggctttga

SEQ ID NO: 535626 - DNA, 25 bp, Mus musculus
aggttgcccagtaagctgggtcagt

SEQ ID NO: 535627 - DNA, 25 bp, Mus musculus
aggttgcccagttagctgggtcagt

SEQ ID NO: 535628 - DNA, 25 bp, Mus musculus
aggttgcggagcaccacgaccgtgt

SEQ ID NO: 535629 - DNA, 25 bp, Mus musculus
aggttgcggagctccacgaccgtgt

SEQ ID NO: 535630 - DNA, 25 bp, Mus musculus
aggttgctgcttctgccatcctgac

SEQ ID NO: 535631 - DNA, 25 bp, Mus musculus
aggttgctgcttgtgccatcctgac

SEQ ID NO: 535632 - DNA, 25 bp, Mus musculus
aggttgctgtgtagaagaaactgca

SEQ ID NO: 535633 - DNA, 25 bp, Mus musculus
aggttgctgtgttgaagaaactgca

SEQ ID NO: 535634 - DNA, 25 bp, Mus musculus
aggttggtgtatactggcagactgc

SEQ ID NO: 535635 - DNA, 25 bp, Mus musculus
aggttggtgtattctggcagactgc

SEQ ID NO: 535636 - DNA, 25 bp, Mus musculus
aggttggttcctcctgtgacatgcc

SEQ ID NO: 535637 - DNA, 25 bp, Mus musculus
aggttggttcctgctgtgacatgcc

SEQ ID NO: 535638 - DNA, 25 bp, Mus musculus
aggttgtcttcacaacggtctttct

SEQ ID NO: 535639 - DNA, 25 bp, Mus musculus
aggttgtcttcagaacggtctttct

SEQ ID NO: 535640 - DNA, 25 bp, Mus musculus
aggttgtgatgtcgtggtcatccca

SEQ ID NO: 535641 - DNA, 25 bp, Mus musculus
aggttgtgatgtggtggtcatccca

SEQ ID NO: 535642 - DNA, 25 bp, Mus musculus
aggttgtgcgcaccccttctgagca

SEQ ID NO: 535643 - DNA, 25 bp, Mus musculus
aggttgtgcgcagcccttctgagca

SEQ ID NO: 535644 - DNA, 25 bp, Mus musculus
aggttgtgctgcagctcccctcggc

SEQ ID NO: 535645 - DNA, 25 bp, Mus musculus
aggttgtgctgctgctcccctcggc

SEQ ID NO: 535646 - DNA, 25 bp, Mus musculus
aggttgtggatcagctggccccata

SEQ ID NO: 535647 - DNA, 25 bp, Mus musculus
aggttgtggatctgctggccccata

SEQ ID NO: 535648 - DNA, 25 bp, Mus musculus
aggttgttctcccaacacatctgaa

SEQ ID NO: 535649 - DNA, 25 bp, Mus musculus
aggttgttctccgaacacatctgaa

SEQ ID NO: 535650 - DNA, 25 bp, Mus musculus
aggtttacacctcccaggtggagca

SEQ ID NO: 535651 - DNA, 25 bp, Mus musculus
aggtttacacctgccaggtggagca

SEQ ID NO: 535652 - DNA, 25 bp, Mus musculus
aggtttattgatccagcacattggg

SEQ ID NO: 535653 - DNA, 25 bp, Mus musculus
aggtttattgatgcagcacattggg

SEQ ID NO: 535654 - DNA, 25 bp, Mus musculus
aggtttcagtgccactccagcccgt

SEQ ID NO: 535655 - DNA, 25 bp, Mus musculus
aggtttcagtgcgactccagcccgt

SEQ ID NO: 535656 - DNA, 25 bp, Mus musculus
aggtttctgccaagtctttttccaa

SEQ ID NO: 535657 - DNA, 25 bp, Mus musculus
aggtttctgccatgtctttttccaa

SEQ ID NO: 535658 - DNA, 25 bp, Mus musculus
aggtttctttgcctgtgacttctcc

SEQ ID NO: 535659 - DNA, 25 bp, Mus musculus
aggtttctttgcgtgtgacttctcc

SEQ ID NO: 535660 - DNA, 25 bp, Mus musculus
aggtttgccaaacgcatctcctctg

SEQ ID NO: 535661 - DNA, 25 bp, Mus musculus
aggtttgccaaaggcatctcctctg

SEQ ID NO: 535662 - DNA, 25 bp, Mus musculus
aggtttgctctcagttctgctctgc

SEQ ID NO: 535663 - DNA, 25 bp, Mus musculus
aggtttgctctctgttctgctctgc

SEQ ID NO: 535664 - DNA, 25 bp, Mus musculus
aggtttgtcagacaccagcccggac

SEQ ID NO: 535665 - DNA, 25 bp, Mus musculus
aggtttgtcagagaccagcccggac

SEQ ID NO: 535666 - DNA, 25 bp, Mus musculus
aggtttgtgtgccttccattccagg

SEQ ID NO: 535667 - DNA, 25 bp, Mus musculus
aggtttgtgtgcgttccattccagg

SEQ ID NO: 535668 - DNA, 25 bp, Mus musculus
aggttttccggcagcgcttcaggca

SEQ ID NO: 535669 - DNA, 25 bp, Mus musculus
aggttttccggctgcgcttcaggca

SEQ ID NO: 535670 - DNA, 25 bp, Mus musculus
aggtttttgactaatatccaggaca

SEQ ID NO: 535671 - DNA, 25 bp, Mus musculus
aggtttttgacttatatccaggaca

SEQ ID NO: 535672 - DNA, 25 bp, Mus musculus
agtaaaagacatccaaagtgtgtat

SEQ ID NO: 535673 - DNA, 25 bp, Mus musculus
agtaaaagacatgcaaagtgtgtat

SEQ ID NO: 535674 - DNA, 25 bp, Mus musculus
agtaaacaaatgatcctcctccgca

SEQ ID NO: 535675 - DNA, 25 bp, Mus musculus
agtaaacaaatgttcctcctccgca

SEQ ID NO: 535676 - DNA, 25 bp, Mus musculus
agtaaactgggcaacaacaccaagt

SEQ ID NO: 535677 - DNA, 25 bp, Mus musculus
agtaaactgggctacaacaccaagt

SEQ ID NO: 535678 - DNA, 25 bp, Mus musculus
agtaaagaagacactgaacatctga

SEQ ID NO: 535679 - DNA, 25 bp, Mus musculus
agtaaagaagactctgaacatctga

SEQ ID NO: 535680 - DNA, 25 bp, Mus musculus
agtaaagacagcactggcaccaagc

SEQ ID NO: 535681 - DNA, 25 bp, Mus musculus
agtaaagacagctctggcaccaagc

SEQ ID NO: 535682 - DNA, 25 bp, Mus musculus
agtaaagagcacctagcatcgggcc

SEQ ID NO: 535683 - DNA, 25 bp, Mus musculus
agtaaagagcacgtagcatcgggcc

SEQ ID NO: 535684 - DNA, 25 bp, Mus musculus
agtaaagctctacaagaatgctcgg

SEQ ID NO: 535685 - DNA, 25 bp, Mus musculus
agtaaagctctagaagaatgctcgg

SEQ ID NO: 535686 - DNA, 25 bp, Mus musculus
agtaaaggtatcaaacaaaagcaga

SEQ ID NO: 535687 - DNA, 25 bp, Mus musculus
agtaaaggtatctaacaaaagcaga

SEQ ID NO: 535688 - DNA, 25 bp, Mus musculus
agtaaatcacaccagaagttgggaa

SEQ ID NO: 535689 - DNA, 25 bp, Mus musculus
agtaaatcacacgagaagttgggaa

SEQ ID NO: 535690 - DNA, 25 bp, Mus musculus
agtaaatccatccaggaagtcctcg

SEQ ID NO: 535691 - DNA, 25 bp, Mus musculus
agtaaatccatcgaggaagtcctcg

SEQ ID NO: 535692 - DNA, 25 bp, Mus musculus
agtaaatcttaaaatcaaggcaggg

SEQ ID NO: 535693 - DNA, 25 bp, Mus musculus
agtaaatcttaatatcaaggcaggg

SEQ ID NO: 535694 - DNA, 25 bp, Mus musculus
agtaaatggagccaggattccagcc

SEQ ID NO: 535695 - DNA, 25 bp, Mus musculus
agtaaatggagcgaggattccagcc

SEQ ID NO: 535696 - DNA, 25 bp, Mus musculus
agtaaatggtgtcactgcagcactg

SEQ ID NO: 535697 - DNA, 25 bp, Mus musculus
agtaaatggtgtgactgcagcactg

SEQ ID NO: 535698 - DNA, 25 bp, Mus musculus
agtaaattccatctcaacaagctac

SEQ ID NO: 535699 - DNA, 25 bp, Mus musculus
agtaaattccatgtcaacaagctac

SEQ ID NO: 535700 - DNA, 25 bp, Mus musculus
agtaacaaattgcagtccctcccag

SEQ ID NO: 535701 - DNA, 25 bp, Mus musculus
agtaacaaattggagtccctcccag

SEQ ID NO: 535702 - DNA, 25 bp, Mus musculus
agtaacaatacaaccaggcagtggt

SEQ ID NO: 535703 - DNA, 25 bp, Mus musculus
agtaacaatacatccaggcagtggt

SEQ ID NO: 535704 - DNA, 25 bp, Mus musculus
agtaacatgctgatccagtgctccc

SEQ ID NO: 535705 - DNA, 25 bp, Mus musculus
agtaacatgctgttccagtgctccc

SEQ ID NO: 535706 - DNA, 25 bp, Mus musculus
agtaactcgctacgcccggttgcct

SEQ ID NO: 535707 - DNA, 25 bp, Mus musculus
agtaactcgctaggcccggttgcct

SEQ ID NO: 535708 - DNA, 25 bp, Mus musculus
agtaactctggtcacttctcgccac

SEQ ID NO: 535709 - DNA, 25 bp, Mus musculus
agtaactctggtgacttctcgccac

SEQ ID NO: 535710 - DNA, 25 bp, Mus musculus
agtaactggaggaggcttgtgtatc

SEQ ID NO: 535711 - DNA, 25 bp, Mus musculus
agtaactggaggtggcttgtgtatc

SEQ ID NO: 535712 - DNA, 25 bp, Mus musculus
agtaactgtgagctgcctcggccca

SEQ ID NO: 535713 - DNA, 25 bp, Mus musculus
agtaactgtgaggtgcctcggccca

SEQ ID NO: 535714 - DNA, 25 bp, Mus musculus
agtaagaccacaccagccatctcag

SEQ ID NO: 535715 - DNA, 25 bp, Mus musculus
agtaagaccacagcagccatctcag

SEQ ID NO: 535716 - DNA, 25 bp, Mus musculus
agtaagactttcagccgggctcaga

SEQ ID NO: 535717 - DNA, 25 bp, Mus musculus
agtaagactttctgccgggctcaga

SEQ ID NO: 535718 - DNA, 25 bp, Mus musculus
agtaagcaatccactaaccctgctg

SEQ ID NO: 535719 - DNA, 25 bp, Mus musculus
agtaagcaatcctctaaccctgctg

SEQ ID NO: 535720 - DNA, 25 bp, Mus musculus
agtaagccctatctcagggtgacta

SEQ ID NO: 535721 - DNA, 25 bp, Mus musculus
agtaagccctatgtcagggtgacta

SEQ ID NO: 535722 - DNA, 25 bp, Mus musculus
agtaaggcctctactgattcccagg

SEQ ID NO: 535723 - DNA, 25 bp, Mus musculus
agtaaggcctcttctgattcccagg

SEQ ID NO: 535724 - DNA, 25 bp, Mus musculus
agtaagtagcggctccctcgagccc

SEQ ID NO: 535725 - DNA, 25 bp, Mus musculus
agtaagtagcgggtccctcgagccc

SEQ ID NO: 535726 - DNA, 25 bp, Mus musculus
agtaagtccctgagtcattgggatt

SEQ ID NO: 535727 - DNA, 25 bp, Mus musculus
agtaagtccctgtgtcattgggatt

SEQ ID NO: 535728 - DNA, 25 bp, Mus musculus
agtaagtgccctactcatgttagag

SEQ ID NO: 535729 - DNA, 25 bp, Mus musculus
agtaagtgcccttctcatgttagag

SEQ ID NO: 535730 - DNA, 25 bp, Mus musculus
agtaagtgtggcagcactcccagga

SEQ ID NO: 535731 - DNA, 25 bp, Mus musculus
agtaagtgtggctgcactcccagga

SEQ ID NO: 535732 - DNA, 25 bp, Mus musculus
agtaatacaacaccgggaagatgga

SEQ ID NO: 535733 - DNA, 25 bp, Mus musculus
agtaatacaacagcgggaagatgga

SEQ ID NO: 535734 - DNA, 25 bp, Mus musculus
agtaatctccatctcccacaggcag

SEQ ID NO: 535735 - DNA, 25 bp, Mus musculus
agtaatctccatgtcccacaggcag

SEQ ID NO: 535736 - DNA, 25 bp, Mus musculus
agtaatgatgaacaccccaagacac

SEQ ID NO: 535737 - DNA, 25 bp, Mus musculus
agtaatgatgaagaccccaagacac

SEQ ID NO: 535738 - DNA, 25 bp, Mus musculus
agtaatggacaaatgggccagcctc

SEQ ID NO: 535739 - DNA, 25 bp, Mus musculus
agtaatggacaattgggccagcctc

SEQ ID NO: 535740 - DNA, 25 bp, Mus musculus
agtaatttctctatcccaaaagcca

SEQ ID NO: 535741 - DNA, 25 bp, Mus musculus
agtaatttctctttcccaaaagcca

SEQ ID NO: 535742 - DNA, 25 bp, Mus musculus
agtacaaagcctactaaatccttag

SEQ ID NO: 535743 - DNA, 25 bp, Mus musculus
agtacaaagccttctaaatccttag

SEQ ID NO: 535744 - DNA, 25 bp, Mus musculus
agtacaaaggacaggcagtggctgt

SEQ ID NO: 535745 - DNA, 25 bp, Mus musculus
agtacaaaggactggcagtggctgt

SEQ ID NO: 535746 - DNA, 25 bp, Mus musculus
agtacaacccctatgcttggaacct

SEQ ID NO: 535747 - DNA, 25 bp, Mus musculus
agtacaacccctttgcttggaacct

SEQ ID NO: 535748 - DNA, 25 bp, Mus musculus
agtacaacgccaagctggacacacg

SEQ ID NO: 535749 - DNA, 25 bp, Mus musculus
agtacaacgccatgctggacacacg

SEQ ID NO: 535750 - DNA, 25 bp, Mus musculus
agtacaagatagagtacggtttggg

SEQ ID NO: 535751 - DNA, 25 bp, Mus musculus
agtacaagatagtgtacggtttggg

SEQ ID NO: 535752 - DNA, 25 bp, Mus musculus
agtacaagttgtagcaggacagcag

SEQ ID NO: 535753 - DNA, 25 bp, Mus musculus
agtacaagttgttgcaggacagcag

SEQ ID NO: 535754 - DNA, 25 bp, Mus musculus
agtacacacacaaccagcttttctt

SEQ ID NO: 535755 - DNA, 25 bp, Mus musculus
agtacacacacatccagcttttctt

SEQ ID NO: 535756 - DNA, 25 bp, Mus musculus
agtacacaggctacgggaatgctgc

SEQ ID NO: 535757 - DNA, 25 bp, Mus musculus
agtacacaggcttcgggaatgctgc

SEQ ID NO: 535758 - DNA, 25 bp, Mus musculus
agtacacattaccatcagaccctgg

SEQ ID NO: 535759 - DNA, 25 bp, Mus musculus
agtacacattacgatcagaccctgg

SEQ ID NO: 535760 - DNA, 25 bp, Mus musculus
agtacacatttgcagcccacatgga

SEQ ID NO: 535761 - DNA, 25 bp, Mus musculus
agtacacatttggagcccacatgga

SEQ ID NO: 535762 - DNA, 25 bp, Mus musculus
agtacaccaccaacgggcggatgga

SEQ ID NO: 535763 - DNA, 25 bp, Mus musculus
agtacaccaccatcgggcggatgga

SEQ ID NO: 535764 - DNA, 25 bp, Mus musculus
agtacaccacgcagctgagcctggg

SEQ ID NO: 535765 - DNA, 25 bp, Mus musculus
agtacaccacgctgctgagcctggg

SEQ ID NO: 535766 - DNA, 25 bp, Mus musculus
agtacacctgccagccatgccggga

SEQ ID NO: 535767 - DNA, 25 bp, Mus musculus
agtacacctgcctgccatgccggga

SEQ ID NO: 535768 - DNA, 25 bp, Mus musculus
agtacacctggaactgcacactcac

SEQ ID NO: 535769 - DNA, 25 bp, Mus musculus
agtacacctggatctgcacactcac

SEQ ID NO: 535770 - DNA, 25 bp, Mus musculus
agtacacggccaagatcgcactgct

SEQ ID NO: 535771 - DNA, 25 bp, Mus musculus
agtacacggccatgatcgcactgct

SEQ ID NO: 535772 - DNA, 25 bp, Mus musculus
agtacacggctgacgggaaagaagt

SEQ ID NO: 535773 - DNA, 25 bp, Mus musculus
agtacacggctgtcgggaaagaagt

SEQ ID NO: 535774 - DNA, 25 bp, Mus musculus
agtacagatcgtcttcaagaacccc

SEQ ID NO: 535775 - DNA, 25 bp, Mus musculus
agtacagatcgtgttcaagaacccc

SEQ ID NO: 535776 - DNA, 25 bp, Mus musculus
agtacagcaacaaagaggagttcgc

SEQ ID NO: 535777 - DNA, 25 bp, Mus musculus
agtacagcaacatagaggagttcgc

SEQ ID NO: 535778 - DNA, 25 bp, Mus musculus
agtacagcctcaagtcccactcgag

SEQ ID NO: 535779 - DNA, 25 bp, Mus musculus
agtacagcctcatgtcccactcgag

SEQ ID NO: 535780 - DNA, 25 bp, Mus musculus
agtacagcctggagcaccagctgcc

SEQ ID NO: 535781 - DNA, 25 bp, Mus musculus
agtacagcctggtgcaccagctgcc

SEQ ID NO: 535782 - DNA, 25 bp, Mus musculus
agtacagcgccaaagactacttctt

SEQ ID NO: 535783 - DNA, 25 bp, Mus musculus
agtacagcgccatagactacttctt

SEQ ID NO: 535784 - DNA, 25 bp, Mus musculus
agtacagctataagtgtgacaacgg

SEQ ID NO: 535785 - DNA, 25 bp, Mus musculus
agtacagctatatgtgtgacaacgg

SEQ ID NO: 535786 - DNA, 25 bp, Mus musculus
agtacaggacgtcgccagtgccctg

SEQ ID NO: 535787 - DNA, 25 bp, Mus musculus
agtacaggacgtggccagtgccctg

SEQ ID NO: 535788 - DNA, 25 bp, Mus musculus
agtacagtcaacacctctcaggatg

SEQ ID NO: 535789 - DNA, 25 bp, Mus musculus
agtacagtcaactcctctcaggatg

SEQ ID NO: 535790 - DNA, 25 bp, Mus musculus
agtacagttgaccaaaagcgtgcca

SEQ ID NO: 535791 - DNA, 25 bp, Mus musculus
agtacagttgacgaaaagcgtgcca

SEQ ID NO: 535792 - DNA, 25 bp, Mus musculus
agtacatccctaacgggcggccatg

SEQ ID NO: 535793 - DNA, 25 bp, Mus musculus
agtacatccctatcgggcggccatg

SEQ ID NO: 535794 - DNA, 25 bp, Mus musculus
agtacatctcggattttcctcttaa

SEQ ID NO: 535795 - DNA, 25 bp, Mus musculus
agtacatctcggtttttcctcttaa

SEQ ID NO: 535796 - DNA, 25 bp, Mus musculus
agtacatgaaccacctcaccgtgca

SEQ ID NO: 535797 - DNA, 25 bp, Mus musculus
agtacatgaacctcctcaccgtgca

SEQ ID NO: 535798 - DNA, 25 bp, Mus musculus
agtacatgaagaacaggcctgctct

SEQ ID NO: 535799 - DNA, 25 bp, Mus musculus
agtacatgaagatcaggcctgctct

SEQ ID NO: 535800 - DNA, 25 bp, Mus musculus
agtacatggacaagcaccctggagg

SEQ ID NO: 535801 - DNA, 25 bp, Mus musculus
agtacatggacatgcaccctggagg

SEQ ID NO: 535802 - DNA, 25 bp, Mus musculus
agtacatggagtatgatctgaatgg

SEQ ID NO: 535803 - DNA, 25 bp, Mus musculus
agtacatggagtttgatctgaatgg

SEQ ID NO: 535804 - DNA, 25 bp, Mus musculus
agtaccaagggtcgcatctctcttc

SEQ ID NO: 535805 - DNA, 25 bp, Mus musculus
agtaccaagggtggcatctctcttc

SEQ ID NO: 535806 - DNA, 25 bp, Mus musculus
agtaccacacttccttttttccagt

SEQ ID NO: 535807 - DNA, 25 bp, Mus musculus
agtaccacacttgcttttttccagt

SEQ ID NO: 535808 - DNA, 25 bp, Mus musculus
agtaccaccttcaccgaattccgag

SEQ ID NO: 535809 - DNA, 25 bp, Mus musculus
agtaccaccttctccgaattccgag

SEQ ID NO: 535810 - DNA, 25 bp, Mus musculus
agtaccacgggaccctggtgctaca

SEQ ID NO: 535811 - DNA, 25 bp, Mus musculus
agtaccacgggagcctggtgctaca

SEQ ID NO: 535812 - DNA, 25 bp, Mus musculus
agtaccactgtgagtgccgcagcgg

SEQ ID NO: 535813 - DNA, 25 bp, Mus musculus
agtaccactgtgtgtgccgcagcgg

SEQ ID NO: 535814 - DNA, 25 bp, Mus musculus
agtaccagaaggctatcgacatcta

SEQ ID NO: 535815 - DNA, 25 bp, Mus musculus
agtaccagaagggtatcgacatcta

SEQ ID NO: 535816 - DNA, 25 bp, Mus musculus
agtaccagcaacagacattgctgaa

SEQ ID NO: 535817 - DNA, 25 bp, Mus musculus
agtaccagcaactgacattgctgaa

SEQ ID NO: 535818 - DNA, 25 bp, Mus musculus
agtaccaggacaagagccgcgaata

SEQ ID NO: 535819 - DNA, 25 bp, Mus musculus
agtaccaggacatgagccgcgaata

SEQ ID NO: 535820 - DNA, 25 bp, Mus musculus
agtaccattttgaaagcaaccagag

SEQ ID NO: 535821 - DNA, 25 bp, Mus musculus
agtaccattttgtaagcaaccagag

SEQ ID NO: 535822 - DNA, 25 bp, Mus musculus
agtacccaagtgagcgcctaatcca

SEQ ID NO: 535823 - DNA, 25 bp, Mus musculus
agtacccaagtgtgcgcctaatcca

SEQ ID NO: 535824 - DNA, 25 bp, Mus musculus
agtacccagaagagctcctcgtgcg

SEQ ID NO: 535825 - DNA, 25 bp, Mus musculus
agtacccagaagtgctcctcgtgcg

SEQ ID NO: 535826 - DNA, 25 bp, Mus musculus
agtacccagctgagccttcttccag

SEQ ID NO: 535827 - DNA, 25 bp, Mus musculus
agtacccagctgtgccttcttccag

SEQ ID NO: 535828 - DNA, 25 bp, Mus musculus
agtacccatacacacacttgccatg

SEQ ID NO: 535829 - DNA, 25 bp, Mus musculus
agtacccatacagacacttgccatg

SEQ ID NO: 535830 - DNA, 25 bp, Mus musculus
agtacccggttcctcggcgacagtg

SEQ ID NO: 535831 - DNA, 25 bp, Mus musculus
agtacccggttcgtcggcgacagtg

SEQ ID NO: 535832 - DNA, 25 bp, Mus musculus
agtacccgtgaccactttatcccat

SEQ ID NO: 535833 - DNA, 25 bp, Mus musculus
agtacccgtgacgactttatcccat

SEQ ID NO: 535834 - DNA, 25 bp, Mus musculus
agtaccgaccacctggaggacctga

SEQ ID NO: 535835 - DNA, 25 bp, Mus musculus
agtaccgaccacgtggaggacctga

SEQ ID NO: 535836 - DNA, 25 bp, Mus musculus
agtaccgaggcgaggccagcaccgc

SEQ ID NO: 535837 - DNA, 25 bp, Mus musculus
agtaccgaggcgtggccagcaccgc

SEQ ID NO: 535838 - DNA, 25 bp, Mus musculus
agtaccgctagaagctgctggcgga

SEQ ID NO: 535839 - DNA, 25 bp, Mus musculus
agtaccgctagatgctgctggcgga

SEQ ID NO: 535840 - DNA, 25 bp, Mus musculus
agtaccgctctcaccggacgacaag

SEQ ID NO: 535841 - DNA, 25 bp, Mus musculus
agtaccgctctctccggacgacaag

SEQ ID NO: 535842 - DNA, 25 bp, Mus musculus
agtaccgctggcacatcaacttcac

SEQ ID NO: 535843 - DNA, 25 bp, Mus musculus
agtaccgctggctcatcaacttcac

SEQ ID NO: 535844 - DNA, 25 bp, Mus musculus
agtaccgggaatatgctgacagttt

SEQ ID NO: 535845 - DNA, 25 bp, Mus musculus
agtaccgggaatttgctgacagttt

SEQ ID NO: 535846 - DNA, 25 bp, Mus musculus
agtaccgtggtaccggcgctctcct

SEQ ID NO: 535847 - DNA, 25 bp, Mus musculus
agtaccgtggtagcggcgctctcct

SEQ ID NO: 535848 - DNA, 25 bp, Mus musculus
agtaccgtgtgacgaaattcttggc

SEQ ID NO: 535849 - DNA, 25 bp, Mus musculus
agtaccgtgtgaggaaattcttggc

SEQ ID NO: 535850 - DNA, 25 bp, Mus musculus
agtaccgttgtcagcacacagcgtt

SEQ ID NO: 535851 - DNA, 25 bp, Mus musculus
agtaccgttgtctgcacacagcgtt

SEQ ID NO: 535852 - DNA, 25 bp, Mus musculus
agtacctaacccatcttggatgcaa

SEQ ID NO: 535853 - DNA, 25 bp, Mus musculus
agtacctaacccttcttggatgcaa

SEQ ID NO: 535854 - DNA, 25 bp, Mus musculus
agtacctaagtcctggcaccacaaa

SEQ ID NO: 535855 - DNA, 25 bp, Mus musculus
agtacctaagtcgtggcaccacaaa

SEQ ID NO: 535856 - DNA, 25 bp, Mus musculus
agtacctcaaccacagaaactgtta

SEQ ID NO: 535857 - DNA, 25 bp, Mus musculus
agtacctcaacctcagaaactgtta

SEQ ID NO: 535858 - DNA, 25 bp, Mus musculus
agtacctcatgtacgccttcaacct

SEQ ID NO: 535859 - DNA, 25 bp, Mus musculus
agtacctcatgttcgccttcaacct

SEQ ID NO: 535860 - DNA, 25 bp, Mus musculus
agtacctccgcaagcgctttggtgg

SEQ ID NO: 535861 - DNA, 25 bp, Mus musculus
agtacctccgcatgcgctttggtgg

SEQ ID NO: 535862 - DNA, 25 bp, Mus musculus
agtacctcggatccactttatgtgg

SEQ ID NO: 535863 - DNA, 25 bp, Mus musculus
agtacctcggatgcactttatgtgg

SEQ ID NO: 535864 - DNA, 25 bp, Mus musculus
agtacctgatccagcacgactccga

SEQ ID NO: 535865 - DNA, 25 bp, Mus musculus
agtacctgatcctgcacgactccga

SEQ ID NO: 535866 - DNA, 25 bp, Mus musculus
agtacctgctctatacctacaactg

SEQ ID NO: 535867 - DNA, 25 bp, Mus musculus
agtacctgctctttacctacaactg

SEQ ID NO: 535868 - DNA, 25 bp, Mus musculus
agtacctggagaagagacccacatg

SEQ ID NO: 535869 - DNA, 25 bp, Mus musculus
agtacctggagatgagacccacatg

SEQ ID NO: 535870 - DNA, 25 bp, Mus musculus
agtacctggcttcggagttccagag

SEQ ID NO: 535871 - DNA, 25 bp, Mus musculus
agtacctggcttgggagttccagag

SEQ ID NO: 535872 - DNA, 25 bp, Mus musculus
agtacctgtgctcctaccgcttgcg

SEQ ID NO: 535873 - DNA, 25 bp, Mus musculus
agtacctgtgctgctaccgcttgcg

SEQ ID NO: 535874 - DNA, 25 bp, Mus musculus
agtaccttcaccatccgggtgacag

SEQ ID NO: 535875 - DNA, 25 bp, Mus musculus
agtaccttcaccttccgggtgacag

SEQ ID NO: 535876 - DNA, 25 bp, Mus musculus
agtacgaagtccagcctagcctcat

SEQ ID NO: 535877 - DNA, 25 bp, Mus musculus
agtacgaagtcctgcctagcctcat

SEQ ID NO: 535878 - DNA, 25 bp, Mus musculus
agtacgaatgctcctgcacacctgg

SEQ ID NO: 535879 - DNA, 25 bp, Mus musculus
agtacgaatgctgctgcacacctgg

SEQ ID NO: 535880 - DNA, 25 bp, Mus musculus
agtacgaccttacttgggaccagca

SEQ ID NO: 535881 - DNA, 25 bp, Mus musculus
agtacgaccttagttgggaccagca

SEQ ID NO: 535882 - DNA, 25 bp, Mus musculus
agtacgcagccaagggcaatctccg

SEQ ID NO: 535883 - DNA, 25 bp, Mus musculus
agtacgcagccatgggcaatctccg

SEQ ID NO: 535884 - DNA, 25 bp, Mus musculus
agtacgctactgaggccaccagaag

SEQ ID NO: 535885 - DNA, 25 bp, Mus musculus
agtacgctactgtggccaccagaag

SEQ ID NO: 535886 - DNA, 25 bp, Mus musculus
agtacgggctgactgaagctgacat

SEQ ID NO: 535887 - DNA, 25 bp, Mus musculus
agtacgggctgagtgaagctgacat

SEQ ID NO: 535888 - DNA, 25 bp, Mus musculus
agtacggtgcttcttgctgcgtcca

SEQ ID NO: 535889 - DNA, 25 bp, Mus musculus
agtacggtgcttgttgctgcgtcca

SEQ ID NO: 535890 - DNA, 25 bp, Mus musculus
agtacgtggagaccttcacccaggg

SEQ ID NO: 535891 - DNA, 25 bp, Mus musculus
agtacgtggagagcttcacccaggg

SEQ ID NO: 535892 - DNA, 25 bp, Mus musculus
agtacgtggatgaggtttttgccaa

SEQ ID NO: 535893 - DNA, 25 bp, Mus musculus
agtacgtggatgtggtttttgccaa

SEQ ID NO: 535894 - DNA, 25 bp, Mus musculus
agtacgtgggtaaccggctcctagt

SEQ ID NO: 535895 - DNA, 25 bp, Mus musculus
agtacgtgggtatccggctcctagt

SEQ ID NO: 535896 - DNA, 25 bp, Mus musculus
agtactacagcccagtgtccctgag

SEQ ID NO: 535897 - DNA, 25 bp, Mus musculus
agtactacagccgagtgtccctgag

SEQ ID NO: 535898 - DNA, 25 bp, Mus musculus
agtactacgtccactgcaataacag

SEQ ID NO: 535899 - DNA, 25 bp, Mus musculus
agtactacgtcctctgcaataacag

SEQ ID NO: 535900 - DNA, 25 bp, Mus musculus
agtactataaggagaacaatgtgga

SEQ ID NO: 535901 - DNA, 25 bp, Mus musculus
agtactataaggtgaacaatgtgga

SEQ ID NO: 535902 - DNA, 25 bp, Mus musculus
agtactattaatcctgtagatgcaa

SEQ ID NO: 535903 - DNA, 25 bp, Mus musculus
agtactattaatgctgtagatgcaa

SEQ ID NO: 535904 - DNA, 25 bp, Mus musculus
agtactcctgcaaggtgggccacga

SEQ ID NO: 535905 - DNA, 25 bp, Mus musculus
agtactcctgcatggtgggccacga

SEQ ID NO: 535906 - DNA, 25 bp, Mus musculus
agtactcttcctctaccagcgacgg

SEQ ID NO: 535907 - DNA, 25 bp, Mus musculus
agtactcttcctgtaccagcgacgg

SEQ ID NO: 535908 - DNA, 25 bp, Mus musculus
agtactgacagtcaacaacaaagcc

SEQ ID NO: 535909 - DNA, 25 bp, Mus musculus
agtactgacagtgaacaacaaagcc

SEQ ID NO: 535910 - DNA, 25 bp, Mus musculus
agtactgcattgagctgagccaggc

SEQ ID NO: 535911 - DNA, 25 bp, Mus musculus
agtactgcattgtgctgagccaggc

SEQ ID NO: 535912 - DNA, 25 bp, Mus musculus
agtactgccgggaacaagaaactgc

SEQ ID NO: 535913 - DNA, 25 bp, Mus musculus
agtactgccgggtacaagaaactgc

SEQ ID NO: 535914 - DNA, 25 bp, Mus musculus
agtactgctataaccccagccacaa

SEQ ID NO: 535915 - DNA, 25 bp, Mus musculus
agtactgctatatccccagccacaa

SEQ ID NO: 535916 - DNA, 25 bp, Mus musculus
agtactgtcaccagaagttcattgt

SEQ ID NO: 535917 - DNA, 25 bp, Mus musculus
agtactgtcacctgaagttcattgt

SEQ ID NO: 535918 - DNA, 25 bp, Mus musculus
agtacttaacccctatgcgccagga

SEQ ID NO: 535919 - DNA, 25 bp, Mus musculus
agtacttaacccgtatgcgccagga

SEQ ID NO: 535920 - DNA, 25 bp, Mus musculus
agtacttaatgccaaaacgagaatc

SEQ ID NO: 535921 - DNA, 25 bp, Mus musculus
agtacttaatgcgaaaacgagaatc

SEQ ID NO: 535922 - DNA, 25 bp, Mus musculus
agtacttacagcagcgtccagcgtg

SEQ ID NO: 535923 - DNA, 25 bp, Mus musculus
agtacttacagctgcgtccagcgtg

SEQ ID NO: 535924 - DNA, 25 bp, Mus musculus
agtacttccaaacaatgaccacaac

SEQ ID NO: 535925 - DNA, 25 bp, Mus musculus
agtacttccaaagaatgaccacaac

SEQ ID NO: 535926 - DNA, 25 bp, Mus musculus
agtacttcctgcaaggcatgggcta

SEQ ID NO: 535927 - DNA, 25 bp, Mus musculus
agtacttcctgctaggcatgggcta

SEQ ID NO: 535928 - DNA, 25 bp, Mus musculus
agtacttcctggagcccatgcttcc

SEQ ID NO: 535929 - DNA, 25 bp, Mus musculus
agtacttcctggtgcccatgcttcc

SEQ ID NO: 535930 - DNA, 25 bp, Mus musculus
agtacttgacgcatgtcagtcccag

SEQ ID NO: 535931 - DNA, 25 bp, Mus musculus
agtacttgacgcttgtcagtcccag

SEQ ID NO: 535932 - DNA, 25 bp, Mus musculus
agtacttgcataacttgctgagtgg

SEQ ID NO: 535933 - DNA, 25 bp, Mus musculus
agtacttgcatatcttgctgagtgg

SEQ ID NO: 535934 - DNA, 25 bp, Mus musculus
agtacttgctaaacctggtcctccc

SEQ ID NO: 535935 - DNA, 25 bp, Mus musculus
agtacttgctaatcctggtcctccc

SEQ ID NO: 535936 - DNA, 25 bp, Mus musculus
agtacttgtcaacactgcagaagag

SEQ ID NO: 535937 - DNA, 25 bp, Mus musculus
agtacttgtcaagactgcagaagag

SEQ ID NO: 535938 - DNA, 25 bp, Mus musculus
agtactttggcgcagtttcagcgct

SEQ ID NO: 535939 - DNA, 25 bp, Mus musculus
agtactttggcggagtttcagcgct

SEQ ID NO: 535940 - DNA, 25 bp, Mus musculus
agtacttttatgaccaatgtccagc

SEQ ID NO: 535941 - DNA, 25 bp, Mus musculus
agtacttttatgtccaatgtccagc

SEQ ID NO: 535942 - DNA, 25 bp, Mus musculus
agtactttttgcagggaatgggcta

SEQ ID NO: 535943 - DNA, 25 bp, Mus musculus
agtactttttgctgggaatgggcta

SEQ ID NO: 535944 - DNA, 25 bp, Mus musculus
agtagaaccagcctcaagaacgccc

SEQ ID NO: 535945 - DNA, 25 bp, Mus musculus
agtagaaccagcgtcaagaacgccc

SEQ ID NO: 535946 - DNA, 25 bp, Mus musculus
agtagaactcccagccctcagctgt

SEQ ID NO: 535947 - DNA, 25 bp, Mus musculus
agtagaactccctgccctcagctgt

SEQ ID NO: 535948 - DNA, 25 bp, Mus musculus
agtagaagatgtcgtcgttagtgac

SEQ ID NO: 535949 - DNA, 25 bp, Mus musculus
agtagaagatgtggtcgttagtgac

SEQ ID NO: 535950 - DNA, 25 bp, Mus musculus
agtagacatgttcctgtgtcttcca

SEQ ID NO: 535951 - DNA, 25 bp, Mus musculus
agtagacatgttgctgtgtcttcca

SEQ ID NO: 535952 - DNA, 25 bp, Mus musculus
agtagacgccaaacctattatttgg

SEQ ID NO: 535953 - DNA, 25 bp, Mus musculus
agtagacgccaatcctattatttgg

SEQ ID NO: 535954 - DNA, 25 bp, Mus musculus
agtagacggccgagacacctatgag

SEQ ID NO: 535955 - DNA, 25 bp, Mus musculus
agtagacggccgtgacacctatgag

SEQ ID NO: 535956 - DNA, 25 bp, Mus musculus
agtagactatctcagctccctgggc

SEQ ID NO: 535957 - DNA, 25 bp, Mus musculus
agtagactatctgagctccctgggc

SEQ ID NO: 535958 - DNA, 25 bp, Mus musculus
agtagagcctgcaaacaagtttgcc

SEQ ID NO: 535959 - DNA, 25 bp, Mus musculus
agtagagcctgctaacaagtttgcc

SEQ ID NO: 535960 - DNA, 25 bp, Mus musculus
agtagagggctcaccgatgcatggt

SEQ ID NO: 535961 - DNA, 25 bp, Mus musculus
agtagagggctctccgatgcatggt

SEQ ID NO: 535962 - DNA, 25 bp, Mus musculus
agtagagtccatccaggccgaggat

SEQ ID NO: 535963 - DNA, 25 bp, Mus musculus
agtagagtccatgcaggccgaggat

SEQ ID NO: 535964 - DNA, 25 bp, Mus musculus
agtagataatgccatcaccaagtcg

SEQ ID NO: 535965 - DNA, 25 bp, Mus musculus
agtagataatgcgatcaccaagtcg

SEQ ID NO: 535966 - DNA, 25 bp, Mus musculus
agtagatgactactgtagaggaaga

SEQ ID NO: 535967 - DNA, 25 bp, Mus musculus
agtagatgactagtgtagaggaaga

SEQ ID NO: 535968 - DNA, 25 bp, Mus musculus
agtagattggcaaaatataggacac

SEQ ID NO: 535969 - DNA, 25 bp, Mus musculus
agtagattggcataatataggacac

SEQ ID NO: 535970 - DNA, 25 bp, Mus musculus
agtagcacgctcatcaccatggata

SEQ ID NO: 535971 - DNA, 25 bp, Mus musculus
agtagcacgctcttcaccatggata

SEQ ID NO: 535972 - DNA, 25 bp, Mus musculus
agtagcagccgtagcctttgggaag

SEQ ID NO: 535973 - DNA, 25 bp, Mus musculus
agtagcagccgttgcctttgggaag

SEQ ID NO: 535974 - DNA, 25 bp, Mus musculus
agtagcagggcaaggcatttcgtcc

SEQ ID NO: 535975 - DNA, 25 bp, Mus musculus
agtagcagggcatggcatttcgtcc

SEQ ID NO: 535976 - DNA, 25 bp, Mus musculus
agtagccagaaaaaagatacttcca

SEQ ID NO: 535977 - DNA, 25 bp, Mus musculus
agtagccagaaataagatacttcca

SEQ ID NO: 535978 - DNA, 25 bp, Mus musculus
agtagccgatgacgccacaggtgcc

SEQ ID NO: 535979 - DNA, 25 bp, Mus musculus
agtagccgatgaggccacaggtgcc

SEQ ID NO: 535980 - DNA, 25 bp, Mus musculus
agtagccgcgcgaaggctgagacaa

SEQ ID NO: 535981 - DNA, 25 bp, Mus musculus
agtagccgcgcgtaggctgagacaa

SEQ ID NO: 535982 - DNA, 25 bp, Mus musculus
agtagcctccttctagttcatcccg

SEQ ID NO: 535983 - DNA, 25 bp, Mus musculus
agtagcctccttgtagttcatcccg

SEQ ID NO: 535984 - DNA, 25 bp, Mus musculus
agtagcctgtcacaagtacttcgag

SEQ ID NO: 535985 - DNA, 25 bp, Mus musculus
agtagcctgtcagaagtacttcgag

SEQ ID NO: 535986 - DNA, 25 bp, Mus musculus
agtagccttcccacatacggaccag

SEQ ID NO: 535987 - DNA, 25 bp, Mus musculus
agtagccttccctcatacggaccag

SEQ ID NO: 535988 - DNA, 25 bp, Mus musculus
agtagcgagcgacaagctagagacc

SEQ ID NO: 535989 - DNA, 25 bp, Mus musculus
agtagcgagcgagaagctagagacc

SEQ ID NO: 535990 - DNA, 25 bp, Mus musculus
agtagcggtaggcttcttgctccca

SEQ ID NO: 535991 - DNA, 25 bp, Mus musculus
agtagcggtagggttcttgctccca

SEQ ID NO: 535992 - DNA, 25 bp, Mus musculus
agtagcgttttcctgagtggctttg

SEQ ID NO: 535993 - DNA, 25 bp, Mus musculus
agtagcgttttcgtgagtggctttg

SEQ ID NO: 535994 - DNA, 25 bp, Mus musculus
agtagctgccgaaagcccaggatgt

SEQ ID NO: 535995 - DNA, 25 bp, Mus musculus
agtagctgccgatagcccaggatgt

SEQ ID NO: 535996 - DNA, 25 bp, Mus musculus
agtagctgcttaagaggatagggaa

SEQ ID NO: 535997 - DNA, 25 bp, Mus musculus
agtagctgcttatgaggatagggaa

SEQ ID NO: 535998 - DNA, 25 bp, Mus musculus
agtagctgggtaattcctacttgca

SEQ ID NO: 535999 - DNA, 25 bp, Mus musculus
agtagctgggtatttcctacttgca

SEQ ID NO: 536000 - DNA, 25 bp, Mus musculus
agtagctgtagcagctcgccatgcc

SEQ ID NO: 536001 - DNA, 25 bp, Mus musculus
agtagctgtagctgctcgccatgcc

SEQ ID NO: 536002 - DNA, 25 bp, Mus musculus
agtagcttggctagtagtggaaaaa

SEQ ID NO: 536003 - DNA, 25 bp, Mus musculus
agtagcttggcttgtagtggaaaaa

SEQ ID NO: 536004 - DNA, 25 bp, Mus musculus
agtaggaacccgagagcgaccctga

SEQ ID NO: 536005 - DNA, 25 bp, Mus musculus
agtaggaacccgtgagcgaccctga

SEQ ID NO: 536006 - DNA, 25 bp, Mus musculus
agtaggaagagtcaagacccttgga

SEQ ID NO: 536007 - DNA, 25 bp, Mus musculus
agtaggaagagtgaagacccttgga

SEQ ID NO: 536008 - DNA, 25 bp, Mus musculus
agtaggactagccatccgaagcaag

SEQ ID NO: 536009 - DNA, 25 bp, Mus musculus
agtaggactagcgatccgaagcaag

SEQ ID NO: 536010 - DNA, 25 bp, Mus musculus
agtaggagacaccattaaagtcacc

SEQ ID NO: 536011 - DNA, 25 bp, Mus musculus
agtaggagacacgattaaagtcacc

SEQ ID NO: 536012 - DNA, 25 bp, Mus musculus
agtaggagcggacgccggagagttg

SEQ ID NO: 536013 - DNA, 25 bp, Mus musculus
agtaggagcggaggccggagagttg

SEQ ID NO: 536014 - DNA, 25 bp, Mus musculus
agtaggagggaaagacagaagtcct

SEQ ID NO: 536015 - DNA, 25 bp, Mus musculus
agtaggagggaatgacagaagtcct

SEQ ID NO: 536016 - DNA, 25 bp, Mus musculus
agtaggatctatcggcctcagacag

SEQ ID NO: 536017 - DNA, 25 bp, Mus musculus
agtaggatctatgggcctcagacag

SEQ ID NO: 536018 - DNA, 25 bp, Mus musculus
agtaggccctgtcgcagccggaggg

SEQ ID NO: 536019 - DNA, 25 bp, Mus musculus
agtaggccctgtggcagccggaggg

SEQ ID NO: 536020 - DNA, 25 bp, Mus musculus
agtaggccttcaacatggcggctgt

SEQ ID NO: 536021 - DNA, 25 bp, Mus musculus
agtaggccttcatcatggcggctgt

SEQ ID NO: 536022 - DNA, 25 bp, Mus musculus
agtaggctccataaaggagagatat

SEQ ID NO: 536023 - DNA, 25 bp, Mus musculus
agtaggctccattaaggagagatat

SEQ ID NO: 536024 - DNA, 25 bp, Mus musculus
agtaggctggacagaatactcaggt

SEQ ID NO: 536025 - DNA, 25 bp, Mus musculus
agtaggctggactgaatactcaggt

SEQ ID NO: 536026 - DNA, 25 bp, Mus musculus
agtaggcttcctcctcaggtacagg

SEQ ID NO: 536027 - DNA, 25 bp, Mus musculus
agtaggcttcctgctcaggtacagg

SEQ ID NO: 536028 - DNA, 25 bp, Mus musculus
agtaggctttgtcagggactcctcc

SEQ ID NO: 536029 - DNA, 25 bp, Mus musculus
agtaggctttgtgagggactcctcc

SEQ ID NO: 536030 - DNA, 25 bp, Mus musculus
agtaggtaatccaatattcgtgtcc

SEQ ID NO: 536031 - DNA, 25 bp, Mus musculus
agtaggtaatcctatattcgtgtcc

SEQ ID NO: 536032 - DNA, 25 bp, Mus musculus
agtaggtacttactgctatctgggc

SEQ ID NO: 536033 - DNA, 25 bp, Mus musculus
agtaggtacttagtgctatctgggc

SEQ ID NO: 536034 - DNA, 25 bp, Mus musculus
agtaggttctccagccgcaagaggg

SEQ ID NO: 536035 - DNA, 25 bp, Mus musculus
agtaggttctcctgccgcaagaggg

SEQ ID NO: 536036 - DNA, 25 bp, Mus musculus
agtagtccgggccattatggacccg

SEQ ID NO: 536037 - DNA, 25 bp, Mus musculus
agtagtccgggcgattatggacccg

SEQ ID NO: 536038 - DNA, 25 bp, Mus musculus
agtagtctccatcggcagctcaagg

SEQ ID NO: 536039 - DNA, 25 bp, Mus musculus
agtagtctccatgggcagctcaagg

SEQ ID NO: 536040 - DNA, 25 bp, Mus musculus
agtagtgaaccccattctcgccagc

SEQ ID NO: 536041 - DNA, 25 bp, Mus musculus
agtagtgaacccgattctcgccagc

SEQ ID NO: 536042 - DNA, 25 bp, Mus musculus
agtagtgagtttccttttggaccgc

SEQ ID NO: 536043 - DNA, 25 bp, Mus musculus
agtagtgagtttgcttttggaccgc

SEQ ID NO: 536044 - DNA, 25 bp, Mus musculus
agtagtgtagttaatgagttaatcc

SEQ ID NO: 536045 - DNA, 25 bp, Mus musculus
agtagtgtagtttatgagttaatcc

SEQ ID NO: 536046 - DNA, 25 bp, Mus musculus
agtagtgtcactcgcatgtgcagga

SEQ ID NO: 536047 - DNA, 25 bp, Mus musculus
agtagtgtcactggcatgtgcagga

SEQ ID NO: 536048 - DNA, 25 bp, Mus musculus
agtataaccgcgaaggagaccttct

SEQ ID NO: 536049 - DNA, 25 bp, Mus musculus
agtataaccgcgtaggagaccttct

SEQ ID NO: 536050 - DNA, 25 bp, Mus musculus
agtataataacccagccatgcttca

SEQ ID NO: 536051 - DNA, 25 bp, Mus musculus
agtataataaccgagccatgcttca

SEQ ID NO: 536052 - DNA, 25 bp, Mus musculus
agtatacccaggagcaggcccggaa

SEQ ID NO: 536053 - DNA, 25 bp, Mus musculus
agtatacccaggtgcaggcccggaa

SEQ ID NO: 536054 - DNA, 25 bp, Mus musculus
agtatacgaagcagagccgcaaccc

SEQ ID NO: 536055 - DNA, 25 bp, Mus musculus
agtatacgaagctgagccgcaaccc

SEQ ID NO: 536056 - DNA, 25 bp, Mus musculus
agtatagagggcagctgtatatgca

SEQ ID NO: 536057 - DNA, 25 bp, Mus musculus
agtatagagggctgctgtatatgca

SEQ ID NO: 536058 - DNA, 25 bp, Mus musculus
agtatagcctcacttctcgggaagg

SEQ ID NO: 536059 - DNA, 25 bp, Mus musculus
agtatagcctcagttctcgggaagg

SEQ ID NO: 536060 - DNA, 25 bp, Mus musculus
agtatatcttctccttcgtcctggg

SEQ ID NO: 536061 - DNA, 25 bp, Mus musculus
agtatatcttctgcttcgtcctggg

SEQ ID NO: 536062 - DNA, 25 bp, Mus musculus
agtatatgccacacaagttcctgga

SEQ ID NO: 536063 - DNA, 25 bp, Mus musculus
agtatatgccactcaagttcctgga

SEQ ID NO: 536064 - DNA, 25 bp, Mus musculus
agtatcacaggtcagcccggaccag

SEQ ID NO: 536065 - DNA, 25 bp, Mus musculus
agtatcacaggtgagcccggaccag

SEQ ID NO: 536066 - DNA, 25 bp, Mus musculus
agtatcactccgagtgccgcctgtg

SEQ ID NO: 536067 - DNA, 25 bp, Mus musculus
agtatcactccgtgtgccgcctgtg

SEQ ID NO: 536068 - DNA, 25 bp, Mus musculus
agtatcagataccacacagcagcca

SEQ ID NO: 536069 - DNA, 25 bp, Mus musculus
agtatcagatacgacacagcagcca

SEQ ID NO: 536070 - DNA, 25 bp, Mus musculus
agtatcagggagcaaacctcatcca

SEQ ID NO: 536071 - DNA, 25 bp, Mus musculus
agtatcagggaggaaacctcatcca

SEQ ID NO: 536072 - DNA, 25 bp, Mus musculus
agtatcaggtgcaccccgcctttgg

SEQ ID NO: 536073 - DNA, 25 bp, Mus musculus
agtatcaggtgctccccgcctttgg

SEQ ID NO: 536074 - DNA, 25 bp, Mus musculus
agtatccacactccgcaaggacgtc

SEQ ID NO: 536075 - DNA, 25 bp, Mus musculus
agtatccacactgcgcaaggacgtc

SEQ ID NO: 536076 - DNA, 25 bp, Mus musculus
agtatccgcctcatccaagtgcgag

SEQ ID NO: 536077 - DNA, 25 bp, Mus musculus
agtatccgcctcttccaagtgcgag

SEQ ID NO: 536078 - DNA, 25 bp, Mus musculus
agtatcctgaaaatgtcttcctggg

SEQ ID NO: 536079 - DNA, 25 bp, Mus musculus
agtatcctgaaattgtcttcctggg

SEQ ID NO: 536080 - DNA, 25 bp, Mus musculus
agtatccttaaacaaggcaccaaca

SEQ ID NO: 536081 - DNA, 25 bp, Mus musculus
agtatccttaaagaaggcaccaaca

SEQ ID NO: 536082 - DNA, 25 bp, Mus musculus
agtatcgacccaaactgtgatgtgg

SEQ ID NO: 536083 - DNA, 25 bp, Mus musculus
agtatcgacccatactgtgatgtgg

SEQ ID NO: 536084 - DNA, 25 bp, Mus musculus
agtatcggttgtcatactgccctga

SEQ ID NO: 536085 - DNA, 25 bp, Mus musculus
agtatcggttgtgatactgccctga

SEQ ID NO: 536086 - DNA, 25 bp, Mus musculus
agtatcgtttgaccagatcctcagc

SEQ ID NO: 536087 - DNA, 25 bp, Mus musculus
agtatcgtttgagcagatcctcagc

SEQ ID NO: 536088 - DNA, 25 bp, Mus musculus
agtatctatggtcgcccgggagctt

SEQ ID NO: 536089 - DNA, 25 bp, Mus musculus
agtatctatggtggcccgggagctt

SEQ ID NO: 536090 - DNA, 25 bp, Mus musculus
agtatctcacataccctgagagagg

SEQ ID NO: 536091 - DNA, 25 bp, Mus musculus
agtatctcacattccctgagagagg

SEQ ID NO: 536092 - DNA, 25 bp, Mus musculus
agtatctgtctacctctgatgttca

SEQ ID NO: 536093 - DNA, 25 bp, Mus musculus
agtatctgtctagctctgatgttca

SEQ ID NO: 536094 - DNA, 25 bp, Mus musculus
agtatcttgcccacagtccaaacag

SEQ ID NO: 536095 - DNA, 25 bp, Mus musculus
agtatcttgccctcagtccaaacag

SEQ ID NO: 536096 - DNA, 25 bp, Mus musculus
agtatgaaaacgagtcccaggcgtc

SEQ ID NO: 536097 - DNA, 25 bp, Mus musculus
agtatgaaaacgtgtcccaggcgtc

SEQ ID NO: 536098 - DNA, 25 bp, Mus musculus
agtatgaagcaacgcagatcagggc

SEQ ID NO: 536099 - DNA, 25 bp, Mus musculus
agtatgaagcaaggcagatcagggc

SEQ ID NO: 536100 - DNA, 25 bp, Mus musculus
agtatgactttcacctgctccccag

SEQ ID NO: 536101 - DNA, 25 bp, Mus musculus
agtatgactttctcctgctccccag

SEQ ID NO: 536102 - DNA, 25 bp, Mus musculus
agtatgagaaacatgaatccagaag

SEQ ID NO: 536103 - DNA, 25 bp, Mus musculus
agtatgagaaacttgaatccagaag

SEQ ID NO: 536104 - DNA, 25 bp, Mus musculus
agtatgaggagaaggccaaccacag

SEQ ID NO: 536105 - DNA, 25 bp, Mus musculus
agtatgaggagatggccaaccacag

SEQ ID NO: 536106 - DNA, 25 bp, Mus musculus
agtatgatggcaacctcctgcggcg

SEQ ID NO: 536107 - DNA, 25 bp, Mus musculus
agtatgatggcatcctcctgcggcg

SEQ ID NO: 536108 - DNA, 25 bp, Mus musculus
agtatgcattagcagcagctcagca

SEQ ID NO: 536109 - DNA, 25 bp, Mus musculus
agtatgcattaggagcagctcagca

SEQ ID NO: 536110 - DNA, 25 bp, Mus musculus
agtatgccccatacctgcagcaggc

SEQ ID NO: 536111 - DNA, 25 bp, Mus musculus
agtatgccccattcctgcagcaggc

SEQ ID NO: 536112 - DNA, 25 bp, Mus musculus
agtatgcctacactgacaacagcct

SEQ ID NO: 536113 - DNA, 25 bp, Mus musculus
agtatgcctacagtgacaacagcct

SEQ ID NO: 536114 - DNA, 25 bp, Mus musculus
agtatgcctacgagctgagagtcgg

SEQ ID NO: 536115 - DNA, 25 bp, Mus musculus
agtatgcctacgtgctgagagtcgg

SEQ ID NO: 536116 - DNA, 25 bp, Mus musculus
agtatgcctcccactttgtgataga

SEQ ID NO: 536117 - DNA, 25 bp, Mus musculus
agtatgcctccctctttgtgataga

SEQ ID NO: 536118 - DNA, 25 bp, Mus musculus
agtatgctcattctgctccccaagg

SEQ ID NO: 536119 - DNA, 25 bp, Mus musculus
agtatgctcattgtgctccccaagg

SEQ ID NO: 536120 - DNA, 25 bp, Mus musculus
agtatggaagacatgcaatggaaga

SEQ ID NO: 536121 - DNA, 25 bp, Mus musculus
agtatggaagacttgcaatggaaga

SEQ ID NO: 536122 - DNA, 25 bp, Mus musculus
agtatggacatcatcactcattatg

SEQ ID NO: 536123 - DNA, 25 bp, Mus musculus
agtatggacatcttcactcattatg

SEQ ID NO: 536124 - DNA, 25 bp, Mus musculus
agtatggagattacctcagggctgt

SEQ ID NO: 536125 - DNA, 25 bp, Mus musculus
agtatggagatttcctcagggctgt

SEQ ID NO: 536126 - DNA, 25 bp, Mus musculus
agtatggagcagagacccctgcaga

SEQ ID NO: 536127 - DNA, 25 bp, Mus musculus
agtatggagcagtgacccctgcaga

SEQ ID NO: 536128 - DNA, 25 bp, Mus musculus
agtatggattctccgaggctgacaa

SEQ ID NO: 536129 - DNA, 25 bp, Mus musculus
agtatggattctgcgaggctgacaa

SEQ ID NO: 536130 - DNA, 25 bp, Mus musculus
agtatggccaatcaagaagatgacc

SEQ ID NO: 536131 - DNA, 25 bp, Mus musculus
agtatggccaatgaagaagatgacc

SEQ ID NO: 536132 - DNA, 25 bp, Mus musculus
agtatggccaccctactccacgatg

SEQ ID NO: 536133 - DNA, 25 bp, Mus musculus
agtatggccaccgtactccacgatg

SEQ ID NO: 536134 - DNA, 25 bp, Mus musculus
agtatggcctgcaggcgtacacaga

SEQ ID NO: 536135 - DNA, 25 bp, Mus musculus
agtatggcctgctggcgtacacaga

SEQ ID NO: 536136 - DNA, 25 bp, Mus musculus
agtatggcgtttctgagaacctgcg

SEQ ID NO: 536137 - DNA, 25 bp, Mus musculus
agtatggcgtttgtgagaacctgcg

SEQ ID NO: 536138 - DNA, 25 bp, Mus musculus
agtatgtagacaataaaggatttcc

SEQ ID NO: 536139 - DNA, 25 bp, Mus musculus
agtatgtagacattaaaggatttcc

SEQ ID NO: 536140 - DNA, 25 bp, Mus musculus
agtatgtcaagtcgcgtctgcgcgt

SEQ ID NO: 536141 - DNA, 25 bp, Mus musculus
agtatgtcaagtggcgtctgcgcgt

SEQ ID NO: 536142 - DNA, 25 bp, Mus musculus
agtatgtccagcaggcgcctgtgag

SEQ ID NO: 536143 - DNA, 25 bp, Mus musculus
agtatgtccagctggcgcctgtgag

SEQ ID NO: 536144 - DNA, 25 bp, Mus musculus
agtatgtccccacaattgtgtttgt

SEQ ID NO: 536145 - DNA, 25 bp, Mus musculus
agtatgtccccagaattgtgtttgt

SEQ ID NO: 536146 - DNA, 25 bp, Mus musculus
agtatgtcctgcaagttttaaagaa

SEQ ID NO: 536147 - DNA, 25 bp, Mus musculus
agtatgtcctgctagttttaaagaa

SEQ ID NO: 536148 - DNA, 25 bp, Mus musculus
agtatgtctaacaagcactgctatg

SEQ ID NO: 536149 - DNA, 25 bp, Mus musculus
agtatgtctaactagcactgctatg

SEQ ID NO: 536150 - DNA, 25 bp, Mus musculus
agtatgtcttcactggctctcgcct

SEQ ID NO: 536151 - DNA, 25 bp, Mus musculus
agtatgtcttcagtggctctcgcct

SEQ ID NO: 536152 - DNA, 25 bp, Mus musculus
agtatgtgctcaaggctgccacggc

SEQ ID NO: 536153 - DNA, 25 bp, Mus musculus
agtatgtgctcatggctgccacggc

SEQ ID NO: 536154 - DNA, 25 bp, Mus musculus
agtatgtgtatacctgaaattgacc

SEQ ID NO: 536155 - DNA, 25 bp, Mus musculus
agtatgtgtatagctgaaattgacc

SEQ ID NO: 536156 - DNA, 25 bp, Mus musculus
agtatgtgtcctatgtcgacgagcc

SEQ ID NO: 536157 - DNA, 25 bp, Mus musculus
agtatgtgtcctttgtcgacgagcc

SEQ ID NO: 536158 - DNA, 25 bp, Mus musculus
agtatgtttctcagtggtctctcca

SEQ ID NO: 536159 - DNA, 25 bp, Mus musculus
agtatgtttctctgtggtctctcca

SEQ ID NO: 536160 - DNA, 25 bp, Mus musculus
agtattacaggactgacccagatgt

SEQ ID NO: 536161 - DNA, 25 bp, Mus musculus
agtattacaggagtgacccagatgt

SEQ ID NO: 536162 - DNA, 25 bp, Mus musculus
agtattaccagtccccatcaggtgc

SEQ ID NO: 536163 - DNA, 25 bp, Mus musculus
agtattaccagtgcccatcaggtgc

SEQ ID NO: 536164 - DNA, 25 bp, Mus musculus
agtattacctaacaactgtttgtgg

SEQ ID NO: 536165 - DNA, 25 bp, Mus musculus
agtattacctaagaactgtttgtgg

SEQ ID NO: 536166 - DNA, 25 bp, Mus musculus
agtattcaacacctccttggagacg

SEQ ID NO: 536167 - DNA, 25 bp, Mus musculus
agtattcaacacgtccttggagacg

SEQ ID NO: 536168 - DNA, 25 bp, Mus musculus
agtattccctagacaacttgccaag

SEQ ID NO: 536169 - DNA, 25 bp, Mus musculus
agtattccctagtcaacttgccaag

SEQ ID NO: 536170 - DNA, 25 bp, Mus musculus
agtattccggccactcaagcctgcg

SEQ ID NO: 536171 - DNA, 25 bp, Mus musculus
agtattccggcctctcaagcctgcg

SEQ ID NO: 536172 - DNA, 25 bp, Mus musculus
agtattcctcgcacaacctgtttga

SEQ ID NO: 536173 - DNA, 25 bp, Mus musculus
agtattcctcgctcaacctgtttga

SEQ ID NO: 536174 - DNA, 25 bp, Mus musculus
agtattcctgttatatatgaacggc

SEQ ID NO: 536175 - DNA, 25 bp, Mus musculus
agtattcctgttttatatgaacggc

SEQ ID NO: 536176 - DNA, 25 bp, Mus musculus
agtattgcgactatctgggctctgg

SEQ ID NO: 536177 - DNA, 25 bp, Mus musculus
agtattgcgactttctgggctctgg

SEQ ID NO: 536178 - DNA, 25 bp, Mus musculus
agtattgggctcaccaatggcaccc

SEQ ID NO: 536179 - DNA, 25 bp, Mus musculus
agtattgggctctccaatggcaccc

SEQ ID NO: 536180 - DNA, 25 bp, Mus musculus
agtattgtcacgctccaacctgggc

SEQ ID NO: 536181 - DNA, 25 bp, Mus musculus
agtattgtcacggtccaacctgggc

SEQ ID NO: 536182 - DNA, 25 bp, Mus musculus
agtattgttcagaatgactgtggca

SEQ ID NO: 536183 - DNA, 25 bp, Mus musculus
agtattgttcagtatgactgtggca

SEQ ID NO: 536184 - DNA, 25 bp, Mus musculus
agtatttctagacttgaaagcaggg

SEQ ID NO: 536185 - DNA, 25 bp, Mus musculus
agtatttctagagttgaaagcaggg

SEQ ID NO: 536186 - DNA, 25 bp, Mus musculus
agtatttgctccatatgcctgtggc

SEQ ID NO: 536187 - DNA, 25 bp, Mus musculus
agtatttgctccttatgcctgtggc

SEQ ID NO: 536188 - DNA, 25 bp, Mus musculus
agtcaaagctgacccacagacataa

SEQ ID NO: 536189 - DNA, 25 bp, Mus musculus
agtcaaagctgagccacagacataa

SEQ ID NO: 536190 - DNA, 25 bp, Mus musculus
agtcaaaggccccaatggccgagac

SEQ ID NO: 536191 - DNA, 25 bp, Mus musculus
agtcaaaggcccgaatggccgagac

SEQ ID NO: 536192 - DNA, 25 bp, Mus musculus
agtcaaagtgctctgtacctggtca

SEQ ID NO: 536193 - DNA, 25 bp, Mus musculus
agtcaaagtgctgtgtacctggtca

SEQ ID NO: 536194 - DNA, 25 bp, Mus musculus
agtcaaagttatcacactttgcccc

SEQ ID NO: 536195 - DNA, 25 bp, Mus musculus
agtcaaagttatgacactttgcccc

SEQ ID NO: 536196 - DNA, 25 bp, Mus musculus
agtcaacacaagatccggcagaggg

SEQ ID NO: 536197 - DNA, 25 bp, Mus musculus
agtcaacacaagttccggcagaggg

SEQ ID NO: 536198 - DNA, 25 bp, Mus musculus
agtcaacactgacccgtatgagccg

SEQ ID NO: 536199 - DNA, 25 bp, Mus musculus
agtcaacactgagccgtatgagccg

SEQ ID NO: 536200 - DNA, 25 bp, Mus musculus
agtcaactgtccaggccactgcaga

SEQ ID NO: 536201 - DNA, 25 bp, Mus musculus
agtcaactgtcctggccactgcaga

SEQ ID NO: 536202 - DNA, 25 bp, Mus musculus
agtcaacttagtccgttcccattct

SEQ ID NO: 536203 - DNA, 25 bp, Mus musculus
agtcaacttagtgcgttcccattct

SEQ ID NO: 536204 - DNA, 25 bp, Mus musculus
agtcaagaggagcacgccttcagcc

SEQ ID NO: 536205 - DNA, 25 bp, Mus musculus
agtcaagaggaggacgccttcagcc

SEQ ID NO: 536206 - DNA, 25 bp, Mus musculus
agtcaagagtcaccccttcttccag

SEQ ID NO: 536207 - DNA, 25 bp, Mus musculus
agtcaagagtcagcccttcttccag

SEQ ID NO: 536208 - DNA, 25 bp, Mus musculus
agtcaagcccagctaatgccagctc

SEQ ID NO: 536209 - DNA, 25 bp, Mus musculus
agtcaagcccaggtaatgccagctc

SEQ ID NO: 536210 - DNA, 25 bp, Mus musculus
agtcaagcctgacccaagtatctcg

SEQ ID NO: 536211 - DNA, 25 bp, Mus musculus
agtcaagcctgagccaagtatctcg

SEQ ID NO: 536212 - DNA, 25 bp, Mus musculus
agtcaagctagcagagcagtatgcc

SEQ ID NO: 536213 - DNA, 25 bp, Mus musculus
agtcaagctagctgagcagtatgcc

SEQ ID NO: 536214 - DNA, 25 bp, Mus musculus
agtcaatgacaaactcatcctgcct

SEQ ID NO: 536215 - DNA, 25 bp, Mus musculus
agtcaatgacaatctcatcctgcct

SEQ ID NO: 536216 - DNA, 25 bp, Mus musculus
agtcaatgctttcttggacaacatg

SEQ ID NO: 536217 - DNA, 25 bp, Mus musculus
agtcaatgctttgttggacaacatg

SEQ ID NO: 536218 - DNA, 25 bp, Mus musculus
agtcaattccaacatcctgctgcct

SEQ ID NO: 536219 - DNA, 25 bp, Mus musculus
agtcaattccaagatcctgctgcct

SEQ ID NO: 536220 - DNA, 25 bp, Mus musculus
agtcacaaggctcttctgcgtctcc

SEQ ID NO: 536221 - DNA, 25 bp, Mus musculus
agtcacaaggctgttctgcgtctcc

SEQ ID NO: 536222 - DNA, 25 bp, Mus musculus
agtcacacaccgatcccgttcagag

SEQ ID NO: 536223 - DNA, 25 bp, Mus musculus
agtcacacaccgttcccgttcagag

SEQ ID NO: 536224 - DNA, 25 bp, Mus musculus
agtcacaccagccattgttgcttac

SEQ ID NO: 536225 - DNA, 25 bp, Mus musculus
agtcacaccagcgattgttgcttac

SEQ ID NO: 536226 - DNA, 25 bp, Mus musculus
agtcacagaaacaccctggaggccg

SEQ ID NO: 536227 - DNA, 25 bp, Mus musculus
agtcacagaaactccctggaggccg

SEQ ID NO: 536228 - DNA, 25 bp, Mus musculus
agtcacagaggtcgcaacaaggccc

SEQ ID NO: 536229 - DNA, 25 bp, Mus musculus
agtcacagaggtggcaacaaggccc

SEQ ID NO: 536230 - DNA, 25 bp, Mus musculus
agtcacatctcaattcgtctccaag

SEQ ID NO: 536231 - DNA, 25 bp, Mus musculus
agtcacatctcatttcgtctccaag

SEQ ID NO: 536232 - DNA, 25 bp, Mus musculus
agtcaccaaagaataccgcctgacc

SEQ ID NO: 536233 - DNA, 25 bp, Mus musculus
agtcaccaaagattaccgcctgacc

SEQ ID NO: 536234 - DNA, 25 bp, Mus musculus
agtcaccacctaagagacgtgccag

SEQ ID NO: 536235 - DNA, 25 bp, Mus musculus
agtcaccacctatgagacgtgccag

SEQ ID NO: 536236 - DNA, 25 bp, Mus musculus
agtcaccagagacccgtggctgcag

SEQ ID NO: 536237 - DNA, 25 bp, Mus musculus
agtcaccagagagccgtggctgcag

SEQ ID NO: 536238 - DNA, 25 bp, Mus musculus
agtcaccatgacattccacagcaag

SEQ ID NO: 536239 - DNA, 25 bp, Mus musculus
agtcaccatgactttccacagcaag

SEQ ID NO: 536240 - DNA, 25 bp, Mus musculus
agtcacccagggactgctagcggca

SEQ ID NO: 536241 - DNA, 25 bp, Mus musculus
agtcacccagggtctgctagcggca

SEQ ID NO: 536242 - DNA, 25 bp, Mus musculus
agtcaccccaggcacatgcgtgatg

SEQ ID NO: 536243 - DNA, 25 bp, Mus musculus
agtcaccccagggacatgcgtgatg

SEQ ID NO: 536244 - DNA, 25 bp, Mus musculus
agtcaccccggaatagttcctccag

SEQ ID NO: 536245 - DNA, 25 bp, Mus musculus
agtcaccccggattagttcctccag

SEQ ID NO: 536246 - DNA, 25 bp, Mus musculus
agtcaccccttaagcagccagagtg

SEQ ID NO: 536247 - DNA, 25 bp, Mus musculus
agtcaccccttatgcagccagagtg

SEQ ID NO: 536248 - DNA, 25 bp, Mus musculus
agtcacccgaggacctggcccgtgt

SEQ ID NO: 536249 - DNA, 25 bp, Mus musculus
agtcacccgaggtcctggcccgtgt

SEQ ID NO: 536250 - DNA, 25 bp, Mus musculus
agtcacccgtgaagggttccgcctg

SEQ ID NO: 536251 - DNA, 25 bp, Mus musculus
agtcacccgtgatgggttccgcctg

SEQ ID NO: 536252 - DNA, 25 bp, Mus musculus
agtcaccgagcactatgggatcagt

SEQ ID NO: 536253 - DNA, 25 bp, Mus musculus
agtcaccgagcagtatgggatcagt

SEQ ID NO: 536254 - DNA, 25 bp, Mus musculus
agtcaccgcagactgtccctgagag

SEQ ID NO: 536255 - DNA, 25 bp, Mus musculus
agtcaccgcagagtgtccctgagag

SEQ ID NO: 536256 - DNA, 25 bp, Mus musculus
agtcaccgtcgaagccgtccctgaa

SEQ ID NO: 536257 - DNA, 25 bp, Mus musculus
agtcaccgtcgatgccgtccctgaa

SEQ ID NO: 536258 - DNA, 25 bp, Mus musculus
agtcacctgataagaaaaaggagca

SEQ ID NO: 536259 - DNA, 25 bp, Mus musculus
agtcacctgatatgaaaaaggagca

SEQ ID NO: 536260 - DNA, 25 bp, Mus musculus
agtcacctgatcagctaccacatgg

SEQ ID NO: 536261 - DNA, 25 bp, Mus musculus
agtcacctgatctgctaccacatgg

SEQ ID NO: 536262 - DNA, 25 bp, Mus musculus
agtcacggaagaagatgggagaccc

SEQ ID NO: 536263 - DNA, 25 bp, Mus musculus
agtcacggaagatgatgggagaccc

SEQ ID NO: 536264 - DNA, 25 bp, Mus musculus
agtcacgtactcaggctatcgcccg

SEQ ID NO: 536265 - DNA, 25 bp, Mus musculus
agtcacgtactctggctatcgcccg

SEQ ID NO: 536266 - DNA, 25 bp, Mus musculus
agtcacgtttcgctcaaaaaatctg

SEQ ID NO: 536267 - DNA, 25 bp, Mus musculus
agtcacgtttcggtcaaaaaatctg

SEQ ID NO: 536268 - DNA, 25 bp, Mus musculus
agtcactccgtgaggcagtggcgac

SEQ ID NO: 536269 - DNA, 25 bp, Mus musculus
agtcactccgtgtggcagtggcgac

SEQ ID NO: 536270 - DNA, 25 bp, Mus musculus
agtcactcgagacgatgacttcaac

SEQ ID NO: 536271 - DNA, 25 bp, Mus musculus
agtcactcgagaggatgacttcaac

SEQ ID NO: 536272 - DNA, 25 bp, Mus musculus
agtcactggttcctcttgctgctgc

SEQ ID NO: 536273 - DNA, 25 bp, Mus musculus
agtcactggttcgtcttgctgctgc

SEQ ID NO: 536274 - DNA, 25 bp, Mus musculus
agtcagaacttacagaagccctcga

SEQ ID NO: 536275 - DNA, 25 bp, Mus musculus
agtcagaacttagagaagccctcga

SEQ ID NO: 536276 - DNA, 25 bp, Mus musculus
agtcagaaggaactgcatgagttct

SEQ ID NO: 536277 - DNA, 25 bp, Mus musculus
agtcagaaggaagtgcatgagttct

SEQ ID NO: 536278 - DNA, 25 bp, Mus musculus
agtcagaagggtcccctaatcaagg

SEQ ID NO: 536279 - DNA, 25 bp, Mus musculus
agtcagaagggtgccctaatcaagg

SEQ ID NO: 536280 - DNA, 25 bp, Mus musculus
agtcagaccttcctcttacaccgaa

SEQ ID NO: 536281 - DNA, 25 bp, Mus musculus
agtcagaccttcgtcttacaccgaa

SEQ ID NO: 536282 - DNA, 25 bp, Mus musculus
agtcagacctttaaatgcgttgaag

SEQ ID NO: 536283 - DNA, 25 bp, Mus musculus
agtcagaccttttaatgcgttgaag

SEQ ID NO: 536284 - DNA, 25 bp, Mus musculus
agtcagactaccaccctgtaactca

SEQ ID NO: 536285 - DNA, 25 bp, Mus musculus
agtcagactacctccctgtaactca

SEQ ID NO: 536286 - DNA, 25 bp, Mus musculus
agtcagagaggaagcttcttgatgg

SEQ ID NO: 536287 - DNA, 25 bp, Mus musculus
agtcagagaggatgcttcttgatgg

SEQ ID NO: 536288 - DNA, 25 bp, Mus musculus
agtcagagatgcagaggcattacgt

SEQ ID NO: 536289 - DNA, 25 bp, Mus musculus
agtcagagatgctgaggcattacgt

SEQ ID NO: 536290 - DNA, 25 bp, Mus musculus
agtcagagctgtccctgcggcagct

SEQ ID NO: 536291 - DNA, 25 bp, Mus musculus
agtcagagctgtgcctgcggcagct

SEQ ID NO: 536292 - DNA, 25 bp, Mus musculus
agtcagaggaccaaacctgtgggcg

SEQ ID NO: 536293 - DNA, 25 bp, Mus musculus
agtcagaggacctaacctgtgggcg

SEQ ID NO: 536294 - DNA, 25 bp, Mus musculus
agtcagaggccaacacagctgatgt

SEQ ID NO: 536295 - DNA, 25 bp, Mus musculus
agtcagaggccatcacagctgatgt

SEQ ID NO: 536296 - DNA, 25 bp, Mus musculus
agtcagagtcccagggcattcctca

SEQ ID NO: 536297 - DNA, 25 bp, Mus musculus
agtcagagtccctgggcattcctca

SEQ ID NO: 536298 - DNA, 25 bp, Mus musculus
agtcagatgccaccccgtcgagcat

SEQ ID NO: 536299 - DNA, 25 bp, Mus musculus
agtcagatgccagcccgtcgagcat

SEQ ID NO: 536300 - DNA, 25 bp, Mus musculus
agtcagatggcaatggcaggacgtc

SEQ ID NO: 536301 - DNA, 25 bp, Mus musculus
agtcagatggcattggcaggacgtc

SEQ ID NO: 536302 - DNA, 25 bp, Mus musculus
agtcagcaatgaagagcgcccagag

SEQ ID NO: 536303 - DNA, 25 bp, Mus musculus
agtcagcaatgatgagcgcccagag

SEQ ID NO: 536304 - DNA, 25 bp, Mus musculus
agtcagcagtctccggagcttttgc

SEQ ID NO: 536305 - DNA, 25 bp, Mus musculus
agtcagcagtctgcggagcttttgc

SEQ ID NO: 536306 - DNA, 25 bp, Mus musculus
agtcagcatgacacgccaggaacag

SEQ ID NO: 536307 - DNA, 25 bp, Mus musculus
agtcagcatgactcgccaggaacag

SEQ ID NO: 536308 - DNA, 25 bp, Mus musculus
agtcagccgggcctcagtctcagct

SEQ ID NO: 536309 - DNA, 25 bp, Mus musculus
agtcagccgggcgtcagtctcagct

SEQ ID NO: 536310 - DNA, 25 bp, Mus musculus
agtcagcgaggcacctcactgaggc

SEQ ID NO: 536311 - DNA, 25 bp, Mus musculus
agtcagcgaggctcctcactgaggc

SEQ ID NO: 536312 - DNA, 25 bp, Mus musculus
agtcagctcagaactccaaagccct

SEQ ID NO: 536313 - DNA, 25 bp, Mus musculus
agtcagctcagatctccaaagccct

SEQ ID NO: 536314 - DNA, 25 bp, Mus musculus
agtcagctggacaggagaacctgtg

SEQ ID NO: 536315 - DNA, 25 bp, Mus musculus
agtcagctggactggagaacctgtg

SEQ ID NO: 536316 - DNA, 25 bp, Mus musculus
agtcagcttgcgaaggcagaccacg

SEQ ID NO: 536317 - DNA, 25 bp, Mus musculus
agtcagcttgcgtaggcagaccacg

SEQ ID NO: 536318 - DNA, 25 bp, Mus musculus
agtcaggaacctctgctgtttgcca

SEQ ID NO: 536319 - DNA, 25 bp, Mus musculus
agtcaggaacctgtgctgtttgcca

SEQ ID NO: 536320 - DNA, 25 bp, Mus musculus
agtcaggcgcacagactcggcacct

SEQ ID NO: 536321 - DNA, 25 bp, Mus musculus
agtcaggcgcactgactcggcacct

SEQ ID NO: 536322 - DNA, 25 bp, Mus musculus
agtcaggcgcagatccacagcgata

SEQ ID NO: 536323 - DNA, 25 bp, Mus musculus
agtcaggcgcagttccacagcgata

SEQ ID NO: 536324 - DNA, 25 bp, Mus musculus
agtcagggtcgcactcagtcttctc

SEQ ID NO: 536325 - DNA, 25 bp, Mus musculus
agtcagggtcgctctcagtcttctc

SEQ ID NO: 536326 - DNA, 25 bp, Mus musculus
agtcagggtgtcacagcagaaggtc

SEQ ID NO: 536327 - DNA, 25 bp, Mus musculus
agtcagggtgtctcagcagaaggtc

SEQ ID NO: 536328 - DNA, 25 bp, Mus musculus
agtcagtcaacgacggccttttcga

SEQ ID NO: 536329 - DNA, 25 bp, Mus musculus
agtcagtcaacgtcggccttttcga

SEQ ID NO: 536330 - DNA, 25 bp, Mus musculus
agtcagtcacctcagtgccaaggga

SEQ ID NO: 536331 - DNA, 25 bp, Mus musculus
agtcagtcacctgagtgccaaggga

SEQ ID NO: 536332 - DNA, 25 bp, Mus musculus
agtcagtcattcctcctctttggag

SEQ ID NO: 536333 - DNA, 25 bp, Mus musculus
agtcagtcattcgtcctctttggag

SEQ ID NO: 536334 - DNA, 25 bp, Mus musculus
agtcagtcttttccggactccgcca

SEQ ID NO: 536335 - DNA, 25 bp, Mus musculus
agtcagtcttttgcggactccgcca

SEQ ID NO: 536336 - DNA, 25 bp, Mus musculus
agtcagtggacgaaagcgcacgagc

SEQ ID NO: 536337 - DNA, 25 bp, Mus musculus
agtcagtggacgtaagcgcacgagc

SEQ ID NO: 536338 - DNA, 25 bp, Mus musculus
agtcagtgggaactacaagaaagga

SEQ ID NO: 536339 - DNA, 25 bp, Mus musculus
agtcagtgggaagtacaagaaagga

SEQ ID NO: 536340 - DNA, 25 bp, Mus musculus
agtcagtgggcaagttgggctcttc

SEQ ID NO: 536341 - DNA, 25 bp, Mus musculus
agtcagtgggcatgttgggctcttc

SEQ ID NO: 536342 - DNA, 25 bp, Mus musculus
agtcagttccccattctgtatgtga

SEQ ID NO: 536343 - DNA, 25 bp, Mus musculus
agtcagttcccctttctgtatgtga

SEQ ID NO: 536344 - DNA, 25 bp, Mus musculus
agtcagttcgagaaaattgccatag

SEQ ID NO: 536345 - DNA, 25 bp, Mus musculus
agtcagttcgagtaaattgccatag

SEQ ID NO: 536346 - DNA, 25 bp, Mus musculus
agtcagtttctcctgtccaggccac

SEQ ID NO: 536347 - DNA, 25 bp, Mus musculus
agtcagtttctcgtgtccaggccac

SEQ ID NO: 536348 - DNA, 25 bp, Mus musculus
agtcataaacgactccctgcgggac

SEQ ID NO: 536349 - DNA, 25 bp, Mus musculus
agtcataaacgagtccctgcgggac

SEQ ID NO: 536350 - DNA, 25 bp, Mus musculus
agtcatacttatcgaagatgtgccc

SEQ ID NO: 536351 - DNA, 25 bp, Mus musculus
agtcatacttatggaagatgtgccc

SEQ ID NO: 536352 - DNA, 25 bp, Mus musculus
agtcatatcttacaagctctttcag

SEQ ID NO: 536353 - DNA, 25 bp, Mus musculus
agtcatatcttagaagctctttcag

SEQ ID NO: 536354 - DNA, 25 bp, Mus musculus
agtcatcaatccaagagccttttca

SEQ ID NO: 536355 - DNA, 25 bp, Mus musculus
agtcatcaatcctagagccttttca

SEQ ID NO: 536356 - DNA, 25 bp, Mus musculus
agtcatcatctcagatatcgatggg

SEQ ID NO: 536357 - DNA, 25 bp, Mus musculus
agtcatcatctctgatatcgatggg

SEQ ID NO: 536358 - DNA, 25 bp, Mus musculus
agtcatccgtatattccaccctgct

SEQ ID NO: 536359 - DNA, 25 bp, Mus musculus
agtcatccgtattttccaccctgct

SEQ ID NO: 536360 - DNA, 25 bp, Mus musculus
agtcatcctcgcagtgcttccagag

SEQ ID NO: 536361 - DNA, 25 bp, Mus musculus
agtcatcctcgctgtgcttccagag

SEQ ID NO: 536362 - DNA, 25 bp, Mus musculus
agtcatctcttcacctcttcttaag

SEQ ID NO: 536363 - DNA, 25 bp, Mus musculus
agtcatctcttctcctcttcttaag

SEQ ID NO: 536364 - DNA, 25 bp, Mus musculus
agtcatcttgcccagaaagatccta

SEQ ID NO: 536365 - DNA, 25 bp, Mus musculus
agtcatcttgccgagaaagatccta

SEQ ID NO: 536366 - DNA, 25 bp, Mus musculus
agtcatgaagatcgaaactcctgcg

SEQ ID NO: 536367 - DNA, 25 bp, Mus musculus
agtcatgaagatggaaactcctgcg

SEQ ID NO: 536368 - DNA, 25 bp, Mus musculus
agtcatgacagacctgagcctgagc

SEQ ID NO: 536369 - DNA, 25 bp, Mus musculus
agtcatgacagagctgagcctgagc

SEQ ID NO: 536370 - DNA, 25 bp, Mus musculus
agtcatggaccaacacaagctcagc

SEQ ID NO: 536371 - DNA, 25 bp, Mus musculus
agtcatggaccatcacaagctcagc

SEQ ID NO: 536372 - DNA, 25 bp, Mus musculus
agtcatgtccttagtgcccgtcccg

SEQ ID NO: 536373 - DNA, 25 bp, Mus musculus
agtcatgtcctttgtgcccgtcccg

SEQ ID NO: 536374 - DNA, 25 bp, Mus musculus
agtcattcaagacgaaaatctccgt

SEQ ID NO: 536375 - DNA, 25 bp, Mus musculus
agtcattcaagaggaaaatctccgt

SEQ ID NO: 536376 - DNA, 25 bp, Mus musculus
agtcattcaagcagtactcgccgaa

SEQ ID NO: 536377 - DNA, 25 bp, Mus musculus
agtcattcaagctgtactcgccgaa

SEQ ID NO: 536378 - DNA, 25 bp, Mus musculus
agtcattccgccctgtcctgacgtg

SEQ ID NO: 536379 - DNA, 25 bp, Mus musculus
agtcattccgccgtgtcctgacgtg

SEQ ID NO: 536380 - DNA, 25 bp, Mus musculus
agtcattgtgatcccaagcatatcc

SEQ ID NO: 536381 - DNA, 25 bp, Mus musculus
agtcattgtgatgccaagcatatcc

SEQ ID NO: 536382 - DNA, 25 bp, Mus musculus
agtcattgttgaccacgctcgaggc

SEQ ID NO: 536383 - DNA, 25 bp, Mus musculus
agtcattgttgagcacgctcgaggc

SEQ ID NO: 536384 - DNA, 25 bp, Mus musculus
agtcatttcctacagtgtaaggagg

SEQ ID NO: 536385 - DNA, 25 bp, Mus musculus
agtcatttcctagagtgtaaggagg

SEQ ID NO: 536386 - DNA, 25 bp, Mus musculus
agtccaaactctctatggttgtctg

SEQ ID NO: 536387 - DNA, 25 bp, Mus musculus
agtccaaactctgtatggttgtctg

SEQ ID NO: 536388 - DNA, 25 bp, Mus musculus
agtccaaaggctatggttttgtatc

SEQ ID NO: 536389 - DNA, 25 bp, Mus musculus
agtccaaaggctttggttttgtatc

SEQ ID NO: 536390 - DNA, 25 bp, Mus musculus
agtccaaccggcataacattctagg

SEQ ID NO: 536391 - DNA, 25 bp, Mus musculus
agtccaaccggcttaacattctagg

SEQ ID NO: 536392 - DNA, 25 bp, Mus musculus
agtccaaccttgatcccagcaacgt

SEQ ID NO: 536393 - DNA, 25 bp, Mus musculus
agtccaaccttgttcccagcaacgt

SEQ ID NO: 536394 - DNA, 25 bp, Mus musculus
agtccaaggcacagactgcctgact

SEQ ID NO: 536395 - DNA, 25 bp, Mus musculus
agtccaaggcactgactgcctgact

SEQ ID NO: 536396 - DNA, 25 bp, Mus musculus
agtccaagtccacccgagacactaa

SEQ ID NO: 536397 - DNA, 25 bp, Mus musculus
agtccaagtccagccgagacactaa

SEQ ID NO: 536398 - DNA, 25 bp, Mus musculus
agtccaattcccagatggaggctga

SEQ ID NO: 536399 - DNA, 25 bp, Mus musculus
agtccaattccctgatggaggctga

SEQ ID NO: 536400 - DNA, 25 bp, Mus musculus
agtccacaagttcgtgatgcctaca

SEQ ID NO: 536401 - DNA, 25 bp, Mus musculus
agtccacaagttggtgatgcctaca

SEQ ID NO: 536402 - DNA, 25 bp, Mus musculus
agtccacacacacaagactgtatgg

SEQ ID NO: 536403 - DNA, 25 bp, Mus musculus
agtccacacacagaagactgtatgg

SEQ ID NO: 536404 - DNA, 25 bp, Mus musculus
agtccacagccaagtgagtacccct

SEQ ID NO: 536405 - DNA, 25 bp, Mus musculus
agtccacagccatgtgagtacccct

SEQ ID NO: 536406 - DNA, 25 bp, Mus musculus
agtccaccaaagagccaaacctagg

SEQ ID NO: 536407 - DNA, 25 bp, Mus musculus
agtccaccaaagtgccaaacctagg

SEQ ID NO: 536408 - DNA, 25 bp, Mus musculus
agtccagaaagaccatgagctgtta

SEQ ID NO: 536409 - DNA, 25 bp, Mus musculus
agtccagaaagagcatgagctgtta

SEQ ID NO: 536410 - DNA, 25 bp, Mus musculus
agtccagaaattacaacagaagata

SEQ ID NO: 536411 - DNA, 25 bp, Mus musculus
agtccagaaatttcaacagaagata

SEQ ID NO: 536412 - DNA, 25 bp, Mus musculus
agtccagacactatcagcagaggtt

SEQ ID NO: 536413 - DNA, 25 bp, Mus musculus
agtccagacactttcagcagaggtt

SEQ ID NO: 536414 - DNA, 25 bp, Mus musculus
agtccagcaaccagacaggcacctg

SEQ ID NO: 536415 - DNA, 25 bp, Mus musculus
agtccagcaacctgacaggcacctg

SEQ ID NO: 536416 - DNA, 25 bp, Mus musculus
agtccagccgagacactaagagcaa

SEQ ID NO: 536417 - DNA, 25 bp, Mus musculus
agtccagccgagtcactaagagcaa

SEQ ID NO: 536418 - DNA, 25 bp, Mus musculus
agtccagcgattctccaagaattcc

SEQ ID NO: 536419 - DNA, 25 bp, Mus musculus
agtccagcgattgtccaagaattcc

SEQ ID NO: 536420 - DNA, 25 bp, Mus musculus
agtccagcgggaagtacacatttgc

SEQ ID NO: 536421 - DNA, 25 bp, Mus musculus
agtccagcgggatgtacacatttgc

SEQ ID NO: 536422 - DNA, 25 bp, Mus musculus
agtccagctacacgtgtggatcacg

SEQ ID NO: 536423 - DNA, 25 bp, Mus musculus
agtccagctacaggtgtggatcacg

SEQ ID NO: 536424 - DNA, 25 bp, Mus musculus
agtccaggcgctactgtcgttgttc

SEQ ID NO: 536425 - DNA, 25 bp, Mus musculus
agtccaggcgcttctgtcgttgttc

SEQ ID NO: 536426 - DNA, 25 bp, Mus musculus
agtccagggacgaggcgctttgtca

SEQ ID NO: 536427 - DNA, 25 bp, Mus musculus
agtccagggacgtggcgctttgtca

SEQ ID NO: 536428 - DNA, 25 bp, Mus musculus
agtccagggagtcccgcgacaaaca

SEQ ID NO: 536429 - DNA, 25 bp, Mus musculus
agtccagggagtgccgcgacaaaca

SEQ ID NO: 536430 - DNA, 25 bp, Mus musculus
agtccaggtgctcgacaatgaaaac

SEQ ID NO: 536431 - DNA, 25 bp, Mus musculus
agtccaggtgctggacaatgaaaac

SEQ ID NO: 536432 - DNA, 25 bp, Mus musculus
agtccagtcgaacattggctccttg

SEQ ID NO: 536433 - DNA, 25 bp, Mus musculus
agtccagtcgaagattggctccttg

SEQ ID NO: 536434 - DNA, 25 bp, Mus musculus
agtccagtgggcagcgggtcttcaa

SEQ ID NO: 536435 - DNA, 25 bp, Mus musculus
agtccagtgggctgcgggtcttcaa

SEQ ID NO: 536436 - DNA, 25 bp, Mus musculus
agtccataaccacatttttagccgg

SEQ ID NO: 536437 - DNA, 25 bp, Mus musculus
agtccataaccagatttttagccgg

SEQ ID NO: 536438 - DNA, 25 bp, Mus musculus
agtccatagaaactccatttagcat

SEQ ID NO: 536439 - DNA, 25 bp, Mus musculus
agtccatagaaagtccatttagcat

SEQ ID NO: 536440 - DNA, 25 bp, Mus musculus
agtccatcatgaaatcaggcaatgt

SEQ ID NO: 536441 - DNA, 25 bp, Mus musculus
agtccatcatgatatcaggcaatgt

SEQ ID NO: 536442 - DNA, 25 bp, Mus musculus
agtccatccgggaggacacaccaca

SEQ ID NO: 536443 - DNA, 25 bp, Mus musculus
agtccatccgggtggacacaccaca

SEQ ID NO: 536444 - DNA, 25 bp, Mus musculus
agtccatcgtggatatttcagtggg

SEQ ID NO: 536445 - DNA, 25 bp, Mus musculus
agtccatcgtggttatttcagtggg

SEQ ID NO: 536446 - DNA, 25 bp, Mus musculus
agtccatctggaaggcatgtgtccg

SEQ ID NO: 536447 - DNA, 25 bp, Mus musculus
agtccatctggatggcatgtgtccg

SEQ ID NO: 536448 - DNA, 25 bp, Mus musculus
agtccatgatggctatgtcctacag

SEQ ID NO: 536449 - DNA, 25 bp, Mus musculus
agtccatgatgggtatgtcctacag

SEQ ID NO: 536450 - DNA, 25 bp, Mus musculus
agtccatgctcaacaccgtgctgca

SEQ ID NO: 536451 - DNA, 25 bp, Mus musculus
agtccatgctcatcaccgtgctgca

SEQ ID NO: 536452 - DNA, 25 bp, Mus musculus
agtccatggcagacaaaggctcagg

SEQ ID NO: 536453 - DNA, 25 bp, Mus musculus
agtccatggcagtcaaaggctcagg

SEQ ID NO: 536454 - DNA, 25 bp, Mus musculus
agtccatggcccctgactacagcat

SEQ ID NO: 536455 - DNA, 25 bp, Mus musculus
agtccatggcccgtgactacagcat

SEQ ID NO: 536456 - DNA, 25 bp, Mus musculus
agtccatttcaacacatactttccg

SEQ ID NO: 536457 - DNA, 25 bp, Mus musculus
agtccatttcaagacatactttccg

SEQ ID NO: 536458 - DNA, 25 bp, Mus musculus
agtccatttggcctggtttcccctg

SEQ ID NO: 536459 - DNA, 25 bp, Mus musculus
agtccatttggcgtggtttcccctg

SEQ ID NO: 536460 - DNA, 25 bp, Mus musculus
agtcccaaggctacactgccatcgt

SEQ ID NO: 536461 - DNA, 25 bp, Mus musculus
agtcccaaggcttcactgccatcgt

SEQ ID NO: 536462 - DNA, 25 bp, Mus musculus
agtcccagaacaccacggccttggt

SEQ ID NO: 536463 - DNA, 25 bp, Mus musculus
agtcccagaacagcacggccttggt

SEQ ID NO: 536464 - DNA, 25 bp, Mus musculus
agtcccagaagaagcgctccagctg

SEQ ID NO: 536465 - DNA, 25 bp, Mus musculus
agtcccagaagatgcgctccagctg

SEQ ID NO: 536466 - DNA, 25 bp, Mus musculus
agtcccagatgaagcccgccagcgt

SEQ ID NO: 536467 - DNA, 25 bp, Mus musculus
agtcccagatgatgcccgccagcgt

SEQ ID NO: 536468 - DNA, 25 bp, Mus musculus
agtcccagatgtcctgggtcctcag

SEQ ID NO: 536469 - DNA, 25 bp, Mus musculus
agtcccagatgtgctgggtcctcag

SEQ ID NO: 536470 - DNA, 25 bp, Mus musculus
agtcccagcatgacaacaccctggg

SEQ ID NO: 536471 - DNA, 25 bp, Mus musculus
agtcccagcatgtcaacaccctggg

SEQ ID NO: 536472 - DNA, 25 bp, Mus musculus
agtcccagccagcatcatgattcct

SEQ ID NO: 536473 - DNA, 25 bp, Mus musculus
agtcccagccaggatcatgattcct

SEQ ID NO: 536474 - DNA, 25 bp, Mus musculus
agtcccagcggcagattcgctcgga

SEQ ID NO: 536475 - DNA, 25 bp, Mus musculus
agtcccagcggctgattcgctcgga

SEQ ID NO: 536476 - DNA, 25 bp, Mus musculus
agtcccagctagaagagaaagccag

SEQ ID NO: 536477 - DNA, 25 bp, Mus musculus
agtcccagctagtagagaaagccag

SEQ ID NO: 536478 - DNA, 25 bp, Mus musculus
agtccccaaaggcagccgacctaat

SEQ ID NO: 536479 - DNA, 25 bp, Mus musculus
agtccccaaagggagccgacctaat

SEQ ID NO: 536480 - DNA, 25 bp, Mus musculus
agtccccaacgccaatagcatcaag

SEQ ID NO: 536481 - DNA, 25 bp, Mus musculus
agtccccaacgcgaatagcatcaag

SEQ ID NO: 536482 - DNA, 25 bp, Mus musculus
agtccccacatcaaatacatctgtc

SEQ ID NO: 536483 - DNA, 25 bp, Mus musculus
agtccccacatctaatacatctgtc

SEQ ID NO: 536484 - DNA, 25 bp, Mus musculus
agtccccaccagcagttccagggag

SEQ ID NO: 536485 - DNA, 25 bp, Mus musculus
agtccccaccaggagttccagggag

SEQ ID NO: 536486 - DNA, 25 bp, Mus musculus
agtccccacccaacacaattgaggt

SEQ ID NO: 536487 - DNA, 25 bp, Mus musculus
agtccccacccatcacaattgaggt

SEQ ID NO: 536488 - DNA, 25 bp, Mus musculus
agtccccacgcgaggatgctgcggt

SEQ ID NO: 536489 - DNA, 25 bp, Mus musculus
agtccccacgcgtggatgctgcggt

SEQ ID NO: 536490 - DNA, 25 bp, Mus musculus
agtccccagggaaaatgcaggtaga

SEQ ID NO: 536491 - DNA, 25 bp, Mus musculus
agtccccagggataatgcaggtaga

SEQ ID NO: 536492 - DNA, 25 bp, Mus musculus
agtccccattctagagccaaagagg

SEQ ID NO: 536493 - DNA, 25 bp, Mus musculus
agtccccattcttgagccaaagagg

SEQ ID NO: 536494 - DNA, 25 bp, Mus musculus
agtccccgacggcaagcggttcctg

SEQ ID NO: 536495 - DNA, 25 bp, Mus musculus
agtccccgacgggaagcggttcctg

SEQ ID NO: 536496 - DNA, 25 bp, Mus musculus
agtccccggagaactaggctcgcca

SEQ ID NO: 536497 - DNA, 25 bp, Mus musculus
agtccccggagaccagggtcccagt

SEQ ID NO: 536498 - DNA, 25 bp, Mus musculus
agtccccggagagcagggtcccagt

SEQ ID NO: 536499 - DNA, 25 bp, Mus musculus
agtccccggagatctaggctcgcca

SEQ ID NO: 536500 - DNA, 25 bp, Mus musculus
agtccccgggagcatcagtccgcgc

SEQ ID NO: 536501 - DNA, 25 bp, Mus musculus
agtccccgggaggatcagtccgcgc

SEQ ID NO: 536502 - DNA, 25 bp, Mus musculus
agtccccgtacacacactggaagca

SEQ ID NO: 536503 - DNA, 25 bp, Mus musculus
agtccccgtacagacactggaagca

SEQ ID NO: 536504 - DNA, 25 bp, Mus musculus
agtcccgaaagcagcccatggctct

SEQ ID NO: 536505 - DNA, 25 bp, Mus musculus
agtcccgaaagctgcccatggctct

SEQ ID NO: 536506 - DNA, 25 bp, Mus musculus
agtcccgagctgagcgcagcaaaca

SEQ ID NO: 536507 - DNA, 25 bp, Mus musculus
agtcccgagctgtgcgcagcaaaca

SEQ ID NO: 536508 - DNA, 25 bp, Mus musculus
agtcccgatgacctggaagtcaaaa

SEQ ID NO: 536509 - DNA, 25 bp, Mus musculus
agtcccgatgacgtggaagtcaaaa

SEQ ID NO: 536510 - DNA, 25 bp, Mus musculus
agtcccgcctggaattctgcactat

SEQ ID NO: 536511 - DNA, 25 bp, Mus musculus
agtcccgcctggtattctgcactat

SEQ ID NO: 536512 - DNA, 25 bp, Mus musculus
agtcccgctctgaccctaagacagg

SEQ ID NO: 536513 - DNA, 25 bp, Mus musculus
agtcccgctctgtccctaagacagg

SEQ ID NO: 536514 - DNA, 25 bp, Mus musculus
agtcccgggaggacatcgacagcat

SEQ ID NO: 536515 - DNA, 25 bp, Mus musculus
agtcccgggaggtcatcgacagcat

SEQ ID NO: 536516 - DNA, 25 bp, Mus musculus
agtccctactacagcagtacctatg

SEQ ID NO: 536517 - DNA, 25 bp, Mus musculus
agtccctactactgcagtacctatg

SEQ ID NO: 536518 - DNA, 25 bp, Mus musculus
agtccctatgagaggtataatccac

SEQ ID NO: 536519 - DNA, 25 bp, Mus musculus
agtccctatgagtggtataatccac

SEQ ID NO: 536520 - DNA, 25 bp, Mus musculus
agtccctattctagccacagcagtt

SEQ ID NO: 536521 - DNA, 25 bp, Mus musculus
agtccctattcttgccacagcagtt

SEQ ID NO: 536522 - DNA, 25 bp, Mus musculus
agtccctgaccgcattgcccgcgga

SEQ ID NO: 536523 - DNA, 25 bp, Mus musculus
agtccctgaccggattgcccgcgga

SEQ ID NO: 536524 - DNA, 25 bp, Mus musculus
agtccctgagctcgacgggaagaca

SEQ ID NO: 536525 - DNA, 25 bp, Mus musculus
agtccctgagctggacgggaagaca

SEQ ID NO: 536526 - DNA, 25 bp, Mus musculus
agtccctgcggcagggcggcacact

SEQ ID NO: 536527 - DNA, 25 bp, Mus musculus
agtccctgcggctgggcggcacact

SEQ ID NO: 536528 - DNA, 25 bp, Mus musculus
agtccctggagcactacatcaatag

SEQ ID NO: 536529 - DNA, 25 bp, Mus musculus
agtccctggagctctacatcaatag

SEQ ID NO: 536530 - DNA, 25 bp, Mus musculus
agtccctggatgcacagccttcctg

SEQ ID NO: 536531 - DNA, 25 bp, Mus musculus
agtccctggatggacagccttcctg

SEQ ID NO: 536532 - DNA, 25 bp, Mus musculus
agtccctgtgatccaccaggtgagc

SEQ ID NO: 536533 - DNA, 25 bp, Mus musculus
agtccctgtgatgcaccaggtgagc

SEQ ID NO: 536534 - DNA, 25 bp, Mus musculus
agtcccttctcactggatgcagcac

SEQ ID NO: 536535 - DNA, 25 bp, Mus musculus
agtcccttctcagtggatgcagcac

SEQ ID NO: 536536 - DNA, 25 bp, Mus musculus
agtccctttgtgaagccaaatccag

SEQ ID NO: 536537 - DNA, 25 bp, Mus musculus
agtccctttgtgtagccaaatccag

SEQ ID NO: 536538 - DNA, 25 bp, Mus musculus
agtccgaccgctcgtttcgaagaca

SEQ ID NO: 536539 - DNA, 25 bp, Mus musculus
agtccgaccgctggtttcgaagaca

SEQ ID NO: 536540 - DNA, 25 bp, Mus musculus
agtccgagtactacttaggcttgac

SEQ ID NO: 536541 - DNA, 25 bp, Mus musculus
agtccgagtacttcttaggcttgac

SEQ ID NO: 536542 - DNA, 25 bp, Mus musculus
agtccgatggctccagaggacaacc

SEQ ID NO: 536543 - DNA, 25 bp, Mus musculus
agtccgatggctgcagaggacaacc

SEQ ID NO: 536544 - DNA, 25 bp, Mus musculus
agtccgcggtcacaaactggcccag

SEQ ID NO: 536545 - DNA, 25 bp, Mus musculus
agtccgcggtcagaaactggcccag

SEQ ID NO: 536546 - DNA, 25 bp, Mus musculus
agtccgggacaaactttgacaattt

SEQ ID NO: 536547 - DNA, 25 bp, Mus musculus
agtccgggacaatctttgacaattt

SEQ ID NO: 536548 - DNA, 25 bp, Mus musculus
agtccgggccaaccagattgcagag

SEQ ID NO: 536549 - DNA, 25 bp, Mus musculus
agtccgggccaagcagattgcagag

SEQ ID NO: 536550 - DNA, 25 bp, Mus musculus
agtccgggtagccacttctcttggg

SEQ ID NO: 536551 - DNA, 25 bp, Mus musculus
agtccgggtagcgacttctcttggg

SEQ ID NO: 536552 - DNA, 25 bp, Mus musculus
agtccggtgggacctgaagacctca

SEQ ID NO: 536553 - DNA, 25 bp, Mus musculus
agtccggtgggagctgaagacctca

SEQ ID NO: 536554 - DNA, 25 bp, Mus musculus
agtccgtaaacacatgttgcctccg

SEQ ID NO: 536555 - DNA, 25 bp, Mus musculus
agtccgtaaacagatgttgcctccg

SEQ ID NO: 536556 - DNA, 25 bp, Mus musculus
agtccgtcagctagacctggccaag

SEQ ID NO: 536557 - DNA, 25 bp, Mus musculus
agtccgtcagcttgacctggccaag

SEQ ID NO: 536558 - DNA, 25 bp, Mus musculus
agtccgtggatcactggagcctgaa

SEQ ID NO: 536559 - DNA, 25 bp, Mus musculus
agtccgtggatctctggagcctgaa

SEQ ID NO: 536560 - DNA, 25 bp, Mus musculus
agtccgtggcctccatcaagtccgt

SEQ ID NO: 536561 - DNA, 25 bp, Mus musculus
agtccgtggcctgcatcaagtccgt

SEQ ID NO: 536562 - DNA, 25 bp, Mus musculus
agtccgtgggagacacatggtgcat

SEQ ID NO: 536563 - DNA, 25 bp, Mus musculus
agtccgtgggagtcacatggtgcat

SEQ ID NO: 536564 - DNA, 25 bp, Mus musculus
agtccgtggtcaacaacacctccaa

SEQ ID NO: 536565 - DNA, 25 bp, Mus musculus
agtccgtggtcatcaacacctccaa

SEQ ID NO: 536566 - DNA, 25 bp, Mus musculus
agtcctaactcacacaactgctgtc

SEQ ID NO: 536567 - DNA, 25 bp, Mus musculus
agtcctaactcagacaactgctgtc

SEQ ID NO: 536568 - DNA, 25 bp, Mus musculus
agtcctacaaagaccggaggcggcg

SEQ ID NO: 536569 - DNA, 25 bp, Mus musculus
agtcctacaaagtccggaggcggcg

SEQ ID NO: 536570 - DNA, 25 bp, Mus musculus
agtcctacctgcacccgcgatagag

SEQ ID NO: 536571 - DNA, 25 bp, Mus musculus
agtcctacctgctcccgcgatagag

SEQ ID NO: 536572 - DNA, 25 bp, Mus musculus
agtcctagagacagaaggaagatgg

SEQ ID NO: 536573 - DNA, 25 bp, Mus musculus
agtcctagagactgaaggaagatgg

SEQ ID NO: 536574 - DNA, 25 bp, Mus musculus
agtcctagaggccacctatggagag

SEQ ID NO: 536575 - DNA, 25 bp, Mus musculus
agtcctagaggcgacctatggagag

SEQ ID NO: 536576 - DNA, 25 bp, Mus musculus
agtcctattacccagagtatctcat

SEQ ID NO: 536577 - DNA, 25 bp, Mus musculus
agtcctattaccgagagtatctcat

SEQ ID NO: 536578 - DNA, 25 bp, Mus musculus
agtcctcagacaccacattcctggt

SEQ ID NO: 536579 - DNA, 25 bp, Mus musculus
agtcctcagacagcacattcctggt

SEQ ID NO: 536580 - DNA, 25 bp, Mus musculus
agtcctcaggtaatggctggaccag

SEQ ID NO: 536581 - DNA, 25 bp, Mus musculus
agtcctcaggtattggctggaccag

SEQ ID NO: 536582 - DNA, 25 bp, Mus musculus
agtcctcagtgaaccggccatggag

SEQ ID NO: 536583 - DNA, 25 bp, Mus musculus
agtcctcagtgatccggccatggag

SEQ ID NO: 536584 - DNA, 25 bp, Mus musculus
agtcctccacctccggcagaaatgt

SEQ ID NO: 536585 - DNA, 25 bp, Mus musculus
agtcctccacctgcggcagaaatgt

SEQ ID NO: 536586 - DNA, 25 bp, Mus musculus
agtcctccaggaaacccttggtcga

SEQ ID NO: 536587 - DNA, 25 bp, Mus musculus
agtcctccaggatacccttggtcga

SEQ ID NO: 536588 - DNA, 25 bp, Mus musculus
agtcctccgggcagctgcttgtctt

SEQ ID NO: 536589 - DNA, 25 bp, Mus musculus
agtcctccgggctgctgcttgtctt

SEQ ID NO: 536590 - DNA, 25 bp, Mus musculus
agtcctcctcagctgcctgtcttaa

SEQ ID NO: 536591 - DNA, 25 bp, Mus musculus
agtcctcctcaggtgcctgtcttaa

SEQ ID NO: 536592 - DNA, 25 bp, Mus musculus
agtcctctcagcaggtgaaccacac

SEQ ID NO: 536593 - DNA, 25 bp, Mus musculus
agtcctctcagctggtgaaccacac

SEQ ID NO: 536594 - DNA, 25 bp, Mus musculus
agtcctctgaggaaataggctcctg

SEQ ID NO: 536595 - DNA, 25 bp, Mus musculus
agtcctctgaggtaataggctcctg

SEQ ID NO: 536596 - DNA, 25 bp, Mus musculus
agtcctctggcaaatctagtagtgg

SEQ ID NO: 536597 - DNA, 25 bp, Mus musculus
agtcctctggcatatctagtagtgg

SEQ ID NO: 536598 - DNA, 25 bp, Mus musculus
agtcctgaaagacggcattgcccag

SEQ ID NO: 536599 - DNA, 25 bp, Mus musculus
agtcctgaaagagggcattgcccag

SEQ ID NO: 536600 - DNA, 25 bp, Mus musculus
agtcctgaagaaaggataaagttca

SEQ ID NO: 536601 - DNA, 25 bp, Mus musculus
agtcctgaagaatggataaagttca

SEQ ID NO: 536602 - DNA, 25 bp, Mus musculus
agtcctgacactcggcgcttccgat

SEQ ID NO: 536603 - DNA, 25 bp, Mus musculus
agtcctgacactgggcgcttccgat

SEQ ID NO: 536604 - DNA, 25 bp, Mus musculus
agtcctgacatccaagcaaaagaag

SEQ ID NO: 536605 - DNA, 25 bp, Mus musculus
agtcctgacatcgaagcaaaagaag

SEQ ID NO: 536606 - DNA, 25 bp, Mus musculus
agtcctgagcgacttcgggagcctc

SEQ ID NO: 536607 - DNA, 25 bp, Mus musculus
agtcctgagcgagttcgggagcctc

SEQ ID NO: 536608 - DNA, 25 bp, Mus musculus
agtcctgcagcaccccagaaagctg

SEQ ID NO: 536609 - DNA, 25 bp, Mus musculus
agtcctgcagcagcccagaaagctg

SEQ ID NO: 536610 - DNA, 25 bp, Mus musculus
agtcctgccctcattataatctgcc

SEQ ID NO: 536611 - DNA, 25 bp, Mus musculus
agtcctgccctctttataatctgcc

SEQ ID NO: 536612 - DNA, 25 bp, Mus musculus
agtcctgccgctccctggaattcag

SEQ ID NO: 536613 - DNA, 25 bp, Mus musculus
agtcctgccgctgcctggaattcag

SEQ ID NO: 536614 - DNA, 25 bp, Mus musculus
agtcctgcgagaaaagtatgttggg

SEQ ID NO: 536615 - DNA, 25 bp, Mus musculus
agtcctgcgagataagtatgttggg

SEQ ID NO: 536616 - DNA, 25 bp, Mus musculus
agtcctggaatgacatgacccacta

SEQ ID NO: 536617 - DNA, 25 bp, Mus musculus
agtcctggaatgtcatgacccacta

SEQ ID NO: 536618 - DNA, 25 bp, Mus musculus
agtcctggacccctgaggactggaa

SEQ ID NO: 536619 - DNA, 25 bp, Mus musculus
agtcctggacccgtgaggactggaa

SEQ ID NO: 536620 - DNA, 25 bp, Mus musculus
agtcctggaggaaaagctcacaccc

SEQ ID NO: 536621 - DNA, 25 bp, Mus musculus
agtcctggaggataagctcacaccc

SEQ ID NO: 536622 - DNA, 25 bp, Mus musculus
agtcctggcaccacaaacacagagg

SEQ ID NO: 536623 - DNA, 25 bp, Mus musculus
agtcctggcacctcaaacacagagg

SEQ ID NO: 536624 - DNA, 25 bp, Mus musculus
agtcctggcataactacatgtgtaa

SEQ ID NO: 536625 - DNA, 25 bp, Mus musculus
agtcctggcatatctacatgtgtaa

SEQ ID NO: 536626 - DNA, 25 bp, Mus musculus
agtcctggccgtagatcaggttggc

SEQ ID NO: 536627 - DNA, 25 bp, Mus musculus
agtcctggccgttgatcaggttggc

SEQ ID NO: 536628 - DNA, 25 bp, Mus musculus
agtcctggtgcacacagacgctgct

SEQ ID NO: 536629 - DNA, 25 bp, Mus musculus
agtcctggtgcagacagacgctgct

SEQ ID NO: 536630 - DNA, 25 bp, Mus musculus
agtcctgtgttgaaccttgtgcaag

SEQ ID NO: 536631 - DNA, 25 bp, Mus musculus
agtcctgtgttgtaccttgtgcaag

SEQ ID NO: 536632 - DNA, 25 bp, Mus musculus
agtccttctggacagtgtggttcct

SEQ ID NO: 536633 - DNA, 25 bp, Mus musculus
agtccttctggagagtgtggttcct

SEQ ID NO: 536634 - DNA, 25 bp, Mus musculus
agtccttcttctccggcctctttgg

SEQ ID NO: 536635 - DNA, 25 bp, Mus musculus
agtccttcttctgcggcctctttgg

SEQ ID NO: 536636 - DNA, 25 bp, Mus musculus
agtccttgaagaagacaagctcttg

SEQ ID NO: 536637 - DNA, 25 bp, Mus musculus
agtccttgaagacaatgtcaagacg

SEQ ID NO: 536638 - DNA, 25 bp, Mus musculus
agtccttgaagagaatgtcaagacg

SEQ ID NO: 536639 - DNA, 25 bp, Mus musculus
agtccttgaagatgacaagctcttg

SEQ ID NO: 536640 - DNA, 25 bp, Mus musculus
agtccttgatagaagcagcgcctga

SEQ ID NO: 536641 - DNA, 25 bp, Mus musculus
agtccttgatagtagcagcgcctga

SEQ ID NO: 536642 - DNA, 25 bp, Mus musculus
agtccttgccagctggaagtctgca

SEQ ID NO: 536643 - DNA, 25 bp, Mus musculus
agtccttgccaggtggaagtctgca

SEQ ID NO: 536644 - DNA, 25 bp, Mus musculus
agtccttgctagcttcggcccaaag

SEQ ID NO: 536645 - DNA, 25 bp, Mus musculus
agtccttgctaggttcggcccaaag

SEQ ID NO: 536646 - DNA, 25 bp, Mus musculus
agtccttgcttcacatccagtctcg

SEQ ID NO: 536647 - DNA, 25 bp, Mus musculus
agtccttgcttctcatccagtctcg

SEQ ID NO: 536648 - DNA, 25 bp, Mus musculus
agtccttgtgcaacggaagtgggta

SEQ ID NO: 536649 - DNA, 25 bp, Mus musculus
agtccttgtgcatcggaagtgggta

SEQ ID NO: 536650 - DNA, 25 bp, Mus musculus
agtcctttcctcaccgaggccaatg

SEQ ID NO: 536651 - DNA, 25 bp, Mus musculus
agtcctttcctctccgaggccaatg

SEQ ID NO: 536652 - DNA, 25 bp, Mus musculus
agtcctttctctcggccgttgtctt

SEQ ID NO: 536653 - DNA, 25 bp, Mus musculus
agtcctttctctgggccgttgtctt

SEQ ID NO: 536654 - DNA, 25 bp, Mus musculus
agtcctttgagtccctccgaggcga

SEQ ID NO: 536655 - DNA, 25 bp, Mus musculus
agtcctttgagtgcctccgaggcga

SEQ ID NO: 536656 - DNA, 25 bp, Mus musculus
agtcctttgcgtagccctactggaa

SEQ ID NO: 536657 - DNA, 25 bp, Mus musculus
agtcctttgcgttgccctactggaa

SEQ ID NO: 536658 - DNA, 25 bp, Mus musculus
agtcgaagagacacagccggagtct

SEQ ID NO: 536659 - DNA, 25 bp, Mus musculus
agtcgaagagactcagccggagtct

SEQ ID NO: 536660 - DNA, 25 bp, Mus musculus
agtcgacactgtactgaccacccag

SEQ ID NO: 536661 - DNA, 25 bp, Mus musculus
agtcgacactgttctgaccacccag

SEQ ID NO: 536662 - DNA, 25 bp, Mus musculus
agtcgaccccgccaagcggctgaag

SEQ ID NO: 536663 - DNA, 25 bp, Mus musculus
agtcgaccccgcgaagcggctgaag

SEQ ID NO: 536664 - DNA, 25 bp, Mus musculus
agtcgacttctgcaggcaatcgcga

SEQ ID NO: 536665 - DNA, 25 bp, Mus musculus
agtcgacttctggaggcaatcgcga

SEQ ID NO: 536666 - DNA, 25 bp, Mus musculus
agtcgactttccaatgatagtcaca

SEQ ID NO: 536667 - DNA, 25 bp, Mus musculus
agtcgactttcctatgatagtcaca

SEQ ID NO: 536668 - DNA, 25 bp, Mus musculus
agtcgagacctgacatgatgatgag

SEQ ID NO: 536669 - DNA, 25 bp, Mus musculus
agtcgagacctgtcatgatgatgag

SEQ ID NO: 536670 - DNA, 25 bp, Mus musculus
agtcgaggtgcacacgtaccagccg

SEQ ID NO: 536671 - DNA, 25 bp, Mus musculus
agtcgaggtgcagacgtaccagccg

SEQ ID NO: 536672 - DNA, 25 bp, Mus musculus
agtcgccaaccaaagccagggccgg

SEQ ID NO: 536673 - DNA, 25 bp, Mus musculus
agtcgccaaccatagccagggccgg

SEQ ID NO: 536674 - DNA, 25 bp, Mus musculus
agtcgccactaacaaacctctcaag

SEQ ID NO: 536675 - DNA, 25 bp, Mus musculus
agtcgccactaagaaacctctcaag

SEQ ID NO: 536676 - DNA, 25 bp, Mus musculus
agtcgccccgtacgtgacagtccga

SEQ ID NO: 536677 - DNA, 25 bp, Mus musculus
agtcgccccgtaggtgacagtccga

SEQ ID NO: 536678 - DNA, 25 bp, Mus musculus
agtcgccgcattctgcctcatcagg

SEQ ID NO: 536679 - DNA, 25 bp, Mus musculus
agtcgccgcattgtgcctcatcagg

SEQ ID NO: 536680 - DNA, 25 bp, Mus musculus
agtcgcctattgactctgctgacga

SEQ ID NO: 536681 - DNA, 25 bp, Mus musculus
agtcgcctattgtctctgctgacga

SEQ ID NO: 536682 - DNA, 25 bp, Mus musculus
agtcgcctccggagagtgacgcgca

SEQ ID NO: 536683 - DNA, 25 bp, Mus musculus
agtcgcctccggtgagtgacgcgca

SEQ ID NO: 536684 - DNA, 25 bp, Mus musculus
agtcgcctgtgtctcctcactattg

SEQ ID NO: 536685 - DNA, 25 bp, Mus musculus
agtcgcctgtgtgtcctcactattg

SEQ ID NO: 536686 - DNA, 25 bp, Mus musculus
agtcgcggcacaatgggtctgctga

SEQ ID NO: 536687 - DNA, 25 bp, Mus musculus
agtcgcggcacattgggtctgctga

SEQ ID NO: 536688 - DNA, 25 bp, Mus musculus
agtcgctggaccaggcagctggaat

SEQ ID NO: 536689 - DNA, 25 bp, Mus musculus
agtcgctggacctggcagctggaat

SEQ ID NO: 536690 - DNA, 25 bp, Mus musculus
agtcgcttcgacaatgacgatgagc

SEQ ID NO: 536691 - DNA, 25 bp, Mus musculus
agtcgcttcgactatgacgatgagc

SEQ ID NO: 536692 - DNA, 25 bp, Mus musculus
agtcggaataagaagcggactgcag

SEQ ID NO: 536693 - DNA, 25 bp, Mus musculus
agtcggaataagtagcggactgcag

SEQ ID NO: 536694 - DNA, 25 bp, Mus musculus
agtcggactcccagttcctaggaag

SEQ ID NO: 536695 - DNA, 25 bp, Mus musculus
agtcggactccctgttcctaggaag

SEQ ID NO: 536696 - DNA, 25 bp, Mus musculus
agtcggagacgccagacgccagcaa

SEQ ID NO: 536697 - DNA, 25 bp, Mus musculus
agtcggagacgcgagacgccagcaa

SEQ ID NO: 536698 - DNA, 25 bp, Mus musculus
agtcggagcaagaggtagatctgac

SEQ ID NO: 536699 - DNA, 25 bp, Mus musculus
agtcggagcaagtggtagatctgac

SEQ ID NO: 536700 - DNA, 25 bp, Mus musculus
agtcggagccaaagtgcagtcacag

SEQ ID NO: 536701 - DNA, 25 bp, Mus musculus
agtcggagccaatgtgcagtcacag

SEQ ID NO: 536702 - DNA, 25 bp, Mus musculus
agtcggatgctcaccaggaagccag

SEQ ID NO: 536703 - DNA, 25 bp, Mus musculus
agtcggatgctcagtatcttctact

SEQ ID NO: 536704 - DNA, 25 bp, Mus musculus
agtcggatgctctccaggaagccag

SEQ ID NO: 536705 - DNA, 25 bp, Mus musculus
agtcggatgctctgtatcttctact

SEQ ID NO: 536706 - DNA, 25 bp, Mus musculus
agtcggcacagcagcgcatttgact

SEQ ID NO: 536707 - DNA, 25 bp, Mus musculus
agtcggcacagctgcgcatttgact

SEQ ID NO: 536708 - DNA, 25 bp, Mus musculus
agtcggcctcggcagaaactcttca

SEQ ID NO: 536709 - DNA, 25 bp, Mus musculus
agtcggcctcgggagaaactcttca

SEQ ID NO: 536710 - DNA, 25 bp, Mus musculus
agtcggcgcagaccttcctgtctga

SEQ ID NO: 536711 - DNA, 25 bp, Mus musculus
agtcggcgcagagcttcctgtctga

SEQ ID NO: 536712 - DNA, 25 bp, Mus musculus
agtcggcggcccagctgtccatgac

SEQ ID NO: 536713 - DNA, 25 bp, Mus musculus
agtcggcggccctgctgtccatgac

SEQ ID NO: 536714 - DNA, 25 bp, Mus musculus
agtcggctggctacctggcgctttt

SEQ ID NO: 536715 - DNA, 25 bp, Mus musculus
agtcggctggcttcctggcgctttt

SEQ ID NO: 536716 - DNA, 25 bp, Mus musculus
agtcgggccggtcgttctctcgcct

SEQ ID NO: 536717 - DNA, 25 bp, Mus musculus
agtcgggccggtggttctctcgcct

SEQ ID NO: 536718 - DNA, 25 bp, Mus musculus
agtcgggtgcccactgcccaagcgt

SEQ ID NO: 536719 - DNA, 25 bp, Mus musculus
agtcgggtgccctctgcccaagcgt

SEQ ID NO: 536720 - DNA, 25 bp, Mus musculus
agtcggtgacaccagacccgaagga

SEQ ID NO: 536721 - DNA, 25 bp, Mus musculus
agtcggtgacacgagacccgaagga

SEQ ID NO: 536722 - DNA, 25 bp, Mus musculus
agtcggtttatcatggtaatgggag

SEQ ID NO: 536723 - DNA, 25 bp, Mus musculus
agtcggtttatcttggtaatgggag

SEQ ID NO: 536724 - DNA, 25 bp, Mus musculus
agtcgtggctggacacagcagagaa

SEQ ID NO: 536725 - DNA, 25 bp, Mus musculus
agtcgtggctggtcacagcagagaa

SEQ ID NO: 536726 - DNA, 25 bp, Mus musculus
agtcgtgttcagagtcacaaccgtt

SEQ ID NO: 536727 - DNA, 25 bp, Mus musculus
agtcgtgttcagtgtcacaaccgtt

SEQ ID NO: 536728 - DNA, 25 bp, Mus musculus
agtctaacgcggctgacgcaactcc

SEQ ID NO: 536729 - DNA, 25 bp, Mus musculus
agtctaacgcgggtgacgcaactcc

SEQ ID NO: 536730 - DNA, 25 bp, Mus musculus
agtctaaggctcacctggaagggta

SEQ ID NO: 536731 - DNA, 25 bp, Mus musculus
agtctaaggctctcctggaagggta

SEQ ID NO: 536732 - DNA, 25 bp, Mus musculus
agtctaattgaacccaacggagaac

SEQ ID NO: 536733 - DNA, 25 bp, Mus musculus
agtctaattgaagccaacggagaac

SEQ ID NO: 536734 - DNA, 25 bp, Mus musculus
agtctacagcctacgcccagaagca

SEQ ID NO: 536735 - DNA, 25 bp, Mus musculus
agtctacagccttcgcccagaagca

SEQ ID NO: 536736 - DNA, 25 bp, Mus musculus
agtctacatacgcaacacccgtgga

SEQ ID NO: 536737 - DNA, 25 bp, Mus musculus
agtctacatacggaacacccgtgga

SEQ ID NO: 536738 - DNA, 25 bp, Mus musculus
agtctaccagacagagtcaccacca

SEQ ID NO: 536739 - DNA, 25 bp, Mus musculus
agtctaccagactgagtcaccacca

SEQ ID NO: 536740 - DNA, 25 bp, Mus musculus
agtctacccaggatgaggttgctgc

SEQ ID NO: 536741 - DNA, 25 bp, Mus musculus
agtctacccaggttgaggttgctgc

SEQ ID NO: 536742 - DNA, 25 bp, Mus musculus
agtctacgtactctgacaccagtgc

SEQ ID NO: 536743 - DNA, 25 bp, Mus musculus
agtctacgtactgtgacaccagtgc

SEQ ID NO: 536744 - DNA, 25 bp, Mus musculus
agtctactcggaaggtcgctttaga

SEQ ID NO: 536745 - DNA, 25 bp, Mus musculus
agtctactcggatggtcgctttaga

SEQ ID NO: 536746 - DNA, 25 bp, Mus musculus
agtctactgccacatggcacactta

SEQ ID NO: 536747 - DNA, 25 bp, Mus musculus
agtctactgccagatggcacactta

SEQ ID NO: 536748 - DNA, 25 bp, Mus musculus
agtctagagcctatctccgcaccag

SEQ ID NO: 536749 - DNA, 25 bp, Mus musculus
agtctagagcctttctccgcaccag

SEQ ID NO: 536750 - DNA, 25 bp, Mus musculus
agtctagcgcgactgcgcctgcgca

SEQ ID NO: 536751 - DNA, 25 bp, Mus musculus
agtctagcgcgagtgcgcctgcgca

SEQ ID NO: 536752 - DNA, 25 bp, Mus musculus
agtctagtgagtctgcaccctggtg

SEQ ID NO: 536753 - DNA, 25 bp, Mus musculus
agtctagtgagtgtgcaccctggtg

SEQ ID NO: 536754 - DNA, 25 bp, Mus musculus
agtctagtggccctggcccgatgcc

SEQ ID NO: 536755 - DNA, 25 bp, Mus musculus
agtctagtggccgtggcccgatgcc

SEQ ID NO: 536756 - DNA, 25 bp, Mus musculus
agtctcaccagtcccaacgggagca

SEQ ID NO: 536757 - DNA, 25 bp, Mus musculus
agtctcaccagtgccaacgggagca

SEQ ID NO: 536758 - DNA, 25 bp, Mus musculus
agtctcactgcgcatcatggatttg

SEQ ID NO: 536759 - DNA, 25 bp, Mus musculus
agtctcactgcggatcatggatttg

SEQ ID NO: 536760 - DNA, 25 bp, Mus musculus
agtctcagacaactactgcctccag

SEQ ID NO: 536761 - DNA, 25 bp, Mus musculus
agtctcagacaagtactgcctccag

SEQ ID NO: 536762 - DNA, 25 bp, Mus musculus
agtctcagcagcactgacgcgggct

SEQ ID NO: 536763 - DNA, 25 bp, Mus musculus
agtctcagcagctctgacgcgggct

SEQ ID NO: 536764 - DNA, 25 bp, Mus musculus
agtctcagctctaggccagtgtcat

SEQ ID NO: 536765 - DNA, 25 bp, Mus musculus
agtctcagctcttggccagtgtcat

SEQ ID NO: 536766 - DNA, 25 bp, Mus musculus
agtctcatctctcaaaaggtcaaag

SEQ ID NO: 536767 - DNA, 25 bp, Mus musculus
agtctcatctctgaaaaggtcaaag

SEQ ID NO: 536768 - DNA, 25 bp, Mus musculus
agtctccaggatcgagcctctcagc

SEQ ID NO: 536769 - DNA, 25 bp, Mus musculus
agtctccaggatggagcctctcagc

SEQ ID NO: 536770 - DNA, 25 bp, Mus musculus
agtctccattggacctcagccagga

SEQ ID NO: 536771 - DNA, 25 bp, Mus musculus
agtctccattggtcctcagccagga

SEQ ID NO: 536772 - DNA, 25 bp, Mus musculus
agtctccgaacacagccccatgatt

SEQ ID NO: 536773 - DNA, 25 bp, Mus musculus
agtctccgaacagagccccatgatt

SEQ ID NO: 536774 - DNA, 25 bp, Mus musculus
agtctccggcacagcaaggaggagc

SEQ ID NO: 536775 - DNA, 25 bp, Mus musculus
agtctccggcactgcaaggaggagc

SEQ ID NO: 536776 - DNA, 25 bp, Mus musculus
agtctcctcaggacaagcaagtgtt

SEQ ID NO: 536777 - DNA, 25 bp, Mus musculus
agtctcctcaggtcaagcaagtgtt

SEQ ID NO: 536778 - DNA, 25 bp, Mus musculus
agtctcctcccacgtgaccagatgg

SEQ ID NO: 536779 - DNA, 25 bp, Mus musculus
agtctcctcccaggtgaccagatgg

SEQ ID NO: 536780 - DNA, 25 bp, Mus musculus
agtctcctgaaaactaaatagctag

SEQ ID NO: 536781 - DNA, 25 bp, Mus musculus
agtctcctgaaatctaaatagctag

SEQ ID NO: 536782 - DNA, 25 bp, Mus musculus
agtctccttactagaggactgtggg

SEQ ID NO: 536783 - DNA, 25 bp, Mus musculus
agtctccttacttgaggactgtggg

SEQ ID NO: 536784 - DNA, 25 bp, Mus musculus
agtctcgacgtgcaccaagggcaca

SEQ ID NO: 536785 - DNA, 25 bp, Mus musculus
agtctcgacgtggaccaagggcaca

SEQ ID NO: 536786 - DNA, 25 bp, Mus musculus
agtctcgacttgattaactgtgaga

SEQ ID NO: 536787 - DNA, 25 bp, Mus musculus
agtctcgacttgtttaactgtgaga

SEQ ID NO: 536788 - DNA, 25 bp, Mus musculus
agtctcgagcccacatatacacaca

SEQ ID NO: 536789 - DNA, 25 bp, Mus musculus
agtctcgagccctcatatacacaca

SEQ ID NO: 536790 - DNA, 25 bp, Mus musculus
agtctcgcctggattcccaggagaa

SEQ ID NO: 536791 - DNA, 25 bp, Mus musculus
agtctcgcctggtttcccaggagaa

SEQ ID NO: 536792 - DNA, 25 bp, Mus musculus
agtctcgctcaaaaccattcccgga

SEQ ID NO: 536793 - DNA, 25 bp, Mus musculus
agtctcgctcaataccattcccgga

SEQ ID NO: 536794 - DNA, 25 bp, Mus musculus
agtctcggatgcacgaacttcccgc

SEQ ID NO: 536795 - DNA, 25 bp, Mus musculus
agtctcggatgctcgaacttcccgc

SEQ ID NO: 536796 - DNA, 25 bp, Mus musculus
agtctcggcccgactgcaaggcaaa

SEQ ID NO: 536797 - DNA, 25 bp, Mus musculus
agtctcggcccgtctgcaaggcaaa

SEQ ID NO: 536798 - DNA, 25 bp, Mus musculus
agtctcgtgtccctggtgccgttac

SEQ ID NO: 536799 - DNA, 25 bp, Mus musculus
agtctcgtgtccgtggtgccgttac

SEQ ID NO: 536800 - DNA, 25 bp, Mus musculus
agtctctagcttcgccatgtacatg

SEQ ID NO: 536801 - DNA, 25 bp, Mus musculus
agtctctagcttggccatgtacatg

SEQ ID NO: 536802 - DNA, 25 bp, Mus musculus
agtctctcaccgacctggccaagta

SEQ ID NO: 536803 - DNA, 25 bp, Mus musculus
agtctctcaccgtcctggccaagta

SEQ ID NO: 536804 - DNA, 25 bp, Mus musculus
agtctctcatcaaatcctggaaaaa

SEQ ID NO: 536805 - DNA, 25 bp, Mus musculus
agtctctcatcatatcctggaaaaa

SEQ ID NO: 536806 - DNA, 25 bp, Mus musculus
agtctctcctagaaatagctgcata

SEQ ID NO: 536807 - DNA, 25 bp, Mus musculus
agtctctcctagtaatagctgcata

SEQ ID NO: 536808 - DNA, 25 bp, Mus musculus
agtctctctcataaatcttgctatg

SEQ ID NO: 536809 - DNA, 25 bp, Mus musculus
agtctctctcattaatcttgctatg

SEQ ID NO: 536810 - DNA, 25 bp, Mus musculus
agtctctgaaccctgcggtgctcac

SEQ ID NO: 536811 - DNA, 25 bp, Mus musculus
agtctctgaaccgtgcggtgctcac

SEQ ID NO: 536812 - DNA, 25 bp, Mus musculus
agtctctgcaagagtcgcctcctga

SEQ ID NO: 536813 - DNA, 25 bp, Mus musculus
agtctctgcaagtgtcgcctcctga

SEQ ID NO: 536814 - DNA, 25 bp, Mus musculus
agtctctgcctgctgtcctactgag

SEQ ID NO: 536815 - DNA, 25 bp, Mus musculus
agtctctgcctggtgtcctactgag

SEQ ID NO: 536816 - DNA, 25 bp, Mus musculus
agtctctggacaagaacggtgtgga

SEQ ID NO: 536817 - DNA, 25 bp, Mus musculus
agtctctggacatgaacggtgtgga

SEQ ID NO: 536818 - DNA, 25 bp, Mus musculus
agtctctggaccatcgcctcggcgg

SEQ ID NO: 536819 - DNA, 25 bp, Mus musculus
agtctctggaccttcgcctcggcgg

SEQ ID NO: 536820 - DNA, 25 bp, Mus musculus
agtctctggacgacttcacagactt

SEQ ID NO: 536821 - DNA, 25 bp, Mus musculus
agtctctggacgtcttcacagactt

SEQ ID NO: 536822 - DNA, 25 bp, Mus musculus
agtctctggagtacctagctcatcc

SEQ ID NO: 536823 - DNA, 25 bp, Mus musculus
agtctctggagttcctagctcatcc

SEQ ID NO: 536824 - DNA, 25 bp, Mus musculus
agtctctggcgccatcgtagcacag

SEQ ID NO: 536825 - DNA, 25 bp, Mus musculus
agtctctggcgcgatcgtagcacag

SEQ ID NO: 536826 - DNA, 25 bp, Mus musculus
agtctctgtcagattctggcactga

SEQ ID NO: 536827 - DNA, 25 bp, Mus musculus
agtctctgtcagtttctggcactga

SEQ ID NO: 536828 - DNA, 25 bp, Mus musculus
agtctctgtgctatcaactccctgc

SEQ ID NO: 536829 - DNA, 25 bp, Mus musculus
agtctctgtgctttcaactccctgc

SEQ ID NO: 536830 - DNA, 25 bp, Mus musculus
agtctcttagcgcttctgacccgga

SEQ ID NO: 536831 - DNA, 25 bp, Mus musculus
agtctcttagcggttctgacccgga

SEQ ID NO: 536832 - DNA, 25 bp, Mus musculus
agtctgaagtctacgacgatggcac

SEQ ID NO: 536833 - DNA, 25 bp, Mus musculus
agtctgaagtcttcgacgatggcac

SEQ ID NO: 536834 - DNA, 25 bp, Mus musculus
agtctgacagtgcagtggacctgag

SEQ ID NO: 536835 - DNA, 25 bp, Mus musculus
agtctgacagtggagtggacctgag

SEQ ID NO: 536836 - DNA, 25 bp, Mus musculus
agtctgactgttcggtcctttccac

SEQ ID NO: 536837 - DNA, 25 bp, Mus musculus
agtctgactgttgggtcctttccac

SEQ ID NO: 536838 - DNA, 25 bp, Mus musculus
agtctgagcacaactgtcctccgag

SEQ ID NO: 536839 - DNA, 25 bp, Mus musculus
agtctgagcacatctgtcctccgag

SEQ ID NO: 536840 - DNA, 25 bp, Mus musculus
agtctgagtcgcaggttcctttggc

SEQ ID NO: 536841 - DNA, 25 bp, Mus musculus
agtctgagtcgctggttcctttggc

SEQ ID NO: 536842 - DNA, 25 bp, Mus musculus
agtctgatatcaccatgtgaactgc

SEQ ID NO: 536843 - DNA, 25 bp, Mus musculus
agtctgatatcagcatgtgaactgc

SEQ ID NO: 536844 - DNA, 25 bp, Mus musculus
agtctgcaagagctgccctccaagt

SEQ ID NO: 536845 - DNA, 25 bp, Mus musculus
agtctgcaagaggtgccctccaagt

SEQ ID NO: 536846 - DNA, 25 bp, Mus musculus
agtctgcaagttctcaaaggccaag

SEQ ID NO: 536847 - DNA, 25 bp, Mus musculus
agtctgcaagttgtcaaaggccaag

SEQ ID NO: 536848 - DNA, 25 bp, Mus musculus
agtctgcagaccattgctgctctgc

SEQ ID NO: 536849 - DNA, 25 bp, Mus musculus
agtctgcagacctttgctgctctgc

SEQ ID NO: 536850 - DNA, 25 bp, Mus musculus
agtctgccagcaagagccacaggtc

SEQ ID NO: 536851 - DNA, 25 bp, Mus musculus
agtctgccagcatgagccacaggtc

SEQ ID NO: 536852 - DNA, 25 bp, Mus musculus
agtctgcccagaaggtagctcccgg

SEQ ID NO: 536853 - DNA, 25 bp, Mus musculus
agtctgcccagatggtagctcccgg

SEQ ID NO: 536854 - DNA, 25 bp, Mus musculus
agtctgccgaacagtcgtctgggcc

SEQ ID NO: 536855 - DNA, 25 bp, Mus musculus
agtctgccgaactgtcgtctgggcc

SEQ ID NO: 536856 - DNA, 25 bp, Mus musculus
agtctgcgtggcacactgtcaccag

SEQ ID NO: 536857 - DNA, 25 bp, Mus musculus
agtctgcgtggctcactgtcaccag

SEQ ID NO: 536858 - DNA, 25 bp, Mus musculus
agtctgcttaaacgccagaaaatag

SEQ ID NO: 536859 - DNA, 25 bp, Mus musculus
agtctgcttaaaggccagaaaatag

SEQ ID NO: 536860 - DNA, 25 bp, Mus musculus
agtctggaagccagtaacccggcgc

SEQ ID NO: 536861 - DNA, 25 bp, Mus musculus
agtctggaagcctgtaacccggcgc

SEQ ID NO: 536862 - DNA, 25 bp, Mus musculus
agtctggcattcaaagggcttaccg

SEQ ID NO: 536863 - DNA, 25 bp, Mus musculus
agtctggcattctaagggcttaccg

SEQ ID NO: 536864 - DNA, 25 bp, Mus musculus
agtctggccaatcttcctcatctga

SEQ ID NO: 536865 - DNA, 25 bp, Mus musculus
agtctggccaatgttcctcatctga

SEQ ID NO: 536866 - DNA, 25 bp, Mus musculus
agtctggcttcacgactcgctacgt

SEQ ID NO: 536867 - DNA, 25 bp, Mus musculus
agtctggcttcaggactcgctacgt

SEQ ID NO: 536868 - DNA, 25 bp, Mus musculus
agtctgggagagatttgaagcagca

SEQ ID NO: 536869 - DNA, 25 bp, Mus musculus
agtctgggagagttttgaagcagca

SEQ ID NO: 536870 - DNA, 25 bp, Mus musculus
agtctgggtgtaagagcttatcttc

SEQ ID NO: 536871 - DNA, 25 bp, Mus musculus
agtctgggtgtatgagcttatcttc

SEQ ID NO: 536872 - DNA, 25 bp, Mus musculus
agtctggtcattccccagctgttgt

SEQ ID NO: 536873 - DNA, 25 bp, Mus musculus
agtctggtcattgcccagctgttgt

SEQ ID NO: 536874 - DNA, 25 bp, Mus musculus
agtctgtaggctatgaggactcagg

SEQ ID NO: 536875 - DNA, 25 bp, Mus musculus
agtctgtaggctttgaggactcagg

SEQ ID NO: 536876 - DNA, 25 bp, Mus musculus
agtctgtcggaaaataccagggatt

SEQ ID NO: 536877 - DNA, 25 bp, Mus musculus
agtctgtcggaatataccagggatt

SEQ ID NO: 536878 - DNA, 25 bp, Mus musculus
agtctgtctggaagcccgcacaaag

SEQ ID NO: 536879 - DNA, 25 bp, Mus musculus
agtctgtctggatgcccgcacaaag

SEQ ID NO: 536880 - DNA, 25 bp, Mus musculus
agtctgtggacacattactctggag

SEQ ID NO: 536881 - DNA, 25 bp, Mus musculus
agtctgtggacagattactctggag

SEQ ID NO: 536882 - DNA, 25 bp, Mus musculus
agtctgttcactccattcaccgtag

SEQ ID NO: 536883 - DNA, 25 bp, Mus musculus
agtctgttcactgcattcaccgtag

SEQ ID NO: 536884 - DNA, 25 bp, Mus musculus
agtctgttccgcagtagaggtgacc

SEQ ID NO: 536885 - DNA, 25 bp, Mus musculus
agtctgttccgctgtagaggtgacc

SEQ ID NO: 536886 - DNA, 25 bp, Mus musculus
agtcttagctgacggacccggaagc

SEQ ID NO: 536887 - DNA, 25 bp, Mus musculus
agtcttagctgagggacccggaagc

SEQ ID NO: 536888 - DNA, 25 bp, Mus musculus
agtcttatctgcctgcagcccatgc

SEQ ID NO: 536889 - DNA, 25 bp, Mus musculus
agtcttatctgcgtgcagcccatgc

SEQ ID NO: 536890 - DNA, 25 bp, Mus musculus
agtcttatgtgaaagtattcagtcc

SEQ ID NO: 536891 - DNA, 25 bp, Mus musculus
agtcttatgtgatagtattcagtcc

SEQ ID NO: 536892 - DNA, 25 bp, Mus musculus
agtcttcccacacatgacattgcag

SEQ ID NO: 536893 - DNA, 25 bp, Mus musculus
agtcttcccacagatgacattgcag

SEQ ID NO: 536894 - DNA, 25 bp, Mus musculus
agtcttccccaaaaaccatgctgct

SEQ ID NO: 536895 - DNA, 25 bp, Mus musculus
agtcttccccaataaccatgctgct

SEQ ID NO: 536896 - DNA, 25 bp, Mus musculus
agtcttcgacgtcacaccagagagc

SEQ ID NO: 536897 - DNA, 25 bp, Mus musculus
agtcttcgacgtgacaccagagagc

SEQ ID NO: 536898 - DNA, 25 bp, Mus musculus
agtcttcgtggcatatttgccttca

SEQ ID NO: 536899 - DNA, 25 bp, Mus musculus
agtcttcgtggcttatttgccttca

SEQ ID NO: 536900 - DNA, 25 bp, Mus musculus
agtcttctaccgattcctgaagccg

SEQ ID NO: 536901 - DNA, 25 bp, Mus musculus
agtcttctaccgtttcctgaagccg

SEQ ID NO: 536902 - DNA, 25 bp, Mus musculus
agtcttctccgacagtctctctggg

SEQ ID NO: 536903 - DNA, 25 bp, Mus musculus
agtcttctccgagagtctctctggg

SEQ ID NO: 536904 - DNA, 25 bp, Mus musculus
agtcttcttgatcgctgtccaggga

SEQ ID NO: 536905 - DNA, 25 bp, Mus musculus
agtcttcttgatggctgtccaggga

SEQ ID NO: 536906 - DNA, 25 bp, Mus musculus
agtcttgcaaacaacaatctccaga

SEQ ID NO: 536907 - DNA, 25 bp, Mus musculus
agtcttgcaaactacaatctccaga

SEQ ID NO: 536908 - DNA, 25 bp, Mus musculus
agtcttgccctcaagaaggaggaga

SEQ ID NO: 536909 - DNA, 25 bp, Mus musculus
agtcttgccctctagaaggaggaga

SEQ ID NO: 536910 - DNA, 25 bp, Mus musculus
agtcttgcgctcaggtagtgtgccc

SEQ ID NO: 536911 - DNA, 25 bp, Mus musculus
agtcttgcgctctggtagtgtgccc

SEQ ID NO: 536912 - DNA, 25 bp, Mus musculus
agtcttggccggactttgcttctcg

SEQ ID NO: 536913 - DNA, 25 bp, Mus musculus
agtcttggccggtctttgcttctcg

SEQ ID NO: 536914 - DNA, 25 bp, Mus musculus
agtctttagaccactgctgggtgtg

SEQ ID NO: 536915 - DNA, 25 bp, Mus musculus
agtctttagacctctgctgggtgtg

SEQ ID NO: 536916 - DNA, 25 bp, Mus musculus
agtctttccccgcatgaatgaagtg

SEQ ID NO: 536917 - DNA, 25 bp, Mus musculus
agtctttccccggatgaatgaagtg

SEQ ID NO: 536918 - DNA, 25 bp, Mus musculus
agtctttcggagcagctggtgaaac

SEQ ID NO: 536919 - DNA, 25 bp, Mus musculus
agtctttcggaggagctggtgaaac

SEQ ID NO: 536920 - DNA, 25 bp, Mus musculus
agtctttgacttcctgggttaccag

SEQ ID NO: 536921 - DNA, 25 bp, Mus musculus
agtctttgacttgctgggttaccag

SEQ ID NO: 536922 - DNA, 25 bp, Mus musculus
agtctttgagagagacatcatcccc

SEQ ID NO: 536923 - DNA, 25 bp, Mus musculus
agtctttgagagtgacatcatcccc

SEQ ID NO: 536924 - DNA, 25 bp, Mus musculus
agtcttttccggactccgccatcag

SEQ ID NO: 536925 - DNA, 25 bp, Mus musculus
agtcttttccggtctccgccatcag

SEQ ID NO: 536926 - DNA, 25 bp, Mus musculus
agtcttttgttcatcagctgggacg

SEQ ID NO: 536927 - DNA, 25 bp, Mus musculus
agtcttttgttcttcagctgggacg

SEQ ID NO: 536928 - DNA, 25 bp, Mus musculus
agtgaaaatggaccattcctagcag

SEQ ID NO: 536929 - DNA, 25 bp, Mus musculus
agtgaaaatggagcattcctagcag

SEQ ID NO: 536930 - DNA, 25 bp, Mus musculus
agtgaaaatgtgctgccccgagagc

SEQ ID NO: 536931 - DNA, 25 bp, Mus musculus
agtgaaaatgtggtgccccgagagc

SEQ ID NO: 536932 - DNA, 25 bp, Mus musculus
agtgaaaccgacctggactgcattt

SEQ ID NO: 536933 - DNA, 25 bp, Mus musculus
agtgaaaccgacgtggactgcattt

SEQ ID NO: 536934 - DNA, 25 bp, Mus musculus
agtgaaaccggccacgtacctggtg

SEQ ID NO: 536935 - DNA, 25 bp, Mus musculus
agtgaaaccggcgacgtacctggtg

SEQ ID NO: 536936 - DNA, 25 bp, Mus musculus
agtgaaacgccgcagcccttcgctg

SEQ ID NO: 536937 - DNA, 25 bp, Mus musculus
agtgaaacgccggagcccttcgctg

SEQ ID NO: 536938 - DNA, 25 bp, Mus musculus
agtgaaaggcacatagaaatgactc

SEQ ID NO: 536939 - DNA, 25 bp, Mus musculus
agtgaaaggcacttagaaatgactc

SEQ ID NO: 536940 - DNA, 25 bp, Mus musculus
agtgaaatagctacagcaaacacag

SEQ ID NO: 536941 - DNA, 25 bp, Mus musculus
agtgaaatagcttcagcaaacacag

SEQ ID NO: 536942 - DNA, 25 bp, Mus musculus
agtgaacagactccggcgctacctt

SEQ ID NO: 536943 - DNA, 25 bp, Mus musculus
agtgaacagactgcggcgctacctt

SEQ ID NO: 536944 - DNA, 25 bp, Mus musculus
agtgaacagtcacctcgagccagga

SEQ ID NO: 536945 - DNA, 25 bp, Mus musculus
agtgaacagtcagctcgagccagga

SEQ ID NO: 536946 - DNA, 25 bp, Mus musculus
agtgaaccttcacagcgtcatcttc

SEQ ID NO: 536947 - DNA, 25 bp, Mus musculus
agtgaaccttcagagcgtcatcttc

SEQ ID NO: 536948 - DNA, 25 bp, Mus musculus
agtgaacgggcacatccattcagtt

SEQ ID NO: 536949 - DNA, 25 bp, Mus musculus
agtgaacgggcagatccattcagtt

SEQ ID NO: 536950 - DNA, 25 bp, Mus musculus
agtgaactcagtctcagccttttct

SEQ ID NO: 536951 - DNA, 25 bp, Mus musculus
agtgaactcagtgtcagccttttct

SEQ ID NO: 536952 - DNA, 25 bp, Mus musculus
agtgaacttcccatcatgcaccagg

SEQ ID NO: 536953 - DNA, 25 bp, Mus musculus
agtgaacttcccttcatgcaccagg

SEQ ID NO: 536954 - DNA, 25 bp, Mus musculus
agtgaagacaatcagggtactgtaa

SEQ ID NO: 536955 - DNA, 25 bp, Mus musculus
agtgaagacaatgagggtactgtaa

SEQ ID NO: 536956 - DNA, 25 bp, Mus musculus
agtgaagaccccattgtggaacatc

SEQ ID NO: 536957 - DNA, 25 bp, Mus musculus
agtgaagacccctttgtggaacatc

SEQ ID NO: 536958 - DNA, 25 bp, Mus musculus
agtgaagaccggaggacccagctga

SEQ ID NO: 536959 - DNA, 25 bp, Mus musculus
agtgaagaccggtggacccagctga

SEQ ID NO: 536960 - DNA, 25 bp, Mus musculus
agtgaagccatacagatgatggatc

SEQ ID NO: 536961 - DNA, 25 bp, Mus musculus
agtgaagccatagagatgatggatc

SEQ ID NO: 536962 - DNA, 25 bp, Mus musculus
agtgaagcctatacttctccctcca

SEQ ID NO: 536963 - DNA, 25 bp, Mus musculus
agtgaagcctattcttctccctcca

SEQ ID NO: 536964 - DNA, 25 bp, Mus musculus
agtgaagcttgcctgcagcctaggt

SEQ ID NO: 536965 - DNA, 25 bp, Mus musculus
agtgaagcttgcgtgcagcctaggt

SEQ ID NO: 536966 - DNA, 25 bp, Mus musculus
agtgaaggacggcagccgaagctca

SEQ ID NO: 536967 - DNA, 25 bp, Mus musculus
agtgaaggacgggagccgaagctca

SEQ ID NO: 536968 - DNA, 25 bp, Mus musculus
agtgaaggcagcatcccgcctccgt

SEQ ID NO: 536969 - DNA, 25 bp, Mus musculus
agtgaaggcagcttcccgcctccgt

SEQ ID NO: 536970 - DNA, 25 bp, Mus musculus
agtgaagtcactccggacggagtac

SEQ ID NO: 536971 - DNA, 25 bp, Mus musculus
agtgaagtcactgcggacggagtac

SEQ ID NO: 536972 - DNA, 25 bp, Mus musculus
agtgaagttctcctacatgtggacc

SEQ ID NO: 536973 - DNA, 25 bp, Mus musculus
agtgaagttctcgtacatgtggacc

SEQ ID NO: 536974 - DNA, 25 bp, Mus musculus
agtgaatagcacagccctctggtgg

SEQ ID NO: 536975 - DNA, 25 bp, Mus musculus
agtgaatagcactgccctctggtgg

SEQ ID NO: 536976 - DNA, 25 bp, Mus musculus
agtgaatcagctaggtggtgtcttt

SEQ ID NO: 536977 - DNA, 25 bp, Mus musculus
agtgaatcagcttggtggtgtcttt

SEQ ID NO: 536978 - DNA, 25 bp, Mus musculus
agtgaatgacagcagcgccgcccgc

SEQ ID NO: 536979 - DNA, 25 bp, Mus musculus
agtgaatgacaggagcgccgcccgc

SEQ ID NO: 536980 - DNA, 25 bp, Mus musculus
agtgaatgctacagtaagccggagc

SEQ ID NO: 536981 - DNA, 25 bp, Mus musculus
agtgaatgctactgtaagccggagc

SEQ ID NO: 536982 - DNA, 25 bp, Mus musculus
agtgaattgggcaacaacccatagc

SEQ ID NO: 536983 - DNA, 25 bp, Mus musculus
agtgaattgggctacaacccatagc

SEQ ID NO: 536984 - DNA, 25 bp, Mus musculus
agtgacaaagtgactgaaagactca

SEQ ID NO: 536985 - DNA, 25 bp, Mus musculus
agtgacaaagtgtctgaaagactca

SEQ ID NO: 536986 - DNA, 25 bp, Mus musculus
agtgacaaccagcacgcctgaggac

SEQ ID NO: 536987 - DNA, 25 bp, Mus musculus
agtgacaaccaggacgcctgaggac

SEQ ID NO: 536988 - DNA, 25 bp, Mus musculus
agtgacaacccaaggcttccctttg

SEQ ID NO: 536989 - DNA, 25 bp, Mus musculus
agtgacaacccatggcttccctttg

SEQ ID NO: 536990 - DNA, 25 bp, Mus musculus
agtgacaacggacccaggtcagcca

SEQ ID NO: 536991 - DNA, 25 bp, Mus musculus
agtgacaacggagccaggtcagcca

SEQ ID NO: 536992 - DNA, 25 bp, Mus musculus
agtgacaccattcttgcctaaccct

SEQ ID NO: 536993 - DNA, 25 bp, Mus musculus
agtgacaccattgttgcctaaccct

SEQ ID NO: 536994 - DNA, 25 bp, Mus musculus
agtgacactgaaaccagcaccagtg

SEQ ID NO: 536995 - DNA, 25 bp, Mus musculus
agtgacactgaatccagcaccagtg

SEQ ID NO: 536996 - DNA, 25 bp, Mus musculus
agtgacactggcctctagtctggtg

SEQ ID NO: 536997 - DNA, 25 bp, Mus musculus
agtgacactggcgtctagtctggtg

SEQ ID NO: 536998 - DNA, 25 bp, Mus musculus
agtgacactgtgaaggagatggcca

SEQ ID NO: 536999 - DNA, 25 bp, Mus musculus
agtgacactgtgtaggagatggcca

SEQ ID NO: 537000 - DNA, 25 bp, Mus musculus
agtgacagcgaccagctcttttata

SEQ ID NO: 537001 - DNA, 25 bp, Mus musculus
agtgacagcgacgagctcttttata

SEQ ID NO: 537002 - DNA, 25 bp, Mus musculus
agtgacattgacaatgcattgaagt

SEQ ID NO: 537003 - DNA, 25 bp, Mus musculus
agtgacattgactatgcattgaagt

SEQ ID NO: 537004 - DNA, 25 bp, Mus musculus
agtgaccaaataagcagctggaggc

SEQ ID NO: 537005 - DNA, 25 bp, Mus musculus
agtgaccaaatatgcagctggaggc

SEQ ID NO: 537006 - DNA, 25 bp, Mus musculus
agtgaccacatcagatagaagaggg

SEQ ID NO: 537007 - DNA, 25 bp, Mus musculus
agtgaccacatctgatagaagaggg

SEQ ID NO: 537008 - DNA, 25 bp, Mus musculus
agtgaccaccagatgaaccacagca

SEQ ID NO: 537009 - DNA, 25 bp, Mus musculus
agtgaccaccagttgaaccacagca

SEQ ID NO: 537010 - DNA, 25 bp, Mus musculus
agtgaccacctaaaggaccgcctcg

SEQ ID NO: 537011 - DNA, 25 bp, Mus musculus
agtgaccacctataggaccgcctcg

SEQ ID NO: 537012 - DNA, 25 bp, Mus musculus
agtgaccagccgaccagtcaagggt

SEQ ID NO: 537013 - DNA, 25 bp, Mus musculus
agtgaccagccgtccagtcaagggt

SEQ ID NO: 537014 - DNA, 25 bp, Mus musculus
agtgaccaggttctccttcttaggg

SEQ ID NO: 537015 - DNA, 25 bp, Mus musculus
agtgaccaggttgtccttcttaggg

SEQ ID NO: 537016 - DNA, 25 bp, Mus musculus
agtgacccaccgaccagctttgtac

SEQ ID NO: 537017 - DNA, 25 bp, Mus musculus
agtgacccaccgtccagctttgtac

SEQ ID NO: 537018 - DNA, 25 bp, Mus musculus
agtgacccagacagtgcctctccag

SEQ ID NO: 537019 - DNA, 25 bp, Mus musculus
agtgacccagactgtgcctctccag

SEQ ID NO: 537020 - DNA, 25 bp, Mus musculus
agtgacccgtttcactgggagaaga

SEQ ID NO: 537021 - DNA, 25 bp, Mus musculus
agtgacccgtttgactgggagaaga

SEQ ID NO: 537022 - DNA, 25 bp, Mus musculus
agtgaccctcccatagctgttttga

SEQ ID NO: 537023 - DNA, 25 bp, Mus musculus
agtgaccctcccttagctgttttga

SEQ ID NO: 537024 - DNA, 25 bp, Mus musculus
agtgaccgctctctctgctctgcat

SEQ ID NO: 537025 - DNA, 25 bp, Mus musculus
agtgaccgctctgtctgctctgcat

SEQ ID NO: 537026 - DNA, 25 bp, Mus musculus
agtgaccggacaccactcgttagtg

SEQ ID NO: 537027 - DNA, 25 bp, Mus musculus
agtgaccggacagcactcgttagtg

SEQ ID NO: 537028 - DNA, 25 bp, Mus musculus
agtgaccggactactaatccccagg

SEQ ID NO: 537029 - DNA, 25 bp, Mus musculus
agtgaccggacttctaatccccagg

SEQ ID NO: 537030 - DNA, 25 bp, Mus musculus
agtgaccgtcacatccaggccctgt

SEQ ID NO: 537031 - DNA, 25 bp, Mus musculus
agtgaccgtcacttccaggccctgt

SEQ ID NO: 537032 - DNA, 25 bp, Mus musculus
agtgacctcataagggcccaccagc

SEQ ID NO: 537033 - DNA, 25 bp, Mus musculus
agtgacctcatatgggcccaccagc

SEQ ID NO: 537034 - DNA, 25 bp, Mus musculus
agtgacctccacaaccaagttttgc

SEQ ID NO: 537035 - DNA, 25 bp, Mus musculus
agtgacctccactaccaagttttgc

SEQ ID NO: 537036 - DNA, 25 bp, Mus musculus
agtgacctccgtccctacgtcagga

SEQ ID NO: 537037 - DNA, 25 bp, Mus musculus
agtgacctccgtgcctacgtcagga

SEQ ID NO: 537038 - DNA, 25 bp, Mus musculus
agtgacctcgtaccctgtgtcctga

SEQ ID NO: 537039 - DNA, 25 bp, Mus musculus
agtgacctcgtagcctgtgtcctga

SEQ ID NO: 537040 - DNA, 25 bp, Mus musculus
agtgacctcgttataggcttactcg

SEQ ID NO: 537041 - DNA, 25 bp, Mus musculus
agtgacctcgttttaggcttactcg

SEQ ID NO: 537042 - DNA, 25 bp, Mus musculus
agtgacctctggacctgtggcatca

SEQ ID NO: 537043 - DNA, 25 bp, Mus musculus
agtgacctctggtcctgtggcatca

SEQ ID NO: 537044 - DNA, 25 bp, Mus musculus
agtgaccttcacaggttcgggcggc

SEQ ID NO: 537045 - DNA, 25 bp, Mus musculus
agtgaccttcactggttcgggcggc

SEQ ID NO: 537046 - DNA, 25 bp, Mus musculus
agtgaccttttccagtccgcacaca

SEQ ID NO: 537047 - DNA, 25 bp, Mus musculus
agtgaccttttcgagtccgcacaca

SEQ ID NO: 537048 - DNA, 25 bp, Mus musculus
agtgacgaagtacggaatgagctcc

SEQ ID NO: 537049 - DNA, 25 bp, Mus musculus
agtgacgaagtagggaatgagctcc

SEQ ID NO: 537050 - DNA, 25 bp, Mus musculus
agtgacgaccgacgcatgacacagt

SEQ ID NO: 537051 - DNA, 25 bp, Mus musculus
agtgacgaccgaggcatgacacagt

SEQ ID NO: 537052 - DNA, 25 bp, Mus musculus
agtgacgactgaaaccttctgggaa

SEQ ID NO: 537053 - DNA, 25 bp, Mus musculus
agtgacgactgataccttctgggaa

SEQ ID NO: 537054 - DNA, 25 bp, Mus musculus
agtgacgctcttcaagaagaagtac

SEQ ID NO: 537055 - DNA, 25 bp, Mus musculus
agtgacgctcttgaagaagaagtac

SEQ ID NO: 537056 - DNA, 25 bp, Mus musculus
agtgacggcctcatcttcctcggtc

SEQ ID NO: 537057 - DNA, 25 bp, Mus musculus
agtgacggcctcttcttcctcggtc

SEQ ID NO: 537058 - DNA, 25 bp, Mus musculus
agtgacgtctccaagctgtccccag

SEQ ID NO: 537059 - DNA, 25 bp, Mus musculus
agtgacgtctcctagctgtccccag

SEQ ID NO: 537060 - DNA, 25 bp, Mus musculus
agtgactaagttaccctgctggtga

SEQ ID NO: 537061 - DNA, 25 bp, Mus musculus
agtgactaagtttccctgctggtga

SEQ ID NO: 537062 - DNA, 25 bp, Mus musculus
agtgactagggccttcagcacaagc

SEQ ID NO: 537063 - DNA, 25 bp, Mus musculus
agtgactagggcgttcagcacaagc

SEQ ID NO: 537064 - DNA, 25 bp, Mus musculus
agtgactatgacatcccgccaacct

SEQ ID NO: 537065 - DNA, 25 bp, Mus musculus
agtgactatgacttcccgccaacct

SEQ ID NO: 537066 - DNA, 25 bp, Mus musculus
agtgactccactaggtgcgctcagc

SEQ ID NO: 537067 - DNA, 25 bp, Mus musculus
agtgactccacttggtgcgctcagc

SEQ ID NO: 537068 - DNA, 25 bp, Mus musculus
agtgactcccgtattgaaccagcca

SEQ ID NO: 537069 - DNA, 25 bp, Mus musculus
agtgactcccgttttgaaccagcca

SEQ ID NO: 537070 - DNA, 25 bp, Mus musculus
agtgactcttgacctgggcgccctg

SEQ ID NO: 537071 - DNA, 25 bp, Mus musculus
agtgactcttgagctgggcgccctg

SEQ ID NO: 537072 - DNA, 25 bp, Mus musculus
agtgactgcaccaagctcttcagtc

SEQ ID NO: 537073 - DNA, 25 bp, Mus musculus
agtgactgcacctagctcttcagtc

SEQ ID NO: 537074 - DNA, 25 bp, Mus musculus
agtgactttcttcgtttgcatagca

SEQ ID NO: 537075 - DNA, 25 bp, Mus musculus
agtgactttcttggtttgcatagca

SEQ ID NO: 537076 - DNA, 25 bp, Mus musculus
agtgagaagaagacctgccagtgcc

SEQ ID NO: 537077 - DNA, 25 bp, Mus musculus
agtgagaagaagtcctgccagtgcc

SEQ ID NO: 537078 - DNA, 25 bp, Mus musculus
agtgagaagtctacccgggcagcct

SEQ ID NO: 537079 - DNA, 25 bp, Mus musculus
agtgagaagtcttcccgggcagcct

SEQ ID NO: 537080 - DNA, 25 bp, Mus musculus
agtgagacagccaatgagccgcctc

SEQ ID NO: 537081 - DNA, 25 bp, Mus musculus
agtgagacagcctatgagccgcctc

SEQ ID NO: 537082 - DNA, 25 bp, Mus musculus
agtgagaccaacacgacacagacca

SEQ ID NO: 537083 - DNA, 25 bp, Mus musculus
agtgagaccaactcgacacagacca

SEQ ID NO: 537084 - DNA, 25 bp, Mus musculus
agtgagacgggcaggctatgccttc

SEQ ID NO: 537085 - DNA, 25 bp, Mus musculus
agtgagacgggctggctatgccttc

SEQ ID NO: 537086 - DNA, 25 bp, Mus musculus
agtgagactataaacgatgctgtgc

SEQ ID NO: 537087 - DNA, 25 bp, Mus musculus
agtgagactatatacgatgctgtgc

SEQ ID NO: 537088 - DNA, 25 bp, Mus musculus
agtgagacttccagccccataacca

SEQ ID NO: 537089 - DNA, 25 bp, Mus musculus
agtgagacttcctgccccataacca

SEQ ID NO: 537090 - DNA, 25 bp, Mus musculus
agtgagagcaatacattctgggaca

SEQ ID NO: 537091 - DNA, 25 bp, Mus musculus
agtgagagcaattcattctgggaca

SEQ ID NO: 537092 - DNA, 25 bp, Mus musculus
agtgagagccaactacttcatttac

SEQ ID NO: 537093 - DNA, 25 bp, Mus musculus
agtgagagccaagtacttcatttac

SEQ ID NO: 537094 - DNA, 25 bp, Mus musculus
agtgagagccttagccgaacaaacg

SEQ ID NO: 537095 - DNA, 25 bp, Mus musculus
agtgagagcctttgccgaacaaacg

SEQ ID NO: 537096 - DNA, 25 bp, Mus musculus
agtgagagggccatgcaccgcatct

SEQ ID NO: 537097 - DNA, 25 bp, Mus musculus
agtgagagggccttgcaccgcatct

SEQ ID NO: 537098 - DNA, 25 bp, Mus musculus
agtgagatatgcacccagggactgg

SEQ ID NO: 537099 - DNA, 25 bp, Mus musculus
agtgagatatgctcccagggactgg

SEQ ID NO: 537100 - DNA, 25 bp, Mus musculus
agtgagatgccgaccttcccgttgg

SEQ ID NO: 537101 - DNA, 25 bp, Mus musculus
agtgagatgccgtccttcccgttgg

SEQ ID NO: 537102 - DNA, 25 bp, Mus musculus
agtgagccatacatagtccagacct

SEQ ID NO: 537103 - DNA, 25 bp, Mus musculus
agtgagccatacttagtccagacct

SEQ ID NO: 537104 - DNA, 25 bp, Mus musculus
agtgagcccactacaccctcagctg

SEQ ID NO: 537105 - DNA, 25 bp, Mus musculus
agtgagcccacttcaccctcagctg

SEQ ID NO: 537106 - DNA, 25 bp, Mus musculus
agtgagcctgtacccgacttccctg

SEQ ID NO: 537107 - DNA, 25 bp, Mus musculus
agtgagcctgtagccgacttccctg

SEQ ID NO: 537108 - DNA, 25 bp, Mus musculus
agtgagcgagccactcagtcattgt

SEQ ID NO: 537109 - DNA, 25 bp, Mus musculus
agtgagcgagcctctcagtcattgt

SEQ ID NO: 537110 - DNA, 25 bp, Mus musculus
agtgagcgccaccttatggccatcg

SEQ ID NO: 537111 - DNA, 25 bp, Mus musculus
agtgagcgccacgttatggccatcg

SEQ ID NO: 537112 - DNA, 25 bp, Mus musculus
agtgagcgggagctgctacagcagc

SEQ ID NO: 537113 - DNA, 25 bp, Mus musculus
agtgagcgggaggtgctacagcagc

SEQ ID NO: 537114 - DNA, 25 bp, Mus musculus
agtgagctaggcaccaactggaaga

SEQ ID NO: 537115 - DNA, 25 bp, Mus musculus
agtgagctaggctccaactggaaga

SEQ ID NO: 537116 - DNA, 25 bp, Mus musculus
agtgagctcaagcaggctatggaac

SEQ ID NO: 537117 - DNA, 25 bp, Mus musculus
agtgagctcaaggaggctatggaac

SEQ ID NO: 537118 - DNA, 25 bp, Mus musculus
agtgagctcgtcatgagggcccaag

SEQ ID NO: 537119 - DNA, 25 bp, Mus musculus
agtgagctcgtcttgagggcccaag

SEQ ID NO: 537120 - DNA, 25 bp, Mus musculus
agtgagctcttgcagatttcaggga

SEQ ID NO: 537121 - DNA, 25 bp, Mus musculus
agtgagctcttggagatttcaggga

SEQ ID NO: 537122 - DNA, 25 bp, Mus musculus
agtgagctggcaaagttcaagatca

SEQ ID NO: 537123 - DNA, 25 bp, Mus musculus
agtgagctggcatagttcaagatca

SEQ ID NO: 537124 - DNA, 25 bp, Mus musculus
agtgagctgtcccacagaatgctaa

SEQ ID NO: 537125 - DNA, 25 bp, Mus musculus
agtgagctgtccgacagaatgctaa

SEQ ID NO: 537126 - DNA, 25 bp, Mus musculus
agtgaggacaaacccgtggccaact

SEQ ID NO: 537127 - DNA, 25 bp, Mus musculus
agtgaggacaaagccgtggccaact

SEQ ID NO: 537128 - DNA, 25 bp, Mus musculus
agtgaggacctgcatgcccctgacg

SEQ ID NO: 537129 - DNA, 25 bp, Mus musculus
agtgaggacctggatgcccctgacg

SEQ ID NO: 537130 - DNA, 25 bp, Mus musculus
agtgaggagaacagctcccgcatgg

SEQ ID NO: 537131 - DNA, 25 bp, Mus musculus
agtgaggagaactgctcccgcatgg

SEQ ID NO: 537132 - DNA, 25 bp, Mus musculus
agtgaggataatcgacagccctgtc

SEQ ID NO: 537133 - DNA, 25 bp, Mus musculus
agtgaggataatggacagccctgtc

SEQ ID NO: 537134 - DNA, 25 bp, Mus musculus
agtgaggcaaaaatgggaccagaag

SEQ ID NO: 537135 - DNA, 25 bp, Mus musculus
agtgaggcaaaattgggaccagaag

SEQ ID NO: 537136 - DNA, 25 bp, Mus musculus
agtgagtaaccacgtgtacctggaa

SEQ ID NO: 537137 - DNA, 25 bp, Mus musculus
agtgagtaaccaggtgtacctggaa

SEQ ID NO: 537138 - DNA, 25 bp, Mus musculus
agtgagtaccgcaggcacatcaact

SEQ ID NO: 537139 - DNA, 25 bp, Mus musculus
agtgagtaccgctggcacatcaact

SEQ ID NO: 537140 - DNA, 25 bp, Mus musculus
agtgagtactacactccttggcagg

SEQ ID NO: 537141 - DNA, 25 bp, Mus musculus
agtgagtactactctccttggcagg

SEQ ID NO: 537142 - DNA, 25 bp, Mus musculus
agtgagtactctagctttgggaaag

SEQ ID NO: 537143 - DNA, 25 bp, Mus musculus
agtgagtactcttgctttgggaaag

SEQ ID NO: 537144 - DNA, 25 bp, Mus musculus
agtgagtcttcgacagggcactgaa

SEQ ID NO: 537145 - DNA, 25 bp, Mus musculus
agtgagtcttcgtcagggcactgaa

SEQ ID NO: 537146 - DNA, 25 bp, Mus musculus
agtgagtgttccctgcccatcctaa

SEQ ID NO: 537147 - DNA, 25 bp, Mus musculus
agtgagtgttccgtgcccatcctaa

SEQ ID NO: 537148 - DNA, 25 bp, Mus musculus
agtgagttgcgaaaccggagattgc

SEQ ID NO: 537149 - DNA, 25 bp, Mus musculus
agtgagttgcgataccggagattgc

SEQ ID NO: 537150 - DNA, 25 bp, Mus musculus
agtgagtttcctcgttcctttctga

SEQ ID NO: 537151 - DNA, 25 bp, Mus musculus
agtgagtttcctggttcctttctga

SEQ ID NO: 537152 - DNA, 25 bp, Mus musculus
agtgagtttcgcacggcaattccgg

SEQ ID NO: 537153 - DNA, 25 bp, Mus musculus
agtgagtttcgctcggcaattccgg

SEQ ID NO: 537154 - DNA, 25 bp, Mus musculus
agtgatacagtgcaacgcctccgcc

SEQ ID NO: 537155 - DNA, 25 bp, Mus musculus
agtgatacagtggaacgcctccgcc

SEQ ID NO: 537156 - DNA, 25 bp, Mus musculus
agtgatacgggacccctcatctcga

SEQ ID NO: 537157 - DNA, 25 bp, Mus musculus
agtgatacgggagccctcatctcga

SEQ ID NO: 537158 - DNA, 25 bp, Mus musculus
agtgatagctcgaaggaagagaatg

SEQ ID NO: 537159 - DNA, 25 bp, Mus musculus
agtgatagctcgtaggaagagaatg

SEQ ID NO: 537160 - DNA, 25 bp, Mus musculus
agtgatatagctcggccttcaggca

SEQ ID NO: 537161 - DNA, 25 bp, Mus musculus
agtgatatagctgggccttcaggca

SEQ ID NO: 537162 - DNA, 25 bp, Mus musculus
agtgatcaagaacgcagacatgtct

SEQ ID NO: 537163 - DNA, 25 bp, Mus musculus
agtgatcaagaaggcagacatgtct

SEQ ID NO: 537164 - DNA, 25 bp, Mus musculus
agtgatcagctcattcaaaaacaag

SEQ ID NO: 537165 - DNA, 25 bp, Mus musculus
agtgatcagctctttcaaaaacaag

SEQ ID NO: 537166 - DNA, 25 bp, Mus musculus
agtgatccacctagaggcaaaggtc

SEQ ID NO: 537167 - DNA, 25 bp, Mus musculus
agtgatccaccttgaggcaaaggtc

SEQ ID NO: 537168 - DNA, 25 bp, Mus musculus
agtgatccggagactgccccgaagg

SEQ ID NO: 537169 - DNA, 25 bp, Mus musculus
agtgatccggagtctgccccgaagg

SEQ ID NO: 537170 - DNA, 25 bp, Mus musculus
agtgatcctcccattgaagtgcgtg

SEQ ID NO: 537171 - DNA, 25 bp, Mus musculus
agtgatcctccctttgaagtgcgtg

SEQ ID NO: 537172 - DNA, 25 bp, Mus musculus
agtgatcctgctctatccattcgca

SEQ ID NO: 537173 - DNA, 25 bp, Mus musculus
agtgatcctgctgtatccattcgca

SEQ ID NO: 537174 - DNA, 25 bp, Mus musculus
agtgatcctggccagactagcatct

SEQ ID NO: 537175 - DNA, 25 bp, Mus musculus
agtgatcctggcgagactagcatct

SEQ ID NO: 537176 - DNA, 25 bp, Mus musculus
agtgatcctggtcccgaggaacctg

SEQ ID NO: 537177 - DNA, 25 bp, Mus musculus
agtgatcctggtgccgaggaacctg

SEQ ID NO: 537178 - DNA, 25 bp, Mus musculus
agtgatcgagacagagaagactctc

SEQ ID NO: 537179 - DNA, 25 bp, Mus musculus
agtgatcgagactgagaagactctc

SEQ ID NO: 537180 - DNA, 25 bp, Mus musculus
agtgatcgctctcgtgaacgcaagg

SEQ ID NO: 537181 - DNA, 25 bp, Mus musculus
agtgatcgctctggtgaacgcaagg

SEQ ID NO: 537182 - DNA, 25 bp, Mus musculus
agtgatctacaacacagcgccagga

SEQ ID NO: 537183 - DNA, 25 bp, Mus musculus
agtgatctacaagacagcgccagga

SEQ ID NO: 537184 - DNA, 25 bp, Mus musculus
agtgatctctgcctttacttaaaga

SEQ ID NO: 537185 - DNA, 25 bp, Mus musculus
agtgatctctgcgtttacttaaaga

SEQ ID NO: 537186 - DNA, 25 bp, Mus musculus
agtgatcttgggacatgaaggtgct

SEQ ID NO: 537187 - DNA, 25 bp, Mus musculus
agtgatcttgggtcatgaaggtgct

SEQ ID NO: 537188 - DNA, 25 bp, Mus musculus
agtgatgaagagcacgcagccgcca

SEQ ID NO: 537189 - DNA, 25 bp, Mus musculus
agtgatgaagaggacgcagccgcca

SEQ ID NO: 537190 - DNA, 25 bp, Mus musculus
agtgatggcctaccaagagcccagg

SEQ ID NO: 537191 - DNA, 25 bp, Mus musculus
agtgatggcctagcaagagcccagg

SEQ ID NO: 537192 - DNA, 25 bp, Mus musculus
agtgatgtaatcagctgtctgtggc

SEQ ID NO: 537193 - DNA, 25 bp, Mus musculus
agtgatgtaatctgctgtctgtggc

SEQ ID NO: 537194 - DNA, 25 bp, Mus musculus
agtgatgtgtccacctgggcatggt

SEQ ID NO: 537195 - DNA, 25 bp, Mus musculus
agtgatgtgtcctcctgggcatggt

SEQ ID NO: 537196 - DNA, 25 bp, Mus musculus
agtgattatggcatctatacaatgc

SEQ ID NO: 537197 - DNA, 25 bp, Mus musculus
agtgattatggcttctatacaatgc

SEQ ID NO: 537198 - DNA, 25 bp, Mus musculus
agtgattcaacacaacccagcgctc

SEQ ID NO: 537199 - DNA, 25 bp, Mus musculus
agtgattcaacagaacccagcgctc

SEQ ID NO: 537200 - DNA, 25 bp, Mus musculus
agtgattcacgaagccccgtcggtg

SEQ ID NO: 537201 - DNA, 25 bp, Mus musculus
agtgattcacgatgccccgtcggtg

SEQ ID NO: 537202 - DNA, 25 bp, Mus musculus
agtgattccttgaccagtgagctgc

SEQ ID NO: 537203 - DNA, 25 bp, Mus musculus
agtgattccttgtccagtgagctgc

SEQ ID NO: 537204 - DNA, 25 bp, Mus musculus
agtgatttctctactggaccctacc

SEQ ID NO: 537205 - DNA, 25 bp, Mus musculus
agtgatttctcttctggaccctacc

SEQ ID NO: 537206 - DNA, 25 bp, Mus musculus
agtgatttggtaagctgtttgcaag

SEQ ID NO: 537207 - DNA, 25 bp, Mus musculus
agtgatttggtatgctgtttgcaag

SEQ ID NO: 537208 - DNA, 25 bp, Mus musculus
agtgcaaacgctacgacctcctgaa

SEQ ID NO: 537209 - DNA, 25 bp, Mus musculus
agtgcaaacgcttcgacctcctgaa

SEQ ID NO: 537210 - DNA, 25 bp, Mus musculus
agtgcaacatgcatgtgagctggag

SEQ ID NO: 537211 - DNA, 25 bp, Mus musculus
agtgcaacatgcttgtgagctggag

SEQ ID NO: 537212 - DNA, 25 bp, Mus musculus
agtgcaagaaacatcaatctgccaa

SEQ ID NO: 537213 - DNA, 25 bp, Mus musculus
agtgcaagaaacttcaatctgccaa

SEQ ID NO: 537214 - DNA, 25 bp, Mus musculus
agtgcaagacgtccgactacgcggc

SEQ ID NO: 537215 - DNA, 25 bp, Mus musculus
agtgcaagacgtgcgactacgcggc

SEQ ID NO: 537216 - DNA, 25 bp, Mus musculus
agtgcaagtctacggatgtactcca

SEQ ID NO: 537217 - DNA, 25 bp, Mus musculus
agtgcaagtctagggatgtactcca

SEQ ID NO: 537218 - DNA, 25 bp, Mus musculus
agtgcacactgtccccatggagggc

SEQ ID NO: 537219 - DNA, 25 bp, Mus musculus
agtgcacactgtgcccatggagggc

SEQ ID NO: 537220 - DNA, 25 bp, Mus musculus
agtgcacagggcctccggtttgcca

SEQ ID NO: 537221 - DNA, 25 bp, Mus musculus
agtgcacagggcgtccggtttgcca

SEQ ID NO: 537222 - DNA, 25 bp, Mus musculus
agtgcacagtctcttccggcgacag

SEQ ID NO: 537223 - DNA, 25 bp, Mus musculus
agtgcacagtctgttccggcgacag

SEQ ID NO: 537224 - DNA, 25 bp, Mus musculus
agtgcaccggcgaccggtgcaagcc

SEQ ID NO: 537225 - DNA, 25 bp, Mus musculus
agtgcaccggcgtccggtgcaagcc

SEQ ID NO: 537226 - DNA, 25 bp, Mus musculus
agtgcacctctaatccctgcctgaa

SEQ ID NO: 537227 - DNA, 25 bp, Mus musculus
agtgcacctctattccctgcctgaa

SEQ ID NO: 537228 - DNA, 25 bp, Mus musculus
agtgcacggccaacgacgggctctc

SEQ ID NO: 537229 - DNA, 25 bp, Mus musculus
agtgcacggccatcgacgggctctc

SEQ ID NO: 537230 - DNA, 25 bp, Mus musculus
agtgcacgggatcttacgccagccg

SEQ ID NO: 537231 - DNA, 25 bp, Mus musculus
agtgcacgggatgttacgccagccg

SEQ ID NO: 537232 - DNA, 25 bp, Mus musculus
agtgcacgtctcatcctctgttgtc

SEQ ID NO: 537233 - DNA, 25 bp, Mus musculus
agtgcacgtctcttcctctgttgtc

SEQ ID NO: 537234 - DNA, 25 bp, Mus musculus
agtgcactcacacatgagaagacaa

SEQ ID NO: 537235 - DNA, 25 bp, Mus musculus
agtgcactcacagatgagaagacaa

SEQ ID NO: 537236 - DNA, 25 bp, Mus musculus
agtgcactccttagctacatcccta

SEQ ID NO: 537237 - DNA, 25 bp, Mus musculus
agtgcactcctttgctacatcccta

SEQ ID NO: 537238 - DNA, 25 bp, Mus musculus
agtgcactgactcgcgagaacgtcg

SEQ ID NO: 537239 - DNA, 25 bp, Mus musculus
agtgcactgactggcgagaacgtcg

SEQ ID NO: 537240 - DNA, 25 bp, Mus musculus
agtgcactgcagctgcaagaacctg

SEQ ID NO: 537241 - DNA, 25 bp, Mus musculus
agtgcactgcaggtgcaagaacctg

SEQ ID NO: 537242 - DNA, 25 bp, Mus musculus
agtgcactgctgcttgctgcctgag

SEQ ID NO: 537243 - DNA, 25 bp, Mus musculus
agtgcactgctggttgctgcctgag

SEQ ID NO: 537244 - DNA, 25 bp, Mus musculus
agtgcagaagctcaaggtcaagtca

SEQ ID NO: 537245 - DNA, 25 bp, Mus musculus
agtgcagaagctgaaggtcaagtca

SEQ ID NO: 537246 - DNA, 25 bp, Mus musculus
agtgcagaagtcagatgtgtcgtcc

SEQ ID NO: 537247 - DNA, 25 bp, Mus musculus
agtgcagaagtctgatgtgtcgtcc

SEQ ID NO: 537248 - DNA, 25 bp, Mus musculus
agtgcagagaagacgaagggcttct

SEQ ID NO: 537249 - DNA, 25 bp, Mus musculus
agtgcagagaagtcgaagggcttct

SEQ ID NO: 537250 - DNA, 25 bp, Mus musculus
agtgcagagcccatcaaaagccggg

SEQ ID NO: 537251 - DNA, 25 bp, Mus musculus
agtgcagagcccttcaaaagccggg

SEQ ID NO: 537252 - DNA, 25 bp, Mus musculus
agtgcagagccgcatgtatcaggca

SEQ ID NO: 537253 - DNA, 25 bp, Mus musculus
agtgcagagccggatgtatcaggca

SEQ ID NO: 537254 - DNA, 25 bp, Mus musculus
agtgcagcaccaaccctctgacagg

SEQ ID NO: 537255 - DNA, 25 bp, Mus musculus
agtgcagcaccatccctctgacagg

SEQ ID NO: 537256 - DNA, 25 bp, Mus musculus
agtgcagcccaccacaacagttcgg

SEQ ID NO: 537257 - DNA, 25 bp, Mus musculus
agtgcagcccacgacaacagttcgg

SEQ ID NO: 537258 - DNA, 25 bp, Mus musculus
agtgcaggctctccaccgaaggctg

SEQ ID NO: 537259 - DNA, 25 bp, Mus musculus
agtgcaggctctgcaccgaaggctg

SEQ ID NO: 537260 - DNA, 25 bp, Mus musculus
agtgcaggtttgcaccatcccatac

SEQ ID NO: 537261 - DNA, 25 bp, Mus musculus
agtgcaggtttggaccatcccatac

SEQ ID NO: 537262 - DNA, 25 bp, Mus musculus
agtgcagtgcaaaaacgtgctgaag

SEQ ID NO: 537263 - DNA, 25 bp, Mus musculus
agtgcagtgcaataacgtgctgaag

SEQ ID NO: 537264 - DNA, 25 bp, Mus musculus
agtgcataggctccgggctgatcca

SEQ ID NO: 537265 - DNA, 25 bp, Mus musculus
agtgcataggctgcgggctgatcca

SEQ ID NO: 537266 - DNA, 25 bp, Mus musculus
agtgcatattccatcacagcctttg

SEQ ID NO: 537267 - DNA, 25 bp, Mus musculus
agtgcatattccttcacagcctttg

SEQ ID NO: 537268 - DNA, 25 bp, Mus musculus
agtgcatcagctcttagtttctttg

SEQ ID NO: 537269 - DNA, 25 bp, Mus musculus
agtgcatcagctgttagtttctttg

SEQ ID NO: 537270 - DNA, 25 bp, Mus musculus
agtgcatcccgcaggccattctggg

SEQ ID NO: 537271 - DNA, 25 bp, Mus musculus
agtgcatcccgctggccattctggg

SEQ ID NO: 537272 - DNA, 25 bp, Mus musculus
agtgcatcgcaacctagcctggtgg

SEQ ID NO: 537273 - DNA, 25 bp, Mus musculus
agtgcatcgcaagctagcctggtgg

SEQ ID NO: 537274 - DNA, 25 bp, Mus musculus
agtgcatgaatccttccttgatttg

SEQ ID NO: 537275 - DNA, 25 bp, Mus musculus
agtgcatgaatcgttccttgatttg

SEQ ID NO: 537276 - DNA, 25 bp, Mus musculus
agtgcatgcatcactggcccagtga

SEQ ID NO: 537277 - DNA, 25 bp, Mus musculus
agtgcatgcatctctggcccagtga

SEQ ID NO: 537278 - DNA, 25 bp, Mus musculus
agtgcatgcggactaaaccttcata

SEQ ID NO: 537279 - DNA, 25 bp, Mus musculus
agtgcatgcggagtaaaccttcata

SEQ ID NO: 537280 - DNA, 25 bp, Mus musculus
agtgcatggccactttcagcccact

SEQ ID NO: 537281 - DNA, 25 bp, Mus musculus
agtgcatggccagtttcagcccact

SEQ ID NO: 537282 - DNA, 25 bp, Mus musculus
agtgcattccaccatggagcagccg

SEQ ID NO: 537283 - DNA, 25 bp, Mus musculus
agtgcattccacgatggagcagccg

SEQ ID NO: 537284 - DNA, 25 bp, Mus musculus
agtgcatttgaacctccgacggcca

SEQ ID NO: 537285 - DNA, 25 bp, Mus musculus
agtgcatttgaagctccgacggcca

SEQ ID NO: 537286 - DNA, 25 bp, Mus musculus
agtgccaacttcatggagcatatcc

SEQ ID NO: 537287 - DNA, 25 bp, Mus musculus
agtgccaacttcttggagcatatcc

SEQ ID NO: 537288 - DNA, 25 bp, Mus musculus
agtgccaagttactgtatagcatcc

SEQ ID NO: 537289 - DNA, 25 bp, Mus musculus
agtgccaagttagtgtatagcatcc

SEQ ID NO: 537290 - DNA, 25 bp, Mus musculus
agtgccaccaacactcatggccagg

SEQ ID NO: 537291 - DNA, 25 bp, Mus musculus
agtgccaccaactctcatggccagg

SEQ ID NO: 537292 - DNA, 25 bp, Mus musculus
agtgccacctacattgactcggagg

SEQ ID NO: 537293 - DNA, 25 bp, Mus musculus
agtgccacctactttgactcggagg

SEQ ID NO: 537294 - DNA, 25 bp, Mus musculus
agtgccacttctcgtaaacggaaag

SEQ ID NO: 537295 - DNA, 25 bp, Mus musculus
agtgccacttctggtaaacggaaag

SEQ ID NO: 537296 - DNA, 25 bp, Mus musculus
agtgccagaagcagaccgacgacca

SEQ ID NO: 537297 - DNA, 25 bp, Mus musculus
agtgccagaagctgaccgacgacca

SEQ ID NO: 537298 - DNA, 25 bp, Mus musculus
agtgccagacgccaacgtttgcacc

SEQ ID NO: 537299 - DNA, 25 bp, Mus musculus
agtgccagacgcgaacgtttgcacc

SEQ ID NO: 537300 - DNA, 25 bp, Mus musculus
agtgccagtgaaagataaagatgac

SEQ ID NO: 537301 - DNA, 25 bp, Mus musculus
agtgccagtgaatgataaagatgac

SEQ ID NO: 537302 - DNA, 25 bp, Mus musculus
agtgccatcgccaccgtcggtgctg

SEQ ID NO: 537303 - DNA, 25 bp, Mus musculus
agtgccatcgcctccgtcggtgctg

SEQ ID NO: 537304 - DNA, 25 bp, Mus musculus
agtgccatctcgctgaaagccaaca

SEQ ID NO: 537305 - DNA, 25 bp, Mus musculus
agtgccatctcggtgaaagccaaca

SEQ ID NO: 537306 - DNA, 25 bp, Mus musculus
agtgccatgactacagaaatgttta

SEQ ID NO: 537307 - DNA, 25 bp, Mus musculus
agtgccatgacttcagaaatgttta

SEQ ID NO: 537308 - DNA, 25 bp, Mus musculus
agtgccatggcgctcctcttctaca

SEQ ID NO: 537309 - DNA, 25 bp, Mus musculus
agtgccatggcggtcctcttctaca

SEQ ID NO: 537310 - DNA, 25 bp, Mus musculus
agtgccatgggcaagtggatgctct

SEQ ID NO: 537311 - DNA, 25 bp, Mus musculus
agtgccatgggctagtggatgctct

SEQ ID NO: 537312 - DNA, 25 bp, Mus musculus
agtgccattcctccgtactctaaga

SEQ ID NO: 537313 - DNA, 25 bp, Mus musculus
agtgccattcctgcgtactctaaga

SEQ ID NO: 537314 - DNA, 25 bp, Mus musculus
agtgccattggtctcagagaccagc

SEQ ID NO: 537315 - DNA, 25 bp, Mus musculus
agtgccattggtgtcagagaccagc

SEQ ID NO: 537316 - DNA, 25 bp, Mus musculus
agtgcccaagctagaaagacaagcc

SEQ ID NO: 537317 - DNA, 25 bp, Mus musculus
agtgcccaagcttgaaagacaagcc

SEQ ID NO: 537318 - DNA, 25 bp, Mus musculus
agtgcccaagtacttgtctccagtg

SEQ ID NO: 537319 - DNA, 25 bp, Mus musculus
agtgcccaagtagttgtctccagtg

SEQ ID NO: 537320 - DNA, 25 bp, Mus musculus
agtgcccacgacacaggcgctgctg

SEQ ID NO: 537321 - DNA, 25 bp, Mus musculus
agtgcccacgactcaggcgctgctg

SEQ ID NO: 537322 - DNA, 25 bp, Mus musculus
agtgcccagatgcagctcacagctt

SEQ ID NO: 537323 - DNA, 25 bp, Mus musculus
agtgcccagatggagctcacagctt

SEQ ID NO: 537324 - DNA, 25 bp, Mus musculus
agtgcccagcccacctgtgattatg

SEQ ID NO: 537325 - DNA, 25 bp, Mus musculus
agtgcccagccctcctgtgattatg

SEQ ID NO: 537326 - DNA, 25 bp, Mus musculus
agtgcccaggctctgttcccagcta

SEQ ID NO: 537327 - DNA, 25 bp, Mus musculus
agtgcccaggctgtgttcccagcta

SEQ ID NO: 537328 - DNA, 25 bp, Mus musculus
agtgcccagtctccatacattaacc

SEQ ID NO: 537329 - DNA, 25 bp, Mus musculus
agtgcccagtctgcatacattaacc

SEQ ID NO: 537330 - DNA, 25 bp, Mus musculus
agtgcccagtgtacaagaaatgttt

SEQ ID NO: 537331 - DNA, 25 bp, Mus musculus
agtgcccagtgttcaagaaatgttt

SEQ ID NO: 537332 - DNA, 25 bp, Mus musculus
agtgcccataacacagaacccctgt

SEQ ID NO: 537333 - DNA, 25 bp, Mus musculus
agtgcccataactcagaacccctgt

SEQ ID NO: 537334 - DNA, 25 bp, Mus musculus
agtgccccggaactcaactgaaatg

SEQ ID NO: 537335 - DNA, 25 bp, Mus musculus
agtgccccggaagtcaactgaaatg

SEQ ID NO: 537336 - DNA, 25 bp, Mus musculus
agtgcccggatcaccatctcggagg

SEQ ID NO: 537337 - DNA, 25 bp, Mus musculus
agtgcccggatctccatctcggagg

SEQ ID NO: 537338 - DNA, 25 bp, Mus musculus
agtgcccgtcgactgggacacccaa

SEQ ID NO: 537339 - DNA, 25 bp, Mus musculus
agtgcccgtcgagtgggacacccaa

SEQ ID NO: 537340 - DNA, 25 bp, Mus musculus
agtgcccgtctgacatcagacttgg

SEQ ID NO: 537341 - DNA, 25 bp, Mus musculus
agtgcccgtctgtcatcagacttgg

SEQ ID NO: 537342 - DNA, 25 bp, Mus musculus
agtgccctcgctcagttctgcaagg

SEQ ID NO: 537343 - DNA, 25 bp, Mus musculus
agtgccctcgctgagttctgcaagg

SEQ ID NO: 537344 - DNA, 25 bp, Mus musculus
agtgccctgccacttccagactggg

SEQ ID NO: 537345 - DNA, 25 bp, Mus musculus
agtgccctgccagttccagactggg

SEQ ID NO: 537346 - DNA, 25 bp, Mus musculus
agtgccgagcggaggagcccagtgc

SEQ ID NO: 537347 - DNA, 25 bp, Mus musculus
agtgccgagcggtggagcccagtgc

SEQ ID NO: 537348 - DNA, 25 bp, Mus musculus
agtgccgattcccttttatccagaa

SEQ ID NO: 537349 - DNA, 25 bp, Mus musculus
agtgccgattccgttttatccagaa

SEQ ID NO: 537350 - DNA, 25 bp, Mus musculus
agtgccgcatcgaccgaaacaagca

SEQ ID NO: 537351 - DNA, 25 bp, Mus musculus
agtgccgcatcgtccgaaacaagca

SEQ ID NO: 537352 - DNA, 25 bp, Mus musculus
agtgccgcctgtatccagggtgcca

SEQ ID NO: 537353 - DNA, 25 bp, Mus musculus
agtgccgcctgtttccagggtgcca

SEQ ID NO: 537354 - DNA, 25 bp, Mus musculus
agtgccggcactactctgctcctgt

SEQ ID NO: 537355 - DNA, 25 bp, Mus musculus
agtgccggcacttctctgctcctgt

SEQ ID NO: 537356 - DNA, 25 bp, Mus musculus
agtgccggcgaaaaaggacttctat

SEQ ID NO: 537357 - DNA, 25 bp, Mus musculus
agtgccggcgaataaggacttctat

SEQ ID NO: 537358 - DNA, 25 bp, Mus musculus
agtgccggctaacgaagtgcaaaga

SEQ ID NO: 537359 - DNA, 25 bp, Mus musculus
agtgccggctaaggaagtgcaaaga

SEQ ID NO: 537360 - DNA, 25 bp, Mus musculus
agtgccggttcgctgcgtaacagcc

SEQ ID NO: 537361 - DNA, 25 bp, Mus musculus
agtgccggttcggtgcgtaacagcc

SEQ ID NO: 537362 - DNA, 25 bp, Mus musculus
agtgcctactacaagcctctcctgt

SEQ ID NO: 537363 - DNA, 25 bp, Mus musculus
agtgcctactactagcctctcctgt

SEQ ID NO: 537364 - DNA, 25 bp, Mus musculus
agtgcctcagaacacgtttggagaa

SEQ ID NO: 537365 - DNA, 25 bp, Mus musculus
agtgcctcagaagacgtttggagaa

SEQ ID NO: 537366 - DNA, 25 bp, Mus musculus
agtgcctcctccctgtcaagggcag

SEQ ID NO: 537367 - DNA, 25 bp, Mus musculus
agtgcctcctccgtgtcaagggcag

SEQ ID NO: 537368 - DNA, 25 bp, Mus musculus
agtgcctctgacaggccaggtgcct

SEQ ID NO: 537369 - DNA, 25 bp, Mus musculus
agtgcctctgactggccaggtgcct

SEQ ID NO: 537370 - DNA, 25 bp, Mus musculus
agtgcctctggacgactctggctaa

SEQ ID NO: 537371 - DNA, 25 bp, Mus musculus
agtgcctctggaggactctggctaa

SEQ ID NO: 537372 - DNA, 25 bp, Mus musculus
agtgcctgcccgagtactatgagca

SEQ ID NO: 537373 - DNA, 25 bp, Mus musculus
agtgcctgcccgtgtactatgagca

SEQ ID NO: 537374 - DNA, 25 bp, Mus musculus
agtgcctgctggagcgccccagttc

SEQ ID NO: 537375 - DNA, 25 bp, Mus musculus
agtgcctgctggtgcgccccagttc

SEQ ID NO: 537376 - DNA, 25 bp, Mus musculus
agtgcctggaagatcgaaaccctgg

SEQ ID NO: 537377 - DNA, 25 bp, Mus musculus
agtgcctggaagttcgaaaccctgg

SEQ ID NO: 537378 - DNA, 25 bp, Mus musculus
agtgcctggtttctatggagaaagt

SEQ ID NO: 537379 - DNA, 25 bp, Mus musculus
agtgcctggtttgtatggagaaagt

SEQ ID NO: 537380 - DNA, 25 bp, Mus musculus
agtgcctgtgcccacacagtctgtg

SEQ ID NO: 537381 - DNA, 25 bp, Mus musculus
agtgcctgtgccgacacagtctgtg

SEQ ID NO: 537382 - DNA, 25 bp, Mus musculus
agtgcctgttttcagccatgaggtc

SEQ ID NO: 537383 - DNA, 25 bp, Mus musculus
agtgcctgttttgagccatgaggtc

SEQ ID NO: 537384 - DNA, 25 bp, Mus musculus
agtgccttatacaccatgatgaagg

SEQ ID NO: 537385 - DNA, 25 bp, Mus musculus
agtgccttatactccatgatgaagg

SEQ ID NO: 537386 - DNA, 25 bp, Mus musculus
agtgcgaagcgcactgcacgcgcct

SEQ ID NO: 537387 - DNA, 25 bp, Mus musculus
agtgcgaagcgctctgcacgcgcct

SEQ ID NO: 537388 - DNA, 25 bp, Mus musculus
agtgcgaggcctcccgacgcactga

SEQ ID NO: 537389 - DNA, 25 bp, Mus musculus
agtgcgaggcctgccgacgcactga

SEQ ID NO: 537390 - DNA, 25 bp, Mus musculus
agtgcgagtttgagcgctaggattt

SEQ ID NO: 537391 - DNA, 25 bp, Mus musculus
agtgcgagtttgtgcgctaggattt

SEQ ID NO: 537392 - DNA, 25 bp, Mus musculus
agtgcgatcacaaccactgtcaacc

SEQ ID NO: 537393 - DNA, 25 bp, Mus musculus
agtgcgatcacatccactgtcaacc

SEQ ID NO: 537394 - DNA, 25 bp, Mus musculus
agtgcgcgccgcaacattctggaga

SEQ ID NO: 537395 - DNA, 25 bp, Mus musculus
agtgcgcgccgctacattctggaga

SEQ ID NO: 537396 - DNA, 25 bp, Mus musculus
agtgcgcgcggccaatgcttcattc

SEQ ID NO: 537397 - DNA, 25 bp, Mus musculus
agtgcgcgcggcgaatgcttcattc

SEQ ID NO: 537398 - DNA, 25 bp, Mus musculus
agtgcggcctgcattgctatccaga

SEQ ID NO: 537399 - DNA, 25 bp, Mus musculus
agtgcggcctgctttgctatccaga

SEQ ID NO: 537400 - DNA, 25 bp, Mus musculus
agtgcggcgcagcaagacacttaga

SEQ ID NO: 537401 - DNA, 25 bp, Mus musculus
agtgcggcgcaggaagacacttaga

SEQ ID NO: 537402 - DNA, 25 bp, Mus musculus
agtgcgggccgcaccctatgactgg

SEQ ID NO: 537403 - DNA, 25 bp, Mus musculus
agtgcgggccgctccctatgactgg

SEQ ID NO: 537404 - DNA, 25 bp, Mus musculus
agtgcgtcctcgagccggactgacc

SEQ ID NO: 537405 - DNA, 25 bp, Mus musculus
agtgcgtcctcgtgccggactgacc

SEQ ID NO: 537406 - DNA, 25 bp, Mus musculus
agtgcgtcgggccaaacaagtgcaa

SEQ ID NO: 537407 - DNA, 25 bp, Mus musculus
agtgcgtcgggcgaaacaagtgcaa

SEQ ID NO: 537408 - DNA, 25 bp, Mus musculus
agtgcgtctcccagagctggcacca

SEQ ID NO: 537409 - DNA, 25 bp, Mus musculus
agtgcgtctccctgagctggcacca

SEQ ID NO: 537410 - DNA, 25 bp, Mus musculus
agtgcgtgacccatctccggaaaag

SEQ ID NO: 537411 - DNA, 25 bp, Mus musculus
agtgcgtgacccttctccggaaaag

SEQ ID NO: 537412 - DNA, 25 bp, Mus musculus
agtgcgtggcccatgggccagtccc

SEQ ID NO: 537413 - DNA, 25 bp, Mus musculus
agtgcgtggcccttgggccagtccc

SEQ ID NO: 537414 - DNA, 25 bp, Mus musculus
agtgctaaaccacctgggagccctc

SEQ ID NO: 537415 - DNA, 25 bp, Mus musculus
agtgctaaaccagctgggagccctc

SEQ ID NO: 537416 - DNA, 25 bp, Mus musculus
agtgctacaaccactgcccagagca

SEQ ID NO: 537417 - DNA, 25 bp, Mus musculus
agtgctacaacctctgcccagagca

SEQ ID NO: 537418 - DNA, 25 bp, Mus musculus
agtgctacatgtcccagttgttggg

SEQ ID NO: 537419 - DNA, 25 bp, Mus musculus
agtgctacatgtgccagttgttggg

SEQ ID NO: 537420 - DNA, 25 bp, Mus musculus
agtgctacggccactccaaccgttg

SEQ ID NO: 537421 - DNA, 25 bp, Mus musculus
agtgctacggcctctccaaccgttg

SEQ ID NO: 537422 - DNA, 25 bp, Mus musculus
agtgctagccgacaaagcccgagtc

SEQ ID NO: 537423 - DNA, 25 bp, Mus musculus
agtgctagccgagaaagcccgagtc

SEQ ID NO: 537424 - DNA, 25 bp, Mus musculus
agtgctagtttaaggccttcatgga

SEQ ID NO: 537425 - DNA, 25 bp, Mus musculus
agtgctagtttatggccttcatgga

SEQ ID NO: 537426 - DNA, 25 bp, Mus musculus
agtgctatggttacaatggtcacca

SEQ ID NO: 537427 - DNA, 25 bp, Mus musculus
agtgctatggtttcaatggtcacca

SEQ ID NO: 537428 - DNA, 25 bp, Mus musculus
agtgctattcctcggtctctggccg

SEQ ID NO: 537429 - DNA, 25 bp, Mus musculus
agtgctattcctgggtctctggccg

SEQ ID NO: 537430 - DNA, 25 bp, Mus musculus
agtgctcacagtactgcactacagg

SEQ ID NO: 537431 - DNA, 25 bp, Mus musculus
agtgctcacagttctgcactacagg

SEQ ID NO: 537432 - DNA, 25 bp, Mus musculus
agtgctcagcaaaccaactcattga

SEQ ID NO: 537433 - DNA, 25 bp, Mus musculus
agtgctcagcaatccaactcattga

SEQ ID NO: 537434 - DNA, 25 bp, Mus musculus
agtgctcagcgcaggagcccatgag

SEQ ID NO: 537435 - DNA, 25 bp, Mus musculus
agtgctcagcgctggagcccatgag

SEQ ID NO: 537436 - DNA, 25 bp, Mus musculus
agtgctcagtacaaagctcgtgtcg

SEQ ID NO: 537437 - DNA, 25 bp, Mus musculus
agtgctcagtactaagctcgtgtcg

SEQ ID NO: 537438 - DNA, 25 bp, Mus musculus
agtgctcatctcatctgtccccagg

SEQ ID NO: 537439 - DNA, 25 bp, Mus musculus
agtgctcatctcttctgtccccagg

SEQ ID NO: 537440 - DNA, 25 bp, Mus musculus
agtgctccaagacctgcggaactgg

SEQ ID NO: 537441 - DNA, 25 bp, Mus musculus
agtgctccaagagctgcggaactgg

SEQ ID NO: 537442 - DNA, 25 bp, Mus musculus
agtgctcccacgaagattgctccag

SEQ ID NO: 537443 - DNA, 25 bp, Mus musculus
agtgctcccacgtagattgctccag

SEQ ID NO: 537444 - DNA, 25 bp, Mus musculus
agtgctcccggaagccagaaacttt

SEQ ID NO: 537445 - DNA, 25 bp, Mus musculus
agtgctcccggatgccagaaacttt

SEQ ID NO: 537446 - DNA, 25 bp, Mus musculus
agtgctccgtgaagcatagccggag

SEQ ID NO: 537447 - DNA, 25 bp, Mus musculus
agtgctccgtgatgcatagccggag

SEQ ID NO: 537448 - DNA, 25 bp, Mus musculus
agtgctcctggccacactagctgct

SEQ ID NO: 537449 - DNA, 25 bp, Mus musculus
agtgctcctggcgacactagctgct

SEQ ID NO: 537450 - DNA, 25 bp, Mus musculus
agtgctcctgtcacatcctgatcca

SEQ ID NO: 537451 - DNA, 25 bp, Mus musculus
agtgctcctgtctcatcctgatcca

SEQ ID NO: 537452 - DNA, 25 bp, Mus musculus
agtgctcgtgccaacatcacgctgt

SEQ ID NO: 537453 - DNA, 25 bp, Mus musculus
agtgctcgtgcctacatcacgctgt

SEQ ID NO: 537454 - DNA, 25 bp, Mus musculus
agtgctctggaacctgccacggagt

SEQ ID NO: 537455 - DNA, 25 bp, Mus musculus
agtgctctggaagctgccacggagt

SEQ ID NO: 537456 - DNA, 25 bp, Mus musculus
agtgctcttctgaccggcgttgtaa

SEQ ID NO: 537457 - DNA, 25 bp, Mus musculus
agtgctcttctgtccggcgttgtaa

SEQ ID NO: 537458 - DNA, 25 bp, Mus musculus
agtgctgaaggcaattcagaaagcc

SEQ ID NO: 537459 - DNA, 25 bp, Mus musculus
agtgctgaaggcagtggaacacatc

SEQ ID NO: 537460 - DNA, 25 bp, Mus musculus
agtgctgaaggccacagcccccgga

SEQ ID NO: 537461 - DNA, 25 bp, Mus musculus
agtgctgaaggcgacagcccccgga

SEQ ID NO: 537462 - DNA, 25 bp, Mus musculus
agtgctgaaggctattcagaaagcc

SEQ ID NO: 537463 - DNA, 25 bp, Mus musculus
agtgctgaaggctgtggaacacatc

SEQ ID NO: 537464 - DNA, 25 bp, Mus musculus
agtgctgacagtacacatttacagg

SEQ ID NO: 537465 - DNA, 25 bp, Mus musculus
agtgctgacagttcacatttacagg

SEQ ID NO: 537466 - DNA, 25 bp, Mus musculus
agtgctgacattcctgatcaattgc

SEQ ID NO: 537467 - DNA, 25 bp, Mus musculus
agtgctgacattgctgatcaattgc

SEQ ID NO: 537468 - DNA, 25 bp, Mus musculus
agtgctgacctcagccggttggaca

SEQ ID NO: 537469 - DNA, 25 bp, Mus musculus
agtgctgacctctgccggttggaca

SEQ ID NO: 537470 - DNA, 25 bp, Mus musculus
agtgctgatcctcgacgaggccacc

SEQ ID NO: 537471 - DNA, 25 bp, Mus musculus
agtgctgatcctggacgaggccacc

SEQ ID NO: 537472 - DNA, 25 bp, Mus musculus
agtgctgatgagcaacttggccctg

SEQ ID NO: 537473 - DNA, 25 bp, Mus musculus
agtgctgatgaggaacttggccctg

SEQ ID NO: 537474 - DNA, 25 bp, Mus musculus
agtgctgattcgactttttgatggg

SEQ ID NO: 537475 - DNA, 25 bp, Mus musculus
agtgctgattcgtctttttgatggg

SEQ ID NO: 537476 - DNA, 25 bp, Mus musculus
agtgctgcccagcatggacaacatc

SEQ ID NO: 537477 - DNA, 25 bp, Mus musculus
agtgctgcccaggatggacaacatc

SEQ ID NO: 537478 - DNA, 25 bp, Mus musculus
agtgctgcctgccttcgcagggcat

SEQ ID NO: 537479 - DNA, 25 bp, Mus musculus
agtgctgcctgcgttcgcagggcat

SEQ ID NO: 537480 - DNA, 25 bp, Mus musculus
agtgctgcgaccactctacatggac

SEQ ID NO: 537481 - DNA, 25 bp, Mus musculus
agtgctgcgacctctctacatggac

SEQ ID NO: 537482 - DNA, 25 bp, Mus musculus
agtgctggaccgcatccgcaagctg

SEQ ID NO: 537483 - DNA, 25 bp, Mus musculus
agtgctggaccggatccgcaagctg

SEQ ID NO: 537484 - DNA, 25 bp, Mus musculus
agtgctggagccatcccatcaggga

SEQ ID NO: 537485 - DNA, 25 bp, Mus musculus
agtgctggagccttcccatcaggga

SEQ ID NO: 537486 - DNA, 25 bp, Mus musculus
agtgctggccgcaccgtgttggtca

SEQ ID NO: 537487 - DNA, 25 bp, Mus musculus
agtgctggccgctccgtgttggtca

SEQ ID NO: 537488 - DNA, 25 bp, Mus musculus
agtgctgggctacgtccttgctttg

SEQ ID NO: 537489 - DNA, 25 bp, Mus musculus
agtgctgggctaggtccttgctttg

SEQ ID NO: 537490 - DNA, 25 bp, Mus musculus
agtgctgtggctcacctctggaaac

SEQ ID NO: 537491 - DNA, 25 bp, Mus musculus
agtgctgtggctgacctctggaaac

SEQ ID NO: 537492 - DNA, 25 bp, Mus musculus
agtgctgtgtctagccggcttccgg

SEQ ID NO: 537493 - DNA, 25 bp, Mus musculus
agtgctgtgtcttgccggcttccgg

SEQ ID NO: 537494 - DNA, 25 bp, Mus musculus
agtgcttaggagactaccagacaga

SEQ ID NO: 537495 - DNA, 25 bp, Mus musculus
agtgcttaggagtctaccagacaga

SEQ ID NO: 537496 - DNA, 25 bp, Mus musculus
agtgcttcacaaagcctcccaggac

SEQ ID NO: 537497 - DNA, 25 bp, Mus musculus
agtgcttcacaatgcctcccaggac

SEQ ID NO: 537498 - DNA, 25 bp, Mus musculus
agtgcttcagcaacgacaaccctgg

SEQ ID NO: 537499 - DNA, 25 bp, Mus musculus
agtgcttcagcatcgacaaccctgg

SEQ ID NO: 537500 - DNA, 25 bp, Mus musculus
agtgcttccagccttctctcgaact

SEQ ID NO: 537501 - DNA, 25 bp, Mus musculus
agtgcttccagcgttctctcgaact

SEQ ID NO: 537502 - DNA, 25 bp, Mus musculus
agtgcttccggacaggtctctgcgt

SEQ ID NO: 537503 - DNA, 25 bp, Mus musculus
agtgcttccggagaggtctctgcgt

SEQ ID NO: 537504 - DNA, 25 bp, Mus musculus
agtgcttccgggagggcatgcgcaa

SEQ ID NO: 537505 - DNA, 25 bp, Mus musculus
agtgcttccgggtgggcatgcgcaa

SEQ ID NO: 537506 - DNA, 25 bp, Mus musculus
agtgcttggtataaatgaatggcag

SEQ ID NO: 537507 - DNA, 25 bp, Mus musculus
agtgcttggtattaatgaatggcag

SEQ ID NO: 537508 - DNA, 25 bp, Mus musculus
agtgctttcacgattctcaagtttc

SEQ ID NO: 537509 - DNA, 25 bp, Mus musculus
agtgctttcacgtttctcaagtttc

SEQ ID NO: 537510 - DNA, 25 bp, Mus musculus
agtgctttggcaccttcatcaccaa

SEQ ID NO: 537511 - DNA, 25 bp, Mus musculus
agtgctttggcagcttcatcaccaa

SEQ ID NO: 537512 - DNA, 25 bp, Mus musculus
agtggaaaaaccactctcgtttcag

SEQ ID NO: 537513 - DNA, 25 bp, Mus musculus
agtggaaaaacctctctcgtttcag

SEQ ID NO: 537514 - DNA, 25 bp, Mus musculus
agtggaaaccacctcaaattgacaa

SEQ ID NO: 537515 - DNA, 25 bp, Mus musculus
agtggaaaccacgtcaaattgacaa

SEQ ID NO: 537516 - DNA, 25 bp, Mus musculus
agtggaaactccagcgtgctgtggc

SEQ ID NO: 537517 - DNA, 25 bp, Mus musculus
agtggaaactcctgcgtgctgtggc

SEQ ID NO: 537518 - DNA, 25 bp, Mus musculus
agtggaactcttaggccctgtgacc

SEQ ID NO: 537519 - DNA, 25 bp, Mus musculus
agtggaactctttggccctgtgacc

SEQ ID NO: 537520 - DNA, 25 bp, Mus musculus
agtggaagacgtcaaagccctggtc

SEQ ID NO: 537521 - DNA, 25 bp, Mus musculus
agtggaagacgtgaaagccctggtc

SEQ ID NO: 537522 - DNA, 25 bp, Mus musculus
agtggaagcaccaatcctcggaagg

SEQ ID NO: 537523 - DNA, 25 bp, Mus musculus
agtggaagcacctatcctcggaagg

SEQ ID NO: 537524 - DNA, 25 bp, Mus musculus
agtggaaggccaacctgcgctgtgc

SEQ ID NO: 537525 - DNA, 25 bp, Mus musculus
agtggaaggccatcctgcgctgtgc

SEQ ID NO: 537526 - DNA, 25 bp, Mus musculus
agtggaagtggccaatatgacctca

SEQ ID NO: 537527 - DNA, 25 bp, Mus musculus
agtggaagtggcgaatatgacctca

SEQ ID NO: 537528 - DNA, 25 bp, Mus musculus
agtggaataaacaaccctgtggtat

SEQ ID NO: 537529 - DNA, 25 bp, Mus musculus
agtggaataaactaccctgtggtat

SEQ ID NO: 537530 - DNA, 25 bp, Mus musculus
agtggaatgagaaagtgacgcagtc

SEQ ID NO: 537531 - DNA, 25 bp, Mus musculus
agtggaatgagatagtgacgcagtc

SEQ ID NO: 537532 - DNA, 25 bp, Mus musculus
agtggaattcacagccttggaggac

SEQ ID NO: 537533 - DNA, 25 bp, Mus musculus
agtggaattcactgccttggaggac

SEQ ID NO: 537534 - DNA, 25 bp, Mus musculus
agtggacaatcacctactgaggacg

SEQ ID NO: 537535 - DNA, 25 bp, Mus musculus
agtggacaatcagctactgaggacg

SEQ ID NO: 537536 - DNA, 25 bp, Mus musculus
agtggacaccctctacagctaatgc

SEQ ID NO: 537537 - DNA, 25 bp, Mus musculus
agtggacaccctgtacagctaatgc

SEQ ID NO: 537538 - DNA, 25 bp, Mus musculus
agtggacagaccctctatgaacaag

SEQ ID NO: 537539 - DNA, 25 bp, Mus musculus
agtggacagaccgtctatgaacaag

SEQ ID NO: 537540 - DNA, 25 bp, Mus musculus
agtggacagagcacctcatcttgcc

SEQ ID NO: 537541 - DNA, 25 bp, Mus musculus
agtggacagagctcctcatcttgcc

SEQ ID NO: 537542 - DNA, 25 bp, Mus musculus
agtggacattgacgatcacacagac

SEQ ID NO: 537543 - DNA, 25 bp, Mus musculus
agtggacattgaggatcacacagac

SEQ ID NO: 537544 - DNA, 25 bp, Mus musculus
agtggaccacaaagctccttttgag

SEQ ID NO: 537545 - DNA, 25 bp, Mus musculus
agtggaccacaatgctccttttgag

SEQ ID NO: 537546 - DNA, 25 bp, Mus musculus
agtggaccacagcaccatacactcg

SEQ ID NO: 537547 - DNA, 25 bp, Mus musculus
agtggaccacaggaccatacactcg

SEQ ID NO: 537548 - DNA, 25 bp, Mus musculus
agtggaccagacacgggagctttgt

SEQ ID NO: 537549 - DNA, 25 bp, Mus musculus
agtggaccagactcgggagctttgt

SEQ ID NO: 537550 - DNA, 25 bp, Mus musculus
agtggacgggccacatccctagaga

SEQ ID NO: 537551 - DNA, 25 bp, Mus musculus
agtggacgggcctcatccctagaga

SEQ ID NO: 537552 - DNA, 25 bp, Mus musculus
agtggacgtataacccagttctcag

SEQ ID NO: 537553 - DNA, 25 bp, Mus musculus
agtggacgtatatcccagttctcag

SEQ ID NO: 537554 - DNA, 25 bp, Mus musculus
agtggactagacagctgacaacgaa

SEQ ID NO: 537555 - DNA, 25 bp, Mus musculus
agtggactagactgctgacaacgaa

SEQ ID NO: 537556 - DNA, 25 bp, Mus musculus
agtggactccatcatgctggtggaa

SEQ ID NO: 537557 - DNA, 25 bp, Mus musculus
agtggactccatgatgctggtggaa

SEQ ID NO: 537558 - DNA, 25 bp, Mus musculus
agtggactgccaactcacacagaac

SEQ ID NO: 537559 - DNA, 25 bp, Mus musculus
agtggactgccatctcacacagaac

SEQ ID NO: 537560 - DNA, 25 bp, Mus musculus
agtggacttccacggtgttacatac

SEQ ID NO: 537561 - DNA, 25 bp, Mus musculus
agtggacttccagggtgttacatac

SEQ ID NO: 537562 - DNA, 25 bp, Mus musculus
agtggacttgatagccaaatacatc

SEQ ID NO: 537563 - DNA, 25 bp, Mus musculus
agtggacttgattgccaaatacatc

SEQ ID NO: 537564 - DNA, 25 bp, Mus musculus
agtggagaaccacaaccttcgaggc

SEQ ID NO: 537565 - DNA, 25 bp, Mus musculus
agtggagaaccagaaccttcgaggc

SEQ ID NO: 537566 - DNA, 25 bp, Mus musculus
agtggagacatcatactctggtggc

SEQ ID NO: 537567 - DNA, 25 bp, Mus musculus
agtggagacatcttactctggtggc

SEQ ID NO: 537568 - DNA, 25 bp, Mus musculus
agtggagaccagactgaaacttcct

SEQ ID NO: 537569 - DNA, 25 bp, Mus musculus
agtggagaccagtctgaaacttcct

SEQ ID NO: 537570 - DNA, 25 bp, Mus musculus
agtggagagctaccctctgaaaggt

SEQ ID NO: 537571 - DNA, 25 bp, Mus musculus
agtggagagctagcctctgaaaggt

SEQ ID NO: 537572 - DNA, 25 bp, Mus musculus
agtggagagttcaatagagcaatcg

SEQ ID NO: 537573 - DNA, 25 bp, Mus musculus
agtggagagttctatagagcaatcg

SEQ ID NO: 537574 - DNA, 25 bp, Mus musculus
agtggagatcatccactgaagttca

SEQ ID NO: 537575 - DNA, 25 bp, Mus musculus
agtggagatcatgcactgaagttca

SEQ ID NO: 537576 - DNA, 25 bp, Mus musculus
agtggagcacaacttcaaagctggg

SEQ ID NO: 537577 - DNA, 25 bp, Mus musculus
agtggagcacaagttcaaagctggg

SEQ ID NO: 537578 - DNA, 25 bp, Mus musculus
agtggagcagccactaggacgagct

SEQ ID NO: 537579 - DNA, 25 bp, Mus musculus
agtggagcagcctctaggacgagct

SEQ ID NO: 537580 - DNA, 25 bp, Mus musculus
agtggagcagctctagtcaatgcat

SEQ ID NO: 537581 - DNA, 25 bp, Mus musculus
agtggagcagctgtagtcaatgcat

SEQ ID NO: 537582 - DNA, 25 bp, Mus musculus
agtggagcccacagcatgctgccct

SEQ ID NO: 537583 - DNA, 25 bp, Mus musculus
agtggagcccactgcatgctgccct

SEQ ID NO: 537584 - DNA, 25 bp, Mus musculus
agtggagccgccacttcgaagcgtc

SEQ ID NO: 537585 - DNA, 25 bp, Mus musculus
agtggagccgcctcttcgaagcgtc

SEQ ID NO: 537586 - DNA, 25 bp, Mus musculus
agtggagcggctcattcacccccag

SEQ ID NO: 537587 - DNA, 25 bp, Mus musculus
agtggagcggctgattcacccccag

SEQ ID NO: 537588 - DNA, 25 bp, Mus musculus
agtggagctggtccctcagtatcca

SEQ ID NO: 537589 - DNA, 25 bp, Mus musculus
agtggagctggtgcctcagtatcca

SEQ ID NO: 537590 - DNA, 25 bp, Mus musculus
agtggaggacatccaaactgaggat

SEQ ID NO: 537591 - DNA, 25 bp, Mus musculus
agtggaggacatgcaaactgaggat

SEQ ID NO: 537592 - DNA, 25 bp, Mus musculus
agtggaggactcagttctgccccaa

SEQ ID NO: 537593 - DNA, 25 bp, Mus musculus
agtggaggactctgttctgccccaa

SEQ ID NO: 537594 - DNA, 25 bp, Mus musculus
agtggaggagttcgcacctgccaaa

SEQ ID NO: 537595 - DNA, 25 bp, Mus musculus
agtggaggagttggcacctgccaaa

SEQ ID NO: 537596 - DNA, 25 bp, Mus musculus
agtggaggttgtatctggattgctc

SEQ ID NO: 537597 - DNA, 25 bp, Mus musculus
agtggaggttgtttctggattgctc

SEQ ID NO: 537598 - DNA, 25 bp, Mus musculus
agtggagtacacagaaccccaccga

SEQ ID NO: 537599 - DNA, 25 bp, Mus musculus
agtggagtacactgaaccccaccga

SEQ ID NO: 537600 - DNA, 25 bp, Mus musculus
agtggagtccccagacacagtacag

SEQ ID NO: 537601 - DNA, 25 bp, Mus musculus
agtggagtcccctgacacagtacag

SEQ ID NO: 537602 - DNA, 25 bp, Mus musculus
agtggagtgaccacaacttctggtc

SEQ ID NO: 537603 - DNA, 25 bp, Mus musculus
agtggagtgacctcaacttctggtc

SEQ ID NO: 537604 - DNA, 25 bp, Mus musculus
agtggagtgggtaaatgtcttgaac

SEQ ID NO: 537605 - DNA, 25 bp, Mus musculus
agtggagtgggttaatgtcttgaac

SEQ ID NO: 537606 - DNA, 25 bp, Mus musculus
agtggagttagcagccaacacaaag

SEQ ID NO: 537607 - DNA, 25 bp, Mus musculus
agtggagttagctgccaacacaaag

SEQ ID NO: 537608 - DNA, 25 bp, Mus musculus
agtggatcaattccatgttaagtga

SEQ ID NO: 537609 - DNA, 25 bp, Mus musculus
agtggatcaattgcatgttaagtga

SEQ ID NO: 537610 - DNA, 25 bp, Mus musculus
agtggatcagcgactatgaagactc

SEQ ID NO: 537611 - DNA, 25 bp, Mus musculus
agtggatcagcgtctatgaagactc

SEQ ID NO: 537612 - DNA, 25 bp, Mus musculus
agtggatccacactgccttcaggag

SEQ ID NO: 537613 - DNA, 25 bp, Mus musculus
agtggatccacagtgccttcaggag

SEQ ID NO: 537614 - DNA, 25 bp, Mus musculus
agtggatgcagcacgatatggaaac

SEQ ID NO: 537615 - DNA, 25 bp, Mus musculus
agtggatgcagctcgatatggaaac

SEQ ID NO: 537616 - DNA, 25 bp, Mus musculus
agtggatgccacagacgtcatgaaa

SEQ ID NO: 537617 - DNA, 25 bp, Mus musculus
agtggatgccactgacgtcatgaaa

SEQ ID NO: 537618 - DNA, 25 bp, Mus musculus
agtggatggacaccaccgcttgcct

SEQ ID NO: 537619 - DNA, 25 bp, Mus musculus
agtggatggacagcaccgcttgcct

SEQ ID NO: 537620 - DNA, 25 bp, Mus musculus
agtggatggagtaaacaagcttcgg

SEQ ID NO: 537621 - DNA, 25 bp, Mus musculus
agtggatggagttaacaagcttcgg

SEQ ID NO: 537622 - DNA, 25 bp, Mus musculus
agtggatgtgtaaacaacacactgc

SEQ ID NO: 537623 - DNA, 25 bp, Mus musculus
agtggatgtgtatacaacacactgc

SEQ ID NO: 537624 - DNA, 25 bp, Mus musculus
agtggatgttccagaggacctgaga

SEQ ID NO: 537625 - DNA, 25 bp, Mus musculus
agtggatgttcctgaggacctgaga

SEQ ID NO: 537626 - DNA, 25 bp, Mus musculus
agtggattagccatcccttcctgct

SEQ ID NO: 537627 - DNA, 25 bp, Mus musculus
agtggattagccttcccttcctgct

SEQ ID NO: 537628 - DNA, 25 bp, Mus musculus
agtggattccctcggtactctccct

SEQ ID NO: 537629 - DNA, 25 bp, Mus musculus
agtggattccctgggtactctccct

SEQ ID NO: 537630 - DNA, 25 bp, Mus musculus
agtggattgaaaagcagaacagagc

SEQ ID NO: 537631 - DNA, 25 bp, Mus musculus
agtggattgaaatgcagaacagagc

SEQ ID NO: 537632 - DNA, 25 bp, Mus musculus
agtggcaaatgcatagatcggtctg

SEQ ID NO: 537633 - DNA, 25 bp, Mus musculus
agtggcaaatgcttagatcggtctg

SEQ ID NO: 537634 - DNA, 25 bp, Mus musculus
agtggcaacgtcaccaccagcttca

SEQ ID NO: 537635 - DNA, 25 bp, Mus musculus
agtggcaacgtctccaccagcttca

SEQ ID NO: 537636 - DNA, 25 bp, Mus musculus
agtggcaagtctccaagcccaagga

SEQ ID NO: 537637 - DNA, 25 bp, Mus musculus
agtggcaagtctgcaagcccaagga

SEQ ID NO: 537638 - DNA, 25 bp, Mus musculus
agtggcactgctctggcccacaaga

SEQ ID NO: 537639 - DNA, 25 bp, Mus musculus
agtggcactgctgtggcccacaaga

SEQ ID NO: 537640 - DNA, 25 bp, Mus musculus
agtggcactgtcagagccccagcca

SEQ ID NO: 537641 - DNA, 25 bp, Mus musculus
agtggcactgtcctctcagattatg

SEQ ID NO: 537642 - DNA, 25 bp, Mus musculus
agtggcactgtcgtctcagattatg

SEQ ID NO: 537643 - DNA, 25 bp, Mus musculus
agtggcactgtctgagccccagcca

SEQ ID NO: 537644 - DNA, 25 bp, Mus musculus
agtggcagaaaacagttgcgcagca

SEQ ID NO: 537645 - DNA, 25 bp, Mus musculus
agtggcagaaaagagttgcgcagca

SEQ ID NO: 537646 - DNA, 25 bp, Mus musculus
agtggcagacccagtgctcgttccc

SEQ ID NO: 537647 - DNA, 25 bp, Mus musculus
agtggcagaccctgtgctcgttccc

SEQ ID NO: 537648 - DNA, 25 bp, Mus musculus
agtggcagcgacacgctacggtgcc

SEQ ID NO: 537649 - DNA, 25 bp, Mus musculus
agtggcagcgactcgctacggtgcc

SEQ ID NO: 537650 - DNA, 25 bp, Mus musculus
agtggccaacggcactgaagcctgt

SEQ ID NO: 537651 - DNA, 25 bp, Mus musculus
agtggccaacgggactgaagcctgt

SEQ ID NO: 537652 - DNA, 25 bp, Mus musculus
agtggccaagagctctgcagcacag

SEQ ID NO: 537653 - DNA, 25 bp, Mus musculus
agtggccaagaggtctgcagcacag

SEQ ID NO: 537654 - DNA, 25 bp, Mus musculus
agtggccaagctaaggaaaccattc

SEQ ID NO: 537655 - DNA, 25 bp, Mus musculus
agtggccaagcttaggaaaccattc

SEQ ID NO: 537656 - DNA, 25 bp, Mus musculus
agtggccacattagcagcgtgccct

SEQ ID NO: 537657 - DNA, 25 bp, Mus musculus
agtggccacatttgcagcgtgccct

SEQ ID NO: 537658 - DNA, 25 bp, Mus musculus
agtggccacggaccagcaggtgcca

SEQ ID NO: 537659 - DNA, 25 bp, Mus musculus
agtggccacggagcagcaggtgcca

SEQ ID NO: 537660 - DNA, 25 bp, Mus musculus
agtggccacgtacaccttcatccag

SEQ ID NO: 537661 - DNA, 25 bp, Mus musculus
agtggccacgtagaccttcatccag

SEQ ID NO: 537662 - DNA, 25 bp, Mus musculus
agtggccactgaacctgaaccgtct

SEQ ID NO: 537663 - DNA, 25 bp, Mus musculus
agtggccactgatcctgaaccgtct

SEQ ID NO: 537664 - DNA, 25 bp, Mus musculus
agtggccatcaaacctcaatatcta

SEQ ID NO: 537665 - DNA, 25 bp, Mus musculus
agtggccatcaatcctcaatatcta

SEQ ID NO: 537666 - DNA, 25 bp, Mus musculus
agtggcccagtaacacatcattctg

SEQ ID NO: 537667 - DNA, 25 bp, Mus musculus
agtggcccagtatcacatcattctg

SEQ ID NO: 537668 - DNA, 25 bp, Mus musculus
agtggcccagtcataccgttcagtg

SEQ ID NO: 537669 - DNA, 25 bp, Mus musculus
agtggcccagtcttaccgttcagtg

SEQ ID NO: 537670 - DNA, 25 bp, Mus musculus
agtggcccgggccatctctgatcct

SEQ ID NO: 537671 - DNA, 25 bp, Mus musculus
agtggcccgggcgatctctgatcct

SEQ ID NO: 537672 - DNA, 25 bp, Mus musculus
agtggccgagctactcagcctggcc

SEQ ID NO: 537673 - DNA, 25 bp, Mus musculus
agtggccgagcttctcagcctggcc

SEQ ID NO: 537674 - DNA, 25 bp, Mus musculus
agtggccgattccagtcttttggac

SEQ ID NO: 537675 - DNA, 25 bp, Mus musculus
agtggccgattcgagtcttttggac

SEQ ID NO: 537676 - DNA, 25 bp, Mus musculus
agtggccgtcctctgaacctgatgg

SEQ ID NO: 537677 - DNA, 25 bp, Mus musculus
agtggccgtcctgtgaacctgatgg

SEQ ID NO: 537678 - DNA, 25 bp, Mus musculus
agtggcctctcacgctgacagtgca

SEQ ID NO: 537679 - DNA, 25 bp, Mus musculus
agtggcctctcaggctgacagtgca

SEQ ID NO: 537680 - DNA, 25 bp, Mus musculus
agtggcctgcaacttattccaaaca

SEQ ID NO: 537681 - DNA, 25 bp, Mus musculus
agtggcctgcaagttattccaaaca

SEQ ID NO: 537682 - DNA, 25 bp, Mus musculus
agtggcctggccaatctgaatggtt

SEQ ID NO: 537683 - DNA, 25 bp, Mus musculus
agtggcctggcctatctgaatggtt

SEQ ID NO: 537684 - DNA, 25 bp, Mus musculus
agtggccttagacctccaaccggca

SEQ ID NO: 537685 - DNA, 25 bp, Mus musculus
agtggccttagagctccaaccggca

SEQ ID NO: 537686 - DNA, 25 bp, Mus musculus
agtggccttatcaatgttcatgcaa

SEQ ID NO: 537687 - DNA, 25 bp, Mus musculus
agtggccttatctatgttcatgcaa

SEQ ID NO: 537688 - DNA, 25 bp, Mus musculus
agtggccttccaacctacgtagcag

SEQ ID NO: 537689 - DNA, 25 bp, Mus musculus
agtggccttccatcctacgtagcag

SEQ ID NO: 537690 - DNA, 25 bp, Mus musculus
agtggccttgccagcccggagttct

SEQ ID NO: 537691 - DNA, 25 bp, Mus musculus
agtggccttgcctgcccggagttct

SEQ ID NO: 537692 - DNA, 25 bp, Mus musculus
agtggcgacctactctaagttccag

SEQ ID NO: 537693 - DNA, 25 bp, Mus musculus
agtggcgacctagtctaagttccag

SEQ ID NO: 537694 - DNA, 25 bp, Mus musculus
agtggcgccagtccctggacaagct

SEQ ID NO: 537695 - DNA, 25 bp, Mus musculus
agtggcgccagtgcctggacaagct

SEQ ID NO: 537696 - DNA, 25 bp, Mus musculus
agtggcgccgaacgctccgttaagc

SEQ ID NO: 537697 - DNA, 25 bp, Mus musculus
agtggcgccgaaggctccgttaagc

SEQ ID NO: 537698 - DNA, 25 bp, Mus musculus
agtggcgcgatcaccagagtgctga

SEQ ID NO: 537699 - DNA, 25 bp, Mus musculus
agtggcgcgatctccagagtgctga

SEQ ID NO: 537700 - DNA, 25 bp, Mus musculus
agtggcggctacaggtcaaccgcct

SEQ ID NO: 537701 - DNA, 25 bp, Mus musculus
agtggcggctactggtcaaccgcct

SEQ ID NO: 537702 - DNA, 25 bp, Mus musculus
agtggcggtcaactccctccgtgtg

SEQ ID NO: 537703 - DNA, 25 bp, Mus musculus
agtggcggtcaagtccctccgtgtg

SEQ ID NO: 537704 - DNA, 25 bp, Mus musculus
agtggctaaactccacttgggcaga

SEQ ID NO: 537705 - DNA, 25 bp, Mus musculus
agtggctaaactgcacttgggcaga

SEQ ID NO: 537706 - DNA, 25 bp, Mus musculus
agtggctagctccaactcttgcgct

SEQ ID NO: 537707 - DNA, 25 bp, Mus musculus
agtggctagctcgaactcttgcgct

SEQ ID NO: 537708 - DNA, 25 bp, Mus musculus
agtggctaggctaaaatattctacc

SEQ ID NO: 537709 - DNA, 25 bp, Mus musculus
agtggctaggcttaaatattctacc

SEQ ID NO: 537710 - DNA, 25 bp, Mus musculus
agtggctccaacagcaaatatcttc

SEQ ID NO: 537711 - DNA, 25 bp, Mus musculus
agtggctccaactgcaaatatcttc

SEQ ID NO: 537712 - DNA, 25 bp, Mus musculus
agtggctccaatccccggtgcatcg

SEQ ID NO: 537713 - DNA, 25 bp, Mus musculus
agtggctccaatgcccggtgcatcg

SEQ ID NO: 537714 - DNA, 25 bp, Mus musculus
agtggctccaggctcgcctcagcat

SEQ ID NO: 537715 - DNA, 25 bp, Mus musculus
agtggctccagggtcgcctcagcat

SEQ ID NO: 537716 - DNA, 25 bp, Mus musculus
agtggctccccaccatatgcacagg

SEQ ID NO: 537717 - DNA, 25 bp, Mus musculus
agtggctccccagcatatgcacagg

SEQ ID NO: 537718 - DNA, 25 bp, Mus musculus
agtggctctcatcccgggacagttc

SEQ ID NO: 537719 - DNA, 25 bp, Mus musculus
agtggctctcatgccgggacagttc

SEQ ID NO: 537720 - DNA, 25 bp, Mus musculus
agtggctctctccttgtgcagcctg

SEQ ID NO: 537721 - DNA, 25 bp, Mus musculus
agtggctctctcgttgtgcagcctg

SEQ ID NO: 537722 - DNA, 25 bp, Mus musculus
agtggctgaggcagttctggtttca

SEQ ID NO: 537723 - DNA, 25 bp, Mus musculus
agtggctgaggctgttctggtttca

SEQ ID NO: 537724 - DNA, 25 bp, Mus musculus
agtggctgatacacatctatttttc

SEQ ID NO: 537725 - DNA, 25 bp, Mus musculus
agtggctgatactcatctatttttc

SEQ ID NO: 537726 - DNA, 25 bp, Mus musculus
agtggctgatgacaaccccttcgcc

SEQ ID NO: 537727 - DNA, 25 bp, Mus musculus
agtggctgatgagaaccccttcgcc

SEQ ID NO: 537728 - DNA, 25 bp, Mus musculus
agtggctgctctccattgggtccag

SEQ ID NO: 537729 - DNA, 25 bp, Mus musculus
agtggctgctctgcattgggtccag

SEQ ID NO: 537730 - DNA, 25 bp, Mus musculus
agtggctggtcaacgggagcctctt

SEQ ID NO: 537731 - DNA, 25 bp, Mus musculus
agtggctggtcatcgggagcctctt

SEQ ID NO: 537732 - DNA, 25 bp, Mus musculus
agtggctgtactcgcctgaagagca

SEQ ID NO: 537733 - DNA, 25 bp, Mus musculus
agtggctgtactggcctgaagagca

SEQ ID NO: 537734 - DNA, 25 bp, Mus musculus
agtggcttacacctcaactaccatc

SEQ ID NO: 537735 - DNA, 25 bp, Mus musculus
agtggcttacacgtcaactaccatc

SEQ ID NO: 537736 - DNA, 25 bp, Mus musculus
agtggcttcacacagccagatgccc

SEQ ID NO: 537737 - DNA, 25 bp, Mus musculus
agtggcttcacagagccagatgccc

SEQ ID NO: 537738 - DNA, 25 bp, Mus musculus
agtggcttgtgaacctcctgtagcg

SEQ ID NO: 537739 - DNA, 25 bp, Mus musculus
agtggcttgtgatcctcctgtagcg

SEQ ID NO: 537740 - DNA, 25 bp, Mus musculus
agtgggaaccacaacgccatgaaga

SEQ ID NO: 537741 - DNA, 25 bp, Mus musculus
agtgggaaccactacgccatgaaga

SEQ ID NO: 537742 - DNA, 25 bp, Mus musculus
agtgggaactcaccacctagcagca

SEQ ID NO: 537743 - DNA, 25 bp, Mus musculus
agtgggaactcagcacctagcagca

SEQ ID NO: 537744 - DNA, 25 bp, Mus musculus
agtgggaactggagaaactgagcct

SEQ ID NO: 537745 - DNA, 25 bp, Mus musculus
agtgggaactggtgaaactgagcct

SEQ ID NO: 537746 - DNA, 25 bp, Mus musculus
agtgggaagagaaagcatccgaaca

SEQ ID NO: 537747 - DNA, 25 bp, Mus musculus
agtgggaagagatagcatccgaaca

SEQ ID NO: 537748 - DNA, 25 bp, Mus musculus
agtgggaagtaaatatataacctca

SEQ ID NO: 537749 - DNA, 25 bp, Mus musculus
agtgggaagtaattatataacctca

SEQ ID NO: 537750 - DNA, 25 bp, Mus musculus
agtgggaagtctcgccctgatcctg

SEQ ID NO: 537751 - DNA, 25 bp, Mus musculus
agtgggaagtctggccctgatcctg

SEQ ID NO: 537752 - DNA, 25 bp, Mus musculus
agtgggaatgtacccgaactggcac

SEQ ID NO: 537753 - DNA, 25 bp, Mus musculus
agtgggaatgtagccgaactggcac

SEQ ID NO: 537754 - DNA, 25 bp, Mus musculus
agtgggacaacaacgtttgctggcc

SEQ ID NO: 537755 - DNA, 25 bp, Mus musculus
agtgggacaacatcgtttgctggcc

SEQ ID NO: 537756 - DNA, 25 bp, Mus musculus
agtgggacagtaatgtcattgagac

SEQ ID NO: 537757 - DNA, 25 bp, Mus musculus
agtgggacagtattgtcattgagac

SEQ ID NO: 537758 - DNA, 25 bp, Mus musculus
agtgggaccagtcccgcaggttcta

SEQ ID NO: 537759 - DNA, 25 bp, Mus musculus
agtgggaccagtgccgcaggttcta

SEQ ID NO: 537760 - DNA, 25 bp, Mus musculus
agtgggaccctacaacgccagaggc

SEQ ID NO: 537761 - DNA, 25 bp, Mus musculus
agtgggaccctagaacgccagaggc

SEQ ID NO: 537762 - DNA, 25 bp, Mus musculus
agtgggaccgcaccgccttgtatga

SEQ ID NO: 537763 - DNA, 25 bp, Mus musculus
agtgggaccgcagcgccttgtatga

SEQ ID NO: 537764 - DNA, 25 bp, Mus musculus
agtgggacgccactcacacctgcag

SEQ ID NO: 537765 - DNA, 25 bp, Mus musculus
agtgggacgccagtcacacctgcag

SEQ ID NO: 537766 - DNA, 25 bp, Mus musculus
agtgggagaaaacttgactgaccca

SEQ ID NO: 537767 - DNA, 25 bp, Mus musculus
agtgggagaaaagttgactgaccca

SEQ ID NO: 537768 - DNA, 25 bp, Mus musculus
agtgggagcctgaaggcactgctac

SEQ ID NO: 537769 - DNA, 25 bp, Mus musculus
agtgggagcctgtaggcactgctac

SEQ ID NO: 537770 - DNA, 25 bp, Mus musculus
agtgggaggctgattttgagccata

SEQ ID NO: 537771 - DNA, 25 bp, Mus musculus
agtgggaggctgtttttgagccata

SEQ ID NO: 537772 - DNA, 25 bp, Mus musculus
agtgggatcaagatgtcagatgcag

SEQ ID NO: 537773 - DNA, 25 bp, Mus musculus
agtgggatcaagttgtcagatgcag

SEQ ID NO: 537774 - DNA, 25 bp, Mus musculus
agtgggatcaccattgtagtctctc

SEQ ID NO: 537775 - DNA, 25 bp, Mus musculus
agtgggatcacctttgtagtctctc

SEQ ID NO: 537776 - DNA, 25 bp, Mus musculus
agtgggatctcacacgactctgtaa

SEQ ID NO: 537777 - DNA, 25 bp, Mus musculus
agtgggatctcagacgactctgtaa

SEQ ID NO: 537778 - DNA, 25 bp, Mus musculus
agtgggatgtccctcataagctctt

SEQ ID NO: 537779 - DNA, 25 bp, Mus musculus
agtgggatgtccgtcataagctctt

SEQ ID NO: 537780 - DNA, 25 bp, Mus musculus
agtgggatttccatggagacgctga

SEQ ID NO: 537781 - DNA, 25 bp, Mus musculus
agtgggatttccttggagacgctga

SEQ ID NO: 537782 - DNA, 25 bp, Mus musculus
agtgggcaccgaacgcacgggcttc

SEQ ID NO: 537783 - DNA, 25 bp, Mus musculus
agtgggcaccgatcgcacgggcttc

SEQ ID NO: 537784 - DNA, 25 bp, Mus musculus
agtgggccctgacggccatacctgt

SEQ ID NO: 537785 - DNA, 25 bp, Mus musculus
agtgggccctgagggccatacctgt

SEQ ID NO: 537786 - DNA, 25 bp, Mus musculus
agtgggccctgcagggtgcctgggt

SEQ ID NO: 537787 - DNA, 25 bp, Mus musculus
agtgggccctgctgggtgcctgggt

SEQ ID NO: 537788 - DNA, 25 bp, Mus musculus
agtgggccgtgacggcatcatccca

SEQ ID NO: 537789 - DNA, 25 bp, Mus musculus
agtgggccgtgagggcatcatccca

SEQ ID NO: 537790 - DNA, 25 bp, Mus musculus
agtgggcctccacaagtcattaggg

SEQ ID NO: 537791 - DNA, 25 bp, Mus musculus
agtgggcctccagaagtcattaggg

SEQ ID NO: 537792 - DNA, 25 bp, Mus musculus
agtgggcctcctcgacatgaccaag

SEQ ID NO: 537793 - DNA, 25 bp, Mus musculus
agtgggcctcctggacatgaccaag

SEQ ID NO: 537794 - DNA, 25 bp, Mus musculus
agtgggcctctccttggcgctttca

SEQ ID NO: 537795 - DNA, 25 bp, Mus musculus
agtgggcctctcgttggcgctttca

SEQ ID NO: 537796 - DNA, 25 bp, Mus musculus
agtgggcggcctccactgttgccct

SEQ ID NO: 537797 - DNA, 25 bp, Mus musculus
agtgggcggcctgcactgttgccct

SEQ ID NO: 537798 - DNA, 25 bp, Mus musculus
agtgggcttccccacttctggccaa

SEQ ID NO: 537799 - DNA, 25 bp, Mus musculus
agtgggcttcccgacttctggccaa

SEQ ID NO: 537800 - DNA, 25 bp, Mus musculus
agtgggtgatttactctgagatctc

SEQ ID NO: 537801 - DNA, 25 bp, Mus musculus
agtgggtgattttctctgagatctc

SEQ ID NO: 537802 - DNA, 25 bp, Mus musculus
agtgggtggtgaataagtcatctca

SEQ ID NO: 537803 - DNA, 25 bp, Mus musculus
agtgggtggtgattaagtcatctca

SEQ ID NO: 537804 - DNA, 25 bp, Mus musculus
agtgggtgtcctcgccagcacccat

SEQ ID NO: 537805 - DNA, 25 bp, Mus musculus
agtgggtgtcctggccagcacccat

SEQ ID NO: 537806 - DNA, 25 bp, Mus musculus
agtgggttgatgactttcctttaca

SEQ ID NO: 537807 - DNA, 25 bp, Mus musculus
agtgggttgatgtctttcctttaca

SEQ ID NO: 537808 - DNA, 25 bp, Mus musculus
agtggtaacttccagactctgtgaa

SEQ ID NO: 537809 - DNA, 25 bp, Mus musculus
agtggtaacttcgagactctgtgaa

SEQ ID NO: 537810 - DNA, 25 bp, Mus musculus
agtggtatcagtacaagaggcaggc

SEQ ID NO: 537811 - DNA, 25 bp, Mus musculus
agtggtatcagttcaagaggcaggc

SEQ ID NO: 537812 - DNA, 25 bp, Mus musculus
agtggtcagcgcatcgggttctaga

SEQ ID NO: 537813 - DNA, 25 bp, Mus musculus
agtggtcagcgcttcgggttctaga

SEQ ID NO: 537814 - DNA, 25 bp, Mus musculus
agtggtcatgtcaacccacagcaag

SEQ ID NO: 537815 - DNA, 25 bp, Mus musculus
agtggtcatgtctacccacagcaag

SEQ ID NO: 537816 - DNA, 25 bp, Mus musculus
agtggtccagtgacatgcgctgcgt

SEQ ID NO: 537817 - DNA, 25 bp, Mus musculus
agtggtccagtgtcatgcgctgcgt

SEQ ID NO: 537818 - DNA, 25 bp, Mus musculus
agtggtccatgtagccaagcctggc

SEQ ID NO: 537819 - DNA, 25 bp, Mus musculus
agtggtccatgttgccaagcctggc

SEQ ID NO: 537820 - DNA, 25 bp, Mus musculus
agtggtcctgcgaggccttaccatg

SEQ ID NO: 537821 - DNA, 25 bp, Mus musculus
agtggtcctgcgtggccttaccatg

SEQ ID NO: 537822 - DNA, 25 bp, Mus musculus
agtggtcgaacgcaccagatgtgaa

SEQ ID NO: 537823 - DNA, 25 bp, Mus musculus
agtggtcgaacggaccagatgtgaa

SEQ ID NO: 537824 - DNA, 25 bp, Mus musculus
agtggtcgccctctgcctctatgag

SEQ ID NO: 537825 - DNA, 25 bp, Mus musculus
agtggtcgccctgtgcctctatgag

SEQ ID NO: 537826 - DNA, 25 bp, Mus musculus
agtggtctcggcatcacacactgca

SEQ ID NO: 537827 - DNA, 25 bp, Mus musculus
agtggtctcggcttcacacactgca

SEQ ID NO: 537828 - DNA, 25 bp, Mus musculus
agtggtgatcagagtcccctgccac

SEQ ID NO: 537829 - DNA, 25 bp, Mus musculus
agtggtgatcagtgtcccctgccac

SEQ ID NO: 537830 - DNA, 25 bp, Mus musculus
agtggtgattgacctgttcatggca

SEQ ID NO: 537831 - DNA, 25 bp, Mus musculus
agtggtgattgagctgttcatggca

SEQ ID NO: 537832 - DNA, 25 bp, Mus musculus
agtggtgcagacagccagtctcacg

SEQ ID NO: 537833 - DNA, 25 bp, Mus musculus
agtggtgcagactgccagtctcacg

SEQ ID NO: 537834 - DNA, 25 bp, Mus musculus
agtggtgctgatcaggaagtttcct

SEQ ID NO: 537835 - DNA, 25 bp, Mus musculus
agtggtgctgatgaggaagtttcct

SEQ ID NO: 537836 - DNA, 25 bp, Mus musculus
agtggtggactcagaaattaggatg

SEQ ID NO: 537837 - DNA, 25 bp, Mus musculus
agtggtggactctgaaattaggatg

SEQ ID NO: 537838 - DNA, 25 bp, Mus musculus
agtggtggagccatcccatcaggga

SEQ ID NO: 537839 - DNA, 25 bp, Mus musculus
agtggtggagccttcccatcaggga

SEQ ID NO: 537840 - DNA, 25 bp, Mus musculus
agtggtgggagactccctttctccg

SEQ ID NO: 537841 - DNA, 25 bp, Mus musculus
agtggtgggagagtccctttctccg

SEQ ID NO: 537842 - DNA, 25 bp, Mus musculus
agtggtgtaatgaatctcaacccag

SEQ ID NO: 537843 - DNA, 25 bp, Mus musculus
agtggtgtaatgtatctcaacccag

SEQ ID NO: 537844 - DNA, 25 bp, Mus musculus
agtggtgtgcgcacagggacttcac

SEQ ID NO: 537845 - DNA, 25 bp, Mus musculus
agtggtgtgcgctcagggacttcac

SEQ ID NO: 537846 - DNA, 25 bp, Mus musculus
agtggttatggcagggatcatcgcc

SEQ ID NO: 537847 - DNA, 25 bp, Mus musculus
agtggttatggctgggatcatcgcc

SEQ ID NO: 537848 - DNA, 25 bp, Mus musculus
agtggttcgccaccacgaagagttc

SEQ ID NO: 537849 - DNA, 25 bp, Mus musculus
agtggttcgccagcacgaagagttc

SEQ ID NO: 537850 - DNA, 25 bp, Mus musculus
agtggttcttcgagtttggctttgt

SEQ ID NO: 537851 - DNA, 25 bp, Mus musculus
agtggttcttcgtgtttggctttgt

SEQ ID NO: 537852 - DNA, 25 bp, Mus musculus
agtggttggaaaaggcacctatgga

SEQ ID NO: 537853 - DNA, 25 bp, Mus musculus
agtggttggaaatggcacctatgga

SEQ ID NO: 537854 - DNA, 25 bp, Mus musculus
agtggttgtactatgatgctcttga

SEQ ID NO: 537855 - DNA, 25 bp, Mus musculus
agtggttgtactttgatgctcttga

SEQ ID NO: 537856 - DNA, 25 bp, Mus musculus
agtggttgtatactggaaatgctca

SEQ ID NO: 537857 - DNA, 25 bp, Mus musculus
agtggttgtatagtggaaatgctca

SEQ ID NO: 537858 - DNA, 25 bp, Mus musculus
agtgtaaagcctcctcaggagtctg

SEQ ID NO: 537859 - DNA, 25 bp, Mus musculus
agtgtaaagcctgctcaggagtctg

SEQ ID NO: 537860 - DNA, 25 bp, Mus musculus
agtgtacaacatactgagcagtggg

SEQ ID NO: 537861 - DNA, 25 bp, Mus musculus
agtgtacaacattctgagcagtggg

SEQ ID NO: 537862 - DNA, 25 bp, Mus musculus
agtgtacaagtaagaccgcgcctgc

SEQ ID NO: 537863 - DNA, 25 bp, Mus musculus
agtgtacaagtatgaccgcgcctgc

SEQ ID NO: 537864 - DNA, 25 bp, Mus musculus
agtgtacacactccctagcttgcta

SEQ ID NO: 537865 - DNA, 25 bp, Mus musculus
agtgtacacactgcctagcttgcta

SEQ ID NO: 537866 - DNA, 25 bp, Mus musculus
agtgtacagcctccaactccctggg

SEQ ID NO: 537867 - DNA, 25 bp, Mus musculus
agtgtacagcctgcaactccctggg

SEQ ID NO: 537868 - DNA, 25 bp, Mus musculus
agtgtacagtgaaaagctctggatc

SEQ ID NO: 537869 - DNA, 25 bp, Mus musculus
agtgtacagtgataagctctggatc

SEQ ID NO: 537870 - DNA, 25 bp, Mus musculus
agtgtacctcttaggcatggtctgc

SEQ ID NO: 537871 - DNA, 25 bp, Mus musculus
agtgtacctctttggcatggtctgc

SEQ ID NO: 537872 - DNA, 25 bp, Mus musculus
agtgtacggcaccattttctgcagg

SEQ ID NO: 537873 - DNA, 25 bp, Mus musculus
agtgtacggcacgattttctgcagg

SEQ ID NO: 537874 - DNA, 25 bp, Mus musculus
agtgtacggggcaccctacgccgct

SEQ ID NO: 537875 - DNA, 25 bp, Mus musculus
agtgtacggggctccctacgccgct

SEQ ID NO: 537876 - DNA, 25 bp, Mus musculus
agtgtactgaccaccaagaaaccca

SEQ ID NO: 537877 - DNA, 25 bp, Mus musculus
agtgtactgacctccaagaaaccca

SEQ ID NO: 537878 - DNA, 25 bp, Mus musculus
agtgtactggtcagggccatgtgct

SEQ ID NO: 537879 - DNA, 25 bp, Mus musculus
agtgtactggtctgggccatgtgct

SEQ ID NO: 537880 - DNA, 25 bp, Mus musculus
agtgtagagacgcaaaatgcatcgc

SEQ ID NO: 537881 - DNA, 25 bp, Mus musculus
agtgtagagacggaaaatgcatcgc

SEQ ID NO: 537882 - DNA, 25 bp, Mus musculus
agtgtagcagctatgcccggtgtta

SEQ ID NO: 537883 - DNA, 25 bp, Mus musculus
agtgtagcagctttgcccggtgtta

SEQ ID NO: 537884 - DNA, 25 bp, Mus musculus
agtgtatagcatccttgaaggacaa

SEQ ID NO: 537885 - DNA, 25 bp, Mus musculus
agtgtatagcatgcttgaaggacaa

SEQ ID NO: 537886 - DNA, 25 bp, Mus musculus
agtgtatcagatcgccatggtgcac

SEQ ID NO: 537887 - DNA, 25 bp, Mus musculus
agtgtatcagatggccatggtgcac

SEQ ID NO: 537888 - DNA, 25 bp, Mus musculus
agtgtatcagcaatagaaaaccacc

SEQ ID NO: 537889 - DNA, 25 bp, Mus musculus
agtgtatcagcattagaaaaccacc

SEQ ID NO: 537890 - DNA, 25 bp, Mus musculus
agtgtatcatcaatacatgcgatgc

SEQ ID NO: 537891 - DNA, 25 bp, Mus musculus
agtgtatcatcattacatgcgatgc

SEQ ID NO: 537892 - DNA, 25 bp, Mus musculus
agtgtatccagccaatttatttcag

SEQ ID NO: 537893 - DNA, 25 bp, Mus musculus
agtgtatccagcgaatttatttcag

SEQ ID NO: 537894 - DNA, 25 bp, Mus musculus
agtgtatcctcccttagtctgttgg

SEQ ID NO: 537895 - DNA, 25 bp, Mus musculus
agtgtatcctccgttagtctgttgg

SEQ ID NO: 537896 - DNA, 25 bp, Mus musculus
agtgtatgaagtagtgcctacctcc

SEQ ID NO: 537897 - DNA, 25 bp, Mus musculus
agtgtatgaagttgtgcctacctcc

SEQ ID NO: 537898 - DNA, 25 bp, Mus musculus
agtgtatgacagctgacgagacccg

SEQ ID NO: 537899 - DNA, 25 bp, Mus musculus
agtgtatgacaggtgacgagacccg

SEQ ID NO: 537900 - DNA, 25 bp, Mus musculus
agtgtatgaggaacccctgtgaagg

SEQ ID NO: 537901 - DNA, 25 bp, Mus musculus
agtgtatgaggatcccctgtgaagg

SEQ ID NO: 537902 - DNA, 25 bp, Mus musculus
agtgtattctatatcttggaccacg

SEQ ID NO: 537903 - DNA, 25 bp, Mus musculus
agtgtattctatttcttggaccacg

SEQ ID NO: 537904 - DNA, 25 bp, Mus musculus
agtgtatttgtgaatcggcggtccc

SEQ ID NO: 537905 - DNA, 25 bp, Mus musculus
agtgtatttgtgtatcggcggtccc

SEQ ID NO: 537906 - DNA, 25 bp, Mus musculus
agtgtcaaatgtctttgcatgctag

SEQ ID NO: 537907 - DNA, 25 bp, Mus musculus
agtgtcaaatgtgtttgcatgctag

SEQ ID NO: 537908 - DNA, 25 bp, Mus musculus
agtgtcaacaatcgtcccaagtgtc

SEQ ID NO: 537909 - DNA, 25 bp, Mus musculus
agtgtcaacaatggtcccaagtgtc

SEQ ID NO: 537910 - DNA, 25 bp, Mus musculus
agtgtcaacatcacctttaccagcg

SEQ ID NO: 537911 - DNA, 25 bp, Mus musculus
agtgtcaacatctcctttaccagcg

SEQ ID NO: 537912 - DNA, 25 bp, Mus musculus
agtgtcaacgctcggacctgcagca

SEQ ID NO: 537913 - DNA, 25 bp, Mus musculus
agtgtcaacgctgggacctgcagca

SEQ ID NO: 537914 - DNA, 25 bp, Mus musculus
agtgtcaagactaaagctgctgtcc

SEQ ID NO: 537915 - DNA, 25 bp, Mus musculus
agtgtcaagacttaagctgctgtcc

SEQ ID NO: 537916 - DNA, 25 bp, Mus musculus
agtgtcaaggtgatgagagactcca

SEQ ID NO: 537917 - DNA, 25 bp, Mus musculus
agtgtcaaggtgttgagagactcca

SEQ ID NO: 537918 - DNA, 25 bp, Mus musculus
agtgtcaagtagcagctgcgtgtct

SEQ ID NO: 537919 - DNA, 25 bp, Mus musculus
agtgtcaagtaggagctgcgtgtct

SEQ ID NO: 537920 - DNA, 25 bp, Mus musculus
agtgtcacctagcactctgagacag

SEQ ID NO: 537921 - DNA, 25 bp, Mus musculus
agtgtcacctaggactctgagacag

SEQ ID NO: 537922 - DNA, 25 bp, Mus musculus
agtgtcacgtctaagatccgcctcc

SEQ ID NO: 537923 - DNA, 25 bp, Mus musculus
agtgtcacgtcttagatccgcctcc

SEQ ID NO: 537924 - DNA, 25 bp, Mus musculus
agtgtcactacccagtaccagggca

SEQ ID NO: 537925 - DNA, 25 bp, Mus musculus
agtgtcactaccgagtaccagggca

SEQ ID NO: 537926 - DNA, 25 bp, Mus musculus
agtgtcagaattatgccaaggaggt

SEQ ID NO: 537927 - DNA, 25 bp, Mus musculus
agtgtcagaattttgccaaggaggt

SEQ ID NO: 537928 - DNA, 25 bp, Mus musculus
agtgtcagagtcaggacctggaaac

SEQ ID NO: 537929 - DNA, 25 bp, Mus musculus
agtgtcagagtctggacctggaaac

SEQ ID NO: 537930 - DNA, 25 bp, Mus musculus
agtgtcagatgaacttcccgctggg

SEQ ID NO: 537931 - DNA, 25 bp, Mus musculus
agtgtcagatgatcttcccgctggg

SEQ ID NO: 537932 - DNA, 25 bp, Mus musculus
agtgtcagcggaaccacgagggtca

SEQ ID NO: 537933 - DNA, 25 bp, Mus musculus
agtgtcagcggatccacgagggtca

SEQ ID NO: 537934 - DNA, 25 bp, Mus musculus
agtgtcatcccacctggcttaagag

SEQ ID NO: 537935 - DNA, 25 bp, Mus musculus
agtgtcatcccagctggcttaagag

SEQ ID NO: 537936 - DNA, 25 bp, Mus musculus
agtgtcatgaatacttccgacccca

SEQ ID NO: 537937 - DNA, 25 bp, Mus musculus
agtgtcatgaattcttccgacccca

SEQ ID NO: 537938 - DNA, 25 bp, Mus musculus
agtgtcatgccaaaccttgtagcta

SEQ ID NO: 537939 - DNA, 25 bp, Mus musculus
agtgtcatgccataccttgtagcta

SEQ ID NO: 537940 - DNA, 25 bp, Mus musculus
agtgtcattgtcactggcggcaaca

SEQ ID NO: 537941 - DNA, 25 bp, Mus musculus
agtgtcattgtctctggcggcaaca

SEQ ID NO: 537942 - DNA, 25 bp, Mus musculus
agtgtccaagagcatttcaaaaggg

SEQ ID NO: 537943 - DNA, 25 bp, Mus musculus
agtgtccaagaggatttcaaaaggg

SEQ ID NO: 537944 - DNA, 25 bp, Mus musculus
agtgtccaagcacgagtacggcttt

SEQ ID NO: 537945 - DNA, 25 bp, Mus musculus
agtgtccaagcaggagtacggcttt

SEQ ID NO: 537946 - DNA, 25 bp, Mus musculus
agtgtcccacagagcaagcccctgt

SEQ ID NO: 537947 - DNA, 25 bp, Mus musculus
agtgtcccacagtgcaagcccctgt

SEQ ID NO: 537948 - DNA, 25 bp, Mus musculus
agtgtccccaaactaattctctgag

SEQ ID NO: 537949 - DNA, 25 bp, Mus musculus
agtgtccccaaagtaattctctgag

SEQ ID NO: 537950 - DNA, 25 bp, Mus musculus
agtgtccccacccaattgccatgtt

SEQ ID NO: 537951 - DNA, 25 bp, Mus musculus
agtgtccccaccgaattgccatgtt

SEQ ID NO: 537952 - DNA, 25 bp, Mus musculus
agtgtccccactctgagggtgtgct

SEQ ID NO: 537953 - DNA, 25 bp, Mus musculus
agtgtccccactgtgagggtgtgct

SEQ ID NO: 537954 - DNA, 25 bp, Mus musculus
agtgtcccctgtctatgtttccctt

SEQ ID NO: 537955 - DNA, 25 bp, Mus musculus
agtgtcccctgtgtatgtttccctt

SEQ ID NO: 537956 - DNA, 25 bp, Mus musculus
agtgtcccgggaagccagcgataag

SEQ ID NO: 537957 - DNA, 25 bp, Mus musculus
agtgtcccgggatgccagcgataag

SEQ ID NO: 537958 - DNA, 25 bp, Mus musculus
agtgtccctattcgccctgattgtg

SEQ ID NO: 537959 - DNA, 25 bp, Mus musculus
agtgtccctattggccctgattgtg

SEQ ID NO: 537960 - DNA, 25 bp, Mus musculus
agtgtccctggaaagagtataagtc

SEQ ID NO: 537961 - DNA, 25 bp, Mus musculus
agtgtccctggatagagtataagtc

SEQ ID NO: 537962 - DNA, 25 bp, Mus musculus
agtgtccctgttcattgtgctcccg

SEQ ID NO: 537963 - DNA, 25 bp, Mus musculus
agtgtccctgttgattgtgctcccg

SEQ ID NO: 537964 - DNA, 25 bp, Mus musculus
agtgtcctcgcaactacagcacggt

SEQ ID NO: 537965 - DNA, 25 bp, Mus musculus
agtgtcctcgcatctacagcacggt

SEQ ID NO: 537966 - DNA, 25 bp, Mus musculus
agtgtcctcttcacagttctggtca

SEQ ID NO: 537967 - DNA, 25 bp, Mus musculus
agtgtcctcttctcagttctggtca

SEQ ID NO: 537968 - DNA, 25 bp, Mus musculus
agtgtcctgagtacctcgctcactg

SEQ ID NO: 537969 - DNA, 25 bp, Mus musculus
agtgtcctgagtccacggccatcga

SEQ ID NO: 537970 - DNA, 25 bp, Mus musculus
agtgtcctgagtgcacggccatcga

SEQ ID NO: 537971 - DNA, 25 bp, Mus musculus
agtgtcctgagttcctcgctcactg

SEQ ID NO: 537972 - DNA, 25 bp, Mus musculus
agtgtccttcctcactcttctctgt

SEQ ID NO: 537973 - DNA, 25 bp, Mus musculus
agtgtccttcctgactcttctctgt

SEQ ID NO: 537974 - DNA, 25 bp, Mus musculus
agtgtccttgctcatggagcaaatt

SEQ ID NO: 537975 - DNA, 25 bp, Mus musculus
agtgtccttgctgatggagcaaatt

SEQ ID NO: 537976 - DNA, 25 bp, Mus musculus
agtgtcggcgagagggcttcagcca

SEQ ID NO: 537977 - DNA, 25 bp, Mus musculus
agtgtcggcgagtgggcttcagcca

SEQ ID NO: 537978 - DNA, 25 bp, Mus musculus
agtgtctcctgcaccgtagatacgg

SEQ ID NO: 537979 - DNA, 25 bp, Mus musculus
agtgtctcctgctccgtagatacgg

SEQ ID NO: 537980 - DNA, 25 bp, Mus musculus
agtgtctctcagagggtccaactca

SEQ ID NO: 537981 - DNA, 25 bp, Mus musculus
agtgtctctcagtgggtccaactca

SEQ ID NO: 537982 - DNA, 25 bp, Mus musculus
agtgtctctcggcttgtctctgcca

SEQ ID NO: 537983 - DNA, 25 bp, Mus musculus
agtgtctctcgggttgtctctgcca

SEQ ID NO: 537984 - DNA, 25 bp, Mus musculus
agtgtctgagtgctgctgaagaaaa

SEQ ID NO: 537985 - DNA, 25 bp, Mus musculus
agtgtctgagtggtgctgaagaaaa

SEQ ID NO: 537986 - DNA, 25 bp, Mus musculus
agtgtctgtggccttcatcctgttc

SEQ ID NO: 537987 - DNA, 25 bp, Mus musculus
agtgtctgtggcgttcatcctgttc

SEQ ID NO: 537988 - DNA, 25 bp, Mus musculus
agtgtcttagtgacgtccagtatag

SEQ ID NO: 537989 - DNA, 25 bp, Mus musculus
agtgtcttagtgtcgtccagtatag

SEQ ID NO: 537990 - DNA, 25 bp, Mus musculus
agtgtcttcaagacggatctcagat

SEQ ID NO: 537991 - DNA, 25 bp, Mus musculus
agtgtcttcaagtcggatctcagat

SEQ ID NO: 537992 - DNA, 25 bp, Mus musculus
agtgtcttgcaaaggctcttcagtc

SEQ ID NO: 537993 - DNA, 25 bp, Mus musculus
agtgtcttgcaatggctcttcagtc

SEQ ID NO: 537994 - DNA, 25 bp, Mus musculus
agtgtgaagaagaggcccaggccct

SEQ ID NO: 537995 - DNA, 25 bp, Mus musculus
agtgtgaagaagtggcccaggccct

SEQ ID NO: 537996 - DNA, 25 bp, Mus musculus
agtgtgacaatcactggtgggatgc

SEQ ID NO: 537997 - DNA, 25 bp, Mus musculus
agtgtgacaatctctggtgggatgc

SEQ ID NO: 537998 - DNA, 25 bp, Mus musculus
agtgtgacagaaagcgcctctcggg

SEQ ID NO: 537999 - DNA, 25 bp, Mus musculus
agtgtgacagaatgcgcctctcggg

SEQ ID NO: 538000 - DNA, 25 bp, Mus musculus
agtgtgacatccagcactttgtgga

SEQ ID NO: 538001 - DNA, 25 bp, Mus musculus
agtgtgacatcctgcactttgtgga

SEQ ID NO: 538002 - DNA, 25 bp, Mus musculus
agtgtgaccagtaccgcaccatcct

SEQ ID NO: 538003 - DNA, 25 bp, Mus musculus
agtgtgaccagttccgcaccatcct

SEQ ID NO: 538004 - DNA, 25 bp, Mus musculus
agtgtgacgaggaagtcaagtactg

SEQ ID NO: 538005 - DNA, 25 bp, Mus musculus
agtgtgacgaggtagtcaagtactg

SEQ ID NO: 538006 - DNA, 25 bp, Mus musculus
agtgtgactcctccaagaagaggcg

SEQ ID NO: 538007 - DNA, 25 bp, Mus musculus
agtgtgactcctgcaagaagaggcg

SEQ ID NO: 538008 - DNA, 25 bp, Mus musculus
agtgtgacttctccgtgacagcacc

SEQ ID NO: 538009 - DNA, 25 bp, Mus musculus
agtgtgacttctgcgtgacagcacc

SEQ ID NO: 538010 - DNA, 25 bp, Mus musculus
agtgtgagtcttcgcagagctatca

SEQ ID NO: 538011 - DNA, 25 bp, Mus musculus
agtgtgagtcttggcagagctatca

SEQ ID NO: 538012 - DNA, 25 bp, Mus musculus
agtgtgatcatcctgggtcttgcct

SEQ ID NO: 538013 - DNA, 25 bp, Mus musculus
agtgtgatcatcgtgggtcttgcct

SEQ ID NO: 538014 - DNA, 25 bp, Mus musculus
agtgtgatgcaaccatggcagttgt

SEQ ID NO: 538015 - DNA, 25 bp, Mus musculus
agtgtgatgcaagcatggcagttgt

SEQ ID NO: 538016 - DNA, 25 bp, Mus musculus
agtgtgatgcagcttcactttacaa

SEQ ID NO: 538017 - DNA, 25 bp, Mus musculus
agtgtgatgcaggttcactttacaa

SEQ ID NO: 538018 - DNA, 25 bp, Mus musculus
agtgtgatgtgacccagagccagcc

SEQ ID NO: 538019 - DNA, 25 bp, Mus musculus
agtgtgatgtgagccagagccagcc

SEQ ID NO: 538020 - DNA, 25 bp, Mus musculus
agtgtgattgtactcgcacgggcta

SEQ ID NO: 538021 - DNA, 25 bp, Mus musculus
agtgtgattgtagtcgcacgggcta

SEQ ID NO: 538022 - DNA, 25 bp, Mus musculus
agtgtgcactagctgtgctctacca

SEQ ID NO: 538023 - DNA, 25 bp, Mus musculus
agtgtgcactaggtgtgctctacca

SEQ ID NO: 538024 - DNA, 25 bp, Mus musculus
agtgtgcactgaccgacacggccct

SEQ ID NO: 538025 - DNA, 25 bp, Mus musculus
agtgtgcactgagcgacacggccct

SEQ ID NO: 538026 - DNA, 25 bp, Mus musculus
agtgtgcagagtacgacggcaccga

SEQ ID NO: 538027 - DNA, 25 bp, Mus musculus
agtgtgcagagttcgacggcaccga

SEQ ID NO: 538028 - DNA, 25 bp, Mus musculus
agtgtgcagcacagaaagctttgct

SEQ ID NO: 538029 - DNA, 25 bp, Mus musculus
agtgtgcagcactgaaagctttgct

SEQ ID NO: 538030 - DNA, 25 bp, Mus musculus
agtgtgcctgccctgatatagatac

SEQ ID NO: 538031 - DNA, 25 bp, Mus musculus
agtgtgcctgccgtgatatagatac

SEQ ID NO: 538032 - DNA, 25 bp, Mus musculus
agtgtgcgcctgagagtgtgtacct

SEQ ID NO: 538033 - DNA, 25 bp, Mus musculus
agtgtgcgcctgtgagtgtgtacct

SEQ ID NO: 538034 - DNA, 25 bp, Mus musculus
agtgtgcggcccagcaggctcccag

SEQ ID NO: 538035 - DNA, 25 bp, Mus musculus
agtgtgcggccctgcaggctcccag

SEQ ID NO: 538036 - DNA, 25 bp, Mus musculus
agtgtgctcatcattcatcgacggg

SEQ ID NO: 538037 - DNA, 25 bp, Mus musculus
agtgtgctcatctttcatcgacggg

SEQ ID NO: 538038 - DNA, 25 bp, Mus musculus
agtgtgctggtcacgagcgtgctca

SEQ ID NO: 538039 - DNA, 25 bp, Mus musculus
agtgtgctggtctcgagcgtgctca

SEQ ID NO: 538040 - DNA, 25 bp, Mus musculus
agtgtgctgtcacccattggactcc

SEQ ID NO: 538041 - DNA, 25 bp, Mus musculus
agtgtgctgtcagccattggactcc

SEQ ID NO: 538042 - DNA, 25 bp, Mus musculus
agtgtgcttcagaggatcctcgctg

SEQ ID NO: 538043 - DNA, 25 bp, Mus musculus
agtgtgcttcagtggatcctcgctg

SEQ ID NO: 538044 - DNA, 25 bp, Mus musculus
agtgtggagaaacgcctgctctcgt

SEQ ID NO: 538045 - DNA, 25 bp, Mus musculus
agtgtggagaaaggcctgctctcgt

SEQ ID NO: 538046 - DNA, 25 bp, Mus musculus
agtgtggagaatccaagttttgtct

SEQ ID NO: 538047 - DNA, 25 bp, Mus musculus
agtgtggagaatgcaagttttgtct

SEQ ID NO: 538048 - DNA, 25 bp, Mus musculus
agtgtggattctcaagggacctctt

SEQ ID NO: 538049 - DNA, 25 bp, Mus musculus
agtgtggattctgaagggacctctt

SEQ ID NO: 538050 - DNA, 25 bp, Mus musculus
agtgtggctcgtaagggaacatcca

SEQ ID NO: 538051 - DNA, 25 bp, Mus musculus
agtgtggctcgttagggaacatcca

SEQ ID NO: 538052 - DNA, 25 bp, Mus musculus
agtgtggctgctatccaggtgatga

SEQ ID NO: 538053 - DNA, 25 bp, Mus musculus
agtgtggctgctttccaggtgatga

SEQ ID NO: 538054 - DNA, 25 bp, Mus musculus
agtgtgggaccaagcaagcctgtgt

SEQ ID NO: 538055 - DNA, 25 bp, Mus musculus
agtgtgggaccatgcaagcctgtgt

SEQ ID NO: 538056 - DNA, 25 bp, Mus musculus
agtgtgggactgacgctggtgggtc

SEQ ID NO: 538057 - DNA, 25 bp, Mus musculus
agtgtgggactgtcgctggtgggtc

SEQ ID NO: 538058 - DNA, 25 bp, Mus musculus
agtgtgggttcgcagccctctcaac

SEQ ID NO: 538059 - DNA, 25 bp, Mus musculus
agtgtgggttcggagccctctcaac

SEQ ID NO: 538060 - DNA, 25 bp, Mus musculus
agtgtggtagctatcgacaacaaaa

SEQ ID NO: 538061 - DNA, 25 bp, Mus musculus
agtgtggtagctttcgacaacaaaa

SEQ ID NO: 538062 - DNA, 25 bp, Mus musculus
agtgtggtcccgacagacaaaggca

SEQ ID NO: 538063 - DNA, 25 bp, Mus musculus
agtgtggtcccgtcagacaaaggca

SEQ ID NO: 538064 - DNA, 25 bp, Mus musculus
agtgtggtctaccaattgtttctca

SEQ ID NO: 538065 - DNA, 25 bp, Mus musculus
agtgtggtctacgaattgtttctca

SEQ ID NO: 538066 - DNA, 25 bp, Mus musculus
agtgtggtgacgatctccgttcaca

SEQ ID NO: 538067 - DNA, 25 bp, Mus musculus
agtgtggtgacgttctccgttcaca

SEQ ID NO: 538068 - DNA, 25 bp, Mus musculus
agtgtggtgcggcacatccaaaaca

SEQ ID NO: 538069 - DNA, 25 bp, Mus musculus
agtgtggtgcgggacatccaaaaca

SEQ ID NO: 538070 - DNA, 25 bp, Mus musculus
agtgtggtggccctagacaacaaga

SEQ ID NO: 538071 - DNA, 25 bp, Mus musculus
agtgtggtggccgtagacaacaaga

SEQ ID NO: 538072 - DNA, 25 bp, Mus musculus
agtgtggtggtcctcctttccaaca

SEQ ID NO: 538073 - DNA, 25 bp, Mus musculus
agtgtggtggtcgtcctttccaaca

SEQ ID NO: 538074 - DNA, 25 bp, Mus musculus
agtgtggtttcaaaacaagcggtgc

SEQ ID NO: 538075 - DNA, 25 bp, Mus musculus
agtgtggtttcaccggctgccgtct

SEQ ID NO: 538076 - DNA, 25 bp, Mus musculus
agtgtggtttcagcggctgccgtct

SEQ ID NO: 538077 - DNA, 25 bp, Mus musculus
agtgtggtttcataacaagcggtgc

SEQ ID NO: 538078 - DNA, 25 bp, Mus musculus
agtgtgtaaaagagtccccactgcc

SEQ ID NO: 538079 - DNA, 25 bp, Mus musculus
agtgtgtaaaagtgtccccactgcc

SEQ ID NO: 538080 - DNA, 25 bp, Mus musculus
agtgtgtaccttcctcccgaggcct

SEQ ID NO: 538081 - DNA, 25 bp, Mus musculus
agtgtgtaccttgctcccgaggcct

SEQ ID NO: 538082 - DNA, 25 bp, Mus musculus
agtgtgtcagcaccaaatccccggg

SEQ ID NO: 538083 - DNA, 25 bp, Mus musculus
agtgtgtcagcagcaaatccccggg

SEQ ID NO: 538084 - DNA, 25 bp, Mus musculus
agtgtgtccactctaaatctcgcgg

SEQ ID NO: 538085 - DNA, 25 bp, Mus musculus
agtgtgtccactgtaaatctcgcgg

SEQ ID NO: 538086 - DNA, 25 bp, Mus musculus
agtgtgtcgggcagcaggccaatcc

SEQ ID NO: 538087 - DNA, 25 bp, Mus musculus
agtgtgtcgggctgcaggccaatcc

SEQ ID NO: 538088 - DNA, 25 bp, Mus musculus
agtgtgtgaacacagaaggctcctt

SEQ ID NO: 538089 - DNA, 25 bp, Mus musculus
agtgtgtgaacagagaaggctcctt

SEQ ID NO: 538090 - DNA, 25 bp, Mus musculus
agtgtgtgaaccagccgggctcata

SEQ ID NO: 538091 - DNA, 25 bp, Mus musculus
agtgtgtgaacctgccgggctcata

SEQ ID NO: 538092 - DNA, 25 bp, Mus musculus
agtgtgtgacctacagagcttttca

SEQ ID NO: 538093 - DNA, 25 bp, Mus musculus
agtgtgtgaccttcagagcttttca

SEQ ID NO: 538094 - DNA, 25 bp, Mus musculus
agtgtgtgatcaatgctatgtttgc

SEQ ID NO: 538095 - DNA, 25 bp, Mus musculus
agtgtgtgatcattgctatgtttgc

SEQ ID NO: 538096 - DNA, 25 bp, Mus musculus
agtgtgtggcgaacactgaagagtc

SEQ ID NO: 538097 - DNA, 25 bp, Mus musculus
agtgtgtggcgatcactgaagagtc

SEQ ID NO: 538098 - DNA, 25 bp, Mus musculus
agtgtgtgtcatatgttccctggaa

SEQ ID NO: 538099 - DNA, 25 bp, Mus musculus
agtgtgtgtcatttgttccctggaa

SEQ ID NO: 538100 - DNA, 25 bp, Mus musculus
agtgttaagtccagtccttcgttgc

SEQ ID NO: 538101 - DNA, 25 bp, Mus musculus
agtgttaagtcctgtccttcgttgc

SEQ ID NO: 538102 - DNA, 25 bp, Mus musculus
agtgttaccagtcctatggagtccc

SEQ ID NO: 538103 - DNA, 25 bp, Mus musculus
agtgttaccagtgctatggagtccc

SEQ ID NO: 538104 - DNA, 25 bp, Mus musculus
agtgttagaacaaggagtcctttcc

SEQ ID NO: 538105 - DNA, 25 bp, Mus musculus
agtgttagaacatggagtcctttcc

SEQ ID NO: 538106 - DNA, 25 bp, Mus musculus
agtgttagaagccttgacttcagct

SEQ ID NO: 538107 - DNA, 25 bp, Mus musculus
agtgttagaagcgttgacttcagct

SEQ ID NO: 538108 - DNA, 25 bp, Mus musculus
agtgttagcactaccatcatggacg

SEQ ID NO: 538109 - DNA, 25 bp, Mus musculus
agtgttagcacttccatcatggacg

SEQ ID NO: 538110 - DNA, 25 bp, Mus musculus
agtgttcaggaaccagtagcctcca

SEQ ID NO: 538111 - DNA, 25 bp, Mus musculus
agtgttcaggaagcagtagcctcca

SEQ ID NO: 538112 - DNA, 25 bp, Mus musculus
agtgttcatcggcactgcaggcagt

SEQ ID NO: 538113 - DNA, 25 bp, Mus musculus
agtgttcatcgggactgcaggcagt

SEQ ID NO: 538114 - DNA, 25 bp, Mus musculus
agtgttccagcacgctgccatcact

SEQ ID NO: 538115 - DNA, 25 bp, Mus musculus
agtgttccagcaggctgccatcact

SEQ ID NO: 538116 - DNA, 25 bp, Mus musculus
agtgttcccaacaaccagcagacag

SEQ ID NO: 538117 - DNA, 25 bp, Mus musculus
agtgttcccaactaccagcagacag

SEQ ID NO: 538118 - DNA, 25 bp, Mus musculus
agtgttcctgaaactgtctcttgcc

SEQ ID NO: 538119 - DNA, 25 bp, Mus musculus
agtgttcctgaatctgtctcttgcc

SEQ ID NO: 538120 - DNA, 25 bp, Mus musculus
agtgttcctggaataagaatatcag

SEQ ID NO: 538121 - DNA, 25 bp, Mus musculus
agtgttcctggattaagaatatcag

SEQ ID NO: 538122 - DNA, 25 bp, Mus musculus
agtgttcggattcgacaactaatgc

SEQ ID NO: 538123 - DNA, 25 bp, Mus musculus
agtgttcggattggacaactaatgc

SEQ ID NO: 538124 - DNA, 25 bp, Mus musculus
agtgttctcttccttccacctttga

SEQ ID NO: 538125 - DNA, 25 bp, Mus musculus
agtgttctcttcgttccacctttga

SEQ ID NO: 538126 - DNA, 25 bp, Mus musculus
agtgttctgtgaagggctgtgtccc

SEQ ID NO: 538127 - DNA, 25 bp, Mus musculus
agtgttctgtgatgggctgtgtccc

SEQ ID NO: 538128 - DNA, 25 bp, Mus musculus
agtgttcttctcctagatagcccca

SEQ ID NO: 538129 - DNA, 25 bp, Mus musculus
agtgttcttctcgtagatagcccca

SEQ ID NO: 538130 - DNA, 25 bp, Mus musculus
agtgttgaaggcacaccctgaagac

SEQ ID NO: 538131 - DNA, 25 bp, Mus musculus
agtgttgaaggctcaccctgaagac

SEQ ID NO: 538132 - DNA, 25 bp, Mus musculus
agtgttgagccaaagtacaaaccgc

SEQ ID NO: 538133 - DNA, 25 bp, Mus musculus
agtgttgagccatagtacaaaccgc

SEQ ID NO: 538134 - DNA, 25 bp, Mus musculus
agtgttgtatttcaattgtggagcc

SEQ ID NO: 538135 - DNA, 25 bp, Mus musculus
agtgttgtatttgaattgtggagcc

SEQ ID NO: 538136 - DNA, 25 bp, Mus musculus
agtgttgtctccatagccctgtcca

SEQ ID NO: 538137 - DNA, 25 bp, Mus musculus
agtgttgtctccttagccctgtcca

SEQ ID NO: 538138 - DNA, 25 bp, Mus musculus
agtgtttatcaccaggatctagcca

SEQ ID NO: 538139 - DNA, 25 bp, Mus musculus
agtgtttatcacgaggatctagcca

SEQ ID NO: 538140 - DNA, 25 bp, Mus musculus
agtgtttgatgactggcaccaggta

SEQ ID NO: 538141 - DNA, 25 bp, Mus musculus
agtgtttgatgagtggcaccaggta

SEQ ID NO: 538142 - DNA, 25 bp, Mus musculus
agtgtttgcctaagggacctatgcg

SEQ ID NO: 538143 - DNA, 25 bp, Mus musculus
agtgtttgcctatgggacctatgcg

SEQ ID NO: 538144 - DNA, 25 bp, Mus musculus
agtgtttgtcctcgccacactgcag

SEQ ID NO: 538145 - DNA, 25 bp, Mus musculus
agtgtttgtcctggccacactgcag

SEQ ID NO: 538146 - DNA, 25 bp, Mus musculus
agtgttttactgatcctctggccaa

SEQ ID NO: 538147 - DNA, 25 bp, Mus musculus
agtgttttactgttcctctggccaa

SEQ ID NO: 538148 - DNA, 25 bp, Mus musculus
agtgttttccatcctgttagaatct

SEQ ID NO: 538149 - DNA, 25 bp, Mus musculus
agtgttttccatgctgttagaatct

SEQ ID NO: 538150 - DNA, 25 bp, Mus musculus
agtgttttcctcaaagcctgtgggc

SEQ ID NO: 538151 - DNA, 25 bp, Mus musculus
agtgttttcctctaagcctgtgggc

SEQ ID NO: 538152 - DNA, 25 bp, Mus musculus
agttaaaagcagatgatgcttctgg

SEQ ID NO: 538153 - DNA, 25 bp, Mus musculus
agttaaaagcagttgatgcttctgg

SEQ ID NO: 538154 - DNA, 25 bp, Mus musculus
agttaaactgcacctgggtggacct

SEQ ID NO: 538155 - DNA, 25 bp, Mus musculus
agttaaactgcagctgggtggacct

SEQ ID NO: 538156 - DNA, 25 bp, Mus musculus
agttaactactgctgctcaccgttg

SEQ ID NO: 538157 - DNA, 25 bp, Mus musculus
agttaactactggtgctcaccgttg

SEQ ID NO: 538158 - DNA, 25 bp, Mus musculus
agttaagagccaccactcagccgta

SEQ ID NO: 538159 - DNA, 25 bp, Mus musculus
agttaagagccagcactcagccgta

SEQ ID NO: 538160 - DNA, 25 bp, Mus musculus
agttaagagcttatcacaatgaggc

SEQ ID NO: 538161 - DNA, 25 bp, Mus musculus
agttaagagcttttcacaatgaggc

SEQ ID NO: 538162 - DNA, 25 bp, Mus musculus
agttaagcaactctgccctgagtga

SEQ ID NO: 538163 - DNA, 25 bp, Mus musculus
agttaagcaactgtgccctgagtga

SEQ ID NO: 538164 - DNA, 25 bp, Mus musculus
agttaagtctggaatatttggaaag

SEQ ID NO: 538165 - DNA, 25 bp, Mus musculus
agttaagtctggtatatttggaaag

SEQ ID NO: 538166 - DNA, 25 bp, Mus musculus
agttaagtgttgcatctcctgtgaa

SEQ ID NO: 538167 - DNA, 25 bp, Mus musculus
agttaagtgttggatctcctgtgaa

SEQ ID NO: 538168 - DNA, 25 bp, Mus musculus
agttaatacgcacgctctgagtgga

SEQ ID NO: 538169 - DNA, 25 bp, Mus musculus
agttaatacgcaggctctgagtgga

SEQ ID NO: 538170 - DNA, 25 bp, Mus musculus
agttaatgagtgcaagactcccggc

SEQ ID NO: 538171 - DNA, 25 bp, Mus musculus
agttaatgagtggaagactcccggc

SEQ ID NO: 538172 - DNA, 25 bp, Mus musculus
agttaatggtgtcgatgatgctgcc

SEQ ID NO: 538173 - DNA, 25 bp, Mus musculus
agttaatggtgtggatgatgctgcc

SEQ ID NO: 538174 - DNA, 25 bp, Mus musculus
agttaatgtgctcgcttctgtcgga

SEQ ID NO: 538175 - DNA, 25 bp, Mus musculus
agttaatgtgctggcttctgtcgga

SEQ ID NO: 538176 - DNA, 25 bp, Mus musculus
agttacaaaggcagcgtgtgcccca

SEQ ID NO: 538177 - DNA, 25 bp, Mus musculus
agttacaaaggctgcgtgtgcccca

SEQ ID NO: 538178 - DNA, 25 bp, Mus musculus
agttacaagtaaacattttagtctg

SEQ ID NO: 538179 - DNA, 25 bp, Mus musculus
agttacaagtaatcattttagtctg

SEQ ID NO: 538180 - DNA, 25 bp, Mus musculus
agttacaccaccatcacagtcctgg

SEQ ID NO: 538181 - DNA, 25 bp, Mus musculus
agttacaccaccttcacagtcctgg

SEQ ID NO: 538182 - DNA, 25 bp, Mus musculus
agttacactcctcgtgcggtcgggc

SEQ ID NO: 538183 - DNA, 25 bp, Mus musculus
agttacactcctggtgcggtcgggc

SEQ ID NO: 538184 - DNA, 25 bp, Mus musculus
agttacagaaagataacacagaccc

SEQ ID NO: 538185 - DNA, 25 bp, Mus musculus
agttacagaaagttaacacagaccc

SEQ ID NO: 538186 - DNA, 25 bp, Mus musculus
agttacagatagacaagagggtgcc

SEQ ID NO: 538187 - DNA, 25 bp, Mus musculus
agttacagatagtcaagagggtgcc

SEQ ID NO: 538188 - DNA, 25 bp, Mus musculus
agttacagccctccttagctccgaa

SEQ ID NO: 538189 - DNA, 25 bp, Mus musculus
agttacagccctgcttagctccgaa

SEQ ID NO: 538190 - DNA, 25 bp, Mus musculus
agttacaggtggaccaggtgtcaga

SEQ ID NO: 538191 - DNA, 25 bp, Mus musculus
agttacaggtggtccaggtgtcaga

SEQ ID NO: 538192 - DNA, 25 bp, Mus musculus
agttacaggttacccagaactgctg

SEQ ID NO: 538193 - DNA, 25 bp, Mus musculus
agttacaggttagccagaactgctg

SEQ ID NO: 538194 - DNA, 25 bp, Mus musculus
agttacatccgtcactctgctgcag

SEQ ID NO: 538195 - DNA, 25 bp, Mus musculus
agttacatccgtgactctgctgcag

SEQ ID NO: 538196 - DNA, 25 bp, Mus musculus
agttaccatcttcagtcttacttgg

SEQ ID NO: 538197 - DNA, 25 bp, Mus musculus
agttaccatcttgagtcttacttgg

SEQ ID NO: 538198 - DNA, 25 bp, Mus musculus
agttaccggagcactagtataggag

SEQ ID NO: 538199 - DNA, 25 bp, Mus musculus
agttaccggagctctagtataggag

SEQ ID NO: 538200 - DNA, 25 bp, Mus musculus
agttaccgtcaacttcgactgaacg

SEQ ID NO: 538201 - DNA, 25 bp, Mus musculus
agttaccgtcaagttcgactgaacg

SEQ ID NO: 538202 - DNA, 25 bp, Mus musculus
agttacctgcacaccgggtcacaga

SEQ ID NO: 538203 - DNA, 25 bp, Mus musculus
agttacctgcactccgggtcacaga

SEQ ID NO: 538204 - DNA, 25 bp, Mus musculus
agttaccttcttcctgtcgtttgcg

SEQ ID NO: 538205 - DNA, 25 bp, Mus musculus
agttaccttcttgctgtcgtttgcg

SEQ ID NO: 538206 - DNA, 25 bp, Mus musculus
agttaccttgaccatgtcccattta

SEQ ID NO: 538207 - DNA, 25 bp, Mus musculus
agttaccttgacgatgtcccattta

SEQ ID NO: 538208 - DNA, 25 bp, Mus musculus
agttacgcctaccaatgttagtgcg

SEQ ID NO: 538209 - DNA, 25 bp, Mus musculus
agttacgcctacgaatgttagtgcg

SEQ ID NO: 538210 - DNA, 25 bp, Mus musculus
agttacggtggcatcagagcaaagg

SEQ ID NO: 538211 - DNA, 25 bp, Mus musculus
agttacggtggcttcagagcaaagg

SEQ ID NO: 538212 - DNA, 25 bp, Mus musculus
agttactggcgacagcaagcccaag

SEQ ID NO: 538213 - DNA, 25 bp, Mus musculus
agttactggcgagagcaagcccaag

SEQ ID NO: 538214 - DNA, 25 bp, Mus musculus
agttagacagcaagcattgttggcc

SEQ ID NO: 538215 - DNA, 25 bp, Mus musculus
agttagacagcatgcattgttggcc

SEQ ID NO: 538216 - DNA, 25 bp, Mus musculus
agttagagtccaccatcgcagaggc

SEQ ID NO: 538217 - DNA, 25 bp, Mus musculus
agttagagtccagcatcgcagaggc

SEQ ID NO: 538218 - DNA, 25 bp, Mus musculus
agttagatgagacggagcacacaat

SEQ ID NO: 538219 - DNA, 25 bp, Mus musculus
agttagatgagagggagcacacaat

SEQ ID NO: 538220 - DNA, 25 bp, Mus musculus
agttagcacagaagaggcctaatcc

SEQ ID NO: 538221 - DNA, 25 bp, Mus musculus
agttagcacagatgaggcctaatcc

SEQ ID NO: 538222 - DNA, 25 bp, Mus musculus
agttagcgatacaatgggtctttcc

SEQ ID NO: 538223 - DNA, 25 bp, Mus musculus
agttagcgatactatgggtctttcc

SEQ ID NO: 538224 - DNA, 25 bp, Mus musculus
agttagtgtataccatccttgaagg

SEQ ID NO: 538225 - DNA, 25 bp, Mus musculus
agttagtgtatagcatccttgaagg

SEQ ID NO: 538226 - DNA, 25 bp, Mus musculus
agttataaatgtctgcgcatgcgca

SEQ ID NO: 538227 - DNA, 25 bp, Mus musculus
agttataaatgtgtgcgcatgcgca

SEQ ID NO: 538228 - DNA, 25 bp, Mus musculus
agttatacacagataaggacacagg

SEQ ID NO: 538229 - DNA, 25 bp, Mus musculus
agttatacacagttaaggacacagg

SEQ ID NO: 538230 - DNA, 25 bp, Mus musculus
agttatccagaaatcagctgaatgc

SEQ ID NO: 538231 - DNA, 25 bp, Mus musculus
agttatccagaattcagctgaatgc

SEQ ID NO: 538232 - DNA, 25 bp, Mus musculus
agttatgacactatgccccattgag

SEQ ID NO: 538233 - DNA, 25 bp, Mus musculus
agttatgacactttgccccattgag

SEQ ID NO: 538234 - DNA, 25 bp, Mus musculus
agttattacagaactgccatgtcgc

SEQ ID NO: 538235 - DNA, 25 bp, Mus musculus
agttattacagatctgccatgtcgc

SEQ ID NO: 538236 - DNA, 25 bp, Mus musculus
agttattggtggagatgatctctca

SEQ ID NO: 538237 - DNA, 25 bp, Mus musculus
agttattggtggtgatgatctctca

SEQ ID NO: 538238 - DNA, 25 bp, Mus musculus
agttcaaacatccaggtgggagacc

SEQ ID NO: 538239 - DNA, 25 bp, Mus musculus
agttcaaacatcgaggtgggagacc

SEQ ID NO: 538240 - DNA, 25 bp, Mus musculus
agttcaacatgtcatccattaccag

SEQ ID NO: 538241 - DNA, 25 bp, Mus musculus
agttcaacatgtgatccattaccag

SEQ ID NO: 538242 - DNA, 25 bp, Mus musculus
agttcaactgcaacatccgggctcc

SEQ ID NO: 538243 - DNA, 25 bp, Mus musculus
agttcaactgcatcatccgggctcc

SEQ ID NO: 538244 - DNA, 25 bp, Mus musculus
agttcaagaagaacattatgggaca

SEQ ID NO: 538245 - DNA, 25 bp, Mus musculus
agttcaagaagatcattatgggaca

SEQ ID NO: 538246 - DNA, 25 bp, Mus musculus
agttcaaggcttacacttttgatga

SEQ ID NO: 538247 - DNA, 25 bp, Mus musculus
agttcaaggctttcacttttgatga

SEQ ID NO: 538248 - DNA, 25 bp, Mus musculus
agttcaagggttacttctcgaccag

SEQ ID NO: 538249 - DNA, 25 bp, Mus musculus
agttcaagggtttcttctcgaccag

SEQ ID NO: 538250 - DNA, 25 bp, Mus musculus
agttcacacagacccgatgggtggt

SEQ ID NO: 538251 - DNA, 25 bp, Mus musculus
agttcacacagagccgatgggtggt

SEQ ID NO: 538252 - DNA, 25 bp, Mus musculus
agttcacagcaccagggaggtatga

SEQ ID NO: 538253 - DNA, 25 bp, Mus musculus
agttcacagcacgagggaggtatga

SEQ ID NO: 538254 - DNA, 25 bp, Mus musculus
agttcacagtggcagacaagccggt

SEQ ID NO: 538255 - DNA, 25 bp, Mus musculus
agttcacagtgggagacaagccggt

SEQ ID NO: 538256 - DNA, 25 bp, Mus musculus
agttcacccgatcccacaagaggac

SEQ ID NO: 538257 - DNA, 25 bp, Mus musculus
agttcacccgatgccacaagaggac

SEQ ID NO: 538258 - DNA, 25 bp, Mus musculus
agttcaccgcagaccgtaccttgga

SEQ ID NO: 538259 - DNA, 25 bp, Mus musculus
agttcaccgcagtccgtaccttgga

SEQ ID NO: 538260 - DNA, 25 bp, Mus musculus
agttcaccttgcatggccgggctat

SEQ ID NO: 538261 - DNA, 25 bp, Mus musculus
agttcaccttgcttggccgggctat

SEQ ID NO: 538262 - DNA, 25 bp, Mus musculus
agttcacgatggactgcgcagcgcc

SEQ ID NO: 538263 - DNA, 25 bp, Mus musculus
agttcacgatggtctgcgcagcgcc

SEQ ID NO: 538264 - DNA, 25 bp, Mus musculus
agttcactcccaacattcaagctag

SEQ ID NO: 538265 - DNA, 25 bp, Mus musculus
agttcactcccatcattcaagctag

SEQ ID NO: 538266 - DNA, 25 bp, Mus musculus
agttcactgtggaccgggccggcca

SEQ ID NO: 538267 - DNA, 25 bp, Mus musculus
agttcactgtggtccgggccggcca

SEQ ID NO: 538268 - DNA, 25 bp, Mus musculus
agttcagaacttcccggatgatggt

SEQ ID NO: 538269 - DNA, 25 bp, Mus musculus
agttcagaacttgccggatgatggt

SEQ ID NO: 538270 - DNA, 25 bp, Mus musculus
agttcagagactcagactatcacag

SEQ ID NO: 538271 - DNA, 25 bp, Mus musculus
agttcagagactgagactatcacag

SEQ ID NO: 538272 - DNA, 25 bp, Mus musculus
agttcagcatgcagcgcgccgcact

SEQ ID NO: 538273 - DNA, 25 bp, Mus musculus
agttcagcatgctgcgcgccgcact

SEQ ID NO: 538274 - DNA, 25 bp, Mus musculus
agttcagcgtcgctggaaacgagct

SEQ ID NO: 538275 - DNA, 25 bp, Mus musculus
agttcagcgtcggtggaaacgagct

SEQ ID NO: 538276 - DNA, 25 bp, Mus musculus
agttcaggacaaaaacgagcacacg

SEQ ID NO: 538277 - DNA, 25 bp, Mus musculus
agttcaggacaataacgagcacacg

SEQ ID NO: 538278 - DNA, 25 bp, Mus musculus
agttcagtaggcatgactttaggtt

SEQ ID NO: 538279 - DNA, 25 bp, Mus musculus
agttcagtaggcttgactttaggtt

SEQ ID NO: 538280 - DNA, 25 bp, Mus musculus
agttcagtgcgcaggtaaaagttaa

SEQ ID NO: 538281 - DNA, 25 bp, Mus musculus
agttcagtgcgctggtaaaagttaa

SEQ ID NO: 538282 - DNA, 25 bp, Mus musculus
agttcagtggcccaggcgcataccc

SEQ ID NO: 538283 - DNA, 25 bp, Mus musculus
agttcagtggccgaggcgcataccc

SEQ ID NO: 538284 - DNA, 25 bp, Mus musculus
agttcatagagaagagtgttgagca

SEQ ID NO: 538285 - DNA, 25 bp, Mus musculus
agttcatagagatgagtgttgagca

SEQ ID NO: 538286 - DNA, 25 bp, Mus musculus
agttcatcacagagactcccacaag

SEQ ID NO: 538287 - DNA, 25 bp, Mus musculus
agttcatcacagtgactcccacaag

SEQ ID NO: 538288 - DNA, 25 bp, Mus musculus
agttcatcaccaaactgctccgcaa

SEQ ID NO: 538289 - DNA, 25 bp, Mus musculus
agttcatcaccatactgctccgcaa

SEQ ID NO: 538290 - DNA, 25 bp, Mus musculus
agttcatcagcaccttccccgatgg

SEQ ID NO: 538291 - DNA, 25 bp, Mus musculus
agttcatcagcagcttccccgatgg

SEQ ID NO: 538292 - DNA, 25 bp, Mus musculus
agttcatcagccaccgattcccaga

SEQ ID NO: 538293 - DNA, 25 bp, Mus musculus
agttcatcagcctccgattcccaga

SEQ ID NO: 538294 - DNA, 25 bp, Mus musculus
agttcatcatggagagtgttcagga

SEQ ID NO: 538295 - DNA, 25 bp, Mus musculus
agttcatcatggtgagtgttcagga

SEQ ID NO: 538296 - DNA, 25 bp, Mus musculus
agttcatcccggaagcccagtgtga

SEQ ID NO: 538297 - DNA, 25 bp, Mus musculus
agttcatcccggtagcccagtgtga

SEQ ID NO: 538298 - DNA, 25 bp, Mus musculus
agttcatcccttagcaccagaccga

SEQ ID NO: 538299 - DNA, 25 bp, Mus musculus
agttcatccctttgcaccagaccga

SEQ ID NO: 538300 - DNA, 25 bp, Mus musculus
agttcatcctctcccaggtggcact

SEQ ID NO: 538301 - DNA, 25 bp, Mus musculus
agttcatcctctgccaggtggcact

SEQ ID NO: 538302 - DNA, 25 bp, Mus musculus
agttcatctacaccagtcagtacga

SEQ ID NO: 538303 - DNA, 25 bp, Mus musculus
agttcatctacagcagtcagtacga

SEQ ID NO: 538304 - DNA, 25 bp, Mus musculus
agttcatctccgacctgtgtacctc

SEQ ID NO: 538305 - DNA, 25 bp, Mus musculus
agttcatctccgtcctgtgtacctc

SEQ ID NO: 538306 - DNA, 25 bp, Mus musculus
agttcatcttcgctcctcgactgga

SEQ ID NO: 538307 - DNA, 25 bp, Mus musculus
agttcatcttcggtcctcgactgga

SEQ ID NO: 538308 - DNA, 25 bp, Mus musculus
agttcatgattcagccagtgggagc

SEQ ID NO: 538309 - DNA, 25 bp, Mus musculus
agttcatgattctgccagtgggagc

SEQ ID NO: 538310 - DNA, 25 bp, Mus musculus
agttcatgccaaccctcacgagaga

SEQ ID NO: 538311 - DNA, 25 bp, Mus musculus
agttcatgccaagcctcacgagaga

SEQ ID NO: 538312 - DNA, 25 bp, Mus musculus
agttcatgcctaatgtttacacccc

SEQ ID NO: 538313 - DNA, 25 bp, Mus musculus
agttcatgcctattgtttacacccc

SEQ ID NO: 538314 - DNA, 25 bp, Mus musculus
agttcatggaacaggcctgccagtg

SEQ ID NO: 538315 - DNA, 25 bp, Mus musculus
agttcatggaactggcctgccagtg

SEQ ID NO: 538316 - DNA, 25 bp, Mus musculus
agttcatggaggaccgcagcgccca

SEQ ID NO: 538317 - DNA, 25 bp, Mus musculus
agttcatggaggcagcgtcttccaa

SEQ ID NO: 538318 - DNA, 25 bp, Mus musculus
agttcatggagggagcgtcttccaa

SEQ ID NO: 538319 - DNA, 25 bp, Mus musculus
agttcatggaggtccgcagcgccca

SEQ ID NO: 538320 - DNA, 25 bp, Mus musculus
agttccaagacccctgcagcctgag

SEQ ID NO: 538321 - DNA, 25 bp, Mus musculus
agttccaagaccgctgcagcctgag

SEQ ID NO: 538322 - DNA, 25 bp, Mus musculus
agttccacggcccagggacagcgct

SEQ ID NO: 538323 - DNA, 25 bp, Mus musculus
agttccacggccgagggacagcgct

SEQ ID NO: 538324 - DNA, 25 bp, Mus musculus
agttccactccccaattctggacat

SEQ ID NO: 538325 - DNA, 25 bp, Mus musculus
agttccactcccgaattctggacat

SEQ ID NO: 538326 - DNA, 25 bp, Mus musculus
agttccagaagcagcacgaccactt

SEQ ID NO: 538327 - DNA, 25 bp, Mus musculus
agttccagaagctgcacgaccactt

SEQ ID NO: 538328 - DNA, 25 bp, Mus musculus
agttccagcaccacagagcaaagcc

SEQ ID NO: 538329 - DNA, 25 bp, Mus musculus
agttccagcacctcagagcaaagcc

SEQ ID NO: 538330 - DNA, 25 bp, Mus musculus
agttccagcctcagtactatgtggc

SEQ ID NO: 538331 - DNA, 25 bp, Mus musculus
agttccagcctctgtactatgtggc

SEQ ID NO: 538332 - DNA, 25 bp, Mus musculus
agttccagccttctgcagtctctga

SEQ ID NO: 538333 - DNA, 25 bp, Mus musculus
agttccagccttgtgcagtctctga

SEQ ID NO: 538334 - DNA, 25 bp, Mus musculus
agttccagctgccactattcttctt

SEQ ID NO: 538335 - DNA, 25 bp, Mus musculus
agttccagctgcgactattcttctt

SEQ ID NO: 538336 - DNA, 25 bp, Mus musculus
agttccaggacactacccctatgca

SEQ ID NO: 538337 - DNA, 25 bp, Mus musculus
agttccaggacagtacccctatgca

SEQ ID NO: 538338 - DNA, 25 bp, Mus musculus
agttccaggtggacacaggtgccaa

SEQ ID NO: 538339 - DNA, 25 bp, Mus musculus
agttccaggtggtcacaggtgccaa

SEQ ID NO: 538340 - DNA, 25 bp, Mus musculus
agttccatggctataattccctgaa

SEQ ID NO: 538341 - DNA, 25 bp, Mus musculus
agttccatggctttaattccctgaa

SEQ ID NO: 538342 - DNA, 25 bp, Mus musculus
agttccatgtgcagccagacgaccc

SEQ ID NO: 538343 - DNA, 25 bp, Mus musculus
agttccatgtgctgccagacgaccc

SEQ ID NO: 538344 - DNA, 25 bp, Mus musculus
agttcccagcatcatgagggcctgg

SEQ ID NO: 538345 - DNA, 25 bp, Mus musculus
agttcccagcatgatgagggcctgg

SEQ ID NO: 538346 - DNA, 25 bp, Mus musculus
agttcccagcttccctaggtgacct

SEQ ID NO: 538347 - DNA, 25 bp, Mus musculus
agttcccagcttgcctaggtgacct

SEQ ID NO: 538348 - DNA, 25 bp, Mus musculus
agttcccatgctactgactccggtg

SEQ ID NO: 538349 - DNA, 25 bp, Mus musculus
agttcccatgcttctgactccggtg

SEQ ID NO: 538350 - DNA, 25 bp, Mus musculus
agttcccggagacgaagcagggcca

SEQ ID NO: 538351 - DNA, 25 bp, Mus musculus
agttcccggagaggaagcagggcca

SEQ ID NO: 538352 - DNA, 25 bp, Mus musculus
agttccctagctcctcacggaggca

SEQ ID NO: 538353 - DNA, 25 bp, Mus musculus
agttccctagctgctcacggaggca

SEQ ID NO: 538354 - DNA, 25 bp, Mus musculus
agttccctcagtctgctagctactg

SEQ ID NO: 538355 - DNA, 25 bp, Mus musculus
agttccctcagtgtgctagctactg

SEQ ID NO: 538356 - DNA, 25 bp, Mus musculus
agttccctccagaagaatcatcagg

SEQ ID NO: 538357 - DNA, 25 bp, Mus musculus
agttccctccagtagaatcatcagg

SEQ ID NO: 538358 - DNA, 25 bp, Mus musculus
agttccctccctaccgcgggatgat

SEQ ID NO: 538359 - DNA, 25 bp, Mus musculus
agttccctcccttccgcgggatgat

SEQ ID NO: 538360 - DNA, 25 bp, Mus musculus
agttccctcggccagcgcctttgtt

SEQ ID NO: 538361 - DNA, 25 bp, Mus musculus
agttccctcggcgagcgcctttgtt

SEQ ID NO: 538362 - DNA, 25 bp, Mus musculus
agttccctgcctcagtagagagcga

SEQ ID NO: 538363 - DNA, 25 bp, Mus musculus
agttccctgcctgagtagagagcga

SEQ ID NO: 538364 - DNA, 25 bp, Mus musculus
agttccctgtggctccttcggctac

SEQ ID NO: 538365 - DNA, 25 bp, Mus musculus
agttccctgtgggtccttcggctac

SEQ ID NO: 538366 - DNA, 25 bp, Mus musculus
agttccgacaccagcccagctgtgg

SEQ ID NO: 538367 - DNA, 25 bp, Mus musculus
agttccgacacctgcccagctgtgg

SEQ ID NO: 538368 - DNA, 25 bp, Mus musculus
agttccgcatttccacagccattga

SEQ ID NO: 538369 - DNA, 25 bp, Mus musculus
agttccgcatttgcacagccattga

SEQ ID NO: 538370 - DNA, 25 bp, Mus musculus
agttccggaaggaacggagcaagat

SEQ ID NO: 538371 - DNA, 25 bp, Mus musculus
agttccggaaggtacggagcaagat

SEQ ID NO: 538372 - DNA, 25 bp, Mus musculus
agttccggcggcagagtgaccttcg

SEQ ID NO: 538373 - DNA, 25 bp, Mus musculus
agttccggcggctgagtgaccttcg

SEQ ID NO: 538374 - DNA, 25 bp, Mus musculus
agttccgggcatagatggcattgat

SEQ ID NO: 538375 - DNA, 25 bp, Mus musculus
agttccgggcatccttcaaccattt

SEQ ID NO: 538376 - DNA, 25 bp, Mus musculus
agttccgggcatgcttcaaccattt

SEQ ID NO: 538377 - DNA, 25 bp, Mus musculus
agttccgggcattgatggcattgat

SEQ ID NO: 538378 - DNA, 25 bp, Mus musculus
agttccgggtccatgagacaccgag

SEQ ID NO: 538379 - DNA, 25 bp, Mus musculus
agttccgggtccttgagacaccgag

SEQ ID NO: 538380 - DNA, 25 bp, Mus musculus
agttccgggtgccaaagatcgctga

SEQ ID NO: 538381 - DNA, 25 bp, Mus musculus
agttccgggtgcgaaagatcgctga

SEQ ID NO: 538382 - DNA, 25 bp, Mus musculus
agttccggtattacagggcggagca

SEQ ID NO: 538383 - DNA, 25 bp, Mus musculus
agttccggtatttcagggcggagca

SEQ ID NO: 538384 - DNA, 25 bp, Mus musculus
agttccgtaatccaaaggccaaatg

SEQ ID NO: 538385 - DNA, 25 bp, Mus musculus
agttccgtaatcgaaaggccaaatg

SEQ ID NO: 538386 - DNA, 25 bp, Mus musculus
agttccgtctgcatcagccgcagtg

SEQ ID NO: 538387 - DNA, 25 bp, Mus musculus
agttccgtctgcttcagccgcagtg

SEQ ID NO: 538388 - DNA, 25 bp, Mus musculus
agttcctaaggacgataccactgag

SEQ ID NO: 538389 - DNA, 25 bp, Mus musculus
agttcctaaggaggataccactgag

SEQ ID NO: 538390 - DNA, 25 bp, Mus musculus
agttcctagcttcacccgcaacata

SEQ ID NO: 538391 - DNA, 25 bp, Mus musculus
agttcctagcttgacccgcaacata

SEQ ID NO: 538392 - DNA, 25 bp, Mus musculus
agttcctcaggccatgacttcagtg

SEQ ID NO: 538393 - DNA, 25 bp, Mus musculus
agttcctcaggcgatgacttcagtg

SEQ ID NO: 538394 - DNA, 25 bp, Mus musculus
agttcctcatctcaagccccgagcc

SEQ ID NO: 538395 - DNA, 25 bp, Mus musculus
agttcctcatctgaagccccgagcc

SEQ ID NO: 538396 - DNA, 25 bp, Mus musculus
agttcctccgctatgcccagggatc

SEQ ID NO: 538397 - DNA, 25 bp, Mus musculus
agttcctccgctttgcccagggatc

SEQ ID NO: 538398 - DNA, 25 bp, Mus musculus
agttcctccgtcagttgtgctctca

SEQ ID NO: 538399 - DNA, 25 bp, Mus musculus
agttcctccgtctgttgtgctctca

SEQ ID NO: 538400 - DNA, 25 bp, Mus musculus
agttcctcctggctggtatcgccta

SEQ ID NO: 538401 - DNA, 25 bp, Mus musculus
agttcctcctgggtggtatcgccta

SEQ ID NO: 538402 - DNA, 25 bp, Mus musculus
agttcctctatgacctgttgcagct

SEQ ID NO: 538403 - DNA, 25 bp, Mus musculus
agttcctctatgtcctgttgcagct

SEQ ID NO: 538404 - DNA, 25 bp, Mus musculus
agttcctctcctaccaaagtgtgtg

SEQ ID NO: 538405 - DNA, 25 bp, Mus musculus
agttcctctccttccaaagtgtgtg

SEQ ID NO: 538406 - DNA, 25 bp, Mus musculus
agttcctgaccaagcctcgttagcc

SEQ ID NO: 538407 - DNA, 25 bp, Mus musculus
agttcctgaccatgcctcgttagcc

SEQ ID NO: 538408 - DNA, 25 bp, Mus musculus
agttcctgaggaacaaggactagta

SEQ ID NO: 538409 - DNA, 25 bp, Mus musculus
agttcctgaggatcaaggactagta

SEQ ID NO: 538410 - DNA, 25 bp, Mus musculus
agttcctgatggagaatgctgccca

SEQ ID NO: 538411 - DNA, 25 bp, Mus musculus
agttcctgatggtgaatgctgccca

SEQ ID NO: 538412 - DNA, 25 bp, Mus musculus
agttcctgcagaagatctcggatgc

SEQ ID NO: 538413 - DNA, 25 bp, Mus musculus
agttcctgcagatgatctcggatgc

SEQ ID NO: 538414 - DNA, 25 bp, Mus musculus
agttcctgcgggaccagcctcagtt

SEQ ID NO: 538415 - DNA, 25 bp, Mus musculus
agttcctgcgggtccagcctcagtt

SEQ ID NO: 538416 - DNA, 25 bp, Mus musculus
agttcctggagcaaaagcgggccga

SEQ ID NO: 538417 - DNA, 25 bp, Mus musculus
agttcctggagctaaagcgggccga

SEQ ID NO: 538418 - DNA, 25 bp, Mus musculus
agttcctggatgaccttttcagctt

SEQ ID NO: 538419 - DNA, 25 bp, Mus musculus
agttcctggatgtccttttcagctt

SEQ ID NO: 538420 - DNA, 25 bp, Mus musculus
agttcctggcagagattgtggaagc

SEQ ID NO: 538421 - DNA, 25 bp, Mus musculus
agttcctggcagtgattgtggaagc

SEQ ID NO: 538422 - DNA, 25 bp, Mus musculus
agttccttgcaaatctgaggcacaa

SEQ ID NO: 538423 - DNA, 25 bp, Mus musculus
agttccttgcaattctgaggcacaa

SEQ ID NO: 538424 - DNA, 25 bp, Mus musculus
agttcgaccccaataagctggcacc

SEQ ID NO: 538425 - DNA, 25 bp, Mus musculus
agttcgaccccattaagctggcacc

SEQ ID NO: 538426 - DNA, 25 bp, Mus musculus
agttcgacggcaccgacttccaggg

SEQ ID NO: 538427 - DNA, 25 bp, Mus musculus
agttcgacggcagcgacttccaggg

SEQ ID NO: 538428 - DNA, 25 bp, Mus musculus
agttcgagatggcaggctctatgcc

SEQ ID NO: 538429 - DNA, 25 bp, Mus musculus
agttcgagatgggaggctctatgcc

SEQ ID NO: 538430 - DNA, 25 bp, Mus musculus
agttcgagcgcgacttccgagccca

SEQ ID NO: 538431 - DNA, 25 bp, Mus musculus
agttcgagcgcgtcttccgagccca

SEQ ID NO: 538432 - DNA, 25 bp, Mus musculus
agttcgaggactcacaggacccaag

SEQ ID NO: 538433 - DNA, 25 bp, Mus musculus
agttcgaggactgacaggacccaag

SEQ ID NO: 538434 - DNA, 25 bp, Mus musculus
agttcgaggagtacgtgagacagca

SEQ ID NO: 538435 - DNA, 25 bp, Mus musculus
agttcgaggagttcgtgagacagca

SEQ ID NO: 538436 - DNA, 25 bp, Mus musculus
agttcgagtgcccatgctgagtagc

SEQ ID NO: 538437 - DNA, 25 bp, Mus musculus
agttcgagtgccgatgctgagtagc

SEQ ID NO: 538438 - DNA, 25 bp, Mus musculus
agttcgatgcccaagtcattcaaga

SEQ ID NO: 538439 - DNA, 25 bp, Mus musculus
agttcgatgccctagtcattcaaga

SEQ ID NO: 538440 - DNA, 25 bp, Mus musculus
agttcggctactctctcctcgtggg

SEQ ID NO: 538441 - DNA, 25 bp, Mus musculus
agttcggctactgtctcctcgtggg

SEQ ID NO: 538442 - DNA, 25 bp, Mus musculus
agttcggtgtccctcatcagtacag

SEQ ID NO: 538443 - DNA, 25 bp, Mus musculus
agttcggtgtccgtcatcagtacag

SEQ ID NO: 538444 - DNA, 25 bp, Mus musculus
agttcgtgtcatcgagcctcgcaaa

SEQ ID NO: 538445 - DNA, 25 bp, Mus musculus
agttcgtgtcatggagcctcgcaaa

SEQ ID NO: 538446 - DNA, 25 bp, Mus musculus
agttcgtgtcgaagggtgttatctc

SEQ ID NO: 538447 - DNA, 25 bp, Mus musculus
agttcgtgtcgatgggtgttatctc

SEQ ID NO: 538448 - DNA, 25 bp, Mus musculus
agttctaaaatacctgcgcagcaag

SEQ ID NO: 538449 - DNA, 25 bp, Mus musculus
agttctaaaatagctgcgcagcaag

SEQ ID NO: 538450 - DNA, 25 bp, Mus musculus
agttctaatgctatgcctctgaaag

SEQ ID NO: 538451 - DNA, 25 bp, Mus musculus
agttctaatgctttgcctctgaaag

SEQ ID NO: 538452 - DNA, 25 bp, Mus musculus
agttctaccgtgcaacacctctgga

SEQ ID NO: 538453 - DNA, 25 bp, Mus musculus
agttctaccgtggaacacctctgga

SEQ ID NO: 538454 - DNA, 25 bp, Mus musculus
agttctacggcgctaccgagtgcaa

SEQ ID NO: 538455 - DNA, 25 bp, Mus musculus
agttctacggcggtaccgagtgcaa

SEQ ID NO: 538456 - DNA, 25 bp, Mus musculus
agttctacgtggaggcctactccca

SEQ ID NO: 538457 - DNA, 25 bp, Mus musculus
agttctacgtggtggcctactccca

SEQ ID NO: 538458 - DNA, 25 bp, Mus musculus
agttctagacccagactttcatgag

SEQ ID NO: 538459 - DNA, 25 bp, Mus musculus
agttctagaccctgactttcatgag

SEQ ID NO: 538460 - DNA, 25 bp, Mus musculus
agttctagcagcaacctttcacttg

SEQ ID NO: 538461 - DNA, 25 bp, Mus musculus
agttctagcagctacctttcacttg

SEQ ID NO: 538462 - DNA, 25 bp, Mus musculus
agttctagcggtcgctctacccgag

SEQ ID NO: 538463 - DNA, 25 bp, Mus musculus
agttctagcggtggctctacccgag

SEQ ID NO: 538464 - DNA, 25 bp, Mus musculus
agttctcaggagaggactcctcccc

SEQ ID NO: 538465 - DNA, 25 bp, Mus musculus
agttctcaggagtggactcctcccc

SEQ ID NO: 538466 - DNA, 25 bp, Mus musculus
agttctcccagtatggacctcatga

SEQ ID NO: 538467 - DNA, 25 bp, Mus musculus
agttctcccagtttggacctcatga

SEQ ID NO: 538468 - DNA, 25 bp, Mus musculus
agttctccgctgctcggactagcca

SEQ ID NO: 538469 - DNA, 25 bp, Mus musculus
agttctccgctggtcggactagcca

SEQ ID NO: 538470 - DNA, 25 bp, Mus musculus
agttctccgtcaaatgctggctccg

SEQ ID NO: 538471 - DNA, 25 bp, Mus musculus
agttctccgtcatatgctggctccg

SEQ ID NO: 538472 - DNA, 25 bp, Mus musculus
agttctcctacaagtggaccatcaa

SEQ ID NO: 538473 - DNA, 25 bp, Mus musculus
agttctcctacatgtggaccatcaa

SEQ ID NO: 538474 - DNA, 25 bp, Mus musculus
agttctctcagaatgtgaacctgaa

SEQ ID NO: 538475 - DNA, 25 bp, Mus musculus
agttctctcagattgtgaacctgaa

SEQ ID NO: 538476 - DNA, 25 bp, Mus musculus
agttctcttaaaacacagcccaggg

SEQ ID NO: 538477 - DNA, 25 bp, Mus musculus
agttctcttaaatcacagcccaggg

SEQ ID NO: 538478 - DNA, 25 bp, Mus musculus
agttctgaaagtccgacatgatgag

SEQ ID NO: 538479 - DNA, 25 bp, Mus musculus
agttctgaaagtgcgacatgatgag

SEQ ID NO: 538480 - DNA, 25 bp, Mus musculus
agttctgacaccagggatggaccac

SEQ ID NO: 538481 - DNA, 25 bp, Mus musculus
agttctgacacctgggatggaccac

SEQ ID NO: 538482 - DNA, 25 bp, Mus musculus
agttctgaggctcctgacggcccca

SEQ ID NO: 538483 - DNA, 25 bp, Mus musculus
agttctgaggctgctgacggcccca

SEQ ID NO: 538484 - DNA, 25 bp, Mus musculus
agttctgatgacatctctctgctca

SEQ ID NO: 538485 - DNA, 25 bp, Mus musculus
agttctgatgacttctctctgctca

SEQ ID NO: 538486 - DNA, 25 bp, Mus musculus
agttctgcaaaacttcctgctcggg

SEQ ID NO: 538487 - DNA, 25 bp, Mus musculus
agttctgcaaaagttcctgctcggg

SEQ ID NO: 538488 - DNA, 25 bp, Mus musculus
agttctgcagccacgagtcctttca

SEQ ID NO: 538489 - DNA, 25 bp, Mus musculus
agttctgcagcctcgagtcctttca

SEQ ID NO: 538490 - DNA, 25 bp, Mus musculus
agttctgcgtgcagcgcatccggct

SEQ ID NO: 538491 - DNA, 25 bp, Mus musculus
agttctgcgtgctgcgcatccggct

SEQ ID NO: 538492 - DNA, 25 bp, Mus musculus
agttctggcagcatcctaccggtgc

SEQ ID NO: 538493 - DNA, 25 bp, Mus musculus
agttctggcagcttcctaccggtgc

SEQ ID NO: 538494 - DNA, 25 bp, Mus musculus
agttctgggctcagacaggatcatg

SEQ ID NO: 538495 - DNA, 25 bp, Mus musculus
agttctgggctctgacaggatcatg

SEQ ID NO: 538496 - DNA, 25 bp, Mus musculus
agttctgggtctccatccacaacag

SEQ ID NO: 538497 - DNA, 25 bp, Mus musculus
agttctgggtctgcatccacaacag

SEQ ID NO: 538498 - DNA, 25 bp, Mus musculus
agttctgtcaatctagatgagtttg

SEQ ID NO: 538499 - DNA, 25 bp, Mus musculus
agttctgtcaatgtagatgagtttg

SEQ ID NO: 538500 - DNA, 25 bp, Mus musculus
agttctgtgaaaatctctcagctga

SEQ ID NO: 538501 - DNA, 25 bp, Mus musculus
agttctgtgaaattctctcagctga

SEQ ID NO: 538502 - DNA, 25 bp, Mus musculus
agttctgtgaccagtacacccctct

SEQ ID NO: 538503 - DNA, 25 bp, Mus musculus
agttctgtgacctgtacacccctct

SEQ ID NO: 538504 - DNA, 25 bp, Mus musculus
agttctgttacgacacccataaggg

SEQ ID NO: 538505 - DNA, 25 bp, Mus musculus
agttctgttacgtcacccataaggg

SEQ ID NO: 538506 - DNA, 25 bp, Mus musculus
agttctgttctccagttgaaccccg

SEQ ID NO: 538507 - DNA, 25 bp, Mus musculus
agttctgttctcgagttgaaccccg

SEQ ID NO: 538508 - DNA, 25 bp, Mus musculus
agttcttcattcagtcttccaaggg

SEQ ID NO: 538509 - DNA, 25 bp, Mus musculus
agttcttcattctgtcttccaaggg

SEQ ID NO: 538510 - DNA, 25 bp, Mus musculus
agttcttccaacctttattctcgag

SEQ ID NO: 538511 - DNA, 25 bp, Mus musculus
agttcttccaacgtttattctcgag

SEQ ID NO: 538512 - DNA, 25 bp, Mus musculus
agttcttggagcatccccgatcctc

SEQ ID NO: 538513 - DNA, 25 bp, Mus musculus
agttcttggagcttccccgatcctc

SEQ ID NO: 538514 - DNA, 25 bp, Mus musculus
agttcttggctcaatggcaaaaaag

SEQ ID NO: 538515 - DNA, 25 bp, Mus musculus
agttcttggctctatggcaaaaaag

SEQ ID NO: 538516 - DNA, 25 bp, Mus musculus
agttcttgtgagctccgaggcaaag

SEQ ID NO: 538517 - DNA, 25 bp, Mus musculus
agttcttgtgaggtccgaggcaaag

SEQ ID NO: 538518 - DNA, 25 bp, Mus musculus
agttctttcgcaattaagatccggg

SEQ ID NO: 538519 - DNA, 25 bp, Mus musculus
agttctttcgcatttaagatccggg

SEQ ID NO: 538520 - DNA, 25 bp, Mus musculus
agttctttgttgctgcagactggca

SEQ ID NO: 538521 - DNA, 25 bp, Mus musculus
agttctttgttggtgcagactggca

SEQ ID NO: 538522 - DNA, 25 bp, Mus musculus
agttgaaaagttcgagtggtagcca

SEQ ID NO: 538523 - DNA, 25 bp, Mus musculus
agttgaaaagttggagtggtagcca

SEQ ID NO: 538524 - DNA, 25 bp, Mus musculus
agttgaaagaggaaagctggagcct

SEQ ID NO: 538525 - DNA, 25 bp, Mus musculus
agttgaaagaggtaagctggagcct

SEQ ID NO: 538526 - DNA, 25 bp, Mus musculus
agttgaaagctgacagcaggacgtg

SEQ ID NO: 538527 - DNA, 25 bp, Mus musculus
agttgaaagctgtcagcaggacgtg

SEQ ID NO: 538528 - DNA, 25 bp, Mus musculus
agttgaaccccgctatccctggagt

SEQ ID NO: 538529 - DNA, 25 bp, Mus musculus
agttgaaccccggtatccctggagt

SEQ ID NO: 538530 - DNA, 25 bp, Mus musculus
agttgaaggactaaaacgcttaatg

SEQ ID NO: 538531 - DNA, 25 bp, Mus musculus
agttgaaggacttaaacgcttaatg

SEQ ID NO: 538532 - DNA, 25 bp, Mus musculus
agttgaagtcatagtcccagtttag

SEQ ID NO: 538533 - DNA, 25 bp, Mus musculus
agttgaagtcattgtcccagtttag

SEQ ID NO: 538534 - DNA, 25 bp, Mus musculus
agttgaagtctaaggtgcgtcacca

SEQ ID NO: 538535 - DNA, 25 bp, Mus musculus
agttgaagtctatggtgcgtcacca

SEQ ID NO: 538536 - DNA, 25 bp, Mus musculus
agttgaatccaacaagtctacaaaa

SEQ ID NO: 538537 - DNA, 25 bp, Mus musculus
agttgaatccaagaagtctacaaaa

SEQ ID NO: 538538 - DNA, 25 bp, Mus musculus
agttgacacactcgagaccacttgc

SEQ ID NO: 538539 - DNA, 25 bp, Mus musculus
agttgacacactggagaccacttgc

SEQ ID NO: 538540 - DNA, 25 bp, Mus musculus
agttgacacatacggacctcaaacc

SEQ ID NO: 538541 - DNA, 25 bp, Mus musculus
agttgacacatagggacctcaaacc

SEQ ID NO: 538542 - DNA, 25 bp, Mus musculus
agttgacaggtgactggtaaccagt

SEQ ID NO: 538543 - DNA, 25 bp, Mus musculus
agttgacaggtgtctggtaaccagt

SEQ ID NO: 538544 - DNA, 25 bp, Mus musculus
agttgacagtcacgtgaccctctga

SEQ ID NO: 538545 - DNA, 25 bp, Mus musculus
agttgacagtcaggtgaccctctga

SEQ ID NO: 538546 - DNA, 25 bp, Mus musculus
agttgacagttgacccaggctgggc

SEQ ID NO: 538547 - DNA, 25 bp, Mus musculus
agttgacagttgtcccaggctgggc

SEQ ID NO: 538548 - DNA, 25 bp, Mus musculus
agttgacatggaaccgctcagagcc

SEQ ID NO: 538549 - DNA, 25 bp, Mus musculus
agttgacatggatccgctcagagcc

SEQ ID NO: 538550 - DNA, 25 bp, Mus musculus
agttgaccaaaaccgtgccagccat

SEQ ID NO: 538551 - DNA, 25 bp, Mus musculus
agttgaccaaaagcgtgccagccat

SEQ ID NO: 538552 - DNA, 25 bp, Mus musculus
agttgaccgcagatgtccagaagcg

SEQ ID NO: 538553 - DNA, 25 bp, Mus musculus
agttgaccgcagttgtccagaagcg

SEQ ID NO: 538554 - DNA, 25 bp, Mus musculus
agttgacctttcctgctgccctgag

SEQ ID NO: 538555 - DNA, 25 bp, Mus musculus
agttgacctttcgtgctgccctgag

SEQ ID NO: 538556 - DNA, 25 bp, Mus musculus
agttgactaccgaccttgcgcgacc

SEQ ID NO: 538557 - DNA, 25 bp, Mus musculus
agttgactaccgtccttgcgcgacc

SEQ ID NO: 538558 - DNA, 25 bp, Mus musculus
agttgactagaactaagaaagtgac

SEQ ID NO: 538559 - DNA, 25 bp, Mus musculus
agttgactagaagtaagaaagtgac

SEQ ID NO: 538560 - DNA, 25 bp, Mus musculus
agttgactgctaagtggctgtcaga

SEQ ID NO: 538561 - DNA, 25 bp, Mus musculus
agttgactgctatgtggctgtcaga

SEQ ID NO: 538562 - DNA, 25 bp, Mus musculus
agttgacttgatcgcctagcatccc

SEQ ID NO: 538563 - DNA, 25 bp, Mus musculus
agttgacttgatggcctagcatccc

SEQ ID NO: 538564 - DNA, 25 bp, Mus musculus
agttgagactggctcccactctgta

SEQ ID NO: 538565 - DNA, 25 bp, Mus musculus
agttgagactgggtcccactctgta

SEQ ID NO: 538566 - DNA, 25 bp, Mus musculus
agttgagcacgcatcccagaggcat

SEQ ID NO: 538567 - DNA, 25 bp, Mus musculus
agttgagcacgcttcccagaggcat

SEQ ID NO: 538568 - DNA, 25 bp, Mus musculus
agttgagctctcagttgtacctcca

SEQ ID NO: 538569 - DNA, 25 bp, Mus musculus
agttgagctctctgttgtacctcca

SEQ ID NO: 538570 - DNA, 25 bp, Mus musculus
agttgagtggccaaagttggttcca

SEQ ID NO: 538571 - DNA, 25 bp, Mus musculus
agttgagtggcctaagttggttcca

SEQ ID NO: 538572 - DNA, 25 bp, Mus musculus
agttgagtttggcactaccaacaag

SEQ ID NO: 538573 - DNA, 25 bp, Mus musculus
agttgagtttgggactaccaacaag

SEQ ID NO: 538574 - DNA, 25 bp, Mus musculus
agttgatattggaggtgggcaaacc

SEQ ID NO: 538575 - DNA, 25 bp, Mus musculus
agttgatattggtggtgggcaaacc

SEQ ID NO: 538576 - DNA, 25 bp, Mus musculus
agttgatcaactcaaagggaaaaag

SEQ ID NO: 538577 - DNA, 25 bp, Mus musculus
agttgatcaactgaaagggaaaaag

SEQ ID NO: 538578 - DNA, 25 bp, Mus musculus
agttgatctcctagtatgaatatag

SEQ ID NO: 538579 - DNA, 25 bp, Mus musculus
agttgatctccttgtatgaatatag

SEQ ID NO: 538580 - DNA, 25 bp, Mus musculus
agttgatgatcgaaaggaatggtta

SEQ ID NO: 538581 - DNA, 25 bp, Mus musculus
agttgatgatcgtaaggaatggtta

SEQ ID NO: 538582 - DNA, 25 bp, Mus musculus
agttgattgtgaaggaaaaggagcc

SEQ ID NO: 538583 - DNA, 25 bp, Mus musculus
agttgattgtgatggaaaaggagcc

SEQ ID NO: 538584 - DNA, 25 bp, Mus musculus
agttgattgtgtcaagaagcttcta

SEQ ID NO: 538585 - DNA, 25 bp, Mus musculus
agttgattgtgtgaagaagcttcta

SEQ ID NO: 538586 - DNA, 25 bp, Mus musculus
agttgcaaggatccaattcgagaag

SEQ ID NO: 538587 - DNA, 25 bp, Mus musculus
agttgcaaggatgcaattcgagaag

SEQ ID NO: 538588 - DNA, 25 bp, Mus musculus
agttgcacagcaaattacagtcatc

SEQ ID NO: 538589 - DNA, 25 bp, Mus musculus
agttgcacagcatattacagtcatc

SEQ ID NO: 538590 - DNA, 25 bp, Mus musculus
agttgcacagccacagactgctcag

SEQ ID NO: 538591 - DNA, 25 bp, Mus musculus
agttgcacagcctcagactgctcag

SEQ ID NO: 538592 - DNA, 25 bp, Mus musculus
agttgcacgtgtcctattctccgga

SEQ ID NO: 538593 - DNA, 25 bp, Mus musculus
agttgcacgtgtgctattctccgga

SEQ ID NO: 538594 - DNA, 25 bp, Mus musculus
agttgcaggtgaccttaagagctgc

SEQ ID NO: 538595 - DNA, 25 bp, Mus musculus
agttgcaggtgagcttaagagctgc

SEQ ID NO: 538596 - DNA, 25 bp, Mus musculus
agttgcagtcctagcttctgacagg

SEQ ID NO: 538597 - DNA, 25 bp, Mus musculus
agttgcagtccttgcttctgacagg

SEQ ID NO: 538598 - DNA, 25 bp, Mus musculus
agttgcatctctagttttgaagcca

SEQ ID NO: 538599 - DNA, 25 bp, Mus musculus
agttgcatctcttgttttgaagcca

SEQ ID NO: 538600 - DNA, 25 bp, Mus musculus
agttgcatgaatacgtctttgccag

SEQ ID NO: 538601 - DNA, 25 bp, Mus musculus
agttgcatgaattcgtctttgccag

SEQ ID NO: 538602 - DNA, 25 bp, Mus musculus
agttgccacaatcaaggactttaca

SEQ ID NO: 538603 - DNA, 25 bp, Mus musculus
agttgccacaatgaaggactttaca

SEQ ID NO: 538604 - DNA, 25 bp, Mus musculus
agttgccaccgccaggactacagtc

SEQ ID NO: 538605 - DNA, 25 bp, Mus musculus
agttgccaccgcgaggactacagtc

SEQ ID NO: 538606 - DNA, 25 bp, Mus musculus
agttgccaggagagccatgatgcag

SEQ ID NO: 538607 - DNA, 25 bp, Mus musculus
agttgccaggagtgccatgatgcag

SEQ ID NO: 538608 - DNA, 25 bp, Mus musculus
agttgcccctgcatgtaggccacag

SEQ ID NO: 538609 - DNA, 25 bp, Mus musculus
agttgcccctgcttgtaggccacag

SEQ ID NO: 538610 - DNA, 25 bp, Mus musculus
agttgcctccggaaaagatctcggg

SEQ ID NO: 538611 - DNA, 25 bp, Mus musculus
agttgcctccggtaaagatctcggg

SEQ ID NO: 538612 - DNA, 25 bp, Mus musculus
agttgcctgactcgcttggaccaca

SEQ ID NO: 538613 - DNA, 25 bp, Mus musculus
agttgcctgactggcttggaccaca

SEQ ID NO: 538614 - DNA, 25 bp, Mus musculus
agttgcctgcctaagctcatggtga

SEQ ID NO: 538615 - DNA, 25 bp, Mus musculus
agttgcctgccttagctcatggtga

SEQ ID NO: 538616 - DNA, 25 bp, Mus musculus
agttgccttattatgatcttgtacc

SEQ ID NO: 538617 - DNA, 25 bp, Mus musculus
agttgccttattttgatcttgtacc

SEQ ID NO: 538618 - DNA, 25 bp, Mus musculus
agttgcgaaaacaacgcctgcgccg

SEQ ID NO: 538619 - DNA, 25 bp, Mus musculus
agttgcgaaaactacgcctgcgccg

SEQ ID NO: 538620 - DNA, 25 bp, Mus musculus
agttgcgacgggacccgatcctgct

SEQ ID NO: 538621 - DNA, 25 bp, Mus musculus
agttgcgacgggtcccgatcctgct

SEQ ID NO: 538622 - DNA, 25 bp, Mus musculus
agttgcgcagctctgtccagcacag

SEQ ID NO: 538623 - DNA, 25 bp, Mus musculus
agttgcgcagctgtgtccagcacag

SEQ ID NO: 538624 - DNA, 25 bp, Mus musculus
agttgcgcctccacaaacacatgcg

SEQ ID NO: 538625 - DNA, 25 bp, Mus musculus
agttgcgcctcctcaaacacatgcg

SEQ ID NO: 538626 - DNA, 25 bp, Mus musculus
agttgcggacagcttcagactcccc

SEQ ID NO: 538627 - DNA, 25 bp, Mus musculus
agttgcggacaggttcagactcccc

SEQ ID NO: 538628 - DNA, 25 bp, Mus musculus
agttgcgggccaagctggccattga

SEQ ID NO: 538629 - DNA, 25 bp, Mus musculus
agttgcgggccatgctggccattga

SEQ ID NO: 538630 - DNA, 25 bp, Mus musculus
agttgcgttcgaaggtttggctgtc

SEQ ID NO: 538631 - DNA, 25 bp, Mus musculus
agttgcgttcgatggtttggctgtc

SEQ ID NO: 538632 - DNA, 25 bp, Mus musculus
agttgctaaagcaagctgatcttta

SEQ ID NO: 538633 - DNA, 25 bp, Mus musculus
agttgctaaagctagctgatcttta

SEQ ID NO: 538634 - DNA, 25 bp, Mus musculus
agttgctcctcacatttgcttctga

SEQ ID NO: 538635 - DNA, 25 bp, Mus musculus
agttgctcctcagatttgcttctga

SEQ ID NO: 538636 - DNA, 25 bp, Mus musculus
agttgctgccaaagagttatctgtg

SEQ ID NO: 538637 - DNA, 25 bp, Mus musculus
agttgctgccaatgagttatctgtg

SEQ ID NO: 538638 - DNA, 25 bp, Mus musculus
agttgctggcccacatgcaggagga

SEQ ID NO: 538639 - DNA, 25 bp, Mus musculus
agttgctggccctcatgcaggagga

SEQ ID NO: 538640 - DNA, 25 bp, Mus musculus
agttgctgtcatatgggcttactgg

SEQ ID NO: 538641 - DNA, 25 bp, Mus musculus
agttgctgtcatttgggcttactgg

SEQ ID NO: 538642 - DNA, 25 bp, Mus musculus
agttgcttatacagtacaaggaaag

SEQ ID NO: 538643 - DNA, 25 bp, Mus musculus
agttgcttatactgtacaaggaaag

SEQ ID NO: 538644 - DNA, 25 bp, Mus musculus
agttgcttccacacatccagagccg

SEQ ID NO: 538645 - DNA, 25 bp, Mus musculus
agttgcttccactcatccagagccg

SEQ ID NO: 538646 - DNA, 25 bp, Mus musculus
agttgcttcccgctggacaccacgg

SEQ ID NO: 538647 - DNA, 25 bp, Mus musculus
agttgcttcccggtggacaccacgg

SEQ ID NO: 538648 - DNA, 25 bp, Mus musculus
agttgcttgttaacctcccagggag

SEQ ID NO: 538649 - DNA, 25 bp, Mus musculus
agttgcttgttatcctcccagggag

SEQ ID NO: 538650 - DNA, 25 bp, Mus musculus
agttggaagtgcagggaggcattct

SEQ ID NO: 538651 - DNA, 25 bp, Mus musculus
agttggaagtgctgggaggcattct

SEQ ID NO: 538652 - DNA, 25 bp, Mus musculus
agttggagtcccacgtgcatcctcg

SEQ ID NO: 538653 - DNA, 25 bp, Mus musculus
agttggagtccctcgtgcatcctcg

SEQ ID NO: 538654 - DNA, 25 bp, Mus musculus
agttggatatacctcgcctagtgtc

SEQ ID NO: 538655 - DNA, 25 bp, Mus musculus
agttggatatacgtcgcctagtgtc

SEQ ID NO: 538656 - DNA, 25 bp, Mus musculus
agttggatcaggaggatgcactgct

SEQ ID NO: 538657 - DNA, 25 bp, Mus musculus
agttggatcaggtggatgcactgct

SEQ ID NO: 538658 - DNA, 25 bp, Mus musculus
agttggattaaaccagtctctggcg

SEQ ID NO: 538659 - DNA, 25 bp, Mus musculus
agttggattaaagcagtctctggcg

SEQ ID NO: 538660 - DNA, 25 bp, Mus musculus
agttggcaagccctggcacgttcca

SEQ ID NO: 538661 - DNA, 25 bp, Mus musculus
agttggcaagccgtggcacgttcca

SEQ ID NO: 538662 - DNA, 25 bp, Mus musculus
agttggcaaggcctgcttcccgagc

SEQ ID NO: 538663 - DNA, 25 bp, Mus musculus
agttggcaaggcgtgcttcccgagc

SEQ ID NO: 538664 - DNA, 25 bp, Mus musculus
agttggcatcgcacaagctggaagt

SEQ ID NO: 538665 - DNA, 25 bp, Mus musculus
agttggcatcgctcaagctggaagt

SEQ ID NO: 538666 - DNA, 25 bp, Mus musculus
agttggccaaagacctccgtcaacg

SEQ ID NO: 538667 - DNA, 25 bp, Mus musculus
agttggccaaagtcctccgtcaacg

SEQ ID NO: 538668 - DNA, 25 bp, Mus musculus
agttggcccggcacatcctgacggg

SEQ ID NO: 538669 - DNA, 25 bp, Mus musculus
agttggcccggctcatcctgacggg

SEQ ID NO: 538670 - DNA, 25 bp, Mus musculus
agttggccctctcatgtcccctggt

SEQ ID NO: 538671 - DNA, 25 bp, Mus musculus
agttggccctctgatgtcccctggt

SEQ ID NO: 538672 - DNA, 25 bp, Mus musculus
agttggcctaccataacaaggctgg

SEQ ID NO: 538673 - DNA, 25 bp, Mus musculus
agttggcctaccttaacaaggctgg

SEQ ID NO: 538674 - DNA, 25 bp, Mus musculus
agttggcctagcagtgcgcgcaccg

SEQ ID NO: 538675 - DNA, 25 bp, Mus musculus
agttggcctagctgtgcgcgcaccg

SEQ ID NO: 538676 - DNA, 25 bp, Mus musculus
agttggccttctccttagacctcgc

SEQ ID NO: 538677 - DNA, 25 bp, Mus musculus
agttggccttctgcttagacctcgc

SEQ ID NO: 538678 - DNA, 25 bp, Mus musculus
agttggcctttcaggcaattgccaa

SEQ ID NO: 538679 - DNA, 25 bp, Mus musculus
agttggcctttctggcaattgccaa

SEQ ID NO: 538680 - DNA, 25 bp, Mus musculus
agttggctatggctttacaggaaga

SEQ ID NO: 538681 - DNA, 25 bp, Mus musculus
agttggctatgggtttacaggaaga

SEQ ID NO: 538682 - DNA, 25 bp, Mus musculus
agttggctcgacaggcactagatag

SEQ ID NO: 538683 - DNA, 25 bp, Mus musculus
agttggctcgactggcactagatag

SEQ ID NO: 538684 - DNA, 25 bp, Mus musculus
agttgggacccaagcaatgtcgccc

SEQ ID NO: 538685 - DNA, 25 bp, Mus musculus
agttgggacccatgcaatgtcgccc

SEQ ID NO: 538686 - DNA, 25 bp, Mus musculus
agttgggctacccagtcctcagtga

SEQ ID NO: 538687 - DNA, 25 bp, Mus musculus
agttgggctaccgagtcctcagtga

SEQ ID NO: 538688 - DNA, 25 bp, Mus musculus
agttgggtctccacctgagcttgct

SEQ ID NO: 538689 - DNA, 25 bp, Mus musculus
agttgggtctcctcctgagcttgct

SEQ ID NO: 538690 - DNA, 25 bp, Mus musculus
agttgggtgacaactgtacctcctt

SEQ ID NO: 538691 - DNA, 25 bp, Mus musculus
agttgggtgacatctgtacctcctt

SEQ ID NO: 538692 - DNA, 25 bp, Mus musculus
agttgggtgaccacaaaggcgtcaa

SEQ ID NO: 538693 - DNA, 25 bp, Mus musculus
agttgggtgacctcaaaggcgtcaa

SEQ ID NO: 538694 - DNA, 25 bp, Mus musculus
agttggtactatagtccatgagaag

SEQ ID NO: 538695 - DNA, 25 bp, Mus musculus
agttggtactattgtccatgagaag

SEQ ID NO: 538696 - DNA, 25 bp, Mus musculus
agttggtggaatctccacacagaaa

SEQ ID NO: 538697 - DNA, 25 bp, Mus musculus
agttggtggaatgtccacacagaaa

SEQ ID NO: 538698 - DNA, 25 bp, Mus musculus
agttggtgggttatccgctgtctcc

SEQ ID NO: 538699 - DNA, 25 bp, Mus musculus
agttggtgggttttccgctgtctcc

SEQ ID NO: 538700 - DNA, 25 bp, Mus musculus
agttggttccagagtcacattctcc

SEQ ID NO: 538701 - DNA, 25 bp, Mus musculus
agttggttccagtgtcacattctcc

SEQ ID NO: 538702 - DNA, 25 bp, Mus musculus
agttgtactggacaatgtatcagag

SEQ ID NO: 538703 - DNA, 25 bp, Mus musculus
agttgtactggagaatgtatcagag

SEQ ID NO: 538704 - DNA, 25 bp, Mus musculus
agttgtagctcgcagcaggactgca

SEQ ID NO: 538705 - DNA, 25 bp, Mus musculus
agttgtagctcggagcaggactgca

SEQ ID NO: 538706 - DNA, 25 bp, Mus musculus
agttgtcacaaacaagtaatgtgga

SEQ ID NO: 538707 - DNA, 25 bp, Mus musculus
agttgtcacaaagaagtaatgtgga

SEQ ID NO: 538708 - DNA, 25 bp, Mus musculus
agttgtcagactcctgtgctttcgg

SEQ ID NO: 538709 - DNA, 25 bp, Mus musculus
agttgtcagactgctgtgctttcgg

SEQ ID NO: 538710 - DNA, 25 bp, Mus musculus
agttgtcagatgcagacctccgggc

SEQ ID NO: 538711 - DNA, 25 bp, Mus musculus
agttgtcagatggagacctccgggc

SEQ ID NO: 538712 - DNA, 25 bp, Mus musculus
agttgtccatcacccaataaacttc

SEQ ID NO: 538713 - DNA, 25 bp, Mus musculus
agttgtccatcagccaataaacttc

SEQ ID NO: 538714 - DNA, 25 bp, Mus musculus
agttgtctatcccatcaaccagaag

SEQ ID NO: 538715 - DNA, 25 bp, Mus musculus
agttgtctatccgatcaaccagaag

SEQ ID NO: 538716 - DNA, 25 bp, Mus musculus
agttgtctcaatattgcctgaatcg

SEQ ID NO: 538717 - DNA, 25 bp, Mus musculus
agttgtctcaattttgcctgaatcg

SEQ ID NO: 538718 - DNA, 25 bp, Mus musculus
agttgtgatcgcatcaagcagtcag

SEQ ID NO: 538719 - DNA, 25 bp, Mus musculus
agttgtgatcgcttcaagcagtcag

SEQ ID NO: 538720 - DNA, 25 bp, Mus musculus
agttgtgtgctcattgtcatagcca

SEQ ID NO: 538721 - DNA, 25 bp, Mus musculus
agttgtgtgctctttgtcatagcca

SEQ ID NO: 538722 - DNA, 25 bp, Mus musculus
agttgtgttggtctctggaccctac

SEQ ID NO: 538723 - DNA, 25 bp, Mus musculus
agttgtgttggtgtctggaccctac

SEQ ID NO: 538724 - DNA, 25 bp, Mus musculus
agttgttacgagagagctcccagga

SEQ ID NO: 538725 - DNA, 25 bp, Mus musculus
agttgttacgagtgagctcccagga

SEQ ID NO: 538726 - DNA, 25 bp, Mus musculus
agttgttccccgagacgaccctgag

SEQ ID NO: 538727 - DNA, 25 bp, Mus musculus
agttgttccccgtgacgaccctgag

SEQ ID NO: 538728 - DNA, 25 bp, Mus musculus
agttgttcgaagacattgaaacgga

SEQ ID NO: 538729 - DNA, 25 bp, Mus musculus
agttgttcgaagtcattgaaacgga

SEQ ID NO: 538730 - DNA, 25 bp, Mus musculus
agttgttgcccaacctcctgcagtg

SEQ ID NO: 538731 - DNA, 25 bp, Mus musculus
agttgttgcccatcctcctgcagtg

SEQ ID NO: 538732 - DNA, 25 bp, Mus musculus
agttgttgccctagtccagctttca

SEQ ID NO: 538733 - DNA, 25 bp, Mus musculus
agttgttgcccttgtccagctttca

SEQ ID NO: 538734 - DNA, 25 bp, Mus musculus
agttgtttgtggacctctgctgtca

SEQ ID NO: 538735 - DNA, 25 bp, Mus musculus
agttgtttgtggtcctctgctgtca

SEQ ID NO: 538736 - DNA, 25 bp, Mus musculus
agtttacctggcacttcagtctgtc

SEQ ID NO: 538737 - DNA, 25 bp, Mus musculus
agtttacctggctcttcagtctgtc

SEQ ID NO: 538738 - DNA, 25 bp, Mus musculus
agtttactgacaagttcaccggctt

SEQ ID NO: 538739 - DNA, 25 bp, Mus musculus
agtttactgacatgttcaccggctt

SEQ ID NO: 538740 - DNA, 25 bp, Mus musculus
agtttagcctgcagaacctctacca

SEQ ID NO: 538741 - DNA, 25 bp, Mus musculus
agtttagcctgctgaacctctacca

SEQ ID NO: 538742 - DNA, 25 bp, Mus musculus
agtttatcatcgatgcattcaaggg

SEQ ID NO: 538743 - DNA, 25 bp, Mus musculus
agtttatcatcgttgcattcaaggg

SEQ ID NO: 538744 - DNA, 25 bp, Mus musculus
agtttatggcaaaagaggatactcc

SEQ ID NO: 538745 - DNA, 25 bp, Mus musculus
agtttatggcaatagaggatactcc

SEQ ID NO: 538746 - DNA, 25 bp, Mus musculus
agtttatgtagacaaattggctgaa

SEQ ID NO: 538747 - DNA, 25 bp, Mus musculus
agtttatgtagagaaattggctgaa

SEQ ID NO: 538748 - DNA, 25 bp, Mus musculus
agtttcaacctgatccccgcagttg

SEQ ID NO: 538749 - DNA, 25 bp, Mus musculus
agtttcaacctgttccccgcagttg

SEQ ID NO: 538750 - DNA, 25 bp, Mus musculus
agtttcagatgaccccacggcgaca

SEQ ID NO: 538751 - DNA, 25 bp, Mus musculus
agtttcagatgagcccacggcgaca

SEQ ID NO: 538752 - DNA, 25 bp, Mus musculus
agtttcagcttccagtgactggaaa

SEQ ID NO: 538753 - DNA, 25 bp, Mus musculus
agtttcagcttcgagtgactggaaa

SEQ ID NO: 538754 - DNA, 25 bp, Mus musculus
agtttcagttcactgtccgcacccg

SEQ ID NO: 538755 - DNA, 25 bp, Mus musculus
agtttcagttcagtgtccgcacccg

SEQ ID NO: 538756 - DNA, 25 bp, Mus musculus
agtttcagttgcagatccagcccca

SEQ ID NO: 538757 - DNA, 25 bp, Mus musculus
agtttcagttgctgatccagcccca

SEQ ID NO: 538758 - DNA, 25 bp, Mus musculus
agtttcatcaacactcttaccggga

SEQ ID NO: 538759 - DNA, 25 bp, Mus musculus
agtttcatcaactctcttaccggga

SEQ ID NO: 538760 - DNA, 25 bp, Mus musculus
agtttccaaccaagaaccgtcgtgg

SEQ ID NO: 538761 - DNA, 25 bp, Mus musculus
agtttccaaccatgaaccgtcgtgg

SEQ ID NO: 538762 - DNA, 25 bp, Mus musculus
agtttccacagacggtcagctgttg

SEQ ID NO: 538763 - DNA, 25 bp, Mus musculus
agtttccacagagggtcagctgttg

SEQ ID NO: 538764 - DNA, 25 bp, Mus musculus
agtttcccaagaacccagcagcaga

SEQ ID NO: 538765 - DNA, 25 bp, Mus musculus
agtttcccaagatcccagcagcaga

SEQ ID NO: 538766 - DNA, 25 bp, Mus musculus
agtttcccagctctggtcagtgctc

SEQ ID NO: 538767 - DNA, 25 bp, Mus musculus
agtttcccagctgtggtcagtgctc

SEQ ID NO: 538768 - DNA, 25 bp, Mus musculus
agtttcccatcgatcacttcacaca

SEQ ID NO: 538769 - DNA, 25 bp, Mus musculus
agtttcccatcgttcacttcacaca

SEQ ID NO: 538770 - DNA, 25 bp, Mus musculus
agtttccccactactgaagacttgg

SEQ ID NO: 538771 - DNA, 25 bp, Mus musculus
agtttccccacttctgaagacttgg

SEQ ID NO: 538772 - DNA, 25 bp, Mus musculus
agtttccgagagacaggcgcactga

SEQ ID NO: 538773 - DNA, 25 bp, Mus musculus
agtttccgagagtcaggcgcactga

SEQ ID NO: 538774 - DNA, 25 bp, Mus musculus
agtttcgccatcactctctgtgcca

SEQ ID NO: 538775 - DNA, 25 bp, Mus musculus
agtttcgccatctctctctgtgcca

SEQ ID NO: 538776 - DNA, 25 bp, Mus musculus
agtttcgcctcgaggccttcgctga

SEQ ID NO: 538777 - DNA, 25 bp, Mus musculus
agtttcgcctcgtggccttcgctga

SEQ ID NO: 538778 - DNA, 25 bp, Mus musculus
agtttcggactcactctacgcagcg

SEQ ID NO: 538779 - DNA, 25 bp, Mus musculus
agtttcggactctctctacgcagcg

SEQ ID NO: 538780 - DNA, 25 bp, Mus musculus
agtttctaaactaccccaatggatg

SEQ ID NO: 538781 - DNA, 25 bp, Mus musculus
agtttctaaacttccccaatggatg

SEQ ID NO: 538782 - DNA, 25 bp, Mus musculus
agtttctaagggaagacagaattca

SEQ ID NO: 538783 - DNA, 25 bp, Mus musculus
agtttctaagggtagacagaattca

SEQ ID NO: 538784 - DNA, 25 bp, Mus musculus
agtttctacgtgaatgcaggcatcc

SEQ ID NO: 538785 - DNA, 25 bp, Mus musculus
agtttctacgtgtatgcaggcatcc

SEQ ID NO: 538786 - DNA, 25 bp, Mus musculus
agtttctcaaccacccctatcaaga

SEQ ID NO: 538787 - DNA, 25 bp, Mus musculus
agtttctcaacctcccctatcaaga

SEQ ID NO: 538788 - DNA, 25 bp, Mus musculus
agtttctcactgattcaactgctca

SEQ ID NO: 538789 - DNA, 25 bp, Mus musculus
agtttctcactgtttcaactgctca

SEQ ID NO: 538790 - DNA, 25 bp, Mus musculus
agtttctgccccagctctgcgtcag

SEQ ID NO: 538791 - DNA, 25 bp, Mus musculus
agtttctgcccctgctctgcgtcag

SEQ ID NO: 538792 - DNA, 25 bp, Mus musculus
agtttctgctccaggccggtgcccg

SEQ ID NO: 538793 - DNA, 25 bp, Mus musculus
agtttctgctcctggccggtgcccg

SEQ ID NO: 538794 - DNA, 25 bp, Mus musculus
agtttctggattactcagcactgca

SEQ ID NO: 538795 - DNA, 25 bp, Mus musculus
agtttctggatttctcagcactgca

SEQ ID NO: 538796 - DNA, 25 bp, Mus musculus
agtttcttattcacaccatcgctgc

SEQ ID NO: 538797 - DNA, 25 bp, Mus musculus
agtttcttattctcaccatcgctgc

SEQ ID NO: 538798 - DNA, 25 bp, Mus musculus
agtttcttcaacctggcagccagag

SEQ ID NO: 538799 - DNA, 25 bp, Mus musculus
agtttcttcaacgtggcagccagag

SEQ ID NO: 538800 - DNA, 25 bp, Mus musculus
agtttcttgccaacaatggattccc

SEQ ID NO: 538801 - DNA, 25 bp, Mus musculus
agtttcttgccatcaatggattccc

SEQ ID NO: 538802 - DNA, 25 bp, Mus musculus
agtttctttgacacctggtgtgagg

SEQ ID NO: 538803 - DNA, 25 bp, Mus musculus
agtttctttgactcctggtgtgagg

SEQ ID NO: 538804 - DNA, 25 bp, Mus musculus
agtttgaaaagacagacagggtgcc

SEQ ID NO: 538805 - DNA, 25 bp, Mus musculus
agtttgaaaagagagacagggtgcc

SEQ ID NO: 538806 - DNA, 25 bp, Mus musculus
agtttgaagggcagatgaggaccct

SEQ ID NO: 538807 - DNA, 25 bp, Mus musculus
agtttgaagggctgatgaggaccct

SEQ ID NO: 538808 - DNA, 25 bp, Mus musculus
agtttgaaggggagccagcgaccca

SEQ ID NO: 538809 - DNA, 25 bp, Mus musculus
agtttgaaggggtgccagcgaccca

SEQ ID NO: 538810 - DNA, 25 bp, Mus musculus
agtttgacaagaaggccgaggctga

SEQ ID NO: 538811 - DNA, 25 bp, Mus musculus
agtttgacaagatggccgaggctga

SEQ ID NO: 538812 - DNA, 25 bp, Mus musculus
agtttgaccctgaccgagtcgatat

SEQ ID NO: 538813 - DNA, 25 bp, Mus musculus
agtttgaccctgtccgagtcgatat

SEQ ID NO: 538814 - DNA, 25 bp, Mus musculus
agtttgagaagcagacccgggcgct

SEQ ID NO: 538815 - DNA, 25 bp, Mus musculus
agtttgagaagctgacccgggcgct

SEQ ID NO: 538816 - DNA, 25 bp, Mus musculus
agtttgagaggacccattatccaga

SEQ ID NO: 538817 - DNA, 25 bp, Mus musculus
agtttgagaggagccattatccaga

SEQ ID NO: 538818 - DNA, 25 bp, Mus musculus
agtttgagagtgcaggaactgcaca

SEQ ID NO: 538819 - DNA, 25 bp, Mus musculus
agtttgagagtggaggaactgcaca

SEQ ID NO: 538820 - DNA, 25 bp, Mus musculus
agtttgaggactcctgccgagtgta

SEQ ID NO: 538821 - DNA, 25 bp, Mus musculus
agtttgaggactgctgccgagtgta

SEQ ID NO: 538822 - DNA, 25 bp, Mus musculus
agtttgagtctcatcggatcctccg

SEQ ID NO: 538823 - DNA, 25 bp, Mus musculus
agtttgagtctcttcggatcctccg

SEQ ID NO: 538824 - DNA, 25 bp, Mus musculus
agtttgatagaaacaagacccttgg

SEQ ID NO: 538825 - DNA, 25 bp, Mus musculus
agtttgatagaatcaagacccttgg

SEQ ID NO: 538826 - DNA, 25 bp, Mus musculus
agtttgatccttcttcgaaaatcta

SEQ ID NO: 538827 - DNA, 25 bp, Mus musculus
agtttgatccttgttcgaaaatcta

SEQ ID NO: 538828 - DNA, 25 bp, Mus musculus
agtttgatcgacactcagtgtttcg

SEQ ID NO: 538829 - DNA, 25 bp, Mus musculus
agtttgatcgactctcagtgtttcg

SEQ ID NO: 538830 - DNA, 25 bp, Mus musculus
agtttgatgctgcttgctgttttgc

SEQ ID NO: 538831 - DNA, 25 bp, Mus musculus
agtttgatgctggttgctgttttgc

SEQ ID NO: 538832 - DNA, 25 bp, Mus musculus
agtttgattcccaggcgagaccagc

SEQ ID NO: 538833 - DNA, 25 bp, Mus musculus
agtttgattccctggcgagaccagc

SEQ ID NO: 538834 - DNA, 25 bp, Mus musculus
agtttgcaacaaccaggactgccca

SEQ ID NO: 538835 - DNA, 25 bp, Mus musculus
agtttgcaacaagcaggactgccca

SEQ ID NO: 538836 - DNA, 25 bp, Mus musculus
agtttgcagagacatcagtaaccaa

SEQ ID NO: 538837 - DNA, 25 bp, Mus musculus
agtttgcagagagatcagtaaccaa

SEQ ID NO: 538838 - DNA, 25 bp, Mus musculus
agtttgcatatcactacagccaatg

SEQ ID NO: 538839 - DNA, 25 bp, Mus musculus
agtttgcatatctctacagccaatg

SEQ ID NO: 538840 - DNA, 25 bp, Mus musculus
agtttgccatcaacagcactgagag

SEQ ID NO: 538841 - DNA, 25 bp, Mus musculus
agtttgccatcatcagcactgagag

SEQ ID NO: 538842 - DNA, 25 bp, Mus musculus
agtttgcccaagagcagcatgtgtc

SEQ ID NO: 538843 - DNA, 25 bp, Mus musculus
agtttgcccaagtgcagcatgtgtc

SEQ ID NO: 538844 - DNA, 25 bp, Mus musculus
agtttgcctattcatgaaaaccagc

SEQ ID NO: 538845 - DNA, 25 bp, Mus musculus
agtttgcctattgatgaaaaccagc

SEQ ID NO: 538846 - DNA, 25 bp, Mus musculus
agtttgcctcggctgcggccttcac

SEQ ID NO: 538847 - DNA, 25 bp, Mus musculus
agtttgcctcgggtgcggccttcac

SEQ ID NO: 538848 - DNA, 25 bp, Mus musculus
agtttgcgaacgcagcagctgcagc

SEQ ID NO: 538849 - DNA, 25 bp, Mus musculus
agtttgcgaacggagcagctgcagc

SEQ ID NO: 538850 - DNA, 25 bp, Mus musculus
agtttgctgagaccctccggctgaa

SEQ ID NO: 538851 - DNA, 25 bp, Mus musculus
agtttgctgagagcctccggctgaa

SEQ ID NO: 538852 - DNA, 25 bp, Mus musculus
agtttgctgccccttatgaaggttt

SEQ ID NO: 538853 - DNA, 25 bp, Mus musculus
agtttgctgcccgttatgaaggttt

SEQ ID NO: 538854 - DNA, 25 bp, Mus musculus
agtttgcttttgcaccgcaaagcca

SEQ ID NO: 538855 - DNA, 25 bp, Mus musculus
agtttgcttttggaccgcaaagcca

SEQ ID NO: 538856 - DNA, 25 bp, Mus musculus
agtttggaaactcctctacgtcagt

SEQ ID NO: 538857 - DNA, 25 bp, Mus musculus
agtttggaaactgctctacgtcagt

SEQ ID NO: 538858 - DNA, 25 bp, Mus musculus
agtttggacagcaagactggaagtt

SEQ ID NO: 538859 - DNA, 25 bp, Mus musculus
agtttggacagctagactggaagtt

SEQ ID NO: 538860 - DNA, 25 bp, Mus musculus
agtttggagaatcagagaagtgccc

SEQ ID NO: 538861 - DNA, 25 bp, Mus musculus
agtttggagaatgagagaagtgccc

SEQ ID NO: 538862 - DNA, 25 bp, Mus musculus
agtttggagactataaatgagccta

SEQ ID NO: 538863 - DNA, 25 bp, Mus musculus
agtttggagactttaaatgagccta

SEQ ID NO: 538864 - DNA, 25 bp, Mus musculus
agtttggcaaggagaagcagtttga

SEQ ID NO: 538865 - DNA, 25 bp, Mus musculus
agtttggcaaggtgaagcagtttga

SEQ ID NO: 538866 - DNA, 25 bp, Mus musculus
agtttggccacaacgagttcattgg

SEQ ID NO: 538867 - DNA, 25 bp, Mus musculus
agtttggccacatcgagttcattgg

SEQ ID NO: 538868 - DNA, 25 bp, Mus musculus
agtttgggcagccacagctccacgg

SEQ ID NO: 538869 - DNA, 25 bp, Mus musculus
agtttgggcagcgacagctccacgg

SEQ ID NO: 538870 - DNA, 25 bp, Mus musculus
agtttgtcaataccctgccctggaa

SEQ ID NO: 538871 - DNA, 25 bp, Mus musculus
agtttgtcaatagcctgccctggaa

SEQ ID NO: 538872 - DNA, 25 bp, Mus musculus
agtttgtgacatactaggtgacacc

SEQ ID NO: 538873 - DNA, 25 bp, Mus musculus
agtttgtgacattctaggtgacacc

SEQ ID NO: 538874 - DNA, 25 bp, Mus musculus
agtttgtgatccagagagatgagaa

SEQ ID NO: 538875 - DNA, 25 bp, Mus musculus
agtttgtgatcctgagagatgagaa

SEQ ID NO: 538876 - DNA, 25 bp, Mus musculus
agtttgtgccctacctcatagcagg

SEQ ID NO: 538877 - DNA, 25 bp, Mus musculus
agtttgtgcccttcctcatagcagg

SEQ ID NO: 538878 - DNA, 25 bp, Mus musculus
agtttgtggcgtaggcctgcaatga

SEQ ID NO: 538879 - DNA, 25 bp, Mus musculus
agtttgtggcgttggcctgcaatga

SEQ ID NO: 538880 - DNA, 25 bp, Mus musculus
agtttgtggttcagcatgctcttcc

SEQ ID NO: 538881 - DNA, 25 bp, Mus musculus
agtttgtggttctgcatgctcttcc

SEQ ID NO: 538882 - DNA, 25 bp, Mus musculus
agtttgttcaagattggctcccaag

SEQ ID NO: 538883 - DNA, 25 bp, Mus musculus
agtttgttcaagtttggctcccaag

SEQ ID NO: 538884 - DNA, 25 bp, Mus musculus
agtttgttctcaacatctccagcac

SEQ ID NO: 538885 - DNA, 25 bp, Mus musculus
agtttgttctcatcatctccagcac

SEQ ID NO: 538886 - DNA, 25 bp, Mus musculus
agtttgttgttgcatatgcccttga

SEQ ID NO: 538887 - DNA, 25 bp, Mus musculus
agtttgttgttggatatgcccttga

SEQ ID NO: 538888 - DNA, 25 bp, Mus musculus
agttttacagccacatggtacgtcc

SEQ ID NO: 538889 - DNA, 25 bp, Mus musculus
agttttacagcctcatggtacgtcc

SEQ ID NO: 538890 - DNA, 25 bp, Mus musculus
agttttaccagaagctgtacagttg

SEQ ID NO: 538891 - DNA, 25 bp, Mus musculus
agttttaccagatgctgtacagttg

SEQ ID NO: 538892 - DNA, 25 bp, Mus musculus
agttttagacaacttgaccacaggg

SEQ ID NO: 538893 - DNA, 25 bp, Mus musculus
agttttagacaagttgaccacaggg

SEQ ID NO: 538894 - DNA, 25 bp, Mus musculus
agttttagatggctacttcagccga

SEQ ID NO: 538895 - DNA, 25 bp, Mus musculus
agttttagatgggtacttcagccga

SEQ ID NO: 538896 - DNA, 25 bp, Mus musculus
agttttcagcgcaggtcaaatacaa

SEQ ID NO: 538897 - DNA, 25 bp, Mus musculus
agttttcagcgctggtcaaatacaa

SEQ ID NO: 538898 - DNA, 25 bp, Mus musculus
agttttccgagaatgatgtcgccct

SEQ ID NO: 538899 - DNA, 25 bp, Mus musculus
agttttccgagattgatgtcgccct

SEQ ID NO: 538900 - DNA, 25 bp, Mus musculus
agttttctgactcagcggtgtgtgc

SEQ ID NO: 538901 - DNA, 25 bp, Mus musculus
agttttctgactgagcggtgtgtgc

SEQ ID NO: 538902 - DNA, 25 bp, Mus musculus
agttttctgcagacactctggtgga

SEQ ID NO: 538903 - DNA, 25 bp, Mus musculus
agttttctgcagtcactctggtgga

SEQ ID NO: 538904 - DNA, 25 bp, Mus musculus
agttttcttggcactcctaacccat

SEQ ID NO: 538905 - DNA, 25 bp, Mus musculus
agttttcttggctctcctaacccat

SEQ ID NO: 538906 - DNA, 25 bp, Mus musculus
agttttgattctagcacagacctca

SEQ ID NO: 538907 - DNA, 25 bp, Mus musculus
agttttgattcttgcacagacctca

SEQ ID NO: 538908 - DNA, 25 bp, Mus musculus
agttttggatccattcaagagacaa

SEQ ID NO: 538909 - DNA, 25 bp, Mus musculus
agttttggatcctttcaagagacaa

SEQ ID NO: 538910 - DNA, 25 bp, Mus musculus
agttttgtacaccagccaggcaggg

SEQ ID NO: 538911 - DNA, 25 bp, Mus musculus
agttttgtacacgagccaggcaggg

SEQ ID NO: 538912 - DNA, 25 bp, Mus musculus
agttttgtatggatataatcactgc

SEQ ID NO: 538913 - DNA, 25 bp, Mus musculus
agttttgtatggttataatcactgc

SEQ ID NO: 538914 - DNA, 25 bp, Mus musculus
agttttgtgcagatactgtaccacc

SEQ ID NO: 538915 - DNA, 25 bp, Mus musculus
agttttgtgcagttactgtaccacc

SEQ ID NO: 538916 - DNA, 25 bp, Mus musculus
agtttttacggtcgtgatcgagacg

SEQ ID NO: 538917 - DNA, 25 bp, Mus musculus
agtttttacggtggtgatcgagacg

SEQ ID NO: 538918 - DNA, 25 bp, Mus musculus
agtttttggtcacggctatacagtg

SEQ ID NO: 538919 - DNA, 25 bp, Mus musculus
agtttttggtcagggctatacagtg

SEQ ID NO: 538920 - DNA, 25 bp, Mus musculus
ataaaaggatttcatactcatctgc

SEQ ID NO: 538921 - DNA, 25 bp, Mus musculus
ataaaaggatttgatactcatctgc

SEQ ID NO: 538922 - DNA, 25 bp, Mus musculus
ataaacactgctagaccaccggtgt

SEQ ID NO: 538923 - DNA, 25 bp, Mus musculus
ataaacactgcttgaccaccggtgt

SEQ ID NO: 538924 - DNA, 25 bp, Mus musculus
ataaacagcacactcccatccaggt

SEQ ID NO: 538925 - DNA, 25 bp, Mus musculus
ataaacagcacagtcccatccaggt

SEQ ID NO: 538926 - DNA, 25 bp, Mus musculus
ataaacatgccacccaagtcctgag

SEQ ID NO: 538927 - DNA, 25 bp, Mus musculus
ataaacatgccagccaagtcctgag

SEQ ID NO: 538928 - DNA, 25 bp, Mus musculus
ataaaccaggtgatgcagcgctcca

SEQ ID NO: 538929 - DNA, 25 bp, Mus musculus
ataaaccaggtgttgcagcgctcca

SEQ ID NO: 538930 - DNA, 25 bp, Mus musculus
ataaaccatcctagctacagcctag

SEQ ID NO: 538931 - DNA, 25 bp, Mus musculus
ataaaccatccttgctacagcctag

SEQ ID NO: 538932 - DNA, 25 bp, Mus musculus
ataaacggagcccacaccttggagc

SEQ ID NO: 538933 - DNA, 25 bp, Mus musculus
ataaacggagccgacaccttggagc

SEQ ID NO: 538934 - DNA, 25 bp, Mus musculus
ataaacgggtgaagcgtcggctgct

SEQ ID NO: 538935 - DNA, 25 bp, Mus musculus
ataaacgggtgatgcgtcggctgct

SEQ ID NO: 538936 - DNA, 25 bp, Mus musculus
ataaactcagaccagaaaatgtgcg

SEQ ID NO: 538937 - DNA, 25 bp, Mus musculus
ataaactcagacgagaaaatgtgcg

SEQ ID NO: 538938 - DNA, 25 bp, Mus musculus
ataaagaaatctcttaacaggccat

SEQ ID NO: 538939 - DNA, 25 bp, Mus musculus
ataaagaaatctgttaacaggccat

SEQ ID NO: 538940 - DNA, 25 bp, Mus musculus
ataaagaatctcatggaagacttcc

SEQ ID NO: 538941 - DNA, 25 bp, Mus musculus
ataaagaatctcttggaagacttcc

SEQ ID NO: 538942 - DNA, 25 bp, Mus musculus
ataaagagggatccgaacaagctca

SEQ ID NO: 538943 - DNA, 25 bp, Mus musculus
ataaagagggatgcgaacaagctca

SEQ ID NO: 538944 - DNA, 25 bp, Mus musculus
ataaagatggctcgttacacacggg

SEQ ID NO: 538945 - DNA, 25 bp, Mus musculus
ataaagatggctggttacacacggg

SEQ ID NO: 538946 - DNA, 25 bp, Mus musculus
ataaagcaactgaatgtccagtggc

SEQ ID NO: 538947 - DNA, 25 bp, Mus musculus
ataaagcaactgtatgtccagtggc

SEQ ID NO: 538948 - DNA, 25 bp, Mus musculus
ataaagcaccctctgtacacagcca

SEQ ID NO: 538949 - DNA, 25 bp, Mus musculus
ataaagcaccctgtgtacacagcca

SEQ ID NO: 538950 - DNA, 25 bp, Mus musculus
ataaagcgcacactgggcgaatccc

SEQ ID NO: 538951 - DNA, 25 bp, Mus musculus
ataaagcgcacagtgggcgaatccc

SEQ ID NO: 538952 - DNA, 25 bp, Mus musculus
ataaaggaaatgacccacctggaga

SEQ ID NO: 538953 - DNA, 25 bp, Mus musculus
ataaaggaaatgtcccacctggaga

SEQ ID NO: 538954 - DNA, 25 bp, Mus musculus
ataaaggaggtgaatgtgagcccat

SEQ ID NO: 538955 - DNA, 25 bp, Mus musculus
ataaaggaggtgtatgtgagcccat

SEQ ID NO: 538956 - DNA, 25 bp, Mus musculus
ataaaggccgccctgccacgaagag

SEQ ID NO: 538957 - DNA, 25 bp, Mus musculus
ataaaggccgccgtgccacgaagag

SEQ ID NO: 538958 - DNA, 25 bp, Mus musculus
ataaaggcgactactgcagcgggtc

SEQ ID NO: 538959 - DNA, 25 bp, Mus musculus
ataaaggcgacttctgcagcgggtc

SEQ ID NO: 538960 - DNA, 25 bp, Mus musculus
ataaatagtcgcctttgcaggcggc

SEQ ID NO: 538961 - DNA, 25 bp, Mus musculus
ataaatagtcgcgtttgcaggcggc

SEQ ID NO: 538962 - DNA, 25 bp, Mus musculus
ataaatatctgaagacccacgtggg

SEQ ID NO: 538963 - DNA, 25 bp, Mus musculus
ataaatatctgatgacccacgtggg

SEQ ID NO: 538964 - DNA, 25 bp, Mus musculus
ataaatgaaaagctgccgcagcggg

SEQ ID NO: 538965 - DNA, 25 bp, Mus musculus
ataaatgaaaaggtgccgcagcggg

SEQ ID NO: 538966 - DNA, 25 bp, Mus musculus
ataaatttccatcgtaaaaagctga

SEQ ID NO: 538967 - DNA, 25 bp, Mus musculus
ataaatttccatggtaaaaagctga

SEQ ID NO: 538968 - DNA, 25 bp, Mus musculus
ataacaaatggtatgcaggagcaca

SEQ ID NO: 538969 - DNA, 25 bp, Mus musculus
ataacaaatggtttgcaggagcaca

SEQ ID NO: 538970 - DNA, 25 bp, Mus musculus
ataacaagaaatcccaagcttctgt

SEQ ID NO: 538971 - DNA, 25 bp, Mus musculus
ataacaagaaatgccaagcttctgt

SEQ ID NO: 538972 - DNA, 25 bp, Mus musculus
ataacagctatcatgcagtcacgtc

SEQ ID NO: 538973 - DNA, 25 bp, Mus musculus
ataacagctatcttgcagtcacgtc

SEQ ID NO: 538974 - DNA, 25 bp, Mus musculus
ataaccaaatgtcccgtgatgtatg

SEQ ID NO: 538975 - DNA, 25 bp, Mus musculus
ataaccaaatgtgccgtgatgtatg

SEQ ID NO: 538976 - DNA, 25 bp, Mus musculus
ataaccacacagcaaacgcctaggg

SEQ ID NO: 538977 - DNA, 25 bp, Mus musculus
ataaccacacaggaaacgcctaggg

SEQ ID NO: 538978 - DNA, 25 bp, Mus musculus
ataaccacgaaaagactaatcagga

SEQ ID NO: 538979 - DNA, 25 bp, Mus musculus
ataaccacgaaatgactaatcagga

SEQ ID NO: 538980 - DNA, 25 bp, Mus musculus
ataacccatacaataatctgtgaag

SEQ ID NO: 538981 - DNA, 25 bp, Mus musculus
ataacccatacattaatctgtgaag

SEQ ID NO: 538982 - DNA, 25 bp, Mus musculus
ataaccccagcaagggactggccct

SEQ ID NO: 538983 - DNA, 25 bp, Mus musculus
ataaccccagcatgggactggccct

SEQ ID NO: 538984 - DNA, 25 bp, Mus musculus
ataacccctatcagcggcccgtgaa

SEQ ID NO: 538985 - DNA, 25 bp, Mus musculus
ataacccctatctgcggcccgtgaa

SEQ ID NO: 538986 - DNA, 25 bp, Mus musculus
ataaccccttccaggattgtggcca

SEQ ID NO: 538987 - DNA, 25 bp, Mus musculus
ataaccccttcctggattgtggcca

SEQ ID NO: 538988 - DNA, 25 bp, Mus musculus
ataaccggagcgctccccatggact

SEQ ID NO: 538989 - DNA, 25 bp, Mus musculus
ataaccggagcggtccccatggact

SEQ ID NO: 538990 - DNA, 25 bp, Mus musculus
ataaccgtccgccacgccgagtggg

SEQ ID NO: 538991 - DNA, 25 bp, Mus musculus
ataaccgtccgcgacgccgagtggg

SEQ ID NO: 538992 - DNA, 25 bp, Mus musculus
ataacctaagcaagaggaagtgtcc

SEQ ID NO: 538993 - DNA, 25 bp, Mus musculus
ataacctaagcatgaggaagtgtcc

SEQ ID NO: 538994 - DNA, 25 bp, Mus musculus
ataacctgggctctctgacacacag

SEQ ID NO: 538995 - DNA, 25 bp, Mus musculus
ataacctgggctgtctgacacacag

SEQ ID NO: 538996 - DNA, 25 bp, Mus musculus
ataacgaaggccacctccagaggag

SEQ ID NO: 538997 - DNA, 25 bp, Mus musculus
ataacgaaggcctcctccagaggag

SEQ ID NO: 538998 - DNA, 25 bp, Mus musculus
ataacgggaagcagcgagagtttga

SEQ ID NO: 538999 - DNA, 25 bp, Mus musculus
ataacgggaagctgcgagagtttga

SEQ ID NO: 539000 - DNA, 25 bp, Mus musculus
ataactaagaatactaggacatggt

SEQ ID NO: 539001 - DNA, 25 bp, Mus musculus
ataactaagaattctaggacatggt

SEQ ID NO: 539002 - DNA, 25 bp, Mus musculus
ataactcgtcctcccattaatgtaa

SEQ ID NO: 539003 - DNA, 25 bp, Mus musculus
ataactcgtcctgccattaatgtaa

SEQ ID NO: 539004 - DNA, 25 bp, Mus musculus
ataactctcttcactattcctagga

SEQ ID NO: 539005 - DNA, 25 bp, Mus musculus
ataactctcttctctattcctagga

SEQ ID NO: 539006 - DNA, 25 bp, Mus musculus
ataacttccaggaattgaaagggtg

SEQ ID NO: 539007 - DNA, 25 bp, Mus musculus
ataacttccaggtattgaaagggtg

SEQ ID NO: 539008 - DNA, 25 bp, Mus musculus
ataactttctcacagacgccaagcg

SEQ ID NO: 539009 - DNA, 25 bp, Mus musculus
ataactttctcagagacgccaagcg

SEQ ID NO: 539010 - DNA, 25 bp, Mus musculus
ataagaaacgcacagttgtagacac

SEQ ID NO: 539011 - DNA, 25 bp, Mus musculus
ataagaaacgcagagttgtagacac

SEQ ID NO: 539012 - DNA, 25 bp, Mus musculus
ataagaacaagaagctccggcccct

SEQ ID NO: 539013 - DNA, 25 bp, Mus musculus
ataagaacaagatgctccggcccct

SEQ ID NO: 539014 - DNA, 25 bp, Mus musculus
ataagaacattaacaacctcctggg

SEQ ID NO: 539015 - DNA, 25 bp, Mus musculus
ataagaacattatcaacctcctggg

SEQ ID NO: 539016 - DNA, 25 bp, Mus musculus
ataagaacttggagcctaagcctgc

SEQ ID NO: 539017 - DNA, 25 bp, Mus musculus
ataagaacttggtgcctaagcctgc

SEQ ID NO: 539018 - DNA, 25 bp, Mus musculus
ataagaatgagaacgcctccgtcgc

SEQ ID NO: 539019 - DNA, 25 bp, Mus musculus
ataagaatgagatcgcctccgtcgc

SEQ ID NO: 539020 - DNA, 25 bp, Mus musculus
ataagaccatcacgtgggctactgg

SEQ ID NO: 539021 - DNA, 25 bp, Mus musculus
ataagaccatcaggtgggctactgg

SEQ ID NO: 539022 - DNA, 25 bp, Mus musculus
ataagagagctacacaatcttcaga

SEQ ID NO: 539023 - DNA, 25 bp, Mus musculus
ataagagagctagacaatcttcaga

SEQ ID NO: 539024 - DNA, 25 bp, Mus musculus
ataagaggagctccttggccccacc

SEQ ID NO: 539025 - DNA, 25 bp, Mus musculus
ataagaggagctgcttggccccacc

SEQ ID NO: 539026 - DNA, 25 bp, Mus musculus
ataagaggataacgcttgagatcag

SEQ ID NO: 539027 - DNA, 25 bp, Mus musculus
ataagaggataaggcttgagatcag

SEQ ID NO: 539028 - DNA, 25 bp, Mus musculus
ataagagttctacggctgtggttgc

SEQ ID NO: 539029 - DNA, 25 bp, Mus musculus
ataagagttctagggctgtggttgc

SEQ ID NO: 539030 - DNA, 25 bp, Mus musculus
ataagatcacgcaggtgtctagtgg

SEQ ID NO: 539031 - DNA, 25 bp, Mus musculus
ataagatcacgctggtgtctagtgg

SEQ ID NO: 539032 - DNA, 25 bp, Mus musculus
ataagcagtcccagcgttcagagcc

SEQ ID NO: 539033 - DNA, 25 bp, Mus musculus
ataagcagtccctgcgttcagagcc

SEQ ID NO: 539034 - DNA, 25 bp, Mus musculus
ataagccagagcatcgttcttccag

SEQ ID NO: 539035 - DNA, 25 bp, Mus musculus
ataagccagagcttcgttcttccag

SEQ ID NO: 539036 - DNA, 25 bp, Mus musculus
ataagccgtgtgaccccgtcgtgac

SEQ ID NO: 539037 - DNA, 25 bp, Mus musculus
ataagccgtgtgtccccgtcgtgac

SEQ ID NO: 539038 - DNA, 25 bp, Mus musculus
ataagctaaggaacctcccctgctc

SEQ ID NO: 539039 - DNA, 25 bp, Mus musculus
ataagctaaggatcctcccctgctc

SEQ ID NO: 539040 - DNA, 25 bp, Mus musculus
ataagctcagccatgggtacccaga

SEQ ID NO: 539041 - DNA, 25 bp, Mus musculus
ataagctcagccttgggtacccaga

SEQ ID NO: 539042 - DNA, 25 bp, Mus musculus
ataagctggaggacttcatcaacaa

SEQ ID NO: 539043 - DNA, 25 bp, Mus musculus
ataagctggaggtcttcatcaacaa

SEQ ID NO: 539044 - DNA, 25 bp, Mus musculus
ataagctggatactccgggcagacg

SEQ ID NO: 539045 - DNA, 25 bp, Mus musculus
ataagctggatagtccgggcagacg

SEQ ID NO: 539046 - DNA, 25 bp, Mus musculus
ataaggacagcaagacccgcaaact

SEQ ID NO: 539047 - DNA, 25 bp, Mus musculus
ataaggacagcatgacccgcaaact

SEQ ID NO: 539048 - DNA, 25 bp, Mus musculus
ataaggacggccaggttcgcatggt

SEQ ID NO: 539049 - DNA, 25 bp, Mus musculus
ataaggacggcctggttcgcatggt

SEQ ID NO: 539050 - DNA, 25 bp, Mus musculus
ataaggagccgcatccgcccaagtg

SEQ ID NO: 539051 - DNA, 25 bp, Mus musculus
ataaggagccgcttccgcccaagtg

SEQ ID NO: 539052 - DNA, 25 bp, Mus musculus
ataaggcgcttcaggactatcgcaa

SEQ ID NO: 539053 - DNA, 25 bp, Mus musculus
ataaggcgcttctggactatcgcaa

SEQ ID NO: 539054 - DNA, 25 bp, Mus musculus
ataaggtatactcgcagcggcagga

SEQ ID NO: 539055 - DNA, 25 bp, Mus musculus
ataaggtatactggcagcggcagga

SEQ ID NO: 539056 - DNA, 25 bp, Mus musculus
ataagtagccctcccactcgaagtc

SEQ ID NO: 539057 - DNA, 25 bp, Mus musculus
ataagtagccctgccactcgaagtc

SEQ ID NO: 539058 - DNA, 25 bp, Mus musculus
ataagtcattgtcatgccaagcata

SEQ ID NO: 539059 - DNA, 25 bp, Mus musculus
ataagtcattgtgatgccaagcata

SEQ ID NO: 539060 - DNA, 25 bp, Mus musculus
ataagtgggagtatacagccagagg

SEQ ID NO: 539061 - DNA, 25 bp, Mus musculus
ataagtgggagtttacagccagagg

SEQ ID NO: 539062 - DNA, 25 bp, Mus musculus
ataataatttcaaagatgttcacag

SEQ ID NO: 539063 - DNA, 25 bp, Mus musculus
ataataatttcatagatgttcacag

SEQ ID NO: 539064 - DNA, 25 bp, Mus musculus
ataatcaacagcaggcccctccgaa

SEQ ID NO: 539065 - DNA, 25 bp, Mus musculus
ataatcaacagctggcccctccgaa

SEQ ID NO: 539066 - DNA, 25 bp, Mus musculus
ataatcaagccaagccttgagagca

SEQ ID NO: 539067 - DNA, 25 bp, Mus musculus
ataatcaagccatgccttgagagca

SEQ ID NO: 539068 - DNA, 25 bp, Mus musculus
ataatcaccgcactggagcacctgg

SEQ ID NO: 539069 - DNA, 25 bp, Mus musculus
ataatcaccgcagtggagcacctgg

SEQ ID NO: 539070 - DNA, 25 bp, Mus musculus
ataatcagccttaatatgccctacc

SEQ ID NO: 539071 - DNA, 25 bp, Mus musculus
ataatcagcctttatatgccctacc

SEQ ID NO: 539072 - DNA, 25 bp, Mus musculus
ataatcaggccgcacctgaagggag

SEQ ID NO: 539073 - DNA, 25 bp, Mus musculus
ataatcaggccggacctgaagggag

SEQ ID NO: 539074 - DNA, 25 bp, Mus musculus
ataatccacaggattgtagaaactg

SEQ ID NO: 539075 - DNA, 25 bp, Mus musculus
ataatccacaggtttgtagaaactg

SEQ ID NO: 539076 - DNA, 25 bp, Mus musculus
ataatcctcaggactgcccctacaa

SEQ ID NO: 539077 - DNA, 25 bp, Mus musculus
ataatcctcaggtctgcccctacaa

SEQ ID NO: 539078 - DNA, 25 bp, Mus musculus
ataatcctcttcatgagccaggccc

SEQ ID NO: 539079 - DNA, 25 bp, Mus musculus
ataatcctcttcttgagccaggccc

SEQ ID NO: 539080 - DNA, 25 bp, Mus musculus
ataatcgttatgaaccttcaggtgt

SEQ ID NO: 539081 - DNA, 25 bp, Mus musculus
ataatcgttatgtaccttcaggtgt

SEQ ID NO: 539082 - DNA, 25 bp, Mus musculus
ataatgacagcgagacccaaagccg

SEQ ID NO: 539083 - DNA, 25 bp, Mus musculus
ataatgacagcgtgacccaaagccg

SEQ ID NO: 539084 - DNA, 25 bp, Mus musculus
ataatgagaaggagaggctctcagg

SEQ ID NO: 539085 - DNA, 25 bp, Mus musculus
ataatgagaaggtgaggctctcagg

SEQ ID NO: 539086 - DNA, 25 bp, Mus musculus
ataatgagcttaatggtggacggca

SEQ ID NO: 539087 - DNA, 25 bp, Mus musculus
ataatgagcttattggtggacggca

SEQ ID NO: 539088 - DNA, 25 bp, Mus musculus
ataatgcagatacgatgtttaacag

SEQ ID NO: 539089 - DNA, 25 bp, Mus musculus
ataatgcagataggatgtttaacag

SEQ ID NO: 539090 - DNA, 25 bp, Mus musculus
ataatgctgacacccggctcacgtt

SEQ ID NO: 539091 - DNA, 25 bp, Mus musculus
ataatgctgacagccggctcacgtt

SEQ ID NO: 539092 - DNA, 25 bp, Mus musculus
ataatgcttacacttgtgacccaag

SEQ ID NO: 539093 - DNA, 25 bp, Mus musculus
ataatgcttacagttgtgacccaag

SEQ ID NO: 539094 - DNA, 25 bp, Mus musculus
ataatggtgcaacaagaaaactggc

SEQ ID NO: 539095 - DNA, 25 bp, Mus musculus
ataatggtgcaagaagaaaactggc

SEQ ID NO: 539096 - DNA, 25 bp, Mus musculus
ataatgtcaggtactccgcgtatag

SEQ ID NO: 539097 - DNA, 25 bp, Mus musculus
ataatgtcaggttctccgcgtatag

SEQ ID NO: 539098 - DNA, 25 bp, Mus musculus
ataattaaacgaagccccaacctca

SEQ ID NO: 539099 - DNA, 25 bp, Mus musculus
ataattaaacgatgccccaacctca

SEQ ID NO: 539100 - DNA, 25 bp, Mus musculus
ataattgctgacatgctcttcaacc

SEQ ID NO: 539101 - DNA, 25 bp, Mus musculus
ataattgctgacttgctcttcaacc

SEQ ID NO: 539102 - DNA, 25 bp, Mus musculus
ataattgggattaaactccagtgaa

SEQ ID NO: 539103 - DNA, 25 bp, Mus musculus
ataattgggatttaactccagtgaa

SEQ ID NO: 539104 - DNA, 25 bp, Mus musculus
ataattgtccgacggcagccccggg

SEQ ID NO: 539105 - DNA, 25 bp, Mus musculus
ataattgtccgagggcagccccggg

SEQ ID NO: 539106 - DNA, 25 bp, Mus musculus
ataattgtgccccatcgtgcccggg

SEQ ID NO: 539107 - DNA, 25 bp, Mus musculus
ataattgtgcccgatcgtgcccggg

SEQ ID NO: 539108 - DNA, 25 bp, Mus musculus
atacaaaactgtatccgaaatgcag

SEQ ID NO: 539109 - DNA, 25 bp, Mus musculus
atacaaaactgtttccgaaatgcag

SEQ ID NO: 539110 - DNA, 25 bp, Mus musculus
atacaaagcggaagaggaccctcgg

SEQ ID NO: 539111 - DNA, 25 bp, Mus musculus
atacaaagcggatgaggaccctcgg

SEQ ID NO: 539112 - DNA, 25 bp, Mus musculus
atacaacgcctaaccctcagagcaa

SEQ ID NO: 539113 - DNA, 25 bp, Mus musculus
atacaacgcctatccctcagagcaa

SEQ ID NO: 539114 - DNA, 25 bp, Mus musculus
atacaacgtgccctgactgccctag

SEQ ID NO: 539115 - DNA, 25 bp, Mus musculus
atacaacgtgccgtgactgccctag

SEQ ID NO: 539116 - DNA, 25 bp, Mus musculus
atacaagaagagatttaactcagag

SEQ ID NO: 539117 - DNA, 25 bp, Mus musculus
atacaagaagagttttaactcagag

SEQ ID NO: 539118 - DNA, 25 bp, Mus musculus
atacaagcgatgaagatcttgagac

SEQ ID NO: 539119 - DNA, 25 bp, Mus musculus
atacaagcgatgtagatcttgagac

SEQ ID NO: 539120 - DNA, 25 bp, Mus musculus
atacaaggaggtctgtacggctcag

SEQ ID NO: 539121 - DNA, 25 bp, Mus musculus
atacaaggaggtgtgtacggctcag

SEQ ID NO: 539122 - DNA, 25 bp, Mus musculus
atacacagctgcaattttgaccatg

SEQ ID NO: 539123 - DNA, 25 bp, Mus musculus
atacacagctgctattttgaccatg

SEQ ID NO: 539124 - DNA, 25 bp, Mus musculus
atacaccagaaaacgctgtcctgtg

SEQ ID NO: 539125 - DNA, 25 bp, Mus musculus
atacaccagaaatcgctgtcctgtg

SEQ ID NO: 539126 - DNA, 25 bp, Mus musculus
atacaccgatgtcgaaagcttcgat

SEQ ID NO: 539127 - DNA, 25 bp, Mus musculus
atacaccgatgtggaaagcttcgat

SEQ ID NO: 539128 - DNA, 25 bp, Mus musculus
atacagaccaggactgctagcccca

SEQ ID NO: 539129 - DNA, 25 bp, Mus musculus
atacagaccaggtctgctagcccca

SEQ ID NO: 539130 - DNA, 25 bp, Mus musculus
atacagagatggacgagtggcacag

SEQ ID NO: 539131 - DNA, 25 bp, Mus musculus
atacagagatggtcgagtggcacag

SEQ ID NO: 539132 - DNA, 25 bp, Mus musculus
atacagaggacaaggtgcggcttcg

SEQ ID NO: 539133 - DNA, 25 bp, Mus musculus
atacagaggacatggtgcggcttcg

SEQ ID NO: 539134 - DNA, 25 bp, Mus musculus
atacagaggcccacagctgcagtcc

SEQ ID NO: 539135 - DNA, 25 bp, Mus musculus
atacagaggccctcagctgcagtcc

SEQ ID NO: 539136 - DNA, 25 bp, Mus musculus
atacagcaaataccgggagcctgaa

SEQ ID NO: 539137 - DNA, 25 bp, Mus musculus
atacagcaaatagcgggagcctgaa

SEQ ID NO: 539138 - DNA, 25 bp, Mus musculus
atacagcctctgcctgcgtttgcgc

SEQ ID NO: 539139 - DNA, 25 bp, Mus musculus
atacagcctctggctgcgtttgcgc

SEQ ID NO: 539140 - DNA, 25 bp, Mus musculus
atacagcgactacgcccaaagccag

SEQ ID NO: 539141 - DNA, 25 bp, Mus musculus
atacagcgactaggcccaaagccag

SEQ ID NO: 539142 - DNA, 25 bp, Mus musculus
atacagctgtgacagtcggatccgg

SEQ ID NO: 539143 - DNA, 25 bp, Mus musculus
atacagctgtgagagtcggatccgg

SEQ ID NO: 539144 - DNA, 25 bp, Mus musculus
atacaggcatctcagcgcagggaca

SEQ ID NO: 539145 - DNA, 25 bp, Mus musculus
atacaggcatctgagcgcagggaca

SEQ ID NO: 539146 - DNA, 25 bp, Mus musculus
atacaggcatggacagcggaggctc

SEQ ID NO: 539147 - DNA, 25 bp, Mus musculus
atacaggcatggtcagcggaggctc

SEQ ID NO: 539148 - DNA, 25 bp, Mus musculus
atacagggattgcacccataatctg

SEQ ID NO: 539149 - DNA, 25 bp, Mus musculus
atacagggattggacccataatctg

SEQ ID NO: 539150 - DNA, 25 bp, Mus musculus
atacagggtgagctacagaatttct

SEQ ID NO: 539151 - DNA, 25 bp, Mus musculus
atacagggtgaggtacagaatttct

SEQ ID NO: 539152 - DNA, 25 bp, Mus musculus
atacaggtgccacgaaggtgctgcc

SEQ ID NO: 539153 - DNA, 25 bp, Mus musculus
atacaggtgccaggaaggtgctgcc

SEQ ID NO: 539154 - DNA, 25 bp, Mus musculus
atacatagcaagacatgccctgccc

SEQ ID NO: 539155 - DNA, 25 bp, Mus musculus
atacatagcaagtcatgccctgccc

SEQ ID NO: 539156 - DNA, 25 bp, Mus musculus
atacatgctgctcagtgtttaaaac

SEQ ID NO: 539157 - DNA, 25 bp, Mus musculus
atacatgctgctgagtgtttaaaac

SEQ ID NO: 539158 - DNA, 25 bp, Mus musculus
atacatggcagaaatggatgagctc

SEQ ID NO: 539159 - DNA, 25 bp, Mus musculus
atacatggcagatatggatgagctc

SEQ ID NO: 539160 - DNA, 25 bp, Mus musculus
atacatgttccgctgtacagtacag

SEQ ID NO: 539161 - DNA, 25 bp, Mus musculus
atacatgttccggtgtacagtacag

SEQ ID NO: 539162 - DNA, 25 bp, Mus musculus
atacattcggctcacataattcaca

SEQ ID NO: 539163 - DNA, 25 bp, Mus musculus
atacattcggctgacataattcaca

SEQ ID NO: 539164 - DNA, 25 bp, Mus musculus
ataccaaagctgagctgaccccact

SEQ ID NO: 539165 - DNA, 25 bp, Mus musculus
ataccaaagctgtgctgaccccact

SEQ ID NO: 539166 - DNA, 25 bp, Mus musculus
ataccaaccctgaccaggactgctg

SEQ ID NO: 539167 - DNA, 25 bp, Mus musculus
ataccaaccctgtccaggactgctg

SEQ ID NO: 539168 - DNA, 25 bp, Mus musculus
ataccaagttctcggcccggccaag

SEQ ID NO: 539169 - DNA, 25 bp, Mus musculus
ataccaagttctgggcccggccaag

SEQ ID NO: 539170 - DNA, 25 bp, Mus musculus
ataccaccagtcaggccacgagggt

SEQ ID NO: 539171 - DNA, 25 bp, Mus musculus
ataccaccagtctggccacgagggt

SEQ ID NO: 539172 - DNA, 25 bp, Mus musculus
ataccagacggtccagaggctcatc

SEQ ID NO: 539173 - DNA, 25 bp, Mus musculus
ataccagacggtgcagaggctcatc

SEQ ID NO: 539174 - DNA, 25 bp, Mus musculus
ataccagatgatcaagttcaacaag

SEQ ID NO: 539175 - DNA, 25 bp, Mus musculus
ataccagatgatgaagttcaacaag

SEQ ID NO: 539176 - DNA, 25 bp, Mus musculus
ataccagatttacaggcgccccact

SEQ ID NO: 539177 - DNA, 25 bp, Mus musculus
ataccagatttagaggcgccccact

SEQ ID NO: 539178 - DNA, 25 bp, Mus musculus
ataccagcagtcagaggcctacaag

SEQ ID NO: 539179 - DNA, 25 bp, Mus musculus
ataccagcagtctgaggcctacaag

SEQ ID NO: 539180 - DNA, 25 bp, Mus musculus
ataccatggaagaccagctctggcc

SEQ ID NO: 539181 - DNA, 25 bp, Mus musculus
ataccatggaagtccagctctggcc

SEQ ID NO: 539182 - DNA, 25 bp, Mus musculus
ataccatggccgagcttcctccatt

SEQ ID NO: 539183 - DNA, 25 bp, Mus musculus
ataccatggccgtgcttcctccatt

SEQ ID NO: 539184 - DNA, 25 bp, Mus musculus
atacccaactctccaagaatggtgg

SEQ ID NO: 539185 - DNA, 25 bp, Mus musculus
atacccaactctgcaagaatggtgg

SEQ ID NO: 539186 - DNA, 25 bp, Mus musculus
atacccaataccaatgacgcccatg

SEQ ID NO: 539187 - DNA, 25 bp, Mus musculus
atacccaatacctatgacgcccatg

SEQ ID NO: 539188 - DNA, 25 bp, Mus musculus
atacccaatgccctgccagcaagtg

SEQ ID NO: 539189 - DNA, 25 bp, Mus musculus
atacccaatgccgtgccagcaagtg

SEQ ID NO: 539190 - DNA, 25 bp, Mus musculus
atacccacagccctgcagttaaacg

SEQ ID NO: 539191 - DNA, 25 bp, Mus musculus
atacccacagccgtgcagttaaacg

SEQ ID NO: 539192 - DNA, 25 bp, Mus musculus
atacccatgacccactgctgaagga

SEQ ID NO: 539193 - DNA, 25 bp, Mus musculus
atacccatgaccgactgctgaagga

SEQ ID NO: 539194 - DNA, 25 bp, Mus musculus
ataccccggtgtccctgtggaggaa

SEQ ID NO: 539195 - DNA, 25 bp, Mus musculus
ataccccggtgtgcctgtggaggaa

SEQ ID NO: 539196 - DNA, 25 bp, Mus musculus
ataccctggcataccggtggaggag

SEQ ID NO: 539197 - DNA, 25 bp, Mus musculus
ataccctggcattccggtggaggag

SEQ ID NO: 539198 - DNA, 25 bp, Mus musculus
ataccgctattgagcatccagtccc

SEQ ID NO: 539199 - DNA, 25 bp, Mus musculus
ataccgctattgtgcatccagtccc

SEQ ID NO: 539200 - DNA, 25 bp, Mus musculus
ataccggccacgctacatcgtggtg

SEQ ID NO: 539201 - DNA, 25 bp, Mus musculus
ataccggccacggtacatcgtggtg

SEQ ID NO: 539202 - DNA, 25 bp, Mus musculus
ataccgtcctttccacaagctgctg

SEQ ID NO: 539203 - DNA, 25 bp, Mus musculus
ataccgtcctttgcacaagctgctg

SEQ ID NO: 539204 - DNA, 25 bp, Mus musculus
ataccgtgcaggcaggcagcctgat

SEQ ID NO: 539205 - DNA, 25 bp, Mus musculus
ataccgtgcagggaggcagcctgat

SEQ ID NO: 539206 - DNA, 25 bp, Mus musculus
atacctatgcccatgtgcgcgtgcg

SEQ ID NO: 539207 - DNA, 25 bp, Mus musculus
atacctatgcccttgtgcgcgtgcg

SEQ ID NO: 539208 - DNA, 25 bp, Mus musculus
atacctcagaggctggcaccatgcc

SEQ ID NO: 539209 - DNA, 25 bp, Mus musculus
atacctcagagggtggcaccatgcc

SEQ ID NO: 539210 - DNA, 25 bp, Mus musculus
atacctcaggaaacgggacaatgcc

SEQ ID NO: 539211 - DNA, 25 bp, Mus musculus
atacctcaggaatcgggacaatgcc

SEQ ID NO: 539212 - DNA, 25 bp, Mus musculus
atacctccccacagtctaagcgtgt

SEQ ID NO: 539213 - DNA, 25 bp, Mus musculus
atacctccccactgtctaagcgtgt

SEQ ID NO: 539214 - DNA, 25 bp, Mus musculus
atacctcgatatccccaagatgttg

SEQ ID NO: 539215 - DNA, 25 bp, Mus musculus
atacctcgatatgcccaagatgttg

SEQ ID NO: 539216 - DNA, 25 bp, Mus musculus
atacctcgcccacaaggatgtggaa

SEQ ID NO: 539217 - DNA, 25 bp, Mus musculus
atacctcgcccagaaggatgtggaa

SEQ ID NO: 539218 - DNA, 25 bp, Mus musculus
atacctgcggcgactcactctacaa

SEQ ID NO: 539219 - DNA, 25 bp, Mus musculus
atacctgcggcgtctcactctacaa

SEQ ID NO: 539220 - DNA, 25 bp, Mus musculus
atacctgcttccagatacccacaaa

SEQ ID NO: 539221 - DNA, 25 bp, Mus musculus
atacctgcttcctgatacccacaaa

SEQ ID NO: 539222 - DNA, 25 bp, Mus musculus
atacctgtatggcatccgagtggag

SEQ ID NO: 539223 - DNA, 25 bp, Mus musculus
atacctgtatgggatccgagtggag

SEQ ID NO: 539224 - DNA, 25 bp, Mus musculus
atacctgtgaacagtccctaccgcg

SEQ ID NO: 539225 - DNA, 25 bp, Mus musculus
atacctgtgaactgtccctaccgcg

SEQ ID NO: 539226 - DNA, 25 bp, Mus musculus
ataccttctttaagtgcacagtgga

SEQ ID NO: 539227 - DNA, 25 bp, Mus musculus
ataccttctttatgtgcacagtgga

SEQ ID NO: 539228 - DNA, 25 bp, Mus musculus
atacggagacggcactccgcgtcgt

SEQ ID NO: 539229 - DNA, 25 bp, Mus musculus
atacggagacgggactccgcgtcgt

SEQ ID NO: 539230 - DNA, 25 bp, Mus musculus
atacggcgatggagctgctaatcag

SEQ ID NO: 539231 - DNA, 25 bp, Mus musculus
atacggcgatggtgctgctaatcag

SEQ ID NO: 539232 - DNA, 25 bp, Mus musculus
atacggcggagtctgcaggccacat

SEQ ID NO: 539233 - DNA, 25 bp, Mus musculus
atacggcggagtgtgcaggccacat

SEQ ID NO: 539234 - DNA, 25 bp, Mus musculus
atacgggaaacacgccagggtccag

SEQ ID NO: 539235 - DNA, 25 bp, Mus musculus
atacgggaaacaggccagggtccag

SEQ ID NO: 539236 - DNA, 25 bp, Mus musculus
atacgggcagcgaggcctcaccaat

SEQ ID NO: 539237 - DNA, 25 bp, Mus musculus
atacgggcagcgtggcctcaccaat

SEQ ID NO: 539238 - DNA, 25 bp, Mus musculus
atacgtacttcaccggtcctgcctt

SEQ ID NO: 539239 - DNA, 25 bp, Mus musculus
atacgtacttcagcggtcctgcctt

SEQ ID NO: 539240 - DNA, 25 bp, Mus musculus
atacgttcctccaccgctcaaagaa

SEQ ID NO: 539241 - DNA, 25 bp, Mus musculus
atacgttcctcctccgctcaaagaa

SEQ ID NO: 539242 - DNA, 25 bp, Mus musculus
atacgttgtaggatgtcgtcgtcag

SEQ ID NO: 539243 - DNA, 25 bp, Mus musculus
atacgttgtaggttgtcgtcgtcag

SEQ ID NO: 539244 - DNA, 25 bp, Mus musculus
atactacaaggaacccacgacctgg

SEQ ID NO: 539245 - DNA, 25 bp, Mus musculus
atactacaaggatcccacgacctgg

SEQ ID NO: 539246 - DNA, 25 bp, Mus musculus
atactaccgaagacgtgggaggagc

SEQ ID NO: 539247 - DNA, 25 bp, Mus musculus
atactaccgaagtcgtgggaggagc

SEQ ID NO: 539248 - DNA, 25 bp, Mus musculus
atactacgagcccatgcacgacgtc

SEQ ID NO: 539249 - DNA, 25 bp, Mus musculus
atactacgagccgatgcacgacgtc

SEQ ID NO: 539250 - DNA, 25 bp, Mus musculus
atactatcctccaagccaaattgct

SEQ ID NO: 539251 - DNA, 25 bp, Mus musculus
atactatcctcctagccaaattgct

SEQ ID NO: 539252 - DNA, 25 bp, Mus musculus
atactcaggcccacgaacacctgat

SEQ ID NO: 539253 - DNA, 25 bp, Mus musculus
atactcaggccctcgaacacctgat

SEQ ID NO: 539254 - DNA, 25 bp, Mus musculus
atactcatccctccggagcaggcag

SEQ ID NO: 539255 - DNA, 25 bp, Mus musculus
atactcatccctgcggagcaggcag

SEQ ID NO: 539256 - DNA, 25 bp, Mus musculus
atactcatcgccacaagaagccgga

SEQ ID NO: 539257 - DNA, 25 bp, Mus musculus
atactcatcgcctcaagaagccgga

SEQ ID NO: 539258 - DNA, 25 bp, Mus musculus
atactcccagacctggcagagcagt

SEQ ID NO: 539259 - DNA, 25 bp, Mus musculus
atactcccagacgtggcagagcagt

SEQ ID NO: 539260 - DNA, 25 bp, Mus musculus
atactcgagggtacttcccaggccg

SEQ ID NO: 539261 - DNA, 25 bp, Mus musculus
atactcgagggttcttcccaggccg

SEQ ID NO: 539262 - DNA, 25 bp, Mus musculus
atactctcatgacctctctgacagt

SEQ ID NO: 539263 - DNA, 25 bp, Mus musculus
atactctcatgagctctctgacagt

SEQ ID NO: 539264 - DNA, 25 bp, Mus musculus
atactctgtgacaaatttagtggcc

SEQ ID NO: 539265 - DNA, 25 bp, Mus musculus
atactctgtgactaatttagtggcc

SEQ ID NO: 539266 - DNA, 25 bp, Mus musculus
atactgcaggaaaatgtcaatctgg

SEQ ID NO: 539267 - DNA, 25 bp, Mus musculus
atactgcaggaatatgtcaatctgg

SEQ ID NO: 539268 - DNA, 25 bp, Mus musculus
atactgccgtggacctagctgggtg

SEQ ID NO: 539269 - DNA, 25 bp, Mus musculus
atactgccgtggtcctagctgggtg

SEQ ID NO: 539270 - DNA, 25 bp, Mus musculus
atactgctgtcaatgggagggctgc

SEQ ID NO: 539271 - DNA, 25 bp, Mus musculus
atactgctgtcattgggagggctgc

SEQ ID NO: 539272 - DNA, 25 bp, Mus musculus
atactggagactcattggagagctg

SEQ ID NO: 539273 - DNA, 25 bp, Mus musculus
atactggagactgattggagagctg

SEQ ID NO: 539274 - DNA, 25 bp, Mus musculus
atactggccgagacaacactgacct

SEQ ID NO: 539275 - DNA, 25 bp, Mus musculus
atactggccgagtcaacactgacct

SEQ ID NO: 539276 - DNA, 25 bp, Mus musculus
atactgtaaagtccgcgtgcacgca

SEQ ID NO: 539277 - DNA, 25 bp, Mus musculus
atactgtaaagtgcgcgtgcacgca

SEQ ID NO: 539278 - DNA, 25 bp, Mus musculus
atacttacatgaaggtgaatgtgcc

SEQ ID NO: 539279 - DNA, 25 bp, Mus musculus
atacttacatgatggtgaatgtgcc

SEQ ID NO: 539280 - DNA, 25 bp, Mus musculus
atacttcatcttcagaagagtgcta

SEQ ID NO: 539281 - DNA, 25 bp, Mus musculus
atacttcatcttgagaagagtgcta

SEQ ID NO: 539282 - DNA, 25 bp, Mus musculus
atacttcctgccagtgattgggttg

SEQ ID NO: 539283 - DNA, 25 bp, Mus musculus
atacttcctgcctgtgattgggttg

SEQ ID NO: 539284 - DNA, 25 bp, Mus musculus
atacttctataactatttcaagacc

SEQ ID NO: 539285 - DNA, 25 bp, Mus musculus
atacttctataagtatttcaagacc

SEQ ID NO: 539286 - DNA, 25 bp, Mus musculus
atacttggtcgtcaagatggagtcc

SEQ ID NO: 539287 - DNA, 25 bp, Mus musculus
atacttggtcgtgaagatggagtcc

SEQ ID NO: 539288 - DNA, 25 bp, Mus musculus
atagaaagtcttcgagccactaact

SEQ ID NO: 539289 - DNA, 25 bp, Mus musculus
atagaaagtcttggagccactaact

SEQ ID NO: 539290 - DNA, 25 bp, Mus musculus
atagaaatggctcaaggaaagcccc

SEQ ID NO: 539291 - DNA, 25 bp, Mus musculus
atagaaatggctgaaggaaagcccc

SEQ ID NO: 539292 - DNA, 25 bp, Mus musculus
atagaacacaggaacagaacgagtg

SEQ ID NO: 539293 - DNA, 25 bp, Mus musculus
atagaacacaggtacagaacgagtg

SEQ ID NO: 539294 - DNA, 25 bp, Mus musculus
atagaactacctcggcagcgggtgc

SEQ ID NO: 539295 - DNA, 25 bp, Mus musculus
atagaactacctgggcagcgggtgc

SEQ ID NO: 539296 - DNA, 25 bp, Mus musculus
atagaagtgatgagtccacctgggc

SEQ ID NO: 539297 - DNA, 25 bp, Mus musculus
atagaagtgatgtgtccacctgggc

SEQ ID NO: 539298 - DNA, 25 bp, Mus musculus
atagacactgcccaccttctggact

SEQ ID NO: 539299 - DNA, 25 bp, Mus musculus
atagacactgccgaccttctggact

SEQ ID NO: 539300 - DNA, 25 bp, Mus musculus
atagacgccatcaccttcttgtcgg

SEQ ID NO: 539301 - DNA, 25 bp, Mus musculus
atagacgccatctccttcttgtcgg

SEQ ID NO: 539302 - DNA, 25 bp, Mus musculus
atagacgctctccagaaagcaccct

SEQ ID NO: 539303 - DNA, 25 bp, Mus musculus
atagacgctctcgagaaagcaccct

SEQ ID NO: 539304 - DNA, 25 bp, Mus musculus
atagacgggagtattcagcgaggct

SEQ ID NO: 539305 - DNA, 25 bp, Mus musculus
atagacgggagttttcagcgaggct

SEQ ID NO: 539306 - DNA, 25 bp, Mus musculus
atagacgtccttcagcccctgatcg

SEQ ID NO: 539307 - DNA, 25 bp, Mus musculus
atagacgtccttgagcccctgatcg

SEQ ID NO: 539308 - DNA, 25 bp, Mus musculus
atagactacactctccccgagcagg

SEQ ID NO: 539309 - DNA, 25 bp, Mus musculus
atagactacactgtccccgagcagg

SEQ ID NO: 539310 - DNA, 25 bp, Mus musculus
atagactcacccatacggaagctgc

SEQ ID NO: 539311 - DNA, 25 bp, Mus musculus
atagactcacccttacggaagctgc

SEQ ID NO: 539312 - DNA, 25 bp, Mus musculus
atagactcatgtcgcatctcagaca

SEQ ID NO: 539313 - DNA, 25 bp, Mus musculus
atagactcatgtggcatctcagaca

SEQ ID NO: 539314 - DNA, 25 bp, Mus musculus
atagactgacccagctggaaaggct

SEQ ID NO: 539315 - DNA, 25 bp, Mus musculus
atagactgaccctgctggaaaggct

SEQ ID NO: 539316 - DNA, 25 bp, Mus musculus
atagacttcttcaaccggccgcaca

SEQ ID NO: 539317 - DNA, 25 bp, Mus musculus
atagacttcttctaccggccgcaca

SEQ ID NO: 539318 - DNA, 25 bp, Mus musculus
atagacttgtgtccccggaagccct

SEQ ID NO: 539319 - DNA, 25 bp, Mus musculus
atagacttgtgtgcccggaagccct

SEQ ID NO: 539320 - DNA, 25 bp, Mus musculus
atagagaaacacacgcgggacagcg

SEQ ID NO: 539321 - DNA, 25 bp, Mus musculus
atagagaaacactcgcgggacagcg

SEQ ID NO: 539322 - DNA, 25 bp, Mus musculus
atagagaaacagacccatccccgga

SEQ ID NO: 539323 - DNA, 25 bp, Mus musculus
atagagaaacagtcccatccccgga

SEQ ID NO: 539324 - DNA, 25 bp, Mus musculus
atagagagttcacggtggcgacccc

SEQ ID NO: 539325 - DNA, 25 bp, Mus musculus
atagagagttcagggtggcgacccc

SEQ ID NO: 539326 - DNA, 25 bp, Mus musculus
atagagatcacaaatcgagcgaaga

SEQ ID NO: 539327 - DNA, 25 bp, Mus musculus
atagagatcacatatcgagcgaaga

SEQ ID NO: 539328 - DNA, 25 bp, Mus musculus
atagagcaagagatccggctgcccc

SEQ ID NO: 539329 - DNA, 25 bp, Mus musculus
atagagcaagagttccggctgcccc

SEQ ID NO: 539330 - DNA, 25 bp, Mus musculus
atagagcgagccactggccaaagac

SEQ ID NO: 539331 - DNA, 25 bp, Mus musculus
atagagcgagcctctggccaaagac

SEQ ID NO: 539332 - DNA, 25 bp, Mus musculus
atagagcgtgcaaacgcctgcaact

SEQ ID NO: 539333 - DNA, 25 bp, Mus musculus
atagagcgtgcatacgcctgcaact

SEQ ID NO: 539334 - DNA, 25 bp, Mus musculus
atagaggaacgcatcaccagagcca

SEQ ID NO: 539335 - DNA, 25 bp, Mus musculus
atagaggaacgcttcaccagagcca

SEQ ID NO: 539336 - DNA, 25 bp, Mus musculus
atagagggactcacgggcctctcca

SEQ ID NO: 539337 - DNA, 25 bp, Mus musculus
atagagggactctcgggcctctcca

SEQ ID NO: 539338 - DNA, 25 bp, Mus musculus
atagaggtgccccacagttggacac

SEQ ID NO: 539339 - DNA, 25 bp, Mus musculus
atagaggtgcccgacagttggacac

SEQ ID NO: 539340 - DNA, 25 bp, Mus musculus
atagataacctactgtcccgtcagc

SEQ ID NO: 539341 - DNA, 25 bp, Mus musculus
atagataacctagtgtcccgtcagc

SEQ ID NO: 539342 - DNA, 25 bp, Mus musculus
atagatacccgactcctgatgggcc

SEQ ID NO: 539343 - DNA, 25 bp, Mus musculus
atagatacccgagtcctgatgggcc

SEQ ID NO: 539344 - DNA, 25 bp, Mus musculus
atagatctgacaacatgccctccgg

SEQ ID NO: 539345 - DNA, 25 bp, Mus musculus
atagatctgacatcatgccctccgg

SEQ ID NO: 539346 - DNA, 25 bp, Mus musculus
atagatcttgataatccacaggaga

SEQ ID NO: 539347 - DNA, 25 bp, Mus musculus
atagatcttgattatccacaggaga

SEQ ID NO: 539348 - DNA, 25 bp, Mus musculus
atagatggtgacaaaggacctcggg

SEQ ID NO: 539349 - DNA, 25 bp, Mus musculus
atagatggtgactaaggacctcggg

SEQ ID NO: 539350 - DNA, 25 bp, Mus musculus
atagcaacaggaactcgcacagaag

SEQ ID NO: 539351 - DNA, 25 bp, Mus musculus
atagcaacaggatctcgcacagaag

SEQ ID NO: 539352 - DNA, 25 bp, Mus musculus
atagcacatcctccctccgaagtgg

SEQ ID NO: 539353 - DNA, 25 bp, Mus musculus
atagcacatcctgcctccgaagtgg

SEQ ID NO: 539354 - DNA, 25 bp, Mus musculus
atagcagcagtcatagccgcagcag

SEQ ID NO: 539355 - DNA, 25 bp, Mus musculus
atagcagcagtcttagccgcagcag

SEQ ID NO: 539356 - DNA, 25 bp, Mus musculus
atagcagtccacatgcaaccccaga

SEQ ID NO: 539357 - DNA, 25 bp, Mus musculus
atagcagtccacttgcaaccccaga

SEQ ID NO: 539358 - DNA, 25 bp, Mus musculus
atagcatccttgaaggacaacccta

SEQ ID NO: 539359 - DNA, 25 bp, Mus musculus
atagcatccttgtaggacaacccta

SEQ ID NO: 539360 - DNA, 25 bp, Mus musculus
atagcatcgcgcagcgcagtggccc

SEQ ID NO: 539361 - DNA, 25 bp, Mus musculus
atagcatcgcgctgcgcagtggccc

SEQ ID NO: 539362 - DNA, 25 bp, Mus musculus
atagccaacaatcgagtgggaggag

SEQ ID NO: 539363 - DNA, 25 bp, Mus musculus
atagccaacaatggagtgggaggag

SEQ ID NO: 539364 - DNA, 25 bp, Mus musculus
atagccaagaccaggaaaaagcccg

SEQ ID NO: 539365 - DNA, 25 bp, Mus musculus
atagccaagacctggaaaaagcccg

SEQ ID NO: 539366 - DNA, 25 bp, Mus musculus
atagccaccagtcttagcagaacag

SEQ ID NO: 539367 - DNA, 25 bp, Mus musculus
atagccaccagtgttagcagaacag

SEQ ID NO: 539368 - DNA, 25 bp, Mus musculus
atagccactgtgagggaggcccatg

SEQ ID NO: 539369 - DNA, 25 bp, Mus musculus
atagccactgtgtgggaggcccatg

SEQ ID NO: 539370 - DNA, 25 bp, Mus musculus
atagccatcgagctggaccccaggc

SEQ ID NO: 539371 - DNA, 25 bp, Mus musculus
atagccatcgaggtggaccccaggc

SEQ ID NO: 539372 - DNA, 25 bp, Mus musculus
atagccatggcaatcattctcatcg

SEQ ID NO: 539373 - DNA, 25 bp, Mus musculus
atagccatggcattcattctcatcg

SEQ ID NO: 539374 - DNA, 25 bp, Mus musculus
atagccccaccaccaggatcaagaa

SEQ ID NO: 539375 - DNA, 25 bp, Mus musculus
atagccccaccagcaggatcaagaa

SEQ ID NO: 539376 - DNA, 25 bp, Mus musculus
atagccctccggaatgatgccgagt

SEQ ID NO: 539377 - DNA, 25 bp, Mus musculus
atagccctccggtatgatgccgagt

SEQ ID NO: 539378 - DNA, 25 bp, Mus musculus
atagccctcgccagggtgaggacct

SEQ ID NO: 539379 - DNA, 25 bp, Mus musculus
atagccctcgcctgggtgaggacct

SEQ ID NO: 539380 - DNA, 25 bp, Mus musculus
atagccgtggccacttcagaccctg

SEQ ID NO: 539381 - DNA, 25 bp, Mus musculus
atagccgtggcctcttcagaccctg

SEQ ID NO: 539382 - DNA, 25 bp, Mus musculus
atagccttgaggaccagccccatag

SEQ ID NO: 539383 - DNA, 25 bp, Mus musculus
atagccttgaggtccagccccatag

SEQ ID NO: 539384 - DNA, 25 bp, Mus musculus
atagcgccgctaagtggcccccgga

SEQ ID NO: 539385 - DNA, 25 bp, Mus musculus
atagcgccgctatgtggcccccgga

SEQ ID NO: 539386 - DNA, 25 bp, Mus musculus
atagctctcgtaagtgagtccctcg

SEQ ID NO: 539387 - DNA, 25 bp, Mus musculus
atagctctcgtatgtgagtccctcg

SEQ ID NO: 539388 - DNA, 25 bp, Mus musculus
atagctctctacagggccacttaga

SEQ ID NO: 539389 - DNA, 25 bp, Mus musculus
atagctctctactgggccacttaga

SEQ ID NO: 539390 - DNA, 25 bp, Mus musculus
atagctgtaggcacagatgctgaca

SEQ ID NO: 539391 - DNA, 25 bp, Mus musculus
atagctgtaggctcagatgctgaca

SEQ ID NO: 539392 - DNA, 25 bp, Mus musculus
atagctgtcctccaagtggccactg

SEQ ID NO: 539393 - DNA, 25 bp, Mus musculus
atagctgtcctcgaagtggccactg

SEQ ID NO: 539394 - DNA, 25 bp, Mus musculus
atagctttgtgacgtaagattcttc

SEQ ID NO: 539395 - DNA, 25 bp, Mus musculus
atagctttgtgaggtaagattcttc

SEQ ID NO: 539396 - DNA, 25 bp, Mus musculus
ataggaaaaaagaagcgacagaaga

SEQ ID NO: 539397 - DNA, 25 bp, Mus musculus
ataggaaaaaagtagcgacagaaga

SEQ ID NO: 539398 - DNA, 25 bp, Mus musculus
ataggaaacgtcaaaaccttgcaag

SEQ ID NO: 539399 - DNA, 25 bp, Mus musculus
ataggaaacgtctaaaccttgcaag

SEQ ID NO: 539400 - DNA, 25 bp, Mus musculus
ataggaagtgacctctgggcccgaa

SEQ ID NO: 539401 - DNA, 25 bp, Mus musculus
ataggaagtgacgtctgggcccgaa

SEQ ID NO: 539402 - DNA, 25 bp, Mus musculus
ataggacacacccactcaacagagg

SEQ ID NO: 539403 - DNA, 25 bp, Mus musculus
ataggacacaccgactcaacagagg

SEQ ID NO: 539404 - DNA, 25 bp, Mus musculus
ataggacccagcagcggaaagtggc

SEQ ID NO: 539405 - DNA, 25 bp, Mus musculus
ataggacccagctgcggaaagtggc

SEQ ID NO: 539406 - DNA, 25 bp, Mus musculus
ataggaccgcggagcagttctagcc

SEQ ID NO: 539407 - DNA, 25 bp, Mus musculus
ataggaccgcggtgcagttctagcc

SEQ ID NO: 539408 - DNA, 25 bp, Mus musculus
ataggacttgaaagtgacagagtac

SEQ ID NO: 539409 - DNA, 25 bp, Mus musculus
ataggacttgaatgtgacagagtac

SEQ ID NO: 539410 - DNA, 25 bp, Mus musculus
ataggagacatcaaaacaggagcac

SEQ ID NO: 539411 - DNA, 25 bp, Mus musculus
ataggagacatctaaacaggagcac

SEQ ID NO: 539412 - DNA, 25 bp, Mus musculus
ataggcaccgagaccccagagtcaa

SEQ ID NO: 539413 - DNA, 25 bp, Mus musculus
ataggcaccgagtccccagagtcaa

SEQ ID NO: 539414 - DNA, 25 bp, Mus musculus
ataggcatccttcttaccgtccttg

SEQ ID NO: 539415 - DNA, 25 bp, Mus musculus
ataggcatccttgttaccgtccttg

SEQ ID NO: 539416 - DNA, 25 bp, Mus musculus
atagggcacagtcgctggaaaagaa

SEQ ID NO: 539417 - DNA, 25 bp, Mus musculus
atagggcacagtggctggaaaagaa

SEQ ID NO: 539418 - DNA, 25 bp, Mus musculus
atagggttgtggcatacaggccatc

SEQ ID NO: 539419 - DNA, 25 bp, Mus musculus
atagggttgtgggatacaggccatc

SEQ ID NO: 539420 - DNA, 25 bp, Mus musculus
ataggtcagctaccctggcgagcag

SEQ ID NO: 539421 - DNA, 25 bp, Mus musculus
ataggtcagctagcctggcgagcag

SEQ ID NO: 539422 - DNA, 25 bp, Mus musculus
ataggtggacagagtagcccgcctc

SEQ ID NO: 539423 - DNA, 25 bp, Mus musculus
ataggtggacagtgtagcccgcctc

SEQ ID NO: 539424 - DNA, 25 bp, Mus musculus
atagtaagagagaaagcctgtggtg

SEQ ID NO: 539425 - DNA, 25 bp, Mus musculus
atagtaagagagtaagcctgtggtg

SEQ ID NO: 539426 - DNA, 25 bp, Mus musculus
atagtaattggtatcctggagctgc

SEQ ID NO: 539427 - DNA, 25 bp, Mus musculus
atagtaattggtttcctggagctgc

SEQ ID NO: 539428 - DNA, 25 bp, Mus musculus
atagtacatcgacgtgaaggagagc

SEQ ID NO: 539429 - DNA, 25 bp, Mus musculus
atagtacatcgaggtgaaggagagc

SEQ ID NO: 539430 - DNA, 25 bp, Mus musculus
atagtaccatcaagccccgactgag

SEQ ID NO: 539431 - DNA, 25 bp, Mus musculus
atagtaccatcatgccccgactgag

SEQ ID NO: 539432 - DNA, 25 bp, Mus musculus
atagtacccagaagaacaccggcaa

SEQ ID NO: 539433 - DNA, 25 bp, Mus musculus
atagtacccagatgaacaccggcaa

SEQ ID NO: 539434 - DNA, 25 bp, Mus musculus
atagtactcacaaggacaccaggca

SEQ ID NO: 539435 - DNA, 25 bp, Mus musculus
atagtactcacatggacaccaggca

SEQ ID NO: 539436 - DNA, 25 bp, Mus musculus
atagtactggagagggcttctccca

SEQ ID NO: 539437 - DNA, 25 bp, Mus musculus
atagtactggagtgggcttctccca

SEQ ID NO: 539438 - DNA, 25 bp, Mus musculus
atagtagaaatgcagttagcagtca

SEQ ID NO: 539439 - DNA, 25 bp, Mus musculus
atagtagaaatggagttagcagtca

SEQ ID NO: 539440 - DNA, 25 bp, Mus musculus
atagtagtaccccagtggtgctcct

SEQ ID NO: 539441 - DNA, 25 bp, Mus musculus
atagtagtacccgagtggtgctcct

SEQ ID NO: 539442 - DNA, 25 bp, Mus musculus
atagtcagcggccttcgagacaaca

SEQ ID NO: 539443 - DNA, 25 bp, Mus musculus
atagtcagcggcgttcgagacaaca

SEQ ID NO: 539444 - DNA, 25 bp, Mus musculus
atagtccatagaaagtccatttagc

SEQ ID NO: 539445 - DNA, 25 bp, Mus musculus
atagtccatagatagtccatttagc

SEQ ID NO: 539446 - DNA, 25 bp, Mus musculus
atagtcccggccagagcccagggtc

SEQ ID NO: 539447 - DNA, 25 bp, Mus musculus
atagtcccggcctgagcccagggtc

SEQ ID NO: 539448 - DNA, 25 bp, Mus musculus
atagtcgccacaacctcagcacggg

SEQ ID NO: 539449 - DNA, 25 bp, Mus musculus
atagtcgccacatcctcagcacggg

SEQ ID NO: 539450 - DNA, 25 bp, Mus musculus
atagtcgcctttccaggcggctgag

SEQ ID NO: 539451 - DNA, 25 bp, Mus musculus
atagtcgcctttgcaggcggctgag

SEQ ID NO: 539452 - DNA, 25 bp, Mus musculus
atagtctctgtacttgtttcctggc

SEQ ID NO: 539453 - DNA, 25 bp, Mus musculus
atagtctctgtagttgtttcctggc

SEQ ID NO: 539454 - DNA, 25 bp, Mus musculus
atagtgacaagtcccggcctggcca

SEQ ID NO: 539455 - DNA, 25 bp, Mus musculus
atagtgacaagtgccggcctggcca

SEQ ID NO: 539456 - DNA, 25 bp, Mus musculus
atagtggacagaccctctatgaaca

SEQ ID NO: 539457 - DNA, 25 bp, Mus musculus
atagtggacagagcctctatgaaca

SEQ ID NO: 539458 - DNA, 25 bp, Mus musculus
atagtggcctcgagaccttccaagc

SEQ ID NO: 539459 - DNA, 25 bp, Mus musculus
atagtggcctcgtgaccttccaagc

SEQ ID NO: 539460 - DNA, 25 bp, Mus musculus
atagttcgaggcctagaggaaaagc

SEQ ID NO: 539461 - DNA, 25 bp, Mus musculus
atagttcgaggcgtagaggaaaagc

SEQ ID NO: 539462 - DNA, 25 bp, Mus musculus
atagttctgaccattcctttgcaat

SEQ ID NO: 539463 - DNA, 25 bp, Mus musculus
atagttctgacctttcctttgcaat

SEQ ID NO: 539464 - DNA, 25 bp, Mus musculus
atagttttgctgaactgggcctaga

SEQ ID NO: 539465 - DNA, 25 bp, Mus musculus
atagttttgctgtactgggcctaga

SEQ ID NO: 539466 - DNA, 25 bp, Mus musculus
atataaaaagcactgcactgaggcg

SEQ ID NO: 539467 - DNA, 25 bp, Mus musculus
atataaaaagcagtgcactgaggcg

SEQ ID NO: 539468 - DNA, 25 bp, Mus musculus
atataaaagggcagtcagagggaga

SEQ ID NO: 539469 - DNA, 25 bp, Mus musculus
atataaaagggctgtcagagggaga

SEQ ID NO: 539470 - DNA, 25 bp, Mus musculus
atataacaccaacgctcaggtccct

SEQ ID NO: 539471 - DNA, 25 bp, Mus musculus
atataacaccaaggctcaggtccct

SEQ ID NO: 539472 - DNA, 25 bp, Mus musculus
atataaccggctcatccattattgg

SEQ ID NO: 539473 - DNA, 25 bp, Mus musculus
atataaccggctgatccattattgg

SEQ ID NO: 539474 - DNA, 25 bp, Mus musculus
atataacctcacagaaggagaggac

SEQ ID NO: 539475 - DNA, 25 bp, Mus musculus
atataacctcactgaaggagaggac

SEQ ID NO: 539476 - DNA, 25 bp, Mus musculus
atataacgatctccccgcactggag

SEQ ID NO: 539477 - DNA, 25 bp, Mus musculus
atataacgatctgcccgcactggag

SEQ ID NO: 539478 - DNA, 25 bp, Mus musculus
atatacaataagaacccacctttag

SEQ ID NO: 539479 - DNA, 25 bp, Mus musculus
atatacaataagtacccacctttag

SEQ ID NO: 539480 - DNA, 25 bp, Mus musculus
atatacattcggctgacataattca

SEQ ID NO: 539481 - DNA, 25 bp, Mus musculus
atatacattcgggtgacataattca

SEQ ID NO: 539482 - DNA, 25 bp, Mus musculus
atataccagggaattgagaagaagc

SEQ ID NO: 539483 - DNA, 25 bp, Mus musculus
atataccagggatttgagaagaagc

SEQ ID NO: 539484 - DNA, 25 bp, Mus musculus
atatacctgttcctgtcccaatggg

SEQ ID NO: 539485 - DNA, 25 bp, Mus musculus
atatacctgttcgtgtcccaatggg

SEQ ID NO: 539486 - DNA, 25 bp, Mus musculus
atatactctgtgatcagattgcggg

SEQ ID NO: 539487 - DNA, 25 bp, Mus musculus
atatactctgtgttcagattgcggg

SEQ ID NO: 539488 - DNA, 25 bp, Mus musculus
atatactgtaaactccgcgtgcacg

SEQ ID NO: 539489 - DNA, 25 bp, Mus musculus
atatactgtaaagtccgcgtgcacg

SEQ ID NO: 539490 - DNA, 25 bp, Mus musculus
atatacttcctaccgggctggcttt

SEQ ID NO: 539491 - DNA, 25 bp, Mus musculus
atatacttcctagcgggctggcttt

SEQ ID NO: 539492 - DNA, 25 bp, Mus musculus
atatactttcataaaccctgcactg

SEQ ID NO: 539493 - DNA, 25 bp, Mus musculus
atatactttcattaaccctgcactg

SEQ ID NO: 539494 - DNA, 25 bp, Mus musculus
atatagactctcacagctcatcctc

SEQ ID NO: 539495 - DNA, 25 bp, Mus musculus
atatagactctctcagctcatcctc

SEQ ID NO: 539496 - DNA, 25 bp, Mus musculus
atatatacctggctatgtggaaaat

SEQ ID NO: 539497 - DNA, 25 bp, Mus musculus
atatatacctgggtatgtggaaaat

SEQ ID NO: 539498 - DNA, 25 bp, Mus musculus
atatatactgtaaagtccgcgtgca

SEQ ID NO: 539499 - DNA, 25 bp, Mus musculus
atatatactgtatagtccgcgtgca

SEQ ID NO: 539500 - DNA, 25 bp, Mus musculus
atatatcaaggacaggaactaccac

SEQ ID NO: 539501 - DNA, 25 bp, Mus musculus
atatatcaaggagaggaactaccac

SEQ ID NO: 539502 - DNA, 25 bp, Mus musculus
atatatccagtgatggagaaggagg

SEQ ID NO: 539503 - DNA, 25 bp, Mus musculus
atatatccagtgttggagaaggagg

SEQ ID NO: 539504 - DNA, 25 bp, Mus musculus
atatcaacgaatccctggtcaataa

SEQ ID NO: 539505 - DNA, 25 bp, Mus musculus
atatcaacgaatgcctggtcaataa

SEQ ID NO: 539506 - DNA, 25 bp, Mus musculus
atatcaagcttgaggattctccaga

SEQ ID NO: 539507 - DNA, 25 bp, Mus musculus
atatcaagcttgtggattctccaga

SEQ ID NO: 539508 - DNA, 25 bp, Mus musculus
atatcaatgagtccctgaccctggg

SEQ ID NO: 539509 - DNA, 25 bp, Mus musculus
atatcaatgagtgcctgaccctggg

SEQ ID NO: 539510 - DNA, 25 bp, Mus musculus
atatcacaggacaaggaggtggctg

SEQ ID NO: 539511 - DNA, 25 bp, Mus musculus
atatcacaggactaggaggtggctg

SEQ ID NO: 539512 - DNA, 25 bp, Mus musculus
atatcacatctgacatcagcaacac

SEQ ID NO: 539513 - DNA, 25 bp, Mus musculus
atatcacatctgtcatcagcaacac

SEQ ID NO: 539514 - DNA, 25 bp, Mus musculus
atatcacttcaaaaggaaaaatgcg

SEQ ID NO: 539515 - DNA, 25 bp, Mus musculus
atatcacttcaataggaaaaatgcg

SEQ ID NO: 539516 - DNA, 25 bp, Mus musculus
atatcatcgttaaccgcacccggac

SEQ ID NO: 539517 - DNA, 25 bp, Mus musculus
atatcatcgttatccgcacccggac

SEQ ID NO: 539518 - DNA, 25 bp, Mus musculus
atatccaaaccccatgaacccgagt

SEQ ID NO: 539519 - DNA, 25 bp, Mus musculus
atatccaaacccgatgaacccgagt

SEQ ID NO: 539520 - DNA, 25 bp, Mus musculus
atatccacagtgacaaaacccctgg

SEQ ID NO: 539521 - DNA, 25 bp, Mus musculus
atatccacagtgtcaaaacccctgg

SEQ ID NO: 539522 - DNA, 25 bp, Mus musculus
atatccatgcctacgtctcactggg

SEQ ID NO: 539523 - DNA, 25 bp, Mus musculus
atatccatgccttcgtctcactggg

SEQ ID NO: 539524 - DNA, 25 bp, Mus musculus
atatccctctccaggtactgggagg

SEQ ID NO: 539525 - DNA, 25 bp, Mus musculus
atatccctctcctggtactgggagg

SEQ ID NO: 539526 - DNA, 25 bp, Mus musculus
atatccgagaaccaggaagctcaga

SEQ ID NO: 539527 - DNA, 25 bp, Mus musculus
atatccgagaacgaggaagctcaga

SEQ ID NO: 539528 - DNA, 25 bp, Mus musculus
atatccgagggcaggtcacctccaa

SEQ ID NO: 539529 - DNA, 25 bp, Mus musculus
atatccgagggctggtcacctccaa

SEQ ID NO: 539530 - DNA, 25 bp, Mus musculus
atatccgatacaaaagtggttctag

SEQ ID NO: 539531 - DNA, 25 bp, Mus musculus
atatccgatacataagtggttctag

SEQ ID NO: 539532 - DNA, 25 bp, Mus musculus
atatcctcagggaatgggagacagc

SEQ ID NO: 539533 - DNA, 25 bp, Mus musculus
atatcctcagggtatgggagacagc

SEQ ID NO: 539534 - DNA, 25 bp, Mus musculus
atatcctcttctactgggtggcccg

SEQ ID NO: 539535 - DNA, 25 bp, Mus musculus
atatcctcttcttctgggtggcccg

SEQ ID NO: 539536 - DNA, 25 bp, Mus musculus
atatcctgcaccatctcacaacgga

SEQ ID NO: 539537 - DNA, 25 bp, Mus musculus
atatcctgcaccttctcacaacgga

SEQ ID NO: 539538 - DNA, 25 bp, Mus musculus
atatccttccagctgatgctcctgc

SEQ ID NO: 539539 - DNA, 25 bp, Mus musculus
atatccttccaggtgatgctcctgc

SEQ ID NO: 539540 - DNA, 25 bp, Mus musculus
atatcgatgagtcccagacccggaa

SEQ ID NO: 539541 - DNA, 25 bp, Mus musculus
atatcgatgagtctgagcagcccgg

SEQ ID NO: 539542 - DNA, 25 bp, Mus musculus
atatcgatgagtgccagacccggaa

SEQ ID NO: 539543 - DNA, 25 bp, Mus musculus
atatcgatgagtgtgagcagcccgg

SEQ ID NO: 539544 - DNA, 25 bp, Mus musculus
atatcgcgagcacaagagcctgaca

SEQ ID NO: 539545 - DNA, 25 bp, Mus musculus
atatcgcgagcagaagagcctgaca

SEQ ID NO: 539546 - DNA, 25 bp, Mus musculus
atatcgggccgtacggaggattgct

SEQ ID NO: 539547 - DNA, 25 bp, Mus musculus
atatcgggccgttcggaggattgct

SEQ ID NO: 539548 - DNA, 25 bp, Mus musculus
atatcgggctctcggtgacgcacag

SEQ ID NO: 539549 - DNA, 25 bp, Mus musculus
atatcgggctctgggtgacgcacag

SEQ ID NO: 539550 - DNA, 25 bp, Mus musculus
atatcgtggtggaagctcagggctc

SEQ ID NO: 539551 - DNA, 25 bp, Mus musculus
atatcgtggtggtagctcagggctc

SEQ ID NO: 539552 - DNA, 25 bp, Mus musculus
atatctaccgagctctgcgcactgc

SEQ ID NO: 539553 - DNA, 25 bp, Mus musculus
atatctaccgaggtctgcgcactgc

SEQ ID NO: 539554 - DNA, 25 bp, Mus musculus
atatctcactccaagctggtgcaga

SEQ ID NO: 539555 - DNA, 25 bp, Mus musculus
atatctcactcctagctggtgcaga

SEQ ID NO: 539556 - DNA, 25 bp, Mus musculus
atatctgaaggcacgccgggcacag

SEQ ID NO: 539557 - DNA, 25 bp, Mus musculus
atatctgaaggctcgccgggcacag

SEQ ID NO: 539558 - DNA, 25 bp, Mus musculus
atatctgctaatctatgtcagtgag

SEQ ID NO: 539559 - DNA, 25 bp, Mus musculus
atatctgctaatgtatgtcagtgag

SEQ ID NO: 539560 - DNA, 25 bp, Mus musculus
atatctggatgtatattctgctggc

SEQ ID NO: 539561 - DNA, 25 bp, Mus musculus
atatctggatgtttattctgctggc

SEQ ID NO: 539562 - DNA, 25 bp, Mus musculus
atatctgggtaaccatcaaagaatc

SEQ ID NO: 539563 - DNA, 25 bp, Mus musculus
atatctgggtaagcatcaaagaatc

SEQ ID NO: 539564 - DNA, 25 bp, Mus musculus
atatctgtcacccaattccaagagg

SEQ ID NO: 539565 - DNA, 25 bp, Mus musculus
atatctgtcaccgaattccaagagg

SEQ ID NO: 539566 - DNA, 25 bp, Mus musculus
atatctgtgaatattgtgctcgggc

SEQ ID NO: 539567 - DNA, 25 bp, Mus musculus
atatctgtgaattttgtgctcgggc

SEQ ID NO: 539568 - DNA, 25 bp, Mus musculus
atatcttactgtcggagcagcggtc

SEQ ID NO: 539569 - DNA, 25 bp, Mus musculus
atatcttactgtgggagcagcggtc

SEQ ID NO: 539570 - DNA, 25 bp, Mus musculus
atatcttccggccaagctgtacccg

SEQ ID NO: 539571 - DNA, 25 bp, Mus musculus
atatcttccggcgaagctgtacccg

SEQ ID NO: 539572 - DNA, 25 bp, Mus musculus
atatgaaaatgcagtacctgggcgg

SEQ ID NO: 539573 - DNA, 25 bp, Mus musculus
atatgaaaatgctgtacctgggcgg

SEQ ID NO: 539574 - DNA, 25 bp, Mus musculus
atatgaaatggccaccctgaagcac

SEQ ID NO: 539575 - DNA, 25 bp, Mus musculus
atatgaaatggcgaccctgaagcac

SEQ ID NO: 539576 - DNA, 25 bp, Mus musculus
atatgaatcggacctttgcagttac

SEQ ID NO: 539577 - DNA, 25 bp, Mus musculus
atatgaatcggagctttgcagttac

SEQ ID NO: 539578 - DNA, 25 bp, Mus musculus
atatgacatctgcaatatctggtgc

SEQ ID NO: 539579 - DNA, 25 bp, Mus musculus
atatgacatctggaatatctggtgc

SEQ ID NO: 539580 - DNA, 25 bp, Mus musculus
atatgacttcccagagaggaatgct

SEQ ID NO: 539581 - DNA, 25 bp, Mus musculus
atatgacttccctgagaggaatgct

SEQ ID NO: 539582 - DNA, 25 bp, Mus musculus
atatgacttcgaccaggagggttcg

SEQ ID NO: 539583 - DNA, 25 bp, Mus musculus
atatgacttcgagcaggagggttcg

SEQ ID NO: 539584 - DNA, 25 bp, Mus musculus
atatgagaacatcccgcataaatga

SEQ ID NO: 539585 - DNA, 25 bp, Mus musculus
atatgagaacatgccgcataaatga

SEQ ID NO: 539586 - DNA, 25 bp, Mus musculus
atatgagtgttcctgagccaccgcc

SEQ ID NO: 539587 - DNA, 25 bp, Mus musculus
atatgagtgttcgtgagccaccgcc

SEQ ID NO: 539588 - DNA, 25 bp, Mus musculus
atatgatgagctcgcagagccccag

SEQ ID NO: 539589 - DNA, 25 bp, Mus musculus
atatgatgagctggcagagccccag

SEQ ID NO: 539590 - DNA, 25 bp, Mus musculus
atatgatgccgcacttggagacaga

SEQ ID NO: 539591 - DNA, 25 bp, Mus musculus
atatgatgccgctcttggagacaga

SEQ ID NO: 539592 - DNA, 25 bp, Mus musculus
atatgatggccaagaaccacgggcg

SEQ ID NO: 539593 - DNA, 25 bp, Mus musculus
atatgatggccatgaaccacgggcg

SEQ ID NO: 539594 - DNA, 25 bp, Mus musculus
atatgatttcccaggatccaactca

SEQ ID NO: 539595 - DNA, 25 bp, Mus musculus
atatgatttccctggatccaactca

SEQ ID NO: 539596 - DNA, 25 bp, Mus musculus
atatgcatttgcaccggccacatta

SEQ ID NO: 539597 - DNA, 25 bp, Mus musculus
atatgcatttgctccggccacatta

SEQ ID NO: 539598 - DNA, 25 bp, Mus musculus
atatgccatgaacgtcttaaggaag

SEQ ID NO: 539599 - DNA, 25 bp, Mus musculus
atatgccatgaaggtcttaaggaag

SEQ ID NO: 539600 - DNA, 25 bp, Mus musculus
atatgccccaacagcgacaagacca

SEQ ID NO: 539601 - DNA, 25 bp, Mus musculus
atatgccccaactgcgacaagacca

SEQ ID NO: 539602 - DNA, 25 bp, Mus musculus
atatgccgcctaagacacacaccat

SEQ ID NO: 539603 - DNA, 25 bp, Mus musculus
atatgccgcctatgacacacaccat

SEQ ID NO: 539604 - DNA, 25 bp, Mus musculus
atatgcggccacataggctgtgggc

SEQ ID NO: 539605 - DNA, 25 bp, Mus musculus
atatgcggccacttaggctgtgggc

SEQ ID NO: 539606 - DNA, 25 bp, Mus musculus
atatgctacctccaaaggcagcttc

SEQ ID NO: 539607 - DNA, 25 bp, Mus musculus
atatgctacctcgaaaggcagcttc

SEQ ID NO: 539608 - DNA, 25 bp, Mus musculus
atatgctggtcaacacccagggccg

SEQ ID NO: 539609 - DNA, 25 bp, Mus musculus
atatgctggtcatcacccagggccg

SEQ ID NO: 539610 - DNA, 25 bp, Mus musculus
atatggaagggcaggattgatctcc

SEQ ID NO: 539611 - DNA, 25 bp, Mus musculus
atatggaagggctggattgatctcc

SEQ ID NO: 539612 - DNA, 25 bp, Mus musculus
atatggactccgagggccgaataca

SEQ ID NO: 539613 - DNA, 25 bp, Mus musculus
atatggactccgtgggccgaataca

SEQ ID NO: 539614 - DNA, 25 bp, Mus musculus
atatggcagatcacaaccgtctgtt

SEQ ID NO: 539615 - DNA, 25 bp, Mus musculus
atatggcagatctcaaccgtctgtt

SEQ ID NO: 539616 - DNA, 25 bp, Mus musculus
atatggccaccaacgaggttcccag

SEQ ID NO: 539617 - DNA, 25 bp, Mus musculus
atatggccaccatcgaggttcccag

SEQ ID NO: 539618 - DNA, 25 bp, Mus musculus
atatggctttgtaattgctgtcacc

SEQ ID NO: 539619 - DNA, 25 bp, Mus musculus
atatggctttgttattgctgtcacc

SEQ ID NO: 539620 - DNA, 25 bp, Mus musculus
atatgggtcccacggccttctggct

SEQ ID NO: 539621 - DNA, 25 bp, Mus musculus
atatgggtcccagggccttctggct

SEQ ID NO: 539622 - DNA, 25 bp, Mus musculus
atatgtaacggaccgccaaaaagtg

SEQ ID NO: 539623 - DNA, 25 bp, Mus musculus
atatgtaacggagcgccaaaaagtg

SEQ ID NO: 539624 - DNA, 25 bp, Mus musculus
atatgtagtgataggagatggacga

SEQ ID NO: 539625 - DNA, 25 bp, Mus musculus
atatgtagtgattggagatggacga

SEQ ID NO: 539626 - DNA, 25 bp, Mus musculus
atatgtcacttgacacacatgccgg

SEQ ID NO: 539627 - DNA, 25 bp, Mus musculus
atatgtcacttgtcacacatgccgg

SEQ ID NO: 539628 - DNA, 25 bp, Mus musculus
atatgtcctttgagcccacctggga

SEQ ID NO: 539629 - DNA, 25 bp, Mus musculus
atatgtcctttgtgcccacctggga

SEQ ID NO: 539630 - DNA, 25 bp, Mus musculus
atatgtgtacaaacctgtcatggat

SEQ ID NO: 539631 - DNA, 25 bp, Mus musculus
atatgtgtacaatcctgtcatggat

SEQ ID NO: 539632 - DNA, 25 bp, Mus musculus
atatgtgtccagcttctaccatgcc

SEQ ID NO: 539633 - DNA, 25 bp, Mus musculus
atatgtgtccaggttctaccatgcc

SEQ ID NO: 539634 - DNA, 25 bp, Mus musculus
atatgttcagcaccgaaaaggagat

SEQ ID NO: 539635 - DNA, 25 bp, Mus musculus
atatgttcagcagcgaaaaggagat

SEQ ID NO: 539636 - DNA, 25 bp, Mus musculus
atatgttcgcgtagtggcttctcca

SEQ ID NO: 539637 - DNA, 25 bp, Mus musculus
atatgttcgcgttgtggcttctcca

SEQ ID NO: 539638 - DNA, 25 bp, Mus musculus
atattaactacacaggcactcaggg

SEQ ID NO: 539639 - DNA, 25 bp, Mus musculus
atattaactacagaggcactcaggg

SEQ ID NO: 539640 - DNA, 25 bp, Mus musculus
atattaagacatctctcaggaactc

SEQ ID NO: 539641 - DNA, 25 bp, Mus musculus
atattaagacatgtctcaggaactc

SEQ ID NO: 539642 - DNA, 25 bp, Mus musculus
atattaatgtgcattccgtttgcaa

SEQ ID NO: 539643 - DNA, 25 bp, Mus musculus
atattaatgtgctttccgtttgcaa

SEQ ID NO: 539644 - DNA, 25 bp, Mus musculus
atattacacgccaaaccagttagca

SEQ ID NO: 539645 - DNA, 25 bp, Mus musculus
atattacacgcctaaccagttagca

SEQ ID NO: 539646 - DNA, 25 bp, Mus musculus
atattcagctccacgacctcgactt

SEQ ID NO: 539647 - DNA, 25 bp, Mus musculus
atattcagctcctcgacctcgactt

SEQ ID NO: 539648 - DNA, 25 bp, Mus musculus
atattccagggaaatgtgtggccag

SEQ ID NO: 539649 - DNA, 25 bp, Mus musculus
atattccagggatatgtgtggccag

SEQ ID NO: 539650 - DNA, 25 bp, Mus musculus
atattctcggctcgctgggtatgaa

SEQ ID NO: 539651 - DNA, 25 bp, Mus musculus
atattctcggctggctgggtatgaa

SEQ ID NO: 539652 - DNA, 25 bp, Mus musculus
atattcttatcaccactcaggagtc

SEQ ID NO: 539653 - DNA, 25 bp, Mus musculus
atattcttatcagcactcaggagtc

SEQ ID NO: 539654 - DNA, 25 bp, Mus musculus
atattgacgaatccgggactgggag

SEQ ID NO: 539655 - DNA, 25 bp, Mus musculus
atattgacgaatgcgggactgggag

SEQ ID NO: 539656 - DNA, 25 bp, Mus musculus
atattgagatcgaattccttggaga

SEQ ID NO: 539657 - DNA, 25 bp, Mus musculus
atattgagatcgtattccttggaga

SEQ ID NO: 539658 - DNA, 25 bp, Mus musculus
atattgatgagtctgaggaccgtga

SEQ ID NO: 539659 - DNA, 25 bp, Mus musculus
atattgatgagtgtgaggaccgtga

SEQ ID NO: 539660 - DNA, 25 bp, Mus musculus
atattgatgggcagtaccgcatcag

SEQ ID NO: 539661 - DNA, 25 bp, Mus musculus
atattgatgggctgtaccgcatcag

SEQ ID NO: 539662 - DNA, 25 bp, Mus musculus
atattgccgtggcttgcccttctca

SEQ ID NO: 539663 - DNA, 25 bp, Mus musculus
atattgccgtgggttgcccttctca

SEQ ID NO: 539664 - DNA, 25 bp, Mus musculus
atattgccgtgtatggcgctggcca

SEQ ID NO: 539665 - DNA, 25 bp, Mus musculus
atattgccgtgtttggcgctggcca

SEQ ID NO: 539666 - DNA, 25 bp, Mus musculus
atattggaagacagggaagactccg

SEQ ID NO: 539667 - DNA, 25 bp, Mus musculus
atattggaagactgggaagactccg

SEQ ID NO: 539668 - DNA, 25 bp, Mus musculus
atattgtccccaatgtccaagaacc

SEQ ID NO: 539669 - DNA, 25 bp, Mus musculus
atattgtccccattgtccaagaacc

SEQ ID NO: 539670 - DNA, 25 bp, Mus musculus
atatttacatacctgcggcaatgac

SEQ ID NO: 539671 - DNA, 25 bp, Mus musculus
atatttacatacgtgcggcaatgac

SEQ ID NO: 539672 - DNA, 25 bp, Mus musculus
atatttctagagctgagtctcagag

SEQ ID NO: 539673 - DNA, 25 bp, Mus musculus
atatttctagaggtgagtctcagag

SEQ ID NO: 539674 - DNA, 25 bp, Mus musculus
atatttcttctacccggtagaaagc

SEQ ID NO: 539675 - DNA, 25 bp, Mus musculus
atatttcttctagccggtagaaagc

SEQ ID NO: 539676 - DNA, 25 bp, Mus musculus
atatttgcatttcgccatttctggg

SEQ ID NO: 539677 - DNA, 25 bp, Mus musculus
atatttgcatttggccatttctggg

SEQ ID NO: 539678 - DNA, 25 bp, Mus musculus
atcaaaagaactcctgggcatagac

SEQ ID NO: 539679 - DNA, 25 bp, Mus musculus
atcaaaagaactgctgggcatagac

SEQ ID NO: 539680 - DNA, 25 bp, Mus musculus
atcaaaagccggcaccaagagccca

SEQ ID NO: 539681 - DNA, 25 bp, Mus musculus
atcaaaagccgggaccaagagccca

SEQ ID NO: 539682 - DNA, 25 bp, Mus musculus
atcaaaaggcaaagctctatagtgg

SEQ ID NO: 539683 - DNA, 25 bp, Mus musculus
atcaaaaggcaatgctctatagtgg

SEQ ID NO: 539684 - DNA, 25 bp, Mus musculus
atcaaacaatgaataccaccccagg

SEQ ID NO: 539685 - DNA, 25 bp, Mus musculus
atcaaacaatgattaccaccccagg

SEQ ID NO: 539686 - DNA, 25 bp, Mus musculus
atcaaacagtgcacattcttcatgc

SEQ ID NO: 539687 - DNA, 25 bp, Mus musculus
atcaaacagtgctcattcttcatgc

SEQ ID NO: 539688 - DNA, 25 bp, Mus musculus
atcaaacatccacgtgctgtgggac

SEQ ID NO: 539689 - DNA, 25 bp, Mus musculus
atcaaacatccaggtgctgtgggac

SEQ ID NO: 539690 - DNA, 25 bp, Mus musculus
atcaaaccactacatgactgccaga

SEQ ID NO: 539691 - DNA, 25 bp, Mus musculus
atcaaaccactagatgactgccaga

SEQ ID NO: 539692 - DNA, 25 bp, Mus musculus
atcaaacctggaccctttcaaccag

SEQ ID NO: 539693 - DNA, 25 bp, Mus musculus
atcaaacctggagcctttcaaccag

SEQ ID NO: 539694 - DNA, 25 bp, Mus musculus
atcaaacggaaacgcgagggatact

SEQ ID NO: 539695 - DNA, 25 bp, Mus musculus
atcaaacggaaaggcgagggatact

SEQ ID NO: 539696 - DNA, 25 bp, Mus musculus
atcaaactgcagaacaaggtgttcc

SEQ ID NO: 539697 - DNA, 25 bp, Mus musculus
atcaaactgcagtacaaggtgttcc

SEQ ID NO: 539698 - DNA, 25 bp, Mus musculus
atcaaagacttgatcctccagggag

SEQ ID NO: 539699 - DNA, 25 bp, Mus musculus
atcaaagacttgttcctccagggag

SEQ ID NO: 539700 - DNA, 25 bp, Mus musculus
atcaaagagatacctgtgactgtga

SEQ ID NO: 539701 - DNA, 25 bp, Mus musculus
atcaaagagatagctgtgactgtga

SEQ ID NO: 539702 - DNA, 25 bp, Mus musculus
atcaaagagggcatctccttccagc

SEQ ID NO: 539703 - DNA, 25 bp, Mus musculus
atcaaagagggcttctccttccagc

SEQ ID NO: 539704 - DNA, 25 bp, Mus musculus
atcaaagatcctcctagtaagcgct

SEQ ID NO: 539705 - DNA, 25 bp, Mus musculus
atcaaagatcctgctagtaagcgct

SEQ ID NO: 539706 - DNA, 25 bp, Mus musculus
atcaaagcaattatccccagcccag

SEQ ID NO: 539707 - DNA, 25 bp, Mus musculus
atcaaagcaattttccccagcccag

SEQ ID NO: 539708 - DNA, 25 bp, Mus musculus
atcaaagcaccaagatgcacccagc

SEQ ID NO: 539709 - DNA, 25 bp, Mus musculus
atcaaagcaccatgatgcacccagc

SEQ ID NO: 539710 - DNA, 25 bp, Mus musculus
atcaaaggaggaaccagacagagaa

SEQ ID NO: 539711 - DNA, 25 bp, Mus musculus
atcaaaggaggatccagacagagaa

SEQ ID NO: 539712 - DNA, 25 bp, Mus musculus
atcaaagggctaaatgacaggccac

SEQ ID NO: 539713 - DNA, 25 bp, Mus musculus
atcaaagggctatatgacaggccac

SEQ ID NO: 539714 - DNA, 25 bp, Mus musculus
atcaaatgggtcattggagggcctg

SEQ ID NO: 539715 - DNA, 25 bp, Mus musculus
atcaaatgggtctttggagggcctg

SEQ ID NO: 539716 - DNA, 25 bp, Mus musculus
atcaacacggatcagtgcgccagca

SEQ ID NO: 539717 - DNA, 25 bp, Mus musculus
atcaacacggatgagtgcgccagca

SEQ ID NO: 539718 - DNA, 25 bp, Mus musculus
atcaacagaatcctgcagaattccc

SEQ ID NO: 539719 - DNA, 25 bp, Mus musculus
atcaacagaatcgtgcagaattccc

SEQ ID NO: 539720 - DNA, 25 bp, Mus musculus
atcaacagggatcgcagcaataaaa

SEQ ID NO: 539721 - DNA, 25 bp, Mus musculus
atcaacagggatggcagcaataaaa

SEQ ID NO: 539722 - DNA, 25 bp, Mus musculus
atcaacccagcgctgtcttttgcaa

SEQ ID NO: 539723 - DNA, 25 bp, Mus musculus
atcaacccagcggtgtcttttgcaa

SEQ ID NO: 539724 - DNA, 25 bp, Mus musculus
atcaaccgacgcacggctgctgaga

SEQ ID NO: 539725 - DNA, 25 bp, Mus musculus
atcaaccgacgctcggctgctgaga

SEQ ID NO: 539726 - DNA, 25 bp, Mus musculus
atcaaccgccagaccaagacaggca

SEQ ID NO: 539727 - DNA, 25 bp, Mus musculus
atcaaccgccagtccaagacaggca

SEQ ID NO: 539728 - DNA, 25 bp, Mus musculus
atcaacctctccatcgcgtatgtgg

SEQ ID NO: 539729 - DNA, 25 bp, Mus musculus
atcaacctctccttcgcgtatgtgg

SEQ ID NO: 539730 - DNA, 25 bp, Mus musculus
atcaaccttgttcacaccgcgcagt

SEQ ID NO: 539731 - DNA, 25 bp, Mus musculus
atcaaccttgttgacaccgcgcagt

SEQ ID NO: 539732 - DNA, 25 bp, Mus musculus
atcaacgaggccagcggcagccgca

SEQ ID NO: 539733 - DNA, 25 bp, Mus musculus
atcaacgaggcctgcggcagccgca

SEQ ID NO: 539734 - DNA, 25 bp, Mus musculus
atcaacggacgtcgcattcttggat

SEQ ID NO: 539735 - DNA, 25 bp, Mus musculus
atcaacggacgtggcattcttggat

SEQ ID NO: 539736 - DNA, 25 bp, Mus musculus
atcaacggcggcactcatgctggaa

SEQ ID NO: 539737 - DNA, 25 bp, Mus musculus
atcaacggcggctctcatgctggaa

SEQ ID NO: 539738 - DNA, 25 bp, Mus musculus
atcaacgtccggctgaccaccatgg

SEQ ID NO: 539739 - DNA, 25 bp, Mus musculus
atcaacgtccgggtgaccaccatgg

SEQ ID NO: 539740 - DNA, 25 bp, Mus musculus
atcaacgtgctgcagaaaatcaatg

SEQ ID NO: 539741 - DNA, 25 bp, Mus musculus
atcaacgtgctggagaaaatcaatg

SEQ ID NO: 539742 - DNA, 25 bp, Mus musculus
atcaacgtggagagagatgagaagc

SEQ ID NO: 539743 - DNA, 25 bp, Mus musculus
atcaacgtggagtgagatgagaagc

SEQ ID NO: 539744 - DNA, 25 bp, Mus musculus
atcaactaaacaatccaatgcatcg

SEQ ID NO: 539745 - DNA, 25 bp, Mus musculus
atcaactaaacattccaatgcatcg

SEQ ID NO: 539746 - DNA, 25 bp, Mus musculus
atcaactgggccaagcacatcccag

SEQ ID NO: 539747 - DNA, 25 bp, Mus musculus
atcaactgggcctagcacatcccag

SEQ ID NO: 539748 - DNA, 25 bp, Mus musculus
atcaacttcggacggtctgggaaga

SEQ ID NO: 539749 - DNA, 25 bp, Mus musculus
atcaacttcggagggtctgggaaga

SEQ ID NO: 539750 - DNA, 25 bp, Mus musculus
atcaagaacttcctgcccctgctgg

SEQ ID NO: 539751 - DNA, 25 bp, Mus musculus
atcaagaacttcgtgcccctgctgg

SEQ ID NO: 539752 - DNA, 25 bp, Mus musculus
atcaagaagcccctgcccgtgggtc

SEQ ID NO: 539753 - DNA, 25 bp, Mus musculus
atcaagaagcccgtgcccgtgggtc

SEQ ID NO: 539754 - DNA, 25 bp, Mus musculus
atcaagactggtcctccctgccgtt

SEQ ID NO: 539755 - DNA, 25 bp, Mus musculus
atcaagactggtgctccctgccgtt

SEQ ID NO: 539756 - DNA, 25 bp, Mus musculus
atcaagagccgacaacaactcatag

SEQ ID NO: 539757 - DNA, 25 bp, Mus musculus
atcaagagccgagaacaactcatag

SEQ ID NO: 539758 - DNA, 25 bp, Mus musculus
atcaagaggcacaccccactgagca

SEQ ID NO: 539759 - DNA, 25 bp, Mus musculus
atcaagaggcactccccactgagca

SEQ ID NO: 539760 - DNA, 25 bp, Mus musculus
atcaagagtgaaaaacctgaagaga

SEQ ID NO: 539761 - DNA, 25 bp, Mus musculus
atcaagagtgaataacctgaagaga

SEQ ID NO: 539762 - DNA, 25 bp, Mus musculus
atcaagatcggacacccaacgggaa

SEQ ID NO: 539763 - DNA, 25 bp, Mus musculus
atcaagatcggagacccaacgggaa

SEQ ID NO: 539764 - DNA, 25 bp, Mus musculus
atcaagcagattcgcacctttgcct

SEQ ID NO: 539765 - DNA, 25 bp, Mus musculus
atcaagcagattggcacctttgcct

SEQ ID NO: 539766 - DNA, 25 bp, Mus musculus
atcaagcagttacatgaagagatca

SEQ ID NO: 539767 - DNA, 25 bp, Mus musculus
atcaagcagttagatgaagagatca

SEQ ID NO: 539768 - DNA, 25 bp, Mus musculus
atcaagcatgcaatcaagtggaggg

SEQ ID NO: 539769 - DNA, 25 bp, Mus musculus
atcaagcatgcattcaagtggaggg

SEQ ID NO: 539770 - DNA, 25 bp, Mus musculus
atcaagcccgccaacgtgttcatca

SEQ ID NO: 539771 - DNA, 25 bp, Mus musculus
atcaagcccgcctacgtgttcatca

SEQ ID NO: 539772 - DNA, 25 bp, Mus musculus
atcaagcccggcctcttcaagggca

SEQ ID NO: 539773 - DNA, 25 bp, Mus musculus
atcaagcccggcgtcttcaagggca

SEQ ID NO: 539774 - DNA, 25 bp, Mus musculus
atcaagcctgtgctcttggctccag

SEQ ID NO: 539775 - DNA, 25 bp, Mus musculus
atcaagcctgtggtcttggctccag

SEQ ID NO: 539776 - DNA, 25 bp, Mus musculus
atcaagcgcatcattcacaccgtca

SEQ ID NO: 539777 - DNA, 25 bp, Mus musculus
atcaagcgcatctttcacaccgtca

SEQ ID NO: 539778 - DNA, 25 bp, Mus musculus
atcaagctccctacttcgaataaga

SEQ ID NO: 539779 - DNA, 25 bp, Mus musculus
atcaagctcccttcttcgaataaga

SEQ ID NO: 539780 - DNA, 25 bp, Mus musculus
atcaagcttgggacgtcgggcccgt

SEQ ID NO: 539781 - DNA, 25 bp, Mus musculus
atcaagcttgggtcgtcgggcccgt

SEQ ID NO: 539782 - DNA, 25 bp, Mus musculus
atcaaggacagccaggccctccagg

SEQ ID NO: 539783 - DNA, 25 bp, Mus musculus
atcaaggacagcgaggccctccagg

SEQ ID NO: 539784 - DNA, 25 bp, Mus musculus
atcaaggagtctccaaaccacccag

SEQ ID NO: 539785 - DNA, 25 bp, Mus musculus
atcaaggagtctgcaaaccacccag

SEQ ID NO: 539786 - DNA, 25 bp, Mus musculus
atcaaggccaagcatgacagtgacc

SEQ ID NO: 539787 - DNA, 25 bp, Mus musculus
atcaaggccaaggatgacagtgacc

SEQ ID NO: 539788 - DNA, 25 bp, Mus musculus
atcaaggcggcgactgagctctaca

SEQ ID NO: 539789 - DNA, 25 bp, Mus musculus
atcaaggcggcgtctgagctctaca

SEQ ID NO: 539790 - DNA, 25 bp, Mus musculus
atcaaggtggagagttgttgtctct

SEQ ID NO: 539791 - DNA, 25 bp, Mus musculus
atcaaggtggagtgttgttgtctct

SEQ ID NO: 539792 - DNA, 25 bp, Mus musculus
atcaaggtggatcggactggagctg

SEQ ID NO: 539793 - DNA, 25 bp, Mus musculus
atcaaggtggatgggactggagctg

SEQ ID NO: 539794 - DNA, 25 bp, Mus musculus
atcaagtccactatcctcgccgtgg

SEQ ID NO: 539795 - DNA, 25 bp, Mus musculus
atcaagtccactttcctcgccgtgg

SEQ ID NO: 539796 - DNA, 25 bp, Mus musculus
atcaagtccgagctccccctggtag

SEQ ID NO: 539797 - DNA, 25 bp, Mus musculus
atcaagtccgaggtccccctggtag

SEQ ID NO: 539798 - DNA, 25 bp, Mus musculus
atcaagtctgtcatcggccacctgc

SEQ ID NO: 539799 - DNA, 25 bp, Mus musculus
atcaagtctgtcttcggccacctgc

SEQ ID NO: 539800 - DNA, 25 bp, Mus musculus
atcaagtcttgtacgctggcccggg

SEQ ID NO: 539801 - DNA, 25 bp, Mus musculus
atcaagtcttgttcgctggcccggg

SEQ ID NO: 539802 - DNA, 25 bp, Mus musculus
atcaagtgacaaaatcatggtgcag

SEQ ID NO: 539803 - DNA, 25 bp, Mus musculus
atcaagtgacaatatcatggtgcag

SEQ ID NO: 539804 - DNA, 25 bp, Mus musculus
atcaagttcagcacttccttggaac

SEQ ID NO: 539805 - DNA, 25 bp, Mus musculus
atcaagttcagctcttccttggaac

SEQ ID NO: 539806 - DNA, 25 bp, Mus musculus
atcaataggcgaacgcggagcgcga

SEQ ID NO: 539807 - DNA, 25 bp, Mus musculus
atcaataggcgatcgcggagcgcga

SEQ ID NO: 539808 - DNA, 25 bp, Mus musculus
atcaatatctgcaccaatgatgggc

SEQ ID NO: 539809 - DNA, 25 bp, Mus musculus
atcaatatctgctccaatgatgggc

SEQ ID NO: 539810 - DNA, 25 bp, Mus musculus
atcaatccaagacccttttcaactg

SEQ ID NO: 539811 - DNA, 25 bp, Mus musculus
atcaatccaagagccttttcaactg

SEQ ID NO: 539812 - DNA, 25 bp, Mus musculus
atcaatcctgccctacctgtggagg

SEQ ID NO: 539813 - DNA, 25 bp, Mus musculus
atcaatcctgccgtacctgtggagg

SEQ ID NO: 539814 - DNA, 25 bp, Mus musculus
atcaatctaaggcagattcaggagg

SEQ ID NO: 539815 - DNA, 25 bp, Mus musculus
atcaatctaagggagattcaggagg

SEQ ID NO: 539816 - DNA, 25 bp, Mus musculus
atcaatctgcagagttaattattcc

SEQ ID NO: 539817 - DNA, 25 bp, Mus musculus
atcaatctgcagtgttaattattcc

SEQ ID NO: 539818 - DNA, 25 bp, Mus musculus
atcaatgacttgcagaacttgggtg

SEQ ID NO: 539819 - DNA, 25 bp, Mus musculus
atcaatgacttggagaacttgggtg

SEQ ID NO: 539820 - DNA, 25 bp, Mus musculus
atcaatgagctcagccaggtaccgc

SEQ ID NO: 539821 - DNA, 25 bp, Mus musculus
atcaatgagctctgccaggtaccgc

SEQ ID NO: 539822 - DNA, 25 bp, Mus musculus
atcaatgagtatctggaaagagtgc

SEQ ID NO: 539823 - DNA, 25 bp, Mus musculus
atcaatgagtatgtggaaagagtgc

SEQ ID NO: 539824 - DNA, 25 bp, Mus musculus
atcaatgcccgtcaggtagctccca

SEQ ID NO: 539825 - DNA, 25 bp, Mus musculus
atcaatgcccgtgaggtagctccca

SEQ ID NO: 539826 - DNA, 25 bp, Mus musculus
atcaatgtcagcaccagccacgaag

SEQ ID NO: 539827 - DNA, 25 bp, Mus musculus
atcaatgtcagctccagccacgaag

SEQ ID NO: 539828 - DNA, 25 bp, Mus musculus
atcaattcctcaatgactagaaccc

SEQ ID NO: 539829 - DNA, 25 bp, Mus musculus
atcaattcctcattgactagaaccc

SEQ ID NO: 539830 - DNA, 25 bp, Mus musculus
atcacaagtactcggcaaattgtca

SEQ ID NO: 539831 - DNA, 25 bp, Mus musculus
atcacaagtactgggcaaattgtca

SEQ ID NO: 539832 - DNA, 25 bp, Mus musculus
atcacaatccatcagtctggccaga

SEQ ID NO: 539833 - DNA, 25 bp, Mus musculus
atcacaatccatgagtctggccaga

SEQ ID NO: 539834 - DNA, 25 bp, Mus musculus
atcacaccgctgaatctgacccagt

SEQ ID NO: 539835 - DNA, 25 bp, Mus musculus
atcacaccgctgtatctgacccagt

SEQ ID NO: 539836 - DNA, 25 bp, Mus musculus
atcacagaagcgctaacgagcagca

SEQ ID NO: 539837 - DNA, 25 bp, Mus musculus
atcacagaagcggtaacgagcagca

SEQ ID NO: 539838 - DNA, 25 bp, Mus musculus
atcacagacctgagacggaccctgc

SEQ ID NO: 539839 - DNA, 25 bp, Mus musculus
atcacagacctgtgacggaccctgc

SEQ ID NO: 539840 - DNA, 25 bp, Mus musculus
atcacagatgccagcggtcacagag

SEQ ID NO: 539841 - DNA, 25 bp, Mus musculus
atcacagatgcctgcggtcacagag

SEQ ID NO: 539842 - DNA, 25 bp, Mus musculus
atcacagcggcgaccgctcctgttg

SEQ ID NO: 539843 - DNA, 25 bp, Mus musculus
atcacagcggcgtccgctcctgttg

SEQ ID NO: 539844 - DNA, 25 bp, Mus musculus
atcacaggccgaagactgcggtgga

SEQ ID NO: 539845 - DNA, 25 bp, Mus musculus
atcacaggccgatgactgcggtgga

SEQ ID NO: 539846 - DNA, 25 bp, Mus musculus
atcacagggaaaagggagaaaccct

SEQ ID NO: 539847 - DNA, 25 bp, Mus musculus
atcacagggaaatgggagaaaccct

SEQ ID NO: 539848 - DNA, 25 bp, Mus musculus
atcacaggtccccagggaacgctca

SEQ ID NO: 539849 - DNA, 25 bp, Mus musculus
atcacaggtcccgagggaacgctca

SEQ ID NO: 539850 - DNA, 25 bp, Mus musculus
atcacaggtgtgacttgccgggacg

SEQ ID NO: 539851 - DNA, 25 bp, Mus musculus
atcacaggtgtgtcttgccgggacg

SEQ ID NO: 539852 - DNA, 25 bp, Mus musculus
atcacatctggaagcggagctggag

SEQ ID NO: 539853 - DNA, 25 bp, Mus musculus
atcacatctggatgcggagctggag

SEQ ID NO: 539854 - DNA, 25 bp, Mus musculus
atcacatgaaagcattaagggctcc

SEQ ID NO: 539855 - DNA, 25 bp, Mus musculus
atcacatgaaaggattaagggctcc

SEQ ID NO: 539856 - DNA, 25 bp, Mus musculus
atcacatttgacaataaagcgcaca

SEQ ID NO: 539857 - DNA, 25 bp, Mus musculus
atcacatttgactataaagcgcaca

SEQ ID NO: 539858 - DNA, 25 bp, Mus musculus
atcaccaaacggaggcgcaagtcct

SEQ ID NO: 539859 - DNA, 25 bp, Mus musculus
atcaccaaacggtggcgcaagtcct

SEQ ID NO: 539860 - DNA, 25 bp, Mus musculus
atcaccaagaagcatcagtatgaga

SEQ ID NO: 539861 - DNA, 25 bp, Mus musculus
atcaccaagaaggatcagtatgaga

SEQ ID NO: 539862 - DNA, 25 bp, Mus musculus
atcaccaagcctcctgacggcagtg

SEQ ID NO: 539863 - DNA, 25 bp, Mus musculus
atcaccaagcctgctgacggcagtg

SEQ ID NO: 539864 - DNA, 25 bp, Mus musculus
atcaccaagtgtctcttcgttggcc

SEQ ID NO: 539865 - DNA, 25 bp, Mus musculus
atcaccaagtgtgtcttcgttggcc

SEQ ID NO: 539866 - DNA, 25 bp, Mus musculus
atcaccaatgatcaggcctatgcag

SEQ ID NO: 539867 - DNA, 25 bp, Mus musculus
atcaccaatgatgaggcctatgcag

SEQ ID NO: 539868 - DNA, 25 bp, Mus musculus
atcaccacaggaagtccggtgggag

SEQ ID NO: 539869 - DNA, 25 bp, Mus musculus
atcaccacaggatgtccggtgggag

SEQ ID NO: 539870 - DNA, 25 bp, Mus musculus
atcaccacccgcactggaaaggtct

SEQ ID NO: 539871 - DNA, 25 bp, Mus musculus
atcaccacccgctctggaaaggtct

SEQ ID NO: 539872 - DNA, 25 bp, Mus musculus
atcaccaccgtgagagtggcagccg

SEQ ID NO: 539873 - DNA, 25 bp, Mus musculus
atcaccaccgtgtgagtggcagccg

SEQ ID NO: 539874 - DNA, 25 bp, Mus musculus
atcaccagcaaaagtaaggagtcta

SEQ ID NO: 539875 - DNA, 25 bp, Mus musculus
atcaccagcaaatgtaaggagtcta

SEQ ID NO: 539876 - DNA, 25 bp, Mus musculus
atcaccagtcaccaacgggaccagt

SEQ ID NO: 539877 - DNA, 25 bp, Mus musculus
atcaccagtcacgaacgggaccagt

SEQ ID NO: 539878 - DNA, 25 bp, Mus musculus
atcaccatgctgacccagggcgtgt

SEQ ID NO: 539879 - DNA, 25 bp, Mus musculus
atcaccatgctgtcccagggcgtgt

SEQ ID NO: 539880 - DNA, 25 bp, Mus musculus
atcaccctcgagaaccccgacatca

SEQ ID NO: 539881 - DNA, 25 bp, Mus musculus
atcaccctcgagtaccccgacatca

SEQ ID NO: 539882 - DNA, 25 bp, Mus musculus
atcacccttactcgacaacggctgg

SEQ ID NO: 539883 - DNA, 25 bp, Mus musculus
atcacccttactggacaacggctgg

SEQ ID NO: 539884 - DNA, 25 bp, Mus musculus
atcaccgaaggtcggtgccggatcc

SEQ ID NO: 539885 - DNA, 25 bp, Mus musculus
atcaccgaaggtgggtgccggatcc

SEQ ID NO: 539886 - DNA, 25 bp, Mus musculus
atcaccgaggagaagccgctgttgc

SEQ ID NO: 539887 - DNA, 25 bp, Mus musculus
atcaccgaggagtagccgctgttgc

SEQ ID NO: 539888 - DNA, 25 bp, Mus musculus
atcacctcagagaccttatcaaaag

SEQ ID NO: 539889 - DNA, 25 bp, Mus musculus
atcacctcagagtccttatcaaaag

SEQ ID NO: 539890 - DNA, 25 bp, Mus musculus
atcacgaagatgatgggcgccgagt

SEQ ID NO: 539891 - DNA, 25 bp, Mus musculus
atcacgaagatgttgggcgccgagt

SEQ ID NO: 539892 - DNA, 25 bp, Mus musculus
atcacgcgcatgcagtacgtgcaca

SEQ ID NO: 539893 - DNA, 25 bp, Mus musculus
atcacgcgcatggagtacgtgcaca

SEQ ID NO: 539894 - DNA, 25 bp, Mus musculus
atcacgctgcacaggttcctcacgg

SEQ ID NO: 539895 - DNA, 25 bp, Mus musculus
atcacgctgcactggttcctcacgg

SEQ ID NO: 539896 - DNA, 25 bp, Mus musculus
atcacggaaacacagtgcacactgg

SEQ ID NO: 539897 - DNA, 25 bp, Mus musculus
atcacggaaacagagtgcacactgg

SEQ ID NO: 539898 - DNA, 25 bp, Mus musculus
atcacggaagccagtgtgggatcct

SEQ ID NO: 539899 - DNA, 25 bp, Mus musculus
atcacggaagcctgtgtgggatcct

SEQ ID NO: 539900 - DNA, 25 bp, Mus musculus
atcacggaggcccatgagagcttca

SEQ ID NO: 539901 - DNA, 25 bp, Mus musculus
atcacggaggccgatgagagcttca

SEQ ID NO: 539902 - DNA, 25 bp, Mus musculus
atcacggtccgcatctccaaagaga

SEQ ID NO: 539903 - DNA, 25 bp, Mus musculus
atcacggtccgcttctccaaagaga

SEQ ID NO: 539904 - DNA, 25 bp, Mus musculus
atcacgtcctcaacgggtagccgag

SEQ ID NO: 539905 - DNA, 25 bp, Mus musculus
atcacgtcctcatcgggtagccgag

SEQ ID NO: 539906 - DNA, 25 bp, Mus musculus
atcacgtggtcgatcggtgctaggt

SEQ ID NO: 539907 - DNA, 25 bp, Mus musculus
atcacgtggtcgttcggtgctaggt

SEQ ID NO: 539908 - DNA, 25 bp, Mus musculus
atcacgttatctcccgctgcgggct

SEQ ID NO: 539909 - DNA, 25 bp, Mus musculus
atcacgttatctgccgctgcgggct

SEQ ID NO: 539910 - DNA, 25 bp, Mus musculus
atcacgtttgtgaccacgggagtgg

SEQ ID NO: 539911 - DNA, 25 bp, Mus musculus
atcacgtttgtgtccacgggagtgg

SEQ ID NO: 539912 - DNA, 25 bp, Mus musculus
atcactactgccacctcgatgagag

SEQ ID NO: 539913 - DNA, 25 bp, Mus musculus
atcactactgcctcctcgatgagag

SEQ ID NO: 539914 - DNA, 25 bp, Mus musculus
atcactcagatgaatcacacactcc

SEQ ID NO: 539915 - DNA, 25 bp, Mus musculus
atcactcagatgtatcacacactcc

SEQ ID NO: 539916 - DNA, 25 bp, Mus musculus
atcactcagctgcaggccgagatca

SEQ ID NO: 539917 - DNA, 25 bp, Mus musculus
atcactcagctggaggccgagatca

SEQ ID NO: 539918 - DNA, 25 bp, Mus musculus
atcactctgcgtcgctggtggtgct

SEQ ID NO: 539919 - DNA, 25 bp, Mus musculus
atcactctgcgtggctggtggtgct

SEQ ID NO: 539920 - DNA, 25 bp, Mus musculus
atcactctggaacgatggacgacag

SEQ ID NO: 539921 - DNA, 25 bp, Mus musculus
atcactctggaaggatggacgacag

SEQ ID NO: 539922 - DNA, 25 bp, Mus musculus
atcactgaaggtaccccagaattta

SEQ ID NO: 539923 - DNA, 25 bp, Mus musculus
atcactgaaggttccccagaattta

SEQ ID NO: 539924 - DNA, 25 bp, Mus musculus
atcactgaatacataggttacctat

SEQ ID NO: 539925 - DNA, 25 bp, Mus musculus
atcactgaatacttaggttacctat

SEQ ID NO: 539926 - DNA, 25 bp, Mus musculus
atcactgagcagatttgtggattca

SEQ ID NO: 539927 - DNA, 25 bp, Mus musculus
atcactgagcagttttgtggattca

SEQ ID NO: 539928 - DNA, 25 bp, Mus musculus
atcactgccgacccaggtacagctt

SEQ ID NO: 539929 - DNA, 25 bp, Mus musculus
atcactgccgacgcaggtacagctt

SEQ ID NO: 539930 - DNA, 25 bp, Mus musculus
atcactgggtacaaagtaacctttg

SEQ ID NO: 539931 - DNA, 25 bp, Mus musculus
atcactgggtactaagtaacctttg

SEQ ID NO: 539932 - DNA, 25 bp, Mus musculus
atcactgtgtcccttcgggcagcag

SEQ ID NO: 539933 - DNA, 25 bp, Mus musculus
atcactgtgtccgttcgggcagcag

SEQ ID NO: 539934 - DNA, 25 bp, Mus musculus
atcacttgcctgactggagtcctgg

SEQ ID NO: 539935 - DNA, 25 bp, Mus musculus
atcacttgcctgtctggagtcctgg

SEQ ID NO: 539936 - DNA, 25 bp, Mus musculus
atcacttggacgaatgcccacacag

SEQ ID NO: 539937 - DNA, 25 bp, Mus musculus
atcacttggacgtatgcccacacag

SEQ ID NO: 539938 - DNA, 25 bp, Mus musculus
atcagaaagcttaaccacccgccag

SEQ ID NO: 539939 - DNA, 25 bp, Mus musculus
atcagaaagctttaccacccgccag

SEQ ID NO: 539940 - DNA, 25 bp, Mus musculus
atcagaaaggatcaagtctagcccc

SEQ ID NO: 539941 - DNA, 25 bp, Mus musculus
atcagaaaggatgaagtctagcccc

SEQ ID NO: 539942 - DNA, 25 bp, Mus musculus
atcagaacgtgactgcacccctgcg

SEQ ID NO: 539943 - DNA, 25 bp, Mus musculus
atcagaacgtgagtgcacccctgcg

SEQ ID NO: 539944 - DNA, 25 bp, Mus musculus
atcagaagtactcccagatcagaag

SEQ ID NO: 539945 - DNA, 25 bp, Mus musculus
atcagaagtactgccagatcagaag

SEQ ID NO: 539946 - DNA, 25 bp, Mus musculus
atcagaagtgttcagtgcctgccag

SEQ ID NO: 539947 - DNA, 25 bp, Mus musculus
atcagaagtgttgagtgcctgccag

SEQ ID NO: 539948 - DNA, 25 bp, Mus musculus
atcagaatgagtatgagtcccgcag

SEQ ID NO: 539949 - DNA, 25 bp, Mus musculus
atcagaatgagtttgagtcccgcag

SEQ ID NO: 539950 - DNA, 25 bp, Mus musculus
atcagaccctggctgactgtgctgg

SEQ ID NO: 539951 - DNA, 25 bp, Mus musculus
atcagaccctgggtgactgtgctgg

SEQ ID NO: 539952 - DNA, 25 bp, Mus musculus
atcagacgccacagggcttgatgcc

SEQ ID NO: 539953 - DNA, 25 bp, Mus musculus
atcagacgccactgggcttgatgcc

SEQ ID NO: 539954 - DNA, 25 bp, Mus musculus
atcagagctctcctgttcttttgga

SEQ ID NO: 539955 - DNA, 25 bp, Mus musculus
atcagagctctcgtgttcttttgga

SEQ ID NO: 539956 - DNA, 25 bp, Mus musculus
atcagaggagtcaaccaccacaaca

SEQ ID NO: 539957 - DNA, 25 bp, Mus musculus
atcagaggagtctaccaccacaaca

SEQ ID NO: 539958 - DNA, 25 bp, Mus musculus
atcagagtcgtactgaaaggcatgg

SEQ ID NO: 539959 - DNA, 25 bp, Mus musculus
atcagagtcgtagtgaaaggcatgg

SEQ ID NO: 539960 - DNA, 25 bp, Mus musculus
atcagataccggcaggatgacgacc

SEQ ID NO: 539961 - DNA, 25 bp, Mus musculus
atcagataccgggaggatgacgacc

SEQ ID NO: 539962 - DNA, 25 bp, Mus musculus
atcagatcctaactgtgctgctgac

SEQ ID NO: 539963 - DNA, 25 bp, Mus musculus
atcagatcctaagtgtgctgctgac

SEQ ID NO: 539964 - DNA, 25 bp, Mus musculus
atcagatctgataggcccacctgga

SEQ ID NO: 539965 - DNA, 25 bp, Mus musculus
atcagatctgattggcccacctgga

SEQ ID NO: 539966 - DNA, 25 bp, Mus musculus
atcagatgaagccacggcagctcat

SEQ ID NO: 539967 - DNA, 25 bp, Mus musculus
atcagatgaagcgacggcagctcat

SEQ ID NO: 539968 - DNA, 25 bp, Mus musculus
atcagatgtgcgacaggcgttcggt

SEQ ID NO: 539969 - DNA, 25 bp, Mus musculus
atcagatgtgcgtcaggcgttcggt

SEQ ID NO: 539970 - DNA, 25 bp, Mus musculus
atcagattagtcagccaggatggga

SEQ ID NO: 539971 - DNA, 25 bp, Mus musculus
atcagattagtctgccaggatggga

SEQ ID NO: 539972 - DNA, 25 bp, Mus musculus
atcagattgtgtagagattctcaag

SEQ ID NO: 539973 - DNA, 25 bp, Mus musculus
atcagattgtgttgagattctcaag

SEQ ID NO: 539974 - DNA, 25 bp, Mus musculus
atcagcaacagcagtatggctctgg

SEQ ID NO: 539975 - DNA, 25 bp, Mus musculus
atcagcaacagctgtatggctctgg

SEQ ID NO: 539976 - DNA, 25 bp, Mus musculus
atcagcaaccgcaggaagctggcca

SEQ ID NO: 539977 - DNA, 25 bp, Mus musculus
atcagcaaccgctggaagctggcca

SEQ ID NO: 539978 - DNA, 25 bp, Mus musculus
atcagcaacggtcgacatccaggtg

SEQ ID NO: 539979 - DNA, 25 bp, Mus musculus
atcagcaacggtggacatccaggtg

SEQ ID NO: 539980 - DNA, 25 bp, Mus musculus
atcagcacaagcagaggcggctcaa

SEQ ID NO: 539981 - DNA, 25 bp, Mus musculus
atcagcacaagctgaggcggctcaa

SEQ ID NO: 539982 - DNA, 25 bp, Mus musculus
atcagcacccttccagcagtaggga

SEQ ID NO: 539983 - DNA, 25 bp, Mus musculus
atcagcacccttgcagcagtaggga

SEQ ID NO: 539984 - DNA, 25 bp, Mus musculus
atcagcagcgaacccagcaggtgga

SEQ ID NO: 539985 - DNA, 25 bp, Mus musculus
atcagcagcgaagccagcaggtgga

SEQ ID NO: 539986 - DNA, 25 bp, Mus musculus
atcagcagcgtcaaccgtctcctgg

SEQ ID NO: 539987 - DNA, 25 bp, Mus musculus
atcagcagcgtctaccgtctcctgg

SEQ ID NO: 539988 - DNA, 25 bp, Mus musculus
atcagcaggctcacattgagcagag

SEQ ID NO: 539989 - DNA, 25 bp, Mus musculus
atcagcaggctctcattgagcagag

SEQ ID NO: 539990 - DNA, 25 bp, Mus musculus
atcagcagtgttaccaatgtgaacc

SEQ ID NO: 539991 - DNA, 25 bp, Mus musculus
atcagcagtgtttccaatgtgaacc

SEQ ID NO: 539992 - DNA, 25 bp, Mus musculus
atcagcatcaacaagcggcacacgg

SEQ ID NO: 539993 - DNA, 25 bp, Mus musculus
atcagcatcaactagcggcacacgg

SEQ ID NO: 539994 - DNA, 25 bp, Mus musculus
atcagccacgctcctgaccttgttg

SEQ ID NO: 539995 - DNA, 25 bp, Mus musculus
atcagccacgctgctgaccttgttg

SEQ ID NO: 539996 - DNA, 25 bp, Mus musculus
atcagccgcagccttgctgctgtgg

SEQ ID NO: 539997 - DNA, 25 bp, Mus musculus
atcagccgcagcgttgctgctgtgg

SEQ ID NO: 539998 - DNA, 25 bp, Mus musculus
atcagccgctacagatccctggagg

SEQ ID NO: 539999 - DNA, 25 bp, Mus musculus
atcagccgctactgatccctggagg

SEQ ID NO: 540000 - DNA, 25 bp, Mus musculus
atcagcctaggtcacggagactcca

SEQ ID NO: 540001 - DNA, 25 bp, Mus musculus
atcagcctaggtgacggagactcca

SEQ ID NO: 540002 - DNA, 25 bp, Mus musculus
atcagcctccagctcatcttctgtg

SEQ ID NO: 540003 - DNA, 25 bp, Mus musculus
atcagcctccaggtcatcttctgtg

SEQ ID NO: 540004 - DNA, 25 bp, Mus musculus
atcagcctcgggagccctgaggacg

SEQ ID NO: 540005 - DNA, 25 bp, Mus musculus
atcagcctcgggtgccctgaggacg

SEQ ID NO: 540006 - DNA, 25 bp, Mus musculus
atcagcctggaccatcgctgccgaa

SEQ ID NO: 540007 - DNA, 25 bp, Mus musculus
atcagcctggacgatcgctgccgaa

SEQ ID NO: 540008 - DNA, 25 bp, Mus musculus
atcagcgcaagaagctggccgccat

SEQ ID NO: 540009 - DNA, 25 bp, Mus musculus
atcagcgcaagatgctggccgccat

SEQ ID NO: 540010 - DNA, 25 bp, Mus musculus
atcagcgcccataacatccccaatg

SEQ ID NO: 540011 - DNA, 25 bp, Mus musculus
atcagcgcccattacatccccaatg

SEQ ID NO: 540012 - DNA, 25 bp, Mus musculus
atcagcggcctccaacgagtagcga

SEQ ID NO: 540013 - DNA, 25 bp, Mus musculus
atcagcggcctcgaacgagtagcga

SEQ ID NO: 540014 - DNA, 25 bp, Mus musculus
atcagcggcggcaccggctacgttc

SEQ ID NO: 540015 - DNA, 25 bp, Mus musculus
atcagcggcggctccggctacgttc

SEQ ID NO: 540016 - DNA, 25 bp, Mus musculus
atcagcggctggaggagttcatgac

SEQ ID NO: 540017 - DNA, 25 bp, Mus musculus
atcagcggctggtggagttcatgac

SEQ ID NO: 540018 - DNA, 25 bp, Mus musculus
atcagcgggtgccttccgaaagacg

SEQ ID NO: 540019 - DNA, 25 bp, Mus musculus
atcagcgggtgcgttccgaaagacg

SEQ ID NO: 540020 - DNA, 25 bp, Mus musculus
atcagcggtaccagaccacctacaa

SEQ ID NO: 540021 - DNA, 25 bp, Mus musculus
atcagcggtacctgaccacctacaa

SEQ ID NO: 540022 - DNA, 25 bp, Mus musculus
atcagcgtgttaccattccccaatg

SEQ ID NO: 540023 - DNA, 25 bp, Mus musculus
atcagcgtgttagcattccccaatg

SEQ ID NO: 540024 - DNA, 25 bp, Mus musculus
atcagctctgggacgtggagtctca

SEQ ID NO: 540025 - DNA, 25 bp, Mus musculus
atcagctctgggtcgtggagtctca

SEQ ID NO: 540026 - DNA, 25 bp, Mus musculus
atcagctgtgcgagattccacaaag

SEQ ID NO: 540027 - DNA, 25 bp, Mus musculus
atcagctgtgcgtgattccacaaag

SEQ ID NO: 540028 - DNA, 25 bp, Mus musculus
atcagctgttccaggcacatcattg

SEQ ID NO: 540029 - DNA, 25 bp, Mus musculus
atcagctgttcctggcacatcattg

SEQ ID NO: 540030 - DNA, 25 bp, Mus musculus
atcaggaagcagagtccacgcgctg

SEQ ID NO: 540031 - DNA, 25 bp, Mus musculus
atcaggaagcagtgtccacgcgctg

SEQ ID NO: 540032 - DNA, 25 bp, Mus musculus
atcaggaaggacacgtggagcactg

SEQ ID NO: 540033 - DNA, 25 bp, Mus musculus
atcaggaaggactcgtggagcactg

SEQ ID NO: 540034 - DNA, 25 bp, Mus musculus
atcaggagggtcctgcgcccgctac

SEQ ID NO: 540035 - DNA, 25 bp, Mus musculus
atcaggagggtcgtgcgcccgctac

SEQ ID NO: 540036 - DNA, 25 bp, Mus musculus
atcaggaggtgccatcgcttgctgt

SEQ ID NO: 540037 - DNA, 25 bp, Mus musculus
atcaggaggtgcgatcgcttgctgt

SEQ ID NO: 540038 - DNA, 25 bp, Mus musculus
atcaggatacgtccatccagcccag

SEQ ID NO: 540039 - DNA, 25 bp, Mus musculus
atcaggatacgtgcatccagcccag

SEQ ID NO: 540040 - DNA, 25 bp, Mus musculus
atcaggatctgaacggagcccggag

SEQ ID NO: 540041 - DNA, 25 bp, Mus musculus
atcaggatctgatcggagcccggag

SEQ ID NO: 540042 - DNA, 25 bp, Mus musculus
atcaggccaaggagctgatgtgtgt

SEQ ID NO: 540043 - DNA, 25 bp, Mus musculus
atcaggccaaggtgctgatgtgtgt

SEQ ID NO: 540044 - DNA, 25 bp, Mus musculus
atcagggctggtccccatgtatgtg

SEQ ID NO: 540045 - DNA, 25 bp, Mus musculus
atcagggctggtgcccatgtatgtg

SEQ ID NO: 540046 - DNA, 25 bp, Mus musculus
atcagggtggcaaggctgcccctgc

SEQ ID NO: 540047 - DNA, 25 bp, Mus musculus
atcagggtggcatggctgcccctgc

SEQ ID NO: 540048 - DNA, 25 bp, Mus musculus
atcaggtgcctgcatcccactacag

SEQ ID NO: 540049 - DNA, 25 bp, Mus musculus
atcaggtgcctggatcccactacag

SEQ ID NO: 540050 - DNA, 25 bp, Mus musculus
atcaggtgttttcagtgtgactgag

SEQ ID NO: 540051 - DNA, 25 bp, Mus musculus
atcaggtgttttgagtgtgactgag

SEQ ID NO: 540052 - DNA, 25 bp, Mus musculus
atcagtacctggatcacggcagcag

SEQ ID NO: 540053 - DNA, 25 bp, Mus musculus
atcagtacctggttcacggcagcag

SEQ ID NO: 540054 - DNA, 25 bp, Mus musculus
atcagtacgaccaggtgatgccagg

SEQ ID NO: 540055 - DNA, 25 bp, Mus musculus
atcagtacgacctggtgatgccagg

SEQ ID NO: 540056 - DNA, 25 bp, Mus musculus
atcagtagcacccagcagtgaggct

SEQ ID NO: 540057 - DNA, 25 bp, Mus musculus
atcagtagcaccgagcagtgaggct

SEQ ID NO: 540058 - DNA, 25 bp, Mus musculus
atcagtatcagacagaggatgagct

SEQ ID NO: 540059 - DNA, 25 bp, Mus musculus
atcagtatcagagagaggatgagct

SEQ ID NO: 540060 - DNA, 25 bp, Mus musculus
atcagtatgtgtaggcactgaaggg

SEQ ID NO: 540061 - DNA, 25 bp, Mus musculus
atcagtatgtgttggcactgaaggg

SEQ ID NO: 540062 - DNA, 25 bp, Mus musculus
atcagtcatgaccaagagaggccgg

SEQ ID NO: 540063 - DNA, 25 bp, Mus musculus
atcagtcatgacgaagagaggccgg

SEQ ID NO: 540064 - DNA, 25 bp, Mus musculus
atcagtccccaacccggacaagtgg

SEQ ID NO: 540065 - DNA, 25 bp, Mus musculus
atcagtccccaagccggacaagtgg

SEQ ID NO: 540066 - DNA, 25 bp, Mus musculus
atcagtcctcagctattggctggac

SEQ ID NO: 540067 - DNA, 25 bp, Mus musculus
atcagtcctcaggtattggctggac

SEQ ID NO: 540068 - DNA, 25 bp, Mus musculus
atcagtctcacactggccaagtgct

SEQ ID NO: 540069 - DNA, 25 bp, Mus musculus
atcagtctcacagtggccaagtgct

SEQ ID NO: 540070 - DNA, 25 bp, Mus musculus
atcagtgacgagcagaagacccttc

SEQ ID NO: 540071 - DNA, 25 bp, Mus musculus
atcagtgacgaggagaagacccttc

SEQ ID NO: 540072 - DNA, 25 bp, Mus musculus
atcagtgcttcgagagcttctttga

SEQ ID NO: 540073 - DNA, 25 bp, Mus musculus
atcagtgcttcgtgagcttctttga

SEQ ID NO: 540074 - DNA, 25 bp, Mus musculus
atcagtgggaccactcagaactcag

SEQ ID NO: 540075 - DNA, 25 bp, Mus musculus
atcagtgggacctctcagaactcag

SEQ ID NO: 540076 - DNA, 25 bp, Mus musculus
atcagttccccaaggttcttgccgg

SEQ ID NO: 540077 - DNA, 25 bp, Mus musculus
atcagttccccatggttcttgccgg

SEQ ID NO: 540078 - DNA, 25 bp, Mus musculus
atcagttccctcagggaccccaaga

SEQ ID NO: 540079 - DNA, 25 bp, Mus musculus
atcagttccctctgggaccccaaga

SEQ ID NO: 540080 - DNA, 25 bp, Mus musculus
atcagtttcataagctcagtgttct

SEQ ID NO: 540081 - DNA, 25 bp, Mus musculus
atcagtttcatatgctcagtgttct

SEQ ID NO: 540082 - DNA, 25 bp, Mus musculus
atcagtttccatatgtaatccaagg

SEQ ID NO: 540083 - DNA, 25 bp, Mus musculus
atcagtttccatttgtaatccaagg

SEQ ID NO: 540084 - DNA, 25 bp, Mus musculus
atcagtttgatacaatcaagaccct

SEQ ID NO: 540085 - DNA, 25 bp, Mus musculus
atcagtttgatagaatcaagaccct

SEQ ID NO: 540086 - DNA, 25 bp, Mus musculus
atcatacaccctcgtacatggctga

SEQ ID NO: 540087 - DNA, 25 bp, Mus musculus
atcatacaccctggtacatggctga

SEQ ID NO: 540088 - DNA, 25 bp, Mus musculus
atcatagtgaaaaagaacggcggcg

SEQ ID NO: 540089 - DNA, 25 bp, Mus musculus
atcatagtgaaatagaacggcggcg

SEQ ID NO: 540090 - DNA, 25 bp, Mus musculus
atcatcaagcgacccgccctggagt

SEQ ID NO: 540091 - DNA, 25 bp, Mus musculus
atcatcaagcgagccgccctggagt

SEQ ID NO: 540092 - DNA, 25 bp, Mus musculus
atcatcactcagatgctgcagtatc

SEQ ID NO: 540093 - DNA, 25 bp, Mus musculus
atcatcactcagttgctgcagtatc

SEQ ID NO: 540094 - DNA, 25 bp, Mus musculus
atcatcagccgcatgaggccggagg

SEQ ID NO: 540095 - DNA, 25 bp, Mus musculus
atcatcagccgcttgaggccggagg

SEQ ID NO: 540096 - DNA, 25 bp, Mus musculus
atcatcaggatcattgagaaaaccc

SEQ ID NO: 540097 - DNA, 25 bp, Mus musculus
atcatcaggatctttgagaaaaccc

SEQ ID NO: 540098 - DNA, 25 bp, Mus musculus
atcatcatcttgctcacagctggac

SEQ ID NO: 540099 - DNA, 25 bp, Mus musculus
atcatcatcttggtcacagctggac

SEQ ID NO: 540100 - DNA, 25 bp, Mus musculus
atcatcattggcctgagcgtagttg

SEQ ID NO: 540101 - DNA, 25 bp, Mus musculus
atcatcattggcgtgagcgtagttg

SEQ ID NO: 540102 - DNA, 25 bp, Mus musculus
atcatccactgaagtgtgcaggccc

SEQ ID NO: 540103 - DNA, 25 bp, Mus musculus
atcatccactgatgtgtgcaggccc

SEQ ID NO: 540104 - DNA, 25 bp, Mus musculus
atcatccagcagacttggaacagga

SEQ ID NO: 540105 - DNA, 25 bp, Mus musculus
atcatccagcagtcttggaacagga

SEQ ID NO: 540106 - DNA, 25 bp, Mus musculus
atcatcccgcaacgctgatgctgca

SEQ ID NO: 540107 - DNA, 25 bp, Mus musculus
atcatcccgcaaggctgatgctgca

SEQ ID NO: 540108 - DNA, 25 bp, Mus musculus
atcatccctgacaaccggaccaagg

SEQ ID NO: 540109 - DNA, 25 bp, Mus musculus
atcatccctgactaccggaccaagg

SEQ ID NO: 540110 - DNA, 25 bp, Mus musculus
atcatccgtgacaacctggcttcca

SEQ ID NO: 540111 - DNA, 25 bp, Mus musculus
atcatccgtgactacctggcttcca

SEQ ID NO: 540112 - DNA, 25 bp, Mus musculus
atcatcctcagaattgccatccagg

SEQ ID NO: 540113 - DNA, 25 bp, Mus musculus
atcatcctcagatttgccatccagg

SEQ ID NO: 540114 - DNA, 25 bp, Mus musculus
atcatcctccgtcgtggcgctgagc

SEQ ID NO: 540115 - DNA, 25 bp, Mus musculus
atcatcctccgtggtggcgctgagc

SEQ ID NO: 540116 - DNA, 25 bp, Mus musculus
atcatcctttgcagctccatcggga

SEQ ID NO: 540117 - DNA, 25 bp, Mus musculus
atcatcctttgctgctccatcggga

SEQ ID NO: 540118 - DNA, 25 bp, Mus musculus
atcatcgtccaacgcttcaagcaag

SEQ ID NO: 540119 - DNA, 25 bp, Mus musculus
atcatcgtccaaggcttcaagcaag

SEQ ID NO: 540120 - DNA, 25 bp, Mus musculus
atcatcgtctccagcggatgggaca

SEQ ID NO: 540121 - DNA, 25 bp, Mus musculus
atcatcgtctcctgcggatgggaca

SEQ ID NO: 540122 - DNA, 25 bp, Mus musculus
atcatcgtgggcaagctctggattg

SEQ ID NO: 540123 - DNA, 25 bp, Mus musculus
atcatcgtgggctagctctggattg

SEQ ID NO: 540124 - DNA, 25 bp, Mus musculus
atcatctataataacaattccaggg

SEQ ID NO: 540125 - DNA, 25 bp, Mus musculus
atcatctataattacaattccaggg

SEQ ID NO: 540126 - DNA, 25 bp, Mus musculus
atcatctgcggaagggtgcgtgtcc

SEQ ID NO: 540127 - DNA, 25 bp, Mus musculus
atcatctgcggatgggtgcgtgtcc

SEQ ID NO: 540128 - DNA, 25 bp, Mus musculus
atcatctgggctaacctgcgctacc

SEQ ID NO: 540129 - DNA, 25 bp, Mus musculus
atcatctgggcttacctgcgctacc

SEQ ID NO: 540130 - DNA, 25 bp, Mus musculus
atcatcttgctcacagctggacaag

SEQ ID NO: 540131 - DNA, 25 bp, Mus musculus
atcatcttgctctcagctggacaag

SEQ ID NO: 540132 - DNA, 25 bp, Mus musculus
atcatgaacctgcacgagcggactc

SEQ ID NO: 540133 - DNA, 25 bp, Mus musculus
atcatgaacctggacgagcggactc

SEQ ID NO: 540134 - DNA, 25 bp, Mus musculus
atcatgaagatcacagggacgcccc

SEQ ID NO: 540135 - DNA, 25 bp, Mus musculus
atcatgaagatctcagggacgcccc

SEQ ID NO: 540136 - DNA, 25 bp, Mus musculus
atcatgacgagtcaccacagccctg

SEQ ID NO: 540137 - DNA, 25 bp, Mus musculus
atcatgacgagtgaccacagccctg

SEQ ID NO: 540138 - DNA, 25 bp, Mus musculus
atcatgagggccaggatcttctttc

SEQ ID NO: 540139 - DNA, 25 bp, Mus musculus
atcatgagggcctggatcttctttc

SEQ ID NO: 540140 - DNA, 25 bp, Mus musculus
atcatgattgtgaggagggccatca

SEQ ID NO: 540141 - DNA, 25 bp, Mus musculus
atcatgattgtgtggagggccatca

SEQ ID NO: 540142 - DNA, 25 bp, Mus musculus
atcatgcaggcacaagccgaagctg

SEQ ID NO: 540143 - DNA, 25 bp, Mus musculus
atcatgcaggcagaagccgaagctg

SEQ ID NO: 540144 - DNA, 25 bp, Mus musculus
atcatgcctcaaaccagatcccaga

SEQ ID NO: 540145 - DNA, 25 bp, Mus musculus
atcatgcctcaatccagatcccaga

SEQ ID NO: 540146 - DNA, 25 bp, Mus musculus
atcatgctagtacgaaataaaacag

SEQ ID NO: 540147 - DNA, 25 bp, Mus musculus
atcatgctagtaggaaataaaacag

SEQ ID NO: 540148 - DNA, 25 bp, Mus musculus
atcatgctgcggcaggaagccactg

SEQ ID NO: 540149 - DNA, 25 bp, Mus musculus
atcatgctgcgggaggaagccactg

SEQ ID NO: 540150 - DNA, 25 bp, Mus musculus
atcatgctgggacctatctgtgcca

SEQ ID NO: 540151 - DNA, 25 bp, Mus musculus
atcatgctgggagctatctgtgcca

SEQ ID NO: 540152 - DNA, 25 bp, Mus musculus
atcatggattccctgcacatcgcag

SEQ ID NO: 540153 - DNA, 25 bp, Mus musculus
atcatggattccgtgcacatcgcag

SEQ ID NO: 540154 - DNA, 25 bp, Mus musculus
atcatggcaattctcatcagcaaca

SEQ ID NO: 540155 - DNA, 25 bp, Mus musculus
atcatggcaattgtcatcagcaaca

SEQ ID NO: 540156 - DNA, 25 bp, Mus musculus
atcatggcagccaacccagttacca

SEQ ID NO: 540157 - DNA, 25 bp, Mus musculus
atcatggcagcctacccagttacca

SEQ ID NO: 540158 - DNA, 25 bp, Mus musculus
atcatggcgaagcaggtcctcgacc

SEQ ID NO: 540159 - DNA, 25 bp, Mus musculus
atcatggcgaaggaggtcctcgacc

SEQ ID NO: 540160 - DNA, 25 bp, Mus musculus
atcatggcggagatgattactggga

SEQ ID NO: 540161 - DNA, 25 bp, Mus musculus
atcatggcggagttgattactggga

SEQ ID NO: 540162 - DNA, 25 bp, Mus musculus
atcatgggtgtcaagggtggctcta

SEQ ID NO: 540163 - DNA, 25 bp, Mus musculus
atcatgggtgtctagggtggctcta

SEQ ID NO: 540164 - DNA, 25 bp, Mus musculus
atcatgtcatcacgcagcggaaggc

SEQ ID NO: 540165 - DNA, 25 bp, Mus musculus
atcatgtcatcaggcagcggaaggc

SEQ ID NO: 540166 - DNA, 25 bp, Mus musculus
atcatgtccctgactcttcagaact

SEQ ID NO: 540167 - DNA, 25 bp, Mus musculus
atcatgtccctgtctcttcagaact

SEQ ID NO: 540168 - DNA, 25 bp, Mus musculus
atcatgtttgacatgcgccgacccc

SEQ ID NO: 540169 - DNA, 25 bp, Mus musculus
atcatgtttgacttgcgccgacccc

SEQ ID NO: 540170 - DNA, 25 bp, Mus musculus
atcatgtttttcactcaacaggaag

SEQ ID NO: 540171 - DNA, 25 bp, Mus musculus
atcatgtttttctctcaacaggaag

SEQ ID NO: 540172 - DNA, 25 bp, Mus musculus
atcattacctgccttcaactgtgag

SEQ ID NO: 540173 - DNA, 25 bp, Mus musculus
atcattacctgcgttcaactgtgag

SEQ ID NO: 540174 - DNA, 25 bp, Mus musculus
atcattctcttcatctgctctggca

SEQ ID NO: 540175 - DNA, 25 bp, Mus musculus
atcattctcttcttctgctctggca

SEQ ID NO: 540176 - DNA, 25 bp, Mus musculus
atcattctttgcatcttgatcctgg

SEQ ID NO: 540177 - DNA, 25 bp, Mus musculus
atcattctttgcttcttgatcctgg

SEQ ID NO: 540178 - DNA, 25 bp, Mus musculus
atcattgactgacactaccccaggg

SEQ ID NO: 540179 - DNA, 25 bp, Mus musculus
atcattgactgagactaccccaggg

SEQ ID NO: 540180 - DNA, 25 bp, Mus musculus
atcattgagcccattgacgacagga

SEQ ID NO: 540181 - DNA, 25 bp, Mus musculus
atcattgagccctttgacgacagga

SEQ ID NO: 540182 - DNA, 25 bp, Mus musculus
atcattgccaagaccttcaagggcc

SEQ ID NO: 540183 - DNA, 25 bp, Mus musculus
atcattgccaagtccttcaagggcc

SEQ ID NO: 540184 - DNA, 25 bp, Mus musculus
atcattggagcacatctccgagacc

SEQ ID NO: 540185 - DNA, 25 bp, Mus musculus
atcattggagcagatctccgagacc

SEQ ID NO: 540186 - DNA, 25 bp, Mus musculus
atcattggccgtcgtaatgaccagg

SEQ ID NO: 540187 - DNA, 25 bp, Mus musculus
atcattggccgtggtaatgaccagg

SEQ ID NO: 540188 - DNA, 25 bp, Mus musculus
atcattggcgctcagcccgtgtgca

SEQ ID NO: 540189 - DNA, 25 bp, Mus musculus
atcattggcgctgagcccgtgtgca

SEQ ID NO: 540190 - DNA, 25 bp, Mus musculus
atcatttcaaacctttgtgggccag

SEQ ID NO: 540191 - DNA, 25 bp, Mus musculus
atcatttcaaacgtttgtgggccag

SEQ ID NO: 540192 - DNA, 25 bp, Mus musculus
atcattttccatcgtgtaatgggca

SEQ ID NO: 540193 - DNA, 25 bp, Mus musculus
atcattttccatggtgtaatgggca

SEQ ID NO: 540194 - DNA, 25 bp, Mus musculus
atcattttcgctcgttccctgtaat

SEQ ID NO: 540195 - DNA, 25 bp, Mus musculus
atcattttcgctggttccctgtaat

SEQ ID NO: 540196 - DNA, 25 bp, Mus musculus
atccaaaatacacaggccctcagct

SEQ ID NO: 540197 - DNA, 25 bp, Mus musculus
atccaaaatacagaggccctcagct

SEQ ID NO: 540198 - DNA, 25 bp, Mus musculus
atccaaagcaaccagcccgagcggg

SEQ ID NO: 540199 - DNA, 25 bp, Mus musculus
atccaaagcaacgagcccgagcggg

SEQ ID NO: 540200 - DNA, 25 bp, Mus musculus
atccaaagtgctccgtggagactct

SEQ ID NO: 540201 - DNA, 25 bp, Mus musculus
atccaaagtgctgcgtggagactct

SEQ ID NO: 540202 - DNA, 25 bp, Mus musculus
atccaaatgaagaggcaggtccaag

SEQ ID NO: 540203 - DNA, 25 bp, Mus musculus
atccaaatgaagtggcaggtccaag

SEQ ID NO: 540204 - DNA, 25 bp, Mus musculus
atccaacggcgccacctaatggcag

SEQ ID NO: 540205 - DNA, 25 bp, Mus musculus
atccaacggcgcgacctaatggcag

SEQ ID NO: 540206 - DNA, 25 bp, Mus musculus
atccaagaatgcagagaagtcaact

SEQ ID NO: 540207 - DNA, 25 bp, Mus musculus
atccaagaatgctgagaagtcaact

SEQ ID NO: 540208 - DNA, 25 bp, Mus musculus
atccaagtcacaccggcgcaacaag

SEQ ID NO: 540209 - DNA, 25 bp, Mus musculus
atccaagtcacagcggcgcaacaag

SEQ ID NO: 540210 - DNA, 25 bp, Mus musculus
atccaataccacatctaagccgagc

SEQ ID NO: 540211 - DNA, 25 bp, Mus musculus
atccaataccacttctaagccgagc

SEQ ID NO: 540212 - DNA, 25 bp, Mus musculus
atccaatgtcttcggcacgaaattc

SEQ ID NO: 540213 - DNA, 25 bp, Mus musculus
atccaatgtcttgggcacgaaattc

SEQ ID NO: 540214 - DNA, 25 bp, Mus musculus
atccaatgtgctcccaactttgaga

SEQ ID NO: 540215 - DNA, 25 bp, Mus musculus
atccaatgtgctgccaactttgaga

SEQ ID NO: 540216 - DNA, 25 bp, Mus musculus
atccacactgcgcaaggacgtcaca

SEQ ID NO: 540217 - DNA, 25 bp, Mus musculus
atccacactgcggaaggacgtcaca

SEQ ID NO: 540218 - DNA, 25 bp, Mus musculus
atccacagagacatgaaatccaaca

SEQ ID NO: 540219 - DNA, 25 bp, Mus musculus
atccacagagacttgaaatccaaca

SEQ ID NO: 540220 - DNA, 25 bp, Mus musculus
atccacagggtcagctccttgggat

SEQ ID NO: 540221 - DNA, 25 bp, Mus musculus
atccacagggtctgctccttgggat

SEQ ID NO: 540222 - DNA, 25 bp, Mus musculus
atccaccacgtgaagcgccttcgag

SEQ ID NO: 540223 - DNA, 25 bp, Mus musculus
atccaccacgtgtagcgccttcgag

SEQ ID NO: 540224 - DNA, 25 bp, Mus musculus
atccaccctgtcctactttggcttg

SEQ ID NO: 540225 - DNA, 25 bp, Mus musculus
atccaccctgtcgtactttggcttg

SEQ ID NO: 540226 - DNA, 25 bp, Mus musculus
atccaccggcacaggcctgagctga

SEQ ID NO: 540227 - DNA, 25 bp, Mus musculus
atccaccggcactggcctgagctga

SEQ ID NO: 540228 - DNA, 25 bp, Mus musculus
atccaccttccgcatggtgacaggg

SEQ ID NO: 540229 - DNA, 25 bp, Mus musculus
atccaccttccggatggtgacaggg

SEQ ID NO: 540230 - DNA, 25 bp, Mus musculus
atccacgaccgtctcctttgggcaa

SEQ ID NO: 540231 - DNA, 25 bp, Mus musculus
atccacgaccgtgtcctttgggcaa

SEQ ID NO: 540232 - DNA, 25 bp, Mus musculus
atccacgctgtcctgtttcaaataa

SEQ ID NO: 540233 - DNA, 25 bp, Mus musculus
atccacgctgtcgtgtttcaaataa

SEQ ID NO: 540234 - DNA, 25 bp, Mus musculus
atccacggatagactgccacccgag

SEQ ID NO: 540235 - DNA, 25 bp, Mus musculus
atccacggatagtctgccacccgag

SEQ ID NO: 540236 - DNA, 25 bp, Mus musculus
atccacgtcacacacgaccagttta

SEQ ID NO: 540237 - DNA, 25 bp, Mus musculus
atccacgtcacagacgaccagttta

SEQ ID NO: 540238 - DNA, 25 bp, Mus musculus
atccactacggacgcaaaaacaaag

SEQ ID NO: 540239 - DNA, 25 bp, Mus musculus
atccactacggaggcaaaaacaaag

SEQ ID NO: 540240 - DNA, 25 bp, Mus musculus
atccactctctaccggaaggcgcgg

SEQ ID NO: 540241 - DNA, 25 bp, Mus musculus
atccactctctagcggaaggcgcgg

SEQ ID NO: 540242 - DNA, 25 bp, Mus musculus
atccactgcaccaggagctgtcctt

SEQ ID NO: 540243 - DNA, 25 bp, Mus musculus
atccactgcacctggagctgtcctt

SEQ ID NO: 540244 - DNA, 25 bp, Mus musculus
atccactgtacaacgggctgcggca

SEQ ID NO: 540245 - DNA, 25 bp, Mus musculus
atccactgtacatcgggctgcggca

SEQ ID NO: 540246 - DNA, 25 bp, Mus musculus
atccacttgcccatcatcattgtca

SEQ ID NO: 540247 - DNA, 25 bp, Mus musculus
atccacttgcccttcatcattgtca

SEQ ID NO: 540248 - DNA, 25 bp, Mus musculus
atccagaagacacgaggcctggaca

SEQ ID NO: 540249 - DNA, 25 bp, Mus musculus
atccagaagacaggaggcctggaca

SEQ ID NO: 540250 - DNA, 25 bp, Mus musculus
atccagaagctgatccggcctgtgg

SEQ ID NO: 540251 - DNA, 25 bp, Mus musculus
atccagaagctgttccggcctgtgg

SEQ ID NO: 540252 - DNA, 25 bp, Mus musculus
atccagagcaacctgagtacatcag

SEQ ID NO: 540253 - DNA, 25 bp, Mus musculus
atccagagcaacgtgagtacatcag

SEQ ID NO: 540254 - DNA, 25 bp, Mus musculus
atccagatcttcaggttcatcaagg

SEQ ID NO: 540255 - DNA, 25 bp, Mus musculus
atccagatcttctggttcatcaagg

SEQ ID NO: 540256 - DNA, 25 bp, Mus musculus
atccagatgtgaatgttttccagag

SEQ ID NO: 540257 - DNA, 25 bp, Mus musculus
atccagatgtgattgttttccagag

SEQ ID NO: 540258 - DNA, 25 bp, Mus musculus
atccagcagactaggaacaggacat

SEQ ID NO: 540259 - DNA, 25 bp, Mus musculus
atccagcagacttggaacaggacat

SEQ ID NO: 540260 - DNA, 25 bp, Mus musculus
atccagcaggctcgagagatgcccc

SEQ ID NO: 540261 - DNA, 25 bp, Mus musculus
atccagcaggctggagagatgcccc

SEQ ID NO: 540262 - DNA, 25 bp, Mus musculus
atccagcattcgcatgatgtcctgc

SEQ ID NO: 540263 - DNA, 25 bp, Mus musculus
atccagcattcggatgatgtcctgc

SEQ ID NO: 540264 - DNA, 25 bp, Mus musculus
atccagccaggaaagcgacactcca

SEQ ID NO: 540265 - DNA, 25 bp, Mus musculus
atccagccaggatagcgacactcca

SEQ ID NO: 540266 - DNA, 25 bp, Mus musculus
atccagccccgacactcaggatttg

SEQ ID NO: 540267 - DNA, 25 bp, Mus musculus
atccagccccgagactcaggatttg

SEQ ID NO: 540268 - DNA, 25 bp, Mus musculus
atccagccttatcgcgaatggtttt

SEQ ID NO: 540269 - DNA, 25 bp, Mus musculus
atccagccttatggcgaatggtttt

SEQ ID NO: 540270 - DNA, 25 bp, Mus musculus
atccagctgccgcacgtggagaacc

SEQ ID NO: 540271 - DNA, 25 bp, Mus musculus
atccagctgccggacgtggagaacc

SEQ ID NO: 540272 - DNA, 25 bp, Mus musculus
atccaggaaagcctgcagacctctg

SEQ ID NO: 540273 - DNA, 25 bp, Mus musculus
atccaggaaagcgtgcagacctctg

SEQ ID NO: 540274 - DNA, 25 bp, Mus musculus
atccaggaatcccactgcggcgtgg

SEQ ID NO: 540275 - DNA, 25 bp, Mus musculus
atccaggaatccgactgcggcgtgg

SEQ ID NO: 540276 - DNA, 25 bp, Mus musculus
atccaggccaatcgcactggcacag

SEQ ID NO: 540277 - DNA, 25 bp, Mus musculus
atccaggccaatggcactggcacag

SEQ ID NO: 540278 - DNA, 25 bp, Mus musculus
atccagggccacatacaagcagcaa

SEQ ID NO: 540279 - DNA, 25 bp, Mus musculus
atccagggccacttacaagcagcaa

SEQ ID NO: 540280 - DNA, 25 bp, Mus musculus
atccaggtgtggcacgcggaacacc

SEQ ID NO: 540281 - DNA, 25 bp, Mus musculus
atccaggtgtgggacgcggaacacc

SEQ ID NO: 540282 - DNA, 25 bp, Mus musculus
atccagtcaaggagggacctgcttt

SEQ ID NO: 540283 - DNA, 25 bp, Mus musculus
atccagtcaaggtgggacctgcttt

SEQ ID NO: 540284 - DNA, 25 bp, Mus musculus
atccagtggaatcgcccggagagca

SEQ ID NO: 540285 - DNA, 25 bp, Mus musculus
atccagtggaatggcccggagagca

SEQ ID NO: 540286 - DNA, 25 bp, Mus musculus
atccagttctgtccccgcaaagtgt

SEQ ID NO: 540287 - DNA, 25 bp, Mus musculus
atccagttctgtgcccgcaaagtgt

SEQ ID NO: 540288 - DNA, 25 bp, Mus musculus
atccagttgaagcaagtgacctgtc

SEQ ID NO: 540289 - DNA, 25 bp, Mus musculus
atccagttgaaggaagtgacctgtc

SEQ ID NO: 540290 - DNA, 25 bp, Mus musculus
atccagtttgacattcagatcctca

SEQ ID NO: 540291 - DNA, 25 bp, Mus musculus
atccagtttgactttcagatcctca

SEQ ID NO: 540292 - DNA, 25 bp, Mus musculus
atccataccactataagagagtgga

SEQ ID NO: 540293 - DNA, 25 bp, Mus musculus
atccataccactttaagagagtgga

SEQ ID NO: 540294 - DNA, 25 bp, Mus musculus
atccatatggttcacagcacccctg

SEQ ID NO: 540295 - DNA, 25 bp, Mus musculus
atccatatggttgacagcacccctg

SEQ ID NO: 540296 - DNA, 25 bp, Mus musculus
atccatcacttcatggagatgtttg

SEQ ID NO: 540297 - DNA, 25 bp, Mus musculus
atccatcacttcttggagatgtttg

SEQ ID NO: 540298 - DNA, 25 bp, Mus musculus
atccatcattgcagctgcatgttca

SEQ ID NO: 540299 - DNA, 25 bp, Mus musculus
atccatcattgctgctgcatgttca

SEQ ID NO: 540300 - DNA, 25 bp, Mus musculus
atccatcgagatatggctgccagaa

SEQ ID NO: 540301 - DNA, 25 bp, Mus musculus
atccatcgagatttggctgccagaa

SEQ ID NO: 540302 - DNA, 25 bp, Mus musculus
atccatcgtggaatgccccaggagg

SEQ ID NO: 540303 - DNA, 25 bp, Mus musculus
atccatcgtggattgccccaggagg

SEQ ID NO: 540304 - DNA, 25 bp, Mus musculus
atccatgccagaaacaagcctgtga

SEQ ID NO: 540305 - DNA, 25 bp, Mus musculus
atccatgccagatacaagcctgtga

SEQ ID NO: 540306 - DNA, 25 bp, Mus musculus
atccatgcccctcagtatgcctttg

SEQ ID NO: 540307 - DNA, 25 bp, Mus musculus
atccatgcccctgagtatgcctttg

SEQ ID NO: 540308 - DNA, 25 bp, Mus musculus
atccatgttttcagcactctccaag

SEQ ID NO: 540309 - DNA, 25 bp, Mus musculus
atccatgttttctgcactctccaag

SEQ ID NO: 540310 - DNA, 25 bp, Mus musculus
atcccaaaaagacctgctgaatttc

SEQ ID NO: 540311 - DNA, 25 bp, Mus musculus
atcccaaaaagagctgctgaatttc

SEQ ID NO: 540312 - DNA, 25 bp, Mus musculus
atcccaaagattccgacttggtgga

SEQ ID NO: 540313 - DNA, 25 bp, Mus musculus
atcccaaagattgcgacttggtgga

SEQ ID NO: 540314 - DNA, 25 bp, Mus musculus
atcccaaagctcctgcctgtgtttg

SEQ ID NO: 540315 - DNA, 25 bp, Mus musculus
atcccaaagctcgtgcctgtgtttg

SEQ ID NO: 540316 - DNA, 25 bp, Mus musculus
atcccaaatttgaagtcatcgacaa

SEQ ID NO: 540317 - DNA, 25 bp, Mus musculus
atcccaaatttgtagtcatcgacaa

SEQ ID NO: 540318 - DNA, 25 bp, Mus musculus
atcccaacgctaactgtgcagccaa

SEQ ID NO: 540319 - DNA, 25 bp, Mus musculus
atcccaacgctatctgtgcagccaa

SEQ ID NO: 540320 - DNA, 25 bp, Mus musculus
atcccaattgtcaatggactgtcag

SEQ ID NO: 540321 - DNA, 25 bp, Mus musculus
atcccaattgtctatggactgtcag

SEQ ID NO: 540322 - DNA, 25 bp, Mus musculus
atcccacgggctcgcccagagaaaa

SEQ ID NO: 540323 - DNA, 25 bp, Mus musculus
atcccacgggctggcccagagaaaa

SEQ ID NO: 540324 - DNA, 25 bp, Mus musculus
atcccactgagaaggcatccgctag

SEQ ID NO: 540325 - DNA, 25 bp, Mus musculus
atcccactgagatggcatccgctag

SEQ ID NO: 540326 - DNA, 25 bp, Mus musculus
atcccagaaggactgatagctcgaa

SEQ ID NO: 540327 - DNA, 25 bp, Mus musculus
atcccagaaggagtgatagctcgaa

SEQ ID NO: 540328 - DNA, 25 bp, Mus musculus
atcccagaccctcggcctgtgtaaa

SEQ ID NO: 540329 - DNA, 25 bp, Mus musculus
atcccagaccctgggcctgtgtaaa

SEQ ID NO: 540330 - DNA, 25 bp, Mus musculus
atcccagcatggacagcgcctacat

SEQ ID NO: 540331 - DNA, 25 bp, Mus musculus
atcccagcatggtcagcgcctacat

SEQ ID NO: 540332 - DNA, 25 bp, Mus musculus
atcccagctactcctggtgttggag

SEQ ID NO: 540333 - DNA, 25 bp, Mus musculus
atcccagctactgctggtgttggag

SEQ ID NO: 540334 - DNA, 25 bp, Mus musculus
atcccaggatgcaaccctctgagca

SEQ ID NO: 540335 - DNA, 25 bp, Mus musculus
atcccaggatgctaccctctgagca

SEQ ID NO: 540336 - DNA, 25 bp, Mus musculus
atcccaggctggatccgggcactgt

SEQ ID NO: 540337 - DNA, 25 bp, Mus musculus
atcccaggctggctgcatggtacca

SEQ ID NO: 540338 - DNA, 25 bp, Mus musculus
atcccaggctgggtgcatggtacca

SEQ ID NO: 540339 - DNA, 25 bp, Mus musculus
atcccaggctggttccgggcactgt

SEQ ID NO: 540340 - DNA, 25 bp, Mus musculus
atcccagtaggtactcctgccgcaa

SEQ ID NO: 540341 - DNA, 25 bp, Mus musculus
atcccagtaggttctcctgccgcaa

SEQ ID NO: 540342 - DNA, 25 bp, Mus musculus
atcccagtgaggaggagaaagccaa

SEQ ID NO: 540343 - DNA, 25 bp, Mus musculus
atcccagtgaggtggagaaagccaa

SEQ ID NO: 540344 - DNA, 25 bp, Mus musculus
atcccagtgcttcaagctgaaggtg

SEQ ID NO: 540345 - DNA, 25 bp, Mus musculus
atcccagtgcttgaagctgaaggtg

SEQ ID NO: 540346 - DNA, 25 bp, Mus musculus
atcccagtggaacagcttttcaagc

SEQ ID NO: 540347 - DNA, 25 bp, Mus musculus
atcccagtggaagagcttttcaagc

SEQ ID NO: 540348 - DNA, 25 bp, Mus musculus
atcccatatatacagaccagtgcca

SEQ ID NO: 540349 - DNA, 25 bp, Mus musculus
atcccatatatagagaccagtgcca

SEQ ID NO: 540350 - DNA, 25 bp, Mus musculus
atcccatgatggcatccttaacttg

SEQ ID NO: 540351 - DNA, 25 bp, Mus musculus
atcccatgatgggatccttaacttg

SEQ ID NO: 540352 - DNA, 25 bp, Mus musculus
atcccatgtggcaaacccaatacgc

SEQ ID NO: 540353 - DNA, 25 bp, Mus musculus
atcccatgtggctaacccaatacgc

SEQ ID NO: 540354 - DNA, 25 bp, Mus musculus
atcccattatcgagagcacttgaac

SEQ ID NO: 540355 - DNA, 25 bp, Mus musculus
atcccattatcgtgagcacttgaac

SEQ ID NO: 540356 - DNA, 25 bp, Mus musculus
atccccaagtctctggactggagag

SEQ ID NO: 540357 - DNA, 25 bp, Mus musculus
atccccaagtctgtggactggagag

SEQ ID NO: 540358 - DNA, 25 bp, Mus musculus
atccccagagaacgctgagctccag

SEQ ID NO: 540359 - DNA, 25 bp, Mus musculus
atccccagagaaggctgagctccag

SEQ ID NO: 540360 - DNA, 25 bp, Mus musculus
atccccagctcaagggcatagtgac

SEQ ID NO: 540361 - DNA, 25 bp, Mus musculus
atccccagctcatgggcatagtgac

SEQ ID NO: 540362 - DNA, 25 bp, Mus musculus
atccccagtcttagggcctgcgacg

SEQ ID NO: 540363 - DNA, 25 bp, Mus musculus
atccccagtctttgggcctgcgacg

SEQ ID NO: 540364 - DNA, 25 bp, Mus musculus
atccccgcgtctaggccgagagagg

SEQ ID NO: 540365 - DNA, 25 bp, Mus musculus
atccccgcgtcttggccgagagagg

SEQ ID NO: 540366 - DNA, 25 bp, Mus musculus
atccccgggcgactcctgtctaaga

SEQ ID NO: 540367 - DNA, 25 bp, Mus musculus
atccccgggcgagtcctgtctaaga

SEQ ID NO: 540368 - DNA, 25 bp, Mus musculus
atccccggtgtaaggcgccgcagga

SEQ ID NO: 540369 - DNA, 25 bp, Mus musculus
atccccggtgtatggcgccgcagga

SEQ ID NO: 540370 - DNA, 25 bp, Mus musculus
atccccgtgctcagggcagttggag

SEQ ID NO: 540371 - DNA, 25 bp, Mus musculus
atccccgtgctctgggcagttggag

SEQ ID NO: 540372 - DNA, 25 bp, Mus musculus
atcccgaagtgacctgccaggctca

SEQ ID NO: 540373 - DNA, 25 bp, Mus musculus
atcccgaagtgagctgccaggctca

SEQ ID NO: 540374 - DNA, 25 bp, Mus musculus
atcccgaagtgcagtggagatcgcc

SEQ ID NO: 540375 - DNA, 25 bp, Mus musculus
atcccgaagtgctgtggagatcgcc

SEQ ID NO: 540376 - DNA, 25 bp, Mus musculus
atcccgcgtgttcgcaggctctgcg

SEQ ID NO: 540377 - DNA, 25 bp, Mus musculus
atcccgcgtgttggcaggctctgcg

SEQ ID NO: 540378 - DNA, 25 bp, Mus musculus
atcccggagggtcgcgagccaaaat

SEQ ID NO: 540379 - DNA, 25 bp, Mus musculus
atcccggagggtggcgagccaaaat

SEQ ID NO: 540380 - DNA, 25 bp, Mus musculus
atcccgggagcgacctggctgccgt

SEQ ID NO: 540381 - DNA, 25 bp, Mus musculus
atcccgggagcgtcctggctgccgt

SEQ ID NO: 540382 - DNA, 25 bp, Mus musculus
atcccgggccctccggagcagaatg

SEQ ID NO: 540383 - DNA, 25 bp, Mus musculus
atcccgggccctgcggagcagaatg

SEQ ID NO: 540384 - DNA, 25 bp, Mus musculus
atcccgggtcccagacttggccttg

SEQ ID NO: 540385 - DNA, 25 bp, Mus musculus
atcccgggtccctgacttggccttg

SEQ ID NO: 540386 - DNA, 25 bp, Mus musculus
atcccggttgtcatttccaaaatat

SEQ ID NO: 540387 - DNA, 25 bp, Mus musculus
atcccggttgtcttttccaaaatat

SEQ ID NO: 540388 - DNA, 25 bp, Mus musculus
atcccgtggcataaaccccgatgag

SEQ ID NO: 540389 - DNA, 25 bp, Mus musculus
atcccgtggcattaaccccgatgag

SEQ ID NO: 540390 - DNA, 25 bp, Mus musculus
atccctactgagcacctgcttcggg

SEQ ID NO: 540391 - DNA, 25 bp, Mus musculus
atccctactgaggacctgcttcggg

SEQ ID NO: 540392 - DNA, 25 bp, Mus musculus
atccctagaagcagctagctactcc

SEQ ID NO: 540393 - DNA, 25 bp, Mus musculus
atccctagaagctgctagctactcc

SEQ ID NO: 540394 - DNA, 25 bp, Mus musculus
atccctagcggtaccgggcagactt

SEQ ID NO: 540395 - DNA, 25 bp, Mus musculus
atccctagcggttccgggcagactt

SEQ ID NO: 540396 - DNA, 25 bp, Mus musculus
atccctagtcaaccagtggccctcc

SEQ ID NO: 540397 - DNA, 25 bp, Mus musculus
atccctagtcaagcagtggccctcc

SEQ ID NO: 540398 - DNA, 25 bp, Mus musculus
atccctcacctcagccagatttaag

SEQ ID NO: 540399 - DNA, 25 bp, Mus musculus
atccctcacctctgccagatttaag

SEQ ID NO: 540400 - DNA, 25 bp, Mus musculus
atccctccaaaaagccagaaaccag

SEQ ID NO: 540401 - DNA, 25 bp, Mus musculus
atccctccaaaatgccagaaaccag

SEQ ID NO: 540402 - DNA, 25 bp, Mus musculus
atccctctgaggacctcctgggtga

SEQ ID NO: 540403 - DNA, 25 bp, Mus musculus
atccctctgaggtcctcctgggtga

SEQ ID NO: 540404 - DNA, 25 bp, Mus musculus
atccctctggctcagtgggagagcc

SEQ ID NO: 540405 - DNA, 25 bp, Mus musculus
atccctctggctgagtgggagagcc

SEQ ID NO: 540406 - DNA, 25 bp, Mus musculus
atccctctggtgctggtctactttg

SEQ ID NO: 540407 - DNA, 25 bp, Mus musculus
atccctctggtggtggtctactttg

SEQ ID NO: 540408 - DNA, 25 bp, Mus musculus
atccctgacctgcaaaacccaggaa

SEQ ID NO: 540409 - DNA, 25 bp, Mus musculus
atccctgacctggaaaacccaggaa

SEQ ID NO: 540410 - DNA, 25 bp, Mus musculus
atccctggacctcagtgagaagcac

SEQ ID NO: 540411 - DNA, 25 bp, Mus musculus
atccctggacctgagtgagaagcac

SEQ ID NO: 540412 - DNA, 25 bp, Mus musculus
atccctggagagcaccgacaaacag

SEQ ID NO: 540413 - DNA, 25 bp, Mus musculus
atccctggagaggaccgacaaacag

SEQ ID NO: 540414 - DNA, 25 bp, Mus musculus
atccctgggttacccctgtctctgg

SEQ ID NO: 540415 - DNA, 25 bp, Mus musculus
atccctgggttagccctgtctctgg

SEQ ID NO: 540416 - DNA, 25 bp, Mus musculus
atccctgtggcccagatcgtggtcg

SEQ ID NO: 540417 - DNA, 25 bp, Mus musculus
atccctgtggccgagatcgtggtcg

SEQ ID NO: 540418 - DNA, 25 bp, Mus musculus
atccctttgtttactgtcgctgtga

SEQ ID NO: 540419 - DNA, 25 bp, Mus musculus
atccctttgttttctgtcgctgtga

SEQ ID NO: 540420 - DNA, 25 bp, Mus musculus
atccgaactcggctctctcttaagg

SEQ ID NO: 540421 - DNA, 25 bp, Mus musculus
atccgaactcgggtctctcttaagg

SEQ ID NO: 540422 - DNA, 25 bp, Mus musculus
atccgaaggtgtccccatgaggttc

SEQ ID NO: 540423 - DNA, 25 bp, Mus musculus
atccgaaggtgtgcccatgaggttc

SEQ ID NO: 540424 - DNA, 25 bp, Mus musculus
atccgaatctttcaggtgagcttct

SEQ ID NO: 540425 - DNA, 25 bp, Mus musculus
atccgaatctttgaggtgagcttct

SEQ ID NO: 540426 - DNA, 25 bp, Mus musculus
atccgaatggccacgggcacaacta

SEQ ID NO: 540427 - DNA, 25 bp, Mus musculus
atccgaatggcctcgggcacaacta

SEQ ID NO: 540428 - DNA, 25 bp, Mus musculus
atccgactggagctcgcgggtcact

SEQ ID NO: 540429 - DNA, 25 bp, Mus musculus
atccgactggaggtcgcgggtcact

SEQ ID NO: 540430 - DNA, 25 bp, Mus musculus
atccgagcttcgagcgaggccgcga

SEQ ID NO: 540431 - DNA, 25 bp, Mus musculus
atccgagcttcgtgcgaggccgcga

SEQ ID NO: 540432 - DNA, 25 bp, Mus musculus
atccgagtcgccaaccaaagccagg

SEQ ID NO: 540433 - DNA, 25 bp, Mus musculus
atccgagtcgcctaccaaagccagg

SEQ ID NO: 540434 - DNA, 25 bp, Mus musculus
atccgattctagagccatggcccag

SEQ ID NO: 540435 - DNA, 25 bp, Mus musculus
atccgattctagtgccatggcccag

SEQ ID NO: 540436 - DNA, 25 bp, Mus musculus
atccgattggcacgctcggaaccct

SEQ ID NO: 540437 - DNA, 25 bp, Mus musculus
atccgattggcaggctcggaaccct

SEQ ID NO: 540438 - DNA, 25 bp, Mus musculus
atccgcagatcaacaagatagcctt

SEQ ID NO: 540439 - DNA, 25 bp, Mus musculus
atccgcagatcatcaagatagcctt

SEQ ID NO: 540440 - DNA, 25 bp, Mus musculus
atccgccagcagattgacggccgtg

SEQ ID NO: 540441 - DNA, 25 bp, Mus musculus
atccgccagcagtttgacggccgtg

SEQ ID NO: 540442 - DNA, 25 bp, Mus musculus
atccgcctgtagatgacccgcagag

SEQ ID NO: 540443 - DNA, 25 bp, Mus musculus
atccgcctgtagttgacccgcagag

SEQ ID NO: 540444 - DNA, 25 bp, Mus musculus
atccgcgagagccaaaccaccaaag

SEQ ID NO: 540445 - DNA, 25 bp, Mus musculus
atccgcgagagcgaaaccaccaaag

SEQ ID NO: 540446 - DNA, 25 bp, Mus musculus
atccgctcatgtaccaggccgtcta

SEQ ID NO: 540447 - DNA, 25 bp, Mus musculus
atccgctcatgttccaggccgtcta

SEQ ID NO: 540448 - DNA, 25 bp, Mus musculus
atccgctgaggaaattcaagctggt

SEQ ID NO: 540449 - DNA, 25 bp, Mus musculus
atccgctgaggatattcaagctggt

SEQ ID NO: 540450 - DNA, 25 bp, Mus musculus
atccgcttggcgagccgatccagca

SEQ ID NO: 540451 - DNA, 25 bp, Mus musculus
atccgcttggcgtgccgatccagca

SEQ ID NO: 540452 - DNA, 25 bp, Mus musculus
atccggagacaaaccctggacgcct

SEQ ID NO: 540453 - DNA, 25 bp, Mus musculus
atccggagacaatccctggacgcct

SEQ ID NO: 540454 - DNA, 25 bp, Mus musculus
atccggatcactcagaagatggcca

SEQ ID NO: 540455 - DNA, 25 bp, Mus musculus
atccggatcactgagaagatggcca

SEQ ID NO: 540456 - DNA, 25 bp, Mus musculus
atccggcggcgtctctacgatgcct

SEQ ID NO: 540457 - DNA, 25 bp, Mus musculus
atccggcggcgtgtctacgatgcct

SEQ ID NO: 540458 - DNA, 25 bp, Mus musculus
atccggctcgacatgtctgagttcc

SEQ ID NO: 540459 - DNA, 25 bp, Mus musculus
atccggctcgacttgtctgagttcc

SEQ ID NO: 540460 - DNA, 25 bp, Mus musculus
atccggctgccgaggaaatttcagg

SEQ ID NO: 540461 - DNA, 25 bp, Mus musculus
atccggctgccgtggaaatttcagg

SEQ ID NO: 540462 - DNA, 25 bp, Mus musculus
atccgggaagagcactattgtcaaa

SEQ ID NO: 540463 - DNA, 25 bp, Mus musculus
atccgggaagaggactattgtcaaa

SEQ ID NO: 540464 - DNA, 25 bp, Mus musculus
atccgggcccagcaggcctgcattg

SEQ ID NO: 540465 - DNA, 25 bp, Mus musculus
atccgggcccaggaggcctgcattg

SEQ ID NO: 540466 - DNA, 25 bp, Mus musculus
atccgggctgcactgcgtgagctcc

SEQ ID NO: 540467 - DNA, 25 bp, Mus musculus
atccgggctgcagtgcgtgagctcc

SEQ ID NO: 540468 - DNA, 25 bp, Mus musculus
atccggtaccgtcccaggctgtgac

SEQ ID NO: 540469 - DNA, 25 bp, Mus musculus
atccggtaccgtgccaggctgtgac

SEQ ID NO: 540470 - DNA, 25 bp, Mus musculus
atccggtgtctcatgcgtcagaggg

SEQ ID NO: 540471 - DNA, 25 bp, Mus musculus
atccggtgtctcttgcgtcagaggg

SEQ ID NO: 540472 - DNA, 25 bp, Mus musculus
atccgtcgggtaccgaagccatcct

SEQ ID NO: 540473 - DNA, 25 bp, Mus musculus
atccgtcgggtagcgaagccatcct

SEQ ID NO: 540474 - DNA, 25 bp, Mus musculus
atccgtctggtcaaggtcaatgagg

SEQ ID NO: 540475 - DNA, 25 bp, Mus musculus
atccgtctggtctaggtcaatgagg

SEQ ID NO: 540476 - DNA, 25 bp, Mus musculus
atccgttgggaaaagaacatcacat

SEQ ID NO: 540477 - DNA, 25 bp, Mus musculus
atccgttgggaatagaacatcacat

SEQ ID NO: 540478 - DNA, 25 bp, Mus musculus
atcctacagtcaaggctaccaaagg

SEQ ID NO: 540479 - DNA, 25 bp, Mus musculus
atcctacagtcatggctaccaaagg

SEQ ID NO: 540480 - DNA, 25 bp, Mus musculus
atcctagcagatcttgaggaagaaa

SEQ ID NO: 540481 - DNA, 25 bp, Mus musculus
atcctagcagatgttgaggaagaaa

SEQ ID NO: 540482 - DNA, 25 bp, Mus musculus
atcctaggaccccagaggaacgcgc

SEQ ID NO: 540483 - DNA, 25 bp, Mus musculus
atcctaggacccgagaggaacgcgc

SEQ ID NO: 540484 - DNA, 25 bp, Mus musculus
atcctcaccaccacaagagcaggag

SEQ ID NO: 540485 - DNA, 25 bp, Mus musculus
atcctcaccacctcaagagcaggag

SEQ ID NO: 540486 - DNA, 25 bp, Mus musculus
atcctcaccacgatgacttgtacct

SEQ ID NO: 540487 - DNA, 25 bp, Mus musculus
atcctcaccacgttgacttgtacct

SEQ ID NO: 540488 - DNA, 25 bp, Mus musculus
atcctcagatgacccttgggatgat

SEQ ID NO: 540489 - DNA, 25 bp, Mus musculus
atcctcagatgagccttgggatgat

SEQ ID NO: 540490 - DNA, 25 bp, Mus musculus
atcctcatccgccaggtggcagcag

SEQ ID NO: 540491 - DNA, 25 bp, Mus musculus
atcctcatccgcgaggtggcagcag

SEQ ID NO: 540492 - DNA, 25 bp, Mus musculus
atcctcattctactgtgtgcttggc

SEQ ID NO: 540493 - DNA, 25 bp, Mus musculus
atcctcattctagtgtgtgcttggc

SEQ ID NO: 540494 - DNA, 25 bp, Mus musculus
atcctcatttcccttcgactggtaa

SEQ ID NO: 540495 - DNA, 25 bp, Mus musculus
atcctcatttccgttcgactggtaa

SEQ ID NO: 540496 - DNA, 25 bp, Mus musculus
atcctccctgaacaggattgctgtg

SEQ ID NO: 540497 - DNA, 25 bp, Mus musculus
atcctccctgaagaggattgctgtg

SEQ ID NO: 540498 - DNA, 25 bp, Mus musculus
atcctccctgacaggtgggtccagc

SEQ ID NO: 540499 - DNA, 25 bp, Mus musculus
atcctccctgactggtgggtccagc

SEQ ID NO: 540500 - DNA, 25 bp, Mus musculus
atcctcctactcaggcacatcaagt

SEQ ID NO: 540501 - DNA, 25 bp, Mus musculus
atcctcctactctggcacatcaagt

SEQ ID NO: 540502 - DNA, 25 bp, Mus musculus
atcctcctcaagctggacaggctgg

SEQ ID NO: 540503 - DNA, 25 bp, Mus musculus
atcctcctcaaggtggacaggctgg

SEQ ID NO: 540504 - DNA, 25 bp, Mus musculus
atcctcggaaggcagtgcacgtctg

SEQ ID NO: 540505 - DNA, 25 bp, Mus musculus
atcctcggaagggagtgcacgtctg

SEQ ID NO: 540506 - DNA, 25 bp, Mus musculus
atcctctcgctaccagggtgccgtg

SEQ ID NO: 540507 - DNA, 25 bp, Mus musculus
atcctctcgctagcagggtgccgtg

SEQ ID NO: 540508 - DNA, 25 bp, Mus musculus
atcctctggaatcgccagaaagaca

SEQ ID NO: 540509 - DNA, 25 bp, Mus musculus
atcctctggaatggccagaaagaca

SEQ ID NO: 540510 - DNA, 25 bp, Mus musculus
atcctcttagagcaagggaaggcta

SEQ ID NO: 540511 - DNA, 25 bp, Mus musculus
atcctcttagaggaagggaaggcta

SEQ ID NO: 540512 - DNA, 25 bp, Mus musculus
atcctctttaggagggaaagagagc

SEQ ID NO: 540513 - DNA, 25 bp, Mus musculus
atcctctttaggtgggaaagagagc

SEQ ID NO: 540514 - DNA, 25 bp, Mus musculus
atcctgaaacaacacggccagttca

SEQ ID NO: 540515 - DNA, 25 bp, Mus musculus
atcctgaaacaagacggccagttca

SEQ ID NO: 540516 - DNA, 25 bp, Mus musculus
atcctgatcacacatgggaaatccc

SEQ ID NO: 540517 - DNA, 25 bp, Mus musculus
atcctgatcacagatgggaaatccc

SEQ ID NO: 540518 - DNA, 25 bp, Mus musculus
atcctgatggctccgaggcgccttg

SEQ ID NO: 540519 - DNA, 25 bp, Mus musculus
atcctgatggctgcgaggcgccttg

SEQ ID NO: 540520 - DNA, 25 bp, Mus musculus
atcctgcagtagaaacaggaagact

SEQ ID NO: 540521 - DNA, 25 bp, Mus musculus
atcctgcagtagtaacaggaagact

SEQ ID NO: 540522 - DNA, 25 bp, Mus musculus
atcctgcagttcaacctgctgggcg

SEQ ID NO: 540523 - DNA, 25 bp, Mus musculus
atcctgcagttctacctgctgggcg

SEQ ID NO: 540524 - DNA, 25 bp, Mus musculus
atcctgcccatcagtgagaacgaca

SEQ ID NO: 540525 - DNA, 25 bp, Mus musculus
atcctgcccatctgtgagaacgaca

SEQ ID NO: 540526 - DNA, 25 bp, Mus musculus
atcctgccctacctgtggaggatgc

SEQ ID NO: 540527 - DNA, 25 bp, Mus musculus
atcctgccctacgtgtggaggatgc

SEQ ID NO: 540528 - DNA, 25 bp, Mus musculus
atcctgcggccccacttgagtgcat

SEQ ID NO: 540529 - DNA, 25 bp, Mus musculus
atcctgcggcccgacttgagtgcat

SEQ ID NO: 540530 - DNA, 25 bp, Mus musculus
atcctgctcttccagctgctgacag

SEQ ID NO: 540531 - DNA, 25 bp, Mus musculus
atcctgctcttcgagctgctgacag

SEQ ID NO: 540532 - DNA, 25 bp, Mus musculus
atcctggaacggagacagcgttggt

SEQ ID NO: 540533 - DNA, 25 bp, Mus musculus
atcctggaacggtgacagcgttggt

SEQ ID NO: 540534 - DNA, 25 bp, Mus musculus
atcctggaagccacagggagacgca

SEQ ID NO: 540535 - DNA, 25 bp, Mus musculus
atcctggaagcctcagggagacgca

SEQ ID NO: 540536 - DNA, 25 bp, Mus musculus
atcctggaggagcttcaccagcaca

SEQ ID NO: 540537 - DNA, 25 bp, Mus musculus
atcctggaggaggttcaccagcaca

SEQ ID NO: 540538 - DNA, 25 bp, Mus musculus
atcctggatctcatcaagaaaggcg

SEQ ID NO: 540539 - DNA, 25 bp, Mus musculus
atcctggatctcttcaagaaaggcg

SEQ ID NO: 540540 - DNA, 25 bp, Mus musculus
atcctggccggcaatgatatcgccc

SEQ ID NO: 540541 - DNA, 25 bp, Mus musculus
atcctggccggctatgatatcgccc

SEQ ID NO: 540542 - DNA, 25 bp, Mus musculus
atcctggcttctctgcgtcctggct

SEQ ID NO: 540543 - DNA, 25 bp, Mus musculus
atcctggcttctgtgcgtcctggct

SEQ ID NO: 540544 - DNA, 25 bp, Mus musculus
atcctgggactaccttggaagggcc

SEQ ID NO: 540545 - DNA, 25 bp, Mus musculus
atcctgggactagcttggaagggcc

SEQ ID NO: 540546 - DNA, 25 bp, Mus musculus
atcctgggcataactaaccccgaag

SEQ ID NO: 540547 - DNA, 25 bp, Mus musculus
atcctgggcatatctaaccccgaag

SEQ ID NO: 540548 - DNA, 25 bp, Mus musculus
atcctgggcatcaacaagcagggcc

SEQ ID NO: 540549 - DNA, 25 bp, Mus musculus
atcctgggcatctacaagcagggcc

SEQ ID NO: 540550 - DNA, 25 bp, Mus musculus
atcctgggtctcagagcggctccgg

SEQ ID NO: 540551 - DNA, 25 bp, Mus musculus
atcctgggtctctgagcggctccgg

SEQ ID NO: 540552 - DNA, 25 bp, Mus musculus
atcctggtcccgaggaacctgcaga

SEQ ID NO: 540553 - DNA, 25 bp, Mus musculus
atcctggtcccgtggaacctgcaga

SEQ ID NO: 540554 - DNA, 25 bp, Mus musculus
atcctggtgcttacatggactgtct

SEQ ID NO: 540555 - DNA, 25 bp, Mus musculus
atcctggtgctttcatggactgtct

SEQ ID NO: 540556 - DNA, 25 bp, Mus musculus
atcctggtgggcaccccaaacaagc

SEQ ID NO: 540557 - DNA, 25 bp, Mus musculus
atcctggtgggctccccaaacaagc

SEQ ID NO: 540558 - DNA, 25 bp, Mus musculus
atcctgtagagccaccagattgtgt

SEQ ID NO: 540559 - DNA, 25 bp, Mus musculus
atcctgtagagcgaccagattgtgt

SEQ ID NO: 540560 - DNA, 25 bp, Mus musculus
atcctgtccgtgagccagttccagc

SEQ ID NO: 540561 - DNA, 25 bp, Mus musculus
atcctgtccgtgtgccagttccagc

SEQ ID NO: 540562 - DNA, 25 bp, Mus musculus
atcctgtcctcacctggatgtgctc

SEQ ID NO: 540563 - DNA, 25 bp, Mus musculus
atcctgtcctcagctggatgtgctc

SEQ ID NO: 540564 - DNA, 25 bp, Mus musculus
atcctgtggcgaaggcagtgtgaaa

SEQ ID NO: 540565 - DNA, 25 bp, Mus musculus
atcctgtggcgatggcagtgtgaaa

SEQ ID NO: 540566 - DNA, 25 bp, Mus musculus
atcctgtgggaaatcacccgcttct

SEQ ID NO: 540567 - DNA, 25 bp, Mus musculus
atcctgtgggaattcacccgcttct

SEQ ID NO: 540568 - DNA, 25 bp, Mus musculus
atcctgtgggtcattggtcttgctt

SEQ ID NO: 540569 - DNA, 25 bp, Mus musculus
atcctgtgggtctttggtcttgctt

SEQ ID NO: 540570 - DNA, 25 bp, Mus musculus
atcctgttttccatgtccgcccttg

SEQ ID NO: 540571 - DNA, 25 bp, Mus musculus
atcctgttttccttgtccgcccttg

SEQ ID NO: 540572 - DNA, 25 bp, Mus musculus
atccttaacaggatgggtgcagcga

SEQ ID NO: 540573 - DNA, 25 bp, Mus musculus
atccttaacaggttgggtgcagcga

SEQ ID NO: 540574 - DNA, 25 bp, Mus musculus
atccttaacttgcaggcgccgcggg

SEQ ID NO: 540575 - DNA, 25 bp, Mus musculus
atccttaacttggaggcgccgcggg

SEQ ID NO: 540576 - DNA, 25 bp, Mus musculus
atccttaagggccagctacaccaca

SEQ ID NO: 540577 - DNA, 25 bp, Mus musculus
atccttaagggcgagctacaccaca

SEQ ID NO: 540578 - DNA, 25 bp, Mus musculus
atccttagacgcatgagaataaaac

SEQ ID NO: 540579 - DNA, 25 bp, Mus musculus
atccttagacgcttgagaataaaac

SEQ ID NO: 540580 - DNA, 25 bp, Mus musculus
atccttaggaatcctttggtgtctc

SEQ ID NO: 540581 - DNA, 25 bp, Mus musculus
atccttaggaatgctttggtgtctc

SEQ ID NO: 540582 - DNA, 25 bp, Mus musculus
atccttcaagctagtcatctcccag

SEQ ID NO: 540583 - DNA, 25 bp, Mus musculus
atccttcaagcttgtcatctcccag

SEQ ID NO: 540584 - DNA, 25 bp, Mus musculus
atccttccgtcaacgtgcagcctgg

SEQ ID NO: 540585 - DNA, 25 bp, Mus musculus
atccttccgtcatcgtgcagcctgg

SEQ ID NO: 540586 - DNA, 25 bp, Mus musculus
atccttctgggacaacaagtgcaag

SEQ ID NO: 540587 - DNA, 25 bp, Mus musculus
atccttctgggagaacaagtgcaag

SEQ ID NO: 540588 - DNA, 25 bp, Mus musculus
atccttgaccctagtgcctctgggc

SEQ ID NO: 540589 - DNA, 25 bp, Mus musculus
atccttgacccttgtgcctctgggc

SEQ ID NO: 540590 - DNA, 25 bp, Mus musculus
atccttgagactcatctgctctgag

SEQ ID NO: 540591 - DNA, 25 bp, Mus musculus
atccttgagactgatctgctctgag

SEQ ID NO: 540592 - DNA, 25 bp, Mus musculus
atccttggaaagctaactacagaat

SEQ ID NO: 540593 - DNA, 25 bp, Mus musculus
atccttggaaaggtaactacagaat

SEQ ID NO: 540594 - DNA, 25 bp, Mus musculus
atccttggaggccacaacaagcggg

SEQ ID NO: 540595 - DNA, 25 bp, Mus musculus
atccttggaggcgacaacaagcggg

SEQ ID NO: 540596 - DNA, 25 bp, Mus musculus
atccttggcacacataaaagatgct

SEQ ID NO: 540597 - DNA, 25 bp, Mus musculus
atccttggcacagataaaagatgct

SEQ ID NO: 540598 - DNA, 25 bp, Mus musculus
atccttgtccctctgggtgagggaa

SEQ ID NO: 540599 - DNA, 25 bp, Mus musculus
atccttgtccctgtgggtgagggaa

SEQ ID NO: 540600 - DNA, 25 bp, Mus musculus
atccttgtctgtcggactggcctgg

SEQ ID NO: 540601 - DNA, 25 bp, Mus musculus
atccttgtctgtgggactggcctgg

SEQ ID NO: 540602 - DNA, 25 bp, Mus musculus
atccttgtggagacaggcgcccttg

SEQ ID NO: 540603 - DNA, 25 bp, Mus musculus
atccttgtggagtcaggcgcccttg

SEQ ID NO: 540604 - DNA, 25 bp, Mus musculus
atcctttcaaacacaactttcactg

SEQ ID NO: 540605 - DNA, 25 bp, Mus musculus
atcctttcaaactcaactttcactg

SEQ ID NO: 540606 - DNA, 25 bp, Mus musculus
atcctttccccgacgctgggcatgg

SEQ ID NO: 540607 - DNA, 25 bp, Mus musculus
atcctttccccgtcgctgggcatgg

SEQ ID NO: 540608 - DNA, 25 bp, Mus musculus
atcctttcctcgagggcctgcgcta

SEQ ID NO: 540609 - DNA, 25 bp, Mus musculus
atcctttcctcgtgggcctgcgcta

SEQ ID NO: 540610 - DNA, 25 bp, Mus musculus
atcctttcttctcatgtccacactg

SEQ ID NO: 540611 - DNA, 25 bp, Mus musculus
atcctttcttctgatgtccacactg

SEQ ID NO: 540612 - DNA, 25 bp, Mus musculus
atccttttcagtcctctgtgaagct

SEQ ID NO: 540613 - DNA, 25 bp, Mus musculus
atccttttcagtgctctgtgaagct

SEQ ID NO: 540614 - DNA, 25 bp, Mus musculus
atccttttgttgcacgaggccacct

SEQ ID NO: 540615 - DNA, 25 bp, Mus musculus
atccttttgttggacgaggccacct

SEQ ID NO: 540616 - DNA, 25 bp, Mus musculus
atcgaaaaggacctgctccgtacca

SEQ ID NO: 540617 - DNA, 25 bp, Mus musculus
atcgaaaaggacgtgctccgtacca

SEQ ID NO: 540618 - DNA, 25 bp, Mus musculus
atcgaagagcagctcagccgtgcca

SEQ ID NO: 540619 - DNA, 25 bp, Mus musculus
atcgaagagcaggtcagccgtgcca

SEQ ID NO: 540620 - DNA, 25 bp, Mus musculus
atcgaagaggttcctggcgagctta

SEQ ID NO: 540621 - DNA, 25 bp, Mus musculus
atcgaagaggttgctggcgagctta

SEQ ID NO: 540622 - DNA, 25 bp, Mus musculus
atcgaagattatatccaccacctgg

SEQ ID NO: 540623 - DNA, 25 bp, Mus musculus
atcgaagattatttccaccacctgg

SEQ ID NO: 540624 - DNA, 25 bp, Mus musculus
atcgaagtggatccccggcgcctga

SEQ ID NO: 540625 - DNA, 25 bp, Mus musculus
atcgaagtggatgcccggcgcctga

SEQ ID NO: 540626 - DNA, 25 bp, Mus musculus
atcgaatacatcaagagccagccca

SEQ ID NO: 540627 - DNA, 25 bp, Mus musculus
atcgaatacatctagagccagccca

SEQ ID NO: 540628 - DNA, 25 bp, Mus musculus
atcgacaagacccagctgaactcct

SEQ ID NO: 540629 - DNA, 25 bp, Mus musculus
atcgacaagaccgagctgaactcct

SEQ ID NO: 540630 - DNA, 25 bp, Mus musculus
atcgacgagtgtcgcgaccctagca

SEQ ID NO: 540631 - DNA, 25 bp, Mus musculus
atcgacgagtgtggcgaccctagca

SEQ ID NO: 540632 - DNA, 25 bp, Mus musculus
atcgacgggatgaaactggtgcaga

SEQ ID NO: 540633 - DNA, 25 bp, Mus musculus
atcgacgggatgtaactggtgcaga

SEQ ID NO: 540634 - DNA, 25 bp, Mus musculus
atcgacgggctcaccctagaccaga

SEQ ID NO: 540635 - DNA, 25 bp, Mus musculus
atcgacgggctctccctagaccaga

SEQ ID NO: 540636 - DNA, 25 bp, Mus musculus
atcgactctcagagtttcggccagg

SEQ ID NO: 540637 - DNA, 25 bp, Mus musculus
atcgactctcagtgtttcggccagg

SEQ ID NO: 540638 - DNA, 25 bp, Mus musculus
atcgactgccggagctggacccacg

SEQ ID NO: 540639 - DNA, 25 bp, Mus musculus
atcgactgccggtgctggacccacg

SEQ ID NO: 540640 - DNA, 25 bp, Mus musculus
atcgacttcgggatcgcgcgactgc

SEQ ID NO: 540641 - DNA, 25 bp, Mus musculus
atcgacttcgggttcgcgcgactgc

SEQ ID NO: 540642 - DNA, 25 bp, Mus musculus
atcgagaacggtactgccgctggga

SEQ ID NO: 540643 - DNA, 25 bp, Mus musculus
atcgagaacggttctgccgctggga

SEQ ID NO: 540644 - DNA, 25 bp, Mus musculus
atcgagactcaaatctccttcaagg

SEQ ID NO: 540645 - DNA, 25 bp, Mus musculus
atcgagactcaattctccttcaagg

SEQ ID NO: 540646 - DNA, 25 bp, Mus musculus
atcgagactgagaagactctctacc

SEQ ID NO: 540647 - DNA, 25 bp, Mus musculus
atcgagactgagtagactctctacc

SEQ ID NO: 540648 - DNA, 25 bp, Mus musculus
atcgagcagtgccaggatagcccca

SEQ ID NO: 540649 - DNA, 25 bp, Mus musculus
atcgagcagtgcgaggatagcccca

SEQ ID NO: 540650 - DNA, 25 bp, Mus musculus
atcgagccactcattgaccggttgc

SEQ ID NO: 540651 - DNA, 25 bp, Mus musculus
atcgagccactctttgaccggttgc

SEQ ID NO: 540652 - DNA, 25 bp, Mus musculus
atcgagcggatccttctgctggtca

SEQ ID NO: 540653 - DNA, 25 bp, Mus musculus
atcgagcggatcgttctgctggtca

SEQ ID NO: 540654 - DNA, 25 bp, Mus musculus
atcgaggaggccctggtcatcaccg

SEQ ID NO: 540655 - DNA, 25 bp, Mus musculus
atcgaggaggccgtggtcatcaccg

SEQ ID NO: 540656 - DNA, 25 bp, Mus musculus
atcgaggcgctcaagaagcttaaca

SEQ ID NO: 540657 - DNA, 25 bp, Mus musculus
atcgaggcgctctagaagcttaaca

SEQ ID NO: 540658 - DNA, 25 bp, Mus musculus
atcgaggtgctgacggactcctggt

SEQ ID NO: 540659 - DNA, 25 bp, Mus musculus
atcgaggtgctgtcggactcctggt

SEQ ID NO: 540660 - DNA, 25 bp, Mus musculus
atcgagttctacagaaatcccagga

SEQ ID NO: 540661 - DNA, 25 bp, Mus musculus
atcgagttctactgaaatcccagga

SEQ ID NO: 540662 - DNA, 25 bp, Mus musculus
atcgatatgggacggccgagtcacc

SEQ ID NO: 540663 - DNA, 25 bp, Mus musculus
atcgatatgggagggccgagtcacc

SEQ ID NO: 540664 - DNA, 25 bp, Mus musculus
atcgatcaaccgcaggagccagttc

SEQ ID NO: 540665 - DNA, 25 bp, Mus musculus
atcgatcaaccggaggagccagttc

SEQ ID NO: 540666 - DNA, 25 bp, Mus musculus
atcgatccgtatcggtttgaaaggc

SEQ ID NO: 540667 - DNA, 25 bp, Mus musculus
atcgatccgtatgggtttgaaaggc

SEQ ID NO: 540668 - DNA, 25 bp, Mus musculus
atcgatctcccaaggatactgaggg

SEQ ID NO: 540669 - DNA, 25 bp, Mus musculus
atcgatctcccatggatactgaggg

SEQ ID NO: 540670 - DNA, 25 bp, Mus musculus
atcgatgaccccaacctcgtggtca

SEQ ID NO: 540671 - DNA, 25 bp, Mus musculus
atcgatgacccctacctcgtggtca

SEQ ID NO: 540672 - DNA, 25 bp, Mus musculus
atcgatgactgaagccttctgtggc

SEQ ID NO: 540673 - DNA, 25 bp, Mus musculus
atcgatgactgatgccttctgtggc

SEQ ID NO: 540674 - DNA, 25 bp, Mus musculus
atcgatgaggctcgccactgcatgg

SEQ ID NO: 540675 - DNA, 25 bp, Mus musculus
atcgatgaggctggccactgcatgg

SEQ ID NO: 540676 - DNA, 25 bp, Mus musculus
atcgatgaggtgataagcccagagc

SEQ ID NO: 540677 - DNA, 25 bp, Mus musculus
atcgatgaggtgttaagcccagagc

SEQ ID NO: 540678 - DNA, 25 bp, Mus musculus
atcgatgagtgccagacccggaatg

SEQ ID NO: 540679 - DNA, 25 bp, Mus musculus
atcgatgagtgcgagacccggaatg

SEQ ID NO: 540680 - DNA, 25 bp, Mus musculus
atcgatggcgttcagcagctgaaca

SEQ ID NO: 540681 - DNA, 25 bp, Mus musculus
atcgatggcgttgagcagctgaaca

SEQ ID NO: 540682 - DNA, 25 bp, Mus musculus
atcgatggtccaacccgggctgtag

SEQ ID NO: 540683 - DNA, 25 bp, Mus musculus
atcgatggtccatcccgggctgtag

SEQ ID NO: 540684 - DNA, 25 bp, Mus musculus
atcgatgtgcccctgccggaggtac

SEQ ID NO: 540685 - DNA, 25 bp, Mus musculus
atcgatgtgcccgtgccggaggtac

SEQ ID NO: 540686 - DNA, 25 bp, Mus musculus
atcgatgtgtacatggctaaaagtc

SEQ ID NO: 540687 - DNA, 25 bp, Mus musculus
atcgatgtgtacttggctaaaagtc

SEQ ID NO: 540688 - DNA, 25 bp, Mus musculus
atcgattatatcctccacggcaaag

SEQ ID NO: 540689 - DNA, 25 bp, Mus musculus
atcgattatatcgtccacggcaaag

SEQ ID NO: 540690 - DNA, 25 bp, Mus musculus
atcgcaaatgctattcaccgatcag

SEQ ID NO: 540691 - DNA, 25 bp, Mus musculus
atcgcaaatgcttttcaccgatcag

SEQ ID NO: 540692 - DNA, 25 bp, Mus musculus
atcgcaaggaacatcagcctcttct

SEQ ID NO: 540693 - DNA, 25 bp, Mus musculus
atcgcaaggaacttcagcctcttct

SEQ ID NO: 540694 - DNA, 25 bp, Mus musculus
atcgcacgtccacaccggtgcggag

SEQ ID NO: 540695 - DNA, 25 bp, Mus musculus
atcgcacgtccagaccggtgcggag

SEQ ID NO: 540696 - DNA, 25 bp, Mus musculus
atcgcagagggtcccattgaccggc

SEQ ID NO: 540697 - DNA, 25 bp, Mus musculus
atcgcagagggtgccattgaccggc

SEQ ID NO: 540698 - DNA, 25 bp, Mus musculus
atcgcagatccccacagccagttgg

SEQ ID NO: 540699 - DNA, 25 bp, Mus musculus
atcgcagatcccgacagccagttgg

SEQ ID NO: 540700 - DNA, 25 bp, Mus musculus
atcgcagctttcaacaagatctgaa

SEQ ID NO: 540701 - DNA, 25 bp, Mus musculus
atcgcagctttctacaagatctgaa

SEQ ID NO: 540702 - DNA, 25 bp, Mus musculus
atcgcaggtgtgatcgccatccagg

SEQ ID NO: 540703 - DNA, 25 bp, Mus musculus
atcgcaggtgtgttcgccatccagg

SEQ ID NO: 540704 - DNA, 25 bp, Mus musculus
atcgcagtctcacctggatgaagcc

SEQ ID NO: 540705 - DNA, 25 bp, Mus musculus
atcgcagtctcagctggatgaagcc

SEQ ID NO: 540706 - DNA, 25 bp, Mus musculus
atcgcatttttgcacactgtaccca

SEQ ID NO: 540707 - DNA, 25 bp, Mus musculus
atcgcatttttggacactgtaccca

SEQ ID NO: 540708 - DNA, 25 bp, Mus musculus
atcgccaagatgctgcaccggctgg

SEQ ID NO: 540709 - DNA, 25 bp, Mus musculus
atcgccaagatggtgcaccggctgg

SEQ ID NO: 540710 - DNA, 25 bp, Mus musculus
atcgccacaggaagcaacccaagga

SEQ ID NO: 540711 - DNA, 25 bp, Mus musculus
atcgccacaggatgcaacccaagga

SEQ ID NO: 540712 - DNA, 25 bp, Mus musculus
atcgccagagccaacgtcaagcatc

SEQ ID NO: 540713 - DNA, 25 bp, Mus musculus
atcgccagagcctacgtcaagcatc

SEQ ID NO: 540714 - DNA, 25 bp, Mus musculus
atcgccagcgcgaggtccactggga

SEQ ID NO: 540715 - DNA, 25 bp, Mus musculus
atcgccagcgcgtggtccactggga

SEQ ID NO: 540716 - DNA, 25 bp, Mus musculus
atcgcccactatcagcaatctgcag

SEQ ID NO: 540717 - DNA, 25 bp, Mus musculus
atcgcccactatgagcaatctgcag

SEQ ID NO: 540718 - DNA, 25 bp, Mus musculus
atcgcccagtggctctgaccaaggc

SEQ ID NO: 540719 - DNA, 25 bp, Mus musculus
atcgcccagtgggtctgaccaaggc

SEQ ID NO: 540720 - DNA, 25 bp, Mus musculus
atcgccctgcggatcccatcgaggt

SEQ ID NO: 540721 - DNA, 25 bp, Mus musculus
atcgccctgcggttcccatcgaggt

SEQ ID NO: 540722 - DNA, 25 bp, Mus musculus
atcgccctgtggagtggcctcaacc

SEQ ID NO: 540723 - DNA, 25 bp, Mus musculus
atcgccctgtggtgtggcctcaacc

SEQ ID NO: 540724 - DNA, 25 bp, Mus musculus
atcgccgcacagacagcaggcatag

SEQ ID NO: 540725 - DNA, 25 bp, Mus musculus
atcgccgcacagtcagcaggcatag

SEQ ID NO: 540726 - DNA, 25 bp, Mus musculus
atcgccgggcagctgtccatagatg

SEQ ID NO: 540727 - DNA, 25 bp, Mus musculus
atcgccgggcaggtgtccatagatg

SEQ ID NO: 540728 - DNA, 25 bp, Mus musculus
atcgcctacccacggctcgtggtga

SEQ ID NO: 540729 - DNA, 25 bp, Mus musculus
atcgcctacccagggctcgtggtga

SEQ ID NO: 540730 - DNA, 25 bp, Mus musculus
atcgcgatgacgccctgcctttggc

SEQ ID NO: 540731 - DNA, 25 bp, Mus musculus
atcgcgatgacggcctgcctttggc

SEQ ID NO: 540732 - DNA, 25 bp, Mus musculus
atcgcgatgtcaaaccctccaacat

SEQ ID NO: 540733 - DNA, 25 bp, Mus musculus
atcgcgatgtcataccctccaacat

SEQ ID NO: 540734 - DNA, 25 bp, Mus musculus
atcgcgcacaggatcgaggctggca

SEQ ID NO: 540735 - DNA, 25 bp, Mus musculus
atcgcgcacaggttcgaggctggca

SEQ ID NO: 540736 - DNA, 25 bp, Mus musculus
atcgcggaccgacacgccatcgtag

SEQ ID NO: 540737 - DNA, 25 bp, Mus musculus
atcgcggaccgagacgccatcgtag

SEQ ID NO: 540738 - DNA, 25 bp, Mus musculus
atcgcggacttcatggccagcacct

SEQ ID NO: 540739 - DNA, 25 bp, Mus musculus
atcgcggacttcttggccagcacct

SEQ ID NO: 540740 - DNA, 25 bp, Mus musculus
atcgcggcgtacaggcatggcaccc

SEQ ID NO: 540741 - DNA, 25 bp, Mus musculus
atcgcggcgtactggcatggcaccc

SEQ ID NO: 540742 - DNA, 25 bp, Mus musculus
atcgcgggacgcaccaccgatgcgg

SEQ ID NO: 540743 - DNA, 25 bp, Mus musculus
atcgcgggacgctccaccgatgcgg

SEQ ID NO: 540744 - DNA, 25 bp, Mus musculus
atcgcgggcgtcaggatccccgagt

SEQ ID NO: 540745 - DNA, 25 bp, Mus musculus
atcgcgggcgtctggatccccgagt

SEQ ID NO: 540746 - DNA, 25 bp, Mus musculus
atcgcggtgaccctgctgggcttcc

SEQ ID NO: 540747 - DNA, 25 bp, Mus musculus
atcgcggtgaccgtgctgggcttcc

SEQ ID NO: 540748 - DNA, 25 bp, Mus musculus
atcgctcaccgtcggaattgcaaag

SEQ ID NO: 540749 - DNA, 25 bp, Mus musculus
atcgctcaccgtgggaattgcaaag

SEQ ID NO: 540750 - DNA, 25 bp, Mus musculus
atcgctcggtaaaggacctcatgcc

SEQ ID NO: 540751 - DNA, 25 bp, Mus musculus
atcgctcggtaatggacctcatgcc

SEQ ID NO: 540752 - DNA, 25 bp, Mus musculus
atcgctgccgaaacttccagaacct

SEQ ID NO: 540753 - DNA, 25 bp, Mus musculus
atcgctgccgaatcttccagaacct

SEQ ID NO: 540754 - DNA, 25 bp, Mus musculus
atcgctggcctgaacgagcgcgcca

SEQ ID NO: 540755 - DNA, 25 bp, Mus musculus
atcgctggcctgtacgagcgcgcca

SEQ ID NO: 540756 - DNA, 25 bp, Mus musculus
atcgctgggacacaaccccactgag

SEQ ID NO: 540757 - DNA, 25 bp, Mus musculus
atcgctgggacagaaccccactgag

SEQ ID NO: 540758 - DNA, 25 bp, Mus musculus
atcgctgtgagacctgctacggcgc

SEQ ID NO: 540759 - DNA, 25 bp, Mus musculus
atcgctgtgagagctgctacggcgc

SEQ ID NO: 540760 - DNA, 25 bp, Mus musculus
atcgctgtggcgagatccgcgagcc

SEQ ID NO: 540761 - DNA, 25 bp, Mus musculus
atcgctgtggcgtgatccgcgagcc

SEQ ID NO: 540762 - DNA, 25 bp, Mus musculus
atcgctgtgtttagccctcgccctg

SEQ ID NO: 540763 - DNA, 25 bp, Mus musculus
atcgctgtgttttgccctcgccctg

SEQ ID NO: 540764 - DNA, 25 bp, Mus musculus
atcgctgttggccagagcttcccag

SEQ ID NO: 540765 - DNA, 25 bp, Mus musculus
atcgctgttggcgagagcttcccag

SEQ ID NO: 540766 - DNA, 25 bp, Mus musculus
atcgcttacactagagaagaactac

SEQ ID NO: 540767 - DNA, 25 bp, Mus musculus
atcgcttacacttgagaagaactac

SEQ ID NO: 540768 - DNA, 25 bp, Mus musculus
atcggaaacgcaagcaggaggaaca

SEQ ID NO: 540769 - DNA, 25 bp, Mus musculus
atcggaaacgcatgcaggaggaaca

SEQ ID NO: 540770 - DNA, 25 bp, Mus musculus
atcggaagacgcagaacccagcctt

SEQ ID NO: 540771 - DNA, 25 bp, Mus musculus
atcggaagacgctgaacccagcctt

SEQ ID NO: 540772 - DNA, 25 bp, Mus musculus
atcggaaggagcaagatcgggccaa

SEQ ID NO: 540773 - DNA, 25 bp, Mus musculus
atcggaaggagctagatcgggccaa

SEQ ID NO: 540774 - DNA, 25 bp, Mus musculus
atcggacagcgtatttacatcaaag

SEQ ID NO: 540775 - DNA, 25 bp, Mus musculus
atcggacagcgtttttacatcaaag

SEQ ID NO: 540776 - DNA, 25 bp, Mus musculus
atcggaccaaatcaaatgtctgaga

SEQ ID NO: 540777 - DNA, 25 bp, Mus musculus
atcggaccaaatgaaatgtctgaga

SEQ ID NO: 540778 - DNA, 25 bp, Mus musculus
atcggaccagtgagggaccaagcaa

SEQ ID NO: 540779 - DNA, 25 bp, Mus musculus
atcggaccagtgtgggaccaagcaa

SEQ ID NO: 540780 - DNA, 25 bp, Mus musculus
atcggagagaaaagccgctcaaagc

SEQ ID NO: 540781 - DNA, 25 bp, Mus musculus
atcggagagaaatgccgctcaaagc

SEQ ID NO: 540782 - DNA, 25 bp, Mus musculus
atcggagtcggaacacagtggccag

SEQ ID NO: 540783 - DNA, 25 bp, Mus musculus
atcggagtcggatcacagtggccag

SEQ ID NO: 540784 - DNA, 25 bp, Mus musculus
atcggcaatggcaatgggttgatca

SEQ ID NO: 540785 - DNA, 25 bp, Mus musculus
atcggcaatggctatgggttgatca

SEQ ID NO: 540786 - DNA, 25 bp, Mus musculus
atcggcagacgccatgacggctctg

SEQ ID NO: 540787 - DNA, 25 bp, Mus musculus
atcggcagacgcgatgacggctctg

SEQ ID NO: 540788 - DNA, 25 bp, Mus musculus
atcggccagcacagagagcctgctg

SEQ ID NO: 540789 - DNA, 25 bp, Mus musculus
atcggccagcactgagagcctgctg

SEQ ID NO: 540790 - DNA, 25 bp, Mus musculus
atcggccgcaacacgtcgcagggct

SEQ ID NO: 540791 - DNA, 25 bp, Mus musculus
atcggccgcaactcgtcgcagggct

SEQ ID NO: 540792 - DNA, 25 bp, Mus musculus
atcggcctggccatctaaacatagg

SEQ ID NO: 540793 - DNA, 25 bp, Mus musculus
atcggcctggccttctaaacatagg

SEQ ID NO: 540794 - DNA, 25 bp, Mus musculus
atcggccttgcactttgcaataatg

SEQ ID NO: 540795 - DNA, 25 bp, Mus musculus
atcggccttgcagtttgcaataatg

SEQ ID NO: 540796 - DNA, 25 bp, Mus musculus
atcggcgactgaagcggcctggccc

SEQ ID NO: 540797 - DNA, 25 bp, Mus musculus
atcggcgactgatgcggcctggccc

SEQ ID NO: 540798 - DNA, 25 bp, Mus musculus
atcggcggcctcactatcgctggga

SEQ ID NO: 540799 - DNA, 25 bp, Mus musculus
atcggcggcctctctatcgctggga

SEQ ID NO: 540800 - DNA, 25 bp, Mus musculus
atcggcggctgcctggccgttggcg

SEQ ID NO: 540801 - DNA, 25 bp, Mus musculus
atcggcggctgcgtggccgttggcg

SEQ ID NO: 540802 - DNA, 25 bp, Mus musculus
atcggcggtctgcataaggagttct

SEQ ID NO: 540803 - DNA, 25 bp, Mus musculus
atcggcggtctggataaggagttct

SEQ ID NO: 540804 - DNA, 25 bp, Mus musculus
atcggcgtggaacgcggccacttaa

SEQ ID NO: 540805 - DNA, 25 bp, Mus musculus
atcggcgtggaaggcggccacttaa

SEQ ID NO: 540806 - DNA, 25 bp, Mus musculus
atcggctctcggaggtcctggaagc

SEQ ID NO: 540807 - DNA, 25 bp, Mus musculus
atcggctctcggtggtcctggaagc

SEQ ID NO: 540808 - DNA, 25 bp, Mus musculus
atcgggacctgcaggttgtggccca

SEQ ID NO: 540809 - DNA, 25 bp, Mus musculus
atcgggacctgctggttgtggccca

SEQ ID NO: 540810 - DNA, 25 bp, Mus musculus
atcgggccccacagctttgagctac

SEQ ID NO: 540811 - DNA, 25 bp, Mus musculus
atcgggccccactgctttgagctac

SEQ ID NO: 540812 - DNA, 25 bp, Mus musculus
atcgggccctatcggaggctatgca

SEQ ID NO: 540813 - DNA, 25 bp, Mus musculus
atcgggccctatgggaggctatgca

SEQ ID NO: 540814 - DNA, 25 bp, Mus musculus
atcgggttcggacaaggcgctggct

SEQ ID NO: 540815 - DNA, 25 bp, Mus musculus
atcgggttcggagaaggcgctggct

SEQ ID NO: 540816 - DNA, 25 bp, Mus musculus
atcggtgagagaaggtcaagatgtc

SEQ ID NO: 540817 - DNA, 25 bp, Mus musculus
atcggtgagagatggtcaagatgtc

SEQ ID NO: 540818 - DNA, 25 bp, Mus musculus
atcggtgattacaatgcctgtgccc

SEQ ID NO: 540819 - DNA, 25 bp, Mus musculus
atcggtgattactatgcctgtgccc

SEQ ID NO: 540820 - DNA, 25 bp, Mus musculus
atcggtggacgacgcactgcagcat

SEQ ID NO: 540821 - DNA, 25 bp, Mus musculus
atcggtggacgaggcactgcagcat

SEQ ID NO: 540822 - DNA, 25 bp, Mus musculus
atcgtaacagatcctaaaaccaatg

SEQ ID NO: 540823 - DNA, 25 bp, Mus musculus
atcgtaacagatgctaaaaccaatg

SEQ ID NO: 540824 - DNA, 25 bp, Mus musculus
atcgtacaagtacttcccttcctcg

SEQ ID NO: 540825 - DNA, 25 bp, Mus musculus
atcgtacaagtagttcccttcctcg

SEQ ID NO: 540826 - DNA, 25 bp, Mus musculus
atcgtcaacgtgaggtactctgtca

SEQ ID NO: 540827 - DNA, 25 bp, Mus musculus
atcgtcaacgtgtggtactctgtca

SEQ ID NO: 540828 - DNA, 25 bp, Mus musculus
atcgtcacggagaacatgagcaaag

SEQ ID NO: 540829 - DNA, 25 bp, Mus musculus
atcgtcacggagtacatgagcaaag

SEQ ID NO: 540830 - DNA, 25 bp, Mus musculus
atcgtcaggagacgagaacaccggc

SEQ ID NO: 540831 - DNA, 25 bp, Mus musculus
atcgtcaggagaggagaacaccggc

SEQ ID NO: 540832 - DNA, 25 bp, Mus musculus
atcgtccagaacacgtacgggtctg

SEQ ID NO: 540833 - DNA, 25 bp, Mus musculus
atcgtccagaactcgtacgggtctg

SEQ ID NO: 540834 - DNA, 25 bp, Mus musculus
atcgtcttcctgagcataggaagta

SEQ ID NO: 540835 - DNA, 25 bp, Mus musculus
atcgtcttcctgtgcataggaagta

SEQ ID NO: 540836 - DNA, 25 bp, Mus musculus
atcgtgaagatgcacccggaattcc

SEQ ID NO: 540837 - DNA, 25 bp, Mus musculus
atcgtgaagatggacccggaattcc

SEQ ID NO: 540838 - DNA, 25 bp, Mus musculus
atcgtgagagatacgagacacttgg

SEQ ID NO: 540839 - DNA, 25 bp, Mus musculus
atcgtgagagattcgagacacttgg

SEQ ID NO: 540840 - DNA, 25 bp, Mus musculus
atcgtgcgcagcaaggcgtgctcgc

SEQ ID NO: 540841 - DNA, 25 bp, Mus musculus
atcgtgcgcagctaggcgtgctcgc

SEQ ID NO: 540842 - DNA, 25 bp, Mus musculus
atcgtgcgcccaagctctggaacct

SEQ ID NO: 540843 - DNA, 25 bp, Mus musculus
atcgtgcgcccatgctctggaacct

SEQ ID NO: 540844 - DNA, 25 bp, Mus musculus
atcgtgcgggccaacgtgcttctcc

SEQ ID NO: 540845 - DNA, 25 bp, Mus musculus
atcgtgcgggcctacgtgcttctcc

SEQ ID NO: 540846 - DNA, 25 bp, Mus musculus
atcgtgctgcccaaggacgaccagg

SEQ ID NO: 540847 - DNA, 25 bp, Mus musculus
atcgtgctgccctaggacgaccagg

SEQ ID NO: 540848 - DNA, 25 bp, Mus musculus
atcgtggactacaagcccagcctgg

SEQ ID NO: 540849 - DNA, 25 bp, Mus musculus
atcgtggactactagcccagcctgg

SEQ ID NO: 540850 - DNA, 25 bp, Mus musculus
atcgtggactggcatgtgcaccatg

SEQ ID NO: 540851 - DNA, 25 bp, Mus musculus
atcgtggactgggatgtgcaccatg

SEQ ID NO: 540852 - DNA, 25 bp, Mus musculus
atcgtggagcgcaggaacctgatca

SEQ ID NO: 540853 - DNA, 25 bp, Mus musculus
atcgtggagcgctggaacctgatca

SEQ ID NO: 540854 - DNA, 25 bp, Mus musculus
atcgtggatccccaggcccagcggt

SEQ ID NO: 540855 - DNA, 25 bp, Mus musculus
atcgtggatcccgaggcccagcggt

SEQ ID NO: 540856 - DNA, 25 bp, Mus musculus
atcgtggcgcgaacatgctccgggt

SEQ ID NO: 540857 - DNA, 25 bp, Mus musculus
atcgtggcgcgatcatgctccgggt

SEQ ID NO: 540858 - DNA, 25 bp, Mus musculus
atcgtgggtgtcagcctgggccttc

SEQ ID NO: 540859 - DNA, 25 bp, Mus musculus
atcgtgggtgtctgcctgggccttc

SEQ ID NO: 540860 - DNA, 25 bp, Mus musculus
atcgtggtcacaatacctcgtccgt

SEQ ID NO: 540861 - DNA, 25 bp, Mus musculus
atcgtggtcacattacctcgtccgt

SEQ ID NO: 540862 - DNA, 25 bp, Mus musculus
atcgtggtgggacgacactccaaca

SEQ ID NO: 540863 - DNA, 25 bp, Mus musculus
atcgtggtgggaggacactccaaca

SEQ ID NO: 540864 - DNA, 25 bp, Mus musculus
atcgtgtacagcagggtgatccgca

SEQ ID NO: 540865 - DNA, 25 bp, Mus musculus
atcgtgtacagctgggtgatccgca

SEQ ID NO: 540866 - DNA, 25 bp, Mus musculus
atcgtgtctttcatgatttccgaaa

SEQ ID NO: 540867 - DNA, 25 bp, Mus musculus
atcgtgtctttcttgatttccgaaa

SEQ ID NO: 540868 - DNA, 25 bp, Mus musculus
atcgttacgaccagaggagattgaa

SEQ ID NO: 540869 - DNA, 25 bp, Mus musculus
atcgttacgacctgaggagattgaa

SEQ ID NO: 540870 - DNA, 25 bp, Mus musculus
atcgttcacccaaagtacaacttct

SEQ ID NO: 540871 - DNA, 25 bp, Mus musculus
atcgttcacccatagtacaacttct

SEQ ID NO: 540872 - DNA, 25 bp, Mus musculus
atcgttcgtaggaagcttggtggcc

SEQ ID NO: 540873 - DNA, 25 bp, Mus musculus
atcgttcgtaggtagcttggtggcc

SEQ ID NO: 540874 - DNA, 25 bp, Mus musculus
atcgttctccggacttctgacccag

SEQ ID NO: 540875 - DNA, 25 bp, Mus musculus
atcgttctccggtcttctgacccag

SEQ ID NO: 540876 - DNA, 25 bp, Mus musculus
atcgttgagccccaggactgcacac

SEQ ID NO: 540877 - DNA, 25 bp, Mus musculus
atcgttgagcccgaggactgcacac

SEQ ID NO: 540878 - DNA, 25 bp, Mus musculus
atcgttggatccattggtgtggaca

SEQ ID NO: 540879 - DNA, 25 bp, Mus musculus
atcgttggatcctttggtgtggaca

SEQ ID NO: 540880 - DNA, 25 bp, Mus musculus
atcgttttaagaacgagggacgtgc

SEQ ID NO: 540881 - DNA, 25 bp, Mus musculus
atcgttttaagatcgagggacgtgc

SEQ ID NO: 540882 - DNA, 25 bp, Mus musculus
atctaacagacacatcatggcatct

SEQ ID NO: 540883 - DNA, 25 bp, Mus musculus
atctaacagacagatcatggcatct

SEQ ID NO: 540884 - DNA, 25 bp, Mus musculus
atctaacatcatcgcctcgctggct

SEQ ID NO: 540885 - DNA, 25 bp, Mus musculus
atctaacatcatggcctcgctggct

SEQ ID NO: 540886 - DNA, 25 bp, Mus musculus
atctaaggaagaagatgaagtgaca

SEQ ID NO: 540887 - DNA, 25 bp, Mus musculus
atctaaggaagatgatgaagtgaca

SEQ ID NO: 540888 - DNA, 25 bp, Mus musculus
atctaatcgttgcatcctttggtgt

SEQ ID NO: 540889 - DNA, 25 bp, Mus musculus
atctaatcgttggatcctttggtgt

SEQ ID NO: 540890 - DNA, 25 bp, Mus musculus
atctacagacgcctggaaggccctc

SEQ ID NO: 540891 - DNA, 25 bp, Mus musculus
atctacagacgcgtggaaggccctc

SEQ ID NO: 540892 - DNA, 25 bp, Mus musculus
atctacagccacctttgacaaacac

SEQ ID NO: 540893 - DNA, 25 bp, Mus musculus
atctacagccacgtttgacaaacac

SEQ ID NO: 540894 - DNA, 25 bp, Mus musculus
atctaccccatgcagcaacctggag

SEQ ID NO: 540895 - DNA, 25 bp, Mus musculus
atctaccccatggagcaacctggag

SEQ ID NO: 540896 - DNA, 25 bp, Mus musculus
atctacctgcagctgctgacagaca

SEQ ID NO: 540897 - DNA, 25 bp, Mus musculus
atctacctgcaggtgctgacagaca

SEQ ID NO: 540898 - DNA, 25 bp, Mus musculus
atctacgctggaaggaccccgaccg

SEQ ID NO: 540899 - DNA, 25 bp, Mus musculus
atctacgctggatggaccccgaccg

SEQ ID NO: 540900 - DNA, 25 bp, Mus musculus
atctacggagagagtcgccgcctct

SEQ ID NO: 540901 - DNA, 25 bp, Mus musculus
atctacggagagtgtcgccgcctct

SEQ ID NO: 540902 - DNA, 25 bp, Mus musculus
atctacgggttgacggtggtactgc

SEQ ID NO: 540903 - DNA, 25 bp, Mus musculus
atctacgggttgtcggtggtactgc

SEQ ID NO: 540904 - DNA, 25 bp, Mus musculus
atctacgtgggcaaccttccgtccg

SEQ ID NO: 540905 - DNA, 25 bp, Mus musculus
atctacgtgggctaccttccgtccg

SEQ ID NO: 540906 - DNA, 25 bp, Mus musculus
atctacgtgtggaaaggcaaaggag

SEQ ID NO: 540907 - DNA, 25 bp, Mus musculus
atctacgtgtggtaaggcaaaggag

SEQ ID NO: 540908 - DNA, 25 bp, Mus musculus
atctactataagcttgggctgcccc

SEQ ID NO: 540909 - DNA, 25 bp, Mus musculus
atctactataaggttgggctgcccc

SEQ ID NO: 540910 - DNA, 25 bp, Mus musculus
atctactatggccaggtcaacatgc

SEQ ID NO: 540911 - DNA, 25 bp, Mus musculus
atctactatggcgaggtcaacatgc

SEQ ID NO: 540912 - DNA, 25 bp, Mus musculus
atctactgccatcgagagctcctgc

SEQ ID NO: 540913 - DNA, 25 bp, Mus musculus
atctactgccatggagagctcctgc

SEQ ID NO: 540914 - DNA, 25 bp, Mus musculus
atctactgtaagaccagcattgtgg

SEQ ID NO: 540915 - DNA, 25 bp, Mus musculus
atctactgtaagtccagcattgtgg

SEQ ID NO: 540916 - DNA, 25 bp, Mus musculus
atctagaggcaaagaaaaacttttt

SEQ ID NO: 540917 - DNA, 25 bp, Mus musculus
atctagaggcaatgaaaaacttttt

SEQ ID NO: 540918 - DNA, 25 bp, Mus musculus
atctagcgggatcgccagcgccgac

SEQ ID NO: 540919 - DNA, 25 bp, Mus musculus
atctagcgggatggccagcgccgac

SEQ ID NO: 540920 - DNA, 25 bp, Mus musculus
atctagtgaagccagtgtgtctgcc

SEQ ID NO: 540921 - DNA, 25 bp, Mus musculus
atctagtgaagcgagtgtgtctgcc

SEQ ID NO: 540922 - DNA, 25 bp, Mus musculus
atctagtggtcgaggcgtgctctgt

SEQ ID NO: 540923 - DNA, 25 bp, Mus musculus
atctagtggtcgtggcgtgctctgt

SEQ ID NO: 540924 - DNA, 25 bp, Mus musculus
atctatatcgatctgcccgtgccgg

SEQ ID NO: 540925 - DNA, 25 bp, Mus musculus
atctatatcgatgtgcccgtgccgg

SEQ ID NO: 540926 - DNA, 25 bp, Mus musculus
atctatcatccgacacctagccaga

SEQ ID NO: 540927 - DNA, 25 bp, Mus musculus
atctatcatccgtcacctagccaga

SEQ ID NO: 540928 - DNA, 25 bp, Mus musculus
atctatcgtttccacgcccagttct

SEQ ID NO: 540929 - DNA, 25 bp, Mus musculus
atctatcgtttcgacgcccagttct

SEQ ID NO: 540930 - DNA, 25 bp, Mus musculus
atctatctctttcgcgtccggtggg

SEQ ID NO: 540931 - DNA, 25 bp, Mus musculus
atctatctctttggcgtccggtggg

SEQ ID NO: 540932 - DNA, 25 bp, Mus musculus
atctatgacagcctaaccggcctca

SEQ ID NO: 540933 - DNA, 25 bp, Mus musculus
atctatgacagcgtaaccggcctca

SEQ ID NO: 540934 - DNA, 25 bp, Mus musculus
atctatgaccgcaatggccgggaag

SEQ ID NO: 540935 - DNA, 25 bp, Mus musculus
atctatgaccgctatggccgggaag

SEQ ID NO: 540936 - DNA, 25 bp, Mus musculus
atctatgagaagagcggtgccaagt

SEQ ID NO: 540937 - DNA, 25 bp, Mus musculus
atctatgagaagtgcggtgccaagt

SEQ ID NO: 540938 - DNA, 25 bp, Mus musculus
atctatgcttctctctgcgtcacca

SEQ ID NO: 540939 - DNA, 25 bp, Mus musculus
atctatgcttctgtctgcgtcacca

SEQ ID NO: 540940 - DNA, 25 bp, Mus musculus
atctatggaggacaatgaagaagac

SEQ ID NO: 540941 - DNA, 25 bp, Mus musculus
atctatggaggagaatgaagaagac

SEQ ID NO: 540942 - DNA, 25 bp, Mus musculus
atctatggctcaacctgcctcactg

SEQ ID NO: 540943 - DNA, 25 bp, Mus musculus
atctatggctcatcctgcctcactg

SEQ ID NO: 540944 - DNA, 25 bp, Mus musculus
atctatggtgccctgggctcccagg

SEQ ID NO: 540945 - DNA, 25 bp, Mus musculus
atctatggtgccgtgggctcccagg

SEQ ID NO: 540946 - DNA, 25 bp, Mus musculus
atctatgtgcccctaccgatgccag

SEQ ID NO: 540947 - DNA, 25 bp, Mus musculus
atctatgtgcccgtaccgatgccag

SEQ ID NO: 540948 - DNA, 25 bp, Mus musculus
atctattctttaccagtgggtggag

SEQ ID NO: 540949 - DNA, 25 bp, Mus musculus
atctattctttagcagtgggtggag

SEQ ID NO: 540950 - DNA, 25 bp, Mus musculus
atctatttccagctgcatcgggccc

SEQ ID NO: 540951 - DNA, 25 bp, Mus musculus
atctatttccaggtgcatcgggccc

SEQ ID NO: 540952 - DNA, 25 bp, Mus musculus
atctcacaggagcaatgcgaggccc

SEQ ID NO: 540953 - DNA, 25 bp, Mus musculus
atctcacaggaggaatgcgaggccc

SEQ ID NO: 540954 - DNA, 25 bp, Mus musculus
atctcacatggccaacctcatcatg

SEQ ID NO: 540955 - DNA, 25 bp, Mus musculus
atctcacatggcgaacctcatcatg

SEQ ID NO: 540956 - DNA, 25 bp, Mus musculus
atctcaccactcaagaatggcatgg

SEQ ID NO: 540957 - DNA, 25 bp, Mus musculus
atctcaccactctagaatggcatgg

SEQ ID NO: 540958 - DNA, 25 bp, Mus musculus
atctcactcgtcaaggagcctcgca

SEQ ID NO: 540959 - DNA, 25 bp, Mus musculus
atctcactcgtctaggagcctcgca

SEQ ID NO: 540960 - DNA, 25 bp, Mus musculus
atctcactctgaatccatgcatgtg

SEQ ID NO: 540961 - DNA, 25 bp, Mus musculus
atctcactctgattccatgcatgtg

SEQ ID NO: 540962 - DNA, 25 bp, Mus musculus
atctcagagggaacctagggtactg

SEQ ID NO: 540963 - DNA, 25 bp, Mus musculus
atctcagagggatcctagggtactg

SEQ ID NO: 540964 - DNA, 25 bp, Mus musculus
atctcagcacaccaggtaggaagga

SEQ ID NO: 540965 - DNA, 25 bp, Mus musculus
atctcagcacacgaggtaggaagga

SEQ ID NO: 540966 - DNA, 25 bp, Mus musculus
atctcagccccgaggcttggcactg

SEQ ID NO: 540967 - DNA, 25 bp, Mus musculus
atctcagccccgtggcttggcactg

SEQ ID NO: 540968 - DNA, 25 bp, Mus musculus
atctcagcggagagggaatgtagcc

SEQ ID NO: 540969 - DNA, 25 bp, Mus musculus
atctcagcggagtgggaatgtagcc

SEQ ID NO: 540970 - DNA, 25 bp, Mus musculus
atctcaggaatccaccgaagctggt

SEQ ID NO: 540971 - DNA, 25 bp, Mus musculus
atctcaggaatcgaccgaagctggt

SEQ ID NO: 540972 - DNA, 25 bp, Mus musculus
atctcatcccacagaggacagcctt

SEQ ID NO: 540973 - DNA, 25 bp, Mus musculus
atctcatcccactgaggacagcctt

SEQ ID NO: 540974 - DNA, 25 bp, Mus musculus
atctcatggtggacttcgggtaccg

SEQ ID NO: 540975 - DNA, 25 bp, Mus musculus
atctcatggtggtcttcgggtaccg

SEQ ID NO: 540976 - DNA, 25 bp, Mus musculus
atctccaagatgcagtaccccaggc

SEQ ID NO: 540977 - DNA, 25 bp, Mus musculus
atctccaagatggagtaccccaggc

SEQ ID NO: 540978 - DNA, 25 bp, Mus musculus
atctccaagtccagtggagggagcc

SEQ ID NO: 540979 - DNA, 25 bp, Mus musculus
atctccaagtcctgtggagggagcc

SEQ ID NO: 540980 - DNA, 25 bp, Mus musculus
atctccaagtcgagcagaaagtcct

SEQ ID NO: 540981 - DNA, 25 bp, Mus musculus
atctccaagtcgtgcagaaagtcct

SEQ ID NO: 540982 - DNA, 25 bp, Mus musculus
atctccaatcagctcatttcaccag

SEQ ID NO: 540983 - DNA, 25 bp, Mus musculus
atctccaatcaggtcatttcaccag

SEQ ID NO: 540984 - DNA, 25 bp, Mus musculus
atctccacggagatggccctggctc

SEQ ID NO: 540985 - DNA, 25 bp, Mus musculus
atctccacggagttggccctggctc

SEQ ID NO: 540986 - DNA, 25 bp, Mus musculus
atctccaggaccaggactctgcttc

SEQ ID NO: 540987 - DNA, 25 bp, Mus musculus
atctccaggacctggactctgcttc

SEQ ID NO: 540988 - DNA, 25 bp, Mus musculus
atctccagtggtctgatgaagctac

SEQ ID NO: 540989 - DNA, 25 bp, Mus musculus
atctccagtggtgtgatgaagctac

SEQ ID NO: 540990 - DNA, 25 bp, Mus musculus
atctcccaatttcagagaccgaagc

SEQ ID NO: 540991 - DNA, 25 bp, Mus musculus
atctcccaatttgagagaccgaagc

SEQ ID NO: 540992 - DNA, 25 bp, Mus musculus
atctccccgagcctagtcaacgtgt

SEQ ID NO: 540993 - DNA, 25 bp, Mus musculus
atctccccgagcgtagtcaacgtgt

SEQ ID NO: 540994 - DNA, 25 bp, Mus musculus
atctccccttacctcggtggcgtag

SEQ ID NO: 540995 - DNA, 25 bp, Mus musculus
atctccccttacgtcggtggcgtag

SEQ ID NO: 540996 - DNA, 25 bp, Mus musculus
atctcccgtttcagggccatgactg

SEQ ID NO: 540997 - DNA, 25 bp, Mus musculus
atctcccgtttctgggccatgactg

SEQ ID NO: 540998 - DNA, 25 bp, Mus musculus
atctccctgagaccctgaacgaact

SEQ ID NO: 540999 - DNA, 25 bp, Mus musculus
atctccctgagagcctgaacgaact

SEQ ID NO: 541000 - DNA, 25 bp, Mus musculus
atctccctgcttcacgagtctcagt

SEQ ID NO: 541001 - DNA, 25 bp, Mus musculus
atctccctgcttgacgagtctcagt

SEQ ID NO: 541002 - DNA, 25 bp, Mus musculus
atctcctatgtgaacactgctgagc

SEQ ID NO: 541003 - DNA, 25 bp, Mus musculus
atctcctatgtgtacactgctgagc

SEQ ID NO: 541004 - DNA, 25 bp, Mus musculus
atctccttgttcatggaggccacca

SEQ ID NO: 541005 - DNA, 25 bp, Mus musculus
atctccttgttcttggaggccacca

SEQ ID NO: 541006 - DNA, 25 bp, Mus musculus
atctcgctacggaggcagatgacag

SEQ ID NO: 541007 - DNA, 25 bp, Mus musculus
atctcgctacggtggcagatgacag

SEQ ID NO: 541008 - DNA, 25 bp, Mus musculus
atctcggcttggagtgacccgcgcc

SEQ ID NO: 541009 - DNA, 25 bp, Mus musculus
atctcggcttggtgtgacccgcgcc

SEQ ID NO: 541010 - DNA, 25 bp, Mus musculus
atctcgggaaaacgtggtgaagctc

SEQ ID NO: 541011 - DNA, 25 bp, Mus musculus
atctcgggaaaaggtggtgaagctc

SEQ ID NO: 541012 - DNA, 25 bp, Mus musculus
atctcgggcattactctgagcacca

SEQ ID NO: 541013 - DNA, 25 bp, Mus musculus
atctcgggcatttctctgagcacca

SEQ ID NO: 541014 - DNA, 25 bp, Mus musculus
atctcgtcgtgtcacctgcgccagg

SEQ ID NO: 541015 - DNA, 25 bp, Mus musculus
atctcgtcgtgtgacctgcgccagg

SEQ ID NO: 541016 - DNA, 25 bp, Mus musculus
atctcgtctccgctatcccattggg

SEQ ID NO: 541017 - DNA, 25 bp, Mus musculus
atctcgtctccggtatcccattggg

SEQ ID NO: 541018 - DNA, 25 bp, Mus musculus
atctctatggatcctgaacctactg

SEQ ID NO: 541019 - DNA, 25 bp, Mus musculus
atctctatggatgctgaacctactg

SEQ ID NO: 541020 - DNA, 25 bp, Mus musculus
atctctccggttctccaggtacaag

SEQ ID NO: 541021 - DNA, 25 bp, Mus musculus
atctctccggttgtccaggtacaag

SEQ ID NO: 541022 - DNA, 25 bp, Mus musculus
atctctgaccgcctccgacggagct

SEQ ID NO: 541023 - DNA, 25 bp, Mus musculus
atctctgaccgcgtccgacggagct

SEQ ID NO: 541024 - DNA, 25 bp, Mus musculus
atctctgagtggcacacaagctctg

SEQ ID NO: 541025 - DNA, 25 bp, Mus musculus
atctctgagtgggacacaagctctg

SEQ ID NO: 541026 - DNA, 25 bp, Mus musculus
atctctgcgctgaaggaacccatgg

SEQ ID NO: 541027 - DNA, 25 bp, Mus musculus
atctctgcgctgtaggaacccatgg

SEQ ID NO: 541028 - DNA, 25 bp, Mus musculus
atctctggctacaagaactgatcag

SEQ ID NO: 541029 - DNA, 25 bp, Mus musculus
atctctggctactagaactgatcag

SEQ ID NO: 541030 - DNA, 25 bp, Mus musculus
atctctggtgttcgccgtgactgtt

SEQ ID NO: 541031 - DNA, 25 bp, Mus musculus
atctctggtgttggccgtgactgtt

SEQ ID NO: 541032 - DNA, 25 bp, Mus musculus
atctcttcattaacctctccaggca

SEQ ID NO: 541033 - DNA, 25 bp, Mus musculus
atctcttcattatcctctccaggca

SEQ ID NO: 541034 - DNA, 25 bp, Mus musculus
atctcttctgcgacatcgttttcta

SEQ ID NO: 541035 - DNA, 25 bp, Mus musculus
atctcttctgcgtcatcgttttcta

SEQ ID NO: 541036 - DNA, 25 bp, Mus musculus
atctcttgatgcaatccccgacaac

SEQ ID NO: 541037 - DNA, 25 bp, Mus musculus
atctcttgatgctatccccgacaac

SEQ ID NO: 541038 - DNA, 25 bp, Mus musculus
atctcttgccttatgtcccctctag

SEQ ID NO: 541039 - DNA, 25 bp, Mus musculus
atctcttgccttttgtcccctctag

SEQ ID NO: 541040 - DNA, 25 bp, Mus musculus
atctctttattcaagcctttggaag

SEQ ID NO: 541041 - DNA, 25 bp, Mus musculus
atctctttattctagcctttggaag

SEQ ID NO: 541042 - DNA, 25 bp, Mus musculus
atctctttcattcggcctgtatcaa

SEQ ID NO: 541043 - DNA, 25 bp, Mus musculus
atctctttcattgggcctgtatcaa

SEQ ID NO: 541044 - DNA, 25 bp, Mus musculus
atctgaagccttctgtagtattaac

SEQ ID NO: 541045 - DNA, 25 bp, Mus musculus
atctgaagccttgtgtagtattaac

SEQ ID NO: 541046 - DNA, 25 bp, Mus musculus
atctgaagtataacagcccagacac

SEQ ID NO: 541047 - DNA, 25 bp, Mus musculus
atctgaagtatatcagcccagacac

SEQ ID NO: 541048 - DNA, 25 bp, Mus musculus
atctgacaaaaaccctttgcgagga

SEQ ID NO: 541049 - DNA, 25 bp, Mus musculus
atctgacaaaaagcctttgcgagga

SEQ ID NO: 541050 - DNA, 25 bp, Mus musculus
atctgacagaacatgccactgtgcc

SEQ ID NO: 541051 - DNA, 25 bp, Mus musculus
atctgacagaacttgccactgtgcc

SEQ ID NO: 541052 - DNA, 25 bp, Mus musculus
atctgaccaagaatgaagacctggg

SEQ ID NO: 541053 - DNA, 25 bp, Mus musculus
atctgaccaagattgaagacctggg

SEQ ID NO: 541054 - DNA, 25 bp, Mus musculus
atctgaccaggtccgcaagtctgtg

SEQ ID NO: 541055 - DNA, 25 bp, Mus musculus
atctgaccaggtgcgcaagtctgtg

SEQ ID NO: 541056 - DNA, 25 bp, Mus musculus
atctgaccgggcaggtcacacgcct

SEQ ID NO: 541057 - DNA, 25 bp, Mus musculus
atctgaccgggctggtcacacgcct

SEQ ID NO: 541058 - DNA, 25 bp, Mus musculus
atctgacctaggatccctggccttg

SEQ ID NO: 541059 - DNA, 25 bp, Mus musculus
atctgacctaggttccctggccttg

SEQ ID NO: 541060 - DNA, 25 bp, Mus musculus
atctgagaatctactctctctgggc

SEQ ID NO: 541061 - DNA, 25 bp, Mus musculus
atctgagaatcttctctctctgggc

SEQ ID NO: 541062 - DNA, 25 bp, Mus musculus
atctgagcactgaggccgttggtgt

SEQ ID NO: 541063 - DNA, 25 bp, Mus musculus
atctgagcactgtggccgttggtgt

SEQ ID NO: 541064 - DNA, 25 bp, Mus musculus
atctgagcggccctggtgctacacc

SEQ ID NO: 541065 - DNA, 25 bp, Mus musculus
atctgagcggccgtggtgctacacc

SEQ ID NO: 541066 - DNA, 25 bp, Mus musculus
atctgaggaagcaattcccaatatc

SEQ ID NO: 541067 - DNA, 25 bp, Mus musculus
atctgaggaagctattcccaatatc

SEQ ID NO: 541068 - DNA, 25 bp, Mus musculus
atctgaggagtcagatgaaatgcca

SEQ ID NO: 541069 - DNA, 25 bp, Mus musculus
atctgaggagtctgatgaaatgcca

SEQ ID NO: 541070 - DNA, 25 bp, Mus musculus
atctgagggcccacgcctggagctg

SEQ ID NO: 541071 - DNA, 25 bp, Mus musculus
atctgagggccctcgcctggagctg

SEQ ID NO: 541072 - DNA, 25 bp, Mus musculus
atctgagtgggaacaagagtgagct

SEQ ID NO: 541073 - DNA, 25 bp, Mus musculus
atctgagtgggatcaagagtgagct

SEQ ID NO: 541074 - DNA, 25 bp, Mus musculus
atctgatcagccaacccgcgcattg

SEQ ID NO: 541075 - DNA, 25 bp, Mus musculus
atctgatcagcctacccgcgcattg

SEQ ID NO: 541076 - DNA, 25 bp, Mus musculus
atctgatccaggagctccgaagacc

SEQ ID NO: 541077 - DNA, 25 bp, Mus musculus
atctgatccaggtgctccgaagacc

SEQ ID NO: 541078 - DNA, 25 bp, Mus musculus
atctgattaattaggcagccgtggg

SEQ ID NO: 541079 - DNA, 25 bp, Mus musculus
atctgattaatttggcagccgtggg

SEQ ID NO: 541080 - DNA, 25 bp, Mus musculus
atctgatttgaacgcagactcaatc

SEQ ID NO: 541081 - DNA, 25 bp, Mus musculus
atctgatttgaaggcagactcaatc

SEQ ID NO: 541082 - DNA, 25 bp, Mus musculus
atctgcaaaaagctgtcctgtccca

SEQ ID NO: 541083 - DNA, 25 bp, Mus musculus
atctgcaaaaaggtgtcctgtccca

SEQ ID NO: 541084 - DNA, 25 bp, Mus musculus
atctgcaaagacagtactcaaaggg

SEQ ID NO: 541085 - DNA, 25 bp, Mus musculus
atctgcaaagactgtactcaaaggg

SEQ ID NO: 541086 - DNA, 25 bp, Mus musculus
atctgcaagcagacctgtgcccggg

SEQ ID NO: 541087 - DNA, 25 bp, Mus musculus
atctgcaagcagtcctgtgcccggg

SEQ ID NO: 541088 - DNA, 25 bp, Mus musculus
atctgcacccaacagaatattttgt

SEQ ID NO: 541089 - DNA, 25 bp, Mus musculus
atctgcacccaagagaatattttgt

SEQ ID NO: 541090 - DNA, 25 bp, Mus musculus
atctgcaccctaagtctcagctcag

SEQ ID NO: 541091 - DNA, 25 bp, Mus musculus
atctgcaccctatgtctcagctcag

SEQ ID NO: 541092 - DNA, 25 bp, Mus musculus
atctgcagcgcaagaaggagcggca

SEQ ID NO: 541093 - DNA, 25 bp, Mus musculus
atctgcagcgcatgaaggagcggca

SEQ ID NO: 541094 - DNA, 25 bp, Mus musculus
atctgcatcagacccatgtgctgca

SEQ ID NO: 541095 - DNA, 25 bp, Mus musculus
atctgcatcagagccatgtgctgca

SEQ ID NO: 541096 - DNA, 25 bp, Mus musculus
atctgcatttaaccggctcttcctg

SEQ ID NO: 541097 - DNA, 25 bp, Mus musculus
atctgcatttaagcggctcttcctg

SEQ ID NO: 541098 - DNA, 25 bp, Mus musculus
atctgccaacctctgcgcctgggta

SEQ ID NO: 541099 - DNA, 25 bp, Mus musculus
atctgccaacctgtgcgcctgggta

SEQ ID NO: 541100 - DNA, 25 bp, Mus musculus
atctgccacaccagccaaattgagt

SEQ ID NO: 541101 - DNA, 25 bp, Mus musculus
atctgccacacctgccaaattgagt

SEQ ID NO: 541102 - DNA, 25 bp, Mus musculus
atctgccccggacctgcgacgattt

SEQ ID NO: 541103 - DNA, 25 bp, Mus musculus
atctgccccggagctgcgacgattt

SEQ ID NO: 541104 - DNA, 25 bp, Mus musculus
atctgccccgggaacaaggaggctc

SEQ ID NO: 541105 - DNA, 25 bp, Mus musculus
atctgccccgggtacaaggaggctc

SEQ ID NO: 541106 - DNA, 25 bp, Mus musculus
atctgccgcagcaggcccaaaggct

SEQ ID NO: 541107 - DNA, 25 bp, Mus musculus
atctgccgcagctggcccaaaggct

SEQ ID NO: 541108 - DNA, 25 bp, Mus musculus
atctgccgggagacgcccaaaggtg

SEQ ID NO: 541109 - DNA, 25 bp, Mus musculus
atctgccgggagtcgcccaaaggtg

SEQ ID NO: 541110 - DNA, 25 bp, Mus musculus
atctgccgggtgagccgacgagacc

SEQ ID NO: 541111 - DNA, 25 bp, Mus musculus
atctgccgggtgtgccgacgagacc

SEQ ID NO: 541112 - DNA, 25 bp, Mus musculus
atctgcctgactccttgggacccgg

SEQ ID NO: 541113 - DNA, 25 bp, Mus musculus
atctgcctgactgcttgggacccgg

SEQ ID NO: 541114 - DNA, 25 bp, Mus musculus
atctgcgaaccactcccgaaatctg

SEQ ID NO: 541115 - DNA, 25 bp, Mus musculus
atctgcgaaccagtcccgaaatctg

SEQ ID NO: 541116 - DNA, 25 bp, Mus musculus
atctgcggcaggaattggctgtgca

SEQ ID NO: 541117 - DNA, 25 bp, Mus musculus
atctgcggcaggtattggctgtgca

SEQ ID NO: 541118 - DNA, 25 bp, Mus musculus
atctgcggcccgagaagaagcccaa

SEQ ID NO: 541119 - DNA, 25 bp, Mus musculus
atctgcggcccgtgaagaagcccaa

SEQ ID NO: 541120 - DNA, 25 bp, Mus musculus
atctgctacaccatctttgacctgg

SEQ ID NO: 541121 - DNA, 25 bp, Mus musculus
atctgctacaccttctttgacctgg

SEQ ID NO: 541122 - DNA, 25 bp, Mus musculus
atctgctcaacaaccccagctggaa

SEQ ID NO: 541123 - DNA, 25 bp, Mus musculus
atctgctcaacatccccagctggaa

SEQ ID NO: 541124 - DNA, 25 bp, Mus musculus
atctgctgcagcatgaggagtcccc

SEQ ID NO: 541125 - DNA, 25 bp, Mus musculus
atctgctgcagcttgaggagtcccc

SEQ ID NO: 541126 - DNA, 25 bp, Mus musculus
atctgctgcccaaactaactccatg

SEQ ID NO: 541127 - DNA, 25 bp, Mus musculus
atctgctgcccatactaactccatg

SEQ ID NO: 541128 - DNA, 25 bp, Mus musculus
atctgctgcggaacttgctcacggg

SEQ ID NO: 541129 - DNA, 25 bp, Mus musculus
atctgctgcggatcttgctcacggg

SEQ ID NO: 541130 - DNA, 25 bp, Mus musculus
atctgctgtgagctgagacccggtc

SEQ ID NO: 541131 - DNA, 25 bp, Mus musculus
atctgctgtgaggtgagacccggtc

SEQ ID NO: 541132 - DNA, 25 bp, Mus musculus
atctggaaagtgctctgaagctaca

SEQ ID NO: 541133 - DNA, 25 bp, Mus musculus
atctggaaagtggtctgaagctaca

SEQ ID NO: 541134 - DNA, 25 bp, Mus musculus
atctggaaccccagggccacgaaag

SEQ ID NO: 541135 - DNA, 25 bp, Mus musculus
atctggaacccctgggccacgaaag

SEQ ID NO: 541136 - DNA, 25 bp, Mus musculus
atctggaacctgaagttgatgcgtt

SEQ ID NO: 541137 - DNA, 25 bp, Mus musculus
atctggaacctgtagttgatgcgtt

SEQ ID NO: 541138 - DNA, 25 bp, Mus musculus
atctggaagaagctgccaaaactga

SEQ ID NO: 541139 - DNA, 25 bp, Mus musculus
atctggaagaaggtgccaaaactga

SEQ ID NO: 541140 - DNA, 25 bp, Mus musculus
atctggacccagaatagcccttcgc

SEQ ID NO: 541141 - DNA, 25 bp, Mus musculus
atctggacccagtatagcccttcgc

SEQ ID NO: 541142 - DNA, 25 bp, Mus musculus
atctggacccggcactgcagcgact

SEQ ID NO: 541143 - DNA, 25 bp, Mus musculus
atctggacccgggactgcagcgact

SEQ ID NO: 541144 - DNA, 25 bp, Mus musculus
atctggacgaccacacggacatgga

SEQ ID NO: 541145 - DNA, 25 bp, Mus musculus
atctggacgacctcacggacatgga

SEQ ID NO: 541146 - DNA, 25 bp, Mus musculus
atctggactggacccaacaagcagc

SEQ ID NO: 541147 - DNA, 25 bp, Mus musculus
atctggactggagccaacaagcagc

SEQ ID NO: 541148 - DNA, 25 bp, Mus musculus
atctggacttggactggaccccacc

SEQ ID NO: 541149 - DNA, 25 bp, Mus musculus
atctggacttggtctggaccccacc

SEQ ID NO: 541150 - DNA, 25 bp, Mus musculus
atctggagaatccagcaggcccagg

SEQ ID NO: 541151 - DNA, 25 bp, Mus musculus
atctggagaatcgagcaggcccagg

SEQ ID NO: 541152 - DNA, 25 bp, Mus musculus
atctggagacatattgtagtctgca

SEQ ID NO: 541153 - DNA, 25 bp, Mus musculus
atctggagacattttgtagtctgca

SEQ ID NO: 541154 - DNA, 25 bp, Mus musculus
atctggagcagtatggaacttcctc

SEQ ID NO: 541155 - DNA, 25 bp, Mus musculus
atctggagcagtttggaacttcctc

SEQ ID NO: 541156 - DNA, 25 bp, Mus musculus
atctggagcgccatggaagcctcgc

SEQ ID NO: 541157 - DNA, 25 bp, Mus musculus
atctggagcgccttggaagcctcgc

SEQ ID NO: 541158 - DNA, 25 bp, Mus musculus
atctggaggctaatcaccaatttct

SEQ ID NO: 541159 - DNA, 25 bp, Mus musculus
atctggaggctattcaccaatttct

SEQ ID NO: 541160 - DNA, 25 bp, Mus musculus
atctggatacgcatagagctactgc

SEQ ID NO: 541161 - DNA, 25 bp, Mus musculus
atctggatacgcttagagctactgc

SEQ ID NO: 541162 - DNA, 25 bp, Mus musculus
atctggatcgtgaagcccggagcca

SEQ ID NO: 541163 - DNA, 25 bp, Mus musculus
atctggatcgtgtagcccggagcca

SEQ ID NO: 541164 - DNA, 25 bp, Mus musculus
atctggattatgagatggctgctgc

SEQ ID NO: 541165 - DNA, 25 bp, Mus musculus
atctggattatgtgatggctgctgc

SEQ ID NO: 541166 - DNA, 25 bp, Mus musculus
atctggcaagttccgtcgtggcagt

SEQ ID NO: 541167 - DNA, 25 bp, Mus musculus
atctggcaagttgcgtcgtggcagt

SEQ ID NO: 541168 - DNA, 25 bp, Mus musculus
atctggccataaatgaggctctgaa

SEQ ID NO: 541169 - DNA, 25 bp, Mus musculus
atctggccataattgaggctctgaa

SEQ ID NO: 541170 - DNA, 25 bp, Mus musculus
atctggccgcgccagctgaccagtg

SEQ ID NO: 541171 - DNA, 25 bp, Mus musculus
atctggccgcgcgagctgaccagtg

SEQ ID NO: 541172 - DNA, 25 bp, Mus musculus
atctggcttcacagcattggctctt

SEQ ID NO: 541173 - DNA, 25 bp, Mus musculus
atctggcttcactgcattggctctt

SEQ ID NO: 541174 - DNA, 25 bp, Mus musculus
atctgggacagaacaactagaagca

SEQ ID NO: 541175 - DNA, 25 bp, Mus musculus
atctgggacagatcaactagaagca

SEQ ID NO: 541176 - DNA, 25 bp, Mus musculus
atctgggacccgctctgagcaggac

SEQ ID NO: 541177 - DNA, 25 bp, Mus musculus
atctgggacccggtctgagcaggac

SEQ ID NO: 541178 - DNA, 25 bp, Mus musculus
atctgggattgtctcttgagctgaa

SEQ ID NO: 541179 - DNA, 25 bp, Mus musculus
atctgggattgtgtcttgagctgaa

SEQ ID NO: 541180 - DNA, 25 bp, Mus musculus
atctgggcaatgaccgggctgaagc

SEQ ID NO: 541181 - DNA, 25 bp, Mus musculus
atctgggcaatgtccgggctgaagc

SEQ ID NO: 541182 - DNA, 25 bp, Mus musculus
atctgggcatcgctcctgtccacag

SEQ ID NO: 541183 - DNA, 25 bp, Mus musculus
atctgggcatcggtcctgtccacag

SEQ ID NO: 541184 - DNA, 25 bp, Mus musculus
atctgggctctgcaactgaaggctc

SEQ ID NO: 541185 - DNA, 25 bp, Mus musculus
atctgggctctggaactgaaggctc

SEQ ID NO: 541186 - DNA, 25 bp, Mus musculus
atctgggtaagcatcaaagaatcca

SEQ ID NO: 541187 - DNA, 25 bp, Mus musculus
atctgggtaagcttcaaagaatcca

SEQ ID NO: 541188 - DNA, 25 bp, Mus musculus
atctggtactgcagcctaccctgct

SEQ ID NO: 541189 - DNA, 25 bp, Mus musculus
atctggtactgctgcctaccctgct

SEQ ID NO: 541190 - DNA, 25 bp, Mus musculus
atctggtgctgacccccctgtcagg

SEQ ID NO: 541191 - DNA, 25 bp, Mus musculus
atctggtgctgagccccctgtcagg

SEQ ID NO: 541192 - DNA, 25 bp, Mus musculus
atctggtgggagaatgctggctacc

SEQ ID NO: 541193 - DNA, 25 bp, Mus musculus
atctggtgggagtatgctggctacc

SEQ ID NO: 541194 - DNA, 25 bp, Mus musculus
atctggtggtgaagggatacatgat

SEQ ID NO: 541195 - DNA, 25 bp, Mus musculus
atctggtggtgatgggatacatgat

SEQ ID NO: 541196 - DNA, 25 bp, Mus musculus
atctgtacacaacggctgccactgc

SEQ ID NO: 541197 - DNA, 25 bp, Mus musculus
atctgtacacaagggctgccactgc

SEQ ID NO: 541198 - DNA, 25 bp, Mus musculus
atctgtacctccatgcgctacgtgc

SEQ ID NO: 541199 - DNA, 25 bp, Mus musculus
atctgtacctccttgcgctacgtgc

SEQ ID NO: 541200 - DNA, 25 bp, Mus musculus
atctgtatccttcaggatgagccgg

SEQ ID NO: 541201 - DNA, 25 bp, Mus musculus
atctgtatccttgaggatgagccgg

SEQ ID NO: 541202 - DNA, 25 bp, Mus musculus
atctgtcacccaattccaagaggaa

SEQ ID NO: 541203 - DNA, 25 bp, Mus musculus
atctgtcacccatttccaagaggaa

SEQ ID NO: 541204 - DNA, 25 bp, Mus musculus
atctgtcagcatcacctggactggg

SEQ ID NO: 541205 - DNA, 25 bp, Mus musculus
atctgtcagcatgacctggactggg

SEQ ID NO: 541206 - DNA, 25 bp, Mus musculus
atctgtcagctcaatgcgcgcacct

SEQ ID NO: 541207 - DNA, 25 bp, Mus musculus
atctgtcagctctatgcgcgcacct

SEQ ID NO: 541208 - DNA, 25 bp, Mus musculus
atctgtcatccccaaaggaaaatct

SEQ ID NO: 541209 - DNA, 25 bp, Mus musculus
atctgtcatcccgaaaggaaaatct

SEQ ID NO: 541210 - DNA, 25 bp, Mus musculus
atctgtccgagtagcccaaaccaca

SEQ ID NO: 541211 - DNA, 25 bp, Mus musculus
atctgtccgagttgcccaaaccaca

SEQ ID NO: 541212 - DNA, 25 bp, Mus musculus
atctgtcctccgagaccaccagtgg

SEQ ID NO: 541213 - DNA, 25 bp, Mus musculus
atctgtcctccgtgaccaccagtgg

SEQ ID NO: 541214 - DNA, 25 bp, Mus musculus
atctgtcgctttatccagcagctca

SEQ ID NO: 541215 - DNA, 25 bp, Mus musculus
atctgtcgctttttccagcagctca

SEQ ID NO: 541216 - DNA, 25 bp, Mus musculus
atctgtcggcttcccagtgggcgac

SEQ ID NO: 541217 - DNA, 25 bp, Mus musculus
atctgtcggcttgccagtgggcgac

SEQ ID NO: 541218 - DNA, 25 bp, Mus musculus
atctgtctcgagagctgaagacact

SEQ ID NO: 541219 - DNA, 25 bp, Mus musculus
atctgtctcgagtgctgaagacact

SEQ ID NO: 541220 - DNA, 25 bp, Mus musculus
atctgtctctaacggatgggccgag

SEQ ID NO: 541221 - DNA, 25 bp, Mus musculus
atctgtctctaagggatgggccgag

SEQ ID NO: 541222 - DNA, 25 bp, Mus musculus
atctgtctgagcagtgtggacatgg

SEQ ID NO: 541223 - DNA, 25 bp, Mus musculus
atctgtctgagctgtgtggacatgg

SEQ ID NO: 541224 - DNA, 25 bp, Mus musculus
atctgtgaatatagtgctcgggcct

SEQ ID NO: 541225 - DNA, 25 bp, Mus musculus
atctgtgaatattgtgctcgggcct

SEQ ID NO: 541226 - DNA, 25 bp, Mus musculus
atctgtgatattcccatcaactggg

SEQ ID NO: 541227 - DNA, 25 bp, Mus musculus
atctgtgatattgccatcaactggg

SEQ ID NO: 541228 - DNA, 25 bp, Mus musculus
atctgtgcgattcgcggcacctctg

SEQ ID NO: 541229 - DNA, 25 bp, Mus musculus
atctgtgcgattggcggcacctctg

SEQ ID NO: 541230 - DNA, 25 bp, Mus musculus
atctgtggccccaaaggaggacacc

SEQ ID NO: 541231 - DNA, 25 bp, Mus musculus
atctgtggcccctaaggaggacacc

SEQ ID NO: 541232 - DNA, 25 bp, Mus musculus
atctgttttcttcaagctagctcgg

SEQ ID NO: 541233 - DNA, 25 bp, Mus musculus
atctgttttcttgaagctagctcgg

SEQ ID NO: 541234 - DNA, 25 bp, Mus musculus
atcttacgcatcatgtgtcacctgg

SEQ ID NO: 541235 - DNA, 25 bp, Mus musculus
atcttacgcatcttgtgtcacctgg

SEQ ID NO: 541236 - DNA, 25 bp, Mus musculus
atcttagaagctacccgcgtgggca

SEQ ID NO: 541237 - DNA, 25 bp, Mus musculus
atcttagaagcttcccgcgtgggca

SEQ ID NO: 541238 - DNA, 25 bp, Mus musculus
atcttagctgcaaagccatcccgag

SEQ ID NO: 541239 - DNA, 25 bp, Mus musculus
atcttagctgcatagccatcccgag

SEQ ID NO: 541240 - DNA, 25 bp, Mus musculus
atcttatagacccaggatggagaag

SEQ ID NO: 541241 - DNA, 25 bp, Mus musculus
atcttatagaccgaggatggagaag

SEQ ID NO: 541242 - DNA, 25 bp, Mus musculus
atcttcaacaagcacctgctggcca

SEQ ID NO: 541243 - DNA, 25 bp, Mus musculus
atcttcaacaaggacctgctggcca

SEQ ID NO: 541244 - DNA, 25 bp, Mus musculus
atcttcacctacaacaccacttggg

SEQ ID NO: 541245 - DNA, 25 bp, Mus musculus
atcttcacctactacaccacttggg

SEQ ID NO: 541246 - DNA, 25 bp, Mus musculus
atcttcataggcctgggagagctcg

SEQ ID NO: 541247 - DNA, 25 bp, Mus musculus
atcttcataggcgtgggagagctcg

SEQ ID NO: 541248 - DNA, 25 bp, Mus musculus
atcttcatcatcctccctcttggga

SEQ ID NO: 541249 - DNA, 25 bp, Mus musculus
atcttcatcatcgtccctcttggga

SEQ ID NO: 541250 - DNA, 25 bp, Mus musculus
atcttcatccagatcggcctctact

SEQ ID NO: 541251 - DNA, 25 bp, Mus musculus
atcttcatccagttcggcctctact

SEQ ID NO: 541252 - DNA, 25 bp, Mus musculus
atcttcatcctgaacaaccgctggg

SEQ ID NO: 541253 - DNA, 25 bp, Mus musculus
atcttcatcctgtacaaccgctggg

SEQ ID NO: 541254 - DNA, 25 bp, Mus musculus
atcttcattaacaatgagtggcacg

SEQ ID NO: 541255 - DNA, 25 bp, Mus musculus
atcttcattaactatgagtggcacg

SEQ ID NO: 541256 - DNA, 25 bp, Mus musculus
atcttccaggcacagacggcggatg

SEQ ID NO: 541257 - DNA, 25 bp, Mus musculus
atcttccaggcagagacggcggatg

SEQ ID NO: 541258 - DNA, 25 bp, Mus musculus
atcttcccacggaggtcactgtgct

SEQ ID NO: 541259 - DNA, 25 bp, Mus musculus
atcttcccacggtggtcactgtgct

SEQ ID NO: 541260 - DNA, 25 bp, Mus musculus
atcttcccatatagccgtggcttgc

SEQ ID NO: 541261 - DNA, 25 bp, Mus musculus
atcttcccatattgccgtggcttgc

SEQ ID NO: 541262 - DNA, 25 bp, Mus musculus
atcttcccctgtcaggagagagaga

SEQ ID NO: 541263 - DNA, 25 bp, Mus musculus
atcttcccctgtgaggagagagaga

SEQ ID NO: 541264 - DNA, 25 bp, Mus musculus
atcttccctaacagccggctgaagc

SEQ ID NO: 541265 - DNA, 25 bp, Mus musculus
atcttccctaactgccggctgaagc

SEQ ID NO: 541266 - DNA, 25 bp, Mus musculus
atcttccgggaacgcccttacatcg

SEQ ID NO: 541267 - DNA, 25 bp, Mus musculus
atcttccgggaaggcccttacatcg

SEQ ID NO: 541268 - DNA, 25 bp, Mus musculus
atcttccgtctcaggcagaacgcgc

SEQ ID NO: 541269 - DNA, 25 bp, Mus musculus
atcttccgtctctggcagaacgcgc

SEQ ID NO: 541270 - DNA, 25 bp, Mus musculus
atcttcgaagagcagggccagacac

SEQ ID NO: 541271 - DNA, 25 bp, Mus musculus
atcttcgaagaggagggccagacac

SEQ ID NO: 541272 - DNA, 25 bp, Mus musculus
atcttcgacctgctgaccggccggg

SEQ ID NO: 541273 - DNA, 25 bp, Mus musculus
atcttcgacctggtgaccggccggg

SEQ ID NO: 541274 - DNA, 25 bp, Mus musculus
atcttcgatgacaatgccaagttgc

SEQ ID NO: 541275 - DNA, 25 bp, Mus musculus
atcttcgatgactatgccaagttgc

SEQ ID NO: 541276 - DNA, 25 bp, Mus musculus
atcttcggcgctctccccgtggccg

SEQ ID NO: 541277 - DNA, 25 bp, Mus musculus
atcttcggcgctgtccccgtggccg

SEQ ID NO: 541278 - DNA, 25 bp, Mus musculus
atcttctatttgcttagtgccacca

SEQ ID NO: 541279 - DNA, 25 bp, Mus musculus
atcttctatttggttagtgccacca

SEQ ID NO: 541280 - DNA, 25 bp, Mus musculus
atcttctcccgaagcacccatgagt

SEQ ID NO: 541281 - DNA, 25 bp, Mus musculus
atcttctcccgatgcacccatgagt

SEQ ID NO: 541282 - DNA, 25 bp, Mus musculus
atcttctgacgaaaaacagagacag

SEQ ID NO: 541283 - DNA, 25 bp, Mus musculus
atcttctgacgataaacagagacag

SEQ ID NO: 541284 - DNA, 25 bp, Mus musculus
atcttctgcgtcacctgcgggcatc

SEQ ID NO: 541285 - DNA, 25 bp, Mus musculus
atcttctgcgtctcctgcgggcatc

SEQ ID NO: 541286 - DNA, 25 bp, Mus musculus
atcttctggccaattccttcctctg

SEQ ID NO: 541287 - DNA, 25 bp, Mus musculus
atcttctggccatttccttcctctg

SEQ ID NO: 541288 - DNA, 25 bp, Mus musculus
atcttctgtcccaccagcagcagtg

SEQ ID NO: 541289 - DNA, 25 bp, Mus musculus
atcttctgtccctccagcagcagtg

SEQ ID NO: 541290 - DNA, 25 bp, Mus musculus
atcttctgtgaaccggtggccatct

SEQ ID NO: 541291 - DNA, 25 bp, Mus musculus
atcttctgtgaagcggtggccatct

SEQ ID NO: 541292 - DNA, 25 bp, Mus musculus
atcttcttgtctcagagagcagtag

SEQ ID NO: 541293 - DNA, 25 bp, Mus musculus
atcttcttgtctgagagagcagtag

SEQ ID NO: 541294 - DNA, 25 bp, Mus musculus
atcttctttatgctaaccgagctct

SEQ ID NO: 541295 - DNA, 25 bp, Mus musculus
atcttctttatggtaaccgagctct

SEQ ID NO: 541296 - DNA, 25 bp, Mus musculus
atcttgaaagctcccaagcctgagc

SEQ ID NO: 541297 - DNA, 25 bp, Mus musculus
atcttgaaagctgccaagcctgagc

SEQ ID NO: 541298 - DNA, 25 bp, Mus musculus
atcttgatccagaagagccccagag

SEQ ID NO: 541299 - DNA, 25 bp, Mus musculus
atcttgatccagtagagccccagag

SEQ ID NO: 541300 - DNA, 25 bp, Mus musculus
atcttgccggaaattcagaagccag

SEQ ID NO: 541301 - DNA, 25 bp, Mus musculus
atcttgccggaatttcagaagccag

SEQ ID NO: 541302 - DNA, 25 bp, Mus musculus
atcttgcgaagtccccaagctcttc

SEQ ID NO: 541303 - DNA, 25 bp, Mus musculus
atcttgcgaagtgcccaagctcttc

SEQ ID NO: 541304 - DNA, 25 bp, Mus musculus
atcttgctatgcctttggaattcta

SEQ ID NO: 541305 - DNA, 25 bp, Mus musculus
atcttgctatgcgtttggaattcta

SEQ ID NO: 541306 - DNA, 25 bp, Mus musculus
atcttgctcacacctggacaagtct

SEQ ID NO: 541307 - DNA, 25 bp, Mus musculus
atcttgctcacagctggacaagtct

SEQ ID NO: 541308 - DNA, 25 bp, Mus musculus
atcttgctgagaaactaacaggccc

SEQ ID NO: 541309 - DNA, 25 bp, Mus musculus
atcttgctgagatactaacaggccc

SEQ ID NO: 541310 - DNA, 25 bp, Mus musculus
atcttgctgcacctggacatcgcct

SEQ ID NO: 541311 - DNA, 25 bp, Mus musculus
atcttgctgcacgtggacatcgcct

SEQ ID NO: 541312 - DNA, 25 bp, Mus musculus
atcttggaacagcacaggccaggcc

SEQ ID NO: 541313 - DNA, 25 bp, Mus musculus
atcttggaacaggacaggccaggcc

SEQ ID NO: 541314 - DNA, 25 bp, Mus musculus
atcttggactggacattggtgccca

SEQ ID NO: 541315 - DNA, 25 bp, Mus musculus
atcttggactggtcattggtgccca

SEQ ID NO: 541316 - DNA, 25 bp, Mus musculus
atcttggcactcaggcttccacatc

SEQ ID NO: 541317 - DNA, 25 bp, Mus musculus
atcttggcactctggcttccacatc

SEQ ID NO: 541318 - DNA, 25 bp, Mus musculus
atcttggcatctctcctggcactgg

SEQ ID NO: 541319 - DNA, 25 bp, Mus musculus
atcttggcatctgtcctggcactgg

SEQ ID NO: 541320 - DNA, 25 bp, Mus musculus
atcttgggcatccttatcatcctta

SEQ ID NO: 541321 - DNA, 25 bp, Mus musculus
atcttgggcatcgttatcatcctta

SEQ ID NO: 541322 - DNA, 25 bp, Mus musculus
atcttggtagaacagagcaacgtgc

SEQ ID NO: 541323 - DNA, 25 bp, Mus musculus
atcttggtagaagagagcaacgtgc

SEQ ID NO: 541324 - DNA, 25 bp, Mus musculus
atcttgtcaccgctgctgctgctga

SEQ ID NO: 541325 - DNA, 25 bp, Mus musculus
atcttgtcaccggtgctgctgctga

SEQ ID NO: 541326 - DNA, 25 bp, Mus musculus
atcttgttctacctttctttctggg

SEQ ID NO: 541327 - DNA, 25 bp, Mus musculus
atcttgttctacgtttctttctggg

SEQ ID NO: 541328 - DNA, 25 bp, Mus musculus
atcttgttgtatcggcctcctggga

SEQ ID NO: 541329 - DNA, 25 bp, Mus musculus
atcttgttgtatgggcctcctggga

SEQ ID NO: 541330 - DNA, 25 bp, Mus musculus
atctttaagcgcctttggctggccc

SEQ ID NO: 541331 - DNA, 25 bp, Mus musculus
atctttaagcgcgtttggctggccc

SEQ ID NO: 541332 - DNA, 25 bp, Mus musculus
atctttaatgtacagatggcctgtg

SEQ ID NO: 541333 - DNA, 25 bp, Mus musculus
atctttaatgtagagatggcctgtg

SEQ ID NO: 541334 - DNA, 25 bp, Mus musculus
atctttacaggtcacgtgcacagac

SEQ ID NO: 541335 - DNA, 25 bp, Mus musculus
atctttacaggtgacgtgcacagac

SEQ ID NO: 541336 - DNA, 25 bp, Mus musculus
atctttatggacatctacatggcct

SEQ ID NO: 541337 - DNA, 25 bp, Mus musculus
atctttatggacttctacatggcct

SEQ ID NO: 541338 - DNA, 25 bp, Mus musculus
atctttcagaaacccctgacggagt

SEQ ID NO: 541339 - DNA, 25 bp, Mus musculus
atctttcagaaagccctgacggagt

SEQ ID NO: 541340 - DNA, 25 bp, Mus musculus
atctttccacccagggctccagagg

SEQ ID NO: 541341 - DNA, 25 bp, Mus musculus
atctttccaccctgggctccagagg

SEQ ID NO: 541342 - DNA, 25 bp, Mus musculus
atctttccctggcagccgcgtgttc

SEQ ID NO: 541343 - DNA, 25 bp, Mus musculus
atctttccctgggagccgcgtgttc

SEQ ID NO: 541344 - DNA, 25 bp, Mus musculus
atctttcccttgaggcccgactcat

SEQ ID NO: 541345 - DNA, 25 bp, Mus musculus
atctttcccttgtggcccgactcat

SEQ ID NO: 541346 - DNA, 25 bp, Mus musculus
atctttcctgttccgttatgccgac

SEQ ID NO: 541347 - DNA, 25 bp, Mus musculus
atctttcctgttgcgttatgccgac

SEQ ID NO: 541348 - DNA, 25 bp, Mus musculus
atctttctacctcttgtcatctgcc

SEQ ID NO: 541349 - DNA, 25 bp, Mus musculus
atctttctacctgttgtcatctgcc

SEQ ID NO: 541350 - DNA, 25 bp, Mus musculus
atctttctggacacggcgctggcgg

SEQ ID NO: 541351 - DNA, 25 bp, Mus musculus
atctttctggactcggcgctggcgg

SEQ ID NO: 541352 - DNA, 25 bp, Mus musculus
atctttgcttgcaatactgtcaggg

SEQ ID NO: 541353 - DNA, 25 bp, Mus musculus
atctttgcttgctatactgtcaggg

SEQ ID NO: 541354 - DNA, 25 bp, Mus musculus
atctttggatttcaggacttcgaaa

SEQ ID NO: 541355 - DNA, 25 bp, Mus musculus
atctttggatttgaggacttcgaaa

SEQ ID NO: 541356 - DNA, 25 bp, Mus musculus
atctttgggcctccaggtaccggca

SEQ ID NO: 541357 - DNA, 25 bp, Mus musculus
atctttgggcctgcaggtaccggca

SEQ ID NO: 541358 - DNA, 25 bp, Mus musculus
atcttttccttgattgccgcctgac

SEQ ID NO: 541359 - DNA, 25 bp, Mus musculus
atcttttccttgtttgccgcctgac

SEQ ID NO: 541360 - DNA, 25 bp, Mus musculus
atgaaaacagaaacccctctccctg

SEQ ID NO: 541361 - DNA, 25 bp, Mus musculus
atgaaaacagaatcccctctccctg

SEQ ID NO: 541362 - DNA, 25 bp, Mus musculus
atgaaaacaggaaggaagcccgacg

SEQ ID NO: 541363 - DNA, 25 bp, Mus musculus
atgaaaacaggatggaagcccgacg

SEQ ID NO: 541364 - DNA, 25 bp, Mus musculus
atgaaaactgaacacgcccaaaggg

SEQ ID NO: 541365 - DNA, 25 bp, Mus musculus
atgaaaactgaagacgcccaaaggg

SEQ ID NO: 541366 - DNA, 25 bp, Mus musculus
atgaaaaggaagctgtcaaagtcgg

SEQ ID NO: 541367 - DNA, 25 bp, Mus musculus
atgaaaaggaaggtgtcaaagtcgg

SEQ ID NO: 541368 - DNA, 25 bp, Mus musculus
atgaaaaggttgatctccagctctt

SEQ ID NO: 541369 - DNA, 25 bp, Mus musculus
atgaaaaggttgttctccagctctt

SEQ ID NO: 541370 - DNA, 25 bp, Mus musculus
atgaaaccggctcggattccgcccg

SEQ ID NO: 541371 - DNA, 25 bp, Mus musculus
atgaaaccggctgggattccgcccg

SEQ ID NO: 541372 - DNA, 25 bp, Mus musculus
atgaaacctcatcgcctggcattga

SEQ ID NO: 541373 - DNA, 25 bp, Mus musculus
atgaaacctcatggcctggcattga

SEQ ID NO: 541374 - DNA, 25 bp, Mus musculus
atgaaagatgggaaatgggatacag

SEQ ID NO: 541375 - DNA, 25 bp, Mus musculus
atgaaagatgggtaatgggatacag

SEQ ID NO: 541376 - DNA, 25 bp, Mus musculus
atgaaagccacactcagtgggaact

SEQ ID NO: 541377 - DNA, 25 bp, Mus musculus
atgaaagccacagtcagtgggaact

SEQ ID NO: 541378 - DNA, 25 bp, Mus musculus
atgaaaggattaagggctccttcct

SEQ ID NO: 541379 - DNA, 25 bp, Mus musculus
atgaaaggattatgggctccttcct

SEQ ID NO: 541380 - DNA, 25 bp, Mus musculus
atgaaagtctcacagacaccgctcg

SEQ ID NO: 541381 - DNA, 25 bp, Mus musculus
atgaaagtctcagagacaccgctcg

SEQ ID NO: 541382 - DNA, 25 bp, Mus musculus
atgaaagtggctctcaagatgctga

SEQ ID NO: 541383 - DNA, 25 bp, Mus musculus
atgaaagtggctgtcaagatgctga

SEQ ID NO: 541384 - DNA, 25 bp, Mus musculus
atgaaatattcactctccattagga

SEQ ID NO: 541385 - DNA, 25 bp, Mus musculus
atgaaatattcagtctccattagga

SEQ ID NO: 541386 - DNA, 25 bp, Mus musculus
atgaaatgccggaaagtccttgaat

SEQ ID NO: 541387 - DNA, 25 bp, Mus musculus
atgaaatgccggtaagtccttgaat

SEQ ID NO: 541388 - DNA, 25 bp, Mus musculus
atgaaattgaaaccctgggatccac

SEQ ID NO: 541389 - DNA, 25 bp, Mus musculus
atgaaattgaaagcctgggatccac

SEQ ID NO: 541390 - DNA, 25 bp, Mus musculus
atgaaattgtaaccaccttaggaga

SEQ ID NO: 541391 - DNA, 25 bp, Mus musculus
atgaaattgtaagcaccttaggaga

SEQ ID NO: 541392 - DNA, 25 bp, Mus musculus
atgaaatttccgaggcgcctgcgcg

SEQ ID NO: 541393 - DNA, 25 bp, Mus musculus
atgaaatttccgtggcgcctgcgcg

SEQ ID NO: 541394 - DNA, 25 bp, Mus musculus
atgaacaagcgccagcgcgagctga

SEQ ID NO: 541395 - DNA, 25 bp, Mus musculus
atgaacaagcgcgagcgcgagctga

SEQ ID NO: 541396 - DNA, 25 bp, Mus musculus
atgaacaccctcctgaatgggcaca

SEQ ID NO: 541397 - DNA, 25 bp, Mus musculus
atgaacaccctcgtgaatgggcaca

SEQ ID NO: 541398 - DNA, 25 bp, Mus musculus
atgaacacctcactgaagacatggg

SEQ ID NO: 541399 - DNA, 25 bp, Mus musculus
atgaacacctcagtgaagacatggg

SEQ ID NO: 541400 - DNA, 25 bp, Mus musculus
atgaacagttgtcggcctcgccccg

SEQ ID NO: 541401 - DNA, 25 bp, Mus musculus
atgaacagttgtgggcctcgccccg

SEQ ID NO: 541402 - DNA, 25 bp, Mus musculus
atgaacatccgcatcaacagccaag

SEQ ID NO: 541403 - DNA, 25 bp, Mus musculus
atgaacatccgcttcaacagccaag

SEQ ID NO: 541404 - DNA, 25 bp, Mus musculus
atgaacccttcgactgcatctataa

SEQ ID NO: 541405 - DNA, 25 bp, Mus musculus
atgaacccttcgtctgcatctataa

SEQ ID NO: 541406 - DNA, 25 bp, Mus musculus
atgaacctcccacactcacaaagga

SEQ ID NO: 541407 - DNA, 25 bp, Mus musculus
atgaacctcccagactcacaaagga

SEQ ID NO: 541408 - DNA, 25 bp, Mus musculus
atgaacctgaccatgaacctcaccg

SEQ ID NO: 541409 - DNA, 25 bp, Mus musculus
atgaacctgaccttgaacctcaccg

SEQ ID NO: 541410 - DNA, 25 bp, Mus musculus
atgaacctgcaccagcggactctca

SEQ ID NO: 541411 - DNA, 25 bp, Mus musculus
atgaacctgcacgagcggactctca

SEQ ID NO: 541412 - DNA, 25 bp, Mus musculus
atgaacctgcctagaagcgccagcg

SEQ ID NO: 541413 - DNA, 25 bp, Mus musculus
atgaacctgccttgaagcgccagcg

SEQ ID NO: 541414 - DNA, 25 bp, Mus musculus
atgaacctggacaccagcagcaacc

SEQ ID NO: 541415 - DNA, 25 bp, Mus musculus
atgaacctggactccagcagcaacc

SEQ ID NO: 541416 - DNA, 25 bp, Mus musculus
atgaacgacccacagacgggcccgg

SEQ ID NO: 541417 - DNA, 25 bp, Mus musculus
atgaacgacccagagacgggcccgg

SEQ ID NO: 541418 - DNA, 25 bp, Mus musculus
atgaacgacttcagcctctgctcaa

SEQ ID NO: 541419 - DNA, 25 bp, Mus musculus
atgaacgacttctgcctctgctcaa

SEQ ID NO: 541420 - DNA, 25 bp, Mus musculus
atgaacgcggcgctgcaggctcttt

SEQ ID NO: 541421 - DNA, 25 bp, Mus musculus
atgaacgcggcggtgcaggctcttt

SEQ ID NO: 541422 - DNA, 25 bp, Mus musculus
atgaacgcttggacttggacgacgg

SEQ ID NO: 541423 - DNA, 25 bp, Mus musculus
atgaacgcttggtcttggacgacgg

SEQ ID NO: 541424 - DNA, 25 bp, Mus musculus
atgaacggaagaaaagggccagcga

SEQ ID NO: 541425 - DNA, 25 bp, Mus musculus
atgaacggaagataagggccagcga

SEQ ID NO: 541426 - DNA, 25 bp, Mus musculus
atgaacgtttcactataaatggtgg

SEQ ID NO: 541427 - DNA, 25 bp, Mus musculus
atgaacgtttcagtataaatggtgg

SEQ ID NO: 541428 - DNA, 25 bp, Mus musculus
atgaactaggggctgtgtatctgca

SEQ ID NO: 541429 - DNA, 25 bp, Mus musculus
atgaactagggggtgtgtatctgca

SEQ ID NO: 541430 - DNA, 25 bp, Mus musculus
atgaactccaacaccccgctggtga

SEQ ID NO: 541431 - DNA, 25 bp, Mus musculus
atgaactccaactccccgctggtga

SEQ ID NO: 541432 - DNA, 25 bp, Mus musculus
atgaactcttctcgcaacctctttg

SEQ ID NO: 541433 - DNA, 25 bp, Mus musculus
atgaactcttctggcaacctctttg

SEQ ID NO: 541434 - DNA, 25 bp, Mus musculus
atgaactgacctccagtgcccggct

SEQ ID NO: 541435 - DNA, 25 bp, Mus musculus
atgaactgacctgcagtgcccggct

SEQ ID NO: 541436 - DNA, 25 bp, Mus musculus
atgaactttattccaagcctggaac

SEQ ID NO: 541437 - DNA, 25 bp, Mus musculus
atgaactttattgcaagcctggaac

SEQ ID NO: 541438 - DNA, 25 bp, Mus musculus
atgaagaacgaaatccttctctccc

SEQ ID NO: 541439 - DNA, 25 bp, Mus musculus
atgaagaacgaattccttctctccc

SEQ ID NO: 541440 - DNA, 25 bp, Mus musculus
atgaagaaggacctgcagatgttcc

SEQ ID NO: 541441 - DNA, 25 bp, Mus musculus
atgaagaaggacgtgcagatgttcc

SEQ ID NO: 541442 - DNA, 25 bp, Mus musculus
atgaagaagttcattgcctactgcc

SEQ ID NO: 541443 - DNA, 25 bp, Mus musculus
atgaagaagttctttgcctactgcc

SEQ ID NO: 541444 - DNA, 25 bp, Mus musculus
atgaagacactgagagcaggctgga

SEQ ID NO: 541445 - DNA, 25 bp, Mus musculus
atgaagacactgtgagcaggctgga

SEQ ID NO: 541446 - DNA, 25 bp, Mus musculus
atgaagacatccacacagccaacga

SEQ ID NO: 541447 - DNA, 25 bp, Mus musculus
atgaagacatcctcacagccaacga

SEQ ID NO: 541448 - DNA, 25 bp, Mus musculus
atgaagactgaactttctcctcggc

SEQ ID NO: 541449 - DNA, 25 bp, Mus musculus
atgaagactgaagtttctcctcggc

SEQ ID NO: 541450 - DNA, 25 bp, Mus musculus
atgaagaggagaccccacatgctac

SEQ ID NO: 541451 - DNA, 25 bp, Mus musculus
atgaagaggagagcccacatgctac

SEQ ID NO: 541452 - DNA, 25 bp, Mus musculus
atgaagatactgagcctcgagctgc

SEQ ID NO: 541453 - DNA, 25 bp, Mus musculus
atgaagatactgtgcctcgagctgc

SEQ ID NO: 541454 - DNA, 25 bp, Mus musculus
atgaagatcgaaactcctgcgcccc

SEQ ID NO: 541455 - DNA, 25 bp, Mus musculus
atgaagatcgaatctcctgcgcccc

SEQ ID NO: 541456 - DNA, 25 bp, Mus musculus
atgaagatctctcgaccacctacct

SEQ ID NO: 541457 - DNA, 25 bp, Mus musculus
atgaagatctctggaccacctacct

SEQ ID NO: 541458 - DNA, 25 bp, Mus musculus
atgaagatggctcggctgaatgcta

SEQ ID NO: 541459 - DNA, 25 bp, Mus musculus
atgaagatggctgggctgaatgcta

SEQ ID NO: 541460 - DNA, 25 bp, Mus musculus
atgaagatgtgaagaaggcgctgct

SEQ ID NO: 541461 - DNA, 25 bp, Mus musculus
atgaagatgtgatgaaggcgctgct

SEQ ID NO: 541462 - DNA, 25 bp, Mus musculus
atgaagattgccctgcagcacggtg

SEQ ID NO: 541463 - DNA, 25 bp, Mus musculus
atgaagattgccgtgcagcacggtg

SEQ ID NO: 541464 - DNA, 25 bp, Mus musculus
atgaagcaatataggctgccctgga

SEQ ID NO: 541465 - DNA, 25 bp, Mus musculus
atgaagcaatattggctgccctgga

SEQ ID NO: 541466 - DNA, 25 bp, Mus musculus
atgaagcagagcagacggtcaagga

SEQ ID NO: 541467 - DNA, 25 bp, Mus musculus
atgaagcagagctgacggtcaagga

SEQ ID NO: 541468 - DNA, 25 bp, Mus musculus
atgaagcagtctagcagcaaaagcc

SEQ ID NO: 541469 - DNA, 25 bp, Mus musculus
atgaagcagtcttgcagcaaaagcc

SEQ ID NO: 541470 - DNA, 25 bp, Mus musculus
atgaagccaaacactctcgtgattg

SEQ ID NO: 541471 - DNA, 25 bp, Mus musculus
atgaagccaaactctctcgtgattg

SEQ ID NO: 541472 - DNA, 25 bp, Mus musculus
atgaagcccggaaatacgttcgcaa

SEQ ID NO: 541473 - DNA, 25 bp, Mus musculus
atgaagcccggatatacgttcgcaa

SEQ ID NO: 541474 - DNA, 25 bp, Mus musculus
atgaagcctctgaacacccgctggt

SEQ ID NO: 541475 - DNA, 25 bp, Mus musculus
atgaagcctctgtacacccgctggt

SEQ ID NO: 541476 - DNA, 25 bp, Mus musculus
atgaagctacccagctctgtgggtc

SEQ ID NO: 541477 - DNA, 25 bp, Mus musculus
atgaagctaccctgctctgtgggtc

SEQ ID NO: 541478 - DNA, 25 bp, Mus musculus
atgaagctctatccctccgaccagg

SEQ ID NO: 541479 - DNA, 25 bp, Mus musculus
atgaagctctatgcctccgaccagg

SEQ ID NO: 541480 - DNA, 25 bp, Mus musculus
atgaagctggcccaccggaaggcta

SEQ ID NO: 541481 - DNA, 25 bp, Mus musculus
atgaagctggccgaccggaaggcta

SEQ ID NO: 541482 - DNA, 25 bp, Mus musculus
atgaaggaactgaagctgctacaga

SEQ ID NO: 541483 - DNA, 25 bp, Mus musculus
atgaaggaactgtagctgctacaga

SEQ ID NO: 541484 - DNA, 25 bp, Mus musculus
atgaaggaaggaacgctgagcaaag

SEQ ID NO: 541485 - DNA, 25 bp, Mus musculus
atgaaggaaggatcgctgagcaaag

SEQ ID NO: 541486 - DNA, 25 bp, Mus musculus
atgaaggactttacaagcctgtgtc

SEQ ID NO: 541487 - DNA, 25 bp, Mus musculus
atgaaggacttttcaagcctgtgtc

SEQ ID NO: 541488 - DNA, 25 bp, Mus musculus
atgaaggagtcaccggcgcggctgc

SEQ ID NO: 541489 - DNA, 25 bp, Mus musculus
atgaaggagtcagcggcgcggctgc

SEQ ID NO: 541490 - DNA, 25 bp, Mus musculus
atgaaggagtgcatccgcctctacc

SEQ ID NO: 541491 - DNA, 25 bp, Mus musculus
atgaaggagtgcttccgcctctacc

SEQ ID NO: 541492 - DNA, 25 bp, Mus musculus
atgaaggccacaaacggccccagca

SEQ ID NO: 541493 - DNA, 25 bp, Mus musculus
atgaaggccacatacggccccagca

SEQ ID NO: 541494 - DNA, 25 bp, Mus musculus
atgaaggctcgaaataaagatgacc

SEQ ID NO: 541495 - DNA, 25 bp, Mus musculus
atgaaggctcgatataaagatgacc

SEQ ID NO: 541496 - DNA, 25 bp, Mus musculus
atgaaggtcagtcggcagtcctcct

SEQ ID NO: 541497 - DNA, 25 bp, Mus musculus
atgaaggtcagtgggcagtcctcct

SEQ ID NO: 541498 - DNA, 25 bp, Mus musculus
atgaaggtggcccagcagacaccgc

SEQ ID NO: 541499 - DNA, 25 bp, Mus musculus
atgaaggtggccgagcagacaccgc

SEQ ID NO: 541500 - DNA, 25 bp, Mus musculus
atgaaggtggtgaagacttgaacag

SEQ ID NO: 541501 - DNA, 25 bp, Mus musculus
atgaaggtggtgtagacttgaacag

SEQ ID NO: 541502 - DNA, 25 bp, Mus musculus
atgaagtccacgaccagatgcagga

SEQ ID NO: 541503 - DNA, 25 bp, Mus musculus
atgaagtccacgtccagatgcagga

SEQ ID NO: 541504 - DNA, 25 bp, Mus musculus
atgaagtcttccagcagcgcctggc

SEQ ID NO: 541505 - DNA, 25 bp, Mus musculus
atgaagtcttcctgcagcgcctggc

SEQ ID NO: 541506 - DNA, 25 bp, Mus musculus
atgaagttgaagcactaaaacgctt

SEQ ID NO: 541507 - DNA, 25 bp, Mus musculus
atgaagttgaaggactaaaacgctt

SEQ ID NO: 541508 - DNA, 25 bp, Mus musculus
atgaagttgggccagacgctgcctc

SEQ ID NO: 541509 - DNA, 25 bp, Mus musculus
atgaagttgggcgagacgctgcctc

SEQ ID NO: 541510 - DNA, 25 bp, Mus musculus
atgaagttgtgcctacctcctccgc

SEQ ID NO: 541511 - DNA, 25 bp, Mus musculus
atgaagttgtgcgtacctcctccgc

SEQ ID NO: 541512 - DNA, 25 bp, Mus musculus
atgaatacaagtagccccagtgctg

SEQ ID NO: 541513 - DNA, 25 bp, Mus musculus
atgaatacaagttgccccagtgctg

SEQ ID NO: 541514 - DNA, 25 bp, Mus musculus
atgaatacccagatgagctccagtg

SEQ ID NO: 541515 - DNA, 25 bp, Mus musculus
atgaatacccagttgagctccagtg

SEQ ID NO: 541516 - DNA, 25 bp, Mus musculus
atgaataccgggagtgccagctgcc

SEQ ID NO: 541517 - DNA, 25 bp, Mus musculus
atgaataccgggtgtgccagctgcc

SEQ ID NO: 541518 - DNA, 25 bp, Mus musculus
atgaatcaagcaagcattcaagtgg

SEQ ID NO: 541519 - DNA, 25 bp, Mus musculus
atgaatcaagcatgcattcaagtgg

SEQ ID NO: 541520 - DNA, 25 bp, Mus musculus
atgaatcggaggagacggtgcccaa

SEQ ID NO: 541521 - DNA, 25 bp, Mus musculus
atgaatcggaggtgacggtgcccaa

SEQ ID NO: 541522 - DNA, 25 bp, Mus musculus
atgaatcggcgcagggctgcccgac

SEQ ID NO: 541523 - DNA, 25 bp, Mus musculus
atgaatcggcgctgggctgcccgac

SEQ ID NO: 541524 - DNA, 25 bp, Mus musculus
atgaatgatgtcctccctaacagcc

SEQ ID NO: 541525 - DNA, 25 bp, Mus musculus
atgaatgatgtcgtccctaacagcc

SEQ ID NO: 541526 - DNA, 25 bp, Mus musculus
atgaatgcaggacgcctccagggtc

SEQ ID NO: 541527 - DNA, 25 bp, Mus musculus
atgaatgcaggaggcctccagggtc

SEQ ID NO: 541528 - DNA, 25 bp, Mus musculus
atgaatgctgctctccgcgctgtgg

SEQ ID NO: 541529 - DNA, 25 bp, Mus musculus
atgaatgctgctgtccgcgctgtgg

SEQ ID NO: 541530 - DNA, 25 bp, Mus musculus
atgaatggacgcattgtgggctcca

SEQ ID NO: 541531 - DNA, 25 bp, Mus musculus
atgaatggacgctttgtgggctcca

SEQ ID NO: 541532 - DNA, 25 bp, Mus musculus
atgaatggactcagccctacccaag

SEQ ID NO: 541533 - DNA, 25 bp, Mus musculus
atgaatggactctgccctacccaag

SEQ ID NO: 541534 - DNA, 25 bp, Mus musculus
atgaatggcaacaaggccagtgagg

SEQ ID NO: 541535 - DNA, 25 bp, Mus musculus
atgaatggcaactaggccagtgagg

SEQ ID NO: 541536 - DNA, 25 bp, Mus musculus
atgaatgggaagcagctcaatggaa

SEQ ID NO: 541537 - DNA, 25 bp, Mus musculus
atgaatgggaaggagctcaatggaa

SEQ ID NO: 541538 - DNA, 25 bp, Mus musculus
atgaatgtggtgctctccgccctgg

SEQ ID NO: 541539 - DNA, 25 bp, Mus musculus
atgaatgtggtggtctccgccctgg

SEQ ID NO: 541540 - DNA, 25 bp, Mus musculus
atgacaaaccagcaagcgcgagagc

SEQ ID NO: 541541 - DNA, 25 bp, Mus musculus
atgacaaaccaggaagcgcgagagc

SEQ ID NO: 541542 - DNA, 25 bp, Mus musculus
atgacaacgacaagatccccgatga

SEQ ID NO: 541543 - DNA, 25 bp, Mus musculus
atgacaacgacatgatccccgatga

SEQ ID NO: 541544 - DNA, 25 bp, Mus musculus
atgacaactgcacggcccgtgctgg

SEQ ID NO: 541545 - DNA, 25 bp, Mus musculus
atgacaactgcagggcccgtgctgg

SEQ ID NO: 541546 - DNA, 25 bp, Mus musculus
atgacaagcagacggcaggtccagt

SEQ ID NO: 541547 - DNA, 25 bp, Mus musculus
atgacaagcagagggcaggtccagt

SEQ ID NO: 541548 - DNA, 25 bp, Mus musculus
atgacaaggaccacacccaccatga

SEQ ID NO: 541549 - DNA, 25 bp, Mus musculus
atgacaaggacctcacccaccatga

SEQ ID NO: 541550 - DNA, 25 bp, Mus musculus
atgacaagggctatgtggacttggt

SEQ ID NO: 541551 - DNA, 25 bp, Mus musculus
atgacaagggctttgtggacttggt

SEQ ID NO: 541552 - DNA, 25 bp, Mus musculus
atgacaagtacaaccgacccgaggg

SEQ ID NO: 541553 - DNA, 25 bp, Mus musculus
atgacaagtacatccgacccgaggg

SEQ ID NO: 541554 - DNA, 25 bp, Mus musculus
atgacaatacttcccaatgactggg

SEQ ID NO: 541555 - DNA, 25 bp, Mus musculus
atgacaatacttgccaatgactggg

SEQ ID NO: 541556 - DNA, 25 bp, Mus musculus
atgacaatgaatatgcctgcctcaa

SEQ ID NO: 541557 - DNA, 25 bp, Mus musculus
atgacaatgaatttgcctgcctcaa

SEQ ID NO: 541558 - DNA, 25 bp, Mus musculus
atgacaatgatcagcccatggagga

SEQ ID NO: 541559 - DNA, 25 bp, Mus musculus
atgacaatgatctgcccatggagga

SEQ ID NO: 541560 - DNA, 25 bp, Mus musculus
atgacacccttgcagctgacgccat

SEQ ID NO: 541561 - DNA, 25 bp, Mus musculus
atgacacccttggagctgacgccat

SEQ ID NO: 541562 - DNA, 25 bp, Mus musculus
atgacaccgcctcggaggagctgaa

SEQ ID NO: 541563 - DNA, 25 bp, Mus musculus
atgacaccgcctgggaggagctgaa

SEQ ID NO: 541564 - DNA, 25 bp, Mus musculus
atgacactccgtctgggccccggga

SEQ ID NO: 541565 - DNA, 25 bp, Mus musculus
atgacactccgtgtgggccccggga

SEQ ID NO: 541566 - DNA, 25 bp, Mus musculus
atgacagaatacaagcttgtggtgg

SEQ ID NO: 541567 - DNA, 25 bp, Mus musculus
atgacagaatactagcttgtggtgg

SEQ ID NO: 541568 - DNA, 25 bp, Mus musculus
atgacagactaccaccgctaagtta

SEQ ID NO: 541569 - DNA, 25 bp, Mus musculus
atgacagactacgaccgctaagtta

SEQ ID NO: 541570 - DNA, 25 bp, Mus musculus
atgacagagctcaaccagtctttag

SEQ ID NO: 541571 - DNA, 25 bp, Mus musculus
atgacagagctctaccagtctttag

SEQ ID NO: 541572 - DNA, 25 bp, Mus musculus
atgacagatcggagccacaggcaga

SEQ ID NO: 541573 - DNA, 25 bp, Mus musculus
atgacagatcggtgccacaggcaga

SEQ ID NO: 541574 - DNA, 25 bp, Mus musculus
atgacagatgaaagtggaaaatcca

SEQ ID NO: 541575 - DNA, 25 bp, Mus musculus
atgacagatgaatgtggaaaatcca

SEQ ID NO: 541576 - DNA, 25 bp, Mus musculus
atgacagcaacacgcccaaccgagt

SEQ ID NO: 541577 - DNA, 25 bp, Mus musculus
atgacagcaacaggcccaaccgagt

SEQ ID NO: 541578 - DNA, 25 bp, Mus musculus
atgacagcctaaccggcctcatgac

SEQ ID NO: 541579 - DNA, 25 bp, Mus musculus
atgacagcctaagcggcctcatgac

SEQ ID NO: 541580 - DNA, 25 bp, Mus musculus
atgacagctataacaacggaggagg

SEQ ID NO: 541581 - DNA, 25 bp, Mus musculus
atgacagctatatcaacggaggagg

SEQ ID NO: 541582 - DNA, 25 bp, Mus musculus
atgacagcttcgatgagggcagtgt

SEQ ID NO: 541583 - DNA, 25 bp, Mus musculus
atgacagcttcgttgagggcagtgt

SEQ ID NO: 541584 - DNA, 25 bp, Mus musculus
atgacaggtggtagaaaagacccgg

SEQ ID NO: 541585 - DNA, 25 bp, Mus musculus
atgacaggtggttgaaaagacccgg

SEQ ID NO: 541586 - DNA, 25 bp, Mus musculus
atgacagtaccaacccgtcccgtat

SEQ ID NO: 541587 - DNA, 25 bp, Mus musculus
atgacagtaccatcccgtcccgtat

SEQ ID NO: 541588 - DNA, 25 bp, Mus musculus
atgacagttccaacgatgacaaaac

SEQ ID NO: 541589 - DNA, 25 bp, Mus musculus
atgacagttccatcgatgacaaaac

SEQ ID NO: 541590 - DNA, 25 bp, Mus musculus
atgacataaacaatgttggactcag

SEQ ID NO: 541591 - DNA, 25 bp, Mus musculus
atgacataaacattgttggactcag

SEQ ID NO: 541592 - DNA, 25 bp, Mus musculus
atgacatcacccaccgagccatatg

SEQ ID NO: 541593 - DNA, 25 bp, Mus musculus
atgacatcaccctccgagccatatg

SEQ ID NO: 541594 - DNA, 25 bp, Mus musculus
atgacatcacggcactgctgtggtg

SEQ ID NO: 541595 - DNA, 25 bp, Mus musculus
atgacatcacgggactgctgtggtg

SEQ ID NO: 541596 - DNA, 25 bp, Mus musculus
atgacatcagcaacggtggacatcc

SEQ ID NO: 541597 - DNA, 25 bp, Mus musculus
atgacatcagcatcggtggacatcc

SEQ ID NO: 541598 - DNA, 25 bp, Mus musculus
atgacattccggaccggccggctgg

SEQ ID NO: 541599 - DNA, 25 bp, Mus musculus
atgacattccggtccggccggctgg

SEQ ID NO: 541600 - DNA, 25 bp, Mus musculus
atgacattgaatcgatgactgggcg

SEQ ID NO: 541601 - DNA, 25 bp, Mus musculus
atgacattgaatggatgactgggcg

SEQ ID NO: 541602 - DNA, 25 bp, Mus musculus
atgaccacaaccacttcagtggaag

SEQ ID NO: 541603 - DNA, 25 bp, Mus musculus
atgaccacaacctcttcagtggaag

SEQ ID NO: 541604 - DNA, 25 bp, Mus musculus
atgaccaccactaagtccaaactct

SEQ ID NO: 541605 - DNA, 25 bp, Mus musculus
atgaccaccacttagtccaaactct

SEQ ID NO: 541606 - DNA, 25 bp, Mus musculus
atgaccaggacgacacagccaatgg

SEQ ID NO: 541607 - DNA, 25 bp, Mus musculus
atgaccaggacgtcacagccaatgg

SEQ ID NO: 541608 - DNA, 25 bp, Mus musculus
atgaccaggactaccgcagtttccg

SEQ ID NO: 541609 - DNA, 25 bp, Mus musculus
atgaccaggacttccgcagtttccg

SEQ ID NO: 541610 - DNA, 25 bp, Mus musculus
atgaccaggcccatcagcaagctgt

SEQ ID NO: 541611 - DNA, 25 bp, Mus musculus
atgaccaggcccttcagcaagctgt

SEQ ID NO: 541612 - DNA, 25 bp, Mus musculus
atgaccagtcctatcatgctgatct

SEQ ID NO: 541613 - DNA, 25 bp, Mus musculus
atgaccagtcctttcatgctgatct

SEQ ID NO: 541614 - DNA, 25 bp, Mus musculus
atgaccatgtgcctccctgacctga

SEQ ID NO: 541615 - DNA, 25 bp, Mus musculus
atgaccatgtgcgtccctgacctga

SEQ ID NO: 541616 - DNA, 25 bp, Mus musculus
atgacccacgtgatggcaggaggcc

SEQ ID NO: 541617 - DNA, 25 bp, Mus musculus
atgacccacgtgttggcaggaggcc

SEQ ID NO: 541618 - DNA, 25 bp, Mus musculus
atgaccccgggccaggcagagatcc

SEQ ID NO: 541619 - DNA, 25 bp, Mus musculus
atgaccccgggcgaggcagagatcc

SEQ ID NO: 541620 - DNA, 25 bp, Mus musculus
atgacccctgccaggccatcagaga

SEQ ID NO: 541621 - DNA, 25 bp, Mus musculus
atgacccctgcctggccatcagaga

SEQ ID NO: 541622 - DNA, 25 bp, Mus musculus
atgacccgactacagctgctctaca

SEQ ID NO: 541623 - DNA, 25 bp, Mus musculus
atgacccgactagagctgctctaca

SEQ ID NO: 541624 - DNA, 25 bp, Mus musculus
atgacccgcagactggagagctacc

SEQ ID NO: 541625 - DNA, 25 bp, Mus musculus
atgacccgcagagtggagagctacc

SEQ ID NO: 541626 - DNA, 25 bp, Mus musculus
atgaccctcgccacatcggctggaa

SEQ ID NO: 541627 - DNA, 25 bp, Mus musculus
atgaccctcgcctcatcggctggaa

SEQ ID NO: 541628 - DNA, 25 bp, Mus musculus
atgaccctgccacgcacatcagtgg

SEQ ID NO: 541629 - DNA, 25 bp, Mus musculus
atgaccctgccaggcacatcagtgg

SEQ ID NO: 541630 - DNA, 25 bp, Mus musculus
atgaccgagcagatgacccttcgcg

SEQ ID NO: 541631 - DNA, 25 bp, Mus musculus
atgaccgagcagttgacccttcgcg

SEQ ID NO: 541632 - DNA, 25 bp, Mus musculus
atgaccgcccttcccgggcaggatg

SEQ ID NO: 541633 - DNA, 25 bp, Mus musculus
atgaccgcccttgccgggcaggatg

SEQ ID NO: 541634 - DNA, 25 bp, Mus musculus
atgaccgggctgacgccttgcaggc

SEQ ID NO: 541635 - DNA, 25 bp, Mus musculus
atgaccgggctgtcgccttgcaggc

SEQ ID NO: 541636 - DNA, 25 bp, Mus musculus
atgaccggtggcaatggcgacacgt

SEQ ID NO: 541637 - DNA, 25 bp, Mus musculus
atgaccggtggctatggcgacacgt

SEQ ID NO: 541638 - DNA, 25 bp, Mus musculus
atgaccgtcagcagtctggcaatca

SEQ ID NO: 541639 - DNA, 25 bp, Mus musculus
atgaccgtcagctgtctggcaatca

SEQ ID NO: 541640 - DNA, 25 bp, Mus musculus
atgacctcagttccatcctcgggac

SEQ ID NO: 541641 - DNA, 25 bp, Mus musculus
atgacctcagttgcatcctcgggac

SEQ ID NO: 541642 - DNA, 25 bp, Mus musculus
atgacctccctgaatgcatccatcg

SEQ ID NO: 541643 - DNA, 25 bp, Mus musculus
atgacctccctgtatgcatccatcg

SEQ ID NO: 541644 - DNA, 25 bp, Mus musculus
atgacctcgctgacccagcggagct

SEQ ID NO: 541645 - DNA, 25 bp, Mus musculus
atgacctcgctgtcccagcggagct

SEQ ID NO: 541646 - DNA, 25 bp, Mus musculus
atgacctctctgacagtccatacgg

SEQ ID NO: 541647 - DNA, 25 bp, Mus musculus
atgacctctctgtcagtccatacgg

SEQ ID NO: 541648 - DNA, 25 bp, Mus musculus
atgacctctgccagctgttctgcct

SEQ ID NO: 541649 - DNA, 25 bp, Mus musculus
atgacctctgcctgctgttctgcct

SEQ ID NO: 541650 - DNA, 25 bp, Mus musculus
atgacctgatgtaactacgcctcag

SEQ ID NO: 541651 - DNA, 25 bp, Mus musculus
atgacctgatgttactacgcctcag

SEQ ID NO: 541652 - DNA, 25 bp, Mus musculus
atgacctgcatcattccaccagttc

SEQ ID NO: 541653 - DNA, 25 bp, Mus musculus
atgacctgcatctttccaccagttc

SEQ ID NO: 541654 - DNA, 25 bp, Mus musculus
atgacctggactacatggacgcccg

SEQ ID NO: 541655 - DNA, 25 bp, Mus musculus
atgacctggacttcatggacgcccg

SEQ ID NO: 541656 - DNA, 25 bp, Mus musculus
atgacctggcacaaggcttggagct

SEQ ID NO: 541657 - DNA, 25 bp, Mus musculus
atgacctggcactaggcttggagct

SEQ ID NO: 541658 - DNA, 25 bp, Mus musculus
atgacctttggcaggcaccgctcag

SEQ ID NO: 541659 - DNA, 25 bp, Mus musculus
atgacctttggctggcaccgctcag

SEQ ID NO: 541660 - DNA, 25 bp, Mus musculus
atgacgaacaatatctatgcagcaa

SEQ ID NO: 541661 - DNA, 25 bp, Mus musculus
atgacgaacaatttctatgcagcaa

SEQ ID NO: 541662 - DNA, 25 bp, Mus musculus
atgacgaagcatcgctcgcgctcca

SEQ ID NO: 541663 - DNA, 25 bp, Mus musculus
atgacgaagcatggctcgcgctcca

SEQ ID NO: 541664 - DNA, 25 bp, Mus musculus
atgacgaccaacctgtgggtgaagc

SEQ ID NO: 541665 - DNA, 25 bp, Mus musculus
atgacgaccaacgtgtgggtgaagc

SEQ ID NO: 541666 - DNA, 25 bp, Mus musculus
atgacgacgctgaacgggtgcttcg

SEQ ID NO: 541667 - DNA, 25 bp, Mus musculus
atgacgacgctgtacgggtgcttcg

SEQ ID NO: 541668 - DNA, 25 bp, Mus musculus
atgacgaggaagaatacgaggcatg

SEQ ID NO: 541669 - DNA, 25 bp, Mus musculus
atgacgaggaagtatacgaggcatg

SEQ ID NO: 541670 - DNA, 25 bp, Mus musculus
atgacgccattaccccgctgctcaa

SEQ ID NO: 541671 - DNA, 25 bp, Mus musculus
atgacgccattagcccgctgctcaa

SEQ ID NO: 541672 - DNA, 25 bp, Mus musculus
atgacgctcttgagcgtgaccctcc

SEQ ID NO: 541673 - DNA, 25 bp, Mus musculus
atgacgctcttgtgcgtgaccctcc

SEQ ID NO: 541674 - DNA, 25 bp, Mus musculus
atgacggatacactggctccaggag

SEQ ID NO: 541675 - DNA, 25 bp, Mus musculus
atgacggatacagtggctccaggag

SEQ ID NO: 541676 - DNA, 25 bp, Mus musculus
atgacggatgtgcaccggcgcttcc

SEQ ID NO: 541677 - DNA, 25 bp, Mus musculus
atgacggatgtggaccggcgcttcc

SEQ ID NO: 541678 - DNA, 25 bp, Mus musculus
atgacgggatttctaccagctgatg

SEQ ID NO: 541679 - DNA, 25 bp, Mus musculus
atgacgggatttgtaccagctgatg

SEQ ID NO: 541680 - DNA, 25 bp, Mus musculus
atgacggtcgtcagcttccaccagg

SEQ ID NO: 541681 - DNA, 25 bp, Mus musculus
atgacggtcgtctgcttccaccagg

SEQ ID NO: 541682 - DNA, 25 bp, Mus musculus
atgacgtggaccatccagcctgggc

SEQ ID NO: 541683 - DNA, 25 bp, Mus musculus
atgacgtggaccttccagcctgggc

SEQ ID NO: 541684 - DNA, 25 bp, Mus musculus
atgactagtgtacaggaagaacaca

SEQ ID NO: 541685 - DNA, 25 bp, Mus musculus
atgactagtgtagaggaagaacaca

SEQ ID NO: 541686 - DNA, 25 bp, Mus musculus
atgactatcaacaccactgtcctca

SEQ ID NO: 541687 - DNA, 25 bp, Mus musculus
atgactatcaactccactgtcctca

SEQ ID NO: 541688 - DNA, 25 bp, Mus musculus
atgactcaaaaacctgcaaccactg

SEQ ID NO: 541689 - DNA, 25 bp, Mus musculus
atgactcaaaaagctgcaaccactg

SEQ ID NO: 541690 - DNA, 25 bp, Mus musculus
atgactcaggcacggtcccagacta

SEQ ID NO: 541691 - DNA, 25 bp, Mus musculus
atgactcaggcagggtcccagacta

SEQ ID NO: 541692 - DNA, 25 bp, Mus musculus
atgactccggaaaggtgcgagatcc

SEQ ID NO: 541693 - DNA, 25 bp, Mus musculus
atgactccggaatggtgcgagatcc

SEQ ID NO: 541694 - DNA, 25 bp, Mus musculus
atgactctccggaaccaacccatgg

SEQ ID NO: 541695 - DNA, 25 bp, Mus musculus
atgactctccggtaccaacccatgg

SEQ ID NO: 541696 - DNA, 25 bp, Mus musculus
atgactctcgggagaaggccatgga

SEQ ID NO: 541697 - DNA, 25 bp, Mus musculus
atgactctcgggtgaaggccatgga

SEQ ID NO: 541698 - DNA, 25 bp, Mus musculus
atgactgcatcccacgcgaagggac

SEQ ID NO: 541699 - DNA, 25 bp, Mus musculus
atgactgcatccgacgcgaagggac

SEQ ID NO: 541700 - DNA, 25 bp, Mus musculus
atgactgccagcaacagcacccatt

SEQ ID NO: 541701 - DNA, 25 bp, Mus musculus
atgactgccagctacagcacccatt

SEQ ID NO: 541702 - DNA, 25 bp, Mus musculus
atgactggccgcaccctcagctggt

SEQ ID NO: 541703 - DNA, 25 bp, Mus musculus
atgactggccgctccctcagctggt

SEQ ID NO: 541704 - DNA, 25 bp, Mus musculus
atgactgggacccggacctgctgtt

SEQ ID NO: 541705 - DNA, 25 bp, Mus musculus
atgactgggaccgggacctgctgtt

SEQ ID NO: 541706 - DNA, 25 bp, Mus musculus
atgactgggagccaactgaggtcct

SEQ ID NO: 541707 - DNA, 25 bp, Mus musculus
atgactgggagcgaactgaggtcct

SEQ ID NO: 541708 - DNA, 25 bp, Mus musculus
atgactgtccagaacctgtttccaa

SEQ ID NO: 541709 - DNA, 25 bp, Mus musculus
atgactgtccagtacctgtttccaa

SEQ ID NO: 541710 - DNA, 25 bp, Mus musculus
atgactgtgaccctgagcctctgtc

SEQ ID NO: 541711 - DNA, 25 bp, Mus musculus
atgactgtgaccgtgagcctctgtc

SEQ ID NO: 541712 - DNA, 25 bp, Mus musculus
atgactgtgatgagcccctggtgtc

SEQ ID NO: 541713 - DNA, 25 bp, Mus musculus
atgactgtgatgtgcccctggtgtc

SEQ ID NO: 541714 - DNA, 25 bp, Mus musculus
atgacttcacgcagcaggctgccca

SEQ ID NO: 541715 - DNA, 25 bp, Mus musculus
atgacttcacgctgcaggctgccca

SEQ ID NO: 541716 - DNA, 25 bp, Mus musculus
atgacttcagaaatgtttattaccg

SEQ ID NO: 541717 - DNA, 25 bp, Mus musculus
atgacttcagaattgtttattaccg

SEQ ID NO: 541718 - DNA, 25 bp, Mus musculus
atgacttggacactcaggagagcgt

SEQ ID NO: 541719 - DNA, 25 bp, Mus musculus
atgacttggacagtcaggagagcgt

SEQ ID NO: 541720 - DNA, 25 bp, Mus musculus
atgacttgggtgacttctcggagct

SEQ ID NO: 541721 - DNA, 25 bp, Mus musculus
atgacttgggtgtcttctcggagct

SEQ ID NO: 541722 - DNA, 25 bp, Mus musculus
atgactttaatgcacattgtcaaac

SEQ ID NO: 541723 - DNA, 25 bp, Mus musculus
atgactttaatggacattgtcaaac

SEQ ID NO: 541724 - DNA, 25 bp, Mus musculus
atgactttgacaagtttgctctgac

SEQ ID NO: 541725 - DNA, 25 bp, Mus musculus
atgactttgacatgtttgctctgac

SEQ ID NO: 541726 - DNA, 25 bp, Mus musculus
atgactttgctaacaactttgaccc

SEQ ID NO: 541727 - DNA, 25 bp, Mus musculus
atgactttgctatcaactttgaccc

SEQ ID NO: 541728 - DNA, 25 bp, Mus musculus
atgactttgctgagagtgatgagga

SEQ ID NO: 541729 - DNA, 25 bp, Mus musculus
atgactttgctgtgagtgatgagga

SEQ ID NO: 541730 - DNA, 25 bp, Mus musculus
atgagaaaaaccagatgatgacgac

SEQ ID NO: 541731 - DNA, 25 bp, Mus musculus
atgagaaaaacctgatgatgacgac

SEQ ID NO: 541732 - DNA, 25 bp, Mus musculus
atgagaaagatcctgacaacaagaa

SEQ ID NO: 541733 - DNA, 25 bp, Mus musculus
atgagaaagatcgtgacaacaagaa

SEQ ID NO: 541734 - DNA, 25 bp, Mus musculus
atgagaaagtgacgcagtctgacct

SEQ ID NO: 541735 - DNA, 25 bp, Mus musculus
atgagaaagtgaggcagtctgacct

SEQ ID NO: 541736 - DNA, 25 bp, Mus musculus
atgagaacacctcagccgggcgcta

SEQ ID NO: 541737 - DNA, 25 bp, Mus musculus
atgagaacacctgagccgggcgcta

SEQ ID NO: 541738 - DNA, 25 bp, Mus musculus
atgagaacactcagggcacagcacg

SEQ ID NO: 541739 - DNA, 25 bp, Mus musculus
atgagaacactctgggcacagcacg

SEQ ID NO: 541740 - DNA, 25 bp, Mus musculus
atgagaaccacaccggtcatcgacg

SEQ ID NO: 541741 - DNA, 25 bp, Mus musculus
atgagaaccacagcggtcatcgacg

SEQ ID NO: 541742 - DNA, 25 bp, Mus musculus
atgagaacctgcctgccgttgggcc

SEQ ID NO: 541743 - DNA, 25 bp, Mus musculus
atgagaacctgcgtgccgttgggcc

SEQ ID NO: 541744 - DNA, 25 bp, Mus musculus
atgagaagaagcaaatggttgccaa

SEQ ID NO: 541745 - DNA, 25 bp, Mus musculus
atgagaagaagctaatggttgccaa

SEQ ID NO: 541746 - DNA, 25 bp, Mus musculus
atgagaagagaaacaagcttcagat

SEQ ID NO: 541747 - DNA, 25 bp, Mus musculus
atgagaagagaatcaagcttcagat

SEQ ID NO: 541748 - DNA, 25 bp, Mus musculus
atgagaagaggcagggaaaactgtc

SEQ ID NO: 541749 - DNA, 25 bp, Mus musculus
atgagaagaggctgggaaaactgtc

SEQ ID NO: 541750 - DNA, 25 bp, Mus musculus
atgagaatgaagatgaaaggccaga

SEQ ID NO: 541751 - DNA, 25 bp, Mus musculus
atgagaatgaagttgaaaggccaga

SEQ ID NO: 541752 - DNA, 25 bp, Mus musculus
atgagaatggctctcgcctcccagc

SEQ ID NO: 541753 - DNA, 25 bp, Mus musculus
atgagaatggctgtcgcctcccagc

SEQ ID NO: 541754 - DNA, 25 bp, Mus musculus
atgagacaagagacatgctggaaag

SEQ ID NO: 541755 - DNA, 25 bp, Mus musculus
atgagacaagagtcatgctggaaag

SEQ ID NO: 541756 - DNA, 25 bp, Mus musculus
atgagacagaacaggtggatgtaga

SEQ ID NO: 541757 - DNA, 25 bp, Mus musculus
atgagacagaactggtggatgtaga

SEQ ID NO: 541758 - DNA, 25 bp, Mus musculus
atgagacagagcacggtctgcggca

SEQ ID NO: 541759 - DNA, 25 bp, Mus musculus
atgagacagagctcggtctgcggca

SEQ ID NO: 541760 - DNA, 25 bp, Mus musculus
atgagacaggcacgccgctacttac

SEQ ID NO: 541761 - DNA, 25 bp, Mus musculus
atgagacaggcaggccgctacttac

SEQ ID NO: 541762 - DNA, 25 bp, Mus musculus
atgagaccagctacctcacaggttc

SEQ ID NO: 541763 - DNA, 25 bp, Mus musculus
atgagaccagcttcctcacaggttc

SEQ ID NO: 541764 - DNA, 25 bp, Mus musculus
atgagaccatgacccacgtgttggc

SEQ ID NO: 541765 - DNA, 25 bp, Mus musculus
atgagaccatgagccacgtgttggc

SEQ ID NO: 541766 - DNA, 25 bp, Mus musculus
atgagaccctttatgctcttcctgc

SEQ ID NO: 541767 - DNA, 25 bp, Mus musculus
atgagaccctttttgctcttcctgc

SEQ ID NO: 541768 - DNA, 25 bp, Mus musculus
atgagacgaaggagcgccaagtagc

SEQ ID NO: 541769 - DNA, 25 bp, Mus musculus
atgagacgaaggtgcgccaagtagc

SEQ ID NO: 541770 - DNA, 25 bp, Mus musculus
atgagactgcctagcggcagctcac

SEQ ID NO: 541771 - DNA, 25 bp, Mus musculus
atgagactgccttgcggcagctcac

SEQ ID NO: 541772 - DNA, 25 bp, Mus musculus
atgagagaggtcctatcaaaaccaa

SEQ ID NO: 541773 - DNA, 25 bp, Mus musculus
atgagagaggtcgtatcaaaaccaa

SEQ ID NO: 541774 - DNA, 25 bp, Mus musculus
atgagagagtccaagagacagaagg

SEQ ID NO: 541775 - DNA, 25 bp, Mus musculus
atgagagagtcctagagacagaagg

SEQ ID NO: 541776 - DNA, 25 bp, Mus musculus
atgagagccgccatgaagccgggct

SEQ ID NO: 541777 - DNA, 25 bp, Mus musculus
atgagagccgccttgaagccgggct

SEQ ID NO: 541778 - DNA, 25 bp, Mus musculus
atgagagcgctgattctcatcccca

SEQ ID NO: 541779 - DNA, 25 bp, Mus musculus
atgagagcgctgtttctcatcccca

SEQ ID NO: 541780 - DNA, 25 bp, Mus musculus
atgagagcttcacggcctgcagcca

SEQ ID NO: 541781 - DNA, 25 bp, Mus musculus
atgagagcttcagggcctgcagcca

SEQ ID NO: 541782 - DNA, 25 bp, Mus musculus
atgagaggccagctcaggcgatttt

SEQ ID NO: 541783 - DNA, 25 bp, Mus musculus
atgagaggccaggtcaggcgatttt

SEQ ID NO: 541784 - DNA, 25 bp, Mus musculus
atgagagggagcacacaatagagga

SEQ ID NO: 541785 - DNA, 25 bp, Mus musculus
atgagagggagctcacaatagagga

SEQ ID NO: 541786 - DNA, 25 bp, Mus musculus
atgagatcgcctccgtcgcttaccg

SEQ ID NO: 541787 - DNA, 25 bp, Mus musculus
atgagatcgcctgcgtcgcttaccg

SEQ ID NO: 541788 - DNA, 25 bp, Mus musculus
atgagcacggccagaacagagaacc

SEQ ID NO: 541789 - DNA, 25 bp, Mus musculus
atgagcacggcctgaacagagaacc

SEQ ID NO: 541790 - DNA, 25 bp, Mus musculus
atgagcactcatatggcttggaagg

SEQ ID NO: 541791 - DNA, 25 bp, Mus musculus
atgagcactcatttggcttggaagg

SEQ ID NO: 541792 - DNA, 25 bp, Mus musculus
atgagccacggccaagggaccacat

SEQ ID NO: 541793 - DNA, 25 bp, Mus musculus
atgagccacggcgaagggaccacat

SEQ ID NO: 541794 - DNA, 25 bp, Mus musculus
atgagccactctatggtgcaacagt

SEQ ID NO: 541795 - DNA, 25 bp, Mus musculus
atgagccactctttggtgcaacagt

SEQ ID NO: 541796 - DNA, 25 bp, Mus musculus
atgagccagatcctaatatagtcaa

SEQ ID NO: 541797 - DNA, 25 bp, Mus musculus
atgagccagatcgtaatatagtcaa

SEQ ID NO: 541798 - DNA, 25 bp, Mus musculus
atgagccaggacataatcaaataca

SEQ ID NO: 541799 - DNA, 25 bp, Mus musculus
atgagccaggacttaatcaaataca

SEQ ID NO: 541800 - DNA, 25 bp, Mus musculus
atgagccagtgactcccgcaaagca

SEQ ID NO: 541801 - DNA, 25 bp, Mus musculus
atgagccagtgagtcccgcaaagca

SEQ ID NO: 541802 - DNA, 25 bp, Mus musculus
atgagccccggcatcttgggagaga

SEQ ID NO: 541803 - DNA, 25 bp, Mus musculus
atgagccccggcttcttgggagaga

SEQ ID NO: 541804 - DNA, 25 bp, Mus musculus
atgagccctcagacggcaggatggt

SEQ ID NO: 541805 - DNA, 25 bp, Mus musculus
atgagccctcagtcggcaggatggt

SEQ ID NO: 541806 - DNA, 25 bp, Mus musculus
atgagccggcagctggttcgctcca

SEQ ID NO: 541807 - DNA, 25 bp, Mus musculus
atgagccggcaggtggttcgctcca

SEQ ID NO: 541808 - DNA, 25 bp, Mus musculus
atgagcctagaacgtctgcccatct

SEQ ID NO: 541809 - DNA, 25 bp, Mus musculus
atgagcctagaaggtctgcccatct

SEQ ID NO: 541810 - DNA, 25 bp, Mus musculus
atgagccttcccatcagttccgaag

SEQ ID NO: 541811 - DNA, 25 bp, Mus musculus
atgagccttcccttcagttccgaag

SEQ ID NO: 541812 - DNA, 25 bp, Mus musculus
atgagcgcatccctttcaggccacg

SEQ ID NO: 541813 - DNA, 25 bp, Mus musculus
atgagcgcatccgtttcaggccacg

SEQ ID NO: 541814 - DNA, 25 bp, Mus musculus
atgagcgcctagaacgaggcctgga

SEQ ID NO: 541815 - DNA, 25 bp, Mus musculus
atgagcgcctagtacgaggcctgga

SEQ ID NO: 541816 - DNA, 25 bp, Mus musculus
atgagcgcttctctaagtacatgcc

SEQ ID NO: 541817 - DNA, 25 bp, Mus musculus
atgagcgcttctgtaagtacatgcc

SEQ ID NO: 541818 - DNA, 25 bp, Mus musculus
atgagcgtctccaggagggcaagat

SEQ ID NO: 541819 - DNA, 25 bp, Mus musculus
atgagcgtctcctggagggcaagat

SEQ ID NO: 541820 - DNA, 25 bp, Mus musculus
atgagctatgaacttccggaatttg

SEQ ID NO: 541821 - DNA, 25 bp, Mus musculus
atgagctatgaagttccggaatttg

SEQ ID NO: 541822 - DNA, 25 bp, Mus musculus
atgagctcagccattgccacgtggc

SEQ ID NO: 541823 - DNA, 25 bp, Mus musculus
atgagctcagcctttgccacgtggc

SEQ ID NO: 541824 - DNA, 25 bp, Mus musculus
atgagctccctgaggatccccgctg

SEQ ID NO: 541825 - DNA, 25 bp, Mus musculus
atgagctccctgtggatccccgctg

SEQ ID NO: 541826 - DNA, 25 bp, Mus musculus
atgagctgacccagcgtcagggcgt

SEQ ID NO: 541827 - DNA, 25 bp, Mus musculus
atgagctgaccctgcgtcagggcgt

SEQ ID NO: 541828 - DNA, 25 bp, Mus musculus
atgagctgacttccatccccgaggg

SEQ ID NO: 541829 - DNA, 25 bp, Mus musculus
atgagctgacttgcatccccgaggg

SEQ ID NO: 541830 - DNA, 25 bp, Mus musculus
atgagctgctctcccgagctgacca

SEQ ID NO: 541831 - DNA, 25 bp, Mus musculus
atgagctgctctgccgagctgacca

SEQ ID NO: 541832 - DNA, 25 bp, Mus musculus
atgagctggcataacaaactggaaa

SEQ ID NO: 541833 - DNA, 25 bp, Mus musculus
atgagctggcattacaaactggaaa

SEQ ID NO: 541834 - DNA, 25 bp, Mus musculus
atgaggaagagaacgaaatgtttcg

SEQ ID NO: 541835 - DNA, 25 bp, Mus musculus
atgaggaagagatcgaaatgtttcg

SEQ ID NO: 541836 - DNA, 25 bp, Mus musculus
atgaggacccctatttgtggctaag

SEQ ID NO: 541837 - DNA, 25 bp, Mus musculus
atgaggacccctttttgtggctaag

SEQ ID NO: 541838 - DNA, 25 bp, Mus musculus
atgaggacctgacctgagaagccag

SEQ ID NO: 541839 - DNA, 25 bp, Mus musculus
atgaggacctgagctgagaagccag

SEQ ID NO: 541840 - DNA, 25 bp, Mus musculus
atgaggacgtctctagccatcccgg

SEQ ID NO: 541841 - DNA, 25 bp, Mus musculus
atgaggacgtctgtagccatcccgg

SEQ ID NO: 541842 - DNA, 25 bp, Mus musculus
atgaggagaatcctgcagaggccca

SEQ ID NO: 541843 - DNA, 25 bp, Mus musculus
atgaggagaatcgtgcagaggccca

SEQ ID NO: 541844 - DNA, 25 bp, Mus musculus
atgaggagctctcccggcggcaact

SEQ ID NO: 541845 - DNA, 25 bp, Mus musculus
atgaggagctctgccggcggcaact

SEQ ID NO: 541846 - DNA, 25 bp, Mus musculus
atgaggatgctacctgaagatgagc

SEQ ID NO: 541847 - DNA, 25 bp, Mus musculus
atgaggatgctagctgaagatgagc

SEQ ID NO: 541848 - DNA, 25 bp, Mus musculus
atgaggatttccaggtcggccaagc

SEQ ID NO: 541849 - DNA, 25 bp, Mus musculus
atgaggatttcctggtcggccaagc

SEQ ID NO: 541850 - DNA, 25 bp, Mus musculus
atgaggcaatggcagccttctggca

SEQ ID NO: 541851 - DNA, 25 bp, Mus musculus
atgaggcaatgggagccttctggca

SEQ ID NO: 541852 - DNA, 25 bp, Mus musculus
atgaggcagtccacagccatcccta

SEQ ID NO: 541853 - DNA, 25 bp, Mus musculus
atgaggcagtcctcagccatcccta

SEQ ID NO: 541854 - DNA, 25 bp, Mus musculus
atgaggccacatccagaggacaccc

SEQ ID NO: 541855 - DNA, 25 bp, Mus musculus
atgaggccacatgcagaggacaccc

SEQ ID NO: 541856 - DNA, 25 bp, Mus musculus
atgaggcctaccatctctatccggg

SEQ ID NO: 541857 - DNA, 25 bp, Mus musculus
atgaggcctaccttctctatccggg

SEQ ID NO: 541858 - DNA, 25 bp, Mus musculus
atgaggctcaagcagacacggaagc

SEQ ID NO: 541859 - DNA, 25 bp, Mus musculus
atgaggctcaaggagacacggaagc

SEQ ID NO: 541860 - DNA, 25 bp, Mus musculus
atgaggctggccactgcatggagcc

SEQ ID NO: 541861 - DNA, 25 bp, Mus musculus
atgaggctggcctctgcatggagcc

SEQ ID NO: 541862 - DNA, 25 bp, Mus musculus
atgagggccacgctcgagcatcaag

SEQ ID NO: 541863 - DNA, 25 bp, Mus musculus
atgagggccacggtcgagcatcaag

SEQ ID NO: 541864 - DNA, 25 bp, Mus musculus
atgagggccagcagttccggtcatt

SEQ ID NO: 541865 - DNA, 25 bp, Mus musculus
atgagggccagctgttccggtcatt

SEQ ID NO: 541866 - DNA, 25 bp, Mus musculus
atgagggctcttaaattttgtctga

SEQ ID NO: 541867 - DNA, 25 bp, Mus musculus
atgagggctctttaattttgtctga

SEQ ID NO: 541868 - DNA, 25 bp, Mus musculus
atgagggtcaccatgacggacggtc

SEQ ID NO: 541869 - DNA, 25 bp, Mus musculus
atgagggtcaccttgacggacggtc

SEQ ID NO: 541870 - DNA, 25 bp, Mus musculus
atgaggtaagagcattggccaagcc

SEQ ID NO: 541871 - DNA, 25 bp, Mus musculus
atgaggtaagaggattggccaagcc

SEQ ID NO: 541872 - DNA, 25 bp, Mus musculus
atgaggtatactcggacttaagagg

SEQ ID NO: 541873 - DNA, 25 bp, Mus musculus
atgaggtatactgggacttaagagg

SEQ ID NO: 541874 - DNA, 25 bp, Mus musculus
atgaggtccaaacacgcctgcaggc

SEQ ID NO: 541875 - DNA, 25 bp, Mus musculus
atgaggtccaaagacgcctgcaggc

SEQ ID NO: 541876 - DNA, 25 bp, Mus musculus
atgaggtccgccaggtcatgggcat

SEQ ID NO: 541877 - DNA, 25 bp, Mus musculus
atgaggtccgcctggtcatgggcat

SEQ ID NO: 541878 - DNA, 25 bp, Mus musculus
atgaggttacaaacctaggaggact

SEQ ID NO: 541879 - DNA, 25 bp, Mus musculus
atgaggttacaatcctaggaggact

SEQ ID NO: 541880 - DNA, 25 bp, Mus musculus
atgaggttctggcacgagaactgct

SEQ ID NO: 541881 - DNA, 25 bp, Mus musculus
atgaggttctgggacgagaactgct

SEQ ID NO: 541882 - DNA, 25 bp, Mus musculus
atgagtacattgagaaactggccac

SEQ ID NO: 541883 - DNA, 25 bp, Mus musculus
atgagtacattgtgaaactggccac

SEQ ID NO: 541884 - DNA, 25 bp, Mus musculus
atgagtaccacacgctgggtcggaa

SEQ ID NO: 541885 - DNA, 25 bp, Mus musculus
atgagtaccacaggctgggtcggaa

SEQ ID NO: 541886 - DNA, 25 bp, Mus musculus
atgagtagctatccagaaatccaag

SEQ ID NO: 541887 - DNA, 25 bp, Mus musculus
atgagtagctatgcagaaatccaag

SEQ ID NO: 541888 - DNA, 25 bp, Mus musculus
atgagtaggtcccagacaggctcct

SEQ ID NO: 541889 - DNA, 25 bp, Mus musculus
atgagtaggtccgagacaggctcct

SEQ ID NO: 541890 - DNA, 25 bp, Mus musculus
atgagtatgcccagagagacgtggt

SEQ ID NO: 541891 - DNA, 25 bp, Mus musculus
atgagtatgccctgagagacgtggt

SEQ ID NO: 541892 - DNA, 25 bp, Mus musculus
atgagtcagagcagtccctgcggca

SEQ ID NO: 541893 - DNA, 25 bp, Mus musculus
atgagtcagagctgtccctgcggca

SEQ ID NO: 541894 - DNA, 25 bp, Mus musculus
atgagtcctggcctgttcctcagcg

SEQ ID NO: 541895 - DNA, 25 bp, Mus musculus
atgagtcctggcgtgttcctcagcg

SEQ ID NO: 541896 - DNA, 25 bp, Mus musculus
atgagtccttcgaccccggctacaa

SEQ ID NO: 541897 - DNA, 25 bp, Mus musculus
atgagtccttcgtccccggctacaa

SEQ ID NO: 541898 - DNA, 25 bp, Mus musculus
atgagtgcactgcaatatataaaga

SEQ ID NO: 541899 - DNA, 25 bp, Mus musculus
atgagtgcactggaatatataaaga

SEQ ID NO: 541900 - DNA, 25 bp, Mus musculus
atgagtgccactactcgtaaacgga

SEQ ID NO: 541901 - DNA, 25 bp, Mus musculus
atgagtgccacttctcgtaaacgga

SEQ ID NO: 541902 - DNA, 25 bp, Mus musculus
atgagtgccaggatccggctgcttg

SEQ ID NO: 541903 - DNA, 25 bp, Mus musculus
atgagtgccaggttccggctgcttg

SEQ ID NO: 541904 - DNA, 25 bp, Mus musculus
atgagtgcctgaccctgggcctctg

SEQ ID NO: 541905 - DNA, 25 bp, Mus musculus
atgagtgcctgagcctgggcctctg

SEQ ID NO: 541906 - DNA, 25 bp, Mus musculus
atgagtggcacgacgccgtcagcag

SEQ ID NO: 541907 - DNA, 25 bp, Mus musculus
atgagtggcacgtcgccgtcagcag

SEQ ID NO: 541908 - DNA, 25 bp, Mus musculus
atgagtgtatgaacttgcgagaagt

SEQ ID NO: 541909 - DNA, 25 bp, Mus musculus
atgagtgtatgatcttgcgagaagt

SEQ ID NO: 541910 - DNA, 25 bp, Mus musculus
atgagtgtcaacctcacccgcagga

SEQ ID NO: 541911 - DNA, 25 bp, Mus musculus
atgagtgtcaacgtcacccgcagga

SEQ ID NO: 541912 - DNA, 25 bp, Mus musculus
atgagtgtctggaccggccctgtca

SEQ ID NO: 541913 - DNA, 25 bp, Mus musculus
atgagtgtctggtccggccctgtca

SEQ ID NO: 541914 - DNA, 25 bp, Mus musculus
atgagtgtgaggaccgtgaagaccc

SEQ ID NO: 541915 - DNA, 25 bp, Mus musculus
atgagtgtgaggtccgtgaagaccc

SEQ ID NO: 541916 - DNA, 25 bp, Mus musculus
atgagttctcagcttcttgcttcac

SEQ ID NO: 541917 - DNA, 25 bp, Mus musculus
atgagttctcaggttcttgcttcac

SEQ ID NO: 541918 - DNA, 25 bp, Mus musculus
atgagttgccatcagatccccggtc

SEQ ID NO: 541919 - DNA, 25 bp, Mus musculus
atgagttgccatgagatccccggtc

SEQ ID NO: 541920 - DNA, 25 bp, Mus musculus
atgagtttctgcaccccaccgaggc

SEQ ID NO: 541921 - DNA, 25 bp, Mus musculus
atgagtttctgctccccaccgaggc

SEQ ID NO: 541922 - DNA, 25 bp, Mus musculus
atgagtttggttaccgtgtggacaa

SEQ ID NO: 541923 - DNA, 25 bp, Mus musculus
atgagtttggtttccgtgtggacaa

SEQ ID NO: 541924 - DNA, 25 bp, Mus musculus
atgataaggaccaccctagtgtgcc

SEQ ID NO: 541925 - DNA, 25 bp, Mus musculus
atgataaggacctccctagtgtgcc

SEQ ID NO: 541926 - DNA, 25 bp, Mus musculus
atgatacatggcctgtgagtcccca

SEQ ID NO: 541927 - DNA, 25 bp, Mus musculus
atgatacatggcgtgtgagtcccca

SEQ ID NO: 541928 - DNA, 25 bp, Mus musculus
atgatacccaacaaccagctgtggg

SEQ ID NO: 541929 - DNA, 25 bp, Mus musculus
atgatacccaactaccagctgtggg

SEQ ID NO: 541930 - DNA, 25 bp, Mus musculus
atgatagcccacagcaccgcagcag

SEQ ID NO: 541931 - DNA, 25 bp, Mus musculus
atgatagcccactgcaccgcagcag

SEQ ID NO: 541932 - DNA, 25 bp, Mus musculus
atgatatctgtgcagctgacccacc

SEQ ID NO: 541933 - DNA, 25 bp, Mus musculus
atgatatctgtggagctgacccacc

SEQ ID NO: 541934 - DNA, 25 bp, Mus musculus
atgatatttcccctgcagaccgaca

SEQ ID NO: 541935 - DNA, 25 bp, Mus musculus
atgatatttcccgtgcagaccgaca

SEQ ID NO: 541936 - DNA, 25 bp, Mus musculus
atgatcaagcaccaccgggacaaac

SEQ ID NO: 541937 - DNA, 25 bp, Mus musculus
atgatcaagcacgaccgggacaaac

SEQ ID NO: 541938 - DNA, 25 bp, Mus musculus
atgatcaagctgcacggagccccta

SEQ ID NO: 541939 - DNA, 25 bp, Mus musculus
atgatcaagctggacggagccccta

SEQ ID NO: 541940 - DNA, 25 bp, Mus musculus
atgatcataactcaaacatttcaag

SEQ ID NO: 541941 - DNA, 25 bp, Mus musculus
atgatcataactgaaacatttcaag

SEQ ID NO: 541942 - DNA, 25 bp, Mus musculus
atgatccaggaaaccgactgcggcg

SEQ ID NO: 541943 - DNA, 25 bp, Mus musculus
atgatccaggaatccgactgcggcg

SEQ ID NO: 541944 - DNA, 25 bp, Mus musculus
atgatcctgataagtgccatggcta

SEQ ID NO: 541945 - DNA, 25 bp, Mus musculus
atgatcctgatatgtgccatggcta

SEQ ID NO: 541946 - DNA, 25 bp, Mus musculus
atgatctccaagatcctggcctcac

SEQ ID NO: 541947 - DNA, 25 bp, Mus musculus
atgatctccaagttcctggcctcac

SEQ ID NO: 541948 - DNA, 25 bp, Mus musculus
atgatctccctgagccccatggtca

SEQ ID NO: 541949 - DNA, 25 bp, Mus musculus
atgatctccctgtgccccatggtca

SEQ ID NO: 541950 - DNA, 25 bp, Mus musculus
atgatctccgtgatgcaacaaggag

SEQ ID NO: 541951 - DNA, 25 bp, Mus musculus
atgatctccgtgttgcaacaaggag

SEQ ID NO: 541952 - DNA, 25 bp, Mus musculus
atgatcttctcacctgcacagcact

SEQ ID NO: 541953 - DNA, 25 bp, Mus musculus
atgatcttctcagctgcacagcact

SEQ ID NO: 541954 - DNA, 25 bp, Mus musculus
atgatgaagttcaacaagttctccc

SEQ ID NO: 541955 - DNA, 25 bp, Mus musculus
atgatgaagttctacaagttctccc

SEQ ID NO: 541956 - DNA, 25 bp, Mus musculus
atgatgaatggacagagactgcatg

SEQ ID NO: 541957 - DNA, 25 bp, Mus musculus
atgatgaatggagagagactgcatg

SEQ ID NO: 541958 - DNA, 25 bp, Mus musculus
atgatgacagtgctgactgtttgcc

SEQ ID NO: 541959 - DNA, 25 bp, Mus musculus
atgatgacagtggtgactgtttgcc

SEQ ID NO: 541960 - DNA, 25 bp, Mus musculus
atgatgacctgcatctttccaccag

SEQ ID NO: 541961 - DNA, 25 bp, Mus musculus
atgatgacctgcttctttccaccag

SEQ ID NO: 541962 - DNA, 25 bp, Mus musculus
atgatgacctggaaagagccaaacg

SEQ ID NO: 541963 - DNA, 25 bp, Mus musculus
atgatgacctggtaagagccaaacg

SEQ ID NO: 541964 - DNA, 25 bp, Mus musculus
atgatgacgaccaacgtgtgggtga

SEQ ID NO: 541965 - DNA, 25 bp, Mus musculus
atgatgacgacctacgtgtgggtga

SEQ ID NO: 541966 - DNA, 25 bp, Mus musculus
atgatgactgcgaagtgaaggcccg

SEQ ID NO: 541967 - DNA, 25 bp, Mus musculus
atgatgactgcgtagtgaaggcccg

SEQ ID NO: 541968 - DNA, 25 bp, Mus musculus
atgatgaggcttaactctgagttcc

SEQ ID NO: 541969 - DNA, 25 bp, Mus musculus
atgatgaggctttactctgagttcc

SEQ ID NO: 541970 - DNA, 25 bp, Mus musculus
atgatgagtttgctttccgtgtgga

SEQ ID NO: 541971 - DNA, 25 bp, Mus musculus
atgatgagtttggtttccgtgtgga

SEQ ID NO: 541972 - DNA, 25 bp, Mus musculus
atgatgatggtgaagttttaggaga

SEQ ID NO: 541973 - DNA, 25 bp, Mus musculus
atgatgatggtgtagttttaggaga

SEQ ID NO: 541974 - DNA, 25 bp, Mus musculus
atgatgattaaaccggtggtgccag

SEQ ID NO: 541975 - DNA, 25 bp, Mus musculus
atgatgattaaagcggtggtgccag

SEQ ID NO: 541976 - DNA, 25 bp, Mus musculus
atgatgcatttccttcctttgttcc

SEQ ID NO: 541977 - DNA, 25 bp, Mus musculus
atgatgcatttcgttcctttgttcc

SEQ ID NO: 541978 - DNA, 25 bp, Mus musculus
atgatgccaacaatgccaaggctgt

SEQ ID NO: 541979 - DNA, 25 bp, Mus musculus
atgatgccaacattgccaaggctgt

SEQ ID NO: 541980 - DNA, 25 bp, Mus musculus
atgatgctcgggagtcctgcgttac

SEQ ID NO: 541981 - DNA, 25 bp, Mus musculus
atgatgctcgggtgtcctgcgttac

SEQ ID NO: 541982 - DNA, 25 bp, Mus musculus
atgatgctgcctcccatgaagctgg

SEQ ID NO: 541983 - DNA, 25 bp, Mus musculus
atgatgctgcctgccatgaagctgg

SEQ ID NO: 541984 - DNA, 25 bp, Mus musculus
atgatggaagaccacggacagcccc

SEQ ID NO: 541985 - DNA, 25 bp, Mus musculus
atgatggaagacgacggacagcccc

SEQ ID NO: 541986 - DNA, 25 bp, Mus musculus
atgatggcactcagacggcccgcac

SEQ ID NO: 541987 - DNA, 25 bp, Mus musculus
atgatggcactctgacggcccgcac

SEQ ID NO: 541988 - DNA, 25 bp, Mus musculus
atgatggccatccatggcccaccta

SEQ ID NO: 541989 - DNA, 25 bp, Mus musculus
atgatggccatcgatggcccaccta

SEQ ID NO: 541990 - DNA, 25 bp, Mus musculus
atgatggcttcgaccccacggagag

SEQ ID NO: 541991 - DNA, 25 bp, Mus musculus
atgatggcttcgtccccacggagag

SEQ ID NO: 541992 - DNA, 25 bp, Mus musculus
atgatgggaccactagacgcacgga

SEQ ID NO: 541993 - DNA, 25 bp, Mus musculus
atgatgggaccagtagacgcacgga

SEQ ID NO: 541994 - DNA, 25 bp, Mus musculus
atgatggtgaacaccgcagagagca

SEQ ID NO: 541995 - DNA, 25 bp, Mus musculus
atgatggtgaactccgcagagagca

SEQ ID NO: 541996 - DNA, 25 bp, Mus musculus
atgatggtgaccagttccaaagacc

SEQ ID NO: 541997 - DNA, 25 bp, Mus musculus
atgatggtgacctgttccaaagacc

SEQ ID NO: 541998 - DNA, 25 bp, Mus musculus
atgatgtagagtctaccatggtgga

SEQ ID NO: 541999 - DNA, 25 bp, Mus musculus
atgatgtagagtgtaccatggtgga

SEQ ID NO: 542000 - DNA, 25 bp, Mus musculus
atgatgtatcccctcccagtgagcc

SEQ ID NO: 542001 - DNA, 25 bp, Mus musculus
atgatgtatcccgtcccagtgagcc

SEQ ID NO: 542002 - DNA, 25 bp, Mus musculus
atgatgtccagcctatcgccagcct

SEQ ID NO: 542003 - DNA, 25 bp, Mus musculus
atgatgtccagcgtatcgccagcct

SEQ ID NO: 542004 - DNA, 25 bp, Mus musculus
atgatgttcagtcctaccttgagca

SEQ ID NO: 542005 - DNA, 25 bp, Mus musculus
atgatgttcagtgctaccttgagca

SEQ ID NO: 542006 - DNA, 25 bp, Mus musculus
atgatgtttccgcaaagccggcact

SEQ ID NO: 542007 - DNA, 25 bp, Mus musculus
atgatgtttccggaaagccggcact

SEQ ID NO: 542008 - DNA, 25 bp, Mus musculus
atgattagaactcccagacccagaa

SEQ ID NO: 542009 - DNA, 25 bp, Mus musculus
atgattagaactgccagacccagaa

SEQ ID NO: 542010 - DNA, 25 bp, Mus musculus
atgattatgttgcaattggagctga

SEQ ID NO: 542011 - DNA, 25 bp, Mus musculus
atgattatgttggaattggagctga

SEQ ID NO: 542012 - DNA, 25 bp, Mus musculus
atgattcctcagaccatgcccagca

SEQ ID NO: 542013 - DNA, 25 bp, Mus musculus
atgattcctcagtccatgcccagca

SEQ ID NO: 542014 - DNA, 25 bp, Mus musculus
atgattgttcgaccaagacagatga

SEQ ID NO: 542015 - DNA, 25 bp, Mus musculus
atgattgttcgagcaagacagatga

SEQ ID NO: 542016 - DNA, 25 bp, Mus musculus
atgatttaccttcctcgaaatggca

SEQ ID NO: 542017 - DNA, 25 bp, Mus musculus
atgatttaccttgctcgaaatggca

SEQ ID NO: 542018 - DNA, 25 bp, Mus musculus
atgcaaagatgaccctgggaatgat

SEQ ID NO: 542019 - DNA, 25 bp, Mus musculus
atgcaaagatgagcctgggaatgat

SEQ ID NO: 542020 - DNA, 25 bp, Mus musculus
atgcaaagcccacgagccaggattt

SEQ ID NO: 542021 - DNA, 25 bp, Mus musculus
atgcaaagcccaggagccaggattt

SEQ ID NO: 542022 - DNA, 25 bp, Mus musculus
atgcaaagtgatcgcctccaagaag

SEQ ID NO: 542023 - DNA, 25 bp, Mus musculus
atgcaaagtgatggcctccaagaag

SEQ ID NO: 542024 - DNA, 25 bp, Mus musculus
atgcaactaagtaaaggccaaaggc

SEQ ID NO: 542025 - DNA, 25 bp, Mus musculus
atgcaactaagttaaggccaaaggc

SEQ ID NO: 542026 - DNA, 25 bp, Mus musculus
atgcaagtgagtccacaggaccgga

SEQ ID NO: 542027 - DNA, 25 bp, Mus musculus
atgcaagtgagtgcacaggaccgga

SEQ ID NO: 542028 - DNA, 25 bp, Mus musculus
atgcaattcgaactcacagtgaatc

SEQ ID NO: 542029 - DNA, 25 bp, Mus musculus
atgcaattcgaagtcacagtgaatc

SEQ ID NO: 542030 - DNA, 25 bp, Mus musculus
atgcacactcgcctgaggtactcca

SEQ ID NO: 542031 - DNA, 25 bp, Mus musculus
atgcacactcgcgtgaggtactcca

SEQ ID NO: 542032 - DNA, 25 bp, Mus musculus
atgcacagaaagagcttcagaagtt

SEQ ID NO: 542033 - DNA, 25 bp, Mus musculus
atgcacagaaagtgcttcagaagtt

SEQ ID NO: 542034 - DNA, 25 bp, Mus musculus
atgcacctgagcacctgggcggaca

SEQ ID NO: 542035 - DNA, 25 bp, Mus musculus
atgcacctgagctcctgggcggaca

SEQ ID NO: 542036 - DNA, 25 bp, Mus musculus
atgcacctggttacatccctggcaa

SEQ ID NO: 542037 - DNA, 25 bp, Mus musculus
atgcacctggtttcatccctggcaa

SEQ ID NO: 542038 - DNA, 25 bp, Mus musculus
atgcacgaacttcccgcgggacgtc

SEQ ID NO: 542039 - DNA, 25 bp, Mus musculus
atgcacgaacttgccgcgggacgtc

SEQ ID NO: 542040 - DNA, 25 bp, Mus musculus
atgcacgcttccaggtcacgcactt

SEQ ID NO: 542041 - DNA, 25 bp, Mus musculus
atgcacgcttcctggtcacgcactt

SEQ ID NO: 542042 - DNA, 25 bp, Mus musculus
atgcacgggcgcagccgcagaacct

SEQ ID NO: 542043 - DNA, 25 bp, Mus musculus
atgcacgggcgctgccgcagaacct

SEQ ID NO: 542044 - DNA, 25 bp, Mus musculus
atgcactgcagcacatggcggagtt

SEQ ID NO: 542045 - DNA, 25 bp, Mus musculus
atgcactgcagctcatggcggagtt

SEQ ID NO: 542046 - DNA, 25 bp, Mus musculus
atgcactgtactaaggaagcaagac

SEQ ID NO: 542047 - DNA, 25 bp, Mus musculus
atgcactgtacttaggaagcaagac

SEQ ID NO: 542048 - DNA, 25 bp, Mus musculus
atgcactttactagggagaagaagt

SEQ ID NO: 542049 - DNA, 25 bp, Mus musculus
atgcactttacttgggagaagaagt

SEQ ID NO: 542050 - DNA, 25 bp, Mus musculus
atgcagaacatgctgtccgccccat

SEQ ID NO: 542051 - DNA, 25 bp, Mus musculus
atgcagaacatggtgtccgccccat

SEQ ID NO: 542052 - DNA, 25 bp, Mus musculus
atgcagaagcctcccgaaccaaaca

SEQ ID NO: 542053 - DNA, 25 bp, Mus musculus
atgcagaagcctgccgaaccaaaca

SEQ ID NO: 542054 - DNA, 25 bp, Mus musculus
atgcagaaggctctgaaccgccagt

SEQ ID NO: 542055 - DNA, 25 bp, Mus musculus
atgcagaaggctgtgaaccgccagt

SEQ ID NO: 542056 - DNA, 25 bp, Mus musculus
atgcagaatccgagagggtggtaca

SEQ ID NO: 542057 - DNA, 25 bp, Mus musculus
atgcagaatccgtgagggtggtaca

SEQ ID NO: 542058 - DNA, 25 bp, Mus musculus
atgcagaatggcacctgtgagggct

SEQ ID NO: 542059 - DNA, 25 bp, Mus musculus
atgcagaatggctcctgtgagggct

SEQ ID NO: 542060 - DNA, 25 bp, Mus musculus
atgcagacaaaccagacaccgccga

SEQ ID NO: 542061 - DNA, 25 bp, Mus musculus
atgcagacaaacgagacaccgccga

SEQ ID NO: 542062 - DNA, 25 bp, Mus musculus
atgcagagctgcaacaccgaggcca

SEQ ID NO: 542063 - DNA, 25 bp, Mus musculus
atgcagagctgctacaccgaggcca

SEQ ID NO: 542064 - DNA, 25 bp, Mus musculus
atgcagatctccacccggacagaag

SEQ ID NO: 542065 - DNA, 25 bp, Mus musculus
atgcagatctcctcccggacagaag

SEQ ID NO: 542066 - DNA, 25 bp, Mus musculus
atgcagatgcaaaagtccaggtgct

SEQ ID NO: 542067 - DNA, 25 bp, Mus musculus
atgcagatgcaatagtccaggtgct

SEQ ID NO: 542068 - DNA, 25 bp, Mus musculus
atgcagattcttaagccccacccag

SEQ ID NO: 542069 - DNA, 25 bp, Mus musculus
atgcagattctttagccccacccag

SEQ ID NO: 542070 - DNA, 25 bp, Mus musculus
atgcagcaagagcaggtcccctctc

SEQ ID NO: 542071 - DNA, 25 bp, Mus musculus
atgcagcaagaggaggtcccctctc

SEQ ID NO: 542072 - DNA, 25 bp, Mus musculus
atgcagcaagctcagaaacacacag

SEQ ID NO: 542073 - DNA, 25 bp, Mus musculus
atgcagcaagctgagaaacacacag

SEQ ID NO: 542074 - DNA, 25 bp, Mus musculus
atgcagccatcgcaagcctgctgtg

SEQ ID NO: 542075 - DNA, 25 bp, Mus musculus
atgcagccatcggaagcctgctgtg

SEQ ID NO: 542076 - DNA, 25 bp, Mus musculus
atgcagcccaccatgtcatgggtcc

SEQ ID NO: 542077 - DNA, 25 bp, Mus musculus
atgcagcccaccttgtcatgggtcc

SEQ ID NO: 542078 - DNA, 25 bp, Mus musculus
atgcagccctttccggtgggcagca

SEQ ID NO: 542079 - DNA, 25 bp, Mus musculus
atgcagccctttgcggtgggcagca

SEQ ID NO: 542080 - DNA, 25 bp, Mus musculus
atgcagccggtcaaggagacccctg

SEQ ID NO: 542081 - DNA, 25 bp, Mus musculus
atgcagccggtctaggagacccctg

SEQ ID NO: 542082 - DNA, 25 bp, Mus musculus
atgcagctcaggatggactgagtca

SEQ ID NO: 542083 - DNA, 25 bp, Mus musculus
atgcagctcaggttggactgagtca

SEQ ID NO: 542084 - DNA, 25 bp, Mus musculus
atgcagctcttccaggaccatggct

SEQ ID NO: 542085 - DNA, 25 bp, Mus musculus
atgcagctcttcgaggaccatggct

SEQ ID NO: 542086 - DNA, 25 bp, Mus musculus
atgcagctcttgagaacagcactgg

SEQ ID NO: 542087 - DNA, 25 bp, Mus musculus
atgcagctcttgtgaacagcactgg

SEQ ID NO: 542088 - DNA, 25 bp, Mus musculus
atgcagctgacgaccccttggtgca

SEQ ID NO: 542089 - DNA, 25 bp, Mus musculus
atgcagctgacgtccccttggtgca

SEQ ID NO: 542090 - DNA, 25 bp, Mus musculus
atgcaggacgccaccagggtctacg

SEQ ID NO: 542091 - DNA, 25 bp, Mus musculus
atgcaggacgcctccagggtctacg

SEQ ID NO: 542092 - DNA, 25 bp, Mus musculus
atgcaggccagcaatcgggaccatg

SEQ ID NO: 542093 - DNA, 25 bp, Mus musculus
atgcaggccagctatcgggaccatg

SEQ ID NO: 542094 - DNA, 25 bp, Mus musculus
atgcaggccgggattatggcagttc

SEQ ID NO: 542095 - DNA, 25 bp, Mus musculus
atgcaggccgggtttatggcagttc

SEQ ID NO: 542096 - DNA, 25 bp, Mus musculus
atgcaggctgttagacctccgtgca

SEQ ID NO: 542097 - DNA, 25 bp, Mus musculus
atgcaggctgtttgacctccgtgca

SEQ ID NO: 542098 - DNA, 25 bp, Mus musculus
atgcagggtcccagggcactgacag

SEQ ID NO: 542099 - DNA, 25 bp, Mus musculus
atgcagggtccctgggcactgacag

SEQ ID NO: 542100 - DNA, 25 bp, Mus musculus
atgcaggtccacagggacacgcgcg

SEQ ID NO: 542101 - DNA, 25 bp, Mus musculus
atgcaggtccactgggacacgcgcg

SEQ ID NO: 542102 - DNA, 25 bp, Mus musculus
atgcaggtggatatgggctgtaact

SEQ ID NO: 542103 - DNA, 25 bp, Mus musculus
atgcaggtggatttgggctgtaact

SEQ ID NO: 542104 - DNA, 25 bp, Mus musculus
atgcaggttcccctcggcagcaggc

SEQ ID NO: 542105 - DNA, 25 bp, Mus musculus
atgcaggttcccgtcggcagcaggc

SEQ ID NO: 542106 - DNA, 25 bp, Mus musculus
atgcagtacactcctacaaaggaag

SEQ ID NO: 542107 - DNA, 25 bp, Mus musculus
atgcagtacactgctacaaaggaag

SEQ ID NO: 542108 - DNA, 25 bp, Mus musculus
atgcagtcctggaccacctgccaga

SEQ ID NO: 542109 - DNA, 25 bp, Mus musculus
atgcagtcctggtccacctgccaga

SEQ ID NO: 542110 - DNA, 25 bp, Mus musculus
atgcagttcatcagccaccgattcc

SEQ ID NO: 542111 - DNA, 25 bp, Mus musculus
atgcagttcatctgccaccgattcc

SEQ ID NO: 542112 - DNA, 25 bp, Mus musculus
atgcatcctagcaggcgcagccttc

SEQ ID NO: 542113 - DNA, 25 bp, Mus musculus
atgcatcctagctggcgcagccttc

SEQ ID NO: 542114 - DNA, 25 bp, Mus musculus
atgcatcctgagctggcctcccaga

SEQ ID NO: 542115 - DNA, 25 bp, Mus musculus
atgcatcctgaggtggcctcccaga

SEQ ID NO: 542116 - DNA, 25 bp, Mus musculus
atgcatggaatcacagtctcttcag

SEQ ID NO: 542117 - DNA, 25 bp, Mus musculus
atgcatggaatctcagtctcttcag

SEQ ID NO: 542118 - DNA, 25 bp, Mus musculus
atgcatggcgtaagtcgcgaaggca

SEQ ID NO: 542119 - DNA, 25 bp, Mus musculus
atgcatggcgtatgtcgcgaaggca

SEQ ID NO: 542120 - DNA, 25 bp, Mus musculus
atgcatgtcaggactgtgcaaagag

SEQ ID NO: 542121 - DNA, 25 bp, Mus musculus
atgcatgtcaggtctgtgcaaagag

SEQ ID NO: 542122 - DNA, 25 bp, Mus musculus
atgcatgttaaaagactcctgaata

SEQ ID NO: 542123 - DNA, 25 bp, Mus musculus
atgcatgttaaatgactcctgaata

SEQ ID NO: 542124 - DNA, 25 bp, Mus musculus
atgcatgttatcagggcagcgttgg

SEQ ID NO: 542125 - DNA, 25 bp, Mus musculus
atgcatgttatctgggcagcgttgg

SEQ ID NO: 542126 - DNA, 25 bp, Mus musculus
atgccaaagctgcacgagaccgtcg

SEQ ID NO: 542127 - DNA, 25 bp, Mus musculus
atgccaaagctggacgagaccgtcg

SEQ ID NO: 542128 - DNA, 25 bp, Mus musculus
atgccaaggtcacgaacacagagcc

SEQ ID NO: 542129 - DNA, 25 bp, Mus musculus
atgccaaggtcaggaacacagagcc

SEQ ID NO: 542130 - DNA, 25 bp, Mus musculus
atgccaatttggctggcacactgag

SEQ ID NO: 542131 - DNA, 25 bp, Mus musculus
atgccaatttgggtggcacactgag

SEQ ID NO: 542132 - DNA, 25 bp, Mus musculus
atgccacatcagaggcggatggaga

SEQ ID NO: 542133 - DNA, 25 bp, Mus musculus
atgccacatcagtggcggatggaga

SEQ ID NO: 542134 - DNA, 25 bp, Mus musculus
atgccaccagccagtgccgctgtta

SEQ ID NO: 542135 - DNA, 25 bp, Mus musculus
atgccaccagcctgtgccgctgtta

SEQ ID NO: 542136 - DNA, 25 bp, Mus musculus
atgccaccagtacccgcgaggaggc

SEQ ID NO: 542137 - DNA, 25 bp, Mus musculus
atgccaccagtagccgcgaggaggc

SEQ ID NO: 542138 - DNA, 25 bp, Mus musculus
atgccaccctccagatacatgaagc

SEQ ID NO: 542139 - DNA, 25 bp, Mus musculus
atgccaccctcctgatacatgaagc

SEQ ID NO: 542140 - DNA, 25 bp, Mus musculus
atgccaccctggaaggcatcctcat

SEQ ID NO: 542141 - DNA, 25 bp, Mus musculus
atgccaccctggtaggcatcctcat

SEQ ID NO: 542142 - DNA, 25 bp, Mus musculus
atgccaccgcagaggcctgctggag

SEQ ID NO: 542143 - DNA, 25 bp, Mus musculus
atgccaccgcagtggcctgctggag

SEQ ID NO: 542144 - DNA, 25 bp, Mus musculus
atgccaccttggcatgggactcctc

SEQ ID NO: 542145 - DNA, 25 bp, Mus musculus
atgccaccttgggatgggactcctc

SEQ ID NO: 542146 - DNA, 25 bp, Mus musculus
atgccacgaggcagccgggactttg

SEQ ID NO: 542147 - DNA, 25 bp, Mus musculus
atgccacgaggcatggtcccagcca

SEQ ID NO: 542148 - DNA, 25 bp, Mus musculus
atgccacgaggctgccgggactttg

SEQ ID NO: 542149 - DNA, 25 bp, Mus musculus
atgccacgaggcttggtcccagcca

SEQ ID NO: 542150 - DNA, 25 bp, Mus musculus
atgccactcgtgagcctgactcctg

SEQ ID NO: 542151 - DNA, 25 bp, Mus musculus
atgccactcgtgtgcctgactcctg

SEQ ID NO: 542152 - DNA, 25 bp, Mus musculus
atgccagacacacggctgcgagtct

SEQ ID NO: 542153 - DNA, 25 bp, Mus musculus
atgccagacacagggctgcgagtct

SEQ ID NO: 542154 - DNA, 25 bp, Mus musculus
atgccagaccagattgatcaggtgg

SEQ ID NO: 542155 - DNA, 25 bp, Mus musculus
atgccagaccagtttgatcaggtgg

SEQ ID NO: 542156 - DNA, 25 bp, Mus musculus
atgccagatgggactagcagattta

SEQ ID NO: 542157 - DNA, 25 bp, Mus musculus
atgccagatgggtctagcagattta

SEQ ID NO: 542158 - DNA, 25 bp, Mus musculus
atgccagcccgtcgatctcctggga

SEQ ID NO: 542159 - DNA, 25 bp, Mus musculus
atgccagcccgtggatctcctggga

SEQ ID NO: 542160 - DNA, 25 bp, Mus musculus
atgccaggaggccagtgtgccacac

SEQ ID NO: 542161 - DNA, 25 bp, Mus musculus
atgccaggaggcgagtgtgccacac

SEQ ID NO: 542162 - DNA, 25 bp, Mus musculus
atgccaggctcacggcaagccaaga

SEQ ID NO: 542163 - DNA, 25 bp, Mus musculus
atgccaggctcagggcaagccaaga

SEQ ID NO: 542164 - DNA, 25 bp, Mus musculus
atgccagtagcgaggccatccagct

SEQ ID NO: 542165 - DNA, 25 bp, Mus musculus
atgccagtagcgtggccatccagct

SEQ ID NO: 542166 - DNA, 25 bp, Mus musculus
atgccagttttaaccatcaggtcac

SEQ ID NO: 542167 - DNA, 25 bp, Mus musculus
atgccagttttatccatcaggtcac

SEQ ID NO: 542168 - DNA, 25 bp, Mus musculus
atgccatatggtcagttgcctggga

SEQ ID NO: 542169 - DNA, 25 bp, Mus musculus
atgccatatggtgagttgcctggga

SEQ ID NO: 542170 - DNA, 25 bp, Mus musculus
atgccatcatgaatgtgaggagggc

SEQ ID NO: 542171 - DNA, 25 bp, Mus musculus
atgccatcatgattgtgaggagggc

SEQ ID NO: 542172 - DNA, 25 bp, Mus musculus
atgccatcggtgcagagtacagttt

SEQ ID NO: 542173 - DNA, 25 bp, Mus musculus
atgccatcggtggagagtacagttt

SEQ ID NO: 542174 - DNA, 25 bp, Mus musculus
atgccatcttcgacctgctgaccgg

SEQ ID NO: 542175 - DNA, 25 bp, Mus musculus
atgccatcttcgtcctgctgaccgg

SEQ ID NO: 542176 - DNA, 25 bp, Mus musculus
atgccatgggccctgccgctaggca

SEQ ID NO: 542177 - DNA, 25 bp, Mus musculus
atgccatgggccgtgccgctaggca

SEQ ID NO: 542178 - DNA, 25 bp, Mus musculus
atgccattcgccagttcctggaata

SEQ ID NO: 542179 - DNA, 25 bp, Mus musculus
atgccattcgcctgttcctggaata

SEQ ID NO: 542180 - DNA, 25 bp, Mus musculus
atgccattgagaaagcccaggactt

SEQ ID NO: 542181 - DNA, 25 bp, Mus musculus
atgccattgagatagcccaggactt

SEQ ID NO: 542182 - DNA, 25 bp, Mus musculus
atgcccaaggtcctggaacaaattg

SEQ ID NO: 542183 - DNA, 25 bp, Mus musculus
atgcccaaggtcgtggaacaaattg

SEQ ID NO: 542184 - DNA, 25 bp, Mus musculus
atgcccagacccagaggaaggccat

SEQ ID NO: 542185 - DNA, 25 bp, Mus musculus
atgcccagaccctgaggaaggccat

SEQ ID NO: 542186 - DNA, 25 bp, Mus musculus
atgcccagatgcagcgtgacatttg

SEQ ID NO: 542187 - DNA, 25 bp, Mus musculus
atgcccagatgctgcgtgacatttg

SEQ ID NO: 542188 - DNA, 25 bp, Mus musculus
atgcccagcttcaccatggcaaaca

SEQ ID NO: 542189 - DNA, 25 bp, Mus musculus
atgcccagcttctccatggcaaaca

SEQ ID NO: 542190 - DNA, 25 bp, Mus musculus
atgcccaggaatcagccaagagtgc

SEQ ID NO: 542191 - DNA, 25 bp, Mus musculus
atgcccaggaatgagccaagagtgc

SEQ ID NO: 542192 - DNA, 25 bp, Mus musculus
atgcccaggctaatgctgacctcag

SEQ ID NO: 542193 - DNA, 25 bp, Mus musculus
atgcccaggctattgctgacctcag

SEQ ID NO: 542194 - DNA, 25 bp, Mus musculus
atgccccatatacgccataagtggc

SEQ ID NO: 542195 - DNA, 25 bp, Mus musculus
atgccccatataggccataagtggc

SEQ ID NO: 542196 - DNA, 25 bp, Mus musculus
atgcccctatggagtcctcagatga

SEQ ID NO: 542197 - DNA, 25 bp, Mus musculus
atgcccctatggtgtcctcagatga

SEQ ID NO: 542198 - DNA, 25 bp, Mus musculus
atgcccctggcgaacctgcagatac

SEQ ID NO: 542199 - DNA, 25 bp, Mus musculus
atgcccctggcgtacctgcagatac

SEQ ID NO: 542200 - DNA, 25 bp, Mus musculus
atgcccctgggtacaatgccgaggt

SEQ ID NO: 542201 - DNA, 25 bp, Mus musculus
atgcccctgggttcaatgccgaggt

SEQ ID NO: 542202 - DNA, 25 bp, Mus musculus
atgcccctttgactggctgggctgt

SEQ ID NO: 542203 - DNA, 25 bp, Mus musculus
atgcccctttgagtggctgggctgt

SEQ ID NO: 542204 - DNA, 25 bp, Mus musculus
atgcccgctctaactacgttggcaa

SEQ ID NO: 542205 - DNA, 25 bp, Mus musculus
atgcccgctctatctacgttggcaa

SEQ ID NO: 542206 - DNA, 25 bp, Mus musculus
atgcccggcagcagagcaccggagc

SEQ ID NO: 542207 - DNA, 25 bp, Mus musculus
atgcccggcagctgagcaccggagc

SEQ ID NO: 542208 - DNA, 25 bp, Mus musculus
atgcccggtgcaacgcactgcttca

SEQ ID NO: 542209 - DNA, 25 bp, Mus musculus
atgcccggtgcatcgcactgcttca

SEQ ID NO: 542210 - DNA, 25 bp, Mus musculus
atgcccgtttctacgcggcgcagat

SEQ ID NO: 542211 - DNA, 25 bp, Mus musculus
atgcccgtttcttcgcggcgcagat

SEQ ID NO: 542212 - DNA, 25 bp, Mus musculus
atgccctcagagagacctgaccaag

SEQ ID NO: 542213 - DNA, 25 bp, Mus musculus
atgccctcagagtgacctgaccaag

SEQ ID NO: 542214 - DNA, 25 bp, Mus musculus
atgccctccgagagaacaacaacca

SEQ ID NO: 542215 - DNA, 25 bp, Mus musculus
atgccctccgagtgaacaacaacca

SEQ ID NO: 542216 - DNA, 25 bp, Mus musculus
atgccctccgcgagcccagggagaa

SEQ ID NO: 542217 - DNA, 25 bp, Mus musculus
atgccctccgcgtgcccagggagaa

SEQ ID NO: 542218 - DNA, 25 bp, Mus musculus
atgccctggtgaccccaactgtgtg

SEQ ID NO: 542219 - DNA, 25 bp, Mus musculus
atgccctggtgagcccaactgtgtg

SEQ ID NO: 542220 - DNA, 25 bp, Mus musculus
atgccgaccaatagcgccgcggcgg

SEQ ID NO: 542221 - DNA, 25 bp, Mus musculus
atgccgaccaattgcgccgcggcgg

SEQ ID NO: 542222 - DNA, 25 bp, Mus musculus
atgccgacgagtcccacgatcttta

SEQ ID NO: 542223 - DNA, 25 bp, Mus musculus
atgccgacgagtgccacgatcttta

SEQ ID NO: 542224 - DNA, 25 bp, Mus musculus
atgccgagatggcattttacaggtg

SEQ ID NO: 542225 - DNA, 25 bp, Mus musculus
atgccgagatgggattttacaggtg

SEQ ID NO: 542226 - DNA, 25 bp, Mus musculus
atgccgagcctgagcgggccactct

SEQ ID NO: 542227 - DNA, 25 bp, Mus musculus
atgccgagcctgtgcgggccactct

SEQ ID NO: 542228 - DNA, 25 bp, Mus musculus
atgccgaggatcagcagaagcgcct

SEQ ID NO: 542229 - DNA, 25 bp, Mus musculus
atgccgaggatctgcagaagcgcct

SEQ ID NO: 542230 - DNA, 25 bp, Mus musculus
atgccgcagcccagtgctggccatt

SEQ ID NO: 542231 - DNA, 25 bp, Mus musculus
atgccgcagccctgtgctggccatt

SEQ ID NO: 542232 - DNA, 25 bp, Mus musculus
atgccgccctatcatgaggagaccc

SEQ ID NO: 542233 - DNA, 25 bp, Mus musculus
atgccgccctatgatgaggagaccc

SEQ ID NO: 542234 - DNA, 25 bp, Mus musculus
atgccgcgctccatcctggtcagga

SEQ ID NO: 542235 - DNA, 25 bp, Mus musculus
atgccgcgctccttcctggtcagga

SEQ ID NO: 542236 - DNA, 25 bp, Mus musculus
atgccgcggaggagcgtgcgggcag

SEQ ID NO: 542237 - DNA, 25 bp, Mus musculus
atgccgcggaggtgcgtgcgggcag

SEQ ID NO: 542238 - DNA, 25 bp, Mus musculus
atgccggatcacatctaactttgtc

SEQ ID NO: 542239 - DNA, 25 bp, Mus musculus
atgccggatcacttctaactttgtc

SEQ ID NO: 542240 - DNA, 25 bp, Mus musculus
atgccggcgtcaaccaggctgcacg

SEQ ID NO: 542241 - DNA, 25 bp, Mus musculus
atgccggcgtcatccaggctgcacg

SEQ ID NO: 542242 - DNA, 25 bp, Mus musculus
atgccggtggaccagcgagaccttc

SEQ ID NO: 542243 - DNA, 25 bp, Mus musculus
atgccggtggacgagcgagaccttc

SEQ ID NO: 542244 - DNA, 25 bp, Mus musculus
atgccggttcctcctggacagtcag

SEQ ID NO: 542245 - DNA, 25 bp, Mus musculus
atgccggttcctgctggacagtcag

SEQ ID NO: 542246 - DNA, 25 bp, Mus musculus
atgccgtcgggtatccagcagatcg

SEQ ID NO: 542247 - DNA, 25 bp, Mus musculus
atgccgtcgggtttccagcagatcg

SEQ ID NO: 542248 - DNA, 25 bp, Mus musculus
atgcctaacgggattcatagcacag

SEQ ID NO: 542249 - DNA, 25 bp, Mus musculus
atgcctaacgggtttcatagcacag

SEQ ID NO: 542250 - DNA, 25 bp, Mus musculus
atgcctaagaaacccggtgcgacaa

SEQ ID NO: 542251 - DNA, 25 bp, Mus musculus
atgcctaagaaagccggtgcgacaa

SEQ ID NO: 542252 - DNA, 25 bp, Mus musculus
atgcctaagcctcgtgtgtttaact

SEQ ID NO: 542253 - DNA, 25 bp, Mus musculus
atgcctaagcctggtgtgtttaact

SEQ ID NO: 542254 - DNA, 25 bp, Mus musculus
atgcctacaaggagctatggaacag

SEQ ID NO: 542255 - DNA, 25 bp, Mus musculus
atgcctacaaggtgctatggaacag

SEQ ID NO: 542256 - DNA, 25 bp, Mus musculus
atgcctacttttatcttcgaacaca

SEQ ID NO: 542257 - DNA, 25 bp, Mus musculus
atgcctacttttttcttcgaacaca

SEQ ID NO: 542258 - DNA, 25 bp, Mus musculus
atgcctagaggaaggtttacaaaac

SEQ ID NO: 542259 - DNA, 25 bp, Mus musculus
atgcctagaggatggtttacaaaac

SEQ ID NO: 542260 - DNA, 25 bp, Mus musculus
atgcctagccgacggagagccggag

SEQ ID NO: 542261 - DNA, 25 bp, Mus musculus
atgcctagccgagggagagccggag

SEQ ID NO: 542262 - DNA, 25 bp, Mus musculus
atgcctcacagcctgtttagaaagg

SEQ ID NO: 542263 - DNA, 25 bp, Mus musculus
atgcctcacagcgtgtttagaaagg

SEQ ID NO: 542264 - DNA, 25 bp, Mus musculus
atgcctcagatgctgctctgatgga

SEQ ID NO: 542265 - DNA, 25 bp, Mus musculus
atgcctcagatggtgctctgatgga

SEQ ID NO: 542266 - DNA, 25 bp, Mus musculus
atgcctcagttgactccacagatcc

SEQ ID NO: 542267 - DNA, 25 bp, Mus musculus
atgcctcagttgtctccacagatcc

SEQ ID NO: 542268 - DNA, 25 bp, Mus musculus
atgcctcatggacggagcccaaacc

SEQ ID NO: 542269 - DNA, 25 bp, Mus musculus
atgcctcatggagggagcccaaacc

SEQ ID NO: 542270 - DNA, 25 bp, Mus musculus
atgcctctgaaactcacaatggtga

SEQ ID NO: 542271 - DNA, 25 bp, Mus musculus
atgcctctgaaagtcacaatggtga

SEQ ID NO: 542272 - DNA, 25 bp, Mus musculus
atgcctgaatccagggtgcctgccg

SEQ ID NO: 542273 - DNA, 25 bp, Mus musculus
atgcctgaatcctgggtgcctgccg

SEQ ID NO: 542274 - DNA, 25 bp, Mus musculus
atgcctgaggccaagaccaggccgc

SEQ ID NO: 542275 - DNA, 25 bp, Mus musculus
atgcctgaggcctagaccaggccgc

SEQ ID NO: 542276 - DNA, 25 bp, Mus musculus
atgcctgctacgagcacaaccacat

SEQ ID NO: 542277 - DNA, 25 bp, Mus musculus
atgcctgctacgtgcacaaccacat

SEQ ID NO: 542278 - DNA, 25 bp, Mus musculus
atgcctggcagcaccgagagaccaa

SEQ ID NO: 542279 - DNA, 25 bp, Mus musculus
atgcctggcagctccgagagaccaa

SEQ ID NO: 542280 - DNA, 25 bp, Mus musculus
atgcctgtccacaccggagctagac

SEQ ID NO: 542281 - DNA, 25 bp, Mus musculus
atgcctgtccactccggagctagac

SEQ ID NO: 542282 - DNA, 25 bp, Mus musculus
atgcctgtgccaccgcgaaggagca

SEQ ID NO: 542283 - DNA, 25 bp, Mus musculus
atgcctgtgccagcgcgaaggagca

SEQ ID NO: 542284 - DNA, 25 bp, Mus musculus
atgcctgtgggcagtactacaagct

SEQ ID NO: 542285 - DNA, 25 bp, Mus musculus
atgcctgtgggctgtactacaagct

SEQ ID NO: 542286 - DNA, 25 bp, Mus musculus
atgccttccttcactgcccggctca

SEQ ID NO: 542287 - DNA, 25 bp, Mus musculus
atgccttccttctctgcccggctca

SEQ ID NO: 542288 - DNA, 25 bp, Mus musculus
atgccttttggaccgggcgtcacaa

SEQ ID NO: 542289 - DNA, 25 bp, Mus musculus
atgccttttggagcgggcgtcacaa

SEQ ID NO: 542290 - DNA, 25 bp, Mus musculus
atgcctttttatactgcaagtctga

SEQ ID NO: 542291 - DNA, 25 bp, Mus musculus
atgcctttttattctgcaagtctga

SEQ ID NO: 542292 - DNA, 25 bp, Mus musculus
atgcgaaccggcacctgctgctcag

SEQ ID NO: 542293 - DNA, 25 bp, Mus musculus
atgcgaaccggctcctgctgctcag

SEQ ID NO: 542294 - DNA, 25 bp, Mus musculus
atgcgaactgcgcaccgcgcgctgt

SEQ ID NO: 542295 - DNA, 25 bp, Mus musculus
atgcgaactgcggaccgcgcgctgt

SEQ ID NO: 542296 - DNA, 25 bp, Mus musculus
atgcgaccctgtacgtgcccagtgc

SEQ ID NO: 542297 - DNA, 25 bp, Mus musculus
atgcgaccctgttcgtgcccagtgc

SEQ ID NO: 542298 - DNA, 25 bp, Mus musculus
atgcgagctgtcaagaagcatgcca

SEQ ID NO: 542299 - DNA, 25 bp, Mus musculus
atgcgagctgtctagaagcatgcca

SEQ ID NO: 542300 - DNA, 25 bp, Mus musculus
atgcgatgatgaccagatgtgtaat

SEQ ID NO: 542301 - DNA, 25 bp, Mus musculus
atgcgatgatgagcagatgtgtaat

SEQ ID NO: 542302 - DNA, 25 bp, Mus musculus
atgcgcaaagcgctctgccttcttt

SEQ ID NO: 542303 - DNA, 25 bp, Mus musculus
atgcgcaaagcggtctgccttcttt

SEQ ID NO: 542304 - DNA, 25 bp, Mus musculus
atgcgcaacaccagtaagcagcagc

SEQ ID NO: 542305 - DNA, 25 bp, Mus musculus
atgcgcaacacctgtaagcagcagc

SEQ ID NO: 542306 - DNA, 25 bp, Mus musculus
atgcgcacggccaacggaggcccga

SEQ ID NO: 542307 - DNA, 25 bp, Mus musculus
atgcgcacggcctacggaggcccga

SEQ ID NO: 542308 - DNA, 25 bp, Mus musculus
atgcgcagcgccagctcgctgagca

SEQ ID NO: 542309 - DNA, 25 bp, Mus musculus
atgcgcagcgcctgctcgctgagca

SEQ ID NO: 542310 - DNA, 25 bp, Mus musculus
atgcgcgctggcacaactgtgtgag

SEQ ID NO: 542311 - DNA, 25 bp, Mus musculus
atgcgcgctggctcaactgtgtgag

SEQ ID NO: 542312 - DNA, 25 bp, Mus musculus
atgcgctcatgaaaccaaatatggg

SEQ ID NO: 542313 - DNA, 25 bp, Mus musculus
atgcgctcatgataccaaatatggg

SEQ ID NO: 542314 - DNA, 25 bp, Mus musculus
atgcgctgaaacctggaggcctcca

SEQ ID NO: 542315 - DNA, 25 bp, Mus musculus
atgcgctgaaacgtggaggcctcca

SEQ ID NO: 542316 - DNA, 25 bp, Mus musculus
atgcgctgccacacgggcgtcaagc

SEQ ID NO: 542317 - DNA, 25 bp, Mus musculus
atgcgctgccactcgggcgtcaagc

SEQ ID NO: 542318 - DNA, 25 bp, Mus musculus
atgcggaaccgaaccctgtccgtgg

SEQ ID NO: 542319 - DNA, 25 bp, Mus musculus
atgcggaaccgatccctgtccgtgg

SEQ ID NO: 542320 - DNA, 25 bp, Mus musculus
atgcggacccaaatactgcttgtag

SEQ ID NO: 542321 - DNA, 25 bp, Mus musculus
atgcggacccaattactgcttgtag

SEQ ID NO: 542322 - DNA, 25 bp, Mus musculus
atgcggagcagcacgcagatggaat

SEQ ID NO: 542323 - DNA, 25 bp, Mus musculus
atgcggagcagctcgcagatggaat

SEQ ID NO: 542324 - DNA, 25 bp, Mus musculus
atgcggagcctgcaccaccctaatg

SEQ ID NO: 542325 - DNA, 25 bp, Mus musculus
atgcggagcctggaccaccctaatg

SEQ ID NO: 542326 - DNA, 25 bp, Mus musculus
atgcggagtacccagccaatggcag

SEQ ID NO: 542327 - DNA, 25 bp, Mus musculus
atgcggagtaccgagccaatggcag

SEQ ID NO: 542328 - DNA, 25 bp, Mus musculus
atgcggatcctgattgcctgccccg

SEQ ID NO: 542329 - DNA, 25 bp, Mus musculus
atgcggatcctgtttgcctgccccg

SEQ ID NO: 542330 - DNA, 25 bp, Mus musculus
atgcggatggagacacccagggtct

SEQ ID NO: 542331 - DNA, 25 bp, Mus musculus
atgcggatggagtcacccagggtct

SEQ ID NO: 542332 - DNA, 25 bp, Mus musculus
atgcggatggtcactgccctaccca

SEQ ID NO: 542333 - DNA, 25 bp, Mus musculus
atgcggatggtctctgccctaccca

SEQ ID NO: 542334 - DNA, 25 bp, Mus musculus
atgcggccaagaaccaactcacgtc

SEQ ID NO: 542335 - DNA, 25 bp, Mus musculus
atgcggccaagatccaactcacgtc

SEQ ID NO: 542336 - DNA, 25 bp, Mus musculus
atgcgggaagatcaccgtgttgcaa

SEQ ID NO: 542337 - DNA, 25 bp, Mus musculus
atgcgggaagatgaccgtgttgcaa

SEQ ID NO: 542338 - DNA, 25 bp, Mus musculus
atgcgggcagcccatccgtctgaca

SEQ ID NO: 542339 - DNA, 25 bp, Mus musculus
atgcgggcagccgatccgtctgaca

SEQ ID NO: 542340 - DNA, 25 bp, Mus musculus
atgcgggtacgcagtgccatcatcc

SEQ ID NO: 542341 - DNA, 25 bp, Mus musculus
atgcgggtacgctgtgccatcatcc

SEQ ID NO: 542342 - DNA, 25 bp, Mus musculus
atgcggtacacacggctaatgggaa

SEQ ID NO: 542343 - DNA, 25 bp, Mus musculus
atgcggtacacagggctaatgggaa

SEQ ID NO: 542344 - DNA, 25 bp, Mus musculus
atgcggtgagcaccccagtcacgtg

SEQ ID NO: 542345 - DNA, 25 bp, Mus musculus
atgcggtgagcagcccagtcacgtg

SEQ ID NO: 542346 - DNA, 25 bp, Mus musculus
atgcgtatggctcacttctggctca

SEQ ID NO: 542347 - DNA, 25 bp, Mus musculus
atgcgtatggctgacttctggctca

SEQ ID NO: 542348 - DNA, 25 bp, Mus musculus
atgcgtctgcctcggagcctgagta

SEQ ID NO: 542349 - DNA, 25 bp, Mus musculus
atgcgtctgcctgggagcctgagta

SEQ ID NO: 542350 - DNA, 25 bp, Mus musculus
atgcgtggttccaccctgctcaggc

SEQ ID NO: 542351 - DNA, 25 bp, Mus musculus
atgcgtggttcctccctgctcaggc

SEQ ID NO: 542352 - DNA, 25 bp, Mus musculus
atgcgttccgctccgcggagccgaa

SEQ ID NO: 542353 - DNA, 25 bp, Mus musculus
atgcgttccgctgcgcggagccgaa

SEQ ID NO: 542354 - DNA, 25 bp, Mus musculus
atgcgttctatgatgcggacctcgg

SEQ ID NO: 542355 - DNA, 25 bp, Mus musculus
atgcgttctatgttgcggacctcgg

SEQ ID NO: 542356 - DNA, 25 bp, Mus musculus
atgcgtttggctctccagtcatttc

SEQ ID NO: 542357 - DNA, 25 bp, Mus musculus
atgcgtttggctgtccagtcatttc

SEQ ID NO: 542358 - DNA, 25 bp, Mus musculus
atgctaacattcacgagctggcccg

SEQ ID NO: 542359 - DNA, 25 bp, Mus musculus
atgctaacattctcgagctggcccg

SEQ ID NO: 542360 - DNA, 25 bp, Mus musculus
atgctaatatgaatgaggacagccc

SEQ ID NO: 542361 - DNA, 25 bp, Mus musculus
atgctaatatgattgaggacagccc

SEQ ID NO: 542362 - DNA, 25 bp, Mus musculus
atgctaatctgcctgtctgggcgga

SEQ ID NO: 542363 - DNA, 25 bp, Mus musculus
atgctaatctgcgtgtctgggcgga

SEQ ID NO: 542364 - DNA, 25 bp, Mus musculus
atgctaatgacgacacagccacccg

SEQ ID NO: 542365 - DNA, 25 bp, Mus musculus
atgctaatgacgtcacagccacccg

SEQ ID NO: 542366 - DNA, 25 bp, Mus musculus
atgctacagcaaagcaccgggcagc

SEQ ID NO: 542367 - DNA, 25 bp, Mus musculus
atgctacagcaatgcaccgggcagc

SEQ ID NO: 542368 - DNA, 25 bp, Mus musculus
atgctacagtaacccggagctgccc

SEQ ID NO: 542369 - DNA, 25 bp, Mus musculus
atgctacagtaagccggagctgccc

SEQ ID NO: 542370 - DNA, 25 bp, Mus musculus
atgctaccaggcctgagcatcacag

SEQ ID NO: 542371 - DNA, 25 bp, Mus musculus
atgctaccaggcgtgagcatcacag

SEQ ID NO: 542372 - DNA, 25 bp, Mus musculus
atgctactgcaacccacagcgggct

SEQ ID NO: 542373 - DNA, 25 bp, Mus musculus
atgctactgcaagccacagcgggct

SEQ ID NO: 542374 - DNA, 25 bp, Mus musculus
atgctagacaggcacggccacatca

SEQ ID NO: 542375 - DNA, 25 bp, Mus musculus
atgctagacagggacggccacatca

SEQ ID NO: 542376 - DNA, 25 bp, Mus musculus
atgctaggccgtctacatgaggtgt

SEQ ID NO: 542377 - DNA, 25 bp, Mus musculus
atgctaggccgtgtacatgaggtgt

SEQ ID NO: 542378 - DNA, 25 bp, Mus musculus
atgctcaaatccctgggaatgtcag

SEQ ID NO: 542379 - DNA, 25 bp, Mus musculus
atgctcaaatccgtgggaatgtcag

SEQ ID NO: 542380 - DNA, 25 bp, Mus musculus
atgctcaagagccagccgagccaga

SEQ ID NO: 542381 - DNA, 25 bp, Mus musculus
atgctcaagagcgagccgagccaga

SEQ ID NO: 542382 - DNA, 25 bp, Mus musculus
atgctcaaggtgacgggcagtgcca

SEQ ID NO: 542383 - DNA, 25 bp, Mus musculus
atgctcaaggtgtcgggcagtgcca

SEQ ID NO: 542384 - DNA, 25 bp, Mus musculus
atgctcaagtcacatgccagcccgt

SEQ ID NO: 542385 - DNA, 25 bp, Mus musculus
atgctcaagtcagatgccagcccgt

SEQ ID NO: 542386 - DNA, 25 bp, Mus musculus
atgctcatgacaactcctgcatccg

SEQ ID NO: 542387 - DNA, 25 bp, Mus musculus
atgctcatgacatctcctgcatccg

SEQ ID NO: 542388 - DNA, 25 bp, Mus musculus
atgctcatggcgacgccgaccgcgg

SEQ ID NO: 542389 - DNA, 25 bp, Mus musculus
atgctcatggcgtcgccgaccgcgg

SEQ ID NO: 542390 - DNA, 25 bp, Mus musculus
atgctcattcacatccggacacaca

SEQ ID NO: 542391 - DNA, 25 bp, Mus musculus
atgctcattcacttccggacacaca

SEQ ID NO: 542392 - DNA, 25 bp, Mus musculus
atgctccatatgctgccggccgtgg

SEQ ID NO: 542393 - DNA, 25 bp, Mus musculus
atgctccatatggtgccggccgtgg

SEQ ID NO: 542394 - DNA, 25 bp, Mus musculus
atgctcccagcacgaaggatcccaa

SEQ ID NO: 542395 - DNA, 25 bp, Mus musculus
atgctcccagcaggaaggatcccaa

SEQ ID NO: 542396 - DNA, 25 bp, Mus musculus
atgctcccccggcagatgtatggcg

SEQ ID NO: 542397 - DNA, 25 bp, Mus musculus
atgctcccccgggagatgtatggcg

SEQ ID NO: 542398 - DNA, 25 bp, Mus musculus
atgctccgtgatcttcagtgggcag

SEQ ID NO: 542399 - DNA, 25 bp, Mus musculus
atgctccgtgatgttcagtgggcag

SEQ ID NO: 542400 - DNA, 25 bp, Mus musculus
atgctcctggccagcgagggtgaca

SEQ ID NO: 542401 - DNA, 25 bp, Mus musculus
atgctcctggcctgcgagggtgaca

SEQ ID NO: 542402 - DNA, 25 bp, Mus musculus
atgctcctggtgattcctaccctgc

SEQ ID NO: 542403 - DNA, 25 bp, Mus musculus
atgctcctggtgtttcctaccctgc

SEQ ID NO: 542404 - DNA, 25 bp, Mus musculus
atgctcggtcccacggtgctgggca

SEQ ID NO: 542405 - DNA, 25 bp, Mus musculus
atgctcggtccctcggtgctgggca

SEQ ID NO: 542406 - DNA, 25 bp, Mus musculus
atgctctattctatcttcatgccag

SEQ ID NO: 542407 - DNA, 25 bp, Mus musculus
atgctctattctttcttcatgccag

SEQ ID NO: 542408 - DNA, 25 bp, Mus musculus
atgctctctgggattgccgggcagc

SEQ ID NO: 542409 - DNA, 25 bp, Mus musculus
atgctctctgggtttgccgggcagc

SEQ ID NO: 542410 - DNA, 25 bp, Mus musculus
atgctcttcagtcgcccagtcttac

SEQ ID NO: 542411 - DNA, 25 bp, Mus musculus
atgctcttcagtggcccagtcttac

SEQ ID NO: 542412 - DNA, 25 bp, Mus musculus
atgctcttttcacttgcattagcag

SEQ ID NO: 542413 - DNA, 25 bp, Mus musculus
atgctcttttcagttgcattagcag

SEQ ID NO: 542414 - DNA, 25 bp, Mus musculus
atgctgaaactgcactgactgatgg

SEQ ID NO: 542415 - DNA, 25 bp, Mus musculus
atgctgaaactggactgactgatgg

SEQ ID NO: 542416 - DNA, 25 bp, Mus musculus
atgctgaattatcagggacactttc

SEQ ID NO: 542417 - DNA, 25 bp, Mus musculus
atgctgaattatgagggacactttc

SEQ ID NO: 542418 - DNA, 25 bp, Mus musculus
atgctgagagccctcagcgaccagg

SEQ ID NO: 542419 - DNA, 25 bp, Mus musculus
atgctgagagccgtcagcgaccagg

SEQ ID NO: 542420 - DNA, 25 bp, Mus musculus
atgctgagccacagtacccagtccg

SEQ ID NO: 542421 - DNA, 25 bp, Mus musculus
atgctgagccactgtacccagtccg

SEQ ID NO: 542422 - DNA, 25 bp, Mus musculus
atgctgagcgagaggacagcaccac

SEQ ID NO: 542423 - DNA, 25 bp, Mus musculus
atgctgagcgagtggacagcaccac

SEQ ID NO: 542424 - DNA, 25 bp, Mus musculus
atgctgatcaagaagtgtctcctga

SEQ ID NO: 542425 - DNA, 25 bp, Mus musculus
atgctgatcaagtagtgtctcctga

SEQ ID NO: 542426 - DNA, 25 bp, Mus musculus
atgctgatcctgatggtggcctcag

SEQ ID NO: 542427 - DNA, 25 bp, Mus musculus
atgctgatcctgttggtggcctcag

SEQ ID NO: 542428 - DNA, 25 bp, Mus musculus
atgctgatcgccatccaacacaagc

SEQ ID NO: 542429 - DNA, 25 bp, Mus musculus
atgctgatcgccttccaacacaagc

SEQ ID NO: 542430 - DNA, 25 bp, Mus musculus
atgctgatgccaccggtgcctgtca

SEQ ID NO: 542431 - DNA, 25 bp, Mus musculus
atgctgatgccagcggtgcctgtca

SEQ ID NO: 542432 - DNA, 25 bp, Mus musculus
atgctgccctttaccggtacctggg

SEQ ID NO: 542433 - DNA, 25 bp, Mus musculus
atgctgcccttttccggtacctggg

SEQ ID NO: 542434 - DNA, 25 bp, Mus musculus
atgctgccgagaaccagcctctagc

SEQ ID NO: 542435 - DNA, 25 bp, Mus musculus
atgctgccgagatccagcctctagc

SEQ ID NO: 542436 - DNA, 25 bp, Mus musculus
atgctgccggcgaaagcgaagagcc

SEQ ID NO: 542437 - DNA, 25 bp, Mus musculus
atgctgccggcgtaagcgaagagcc

SEQ ID NO: 542438 - DNA, 25 bp, Mus musculus
atgctgcgcaggacctgtggaccgc

SEQ ID NO: 542439 - DNA, 25 bp, Mus musculus
atgctgcgcaggtcctgtggaccgc

SEQ ID NO: 542440 - DNA, 25 bp, Mus musculus
atgctgcgggagaccgcaatcccca

SEQ ID NO: 542441 - DNA, 25 bp, Mus musculus
atgctgcgggagtccgcaatcccca

SEQ ID NO: 542442 - DNA, 25 bp, Mus musculus
atgctgcgggcacgagcacctaccg

SEQ ID NO: 542443 - DNA, 25 bp, Mus musculus
atgctgcgggcaggagcacctaccg

SEQ ID NO: 542444 - DNA, 25 bp, Mus musculus
atgctgctctccagcaagtaccggg

SEQ ID NO: 542445 - DNA, 25 bp, Mus musculus
atgctgctctcctgcaagtaccggg

SEQ ID NO: 542446 - DNA, 25 bp, Mus musculus
atgctgctgccacacgggtcctgct

SEQ ID NO: 542447 - DNA, 25 bp, Mus musculus
atgctgctgccagacgggtcctgct

SEQ ID NO: 542448 - DNA, 25 bp, Mus musculus
atgctgctgggtatctgtagtgaaa

SEQ ID NO: 542449 - DNA, 25 bp, Mus musculus
atgctgctgggtttctgtagtgaaa

SEQ ID NO: 542450 - DNA, 25 bp, Mus musculus
atgctgctgtcaccccgagggtaag

SEQ ID NO: 542451 - DNA, 25 bp, Mus musculus
atgctgctgtcacggctgtgacccg

SEQ ID NO: 542452 - DNA, 25 bp, Mus musculus
atgctgctgtcagcccgagggtaag

SEQ ID NO: 542453 - DNA, 25 bp, Mus musculus
atgctgctgtcagggctgtgacccg

SEQ ID NO: 542454 - DNA, 25 bp, Mus musculus
atgctggaccatcccgtgctgctac

SEQ ID NO: 542455 - DNA, 25 bp, Mus musculus
atgctggaccatgccgtgctgctac

SEQ ID NO: 542456 - DNA, 25 bp, Mus musculus
atgctggagactaggtgaaaacgag

SEQ ID NO: 542457 - DNA, 25 bp, Mus musculus
atgctggagacttggtgaaaacgag

SEQ ID NO: 542458 - DNA, 25 bp, Mus musculus
atgctggagtatctgcaaacatgat

SEQ ID NO: 542459 - DNA, 25 bp, Mus musculus
atgctggagtatgtgcaaacatgat

SEQ ID NO: 542460 - DNA, 25 bp, Mus musculus
atgctggcatctatagctgtggcag

SEQ ID NO: 542461 - DNA, 25 bp, Mus musculus
atgctggcatctttagctgtggcag

SEQ ID NO: 542462 - DNA, 25 bp, Mus musculus
atgctggccacgagctccaatgggt

SEQ ID NO: 542463 - DNA, 25 bp, Mus musculus
atgctggccacgtgctccaatgggt

SEQ ID NO: 542464 - DNA, 25 bp, Mus musculus
atgctggctgatattgggccccacg

SEQ ID NO: 542465 - DNA, 25 bp, Mus musculus
atgctggctgattttgggccccacg

SEQ ID NO: 542466 - DNA, 25 bp, Mus musculus
atgctgggaattcctccgagaacca

SEQ ID NO: 542467 - DNA, 25 bp, Mus musculus
atgctgggaattgctccgagaacca

SEQ ID NO: 542468 - DNA, 25 bp, Mus musculus
atgctgggaccgagcaggacatgct

SEQ ID NO: 542469 - DNA, 25 bp, Mus musculus
atgctgggaccgtgcaggacatgct

SEQ ID NO: 542470 - DNA, 25 bp, Mus musculus
atgctgggagctatctgtgccatca

SEQ ID NO: 542471 - DNA, 25 bp, Mus musculus
atgctgggagctttctgtgccatca

SEQ ID NO: 542472 - DNA, 25 bp, Mus musculus
atgctgggcgacacgtgcgccgact

SEQ ID NO: 542473 - DNA, 25 bp, Mus musculus
atgctgggcgactcgtgcgccgact

SEQ ID NO: 542474 - DNA, 25 bp, Mus musculus
atgctggtggttcgagaccaagcac

SEQ ID NO: 542475 - DNA, 25 bp, Mus musculus
atgctggtggttggagaccaagcac

SEQ ID NO: 542476 - DNA, 25 bp, Mus musculus
atgctgtaccatcccaggtgctcca

SEQ ID NO: 542477 - DNA, 25 bp, Mus musculus
atgctgtaccatgccaggtgctcca

SEQ ID NO: 542478 - DNA, 25 bp, Mus musculus
atgctgtactttccaactttcttcc

SEQ ID NO: 542479 - DNA, 25 bp, Mus musculus
atgctgtactttgcaactttcttcc

SEQ ID NO: 542480 - DNA, 25 bp, Mus musculus
atgctgtcagccagaacccagcctt

SEQ ID NO: 542481 - DNA, 25 bp, Mus musculus
atgctgtcagcctgaacccagcctt

SEQ ID NO: 542482 - DNA, 25 bp, Mus musculus
atgctgtcccgcagcccgagaacat

SEQ ID NO: 542483 - DNA, 25 bp, Mus musculus
atgctgtcccgctgcccgagaacat

SEQ ID NO: 542484 - DNA, 25 bp, Mus musculus
atgctgtccgacctcaccgtgggca

SEQ ID NO: 542485 - DNA, 25 bp, Mus musculus
atgctgtccgacgtcaccgtgggca

SEQ ID NO: 542486 - DNA, 25 bp, Mus musculus
atgctgtccgccacacaggtctaca

SEQ ID NO: 542487 - DNA, 25 bp, Mus musculus
atgctgtccgcctcacaggtctaca

SEQ ID NO: 542488 - DNA, 25 bp, Mus musculus
atgctgtcgcccacaccctgattgt

SEQ ID NO: 542489 - DNA, 25 bp, Mus musculus
atgctgtcgccctcaccctgattgt

SEQ ID NO: 542490 - DNA, 25 bp, Mus musculus
atgctgtctggccaggttcccttcc

SEQ ID NO: 542491 - DNA, 25 bp, Mus musculus
atgctgtctggcgaggttcccttcc

SEQ ID NO: 542492 - DNA, 25 bp, Mus musculus
atgctgttcacgcagccgacgtcac

SEQ ID NO: 542493 - DNA, 25 bp, Mus musculus
atgctgttcacggagccgacgtcac

SEQ ID NO: 542494 - DNA, 25 bp, Mus musculus
atgctgttgatgaccgaggtctcta

SEQ ID NO: 542495 - DNA, 25 bp, Mus musculus
atgctgttgatgtccgaggtctcta

SEQ ID NO: 542496 - DNA, 25 bp, Mus musculus
atgcttacaggtcctgtgcagcatc

SEQ ID NO: 542497 - DNA, 25 bp, Mus musculus
atgcttacaggtgctgtgcagcatc

SEQ ID NO: 542498 - DNA, 25 bp, Mus musculus
atgcttcatccgacctcatcacagg

SEQ ID NO: 542499 - DNA, 25 bp, Mus musculus
atgcttcatccgtcctcatcacagg

SEQ ID NO: 542500 - DNA, 25 bp, Mus musculus
atgcttctgactccggtggaagtga

SEQ ID NO: 542501 - DNA, 25 bp, Mus musculus
atgcttctgactgcggtggaagtga

SEQ ID NO: 542502 - DNA, 25 bp, Mus musculus
atgcttgtatacattgctccacctg

SEQ ID NO: 542503 - DNA, 25 bp, Mus musculus
atgcttgtatactttgctccacctg

SEQ ID NO: 542504 - DNA, 25 bp, Mus musculus
atgcttgttgaacgatctcagtgac

SEQ ID NO: 542505 - DNA, 25 bp, Mus musculus
atgcttgttgaaggatctcagtgac

SEQ ID NO: 542506 - DNA, 25 bp, Mus musculus
atggaaaaagctagatggacagtga

SEQ ID NO: 542507 - DNA, 25 bp, Mus musculus
atggaaaaagcttgatggacagtga

SEQ ID NO: 542508 - DNA, 25 bp, Mus musculus
atggaaaagcgacggtactggtact

SEQ ID NO: 542509 - DNA, 25 bp, Mus musculus
atggaaaagcgagggtactggtact

SEQ ID NO: 542510 - DNA, 25 bp, Mus musculus
atggaaagcagacaccacaggcgcc

SEQ ID NO: 542511 - DNA, 25 bp, Mus musculus
atggaaagcagagaccacaggcgcc

SEQ ID NO: 542512 - DNA, 25 bp, Mus musculus
atggaaatcagccttccgaacattc

SEQ ID NO: 542513 - DNA, 25 bp, Mus musculus
atggaaatcagcgttccgaacattc

SEQ ID NO: 542514 - DNA, 25 bp, Mus musculus
atggaaatcattccaaccagacctg

SEQ ID NO: 542515 - DNA, 25 bp, Mus musculus
atggaaatcattgcaaccagacctg

SEQ ID NO: 542516 - DNA, 25 bp, Mus musculus
atggaacactgtcgatccgtcgggt

SEQ ID NO: 542517 - DNA, 25 bp, Mus musculus
atggaacactgtggatccgtcgggt

SEQ ID NO: 542518 - DNA, 25 bp, Mus musculus
atggaaccactcctggctaccgctc

SEQ ID NO: 542519 - DNA, 25 bp, Mus musculus
atggaaccactcgtggctaccgctc

SEQ ID NO: 542520 - DNA, 25 bp, Mus musculus
atggaaccggccacgtaactgggct

SEQ ID NO: 542521 - DNA, 25 bp, Mus musculus
atggaaccggcctcgtaactgggct

SEQ ID NO: 542522 - DNA, 25 bp, Mus musculus
atggaacttgcgaggacctggagaa

SEQ ID NO: 542523 - DNA, 25 bp, Mus musculus
atggaacttgcgtggacctggagaa

SEQ ID NO: 542524 - DNA, 25 bp, Mus musculus
atggaagaagaaatcctaattaaga

SEQ ID NO: 542525 - DNA, 25 bp, Mus musculus
atggaagaagaattcctaattaaga

SEQ ID NO: 542526 - DNA, 25 bp, Mus musculus
atggaagaccttcggttatggagca

SEQ ID NO: 542527 - DNA, 25 bp, Mus musculus
atggaagaccttgggttatggagca

SEQ ID NO: 542528 - DNA, 25 bp, Mus musculus
atggaagagataacccgggcttcgg

SEQ ID NO: 542529 - DNA, 25 bp, Mus musculus
atggaagagatatcccgggcttcgg

SEQ ID NO: 542530 - DNA, 25 bp, Mus musculus
atggaagcctcaccctggatggagc

SEQ ID NO: 542531 - DNA, 25 bp, Mus musculus
atggaagcctcagcctggatggagc

SEQ ID NO: 542532 - DNA, 25 bp, Mus musculus
atggaagcctgaaagccctccgtga

SEQ ID NO: 542533 - DNA, 25 bp, Mus musculus
atggaagcctgatagccctccgtga

SEQ ID NO: 542534 - DNA, 25 bp, Mus musculus
atggaagtacaacagggatatggct

SEQ ID NO: 542535 - DNA, 25 bp, Mus musculus
atggaagtacaagagggatatggct

SEQ ID NO: 542536 - DNA, 25 bp, Mus musculus
atggaagtaccccaggcacccattc

SEQ ID NO: 542537 - DNA, 25 bp, Mus musculus
atggaagtacccgaggcacccattc

SEQ ID NO: 542538 - DNA, 25 bp, Mus musculus
atggaagtcagacggcttaactgct

SEQ ID NO: 542539 - DNA, 25 bp, Mus musculus
atggaagtcagagggcttaactgct

SEQ ID NO: 542540 - DNA, 25 bp, Mus musculus
atggaagtggccagcccgggcactc

SEQ ID NO: 542541 - DNA, 25 bp, Mus musculus
atggaagtggcctgcccgggcactc

SEQ ID NO: 542542 - DNA, 25 bp, Mus musculus
atggaataagcccagccttagtggg

SEQ ID NO: 542543 - DNA, 25 bp, Mus musculus
atggaataagccgagccttagtggg

SEQ ID NO: 542544 - DNA, 25 bp, Mus musculus
atggaatactctcggtgtctgcaag

SEQ ID NO: 542545 - DNA, 25 bp, Mus musculus
atggaatactctgggtgtctgcaag

SEQ ID NO: 542546 - DNA, 25 bp, Mus musculus
atggaatccacccttgggagctaga

SEQ ID NO: 542547 - DNA, 25 bp, Mus musculus
atggaatccaccgttgggagctaga

SEQ ID NO: 542548 - DNA, 25 bp, Mus musculus
atggaatctctaagcaaagtgacag

SEQ ID NO: 542549 - DNA, 25 bp, Mus musculus
atggaatctctatgcaaagtgacag

SEQ ID NO: 542550 - DNA, 25 bp, Mus musculus
atggacaaagcacaggcaccaagct

SEQ ID NO: 542551 - DNA, 25 bp, Mus musculus
atggacaaagcagaggcaccaagct

SEQ ID NO: 542552 - DNA, 25 bp, Mus musculus
atggacaaccgcatggtgctggcga

SEQ ID NO: 542553 - DNA, 25 bp, Mus musculus
atggacaaccgcttggtgctggcga

SEQ ID NO: 542554 - DNA, 25 bp, Mus musculus
atggacaactgccaccttatgagtc

SEQ ID NO: 542555 - DNA, 25 bp, Mus musculus
atggacaactgcgaccttatgagtc

SEQ ID NO: 542556 - DNA, 25 bp, Mus musculus
atggacaattctatgacctcaagga

SEQ ID NO: 542557 - DNA, 25 bp, Mus musculus
atggacaattctttgacctcaagga

SEQ ID NO: 542558 - DNA, 25 bp, Mus musculus
atggacagccgcacggccgcgtggt

SEQ ID NO: 542559 - DNA, 25 bp, Mus musculus
atggacagccgctcggccgcgtggt

SEQ ID NO: 542560 - DNA, 25 bp, Mus musculus
atggacagtacacttgctgttcagc

SEQ ID NO: 542561 - DNA, 25 bp, Mus musculus
atggacagtacagttgctgttcagc

SEQ ID NO: 542562 - DNA, 25 bp, Mus musculus
atggacatcattcgcaactacactg

SEQ ID NO: 542563 - DNA, 25 bp, Mus musculus
atggacatcattggcaactacactg

SEQ ID NO: 542564 - DNA, 25 bp, Mus musculus
atggacatgaagatgtgaagaaggc

SEQ ID NO: 542565 - DNA, 25 bp, Mus musculus
atggacatgaagttgtgaagaaggc

SEQ ID NO: 542566 - DNA, 25 bp, Mus musculus
atggaccaacacaagctcagcaggg

SEQ ID NO: 542567 - DNA, 25 bp, Mus musculus
atggaccaacactagctcagcaggg

SEQ ID NO: 542568 - DNA, 25 bp, Mus musculus
atggaccaggccattggcaaggcag

SEQ ID NO: 542569 - DNA, 25 bp, Mus musculus
atggaccaggcctttggcaaggcag

SEQ ID NO: 542570 - DNA, 25 bp, Mus musculus
atggacccaagtccgcggcgatttc

SEQ ID NO: 542571 - DNA, 25 bp, Mus musculus
atggacccaagtgcgcggcgatttc

SEQ ID NO: 542572 - DNA, 25 bp, Mus musculus
atggaccgcattactgacttttact

SEQ ID NO: 542573 - DNA, 25 bp, Mus musculus
atggaccgcatttctgacttttact

SEQ ID NO: 542574 - DNA, 25 bp, Mus musculus
atggaccgcgatcgcaccatgacca

SEQ ID NO: 542575 - DNA, 25 bp, Mus musculus
atggaccgcgatggcaccatgacca

SEQ ID NO: 542576 - DNA, 25 bp, Mus musculus
atggacctaccaaggccttagtctg

SEQ ID NO: 542577 - DNA, 25 bp, Mus musculus
atggacctaccatggccttagtctg

SEQ ID NO: 542578 - DNA, 25 bp, Mus musculus
atggacctattcctcaaatcagagt

SEQ ID NO: 542579 - DNA, 25 bp, Mus musculus
atggacctattcgtcaaatcagagt

SEQ ID NO: 542580 - DNA, 25 bp, Mus musculus
atggacctcggaccagcgaaggacc

SEQ ID NO: 542581 - DNA, 25 bp, Mus musculus
atggacctcggagcagcgaaggacc

SEQ ID NO: 542582 - DNA, 25 bp, Mus musculus
atggacgcctccatggccatcaagc

SEQ ID NO: 542583 - DNA, 25 bp, Mus musculus
atggacgcctccttggccatcaagc

SEQ ID NO: 542584 - DNA, 25 bp, Mus musculus
atggacgccttcatccgagtcgcca

SEQ ID NO: 542585 - DNA, 25 bp, Mus musculus
atggacgccttcttccgagtcgcca

SEQ ID NO: 542586 - DNA, 25 bp, Mus musculus
atggacggagccaccctctgcagct

SEQ ID NO: 542587 - DNA, 25 bp, Mus musculus
atggacggagcctccctctgcagct

SEQ ID NO: 542588 - DNA, 25 bp, Mus musculus
atggacggctgccagctcatgtgct

SEQ ID NO: 542589 - DNA, 25 bp, Mus musculus
atggacggctgcgagctcatgtgct

SEQ ID NO: 542590 - DNA, 25 bp, Mus musculus
atggactcagtgactcccactttcc

SEQ ID NO: 542591 - DNA, 25 bp, Mus musculus
atggactcagtgtctcccactttcc

SEQ ID NO: 542592 - DNA, 25 bp, Mus musculus
atggactccattaaacccagtgact

SEQ ID NO: 542593 - DNA, 25 bp, Mus musculus
atggactccatttaacccagtgact

SEQ ID NO: 542594 - DNA, 25 bp, Mus musculus
atggactcggcgcaaccgaaggatc

SEQ ID NO: 542595 - DNA, 25 bp, Mus musculus
atggactcggcggaaccgaaggatc

SEQ ID NO: 542596 - DNA, 25 bp, Mus musculus
atggactcttttactacaaccaaga

SEQ ID NO: 542597 - DNA, 25 bp, Mus musculus
atggactctttttctacaaccaaga

SEQ ID NO: 542598 - DNA, 25 bp, Mus musculus
atggactgcacaccccgtgttccag

SEQ ID NO: 542599 - DNA, 25 bp, Mus musculus
atggactgcacagcccgtgttccag

SEQ ID NO: 542600 - DNA, 25 bp, Mus musculus
atggactggcccacgctaagctggg

SEQ ID NO: 542601 - DNA, 25 bp, Mus musculus
atggactggccctcgctaagctggg

SEQ ID NO: 542602 - DNA, 25 bp, Mus musculus
atggacttccctcagctgatgaaga

SEQ ID NO: 542603 - DNA, 25 bp, Mus musculus
atggacttccctgagctgatgaaga

SEQ ID NO: 542604 - DNA, 25 bp, Mus musculus
atggacttgagtcgccaatacgaga

SEQ ID NO: 542605 - DNA, 25 bp, Mus musculus
atggacttgagtggccaatacgaga

SEQ ID NO: 542606 - DNA, 25 bp, Mus musculus
atggagaaatctatgacgacatcgc

SEQ ID NO: 542607 - DNA, 25 bp, Mus musculus
atggagaaatctttgacgacatcgc

SEQ ID NO: 542608 - DNA, 25 bp, Mus musculus
atggagaacaacactgggcagaggt

SEQ ID NO: 542609 - DNA, 25 bp, Mus musculus
atggagaacaactctgggcagaggt

SEQ ID NO: 542610 - DNA, 25 bp, Mus musculus
atggagaagaccacaaacatgactt

SEQ ID NO: 542611 - DNA, 25 bp, Mus musculus
atggagaagacctcaaacatgactt

SEQ ID NO: 542612 - DNA, 25 bp, Mus musculus
atggagacaaagcacgatacctggg

SEQ ID NO: 542613 - DNA, 25 bp, Mus musculus
atggagacaaaggacgatacctggg

SEQ ID NO: 542614 - DNA, 25 bp, Mus musculus
atggagacacggaaacgcctggcta

SEQ ID NO: 542615 - DNA, 25 bp, Mus musculus
atggagacacggtaacgcctggcta

SEQ ID NO: 542616 - DNA, 25 bp, Mus musculus
atggagacatcacctccttgtcatt

SEQ ID NO: 542617 - DNA, 25 bp, Mus musculus
atggagacatcagctccttgtcatt

SEQ ID NO: 542618 - DNA, 25 bp, Mus musculus
atggagacattcctacacagcttca

SEQ ID NO: 542619 - DNA, 25 bp, Mus musculus
atggagacattcgtacacagcttca

SEQ ID NO: 542620 - DNA, 25 bp, Mus musculus
atggagaccgcaccccaaaagacag

SEQ ID NO: 542621 - DNA, 25 bp, Mus musculus
atggagaccgcagcccaaaagacag

SEQ ID NO: 542622 - DNA, 25 bp, Mus musculus
atggagacgtccatgtgagcatgag

SEQ ID NO: 542623 - DNA, 25 bp, Mus musculus
atggagacgtccttgtgagcatgag

SEQ ID NO: 542624 - DNA, 25 bp, Mus musculus
atggagagcagtccctttactccag

SEQ ID NO: 542625 - DNA, 25 bp, Mus musculus
atggagagcagtgcctttactccag

SEQ ID NO: 542626 - DNA, 25 bp, Mus musculus
atggagaggtctcggaacatctacg

SEQ ID NO: 542627 - DNA, 25 bp, Mus musculus
atggagaggtctgggaacatctacg

SEQ ID NO: 542628 - DNA, 25 bp, Mus musculus
atggagagtccaacgtggttatttc

SEQ ID NO: 542629 - DNA, 25 bp, Mus musculus
atggagagtccatcgtggttatttc

SEQ ID NO: 542630 - DNA, 25 bp, Mus musculus
atggagatcagaatagtcagccagg

SEQ ID NO: 542631 - DNA, 25 bp, Mus musculus
atggagatcagattagtcagccagg

SEQ ID NO: 542632 - DNA, 25 bp, Mus musculus
atggagatcgttcagaccatgaaca

SEQ ID NO: 542633 - DNA, 25 bp, Mus musculus
atggagatcgttgagaccatgaaca

SEQ ID NO: 542634 - DNA, 25 bp, Mus musculus
atggagatggccaggtcaattatga

SEQ ID NO: 542635 - DNA, 25 bp, Mus musculus
atggagatggcctggtcaattatga

SEQ ID NO: 542636 - DNA, 25 bp, Mus musculus
atggagcaacacctagaggcaggct

SEQ ID NO: 542637 - DNA, 25 bp, Mus musculus
atggagcaacacgtagaggcaggct

SEQ ID NO: 542638 - DNA, 25 bp, Mus musculus
atggagcagcgaagcagagaccctg

SEQ ID NO: 542639 - DNA, 25 bp, Mus musculus
atggagcagcgatgcagagaccctg

SEQ ID NO: 542640 - DNA, 25 bp, Mus musculus
atggagccaataaacactttgcaaa

SEQ ID NO: 542641 - DNA, 25 bp, Mus musculus
atggagccaatatacactttgcaaa

SEQ ID NO: 542642 - DNA, 25 bp, Mus musculus
atggagccacaccacgtgaacggat

SEQ ID NO: 542643 - DNA, 25 bp, Mus musculus
atggagccacacgacgtgaacggat

SEQ ID NO: 542644 - DNA, 25 bp, Mus musculus
atggagcccctaaaccaacaaacga

SEQ ID NO: 542645 - DNA, 25 bp, Mus musculus
atggagcccctataccaacaaacga

SEQ ID NO: 542646 - DNA, 25 bp, Mus musculus
atggagcccgacaacagcccacgga

SEQ ID NO: 542647 - DNA, 25 bp, Mus musculus
atggagcccgactacagcccacgga

SEQ ID NO: 542648 - DNA, 25 bp, Mus musculus
atggagcctcttaggaccacgaccc

SEQ ID NO: 542649 - DNA, 25 bp, Mus musculus
atggagcctctttggaccacgaccc

SEQ ID NO: 542650 - DNA, 25 bp, Mus musculus
atggagcgccagctcctacggcttc

SEQ ID NO: 542651 - DNA, 25 bp, Mus musculus
atggagcgccaggtcctacggcttc

SEQ ID NO: 542652 - DNA, 25 bp, Mus musculus
atggagctccagacttaccgctacc

SEQ ID NO: 542653 - DNA, 25 bp, Mus musculus
atggagctccagtcttaccgctacc

SEQ ID NO: 542654 - DNA, 25 bp, Mus musculus
atggagctccgaccagcgcatcctg

SEQ ID NO: 542655 - DNA, 25 bp, Mus musculus
atggagctccgagcagcgcatcctg

SEQ ID NO: 542656 - DNA, 25 bp, Mus musculus
atggagctgaccagtaccccttcac

SEQ ID NO: 542657 - DNA, 25 bp, Mus musculus
atggagctgacctgtaccccttcac

SEQ ID NO: 542658 - DNA, 25 bp, Mus musculus
atggagctgagcacatctgggataa

SEQ ID NO: 542659 - DNA, 25 bp, Mus musculus
atggagctgagctcatctgggataa

SEQ ID NO: 542660 - DNA, 25 bp, Mus musculus
atggagctgctgacccgcgtcctgc

SEQ ID NO: 542661 - DNA, 25 bp, Mus musculus
atggagctgctgtcccgcgtcctgc

SEQ ID NO: 542662 - DNA, 25 bp, Mus musculus
atggagctggtgacttaagatcagg

SEQ ID NO: 542663 - DNA, 25 bp, Mus musculus
atggagctggtgtcttaagatcagg

SEQ ID NO: 542664 - DNA, 25 bp, Mus musculus
atggagctgtaaaaccacccacaaa

SEQ ID NO: 542665 - DNA, 25 bp, Mus musculus
atggagctgtaataccacccacaaa

SEQ ID NO: 542666 - DNA, 25 bp, Mus musculus
atggagctgtgtctcacagcctgtg

SEQ ID NO: 542667 - DNA, 25 bp, Mus musculus
atggagctgtgtgtcacagcctgtg

SEQ ID NO: 542668 - DNA, 25 bp, Mus musculus
atggagcttcgacagtatcacacca

SEQ ID NO: 542669 - DNA, 25 bp, Mus musculus
atggagcttcgagagtatcacacca

SEQ ID NO: 542670 - DNA, 25 bp, Mus musculus
atggaggagggcatggctttcacca

SEQ ID NO: 542671 - DNA, 25 bp, Mus musculus
atggaggagggcttggctttcacca

SEQ ID NO: 542672 - DNA, 25 bp, Mus musculus
atggaggccattagtgatgatgagc

SEQ ID NO: 542673 - DNA, 25 bp, Mus musculus
atggaggccatttgtgatgatgagc

SEQ ID NO: 542674 - DNA, 25 bp, Mus musculus
atggaggccgcacacatggcagcca

SEQ ID NO: 542675 - DNA, 25 bp, Mus musculus
atggaggccgcagacatggcagcca

SEQ ID NO: 542676 - DNA, 25 bp, Mus musculus
atggaggcctccaacgccaccgtga

SEQ ID NO: 542677 - DNA, 25 bp, Mus musculus
atggaggcctcctacgccaccgtga

SEQ ID NO: 542678 - DNA, 25 bp, Mus musculus
atggagggagcccaaaccacctctg

SEQ ID NO: 542679 - DNA, 25 bp, Mus musculus
atggagggagccgaaaccacctctg

SEQ ID NO: 542680 - DNA, 25 bp, Mus musculus
atggagggctgcaggccaacaaccc

SEQ ID NO: 542681 - DNA, 25 bp, Mus musculus
atggagggctgctggccaacaaccc

SEQ ID NO: 542682 - DNA, 25 bp, Mus musculus
atggagggtcctatgtccgtgttcg

SEQ ID NO: 542683 - DNA, 25 bp, Mus musculus
atggagggtcctttgtccgtgttcg

SEQ ID NO: 542684 - DNA, 25 bp, Mus musculus
atggaggtcggacccagaaccctta

SEQ ID NO: 542685 - DNA, 25 bp, Mus musculus
atggaggtcggagccagaaccctta

SEQ ID NO: 542686 - DNA, 25 bp, Mus musculus
atggaggtgatgaagctaatcggaa

SEQ ID NO: 542687 - DNA, 25 bp, Mus musculus
atggaggtgatgtagctaatcggaa

SEQ ID NO: 542688 - DNA, 25 bp, Mus musculus
atggagtcaaaaaccgggcccctca

SEQ ID NO: 542689 - DNA, 25 bp, Mus musculus
atggagtcaaaatccgggcccctca

SEQ ID NO: 542690 - DNA, 25 bp, Mus musculus
atggagtcagtgcaaaagaccacga

SEQ ID NO: 542691 - DNA, 25 bp, Mus musculus
atggagtcagtggaaaagaccacga

SEQ ID NO: 542692 - DNA, 25 bp, Mus musculus
atggagtccagtataactatcccac

SEQ ID NO: 542693 - DNA, 25 bp, Mus musculus
atggagtccagtttaactatcccac

SEQ ID NO: 542694 - DNA, 25 bp, Mus musculus
atggagtctgaaccccaggtggccc

SEQ ID NO: 542695 - DNA, 25 bp, Mus musculus
atggagtctgaagcccaggtggccc

SEQ ID NO: 542696 - DNA, 25 bp, Mus musculus
atggagtgagcacgtagcccctgac

SEQ ID NO: 542697 - DNA, 25 bp, Mus musculus
atggagtgagcaggtagcccctgac

SEQ ID NO: 542698 - DNA, 25 bp, Mus musculus
atggagtgcgccaagtcccgggact

SEQ ID NO: 542699 - DNA, 25 bp, Mus musculus
atggagtgcgcctagtcccgggact

SEQ ID NO: 542700 - DNA, 25 bp, Mus musculus
atggagttcaaacgcggccgcttcc

SEQ ID NO: 542701 - DNA, 25 bp, Mus musculus
atggagttcaaaggcggccgcttcc

SEQ ID NO: 542702 - DNA, 25 bp, Mus musculus
atggataatccacaggtttgtagaa

SEQ ID NO: 542703 - DNA, 25 bp, Mus musculus
atggataatccagaggtttgtagaa

SEQ ID NO: 542704 - DNA, 25 bp, Mus musculus
atggataggcgtactgttgagccac

SEQ ID NO: 542705 - DNA, 25 bp, Mus musculus
atggataggcgttctgttgagccac

SEQ ID NO: 542706 - DNA, 25 bp, Mus musculus
atggatatctacacgcgcctgcggc

SEQ ID NO: 542707 - DNA, 25 bp, Mus musculus
atggatatctactcgcgcctgcggc

SEQ ID NO: 542708 - DNA, 25 bp, Mus musculus
atggatatggcccactacagcgctg

SEQ ID NO: 542709 - DNA, 25 bp, Mus musculus
atggatatggccgactacagcgctg

SEQ ID NO: 542710 - DNA, 25 bp, Mus musculus
atggatcctgagaaccgtgtgagga

SEQ ID NO: 542711 - DNA, 25 bp, Mus musculus
atggatcctgagtaccgtgtgagga

SEQ ID NO: 542712 - DNA, 25 bp, Mus musculus
atggatcgaactctgcacaagatca

SEQ ID NO: 542713 - DNA, 25 bp, Mus musculus
atggatcgaactgtgcacaagatca

SEQ ID NO: 542714 - DNA, 25 bp, Mus musculus
atggatcgctcgctaatggacctca

SEQ ID NO: 542715 - DNA, 25 bp, Mus musculus
atggatcgctcggtaatggacctca

SEQ ID NO: 542716 - DNA, 25 bp, Mus musculus
atggatctcttgatggcagagaaaa

SEQ ID NO: 542717 - DNA, 25 bp, Mus musculus
atggatctcttgttggcagagaaaa

SEQ ID NO: 542718 - DNA, 25 bp, Mus musculus
atggatcttgggaccggccgatgcc

SEQ ID NO: 542719 - DNA, 25 bp, Mus musculus
atggatcttgggtccggccgatgcc

SEQ ID NO: 542720 - DNA, 25 bp, Mus musculus
atggatgagctacctgagatgctgc

SEQ ID NO: 542721 - DNA, 25 bp, Mus musculus
atggatgagctagctgagatgctgc

SEQ ID NO: 542722 - DNA, 25 bp, Mus musculus
atggatgggcccattggctccgtcg

SEQ ID NO: 542723 - DNA, 25 bp, Mus musculus
atggatgggccctttggctccgtcg

SEQ ID NO: 542724 - DNA, 25 bp, Mus musculus
atggatgtcaatcttcgaggaccag

SEQ ID NO: 542725 - DNA, 25 bp, Mus musculus
atggatgtcaatgttcgaggaccag

SEQ ID NO: 542726 - DNA, 25 bp, Mus musculus
atggatgtcctgagccaggccaagt

SEQ ID NO: 542727 - DNA, 25 bp, Mus musculus
atggatgtcctgtgccaggccaagt

SEQ ID NO: 542728 - DNA, 25 bp, Mus musculus
atggattgtagaagcctcacaccag

SEQ ID NO: 542729 - DNA, 25 bp, Mus musculus
atggattgtagatgcctcacaccag

SEQ ID NO: 542730 - DNA, 25 bp, Mus musculus
atggatttgcagagctcgtctcccc

SEQ ID NO: 542731 - DNA, 25 bp, Mus musculus
atggatttgcagtgctcgtctcccc

SEQ ID NO: 542732 - DNA, 25 bp, Mus musculus
atggcaaaccgcagtctaacccagc

SEQ ID NO: 542733 - DNA, 25 bp, Mus musculus
atggcaaaccgctgtctaacccagc

SEQ ID NO: 542734 - DNA, 25 bp, Mus musculus
atggcaaagaggagcacccacagga

SEQ ID NO: 542735 - DNA, 25 bp, Mus musculus
atggcaaagaggtgcacccacagga

SEQ ID NO: 542736 - DNA, 25 bp, Mus musculus
atggcaaagctgacggccctacagg

SEQ ID NO: 542737 - DNA, 25 bp, Mus musculus
atggcaaagctgtcggccctacagg

SEQ ID NO: 542738 - DNA, 25 bp, Mus musculus
atggcaaagtccagacccctgaaga

SEQ ID NO: 542739 - DNA, 25 bp, Mus musculus
atggcaaagtcctgacccctgaaga

SEQ ID NO: 542740 - DNA, 25 bp, Mus musculus
atggcaacacgcatctgccccagtt

SEQ ID NO: 542741 - DNA, 25 bp, Mus musculus
atggcaacacgcttctgccccagtt

SEQ ID NO: 542742 - DNA, 25 bp, Mus musculus
atggcaacagttccccacctctgaa

SEQ ID NO: 542743 - DNA, 25 bp, Mus musculus
atggcaacagttgcccacctctgaa

SEQ ID NO: 542744 - DNA, 25 bp, Mus musculus
atggcaacctccagcggcgggagct

SEQ ID NO: 542745 - DNA, 25 bp, Mus musculus
atggcaacctcctgcggcgggagct

SEQ ID NO: 542746 - DNA, 25 bp, Mus musculus
atggcaacctcgctgggaacgcgct

SEQ ID NO: 542747 - DNA, 25 bp, Mus musculus
atggcaacctcggtgggaacgcgct

SEQ ID NO: 542748 - DNA, 25 bp, Mus musculus
atggcaagaagaagctgaaatacct

SEQ ID NO: 542749 - DNA, 25 bp, Mus musculus
atggcaagaagatgctgaaatacct

SEQ ID NO: 542750 - DNA, 25 bp, Mus musculus
atggcaagccggcaggccctgtcac

SEQ ID NO: 542751 - DNA, 25 bp, Mus musculus
atggcaagccgggaggccctgtcac

SEQ ID NO: 542752 - DNA, 25 bp, Mus musculus
atggcaagccgtctacagttatctg

SEQ ID NO: 542753 - DNA, 25 bp, Mus musculus
atggcaagccgtgtacagttatctg

SEQ ID NO: 542754 - DNA, 25 bp, Mus musculus
atggcaagcctcagctcaccacggt

SEQ ID NO: 542755 - DNA, 25 bp, Mus musculus
atggcaagcctctgctcaccacggt

SEQ ID NO: 542756 - DNA, 25 bp, Mus musculus
atggcaatgcggacactgtggctga

SEQ ID NO: 542757 - DNA, 25 bp, Mus musculus
atggcaatgcggtcactgtggctga

SEQ ID NO: 542758 - DNA, 25 bp, Mus musculus
atggcaattggacttctctcccgac

SEQ ID NO: 542759 - DNA, 25 bp, Mus musculus
atggcaattggagttctctcccgac

SEQ ID NO: 542760 - DNA, 25 bp, Mus musculus
atggcacacgaaacttccaggactt

SEQ ID NO: 542761 - DNA, 25 bp, Mus musculus
atggcacacgaatcttccaggactt

SEQ ID NO: 542762 - DNA, 25 bp, Mus musculus
atggcaccacccagtgaggtcctga

SEQ ID NO: 542763 - DNA, 25 bp, Mus musculus
atggcaccaccctgtgaggtcctga

SEQ ID NO: 542764 - DNA, 25 bp, Mus musculus
atggcactcaggctaagccttcctc

SEQ ID NO: 542765 - DNA, 25 bp, Mus musculus
atggcactcagggtaagccttcctc

SEQ ID NO: 542766 - DNA, 25 bp, Mus musculus
atggcagacattcgcgtgtagtgtc

SEQ ID NO: 542767 - DNA, 25 bp, Mus musculus
atggcagacattggcgtgtagtgtc

SEQ ID NO: 542768 - DNA, 25 bp, Mus musculus
atggcagagcacctaatgaccttgg

SEQ ID NO: 542769 - DNA, 25 bp, Mus musculus
atggcagagcacgtaatgaccttgg

SEQ ID NO: 542770 - DNA, 25 bp, Mus musculus
atggcagaggctccaggcagtccta

SEQ ID NO: 542771 - DNA, 25 bp, Mus musculus
atggcagaggctgcaggcagtccta

SEQ ID NO: 542772 - DNA, 25 bp, Mus musculus
atggcagatacccagtacatcctgc

SEQ ID NO: 542773 - DNA, 25 bp, Mus musculus
atggcagataccgagtacatcctgc

SEQ ID NO: 542774 - DNA, 25 bp, Mus musculus
atggcagatatgcatgagctcttct

SEQ ID NO: 542775 - DNA, 25 bp, Mus musculus
atggcagatatggatgagctcttct

SEQ ID NO: 542776 - DNA, 25 bp, Mus musculus
atggcagcagtgacaatgggctttg

SEQ ID NO: 542777 - DNA, 25 bp, Mus musculus
atggcagcagtgtcaatgggctttg

SEQ ID NO: 542778 - DNA, 25 bp, Mus musculus
atggcagcatttaactgaagaacag

SEQ ID NO: 542779 - DNA, 25 bp, Mus musculus
atggcagcattttactgaagaacag

SEQ ID NO: 542780 - DNA, 25 bp, Mus musculus
atggcagccttaccccaagtggacg

SEQ ID NO: 542781 - DNA, 25 bp, Mus musculus
atggcagccttagcccaagtggacg

SEQ ID NO: 542782 - DNA, 25 bp, Mus musculus
atggcagcgtggaggcaacgcatcc

SEQ ID NO: 542783 - DNA, 25 bp, Mus musculus
atggcagcgtggtggcaacgcatcc

SEQ ID NO: 542784 - DNA, 25 bp, Mus musculus
atggcagcgtgtacaaggctattca

SEQ ID NO: 542785 - DNA, 25 bp, Mus musculus
atggcagcgtgttcaaggctattca

SEQ ID NO: 542786 - DNA, 25 bp, Mus musculus
atggcagcgtttccggtggatcccc

SEQ ID NO: 542787 - DNA, 25 bp, Mus musculus
atggcagcgtttgcggtggatcccc

SEQ ID NO: 542788 - DNA, 25 bp, Mus musculus
atggcagctgcgcacgagcccaagc

SEQ ID NO: 542789 - DNA, 25 bp, Mus musculus
atggcagctgcggacgagcccaagc

SEQ ID NO: 542790 - DNA, 25 bp, Mus musculus
atggcaggccgactccaccacaaga

SEQ ID NO: 542791 - DNA, 25 bp, Mus musculus
atggcaggccgagtccaccacaaga

SEQ ID NO: 542792 - DNA, 25 bp, Mus musculus
atggcaggttcaccggaaagtgatc

SEQ ID NO: 542793 - DNA, 25 bp, Mus musculus
atggcaggttcagcggaaagtgatc

SEQ ID NO: 542794 - DNA, 25 bp, Mus musculus
atggcagtcgtgctcctcatcgtcc

SEQ ID NO: 542795 - DNA, 25 bp, Mus musculus
atggcagtcgtggtcctcatcgtcc

SEQ ID NO: 542796 - DNA, 25 bp, Mus musculus
atggcagtgtcccagacgctcagtc

SEQ ID NO: 542797 - DNA, 25 bp, Mus musculus
atggcagtgtccgagacgctcagtc

SEQ ID NO: 542798 - DNA, 25 bp, Mus musculus
atggcatcctacagcttcggcccag

SEQ ID NO: 542799 - DNA, 25 bp, Mus musculus
atggcatcctactgcttcggcccag

SEQ ID NO: 542800 - DNA, 25 bp, Mus musculus
atggcatcgaggagaatggagacca

SEQ ID NO: 542801 - DNA, 25 bp, Mus musculus
atggcatcgaggtgaatggagacca

SEQ ID NO: 542802 - DNA, 25 bp, Mus musculus
atggcatctcgtagccggagacccg

SEQ ID NO: 542803 - DNA, 25 bp, Mus musculus
atggcatctcgttgccggagacccg

SEQ ID NO: 542804 - DNA, 25 bp, Mus musculus
atggcatctgcacgaacacaccagg

SEQ ID NO: 542805 - DNA, 25 bp, Mus musculus
atggcatctgcaggaacacaccagg

SEQ ID NO: 542806 - DNA, 25 bp, Mus musculus
atggcatggaggaaccgctctcacc

SEQ ID NO: 542807 - DNA, 25 bp, Mus musculus
atggcatggaggtaccgctctcacc

SEQ ID NO: 542808 - DNA, 25 bp, Mus musculus
atggcatttgcaaatcatcagactg

SEQ ID NO: 542809 - DNA, 25 bp, Mus musculus
atggcatttgcatatcatcagactg

SEQ ID NO: 542810 - DNA, 25 bp, Mus musculus
atggcatttggacgctgacgatttc

SEQ ID NO: 542811 - DNA, 25 bp, Mus musculus
atggcatttggaggctgacgatttc

SEQ ID NO: 542812 - DNA, 25 bp, Mus musculus
atggccaaagctagggccgccctgc

SEQ ID NO: 542813 - DNA, 25 bp, Mus musculus
atggccaaagcttgggccgccctgc

SEQ ID NO: 542814 - DNA, 25 bp, Mus musculus
atggccaagacacgcgagacccaga

SEQ ID NO: 542815 - DNA, 25 bp, Mus musculus
atggccaagacaggcgagacccaga

SEQ ID NO: 542816 - DNA, 25 bp, Mus musculus
atggccaagcgccactcaaaggctg

SEQ ID NO: 542817 - DNA, 25 bp, Mus musculus
atggccaagcgcgactcaaaggctg

SEQ ID NO: 542818 - DNA, 25 bp, Mus musculus
atggccaatgcccaccagcgtgtca

SEQ ID NO: 542819 - DNA, 25 bp, Mus musculus
atggccaatgccgaccagcgtgtca

SEQ ID NO: 542820 - DNA, 25 bp, Mus musculus
atggccacagagactacagccgctg

SEQ ID NO: 542821 - DNA, 25 bp, Mus musculus
atggccacagagtctacagccgctg

SEQ ID NO: 542822 - DNA, 25 bp, Mus musculus
atggccaccaacaagggcggccgga

SEQ ID NO: 542823 - DNA, 25 bp, Mus musculus
atggccaccaactagggcggccgga

SEQ ID NO: 542824 - DNA, 25 bp, Mus musculus
atggccaccatacagggcacctacg

SEQ ID NO: 542825 - DNA, 25 bp, Mus musculus
atggccaccatagagggcacctacg

SEQ ID NO: 542826 - DNA, 25 bp, Mus musculus
atggccaccttcctgctagaactgc

SEQ ID NO: 542827 - DNA, 25 bp, Mus musculus
atggccaccttcgtgctagaactgc

SEQ ID NO: 542828 - DNA, 25 bp, Mus musculus
atggccagatcaacagcaacctctt

SEQ ID NO: 542829 - DNA, 25 bp, Mus musculus
atggccagatcatcagcaacctctt

SEQ ID NO: 542830 - DNA, 25 bp, Mus musculus
atggccagtatgaccccagaattgt

SEQ ID NO: 542831 - DNA, 25 bp, Mus musculus
atggccagtatgtccccagaattgt

SEQ ID NO: 542832 - DNA, 25 bp, Mus musculus
atggccatcgagaacactcaagaag

SEQ ID NO: 542833 - DNA, 25 bp, Mus musculus
atggccatcgagtacactcaagaag

SEQ ID NO: 542834 - DNA, 25 bp, Mus musculus
atggccatgtgcacgagctgctcgt

SEQ ID NO: 542835 - DNA, 25 bp, Mus musculus
atggccatgtgctcgagctgctcgt

SEQ ID NO: 542836 - DNA, 25 bp, Mus musculus
atggcccccgaactggcaggacagt

SEQ ID NO: 542837 - DNA, 25 bp, Mus musculus
atggcccccgaagtggcaggacagt

SEQ ID NO: 542838 - DNA, 25 bp, Mus musculus
atggccccggacattgaggcagcac

SEQ ID NO: 542839 - DNA, 25 bp, Mus musculus
atggccccggactttgaggcagcac

SEQ ID NO: 542840 - DNA, 25 bp, Mus musculus
atggcccgggcgacattcgacatga

SEQ ID NO: 542841 - DNA, 25 bp, Mus musculus
atggcccgggcgtcattcgacatga

SEQ ID NO: 542842 - DNA, 25 bp, Mus musculus
atggccctcaggactcgttcttcag

SEQ ID NO: 542843 - DNA, 25 bp, Mus musculus
atggccctcaggtctcgttcttcag

SEQ ID NO: 542844 - DNA, 25 bp, Mus musculus
atggccgactacagcgctgccctgg

SEQ ID NO: 542845 - DNA, 25 bp, Mus musculus
atggccgactactgcgctgccctgg

SEQ ID NO: 542846 - DNA, 25 bp, Mus musculus
atggccgactctcgaggtcagccac

SEQ ID NO: 542847 - DNA, 25 bp, Mus musculus
atggccgactctggaggtcagccac

SEQ ID NO: 542848 - DNA, 25 bp, Mus musculus
atggccgcattgagccgggcgacat

SEQ ID NO: 542849 - DNA, 25 bp, Mus musculus
atggccgcattgtgccgggcgacat

SEQ ID NO: 542850 - DNA, 25 bp, Mus musculus
atggccgcccgaccatatgccagta

SEQ ID NO: 542851 - DNA, 25 bp, Mus musculus
atggccgcccgagcatatgccagta

SEQ ID NO: 542852 - DNA, 25 bp, Mus musculus
atggccgccgacatcagccagtggg

SEQ ID NO: 542853 - DNA, 25 bp, Mus musculus
atggccgccgacttcagccagtggg

SEQ ID NO: 542854 - DNA, 25 bp, Mus musculus
atggccgctgccagatagaagaccc

SEQ ID NO: 542855 - DNA, 25 bp, Mus musculus
atggccgctgcctgatagaagaccc

SEQ ID NO: 542856 - DNA, 25 bp, Mus musculus
atggccggaggcacgccgatgatct

SEQ ID NO: 542857 - DNA, 25 bp, Mus musculus
atggccggaggctcgccgatgatct

SEQ ID NO: 542858 - DNA, 25 bp, Mus musculus
atggccgggctgcaagacctcactt

SEQ ID NO: 542859 - DNA, 25 bp, Mus musculus
atggccgggctggaagacctcactt

SEQ ID NO: 542860 - DNA, 25 bp, Mus musculus
atggcctaccggctctggagcacag

SEQ ID NO: 542861 - DNA, 25 bp, Mus musculus
atggcctaccgggtctggagcacag

SEQ ID NO: 542862 - DNA, 25 bp, Mus musculus
atggcctagcaacagcccagggtct

SEQ ID NO: 542863 - DNA, 25 bp, Mus musculus
atggcctagcaagagcccagggtct

SEQ ID NO: 542864 - DNA, 25 bp, Mus musculus
atggcctaggcgcatcacacacata

SEQ ID NO: 542865 - DNA, 25 bp, Mus musculus
atggcctaggcggatcacacacata

SEQ ID NO: 542866 - DNA, 25 bp, Mus musculus
atggcctcaatgagcacgatggagc

SEQ ID NO: 542867 - DNA, 25 bp, Mus musculus
atggcctcaatgtgcacgatggagc

SEQ ID NO: 542868 - DNA, 25 bp, Mus musculus
atggcctccgagatcttttcaatgc

SEQ ID NO: 542869 - DNA, 25 bp, Mus musculus
atggcctccgagttcttttcaatgc

SEQ ID NO: 542870 - DNA, 25 bp, Mus musculus
atggcctccggccagttctacacta

SEQ ID NO: 542871 - DNA, 25 bp, Mus musculus
atggcctccggcgagttctacacta

SEQ ID NO: 542872 - DNA, 25 bp, Mus musculus
atggcctcctacatcggctatgctg

SEQ ID NO: 542873 - DNA, 25 bp, Mus musculus
atggcctcctacttcggctatgctg

SEQ ID NO: 542874 - DNA, 25 bp, Mus musculus
atggcctcgtacagggccagcctct

SEQ ID NO: 542875 - DNA, 25 bp, Mus musculus
atggcctcgtactgggccagcctct

SEQ ID NO: 542876 - DNA, 25 bp, Mus musculus
atggcctcttgaagagtactggtga

SEQ ID NO: 542877 - DNA, 25 bp, Mus musculus
atggcctcttgatgagtactggtga

SEQ ID NO: 542878 - DNA, 25 bp, Mus musculus
atggcctgaagcacaattacctgcg

SEQ ID NO: 542879 - DNA, 25 bp, Mus musculus
atggcctgaagctcaattacctgcg

SEQ ID NO: 542880 - DNA, 25 bp, Mus musculus
atggcctgaggccaaggccctccga

SEQ ID NO: 542881 - DNA, 25 bp, Mus musculus
atggcctgaggcgaaggccctccga

SEQ ID NO: 542882 - DNA, 25 bp, Mus musculus
atggcctgtcggagaggaccacgcc

SEQ ID NO: 542883 - DNA, 25 bp, Mus musculus
atggcctgtcggtgaggaccacgcc

SEQ ID NO: 542884 - DNA, 25 bp, Mus musculus
atggcgaacgacactcccgcgaaga

SEQ ID NO: 542885 - DNA, 25 bp, Mus musculus
atggcgaacgactctcccgcgaaga

SEQ ID NO: 542886 - DNA, 25 bp, Mus musculus
atggcgactgcaatccggctgctgg

SEQ ID NO: 542887 - DNA, 25 bp, Mus musculus
atggcgactgcattccggctgctgg

SEQ ID NO: 542888 - DNA, 25 bp, Mus musculus
atggcgactgccacggctcgctgga

SEQ ID NO: 542889 - DNA, 25 bp, Mus musculus
atggcgactgcctcggctcgctgga

SEQ ID NO: 542890 - DNA, 25 bp, Mus musculus
atggcgactggaagaccattccaac

SEQ ID NO: 542891 - DNA, 25 bp, Mus musculus
atggcgactggatgaccattccaac

SEQ ID NO: 542892 - DNA, 25 bp, Mus musculus
atggcgagcaccctcattggcacac

SEQ ID NO: 542893 - DNA, 25 bp, Mus musculus
atggcgagcaccgtcattggcacac

SEQ ID NO: 542894 - DNA, 25 bp, Mus musculus
atggcgaggagaccttcaaccgagc

SEQ ID NO: 542895 - DNA, 25 bp, Mus musculus
atggcgaggagagcttcaaccgagc

SEQ ID NO: 542896 - DNA, 25 bp, Mus musculus
atggcgcccaggcaggtcctcacag

SEQ ID NO: 542897 - DNA, 25 bp, Mus musculus
atggcgcccagggaggtcctcacag

SEQ ID NO: 542898 - DNA, 25 bp, Mus musculus
atggcgcttaagcactacgcgatcg

SEQ ID NO: 542899 - DNA, 25 bp, Mus musculus
atggcgcttaaggactacgcgatcg

SEQ ID NO: 542900 - DNA, 25 bp, Mus musculus
atggcggagatcagcgacctggacc

SEQ ID NO: 542901 - DNA, 25 bp, Mus musculus
atggcggagatctgcgacctggacc

SEQ ID NO: 542902 - DNA, 25 bp, Mus musculus
atggcggaggcaatcataagaacag

SEQ ID NO: 542903 - DNA, 25 bp, Mus musculus
atggcggaggcattcataagaacag

SEQ ID NO: 542904 - DNA, 25 bp, Mus musculus
atggcggatccacacctgttggaag

SEQ ID NO: 542905 - DNA, 25 bp, Mus musculus
atggcggatccagacctgttggaag

SEQ ID NO: 542906 - DNA, 25 bp, Mus musculus
atggcggcgacacagagaccttcgc

SEQ ID NO: 542907 - DNA, 25 bp, Mus musculus
atggcggcgacagagagaccttcgc

SEQ ID NO: 542908 - DNA, 25 bp, Mus musculus
atggcggcgactacagctaacccag

SEQ ID NO: 542909 - DNA, 25 bp, Mus musculus
atggcggcgacttcagctaacccag

SEQ ID NO: 542910 - DNA, 25 bp, Mus musculus
atggcggcgagcaccatggaccact

SEQ ID NO: 542911 - DNA, 25 bp, Mus musculus
atggcggcgagctccatggaccact

SEQ ID NO: 542912 - DNA, 25 bp, Mus musculus
atggcggcgtccaccctggagcaga

SEQ ID NO: 542913 - DNA, 25 bp, Mus musculus
atggcggcgtcctccctggagcaga

SEQ ID NO: 542914 - DNA, 25 bp, Mus musculus
atggcggctgcgacactcagcttcg

SEQ ID NO: 542915 - DNA, 25 bp, Mus musculus
atggcggctgcgtcactcagcttcg

SEQ ID NO: 542916 - DNA, 25 bp, Mus musculus
atggcggtgcagatttccaagaaga

SEQ ID NO: 542917 - DNA, 25 bp, Mus musculus
atggcggtgcagttttccaagaaga

SEQ ID NO: 542918 - DNA, 25 bp, Mus musculus
atggcgtaccagagcctccggctgg

SEQ ID NO: 542919 - DNA, 25 bp, Mus musculus
atggcgtaccagtgcctccggctgg

SEQ ID NO: 542920 - DNA, 25 bp, Mus musculus
atggcgtccggaagacctgagccga

SEQ ID NO: 542921 - DNA, 25 bp, Mus musculus
atggcgtccggatgacctgagccga

SEQ ID NO: 542922 - DNA, 25 bp, Mus musculus
atggcgtgaagaatgcaactgggca

SEQ ID NO: 542923 - DNA, 25 bp, Mus musculus
atggcgtgaagattgcaactgggca

SEQ ID NO: 542924 - DNA, 25 bp, Mus musculus
atggcgtggtcaaccacttgccggg

SEQ ID NO: 542925 - DNA, 25 bp, Mus musculus
atggcgtggtcatccacttgccggg

SEQ ID NO: 542926 - DNA, 25 bp, Mus musculus
atggcgttcgctccaggcgagacct

SEQ ID NO: 542927 - DNA, 25 bp, Mus musculus
atggcgttcgctgcaggcgagacct

SEQ ID NO: 542928 - DNA, 25 bp, Mus musculus
atggctaaagtaaaagggatgtggc

SEQ ID NO: 542929 - DNA, 25 bp, Mus musculus
atggctaaagtataagggatgtggc

SEQ ID NO: 542930 - DNA, 25 bp, Mus musculus
atggctaccggtccgcagtgctaaa

SEQ ID NO: 542931 - DNA, 25 bp, Mus musculus
atggctaccggtgcgcagtgctaaa

SEQ ID NO: 542932 - DNA, 25 bp, Mus musculus
atggctaggcgccacacaatctcag

SEQ ID NO: 542933 - DNA, 25 bp, Mus musculus
atggctaggcgcgacacaatctcag

SEQ ID NO: 542934 - DNA, 25 bp, Mus musculus
atggctcacctgctccgagcactag

SEQ ID NO: 542935 - DNA, 25 bp, Mus musculus
atggctcacctggtccgagcactag

SEQ ID NO: 542936 - DNA, 25 bp, Mus musculus
atggctcagtttagtggcgccttct

SEQ ID NO: 542937 - DNA, 25 bp, Mus musculus
atggctcagttttgtggcgccttct

SEQ ID NO: 542938 - DNA, 25 bp, Mus musculus
atggctccaaggctgtgacccgcca

SEQ ID NO: 542939 - DNA, 25 bp, Mus musculus
atggctccaagggtgtgacccgcca

SEQ ID NO: 542940 - DNA, 25 bp, Mus musculus
atggctcggtcacttttactgtgta

SEQ ID NO: 542941 - DNA, 25 bp, Mus musculus
atggctcggtcagttttactgtgta

SEQ ID NO: 542942 - DNA, 25 bp, Mus musculus
atggctctctccactggcccgagtg

SEQ ID NO: 542943 - DNA, 25 bp, Mus musculus
atggctctctcctctggcccgagtg

SEQ ID NO: 542944 - DNA, 25 bp, Mus musculus
atggctctcttcagtgcccagtctc

SEQ ID NO: 542945 - DNA, 25 bp, Mus musculus
atggctctcttcctggctacctgga

SEQ ID NO: 542946 - DNA, 25 bp, Mus musculus
atggctctcttcgtggctacctgga

SEQ ID NO: 542947 - DNA, 25 bp, Mus musculus
atggctctcttctgtgcccagtctc

SEQ ID NO: 542948 - DNA, 25 bp, Mus musculus
atggctctgatgaggcccactgcca

SEQ ID NO: 542949 - DNA, 25 bp, Mus musculus
atggctctgatgtggcccactgcca

SEQ ID NO: 542950 - DNA, 25 bp, Mus musculus
atggctctgcgccagcgcaatgtgc

SEQ ID NO: 542951 - DNA, 25 bp, Mus musculus
atggctctgcgcgagcgcaatgtgc

SEQ ID NO: 542952 - DNA, 25 bp, Mus musculus
atggctctgctcagttcagcccagc

SEQ ID NO: 542953 - DNA, 25 bp, Mus musculus
atggctctgctctgttcagcccagc

SEQ ID NO: 542954 - DNA, 25 bp, Mus musculus
atggctcttccccaggtcatgatgg

SEQ ID NO: 542955 - DNA, 25 bp, Mus musculus
atggctcttcccgaggtcatgatgg

SEQ ID NO: 542956 - DNA, 25 bp, Mus musculus
atggctgcagcgatacctgcccggt

SEQ ID NO: 542957 - DNA, 25 bp, Mus musculus
atggctgcagcgttacctgcccggt

SEQ ID NO: 542958 - DNA, 25 bp, Mus musculus
atggctgcccccaggccaataggga

SEQ ID NO: 542959 - DNA, 25 bp, Mus musculus
atggctgccccctggccaataggga

SEQ ID NO: 542960 - DNA, 25 bp, Mus musculus
atggctgctcagctcacggattgag

SEQ ID NO: 542961 - DNA, 25 bp, Mus musculus
atggctgctcagctccatgatctga

SEQ ID NO: 542962 - DNA, 25 bp, Mus musculus
atggctgctcaggtcacggattgag

SEQ ID NO: 542963 - DNA, 25 bp, Mus musculus
atggctgctcaggtccatgatctga

SEQ ID NO: 542964 - DNA, 25 bp, Mus musculus
atggctgctggcactccgggattga

SEQ ID NO: 542965 - DNA, 25 bp, Mus musculus
atggctgctggctctccgggattga

SEQ ID NO: 542966 - DNA, 25 bp, Mus musculus
atggctggactgcactcttccactg

SEQ ID NO: 542967 - DNA, 25 bp, Mus musculus
atggctggactggactcttccactg

SEQ ID NO: 542968 - DNA, 25 bp, Mus musculus
atggctggacttcttgttggagccc

SEQ ID NO: 542969 - DNA, 25 bp, Mus musculus
atggctggacttgttgttggagccc

SEQ ID NO: 542970 - DNA, 25 bp, Mus musculus
atggctgggagaacttcatgtgtga

SEQ ID NO: 542971 - DNA, 25 bp, Mus musculus
atggctgggagatcttcatgtgtga

SEQ ID NO: 542972 - DNA, 25 bp, Mus musculus
atggctgtgtctaaagggcatgtca

SEQ ID NO: 542973 - DNA, 25 bp, Mus musculus
atggctgtgtcttaagggcatgtca

SEQ ID NO: 542974 - DNA, 25 bp, Mus musculus
atggcttatcttctttgtgctgggc

SEQ ID NO: 542975 - DNA, 25 bp, Mus musculus
atggcttatcttgtttgtgctgggc

SEQ ID NO: 542976 - DNA, 25 bp, Mus musculus
atggcttccagcactaatagaactc

SEQ ID NO: 542977 - DNA, 25 bp, Mus musculus
atggcttccagctctaatagaactc

SEQ ID NO: 542978 - DNA, 25 bp, Mus musculus
atggcttccggcctgatctcgctgg

SEQ ID NO: 542979 - DNA, 25 bp, Mus musculus
atggcttccggcgtgatctcgctgg

SEQ ID NO: 542980 - DNA, 25 bp, Mus musculus
atggcttcggaactgctgctcagaa

SEQ ID NO: 542981 - DNA, 25 bp, Mus musculus
atggcttcggaagtgctgctcagaa

SEQ ID NO: 542982 - DNA, 25 bp, Mus musculus
atggcttctcagagccccttacctt

SEQ ID NO: 542983 - DNA, 25 bp, Mus musculus
atggcttctcagtgccccttacctt

SEQ ID NO: 542984 - DNA, 25 bp, Mus musculus
atggcttgccagaagtcaccctggt

SEQ ID NO: 542985 - DNA, 25 bp, Mus musculus
atggcttgccagtagtcaccctggt

SEQ ID NO: 542986 - DNA, 25 bp, Mus musculus
atggcttgtgccaaccctgcgccag

SEQ ID NO: 542987 - DNA, 25 bp, Mus musculus
atggcttgtgcctaccctgcgccag

SEQ ID NO: 542988 - DNA, 25 bp, Mus musculus
atggctttcctgactataagaaggg

SEQ ID NO: 542989 - DNA, 25 bp, Mus musculus
atggctttcctgtctataagaaggg

SEQ ID NO: 542990 - DNA, 25 bp, Mus musculus
atggctttggccacgtttttctcct

SEQ ID NO: 542991 - DNA, 25 bp, Mus musculus
atggctttggcctcgtttttctcct

SEQ ID NO: 542992 - DNA, 25 bp, Mus musculus
atgggaaaccacctgccgcttctgc

SEQ ID NO: 542993 - DNA, 25 bp, Mus musculus
atgggaaaccacgtgccgcttctgc

SEQ ID NO: 542994 - DNA, 25 bp, Mus musculus
atgggaaagcccagcgatgccaagg

SEQ ID NO: 542995 - DNA, 25 bp, Mus musculus
atgggaaagccctgcgatgccaagg

SEQ ID NO: 542996 - DNA, 25 bp, Mus musculus
atgggaaagcgaaggcagtcaccag

SEQ ID NO: 542997 - DNA, 25 bp, Mus musculus
atgggaaagcgatggcagtcaccag

SEQ ID NO: 542998 - DNA, 25 bp, Mus musculus
atgggaaataccaggccagcggagc

SEQ ID NO: 542999 - DNA, 25 bp, Mus musculus
atgggaaatacctggccagcggagc

SEQ ID NO: 543000 - DNA, 25 bp, Mus musculus
atgggaaccaggactcggcaggatc

SEQ ID NO: 543001 - DNA, 25 bp, Mus musculus
atgggaaccaggtctcggcaggatc

SEQ ID NO: 543002 - DNA, 25 bp, Mus musculus
atgggaaccccgaccccattgtcat

SEQ ID NO: 543003 - DNA, 25 bp, Mus musculus
atgggaaccccgtccccattgtcat

SEQ ID NO: 543004 - DNA, 25 bp, Mus musculus
atgggaaccctcctcacggcctatt

SEQ ID NO: 543005 - DNA, 25 bp, Mus musculus
atgggaaccctcgtcacggcctatt

SEQ ID NO: 543006 - DNA, 25 bp, Mus musculus
atgggaacgagccttccaaacagcc

SEQ ID NO: 543007 - DNA, 25 bp, Mus musculus
atgggaacgagcgttccaaacagcc

SEQ ID NO: 543008 - DNA, 25 bp, Mus musculus
atgggaacgccaatatagccgccag

SEQ ID NO: 543009 - DNA, 25 bp, Mus musculus
atgggaacgccattatagccgccag

SEQ ID NO: 543010 - DNA, 25 bp, Mus musculus
atgggaagagtcatcgccagcgctc

SEQ ID NO: 543011 - DNA, 25 bp, Mus musculus
atgggaagagtcttcgccagcgctc

SEQ ID NO: 543012 - DNA, 25 bp, Mus musculus
atgggaaggagcacaatggaaaaca

SEQ ID NO: 543013 - DNA, 25 bp, Mus musculus
atgggaaggagctcaatggaaaaca

SEQ ID NO: 543014 - DNA, 25 bp, Mus musculus
atgggaataaagcatagcgtttcca

SEQ ID NO: 543015 - DNA, 25 bp, Mus musculus
atgggaataaaggatagcgtttcca

SEQ ID NO: 543016 - DNA, 25 bp, Mus musculus
atgggacagagtagatattgccaaa

SEQ ID NO: 543017 - DNA, 25 bp, Mus musculus
atgggacagagttgatattgccaaa

SEQ ID NO: 543018 - DNA, 25 bp, Mus musculus
atgggaccaacgacgggcctgctct

SEQ ID NO: 543019 - DNA, 25 bp, Mus musculus
atgggaccaacgtcgggcctgctct

SEQ ID NO: 543020 - DNA, 25 bp, Mus musculus
atgggacgcctcagctcaggacatg

SEQ ID NO: 543021 - DNA, 25 bp, Mus musculus
atgggacgcctctgctcaggacatg

SEQ ID NO: 543022 - DNA, 25 bp, Mus musculus
atgggacggctgaatatgagaaaaa

SEQ ID NO: 543023 - DNA, 25 bp, Mus musculus
atgggacggctgtatatgagaaaaa

SEQ ID NO: 543024 - DNA, 25 bp, Mus musculus
atgggagaatctacattggcacctt

SEQ ID NO: 543025 - DNA, 25 bp, Mus musculus
atgggagaatcttcattggcacctt

SEQ ID NO: 543026 - DNA, 25 bp, Mus musculus
atgggagaggcgctaccctacgcac

SEQ ID NO: 543027 - DNA, 25 bp, Mus musculus
atgggagaggcggtaccctacgcac

SEQ ID NO: 543028 - DNA, 25 bp, Mus musculus
atgggagcatccaaggtcactggct

SEQ ID NO: 543029 - DNA, 25 bp, Mus musculus
atgggagcatcctaggtcactggct

SEQ ID NO: 543030 - DNA, 25 bp, Mus musculus
atgggagccgccaatggcacagcca

SEQ ID NO: 543031 - DNA, 25 bp, Mus musculus
atgggagccgcctatggcacagcca

SEQ ID NO: 543032 - DNA, 25 bp, Mus musculus
atgggatgagccaccagccgcctct

SEQ ID NO: 543033 - DNA, 25 bp, Mus musculus
atgggatgagcctccagccgcctct

SEQ ID NO: 543034 - DNA, 25 bp, Mus musculus
atgggattctccaggccaccggcct

SEQ ID NO: 543035 - DNA, 25 bp, Mus musculus
atgggattctcctggccaccggcct

SEQ ID NO: 543036 - DNA, 25 bp, Mus musculus
atgggcaagtttaaccctgaactga

SEQ ID NO: 543037 - DNA, 25 bp, Mus musculus
atgggcaagttttaccctgaactga

SEQ ID NO: 543038 - DNA, 25 bp, Mus musculus
atgggcagcgagcagagcgcggagg

SEQ ID NO: 543039 - DNA, 25 bp, Mus musculus
atgggcagcgaggagagcgcggagg

SEQ ID NO: 543040 - DNA, 25 bp, Mus musculus
atgggcagtggcaccctgaacaggt

SEQ ID NO: 543041 - DNA, 25 bp, Mus musculus
atgggcagtggctccctgaacaggt

SEQ ID NO: 543042 - DNA, 25 bp, Mus musculus
atgggcatccatacaaagagctctg

SEQ ID NO: 543043 - DNA, 25 bp, Mus musculus
atgggcatccattcaaagagctctg

SEQ ID NO: 543044 - DNA, 25 bp, Mus musculus
atgggccacagccaaggcatctgcc

SEQ ID NO: 543045 - DNA, 25 bp, Mus musculus
atgggccacagcgaaggcatctgcc

SEQ ID NO: 543046 - DNA, 25 bp, Mus musculus
atgggccagccaatacactctaggg

SEQ ID NO: 543047 - DNA, 25 bp, Mus musculus
atgggccagccattacactctaggg

SEQ ID NO: 543048 - DNA, 25 bp, Mus musculus
atgggccagggcatccaggtcagcc

SEQ ID NO: 543049 - DNA, 25 bp, Mus musculus
atgggccagggcttccaggtcagcc

SEQ ID NO: 543050 - DNA, 25 bp, Mus musculus
atgggccagtcccagcggtaactcg

SEQ ID NO: 543051 - DNA, 25 bp, Mus musculus
atgggccagtccgagcggtaactcg

SEQ ID NO: 543052 - DNA, 25 bp, Mus musculus
atgggcctagccaatgccgcggcct

SEQ ID NO: 543053 - DNA, 25 bp, Mus musculus
atgggcctagcctatgccgcggcct

SEQ ID NO: 543054 - DNA, 25 bp, Mus musculus
atgggccttcaaaacctactgctgc

SEQ ID NO: 543055 - DNA, 25 bp, Mus musculus
atgggccttcaatacctactgctgc

SEQ ID NO: 543056 - DNA, 25 bp, Mus musculus
atgggcgcctctcgtgtgcgaccac

SEQ ID NO: 543057 - DNA, 25 bp, Mus musculus
atgggcgcctctggtgtgcgaccac

SEQ ID NO: 543058 - DNA, 25 bp, Mus musculus
atgggcggcagcacccgccgaaaga

SEQ ID NO: 543059 - DNA, 25 bp, Mus musculus
atgggcggcagctcccgccgaaaga

SEQ ID NO: 543060 - DNA, 25 bp, Mus musculus
atgggctcccggaacatgatgggaa

SEQ ID NO: 543061 - DNA, 25 bp, Mus musculus
atgggctcccggtacatgatgggaa

SEQ ID NO: 543062 - DNA, 25 bp, Mus musculus
atgggctcctgtccacagggattca

SEQ ID NO: 543063 - DNA, 25 bp, Mus musculus
atgggctcctgtgcacagggattca

SEQ ID NO: 543064 - DNA, 25 bp, Mus musculus
atgggctgctgcatcactaagagga

SEQ ID NO: 543065 - DNA, 25 bp, Mus musculus
atgggctgctgcttcactaagagga

SEQ ID NO: 543066 - DNA, 25 bp, Mus musculus
atgggctggacacctacacctgcct

SEQ ID NO: 543067 - DNA, 25 bp, Mus musculus
atgggctggacagctacacctgcct

SEQ ID NO: 543068 - DNA, 25 bp, Mus musculus
atgggcttcaggctcactaacgggc

SEQ ID NO: 543069 - DNA, 25 bp, Mus musculus
atgggcttcagggtcactaacgggc

SEQ ID NO: 543070 - DNA, 25 bp, Mus musculus
atgggctttgctcgaattgctgttg

SEQ ID NO: 543071 - DNA, 25 bp, Mus musculus
atgggctttgctggaattgctgttg

SEQ ID NO: 543072 - DNA, 25 bp, Mus musculus
atgggctttggacatcctctctcac

SEQ ID NO: 543073 - DNA, 25 bp, Mus musculus
atgggctttggagatcctctctcac

SEQ ID NO: 543074 - DNA, 25 bp, Mus musculus
atgggcttttgcaccggccgctgca

SEQ ID NO: 543075 - DNA, 25 bp, Mus musculus
atgggcttttgctccggccgctgca

SEQ ID NO: 543076 - DNA, 25 bp, Mus musculus
atgggtacagtacctcagactcttt

SEQ ID NO: 543077 - DNA, 25 bp, Mus musculus
atgggtacagtagctcagactcttt

SEQ ID NO: 543078 - DNA, 25 bp, Mus musculus
atgggtagacttaggaactacttga

SEQ ID NO: 543079 - DNA, 25 bp, Mus musculus
atgggtagactttggaactacttga

SEQ ID NO: 543080 - DNA, 25 bp, Mus musculus
atgggtaggcagatcgacatgagtt

SEQ ID NO: 543081 - DNA, 25 bp, Mus musculus
atgggtaggcagttcgacatgagtt

SEQ ID NO: 543082 - DNA, 25 bp, Mus musculus
atgggtccacgtcctgcagctgctg

SEQ ID NO: 543083 - DNA, 25 bp, Mus musculus
atgggtccacgtgctgcagctgctg

SEQ ID NO: 543084 - DNA, 25 bp, Mus musculus
atgggtcccacgagcgcgaagaagc

SEQ ID NO: 543085 - DNA, 25 bp, Mus musculus
atgggtcccacgtgcgcgaagaagc

SEQ ID NO: 543086 - DNA, 25 bp, Mus musculus
atgggtcccctgaactgcctctgct

SEQ ID NO: 543087 - DNA, 25 bp, Mus musculus
atgggtcccctgtactgcctctgct

SEQ ID NO: 543088 - DNA, 25 bp, Mus musculus
atgggtcgagtgactctctttggtg

SEQ ID NO: 543089 - DNA, 25 bp, Mus musculus
atgggtcgagtgtctctctttggtg

SEQ ID NO: 543090 - DNA, 25 bp, Mus musculus
atgggtctgtggaaacagcctcgag

SEQ ID NO: 543091 - DNA, 25 bp, Mus musculus
atgggtctgtggtaacagcctcgag

SEQ ID NO: 543092 - DNA, 25 bp, Mus musculus
atgggtcttatgacattggcatggc

SEQ ID NO: 543093 - DNA, 25 bp, Mus musculus
atgggtcttatgtcattggcatggc

SEQ ID NO: 543094 - DNA, 25 bp, Mus musculus
atgggtgctggaatctgcctgctga

SEQ ID NO: 543095 - DNA, 25 bp, Mus musculus
atgggtgctggattctgcctgctga

SEQ ID NO: 543096 - DNA, 25 bp, Mus musculus
atgggtggcaccaaccagcatccag

SEQ ID NO: 543097 - DNA, 25 bp, Mus musculus
atgggtggcacctaccagcatccag

SEQ ID NO: 543098 - DNA, 25 bp, Mus musculus
atgggtgtcatcagtgggcctctcc

SEQ ID NO: 543099 - DNA, 25 bp, Mus musculus
atgggtgtcatctgtgggcctctcc

SEQ ID NO: 543100 - DNA, 25 bp, Mus musculus
atgggtttcacccagttctctgttt

SEQ ID NO: 543101 - DNA, 25 bp, Mus musculus
atgggtttcaccgagttctctgttt

SEQ ID NO: 543102 - DNA, 25 bp, Mus musculus
atggtaacgcacagcagccgcaagg

SEQ ID NO: 543103 - DNA, 25 bp, Mus musculus
atggtaacgcactgcagccgcaagg

SEQ ID NO: 543104 - DNA, 25 bp, Mus musculus
atggtacaggtcaggtggcctccca

SEQ ID NO: 543105 - DNA, 25 bp, Mus musculus
atggtacaggtctggtggcctccca

SEQ ID NO: 543106 - DNA, 25 bp, Mus musculus
atggtaccacaacaacattacgaga

SEQ ID NO: 543107 - DNA, 25 bp, Mus musculus
atggtaccacaagaacattacgaga

SEQ ID NO: 543108 - DNA, 25 bp, Mus musculus
atggtacccatgcagcttcccaggg

SEQ ID NO: 543109 - DNA, 25 bp, Mus musculus
atggtacccatggagcttcccaggg

SEQ ID NO: 543110 - DNA, 25 bp, Mus musculus
atggtacccgctcctgcacatactg

SEQ ID NO: 543111 - DNA, 25 bp, Mus musculus
atggtacccgctgctgcacatactg

SEQ ID NO: 543112 - DNA, 25 bp, Mus musculus
atggtactaccaatgaagggcatgt

SEQ ID NO: 543113 - DNA, 25 bp, Mus musculus
atggtactaccattgaagggcatgt

SEQ ID NO: 543114 - DNA, 25 bp, Mus musculus
atggtagtcagcacgtggcgcgacc

SEQ ID NO: 543115 - DNA, 25 bp, Mus musculus
atggtagtcagctcgtggcgcgacc

SEQ ID NO: 543116 - DNA, 25 bp, Mus musculus
atggtcaagacacaatgacatgtac

SEQ ID NO: 543117 - DNA, 25 bp, Mus musculus
atggtcaagacagaatgacatgtac

SEQ ID NO: 543118 - DNA, 25 bp, Mus musculus
atggtcaccagaaggtcataagttg

SEQ ID NO: 543119 - DNA, 25 bp, Mus musculus
atggtcaccagatggtcataagttg

SEQ ID NO: 543120 - DNA, 25 bp, Mus musculus
atggtcacccacagcaagtttcccg

SEQ ID NO: 543121 - DNA, 25 bp, Mus musculus
atggtcacccactgcaagtttcccg

SEQ ID NO: 543122 - DNA, 25 bp, Mus musculus
atggtcagctccacaccattctgag

SEQ ID NO: 543123 - DNA, 25 bp, Mus musculus
atggtcagctcctcaccattctgag

SEQ ID NO: 543124 - DNA, 25 bp, Mus musculus
atggtcaggacgcactctctgtggc

SEQ ID NO: 543125 - DNA, 25 bp, Mus musculus
atggtcaggacggactctctgtggc

SEQ ID NO: 543126 - DNA, 25 bp, Mus musculus
atggtcatcaatcgcctggagaagt

SEQ ID NO: 543127 - DNA, 25 bp, Mus musculus
atggtcatcaatggcctggagaagt

SEQ ID NO: 543128 - DNA, 25 bp, Mus musculus
atggtccagagccaggaggcaccaa

SEQ ID NO: 543129 - DNA, 25 bp, Mus musculus
atggtccagagcgaggaggcaccaa

SEQ ID NO: 543130 - DNA, 25 bp, Mus musculus
atggtccatcaaagagactgctggg

SEQ ID NO: 543131 - DNA, 25 bp, Mus musculus
atggtccatcaatgagactgctggg

SEQ ID NO: 543132 - DNA, 25 bp, Mus musculus
atggtcccctgccttgcccaaaggg

SEQ ID NO: 543133 - DNA, 25 bp, Mus musculus
atggtcccctgcgttgcccaaaggg

SEQ ID NO: 543134 - DNA, 25 bp, Mus musculus
atggtccctgttccctacgagcaga

SEQ ID NO: 543135 - DNA, 25 bp, Mus musculus
atggtccctgttgcctacgagcaga

SEQ ID NO: 543136 - DNA, 25 bp, Mus musculus
atggtccgacccagagtgtggcgct

SEQ ID NO: 543137 - DNA, 25 bp, Mus musculus
atggtccgaccctgagtgtggcgct

SEQ ID NO: 543138 - DNA, 25 bp, Mus musculus
atggtcctaccaacgtggcccctat

SEQ ID NO: 543139 - DNA, 25 bp, Mus musculus
atggtcctaccatcgtggcccctat

SEQ ID NO: 543140 - DNA, 25 bp, Mus musculus
atggtcctcatgaacgactggagcg

SEQ ID NO: 543141 - DNA, 25 bp, Mus musculus
atggtcctcatgtacgactggagcg

SEQ ID NO: 543142 - DNA, 25 bp, Mus musculus
atggtccttgtcaccttctccgtta

SEQ ID NO: 543143 - DNA, 25 bp, Mus musculus
atggtccttgtctccttctccgtta

SEQ ID NO: 543144 - DNA, 25 bp, Mus musculus
atggtcgcggtcatgggagcctcaa

SEQ ID NO: 543145 - DNA, 25 bp, Mus musculus
atggtcgcggtcttgggagcctcaa

SEQ ID NO: 543146 - DNA, 25 bp, Mus musculus
atggtcgctcccaggactcggttct

SEQ ID NO: 543147 - DNA, 25 bp, Mus musculus
atggtcgctccctggactcggttct

SEQ ID NO: 543148 - DNA, 25 bp, Mus musculus
atggtcggctgcaggtgtcccatcg

SEQ ID NO: 543149 - DNA, 25 bp, Mus musculus
atggtcggctgctggtgtcccatcg

SEQ ID NO: 543150 - DNA, 25 bp, Mus musculus
atggtctccacaccacaggcgtcca

SEQ ID NO: 543151 - DNA, 25 bp, Mus musculus
atggtctccacagcacaggcgtcca

SEQ ID NO: 543152 - DNA, 25 bp, Mus musculus
atggtctcttccaacttcatgtacc

SEQ ID NO: 543153 - DNA, 25 bp, Mus musculus
atggtctcttcctacttcatgtacc

SEQ ID NO: 543154 - DNA, 25 bp, Mus musculus
atggtctggaccaacgtcacctccg

SEQ ID NO: 543155 - DNA, 25 bp, Mus musculus
atggtctggacctacgtcacctccg

SEQ ID NO: 543156 - DNA, 25 bp, Mus musculus
atggtctggcttcatatttggaaaa

SEQ ID NO: 543157 - DNA, 25 bp, Mus musculus
atggtctggcttgatatttggaaaa

SEQ ID NO: 543158 - DNA, 25 bp, Mus musculus
atggtctgtgttcccggatctgtga

SEQ ID NO: 543159 - DNA, 25 bp, Mus musculus
atggtctgtgttgccggatctgtga

SEQ ID NO: 543160 - DNA, 25 bp, Mus musculus
atggtcttcagcattgccacggtca

SEQ ID NO: 543161 - DNA, 25 bp, Mus musculus
atggtcttcagctttgccacggtca

SEQ ID NO: 543162 - DNA, 25 bp, Mus musculus
atggtgaccctgcacctaaaggaga

SEQ ID NO: 543163 - DNA, 25 bp, Mus musculus
atggtgaccctggacctaaaggaga

SEQ ID NO: 543164 - DNA, 25 bp, Mus musculus
atggtgacgatcactgcacccttcc

SEQ ID NO: 543165 - DNA, 25 bp, Mus musculus
atggtgacgatctctgcacccttcc

SEQ ID NO: 543166 - DNA, 25 bp, Mus musculus
atggtgactgccacaacaaccctgg

SEQ ID NO: 543167 - DNA, 25 bp, Mus musculus
atggtgactgcctcaacaaccctgg

SEQ ID NO: 543168 - DNA, 25 bp, Mus musculus
atggtgagcacaaggagaaggacct

SEQ ID NO: 543169 - DNA, 25 bp, Mus musculus
atggtgagcacatggagaaggacct

SEQ ID NO: 543170 - DNA, 25 bp, Mus musculus
atggtgagccacaaagttggcctgg

SEQ ID NO: 543171 - DNA, 25 bp, Mus musculus
atggtgagccactaagttggcctgg

SEQ ID NO: 543172 - DNA, 25 bp, Mus musculus
atggtgagtgccagactgtcccagg

SEQ ID NO: 543173 - DNA, 25 bp, Mus musculus
atggtgagtgcctgactgtcccagg

SEQ ID NO: 543174 - DNA, 25 bp, Mus musculus
atggtgcagcccagtggtggcccag

SEQ ID NO: 543175 - DNA, 25 bp, Mus musculus
atggtgcagccctgtggtggcccag

SEQ ID NO: 543176 - DNA, 25 bp, Mus musculus
atggtgccagcgagatcctccgaga

SEQ ID NO: 543177 - DNA, 25 bp, Mus musculus
atggtgccagcgtgatcctccgaga

SEQ ID NO: 543178 - DNA, 25 bp, Mus musculus
atggtgccatacaagcctttgacag

SEQ ID NO: 543179 - DNA, 25 bp, Mus musculus
atggtgccatactagcctttgacag

SEQ ID NO: 543180 - DNA, 25 bp, Mus musculus
atggtgccttctatatgccggtcgc

SEQ ID NO: 543181 - DNA, 25 bp, Mus musculus
atggtgccttctttatgccggtcgc

SEQ ID NO: 543182 - DNA, 25 bp, Mus musculus
atggtgcgcaaacatacatgcaggt

SEQ ID NO: 543183 - DNA, 25 bp, Mus musculus
atggtgcgcaaagatacatgcaggt

SEQ ID NO: 543184 - DNA, 25 bp, Mus musculus
atggtgcggcttcgagagccagact

SEQ ID NO: 543185 - DNA, 25 bp, Mus musculus
atggtgcggcttggagagccagact

SEQ ID NO: 543186 - DNA, 25 bp, Mus musculus
atggtggacagcctgtaccgtaccc

SEQ ID NO: 543187 - DNA, 25 bp, Mus musculus
atggtggacagcgtgtaccgtaccc

SEQ ID NO: 543188 - DNA, 25 bp, Mus musculus
atggtggctcatactggtgtgtctg

SEQ ID NO: 543189 - DNA, 25 bp, Mus musculus
atggtggctcattctggtgtgtctg

SEQ ID NO: 543190 - DNA, 25 bp, Mus musculus
atggtgggcccactatcttgagagc

SEQ ID NO: 543191 - DNA, 25 bp, Mus musculus
atggtgggcccagtatcttgagagc

SEQ ID NO: 543192 - DNA, 25 bp, Mus musculus
atggtggtttctatgcgctgtatag

SEQ ID NO: 543193 - DNA, 25 bp, Mus musculus
atggtggtttctttgcgctgtatag

SEQ ID NO: 543194 - DNA, 25 bp, Mus musculus
atggtgtcaacccagtcaaggccca

SEQ ID NO: 543195 - DNA, 25 bp, Mus musculus
atggtgtcaaccgagtcaaggccca

SEQ ID NO: 543196 - DNA, 25 bp, Mus musculus
atggtgtcagggacatggacgccaa

SEQ ID NO: 543197 - DNA, 25 bp, Mus musculus
atggtgtcagggtcatggacgccaa

SEQ ID NO: 543198 - DNA, 25 bp, Mus musculus
atggtgtcaggtaccaacgtgtatg

SEQ ID NO: 543199 - DNA, 25 bp, Mus musculus
atggtgtcaggttccaacgtgtatg

SEQ ID NO: 543200 - DNA, 25 bp, Mus musculus
atggtgtccgaaccttcaggctgga

SEQ ID NO: 543201 - DNA, 25 bp, Mus musculus
atggtgtccgaagcttcaggctgga

SEQ ID NO: 543202 - DNA, 25 bp, Mus musculus
atggtgtgttgcataggaagctcct

SEQ ID NO: 543203 - DNA, 25 bp, Mus musculus
atggtgtgttgcttaggaagctcct

SEQ ID NO: 543204 - DNA, 25 bp, Mus musculus
atggttaccttcagccacgtctcca

SEQ ID NO: 543205 - DNA, 25 bp, Mus musculus
atggttaccttctgccacgtctcca

SEQ ID NO: 543206 - DNA, 25 bp, Mus musculus
atggttatattaaaacaactgccgt

SEQ ID NO: 543207 - DNA, 25 bp, Mus musculus
atggttatattataacaactgccgt

SEQ ID NO: 543208 - DNA, 25 bp, Mus musculus
atggttatgtccatcggagttacct

SEQ ID NO: 543209 - DNA, 25 bp, Mus musculus
atggttatgtccttcggagttacct

SEQ ID NO: 543210 - DNA, 25 bp, Mus musculus
atggttcacatccttctgttctaca

SEQ ID NO: 543211 - DNA, 25 bp, Mus musculus
atggttcacatcgttctgttctaca

SEQ ID NO: 543212 - DNA, 25 bp, Mus musculus
atggttccaccaacgtcacacactg

SEQ ID NO: 543213 - DNA, 25 bp, Mus musculus
atggttccaccatcgtcacacactg

SEQ ID NO: 543214 - DNA, 25 bp, Mus musculus
atggttcctacacatgtctctgtcc

SEQ ID NO: 543215 - DNA, 25 bp, Mus musculus
atggttcctacagatgtctctgtcc

SEQ ID NO: 543216 - DNA, 25 bp, Mus musculus
atggttcgaggacacccaagggcca

SEQ ID NO: 543217 - DNA, 25 bp, Mus musculus
atggttcgaggagacccaagggcca

SEQ ID NO: 543218 - DNA, 25 bp, Mus musculus
atggttgaccagcacagcccagaag

SEQ ID NO: 543219 - DNA, 25 bp, Mus musculus
atggttgaccaggacagcccagaag

SEQ ID NO: 543220 - DNA, 25 bp, Mus musculus
atggttgccagcagctgccgtggac

SEQ ID NO: 543221 - DNA, 25 bp, Mus musculus
atggttgccagctgctgccgtggac

SEQ ID NO: 543222 - DNA, 25 bp, Mus musculus
atggttgcccaacccaagcgcaggg

SEQ ID NO: 543223 - DNA, 25 bp, Mus musculus
atggttgcccaagccaagcgcaggg

SEQ ID NO: 543224 - DNA, 25 bp, Mus musculus
atggttgctaagacactctggctcg

SEQ ID NO: 543225 - DNA, 25 bp, Mus musculus
atggttgctaagtcactctggctcg

SEQ ID NO: 543226 - DNA, 25 bp, Mus musculus
atggttgctacgaggtcagcgtgct

SEQ ID NO: 543227 - DNA, 25 bp, Mus musculus
atggttgctacgtggtcagcgtgct

SEQ ID NO: 543228 - DNA, 25 bp, Mus musculus
atggttggtaaacgcttctccctag

SEQ ID NO: 543229 - DNA, 25 bp, Mus musculus
atggttggtaaaggcttctccctag

SEQ ID NO: 543230 - DNA, 25 bp, Mus musculus
atggttgtgcctccccaggaacctg

SEQ ID NO: 543231 - DNA, 25 bp, Mus musculus
atggttgtgcctgcccaggaacctg

SEQ ID NO: 543232 - DNA, 25 bp, Mus musculus
atggtttccacaacccacccaaatg

SEQ ID NO: 543233 - DNA, 25 bp, Mus musculus
atggtttccacatcccacccaaatg

SEQ ID NO: 543234 - DNA, 25 bp, Mus musculus
atggtttgctccacggctgccaaga

SEQ ID NO: 543235 - DNA, 25 bp, Mus musculus
atggtttgctcctcggctgccaaga

SEQ ID NO: 543236 - DNA, 25 bp, Mus musculus
atggttttcaaaaccatgctgagac

SEQ ID NO: 543237 - DNA, 25 bp, Mus musculus
atggttttcaaatccatgctgagac

SEQ ID NO: 543238 - DNA, 25 bp, Mus musculus
atggtttttgatcatcctgtgaaaa

SEQ ID NO: 543239 - DNA, 25 bp, Mus musculus
atggtttttgatgatcctgtgaaaa

SEQ ID NO: 543240 - DNA, 25 bp, Mus musculus
atgtaactcaaacctggaccccaca

SEQ ID NO: 543241 - DNA, 25 bp, Mus musculus
atgtaactcaaagctggaccccaca

SEQ ID NO: 543242 - DNA, 25 bp, Mus musculus
atgtaactgtaaccagatcggctct

SEQ ID NO: 543243 - DNA, 25 bp, Mus musculus
atgtaactgtaagcagatcggctct

SEQ ID NO: 543244 - DNA, 25 bp, Mus musculus
atgtaagcccctcctcatggagtgg

SEQ ID NO: 543245 - DNA, 25 bp, Mus musculus
atgtaagcccctgctcatggagtgg

SEQ ID NO: 543246 - DNA, 25 bp, Mus musculus
atgtacaccacgctgatcgccatga

SEQ ID NO: 543247 - DNA, 25 bp, Mus musculus
atgtacaccacggtgatcgccatga

SEQ ID NO: 543248 - DNA, 25 bp, Mus musculus
atgtaccatgatcccagccgatggg

SEQ ID NO: 543249 - DNA, 25 bp, Mus musculus
atgtaccatgatgccagccgatggg

SEQ ID NO: 543250 - DNA, 25 bp, Mus musculus
atgtacccacctacatacctggagc

SEQ ID NO: 543251 - DNA, 25 bp, Mus musculus
atgtacccaccttcatacctggagc

SEQ ID NO: 543252 - DNA, 25 bp, Mus musculus
atgtaccctggtcatggccctctgc

SEQ ID NO: 543253 - DNA, 25 bp, Mus musculus
atgtaccctggtgatggccctctgc

SEQ ID NO: 543254 - DNA, 25 bp, Mus musculus
atgtacgatggcaccaaggaagtgc

SEQ ID NO: 543255 - DNA, 25 bp, Mus musculus
atgtacgatggctccaaggaagtgc

SEQ ID NO: 543256 - DNA, 25 bp, Mus musculus
atgtacgtggcaccggccgccttcg

SEQ ID NO: 543257 - DNA, 25 bp, Mus musculus
atgtacgtggcagcggccgccttcg

SEQ ID NO: 543258 - DNA, 25 bp, Mus musculus
atgtagaaattgctgagctgcaccg

SEQ ID NO: 543259 - DNA, 25 bp, Mus musculus
atgtagaaattggtgagctgcaccg

SEQ ID NO: 543260 - DNA, 25 bp, Mus musculus
atgtagaagccgaaacaatgtacag

SEQ ID NO: 543261 - DNA, 25 bp, Mus musculus
atgtagaagccgtaacaatgtacag

SEQ ID NO: 543262 - DNA, 25 bp, Mus musculus
atgtagccagtgatgagatcgccca

SEQ ID NO: 543263 - DNA, 25 bp, Mus musculus
atgtagccagtgttgagatcgccca

SEQ ID NO: 543264 - DNA, 25 bp, Mus musculus
atgtagctggtacaatacatcaaag

SEQ ID NO: 543265 - DNA, 25 bp, Mus musculus
atgtagctggtagaatacatcaaag

SEQ ID NO: 543266 - DNA, 25 bp, Mus musculus
atgtagctgtggactctggaggaca

SEQ ID NO: 543267 - DNA, 25 bp, Mus musculus
atgtagctgtggtctctggaggaca

SEQ ID NO: 543268 - DNA, 25 bp, Mus musculus
atgtagtgacgaaattgaagttctc

SEQ ID NO: 543269 - DNA, 25 bp, Mus musculus
atgtagtgacgatattgaagttctc

SEQ ID NO: 543270 - DNA, 25 bp, Mus musculus
atgtagtttaatcgctttacaaaga

SEQ ID NO: 543271 - DNA, 25 bp, Mus musculus
atgtagtttaatggctttacaaaga

SEQ ID NO: 543272 - DNA, 25 bp, Mus musculus
atgtatatcaggaactgctgtgatg

SEQ ID NO: 543273 - DNA, 25 bp, Mus musculus
atgtatatcaggtactgctgtgatg

SEQ ID NO: 543274 - DNA, 25 bp, Mus musculus
atgtatgaagccctgcatggtcccc

SEQ ID NO: 543275 - DNA, 25 bp, Mus musculus
atgtatgaagccgtgcatggtcccc

SEQ ID NO: 543276 - DNA, 25 bp, Mus musculus
atgtattggtcgctggtcctgcccc

SEQ ID NO: 543277 - DNA, 25 bp, Mus musculus
atgtattggtcggtggtcctgcccc

SEQ ID NO: 543278 - DNA, 25 bp, Mus musculus
atgtatttgatactgagctgaaggg

SEQ ID NO: 543279 - DNA, 25 bp, Mus musculus
atgtatttgatagtgagctgaaggg

SEQ ID NO: 543280 - DNA, 25 bp, Mus musculus
atgtattttgttcctccggcggaac

SEQ ID NO: 543281 - DNA, 25 bp, Mus musculus
atgtattttgttgctccggcggaac

SEQ ID NO: 543282 - DNA, 25 bp, Mus musculus
atgtcaaaggtgacaccatttcagt

SEQ ID NO: 543283 - DNA, 25 bp, Mus musculus
atgtcaaaggtgtcaccatttcagt

SEQ ID NO: 543284 - DNA, 25 bp, Mus musculus
atgtcaacacccagggccaattctg

SEQ ID NO: 543285 - DNA, 25 bp, Mus musculus
atgtcaacaccctgggccaattctg

SEQ ID NO: 543286 - DNA, 25 bp, Mus musculus
atgtcaacagacaatgagctttcag

SEQ ID NO: 543287 - DNA, 25 bp, Mus musculus
atgtcaacagactatgagctttcag

SEQ ID NO: 543288 - DNA, 25 bp, Mus musculus
atgtcaacatcccttagtgggcggg

SEQ ID NO: 543289 - DNA, 25 bp, Mus musculus
atgtcaacatccgttagtgggcggg

SEQ ID NO: 543290 - DNA, 25 bp, Mus musculus
atgtcaacgaatcctccgagggtac

SEQ ID NO: 543291 - DNA, 25 bp, Mus musculus
atgtcaacgaatgctccgagggtac

SEQ ID NO: 543292 - DNA, 25 bp, Mus musculus
atgtcaacgccaagtctcgagtccg

SEQ ID NO: 543293 - DNA, 25 bp, Mus musculus
atgtcaacgccatgtctcgagtccg

SEQ ID NO: 543294 - DNA, 25 bp, Mus musculus
atgtcaagtccgagccaaacctgca

SEQ ID NO: 543295 - DNA, 25 bp, Mus musculus
atgtcaagtccgtgccaaacctgca

SEQ ID NO: 543296 - DNA, 25 bp, Mus musculus
atgtcacacctgaacacagacaggc

SEQ ID NO: 543297 - DNA, 25 bp, Mus musculus
atgtcacacctgtacacagacaggc

SEQ ID NO: 543298 - DNA, 25 bp, Mus musculus
atgtcacagtgcagaatgtgctgca

SEQ ID NO: 543299 - DNA, 25 bp, Mus musculus
atgtcacagtgctgaatgtgctgca

SEQ ID NO: 543300 - DNA, 25 bp, Mus musculus
atgtcacagttcacaccagctccgg

SEQ ID NO: 543301 - DNA, 25 bp, Mus musculus
atgtcacagttctcaccagctccgg

SEQ ID NO: 543302 - DNA, 25 bp, Mus musculus
atgtcacataagataggtgatccag

SEQ ID NO: 543303 - DNA, 25 bp, Mus musculus
atgtcacataagttaggtgatccag

SEQ ID NO: 543304 - DNA, 25 bp, Mus musculus
atgtcaccaacaacctcaagtctct

SEQ ID NO: 543305 - DNA, 25 bp, Mus musculus
atgtcaccaacatcctcaagtctct

SEQ ID NO: 543306 - DNA, 25 bp, Mus musculus
atgtcacctgtacggttgatggaaa

SEQ ID NO: 543307 - DNA, 25 bp, Mus musculus
atgtcacctgtagggttgatggaaa

SEQ ID NO: 543308 - DNA, 25 bp, Mus musculus
atgtcactagagcagaccaaggaac

SEQ ID NO: 543309 - DNA, 25 bp, Mus musculus
atgtcactagaggagaccaaggaac

SEQ ID NO: 543310 - DNA, 25 bp, Mus musculus
atgtcactgtccagtcgcctgtgtc

SEQ ID NO: 543311 - DNA, 25 bp, Mus musculus
atgtcactgtcctgtcgcctgtgtc

SEQ ID NO: 543312 - DNA, 25 bp, Mus musculus
atgtcagccaagcacgagcgggcca

SEQ ID NO: 543313 - DNA, 25 bp, Mus musculus
atgtcagccaaggacgagcgggcca

SEQ ID NO: 543314 - DNA, 25 bp, Mus musculus
atgtcaggccaaccaggcgtcagct

SEQ ID NO: 543315 - DNA, 25 bp, Mus musculus
atgtcaggccaagcaggcgtcagct

SEQ ID NO: 543316 - DNA, 25 bp, Mus musculus
atgtcaggcccacgctggagacgct

SEQ ID NO: 543317 - DNA, 25 bp, Mus musculus
atgtcaggcccaggctggagacgct

SEQ ID NO: 543318 - DNA, 25 bp, Mus musculus
atgtcaggccggcaaccatccttgg

SEQ ID NO: 543319 - DNA, 25 bp, Mus musculus
atgtcaggccgggaaccatccttgg

SEQ ID NO: 543320 - DNA, 25 bp, Mus musculus
atgtcaggttctccgcgtataggac

SEQ ID NO: 543321 - DNA, 25 bp, Mus musculus
atgtcaggttctgcgcgtataggac

SEQ ID NO: 543322 - DNA, 25 bp, Mus musculus
atgtcagtggacagctcaactccac

SEQ ID NO: 543323 - DNA, 25 bp, Mus musculus
atgtcagtggactgctcaactccac

SEQ ID NO: 543324 - DNA, 25 bp, Mus musculus
atgtcatccacaaatacttcctgcc

SEQ ID NO: 543325 - DNA, 25 bp, Mus musculus
atgtcatccacatatacttcctgcc

SEQ ID NO: 543326 - DNA, 25 bp, Mus musculus
atgtcatgacccactacctaccaag

SEQ ID NO: 543327 - DNA, 25 bp, Mus musculus
atgtcatgaccctctacctaccaag

SEQ ID NO: 543328 - DNA, 25 bp, Mus musculus
atgtcatgaggaacatcaatgagcc

SEQ ID NO: 543329 - DNA, 25 bp, Mus musculus
atgtcatgaggatcatcaatgagcc

SEQ ID NO: 543330 - DNA, 25 bp, Mus musculus
atgtcatggcgaagaccgagtcccc

SEQ ID NO: 543331 - DNA, 25 bp, Mus musculus
atgtcatggcgatgaccgagtcccc

SEQ ID NO: 543332 - DNA, 25 bp, Mus musculus
atgtcattgcgccactcatgacccg

SEQ ID NO: 543333 - DNA, 25 bp, Mus musculus
atgtcattgcgcgactcatgacccg

SEQ ID NO: 543334 - DNA, 25 bp, Mus musculus
atgtcattggccaccccatcgggat

SEQ ID NO: 543335 - DNA, 25 bp, Mus musculus
atgtcattggcctccccatcgggat

SEQ ID NO: 543336 - DNA, 25 bp, Mus musculus
atgtccaagagcatccgccagccgg

SEQ ID NO: 543337 - DNA, 25 bp, Mus musculus
atgtccaagagcttccgccagccgg

SEQ ID NO: 543338 - DNA, 25 bp, Mus musculus
atgtccaagggccatgcagatacca

SEQ ID NO: 543339 - DNA, 25 bp, Mus musculus
atgtccaagggcgatgcagatacca

SEQ ID NO: 543340 - DNA, 25 bp, Mus musculus
atgtccacgcctctccattgactgg

SEQ ID NO: 543341 - DNA, 25 bp, Mus musculus
atgtccacgcctgtccattgactgg

SEQ ID NO: 543342 - DNA, 25 bp, Mus musculus
atgtccagggtacaggccatcggca

SEQ ID NO: 543343 - DNA, 25 bp, Mus musculus
atgtccagggtagaggccatcggca

SEQ ID NO: 543344 - DNA, 25 bp, Mus musculus
atgtccatgcagagccccgtctctg

SEQ ID NO: 543345 - DNA, 25 bp, Mus musculus
atgtccatgcagtgccccgtctctg

SEQ ID NO: 543346 - DNA, 25 bp, Mus musculus
atgtcccggccaaccttgagcagga

SEQ ID NO: 543347 - DNA, 25 bp, Mus musculus
atgtcccggccatccttgagcagga

SEQ ID NO: 543348 - DNA, 25 bp, Mus musculus
atgtccctaccccaggcaatgctga

SEQ ID NO: 543349 - DNA, 25 bp, Mus musculus
atgtccctacccgaggcaatgctga

SEQ ID NO: 543350 - DNA, 25 bp, Mus musculus
atgtccctatgaccccaagctggac

SEQ ID NO: 543351 - DNA, 25 bp, Mus musculus
atgtccctatgagcccaagctggac

SEQ ID NO: 543352 - DNA, 25 bp, Mus musculus
atgtccctgtctcttcagaactgtc

SEQ ID NO: 543353 - DNA, 25 bp, Mus musculus
atgtccctgtctgttcagaactgtc

SEQ ID NO: 543354 - DNA, 25 bp, Mus musculus
atgtcccttatgctgtgggcaaagc

SEQ ID NO: 543355 - DNA, 25 bp, Mus musculus
atgtcccttatggtgtgggcaaagc

SEQ ID NO: 543356 - DNA, 25 bp, Mus musculus
atgtccgacgtgaacctccgcagca

SEQ ID NO: 543357 - DNA, 25 bp, Mus musculus
atgtccgacgtgtacctccgcagca

SEQ ID NO: 543358 - DNA, 25 bp, Mus musculus
atgtccgctccacactgtcctgaaa

SEQ ID NO: 543359 - DNA, 25 bp, Mus musculus
atgtccgctccagactgtcctgaaa

SEQ ID NO: 543360 - DNA, 25 bp, Mus musculus
atgtcctaccttcctggtatgagta

SEQ ID NO: 543361 - DNA, 25 bp, Mus musculus
atgtcctaccttgctggtatgagta

SEQ ID NO: 543362 - DNA, 25 bp, Mus musculus
atgtcctgaccaccggaggcgggaa

SEQ ID NO: 543363 - DNA, 25 bp, Mus musculus
atgtcctgaccagcggaggcgggaa

SEQ ID NO: 543364 - DNA, 25 bp, Mus musculus
atgtcctgagagatgcgtgcctggt

SEQ ID NO: 543365 - DNA, 25 bp, Mus musculus
atgtcctgagagttgcgtgcctggt

SEQ ID NO: 543366 - DNA, 25 bp, Mus musculus
atgtcctgcattaaagacgtggcca

SEQ ID NO: 543367 - DNA, 25 bp, Mus musculus
atgtcctgcatttaagacgtggcca

SEQ ID NO: 543368 - DNA, 25 bp, Mus musculus
atgtccttcccaccaggagggccgt

SEQ ID NO: 543369 - DNA, 25 bp, Mus musculus
atgtccttcccagcaggagggccgt

SEQ ID NO: 543370 - DNA, 25 bp, Mus musculus
atgtccttcggacttacctggtgga

SEQ ID NO: 543371 - DNA, 25 bp, Mus musculus
atgtccttcggagttacctggtgga

SEQ ID NO: 543372 - DNA, 25 bp, Mus musculus
atgtccttgcagatggatcgcaggg

SEQ ID NO: 543373 - DNA, 25 bp, Mus musculus
atgtccttgcagttggatcgcaggg

SEQ ID NO: 543374 - DNA, 25 bp, Mus musculus
atgtccttgtgacgccagagcttct

SEQ ID NO: 543375 - DNA, 25 bp, Mus musculus
atgtccttgtgaggccagagcttct

SEQ ID NO: 543376 - DNA, 25 bp, Mus musculus
atgtcgcactggctgccgttctggt

SEQ ID NO: 543377 - DNA, 25 bp, Mus musculus
atgtcgcactgggtgccgttctggt

SEQ ID NO: 543378 - DNA, 25 bp, Mus musculus
atgtcgcagagcacccagacaagcg

SEQ ID NO: 543379 - DNA, 25 bp, Mus musculus
atgtcgcagagctcccagacaagcg

SEQ ID NO: 543380 - DNA, 25 bp, Mus musculus
atgtcggccggccaggtggagcgcc

SEQ ID NO: 543381 - DNA, 25 bp, Mus musculus
atgtcggccggcgaggtggagcgcc

SEQ ID NO: 543382 - DNA, 25 bp, Mus musculus
atgtcgggccgcacagtgccacacg

SEQ ID NO: 543383 - DNA, 25 bp, Mus musculus
atgtcgggccgctcagtgccacacg

SEQ ID NO: 543384 - DNA, 25 bp, Mus musculus
atgtcgtttggtcactttaaagccg

SEQ ID NO: 543385 - DNA, 25 bp, Mus musculus
atgtcgtttggtgactttaaagccg

SEQ ID NO: 543386 - DNA, 25 bp, Mus musculus
atgtctcctgccagtccgtccaggg

SEQ ID NO: 543387 - DNA, 25 bp, Mus musculus
atgtctcctgcctgtccgtccaggg

SEQ ID NO: 543388 - DNA, 25 bp, Mus musculus
atgtctcgacccctgcttggcttaa

SEQ ID NO: 543389 - DNA, 25 bp, Mus musculus
atgtctcgacccgtgcttggcttaa

SEQ ID NO: 543390 - DNA, 25 bp, Mus musculus
atgtctcggcgcaactggaacgcgt

SEQ ID NO: 543391 - DNA, 25 bp, Mus musculus
atgtctcggcgctactggaacgcgt

SEQ ID NO: 543392 - DNA, 25 bp, Mus musculus
atgtctctcaagattactgtttcaa

SEQ ID NO: 543393 - DNA, 25 bp, Mus musculus
atgtctctcaagtttactgtttcaa

SEQ ID NO: 543394 - DNA, 25 bp, Mus musculus
atgtctctcttcagagcactgcagg

SEQ ID NO: 543395 - DNA, 25 bp, Mus musculus
atgtctctcttctgagcactgcagg

SEQ ID NO: 543396 - DNA, 25 bp, Mus musculus
atgtctctgcaaccccggctataag

SEQ ID NO: 543397 - DNA, 25 bp, Mus musculus
atgtctctgcaagcccggctataag

SEQ ID NO: 543398 - DNA, 25 bp, Mus musculus
atgtctctggcaacctggactcacc

SEQ ID NO: 543399 - DNA, 25 bp, Mus musculus
atgtctctggcatcctggactcacc

SEQ ID NO: 543400 - DNA, 25 bp, Mus musculus
atgtctctgtgtacgcccggcctgg

SEQ ID NO: 543401 - DNA, 25 bp, Mus musculus
atgtctctgtgttcgcccggcctgg

SEQ ID NO: 543402 - DNA, 25 bp, Mus musculus
atgtctctttatccatctcttgaag

SEQ ID NO: 543403 - DNA, 25 bp, Mus musculus
atgtctctttatgcatctcttgaag

SEQ ID NO: 543404 - DNA, 25 bp, Mus musculus
atgtctgcattgaccctgaaaaatt

SEQ ID NO: 543405 - DNA, 25 bp, Mus musculus
atgtctgcattgtccctgaaaaatt

SEQ ID NO: 543406 - DNA, 25 bp, Mus musculus
atgtctgtcaggcttatgtccacca

SEQ ID NO: 543407 - DNA, 25 bp, Mus musculus
atgtctgtcagggttatgtccacca

SEQ ID NO: 543408 - DNA, 25 bp, Mus musculus
atgtctgttatcctcggcatcatcc

SEQ ID NO: 543409 - DNA, 25 bp, Mus musculus
atgtctgttatcgtcggcatcatcc

SEQ ID NO: 543410 - DNA, 25 bp, Mus musculus
atgtgaaaacaaacctggcagcttc

SEQ ID NO: 543411 - DNA, 25 bp, Mus musculus
atgtgaaaacaatcctggcagcttc

SEQ ID NO: 543412 - DNA, 25 bp, Mus musculus
atgtgaaagcaactcctaagagagg

SEQ ID NO: 543413 - DNA, 25 bp, Mus musculus
atgtgaaagcaagtcctaagagagg

SEQ ID NO: 543414 - DNA, 25 bp, Mus musculus
atgtgaaccacaaccggaccagtcc

SEQ ID NO: 543415 - DNA, 25 bp, Mus musculus
atgtgaaccacatccggaccagtcc

SEQ ID NO: 543416 - DNA, 25 bp, Mus musculus
atgtgaacgaatcctgggtctcgcc

SEQ ID NO: 543417 - DNA, 25 bp, Mus musculus
atgtgaacgaatgctgggtctcgcc

SEQ ID NO: 543418 - DNA, 25 bp, Mus musculus
atgtgaactgccaggctgcaatatt

SEQ ID NO: 543419 - DNA, 25 bp, Mus musculus
atgtgaactgcctggctgcaatatt

SEQ ID NO: 543420 - DNA, 25 bp, Mus musculus
atgtgaagagacaccggccacggct

SEQ ID NO: 543421 - DNA, 25 bp, Mus musculus
atgtgaagagactccggccacggct

SEQ ID NO: 543422 - DNA, 25 bp, Mus musculus
atgtgaaggattcctcctggtgcag

SEQ ID NO: 543423 - DNA, 25 bp, Mus musculus
atgtgaaggattgctcctggtgcag

SEQ ID NO: 543424 - DNA, 25 bp, Mus musculus
atgtgaagtggccattccccgcggt

SEQ ID NO: 543425 - DNA, 25 bp, Mus musculus
atgtgaagtggcgattccccgcggt

SEQ ID NO: 543426 - DNA, 25 bp, Mus musculus
atgtgaataagaacatcgccctggg

SEQ ID NO: 543427 - DNA, 25 bp, Mus musculus
atgtgaataagatcatcgccctggg

SEQ ID NO: 543428 - DNA, 25 bp, Mus musculus
atgtgaatcagtcctttgccccttc

SEQ ID NO: 543429 - DNA, 25 bp, Mus musculus
atgtgaatcagtgctttgccccttc

SEQ ID NO: 543430 - DNA, 25 bp, Mus musculus
atgtgacaatcacgtgtctgacaga

SEQ ID NO: 543431 - DNA, 25 bp, Mus musculus
atgtgacaatcaggtgtctgacaga

SEQ ID NO: 543432 - DNA, 25 bp, Mus musculus
atgtgacagaagctctcatcctcca

SEQ ID NO: 543433 - DNA, 25 bp, Mus musculus
atgtgacagaaggtctcatcctcca

SEQ ID NO: 543434 - DNA, 25 bp, Mus musculus
atgtgaccttgccattaaccgcgct

SEQ ID NO: 543435 - DNA, 25 bp, Mus musculus
atgtgaccttgcgattaaccgcgct

SEQ ID NO: 543436 - DNA, 25 bp, Mus musculus
atgtgactactgcagagaagcggcc

SEQ ID NO: 543437 - DNA, 25 bp, Mus musculus
atgtgactactggagagaagcggcc

SEQ ID NO: 543438 - DNA, 25 bp, Mus musculus
atgtgacttcccagcggcctgcatc

SEQ ID NO: 543439 - DNA, 25 bp, Mus musculus
atgtgacttccctgcggcctgcatc

SEQ ID NO: 543440 - DNA, 25 bp, Mus musculus
atgtgacttttgcagaggaagccct

SEQ ID NO: 543441 - DNA, 25 bp, Mus musculus
atgtgacttttggagaggaagccct

SEQ ID NO: 543442 - DNA, 25 bp, Mus musculus
atgtgagatcaccaaacggaggcgc

SEQ ID NO: 543443 - DNA, 25 bp, Mus musculus
atgtgagatcacgaaacggaggcgc

SEQ ID NO: 543444 - DNA, 25 bp, Mus musculus
atgtgagcgaggatgacccagacgt

SEQ ID NO: 543445 - DNA, 25 bp, Mus musculus
atgtgagcgaggttgacccagacgt

SEQ ID NO: 543446 - DNA, 25 bp, Mus musculus
atgtgaggcaccacacaggcgagaa

SEQ ID NO: 543447 - DNA, 25 bp, Mus musculus
atgtgaggcacctcacaggcgagaa

SEQ ID NO: 543448 - DNA, 25 bp, Mus musculus
atgtgaggcgccagagtgacacctg

SEQ ID NO: 543449 - DNA, 25 bp, Mus musculus
atgtgaggcgcctgagtgacacctg

SEQ ID NO: 543450 - DNA, 25 bp, Mus musculus
atgtgaggtttgactttggaaccac

SEQ ID NO: 543451 - DNA, 25 bp, Mus musculus
atgtgaggtttgtctttggaaccac

SEQ ID NO: 543452 - DNA, 25 bp, Mus musculus
atgtgagttccaccgggccaagtgc

SEQ ID NO: 543453 - DNA, 25 bp, Mus musculus
atgtgagttccagcgggccaagtgc

SEQ ID NO: 543454 - DNA, 25 bp, Mus musculus
atgtgatcagcaagagtgacgtgaa

SEQ ID NO: 543455 - DNA, 25 bp, Mus musculus
atgtgatcagcatgagtgacgtgaa

SEQ ID NO: 543456 - DNA, 25 bp, Mus musculus
atgtgcaggagtatgtgagaccaga

SEQ ID NO: 543457 - DNA, 25 bp, Mus musculus
atgtgcaggagtttgtgagaccaga

SEQ ID NO: 543458 - DNA, 25 bp, Mus musculus
atgtgcatgggcacacgaaggtcgt

SEQ ID NO: 543459 - DNA, 25 bp, Mus musculus
atgtgcatgggctcacgaaggtcgt

SEQ ID NO: 543460 - DNA, 25 bp, Mus musculus
atgtgccaaccacgtcagcaccatg

SEQ ID NO: 543461 - DNA, 25 bp, Mus musculus
atgtgccaaccaggtcagcaccatg

SEQ ID NO: 543462 - DNA, 25 bp, Mus musculus
atgtgccacgagagacagcccacag

SEQ ID NO: 543463 - DNA, 25 bp, Mus musculus
atgtgccacgagtgacagcccacag

SEQ ID NO: 543464 - DNA, 25 bp, Mus musculus
atgtgccagacacaaatccctaccg

SEQ ID NO: 543465 - DNA, 25 bp, Mus musculus
atgtgccagacagaaatccctaccg

SEQ ID NO: 543466 - DNA, 25 bp, Mus musculus
atgtgcccatccaagcagcctgttc

SEQ ID NO: 543467 - DNA, 25 bp, Mus musculus
atgtgcccatcctagcagcctgttc

SEQ ID NO: 543468 - DNA, 25 bp, Mus musculus
atgtgccctacaccctgtactcggt

SEQ ID NO: 543469 - DNA, 25 bp, Mus musculus
atgtgccctacagcctgtactcggt

SEQ ID NO: 543470 - DNA, 25 bp, Mus musculus
atgtgccgaaaaaacctacaaatca

SEQ ID NO: 543471 - DNA, 25 bp, Mus musculus
atgtgccgaaaatacctacaaatca

SEQ ID NO: 543472 - DNA, 25 bp, Mus musculus
atgtgccgggtaactacaccagagt

SEQ ID NO: 543473 - DNA, 25 bp, Mus musculus
atgtgccgggtatctacaccagagt

SEQ ID NO: 543474 - DNA, 25 bp, Mus musculus
atgtgccttgtccaggaaccgcctg

SEQ ID NO: 543475 - DNA, 25 bp, Mus musculus
atgtgccttgtcgaggaaccgcctg

SEQ ID NO: 543476 - DNA, 25 bp, Mus musculus
atgtgctcaagtctgcagagctggc

SEQ ID NO: 543477 - DNA, 25 bp, Mus musculus
atgtgctcaagtgtgcagagctggc

SEQ ID NO: 543478 - DNA, 25 bp, Mus musculus
atgtgctcatggctgccacggccct

SEQ ID NO: 543479 - DNA, 25 bp, Mus musculus
atgtgctcatgggtgccacggccct

SEQ ID NO: 543480 - DNA, 25 bp, Mus musculus
atgtgctcctggaggtcttccctac

SEQ ID NO: 543481 - DNA, 25 bp, Mus musculus
atgtgctcctggtggtcttccctac

SEQ ID NO: 543482 - DNA, 25 bp, Mus musculus
atgtgctcgtgtatctccaggaaaa

SEQ ID NO: 543483 - DNA, 25 bp, Mus musculus
atgtgctcgtgtttctccaggaaaa

SEQ ID NO: 543484 - DNA, 25 bp, Mus musculus
atgtgctctgcgctcccggaaacag

SEQ ID NO: 543485 - DNA, 25 bp, Mus musculus
atgtgctctgcggtcccggaaacag

SEQ ID NO: 543486 - DNA, 25 bp, Mus musculus
atgtggaaacagaaggttttccctg

SEQ ID NO: 543487 - DNA, 25 bp, Mus musculus
atgtggaaacagtaggttttccctg

SEQ ID NO: 543488 - DNA, 25 bp, Mus musculus
atgtggaataccagacagccttcag

SEQ ID NO: 543489 - DNA, 25 bp, Mus musculus
atgtggaatacctgacagccttcag

SEQ ID NO: 543490 - DNA, 25 bp, Mus musculus
atgtggacacctctggttttcagtg

SEQ ID NO: 543491 - DNA, 25 bp, Mus musculus
atgtggacacctgtggttttcagtg

SEQ ID NO: 543492 - DNA, 25 bp, Mus musculus
atgtggaccacgactttgtgggtga

SEQ ID NO: 543493 - DNA, 25 bp, Mus musculus
atgtggaccacgtctttgtgggtga

SEQ ID NO: 543494 - DNA, 25 bp, Mus musculus
atgtggaccactactgccccaactg

SEQ ID NO: 543495 - DNA, 25 bp, Mus musculus
atgtggaccacttctgccccaactg

SEQ ID NO: 543496 - DNA, 25 bp, Mus musculus
atgtggaccctgatccccagggtca

SEQ ID NO: 543497 - DNA, 25 bp, Mus musculus
atgtggaccctgttccccagggtca

SEQ ID NO: 543498 - DNA, 25 bp, Mus musculus
atgtggacgtctagccttgaagaca

SEQ ID NO: 543499 - DNA, 25 bp, Mus musculus
atgtggacgtcttgccttgaagaca

SEQ ID NO: 543500 - DNA, 25 bp, Mus musculus
atgtggagaagtacaaggaagcagc

SEQ ID NO: 543501 - DNA, 25 bp, Mus musculus
atgtggagaagttcaaggaagcagc

SEQ ID NO: 543502 - DNA, 25 bp, Mus musculus
atgtggagagagccaaagctctgaa

SEQ ID NO: 543503 - DNA, 25 bp, Mus musculus
atgtggagagaggcaaagctctgaa

SEQ ID NO: 543504 - DNA, 25 bp, Mus musculus
atgtggagcctgacacgtactgccg

SEQ ID NO: 543505 - DNA, 25 bp, Mus musculus
atgtggagcctgtcacgtactgccg

SEQ ID NO: 543506 - DNA, 25 bp, Mus musculus
atgtggaggagcaagacgctgcccc

SEQ ID NO: 543507 - DNA, 25 bp, Mus musculus
atgtggaggagctagacgctgcccc

SEQ ID NO: 543508 - DNA, 25 bp, Mus musculus
atgtggagtctgaccggtctccttg

SEQ ID NO: 543509 - DNA, 25 bp, Mus musculus
atgtggagtctgtccggtctccttg

SEQ ID NO: 543510 - DNA, 25 bp, Mus musculus
atgtggatgagcagaaccaggagca

SEQ ID NO: 543511 - DNA, 25 bp, Mus musculus
atgtggatgagctgaaccaggagca

SEQ ID NO: 543512 - DNA, 25 bp, Mus musculus
atgtggatgcctcagacttccctcc

SEQ ID NO: 543513 - DNA, 25 bp, Mus musculus
atgtggatgcctgagacttccctcc

SEQ ID NO: 543514 - DNA, 25 bp, Mus musculus
atgtggcaaacccaatacgccggga

SEQ ID NO: 543515 - DNA, 25 bp, Mus musculus
atgtggcaaaccgaatacgccggga

SEQ ID NO: 543516 - DNA, 25 bp, Mus musculus
atgtggcaagcgatgacaaggatgt

SEQ ID NO: 543517 - DNA, 25 bp, Mus musculus
atgtggcaagcgttgacaaggatgt

SEQ ID NO: 543518 - DNA, 25 bp, Mus musculus
atgtggccacggagaccaccaccag

SEQ ID NO: 543519 - DNA, 25 bp, Mus musculus
atgtggccacggtgaccaccaccag

SEQ ID NO: 543520 - DNA, 25 bp, Mus musculus
atgtggccagtgcagaagccctgct

SEQ ID NO: 543521 - DNA, 25 bp, Mus musculus
atgtggccagtggagaagccctgct

SEQ ID NO: 543522 - DNA, 25 bp, Mus musculus
atgtggcccggcaacttcgagagta

SEQ ID NO: 543523 - DNA, 25 bp, Mus musculus
atgtggcccggctacttcgagagta

SEQ ID NO: 543524 - DNA, 25 bp, Mus musculus
atgtggccgtagacttcagtgaaga

SEQ ID NO: 543525 - DNA, 25 bp, Mus musculus
atgtggccgtagtcttcagtgaaga

SEQ ID NO: 543526 - DNA, 25 bp, Mus musculus
atgtggcctaaaaagggtgggcaca

SEQ ID NO: 543527 - DNA, 25 bp, Mus musculus
atgtggcctaaatagggtgggcaca

SEQ ID NO: 543528 - DNA, 25 bp, Mus musculus
atgtggcctgtcacacggagagaaa

SEQ ID NO: 543529 - DNA, 25 bp, Mus musculus
atgtggcctgtctcacggagagaaa

SEQ ID NO: 543530 - DNA, 25 bp, Mus musculus
atgtggcgcgccactgcctgatcag

SEQ ID NO: 543531 - DNA, 25 bp, Mus musculus
atgtggcgcgcctctgcctgatcag

SEQ ID NO: 543532 - DNA, 25 bp, Mus musculus
atgtggctgatgacctatgttggtg

SEQ ID NO: 543533 - DNA, 25 bp, Mus musculus
atgtggctgatgtcctatgttggtg

SEQ ID NO: 543534 - DNA, 25 bp, Mus musculus
atgtgggacagcatgcaagaaggca

SEQ ID NO: 543535 - DNA, 25 bp, Mus musculus
atgtgggacagcttgcaagaaggca

SEQ ID NO: 543536 - DNA, 25 bp, Mus musculus
atgtgggacggaagcctcctacttt

SEQ ID NO: 543537 - DNA, 25 bp, Mus musculus
atgtgggacggatgcctcctacttt

SEQ ID NO: 543538 - DNA, 25 bp, Mus musculus
atgtgggtccccaccgaactcattg

SEQ ID NO: 543539 - DNA, 25 bp, Mus musculus
atgtgggtcccctccgaactcattg

SEQ ID NO: 543540 - DNA, 25 bp, Mus musculus
atgtggtacttaactggaatgtggg

SEQ ID NO: 543541 - DNA, 25 bp, Mus musculus
atgtggtacttatctggaatgtggg

SEQ ID NO: 543542 - DNA, 25 bp, Mus musculus
atgtggtcacgcacactggagagaa

SEQ ID NO: 543543 - DNA, 25 bp, Mus musculus
atgtggtcacgctcactggagagaa

SEQ ID NO: 543544 - DNA, 25 bp, Mus musculus
atgtggtcattgaggcagccccaga

SEQ ID NO: 543545 - DNA, 25 bp, Mus musculus
atgtggtcattgtggcagccccaga

SEQ ID NO: 543546 - DNA, 25 bp, Mus musculus
atgtggtgaagcctacgccccgcag

SEQ ID NO: 543547 - DNA, 25 bp, Mus musculus
atgtggtgaagcgtacgccccgcag

SEQ ID NO: 543548 - DNA, 25 bp, Mus musculus
atgtgtacaaacctgtcatggatca

SEQ ID NO: 543549 - DNA, 25 bp, Mus musculus
atgtgtacaaacgtgtcatggatca

SEQ ID NO: 543550 - DNA, 25 bp, Mus musculus
atgtgtacttggctaaaagtctggc

SEQ ID NO: 543551 - DNA, 25 bp, Mus musculus
atgtgtacttgggtaaaagtctggc

SEQ ID NO: 543552 - DNA, 25 bp, Mus musculus
atgtgtcactagaagagggcttgga

SEQ ID NO: 543553 - DNA, 25 bp, Mus musculus
atgtgtcactagtagagggcttgga

SEQ ID NO: 543554 - DNA, 25 bp, Mus musculus
atgtgtccatccagtcacctgcctg

SEQ ID NO: 543555 - DNA, 25 bp, Mus musculus
atgtgtccatcctgtcacctgcctg

SEQ ID NO: 543556 - DNA, 25 bp, Mus musculus
atgtgtcccactatacctcccacgg

SEQ ID NO: 543557 - DNA, 25 bp, Mus musculus
atgtgtcccactttacctcccacgg

SEQ ID NO: 543558 - DNA, 25 bp, Mus musculus
atgtgtctgatgatcaagtgaatcc

SEQ ID NO: 543559 - DNA, 25 bp, Mus musculus
atgtgtctgatgttcaagtgaatcc

SEQ ID NO: 543560 - DNA, 25 bp, Mus musculus
atgtgtctgctcagtcgcctccaac

SEQ ID NO: 543561 - DNA, 25 bp, Mus musculus
atgtgtctgctctgtcgcctccaac

SEQ ID NO: 543562 - DNA, 25 bp, Mus musculus
atgtgtgaccggaacggcgggcggc

SEQ ID NO: 543563 - DNA, 25 bp, Mus musculus
atgtgtgaccggtacggcgggcggc

SEQ ID NO: 543564 - DNA, 25 bp, Mus musculus
atgtgtgcacccaagcttggccagc

SEQ ID NO: 543565 - DNA, 25 bp, Mus musculus
atgtgtgcaccctagcttggccagc

SEQ ID NO: 543566 - DNA, 25 bp, Mus musculus
atgtgtgccccgagaacgccgaggt

SEQ ID NO: 543567 - DNA, 25 bp, Mus musculus
atgtgtgccccgtgaacgccgaggt

SEQ ID NO: 543568 - DNA, 25 bp, Mus musculus
atgtgtgtgctaactgtctggagga

SEQ ID NO: 543569 - DNA, 25 bp, Mus musculus
atgtgtgtgctatctgtctggagga

SEQ ID NO: 543570 - DNA, 25 bp, Mus musculus
atgtgttaccgtcagtggaacagag

SEQ ID NO: 543571 - DNA, 25 bp, Mus musculus
atgtgttaccgtgagtggaacagag

SEQ ID NO: 543572 - DNA, 25 bp, Mus musculus
atgtgttctgtcaggaccaccacag

SEQ ID NO: 543573 - DNA, 25 bp, Mus musculus
atgtgttctgtctggaccaccacag

SEQ ID NO: 543574 - DNA, 25 bp, Mus musculus
atgtgtttgtgcaggtggccaactc

SEQ ID NO: 543575 - DNA, 25 bp, Mus musculus
atgtgtttgtgctggtggccaactc

SEQ ID NO: 543576 - DNA, 25 bp, Mus musculus
atgttaaggagactcagcctccaga

SEQ ID NO: 543577 - DNA, 25 bp, Mus musculus
atgttaaggagagtcagcctccaga

SEQ ID NO: 543578 - DNA, 25 bp, Mus musculus
atgttaatgagtccatctccaaccc

SEQ ID NO: 543579 - DNA, 25 bp, Mus musculus
atgttaatgagtgcatctccaaccc

SEQ ID NO: 543580 - DNA, 25 bp, Mus musculus
atgttaccacagagcaccacggcca

SEQ ID NO: 543581 - DNA, 25 bp, Mus musculus
atgttaccacagtgcaccacggcca

SEQ ID NO: 543582 - DNA, 25 bp, Mus musculus
atgttatgggaacttctgcgggctc

SEQ ID NO: 543583 - DNA, 25 bp, Mus musculus
atgttatgggaagttctgcgggctc

SEQ ID NO: 543584 - DNA, 25 bp, Mus musculus
atgttcagcacccaaaaggagatcc

SEQ ID NO: 543585 - DNA, 25 bp, Mus musculus
atgttcagcaccgaaaaggagatcc

SEQ ID NO: 543586 - DNA, 25 bp, Mus musculus
atgttcaggaaaaggagggacagca

SEQ ID NO: 543587 - DNA, 25 bp, Mus musculus
atgttcaggaaatggagggacagca

SEQ ID NO: 543588 - DNA, 25 bp, Mus musculus
atgttcagtgccacactggcgggca

SEQ ID NO: 543589 - DNA, 25 bp, Mus musculus
atgttcagtgcctcactggcgggca

SEQ ID NO: 543590 - DNA, 25 bp, Mus musculus
atgttcatgcccaggtctccttccg

SEQ ID NO: 543591 - DNA, 25 bp, Mus musculus
atgttcatgccctggtctccttccg

SEQ ID NO: 543592 - DNA, 25 bp, Mus musculus
atgttccacaccagggtcttcacca

SEQ ID NO: 543593 - DNA, 25 bp, Mus musculus
atgttccacacctgggtcttcacca

SEQ ID NO: 543594 - DNA, 25 bp, Mus musculus
atgttccggccacctcctgacagtg

SEQ ID NO: 543595 - DNA, 25 bp, Mus musculus
atgttccggccagctcctgacagtg

SEQ ID NO: 543596 - DNA, 25 bp, Mus musculus
atgttcctacaactgagtcagaaag

SEQ ID NO: 543597 - DNA, 25 bp, Mus musculus
atgttcctacaagtgagtcagaaag

SEQ ID NO: 543598 - DNA, 25 bp, Mus musculus
atgttcctgatgatgtccagcctat

SEQ ID NO: 543599 - DNA, 25 bp, Mus musculus
atgttcctgatgttgtccagcctat

SEQ ID NO: 543600 - DNA, 25 bp, Mus musculus
atgttcctggccacgctggcgggtc

SEQ ID NO: 543601 - DNA, 25 bp, Mus musculus
atgttcctggcctcgctggcgggtc

SEQ ID NO: 543602 - DNA, 25 bp, Mus musculus
atgttcctgtgcaccgggtctctca

SEQ ID NO: 543603 - DNA, 25 bp, Mus musculus
atgttcctgtgctccgggtctctca

SEQ ID NO: 543604 - DNA, 25 bp, Mus musculus
atgttcgaaggccacgacaccacca

SEQ ID NO: 543605 - DNA, 25 bp, Mus musculus
atgttcgaaggcgacgacaccacca

SEQ ID NO: 543606 - DNA, 25 bp, Mus musculus
atgttcgacaagacgcggctgccgt

SEQ ID NO: 543607 - DNA, 25 bp, Mus musculus
atgttcgacaagtcgcggctgccgt

SEQ ID NO: 543608 - DNA, 25 bp, Mus musculus
atgttcggaaggctctccacatccc

SEQ ID NO: 543609 - DNA, 25 bp, Mus musculus
atgttcggaagggtctccacatccc

SEQ ID NO: 543610 - DNA, 25 bp, Mus musculus
atgttcggactgagcgggccttcgc

SEQ ID NO: 543611 - DNA, 25 bp, Mus musculus
atgttcggactgtgcgggccttcgc

SEQ ID NO: 543612 - DNA, 25 bp, Mus musculus
atgttcggcaagcttggtgtcctgc

SEQ ID NO: 543613 - DNA, 25 bp, Mus musculus
atgttcggcaaggttggtgtcctgc

SEQ ID NO: 543614 - DNA, 25 bp, Mus musculus
atgttcgttcacctggctgaggtga

SEQ ID NO: 543615 - DNA, 25 bp, Mus musculus
atgttcgttcacgtggctgaggtga

SEQ ID NO: 543616 - DNA, 25 bp, Mus musculus
atgttctcaagtctcccactccagg

SEQ ID NO: 543617 - DNA, 25 bp, Mus musculus
atgttctcaagtgtcccactccagg

SEQ ID NO: 543618 - DNA, 25 bp, Mus musculus
atgttctgggtacggcacgtgttcc

SEQ ID NO: 543619 - DNA, 25 bp, Mus musculus
atgttctgggtagggcacgtgttcc

SEQ ID NO: 543620 - DNA, 25 bp, Mus musculus
atgttcttcagtcccataaactggg

SEQ ID NO: 543621 - DNA, 25 bp, Mus musculus
atgttcttcagtgccataaactggg

SEQ ID NO: 543622 - DNA, 25 bp, Mus musculus
atgttcttggtgaagtcggccagcc

SEQ ID NO: 543623 - DNA, 25 bp, Mus musculus
atgttcttggtgtagtcggccagcc

SEQ ID NO: 543624 - DNA, 25 bp, Mus musculus
atgttctttggcctgccgccgtcca

SEQ ID NO: 543625 - DNA, 25 bp, Mus musculus
atgttctttggcgtgccgccgtcca

SEQ ID NO: 543626 - DNA, 25 bp, Mus musculus
atgttgaagaggactaccaaaatct

SEQ ID NO: 543627 - DNA, 25 bp, Mus musculus
atgttgaagaggtctaccaaaatct

SEQ ID NO: 543628 - DNA, 25 bp, Mus musculus
atgttgatgaatctgcagccacaga

SEQ ID NO: 543629 - DNA, 25 bp, Mus musculus
atgttgatgaatgtgcagccacaga

SEQ ID NO: 543630 - DNA, 25 bp, Mus musculus
atgttgatgagacagtcctagagac

SEQ ID NO: 543631 - DNA, 25 bp, Mus musculus
atgttgatgagagagtcctagagac

SEQ ID NO: 543632 - DNA, 25 bp, Mus musculus
atgttgcaaaatctactccctgaag

SEQ ID NO: 543633 - DNA, 25 bp, Mus musculus
atgttgcaaaatgtactccctgaag

SEQ ID NO: 543634 - DNA, 25 bp, Mus musculus
atgttgcaaagtccccgggcctcca

SEQ ID NO: 543635 - DNA, 25 bp, Mus musculus
atgttgcaaagtgcccgggcctcca

SEQ ID NO: 543636 - DNA, 25 bp, Mus musculus
atgttgcctatgatgccaaagaccc

SEQ ID NO: 543637 - DNA, 25 bp, Mus musculus
atgttgcctatgttgccaaagaccc

SEQ ID NO: 543638 - DNA, 25 bp, Mus musculus
atgttggagcgcatttgccggagcc

SEQ ID NO: 543639 - DNA, 25 bp, Mus musculus
atgttggagcgcttttgccggagcc

SEQ ID NO: 543640 - DNA, 25 bp, Mus musculus
atgttggctgtccacgcaccgagga

SEQ ID NO: 543641 - DNA, 25 bp, Mus musculus
atgttggctgtcgacgcaccgagga

SEQ ID NO: 543642 - DNA, 25 bp, Mus musculus
atgttgggcttacaaacacatgacc

SEQ ID NO: 543643 - DNA, 25 bp, Mus musculus
atgttgggcttagaaacacatgacc

SEQ ID NO: 543644 - DNA, 25 bp, Mus musculus
atgtttacaacaacattggaggact

SEQ ID NO: 543645 - DNA, 25 bp, Mus musculus
atgtttacaacatcattggaggact

SEQ ID NO: 543646 - DNA, 25 bp, Mus musculus
atgtttacagcgcagtcttaccgaa

SEQ ID NO: 543647 - DNA, 25 bp, Mus musculus
atgtttacagcggagtcttaccgaa

SEQ ID NO: 543648 - DNA, 25 bp, Mus musculus
atgtttagcggaaagttgcaaactc

SEQ ID NO: 543649 - DNA, 25 bp, Mus musculus
atgtttagcggatagttgcaaactc

SEQ ID NO: 543650 - DNA, 25 bp, Mus musculus
atgtttccctgcaagatcacttcaa

SEQ ID NO: 543651 - DNA, 25 bp, Mus musculus
atgtttccctgctagatcacttcaa

SEQ ID NO: 543652 - DNA, 25 bp, Mus musculus
atgtttctgtacaacctgaccttac

SEQ ID NO: 543653 - DNA, 25 bp, Mus musculus
atgtttctgtactacctgaccttac

SEQ ID NO: 543654 - DNA, 25 bp, Mus musculus
atgtttgcggttcgatagcattgag

SEQ ID NO: 543655 - DNA, 25 bp, Mus musculus
atgtttgcggttggatagcattgag

SEQ ID NO: 543656 - DNA, 25 bp, Mus musculus
atgtttgctgagaaccttgccagtg

SEQ ID NO: 543657 - DNA, 25 bp, Mus musculus
atgtttgctgagtaccttgccagtg

SEQ ID NO: 543658 - DNA, 25 bp, Mus musculus
atgtttggaaccattagcacagctt

SEQ ID NO: 543659 - DNA, 25 bp, Mus musculus
atgtttggaacctttagcacagctt

SEQ ID NO: 543660 - DNA, 25 bp, Mus musculus
atgtttgtacagcaagaggccctgg

SEQ ID NO: 543661 - DNA, 25 bp, Mus musculus
atgtttgtacaggaagaggccctgg

SEQ ID NO: 543662 - DNA, 25 bp, Mus musculus
atgtttgtccagagagtcaaagaga

SEQ ID NO: 543663 - DNA, 25 bp, Mus musculus
atgtttgtccagtgagtcaaagaga

SEQ ID NO: 543664 - DNA, 25 bp, Mus musculus
atgtttgtgcaccacaggcattcag

SEQ ID NO: 543665 - DNA, 25 bp, Mus musculus
atgtttgtgcacgacaggcattcag

SEQ ID NO: 543666 - DNA, 25 bp, Mus musculus
atgttttggccacccaagagcaaca

SEQ ID NO: 543667 - DNA, 25 bp, Mus musculus
atgttttggccagccaagagcaaca

SEQ ID NO: 543668 - DNA, 25 bp, Mus musculus
atgtttttatcccatgcttccggga

SEQ ID NO: 543669 - DNA, 25 bp, Mus musculus
atgtttttatccgatgcttccggga

SEQ ID NO: 543670 - DNA, 25 bp, Mus musculus
attaaacatgcccttagcgcaggct

SEQ ID NO: 543671 - DNA, 25 bp, Mus musculus
attaaacatgccgttagcgcaggct

SEQ ID NO: 543672 - DNA, 25 bp, Mus musculus
attaaaccaggccagcacggctcca

SEQ ID NO: 543673 - DNA, 25 bp, Mus musculus
attaaaccaggcgagcacggctcca

SEQ ID NO: 543674 - DNA, 25 bp, Mus musculus
attaaagtacttcagtccacatctg

SEQ ID NO: 543675 - DNA, 25 bp, Mus musculus
attaaagtacttgagtccacatctg

SEQ ID NO: 543676 - DNA, 25 bp, Mus musculus
attaaatagcagaaggcctccctct

SEQ ID NO: 543677 - DNA, 25 bp, Mus musculus
attaaatagcagtaggcctccctct

SEQ ID NO: 543678 - DNA, 25 bp, Mus musculus
attaacaacaacctcagacacccag

SEQ ID NO: 543679 - DNA, 25 bp, Mus musculus
attaacaacaacgtcagacacccag

SEQ ID NO: 543680 - DNA, 25 bp, Mus musculus
attaaccacctcaagccaggactcc

SEQ ID NO: 543681 - DNA, 25 bp, Mus musculus
attaaccacctctagccaggactcc

SEQ ID NO: 543682 - DNA, 25 bp, Mus musculus
attaaccctgaaacctccagaagga

SEQ ID NO: 543683 - DNA, 25 bp, Mus musculus
attaaccctgaatcctccagaagga

SEQ ID NO: 543684 - DNA, 25 bp, Mus musculus
attaaccgggaaacacctggcagcc

SEQ ID NO: 543685 - DNA, 25 bp, Mus musculus
attaaccgggaatcacctggcagcc

SEQ ID NO: 543686 - DNA, 25 bp, Mus musculus
attaagaacttgcatgacaccattg

SEQ ID NO: 543687 - DNA, 25 bp, Mus musculus
attaagaacttggatgacaccattg

SEQ ID NO: 543688 - DNA, 25 bp, Mus musculus
attaagaagccgatccgctccacag

SEQ ID NO: 543689 - DNA, 25 bp, Mus musculus
attaagaagccgttccgctccacag

SEQ ID NO: 543690 - DNA, 25 bp, Mus musculus
attaagatccggctggaaacaatgg

SEQ ID NO: 543691 - DNA, 25 bp, Mus musculus
attaagatccgggtggaaacaatgg

SEQ ID NO: 543692 - DNA, 25 bp, Mus musculus
attaagattctgagtgtaggcggag

SEQ ID NO: 543693 - DNA, 25 bp, Mus musculus
attaagattctgtgtgtaggcggag

SEQ ID NO: 543694 - DNA, 25 bp, Mus musculus
attaagcagattacggaggaagtgg

SEQ ID NO: 543695 - DNA, 25 bp, Mus musculus
attaagcagatttcggaggaagtgg

SEQ ID NO: 543696 - DNA, 25 bp, Mus musculus
attaagctctgcctgctgtccagtg

SEQ ID NO: 543697 - DNA, 25 bp, Mus musculus
attaagctctgcgtgctgtccagtg

SEQ ID NO: 543698 - DNA, 25 bp, Mus musculus
attaaggagtgtcatgtggccaaag

SEQ ID NO: 543699 - DNA, 25 bp, Mus musculus
attaaggagtgtgatgtggccaaag

SEQ ID NO: 543700 - DNA, 25 bp, Mus musculus
attaaggttgagcaagactttggct

SEQ ID NO: 543701 - DNA, 25 bp, Mus musculus
attaaggttgaggaagactttggct

SEQ ID NO: 543702 - DNA, 25 bp, Mus musculus
attaagtctccaaagtcggtactcg

SEQ ID NO: 543703 - DNA, 25 bp, Mus musculus
attaagtctccatagtcggtactcg

SEQ ID NO: 543704 - DNA, 25 bp, Mus musculus
attaagtgtgtgctccaggacccca

SEQ ID NO: 543705 - DNA, 25 bp, Mus musculus
attaagtgtgtggtccaggacccca

SEQ ID NO: 543706 - DNA, 25 bp, Mus musculus
attaataaagagacaggagagtggg

SEQ ID NO: 543707 - DNA, 25 bp, Mus musculus
attaataaagagtcaggagagtggg

SEQ ID NO: 543708 - DNA, 25 bp, Mus musculus
attaatcccgggcagccgtggcctg

SEQ ID NO: 543709 - DNA, 25 bp, Mus musculus
attaatcccggggagccgtggcctg

SEQ ID NO: 543710 - DNA, 25 bp, Mus musculus
attaatcctcttcctggcacctggg

SEQ ID NO: 543711 - DNA, 25 bp, Mus musculus
attaatcctcttgctggcacctggg

SEQ ID NO: 543712 - DNA, 25 bp, Mus musculus
attaatgacagaaggaagccccgcc

SEQ ID NO: 543713 - DNA, 25 bp, Mus musculus
attaatgacagatggaagccccgcc

SEQ ID NO: 543714 - DNA, 25 bp, Mus musculus
attaatgcagaaaggaacaatcctc

SEQ ID NO: 543715 - DNA, 25 bp, Mus musculus
attaatgcagaatggaacaatcctc

SEQ ID NO: 543716 - DNA, 25 bp, Mus musculus
attaatgtgaggaaatgcagacatg

SEQ ID NO: 543717 - DNA, 25 bp, Mus musculus
attaatgtgaggtaatgcagacatg

SEQ ID NO: 543718 - DNA, 25 bp, Mus musculus
attaatttgcgaattcagacccggg

SEQ ID NO: 543719 - DNA, 25 bp, Mus musculus
attaatttgcgatttcagacccggg

SEQ ID NO: 543720 - DNA, 25 bp, Mus musculus
attacaaagcctacgaggacgcagc

SEQ ID NO: 543721 - DNA, 25 bp, Mus musculus
attacaaagccttcgaggacgcagc

SEQ ID NO: 543722 - DNA, 25 bp, Mus musculus
attacacgcctaaccagttagcaca

SEQ ID NO: 543723 - DNA, 25 bp, Mus musculus
attacacgcctatccagttagcaca

SEQ ID NO: 543724 - DNA, 25 bp, Mus musculus
attacactagcaagaaagagagctg

SEQ ID NO: 543725 - DNA, 25 bp, Mus musculus
attacactagcatgaaagagagctg

SEQ ID NO: 543726 - DNA, 25 bp, Mus musculus
attacactttctcgcagtggtttga

SEQ ID NO: 543727 - DNA, 25 bp, Mus musculus
attacactttctggcagtggtttga

SEQ ID NO: 543728 - DNA, 25 bp, Mus musculus
attacagggactcccgggaagaagt

SEQ ID NO: 543729 - DNA, 25 bp, Mus musculus
attacagggactgccgggaagaagt

SEQ ID NO: 543730 - DNA, 25 bp, Mus musculus
attacagtccttccgttagatgcag

SEQ ID NO: 543731 - DNA, 25 bp, Mus musculus
attacagtccttgcgttagatgcag

SEQ ID NO: 543732 - DNA, 25 bp, Mus musculus
attacatcttctacctggagcctga

SEQ ID NO: 543733 - DNA, 25 bp, Mus musculus
attacatcttcttcctggagcctga

SEQ ID NO: 543734 - DNA, 25 bp, Mus musculus
attaccaaacctcagactgctggca

SEQ ID NO: 543735 - DNA, 25 bp, Mus musculus
attaccaaacctgagactgctggca

SEQ ID NO: 543736 - DNA, 25 bp, Mus musculus
attaccacacccagcggatcggcgg

SEQ ID NO: 543737 - DNA, 25 bp, Mus musculus
attaccacaccctgcggatcggcgg

SEQ ID NO: 543738 - DNA, 25 bp, Mus musculus
attaccaggccgacgggaagctcct

SEQ ID NO: 543739 - DNA, 25 bp, Mus musculus
attaccaggccgtcgggaagctcct

SEQ ID NO: 543740 - DNA, 25 bp, Mus musculus
attacccggtgtcggctgtccaatt

SEQ ID NO: 543741 - DNA, 25 bp, Mus musculus
attacccggtgtgggctgtccaatt

SEQ ID NO: 543742 - DNA, 25 bp, Mus musculus
attacctgcagcacaaccttgcggg

SEQ ID NO: 543743 - DNA, 25 bp, Mus musculus
attacctgcagctcaaccttgcggg

SEQ ID NO: 543744 - DNA, 25 bp, Mus musculus
attacgtcaccaagtgagaagccat

SEQ ID NO: 543745 - DNA, 25 bp, Mus musculus
attacgtcaccatgtgagaagccat

SEQ ID NO: 543746 - DNA, 25 bp, Mus musculus
attacgtgactgacccgagggctcg

SEQ ID NO: 543747 - DNA, 25 bp, Mus musculus
attacgtgactgtcccgagggctcg

SEQ ID NO: 543748 - DNA, 25 bp, Mus musculus
attactatagcccagcaatgctggg

SEQ ID NO: 543749 - DNA, 25 bp, Mus musculus
attactatagccgagcaatgctggg

SEQ ID NO: 543750 - DNA, 25 bp, Mus musculus
attactcgaggaccattcctgggaa

SEQ ID NO: 543751 - DNA, 25 bp, Mus musculus
attactcgaggagcattcctgggaa

SEQ ID NO: 543752 - DNA, 25 bp, Mus musculus
attactgcaagaagtcgcgcctcgt

SEQ ID NO: 543753 - DNA, 25 bp, Mus musculus
attactgcaagatgtcgcgcctcgt

SEQ ID NO: 543754 - DNA, 25 bp, Mus musculus
attactgcatggcaagaatgtgtaa

SEQ ID NO: 543755 - DNA, 25 bp, Mus musculus
attactgcatgggaagaatgtgtaa

SEQ ID NO: 543756 - DNA, 25 bp, Mus musculus
attactgccctgacataaatcctat

SEQ ID NO: 543757 - DNA, 25 bp, Mus musculus
attactgccctgtcataaatcctat

SEQ ID NO: 543758 - DNA, 25 bp, Mus musculus
attacttaccacagcccaggcgaaa

SEQ ID NO: 543759 - DNA, 25 bp, Mus musculus
attacttaccactgcccaggcgaaa

SEQ ID NO: 543760 - DNA, 25 bp, Mus musculus
attagaaagcaaccccaggacctgc

SEQ ID NO: 543761 - DNA, 25 bp, Mus musculus
attagaaagcaagcccaggacctgc

SEQ ID NO: 543762 - DNA, 25 bp, Mus musculus
attagaagaaccagttcaaggagaa

SEQ ID NO: 543763 - DNA, 25 bp, Mus musculus
attagaagaacctgttcaaggagaa

SEQ ID NO: 543764 - DNA, 25 bp, Mus musculus
attagaagccttccttcagggtggt

SEQ ID NO: 543765 - DNA, 25 bp, Mus musculus
attagaagccttgcttcagggtggt

SEQ ID NO: 543766 - DNA, 25 bp, Mus musculus
attagaaggcataattcctggagca

SEQ ID NO: 543767 - DNA, 25 bp, Mus musculus
attagaaggcattattcctggagca

SEQ ID NO: 543768 - DNA, 25 bp, Mus musculus
attagagaggtgaccagtggctccg

SEQ ID NO: 543769 - DNA, 25 bp, Mus musculus
attagagaggtgtccagtggctccg

SEQ ID NO: 543770 - DNA, 25 bp, Mus musculus
attagagcccgcatgctgccggagg

SEQ ID NO: 543771 - DNA, 25 bp, Mus musculus
attagagcccgcttgctgccggagg

SEQ ID NO: 543772 - DNA, 25 bp, Mus musculus
attagaggcactccggccctgggct

SEQ ID NO: 543773 - DNA, 25 bp, Mus musculus
attagaggcactgcggccctgggct

SEQ ID NO: 543774 - DNA, 25 bp, Mus musculus
attagagggaaaagaagcaatccca

SEQ ID NO: 543775 - DNA, 25 bp, Mus musculus
attagagggaaatgaagcaatccca

SEQ ID NO: 543776 - DNA, 25 bp, Mus musculus
attagatgccctcaaatggagttat

SEQ ID NO: 543777 - DNA, 25 bp, Mus musculus
attagatgccctgaaatggagttat

SEQ ID NO: 543778 - DNA, 25 bp, Mus musculus
attagcaaccagctaggccccaaga

SEQ ID NO: 543779 - DNA, 25 bp, Mus musculus
attagcaaccaggtaggccccaaga

SEQ ID NO: 543780 - DNA, 25 bp, Mus musculus
attagcgacgagctggaccacgccc

SEQ ID NO: 543781 - DNA, 25 bp, Mus musculus
attagcgacgaggtggaccacgccc

SEQ ID NO: 543782 - DNA, 25 bp, Mus musculus
attagcgatgatcaaccaggttatg

SEQ ID NO: 543783 - DNA, 25 bp, Mus musculus
attagcgatgatgaaccaggttatg

SEQ ID NO: 543784 - DNA, 25 bp, Mus musculus
attagcgctgcccagctgcgtcacg

SEQ ID NO: 543785 - DNA, 25 bp, Mus musculus
attagcgctgccgagctgcgtcacg

SEQ ID NO: 543786 - DNA, 25 bp, Mus musculus
attagctcctcacctgcacaagcag

SEQ ID NO: 543787 - DNA, 25 bp, Mus musculus
attagctcctcagctgcacaagcag

SEQ ID NO: 543788 - DNA, 25 bp, Mus musculus
attaggcggaatacgctcccaccgg

SEQ ID NO: 543789 - DNA, 25 bp, Mus musculus
attaggcggaattcgctcccaccgg

SEQ ID NO: 543790 - DNA, 25 bp, Mus musculus
attagtccacgaaaccaagccatgg

SEQ ID NO: 543791 - DNA, 25 bp, Mus musculus
attagtccacgataccaagccatgg

SEQ ID NO: 543792 - DNA, 25 bp, Mus musculus
attagtgaggaacttccctatagtg

SEQ ID NO: 543793 - DNA, 25 bp, Mus musculus
attagtgaggaagttccctatagtg

SEQ ID NO: 543794 - DNA, 25 bp, Mus musculus
attagtggatcccatggctgacacg

SEQ ID NO: 543795 - DNA, 25 bp, Mus musculus
attagtggatccgatggctgacacg

SEQ ID NO: 543796 - DNA, 25 bp, Mus musculus
attagtggcacgctgagcctgctgc

SEQ ID NO: 543797 - DNA, 25 bp, Mus musculus
attagtggcacggtgagcctgctgc

SEQ ID NO: 543798 - DNA, 25 bp, Mus musculus
attagtgttaagcataatgatagcc

SEQ ID NO: 543799 - DNA, 25 bp, Mus musculus
attagtgttaaggataatgatagcc

SEQ ID NO: 543800 - DNA, 25 bp, Mus musculus
attagttcggagacggtgaatgagc

SEQ ID NO: 543801 - DNA, 25 bp, Mus musculus
attagttcggagtcggtgaatgagc

SEQ ID NO: 543802 - DNA, 25 bp, Mus musculus
attataaatgcacctcgagcgagcc

SEQ ID NO: 543803 - DNA, 25 bp, Mus musculus
attataaatgcagctcgagcgagcc

SEQ ID NO: 543804 - DNA, 25 bp, Mus musculus
attataccgaaaagaagttctacag

SEQ ID NO: 543805 - DNA, 25 bp, Mus musculus
attataccgaaatgaagttctacag

SEQ ID NO: 543806 - DNA, 25 bp, Mus musculus
attatatcacctacaagaactttgg

SEQ ID NO: 543807 - DNA, 25 bp, Mus musculus
attatatcaccttcaagaactttgg

SEQ ID NO: 543808 - DNA, 25 bp, Mus musculus
attatattatgtctcccagcgtggg

SEQ ID NO: 543809 - DNA, 25 bp, Mus musculus
attatattatgtgtcccagcgtggg

SEQ ID NO: 543810 - DNA, 25 bp, Mus musculus
attatatttctacagctgagtctca

SEQ ID NO: 543811 - DNA, 25 bp, Mus musculus
attatatttctagagctgagtctca

SEQ ID NO: 543812 - DNA, 25 bp, Mus musculus
attatcaaattcatcggattcgaca

SEQ ID NO: 543813 - DNA, 25 bp, Mus musculus
attatcaaattcttcggattcgaca

SEQ ID NO: 543814 - DNA, 25 bp, Mus musculus
attatcaggagaacagatcagtgga

SEQ ID NO: 543815 - DNA, 25 bp, Mus musculus
attatcaggagatcagatcagtgga

SEQ ID NO: 543816 - DNA, 25 bp, Mus musculus
attatccagttgctcccatctatcc

SEQ ID NO: 543817 - DNA, 25 bp, Mus musculus
attatccagttggtcccatctatcc

SEQ ID NO: 543818 - DNA, 25 bp, Mus musculus
attatcggccgcagcactggcactg

SEQ ID NO: 543819 - DNA, 25 bp, Mus musculus
attatcggccgctgcactggcactg

SEQ ID NO: 543820 - DNA, 25 bp, Mus musculus
attatcttctgtcaagcggtggcca

SEQ ID NO: 543821 - DNA, 25 bp, Mus musculus
attatcttctgtcgccaccgggtgg

SEQ ID NO: 543822 - DNA, 25 bp, Mus musculus
attatcttctgtgaagcggtggcca

SEQ ID NO: 543823 - DNA, 25 bp, Mus musculus
attatcttctgtggccaccgggtgg

SEQ ID NO: 543824 - DNA, 25 bp, Mus musculus
attatgacatctcccaaagttgctt

SEQ ID NO: 543825 - DNA, 25 bp, Mus musculus
attatgacatctgccaaagttgctt

SEQ ID NO: 543826 - DNA, 25 bp, Mus musculus
attatgcccgtgcaggctccttcac

SEQ ID NO: 543827 - DNA, 25 bp, Mus musculus
attatgcccgtggaggctccttcac

SEQ ID NO: 543828 - DNA, 25 bp, Mus musculus
attatggcagagaacgatgtggaca

SEQ ID NO: 543829 - DNA, 25 bp, Mus musculus
attatggcagagtacgatgtggaca

SEQ ID NO: 543830 - DNA, 25 bp, Mus musculus
attatgttgcaaatggagctgatga

SEQ ID NO: 543831 - DNA, 25 bp, Mus musculus
attatgttgcaattggagctgatga

SEQ ID NO: 543832 - DNA, 25 bp, Mus musculus
attattatatacacgtctaggacgc

SEQ ID NO: 543833 - DNA, 25 bp, Mus musculus
attattatatactcgtctaggacgc

SEQ ID NO: 543834 - DNA, 25 bp, Mus musculus
attattcctaatattccgtgtgcag

SEQ ID NO: 543835 - DNA, 25 bp, Mus musculus
attattcctaattttccgtgtgcag

SEQ ID NO: 543836 - DNA, 25 bp, Mus musculus
attattcgagaaagcctccttcctg

SEQ ID NO: 543837 - DNA, 25 bp, Mus musculus
attattcgagaatgcctccttcctg

SEQ ID NO: 543838 - DNA, 25 bp, Mus musculus
attattggctcaaaaggcaccagcg

SEQ ID NO: 543839 - DNA, 25 bp, Mus musculus
attattggctcataaggcaccagcg

SEQ ID NO: 543840 - DNA, 25 bp, Mus musculus
attcaaagagaacggctctgagctg

SEQ ID NO: 543841 - DNA, 25 bp, Mus musculus
attcaaagagaagggctctgagctg

SEQ ID NO: 543842 - DNA, 25 bp, Mus musculus
attcaaagatgtcggacggaagcct

SEQ ID NO: 543843 - DNA, 25 bp, Mus musculus
attcaaagatgtgggacggaagcct

SEQ ID NO: 543844 - DNA, 25 bp, Mus musculus
attcaacttacacggcagagccaag

SEQ ID NO: 543845 - DNA, 25 bp, Mus musculus
attcaacttacagggcagagccaag

SEQ ID NO: 543846 - DNA, 25 bp, Mus musculus
attcaagctggtcttcctgggagag

SEQ ID NO: 543847 - DNA, 25 bp, Mus musculus
attcaagctggtgttcctgggagag

SEQ ID NO: 543848 - DNA, 25 bp, Mus musculus
attcaaggcggacctgaggcaccta

SEQ ID NO: 543849 - DNA, 25 bp, Mus musculus
attcaaggcggagctgaggcaccta

SEQ ID NO: 543850 - DNA, 25 bp, Mus musculus
attcaataccgcctgggtatttggg

SEQ ID NO: 543851 - DNA, 25 bp, Mus musculus
attcaataccgcgtgggtatttggg

SEQ ID NO: 543852 - DNA, 25 bp, Mus musculus
attcaatatcgcctgagtatctggg

SEQ ID NO: 543853 - DNA, 25 bp, Mus musculus
attcaatatcgcgtgagtatctggg

SEQ ID NO: 543854 - DNA, 25 bp, Mus musculus
attcaatatttcacttactcccaag

SEQ ID NO: 543855 - DNA, 25 bp, Mus musculus
attcaatatttctcttactcccaag

SEQ ID NO: 543856 - DNA, 25 bp, Mus musculus
attcacaagcctacacaacttctcg

SEQ ID NO: 543857 - DNA, 25 bp, Mus musculus
attcacaagccttcacaacttctcg

SEQ ID NO: 543858 - DNA, 25 bp, Mus musculus
attcacagcagaagatatcaacaag

SEQ ID NO: 543859 - DNA, 25 bp, Mus musculus
attcacagcagatgatatcaacaag

SEQ ID NO: 543860 - DNA, 25 bp, Mus musculus
attcacccatgaaccctgtgagcag

SEQ ID NO: 543861 - DNA, 25 bp, Mus musculus
attcacccatgatccctgtgagcag

SEQ ID NO: 543862 - DNA, 25 bp, Mus musculus
attcaccgcctcaacgaggagtggc

SEQ ID NO: 543863 - DNA, 25 bp, Mus musculus
attcaccgcctctacgaggagtggc

SEQ ID NO: 543864 - DNA, 25 bp, Mus musculus
attcactatgagactaccggccctg

SEQ ID NO: 543865 - DNA, 25 bp, Mus musculus
attcactatgagtctaccggccctg

SEQ ID NO: 543866 - DNA, 25 bp, Mus musculus
attcactgtgagaggcaaccccaag

SEQ ID NO: 543867 - DNA, 25 bp, Mus musculus
attcactgtgagtggcaaccccaag

SEQ ID NO: 543868 - DNA, 25 bp, Mus musculus
attcagaaagcacctacatcctgag

SEQ ID NO: 543869 - DNA, 25 bp, Mus musculus
attcagaaagcagctacatcctgag

SEQ ID NO: 543870 - DNA, 25 bp, Mus musculus
attcagaagcacaacctgcgcaccg

SEQ ID NO: 543871 - DNA, 25 bp, Mus musculus
attcagaagcactacctgcgcaccg

SEQ ID NO: 543872 - DNA, 25 bp, Mus musculus
attcagacgtggaggaagtgaccat

SEQ ID NO: 543873 - DNA, 25 bp, Mus musculus
attcagacgtggtggaagtgaccat

SEQ ID NO: 543874 - DNA, 25 bp, Mus musculus
attcagaggacgctcccaagagggc

SEQ ID NO: 543875 - DNA, 25 bp, Mus musculus
attcagaggacggtcccaagagggc

SEQ ID NO: 543876 - DNA, 25 bp, Mus musculus
attcagatgagtcccgttgtgtgag

SEQ ID NO: 543877 - DNA, 25 bp, Mus musculus
attcagatgagtgccgttgtgtgag

SEQ ID NO: 543878 - DNA, 25 bp, Mus musculus
attcagatgtggatcgacccagccc

SEQ ID NO: 543879 - DNA, 25 bp, Mus musculus
attcagatgtggttcgacccagccc

SEQ ID NO: 543880 - DNA, 25 bp, Mus musculus
attcagcatccgacgggtaccgaag

SEQ ID NO: 543881 - DNA, 25 bp, Mus musculus
attcagcatccgtcgggtaccgaag

SEQ ID NO: 543882 - DNA, 25 bp, Mus musculus
attcagccgccgaggactcagacat

SEQ ID NO: 543883 - DNA, 25 bp, Mus musculus
attcagccgccgtggactcagacat

SEQ ID NO: 543884 - DNA, 25 bp, Mus musculus
attcaggaggtaatcaaccagttca

SEQ ID NO: 543885 - DNA, 25 bp, Mus musculus
attcaggaggtattcaaccagttca

SEQ ID NO: 543886 - DNA, 25 bp, Mus musculus
attcaggcacagaggccctaactcc

SEQ ID NO: 543887 - DNA, 25 bp, Mus musculus
attcaggcacagtggccctaactcc

SEQ ID NO: 543888 - DNA, 25 bp, Mus musculus
attcagtgatgtagagagggccatt

SEQ ID NO: 543889 - DNA, 25 bp, Mus musculus
attcagtgatgttgagagggccatt

SEQ ID NO: 543890 - DNA, 25 bp, Mus musculus
attcagtgccgcagctgccacaata

SEQ ID NO: 543891 - DNA, 25 bp, Mus musculus
attcagtgccgctgctgccacaata

SEQ ID NO: 543892 - DNA, 25 bp, Mus musculus
attcagtgtagcatcaaaccccatg

SEQ ID NO: 543893 - DNA, 25 bp, Mus musculus
attcagtgtagcttcaaaccccatg

SEQ ID NO: 543894 - DNA, 25 bp, Mus musculus
attcatatgtatatcaacagcccag

SEQ ID NO: 543895 - DNA, 25 bp, Mus musculus
attcatatgtatttcaacagcccag

SEQ ID NO: 543896 - DNA, 25 bp, Mus musculus
attcatcacaatccatcagtctggc

SEQ ID NO: 543897 - DNA, 25 bp, Mus musculus
attcatcacaatgcatcagtctggc

SEQ ID NO: 543898 - DNA, 25 bp, Mus musculus
attcatcagtgtaatgtgacttcat

SEQ ID NO: 543899 - DNA, 25 bp, Mus musculus
attcatcagtgttatgtgacttcat

SEQ ID NO: 543900 - DNA, 25 bp, Mus musculus
attcatctatggctcaacctgcctc

SEQ ID NO: 543901 - DNA, 25 bp, Mus musculus
attcatctatgggtcaacctgcctc

SEQ ID NO: 543902 - DNA, 25 bp, Mus musculus
attcatgaagctagtgcgtcctttc

SEQ ID NO: 543903 - DNA, 25 bp, Mus musculus
attcatgaagcttgtgcgtcctttc

SEQ ID NO: 543904 - DNA, 25 bp, Mus musculus
attcatgagtatccccagagagacg

SEQ ID NO: 543905 - DNA, 25 bp, Mus musculus
attcatgagtatgcccagagagacg

SEQ ID NO: 543906 - DNA, 25 bp, Mus musculus
attcatggaaacctccctgctccgg

SEQ ID NO: 543907 - DNA, 25 bp, Mus musculus
attcatggaaacgtccctgctccgg

SEQ ID NO: 543908 - DNA, 25 bp, Mus musculus
attcatggaagacatgatgcccaag

SEQ ID NO: 543909 - DNA, 25 bp, Mus musculus
attcatggaagagatgatgcccaag

SEQ ID NO: 543910 - DNA, 25 bp, Mus musculus
attcatggaatcaaacacgccacgg

SEQ ID NO: 543911 - DNA, 25 bp, Mus musculus
attcatggaatctaacacgccacgg

SEQ ID NO: 543912 - DNA, 25 bp, Mus musculus
attcatggattgatgccgccctgca

SEQ ID NO: 543913 - DNA, 25 bp, Mus musculus
attcatggattgttgccgccctgca

SEQ ID NO: 543914 - DNA, 25 bp, Mus musculus
attcatggccacattgagttccacc

SEQ ID NO: 543915 - DNA, 25 bp, Mus musculus
attcatggccactttgagttccacc

SEQ ID NO: 543916 - DNA, 25 bp, Mus musculus
attcatggtactcgtgagcagctct

SEQ ID NO: 543917 - DNA, 25 bp, Mus musculus
attcatggtactggtgagcagctct

SEQ ID NO: 543918 - DNA, 25 bp, Mus musculus
attcatgtaagaagtcgcgtggagg

SEQ ID NO: 543919 - DNA, 25 bp, Mus musculus
attcatgtaagatgtcgcgtggagg

SEQ ID NO: 543920 - DNA, 25 bp, Mus musculus
attcattctgaacactacagcaagg

SEQ ID NO: 543921 - DNA, 25 bp, Mus musculus
attcattctgaagactacagcaagg

SEQ ID NO: 543922 - DNA, 25 bp, Mus musculus
attcatttaacccattcacttgagg

SEQ ID NO: 543923 - DNA, 25 bp, Mus musculus
attcatttaaccgattcacttgagg

SEQ ID NO: 543924 - DNA, 25 bp, Mus musculus
attccaaactgtcaccgcaacggca

SEQ ID NO: 543925 - DNA, 25 bp, Mus musculus
attccaaactgtgaccgcaacggca

SEQ ID NO: 543926 - DNA, 25 bp, Mus musculus
attccaaagaaaagcccttcaaatg

SEQ ID NO: 543927 - DNA, 25 bp, Mus musculus
attccaaagaaatgcccttcaaatg

SEQ ID NO: 543928 - DNA, 25 bp, Mus musculus
attccaagagctcgccgacaagtgc

SEQ ID NO: 543929 - DNA, 25 bp, Mus musculus
attccaagagctggccgacaagtgc

SEQ ID NO: 543930 - DNA, 25 bp, Mus musculus
attccaaggagtcatggactttaag

SEQ ID NO: 543931 - DNA, 25 bp, Mus musculus
attccaaggagtgatggactttaag

SEQ ID NO: 543932 - DNA, 25 bp, Mus musculus
attccaaggctgaagtaaggtttca

SEQ ID NO: 543933 - DNA, 25 bp, Mus musculus
attccaaggctgtagtaaggtttca

SEQ ID NO: 543934 - DNA, 25 bp, Mus musculus
attccacagagcctgctgtcactgt

SEQ ID NO: 543935 - DNA, 25 bp, Mus musculus
attccacagagcgtgctgtcactgt

SEQ ID NO: 543936 - DNA, 25 bp, Mus musculus
attccaccatggagcagccgcggaa

SEQ ID NO: 543937 - DNA, 25 bp, Mus musculus
attccaccatggtgcagccgcggaa

SEQ ID NO: 543938 - DNA, 25 bp, Mus musculus
attccacccctgatcacagtcagtg

SEQ ID NO: 543939 - DNA, 25 bp, Mus musculus
attccacccctgttcacagtcagtg

SEQ ID NO: 543940 - DNA, 25 bp, Mus musculus
attccagaattactttgctgatggg

SEQ ID NO: 543941 - DNA, 25 bp, Mus musculus
attccagaattagtttgctgatggg

SEQ ID NO: 543942 - DNA, 25 bp, Mus musculus
attccagatgccaggccaatctgcc

SEQ ID NO: 543943 - DNA, 25 bp, Mus musculus
attccagatgcctggccaatctgcc

SEQ ID NO: 543944 - DNA, 25 bp, Mus musculus
attccagttgttcgaatgtctccac

SEQ ID NO: 543945 - DNA, 25 bp, Mus musculus
attccagttgttggaatgtctccac

SEQ ID NO: 543946 - DNA, 25 bp, Mus musculus
attccataagtaagcctgccatgag

SEQ ID NO: 543947 - DNA, 25 bp, Mus musculus
attccataagtatgcctgccatgag

SEQ ID NO: 543948 - DNA, 25 bp, Mus musculus
attccatacccaaaggtctctgctc

SEQ ID NO: 543949 - DNA, 25 bp, Mus musculus
attccatacccataggtctctgctc

SEQ ID NO: 543950 - DNA, 25 bp, Mus musculus
attccatcaaagaggctcgtcccca

SEQ ID NO: 543951 - DNA, 25 bp, Mus musculus
attccatcaaagtggctcgtcccca

SEQ ID NO: 543952 - DNA, 25 bp, Mus musculus
attccatctgctccaccaagtgcca

SEQ ID NO: 543953 - DNA, 25 bp, Mus musculus
attccatctgctgcaccaagtgcca

SEQ ID NO: 543954 - DNA, 25 bp, Mus musculus
attccatgagagatagggcgcccgg

SEQ ID NO: 543955 - DNA, 25 bp, Mus musculus
attccatgagagttagggcgcccgg

SEQ ID NO: 543956 - DNA, 25 bp, Mus musculus
attccatttgtaatgaagaagaagg

SEQ ID NO: 543957 - DNA, 25 bp, Mus musculus
attccatttgtattgaagaagaagg

SEQ ID NO: 543958 - DNA, 25 bp, Mus musculus
attcccacggcaacatctaccggga

SEQ ID NO: 543959 - DNA, 25 bp, Mus musculus
attcccacggcatcatctaccggga

SEQ ID NO: 543960 - DNA, 25 bp, Mus musculus
attcccagctgacctcggatcctgg

SEQ ID NO: 543961 - DNA, 25 bp, Mus musculus
attcccagctgagctcggatcctgg

SEQ ID NO: 543962 - DNA, 25 bp, Mus musculus
attcccagtaatccagcattgaaaa

SEQ ID NO: 543963 - DNA, 25 bp, Mus musculus
attcccagtaatgcagcattgaaaa

SEQ ID NO: 543964 - DNA, 25 bp, Mus musculus
attcccagtctccaggcctgatgca

SEQ ID NO: 543965 - DNA, 25 bp, Mus musculus
attcccagtctcgaggcctgatgca

SEQ ID NO: 543966 - DNA, 25 bp, Mus musculus
attcccatttgtagatgaccatgag

SEQ ID NO: 543967 - DNA, 25 bp, Mus musculus
attcccatttgttgatgaccatgag

SEQ ID NO: 543968 - DNA, 25 bp, Mus musculus
attccccagacccagctaatgctgg

SEQ ID NO: 543969 - DNA, 25 bp, Mus musculus
attccccagaccgagctaatgctgg

SEQ ID NO: 543970 - DNA, 25 bp, Mus musculus
attccccagtacacctggatctgca

SEQ ID NO: 543971 - DNA, 25 bp, Mus musculus
attccccagtactcctggatctgca

SEQ ID NO: 543972 - DNA, 25 bp, Mus musculus
attcccgagaacactaacttccctg

SEQ ID NO: 543973 - DNA, 25 bp, Mus musculus
attcccgagaactctaacttccctg

SEQ ID NO: 543974 - DNA, 25 bp, Mus musculus
attcccgagggaacccagagagtgg

SEQ ID NO: 543975 - DNA, 25 bp, Mus musculus
attcccgagggatcccagagagtgg

SEQ ID NO: 543976 - DNA, 25 bp, Mus musculus
attcccgtcaataacgtcctccagg

SEQ ID NO: 543977 - DNA, 25 bp, Mus musculus
attcccgtcaattacgtcctccagg

SEQ ID NO: 543978 - DNA, 25 bp, Mus musculus
attccctactccactggcgaggact

SEQ ID NO: 543979 - DNA, 25 bp, Mus musculus
attccctactcctctggcgaggact

SEQ ID NO: 543980 - DNA, 25 bp, Mus musculus
attccctggagcaacccacggcaga

SEQ ID NO: 543981 - DNA, 25 bp, Mus musculus
attccctggagctacccacggcaga

SEQ ID NO: 543982 - DNA, 25 bp, Mus musculus
attccgagcagcagtgcccagtgga

SEQ ID NO: 543983 - DNA, 25 bp, Mus musculus
attccgagcagctgtgcccagtgga

SEQ ID NO: 543984 - DNA, 25 bp, Mus musculus
attccgcaggctctccctgttgagg

SEQ ID NO: 543985 - DNA, 25 bp, Mus musculus
attccgcaggctgtccctgttgagg

SEQ ID NO: 543986 - DNA, 25 bp, Mus musculus
attccgccatgtagagtcttgtggg

SEQ ID NO: 543987 - DNA, 25 bp, Mus musculus
attccgccatgttgagtcttgtggg

SEQ ID NO: 543988 - DNA, 25 bp, Mus musculus
attccgggatttcctactgcctcca

SEQ ID NO: 543989 - DNA, 25 bp, Mus musculus
attccgggatttgctactgcctcca

SEQ ID NO: 543990 - DNA, 25 bp, Mus musculus
attccgtaagccagagctgtggtca

SEQ ID NO: 543991 - DNA, 25 bp, Mus musculus
attccgtaagcctgagctgtggtca

SEQ ID NO: 543992 - DNA, 25 bp, Mus musculus
attcctaaagttccctcagcttcag

SEQ ID NO: 543993 - DNA, 25 bp, Mus musculus
attcctaaagttgcctcagcttcag

SEQ ID NO: 543994 - DNA, 25 bp, Mus musculus
attcctaagcatactctgttcccgg

SEQ ID NO: 543995 - DNA, 25 bp, Mus musculus
attcctaagcattctctgttcccgg

SEQ ID NO: 543996 - DNA, 25 bp, Mus musculus
attcctacaagcaagtgggagtgtc

SEQ ID NO: 543997 - DNA, 25 bp, Mus musculus
attcctacaagctagtgggagtgtc

SEQ ID NO: 543998 - DNA, 25 bp, Mus musculus
attcctacagcaagcgtgccgccga

SEQ ID NO: 543999 - DNA, 25 bp, Mus musculus
attcctacagcatgcgtgccgccga

SEQ ID NO: 544000 - DNA, 25 bp, Mus musculus
attcctagctacattcgagactcca

SEQ ID NO: 544001 - DNA, 25 bp, Mus musculus
attcctagctactttcgagactcca

SEQ ID NO: 544002 - DNA, 25 bp, Mus musculus
attcctccaggaaaactcaccaatc

SEQ ID NO: 544003 - DNA, 25 bp, Mus musculus
attcctccaggataactcaccaatc

SEQ ID NO: 544004 - DNA, 25 bp, Mus musculus
attcctctcaggataacatgcaaag

SEQ ID NO: 544005 - DNA, 25 bp, Mus musculus
attcctctcaggttaacatgcaaag

SEQ ID NO: 544006 - DNA, 25 bp, Mus musculus
attcctctgagaacggcagcctgcg

SEQ ID NO: 544007 - DNA, 25 bp, Mus musculus
attcctctgagatcggcagcctgcg

SEQ ID NO: 544008 - DNA, 25 bp, Mus musculus
attcctgcctcgagttccagcctgt

SEQ ID NO: 544009 - DNA, 25 bp, Mus musculus
attcctgcctcgtgttccagcctgt

SEQ ID NO: 544010 - DNA, 25 bp, Mus musculus
attcctgctgaaccgtggcttgagg

SEQ ID NO: 544011 - DNA, 25 bp, Mus musculus
attcctgctgaagcgtggcttgagg

SEQ ID NO: 544012 - DNA, 25 bp, Mus musculus
attcctggaatgattaccaaagatg

SEQ ID NO: 544013 - DNA, 25 bp, Mus musculus
attcctggaatgtttaccaaagatg

SEQ ID NO: 544014 - DNA, 25 bp, Mus musculus
attcctggcaagcaggacctggcta

SEQ ID NO: 544015 - DNA, 25 bp, Mus musculus
attcctggcaaggaggacctggcta

SEQ ID NO: 544016 - DNA, 25 bp, Mus musculus
attcctggcacgcagacccacatgg

SEQ ID NO: 544017 - DNA, 25 bp, Mus musculus
attcctggcacggagacccacatgg

SEQ ID NO: 544018 - DNA, 25 bp, Mus musculus
attcctggcggcagtcgcccacagt

SEQ ID NO: 544019 - DNA, 25 bp, Mus musculus
attcctggcggctgtcgcccacagt

SEQ ID NO: 544020 - DNA, 25 bp, Mus musculus
attcctgggaagctgaagacccaac

SEQ ID NO: 544021 - DNA, 25 bp, Mus musculus
attcctgggaaggtgaagacccaac

SEQ ID NO: 544022 - DNA, 25 bp, Mus musculus
attcctgtagccctcatggtcaccg

SEQ ID NO: 544023 - DNA, 25 bp, Mus musculus
attcctgtagccgtcatggtcaccg

SEQ ID NO: 544024 - DNA, 25 bp, Mus musculus
attcctgtgggcatcgtggcgtccc

SEQ ID NO: 544025 - DNA, 25 bp, Mus musculus
attcctgtgggcttcgtggcgtccc

SEQ ID NO: 544026 - DNA, 25 bp, Mus musculus
attcctgttataaatgaacggcatc

SEQ ID NO: 544027 - DNA, 25 bp, Mus musculus
attcctgttatatatgaacggcatc

SEQ ID NO: 544028 - DNA, 25 bp, Mus musculus
attccttctctacaccgggatgtgt

SEQ ID NO: 544029 - DNA, 25 bp, Mus musculus
attccttctctagaccgggatgtgt

SEQ ID NO: 544030 - DNA, 25 bp, Mus musculus
attccttctgttcagcctgctgcaa

SEQ ID NO: 544031 - DNA, 25 bp, Mus musculus
attccttctgttgagcctgctgcaa

SEQ ID NO: 544032 - DNA, 25 bp, Mus musculus
attccttgtccactgagctgcagca

SEQ ID NO: 544033 - DNA, 25 bp, Mus musculus
attccttgtccagtgagctgcagca

SEQ ID NO: 544034 - DNA, 25 bp, Mus musculus
attcctttgcagctcaccattggag

SEQ ID NO: 544035 - DNA, 25 bp, Mus musculus
attcctttgcaggtcaccattggag

SEQ ID NO: 544036 - DNA, 25 bp, Mus musculus
attcctttgtgaacggctcgggctg

SEQ ID NO: 544037 - DNA, 25 bp, Mus musculus
attcctttgtgatcggctcgggctg

SEQ ID NO: 544038 - DNA, 25 bp, Mus musculus
attcgaaatgccaattccctgggag

SEQ ID NO: 544039 - DNA, 25 bp, Mus musculus
attcgaaatgcctattccctgggag

SEQ ID NO: 544040 - DNA, 25 bp, Mus musculus
attcgaagagacatgataaaacatg

SEQ ID NO: 544041 - DNA, 25 bp, Mus musculus
attcgaagagacttgataaaacatg

SEQ ID NO: 544042 - DNA, 25 bp, Mus musculus
attcgagttaatccaagagtgagca

SEQ ID NO: 544043 - DNA, 25 bp, Mus musculus
attcgagttaatgcaagagtgagca

SEQ ID NO: 544044 - DNA, 25 bp, Mus musculus
attcgataaagaaggtgacggcacc

SEQ ID NO: 544045 - DNA, 25 bp, Mus musculus
attcgataaagatggtgacggcacc

SEQ ID NO: 544046 - DNA, 25 bp, Mus musculus
attcgatgtacaatgagaacctgga

SEQ ID NO: 544047 - DNA, 25 bp, Mus musculus
attcgatgtacattgagaacctgga

SEQ ID NO: 544048 - DNA, 25 bp, Mus musculus
attcgcaactacactgccaatgcca

SEQ ID NO: 544049 - DNA, 25 bp, Mus musculus
attcgcaactactctgccaatgcca

SEQ ID NO: 544050 - DNA, 25 bp, Mus musculus
attcgcagcgcaaggctctcagagg

SEQ ID NO: 544051 - DNA, 25 bp, Mus musculus
attcgcagcgcatggctctcagagg

SEQ ID NO: 544052 - DNA, 25 bp, Mus musculus
attcgcccgaagagcaggacctctt

SEQ ID NO: 544053 - DNA, 25 bp, Mus musculus
attcgcccgaagtgcaggacctctt

SEQ ID NO: 544054 - DNA, 25 bp, Mus musculus
attcgcctcggcctggcgctgaatt

SEQ ID NO: 544055 - DNA, 25 bp, Mus musculus
attcgcctcggcgtggcgctgaatt

SEQ ID NO: 544056 - DNA, 25 bp, Mus musculus
attcgctcggagacgcggacagaac

SEQ ID NO: 544057 - DNA, 25 bp, Mus musculus
attcgctcggagtcgcggacagaac

SEQ ID NO: 544058 - DNA, 25 bp, Mus musculus
attcgctgcgcgctctccggctagg

SEQ ID NO: 544059 - DNA, 25 bp, Mus musculus
attcgctgcgcggtctccggctagg

SEQ ID NO: 544060 - DNA, 25 bp, Mus musculus
attcgcttagcacaagcccatgcta

SEQ ID NO: 544061 - DNA, 25 bp, Mus musculus
attcgcttagcagaagcccatgcta

SEQ ID NO: 544062 - DNA, 25 bp, Mus musculus
attcggactgcgcagccatgctgcg

SEQ ID NO: 544063 - DNA, 25 bp, Mus musculus
attcggactgcggagccatgctgcg

SEQ ID NO: 544064 - DNA, 25 bp, Mus musculus
attcggagtgaccatgggagtccat

SEQ ID NO: 544065 - DNA, 25 bp, Mus musculus
attcggagtgacgatgggagtccat

SEQ ID NO: 544066 - DNA, 25 bp, Mus musculus
attcggatgatgacctgccctccag

SEQ ID NO: 544067 - DNA, 25 bp, Mus musculus
attcggatgatgtcctgccctccag

SEQ ID NO: 544068 - DNA, 25 bp, Mus musculus
attcggcccctcaggagacactact

SEQ ID NO: 544069 - DNA, 25 bp, Mus musculus
attcggcccctctggagacactact

SEQ ID NO: 544070 - DNA, 25 bp, Mus musculus
attcggcttcgcctccaaaaccaag

SEQ ID NO: 544071 - DNA, 25 bp, Mus musculus
attcggcttcgcgtccaaaaccaag

SEQ ID NO: 544072 - DNA, 25 bp, Mus musculus
attcggcttgctcagactgaagcgc

SEQ ID NO: 544073 - DNA, 25 bp, Mus musculus
attcggcttgctgagactgaagcgc

SEQ ID NO: 544074 - DNA, 25 bp, Mus musculus
attcgtgtacatcaactctggcatg

SEQ ID NO: 544075 - DNA, 25 bp, Mus musculus
attcgtgtacatgaactctggcatg

SEQ ID NO: 544076 - DNA, 25 bp, Mus musculus
attctaagcttcaggagattctgag

SEQ ID NO: 544077 - DNA, 25 bp, Mus musculus
attctaagcttctggagattctgag

SEQ ID NO: 544078 - DNA, 25 bp, Mus musculus
attctaccagacagcttacctctag

SEQ ID NO: 544079 - DNA, 25 bp, Mus musculus
attctaccagactgcttacctctag

SEQ ID NO: 544080 - DNA, 25 bp, Mus musculus
attctactttttcagatgtctcctg

SEQ ID NO: 544081 - DNA, 25 bp, Mus musculus
attctactttttgagatgtctcctg

SEQ ID NO: 544082 - DNA, 25 bp, Mus musculus
attctagacgtaccgcggagtgcgt

SEQ ID NO: 544083 - DNA, 25 bp, Mus musculus
attctagacgtagcgcggagtgcgt

SEQ ID NO: 544084 - DNA, 25 bp, Mus musculus
attctcagctacatgggtgagctgc

SEQ ID NO: 544085 - DNA, 25 bp, Mus musculus
attctcagctacttgggtgagctgc

SEQ ID NO: 544086 - DNA, 25 bp, Mus musculus
attctccaacaaccgaggacttcca

SEQ ID NO: 544087 - DNA, 25 bp, Mus musculus
attctccaacaagcgaggacttcca

SEQ ID NO: 544088 - DNA, 25 bp, Mus musculus
attctccatgagcaactgttccaca

SEQ ID NO: 544089 - DNA, 25 bp, Mus musculus
attctccatgaggaactgttccaca

SEQ ID NO: 544090 - DNA, 25 bp, Mus musculus
attctccctaggaggcgcttccatg

SEQ ID NO: 544091 - DNA, 25 bp, Mus musculus
attctccctaggtggcgcttccatg

SEQ ID NO: 544092 - DNA, 25 bp, Mus musculus
attctccgagtcaagtcagaggagg

SEQ ID NO: 544093 - DNA, 25 bp, Mus musculus
attctccgagtctagtcagaggagg

SEQ ID NO: 544094 - DNA, 25 bp, Mus musculus
attctcggaagcaagaagcggagtg

SEQ ID NO: 544095 - DNA, 25 bp, Mus musculus
attctcggaagctagaagcggagtg

SEQ ID NO: 544096 - DNA, 25 bp, Mus musculus
attctctaggacctgcactggaacc

SEQ ID NO: 544097 - DNA, 25 bp, Mus musculus
attctctaggacgtgcactggaacc

SEQ ID NO: 544098 - DNA, 25 bp, Mus musculus
attctctgaaaccaaatgaccagat

SEQ ID NO: 544099 - DNA, 25 bp, Mus musculus
attctctgaaacgaaatgaccagat

SEQ ID NO: 544100 - DNA, 25 bp, Mus musculus
attctctggcgtcaggctgcagaag

SEQ ID NO: 544101 - DNA, 25 bp, Mus musculus
attctctggcgtgaggctgcagaag

SEQ ID NO: 544102 - DNA, 25 bp, Mus musculus
attctgaaacgccaactagaagaga

SEQ ID NO: 544103 - DNA, 25 bp, Mus musculus
attctgaaacgcgaactagaagaga

SEQ ID NO: 544104 - DNA, 25 bp, Mus musculus
attctgaagcaaaatgatcatccca

SEQ ID NO: 544105 - DNA, 25 bp, Mus musculus
attctgaagcaatatgatcatccca

SEQ ID NO: 544106 - DNA, 25 bp, Mus musculus
attctgacggacaaaggaggcactt

SEQ ID NO: 544107 - DNA, 25 bp, Mus musculus
attctgacggactaaggaggcactt

SEQ ID NO: 544108 - DNA, 25 bp, Mus musculus
attctgactgcaccgaggacggcga

SEQ ID NO: 544109 - DNA, 25 bp, Mus musculus
attctgactgcagcgaggacggcga

SEQ ID NO: 544110 - DNA, 25 bp, Mus musculus
attctgagtgcaccgtggagcccat

SEQ ID NO: 544111 - DNA, 25 bp, Mus musculus
attctgagtgcagcgtggagcccat

SEQ ID NO: 544112 - DNA, 25 bp, Mus musculus
attctgccgtgcaggcaggccttga

SEQ ID NO: 544113 - DNA, 25 bp, Mus musculus
attctgccgtgctggcaggccttga

SEQ ID NO: 544114 - DNA, 25 bp, Mus musculus
attctgcctagtcgccattggcagg

SEQ ID NO: 544115 - DNA, 25 bp, Mus musculus
attctgcctagtggccattggcagg

SEQ ID NO: 544116 - DNA, 25 bp, Mus musculus
attctggaccgtaaccctcgcttgc

SEQ ID NO: 544117 - DNA, 25 bp, Mus musculus
attctggaccgttaccctcgcttgc

SEQ ID NO: 544118 - DNA, 25 bp, Mus musculus
attctggattttcggctggctcggc

SEQ ID NO: 544119 - DNA, 25 bp, Mus musculus
attctggattttgggctggctcggc

SEQ ID NO: 544120 - DNA, 25 bp, Mus musculus
attctggccagtcgtggaccccaag

SEQ ID NO: 544121 - DNA, 25 bp, Mus musculus
attctggccagtggtggaccccaag

SEQ ID NO: 544122 - DNA, 25 bp, Mus musculus
attctgggagtgaagagagaatccg

SEQ ID NO: 544123 - DNA, 25 bp, Mus musculus
attctgggagtgtagagagaatccg

SEQ ID NO: 544124 - DNA, 25 bp, Mus musculus
attctgggctcaataaccatcagcg

SEQ ID NO: 544125 - DNA, 25 bp, Mus musculus
attctgggctcattaaccatcagcg

SEQ ID NO: 544126 - DNA, 25 bp, Mus musculus
attctggtcactcgatcctctggag

SEQ ID NO: 544127 - DNA, 25 bp, Mus musculus
attctggtcactggatcctctggag

SEQ ID NO: 544128 - DNA, 25 bp, Mus musculus
attctggtgctaagaaaccatggca

SEQ ID NO: 544129 - DNA, 25 bp, Mus musculus
attctggtgctatgaaaccatggca

SEQ ID NO: 544130 - DNA, 25 bp, Mus musculus
attctggttgcccacacagtggtgg

SEQ ID NO: 544131 - DNA, 25 bp, Mus musculus
attctggttgccgacacagtggtgg

SEQ ID NO: 544132 - DNA, 25 bp, Mus musculus
attctgtacccacagattccaaaga

SEQ ID NO: 544133 - DNA, 25 bp, Mus musculus
attctgtacccagagattccaaaga

SEQ ID NO: 544134 - DNA, 25 bp, Mus musculus
attctgtacgaacggctcctgggtg

SEQ ID NO: 544135 - DNA, 25 bp, Mus musculus
attctgtacgaagggctcctgggtg

SEQ ID NO: 544136 - DNA, 25 bp, Mus musculus
attctgtagcccagcagccctgtag

SEQ ID NO: 544137 - DNA, 25 bp, Mus musculus
attctgtagccctgcagccctgtag

SEQ ID NO: 544138 - DNA, 25 bp, Mus musculus
attctgtgtactcccgcctggtgct

SEQ ID NO: 544139 - DNA, 25 bp, Mus musculus
attctgtgtactgccgcctggtgct

SEQ ID NO: 544140 - DNA, 25 bp, Mus musculus
attcttcagcctccgataggcagag

SEQ ID NO: 544141 - DNA, 25 bp, Mus musculus
attcttcagcctgcgataggcagag

SEQ ID NO: 544142 - DNA, 25 bp, Mus musculus
attcttctctttcgccacgacatga

SEQ ID NO: 544143 - DNA, 25 bp, Mus musculus
attcttctctttggccacgacatga

SEQ ID NO: 544144 - DNA, 25 bp, Mus musculus
attcttcttcagaccctcagggacc

SEQ ID NO: 544145 - DNA, 25 bp, Mus musculus
attcttcttcagtccctcagggacc

SEQ ID NO: 544146 - DNA, 25 bp, Mus musculus
attcttcttcgacgaagacatcggg

SEQ ID NO: 544147 - DNA, 25 bp, Mus musculus
attcttcttcgaggaagacatcggg

SEQ ID NO: 544148 - DNA, 25 bp, Mus musculus
attcttgccacaccagttcaggaag

SEQ ID NO: 544149 - DNA, 25 bp, Mus musculus
attcttgccacagcagttcaggaag

SEQ ID NO: 544150 - DNA, 25 bp, Mus musculus
attcttgcttttaggaggtccaggc

SEQ ID NO: 544151 - DNA, 25 bp, Mus musculus
attcttgctttttggaggtccaggc

SEQ ID NO: 544152 - DNA, 25 bp, Mus musculus
attctttaagatatccatgtgaggg

SEQ ID NO: 544153 - DNA, 25 bp, Mus musculus
attctttaagatttccatgtgaggg

SEQ ID NO: 544154 - DNA, 25 bp, Mus musculus
attctttgtggtctttgtgcatcag

SEQ ID NO: 544155 - DNA, 25 bp, Mus musculus
attctttgtggtgtttgtgcatcag

SEQ ID NO: 544156 - DNA, 25 bp, Mus musculus
attgaaaagcagaacagagccacga

SEQ ID NO: 544157 - DNA, 25 bp, Mus musculus
attgaaaagcagtacagagccacga

SEQ ID NO: 544158 - DNA, 25 bp, Mus musculus
attgaaaatatccaactaccgcaca

SEQ ID NO: 544159 - DNA, 25 bp, Mus musculus
attgaaaatatcgaactaccgcaca

SEQ ID NO: 544160 - DNA, 25 bp, Mus musculus
attgaaacagttcgctcgacaggca

SEQ ID NO: 544161 - DNA, 25 bp, Mus musculus
attgaaacagttggctcgacaggca

SEQ ID NO: 544162 - DNA, 25 bp, Mus musculus
attgaaactcgccaggatggtgtct

SEQ ID NO: 544163 - DNA, 25 bp, Mus musculus
attgaaactcgcgaggatggtgtct

SEQ ID NO: 544164 - DNA, 25 bp, Mus musculus
attgaaagccgaccccaaaaagatg

SEQ ID NO: 544165 - DNA, 25 bp, Mus musculus
attgaaagccgagcccaaaaagatg

SEQ ID NO: 544166 - DNA, 25 bp, Mus musculus
attgaacaaatgaaaatcatcaggg

SEQ ID NO: 544167 - DNA, 25 bp, Mus musculus
attgaacaaatgtaaatcatcaggg

SEQ ID NO: 544168 - DNA, 25 bp, Mus musculus
attgaacaaggcataccaaaagcca

SEQ ID NO: 544169 - DNA, 25 bp, Mus musculus
attgaacaaggcttaccaaaagcca

SEQ ID NO: 544170 - DNA, 25 bp, Mus musculus
attgaacaccggctgatgatggagc

SEQ ID NO: 544171 - DNA, 25 bp, Mus musculus
attgaacaccgggtgatgatggagc

SEQ ID NO: 544172 - DNA, 25 bp, Mus musculus
attgaacatcgacatgcacaaacag

SEQ ID NO: 544173 - DNA, 25 bp, Mus musculus
attgaacatcgagatgcacaaacag

SEQ ID NO: 544174 - DNA, 25 bp, Mus musculus
attgaacatgcacagaaagagcttc

SEQ ID NO: 544175 - DNA, 25 bp, Mus musculus
attgaacatgcagagaaagagcttc

SEQ ID NO: 544176 - DNA, 25 bp, Mus musculus
attgaacatggacctatgccagaac

SEQ ID NO: 544177 - DNA, 25 bp, Mus musculus
attgaacatggagctatgccagaac

SEQ ID NO: 544178 - DNA, 25 bp, Mus musculus
attgaactacgccagctggcaccgt

SEQ ID NO: 544179 - DNA, 25 bp, Mus musculus
attgaactacgcgagctggcaccgt

SEQ ID NO: 544180 - DNA, 25 bp, Mus musculus
attgaacttcccaccttataccagg

SEQ ID NO: 544181 - DNA, 25 bp, Mus musculus
attgaacttccctccttataccagg

SEQ ID NO: 544182 - DNA, 25 bp, Mus musculus
attgaagacaagcaggcgtggcacg

SEQ ID NO: 544183 - DNA, 25 bp, Mus musculus
attgaagacaaggaggcgtggcacg

SEQ ID NO: 544184 - DNA, 25 bp, Mus musculus
attgaagcaagaagttatcagcacc

SEQ ID NO: 544185 - DNA, 25 bp, Mus musculus
attgaagcaagatgttatcagcacc

SEQ ID NO: 544186 - DNA, 25 bp, Mus musculus
attgaaggagacatggaacgcacgg

SEQ ID NO: 544187 - DNA, 25 bp, Mus musculus
attgaaggagacttggaacgcacgg

SEQ ID NO: 544188 - DNA, 25 bp, Mus musculus
attgaaggttccaacaaggtgccag

SEQ ID NO: 544189 - DNA, 25 bp, Mus musculus
attgaaggttcctacaaggtgccag

SEQ ID NO: 544190 - DNA, 25 bp, Mus musculus
attgaagtctctaccggtgggagtc

SEQ ID NO: 544191 - DNA, 25 bp, Mus musculus
attgaagtctcttccggtgggagtc

SEQ ID NO: 544192 - DNA, 25 bp, Mus musculus
attgaataccagcagaagccgttgc

SEQ ID NO: 544193 - DNA, 25 bp, Mus musculus
attgaataccaggagaagccgttgc

SEQ ID NO: 544194 - DNA, 25 bp, Mus musculus
attgaatcatatcagaagcccttat

SEQ ID NO: 544195 - DNA, 25 bp, Mus musculus
attgaatcatatgagaagcccttat

SEQ ID NO: 544196 - DNA, 25 bp, Mus musculus
attgaatgtggcctcagatttcttc

SEQ ID NO: 544197 - DNA, 25 bp, Mus musculus
attgaatgtggcgtcagatttcttc

SEQ ID NO: 544198 - DNA, 25 bp, Mus musculus
attgacaggcgcagcccctcgatgt

SEQ ID NO: 544199 - DNA, 25 bp, Mus musculus
attgacaggcgctgcccctcgatgt

SEQ ID NO: 544200 - DNA, 25 bp, Mus musculus
attgacagttatccccaacaagacc

SEQ ID NO: 544201 - DNA, 25 bp, Mus musculus
attgacagttatgcccaacaagacc

SEQ ID NO: 544202 - DNA, 25 bp, Mus musculus
attgaccacagtcgcgtccggctcg

SEQ ID NO: 544203 - DNA, 25 bp, Mus musculus
attgaccacagtggcgtccggctcg

SEQ ID NO: 544204 - DNA, 25 bp, Mus musculus
attgaccagcgaagaactttctgag

SEQ ID NO: 544205 - DNA, 25 bp, Mus musculus
attgaccagcgatgaactttctgag

SEQ ID NO: 544206 - DNA, 25 bp, Mus musculus
attgacccagccctacggcgatttg

SEQ ID NO: 544207 - DNA, 25 bp, Mus musculus
attgacccagccgtacggcgatttg

SEQ ID NO: 544208 - DNA, 25 bp, Mus musculus
attgacgaatgtccgggcagcccct

SEQ ID NO: 544209 - DNA, 25 bp, Mus musculus
attgacgaatgtgcgggcagcccct

SEQ ID NO: 544210 - DNA, 25 bp, Mus musculus
attgacgagtatcccgaaaacactt

SEQ ID NO: 544211 - DNA, 25 bp, Mus musculus
attgacgagtatgccgaaaacactt

SEQ ID NO: 544212 - DNA, 25 bp, Mus musculus
attgactacaggatgaggtgcatcc

SEQ ID NO: 544213 - DNA, 25 bp, Mus musculus
attgactacaggttgaggtgcatcc

SEQ ID NO: 544214 - DNA, 25 bp, Mus musculus
attgactcgtggagcaaagacaaca

SEQ ID NO: 544215 - DNA, 25 bp, Mus musculus
attgactcgtggtgcaaagacaaca

SEQ ID NO: 544216 - DNA, 25 bp, Mus musculus
attgacttactacagcgtcttaaag

SEQ ID NO: 544217 - DNA, 25 bp, Mus musculus
attgacttactagagcgtcttaaag

SEQ ID NO: 544218 - DNA, 25 bp, Mus musculus
attgacttccttcctgagaaggacc

SEQ ID NO: 544219 - DNA, 25 bp, Mus musculus
attgacttccttgctgagaaggacc

SEQ ID NO: 544220 - DNA, 25 bp, Mus musculus
attgagaaagctctcaaggaagcca

SEQ ID NO: 544221 - DNA, 25 bp, Mus musculus
attgagaaagctgtcaaggaagcca

SEQ ID NO: 544222 - DNA, 25 bp, Mus musculus
attgagaatgggagcctgagttttc

SEQ ID NO: 544223 - DNA, 25 bp, Mus musculus
attgagaatgggtgcctgagttttc

SEQ ID NO: 544224 - DNA, 25 bp, Mus musculus
attgagacccacatcgacgaactcc

SEQ ID NO: 544225 - DNA, 25 bp, Mus musculus
attgagacccacttcgacgaactcc

SEQ ID NO: 544226 - DNA, 25 bp, Mus musculus
attgagagtgagattaggcgagaac

SEQ ID NO: 544227 - DNA, 25 bp, Mus musculus
attgagagtgagtttaggcgagaac

SEQ ID NO: 544228 - DNA, 25 bp, Mus musculus
attgagatagacatcgaacccacag

SEQ ID NO: 544229 - DNA, 25 bp, Mus musculus
attgagatagacttcgaacccacag

SEQ ID NO: 544230 - DNA, 25 bp, Mus musculus
attgagccccagagcaatattccag

SEQ ID NO: 544231 - DNA, 25 bp, Mus musculus
attgagccccagtgcaatattccag

SEQ ID NO: 544232 - DNA, 25 bp, Mus musculus
attgagccctttcacgacaggaccc

SEQ ID NO: 544233 - DNA, 25 bp, Mus musculus
attgagccctttgacgacaggaccc

SEQ ID NO: 544234 - DNA, 25 bp, Mus musculus
attgagccgctacacgacatcgcag

SEQ ID NO: 544235 - DNA, 25 bp, Mus musculus
attgagccgctagacgacatcgcag

SEQ ID NO: 544236 - DNA, 25 bp, Mus musculus
attgaggacttgaagtcggagctga

SEQ ID NO: 544237 - DNA, 25 bp, Mus musculus
attgaggacttgtagtcggagctga

SEQ ID NO: 544238 - DNA, 25 bp, Mus musculus
attgaggagcaaagatttggtggcc

SEQ ID NO: 544239 - DNA, 25 bp, Mus musculus
attgaggagcaatgatttggtggcc

SEQ ID NO: 544240 - DNA, 25 bp, Mus musculus
attgaggagcagcacaaggagatcc

SEQ ID NO: 544241 - DNA, 25 bp, Mus musculus
attgaggagcaggacaaggagatcc

SEQ ID NO: 544242 - DNA, 25 bp, Mus musculus
attgaggagcccctgcgccagaaga

SEQ ID NO: 544243 - DNA, 25 bp, Mus musculus
attgaggagcccgtgcgccagaaga

SEQ ID NO: 544244 - DNA, 25 bp, Mus musculus
attgaggatgagacgcaggtgtctc

SEQ ID NO: 544245 - DNA, 25 bp, Mus musculus
attgaggatgagtcgcaggtgtctc

SEQ ID NO: 544246 - DNA, 25 bp, Mus musculus
attgagggcaatattgcaagtggga

SEQ ID NO: 544247 - DNA, 25 bp, Mus musculus
attgagggcaattttgcaagtggga

SEQ ID NO: 544248 - DNA, 25 bp, Mus musculus
attgagggccagctacaacaacccc

SEQ ID NO: 544249 - DNA, 25 bp, Mus musculus
attgagggccaggtacaacaacccc

SEQ ID NO: 544250 - DNA, 25 bp, Mus musculus
attgagggccccatcgatgctgcct

SEQ ID NO: 544251 - DNA, 25 bp, Mus musculus
attgagggccccttcgatgctgcct

SEQ ID NO: 544252 - DNA, 25 bp, Mus musculus
attgaggtggcgctctctggctttc

SEQ ID NO: 544253 - DNA, 25 bp, Mus musculus
attgaggtggcggtctctggctttc

SEQ ID NO: 544254 - DNA, 25 bp, Mus musculus
attgagtaggagcacacaggcgcac

SEQ ID NO: 544255 - DNA, 25 bp, Mus musculus
attgagtaggaggacacaggcgcac

SEQ ID NO: 544256 - DNA, 25 bp, Mus musculus
attgagtgttacctctgcgggcagt

SEQ ID NO: 544257 - DNA, 25 bp, Mus musculus
attgagtgttacgtctgcgggcagt

SEQ ID NO: 544258 - DNA, 25 bp, Mus musculus
attgataaaaaaccgtgttccttct

SEQ ID NO: 544259 - DNA, 25 bp, Mus musculus
attgataaaaaagcgtgttccttct

SEQ ID NO: 544260 - DNA, 25 bp, Mus musculus
attgatcagcaccaccggaaccagt

SEQ ID NO: 544261 - DNA, 25 bp, Mus musculus
attgatcagcacgaccggaaccagt

SEQ ID NO: 544262 - DNA, 25 bp, Mus musculus
attgatccaaccagaacaatctctg

SEQ ID NO: 544263 - DNA, 25 bp, Mus musculus
attgatccaacctgaacaatctctg

SEQ ID NO: 544264 - DNA, 25 bp, Mus musculus
attgatctccgacatgaccccaaaa

SEQ ID NO: 544265 - DNA, 25 bp, Mus musculus
attgatctccgagatgaccccaaaa

SEQ ID NO: 544266 - DNA, 25 bp, Mus musculus
attgatcttgatcgaaaaagttccc

SEQ ID NO: 544267 - DNA, 25 bp, Mus musculus
attgatcttgatggaaaaagttccc

SEQ ID NO: 544268 - DNA, 25 bp, Mus musculus
attgatgaagacagtgggcccacca

SEQ ID NO: 544269 - DNA, 25 bp, Mus musculus
attgatgaagactgtgggcccacca

SEQ ID NO: 544270 - DNA, 25 bp, Mus musculus
attgatgaccgcagaacaccggcca

SEQ ID NO: 544271 - DNA, 25 bp, Mus musculus
attgatgaccgctgaacaccggcca

SEQ ID NO: 544272 - DNA, 25 bp, Mus musculus
attgatgcatatacctgatcttcca

SEQ ID NO: 544273 - DNA, 25 bp, Mus musculus
attgatgcatattcctgatcttcca

SEQ ID NO: 544274 - DNA, 25 bp, Mus musculus
attgatgctgttcttagcgtggcgc

SEQ ID NO: 544275 - DNA, 25 bp, Mus musculus
attgatgctgttgttagcgtggcgc

SEQ ID NO: 544276 - DNA, 25 bp, Mus musculus
attgatgtgcagacgggcatgctca

SEQ ID NO: 544277 - DNA, 25 bp, Mus musculus
attgatgtgcagtcgggcatgctca

SEQ ID NO: 544278 - DNA, 25 bp, Mus musculus
attgcaaagccactgacatccaaca

SEQ ID NO: 544279 - DNA, 25 bp, Mus musculus
attgcaaagccagtgacatccaaca

SEQ ID NO: 544280 - DNA, 25 bp, Mus musculus
attgcacaggacagcgggccgcgac

SEQ ID NO: 544281 - DNA, 25 bp, Mus musculus
attgcacaggactgcgggccgcgac

SEQ ID NO: 544282 - DNA, 25 bp, Mus musculus
attgcacagtcccagtctggtactg

SEQ ID NO: 544283 - DNA, 25 bp, Mus musculus
attgcacagtccgagtctggtactg

SEQ ID NO: 544284 - DNA, 25 bp, Mus musculus
attgcacccatgctcgccaagcttg

SEQ ID NO: 544285 - DNA, 25 bp, Mus musculus
attgcacccatggtcgccaagcttg

SEQ ID NO: 544286 - DNA, 25 bp, Mus musculus
attgcactgcagaggcgccgagacc

SEQ ID NO: 544287 - DNA, 25 bp, Mus musculus
attgcactgcagtggcgccgagacc

SEQ ID NO: 544288 - DNA, 25 bp, Mus musculus
attgcagagtcgctagttgcagaag

SEQ ID NO: 544289 - DNA, 25 bp, Mus musculus
attgcagagtcggtagttgcagaag

SEQ ID NO: 544290 - DNA, 25 bp, Mus musculus
attgcagatgttactgggattcctc

SEQ ID NO: 544291 - DNA, 25 bp, Mus musculus
attgcagatgtttctgggattcctc

SEQ ID NO: 544292 - DNA, 25 bp, Mus musculus
attgcagccctgagtgactgggcag

SEQ ID NO: 544293 - DNA, 25 bp, Mus musculus
attgcagccctgctgatattgatgc

SEQ ID NO: 544294 - DNA, 25 bp, Mus musculus
attgcagccctggtgatattgatgc

SEQ ID NO: 544295 - DNA, 25 bp, Mus musculus
attgcagccctgtgtgactgggcag

SEQ ID NO: 544296 - DNA, 25 bp, Mus musculus
attgcagggtttagtgccgctgtga

SEQ ID NO: 544297 - DNA, 25 bp, Mus musculus
attgcagggttttgtgccgctgtga

SEQ ID NO: 544298 - DNA, 25 bp, Mus musculus
attgcatatgcccatagtaccatca

SEQ ID NO: 544299 - DNA, 25 bp, Mus musculus
attgcatatgccgatagtaccatca

SEQ ID NO: 544300 - DNA, 25 bp, Mus musculus
attgcattccgcaggctctccctgt

SEQ ID NO: 544301 - DNA, 25 bp, Mus musculus
attgcattccgctggctctccctgt

SEQ ID NO: 544302 - DNA, 25 bp, Mus musculus
attgccaaccagatccctgacatct

SEQ ID NO: 544303 - DNA, 25 bp, Mus musculus
attgccaaccagttccctgacatct

SEQ ID NO: 544304 - DNA, 25 bp, Mus musculus
attgccaacgtgctgtatatcgagt

SEQ ID NO: 544305 - DNA, 25 bp, Mus musculus
attgccaacgtggtgtatatcgagt

SEQ ID NO: 544306 - DNA, 25 bp, Mus musculus
attgccaatggacaccggcagtccc

SEQ ID NO: 544307 - DNA, 25 bp, Mus musculus
attgccaatggagaccggcagtccc

SEQ ID NO: 544308 - DNA, 25 bp, Mus musculus
attgccacagcactgaagttcctac

SEQ ID NO: 544309 - DNA, 25 bp, Mus musculus
attgccacagcagtgaagttcctac

SEQ ID NO: 544310 - DNA, 25 bp, Mus musculus
attgccagccatctgtgtgtaagcc

SEQ ID NO: 544311 - DNA, 25 bp, Mus musculus
attgccagccatgtgtgtgtaagcc

SEQ ID NO: 544312 - DNA, 25 bp, Mus musculus
attgccagcctgcatgctccgcgat

SEQ ID NO: 544313 - DNA, 25 bp, Mus musculus
attgccagcctggatgctccgcgat

SEQ ID NO: 544314 - DNA, 25 bp, Mus musculus
attgccagggcaacaggtgtagcag

SEQ ID NO: 544315 - DNA, 25 bp, Mus musculus
attgccagggcatcaggtgtagcag

SEQ ID NO: 544316 - DNA, 25 bp, Mus musculus
attgcccaaattcatcccactgaag

SEQ ID NO: 544317 - DNA, 25 bp, Mus musculus
attgcccaaattgatcccactgaag

SEQ ID NO: 544318 - DNA, 25 bp, Mus musculus
attgcccagaatccacagaaccaag

SEQ ID NO: 544319 - DNA, 25 bp, Mus musculus
attgcccagaatgcacagaaccaag

SEQ ID NO: 544320 - DNA, 25 bp, Mus musculus
attgcccagcttctgccacaggagg

SEQ ID NO: 544321 - DNA, 25 bp, Mus musculus
attgcccagcttgtgccacaggagg

SEQ ID NO: 544322 - DNA, 25 bp, Mus musculus
attgcccaggcacagtctctacgct

SEQ ID NO: 544323 - DNA, 25 bp, Mus musculus
attgcccaggcagagtctctacgct

SEQ ID NO: 544324 - DNA, 25 bp, Mus musculus
attgccccaacaccggagcaggagt

SEQ ID NO: 544325 - DNA, 25 bp, Mus musculus
attgccccaacagcggagcaggagt

SEQ ID NO: 544326 - DNA, 25 bp, Mus musculus
attgcccgcggacggaccgcgcgga

SEQ ID NO: 544327 - DNA, 25 bp, Mus musculus
attgcccgcggagggaccgcgcgga

SEQ ID NO: 544328 - DNA, 25 bp, Mus musculus
attgcccgggatcagaccaagtcaa

SEQ ID NO: 544329 - DNA, 25 bp, Mus musculus
attgcccgggatgagaccaagtcaa

SEQ ID NO: 544330 - DNA, 25 bp, Mus musculus
attgcccttcgcatggagaccacag

SEQ ID NO: 544331 - DNA, 25 bp, Mus musculus
attgcccttcgcttggagaccacag

SEQ ID NO: 544332 - DNA, 25 bp, Mus musculus
attgccgcccggcacgatgatgccg

SEQ ID NO: 544333 - DNA, 25 bp, Mus musculus
attgccgcccgggacgatgatgccg

SEQ ID NO: 544334 - DNA, 25 bp, Mus musculus
attgccgccggcagacgcgcgaagc

SEQ ID NO: 544335 - DNA, 25 bp, Mus musculus
attgccgccggctgacgcgcgaagc

SEQ ID NO: 544336 - DNA, 25 bp, Mus musculus
attgccggggccactccaagagaaa

SEQ ID NO: 544337 - DNA, 25 bp, Mus musculus
attgccggggcctctccaagagaaa

SEQ ID NO: 544338 - DNA, 25 bp, Mus musculus
attgccgtcggtcgacctggatagt

SEQ ID NO: 544339 - DNA, 25 bp, Mus musculus
attgccgtcggtggacctggatagt

SEQ ID NO: 544340 - DNA, 25 bp, Mus musculus
attgccgtggctagcccttctcacg

SEQ ID NO: 544341 - DNA, 25 bp, Mus musculus
attgccgtggcttgcccttctcacg

SEQ ID NO: 544342 - DNA, 25 bp, Mus musculus
attgcctacctcaacaatgaaggcc

SEQ ID NO: 544343 - DNA, 25 bp, Mus musculus
attgcctacctctacaatgaaggcc

SEQ ID NO: 544344 - DNA, 25 bp, Mus musculus
attgcctcgcggcacaacggtcggc

SEQ ID NO: 544345 - DNA, 25 bp, Mus musculus
attgcctcgcgggacaacggtcggc

SEQ ID NO: 544346 - DNA, 25 bp, Mus musculus
attgcctgttttcaagagggagagt

SEQ ID NO: 544347 - DNA, 25 bp, Mus musculus
attgcctgttttgaagagggagagt

SEQ ID NO: 544348 - DNA, 25 bp, Mus musculus
attgccttgcccaaacctacgtcta

SEQ ID NO: 544349 - DNA, 25 bp, Mus musculus
attgccttgccctaacctacgtcta

SEQ ID NO: 544350 - DNA, 25 bp, Mus musculus
attgccttgggacctgcgctttcgc

SEQ ID NO: 544351 - DNA, 25 bp, Mus musculus
attgccttgggagctgcgctttcgc

SEQ ID NO: 544352 - DNA, 25 bp, Mus musculus
attgcgccggttcgttctctcgctc

SEQ ID NO: 544353 - DNA, 25 bp, Mus musculus
attgcgccggttggttctctcgctc

SEQ ID NO: 544354 - DNA, 25 bp, Mus musculus
attgcggggctcagccacgacctag

SEQ ID NO: 544355 - DNA, 25 bp, Mus musculus
attgcggggctctgccacgacctag

SEQ ID NO: 544356 - DNA, 25 bp, Mus musculus
attgcgtcccttcctcttcggactt

SEQ ID NO: 544357 - DNA, 25 bp, Mus musculus
attgcgtcccttgctcttcggactt

SEQ ID NO: 544358 - DNA, 25 bp, Mus musculus
attgcgtttggaatgggaattgaca

SEQ ID NO: 544359 - DNA, 25 bp, Mus musculus
attgcgtttggattgggaattgaca

SEQ ID NO: 544360 - DNA, 25 bp, Mus musculus
attgctactgtcaccatctgtaaga

SEQ ID NO: 544361 - DNA, 25 bp, Mus musculus
attgctactgtctccatctgtaaga

SEQ ID NO: 544362 - DNA, 25 bp, Mus musculus
attgctatatccctgcaccgttcct

SEQ ID NO: 544363 - DNA, 25 bp, Mus musculus
attgctatatccgtgcaccgttcct

SEQ ID NO: 544364 - DNA, 25 bp, Mus musculus
attgctcacccacgcaacagtgtgg

SEQ ID NO: 544365 - DNA, 25 bp, Mus musculus
attgctcacccaggcaacagtgtgg

SEQ ID NO: 544366 - DNA, 25 bp, Mus musculus
attgctcagcaactcaaagggaaga

SEQ ID NO: 544367 - DNA, 25 bp, Mus musculus
attgctcagcaagtcaaagggaaga

SEQ ID NO: 544368 - DNA, 25 bp, Mus musculus
attgctccagctagctcacccaggg

SEQ ID NO: 544369 - DNA, 25 bp, Mus musculus
attgctccagcttgctcacccaggg

SEQ ID NO: 544370 - DNA, 25 bp, Mus musculus
attgctctcctcaatttctccctgg

SEQ ID NO: 544371 - DNA, 25 bp, Mus musculus
attgctctcctctatttctccctgg

SEQ ID NO: 544372 - DNA, 25 bp, Mus musculus
attgctcttaaactcggtgtaaccg

SEQ ID NO: 544373 - DNA, 25 bp, Mus musculus
attgctcttaaagtcggtgtaaccg

SEQ ID NO: 544374 - DNA, 25 bp, Mus musculus
attgctgagatcctcctgtggtttt

SEQ ID NO: 544375 - DNA, 25 bp, Mus musculus
attgctgagatcgtcctgtggtttt

SEQ ID NO: 544376 - DNA, 25 bp, Mus musculus
attgctgagtggctgcccaattata

SEQ ID NO: 544377 - DNA, 25 bp, Mus musculus
attgctgagtgggtgcccaattata

SEQ ID NO: 544378 - DNA, 25 bp, Mus musculus
attgctgagtgtcatctgaatccca

SEQ ID NO: 544379 - DNA, 25 bp, Mus musculus
attgctgagtgtgatctgaatccca

SEQ ID NO: 544380 - DNA, 25 bp, Mus musculus
attgctgataatcgaggtattggcc

SEQ ID NO: 544381 - DNA, 25 bp, Mus musculus
attgctgataatggaggtattggcc

SEQ ID NO: 544382 - DNA, 25 bp, Mus musculus
attgctgcaattcctcaggagctca

SEQ ID NO: 544383 - DNA, 25 bp, Mus musculus
attgctgcaattgctcaggagctca

SEQ ID NO: 544384 - DNA, 25 bp, Mus musculus
attgctgcgctcagggttctgggta

SEQ ID NO: 544385 - DNA, 25 bp, Mus musculus
attgctgcgctctgggttctgggta

SEQ ID NO: 544386 - DNA, 25 bp, Mus musculus
attgctgctttcctgcacatcctgc

SEQ ID NO: 544387 - DNA, 25 bp, Mus musculus
attgctgctttcgtgcacatcctgc

SEQ ID NO: 544388 - DNA, 25 bp, Mus musculus
attgctggatggagacgaaggcccc

SEQ ID NO: 544389 - DNA, 25 bp, Mus musculus
attgctggatggtgacgaaggcccc

SEQ ID NO: 544390 - DNA, 25 bp, Mus musculus
attgctggctttaatcgccttcggc

SEQ ID NO: 544391 - DNA, 25 bp, Mus musculus
attgctggcttttatcgccttcggc

SEQ ID NO: 544392 - DNA, 25 bp, Mus musculus
attgctgtgaagcagaagtatgcca

SEQ ID NO: 544393 - DNA, 25 bp, Mus musculus
attgctgtgaaggagaagtatgcca

SEQ ID NO: 544394 - DNA, 25 bp, Mus musculus
attgcttaagcacgaactggccatc

SEQ ID NO: 544395 - DNA, 25 bp, Mus musculus
attgcttaagcaggaactggccatc

SEQ ID NO: 544396 - DNA, 25 bp, Mus musculus
attgcttatggtcccctaccccgtg

SEQ ID NO: 544397 - DNA, 25 bp, Mus musculus
attgcttatggtgccctaccccgtg

SEQ ID NO: 544398 - DNA, 25 bp, Mus musculus
attgcttcagcgagccatcggcttc

SEQ ID NO: 544399 - DNA, 25 bp, Mus musculus
attgcttcagcgtgccatcggcttc

SEQ ID NO: 544400 - DNA, 25 bp, Mus musculus
attgcttctctacctaccccttggg

SEQ ID NO: 544401 - DNA, 25 bp, Mus musculus
attgcttctctagctaccccttggg

SEQ ID NO: 544402 - DNA, 25 bp, Mus musculus
attgcttctgagctcagacagagcc

SEQ ID NO: 544403 - DNA, 25 bp, Mus musculus
attgcttctgaggtcagacagagcc

SEQ ID NO: 544404 - DNA, 25 bp, Mus musculus
attggaaactctcccagcgggcctg

SEQ ID NO: 544405 - DNA, 25 bp, Mus musculus
attggaaactctgccagcgggcctg

SEQ ID NO: 544406 - DNA, 25 bp, Mus musculus
attggaaagccgagccccgctctgc

SEQ ID NO: 544407 - DNA, 25 bp, Mus musculus
attggaaagccgtgccccgctctgc

SEQ ID NO: 544408 - DNA, 25 bp, Mus musculus
attggaaccatgctcgaccgggcag

SEQ ID NO: 544409 - DNA, 25 bp, Mus musculus
attggaaccatggtcgaccgggcag

SEQ ID NO: 544410 - DNA, 25 bp, Mus musculus
attggacaagagctgcaacaaggac

SEQ ID NO: 544411 - DNA, 25 bp, Mus musculus
attggacaagaggtgcaacaaggac

SEQ ID NO: 544412 - DNA, 25 bp, Mus musculus
attggacctgccacacaaggccttc

SEQ ID NO: 544413 - DNA, 25 bp, Mus musculus
attggacctgcctcacaaggccttc

SEQ ID NO: 544414 - DNA, 25 bp, Mus musculus
attggacggctgattgctgagtgtc

SEQ ID NO: 544415 - DNA, 25 bp, Mus musculus
attggacggctgtttgctgagtgtc

SEQ ID NO: 544416 - DNA, 25 bp, Mus musculus
attggagaaaatcgcttagtcacat

SEQ ID NO: 544417 - DNA, 25 bp, Mus musculus
attggagaaaatggcttagtcacat

SEQ ID NO: 544418 - DNA, 25 bp, Mus musculus
attggagacaccattgaattccggg

SEQ ID NO: 544419 - DNA, 25 bp, Mus musculus
attggagacacctttgaattccggg

SEQ ID NO: 544420 - DNA, 25 bp, Mus musculus
attggagagcgacgagccaacctga

SEQ ID NO: 544421 - DNA, 25 bp, Mus musculus
attggagagcgaggagccaacctga

SEQ ID NO: 544422 - DNA, 25 bp, Mus musculus
attggagatatcacctcctgctcag

SEQ ID NO: 544423 - DNA, 25 bp, Mus musculus
attggagatatctcctcctgctcag

SEQ ID NO: 544424 - DNA, 25 bp, Mus musculus
attggagccggactccatcgcctgt

SEQ ID NO: 544425 - DNA, 25 bp, Mus musculus
attggagccggagtccatcgcctgt

SEQ ID NO: 544426 - DNA, 25 bp, Mus musculus
attggaggagccacctatgaagagg

SEQ ID NO: 544427 - DNA, 25 bp, Mus musculus
attggaggagcctcctatgaagagg

SEQ ID NO: 544428 - DNA, 25 bp, Mus musculus
attggaggcaaaaatcagtgccatg

SEQ ID NO: 544429 - DNA, 25 bp, Mus musculus
attggaggcaaatatcagtgccatg

SEQ ID NO: 544430 - DNA, 25 bp, Mus musculus
attggagtgtggaagaccatctccc

SEQ ID NO: 544431 - DNA, 25 bp, Mus musculus
attggagtgtggtagaccatctccc

SEQ ID NO: 544432 - DNA, 25 bp, Mus musculus
attggataaccacgaaatgactaat

SEQ ID NO: 544433 - DNA, 25 bp, Mus musculus
attggataaccaggaaatgactaat

SEQ ID NO: 544434 - DNA, 25 bp, Mus musculus
attggcaagtctaatgattacatcg

SEQ ID NO: 544435 - DNA, 25 bp, Mus musculus
attggcaagtcttatgattacatcg

SEQ ID NO: 544436 - DNA, 25 bp, Mus musculus
attggcacccagcaggatccccttg

SEQ ID NO: 544437 - DNA, 25 bp, Mus musculus
attggcacccaggaggatccccttg

SEQ ID NO: 544438 - DNA, 25 bp, Mus musculus
attggcatcggcatcacggatcggg

SEQ ID NO: 544439 - DNA, 25 bp, Mus musculus
attggcatcggcttcacggatcggg

SEQ ID NO: 544440 - DNA, 25 bp, Mus musculus
attggcattgcactctcaggcctgc

SEQ ID NO: 544441 - DNA, 25 bp, Mus musculus
attggcattgcagtctcaggcctgc

SEQ ID NO: 544442 - DNA, 25 bp, Mus musculus
attggccaacaccatctcccagttt

SEQ ID NO: 544443 - DNA, 25 bp, Mus musculus
attggccaacacgatctcccagttt

SEQ ID NO: 544444 - DNA, 25 bp, Mus musculus
attggccaagcacaggtaagtcttt

SEQ ID NO: 544445 - DNA, 25 bp, Mus musculus
attggccaagcagaggtaagtcttt

SEQ ID NO: 544446 - DNA, 25 bp, Mus musculus
attggccagctcagcgcagcctgca

SEQ ID NO: 544447 - DNA, 25 bp, Mus musculus
attggccagctctgcgcagcctgca

SEQ ID NO: 544448 - DNA, 25 bp, Mus musculus
attggccctgacatccagaagggtc

SEQ ID NO: 544449 - DNA, 25 bp, Mus musculus
attggccctgacttccagaagggtc

SEQ ID NO: 544450 - DNA, 25 bp, Mus musculus
attggccggaccctgataccacgct

SEQ ID NO: 544451 - DNA, 25 bp, Mus musculus
attggccggaccgtgataccacgct

SEQ ID NO: 544452 - DNA, 25 bp, Mus musculus
attggcctgttccacctggaggtga

SEQ ID NO: 544453 - DNA, 25 bp, Mus musculus
attggcctgttcgacctggaggtga

SEQ ID NO: 544454 - DNA, 25 bp, Mus musculus
attggcgatgccagcgatgatgacg

SEQ ID NO: 544455 - DNA, 25 bp, Mus musculus
attggcgatgcctgcgatgatgacg

SEQ ID NO: 544456 - DNA, 25 bp, Mus musculus
attggcgtccgaaccaccatgatgc

SEQ ID NO: 544457 - DNA, 25 bp, Mus musculus
attggcgtccgatccaccatgatgc

SEQ ID NO: 544458 - DNA, 25 bp, Mus musculus
attggcgtgaccagcccaacataca

SEQ ID NO: 544459 - DNA, 25 bp, Mus musculus
attggcgtgacctgcccaacataca

SEQ ID NO: 544460 - DNA, 25 bp, Mus musculus
attggctctctgatggacgactact

SEQ ID NO: 544461 - DNA, 25 bp, Mus musculus
attggctctctgttggacgactact

SEQ ID NO: 544462 - DNA, 25 bp, Mus musculus
attggctctgccacggacatctggg

SEQ ID NO: 544463 - DNA, 25 bp, Mus musculus
attggctctgcctcggacatctggg

SEQ ID NO: 544464 - DNA, 25 bp, Mus musculus
attggctctggacgccgcaatcaaa

SEQ ID NO: 544465 - DNA, 25 bp, Mus musculus
attggctctggaggccgcaatcaaa

SEQ ID NO: 544466 - DNA, 25 bp, Mus musculus
attggctctgtgcagttagtgaccc

SEQ ID NO: 544467 - DNA, 25 bp, Mus musculus
attggctctgtggagttagtgaccc

SEQ ID NO: 544468 - DNA, 25 bp, Mus musculus
attggctgcccacccttagattgtc

SEQ ID NO: 544469 - DNA, 25 bp, Mus musculus
attggctgcccagccttagattgtc

SEQ ID NO: 544470 - DNA, 25 bp, Mus musculus
attggctgccgcaaggtcacgggca

SEQ ID NO: 544471 - DNA, 25 bp, Mus musculus
attggctgccgctaggtcacgggca

SEQ ID NO: 544472 - DNA, 25 bp, Mus musculus
attggctggatacctctagatctac

SEQ ID NO: 544473 - DNA, 25 bp, Mus musculus
attggctggatagctctagatctac

SEQ ID NO: 544474 - DNA, 25 bp, Mus musculus
attggctgggcacactcgctgccta

SEQ ID NO: 544475 - DNA, 25 bp, Mus musculus
attggctgggcagactcgctgccta

SEQ ID NO: 544476 - DNA, 25 bp, Mus musculus
attggcttcactccgctcgttctga

SEQ ID NO: 544477 - DNA, 25 bp, Mus musculus
attggcttcactgcgctcgttctga

SEQ ID NO: 544478 - DNA, 25 bp, Mus musculus
attgggcagggacgacgcccctcct

SEQ ID NO: 544479 - DNA, 25 bp, Mus musculus
attgggcagggaggacgcccctcct

SEQ ID NO: 544480 - DNA, 25 bp, Mus musculus
attgggccaggactgtcttcttgga

SEQ ID NO: 544481 - DNA, 25 bp, Mus musculus
attgggccaggagtgtcttcttgga

SEQ ID NO: 544482 - DNA, 25 bp, Mus musculus
attgggcgcactcgccgctttggca

SEQ ID NO: 544483 - DNA, 25 bp, Mus musculus
attgggcgcactggccgctttggca

SEQ ID NO: 544484 - DNA, 25 bp, Mus musculus
attgggcgggccattggccacttgc

SEQ ID NO: 544485 - DNA, 25 bp, Mus musculus
attgggcgggcctttggccacttgc

SEQ ID NO: 544486 - DNA, 25 bp, Mus musculus
attgggctgggtcagtaccccgtct

SEQ ID NO: 544487 - DNA, 25 bp, Mus musculus
attgggctgggtgagtaccccgtct

SEQ ID NO: 544488 - DNA, 25 bp, Mus musculus
attgggtgagccacctggcttcctg

SEQ ID NO: 544489 - DNA, 25 bp, Mus musculus
attgggtgagcctcctggcttcctg

SEQ ID NO: 544490 - DNA, 25 bp, Mus musculus
attgggttgggcaacctgtcccatt

SEQ ID NO: 544491 - DNA, 25 bp, Mus musculus
attgggttgggctacctgtcccatt

SEQ ID NO: 544492 - DNA, 25 bp, Mus musculus
attgggtttggacggcttacacagc

SEQ ID NO: 544493 - DNA, 25 bp, Mus musculus
attgggtttggagggcttacacagc

SEQ ID NO: 544494 - DNA, 25 bp, Mus musculus
attggtacagccaccgagtcggcgg

SEQ ID NO: 544495 - DNA, 25 bp, Mus musculus
attggtacagcctccgagtcggcgg

SEQ ID NO: 544496 - DNA, 25 bp, Mus musculus
attggtcctcgtactacttggtgcc

SEQ ID NO: 544497 - DNA, 25 bp, Mus musculus
attggtcctcgttctacttggtgcc

SEQ ID NO: 544498 - DNA, 25 bp, Mus musculus
attggtctatgacatttgggaacag

SEQ ID NO: 544499 - DNA, 25 bp, Mus musculus
attggtctatgagatttgggaacag

SEQ ID NO: 544500 - DNA, 25 bp, Mus musculus
attggtgagagaccatggagctttt

SEQ ID NO: 544501 - DNA, 25 bp, Mus musculus
attggtgagagagcatggagctttt

SEQ ID NO: 544502 - DNA, 25 bp, Mus musculus
attggtgcagaaccttcatgacttc

SEQ ID NO: 544503 - DNA, 25 bp, Mus musculus
attggtgcagaagcttcatgacttc

SEQ ID NO: 544504 - DNA, 25 bp, Mus musculus
attggtgccagtcaacagggtgacc

SEQ ID NO: 544505 - DNA, 25 bp, Mus musculus
attggtgccagtgaacagggtgacc

SEQ ID NO: 544506 - DNA, 25 bp, Mus musculus
attggtgctgtcattcggatactgc

SEQ ID NO: 544507 - DNA, 25 bp, Mus musculus
attggtgctgtctttcggatactgc

SEQ ID NO: 544508 - DNA, 25 bp, Mus musculus
attggtggagcacgctatggccggc

SEQ ID NO: 544509 - DNA, 25 bp, Mus musculus
attggtggagcaggctatggccggc

SEQ ID NO: 544510 - DNA, 25 bp, Mus musculus
attggtggaggtaggaactttgact

SEQ ID NO: 544511 - DNA, 25 bp, Mus musculus
attggtggaggttggaactttgact

SEQ ID NO: 544512 - DNA, 25 bp, Mus musculus
attggtggccttatagactccaaag

SEQ ID NO: 544513 - DNA, 25 bp, Mus musculus
attggtggccttttagactccaaag

SEQ ID NO: 544514 - DNA, 25 bp, Mus musculus
attggtgtgccgattaaagtcttgc

SEQ ID NO: 544515 - DNA, 25 bp, Mus musculus
attggtgtgccgtttaaagtcttgc

SEQ ID NO: 544516 - DNA, 25 bp, Mus musculus
attggtgtgtcacatccggaaaaag

SEQ ID NO: 544517 - DNA, 25 bp, Mus musculus
attggtgtgtcagatccggaaaaag

SEQ ID NO: 544518 - DNA, 25 bp, Mus musculus
attggttctgtgagggctccttcaa

SEQ ID NO: 544519 - DNA, 25 bp, Mus musculus
attggttctgtgtgggctccttcaa

SEQ ID NO: 544520 - DNA, 25 bp, Mus musculus
attgtaaattcacctgccactcgga

SEQ ID NO: 544521 - DNA, 25 bp, Mus musculus
attgtaaattcagctgccactcgga

SEQ ID NO: 544522 - DNA, 25 bp, Mus musculus
attgtaactttgagtcagcgtgcag

SEQ ID NO: 544523 - DNA, 25 bp, Mus musculus
attgtaactttgtgtcagcgtgcag

SEQ ID NO: 544524 - DNA, 25 bp, Mus musculus
attgtaagtaagaatcgctgaggtc

SEQ ID NO: 544525 - DNA, 25 bp, Mus musculus
attgtaagtaagtatcgctgaggtc

SEQ ID NO: 544526 - DNA, 25 bp, Mus musculus
attgtacaggccaagatctcatcca

SEQ ID NO: 544527 - DNA, 25 bp, Mus musculus
attgtacaggcctagatctcatcca

SEQ ID NO: 544528 - DNA, 25 bp, Mus musculus
attgtactgtcacagcacctgggca

SEQ ID NO: 544529 - DNA, 25 bp, Mus musculus
attgtactgtcagagcacctgggca

SEQ ID NO: 544530 - DNA, 25 bp, Mus musculus
attgtagacagcctccatcctcggc

SEQ ID NO: 544531 - DNA, 25 bp, Mus musculus
attgtagacagcgtccatcctcggc

SEQ ID NO: 544532 - DNA, 25 bp, Mus musculus
attgtaggacaacgcccagcgccga

SEQ ID NO: 544533 - DNA, 25 bp, Mus musculus
attgtaggacaaggcccagcgccga

SEQ ID NO: 544534 - DNA, 25 bp, Mus musculus
attgtaggtgaactgctaaaacagt

SEQ ID NO: 544535 - DNA, 25 bp, Mus musculus
attgtaggtgaagtgctaaaacagt

SEQ ID NO: 544536 - DNA, 25 bp, Mus musculus
attgtatgacttagacaacagtggg

SEQ ID NO: 544537 - DNA, 25 bp, Mus musculus
attgtatgactttgacaacagtggg

SEQ ID NO: 544538 - DNA, 25 bp, Mus musculus
attgtcactgacaacaccccgcaga

SEQ ID NO: 544539 - DNA, 25 bp, Mus musculus
attgtcactgactacaccccgcaga

SEQ ID NO: 544540 - DNA, 25 bp, Mus musculus
attgtcactgcaaccgaggctaccg

SEQ ID NO: 544541 - DNA, 25 bp, Mus musculus
attgtcactgcatccgaggctaccg

SEQ ID NO: 544542 - DNA, 25 bp, Mus musculus
attgtcagcatgctctcctccggct

SEQ ID NO: 544543 - DNA, 25 bp, Mus musculus
attgtcagcatggtctcctccggct

SEQ ID NO: 544544 - DNA, 25 bp, Mus musculus
attgtcagccgacggtcagccgtca

SEQ ID NO: 544545 - DNA, 25 bp, Mus musculus
attgtcagccgagggtcagccgtca

SEQ ID NO: 544546 - DNA, 25 bp, Mus musculus
attgtcatccggcagcccaatggca

SEQ ID NO: 544547 - DNA, 25 bp, Mus musculus
attgtcatccgggagcccaatggca

SEQ ID NO: 544548 - DNA, 25 bp, Mus musculus
attgtcatcctcatcgccatagctg

SEQ ID NO: 544549 - DNA, 25 bp, Mus musculus
attgtcatcctcttcgccatagctg

SEQ ID NO: 544550 - DNA, 25 bp, Mus musculus
attgtcatgggcatctgcgaaggag

SEQ ID NO: 544551 - DNA, 25 bp, Mus musculus
attgtcatgggcttctgcgaaggag

SEQ ID NO: 544552 - DNA, 25 bp, Mus musculus
attgtcattggcacccccgggaccg

SEQ ID NO: 544553 - DNA, 25 bp, Mus musculus
attgtcattggccatctcttgcaac

SEQ ID NO: 544554 - DNA, 25 bp, Mus musculus
attgtcattggcgatctcttgcaac

SEQ ID NO: 544555 - DNA, 25 bp, Mus musculus
attgtcattggctcccccgggaccg

SEQ ID NO: 544556 - DNA, 25 bp, Mus musculus
attgtccaagaaatcctcacagcaa

SEQ ID NO: 544557 - DNA, 25 bp, Mus musculus
attgtccaagaattcctcacagcaa

SEQ ID NO: 544558 - DNA, 25 bp, Mus musculus
attgtccgccagctagtggagaaca

SEQ ID NO: 544559 - DNA, 25 bp, Mus musculus
attgtccgccaggtagtggagaaca

SEQ ID NO: 544560 - DNA, 25 bp, Mus musculus
attgtccgcccactgctgagctcta

SEQ ID NO: 544561 - DNA, 25 bp, Mus musculus
attgtccgcccagtgctgagctcta

SEQ ID NO: 544562 - DNA, 25 bp, Mus musculus
attgtcctccagctgtctcagcagc

SEQ ID NO: 544563 - DNA, 25 bp, Mus musculus
attgtcctccaggtgtctcagcagc

SEQ ID NO: 544564 - DNA, 25 bp, Mus musculus
attgtcctgcttagtacagattgcc

SEQ ID NO: 544565 - DNA, 25 bp, Mus musculus
attgtcctgctttgtacagattgcc

SEQ ID NO: 544566 - DNA, 25 bp, Mus musculus
attgtcctggcacccggcttggtgc

SEQ ID NO: 544567 - DNA, 25 bp, Mus musculus
attgtcctggcagccggcttggtgc

SEQ ID NO: 544568 - DNA, 25 bp, Mus musculus
attgtccttttacgatgcggccttg

SEQ ID NO: 544569 - DNA, 25 bp, Mus musculus
attgtccttttaggatgcggccttg

SEQ ID NO: 544570 - DNA, 25 bp, Mus musculus
attgtcgagaacaaaccctcccacg

SEQ ID NO: 544571 - DNA, 25 bp, Mus musculus
attgtcgagaactaaccctcccacg

SEQ ID NO: 544572 - DNA, 25 bp, Mus musculus
attgtcgcctttccagaggaagcag

SEQ ID NO: 544573 - DNA, 25 bp, Mus musculus
attgtcgcctttgcagaggaagcag

SEQ ID NO: 544574 - DNA, 25 bp, Mus musculus
attgtcgctgacctgggctcacctc

SEQ ID NO: 544575 - DNA, 25 bp, Mus musculus
attgtcgctgacgtgggctcacctc

SEQ ID NO: 544576 - DNA, 25 bp, Mus musculus
attgtctcctcccagcgcttctaca

SEQ ID NO: 544577 - DNA, 25 bp, Mus musculus
attgtctcctccgagcgcttctaca

SEQ ID NO: 544578 - DNA, 25 bp, Mus musculus
attgtctcgggcaggtattggtgca

SEQ ID NO: 544579 - DNA, 25 bp, Mus musculus
attgtctcgggctggtattggtgca

SEQ ID NO: 544580 - DNA, 25 bp, Mus musculus
attgtgaagatgacaaagagtgacg

SEQ ID NO: 544581 - DNA, 25 bp, Mus musculus
attgtgaagatgtcaaagagtgacg

SEQ ID NO: 544582 - DNA, 25 bp, Mus musculus
attgtgactcagaggtgtgaaggca

SEQ ID NO: 544583 - DNA, 25 bp, Mus musculus
attgtgactcagtggtgtgaaggca

SEQ ID NO: 544584 - DNA, 25 bp, Mus musculus
attgtgaggttcatggaattggcag

SEQ ID NO: 544585 - DNA, 25 bp, Mus musculus
attgtgaggttcttggaattggcag

SEQ ID NO: 544586 - DNA, 25 bp, Mus musculus
attgtgatcgctcaccgcctgtcca

SEQ ID NO: 544587 - DNA, 25 bp, Mus musculus
attgtgatcgctgaccgcctgtcca

SEQ ID NO: 544588 - DNA, 25 bp, Mus musculus
attgtgatgccaagcatatccgagg

SEQ ID NO: 544589 - DNA, 25 bp, Mus musculus
attgtgatgccatgcatatccgagg

SEQ ID NO: 544590 - DNA, 25 bp, Mus musculus
attgtgattggtcgttcttctgaaa

SEQ ID NO: 544591 - DNA, 25 bp, Mus musculus
attgtgattggtggttcttctgaaa

SEQ ID NO: 544592 - DNA, 25 bp, Mus musculus
attgtgctcccgctcagcctgcaga

SEQ ID NO: 544593 - DNA, 25 bp, Mus musculus
attgtgctcccggtcagcctgcaga

SEQ ID NO: 544594 - DNA, 25 bp, Mus musculus
attgtggaaggcctccggcataact

SEQ ID NO: 544595 - DNA, 25 bp, Mus musculus
attgtggaaggcgtccggcataact

SEQ ID NO: 544596 - DNA, 25 bp, Mus musculus
attgtggactatcgcacccgctgga

SEQ ID NO: 544597 - DNA, 25 bp, Mus musculus
attgtggactatggcacccgctgga

SEQ ID NO: 544598 - DNA, 25 bp, Mus musculus
attgtggagaatctccgcacctaca

SEQ ID NO: 544599 - DNA, 25 bp, Mus musculus
attgtggagaatgtccgcacctaca

SEQ ID NO: 544600 - DNA, 25 bp, Mus musculus
attgtggcaccgaataagatagagc

SEQ ID NO: 544601 - DNA, 25 bp, Mus musculus
attgtggcaccgtataagatagagc

SEQ ID NO: 544602 - DNA, 25 bp, Mus musculus
attgtggccaccctgacggctgcct

SEQ ID NO: 544603 - DNA, 25 bp, Mus musculus
attgtggccaccgtgacggctgcct

SEQ ID NO: 544604 - DNA, 25 bp, Mus musculus
attgtggccgttctctctgctgtca

SEQ ID NO: 544605 - DNA, 25 bp, Mus musculus
attgtggccgttgtctctgctgtca

SEQ ID NO: 544606 - DNA, 25 bp, Mus musculus
attgtggctcttctgggccagtctg

SEQ ID NO: 544607 - DNA, 25 bp, Mus musculus
attgtggctcttgtgggccagtctg

SEQ ID NO: 544608 - DNA, 25 bp, Mus musculus
attgtggctgccatgaccctggagg

SEQ ID NO: 544609 - DNA, 25 bp, Mus musculus
attgtggctgccttgaccctggagg

SEQ ID NO: 544610 - DNA, 25 bp, Mus musculus
attgtgggaaacacctgagcactcc

SEQ ID NO: 544611 - DNA, 25 bp, Mus musculus
attgtgggaaactcctgagcactcc

SEQ ID NO: 544612 - DNA, 25 bp, Mus musculus
attgtgggcagcctgcaccacacgg

SEQ ID NO: 544613 - DNA, 25 bp, Mus musculus
attgtgggcagcgtgcaccacacgg

SEQ ID NO: 544614 - DNA, 25 bp, Mus musculus
attgtgtaggcgcaactcgagtgca

SEQ ID NO: 544615 - DNA, 25 bp, Mus musculus
attgtgtaggcggaactcgagtgca

SEQ ID NO: 544616 - DNA, 25 bp, Mus musculus
attgtgtcacaaaccaaggtcacta

SEQ ID NO: 544617 - DNA, 25 bp, Mus musculus
attgtgtcacaatccaaggtcacta

SEQ ID NO: 544618 - DNA, 25 bp, Mus musculus
attgttcacagcctgttggtctcga

SEQ ID NO: 544619 - DNA, 25 bp, Mus musculus
attgttcacagcgtgttggtctcga

SEQ ID NO: 544620 - DNA, 25 bp, Mus musculus
attgttcccaagagagcatctgtca

SEQ ID NO: 544621 - DNA, 25 bp, Mus musculus
attgttcccaagtgagcatctgtca

SEQ ID NO: 544622 - DNA, 25 bp, Mus musculus
attgttctaacacgcattctggagc

SEQ ID NO: 544623 - DNA, 25 bp, Mus musculus
attgttctaacaggcattctggagc

SEQ ID NO: 544624 - DNA, 25 bp, Mus musculus
attgttgccagtcccagaggtgccg

SEQ ID NO: 544625 - DNA, 25 bp, Mus musculus
attgttgccagtgccagaggtgccg

SEQ ID NO: 544626 - DNA, 25 bp, Mus musculus
attgttgcgaccatcagttttggga

SEQ ID NO: 544627 - DNA, 25 bp, Mus musculus
attgttgcgaccttcagttttggga

SEQ ID NO: 544628 - DNA, 25 bp, Mus musculus
attgttgtggcgacagacgcgcaga

SEQ ID NO: 544629 - DNA, 25 bp, Mus musculus
attgttgtggcgtcagacgcgcaga

SEQ ID NO: 544630 - DNA, 25 bp, Mus musculus
attgttgtgtctctggcttccctgg

SEQ ID NO: 544631 - DNA, 25 bp, Mus musculus
attgttgtgtctgtggcttccctgg

SEQ ID NO: 544632 - DNA, 25 bp, Mus musculus
attgtttccgcactacagtattgcc

SEQ ID NO: 544633 - DNA, 25 bp, Mus musculus
attgtttccgcagtacagtattgcc

SEQ ID NO: 544634 - DNA, 25 bp, Mus musculus
attgttttgcagactgcccgcaaca

SEQ ID NO: 544635 - DNA, 25 bp, Mus musculus
attgttttgcagtctgcccgcaaca

SEQ ID NO: 544636 - DNA, 25 bp, Mus musculus
atttaaaagagactggtccagtgtc

SEQ ID NO: 544637 - DNA, 25 bp, Mus musculus
atttaaaagagagtggtccagtgtc

SEQ ID NO: 544638 - DNA, 25 bp, Mus musculus
atttaaacgagtctggcctgaagcc

SEQ ID NO: 544639 - DNA, 25 bp, Mus musculus
atttaaacgagtgtggcctgaagcc

SEQ ID NO: 544640 - DNA, 25 bp, Mus musculus
atttaaagacagcaggctaaaaagg

SEQ ID NO: 544641 - DNA, 25 bp, Mus musculus
atttaaagacaggaggctaaaaagg

SEQ ID NO: 544642 - DNA, 25 bp, Mus musculus
atttaaaggtatcgcgccacccagc

SEQ ID NO: 544643 - DNA, 25 bp, Mus musculus
atttaaaggtatggcgccacccagc

SEQ ID NO: 544644 - DNA, 25 bp, Mus musculus
atttaacccagtcactgtgaggtca

SEQ ID NO: 544645 - DNA, 25 bp, Mus musculus
atttaacccagtgactgtgaggtca

SEQ ID NO: 544646 - DNA, 25 bp, Mus musculus
atttaagctcgactacagccgggac

SEQ ID NO: 544647 - DNA, 25 bp, Mus musculus
atttaagctcgagtacagccgggac

SEQ ID NO: 544648 - DNA, 25 bp, Mus musculus
atttaaggaagcagctcggcttgca

SEQ ID NO: 544649 - DNA, 25 bp, Mus musculus
atttaaggaagctgctcggcttgca

SEQ ID NO: 544650 - DNA, 25 bp, Mus musculus
atttaagtcattacagccaagctga

SEQ ID NO: 544651 - DNA, 25 bp, Mus musculus
atttaagtcatttcagccaagctga

SEQ ID NO: 544652 - DNA, 25 bp, Mus musculus
atttaatactacaggccagcgagga

SEQ ID NO: 544653 - DNA, 25 bp, Mus musculus
atttaatactactggccagcgagga

SEQ ID NO: 544654 - DNA, 25 bp, Mus musculus
atttacactccaagtgcatcatcca

SEQ ID NO: 544655 - DNA, 25 bp, Mus musculus
atttacactccatgtgcatcatcca

SEQ ID NO: 544656 - DNA, 25 bp, Mus musculus
atttactaattcctgtggtgacgtc

SEQ ID NO: 544657 - DNA, 25 bp, Mus musculus
atttactaattcgtgtggtgacgtc

SEQ ID NO: 544658 - DNA, 25 bp, Mus musculus
atttactcgaccacatccagcctta

SEQ ID NO: 544659 - DNA, 25 bp, Mus musculus
atttactcgacctcatccagcctta

SEQ ID NO: 544660 - DNA, 25 bp, Mus musculus
atttagagcgcaccgcctgactggc

SEQ ID NO: 544661 - DNA, 25 bp, Mus musculus
atttagagcgcagcgcctgactggc

SEQ ID NO: 544662 - DNA, 25 bp, Mus musculus
atttagctacctctgcaccgtccat

SEQ ID NO: 544663 - DNA, 25 bp, Mus musculus
atttagctacctgtgcaccgtccat

SEQ ID NO: 544664 - DNA, 25 bp, Mus musculus
atttagggaaggctgtaaagcagcc

SEQ ID NO: 544665 - DNA, 25 bp, Mus musculus
atttagggaagggtgtaaagcagcc

SEQ ID NO: 544666 - DNA, 25 bp, Mus musculus
atttatcagttcaaccaaaagacca

SEQ ID NO: 544667 - DNA, 25 bp, Mus musculus
atttatcagttctaccaaaagacca

SEQ ID NO: 544668 - DNA, 25 bp, Mus musculus
atttatccctagagatgggtacagg

SEQ ID NO: 544669 - DNA, 25 bp, Mus musculus
atttatccctagtgatgggtacagg

SEQ ID NO: 544670 - DNA, 25 bp, Mus musculus
atttatgagcggcttgcttcagcct

SEQ ID NO: 544671 - DNA, 25 bp, Mus musculus
atttatgagcgggttgcttcagcct

SEQ ID NO: 544672 - DNA, 25 bp, Mus musculus
atttatgctcacaaagtccttctca

SEQ ID NO: 544673 - DNA, 25 bp, Mus musculus
atttatgctcactaagtccttctca

SEQ ID NO: 544674 - DNA, 25 bp, Mus musculus
atttatgtgatgaggtgtgggctac

SEQ ID NO: 544675 - DNA, 25 bp, Mus musculus
atttatgtgatgtggtgtgggctac

SEQ ID NO: 544676 - DNA, 25 bp, Mus musculus
atttattacaccagagccattgaat

SEQ ID NO: 544677 - DNA, 25 bp, Mus musculus
atttattacacctgagccattgaat

SEQ ID NO: 544678 - DNA, 25 bp, Mus musculus
atttattgtcaacgcgggaaagctc

SEQ ID NO: 544679 - DNA, 25 bp, Mus musculus
atttattgtcaaggcgggaaagctc

SEQ ID NO: 544680 - DNA, 25 bp, Mus musculus
atttatttgtgcctgcaacccaggg

SEQ ID NO: 544681 - DNA, 25 bp, Mus musculus
atttatttgtgcgtgcaacccaggg

SEQ ID NO: 544682 - DNA, 25 bp, Mus musculus
atttcaaagatgcaggcggcggctc

SEQ ID NO: 544683 - DNA, 25 bp, Mus musculus
atttcaaagatggaggcggcggctc

SEQ ID NO: 544684 - DNA, 25 bp, Mus musculus
atttcaacccgaacgctggctcaga

SEQ ID NO: 544685 - DNA, 25 bp, Mus musculus
atttcaacccgatcgctggctcaga

SEQ ID NO: 544686 - DNA, 25 bp, Mus musculus
atttcaactgctcctacagctgctc

SEQ ID NO: 544687 - DNA, 25 bp, Mus musculus
atttcaactgctgctacagctgctc

SEQ ID NO: 544688 - DNA, 25 bp, Mus musculus
atttcaaggtggacgaggacggcac

SEQ ID NO: 544689 - DNA, 25 bp, Mus musculus
atttcaaggtggtcgaggacggcac

SEQ ID NO: 544690 - DNA, 25 bp, Mus musculus
atttcaatgatgagtctcctctggg

SEQ ID NO: 544691 - DNA, 25 bp, Mus musculus
atttcaatgatgtgtctcctctggg

SEQ ID NO: 544692 - DNA, 25 bp, Mus musculus
atttcaatgcacaagacaactcgga

SEQ ID NO: 544693 - DNA, 25 bp, Mus musculus
atttcaatgcactagacaactcgga

SEQ ID NO: 544694 - DNA, 25 bp, Mus musculus
atttcaattcttcatccgcctgtag

SEQ ID NO: 544695 - DNA, 25 bp, Mus musculus
atttcaattcttgatccgcctgtag

SEQ ID NO: 544696 - DNA, 25 bp, Mus musculus
atttcacaaaggagatgtcctcatc

SEQ ID NO: 544697 - DNA, 25 bp, Mus musculus
atttcacaaaggtgatgtcctcatc

SEQ ID NO: 544698 - DNA, 25 bp, Mus musculus
atttcagacagaccgcagggagagc

SEQ ID NO: 544699 - DNA, 25 bp, Mus musculus
atttcagacagagcgcagggagagc

SEQ ID NO: 544700 - DNA, 25 bp, Mus musculus
atttcagctaccaccatacaaactg

SEQ ID NO: 544701 - DNA, 25 bp, Mus musculus
atttcagctacctccatacaaactg

SEQ ID NO: 544702 - DNA, 25 bp, Mus musculus
atttcagggcctacatttcctttca

SEQ ID NO: 544703 - DNA, 25 bp, Mus musculus
atttcagggccttcatttcctttca

SEQ ID NO: 544704 - DNA, 25 bp, Mus musculus
atttcatactgtcagtggaagcaag

SEQ ID NO: 544705 - DNA, 25 bp, Mus musculus
atttcatactgtgagtggaagcaag

SEQ ID NO: 544706 - DNA, 25 bp, Mus musculus
atttcatccatcagcagcgaaccca

SEQ ID NO: 544707 - DNA, 25 bp, Mus musculus
atttcatccatctgcagcgaaccca

SEQ ID NO: 544708 - DNA, 25 bp, Mus musculus
atttcatcccagcagctaggtcagg

SEQ ID NO: 544709 - DNA, 25 bp, Mus musculus
atttcatcccaggagctaggtcagg

SEQ ID NO: 544710 - DNA, 25 bp, Mus musculus
atttcatctacaagtggcagcgtct

SEQ ID NO: 544711 - DNA, 25 bp, Mus musculus
atttcatctacatgtggcagcgtct

SEQ ID NO: 544712 - DNA, 25 bp, Mus musculus
atttcatctgatcacagtggaaagc

SEQ ID NO: 544713 - DNA, 25 bp, Mus musculus
atttcatctgatgacagtggaaagc

SEQ ID NO: 544714 - DNA, 25 bp, Mus musculus
atttcattccgtcgcagccagaagg

SEQ ID NO: 544715 - DNA, 25 bp, Mus musculus
atttcattccgtggcagccagaagg

SEQ ID NO: 544716 - DNA, 25 bp, Mus musculus
atttcattgcacagccggctcagct

SEQ ID NO: 544717 - DNA, 25 bp, Mus musculus
atttcattgcactgccggctcagct

SEQ ID NO: 544718 - DNA, 25 bp, Mus musculus
atttcattgttgcagagtcctcttg

SEQ ID NO: 544719 - DNA, 25 bp, Mus musculus
atttcattgttggagagtcctcttg

SEQ ID NO: 544720 - DNA, 25 bp, Mus musculus
atttccaagcctcggcaagccgact

SEQ ID NO: 544721 - DNA, 25 bp, Mus musculus
atttccaagcctgggcaagccgact

SEQ ID NO: 544722 - DNA, 25 bp, Mus musculus
atttccacgagtccaccaacaaggc

SEQ ID NO: 544723 - DNA, 25 bp, Mus musculus
atttccacgagtgcaccaacaaggc

SEQ ID NO: 544724 - DNA, 25 bp, Mus musculus
atttccaggcagaactaagacaggc

SEQ ID NO: 544725 - DNA, 25 bp, Mus musculus
atttccaggcagtactaagacaggc

SEQ ID NO: 544726 - DNA, 25 bp, Mus musculus
atttccagggaacgtctgcagagtg

SEQ ID NO: 544727 - DNA, 25 bp, Mus musculus
atttccagggaaggtctgcagagtg

SEQ ID NO: 544728 - DNA, 25 bp, Mus musculus
atttccagtgtgaaggacatgagcc

SEQ ID NO: 544729 - DNA, 25 bp, Mus musculus
atttccagtgtgtaggacatgagcc

SEQ ID NO: 544730 - DNA, 25 bp, Mus musculus
atttcccagaagcatgagcactgct

SEQ ID NO: 544731 - DNA, 25 bp, Mus musculus
atttcccagaaggatgagcactgct

SEQ ID NO: 544732 - DNA, 25 bp, Mus musculus
atttccctggagcacgagatcctcc

SEQ ID NO: 544733 - DNA, 25 bp, Mus musculus
atttccctggaggacgagatcctcc

SEQ ID NO: 544734 - DNA, 25 bp, Mus musculus
atttccgaccctccaggcggctgga

SEQ ID NO: 544735 - DNA, 25 bp, Mus musculus
atttccgaccctgcaggcggctgga

SEQ ID NO: 544736 - DNA, 25 bp, Mus musculus
atttcctcaggcagtgcatgttctt

SEQ ID NO: 544737 - DNA, 25 bp, Mus musculus
atttcctcaggctgtgcatgttctt

SEQ ID NO: 544738 - DNA, 25 bp, Mus musculus
atttcctcccagatatatgaagcct

SEQ ID NO: 544739 - DNA, 25 bp, Mus musculus
atttcctcccagttatatgaagcct

SEQ ID NO: 544740 - DNA, 25 bp, Mus musculus
atttcctgcaaaagagcatcctgtg

SEQ ID NO: 544741 - DNA, 25 bp, Mus musculus
atttcctgcaaatgagcatcctgtg

SEQ ID NO: 544742 - DNA, 25 bp, Mus musculus
atttcctgtgacaccttggccccag

SEQ ID NO: 544743 - DNA, 25 bp, Mus musculus
atttcctgtgactccttggccccag

SEQ ID NO: 544744 - DNA, 25 bp, Mus musculus
atttccttcaaaacccatctcctgg

SEQ ID NO: 544745 - DNA, 25 bp, Mus musculus
atttccttcaaatcccatctcctgg

SEQ ID NO: 544746 - DNA, 25 bp, Mus musculus
atttcgatgtcacacttgtggctac

SEQ ID NO: 544747 - DNA, 25 bp, Mus musculus
atttcgatgtcagacttgtggctac

SEQ ID NO: 544748 - DNA, 25 bp, Mus musculus
atttcgggcgaacagctcagtgagc

SEQ ID NO: 544749 - DNA, 25 bp, Mus musculus
atttcgggcgaagagctcagtgagc

SEQ ID NO: 544750 - DNA, 25 bp, Mus musculus
atttcgggtccactgagcgcctcgg

SEQ ID NO: 544751 - DNA, 25 bp, Mus musculus
atttcgggtccagtgagcgcctcgg

SEQ ID NO: 544752 - DNA, 25 bp, Mus musculus
atttcggtcgtacggatctggatga

SEQ ID NO: 544753 - DNA, 25 bp, Mus musculus
atttcggtcgtagggatctggatga

SEQ ID NO: 544754 - DNA, 25 bp, Mus musculus
atttcgtcgccgcaggtgtccttct

SEQ ID NO: 544755 - DNA, 25 bp, Mus musculus
atttcgtcgccggaggtgtccttct

SEQ ID NO: 544756 - DNA, 25 bp, Mus musculus
atttctagagctcagtctcagagca

SEQ ID NO: 544757 - DNA, 25 bp, Mus musculus
atttctagagctgagtctcagagca

SEQ ID NO: 544758 - DNA, 25 bp, Mus musculus
atttctagatccaaaaattgctcag

SEQ ID NO: 544759 - DNA, 25 bp, Mus musculus
atttctagatcctaaaattgctcag

SEQ ID NO: 544760 - DNA, 25 bp, Mus musculus
atttctcaggacacaactgtgggac

SEQ ID NO: 544761 - DNA, 25 bp, Mus musculus
atttctcaggactcaactgtgggac

SEQ ID NO: 544762 - DNA, 25 bp, Mus musculus
atttctccatgaaggcctcacggtg

SEQ ID NO: 544763 - DNA, 25 bp, Mus musculus
atttctccatgatggcctcacggtg

SEQ ID NO: 544764 - DNA, 25 bp, Mus musculus
atttctcctgttaccatgcctcgta

SEQ ID NO: 544765 - DNA, 25 bp, Mus musculus
atttctcctgtttccatgcctcgta

SEQ ID NO: 544766 - DNA, 25 bp, Mus musculus
atttctcgggataagaagaggctgt

SEQ ID NO: 544767 - DNA, 25 bp, Mus musculus
atttctcgggattagaagaggctgt

SEQ ID NO: 544768 - DNA, 25 bp, Mus musculus
atttctgaaaacacgggatgacctg

SEQ ID NO: 544769 - DNA, 25 bp, Mus musculus
atttctgaaaactcgggatgacctg

SEQ ID NO: 544770 - DNA, 25 bp, Mus musculus
atttctggctgcatctcctgacccg

SEQ ID NO: 544771 - DNA, 25 bp, Mus musculus
atttctggctgcttctcctgacccg

SEQ ID NO: 544772 - DNA, 25 bp, Mus musculus
atttctgggctgacactgtcgatct

SEQ ID NO: 544773 - DNA, 25 bp, Mus musculus
atttctgggctgtcactgtcgatct

SEQ ID NO: 544774 - DNA, 25 bp, Mus musculus
atttctgtgaaaagatggccaacga

SEQ ID NO: 544775 - DNA, 25 bp, Mus musculus
atttctgtgaaatgatggccaacga

SEQ ID NO: 544776 - DNA, 25 bp, Mus musculus
atttcttactgtcccgagaagccgc

SEQ ID NO: 544777 - DNA, 25 bp, Mus musculus
atttcttactgtgccgagaagccgc

SEQ ID NO: 544778 - DNA, 25 bp, Mus musculus
atttcttagggccacagtccccgcg

SEQ ID NO: 544779 - DNA, 25 bp, Mus musculus
atttcttagggcgacagtccccgcg

SEQ ID NO: 544780 - DNA, 25 bp, Mus musculus
atttcttcacttcctctactctcag

SEQ ID NO: 544781 - DNA, 25 bp, Mus musculus
atttcttcacttgctctactctcag

SEQ ID NO: 544782 - DNA, 25 bp, Mus musculus
atttcttggtgaattctgtgtggcc

SEQ ID NO: 544783 - DNA, 25 bp, Mus musculus
atttcttggtgatttctgtgtggcc

SEQ ID NO: 544784 - DNA, 25 bp, Mus musculus
atttgaaaggctcaaggccacacag

SEQ ID NO: 544785 - DNA, 25 bp, Mus musculus
atttgaaaggctgaaggccacacag

SEQ ID NO: 544786 - DNA, 25 bp, Mus musculus
atttgaatgtaacctgccgctacgc

SEQ ID NO: 544787 - DNA, 25 bp, Mus musculus
atttgaatgtaagctgccgctacgc

SEQ ID NO: 544788 - DNA, 25 bp, Mus musculus
atttgacaaagacaaggatggttac

SEQ ID NO: 544789 - DNA, 25 bp, Mus musculus
atttgacaaagagaaggatggttac

SEQ ID NO: 544790 - DNA, 25 bp, Mus musculus
atttgaccgcaaccaatatttatca

SEQ ID NO: 544791 - DNA, 25 bp, Mus musculus
atttgaccgcaagcaatatttatca

SEQ ID NO: 544792 - DNA, 25 bp, Mus musculus
atttgacttcgcaagtcggtgacgc

SEQ ID NO: 544793 - DNA, 25 bp, Mus musculus
atttgacttcgctagtcggtgacgc

SEQ ID NO: 544794 - DNA, 25 bp, Mus musculus
atttgagatcgaaccgcacctgcaa

SEQ ID NO: 544795 - DNA, 25 bp, Mus musculus
atttgagatcgatccgcacctgcaa

SEQ ID NO: 544796 - DNA, 25 bp, Mus musculus
atttgagattccaaaagcgtctgag

SEQ ID NO: 544797 - DNA, 25 bp, Mus musculus
atttgagattcctaaagcgtctgag

SEQ ID NO: 544798 - DNA, 25 bp, Mus musculus
atttgagccccacagagcttagcac

SEQ ID NO: 544799 - DNA, 25 bp, Mus musculus
atttgagccccagagagcttagcac

SEQ ID NO: 544800 - DNA, 25 bp, Mus musculus
atttgagtaaccatcggcagctcag

SEQ ID NO: 544801 - DNA, 25 bp, Mus musculus
atttgagtaaccttcggcagctcag

SEQ ID NO: 544802 - DNA, 25 bp, Mus musculus
atttgatcccgcagctcgccggctt

SEQ ID NO: 544803 - DNA, 25 bp, Mus musculus
atttgatcccgctgctcgccggctt

SEQ ID NO: 544804 - DNA, 25 bp, Mus musculus
atttgatgaggccattgctgagttg

SEQ ID NO: 544805 - DNA, 25 bp, Mus musculus
atttgatgaggcgattgctgagttg

SEQ ID NO: 544806 - DNA, 25 bp, Mus musculus
atttgcacttcacggattgcaagac

SEQ ID NO: 544807 - DNA, 25 bp, Mus musculus
atttgcacttcagggattgcaagac

SEQ ID NO: 544808 - DNA, 25 bp, Mus musculus
atttgcagagacacggaagatgagg

SEQ ID NO: 544809 - DNA, 25 bp, Mus musculus
atttgcagagactcggaagatgagg

SEQ ID NO: 544810 - DNA, 25 bp, Mus musculus
atttgcatgcaaagaacatcatcca

SEQ ID NO: 544811 - DNA, 25 bp, Mus musculus
atttgcatgcaatgaacatcatcca

SEQ ID NO: 544812 - DNA, 25 bp, Mus musculus
atttgccagtataagaattccaggg

SEQ ID NO: 544813 - DNA, 25 bp, Mus musculus
atttgccagtattagaattccaggg

SEQ ID NO: 544814 - DNA, 25 bp, Mus musculus
atttgcctcctgattctacggtcct

SEQ ID NO: 544815 - DNA, 25 bp, Mus musculus
atttgcctcctgtttctacggtcct

SEQ ID NO: 544816 - DNA, 25 bp, Mus musculus
atttgccttgtgaggccaaatactt

SEQ ID NO: 544817 - DNA, 25 bp, Mus musculus
atttgccttgtgtggccaaatactt

SEQ ID NO: 544818 - DNA, 25 bp, Mus musculus
atttgcgatcgtccccttgcatgca

SEQ ID NO: 544819 - DNA, 25 bp, Mus musculus
atttgcgatcgtgcccttgcatgca

SEQ ID NO: 544820 - DNA, 25 bp, Mus musculus
atttgcggactccaccccactgggt

SEQ ID NO: 544821 - DNA, 25 bp, Mus musculus
atttgcggactcgaccccactgggt

SEQ ID NO: 544822 - DNA, 25 bp, Mus musculus
atttgcgtccgccttcttcactaga

SEQ ID NO: 544823 - DNA, 25 bp, Mus musculus
atttgcgtccgcgttcttcactaga

SEQ ID NO: 544824 - DNA, 25 bp, Mus musculus
atttgctactgcctccatcaagtca

SEQ ID NO: 544825 - DNA, 25 bp, Mus musculus
atttgctactgcgtccatcaagtca

SEQ ID NO: 544826 - DNA, 25 bp, Mus musculus
atttgctagaacagtaatccctgcc

SEQ ID NO: 544827 - DNA, 25 bp, Mus musculus
atttgctagaactgtaatccctgcc

SEQ ID NO: 544828 - DNA, 25 bp, Mus musculus
atttgctccaagaacttttatgacc

SEQ ID NO: 544829 - DNA, 25 bp, Mus musculus
atttgctccaagtacttttatgacc

SEQ ID NO: 544830 - DNA, 25 bp, Mus musculus
atttgctccataagcctgtggctct

SEQ ID NO: 544831 - DNA, 25 bp, Mus musculus
atttgctccatatgcctgtggctct

SEQ ID NO: 544832 - DNA, 25 bp, Mus musculus
atttgctccggccacattagtgact

SEQ ID NO: 544833 - DNA, 25 bp, Mus musculus
atttgctccggcgacattagtgact

SEQ ID NO: 544834 - DNA, 25 bp, Mus musculus
atttgctgatcacgaggtgcgatcg

SEQ ID NO: 544835 - DNA, 25 bp, Mus musculus
atttgctgatcaggaggtgcgatcg

SEQ ID NO: 544836 - DNA, 25 bp, Mus musculus
atttggaacattccaaccaacaagc

SEQ ID NO: 544837 - DNA, 25 bp, Mus musculus
atttggaacattgcaaccaacaagc

SEQ ID NO: 544838 - DNA, 25 bp, Mus musculus
atttggaccaaaacagcgcccagcc

SEQ ID NO: 544839 - DNA, 25 bp, Mus musculus
atttggaccaaatcagcgcccagcc

SEQ ID NO: 544840 - DNA, 25 bp, Mus musculus
atttggagaagactgctgtcttgca

SEQ ID NO: 544841 - DNA, 25 bp, Mus musculus
atttggagaagagtgctgtcttgca

SEQ ID NO: 544842 - DNA, 25 bp, Mus musculus
atttggagctggcaactccggctcc

SEQ ID NO: 544843 - DNA, 25 bp, Mus musculus
atttggagctgggaactccggctcc

SEQ ID NO: 544844 - DNA, 25 bp, Mus musculus
atttggaggcgccatgacagacgcc

SEQ ID NO: 544845 - DNA, 25 bp, Mus musculus
atttggaggcgcgatgacagacgcc

SEQ ID NO: 544846 - DNA, 25 bp, Mus musculus
atttggagtctacgtgcgctcggaa

SEQ ID NO: 544847 - DNA, 25 bp, Mus musculus
atttggagtctaggtgcgctcggaa

SEQ ID NO: 544848 - DNA, 25 bp, Mus musculus
atttgggctgtcagcttcgggccca

SEQ ID NO: 544849 - DNA, 25 bp, Mus musculus
atttgggctgtctgcttcgggccca

SEQ ID NO: 544850 - DNA, 25 bp, Mus musculus
atttggtggcctagcaatcggagga

SEQ ID NO: 544851 - DNA, 25 bp, Mus musculus
atttggtggccttgcaatcggagga

SEQ ID NO: 544852 - DNA, 25 bp, Mus musculus
atttgtaaggcccacggcaccgtca

SEQ ID NO: 544853 - DNA, 25 bp, Mus musculus
atttgtaaggccgacggcaccgtca

SEQ ID NO: 544854 - DNA, 25 bp, Mus musculus
atttgtaggccgagcacagaaaaag

SEQ ID NO: 544855 - DNA, 25 bp, Mus musculus
atttgtaggccgtgcacagaaaaag

SEQ ID NO: 544856 - DNA, 25 bp, Mus musculus
atttgtcctttccagttcggcgcgg

SEQ ID NO: 544857 - DNA, 25 bp, Mus musculus
atttgtcctttcgagttcggcgcgg

SEQ ID NO: 544858 - DNA, 25 bp, Mus musculus
atttgtctagatcatgtcgcaacca

SEQ ID NO: 544859 - DNA, 25 bp, Mus musculus
atttgtctagatgatgtcgcaacca

SEQ ID NO: 544860 - DNA, 25 bp, Mus musculus
atttgtctcagcagctggttgagcc

SEQ ID NO: 544861 - DNA, 25 bp, Mus musculus
atttgtctcagctgctggttgagcc

SEQ ID NO: 544862 - DNA, 25 bp, Mus musculus
atttgtgaagggagatgcccggcca

SEQ ID NO: 544863 - DNA, 25 bp, Mus musculus
atttgtgaagggtgatgcccggcca

SEQ ID NO: 544864 - DNA, 25 bp, Mus musculus
atttgtggatagcaagcgagttgca

SEQ ID NO: 544865 - DNA, 25 bp, Mus musculus
atttgtggataggaagcgagttgca

SEQ ID NO: 544866 - DNA, 25 bp, Mus musculus
atttgttatgaaacctccacaggtc

SEQ ID NO: 544867 - DNA, 25 bp, Mus musculus
atttgttatgaatcctccacaggtc

SEQ ID NO: 544868 - DNA, 25 bp, Mus musculus
atttgttcagcgctggaaatgaggc

SEQ ID NO: 544869 - DNA, 25 bp, Mus musculus
atttgttcagcggtggaaatgaggc

SEQ ID NO: 544870 - DNA, 25 bp, Mus musculus
attttaagtcggcaggtgtcacgct

SEQ ID NO: 544871 - DNA, 25 bp, Mus musculus
attttaagtcgggaggtgtcacgct

SEQ ID NO: 544872 - DNA, 25 bp, Mus musculus
attttaccccatcactgctgaatgg

SEQ ID NO: 544873 - DNA, 25 bp, Mus musculus
attttaccccatgactgctgaatgg

SEQ ID NO: 544874 - DNA, 25 bp, Mus musculus
attttatgaacacagagatgcagct

SEQ ID NO: 544875 - DNA, 25 bp, Mus musculus
attttatgaacagagagatgcagct

SEQ ID NO: 544876 - DNA, 25 bp, Mus musculus
attttattcaccagccagttatgag

SEQ ID NO: 544877 - DNA, 25 bp, Mus musculus
attttattcacctgccagttatgag

SEQ ID NO: 544878 - DNA, 25 bp, Mus musculus
attttattcctcaggccgaaatcag

SEQ ID NO: 544879 - DNA, 25 bp, Mus musculus
attttattcctctggccgaaatcag

SEQ ID NO: 544880 - DNA, 25 bp, Mus musculus
attttcaaccctctcagcacagtct

SEQ ID NO: 544881 - DNA, 25 bp, Mus musculus
attttcaaccctgtcagcacagtct

SEQ ID NO: 544882 - DNA, 25 bp, Mus musculus
attttcaagcccatcagagagttca

SEQ ID NO: 544883 - DNA, 25 bp, Mus musculus
attttcaagcccttcagagagttca

SEQ ID NO: 544884 - DNA, 25 bp, Mus musculus
attttcacaaatccggtacgatgct

SEQ ID NO: 544885 - DNA, 25 bp, Mus musculus
attttcacaaatgcggtacgatgct

SEQ ID NO: 544886 - DNA, 25 bp, Mus musculus
attttccactcacgagagtgcggcc

SEQ ID NO: 544887 - DNA, 25 bp, Mus musculus
attttccactcaggagagtgcggcc

SEQ ID NO: 544888 - DNA, 25 bp, Mus musculus
attttcgaacagactttcccatagc

SEQ ID NO: 544889 - DNA, 25 bp, Mus musculus
attttcgaacagtctttcccatagc

SEQ ID NO: 544890 - DNA, 25 bp, Mus musculus
attttctacaggcttggtcactgag

SEQ ID NO: 544891 - DNA, 25 bp, Mus musculus
attttctacagggttggtcactgag

SEQ ID NO: 544892 - DNA, 25 bp, Mus musculus
attttctagacacatacaagctgcc

SEQ ID NO: 544893 - DNA, 25 bp, Mus musculus
attttctagacagatacaagctgcc

SEQ ID NO: 544894 - DNA, 25 bp, Mus musculus
attttctccagccatttctccaacg

SEQ ID NO: 544895 - DNA, 25 bp, Mus musculus
attttctccagcgatttctccaacg

SEQ ID NO: 544896 - DNA, 25 bp, Mus musculus
attttctggccccaggcaagcgctc

SEQ ID NO: 544897 - DNA, 25 bp, Mus musculus
attttctggcccgaggcaagcgctc

SEQ ID NO: 544898 - DNA, 25 bp, Mus musculus
attttgaaatttcagccatgtgaag

SEQ ID NO: 544899 - DNA, 25 bp, Mus musculus
attttgaaatttgagccatgtgaag

SEQ ID NO: 544900 - DNA, 25 bp, Mus musculus
attttgaccatgcactctgtggatg

SEQ ID NO: 544901 - DNA, 25 bp, Mus musculus
attttgaccatggactctgtggatg

SEQ ID NO: 544902 - DNA, 25 bp, Mus musculus
attttgacttcaaagattgtggtgg

SEQ ID NO: 544903 - DNA, 25 bp, Mus musculus
attttgacttcatagattgtggtgg

SEQ ID NO: 544904 - DNA, 25 bp, Mus musculus
attttgatactgagcctgttgctgc

SEQ ID NO: 544905 - DNA, 25 bp, Mus musculus
attttgatactgtgcctgttgctgc

SEQ ID NO: 544906 - DNA, 25 bp, Mus musculus
attttgcctggcatccctctttgag

SEQ ID NO: 544907 - DNA, 25 bp, Mus musculus
attttgcctggcttccctctttgag

SEQ ID NO: 544908 - DNA, 25 bp, Mus musculus
attttgcgtgggagacaaattcttc

SEQ ID NO: 544909 - DNA, 25 bp, Mus musculus
attttgcgtgggtgacaaattcttc

SEQ ID NO: 544910 - DNA, 25 bp, Mus musculus
attttgctgcccctctagtggccca

SEQ ID NO: 544911 - DNA, 25 bp, Mus musculus
attttgctgcccgtctagtggccca

SEQ ID NO: 544912 - DNA, 25 bp, Mus musculus
attttggaccagaggtgccctgcgg

SEQ ID NO: 544913 - DNA, 25 bp, Mus musculus
attttggaccagtggtgccctgcgg

SEQ ID NO: 544914 - DNA, 25 bp, Mus musculus
attttggacggtctggtcgcaccaa

SEQ ID NO: 544915 - DNA, 25 bp, Mus musculus
attttggacggtgtggtcgcaccaa

SEQ ID NO: 544916 - DNA, 25 bp, Mus musculus
attttggagctgagaattaaggaaa

SEQ ID NO: 544917 - DNA, 25 bp, Mus musculus
attttggagctgtgaattaaggaaa

SEQ ID NO: 544918 - DNA, 25 bp, Mus musculus
attttggatcatacatacaagatgc

SEQ ID NO: 544919 - DNA, 25 bp, Mus musculus
attttggatcattcatacaagatgc

SEQ ID NO: 544920 - DNA, 25 bp, Mus musculus
attttggctatactcctgttctggg

SEQ ID NO: 544921 - DNA, 25 bp, Mus musculus
attttggctatagtcctgttctggg

SEQ ID NO: 544922 - DNA, 25 bp, Mus musculus
attttgggccaccaaagctctgggt

SEQ ID NO: 544923 - DNA, 25 bp, Mus musculus
attttgggccacgaaagctctgggt

SEQ ID NO: 544924 - DNA, 25 bp, Mus musculus
attttgggctggctcggcacactga

SEQ ID NO: 544925 - DNA, 25 bp, Mus musculus
attttgggctgggtcggcacactga

SEQ ID NO: 544926 - DNA, 25 bp, Mus musculus
attttggtatcaaatgatcttgccc

SEQ ID NO: 544927 - DNA, 25 bp, Mus musculus
attttggtatcatatgatcttgccc

SEQ ID NO: 544928 - DNA, 25 bp, Mus musculus
attttggtctggacagatgagcgtg

SEQ ID NO: 544929 - DNA, 25 bp, Mus musculus
attttggtctggtcagatgagcgtg

SEQ ID NO: 544930 - DNA, 25 bp, Mus musculus
attttggtgtaaccgctcagctgga

SEQ ID NO: 544931 - DNA, 25 bp, Mus musculus
attttggtgtaagcgctcagctgga

SEQ ID NO: 544932 - DNA, 25 bp, Mus musculus
attttgtgacttatctcttgccctc

SEQ ID NO: 544933 - DNA, 25 bp, Mus musculus
attttgtgacttttctcttgccctc

SEQ ID NO: 544934 - DNA, 25 bp, Mus musculus
attttgttcttcctctgttatgacc

SEQ ID NO: 544935 - DNA, 25 bp, Mus musculus
attttgttcttcgtctgttatgacc

SEQ ID NO: 544936 - DNA, 25 bp, Mus musculus
atttttattggcagaattgggtaca

SEQ ID NO: 544937 - DNA, 25 bp, Mus musculus
atttttattggctgaattgggtaca

SEQ ID NO: 544938 - DNA, 25 bp, Mus musculus
atttttcaccggaggcagacgcacc

SEQ ID NO: 544939 - DNA, 25 bp, Mus musculus
atttttcaccggtggcagacgcacc

SEQ ID NO: 544940 - DNA, 25 bp, Mus musculus
atttttctgctgcttctgggcggag

SEQ ID NO: 544941 - DNA, 25 bp, Mus musculus
atttttctgctggttctgggcggag

SEQ ID NO: 544942 - DNA, 25 bp, Mus musculus
atttttggacaaccaaacacttcct

SEQ ID NO: 544943 - DNA, 25 bp, Mus musculus
atttttggacaagcaaacacttcct

SEQ ID NO: 544944 - DNA, 25 bp, Mus musculus
atttttggatcaagtcctacaccag

SEQ ID NO: 544945 - DNA, 25 bp, Mus musculus
atttttggatcatgtcctacaccag

SEQ ID NO: 544946 - DNA, 25 bp, Mus musculus
atttttgggttcagcagctcgtcag

SEQ ID NO: 544947 - DNA, 25 bp, Mus musculus
atttttgggttctgcagctcgtcag

SEQ ID NO: 544948 - DNA, 25 bp, Mus musculus
caaaaaacatgcctgtgctaaaatg

SEQ ID NO: 544949 - DNA, 25 bp, Mus musculus
caaaaaacatgcgtgtgctaaaatg

SEQ ID NO: 544950 - DNA, 25 bp, Mus musculus
caaaaaaccaccatcaaagctgaac

SEQ ID NO: 544951 - DNA, 25 bp, Mus musculus
caaaaaaccaccttcaaagctgaac

SEQ ID NO: 544952 - DNA, 25 bp, Mus musculus
caaaaaacgggacgtcattgagaag

SEQ ID NO: 544953 - DNA, 25 bp, Mus musculus
caaaaaacgggaggtcattgagaag

SEQ ID NO: 544954 - DNA, 25 bp, Mus musculus
caaaaaactgctaccacctggctta

SEQ ID NO: 544955 - DNA, 25 bp, Mus musculus
caaaaaactgcttccacctggctta

SEQ ID NO: 544956 - DNA, 25 bp, Mus musculus
caaaaaagaaatcgtgatgcagtac

SEQ ID NO: 544957 - DNA, 25 bp, Mus musculus
caaaaaagaaatggtgatgcagtac

SEQ ID NO: 544958 - DNA, 25 bp, Mus musculus
caaaaaagacgacgcttgactctgg

SEQ ID NO: 544959 - DNA, 25 bp, Mus musculus
caaaaaagacgaggcttgactctgg

SEQ ID NO: 544960 - DNA, 25 bp, Mus musculus
caaaaaagatttcgaggaggcagag

SEQ ID NO: 544961 - DNA, 25 bp, Mus musculus
caaaaaagatttggaggaggcagag

SEQ ID NO: 544962 - DNA, 25 bp, Mus musculus
caaaaaagtattcgctgtcctaagg

SEQ ID NO: 544963 - DNA, 25 bp, Mus musculus
caaaaaagtattggctgtcctaagg

SEQ ID NO: 544964 - DNA, 25 bp, Mus musculus
caaaaaatacttactgctcaggatc

SEQ ID NO: 544965 - DNA, 25 bp, Mus musculus
caaaaaatactttctgctcaggatc

SEQ ID NO: 544966 - DNA, 25 bp, Mus musculus
caaaaaatctgactattgtggagct

SEQ ID NO: 544967 - DNA, 25 bp, Mus musculus
caaaaaatctgagtattgtggagct

SEQ ID NO: 544968 - DNA, 25 bp, Mus musculus
caaaaaatctttatggctgctgcca

SEQ ID NO: 544969 - DNA, 25 bp, Mus musculus
caaaaaatctttttggctgctgcca

SEQ ID NO: 544970 - DNA, 25 bp, Mus musculus
caaaaaatgagccattagatgttgg

SEQ ID NO: 544971 - DNA, 25 bp, Mus musculus
caaaaaatgagcgattagatgttgg

SEQ ID NO: 544972 - DNA, 25 bp, Mus musculus
caaaaaatggcgctgtgacggagac

SEQ ID NO: 544973 - DNA, 25 bp, Mus musculus
caaaaaatggcggtgtgacggagac

SEQ ID NO: 544974 - DNA, 25 bp, Mus musculus
caaaaaatggtgcaccttcggcagc

SEQ ID NO: 544975 - DNA, 25 bp, Mus musculus
caaaaaatggtggaccttcggcagc

SEQ ID NO: 544976 - DNA, 25 bp, Mus musculus
caaaaaattccaacaaatgcaactc

SEQ ID NO: 544977 - DNA, 25 bp, Mus musculus
caaaaaattccatcaaatgcaactc

SEQ ID NO: 544978 - DNA, 25 bp, Mus musculus
caaaaaatttgccatttaccgatgg

SEQ ID NO: 544979 - DNA, 25 bp, Mus musculus
caaaaaatttgcgatttaccgatgg

SEQ ID NO: 544980 - DNA, 25 bp, Mus musculus
caaaaacaatgtacttggaggatag

SEQ ID NO: 544981 - DNA, 25 bp, Mus musculus
caaaaacaatgttcttggaggatag

SEQ ID NO: 544982 - DNA, 25 bp, Mus musculus
caaaaacacggtcaggatggtgcag

SEQ ID NO: 544983 - DNA, 25 bp, Mus musculus
caaaaacacggtgaggatggtgcag

SEQ ID NO: 544984 - DNA, 25 bp, Mus musculus
caaaaacagagaaggtgttgacaga

SEQ ID NO: 544985 - DNA, 25 bp, Mus musculus
caaaaacagagatggtgttgacaga

SEQ ID NO: 544986 - DNA, 25 bp, Mus musculus
caaaaacagagtacgaagtaggata

SEQ ID NO: 544987 - DNA, 25 bp, Mus musculus
caaaaacagagttcgaagtaggata

SEQ ID NO: 544988 - DNA, 25 bp, Mus musculus
caaaaacagtagctccctggcccgt

SEQ ID NO: 544989 - DNA, 25 bp, Mus musculus
caaaaacagtaggtccctggcccgt

SEQ ID NO: 544990 - DNA, 25 bp, Mus musculus
caaaaacattgtctggatttcggcc

SEQ ID NO: 544991 - DNA, 25 bp, Mus musculus
caaaaacattgtgtggatttcggcc

SEQ ID NO: 544992 - DNA, 25 bp, Mus musculus
caaaaaccctgactgtctgagaagc

SEQ ID NO: 544993 - DNA, 25 bp, Mus musculus
caaaaaccctgagtgtctgagaagc

SEQ ID NO: 544994 - DNA, 25 bp, Mus musculus
caaaaacccttgcagaacacaagga

SEQ ID NO: 544995 - DNA, 25 bp, Mus musculus
caaaaacccttggagaacacaagga

SEQ ID NO: 544996 - DNA, 25 bp, Mus musculus
caaaaaccgcctctggaagctgctg

SEQ ID NO: 544997 - DNA, 25 bp, Mus musculus
caaaaaccgcctgtggaagctgctg

SEQ ID NO: 544998 - DNA, 25 bp, Mus musculus
caaaaacggattcttcacagagacc

SEQ ID NO: 544999 - DNA, 25 bp, Mus musculus
caaaaacggattgttcacagagacc

SEQ ID NO: 545000 - DNA, 25 bp, Mus musculus
caaaaacgtcatctcagcatttgga

SEQ ID NO: 545001 - DNA, 25 bp, Mus musculus
caaaaacgtcatgtcagcatttgga

SEQ ID NO: 545002 - DNA, 25 bp, Mus musculus
caaaaactaagaaactaaggcagcg

SEQ ID NO: 545003 - DNA, 25 bp, Mus musculus
caaaaactaagatactaaggcagcg

SEQ ID NO: 545004 - DNA, 25 bp, Mus musculus
caaaaactaccaaccgcctagtgaa

SEQ ID NO: 545005 - DNA, 25 bp, Mus musculus
caaaaactaccacccaaagatcagg

SEQ ID NO: 545006 - DNA, 25 bp, Mus musculus
caaaaactaccagccaaagatcagg

SEQ ID NO: 545007 - DNA, 25 bp, Mus musculus
caaaaactaccatccgcctagtgaa

SEQ ID NO: 545008 - DNA, 25 bp, Mus musculus
caaaaactacttaagtagctggagg

SEQ ID NO: 545009 - DNA, 25 bp, Mus musculus
caaaaactactttagtagctggagg

SEQ ID NO: 545010 - DNA, 25 bp, Mus musculus
caaaaactctgtaaaaatgaccctg

SEQ ID NO: 545011 - DNA, 25 bp, Mus musculus
caaaaactctgttaaaatgaccctg

SEQ ID NO: 545012 - DNA, 25 bp, Mus musculus
caaaaactggagaaattcaacctgc

SEQ ID NO: 545013 - DNA, 25 bp, Mus musculus
caaaaactggagtaattcaacctgc

SEQ ID NO: 545014 - DNA, 25 bp, Mus musculus
caaaaactgtggagtcctggtgcat

SEQ ID NO: 545015 - DNA, 25 bp, Mus musculus
caaaaactgtggtgtcctggtgcat

SEQ ID NO: 545016 - DNA, 25 bp, Mus musculus
caaaaacttgccagttggagaggca

SEQ ID NO: 545017 - DNA, 25 bp, Mus musculus
caaaaacttgcctgttggagaggca

SEQ ID NO: 545018 - DNA, 25 bp, Mus musculus
caaaaagaagaacccacctagcatc

SEQ ID NO: 545019 - DNA, 25 bp, Mus musculus
caaaaagaagaagccacctagcatc

SEQ ID NO: 545020 - DNA, 25 bp, Mus musculus
caaaaagaagccctggcacctgagg

SEQ ID NO: 545021 - DNA, 25 bp, Mus musculus
caaaaagaagccgtggcacctgagg

SEQ ID NO: 545022 - DNA, 25 bp, Mus musculus
caaaaagaatgccatatccttccag

SEQ ID NO: 545023 - DNA, 25 bp, Mus musculus
caaaaagaatgcgatatccttccag

SEQ ID NO: 545024 - DNA, 25 bp, Mus musculus
caaaaagaccgtcggagtgaagaag

SEQ ID NO: 545025 - DNA, 25 bp, Mus musculus
caaaaagaccgtgggagtgaagaag

SEQ ID NO: 545026 - DNA, 25 bp, Mus musculus
caaaaagacctccttcagcatataa

SEQ ID NO: 545027 - DNA, 25 bp, Mus musculus
caaaaagacctcgttcagcatataa

SEQ ID NO: 545028 - DNA, 25 bp, Mus musculus
caaaaagactccaatctgtatgcca

SEQ ID NO: 545029 - DNA, 25 bp, Mus musculus
caaaaagactcctatctgtatgcca

SEQ ID NO: 545030 - DNA, 25 bp, Mus musculus
caaaaagagagcagcgccaaaggga

SEQ ID NO: 545031 - DNA, 25 bp, Mus musculus
caaaaagagagctgcgccaaaggga

SEQ ID NO: 545032 - DNA, 25 bp, Mus musculus
caaaaagaggatctagcgaatcagt

SEQ ID NO: 545033 - DNA, 25 bp, Mus musculus
caaaaagaggatgtagcgaatcagt

SEQ ID NO: 545034 - DNA, 25 bp, Mus musculus
caaaaagagtgaccttatcctggac

SEQ ID NO: 545035 - DNA, 25 bp, Mus musculus
caaaaagagtgagcttatcctggac

SEQ ID NO: 545036 - DNA, 25 bp, Mus musculus
caaaaagatgctcggattggcgaag

SEQ ID NO: 545037 - DNA, 25 bp, Mus musculus
caaaaagatgctgggattggcgaag

SEQ ID NO: 545038 - DNA, 25 bp, Mus musculus
caaaaagattcgacaggaggtggac

SEQ ID NO: 545039 - DNA, 25 bp, Mus musculus
caaaaagattcgtcaggaggtggac

SEQ ID NO: 545040 - DNA, 25 bp, Mus musculus
caaaaagatttgcatctcccaggcc

SEQ ID NO: 545041 - DNA, 25 bp, Mus musculus
caaaaagatttggatctcccaggcc

SEQ ID NO: 545042 - DNA, 25 bp, Mus musculus
caaaaagcaaacatgatgaaagaga

SEQ ID NO: 545043 - DNA, 25 bp, Mus musculus
caaaaagcaaacttgatgaaagaga

SEQ ID NO: 545044 - DNA, 25 bp, Mus musculus
caaaaagcacacacaggatgtgacc

SEQ ID NO: 545045 - DNA, 25 bp, Mus musculus
caaaaagcacactcaggatgtgacc

SEQ ID NO: 545046 - DNA, 25 bp, Mus musculus
caaaaagcagtgaggttccatgccg

SEQ ID NO: 545047 - DNA, 25 bp, Mus musculus
caaaaagcagtgtggttccatgccg

SEQ ID NO: 545048 - DNA, 25 bp, Mus musculus
caaaaagctcaacgtggaagcgcca

SEQ ID NO: 545049 - DNA, 25 bp, Mus musculus
caaaaagctcaaggtggaagcgcca

SEQ ID NO: 545050 - DNA, 25 bp, Mus musculus
caaaaagctgtcaatgagctgcagg

SEQ ID NO: 545051 - DNA, 25 bp, Mus musculus
caaaaagctgtctatgagctgcagg

SEQ ID NO: 545052 - DNA, 25 bp, Mus musculus
caaaaagcttgcagcgttctggttg

SEQ ID NO: 545053 - DNA, 25 bp, Mus musculus
caaaaagcttgctgcgttctggttg

SEQ ID NO: 545054 - DNA, 25 bp, Mus musculus
caaaaaggaaagacgcttcacctcg

SEQ ID NO: 545055 - DNA, 25 bp, Mus musculus
caaaaaggaaagtcgcttcacctcg

SEQ ID NO: 545056 - DNA, 25 bp, Mus musculus
caaaaaggaagtcgccagtttcaca

SEQ ID NO: 545057 - DNA, 25 bp, Mus musculus
caaaaaggaagtggccagtttcaca

SEQ ID NO: 545058 - DNA, 25 bp, Mus musculus
caaaaaggacgactatactgcccgt

SEQ ID NO: 545059 - DNA, 25 bp, Mus musculus
caaaaaggacgagtatactgcccgt

SEQ ID NO: 545060 - DNA, 25 bp, Mus musculus
caaaaaggcacacaatattcactgt

SEQ ID NO: 545061 - DNA, 25 bp, Mus musculus
caaaaaggcacagaatattcactgt

SEQ ID NO: 545062 - DNA, 25 bp, Mus musculus
caaaaaggctagaagaataaaggca

SEQ ID NO: 545063 - DNA, 25 bp, Mus musculus
caaaaaggctagtagaataaaggca

SEQ ID NO: 545064 - DNA, 25 bp, Mus musculus
caaaaagggtaaccctctatcaagc

SEQ ID NO: 545065 - DNA, 25 bp, Mus musculus
caaaaagggtaagcctctatcaagc

SEQ ID NO: 545066 - DNA, 25 bp, Mus musculus
caaaaaggtccaacgagctgaatct

SEQ ID NO: 545067 - DNA, 25 bp, Mus musculus
caaaaaggtccatcgagctgaatct

SEQ ID NO: 545068 - DNA, 25 bp, Mus musculus
caaaaagtacttcgcaaaggcagct

SEQ ID NO: 545069 - DNA, 25 bp, Mus musculus
caaaaagtacttggcaaaggcagct

SEQ ID NO: 545070 - DNA, 25 bp, Mus musculus
caaaaagtctgtatgacgcctggtc

SEQ ID NO: 545071 - DNA, 25 bp, Mus musculus
caaaaagtctgtttgacgcctggtc

SEQ ID NO: 545072 - DNA, 25 bp, Mus musculus
caaaaagtgaatcccgactgaaaca

SEQ ID NO: 545073 - DNA, 25 bp, Mus musculus
caaaaagtgaatgccgactgaaaca

SEQ ID NO: 545074 - DNA, 25 bp, Mus musculus
caaaaatacacacaaaaggacagct

SEQ ID NO: 545075 - DNA, 25 bp, Mus musculus
caaaaatacacagaaaaggacagct

SEQ ID NO: 545076 - DNA, 25 bp, Mus musculus
caaaaatactgtagtgagattctcg

SEQ ID NO: 545077 - DNA, 25 bp, Mus musculus
caaaaatactgttgtgagattctcg

SEQ ID NO: 545078 - DNA, 25 bp, Mus musculus
caaaaatagcagcaatttgagtttg

SEQ ID NO: 545079 - DNA, 25 bp, Mus musculus
caaaaatagcaggaatttgagtttg

SEQ ID NO: 545080 - DNA, 25 bp, Mus musculus
caaaaatcaaatcactctgcctttg

SEQ ID NO: 545081 - DNA, 25 bp, Mus musculus
caaaaatcaaatgactctgcctttg

SEQ ID NO: 545082 - DNA, 25 bp, Mus musculus
caaaaatcacgaaacaatgaatcag

SEQ ID NO: 545083 - DNA, 25 bp, Mus musculus
caaaaatcacgatacaatgaatcag

SEQ ID NO: 545084 - DNA, 25 bp, Mus musculus
caaaaatcacggaaggtttgtattg

SEQ ID NO: 545085 - DNA, 25 bp, Mus musculus
caaaaatcacggtaggtttgtattg

SEQ ID NO: 545086 - DNA, 25 bp, Mus musculus
caaaaatcagatccagagtgagcat

SEQ ID NO: 545087 - DNA, 25 bp, Mus musculus
caaaaatcagatgcagagtgagcat

SEQ ID NO: 545088 - DNA, 25 bp, Mus musculus
caaaaatcctgacaatacagacagg

SEQ ID NO: 545089 - DNA, 25 bp, Mus musculus
caaaaatcctgagaatacagacagg

SEQ ID NO: 545090 - DNA, 25 bp, Mus musculus
caaaaatcgctcacaaaagcaagtg

SEQ ID NO: 545091 - DNA, 25 bp, Mus musculus
caaaaatcgctctcaaaagcaagtg

SEQ ID NO: 545092 - DNA, 25 bp, Mus musculus
caaaaatctccgctgtttctctgcg

SEQ ID NO: 545093 - DNA, 25 bp, Mus musculus
caaaaatctccggtgtttctctgcg

SEQ ID NO: 545094 - DNA, 25 bp, Mus musculus
caaaaatctgtaaagacagctcatc

SEQ ID NO: 545095 - DNA, 25 bp, Mus musculus
caaaaatctgtatagacagctcatc

SEQ ID NO: 545096 - DNA, 25 bp, Mus musculus
caaaaatgaagcatggtgtacaggt

SEQ ID NO: 545097 - DNA, 25 bp, Mus musculus
caaaaatgaagcttggtgtacaggt

SEQ ID NO: 545098 - DNA, 25 bp, Mus musculus
caaaaatgggccacctccatgtcct

SEQ ID NO: 545099 - DNA, 25 bp, Mus musculus
caaaaatgggcctcctccatgtcct

SEQ ID NO: 545100 - DNA, 25 bp, Mus musculus
caaaaatgtcccatcgctcctacgg

SEQ ID NO: 545101 - DNA, 25 bp, Mus musculus
caaaaatgtcccttcgctcctacgg

SEQ ID NO: 545102 - DNA, 25 bp, Mus musculus
caaaaattggcgctatattgtgccc

SEQ ID NO: 545103 - DNA, 25 bp, Mus musculus
caaaaattggcggtatattgtgccc

SEQ ID NO: 545104 - DNA, 25 bp, Mus musculus
caaaacaaacaacgcagcaaactgc

SEQ ID NO: 545105 - DNA, 25 bp, Mus musculus
caaaacaaacaaggcagcaaactgc

SEQ ID NO: 545106 - DNA, 25 bp, Mus musculus
caaaacaaacgtcaaattcttggct

SEQ ID NO: 545107 - DNA, 25 bp, Mus musculus
caaaacaaacgtgaaattcttggct

SEQ ID NO: 545108 - DNA, 25 bp, Mus musculus
caaaacaaagacagtcaggtgctcg

SEQ ID NO: 545109 - DNA, 25 bp, Mus musculus
caaaacaaagactgtcaggtgctcg

SEQ ID NO: 545110 - DNA, 25 bp, Mus musculus
caaaacaagacactaaagctagcgg

SEQ ID NO: 545111 - DNA, 25 bp, Mus musculus
caaaacaagacagtaaagctagcgg

SEQ ID NO: 545112 - DNA, 25 bp, Mus musculus
caaaacaatagtatccagctggaat

SEQ ID NO: 545113 - DNA, 25 bp, Mus musculus
caaaacaatagtttccagctggaat

SEQ ID NO: 545114 - DNA, 25 bp, Mus musculus
caaaacacaattcagcttacgtttg

SEQ ID NO: 545115 - DNA, 25 bp, Mus musculus
caaaacacaattgagcttacgtttg

SEQ ID NO: 545116 - DNA, 25 bp, Mus musculus
caaaacaccagtaggatctagaacg

SEQ ID NO: 545117 - DNA, 25 bp, Mus musculus
caaaacaccagttggatctagaacg

SEQ ID NO: 545118 - DNA, 25 bp, Mus musculus
caaaacacggagagctggctgtgct

SEQ ID NO: 545119 - DNA, 25 bp, Mus musculus
caaaacacggagtgctggctgtgct

SEQ ID NO: 545120 - DNA, 25 bp, Mus musculus
caaaacacgttaatgcagaaataat

SEQ ID NO: 545121 - DNA, 25 bp, Mus musculus
caaaacacgttattgcagaaataat

SEQ ID NO: 545122 - DNA, 25 bp, Mus musculus
caaaacagaaacaggcacgggatac

SEQ ID NO: 545123 - DNA, 25 bp, Mus musculus
caaaacagaaactggcacgggatac

SEQ ID NO: 545124 - DNA, 25 bp, Mus musculus
caaaacagaagtctccggctgtcct

SEQ ID NO: 545125 - DNA, 25 bp, Mus musculus
caaaacagaagtgtccggctgtcct

SEQ ID NO: 545126 - DNA, 25 bp, Mus musculus
caaaacagatgtcctaggtgttcac

SEQ ID NO: 545127 - DNA, 25 bp, Mus musculus
caaaacagatgtgctaggtgttcac

SEQ ID NO: 545128 - DNA, 25 bp, Mus musculus
caaaacagcccaagccctgagacat

SEQ ID NO: 545129 - DNA, 25 bp, Mus musculus
caaaacagcccatgccctgagacat

SEQ ID NO: 545130 - DNA, 25 bp, Mus musculus
caaaacagctgtatgtgacaccaca

SEQ ID NO: 545131 - DNA, 25 bp, Mus musculus
caaaacagctgtttgtgacaccaca

SEQ ID NO: 545132 - DNA, 25 bp, Mus musculus
caaaacaggattatatgccaagtga

SEQ ID NO: 545133 - DNA, 25 bp, Mus musculus
caaaacaggattttatgccaagtga

SEQ ID NO: 545134 - DNA, 25 bp, Mus musculus
caaaacatgtctcaatccatagaag

SEQ ID NO: 545135 - DNA, 25 bp, Mus musculus
caaaacatgtctgaatccatagaag

SEQ ID NO: 545136 - DNA, 25 bp, Mus musculus
caaaacattaacctgaagccaccga

SEQ ID NO: 545137 - DNA, 25 bp, Mus musculus
caaaacattaacgtgaagccaccga

SEQ ID NO: 545138 - DNA, 25 bp, Mus musculus
caaaaccaacttcttgacaagatga

SEQ ID NO: 545139 - DNA, 25 bp, Mus musculus
caaaaccaacttgttgacaagatga

SEQ ID NO: 545140 - DNA, 25 bp, Mus musculus
caaaaccaatggattgcgaacagat

SEQ ID NO: 545141 - DNA, 25 bp, Mus musculus
caaaaccaatggtttgcgaacagat

SEQ ID NO: 545142 - DNA, 25 bp, Mus musculus
caaaaccacatgaaagaggagaggg

SEQ ID NO: 545143 - DNA, 25 bp, Mus musculus
caaaaccacatgtaagaggagaggg

SEQ ID NO: 545144 - DNA, 25 bp, Mus musculus
caaaaccagcaaacaagaagctaga

SEQ ID NO: 545145 - DNA, 25 bp, Mus musculus
caaaaccagcaatcaagaagctaga

SEQ ID NO: 545146 - DNA, 25 bp, Mus musculus
caaaaccagggcaccgtgtaggctt

SEQ ID NO: 545147 - DNA, 25 bp, Mus musculus
caaaaccagggctccgtgtaggctt

SEQ ID NO: 545148 - DNA, 25 bp, Mus musculus
caaaaccagtgtctggaaaggcagc

SEQ ID NO: 545149 - DNA, 25 bp, Mus musculus
caaaaccagtgtgtggaaaggcagc

SEQ ID NO: 545150 - DNA, 25 bp, Mus musculus
caaaaccattggacccatctgtccg

SEQ ID NO: 545151 - DNA, 25 bp, Mus musculus
caaaaccattggtcccatctgtccg

SEQ ID NO: 545152 - DNA, 25 bp, Mus musculus
caaaacccagtgagaccagtgtctc

SEQ ID NO: 545153 - DNA, 25 bp, Mus musculus
caaaacccagtgtgaccagtgtctc

SEQ ID NO: 545154 - DNA, 25 bp, Mus musculus
caaaaccccatcctgaagaacatca

SEQ ID NO: 545155 - DNA, 25 bp, Mus musculus
caaaaccccatcgtgaagaacatca

SEQ ID NO: 545156 - DNA, 25 bp, Mus musculus
caaaaccctaatattgtcaacagta

SEQ ID NO: 545157 - DNA, 25 bp, Mus musculus
caaaaccctaattttgtcaacagta

SEQ ID NO: 545158 - DNA, 25 bp, Mus musculus
caaaaccgagtcagttaccagtggc

SEQ ID NO: 545159 - DNA, 25 bp, Mus musculus
caaaaccgagtctgttaccagtggc

SEQ ID NO: 545160 - DNA, 25 bp, Mus musculus
caaaacctagagatgaatgtcacag

SEQ ID NO: 545161 - DNA, 25 bp, Mus musculus
caaaacctagagttgaatgtcacag

SEQ ID NO: 545162 - DNA, 25 bp, Mus musculus
caaaacctcaaactagggcttgctt

SEQ ID NO: 545163 - DNA, 25 bp, Mus musculus
caaaacctcaaagtagggcttgctt

SEQ ID NO: 545164 - DNA, 25 bp, Mus musculus
caaaacctctggaagccgcgattga

SEQ ID NO: 545165 - DNA, 25 bp, Mus musculus
caaaacctctggtagccgcgattga

SEQ ID NO: 545166 - DNA, 25 bp, Mus musculus
caaaacctgatgaattaatggattc

SEQ ID NO: 545167 - DNA, 25 bp, Mus musculus
caaaacctgatgtattaatggattc

SEQ ID NO: 545168 - DNA, 25 bp, Mus musculus
caaaacctggccaggctaccaagaa

SEQ ID NO: 545169 - DNA, 25 bp, Mus musculus
caaaacctggcctggctaccaagaa

SEQ ID NO: 545170 - DNA, 25 bp, Mus musculus
caaaacctgtctagaaagtgaccag

SEQ ID NO: 545171 - DNA, 25 bp, Mus musculus
caaaacctgtcttgaaagtgaccag

SEQ ID NO: 545172 - DNA, 25 bp, Mus musculus
caaaaccttccccatggctgaatac

SEQ ID NO: 545173 - DNA, 25 bp, Mus musculus
caaaaccttcccgatggctgaatac

SEQ ID NO: 545174 - DNA, 25 bp, Mus musculus
caaaacgaacctcactttcacagct

SEQ ID NO: 545175 - DNA, 25 bp, Mus musculus
caaaacgaacctgactttcacagct

SEQ ID NO: 545176 - DNA, 25 bp, Mus musculus
caaaacgaatgaaccatcactgagc

SEQ ID NO: 545177 - DNA, 25 bp, Mus musculus
caaaacgaatgatccatcactgagc

SEQ ID NO: 545178 - DNA, 25 bp, Mus musculus
caaaacgggtccacctgatgaatcc

SEQ ID NO: 545179 - DNA, 25 bp, Mus musculus
caaaacgggtcctcctgatgaatcc

SEQ ID NO: 545180 - DNA, 25 bp, Mus musculus
caaaacgggttacagcgcaaacatc

SEQ ID NO: 545181 - DNA, 25 bp, Mus musculus
caaaacgggttagagcgcaaacatc

SEQ ID NO: 545182 - DNA, 25 bp, Mus musculus
caaaacggtctcagaggatggtcat

SEQ ID NO: 545183 - DNA, 25 bp, Mus musculus
caaaacggtctctgaggatggtcat

SEQ ID NO: 545184 - DNA, 25 bp, Mus musculus
caaaacgtgaagaaataatggagag

SEQ ID NO: 545185 - DNA, 25 bp, Mus musculus
caaaacgtgaagtaataatggagag

SEQ ID NO: 545186 - DNA, 25 bp, Mus musculus
caaaacgtggggctggttccatccg

SEQ ID NO: 545187 - DNA, 25 bp, Mus musculus
caaaacgtgggggtggttccatccg

SEQ ID NO: 545188 - DNA, 25 bp, Mus musculus
caaaactaagaaagaaacaaccgtg

SEQ ID NO: 545189 - DNA, 25 bp, Mus musculus
caaaactaagaatgaaacaaccgtg

SEQ ID NO: 545190 - DNA, 25 bp, Mus musculus
caaaactaagagctctacatgccag

SEQ ID NO: 545191 - DNA, 25 bp, Mus musculus
caaaactaagaggtctacatgccag

SEQ ID NO: 545192 - DNA, 25 bp, Mus musculus
caaaactagttcctggtgcttgagc

SEQ ID NO: 545193 - DNA, 25 bp, Mus musculus
caaaactagttcgtggtgcttgagc

SEQ ID NO: 545194 - DNA, 25 bp, Mus musculus
caaaactatatcagaactgcttcta

SEQ ID NO: 545195 - DNA, 25 bp, Mus musculus
caaaactatatctgaactgcttcta

SEQ ID NO: 545196 - DNA, 25 bp, Mus musculus
caaaactcagagcttgtctgtttca

SEQ ID NO: 545197 - DNA, 25 bp, Mus musculus
caaaactcagaggttgtctgtttca

SEQ ID NO: 545198 - DNA, 25 bp, Mus musculus
caaaactcttacaaacaggagtgtc

SEQ ID NO: 545199 - DNA, 25 bp, Mus musculus
caaaactcttactaacaggagtgtc

SEQ ID NO: 545200 - DNA, 25 bp, Mus musculus
caaaactgaaatcccactgggcgca

SEQ ID NO: 545201 - DNA, 25 bp, Mus musculus
caaaactgaaatgccactgggcgca

SEQ ID NO: 545202 - DNA, 25 bp, Mus musculus
caaaactgaatcagtaagcagctcc

SEQ ID NO: 545203 - DNA, 25 bp, Mus musculus
caaaactgaatctgtaagcagctcc

SEQ ID NO: 545204 - DNA, 25 bp, Mus musculus
caaaactgacctagattgaggagca

SEQ ID NO: 545205 - DNA, 25 bp, Mus musculus
caaaactgaccttgattgaggagca

SEQ ID NO: 545206 - DNA, 25 bp, Mus musculus
caaaactgcaaacgatcaatctttc

SEQ ID NO: 545207 - DNA, 25 bp, Mus musculus
caaaactgcaaaggatcaatctttc

SEQ ID NO: 545208 - DNA, 25 bp, Mus musculus
caaaactgcagccatcatcacggca

SEQ ID NO: 545209 - DNA, 25 bp, Mus musculus
caaaactgcagcgatcatcacggca

SEQ ID NO: 545210 - DNA, 25 bp, Mus musculus
caaaactgccacctgattgagggcc

SEQ ID NO: 545211 - DNA, 25 bp, Mus musculus
caaaactgccacgtgattgagggcc

SEQ ID NO: 545212 - DNA, 25 bp, Mus musculus
caaaactgctaaacgatgaggacca

SEQ ID NO: 545213 - DNA, 25 bp, Mus musculus
caaaactgctaatcgatgaggacca

SEQ ID NO: 545214 - DNA, 25 bp, Mus musculus
caaaactgctcgcttcctgaagtca

SEQ ID NO: 545215 - DNA, 25 bp, Mus musculus
caaaactgctcggttcctgaagtca

SEQ ID NO: 545216 - DNA, 25 bp, Mus musculus
caaaactggattattgccctatcac

SEQ ID NO: 545217 - DNA, 25 bp, Mus musculus
caaaactggatttttgccctatcac

SEQ ID NO: 545218 - DNA, 25 bp, Mus musculus
caaaactgggtacatcaggatcgac

SEQ ID NO: 545219 - DNA, 25 bp, Mus musculus
caaaactgggtagatcaggatcgac

SEQ ID NO: 545220 - DNA, 25 bp, Mus musculus
caaaactggtctagcgtgccagagc

SEQ ID NO: 545221 - DNA, 25 bp, Mus musculus
caaaactggtcttgcgtgccagagc

SEQ ID NO: 545222 - DNA, 25 bp, Mus musculus
caaaactgtagtaactgtgtgggcc

SEQ ID NO: 545223 - DNA, 25 bp, Mus musculus
caaaactgtagttactgtgtgggcc

SEQ ID NO: 545224 - DNA, 25 bp, Mus musculus
caaaactgtcttaggactctcagaa

SEQ ID NO: 545225 - DNA, 25 bp, Mus musculus
caaaactgtctttggactctcagaa

SEQ ID NO: 545226 - DNA, 25 bp, Mus musculus
caaaacttactcattgctgcatcag

SEQ ID NO: 545227 - DNA, 25 bp, Mus musculus
caaaacttactctttgctgcatcag

SEQ ID NO: 545228 - DNA, 25 bp, Mus musculus
caaaacttgaagagggtaggcacac

SEQ ID NO: 545229 - DNA, 25 bp, Mus musculus
caaaacttgaagtgggtaggcacac

SEQ ID NO: 545230 - DNA, 25 bp, Mus musculus
caaaacttgatccttttagcggaga

SEQ ID NO: 545231 - DNA, 25 bp, Mus musculus
caaaacttgatcgttttagcggaga

SEQ ID NO: 545232 - DNA, 25 bp, Mus musculus
caaaacttgtctctagagggatccg

SEQ ID NO: 545233 - DNA, 25 bp, Mus musculus
caaaacttgtctgtagagggatccg

SEQ ID NO: 545234 - DNA, 25 bp, Mus musculus
caaaacttgttaatccagaagatgt

SEQ ID NO: 545235 - DNA, 25 bp, Mus musculus
caaaacttgttattccagaagatgt

SEQ ID NO: 545236 - DNA, 25 bp, Mus musculus
caaaagaaaaggacatgaatatacc

SEQ ID NO: 545237 - DNA, 25 bp, Mus musculus
caaaagaaaaggcatctacaagagt

SEQ ID NO: 545238 - DNA, 25 bp, Mus musculus
caaaagaaaagggatctacaagagt

SEQ ID NO: 545239 - DNA, 25 bp, Mus musculus
caaaagaaaaggtcatgaatatacc

SEQ ID NO: 545240 - DNA, 25 bp, Mus musculus
caaaagaaactcaagggcactgaag

SEQ ID NO: 545241 - DNA, 25 bp, Mus musculus
caaaagaaactctagggcactgaag

SEQ ID NO: 545242 - DNA, 25 bp, Mus musculus
caaaagaaatgaagaagattttcca

SEQ ID NO: 545243 - DNA, 25 bp, Mus musculus
caaaagaaatgatgaagattttcca

SEQ ID NO: 545244 - DNA, 25 bp, Mus musculus
caaaagaaattgatgagctgacccg

SEQ ID NO: 545245 - DNA, 25 bp, Mus musculus
caaaagaaattgttgagctgacccg

SEQ ID NO: 545246 - DNA, 25 bp, Mus musculus
caaaagaagaacagtggaagcacat

SEQ ID NO: 545247 - DNA, 25 bp, Mus musculus
caaaagaagaactgtggaagcacat

SEQ ID NO: 545248 - DNA, 25 bp, Mus musculus
caaaagaagacaagacagacatata

SEQ ID NO: 545249 - DNA, 25 bp, Mus musculus
caaaagaagacatgacagacatata

SEQ ID NO: 545250 - DNA, 25 bp, Mus musculus
caaaagaagctgctggcaacggtgt

SEQ ID NO: 545251 - DNA, 25 bp, Mus musculus
caaaagaagctggtggcaacggtgt

SEQ ID NO: 545252 - DNA, 25 bp, Mus musculus
caaaagaaggcaagagtggctgtct

SEQ ID NO: 545253 - DNA, 25 bp, Mus musculus
caaaagaaggcatgagtggctgtct

SEQ ID NO: 545254 - DNA, 25 bp, Mus musculus
caaaagaatgtcatgtcagaatttc

SEQ ID NO: 545255 - DNA, 25 bp, Mus musculus
caaaagaatgtcttgtcagaatttc

SEQ ID NO: 545256 - DNA, 25 bp, Mus musculus
caaaagacagcgaggagtttgcgtt

SEQ ID NO: 545257 - DNA, 25 bp, Mus musculus
caaaagacagcgtggagtttgcgtt

SEQ ID NO: 545258 - DNA, 25 bp, Mus musculus
caaaagacttttctcacttgtcagt

SEQ ID NO: 545259 - DNA, 25 bp, Mus musculus
caaaagacttttgtcacttgtcagt

SEQ ID NO: 545260 - DNA, 25 bp, Mus musculus
caaaagagaaataagctagagtgtc

SEQ ID NO: 545261 - DNA, 25 bp, Mus musculus
caaaagagaaattagctagagtgtc

SEQ ID NO: 545262 - DNA, 25 bp, Mus musculus
caaaagagaatgaactaggttcagc

SEQ ID NO: 545263 - DNA, 25 bp, Mus musculus
caaaagagaatgtactaggttcagc

SEQ ID NO: 545264 - DNA, 25 bp, Mus musculus
caaaagaggaggctgctaccaagga

SEQ ID NO: 545265 - DNA, 25 bp, Mus musculus
caaaagaggagggtgctaccaagga

SEQ ID NO: 545266 - DNA, 25 bp, Mus musculus
caaaagagggccaccaggtggccct

SEQ ID NO: 545267 - DNA, 25 bp, Mus musculus
caaaagagggcctccaggtggccct

SEQ ID NO: 545268 - DNA, 25 bp, Mus musculus
caaaagagggttcgttctctatcca

SEQ ID NO: 545269 - DNA, 25 bp, Mus musculus
caaaagagggttggttctctatcca

SEQ ID NO: 545270 - DNA, 25 bp, Mus musculus
caaaagaggtccattgtggtgtccc

SEQ ID NO: 545271 - DNA, 25 bp, Mus musculus
caaaagaggtcctttgtggtgtccc

SEQ ID NO: 545272 - DNA, 25 bp, Mus musculus
caaaagagtaacagagatccttgga

SEQ ID NO: 545273 - DNA, 25 bp, Mus musculus
caaaagagtaactgagatccttgga

SEQ ID NO: 545274 - DNA, 25 bp, Mus musculus
caaaagagtatgcaacgggtacagt

SEQ ID NO: 545275 - DNA, 25 bp, Mus musculus
caaaagagtatggaacgggtacagt

SEQ ID NO: 545276 - DNA, 25 bp, Mus musculus
caaaagagtccaacagatctgtgga

SEQ ID NO: 545277 - DNA, 25 bp, Mus musculus
caaaagagtccatcagatctgtgga

SEQ ID NO: 545278 - DNA, 25 bp, Mus musculus
caaaagatctacacatacgcgggca

SEQ ID NO: 545279 - DNA, 25 bp, Mus musculus
caaaagatctactcatacgcgggca

SEQ ID NO: 545280 - DNA, 25 bp, Mus musculus
caaaagatctggattagctggggca

SEQ ID NO: 545281 - DNA, 25 bp, Mus musculus
caaaagatctggtttagctggggca

SEQ ID NO: 545282 - DNA, 25 bp, Mus musculus
caaaagatggacaaaaaggcatatt

SEQ ID NO: 545283 - DNA, 25 bp, Mus musculus
caaaagatggactaaaaggcatatt

SEQ ID NO: 545284 - DNA, 25 bp, Mus musculus
caaaagatgtggacgtgctctgagg

SEQ ID NO: 545285 - DNA, 25 bp, Mus musculus
caaaagatgtggtcgtgctctgagg

SEQ ID NO: 545286 - DNA, 25 bp, Mus musculus
caaaagattcacctcgatccggaag

SEQ ID NO: 545287 - DNA, 25 bp, Mus musculus
caaaagattcacgtcgatccggaag

SEQ ID NO: 545288 - DNA, 25 bp, Mus musculus
caaaagattccacgcttcaagatca

SEQ ID NO: 545289 - DNA, 25 bp, Mus musculus
caaaagattccaggcttcaagatca

SEQ ID NO: 545290 - DNA, 25 bp, Mus musculus
caaaagcaagaaatcaccgattggt

SEQ ID NO: 545291 - DNA, 25 bp, Mus musculus
caaaagcaagaattcaccgattggt

SEQ ID NO: 545292 - DNA, 25 bp, Mus musculus
caaaagcacattatgaagcagaaat

SEQ ID NO: 545293 - DNA, 25 bp, Mus musculus
caaaagcacattttgaagcagaaat

SEQ ID NO: 545294 - DNA, 25 bp, Mus musculus
caaaagcaccgtctagtggcctggc

SEQ ID NO: 545295 - DNA, 25 bp, Mus musculus
caaaagcaccgtgtagtggcctggc

SEQ ID NO: 545296 - DNA, 25 bp, Mus musculus
caaaagcaggcgcagatgatggaat

SEQ ID NO: 545297 - DNA, 25 bp, Mus musculus
caaaagcaggcggagatgatggaat

SEQ ID NO: 545298 - DNA, 25 bp, Mus musculus
caaaagcatctcaagacgatggatc

SEQ ID NO: 545299 - DNA, 25 bp, Mus musculus
caaaagcatctctagacgatggatc

SEQ ID NO: 545300 - DNA, 25 bp, Mus musculus
caaaagcatgggaactcacaggagt

SEQ ID NO: 545301 - DNA, 25 bp, Mus musculus
caaaagcatgggtactcacaggagt

SEQ ID NO: 545302 - DNA, 25 bp, Mus musculus
caaaagcatgtcatttgctgttgga

SEQ ID NO: 545303 - DNA, 25 bp, Mus musculus
caaaagcatgtcttttgctgttgga

SEQ ID NO: 545304 - DNA, 25 bp, Mus musculus
caaaagcattcgaagtatgctggcc

SEQ ID NO: 545305 - DNA, 25 bp, Mus musculus
caaaagcattcgtagtatgctggcc

SEQ ID NO: 545306 - DNA, 25 bp, Mus musculus
caaaagccaaccacagtcacagtgg

SEQ ID NO: 545307 - DNA, 25 bp, Mus musculus
caaaagccaacctcagtcacagtgg

SEQ ID NO: 545308 - DNA, 25 bp, Mus musculus
caaaagccaagactcaaatctttaa

SEQ ID NO: 545309 - DNA, 25 bp, Mus musculus
caaaagccaagagtcaaatctttaa

SEQ ID NO: 545310 - DNA, 25 bp, Mus musculus
caaaagccaattacttaagccaggt

SEQ ID NO: 545311 - DNA, 25 bp, Mus musculus
caaaagccaatttcttaagccaggt

SEQ ID NO: 545312 - DNA, 25 bp, Mus musculus
caaaagccacatctgatgactctcg

SEQ ID NO: 545313 - DNA, 25 bp, Mus musculus
caaaagccacatgtgatgactctcg

SEQ ID NO: 545314 - DNA, 25 bp, Mus musculus
caaaagcccaccagtgcagaatgca

SEQ ID NO: 545315 - DNA, 25 bp, Mus musculus
caaaagcccacctgtgcagaatgca

SEQ ID NO: 545316 - DNA, 25 bp, Mus musculus
caaaagcccagcctcaatgcggttg

SEQ ID NO: 545317 - DNA, 25 bp, Mus musculus
caaaagcccagcgtcaatgcggttg

SEQ ID NO: 545318 - DNA, 25 bp, Mus musculus
caaaagcccaggcccaagtatctca

SEQ ID NO: 545319 - DNA, 25 bp, Mus musculus
caaaagcccagggccaagtatctca

SEQ ID NO: 545320 - DNA, 25 bp, Mus musculus
caaaagcccttaatactactggata

SEQ ID NO: 545321 - DNA, 25 bp, Mus musculus
caaaagcccttattactactggata

SEQ ID NO: 545322 - DNA, 25 bp, Mus musculus
caaaagccttgtaagttcagcatca

SEQ ID NO: 545323 - DNA, 25 bp, Mus musculus
caaaagccttgttagttcagcatca

SEQ ID NO: 545324 - DNA, 25 bp, Mus musculus
caaaagcggtaccagcagataaaga

SEQ ID NO: 545325 - DNA, 25 bp, Mus musculus
caaaagcggtacgagcagataaaga

SEQ ID NO: 545326 - DNA, 25 bp, Mus musculus
caaaagcgttggaaccaactcctgg

SEQ ID NO: 545327 - DNA, 25 bp, Mus musculus
caaaagcgttggtaccaactcctgg

SEQ ID NO: 545328 - DNA, 25 bp, Mus musculus
caaaagctgcttatagatctcttca

SEQ ID NO: 545329 - DNA, 25 bp, Mus musculus
caaaagctgcttttagatctcttca

SEQ ID NO: 545330 - DNA, 25 bp, Mus musculus
caaaagctggagcagttgctgaaga

SEQ ID NO: 545331 - DNA, 25 bp, Mus musculus
caaaagctggaggagttgctgaaga

SEQ ID NO: 545332 - DNA, 25 bp, Mus musculus
caaaagctgtaaccatgatgccgct

SEQ ID NO: 545333 - DNA, 25 bp, Mus musculus
caaaagctgtaacggcagcctggcc

SEQ ID NO: 545334 - DNA, 25 bp, Mus musculus
caaaagctgtaagcatgatgccgct

SEQ ID NO: 545335 - DNA, 25 bp, Mus musculus
caaaagctgtaagggcagcctggcc

SEQ ID NO: 545336 - DNA, 25 bp, Mus musculus
caaaagcttttgaatactggatgta

SEQ ID NO: 545337 - DNA, 25 bp, Mus musculus
caaaagcttttgtatactggatgta

SEQ ID NO: 545338 - DNA, 25 bp, Mus musculus
caaaaggaaaatcacctctgccatt

SEQ ID NO: 545339 - DNA, 25 bp, Mus musculus
caaaaggaaaatgacctctgccatt

SEQ ID NO: 545340 - DNA, 25 bp, Mus musculus
caaaaggaaagacgcggagcttcgc

SEQ ID NO: 545341 - DNA, 25 bp, Mus musculus
caaaaggaaagaggcggagcttcgc

SEQ ID NO: 545342 - DNA, 25 bp, Mus musculus
caaaaggacaagcagttcgttgcca

SEQ ID NO: 545343 - DNA, 25 bp, Mus musculus
caaaaggacaaggagttcgttgcca

SEQ ID NO: 545344 - DNA, 25 bp, Mus musculus
caaaaggacagtcagattgcccgcc

SEQ ID NO: 545345 - DNA, 25 bp, Mus musculus
caaaaggacagtgagattgcccgcc

SEQ ID NO: 545346 - DNA, 25 bp, Mus musculus
caaaaggaccatccccatgtttgtg

SEQ ID NO: 545347 - DNA, 25 bp, Mus musculus
caaaaggaccatccttcgtatacat

SEQ ID NO: 545348 - DNA, 25 bp, Mus musculus
caaaaggaccatgcccatgtttgtg

SEQ ID NO: 545349 - DNA, 25 bp, Mus musculus
caaaaggaccatgcttcgtatacat

SEQ ID NO: 545350 - DNA, 25 bp, Mus musculus
caaaaggacctaccgagagttgcgt

SEQ ID NO: 545351 - DNA, 25 bp, Mus musculus
caaaaggacctagcgagagttgcgt

SEQ ID NO: 545352 - DNA, 25 bp, Mus musculus
caaaaggagaaacacactgaagcac

SEQ ID NO: 545353 - DNA, 25 bp, Mus musculus
caaaaggagaaagacactgaagcac

SEQ ID NO: 545354 - DNA, 25 bp, Mus musculus
caaaaggagaccaacaatcccggtg

SEQ ID NO: 545355 - DNA, 25 bp, Mus musculus
caaaaggagacctacaatcccggtg

SEQ ID NO: 545356 - DNA, 25 bp, Mus musculus
caaaaggagcacagagaaacggaac

SEQ ID NO: 545357 - DNA, 25 bp, Mus musculus
caaaaggagcactgagaaacggaac

SEQ ID NO: 545358 - DNA, 25 bp, Mus musculus
caaaaggagcctatcccacgagagg

SEQ ID NO: 545359 - DNA, 25 bp, Mus musculus
caaaaggagcctttcccacgagagg

SEQ ID NO: 545360 - DNA, 25 bp, Mus musculus
caaaaggaggcacggcctcatgcct

SEQ ID NO: 545361 - DNA, 25 bp, Mus musculus
caaaaggaggcagggcctcatgcct

SEQ ID NO: 545362 - DNA, 25 bp, Mus musculus
caaaaggatccaagccagaaacaag

SEQ ID NO: 545363 - DNA, 25 bp, Mus musculus
caaaaggatccatgccagaaacaag

SEQ ID NO: 545364 - DNA, 25 bp, Mus musculus
caaaaggatggcaatatgttgagcc

SEQ ID NO: 545365 - DNA, 25 bp, Mus musculus
caaaaggatggctatatgttgagcc

SEQ ID NO: 545366 - DNA, 25 bp, Mus musculus
caaaaggatgtgcttaaattgctca

SEQ ID NO: 545367 - DNA, 25 bp, Mus musculus
caaaaggatgtggttaaattgctca

SEQ ID NO: 545368 - DNA, 25 bp, Mus musculus
caaaaggcatcgactatgacaagct

SEQ ID NO: 545369 - DNA, 25 bp, Mus musculus
caaaaggcatcgtctatgacaagct

SEQ ID NO: 545370 - DNA, 25 bp, Mus musculus
caaaaggcttggactagatcagaca

SEQ ID NO: 545371 - DNA, 25 bp, Mus musculus
caaaaggcttggtctagatcagaca

SEQ ID NO: 545372 - DNA, 25 bp, Mus musculus
caaaaggcttgtaaccacccatggg

SEQ ID NO: 545373 - DNA, 25 bp, Mus musculus
caaaaggcttgttaccacccatggg

SEQ ID NO: 545374 - DNA, 25 bp, Mus musculus
caaaagggcatgctggttcctaatc

SEQ ID NO: 545375 - DNA, 25 bp, Mus musculus
caaaagggcatggtggttcctaatc

SEQ ID NO: 545376 - DNA, 25 bp, Mus musculus
caaaaggtcagacgttctcgccaca

SEQ ID NO: 545377 - DNA, 25 bp, Mus musculus
caaaaggtcagaggttctcgccaca

SEQ ID NO: 545378 - DNA, 25 bp, Mus musculus
caaaaggtctcccagagacgaggtt

SEQ ID NO: 545379 - DNA, 25 bp, Mus musculus
caaaaggtctccgagagacgaggtt

SEQ ID NO: 545380 - DNA, 25 bp, Mus musculus
caaaaggtgatgatttatcaacagc

SEQ ID NO: 545381 - DNA, 25 bp, Mus musculus
caaaaggtgatgttttatcaacagc

SEQ ID NO: 545382 - DNA, 25 bp, Mus musculus
caaaaggtggccatactaatgttgt

SEQ ID NO: 545383 - DNA, 25 bp, Mus musculus
caaaaggtggccttactaatgttgt

SEQ ID NO: 545384 - DNA, 25 bp, Mus musculus
caaaaggtgggaagtcagctgctac

SEQ ID NO: 545385 - DNA, 25 bp, Mus musculus
caaaaggtgggatgtcagctgctac

SEQ ID NO: 545386 - DNA, 25 bp, Mus musculus
caaaaggtgtgaacaatgactggcg

SEQ ID NO: 545387 - DNA, 25 bp, Mus musculus
caaaaggtgtgatcaatgactggcg

SEQ ID NO: 545388 - DNA, 25 bp, Mus musculus
caaaaggtgttcaaagcagagcttc

SEQ ID NO: 545389 - DNA, 25 bp, Mus musculus
caaaaggtgttctaagcagagcttc

SEQ ID NO: 545390 - DNA, 25 bp, Mus musculus
caaaagtaaggactctatttgggag

SEQ ID NO: 545391 - DNA, 25 bp, Mus musculus
caaaagtaaggagtctatttgggag

SEQ ID NO: 545392 - DNA, 25 bp, Mus musculus
caaaagtaatgaaggcttcgtcccc

SEQ ID NO: 545393 - DNA, 25 bp, Mus musculus
caaaagtaatgatggcttcgtcccc

SEQ ID NO: 545394 - DNA, 25 bp, Mus musculus
caaaagtacagacgtatcatccaac

SEQ ID NO: 545395 - DNA, 25 bp, Mus musculus
caaaagtacagaggtatcatccaac

SEQ ID NO: 545396 - DNA, 25 bp, Mus musculus
caaaagtacttcaaactggagcctc

SEQ ID NO: 545397 - DNA, 25 bp, Mus musculus
caaaagtacttctaactggagcctc

SEQ ID NO: 545398 - DNA, 25 bp, Mus musculus
caaaagtcagaaaccttggtgaacg

SEQ ID NO: 545399 - DNA, 25 bp, Mus musculus
caaaagtcagaatccttggtgaacg

SEQ ID NO: 545400 - DNA, 25 bp, Mus musculus
caaaagtcagccatcagcgaggaag

SEQ ID NO: 545401 - DNA, 25 bp, Mus musculus
caaaagtcagccttcagcgaggaag

SEQ ID NO: 545402 - DNA, 25 bp, Mus musculus
caaaagtcagtgcagctaggtggct

SEQ ID NO: 545403 - DNA, 25 bp, Mus musculus
caaaagtcagtggagctaggtggct

SEQ ID NO: 545404 - DNA, 25 bp, Mus musculus
caaaagtcctcaagggctcgtggga

SEQ ID NO: 545405 - DNA, 25 bp, Mus musculus
caaaagtcctcatgggctcgtggga

SEQ ID NO: 545406 - DNA, 25 bp, Mus musculus
caaaagtctggacagcccaattgcc

SEQ ID NO: 545407 - DNA, 25 bp, Mus musculus
caaaagtctggagagcccaattgcc

SEQ ID NO: 545408 - DNA, 25 bp, Mus musculus
caaaagtctgttcgcactcacgagg

SEQ ID NO: 545409 - DNA, 25 bp, Mus musculus
caaaagtctgttggcactcacgagg

SEQ ID NO: 545410 - DNA, 25 bp, Mus musculus
caaaagtgaagtcgagatcccagcc

SEQ ID NO: 545411 - DNA, 25 bp, Mus musculus
caaaagtgaagtggagatcccagcc

SEQ ID NO: 545412 - DNA, 25 bp, Mus musculus
caaaagtgactacggcgttcagcac

SEQ ID NO: 545413 - DNA, 25 bp, Mus musculus
caaaagtgactagggcgttcagcac

SEQ ID NO: 545414 - DNA, 25 bp, Mus musculus
caaaagtgagaaagctaaggttggc

SEQ ID NO: 545415 - DNA, 25 bp, Mus musculus
caaaagtgagaatgctaaggttggc

SEQ ID NO: 545416 - DNA, 25 bp, Mus musculus
caaaagtgcactagtggcttggaag

SEQ ID NO: 545417 - DNA, 25 bp, Mus musculus
caaaagtgcactccagctgcaagaa

SEQ ID NO: 545418 - DNA, 25 bp, Mus musculus
caaaagtgcactgcagctgcaagaa

SEQ ID NO: 545419 - DNA, 25 bp, Mus musculus
caaaagtgcacttgtggcttggaag

SEQ ID NO: 545420 - DNA, 25 bp, Mus musculus
caaaagtgtgagattgcgctggaga

SEQ ID NO: 545421 - DNA, 25 bp, Mus musculus
caaaagtgtgagtttgcgctggaga

SEQ ID NO: 545422 - DNA, 25 bp, Mus musculus
caaaagtgttggagtttaattgccg

SEQ ID NO: 545423 - DNA, 25 bp, Mus musculus
caaaagtgttggtgtttaattgccg

SEQ ID NO: 545424 - DNA, 25 bp, Mus musculus
caaaagttatcaaagcaggaagtta

SEQ ID NO: 545425 - DNA, 25 bp, Mus musculus
caaaagttatcatagcaggaagtta

SEQ ID NO: 545426 - DNA, 25 bp, Mus musculus
caaaagttctgtaacctgtacacaa

SEQ ID NO: 545427 - DNA, 25 bp, Mus musculus
caaaagttctgttacctgtacacaa

SEQ ID NO: 545428 - DNA, 25 bp, Mus musculus
caaaagttgaaacctgtcagcagga

SEQ ID NO: 545429 - DNA, 25 bp, Mus musculus
caaaagttgaaagctgtcagcagga

SEQ ID NO: 545430 - DNA, 25 bp, Mus musculus
caaaagttgcttcaacagagtatcc

SEQ ID NO: 545431 - DNA, 25 bp, Mus musculus
caaaagttgcttgaacagagtatcc

SEQ ID NO: 545432 - DNA, 25 bp, Mus musculus
caaaagttgtacattccagtaggac

SEQ ID NO: 545433 - DNA, 25 bp, Mus musculus
caaaagttgtactttccagtaggac

SEQ ID NO: 545434 - DNA, 25 bp, Mus musculus
caaaagttgttcctatgaaagccaa

SEQ ID NO: 545435 - DNA, 25 bp, Mus musculus
caaaagttgttcgtatgaaagccaa

SEQ ID NO: 545436 - DNA, 25 bp, Mus musculus
caaaataaacctatagcacgtggct

SEQ ID NO: 545437 - DNA, 25 bp, Mus musculus
caaaataaacctttagcacgtggct

SEQ ID NO: 545438 - DNA, 25 bp, Mus musculus
caaaataattgcagacatgctcttc

SEQ ID NO: 545439 - DNA, 25 bp, Mus musculus
caaaataattgctgacatgctcttc

SEQ ID NO: 545440 - DNA, 25 bp, Mus musculus
caaaataattttcattacaagcgct

SEQ ID NO: 545441 - DNA, 25 bp, Mus musculus
caaaataattttgattacaagcgct

SEQ ID NO: 545442 - DNA, 25 bp, Mus musculus
caaaatacaggtagttcaaggagca

SEQ ID NO: 545443 - DNA, 25 bp, Mus musculus
caaaatacaggttgttcaaggagca

SEQ ID NO: 545444 - DNA, 25 bp, Mus musculus
caaaatacccagatctcaggaagaa

SEQ ID NO: 545445 - DNA, 25 bp, Mus musculus
caaaatacccagttctcaggaagaa

SEQ ID NO: 545446 - DNA, 25 bp, Mus musculus
caaaatacctatcggcaagtgtcct

SEQ ID NO: 545447 - DNA, 25 bp, Mus musculus
caaaatacctatgggcaagtgtcct

SEQ ID NO: 545448 - DNA, 25 bp, Mus musculus
caaaatactcagacttcaagaagct

SEQ ID NO: 545449 - DNA, 25 bp, Mus musculus
caaaatactcagtcttcaagaagct

SEQ ID NO: 545450 - DNA, 25 bp, Mus musculus
caaaatagaagacgctccgagacga

SEQ ID NO: 545451 - DNA, 25 bp, Mus musculus
caaaatagaagaggctccgagacga

SEQ ID NO: 545452 - DNA, 25 bp, Mus musculus
caaaataggttcaacaggtcccagg

SEQ ID NO: 545453 - DNA, 25 bp, Mus musculus
caaaataggttctacaggtcccagg

SEQ ID NO: 545454 - DNA, 25 bp, Mus musculus
caaaatagttctcgaatcatgcctg

SEQ ID NO: 545455 - DNA, 25 bp, Mus musculus
caaaatagttctggaatcatgcctg

SEQ ID NO: 545456 - DNA, 25 bp, Mus musculus
caaaatagttgtcttcccaccacca

SEQ ID NO: 545457 - DNA, 25 bp, Mus musculus
caaaatagttgtgttcccaccacca

SEQ ID NO: 545458 - DNA, 25 bp, Mus musculus
caaaatattgaacgtgtggccagga

SEQ ID NO: 545459 - DNA, 25 bp, Mus musculus
caaaatattgaaggtgtggccagga

SEQ ID NO: 545460 - DNA, 25 bp, Mus musculus
caaaatattttgaggcgggagcaga

SEQ ID NO: 545461 - DNA, 25 bp, Mus musculus
caaaatattttgtggcgggagcaga

SEQ ID NO: 545462 - DNA, 25 bp, Mus musculus
caaaatcaaattcgatatccaccaa

SEQ ID NO: 545463 - DNA, 25 bp, Mus musculus
caaaatcaaattggatatccaccaa

SEQ ID NO: 545464 - DNA, 25 bp, Mus musculus
caaaatcagtgtccttgccatacaa

SEQ ID NO: 545465 - DNA, 25 bp, Mus musculus
caaaatcagtgtgcttgccatacaa

SEQ ID NO: 545466 - DNA, 25 bp, Mus musculus
caaaatccacgtagagagagccgtc

SEQ ID NO: 545467 - DNA, 25 bp, Mus musculus
caaaatccacgttgagagagccgtc

SEQ ID NO: 545468 - DNA, 25 bp, Mus musculus
caaaatccaggcaattgagttggag

SEQ ID NO: 545469 - DNA, 25 bp, Mus musculus
caaaatccaggctattgagttggag

SEQ ID NO: 545470 - DNA, 25 bp, Mus musculus
caaaatccatgacgagcacctattc

SEQ ID NO: 545471 - DNA, 25 bp, Mus musculus
caaaatccatgaggagcacctattc

SEQ ID NO: 545472 - DNA, 25 bp, Mus musculus
caaaatccgaagcacgctgaatgag

SEQ ID NO: 545473 - DNA, 25 bp, Mus musculus
caaaatccgaaggacgctgaatgag

SEQ ID NO: 545474 - DNA, 25 bp, Mus musculus
caaaatcctgaaaggcaacattcgc

SEQ ID NO: 545475 - DNA, 25 bp, Mus musculus
caaaatcctgaatggcaacattcgc

SEQ ID NO: 545476 - DNA, 25 bp, Mus musculus
caaaatcctggaagaagacttatat

SEQ ID NO: 545477 - DNA, 25 bp, Mus musculus
caaaatcctggatgaagacttatat

SEQ ID NO: 545478 - DNA, 25 bp, Mus musculus
caaaatcctgtgcagcagacagcta

SEQ ID NO: 545479 - DNA, 25 bp, Mus musculus
caaaatcctgtggagcagacagcta

SEQ ID NO: 545480 - DNA, 25 bp, Mus musculus
caaaatcctttgaggaggtacagtt

SEQ ID NO: 545481 - DNA, 25 bp, Mus musculus
caaaatcctttgtggaggtacagtt

SEQ ID NO: 545482 - DNA, 25 bp, Mus musculus
caaaatcgaataatacagcagcccg

SEQ ID NO: 545483 - DNA, 25 bp, Mus musculus
caaaatcgaatattacagcagcccg

SEQ ID NO: 545484 - DNA, 25 bp, Mus musculus
caaaatcgacctccttgatcggaag

SEQ ID NO: 545485 - DNA, 25 bp, Mus musculus
caaaatcgacctgcttgatcggaag

SEQ ID NO: 545486 - DNA, 25 bp, Mus musculus
caaaatcgtgcgcatagagaaggac

SEQ ID NO: 545487 - DNA, 25 bp, Mus musculus
caaaatcgtgcggatagagaaggac

SEQ ID NO: 545488 - DNA, 25 bp, Mus musculus
caaaatctcagcattggctctactg

SEQ ID NO: 545489 - DNA, 25 bp, Mus musculus
caaaatctcagctttggctctactg

SEQ ID NO: 545490 - DNA, 25 bp, Mus musculus
caaaatctgcagatcagaaaaccac

SEQ ID NO: 545491 - DNA, 25 bp, Mus musculus
caaaatctgcagttcagaaaaccac

SEQ ID NO: 545492 - DNA, 25 bp, Mus musculus
caaaatctgcttcggcgatggtgac

SEQ ID NO: 545493 - DNA, 25 bp, Mus musculus
caaaatctgcttgggcgatggtgac

SEQ ID NO: 545494 - DNA, 25 bp, Mus musculus
caaaatctgtctagaggcctgagct

SEQ ID NO: 545495 - DNA, 25 bp, Mus musculus
caaaatctgtcttgaggcctgagct

SEQ ID NO: 545496 - DNA, 25 bp, Mus musculus
caaaatctgtttccacctctgtaaa

SEQ ID NO: 545497 - DNA, 25 bp, Mus musculus
caaaatctgtttgcacctctgtaaa

SEQ ID NO: 545498 - DNA, 25 bp, Mus musculus
caaaatgaaccacaggtgcaacaca

SEQ ID NO: 545499 - DNA, 25 bp, Mus musculus
caaaatgaaccagaggtgcaacaca

SEQ ID NO: 545500 - DNA, 25 bp, Mus musculus
caaaatgaagccacggagggtagat

SEQ ID NO: 545501 - DNA, 25 bp, Mus musculus
caaaatgaagcctcggagggtagat

SEQ ID NO: 545502 - DNA, 25 bp, Mus musculus
caaaatgaatgacgaaacggccagt

SEQ ID NO: 545503 - DNA, 25 bp, Mus musculus
caaaatgaatgaggaaacggccagt

SEQ ID NO: 545504 - DNA, 25 bp, Mus musculus
caaaatgacagacctctaccagtct

SEQ ID NO: 545505 - DNA, 25 bp, Mus musculus
caaaatgacagagctctaccagtct

SEQ ID NO: 545506 - DNA, 25 bp, Mus musculus
caaaatgacattcgccaagctgcag

SEQ ID NO: 545507 - DNA, 25 bp, Mus musculus
caaaatgacattggccaagctgcag

SEQ ID NO: 545508 - DNA, 25 bp, Mus musculus
caaaatgacttcagccgagctggac

SEQ ID NO: 545509 - DNA, 25 bp, Mus musculus
caaaatgacttctgccgagctggac

SEQ ID NO: 545510 - DNA, 25 bp, Mus musculus
caaaatgaggtgaacaaggtggacc

SEQ ID NO: 545511 - DNA, 25 bp, Mus musculus
caaaatgaggtgtacaaggtggacc

SEQ ID NO: 545512 - DNA, 25 bp, Mus musculus
caaaatgagttactggccagattcc

SEQ ID NO: 545513 - DNA, 25 bp, Mus musculus
caaaatgagttagtggccagattcc

SEQ ID NO: 545514 - DNA, 25 bp, Mus musculus
caaaatgataacagattgaaaacgc

SEQ ID NO: 545515 - DNA, 25 bp, Mus musculus
caaaatgataactgattgaaaacgc

SEQ ID NO: 545516 - DNA, 25 bp, Mus musculus
caaaatgatgatagagaattgacca

SEQ ID NO: 545517 - DNA, 25 bp, Mus musculus
caaaatgatgattgagaattgacca

SEQ ID NO: 545518 - DNA, 25 bp, Mus musculus
caaaatgatgcaaatcaacctgact

SEQ ID NO: 545519 - DNA, 25 bp, Mus musculus
caaaatgatgcatatcaacctgact

SEQ ID NO: 545520 - DNA, 25 bp, Mus musculus
caaaatgattttcaaagcctcagta

SEQ ID NO: 545521 - DNA, 25 bp, Mus musculus
caaaatgattttgaaagcctcagta

SEQ ID NO: 545522 - DNA, 25 bp, Mus musculus
caaaatgccagaaaccagcacaaag

SEQ ID NO: 545523 - DNA, 25 bp, Mus musculus
caaaatgccagataccagcacaaag

SEQ ID NO: 545524 - DNA, 25 bp, Mus musculus
caaaatgccagtcccttccttcagt

SEQ ID NO: 545525 - DNA, 25 bp, Mus musculus
caaaatgccagtgccttccttcagt

SEQ ID NO: 545526 - DNA, 25 bp, Mus musculus
caaaatgcggatagtttaatgcaag

SEQ ID NO: 545527 - DNA, 25 bp, Mus musculus
caaaatgcggattgtttaatgcaag

SEQ ID NO: 545528 - DNA, 25 bp, Mus musculus
caaaatgctacaaagaagtatatca

SEQ ID NO: 545529 - DNA, 25 bp, Mus musculus
caaaatgctacatagaagtatatca

SEQ ID NO: 545530 - DNA, 25 bp, Mus musculus
caaaatgctgatccggatgtggaca

SEQ ID NO: 545531 - DNA, 25 bp, Mus musculus
caaaatgctgatgcggatgtggaca

SEQ ID NO: 545532 - DNA, 25 bp, Mus musculus
caaaatgctgctagactgtggagtt

SEQ ID NO: 545533 - DNA, 25 bp, Mus musculus
caaaatgctgcttgactgtggagtt

SEQ ID NO: 545534 - DNA, 25 bp, Mus musculus
caaaatggaaaaaccctgatggaca

SEQ ID NO: 545535 - DNA, 25 bp, Mus musculus
caaaatggaaaatccctgatggaca

SEQ ID NO: 545536 - DNA, 25 bp, Mus musculus
caaaatggaagaagctcctgctttc

SEQ ID NO: 545537 - DNA, 25 bp, Mus musculus
caaaatggaagatgctcctgctttc

SEQ ID NO: 545538 - DNA, 25 bp, Mus musculus
caaaatggatggctatgggcatgca

SEQ ID NO: 545539 - DNA, 25 bp, Mus musculus
caaaatggatgggtatgggcatgca

SEQ ID NO: 545540 - DNA, 25 bp, Mus musculus
caaaatggattgatgatgtcagaac

SEQ ID NO: 545541 - DNA, 25 bp, Mus musculus
caaaatggattgttgatgtcagaac

SEQ ID NO: 545542 - DNA, 25 bp, Mus musculus
caaaatggcaataaggtttgagaaa

SEQ ID NO: 545543 - DNA, 25 bp, Mus musculus
caaaatggcaattaggtttgagaaa

SEQ ID NO: 545544 - DNA, 25 bp, Mus musculus
caaaatggcgagcagacagggccac

SEQ ID NO: 545545 - DNA, 25 bp, Mus musculus
caaaatggcgaggagacagggccac

SEQ ID NO: 545546 - DNA, 25 bp, Mus musculus
caaaatggctttatggaacaatgga

SEQ ID NO: 545547 - DNA, 25 bp, Mus musculus
caaaatggctttttggaacaatgga

SEQ ID NO: 545548 - DNA, 25 bp, Mus musculus
caaaatggtccacatcgtattggaa

SEQ ID NO: 545549 - DNA, 25 bp, Mus musculus
caaaatggtccagatcgtattggaa

SEQ ID NO: 545550 - DNA, 25 bp, Mus musculus
caaaatggtgcacaaaaagaatgcg

SEQ ID NO: 545551 - DNA, 25 bp, Mus musculus
caaaatggtgcagaaaaagaatgcg

SEQ ID NO: 545552 - DNA, 25 bp, Mus musculus
caaaatggtgctattccaacatttg

SEQ ID NO: 545553 - DNA, 25 bp, Mus musculus
caaaatggtgctctatctctgatat

SEQ ID NO: 545554 - DNA, 25 bp, Mus musculus
caaaatggtgctgtatctctgatat

SEQ ID NO: 545555 - DNA, 25 bp, Mus musculus
caaaatggtgcttttccaacatttg

SEQ ID NO: 545556 - DNA, 25 bp, Mus musculus
caaaatggttccagcaccgcaagct

SEQ ID NO: 545557 - DNA, 25 bp, Mus musculus
caaaatggttcctgcaccgcaagct

SEQ ID NO: 545558 - DNA, 25 bp, Mus musculus
caaaatgtaaagctagaagaccaag

SEQ ID NO: 545559 - DNA, 25 bp, Mus musculus
caaaatgtaaaggtagaagaccaag

SEQ ID NO: 545560 - DNA, 25 bp, Mus musculus
caaaatgtacagaaccaaagtgggt

SEQ ID NO: 545561 - DNA, 25 bp, Mus musculus
caaaatgtacagtaccaaagtgggt

SEQ ID NO: 545562 - DNA, 25 bp, Mus musculus
caaaatgtagaaagacgagatctgc

SEQ ID NO: 545563 - DNA, 25 bp, Mus musculus
caaaatgtagaatgacgagatctgc

SEQ ID NO: 545564 - DNA, 25 bp, Mus musculus
caaaatgtgagtcctggttcttgta

SEQ ID NO: 545565 - DNA, 25 bp, Mus musculus
caaaatgtgagtgctggttcttgta

SEQ ID NO: 545566 - DNA, 25 bp, Mus musculus
caaaatgtgtaacggactggcagct

SEQ ID NO: 545567 - DNA, 25 bp, Mus musculus
caaaatgtgtaagggactggcagct

SEQ ID NO: 545568 - DNA, 25 bp, Mus musculus
caaaatgttccgaccgacagaagga

SEQ ID NO: 545569 - DNA, 25 bp, Mus musculus
caaaatgttccgtccgacagaagga

SEQ ID NO: 545570 - DNA, 25 bp, Mus musculus
caaaatgttgccatgacctttcgaa

SEQ ID NO: 545571 - DNA, 25 bp, Mus musculus
caaaatgttgccttgacctttcgaa

SEQ ID NO: 545572 - DNA, 25 bp, Mus musculus
caaaattactacagccaggagataa

SEQ ID NO: 545573 - DNA, 25 bp, Mus musculus
caaaattactactgccaggagataa

SEQ ID NO: 545574 - DNA, 25 bp, Mus musculus
caaaattagacacatcagcagtgcc

SEQ ID NO: 545575 - DNA, 25 bp, Mus musculus
caaaattagacagatcagcagtgcc

SEQ ID NO: 545576 - DNA, 25 bp, Mus musculus
caaaattagaccattgtggcgacat

SEQ ID NO: 545577 - DNA, 25 bp, Mus musculus
caaaattagacctttgtggcgacat

SEQ ID NO: 545578 - DNA, 25 bp, Mus musculus
caaaattcgggaagcaccttcaagc

SEQ ID NO: 545579 - DNA, 25 bp, Mus musculus
caaaattcgggatgcaccttcaagc

SEQ ID NO: 545580 - DNA, 25 bp, Mus musculus
caaaattcttcacggagtgtcacct

SEQ ID NO: 545581 - DNA, 25 bp, Mus musculus
caaaattcttcagggagtgtcacct

SEQ ID NO: 545582 - DNA, 25 bp, Mus musculus
caaaattgacttcgagcagttccgt

SEQ ID NO: 545583 - DNA, 25 bp, Mus musculus
caaaattgacttggagcagttccgt

SEQ ID NO: 545584 - DNA, 25 bp, Mus musculus
caaaattgctaaaatgtgtttgagc

SEQ ID NO: 545585 - DNA, 25 bp, Mus musculus
caaaattgctaatatgtgtttgagc

SEQ ID NO: 545586 - DNA, 25 bp, Mus musculus
caaaattgctctcgtgggaagttcg

SEQ ID NO: 545587 - DNA, 25 bp, Mus musculus
caaaattgctctggtgggaagttcg

SEQ ID NO: 545588 - DNA, 25 bp, Mus musculus
caaaattggagaaagcagaagtcag

SEQ ID NO: 545589 - DNA, 25 bp, Mus musculus
caaaattggagatagcagaagtcag

SEQ ID NO: 545590 - DNA, 25 bp, Mus musculus
caaaattggatccttctgaggtcta

SEQ ID NO: 545591 - DNA, 25 bp, Mus musculus
caaaattggatcgttctgaggtcta

SEQ ID NO: 545592 - DNA, 25 bp, Mus musculus
caaaattggctgagctggcttggca

SEQ ID NO: 545593 - DNA, 25 bp, Mus musculus
caaaattggctgtgctggcttggca

SEQ ID NO: 545594 - DNA, 25 bp, Mus musculus
caaaattgtagcagagatccgaggc

SEQ ID NO: 545595 - DNA, 25 bp, Mus musculus
caaaattgtagctgagatccgaggc

SEQ ID NO: 545596 - DNA, 25 bp, Mus musculus
caaaattgtccaagtggatttgagt

SEQ ID NO: 545597 - DNA, 25 bp, Mus musculus
caaaattgtccatgtggatttgagt

SEQ ID NO: 545598 - DNA, 25 bp, Mus musculus
caaaattgtcgtcttccatcgtcca

SEQ ID NO: 545599 - DNA, 25 bp, Mus musculus
caaaattgtcgtgttccatcgtcca

SEQ ID NO: 545600 - DNA, 25 bp, Mus musculus
caaaatttatgcctaggaaatgtgc

SEQ ID NO: 545601 - DNA, 25 bp, Mus musculus
caaaatttatgcgtaggaaatgtgc

SEQ ID NO: 545602 - DNA, 25 bp, Mus musculus
caaaatttctggagactcaaggagc

SEQ ID NO: 545603 - DNA, 25 bp, Mus musculus
caaaatttctggtgactcaaggagc

SEQ ID NO: 545604 - DNA, 25 bp, Mus musculus
caaaattttgtcagaagcactggag

SEQ ID NO: 545605 - DNA, 25 bp, Mus musculus
caaaattttgtctgaagcactggag

SEQ ID NO: 545606 - DNA, 25 bp, Mus musculus
caaacaaaatatagaaggtgtggcc

SEQ ID NO: 545607 - DNA, 25 bp, Mus musculus
caaacaaaatattgaaggtgtggcc

SEQ ID NO: 545608 - DNA, 25 bp, Mus musculus
caaacaaacaaccttgtcagcactg

SEQ ID NO: 545609 - DNA, 25 bp, Mus musculus
caaacaaacaacgttgtcagcactg

SEQ ID NO: 545610 - DNA, 25 bp, Mus musculus
caaacaaagggaaagccactgctga

SEQ ID NO: 545611 - DNA, 25 bp, Mus musculus
caaacaaagggatagccactgctga

SEQ ID NO: 545612 - DNA, 25 bp, Mus musculus
caaacaacccttcgctgacctgatt

SEQ ID NO: 545613 - DNA, 25 bp, Mus musculus
caaacaacccttggctgacctgatt

SEQ ID NO: 545614 - DNA, 25 bp, Mus musculus
caaacaacgcaacgaggacttccgg

SEQ ID NO: 545615 - DNA, 25 bp, Mus musculus
caaacaacgcaaggaggacttccgg

SEQ ID NO: 545616 - DNA, 25 bp, Mus musculus
caaacaagaaggaacgcgaagtctg

SEQ ID NO: 545617 - DNA, 25 bp, Mus musculus
caaacaagaaggtacgcgaagtctg

SEQ ID NO: 545618 - DNA, 25 bp, Mus musculus
caaacaagagaacaatatcttgctg

SEQ ID NO: 545619 - DNA, 25 bp, Mus musculus
caaacaagagaagaatatcttgctg

SEQ ID NO: 545620 - DNA, 25 bp, Mus musculus
caaacaagagcgataaggatgccat

SEQ ID NO: 545621 - DNA, 25 bp, Mus musculus
caaacaagagcgttaaggatgccat

SEQ ID NO: 545622 - DNA, 25 bp, Mus musculus
caaacaagcaatctaaccgtggatg

SEQ ID NO: 545623 - DNA, 25 bp, Mus musculus
caaacaagcaatgtaaccgtggatg

SEQ ID NO: 545624 - DNA, 25 bp, Mus musculus
caaacaagcagactttcaaccctgg

SEQ ID NO: 545625 - DNA, 25 bp, Mus musculus
caaacaagcagagtttcaaccctgg

SEQ ID NO: 545626 - DNA, 25 bp, Mus musculus
caaacaagcccgagagtgtcaaggt

SEQ ID NO: 545627 - DNA, 25 bp, Mus musculus
caaacaagcccgtgagtgtcaaggt

SEQ ID NO: 545628 - DNA, 25 bp, Mus musculus
caaacaaggactcaacagggagctt

SEQ ID NO: 545629 - DNA, 25 bp, Mus musculus
caaacaaggactgaacagggagctt

SEQ ID NO: 545630 - DNA, 25 bp, Mus musculus
caaacaaggtttcggcaccatctgc

SEQ ID NO: 545631 - DNA, 25 bp, Mus musculus
caaacaaggtttgggcaccatctgc

SEQ ID NO: 545632 - DNA, 25 bp, Mus musculus
caaacaagtacaaccctaacgggcg

SEQ ID NO: 545633 - DNA, 25 bp, Mus musculus
caaacaagtacactgaagtgttccc

SEQ ID NO: 545634 - DNA, 25 bp, Mus musculus
caaacaagtacagtgaagtgttccc

SEQ ID NO: 545635 - DNA, 25 bp, Mus musculus
caaacaagtacatccctaacgggcg

SEQ ID NO: 545636 - DNA, 25 bp, Mus musculus
caaacaagtgcaaatgtcaccctgg

SEQ ID NO: 545637 - DNA, 25 bp, Mus musculus
caaacaagtgcatatgtcaccctgg

SEQ ID NO: 545638 - DNA, 25 bp, Mus musculus
caaacaagtggcacaatgaagtaga

SEQ ID NO: 545639 - DNA, 25 bp, Mus musculus
caaacaagtggctcaatgaagtaga

SEQ ID NO: 545640 - DNA, 25 bp, Mus musculus
caaacaataaccatctccttgctga

SEQ ID NO: 545641 - DNA, 25 bp, Mus musculus
caaacaataaccttctccttgctga

SEQ ID NO: 545642 - DNA, 25 bp, Mus musculus
caaacaatattgatccagtgggaag

SEQ ID NO: 545643 - DNA, 25 bp, Mus musculus
caaacaatattgttccagtgggaag

SEQ ID NO: 545644 - DNA, 25 bp, Mus musculus
caaacaattaccatgagttctgcag

SEQ ID NO: 545645 - DNA, 25 bp, Mus musculus
caaacaattaccttgagttctgcag

SEQ ID NO: 545646 - DNA, 25 bp, Mus musculus
caaacaatttccacattcagactcg

SEQ ID NO: 545647 - DNA, 25 bp, Mus musculus
caaacaatttcctcattcagactcg

SEQ ID NO: 545648 - DNA, 25 bp, Mus musculus
caaacacaacatccatgtgcataaa

SEQ ID NO: 545649 - DNA, 25 bp, Mus musculus
caaacacaacatgcatgtgcataaa

SEQ ID NO: 545650 - DNA, 25 bp, Mus musculus
caaacacaaggacgccgtggtggat

SEQ ID NO: 545651 - DNA, 25 bp, Mus musculus
caaacacaaggaggccgtggtggat

SEQ ID NO: 545652 - DNA, 25 bp, Mus musculus
caaacacactggagctcgttgagct

SEQ ID NO: 545653 - DNA, 25 bp, Mus musculus
caaacacactggtgctcgttgagct

SEQ ID NO: 545654 - DNA, 25 bp, Mus musculus
caaacacatggccaaagctagggcc

SEQ ID NO: 545655 - DNA, 25 bp, Mus musculus
caaacacatggcgaaagctagggcc

SEQ ID NO: 545656 - DNA, 25 bp, Mus musculus
caaacaccataacacaaagccgggc

SEQ ID NO: 545657 - DNA, 25 bp, Mus musculus
caaacaccataagacaaagccgggc

SEQ ID NO: 545658 - DNA, 25 bp, Mus musculus
caaacacccttcatctgctggtgcg

SEQ ID NO: 545659 - DNA, 25 bp, Mus musculus
caaacacccttcttctgctggtgcg

SEQ ID NO: 545660 - DNA, 25 bp, Mus musculus
caaacacctggcagtccttgataga

SEQ ID NO: 545661 - DNA, 25 bp, Mus musculus
caaacacctggctgtccttgataga

SEQ ID NO: 545662 - DNA, 25 bp, Mus musculus
caaacacgaccgaaaagagctggct

SEQ ID NO: 545663 - DNA, 25 bp, Mus musculus
caaacacgaccgtaaagagctggct

SEQ ID NO: 545664 - DNA, 25 bp, Mus musculus
caaacacgagttctgctgctgggtc

SEQ ID NO: 545665 - DNA, 25 bp, Mus musculus
caaacacgagttgtgctgctgggtc

SEQ ID NO: 545666 - DNA, 25 bp, Mus musculus
caaacacggaggcatctgtgaccac

SEQ ID NO: 545667 - DNA, 25 bp, Mus musculus
caaacacggagggatctgtgaccac

SEQ ID NO: 545668 - DNA, 25 bp, Mus musculus
caaacacggcttcgtgcctgggctg

SEQ ID NO: 545669 - DNA, 25 bp, Mus musculus
caaacacggcttggtgcctgggctg

SEQ ID NO: 545670 - DNA, 25 bp, Mus musculus
caaacactaactactgaggagacgg

SEQ ID NO: 545671 - DNA, 25 bp, Mus musculus
caaacactaacttctgaggagacgg

SEQ ID NO: 545672 - DNA, 25 bp, Mus musculus
caaacactacggagcctcgagctgt

SEQ ID NO: 545673 - DNA, 25 bp, Mus musculus
caaacactacggtgcctcgagctgt

SEQ ID NO: 545674 - DNA, 25 bp, Mus musculus
caaacactcctgctgtgtcacagga

SEQ ID NO: 545675 - DNA, 25 bp, Mus musculus
caaacactcctggtgtgtcacagga

SEQ ID NO: 545676 - DNA, 25 bp, Mus musculus
caaacactctatctgttcagtcaag

SEQ ID NO: 545677 - DNA, 25 bp, Mus musculus
caaacactctatgtgttcagtcaag

SEQ ID NO: 545678 - DNA, 25 bp, Mus musculus
caaacactctcgagattggatacaa

SEQ ID NO: 545679 - DNA, 25 bp, Mus musculus
caaacactctcgtgattggatacaa

SEQ ID NO: 545680 - DNA, 25 bp, Mus musculus
caaacacttgagcaactgataccac

SEQ ID NO: 545681 - DNA, 25 bp, Mus musculus
caaacacttgaggaactgataccac

SEQ ID NO: 545682 - DNA, 25 bp, Mus musculus
caaacacttggcatcaatgtcccag

SEQ ID NO: 545683 - DNA, 25 bp, Mus musculus
caaacacttggcttcaatgtcccag

SEQ ID NO: 545684 - DNA, 25 bp, Mus musculus
caaacagaaaaaccggcagcgagac

SEQ ID NO: 545685 - DNA, 25 bp, Mus musculus
caaacagaaaaagcggcagcgagac

SEQ ID NO: 545686 - DNA, 25 bp, Mus musculus
caaacagaaaccactatttgtagtg

SEQ ID NO: 545687 - DNA, 25 bp, Mus musculus
caaacagaaacctctatttgtagtg

SEQ ID NO: 545688 - DNA, 25 bp, Mus musculus
caaacagaaatgatcgactctgtat

SEQ ID NO: 545689 - DNA, 25 bp, Mus musculus
caaacagaaatgttcgactctgtat

SEQ ID NO: 545690 - DNA, 25 bp, Mus musculus
caaacagaagaaactcctcaagcag

SEQ ID NO: 545691 - DNA, 25 bp, Mus musculus
caaacagaagaaccgacccaatcgg

SEQ ID NO: 545692 - DNA, 25 bp, Mus musculus
caaacagaagaagcgacccaatcgg

SEQ ID NO: 545693 - DNA, 25 bp, Mus musculus
caaacagaagaatctcctcaagcag

SEQ ID NO: 545694 - DNA, 25 bp, Mus musculus
caaacagaagtcagttttatttctg

SEQ ID NO: 545695 - DNA, 25 bp, Mus musculus
caaacagaagtctgttttatttctg

SEQ ID NO: 545696 - DNA, 25 bp, Mus musculus
caaacagacaaaactccagtggata

SEQ ID NO: 545697 - DNA, 25 bp, Mus musculus
caaacagacaaatctccagtggata

SEQ ID NO: 545698 - DNA, 25 bp, Mus musculus
caaacagactcaagattgaaaaaca

SEQ ID NO: 545699 - DNA, 25 bp, Mus musculus
caaacagactcatgattgaaaaaca

SEQ ID NO: 545700 - DNA, 25 bp, Mus musculus
caaacagaggaaaagtttctcttca

SEQ ID NO: 545701 - DNA, 25 bp, Mus musculus
caaacagaggaatagtttctcttca

SEQ ID NO: 545702 - DNA, 25 bp, Mus musculus
caaacagatctgctgaagcacagac

SEQ ID NO: 545703 - DNA, 25 bp, Mus musculus
caaacagatctggtgaagcacagac

SEQ ID NO: 545704 - DNA, 25 bp, Mus musculus
caaacagatgctctacaccaaccag

SEQ ID NO: 545705 - DNA, 25 bp, Mus musculus
caaacagatgctgtacaccaaccag

SEQ ID NO: 545706 - DNA, 25 bp, Mus musculus
caaacagatggacaaataaacaaac

SEQ ID NO: 545707 - DNA, 25 bp, Mus musculus
caaacagatggagaaataaacaaac

SEQ ID NO: 545708 - DNA, 25 bp, Mus musculus
caaacagcaatgcacgtcttgcagt

SEQ ID NO: 545709 - DNA, 25 bp, Mus musculus
caaacagcaatggacgtcttgcagt

SEQ ID NO: 545710 - DNA, 25 bp, Mus musculus
caaacagcacttagagatgctcctg

SEQ ID NO: 545711 - DNA, 25 bp, Mus musculus
caaacagcactttgagatgctcctg

SEQ ID NO: 545712 - DNA, 25 bp, Mus musculus
caaacagcagaaagtggaccgtgca

SEQ ID NO: 545713 - DNA, 25 bp, Mus musculus
caaacagcagaatgtggaccgtgca

SEQ ID NO: 545714 - DNA, 25 bp, Mus musculus
caaacagctcacaaaggttaggtca

SEQ ID NO: 545715 - DNA, 25 bp, Mus musculus
caaacagctcactaaggttaggtca

SEQ ID NO: 545716 - DNA, 25 bp, Mus musculus
caaacagcttgtcagggcgttggtc

SEQ ID NO: 545717 - DNA, 25 bp, Mus musculus
caaacagcttgtgagggcgttggtc

SEQ ID NO: 545718 - DNA, 25 bp, Mus musculus
caaacaggagacattcacctttgcc

SEQ ID NO: 545719 - DNA, 25 bp, Mus musculus
caaacaggagactttcacctttgcc

SEQ ID NO: 545720 - DNA, 25 bp, Mus musculus
caaacaggaggtagattccaaagaa

SEQ ID NO: 545721 - DNA, 25 bp, Mus musculus
caaacaggaggtcgataaagtgcta

SEQ ID NO: 545722 - DNA, 25 bp, Mus musculus
caaacaggaggtggataaagtgcta

SEQ ID NO: 545723 - DNA, 25 bp, Mus musculus
caaacaggaggttgattccaaagaa

SEQ ID NO: 545724 - DNA, 25 bp, Mus musculus
caaacaggtagccatgggcagaaag

SEQ ID NO: 545725 - DNA, 25 bp, Mus musculus
caaacaggtagcgatgggcagaaag

SEQ ID NO: 545726 - DNA, 25 bp, Mus musculus
caaacaggtaggaagggctgctgaa

SEQ ID NO: 545727 - DNA, 25 bp, Mus musculus
caaacaggtaggtagggctgctgaa

SEQ ID NO: 545728 - DNA, 25 bp, Mus musculus
caaacaggtatgcacttgttggctt

SEQ ID NO: 545729 - DNA, 25 bp, Mus musculus
caaacaggtatggacttgttggctt

SEQ ID NO: 545730 - DNA, 25 bp, Mus musculus
caaacaggtcttcaatcagatcgac

SEQ ID NO: 545731 - DNA, 25 bp, Mus musculus
caaacaggtcttgaatcagatcgac

SEQ ID NO: 545732 - DNA, 25 bp, Mus musculus
caaacagtatctcaggaatccaccg

SEQ ID NO: 545733 - DNA, 25 bp, Mus musculus
caaacagtatctgaggaatccaccg

SEQ ID NO: 545734 - DNA, 25 bp, Mus musculus
caaacagtcaccctactgaggaccg

SEQ ID NO: 545735 - DNA, 25 bp, Mus musculus
caaacagtcaccgtactgaggaccg

SEQ ID NO: 545736 - DNA, 25 bp, Mus musculus
caaacagtctatatcggcgaatctt

SEQ ID NO: 545737 - DNA, 25 bp, Mus musculus
caaacagtctatccgtagtgaggag

SEQ ID NO: 545738 - DNA, 25 bp, Mus musculus
caaacagtctatgcgtagtgaggag

SEQ ID NO: 545739 - DNA, 25 bp, Mus musculus
caaacagtctatttcggcgaatctt

SEQ ID NO: 545740 - DNA, 25 bp, Mus musculus
caaacagtgaccacagcaatagcac

SEQ ID NO: 545741 - DNA, 25 bp, Mus musculus
caaacagtgacctcagcaatagcac

SEQ ID NO: 545742 - DNA, 25 bp, Mus musculus
caaacagtggtaagatgaggaggct

SEQ ID NO: 545743 - DNA, 25 bp, Mus musculus
caaacagtggtatgatgaggaggct

SEQ ID NO: 545744 - DNA, 25 bp, Mus musculus
caaacagttctgctattattgatca

SEQ ID NO: 545745 - DNA, 25 bp, Mus musculus
caaacagttctggtattattgatca

SEQ ID NO: 545746 - DNA, 25 bp, Mus musculus
caaacataaccacgcaacagggact

SEQ ID NO: 545747 - DNA, 25 bp, Mus musculus
caaacataaccaggcaacagggact

SEQ ID NO: 545748 - DNA, 25 bp, Mus musculus
caaacatactctcgataggccatgg

SEQ ID NO: 545749 - DNA, 25 bp, Mus musculus
caaacatactctggataggccatgg

SEQ ID NO: 545750 - DNA, 25 bp, Mus musculus
caaacataggcaaaccacaggctgt

SEQ ID NO: 545751 - DNA, 25 bp, Mus musculus
caaacataggcataccacaggctgt

SEQ ID NO: 545752 - DNA, 25 bp, Mus musculus
caaacatattcacgatggatttccg

SEQ ID NO: 545753 - DNA, 25 bp, Mus musculus
caaacatattcaggatggatttccg

SEQ ID NO: 545754 - DNA, 25 bp, Mus musculus
caaacatcaacaagtcttcgatgag

SEQ ID NO: 545755 - DNA, 25 bp, Mus musculus
caaacatcaacatgtcttcgatgag

SEQ ID NO: 545756 - DNA, 25 bp, Mus musculus
caaacatccaagacactgagggtaa

SEQ ID NO: 545757 - DNA, 25 bp, Mus musculus
caaacatccaagtcactgagggtaa

SEQ ID NO: 545758 - DNA, 25 bp, Mus musculus
caaacatccaggagggagacctcat

SEQ ID NO: 545759 - DNA, 25 bp, Mus musculus
caaacatccaggtgggagacctcat

SEQ ID NO: 545760 - DNA, 25 bp, Mus musculus
caaacatcgaagagtattaattaca

SEQ ID NO: 545761 - DNA, 25 bp, Mus musculus
caaacatcgaagtgtattaattaca

SEQ ID NO: 545762 - DNA, 25 bp, Mus musculus
caaacatcgtggagtcaggctgtga

SEQ ID NO: 545763 - DNA, 25 bp, Mus musculus
caaacatcgtggtgtcaggctgtga

SEQ ID NO: 545764 - DNA, 25 bp, Mus musculus
caaacatcgtgtcctctgtgaacca

SEQ ID NO: 545765 - DNA, 25 bp, Mus musculus
caaacatcgtgtgctctgtgaacca

SEQ ID NO: 545766 - DNA, 25 bp, Mus musculus
caaacatgaacgcagtgaggaagga

SEQ ID NO: 545767 - DNA, 25 bp, Mus musculus
caaacatgaacggagtgaggaagga

SEQ ID NO: 545768 - DNA, 25 bp, Mus musculus
caaacatgagaacatttgctgcaga

SEQ ID NO: 545769 - DNA, 25 bp, Mus musculus
caaacatgagaagatttgctgcaga

SEQ ID NO: 545770 - DNA, 25 bp, Mus musculus
caaacatggcacagagtaggacccg

SEQ ID NO: 545771 - DNA, 25 bp, Mus musculus
caaacatggcactgagtaggacccg

SEQ ID NO: 545772 - DNA, 25 bp, Mus musculus
caaacatggctgaggtagaggaaga

SEQ ID NO: 545773 - DNA, 25 bp, Mus musculus
caaacatggctgtggtagaggaaga

SEQ ID NO: 545774 - DNA, 25 bp, Mus musculus
caaacatggtgaacatgagagttcc

SEQ ID NO: 545775 - DNA, 25 bp, Mus musculus
caaacatggtgatcatgagagttcc

SEQ ID NO: 545776 - DNA, 25 bp, Mus musculus
caaacatgtaagcagccttatcgac

SEQ ID NO: 545777 - DNA, 25 bp, Mus musculus
caaacatgtaaggagccttatcgac

SEQ ID NO: 545778 - DNA, 25 bp, Mus musculus
caaacattagttattggccgtaccg

SEQ ID NO: 545779 - DNA, 25 bp, Mus musculus
caaacattagtttttggccgtaccg

SEQ ID NO: 545780 - DNA, 25 bp, Mus musculus
caaacattatggcatggtaccaatc

SEQ ID NO: 545781 - DNA, 25 bp, Mus musculus
caaacattatgggatggtaccaatc

SEQ ID NO: 545782 - DNA, 25 bp, Mus musculus
caaacattgaccctaccttatatgt

SEQ ID NO: 545783 - DNA, 25 bp, Mus musculus
caaacattgaccgtaccttatatgt

SEQ ID NO: 545784 - DNA, 25 bp, Mus musculus
caaacattgacgatgttgtgaacaa

SEQ ID NO: 545785 - DNA, 25 bp, Mus musculus
caaacattgacgttgttgtgaacaa

SEQ ID NO: 545786 - DNA, 25 bp, Mus musculus
caaacatttcatagttgcagagtcc

SEQ ID NO: 545787 - DNA, 25 bp, Mus musculus
caaacatttcattgttgcagagtcc

SEQ ID NO: 545788 - DNA, 25 bp, Mus musculus
caaacatttggcaagagtatggcca

SEQ ID NO: 545789 - DNA, 25 bp, Mus musculus
caaacatttggctagagtatggcca

SEQ ID NO: 545790 - DNA, 25 bp, Mus musculus
caaacattttcaccatttggacaaa

SEQ ID NO: 545791 - DNA, 25 bp, Mus musculus
caaacattttcagcatttggacaaa

SEQ ID NO: 545792 - DNA, 25 bp, Mus musculus
caaaccaaaaatctgaagggccagg

SEQ ID NO: 545793 - DNA, 25 bp, Mus musculus
caaaccaaaaatgtgaagggccagg

SEQ ID NO: 545794 - DNA, 25 bp, Mus musculus
caaaccaaaagtcagccgtagtcgg

SEQ ID NO: 545795 - DNA, 25 bp, Mus musculus
caaaccaaaagtgagccgtagtcgg

SEQ ID NO: 545796 - DNA, 25 bp, Mus musculus
caaaccaaagatcatctccgtgttg

SEQ ID NO: 545797 - DNA, 25 bp, Mus musculus
caaaccaaagatgatctccgtgttg

SEQ ID NO: 545798 - DNA, 25 bp, Mus musculus
caaaccaactgcctggaatggacat

SEQ ID NO: 545799 - DNA, 25 bp, Mus musculus
caaaccaactgcgtggaatggacat

SEQ ID NO: 545800 - DNA, 25 bp, Mus musculus
caaaccaagacaattgccccagaag

SEQ ID NO: 545801 - DNA, 25 bp, Mus musculus
caaaccaagacatttgccccagaag

SEQ ID NO: 545802 - DNA, 25 bp, Mus musculus
caaaccaagcaaaggtcagagccca

SEQ ID NO: 545803 - DNA, 25 bp, Mus musculus
caaaccaagcaatggtcagagccca

SEQ ID NO: 545804 - DNA, 25 bp, Mus musculus
caaaccaaggtcactaagccattac

SEQ ID NO: 545805 - DNA, 25 bp, Mus musculus
caaaccaaggtctctaagccattac

SEQ ID NO: 545806 - DNA, 25 bp, Mus musculus
caaaccaagtgcaaagtctatctat

SEQ ID NO: 545807 - DNA, 25 bp, Mus musculus
caaaccaagtgctaagtctatctat

SEQ ID NO: 545808 - DNA, 25 bp, Mus musculus
caaaccacagagaaggcactaaaag

SEQ ID NO: 545809 - DNA, 25 bp, Mus musculus
caaaccacagagtaggcactaaaag

SEQ ID NO: 545810 - DNA, 25 bp, Mus musculus
caaaccacgaggaagcaatccgctg

SEQ ID NO: 545811 - DNA, 25 bp, Mus musculus
caaaccacgaggtagcaatccgctg

SEQ ID NO: 545812 - DNA, 25 bp, Mus musculus
caaaccactagaagactgccagaaa

SEQ ID NO: 545813 - DNA, 25 bp, Mus musculus
caaaccactagatgactgccagaaa

SEQ ID NO: 545814 - DNA, 25 bp, Mus musculus
caaaccactagcactgccaagaaag

SEQ ID NO: 545815 - DNA, 25 bp, Mus musculus
caaaccactagctctgccaagaaag

SEQ ID NO: 545816 - DNA, 25 bp, Mus musculus
caaaccactccgagtacccataggt

SEQ ID NO: 545817 - DNA, 25 bp, Mus musculus
caaaccactccgtgtacccataggt

SEQ ID NO: 545818 - DNA, 25 bp, Mus musculus
caaaccactgctatgtactgactga

SEQ ID NO: 545819 - DNA, 25 bp, Mus musculus
caaaccactgctcaggaatcccaga

SEQ ID NO: 545820 - DNA, 25 bp, Mus musculus
caaaccactgctgaggaatcccaga

SEQ ID NO: 545821 - DNA, 25 bp, Mus musculus
caaaccactgctttgtactgactga

SEQ ID NO: 545822 - DNA, 25 bp, Mus musculus
caaaccacttggcacagtggcttct

SEQ ID NO: 545823 - DNA, 25 bp, Mus musculus
caaaccacttgggacagtggcttct

SEQ ID NO: 545824 - DNA, 25 bp, Mus musculus
caaaccagagctctaccagggcact

SEQ ID NO: 545825 - DNA, 25 bp, Mus musculus
caaaccagagctgtaccagggcact

SEQ ID NO: 545826 - DNA, 25 bp, Mus musculus
caaaccagcagcagccaatgctcag

SEQ ID NO: 545827 - DNA, 25 bp, Mus musculus
caaaccagcagctgccaatgctcag

SEQ ID NO: 545828 - DNA, 25 bp, Mus musculus
caaaccagccctatgagtggatttc

SEQ ID NO: 545829 - DNA, 25 bp, Mus musculus
caaaccagccctttgagtggatttc

SEQ ID NO: 545830 - DNA, 25 bp, Mus musculus
caaaccaggagtaatttgaagaata

SEQ ID NO: 545831 - DNA, 25 bp, Mus musculus
caaaccaggagttatttgaagaata

SEQ ID NO: 545832 - DNA, 25 bp, Mus musculus
caaaccatccgaactatacccatga

SEQ ID NO: 545833 - DNA, 25 bp, Mus musculus
caaaccatccgatctatacccatga

SEQ ID NO: 545834 - DNA, 25 bp, Mus musculus
caaaccatgcctcttgccagtaact

SEQ ID NO: 545835 - DNA, 25 bp, Mus musculus
caaaccatgcctgttgccagtaact

SEQ ID NO: 545836 - DNA, 25 bp, Mus musculus
caaaccattgtacatagattaaaag

SEQ ID NO: 545837 - DNA, 25 bp, Mus musculus
caaaccattgtagatagattaaaag

SEQ ID NO: 545838 - DNA, 25 bp, Mus musculus
caaacccaaccgagtgaccaaagtg

SEQ ID NO: 545839 - DNA, 25 bp, Mus musculus
caaacccaaccgtgtgaccaaagtg

SEQ ID NO: 545840 - DNA, 25 bp, Mus musculus
caaacccaagagagtaggagctggc

SEQ ID NO: 545841 - DNA, 25 bp, Mus musculus
caaacccaagagtgtaggagctggc

SEQ ID NO: 545842 - DNA, 25 bp, Mus musculus
caaacccaaggacgcggtcaccgtg

SEQ ID NO: 545843 - DNA, 25 bp, Mus musculus
caaacccaaggaggcggtcaccgtg

SEQ ID NO: 545844 - DNA, 25 bp, Mus musculus
caaacccacggtcttctcagatgtt

SEQ ID NO: 545845 - DNA, 25 bp, Mus musculus
caaacccacggtgttctcagatgtt

SEQ ID NO: 545846 - DNA, 25 bp, Mus musculus
caaacccagagacagaagttagggc

SEQ ID NO: 545847 - DNA, 25 bp, Mus musculus
caaacccagagagagaagttagggc

SEQ ID NO: 545848 - DNA, 25 bp, Mus musculus
caaacccagtttatgcggagggcgc

SEQ ID NO: 545849 - DNA, 25 bp, Mus musculus
caaacccagtttttgcggagggcgc

SEQ ID NO: 545850 - DNA, 25 bp, Mus musculus
caaacccatctgcaagagctctgtc

SEQ ID NO: 545851 - DNA, 25 bp, Mus musculus
caaacccatctggaagagctctgtc

SEQ ID NO: 545852 - DNA, 25 bp, Mus musculus
caaacccatttgaggaggacgacat

SEQ ID NO: 545853 - DNA, 25 bp, Mus musculus
caaacccatttgtggaggacgacat

SEQ ID NO: 545854 - DNA, 25 bp, Mus musculus
caaaccccacctcttgtgtgcataa

SEQ ID NO: 545855 - DNA, 25 bp, Mus musculus
caaaccccacctgttgtgtgcataa

SEQ ID NO: 545856 - DNA, 25 bp, Mus musculus
caaaccccatgaacccgagtgtggt

SEQ ID NO: 545857 - DNA, 25 bp, Mus musculus
caaaccccatgatcccgagtgtggt

SEQ ID NO: 545858 - DNA, 25 bp, Mus musculus
caaaccctattgaatcccttgagca

SEQ ID NO: 545859 - DNA, 25 bp, Mus musculus
caaaccctattgtatcccttgagca

SEQ ID NO: 545860 - DNA, 25 bp, Mus musculus
caaaccctctataggcttggcaact

SEQ ID NO: 545861 - DNA, 25 bp, Mus musculus
caaaccctctattggcttggcaact

SEQ ID NO: 545862 - DNA, 25 bp, Mus musculus
caaacccttcaacgagtttgtagag

SEQ ID NO: 545863 - DNA, 25 bp, Mus musculus
caaacccttcaaggagtttgtagag

SEQ ID NO: 545864 - DNA, 25 bp, Mus musculus
caaacccttgctaagtgacggcgag

SEQ ID NO: 545865 - DNA, 25 bp, Mus musculus
caaacccttgcttagtgacggcgag

SEQ ID NO: 545866 - DNA, 25 bp, Mus musculus
caaaccctttcgaatgctatgcaag

SEQ ID NO: 545867 - DNA, 25 bp, Mus musculus
caaaccctttcgtatgctatgcaag

SEQ ID NO: 545868 - DNA, 25 bp, Mus musculus
caaaccgaatgaacactcaaacttc

SEQ ID NO: 545869 - DNA, 25 bp, Mus musculus
caaaccgaatgatcactcaaacttc

SEQ ID NO: 545870 - DNA, 25 bp, Mus musculus
caaaccgactatagaatatttgagc

SEQ ID NO: 545871 - DNA, 25 bp, Mus musculus
caaaccgactattgaatatttgagc

SEQ ID NO: 545872 - DNA, 25 bp, Mus musculus
caaaccgaggatcttctatgagtcg

SEQ ID NO: 545873 - DNA, 25 bp, Mus musculus
caaaccgaggatgttctatgagtcg

SEQ ID NO: 545874 - DNA, 25 bp, Mus musculus
caaaccgattctatgtggctgcaga

SEQ ID NO: 545875 - DNA, 25 bp, Mus musculus
caaaccgattctttgtggctgcaga

SEQ ID NO: 545876 - DNA, 25 bp, Mus musculus
caaaccggagaacacgggctttgct

SEQ ID NO: 545877 - DNA, 25 bp, Mus musculus
caaaccggagaagacgggctttgct

SEQ ID NO: 545878 - DNA, 25 bp, Mus musculus
caaaccggatcgaggattccgcaag

SEQ ID NO: 545879 - DNA, 25 bp, Mus musculus
caaaccggatcgtggattccgcaag

SEQ ID NO: 545880 - DNA, 25 bp, Mus musculus
caaaccggatgaccgtggcttcacc

SEQ ID NO: 545881 - DNA, 25 bp, Mus musculus
caaaccggatgagcgtggcttcacc

SEQ ID NO: 545882 - DNA, 25 bp, Mus musculus
caaaccggcaacctgggaatgaggt

SEQ ID NO: 545883 - DNA, 25 bp, Mus musculus
caaaccggcaacgtgggaatgaggt

SEQ ID NO: 545884 - DNA, 25 bp, Mus musculus
caaaccggctctacgcttatgaacc

SEQ ID NO: 545885 - DNA, 25 bp, Mus musculus
caaaccggctcttcgcttatgaacc

SEQ ID NO: 545886 - DNA, 25 bp, Mus musculus
caaaccggcttaagggaccacagga

SEQ ID NO: 545887 - DNA, 25 bp, Mus musculus
caaaccggcttatgggaccacagga

SEQ ID NO: 545888 - DNA, 25 bp, Mus musculus
caaaccgtctgaaaaggccaccctg

SEQ ID NO: 545889 - DNA, 25 bp, Mus musculus
caaaccgtctgataaggccaccctg

SEQ ID NO: 545890 - DNA, 25 bp, Mus musculus
caaacctaaggacaattcagaacaa

SEQ ID NO: 545891 - DNA, 25 bp, Mus musculus
caaacctaaggagaattcagaacaa

SEQ ID NO: 545892 - DNA, 25 bp, Mus musculus
caaacctacaggaattggtctccaa

SEQ ID NO: 545893 - DNA, 25 bp, Mus musculus
caaacctacaggtattggtctccaa

SEQ ID NO: 545894 - DNA, 25 bp, Mus musculus
caaacctacataaactaccagggaa

SEQ ID NO: 545895 - DNA, 25 bp, Mus musculus
caaacctacatatactaccagggaa

SEQ ID NO: 545896 - DNA, 25 bp, Mus musculus
caaacctaggcgagtctccaacagg

SEQ ID NO: 545897 - DNA, 25 bp, Mus musculus
caaacctaggcgtgtctccaacagg

SEQ ID NO: 545898 - DNA, 25 bp, Mus musculus
caaacctcgggacaggagtcatcct

SEQ ID NO: 545899 - DNA, 25 bp, Mus musculus
caaacctcgggagaggagtcatcct

SEQ ID NO: 545900 - DNA, 25 bp, Mus musculus
caaacctctctaagggaatgatcga

SEQ ID NO: 545901 - DNA, 25 bp, Mus musculus
caaacctctctatgggaatgatcga

SEQ ID NO: 545902 - DNA, 25 bp, Mus musculus
caaacctctctgaagaggagcaccg

SEQ ID NO: 545903 - DNA, 25 bp, Mus musculus
caaacctctctgtagaggagcaccg

SEQ ID NO: 545904 - DNA, 25 bp, Mus musculus
caaacctcttttcttactggagatc

SEQ ID NO: 545905 - DNA, 25 bp, Mus musculus
caaacctcttttgttactggagatc

SEQ ID NO: 545906 - DNA, 25 bp, Mus musculus
caaacctgacaacgctgtatccatt

SEQ ID NO: 545907 - DNA, 25 bp, Mus musculus
caaacctgacaaggctgtatccatt

SEQ ID NO: 545908 - DNA, 25 bp, Mus musculus
caaacctgagatcgaatttaggcca

SEQ ID NO: 545909 - DNA, 25 bp, Mus musculus
caaacctgagatggaatttaggcca

SEQ ID NO: 545910 - DNA, 25 bp, Mus musculus
caaacctgaggcctctgtggatgag

SEQ ID NO: 545911 - DNA, 25 bp, Mus musculus
caaacctgaggcgtctgtggatgag

SEQ ID NO: 545912 - DNA, 25 bp, Mus musculus
caaacctgcaataaatctggagtct

SEQ ID NO: 545913 - DNA, 25 bp, Mus musculus
caaacctgcaattaatctggagtct

SEQ ID NO: 545914 - DNA, 25 bp, Mus musculus
caaacctgcattcctcctgactata

SEQ ID NO: 545915 - DNA, 25 bp, Mus musculus
caaacctgcattgctcctgactata

SEQ ID NO: 545916 - DNA, 25 bp, Mus musculus
caaacctgccatcaacccgagatgc

SEQ ID NO: 545917 - DNA, 25 bp, Mus musculus
caaacctgccatgaacccgagatgc

SEQ ID NO: 545918 - DNA, 25 bp, Mus musculus
caaacctgtaagcaagagacgccag

SEQ ID NO: 545919 - DNA, 25 bp, Mus musculus
caaacctgtaaggaagagacgccag

SEQ ID NO: 545920 - DNA, 25 bp, Mus musculus
caaacctgtgtgattcactagaagg

SEQ ID NO: 545921 - DNA, 25 bp, Mus musculus
caaacctgtgtgtttcactagaagg

SEQ ID NO: 545922 - DNA, 25 bp, Mus musculus
caaaccttcggaattgaccttagct

SEQ ID NO: 545923 - DNA, 25 bp, Mus musculus
caaaccttcggatttgaccttagct

SEQ ID NO: 545924 - DNA, 25 bp, Mus musculus
caaaccttgtagagtgagctcttct

SEQ ID NO: 545925 - DNA, 25 bp, Mus musculus
caaaccttgtagtgtgagctcttct

SEQ ID NO: 545926 - DNA, 25 bp, Mus musculus
caaacctttagtccagagtggcacc

SEQ ID NO: 545927 - DNA, 25 bp, Mus musculus
caaacctttagtgcagagtggcacc

SEQ ID NO: 545928 - DNA, 25 bp, Mus musculus
caaacgaaactgcatcttgggacac

SEQ ID NO: 545929 - DNA, 25 bp, Mus musculus
caaacgaaactggatcttgggacac

SEQ ID NO: 545930 - DNA, 25 bp, Mus musculus
caaacgaagcttcatgggaaacagc

SEQ ID NO: 545931 - DNA, 25 bp, Mus musculus
caaacgaagcttgatgggaaacagc

SEQ ID NO: 545932 - DNA, 25 bp, Mus musculus
caaacgaatcagctacaagaagaac

SEQ ID NO: 545933 - DNA, 25 bp, Mus musculus
caaacgaatcaggtacaagaagaac

SEQ ID NO: 545934 - DNA, 25 bp, Mus musculus
caaacgaatcgtagggctggagaga

SEQ ID NO: 545935 - DNA, 25 bp, Mus musculus
caaacgaatcgttgggctggagaga

SEQ ID NO: 545936 - DNA, 25 bp, Mus musculus
caaacgaatgggacattggtggcaa

SEQ ID NO: 545937 - DNA, 25 bp, Mus musculus
caaacgaatgggtcattggtggcaa

SEQ ID NO: 545938 - DNA, 25 bp, Mus musculus
caaacgacgttgatcgatacagggt

SEQ ID NO: 545939 - DNA, 25 bp, Mus musculus
caaacgacgttgttcgatacagggt

SEQ ID NO: 545940 - DNA, 25 bp, Mus musculus
caaacgagaagccagaaacggacaa

SEQ ID NO: 545941 - DNA, 25 bp, Mus musculus
caaacgagaagcgagaaacggacaa

SEQ ID NO: 545942 - DNA, 25 bp, Mus musculus
caaacgagaggaaggaggtccatgt

SEQ ID NO: 545943 - DNA, 25 bp, Mus musculus
caaacgagaggatggaggtccatgt

SEQ ID NO: 545944 - DNA, 25 bp, Mus musculus
caaacgagccaaacgagactcctcg

SEQ ID NO: 545945 - DNA, 25 bp, Mus musculus
caaacgagccaatcgagactcctcg

SEQ ID NO: 545946 - DNA, 25 bp, Mus musculus
caaacgagtgtgacttctgcgtgac

SEQ ID NO: 545947 - DNA, 25 bp, Mus musculus
caaacgagtgtgtcttctgcgtgac

SEQ ID NO: 545948 - DNA, 25 bp, Mus musculus
caaacgatcagcacggatgtgtggt

SEQ ID NO: 545949 - DNA, 25 bp, Mus musculus
caaacgatcagctcggatgtgtggt

SEQ ID NO: 545950 - DNA, 25 bp, Mus musculus
caaacgatgaccaccttgccttggc

SEQ ID NO: 545951 - DNA, 25 bp, Mus musculus
caaacgatgacctccttgccttggc

SEQ ID NO: 545952 - DNA, 25 bp, Mus musculus
caaacgatgagcagctgtatgatcc

SEQ ID NO: 545953 - DNA, 25 bp, Mus musculus
caaacgatgagctgctgtatgatcc

SEQ ID NO: 545954 - DNA, 25 bp, Mus musculus
caaacgcaacgtaatgatcttgacc

SEQ ID NO: 545955 - DNA, 25 bp, Mus musculus
caaacgcaacgttatgatcttgacc

SEQ ID NO: 545956 - DNA, 25 bp, Mus musculus
caaacgcacacacgtcaagatccgg

SEQ ID NO: 545957 - DNA, 25 bp, Mus musculus
caaacgcacacaggtcaagatccgg

SEQ ID NO: 545958 - DNA, 25 bp, Mus musculus
caaacgcacgaccaagatcttgcat

SEQ ID NO: 545959 - DNA, 25 bp, Mus musculus
caaacgcacgacgaagatcttgcat

SEQ ID NO: 545960 - DNA, 25 bp, Mus musculus
caaacgcagaagcacggagaacagt

SEQ ID NO: 545961 - DNA, 25 bp, Mus musculus
caaacgcagaaggacggagaacagt

SEQ ID NO: 545962 - DNA, 25 bp, Mus musculus
caaacgccagtgcttagagaactac

SEQ ID NO: 545963 - DNA, 25 bp, Mus musculus
caaacgccagtggttagagaactac

SEQ ID NO: 545964 - DNA, 25 bp, Mus musculus
caaacgccggatcctgattgtggtc

SEQ ID NO: 545965 - DNA, 25 bp, Mus musculus
caaacgccggatgctgattgtggtc

SEQ ID NO: 545966 - DNA, 25 bp, Mus musculus
caaacgcgcagtcaatagccttcga

SEQ ID NO: 545967 - DNA, 25 bp, Mus musculus
caaacgcgcagtgaatagccttcga

SEQ ID NO: 545968 - DNA, 25 bp, Mus musculus
caaacgcgctcgacctctgtgtgta

SEQ ID NO: 545969 - DNA, 25 bp, Mus musculus
caaacgcgctcgtcctctgtgtgta

SEQ ID NO: 545970 - DNA, 25 bp, Mus musculus
caaacgcgctgacatctatgcaatg

SEQ ID NO: 545971 - DNA, 25 bp, Mus musculus
caaacgcgctgagatctatgcaatg

SEQ ID NO: 545972 - DNA, 25 bp, Mus musculus
caaacgcggagaacggatcctgatc

SEQ ID NO: 545973 - DNA, 25 bp, Mus musculus
caaacgcggagatcggatcctgatc

SEQ ID NO: 545974 - DNA, 25 bp, Mus musculus
caaacgcggtaaatacaaggaggca

SEQ ID NO: 545975 - DNA, 25 bp, Mus musculus
caaacgcggtaattacaaggaggca

SEQ ID NO: 545976 - DNA, 25 bp, Mus musculus
caaacgctacaacaattccttggag

SEQ ID NO: 545977 - DNA, 25 bp, Mus musculus
caaacgctacaagaattccttggag

SEQ ID NO: 545978 - DNA, 25 bp, Mus musculus
caaacgctggaccaaagtggacaca

SEQ ID NO: 545979 - DNA, 25 bp, Mus musculus
caaacgctggacgaaagtggacaca

SEQ ID NO: 545980 - DNA, 25 bp, Mus musculus
caaacgcttccaacagttcatccgg

SEQ ID NO: 545981 - DNA, 25 bp, Mus musculus
caaacgcttccatcagttcatccgg

SEQ ID NO: 545982 - DNA, 25 bp, Mus musculus
caaacggaaacaatgcaatggcagc

SEQ ID NO: 545983 - DNA, 25 bp, Mus musculus
caaacggaaacattgcaatggcagc

SEQ ID NO: 545984 - DNA, 25 bp, Mus musculus
caaacggaatgacaagcgagaagtg

SEQ ID NO: 545985 - DNA, 25 bp, Mus musculus
caaacggaatgagaagcgagaagtg

SEQ ID NO: 545986 - DNA, 25 bp, Mus musculus
caaacggacatcattctagctagca

SEQ ID NO: 545987 - DNA, 25 bp, Mus musculus
caaacggacatctttctagctagca

SEQ ID NO: 545988 - DNA, 25 bp, Mus musculus
caaacggaccctcagggagctgaag

SEQ ID NO: 545989 - DNA, 25 bp, Mus musculus
caaacggaccctgagggagctgaag

SEQ ID NO: 545990 - DNA, 25 bp, Mus musculus
caaacggaggaaacggaagatgtca

SEQ ID NO: 545991 - DNA, 25 bp, Mus musculus
caaacggaggaatcggaagatgtca

SEQ ID NO: 545992 - DNA, 25 bp, Mus musculus
caaacggcaataaagatattggtca

SEQ ID NO: 545993 - DNA, 25 bp, Mus musculus
caaacggcaatatagatattggtca

SEQ ID NO: 545994 - DNA, 25 bp, Mus musculus
caaacggcagtgcaagatacatctc

SEQ ID NO: 545995 - DNA, 25 bp, Mus musculus
caaacggcagtggaagatacatctc

SEQ ID NO: 545996 - DNA, 25 bp, Mus musculus
caaacggcatttcactcaggtggag

SEQ ID NO: 545997 - DNA, 25 bp, Mus musculus
caaacggcatttgactcaggtggag

SEQ ID NO: 545998 - DNA, 25 bp, Mus musculus
caaacggctacacaactggacagag

SEQ ID NO: 545999 - DNA, 25 bp, Mus musculus
caaacggctacagaactggacagag

SEQ ID NO: 546000 - DNA, 25 bp, Mus musculus
caaacggctttgacctggaccgcca

SEQ ID NO: 546001 - DNA, 25 bp, Mus musculus
caaacggctttgtcctggaccgcca

SEQ ID NO: 546002 - DNA, 25 bp, Mus musculus
caaacgggaaccacattaggatgct

SEQ ID NO: 546003 - DNA, 25 bp, Mus musculus
caaacgggaacctcattaggatgct

SEQ ID NO: 546004 - DNA, 25 bp, Mus musculus
caaacgggaagcctgagaagtgtct

SEQ ID NO: 546005 - DNA, 25 bp, Mus musculus
caaacgggaagcgtgagaagtgtct

SEQ ID NO: 546006 - DNA, 25 bp, Mus musculus
caaacgggaggtaactactgtccag

SEQ ID NO: 546007 - DNA, 25 bp, Mus musculus
caaacgggaggttactactgtccag

SEQ ID NO: 546008 - DNA, 25 bp, Mus musculus
caaacgggtatcacatgtctcaggg

SEQ ID NO: 546009 - DNA, 25 bp, Mus musculus
caaacgggtatctcatgtctcaggg

SEQ ID NO: 546010 - DNA, 25 bp, Mus musculus
caaacgggtgatagatgagacctcc

SEQ ID NO: 546011 - DNA, 25 bp, Mus musculus
caaacgggtgattgatgagacctcc

SEQ ID NO: 546012 - DNA, 25 bp, Mus musculus
caaacgtcttccacttttggaggca

SEQ ID NO: 546013 - DNA, 25 bp, Mus musculus
caaacgtcttcctcttttggaggca

SEQ ID NO: 546014 - DNA, 25 bp, Mus musculus
caaacgtgacgtcacgttggccgca

SEQ ID NO: 546015 - DNA, 25 bp, Mus musculus
caaacgtgacgtgacgttggccgca

SEQ ID NO: 546016 - DNA, 25 bp, Mus musculus
caaacgtgaggaaggttcatatact

SEQ ID NO: 546017 - DNA, 25 bp, Mus musculus
caaacgtgaggatggttcatatact

SEQ ID NO: 546018 - DNA, 25 bp, Mus musculus
caaacgtgctggctggccaaatcag

SEQ ID NO: 546019 - DNA, 25 bp, Mus musculus
caaacgtgctgggtggccaaatcag

SEQ ID NO: 546020 - DNA, 25 bp, Mus musculus
caaacgtgtcagatgtggacctgac

SEQ ID NO: 546021 - DNA, 25 bp, Mus musculus
caaacgtgtcagttgtggacctgac

SEQ ID NO: 546022 - DNA, 25 bp, Mus musculus
caaacgtgtgtacttcggcctgaga

SEQ ID NO: 546023 - DNA, 25 bp, Mus musculus
caaacgtgtgtagttcggcctgaga

SEQ ID NO: 546024 - DNA, 25 bp, Mus musculus
caaacgttccaacagtgaggttgac

SEQ ID NO: 546025 - DNA, 25 bp, Mus musculus
caaacgttccaagagtgaggttgac

SEQ ID NO: 546026 - DNA, 25 bp, Mus musculus
caaacgttctgtactgtccaaatca

SEQ ID NO: 546027 - DNA, 25 bp, Mus musculus
caaacgttctgttctgtccaaatca

SEQ ID NO: 546028 - DNA, 25 bp, Mus musculus
caaactaaacatcccgaatcaaaag

SEQ ID NO: 546029 - DNA, 25 bp, Mus musculus
caaactaaacatgccgaatcaaaag

SEQ ID NO: 546030 - DNA, 25 bp, Mus musculus
caaactaacacgaaactgcgccgga

SEQ ID NO: 546031 - DNA, 25 bp, Mus musculus
caaactaacacgtaactgcgccgga

SEQ ID NO: 546032 - DNA, 25 bp, Mus musculus
caaactaagacaagaagccgtggta

SEQ ID NO: 546033 - DNA, 25 bp, Mus musculus
caaactaagacatgaagccgtggta

SEQ ID NO: 546034 - DNA, 25 bp, Mus musculus
caaactaagagacatgggctgcaac

SEQ ID NO: 546035 - DNA, 25 bp, Mus musculus
caaactaagagagatgggctgcaac

SEQ ID NO: 546036 - DNA, 25 bp, Mus musculus
caaactaatgatcctgactgtaacc

SEQ ID NO: 546037 - DNA, 25 bp, Mus musculus
caaactaatgatgctgactgtaacc

SEQ ID NO: 546038 - DNA, 25 bp, Mus musculus
caaactaatggcagtttctatagcc

SEQ ID NO: 546039 - DNA, 25 bp, Mus musculus
caaactaatggctgtttctatagcc

SEQ ID NO: 546040 - DNA, 25 bp, Mus musculus
caaactacagcaaccagacatgctg

SEQ ID NO: 546041 - DNA, 25 bp, Mus musculus
caaactacagcatccagacatgctg

SEQ ID NO: 546042 - DNA, 25 bp, Mus musculus
caaactacaggccattgccaaccag

SEQ ID NO: 546043 - DNA, 25 bp, Mus musculus
caaactacaggcgattgccaaccag

SEQ ID NO: 546044 - DNA, 25 bp, Mus musculus
caaactacagggagtggcgtcacaa

SEQ ID NO: 546045 - DNA, 25 bp, Mus musculus
caaactacagggtgtggcgtcacaa

SEQ ID NO: 546046 - DNA, 25 bp, Mus musculus
caaactacggtaagatatacggtgt

SEQ ID NO: 546047 - DNA, 25 bp, Mus musculus
caaactacggtatgatatacggtgt

SEQ ID NO: 546048 - DNA, 25 bp, Mus musculus
caaactacggtgagagtgtgaagat

SEQ ID NO: 546049 - DNA, 25 bp, Mus musculus
caaactacggtgtgagtgtgaagat

SEQ ID NO: 546050 - DNA, 25 bp, Mus musculus
caaactagccggagtcagcggccag

SEQ ID NO: 546051 - DNA, 25 bp, Mus musculus
caaactagccggtgtcagcggccag

SEQ ID NO: 546052 - DNA, 25 bp, Mus musculus
caaactagtgatcctgggtgccggt

SEQ ID NO: 546053 - DNA, 25 bp, Mus musculus
caaactagtgatgctgggtgccggt

SEQ ID NO: 546054 - DNA, 25 bp, Mus musculus
caaactagtggacttcctggacacg

SEQ ID NO: 546055 - DNA, 25 bp, Mus musculus
caaactagtggagttcctggacacg

SEQ ID NO: 546056 - DNA, 25 bp, Mus musculus
caaactagtttcatgataacccata

SEQ ID NO: 546057 - DNA, 25 bp, Mus musculus
caaactagtttcttgataacccata

SEQ ID NO: 546058 - DNA, 25 bp, Mus musculus
caaactatcaagcaaggaatctgtg

SEQ ID NO: 546059 - DNA, 25 bp, Mus musculus
caaactatcaaggaaggaatctgtg

SEQ ID NO: 546060 - DNA, 25 bp, Mus musculus
caaactatgtcaagtcagaaggcca

SEQ ID NO: 546061 - DNA, 25 bp, Mus musculus
caaactatgtcatgtcagaaggcca

SEQ ID NO: 546062 - DNA, 25 bp, Mus musculus
caaactattggacagacctggccat

SEQ ID NO: 546063 - DNA, 25 bp, Mus musculus
caaactattggagagacctggccat

SEQ ID NO: 546064 - DNA, 25 bp, Mus musculus
caaactcaaatgaccttgcaggctc

SEQ ID NO: 546065 - DNA, 25 bp, Mus musculus
caaactcaaatgtccttgcaggctc

SEQ ID NO: 546066 - DNA, 25 bp, Mus musculus
caaactcacattcgagcagtcttct

SEQ ID NO: 546067 - DNA, 25 bp, Mus musculus
caaactcacattggagcagtcttct

SEQ ID NO: 546068 - DNA, 25 bp, Mus musculus
caaactcagtatatcccggactgta

SEQ ID NO: 546069 - DNA, 25 bp, Mus musculus
caaactcagtatttcccggactgta

SEQ ID NO: 546070 - DNA, 25 bp, Mus musculus
caaactcatgggagtctattaggat

SEQ ID NO: 546071 - DNA, 25 bp, Mus musculus
caaactcatgggtgtctattaggat

SEQ ID NO: 546072 - DNA, 25 bp, Mus musculus
caaactcattctccagaacacaggg

SEQ ID NO: 546073 - DNA, 25 bp, Mus musculus
caaactcattctgcagaacacaggg

SEQ ID NO: 546074 - DNA, 25 bp, Mus musculus
caaactcattgactgcttcaaaaag

SEQ ID NO: 546075 - DNA, 25 bp, Mus musculus
caaactcattgagtgcttcaaaaag

SEQ ID NO: 546076 - DNA, 25 bp, Mus musculus
caaactccaagcatccttacatcgt

SEQ ID NO: 546077 - DNA, 25 bp, Mus musculus
caaactccaagcttccttacatcgt

SEQ ID NO: 546078 - DNA, 25 bp, Mus musculus
caaactccagagaagtctcacttgc

SEQ ID NO: 546079 - DNA, 25 bp, Mus musculus
caaactccagagtagtctcacttgc

SEQ ID NO: 546080 - DNA, 25 bp, Mus musculus
caaactccccagagagcggtgttca

SEQ ID NO: 546081 - DNA, 25 bp, Mus musculus
caaactccccagtgagcggtgttca

SEQ ID NO: 546082 - DNA, 25 bp, Mus musculus
caaactccctggaatcgctgagtcc

SEQ ID NO: 546083 - DNA, 25 bp, Mus musculus
caaactccctggtatcgctgagtcc

SEQ ID NO: 546084 - DNA, 25 bp, Mus musculus
caaactccctgtctataaaactgta

SEQ ID NO: 546085 - DNA, 25 bp, Mus musculus
caaactccctgtgtataaaactgta

SEQ ID NO: 546086 - DNA, 25 bp, Mus musculus
caaactcctcaaaaactgcctattg

SEQ ID NO: 546087 - DNA, 25 bp, Mus musculus
caaactcctcaataactgcctattg

SEQ ID NO: 546088 - DNA, 25 bp, Mus musculus
caaactcctgtcctctgggcttcgg

SEQ ID NO: 546089 - DNA, 25 bp, Mus musculus
caaactcctgtcgtctgggcttcgg

SEQ ID NO: 546090 - DNA, 25 bp, Mus musculus
caaactccttgacactgcacctggg

SEQ ID NO: 546091 - DNA, 25 bp, Mus musculus
caaactccttgagactgcacctggg

SEQ ID NO: 546092 - DNA, 25 bp, Mus musculus
caaactccttggagggcttgcggtt

SEQ ID NO: 546093 - DNA, 25 bp, Mus musculus
caaactccttggtgggcttgcggtt

SEQ ID NO: 546094 - DNA, 25 bp, Mus musculus
caaactcgtagtcctgatgaaccaa

SEQ ID NO: 546095 - DNA, 25 bp, Mus musculus
caaactcgtagtgctgatgaaccaa

SEQ ID NO: 546096 - DNA, 25 bp, Mus musculus
caaactcgtggcagccctcttgcat

SEQ ID NO: 546097 - DNA, 25 bp, Mus musculus
caaactcgtggctgccctcttgcat

SEQ ID NO: 546098 - DNA, 25 bp, Mus musculus
caaactcgttgaagtggtgaaaaag

SEQ ID NO: 546099 - DNA, 25 bp, Mus musculus
caaactcgttgatgtggtgaaaaag

SEQ ID NO: 546100 - DNA, 25 bp, Mus musculus
caaactctcagactctgtggaagag

SEQ ID NO: 546101 - DNA, 25 bp, Mus musculus
caaactctcagagtctgtggaagag

SEQ ID NO: 546102 - DNA, 25 bp, Mus musculus
caaactctcctgctatcaatagcct

SEQ ID NO: 546103 - DNA, 25 bp, Mus musculus
caaactctcctggtatcaatagcct

SEQ ID NO: 546104 - DNA, 25 bp, Mus musculus
caaactctctggactagttgacggg

SEQ ID NO: 546105 - DNA, 25 bp, Mus musculus
caaactctctggtctagttgacggg

SEQ ID NO: 546106 - DNA, 25 bp, Mus musculus
caaactctgacccaatttgattcta

SEQ ID NO: 546107 - DNA, 25 bp, Mus musculus
caaactctgaccgaatttgattcta

SEQ ID NO: 546108 - DNA, 25 bp, Mus musculus
caaactctgagtaaaagcgttcatc

SEQ ID NO: 546109 - DNA, 25 bp, Mus musculus
caaactctgagttaaagcgttcatc

SEQ ID NO: 546110 - DNA, 25 bp, Mus musculus
caaactctggcgcaagaggaaacct

SEQ ID NO: 546111 - DNA, 25 bp, Mus musculus
caaactctggcggaagaggaaacct

SEQ ID NO: 546112 - DNA, 25 bp, Mus musculus
caaactctgtatatgctatgcaggg

SEQ ID NO: 546113 - DNA, 25 bp, Mus musculus
caaactctgtatttgctatgcaggg

SEQ ID NO: 546114 - DNA, 25 bp, Mus musculus
caaactcttcgcagggtgacctggg

SEQ ID NO: 546115 - DNA, 25 bp, Mus musculus
caaactcttcgctgggtgacctggg

SEQ ID NO: 546116 - DNA, 25 bp, Mus musculus
caaactctttggaagacctgctagg

SEQ ID NO: 546117 - DNA, 25 bp, Mus musculus
caaactctttggtagacctgctagg

SEQ ID NO: 546118 - DNA, 25 bp, Mus musculus
caaactgaaaacattctagtggcca

SEQ ID NO: 546119 - DNA, 25 bp, Mus musculus
caaactgaaaactttctagtggcca

SEQ ID NO: 546120 - DNA, 25 bp, Mus musculus
caaactgaacgacacactgctgctg

SEQ ID NO: 546121 - DNA, 25 bp, Mus musculus
caaactgaacgagacactgctgctg

SEQ ID NO: 546122 - DNA, 25 bp, Mus musculus
caaactgaagtgagaaaaaggagct

SEQ ID NO: 546123 - DNA, 25 bp, Mus musculus
caaactgaagtgtgaaaaaggagct

SEQ ID NO: 546124 - DNA, 25 bp, Mus musculus
caaactgaataaagagtatcttgag

SEQ ID NO: 546125 - DNA, 25 bp, Mus musculus
caaactgaataatgagtatcttgag

SEQ ID NO: 546126 - DNA, 25 bp, Mus musculus
caaactgaatcaagaagagccggcc

SEQ ID NO: 546127 - DNA, 25 bp, Mus musculus
caaactgaatcatgaagagccggcc

SEQ ID NO: 546128 - DNA, 25 bp, Mus musculus
caaactgatttgcaggaagcattca

SEQ ID NO: 546129 - DNA, 25 bp, Mus musculus
caaactgatttggaggaagcattca

SEQ ID NO: 546130 - DNA, 25 bp, Mus musculus
caaactgcactcactccgaagggat

SEQ ID NO: 546131 - DNA, 25 bp, Mus musculus
caaactgcactctctccgaagggat

SEQ ID NO: 546132 - DNA, 25 bp, Mus musculus
caaactgcagaacaaggtgttccag

SEQ ID NO: 546133 - DNA, 25 bp, Mus musculus
caaactgcagaagaaggtgttccag

SEQ ID NO: 546134 - DNA, 25 bp, Mus musculus
caaactgcagatcattgaggtgcct

SEQ ID NO: 546135 - DNA, 25 bp, Mus musculus
caaactgcagatgattgaggtgcct

SEQ ID NO: 546136 - DNA, 25 bp, Mus musculus
caaactgcatgaacgcaagtgtgag

SEQ ID NO: 546137 - DNA, 25 bp, Mus musculus
caaactgcatgatcgcaagtgtgag

SEQ ID NO: 546138 - DNA, 25 bp, Mus musculus
caaactgccactcagatttctgcta

SEQ ID NO: 546139 - DNA, 25 bp, Mus musculus
caaactgccactgagatttctgcta

SEQ ID NO: 546140 - DNA, 25 bp, Mus musculus
caaactgctctactgcagcaacggg

SEQ ID NO: 546141 - DNA, 25 bp, Mus musculus
caaactgctctagtgcagcaacggg

SEQ ID NO: 546142 - DNA, 25 bp, Mus musculus
caaactgctcttcatcgggaacagc

SEQ ID NO: 546143 - DNA, 25 bp, Mus musculus
caaactgctcttcattgagacccag

SEQ ID NO: 546144 - DNA, 25 bp, Mus musculus
caaactgctcttgatcgggaacagc

SEQ ID NO: 546145 - DNA, 25 bp, Mus musculus
caaactgctcttgattgagacccag

SEQ ID NO: 546146 - DNA, 25 bp, Mus musculus
caaactgcttatactgccaatcccg

SEQ ID NO: 546147 - DNA, 25 bp, Mus musculus
caaactgcttattctgccaatcccg

SEQ ID NO: 546148 - DNA, 25 bp, Mus musculus
caaactggaagtcctttatgtcctc

SEQ ID NO: 546149 - DNA, 25 bp, Mus musculus
caaactggaagtcggctaatcttgc

SEQ ID NO: 546150 - DNA, 25 bp, Mus musculus
caaactggaagtgctttatgtcctc

SEQ ID NO: 546151 - DNA, 25 bp, Mus musculus
caaactggaagtgggctaatcttgc

SEQ ID NO: 546152 - DNA, 25 bp, Mus musculus
caaactggaatgaaggcaagcatgc

SEQ ID NO: 546153 - DNA, 25 bp, Mus musculus
caaactggaatgtaggcaagcatgc

SEQ ID NO: 546154 - DNA, 25 bp, Mus musculus
caaactggacctccagcagggacag

SEQ ID NO: 546155 - DNA, 25 bp, Mus musculus
caaactggacctgcagcagggacag

SEQ ID NO: 546156 - DNA, 25 bp, Mus musculus
caaactggactcagcagtttacaag

SEQ ID NO: 546157 - DNA, 25 bp, Mus musculus
caaactggactctgcagtttacaag

SEQ ID NO: 546158 - DNA, 25 bp, Mus musculus
caaactggagataaatatgctgaag

SEQ ID NO: 546159 - DNA, 25 bp, Mus musculus
caaactggagattaatatgctgaag

SEQ ID NO: 546160 - DNA, 25 bp, Mus musculus
caaactggatgcagaaggatctaga

SEQ ID NO: 546161 - DNA, 25 bp, Mus musculus
caaactggatgctgaaggatctaga

SEQ ID NO: 546162 - DNA, 25 bp, Mus musculus
caaactggatggcaaattgatagac

SEQ ID NO: 546163 - DNA, 25 bp, Mus musculus
caaactggatgggaaattgatagac

SEQ ID NO: 546164 - DNA, 25 bp, Mus musculus
caaactggcgatctcaagggttcca

SEQ ID NO: 546165 - DNA, 25 bp, Mus musculus
caaactggcgatgtcaagggttcca

SEQ ID NO: 546166 - DNA, 25 bp, Mus musculus
caaactggcttactgctctgctcag

SEQ ID NO: 546167 - DNA, 25 bp, Mus musculus
caaactggcttagtgctctgctcag

SEQ ID NO: 546168 - DNA, 25 bp, Mus musculus
caaactggtgcccttgtggtgaatg

SEQ ID NO: 546169 - DNA, 25 bp, Mus musculus
caaactggtgccgttgtggtgaatg

SEQ ID NO: 546170 - DNA, 25 bp, Mus musculus
caaactggttacacagcagaaacgc

SEQ ID NO: 546171 - DNA, 25 bp, Mus musculus
caaactggttactcagcagaaacgc

SEQ ID NO: 546172 - DNA, 25 bp, Mus musculus
caaactggttggaatctgcggcagt

SEQ ID NO: 546173 - DNA, 25 bp, Mus musculus
caaactggttggtatctgcggcagt

SEQ ID NO: 546174 - DNA, 25 bp, Mus musculus
caaactgtcagtatggctgtgacgt

SEQ ID NO: 546175 - DNA, 25 bp, Mus musculus
caaactgtcagtttggctgtgacgt

SEQ ID NO: 546176 - DNA, 25 bp, Mus musculus
caaactgtctgtattcgtttcacct

SEQ ID NO: 546177 - DNA, 25 bp, Mus musculus
caaactgtctgttttcgtttcacct

SEQ ID NO: 546178 - DNA, 25 bp, Mus musculus
caaactgtggagaaatattgaacct

SEQ ID NO: 546179 - DNA, 25 bp, Mus musculus
caaactgtggagtaatattgaacct

SEQ ID NO: 546180 - DNA, 25 bp, Mus musculus
caaactgttcccagagtcagtcatc

SEQ ID NO: 546181 - DNA, 25 bp, Mus musculus
caaactgttccctgagtcagtcatc

SEQ ID NO: 546182 - DNA, 25 bp, Mus musculus
caaacttactagagctaaaaatgac

SEQ ID NO: 546183 - DNA, 25 bp, Mus musculus
caaacttactagtgctaaaaatgac

SEQ ID NO: 546184 - DNA, 25 bp, Mus musculus
caaacttactgtctcaccaaggatg

SEQ ID NO: 546185 - DNA, 25 bp, Mus musculus
caaacttactgtgtcaccaaggatg

SEQ ID NO: 546186 - DNA, 25 bp, Mus musculus
caaacttcaagtctacctgtcagcg

SEQ ID NO: 546187 - DNA, 25 bp, Mus musculus
caaacttcaagtgtacctgtcagcg

SEQ ID NO: 546188 - DNA, 25 bp, Mus musculus
caaacttcacagaaagagacaacag

SEQ ID NO: 546189 - DNA, 25 bp, Mus musculus
caaacttcacagtaagagacaacag

SEQ ID NO: 546190 - DNA, 25 bp, Mus musculus
caaacttcataaatggtgacgtgac

SEQ ID NO: 546191 - DNA, 25 bp, Mus musculus
caaacttcataattggtgacgtgac

SEQ ID NO: 546192 - DNA, 25 bp, Mus musculus
caaacttcatgacagcgtgggtccc

SEQ ID NO: 546193 - DNA, 25 bp, Mus musculus
caaacttcatgagagcgtgggtccc

SEQ ID NO: 546194 - DNA, 25 bp, Mus musculus
caaacttccaaaagatagggtgagc

SEQ ID NO: 546195 - DNA, 25 bp, Mus musculus
caaacttccaaatgatagggtgagc

SEQ ID NO: 546196 - DNA, 25 bp, Mus musculus
caaacttcctcaacctttgctgcag

SEQ ID NO: 546197 - DNA, 25 bp, Mus musculus
caaacttcctcatcctttgctgcag

SEQ ID NO: 546198 - DNA, 25 bp, Mus musculus
caaacttcgatgaatttccagagtc

SEQ ID NO: 546199 - DNA, 25 bp, Mus musculus
caaacttcgatgtatttccagagtc

SEQ ID NO: 546200 - DNA, 25 bp, Mus musculus
caaacttctctaaagccgaaaagaa

SEQ ID NO: 546201 - DNA, 25 bp, Mus musculus
caaacttctctatagccgaaaagaa

SEQ ID NO: 546202 - DNA, 25 bp, Mus musculus
caaacttgaagaaaaaccccagcag

SEQ ID NO: 546203 - DNA, 25 bp, Mus musculus
caaacttgaagataaaccccagcag

SEQ ID NO: 546204 - DNA, 25 bp, Mus musculus
caaacttgacatcacggaagaaaca

SEQ ID NO: 546205 - DNA, 25 bp, Mus musculus
caaacttgacatgacggaagaaaca

SEQ ID NO: 546206 - DNA, 25 bp, Mus musculus
caaacttgacctatggagatgttgc

SEQ ID NO: 546207 - DNA, 25 bp, Mus musculus
caaacttgacctttggagatgttgc

SEQ ID NO: 546208 - DNA, 25 bp, Mus musculus
caaacttgagtgctctcggcttcac

SEQ ID NO: 546209 - DNA, 25 bp, Mus musculus
caaacttgagtggtctcggcttcac

SEQ ID NO: 546210 - DNA, 25 bp, Mus musculus
caaacttgatgaagccaacgatgca

SEQ ID NO: 546211 - DNA, 25 bp, Mus musculus
caaacttgatgatgccaacgatgca

SEQ ID NO: 546212 - DNA, 25 bp, Mus musculus
caaacttgctcaacacggtgaagca

SEQ ID NO: 546213 - DNA, 25 bp, Mus musculus
caaacttgctcatcacggtgaagca

SEQ ID NO: 546214 - DNA, 25 bp, Mus musculus
caaacttgtcaactgcttcaacggc

SEQ ID NO: 546215 - DNA, 25 bp, Mus musculus
caaacttgtcaagtgcttcaacggc

SEQ ID NO: 546216 - DNA, 25 bp, Mus musculus
caaactttaagtagctgcttatgag

SEQ ID NO: 546217 - DNA, 25 bp, Mus musculus
caaactttaagttgctgcttatgag

SEQ ID NO: 546218 - DNA, 25 bp, Mus musculus
caaactttactacagcttcccctgg

SEQ ID NO: 546219 - DNA, 25 bp, Mus musculus
caaactttactagagcttcccctgg

SEQ ID NO: 546220 - DNA, 25 bp, Mus musculus
caaacttttccgagggagcttgcaa

SEQ ID NO: 546221 - DNA, 25 bp, Mus musculus
caaacttttccgtgggagcttgcaa

SEQ ID NO: 546222 - DNA, 25 bp, Mus musculus
caaacttttctgatcctacattagg

SEQ ID NO: 546223 - DNA, 25 bp, Mus musculus
caaacttttctgttcctacattagg

SEQ ID NO: 546224 - DNA, 25 bp, Mus musculus
caaagaaaaactcgacactattgct

SEQ ID NO: 546225 - DNA, 25 bp, Mus musculus
caaagaaaaactggacactattgct

SEQ ID NO: 546226 - DNA, 25 bp, Mus musculus
caaagaaaagctcacgcaggctgcc

SEQ ID NO: 546227 - DNA, 25 bp, Mus musculus
caaagaaaagctgacgcaggctgcc

SEQ ID NO: 546228 - DNA, 25 bp, Mus musculus
caaagaaaatacagtctacttacag

SEQ ID NO: 546229 - DNA, 25 bp, Mus musculus
caaagaaaatactgtctacttacag

SEQ ID NO: 546230 - DNA, 25 bp, Mus musculus
caaagaaactctctgcggagtgtgc

SEQ ID NO: 546231 - DNA, 25 bp, Mus musculus
caaagaaactctgtgcggagtgtgc

SEQ ID NO: 546232 - DNA, 25 bp, Mus musculus
caaagaaactgtcgattcagttcaa

SEQ ID NO: 546233 - DNA, 25 bp, Mus musculus
caaagaaactgtggattcagttcaa

SEQ ID NO: 546234 - DNA, 25 bp, Mus musculus
caaagaaagcacatcgtctgtatcc

SEQ ID NO: 546235 - DNA, 25 bp, Mus musculus
caaagaaagcacttcgtctgtatcc

SEQ ID NO: 546236 - DNA, 25 bp, Mus musculus
caaagaaaggtcaagctcccgaggt

SEQ ID NO: 546237 - DNA, 25 bp, Mus musculus
caaagaaaggtctagctcccgaggt

SEQ ID NO: 546238 - DNA, 25 bp, Mus musculus
caaagaaatctgagcttcaggagga

SEQ ID NO: 546239 - DNA, 25 bp, Mus musculus
caaagaaatctgtgcttcaggagga

SEQ ID NO: 546240 - DNA, 25 bp, Mus musculus
caaagaacaatacacctcatgccag

SEQ ID NO: 546241 - DNA, 25 bp, Mus musculus
caaagaacaatagacctcatgccag

SEQ ID NO: 546242 - DNA, 25 bp, Mus musculus
caaagaacaccccattctggattct

SEQ ID NO: 546243 - DNA, 25 bp, Mus musculus
caaagaacacccgattctggattct

SEQ ID NO: 546244 - DNA, 25 bp, Mus musculus
caaagaacagatcaggaagtacaag

SEQ ID NO: 546245 - DNA, 25 bp, Mus musculus
caaagaacagatgaggaagtacaag

SEQ ID NO: 546246 - DNA, 25 bp, Mus musculus
caaagaacaggcaatcagcacaggc

SEQ ID NO: 546247 - DNA, 25 bp, Mus musculus
caaagaacaggctatcagcacaggc

SEQ ID NO: 546248 - DNA, 25 bp, Mus musculus
caaagaaccagaaagaccagtgcag

SEQ ID NO: 546249 - DNA, 25 bp, Mus musculus
caaagaaccagatagaccagtgcag

SEQ ID NO: 546250 - DNA, 25 bp, Mus musculus
caaagaacggcgatggtacgaagcg

SEQ ID NO: 546251 - DNA, 25 bp, Mus musculus
caaagaacggcgttggtacgaagcg

SEQ ID NO: 546252 - DNA, 25 bp, Mus musculus
caaagaacttagaagtcagccgtaa

SEQ ID NO: 546253 - DNA, 25 bp, Mus musculus
caaagaacttagtagtcagccgtaa

SEQ ID NO: 546254 - DNA, 25 bp, Mus musculus
caaagaagaaacagcgatggactcc

SEQ ID NO: 546255 - DNA, 25 bp, Mus musculus
caaagaagaaactgcgatggactcc

SEQ ID NO: 546256 - DNA, 25 bp, Mus musculus
caaagaagacgtaaggctacaggcc

SEQ ID NO: 546257 - DNA, 25 bp, Mus musculus
caaagaagacgttaggctacaggcc

SEQ ID NO: 546258 - DNA, 25 bp, Mus musculus
caaagaagagaccatttgtaaactg

SEQ ID NO: 546259 - DNA, 25 bp, Mus musculus
caaagaagagacctctgtggatgcc

SEQ ID NO: 546260 - DNA, 25 bp, Mus musculus
caaagaagagacgatttgtaaactg

SEQ ID NO: 546261 - DNA, 25 bp, Mus musculus
caaagaagagacgtctgtggatgcc

SEQ ID NO: 546262 - DNA, 25 bp, Mus musculus
caaagaagcaaaactcatgcacctt

SEQ ID NO: 546263 - DNA, 25 bp, Mus musculus
caaagaagcaaatctcatgcacctt

SEQ ID NO: 546264 - DNA, 25 bp, Mus musculus
caaagaagcacccacacagtgtgat

SEQ ID NO: 546265 - DNA, 25 bp, Mus musculus
caaagaagcaccgacacagtgtgat

SEQ ID NO: 546266 - DNA, 25 bp, Mus musculus
caaagaagccatcagggagcatcag

SEQ ID NO: 546267 - DNA, 25 bp, Mus musculus
caaagaagccatgagggagcatcag

SEQ ID NO: 546268 - DNA, 25 bp, Mus musculus
caaagaagccgtatagctgccatga

SEQ ID NO: 546269 - DNA, 25 bp, Mus musculus
caaagaagccgtttagctgccatga

SEQ ID NO: 546270 - DNA, 25 bp, Mus musculus
caaagaagcgaccaacagcaagcca

SEQ ID NO: 546271 - DNA, 25 bp, Mus musculus
caaagaagcgacgaacagcaagcca

SEQ ID NO: 546272 - DNA, 25 bp, Mus musculus
caaagaagcttccaagatcctgtcc

SEQ ID NO: 546273 - DNA, 25 bp, Mus musculus
caaagaagcttcgaagatcctgtcc

SEQ ID NO: 546274 - DNA, 25 bp, Mus musculus
caaagaaggctcaggtggatcgccg

SEQ ID NO: 546275 - DNA, 25 bp, Mus musculus
caaagaaggctctggtggatcgccg

SEQ ID NO: 546276 - DNA, 25 bp, Mus musculus
caaagaagtccccaggttcaggatg

SEQ ID NO: 546277 - DNA, 25 bp, Mus musculus
caaagaagtcccgaggttcaggatg

SEQ ID NO: 546278 - DNA, 25 bp, Mus musculus
caaagaagtctaaggctgatggtca

SEQ ID NO: 546279 - DNA, 25 bp, Mus musculus
caaagaagtctatggctgatggtca

SEQ ID NO: 546280 - DNA, 25 bp, Mus musculus
caaagaagtgctccctgccttggag

SEQ ID NO: 546281 - DNA, 25 bp, Mus musculus
caaagaagtgctgcctgccttggag

SEQ ID NO: 546282 - DNA, 25 bp, Mus musculus
caaagaatcacacatgagagaaagc

SEQ ID NO: 546283 - DNA, 25 bp, Mus musculus
caaagaatcacagatgagagaaagc

SEQ ID NO: 546284 - DNA, 25 bp, Mus musculus
caaagaatcggcctggcaatgcctt

SEQ ID NO: 546285 - DNA, 25 bp, Mus musculus
caaagaatcggcgtggcaatgcctt

SEQ ID NO: 546286 - DNA, 25 bp, Mus musculus
caaagaatctcaccaacctaagcag

SEQ ID NO: 546287 - DNA, 25 bp, Mus musculus
caaagaatctcagcaacctaagcag

SEQ ID NO: 546288 - DNA, 25 bp, Mus musculus
caaagaattcaaacggaggattcgc

SEQ ID NO: 546289 - DNA, 25 bp, Mus musculus
caaagaattcaatcggaggattcgc

SEQ ID NO: 546290 - DNA, 25 bp, Mus musculus
caaagacaatttatccctccgcaga

SEQ ID NO: 546291 - DNA, 25 bp, Mus musculus
caaagacaatttttccctccgcaga

SEQ ID NO: 546292 - DNA, 25 bp, Mus musculus
caaagacactaacctgctaatactc

SEQ ID NO: 546293 - DNA, 25 bp, Mus musculus
caaagacactaagctgctaatactc

SEQ ID NO: 546294 - DNA, 25 bp, Mus musculus
caaagacagccgcttacgtgggaat

SEQ ID NO: 546295 - DNA, 25 bp, Mus musculus
caaagacagccggttacgtgggaat

SEQ ID NO: 546296 - DNA, 25 bp, Mus musculus
caaagacaggcaaactggaaatgag

SEQ ID NO: 546297 - DNA, 25 bp, Mus musculus
caaagacaggcatactggaaatgag

SEQ ID NO: 546298 - DNA, 25 bp, Mus musculus
caaagacaggctcctctgtgagcaa

SEQ ID NO: 546299 - DNA, 25 bp, Mus musculus
caaagacaggctgctctgtgagcaa

SEQ ID NO: 546300 - DNA, 25 bp, Mus musculus
caaagacatccacggctccttgcag

SEQ ID NO: 546301 - DNA, 25 bp, Mus musculus
caaagacatccagggctccttgcag

SEQ ID NO: 546302 - DNA, 25 bp, Mus musculus
caaagacatgtaacacgccagcaag

SEQ ID NO: 546303 - DNA, 25 bp, Mus musculus
caaagacatgtatcacgccagcaag

SEQ ID NO: 546304 - DNA, 25 bp, Mus musculus
caaagacatgtcacgcaatgggagc

SEQ ID NO: 546305 - DNA, 25 bp, Mus musculus
caaagacatgtctcgcaatgggagc

SEQ ID NO: 546306 - DNA, 25 bp, Mus musculus
caaagaccacagagccatgcagggt

SEQ ID NO: 546307 - DNA, 25 bp, Mus musculus
caaagaccacagtgccatgcagggt

SEQ ID NO: 546308 - DNA, 25 bp, Mus musculus
caaagaccatttctgtcccttggga

SEQ ID NO: 546309 - DNA, 25 bp, Mus musculus
caaagaccatttgtgtcccttggga

SEQ ID NO: 546310 - DNA, 25 bp, Mus musculus
caaagacccaagaatgtagtaggag

SEQ ID NO: 546311 - DNA, 25 bp, Mus musculus
caaagacccaagtatgtagtaggag

SEQ ID NO: 546312 - DNA, 25 bp, Mus musculus
caaagacccaatccacttgctgttc

SEQ ID NO: 546313 - DNA, 25 bp, Mus musculus
caaagacccaatgcacttgctgttc

SEQ ID NO: 546314 - DNA, 25 bp, Mus musculus
caaagacccagactgtgtaaacaat

SEQ ID NO: 546315 - DNA, 25 bp, Mus musculus
caaagacccagagtgtgtaaacaat

SEQ ID NO: 546316 - DNA, 25 bp, Mus musculus
caaagacctggaaggatttaaggca

SEQ ID NO: 546317 - DNA, 25 bp, Mus musculus
caaagacctggatggatttaaggca

SEQ ID NO: 546318 - DNA, 25 bp, Mus musculus
caaagacctgtgaggcgagcgagtc

SEQ ID NO: 546319 - DNA, 25 bp, Mus musculus
caaagacctgtgatgggaatgagag

SEQ ID NO: 546320 - DNA, 25 bp, Mus musculus
caaagacctgtgtggcgagcgagtc

SEQ ID NO: 546321 - DNA, 25 bp, Mus musculus
caaagacctgtgttgggaatgagag

SEQ ID NO: 546322 - DNA, 25 bp, Mus musculus
caaagacgagtgcaaagacttgacc

SEQ ID NO: 546323 - DNA, 25 bp, Mus musculus
caaagacgagtggaaagacttgacc

SEQ ID NO: 546324 - DNA, 25 bp, Mus musculus
caaagacgctttagcaaacaggcac

SEQ ID NO: 546325 - DNA, 25 bp, Mus musculus
caaagacgcttttgcaaacaggcac

SEQ ID NO: 546326 - DNA, 25 bp, Mus musculus
caaagacggaagcttcgtgttgacc

SEQ ID NO: 546327 - DNA, 25 bp, Mus musculus
caaagacggaaggttcgtgttgacc

SEQ ID NO: 546328 - DNA, 25 bp, Mus musculus
caaagacggaataagactggttcct

SEQ ID NO: 546329 - DNA, 25 bp, Mus musculus
caaagacggaattagactggttcct

SEQ ID NO: 546330 - DNA, 25 bp, Mus musculus
caaagacggacacgccttgcagctg

SEQ ID NO: 546331 - DNA, 25 bp, Mus musculus
caaagacggacaggccttgcagctg

SEQ ID NO: 546332 - DNA, 25 bp, Mus musculus
caaagacggcaaagtactgcttcat

SEQ ID NO: 546333 - DNA, 25 bp, Mus musculus
caaagacggcaatgtactgcttcat

SEQ ID NO: 546334 - DNA, 25 bp, Mus musculus
caaagacgtgaactcggaagtcgcc

SEQ ID NO: 546335 - DNA, 25 bp, Mus musculus
caaagacgtgaagtcggaagtcgcc

SEQ ID NO: 546336 - DNA, 25 bp, Mus musculus
caaagacgttttcaagctctgcaca

SEQ ID NO: 546337 - DNA, 25 bp, Mus musculus
caaagacgttttgaagctctgcaca

SEQ ID NO: 546338 - DNA, 25 bp, Mus musculus
caaagactacttagaggagcctgag

SEQ ID NO: 546339 - DNA, 25 bp, Mus musculus
caaagactacttcttcaaggcggcc

SEQ ID NO: 546340 - DNA, 25 bp, Mus musculus
caaagactacttgttcaaggcggcc

SEQ ID NO: 546341 - DNA, 25 bp, Mus musculus
caaagactactttgaggagcctgag

SEQ ID NO: 546342 - DNA, 25 bp, Mus musculus
caaagactcctaactgatcctggag

SEQ ID NO: 546343 - DNA, 25 bp, Mus musculus
caaagactcctatctgatcctggag

SEQ ID NO: 546344 - DNA, 25 bp, Mus musculus
caaagactggaacatgccttcaaca

SEQ ID NO: 546345 - DNA, 25 bp, Mus musculus
caaagactggaagatgccttcaaca

SEQ ID NO: 546346 - DNA, 25 bp, Mus musculus
caaagactggatcttgtatgccgag

SEQ ID NO: 546347 - DNA, 25 bp, Mus musculus
caaagactggatgttgtatgccgag

SEQ ID NO: 546348 - DNA, 25 bp, Mus musculus
caaagactgtggcacgaggttttga

SEQ ID NO: 546349 - DNA, 25 bp, Mus musculus
caaagactgtgggacgaggttttga

SEQ ID NO: 546350 - DNA, 25 bp, Mus musculus
caaagactgtgtaggcgatgtgaca

SEQ ID NO: 546351 - DNA, 25 bp, Mus musculus
caaagactgtgttggcgatgtgaca

SEQ ID NO: 546352 - DNA, 25 bp, Mus musculus
caaagacttaacaggagctggagag

SEQ ID NO: 546353 - DNA, 25 bp, Mus musculus
caaagacttaactggagctggagag

SEQ ID NO: 546354 - DNA, 25 bp, Mus musculus
caaagacttgggacatggattgtag

SEQ ID NO: 546355 - DNA, 25 bp, Mus musculus
caaagacttgggtcatggattgtag

SEQ ID NO: 546356 - DNA, 25 bp, Mus musculus
caaagactttgtcatcatccgtcgg

SEQ ID NO: 546357 - DNA, 25 bp, Mus musculus
caaagactttgtgatcatccgtcgg

SEQ ID NO: 546358 - DNA, 25 bp, Mus musculus
caaagagaaagaaatgaccagcgct

SEQ ID NO: 546359 - DNA, 25 bp, Mus musculus
caaagagaaagatatgaccagcgct

SEQ ID NO: 546360 - DNA, 25 bp, Mus musculus
caaagagaacgccttggatcgagct

SEQ ID NO: 546361 - DNA, 25 bp, Mus musculus
caaagagaacgcgttggatcgagct

SEQ ID NO: 546362 - DNA, 25 bp, Mus musculus
caaagagaaggtactggtgaccacc

SEQ ID NO: 546363 - DNA, 25 bp, Mus musculus
caaagagaaggttctggtgaccacc

SEQ ID NO: 546364 - DNA, 25 bp, Mus musculus
caaagagaatgtactggaccgagct

SEQ ID NO: 546365 - DNA, 25 bp, Mus musculus
caaagagaatgttctggaccgagct

SEQ ID NO: 546366 - DNA, 25 bp, Mus musculus
caaagagactgtctactctgccttc

SEQ ID NO: 546367 - DNA, 25 bp, Mus musculus
caaagagactgtgtactctgccttc

SEQ ID NO: 546368 - DNA, 25 bp, Mus musculus
caaagagacttgaacagacggaatc

SEQ ID NO: 546369 - DNA, 25 bp, Mus musculus
caaagagacttgtacagacggaatc

SEQ ID NO: 546370 - DNA, 25 bp, Mus musculus
caaagagactttccgatttataagt

SEQ ID NO: 546371 - DNA, 25 bp, Mus musculus
caaagagactttgcgatttataagt

SEQ ID NO: 546372 - DNA, 25 bp, Mus musculus
caaagagaggtaatttgaccgaatc

SEQ ID NO: 546373 - DNA, 25 bp, Mus musculus
caaagagaggtattttgaccgaatc

SEQ ID NO: 546374 - DNA, 25 bp, Mus musculus
caaagagagtgaagaggctctgcag

SEQ ID NO: 546375 - DNA, 25 bp, Mus musculus
caaagagagtgatgaggctctgcag

SEQ ID NO: 546376 - DNA, 25 bp, Mus musculus
caaagagcaactcgcacctgttgga

SEQ ID NO: 546377 - DNA, 25 bp, Mus musculus
caaagagcaactggcacctgttgga

SEQ ID NO: 546378 - DNA, 25 bp, Mus musculus
caaagagcagaaccccgagaaagga

SEQ ID NO: 546379 - DNA, 25 bp, Mus musculus
caaagagcagaagcccgagaaagga

SEQ ID NO: 546380 - DNA, 25 bp, Mus musculus
caaagagcagcgatcctgagactgg

SEQ ID NO: 546381 - DNA, 25 bp, Mus musculus
caaagagcagcgttcctgagactgg

SEQ ID NO: 546382 - DNA, 25 bp, Mus musculus
caaagagcatcgagactctgcgagt

SEQ ID NO: 546383 - DNA, 25 bp, Mus musculus
caaagagcatcgtgactctgcgagt

SEQ ID NO: 546384 - DNA, 25 bp, Mus musculus
caaagagccacaaccaggcctgagg

SEQ ID NO: 546385 - DNA, 25 bp, Mus musculus
caaagagccacatccaggcctgagg

SEQ ID NO: 546386 - DNA, 25 bp, Mus musculus
caaagagcccagaagagaaaacatg

SEQ ID NO: 546387 - DNA, 25 bp, Mus musculus
caaagagcccagaggtagtgcttcc

SEQ ID NO: 546388 - DNA, 25 bp, Mus musculus
caaagagcccagtagagaaaacatg

SEQ ID NO: 546389 - DNA, 25 bp, Mus musculus
caaagagcccagtggtagtgcttcc

SEQ ID NO: 546390 - DNA, 25 bp, Mus musculus
caaagagcctcccatgaaatcagaa

SEQ ID NO: 546391 - DNA, 25 bp, Mus musculus
caaagagcctccgatgaaatcagaa

SEQ ID NO: 546392 - DNA, 25 bp, Mus musculus
caaagagcgagtactccgtaggccc

SEQ ID NO: 546393 - DNA, 25 bp, Mus musculus
caaagagcgagttctccgtaggccc

SEQ ID NO: 546394 - DNA, 25 bp, Mus musculus
caaagagcgcctctcagtggaatgt

SEQ ID NO: 546395 - DNA, 25 bp, Mus musculus
caaagagcgcctgtcagtggaatgt

SEQ ID NO: 546396 - DNA, 25 bp, Mus musculus
caaagagcggatccttgatgttccc

SEQ ID NO: 546397 - DNA, 25 bp, Mus musculus
caaagagcggatgcttgatgttccc

SEQ ID NO: 546398 - DNA, 25 bp, Mus musculus
caaagagctataagccctgggagtc

SEQ ID NO: 546399 - DNA, 25 bp, Mus musculus
caaagagctatatgccctgggagtc

SEQ ID NO: 546400 - DNA, 25 bp, Mus musculus
caaagagctcacagtcatcaagaag

SEQ ID NO: 546401 - DNA, 25 bp, Mus musculus
caaagagctcactgtcatcaagaag

SEQ ID NO: 546402 - DNA, 25 bp, Mus musculus
caaagagctcgtccctcaagaagaa

SEQ ID NO: 546403 - DNA, 25 bp, Mus musculus
caaagagctcgtgcctcaagaagaa

SEQ ID NO: 546404 - DNA, 25 bp, Mus musculus
caaagagctgataaaccgaatagag

SEQ ID NO: 546405 - DNA, 25 bp, Mus musculus
caaagagctgattaaccgaatagag

SEQ ID NO: 546406 - DNA, 25 bp, Mus musculus
caaagaggaagtaggtgccctggcc

SEQ ID NO: 546407 - DNA, 25 bp, Mus musculus
caaagaggaagttggtgccctggcc

SEQ ID NO: 546408 - DNA, 25 bp, Mus musculus
caaagaggccgtcgtactgaagctc

SEQ ID NO: 546409 - DNA, 25 bp, Mus musculus
caaagaggccgtggtactgaagctc

SEQ ID NO: 546410 - DNA, 25 bp, Mus musculus
caaagaggcggtatcatgttactat

SEQ ID NO: 546411 - DNA, 25 bp, Mus musculus
caaagaggcggtttcatgttactat

SEQ ID NO: 546412 - DNA, 25 bp, Mus musculus
caaagaggctctcacagaggagaag

SEQ ID NO: 546413 - DNA, 25 bp, Mus musculus
caaagaggctctgacagaggagaag

SEQ ID NO: 546414 - DNA, 25 bp, Mus musculus
caaagagggacaagcaggaaaattt

SEQ ID NO: 546415 - DNA, 25 bp, Mus musculus
caaagagggacatgcaggaaaattt

SEQ ID NO: 546416 - DNA, 25 bp, Mus musculus
caaagagggagacaccgtcattatc

SEQ ID NO: 546417 - DNA, 25 bp, Mus musculus
caaagagggagagaccgtcattatc

SEQ ID NO: 546418 - DNA, 25 bp, Mus musculus
caaagagggcccactggtgcatgtg

SEQ ID NO: 546419 - DNA, 25 bp, Mus musculus
caaagagggccctctggtgcatgtg

SEQ ID NO: 546420 - DNA, 25 bp, Mus musculus
caaagagggtaacagcctgctcaac

SEQ ID NO: 546421 - DNA, 25 bp, Mus musculus
caaagagggtaagagcctgctcaac

SEQ ID NO: 546422 - DNA, 25 bp, Mus musculus
caaagaggtcatagtggctgctgag

SEQ ID NO: 546423 - DNA, 25 bp, Mus musculus
caaagaggtcattgtggctgctgag

SEQ ID NO: 546424 - DNA, 25 bp, Mus musculus
caaagagtactgaaaaaccaccagg

SEQ ID NO: 546425 - DNA, 25 bp, Mus musculus
caaagagtactgtaaaaccaccagg

SEQ ID NO: 546426 - DNA, 25 bp, Mus musculus
caaagagtatgacaaacttgaatcc

SEQ ID NO: 546427 - DNA, 25 bp, Mus musculus
caaagagtatgagaaacttgaatcc

SEQ ID NO: 546428 - DNA, 25 bp, Mus musculus
caaagagtcaagctggggagccaac

SEQ ID NO: 546429 - DNA, 25 bp, Mus musculus
caaagagtcaaggtggggagccaac

SEQ ID NO: 546430 - DNA, 25 bp, Mus musculus
caaagagtcagtcaggacgtccctg

SEQ ID NO: 546431 - DNA, 25 bp, Mus musculus
caaagagtcagtgaggacgtccctg

SEQ ID NO: 546432 - DNA, 25 bp, Mus musculus
caaagagtccctcttcatttgaggg

SEQ ID NO: 546433 - DNA, 25 bp, Mus musculus
caaagagtccctgttcatttgaggg

SEQ ID NO: 546434 - DNA, 25 bp, Mus musculus
caaagagtctgcagagatacgggat

SEQ ID NO: 546435 - DNA, 25 bp, Mus musculus
caaagagtctgctgagatacgggat

SEQ ID NO: 546436 - DNA, 25 bp, Mus musculus
caaagagtgtagctgtgtcccaata

SEQ ID NO: 546437 - DNA, 25 bp, Mus musculus
caaagagtgtaggtgtgtcccaata

SEQ ID NO: 546438 - DNA, 25 bp, Mus musculus
caaagagtttaaccctgaccaccga

SEQ ID NO: 546439 - DNA, 25 bp, Mus musculus
caaagagtttaagcctgaccaccga

SEQ ID NO: 546440 - DNA, 25 bp, Mus musculus
caaagagtttagaagatcaaaaagg

SEQ ID NO: 546441 - DNA, 25 bp, Mus musculus
caaagagtttagtagatcaaaaagg

SEQ ID NO: 546442 - DNA, 25 bp, Mus musculus
caaagataacaacgttgtattcaac

SEQ ID NO: 546443 - DNA, 25 bp, Mus musculus
caaagataacaaggttgtattcaac

SEQ ID NO: 546444 - DNA, 25 bp, Mus musculus
caaagataagagcaaccagtgtcgt

SEQ ID NO: 546445 - DNA, 25 bp, Mus musculus
caaagataagaggaaccagtgtcgt

SEQ ID NO: 546446 - DNA, 25 bp, Mus musculus
caaagatacttccatgcatctaggc

SEQ ID NO: 546447 - DNA, 25 bp, Mus musculus
caaagatacttcgatgcatctaggc

SEQ ID NO: 546448 - DNA, 25 bp, Mus musculus
caaagatactttcagtcccgatgag

SEQ ID NO: 546449 - DNA, 25 bp, Mus musculus
caaagatactttgagtcccgatgag

SEQ ID NO: 546450 - DNA, 25 bp, Mus musculus
caaagatagagtacctggacctgag

SEQ ID NO: 546451 - DNA, 25 bp, Mus musculus
caaagatagagttcctggacctgag

SEQ ID NO: 546452 - DNA, 25 bp, Mus musculus
caaagataggcaaatttgcagttca

SEQ ID NO: 546453 - DNA, 25 bp, Mus musculus
caaagataggcatatttgcagttca

SEQ ID NO: 546454 - DNA, 25 bp, Mus musculus
caaagatatagtcaaacagttcagg

SEQ ID NO: 546455 - DNA, 25 bp, Mus musculus
caaagatatagtgaaacagttcagg

SEQ ID NO: 546456 - DNA, 25 bp, Mus musculus
caaagatattgtagcactgatggtc

SEQ ID NO: 546457 - DNA, 25 bp, Mus musculus
caaagatattgttgcactgatggtc

SEQ ID NO: 546458 - DNA, 25 bp, Mus musculus
caaagatccctcatgtggtcaggag

SEQ ID NO: 546459 - DNA, 25 bp, Mus musculus
caaagatccctcttgtggtcaggag

SEQ ID NO: 546460 - DNA, 25 bp, Mus musculus
caaagatcgccaatggtctgctgga

SEQ ID NO: 546461 - DNA, 25 bp, Mus musculus
caaagatcgccattggtctgctgga

SEQ ID NO: 546462 - DNA, 25 bp, Mus musculus
caaagatcggctacccttggagtga

SEQ ID NO: 546463 - DNA, 25 bp, Mus musculus
caaagatcggcttcccttggagtga

SEQ ID NO: 546464 - DNA, 25 bp, Mus musculus
caaagatctgacagagctggtccag

SEQ ID NO: 546465 - DNA, 25 bp, Mus musculus
caaagatctgactgagctggtccag

SEQ ID NO: 546466 - DNA, 25 bp, Mus musculus
caaagatctggtatcctgtgcctat

SEQ ID NO: 546467 - DNA, 25 bp, Mus musculus
caaagatctggtttcctgtgcctat

SEQ ID NO: 546468 - DNA, 25 bp, Mus musculus
caaagatcttgtaagttctgaggca

SEQ ID NO: 546469 - DNA, 25 bp, Mus musculus
caaagatcttgttagttctgaggca

SEQ ID NO: 546470 - DNA, 25 bp, Mus musculus
caaagatgactgaaaagcgcaccca

SEQ ID NO: 546471 - DNA, 25 bp, Mus musculus
caaagatgactgtaaagcgcaccca

SEQ ID NO: 546472 - DNA, 25 bp, Mus musculus
caaagatgatgacttctatcagcag

SEQ ID NO: 546473 - DNA, 25 bp, Mus musculus
caaagatgatgagttctatcagcag

SEQ ID NO: 546474 - DNA, 25 bp, Mus musculus
caaagatgccatccaactttggagg

SEQ ID NO: 546475 - DNA, 25 bp, Mus musculus
caaagatgccatgcaactttggagg

SEQ ID NO: 546476 - DNA, 25 bp, Mus musculus
caaagatgccttccgagcagtgaag

SEQ ID NO: 546477 - DNA, 25 bp, Mus musculus
caaagatgccttgcgagcagtgaag

SEQ ID NO: 546478 - DNA, 25 bp, Mus musculus
caaagatgctatacttcgagcaacg

SEQ ID NO: 546479 - DNA, 25 bp, Mus musculus
caaagatgctattcttcgagcaacg

SEQ ID NO: 546480 - DNA, 25 bp, Mus musculus
caaagatggacgagacggtgccaag

SEQ ID NO: 546481 - DNA, 25 bp, Mus musculus
caaagatggacgtgacggtgccaag

SEQ ID NO: 546482 - DNA, 25 bp, Mus musculus
caaagatggagaatacactacagtg

SEQ ID NO: 546483 - DNA, 25 bp, Mus musculus
caaagatggagattacactacagtg

SEQ ID NO: 546484 - DNA, 25 bp, Mus musculus
caaagatggagtagaaagcaacgct

SEQ ID NO: 546485 - DNA, 25 bp, Mus musculus
caaagatggagttgaaagcaacgct

SEQ ID NO: 546486 - DNA, 25 bp, Mus musculus
caaagatggcagagttgccattgcc

SEQ ID NO: 546487 - DNA, 25 bp, Mus musculus
caaagatggcagtgttgccattgcc

SEQ ID NO: 546488 - DNA, 25 bp, Mus musculus
caaagatggcccaaaagtgttggag

SEQ ID NO: 546489 - DNA, 25 bp, Mus musculus
caaagatggccctaaagtgttggag

SEQ ID NO: 546490 - DNA, 25 bp, Mus musculus
caaagatggcggcaggaaccagcaa

SEQ ID NO: 546491 - DNA, 25 bp, Mus musculus
caaagatggcgggaggaaccagcaa

SEQ ID NO: 546492 - DNA, 25 bp, Mus musculus
caaagatggctacatcactaaagaa

SEQ ID NO: 546493 - DNA, 25 bp, Mus musculus
caaagatggctagatcactaaagaa

SEQ ID NO: 546494 - DNA, 25 bp, Mus musculus
caaagatggctgaagaaacggagga

SEQ ID NO: 546495 - DNA, 25 bp, Mus musculus
caaagatggctgtagaaacggagga

SEQ ID NO: 546496 - DNA, 25 bp, Mus musculus
caaagatgtcaactccaaactgagc

SEQ ID NO: 546497 - DNA, 25 bp, Mus musculus
caaagatgtcaagtccaaactgagc

SEQ ID NO: 546498 - DNA, 25 bp, Mus musculus
caaagatgtcggaagattcagaggt

SEQ ID NO: 546499 - DNA, 25 bp, Mus musculus
caaagatgtcggtagattcagaggt

SEQ ID NO: 546500 - DNA, 25 bp, Mus musculus
caaagatgtcgtcgctgtgatcatg

SEQ ID NO: 546501 - DNA, 25 bp, Mus musculus
caaagatgtcgtggctgtgatcatg

SEQ ID NO: 546502 - DNA, 25 bp, Mus musculus
caaagatgtctcacgcatgcgctca

SEQ ID NO: 546503 - DNA, 25 bp, Mus musculus
caaagatgtctctcgcatgcgctca

SEQ ID NO: 546504 - DNA, 25 bp, Mus musculus
caaagatgtgctacgagatgtgtgg

SEQ ID NO: 546505 - DNA, 25 bp, Mus musculus
caaagatgtgcttcgagatgtgtgg

SEQ ID NO: 546506 - DNA, 25 bp, Mus musculus
caaagatgtgggacggaagcctcct

SEQ ID NO: 546507 - DNA, 25 bp, Mus musculus
caaagatgtgggtcggaagcctcct

SEQ ID NO: 546508 - DNA, 25 bp, Mus musculus
caaagatgtgtcacatgtactcaag

SEQ ID NO: 546509 - DNA, 25 bp, Mus musculus
caaagatgtgtctcatgtactcaag

SEQ ID NO: 546510 - DNA, 25 bp, Mus musculus
caaagattacctctcgctttacctg

SEQ ID NO: 546511 - DNA, 25 bp, Mus musculus
caaagattacctgtcgctttacctg

SEQ ID NO: 546512 - DNA, 25 bp, Mus musculus
caaagattagaacgactccgcaaag

SEQ ID NO: 546513 - DNA, 25 bp, Mus musculus
caaagattagaaggactccgcaaag

SEQ ID NO: 546514 - DNA, 25 bp, Mus musculus
caaagattatcacaaggatgttcgt

SEQ ID NO: 546515 - DNA, 25 bp, Mus musculus
caaagattatcagaaggatgttcgt

SEQ ID NO: 546516 - DNA, 25 bp, Mus musculus
caaagattccgacttggtggaagcc

SEQ ID NO: 546517 - DNA, 25 bp, Mus musculus
caaagattccgagttggtggaagcc

SEQ ID NO: 546518 - DNA, 25 bp, Mus musculus
caaagattcttcaagtgtggaaaag

SEQ ID NO: 546519 - DNA, 25 bp, Mus musculus
caaagattcttctagtgtggaaaag

SEQ ID NO: 546520 - DNA, 25 bp, Mus musculus
caaagattgggtaggtatattcaag

SEQ ID NO: 546521 - DNA, 25 bp, Mus musculus
caaagattgggttggtatattcaag

SEQ ID NO: 546522 - DNA, 25 bp, Mus musculus
caaagattggtaccttcatgattcg

SEQ ID NO: 546523 - DNA, 25 bp, Mus musculus
caaagattggtagcttcatgattcg

SEQ ID NO: 546524 - DNA, 25 bp, Mus musculus
caaagatttaagcactgctcatggt

SEQ ID NO: 546525 - DNA, 25 bp, Mus musculus
caaagatttaaggactgctcatggt

SEQ ID NO: 546526 - DNA, 25 bp, Mus musculus
caaagatttgaccactgctgagaaa

SEQ ID NO: 546527 - DNA, 25 bp, Mus musculus
caaagatttgacgactgctgagaaa

SEQ ID NO: 546528 - DNA, 25 bp, Mus musculus
caaagatttgcaatctcgggaggag

SEQ ID NO: 546529 - DNA, 25 bp, Mus musculus
caaagatttgcattctcgggaggag

SEQ ID NO: 546530 - DNA, 25 bp, Mus musculus
caaagatttgggaaatggcctggaa

SEQ ID NO: 546531 - DNA, 25 bp, Mus musculus
caaagatttgggtaatggcctggaa

SEQ ID NO: 546532 - DNA, 25 bp, Mus musculus
caaagatttgttaactagggcccag

SEQ ID NO: 546533 - DNA, 25 bp, Mus musculus
caaagatttgtttactagggcccag

SEQ ID NO: 546534 - DNA, 25 bp, Mus musculus
caaagattttgcacgaggattcaca

SEQ ID NO: 546535 - DNA, 25 bp, Mus musculus
caaagattttgctcgaggattcaca

SEQ ID NO: 546536 - DNA, 25 bp, Mus musculus
caaagcaaaacaagagacacacaaa

SEQ ID NO: 546537 - DNA, 25 bp, Mus musculus
caaagcaaaacatgagacacacaaa

SEQ ID NO: 546538 - DNA, 25 bp, Mus musculus
caaagcaaaagcaggatagaggaca

SEQ ID NO: 546539 - DNA, 25 bp, Mus musculus
caaagcaaaagctggatagaggaca

SEQ ID NO: 546540 - DNA, 25 bp, Mus musculus
caaagcaaacttaacggcaatacgg

SEQ ID NO: 546541 - DNA, 25 bp, Mus musculus
caaagcaaactttacggcaatacgg

SEQ ID NO: 546542 - DNA, 25 bp, Mus musculus
caaagcaaagaactgcaggcagcct

SEQ ID NO: 546543 - DNA, 25 bp, Mus musculus
caaagcaaagaagtgcaggcagcct

SEQ ID NO: 546544 - DNA, 25 bp, Mus musculus
caaagcaaagctcctaactgtgatc

SEQ ID NO: 546545 - DNA, 25 bp, Mus musculus
caaagcaaagctgctaactgtgatc

SEQ ID NO: 546546 - DNA, 25 bp, Mus musculus
caaagcaagctacaggagagatggc

SEQ ID NO: 546547 - DNA, 25 bp, Mus musculus
caaagcaagctagaggagagatggc

SEQ ID NO: 546548 - DNA, 25 bp, Mus musculus
caaagcaatggactggatctcggcc

SEQ ID NO: 546549 - DNA, 25 bp, Mus musculus
caaagcaatggagtggatctcggcc

SEQ ID NO: 546550 - DNA, 25 bp, Mus musculus
caaagcaattcaagacgagaatcca

SEQ ID NO: 546551 - DNA, 25 bp, Mus musculus
caaagcaattcatgacgagaatcca

SEQ ID NO: 546552 - DNA, 25 bp, Mus musculus
caaagcacagacaacccaggaggtg

SEQ ID NO: 546553 - DNA, 25 bp, Mus musculus
caaagcacagacatgaagaaagaca

SEQ ID NO: 546554 - DNA, 25 bp, Mus musculus
caaagcacagactacccaggaggtg

SEQ ID NO: 546555 - DNA, 25 bp, Mus musculus
caaagcacagacttgaagaaagaca

SEQ ID NO: 546556 - DNA, 25 bp, Mus musculus
caaagcacctacattttgtgattac

SEQ ID NO: 546557 - DNA, 25 bp, Mus musculus
caaagcacctactttttgtgattac

SEQ ID NO: 546558 - DNA, 25 bp, Mus musculus
caaagcacgaccagatgatgaaggg

SEQ ID NO: 546559 - DNA, 25 bp, Mus musculus
caaagcacgacctgatgatgaaggg

SEQ ID NO: 546560 - DNA, 25 bp, Mus musculus
caaagcacggaacgagagattccag

SEQ ID NO: 546561 - DNA, 25 bp, Mus musculus
caaagcacggaaggagagattccag

SEQ ID NO: 546562 - DNA, 25 bp, Mus musculus
caaagcacgtgtcaagcagttatga

SEQ ID NO: 546563 - DNA, 25 bp, Mus musculus
caaagcacgtgtgaagcagttatga

SEQ ID NO: 546564 - DNA, 25 bp, Mus musculus
caaagcactgaaacgctacgaaggc

SEQ ID NO: 546565 - DNA, 25 bp, Mus musculus
caaagcactgaatcgctacgaaggc

SEQ ID NO: 546566 - DNA, 25 bp, Mus musculus
caaagcagaaaactcagaacaaatg

SEQ ID NO: 546567 - DNA, 25 bp, Mus musculus
caaagcagaaaagtcagaacaaatg

SEQ ID NO: 546568 - DNA, 25 bp, Mus musculus
caaagcagacataaaccaatggagg

SEQ ID NO: 546569 - DNA, 25 bp, Mus musculus
caaagcagacattaaccaatggagg

SEQ ID NO: 546570 - DNA, 25 bp, Mus musculus
caaagcagacccctacgtggagatt

SEQ ID NO: 546571 - DNA, 25 bp, Mus musculus
caaagcagacccgtacgtggagatt

SEQ ID NO: 546572 - DNA, 25 bp, Mus musculus
caaagcagactaatcctacagtggg

SEQ ID NO: 546573 - DNA, 25 bp, Mus musculus
caaagcagactattcctacagtggg

SEQ ID NO: 546574 - DNA, 25 bp, Mus musculus
caaagcagagacacagtaaggtggt

SEQ ID NO: 546575 - DNA, 25 bp, Mus musculus
caaagcagagactcagtaaggtggt

SEQ ID NO: 546576 - DNA, 25 bp, Mus musculus
caaagcagcccacggttctcggaga

SEQ ID NO: 546577 - DNA, 25 bp, Mus musculus
caaagcagcccagggttctcggaga

SEQ ID NO: 546578 - DNA, 25 bp, Mus musculus
caaagcagcgttagcaccatttgga

SEQ ID NO: 546579 - DNA, 25 bp, Mus musculus
caaagcagcgtttgcaccatttgga

SEQ ID NO: 546580 - DNA, 25 bp, Mus musculus
caaagcagctcaatattttgggatg

SEQ ID NO: 546581 - DNA, 25 bp, Mus musculus
caaagcagctcattattttgggatg

SEQ ID NO: 546582 - DNA, 25 bp, Mus musculus
caaagcagtacaagcggtcaggcac

SEQ ID NO: 546583 - DNA, 25 bp, Mus musculus
caaagcagtacatgcggtcaggcac

SEQ ID NO: 546584 - DNA, 25 bp, Mus musculus
caaagcagtcttaggtgggagacat

SEQ ID NO: 546585 - DNA, 25 bp, Mus musculus
caaagcagtctttggtgggagacat

SEQ ID NO: 546586 - DNA, 25 bp, Mus musculus
caaagcagttctacagtcatggaca

SEQ ID NO: 546587 - DNA, 25 bp, Mus musculus
caaagcagttcttcagtcatggaca

SEQ ID NO: 546588 - DNA, 25 bp, Mus musculus
caaagcatgtcgatcttctagatgt

SEQ ID NO: 546589 - DNA, 25 bp, Mus musculus
caaagcatgtcgttcttctagatgt

SEQ ID NO: 546590 - DNA, 25 bp, Mus musculus
caaagcattactactcatttgctga

SEQ ID NO: 546591 - DNA, 25 bp, Mus musculus
caaagcattacttctcatttgctga

SEQ ID NO: 546592 - DNA, 25 bp, Mus musculus
caaagcattgggaactcgaggatga

SEQ ID NO: 546593 - DNA, 25 bp, Mus musculus
caaagcattgggtactcgaggatga

SEQ ID NO: 546594 - DNA, 25 bp, Mus musculus
caaagccaaagacagggccttcaag

SEQ ID NO: 546595 - DNA, 25 bp, Mus musculus
caaagccaaagagagggccttcaag

SEQ ID NO: 546596 - DNA, 25 bp, Mus musculus
caaagccaaagtaggcaagccgtgg

SEQ ID NO: 546597 - DNA, 25 bp, Mus musculus
caaagccaaagttggcaagccgtgg

SEQ ID NO: 546598 - DNA, 25 bp, Mus musculus
caaagccaagaaagaatttgcagcc

SEQ ID NO: 546599 - DNA, 25 bp, Mus musculus
caaagccaagaaatctgagccctca

SEQ ID NO: 546600 - DNA, 25 bp, Mus musculus
caaagccaagaatgaatttgcagcc

SEQ ID NO: 546601 - DNA, 25 bp, Mus musculus
caaagccaagaattctgagccctca

SEQ ID NO: 546602 - DNA, 25 bp, Mus musculus
caaagccaatgaaaaggatgagaag

SEQ ID NO: 546603 - DNA, 25 bp, Mus musculus
caaagccaatgataaggatgagaag

SEQ ID NO: 546604 - DNA, 25 bp, Mus musculus
caaagccagaagactgtggtgtcct

SEQ ID NO: 546605 - DNA, 25 bp, Mus musculus
caaagccagaagtctgtggtgtcct

SEQ ID NO: 546606 - DNA, 25 bp, Mus musculus
caaagccaggctaaaggagacttca

SEQ ID NO: 546607 - DNA, 25 bp, Mus musculus
caaagccaggcttaaggagacttca

SEQ ID NO: 546608 - DNA, 25 bp, Mus musculus
caaagccagtcaaagtccatctgga

SEQ ID NO: 546609 - DNA, 25 bp, Mus musculus
caaagccagtcatagtccatctgga

SEQ ID NO: 546610 - DNA, 25 bp, Mus musculus
caaagccagttcagtgctccgtgca

SEQ ID NO: 546611 - DNA, 25 bp, Mus musculus
caaagccagttctgtgctccgtgca

SEQ ID NO: 546612 - DNA, 25 bp, Mus musculus
caaagccatgagagccaagttcgag

SEQ ID NO: 546613 - DNA, 25 bp, Mus musculus
caaagccatgagtgccaagttcgag

SEQ ID NO: 546614 - DNA, 25 bp, Mus musculus
caaagcccagtgcaagagcctgctg

SEQ ID NO: 546615 - DNA, 25 bp, Mus musculus
caaagcccagtggaagagcctgctg

SEQ ID NO: 546616 - DNA, 25 bp, Mus musculus
caaagcccctataagcctcatgtgg

SEQ ID NO: 546617 - DNA, 25 bp, Mus musculus
caaagcccctattagcctcatgtgg

SEQ ID NO: 546618 - DNA, 25 bp, Mus musculus
caaagccctcaacatcctaggaggt

SEQ ID NO: 546619 - DNA, 25 bp, Mus musculus
caaagccctcaagatcctaggaggt

SEQ ID NO: 546620 - DNA, 25 bp, Mus musculus
caaagccctgaaacagatcgagatc

SEQ ID NO: 546621 - DNA, 25 bp, Mus musculus
caaagccctgaatcagatcgagatc

SEQ ID NO: 546622 - DNA, 25 bp, Mus musculus
caaagccctgtacccaggtgctctg

SEQ ID NO: 546623 - DNA, 25 bp, Mus musculus
caaagccctgtagccaggtgctctg

SEQ ID NO: 546624 - DNA, 25 bp, Mus musculus
caaagccgtggaccatgcagacgga

SEQ ID NO: 546625 - DNA, 25 bp, Mus musculus
caaagccgtggagcatgcagacgga

SEQ ID NO: 546626 - DNA, 25 bp, Mus musculus
caaagccgtgttctgcaggagaaac

SEQ ID NO: 546627 - DNA, 25 bp, Mus musculus
caaagccgtgttgtgcaggagaaac

SEQ ID NO: 546628 - DNA, 25 bp, Mus musculus
caaagccgttacattcccacttgga

SEQ ID NO: 546629 - DNA, 25 bp, Mus musculus
caaagccgttactttcccacttgga

SEQ ID NO: 546630 - DNA, 25 bp, Mus musculus
caaagcctatccaatagcggcgcgc

SEQ ID NO: 546631 - DNA, 25 bp, Mus musculus
caaagcctatcctatagcggcgcgc

SEQ ID NO: 546632 - DNA, 25 bp, Mus musculus
caaagcctgcacatcattgaggaca

SEQ ID NO: 546633 - DNA, 25 bp, Mus musculus
caaagcctgcacttcattgaggaca

SEQ ID NO: 546634 - DNA, 25 bp, Mus musculus
caaagcctgcgcaattaaaaggagc

SEQ ID NO: 546635 - DNA, 25 bp, Mus musculus
caaagcctgcgctattaaaaggagc

SEQ ID NO: 546636 - DNA, 25 bp, Mus musculus
caaagcctgcggcaatgggaattcc

SEQ ID NO: 546637 - DNA, 25 bp, Mus musculus
caaagcctgcgggaatgggaattcc

SEQ ID NO: 546638 - DNA, 25 bp, Mus musculus
caaagcctgggacctctatggctca

SEQ ID NO: 546639 - DNA, 25 bp, Mus musculus
caaagcctgggagctctatggctca

SEQ ID NO: 546640 - DNA, 25 bp, Mus musculus
caaagcctggtgactttccttggca

SEQ ID NO: 546641 - DNA, 25 bp, Mus musculus
caaagcctggtgtctttccttggca

SEQ ID NO: 546642 - DNA, 25 bp, Mus musculus
caaagcctgtaaatagaacgttcct

SEQ ID NO: 546643 - DNA, 25 bp, Mus musculus
caaagcctgtaattagaacgttcct

SEQ ID NO: 546644 - DNA, 25 bp, Mus musculus
caaagcctgtataccaatagagaat

SEQ ID NO: 546645 - DNA, 25 bp, Mus musculus
caaagcctgtattccaatagagaat

SEQ ID NO: 546646 - DNA, 25 bp, Mus musculus
caaagccttagactgagctgagcag

SEQ ID NO: 546647 - DNA, 25 bp, Mus musculus
caaagccttagagtgagctgagcag

SEQ ID NO: 546648 - DNA, 25 bp, Mus musculus
caaagcctttacctatgaccacagc

SEQ ID NO: 546649 - DNA, 25 bp, Mus musculus
caaagcctttacgtatgaccacagc

SEQ ID NO: 546650 - DNA, 25 bp, Mus musculus
caaagcctttgcagaaagagatgaa

SEQ ID NO: 546651 - DNA, 25 bp, Mus musculus
caaagcctttgctgaaagagatgaa

SEQ ID NO: 546652 - DNA, 25 bp, Mus musculus
caaagcgaagccaatccgtttctgg

SEQ ID NO: 546653 - DNA, 25 bp, Mus musculus
caaagcgaagcctatccgtttctgg

SEQ ID NO: 546654 - DNA, 25 bp, Mus musculus
caaagcgatccgctgtcaagagttc

SEQ ID NO: 546655 - DNA, 25 bp, Mus musculus
caaagcgatccggtgtcaagagttc

SEQ ID NO: 546656 - DNA, 25 bp, Mus musculus
caaagcgccatcagctggacataaa

SEQ ID NO: 546657 - DNA, 25 bp, Mus musculus
caaagcgccatctgctggacataaa

SEQ ID NO: 546658 - DNA, 25 bp, Mus musculus
caaagcgggagaagctcacgttctt

SEQ ID NO: 546659 - DNA, 25 bp, Mus musculus
caaagcgggagatgctcacgttctt

SEQ ID NO: 546660 - DNA, 25 bp, Mus musculus
caaagcgggcaacgagaaagacgtc

SEQ ID NO: 546661 - DNA, 25 bp, Mus musculus
caaagcgggcaaggagaaagacgtc

SEQ ID NO: 546662 - DNA, 25 bp, Mus musculus
caaagcgtgggaaaaccagagcgga

SEQ ID NO: 546663 - DNA, 25 bp, Mus musculus
caaagcgtgggataaccagagcgga

SEQ ID NO: 546664 - DNA, 25 bp, Mus musculus
caaagcgttccgctcacttggagaa

SEQ ID NO: 546665 - DNA, 25 bp, Mus musculus
caaagcgttccggtcacttggagaa

SEQ ID NO: 546666 - DNA, 25 bp, Mus musculus
caaagcgtttctcaaaaacagcaac

SEQ ID NO: 546667 - DNA, 25 bp, Mus musculus
caaagcgtttctgaaaaacagcaac

SEQ ID NO: 546668 - DNA, 25 bp, Mus musculus
caaagctaacgccagttcctagagc

SEQ ID NO: 546669 - DNA, 25 bp, Mus musculus
caaagctaacgcgagttcctagagc

SEQ ID NO: 546670 - DNA, 25 bp, Mus musculus
caaagctaattcagcctgtggctgg

SEQ ID NO: 546671 - DNA, 25 bp, Mus musculus
caaagctaattctgcctgtggctgg

SEQ ID NO: 546672 - DNA, 25 bp, Mus musculus
caaagctccttcagcaacttcagcg

SEQ ID NO: 546673 - DNA, 25 bp, Mus musculus
caaagctccttctgcaacttcagcg

SEQ ID NO: 546674 - DNA, 25 bp, Mus musculus
caaagctcctttaactctgtttctg

SEQ ID NO: 546675 - DNA, 25 bp, Mus musculus
caaagctccttttactctgtttctg

SEQ ID NO: 546676 - DNA, 25 bp, Mus musculus
caaagctcggcacttcatgatgact

SEQ ID NO: 546677 - DNA, 25 bp, Mus musculus
caaagctcggcagttcatgatgact

SEQ ID NO: 546678 - DNA, 25 bp, Mus musculus
caaagctctaggcagggcatgtacc

SEQ ID NO: 546679 - DNA, 25 bp, Mus musculus
caaagctctagggagggcatgtacc

SEQ ID NO: 546680 - DNA, 25 bp, Mus musculus
caaagctctgaacttgattgggaag

SEQ ID NO: 546681 - DNA, 25 bp, Mus musculus
caaagctctgaagttgattgggaag

SEQ ID NO: 546682 - DNA, 25 bp, Mus musculus
caaagctctgtactgtgacctctag

SEQ ID NO: 546683 - DNA, 25 bp, Mus musculus
caaagctctgtagtgtgacctctag

SEQ ID NO: 546684 - DNA, 25 bp, Mus musculus
caaagctgaccccagatgcatgggt

SEQ ID NO: 546685 - DNA, 25 bp, Mus musculus
caaagctgacccgagatgcatgggt

SEQ ID NO: 546686 - DNA, 25 bp, Mus musculus
caaagctgagtcataatcaacttca

SEQ ID NO: 546687 - DNA, 25 bp, Mus musculus
caaagctgagtcttaatcaacttca

SEQ ID NO: 546688 - DNA, 25 bp, Mus musculus
caaagctgatgaactaattggtcct

SEQ ID NO: 546689 - DNA, 25 bp, Mus musculus
caaagctgatgatctaattggtcct

SEQ ID NO: 546690 - DNA, 25 bp, Mus musculus
caaagctgccagagagaagaaatca

SEQ ID NO: 546691 - DNA, 25 bp, Mus musculus
caaagctgccagtgagaagaaatca

SEQ ID NO: 546692 - DNA, 25 bp, Mus musculus
caaagctgcgtgacctggaggactc

SEQ ID NO: 546693 - DNA, 25 bp, Mus musculus
caaagctgcgtgtcctggaggactc

SEQ ID NO: 546694 - DNA, 25 bp, Mus musculus
caaagctgctcacaagttgctgact

SEQ ID NO: 546695 - DNA, 25 bp, Mus musculus
caaagctgctcagaagttgctgact

SEQ ID NO: 546696 - DNA, 25 bp, Mus musculus
caaagctgctgactcggcttggcca

SEQ ID NO: 546697 - DNA, 25 bp, Mus musculus
caaagctgctgagtcggcttggcca

SEQ ID NO: 546698 - DNA, 25 bp, Mus musculus
caaagctggataagccaaaggttgt

SEQ ID NO: 546699 - DNA, 25 bp, Mus musculus
caaagctggatatgccaaaggttgt

SEQ ID NO: 546700 - DNA, 25 bp, Mus musculus
caaagctggccacggtatcccggca

SEQ ID NO: 546701 - DNA, 25 bp, Mus musculus
caaagctggccagggtatcccggca

SEQ ID NO: 546702 - DNA, 25 bp, Mus musculus
caaagctgggaaagtgaacctcacc

SEQ ID NO: 546703 - DNA, 25 bp, Mus musculus
caaagctgggaatgtgaacctcacc

SEQ ID NO: 546704 - DNA, 25 bp, Mus musculus
caaagctgggtaatgtgtgaagcaa

SEQ ID NO: 546705 - DNA, 25 bp, Mus musculus
caaagctgggtattgtgtgaagcaa

SEQ ID NO: 546706 - DNA, 25 bp, Mus musculus
caaagctgggttacttctggccact

SEQ ID NO: 546707 - DNA, 25 bp, Mus musculus
caaagctgggtttcttctggccact

SEQ ID NO: 546708 - DNA, 25 bp, Mus musculus
caaagctggtaacgagagtgaagac

SEQ ID NO: 546709 - DNA, 25 bp, Mus musculus
caaagctggtaaggagagtgaagac

SEQ ID NO: 546710 - DNA, 25 bp, Mus musculus
caaagctggtgaaatacatttgcaa

SEQ ID NO: 546711 - DNA, 25 bp, Mus musculus
caaagctggtgatatacatttgcaa

SEQ ID NO: 546712 - DNA, 25 bp, Mus musculus
caaagctggtttagttgaatatgcc

SEQ ID NO: 546713 - DNA, 25 bp, Mus musculus
caaagctggttttgttgaatatgcc

SEQ ID NO: 546714 - DNA, 25 bp, Mus musculus
caaagctgtaccacaaagtaagcca

SEQ ID NO: 546715 - DNA, 25 bp, Mus musculus
caaagctgtacctcaaagtaagcca

SEQ ID NO: 546716 - DNA, 25 bp, Mus musculus
caaagctgtgccctgccaagaggct

SEQ ID NO: 546717 - DNA, 25 bp, Mus musculus
caaagctgtgccgtgccaagaggct

SEQ ID NO: 546718 - DNA, 25 bp, Mus musculus
caaagcttattaccacctgctcgag

SEQ ID NO: 546719 - DNA, 25 bp, Mus musculus
caaagcttattagcacctgctcgag

SEQ ID NO: 546720 - DNA, 25 bp, Mus musculus
caaagcttcgatcgctttcttacaa

SEQ ID NO: 546721 - DNA, 25 bp, Mus musculus
caaagcttcgatggctttcttacaa

SEQ ID NO: 546722 - DNA, 25 bp, Mus musculus
caaagcttgcgaatctcgatggaga

SEQ ID NO: 546723 - DNA, 25 bp, Mus musculus
caaagcttgcgattctcgatggaga

SEQ ID NO: 546724 - DNA, 25 bp, Mus musculus
caaagcttgctgagggttttagccc

SEQ ID NO: 546725 - DNA, 25 bp, Mus musculus
caaagcttgctgtgggttttagccc

SEQ ID NO: 546726 - DNA, 25 bp, Mus musculus
caaagctttggacacgagggactcg

SEQ ID NO: 546727 - DNA, 25 bp, Mus musculus
caaagctttggagacgagggactcg

SEQ ID NO: 546728 - DNA, 25 bp, Mus musculus
caaagctttttaagctgcagtggct

SEQ ID NO: 546729 - DNA, 25 bp, Mus musculus
caaagctttttatgctgcagtggct

SEQ ID NO: 546730 - DNA, 25 bp, Mus musculus
caaaggaaaatcacagaggcgggca

SEQ ID NO: 546731 - DNA, 25 bp, Mus musculus
caaaggaaaatcagacaaaaagcct

SEQ ID NO: 546732 - DNA, 25 bp, Mus musculus
caaaggaaaatctcagaggcgggca

SEQ ID NO: 546733 - DNA, 25 bp, Mus musculus
caaaggaaaatctgacaaaaagcct

SEQ ID NO: 546734 - DNA, 25 bp, Mus musculus
caaaggaaagctaggcagactgctc

SEQ ID NO: 546735 - DNA, 25 bp, Mus musculus
caaaggaaagctcgttatctacgag

SEQ ID NO: 546736 - DNA, 25 bp, Mus musculus
caaaggaaagctggttatctacgag

SEQ ID NO: 546737 - DNA, 25 bp, Mus musculus
caaaggaaagcttggcagactgctc

SEQ ID NO: 546738 - DNA, 25 bp, Mus musculus
caaaggaaatgtcaatgaaaactga

SEQ ID NO: 546739 - DNA, 25 bp, Mus musculus
caaaggaaatgtgaatgaaaactga

SEQ ID NO: 546740 - DNA, 25 bp, Mus musculus
caaaggaacaatctggtccgcagca

SEQ ID NO: 546741 - DNA, 25 bp, Mus musculus
caaaggaacaatgtggtccgcagca

SEQ ID NO: 546742 - DNA, 25 bp, Mus musculus
caaaggaacgcaaatgctgcagtgt

SEQ ID NO: 546743 - DNA, 25 bp, Mus musculus
caaaggaacgcatatgctgcagtgt

SEQ ID NO: 546744 - DNA, 25 bp, Mus musculus
caaaggaagaataacgtgcgcccag

SEQ ID NO: 546745 - DNA, 25 bp, Mus musculus
caaaggaagaattacgtgcgcccag

SEQ ID NO: 546746 - DNA, 25 bp, Mus musculus
caaaggaagacaactaggcttcggg

SEQ ID NO: 546747 - DNA, 25 bp, Mus musculus
caaaggaagacatctaggcttcggg

SEQ ID NO: 546748 - DNA, 25 bp, Mus musculus
caaaggaagactatgggcactggga

SEQ ID NO: 546749 - DNA, 25 bp, Mus musculus
caaaggaagactttgggcactggga

SEQ ID NO: 546750 - DNA, 25 bp, Mus musculus
caaaggaagcctagagtggagacaa

SEQ ID NO: 546751 - DNA, 25 bp, Mus musculus
caaaggaagccttgagtggagacaa

SEQ ID NO: 546752 - DNA, 25 bp, Mus musculus
caaaggaagctgctccctctgaatg

SEQ ID NO: 546753 - DNA, 25 bp, Mus musculus
caaaggaagctggtccctctgaatg

SEQ ID NO: 546754 - DNA, 25 bp, Mus musculus
caaaggaatagccaccctgggtcaa

SEQ ID NO: 546755 - DNA, 25 bp, Mus musculus
caaaggaatagcgaccctgggtcaa

SEQ ID NO: 546756 - DNA, 25 bp, Mus musculus
caaaggaatctcagcggagtgggaa

SEQ ID NO: 546757 - DNA, 25 bp, Mus musculus
caaaggaatctctgcggagtgggaa

SEQ ID NO: 546758 - DNA, 25 bp, Mus musculus
caaaggaatcttagcccctggcatg

SEQ ID NO: 546759 - DNA, 25 bp, Mus musculus
caaaggaatctttgcccctggcatg

SEQ ID NO: 546760 - DNA, 25 bp, Mus musculus
caaaggaattgtagttgggtttgct

SEQ ID NO: 546761 - DNA, 25 bp, Mus musculus
caaaggaattgttgttgggtttgct

SEQ ID NO: 546762 - DNA, 25 bp, Mus musculus
caaaggacaaaaattccatcttggg

SEQ ID NO: 546763 - DNA, 25 bp, Mus musculus
caaaggacaaaatttccatcttggg

SEQ ID NO: 546764 - DNA, 25 bp, Mus musculus
caaaggacaatgactactgatgagg

SEQ ID NO: 546765 - DNA, 25 bp, Mus musculus
caaaggacaatgtctactgatgagg

SEQ ID NO: 546766 - DNA, 25 bp, Mus musculus
caaaggacaccaagatgtggaagcc

SEQ ID NO: 546767 - DNA, 25 bp, Mus musculus
caaaggacaccatgatgtggaagcc

SEQ ID NO: 546768 - DNA, 25 bp, Mus musculus
caaaggacaccgacatgtcacggat

SEQ ID NO: 546769 - DNA, 25 bp, Mus musculus
caaaggacaccgtcatgtcacggat

SEQ ID NO: 546770 - DNA, 25 bp, Mus musculus
caaaggacaggtccgatgtcagtgt

SEQ ID NO: 546771 - DNA, 25 bp, Mus musculus
caaaggacaggtgcgatgtcagtgt

SEQ ID NO: 546772 - DNA, 25 bp, Mus musculus
caaaggacatcaatgcctgtggctt

SEQ ID NO: 546773 - DNA, 25 bp, Mus musculus
caaaggacatcattgcctgtggctt

SEQ ID NO: 546774 - DNA, 25 bp, Mus musculus
caaaggacatcgacaacgggctgag

SEQ ID NO: 546775 - DNA, 25 bp, Mus musculus
caaaggacatcgtcaacgggctgag

SEQ ID NO: 546776 - DNA, 25 bp, Mus musculus
caaaggacgccgagtagtccgtgct

SEQ ID NO: 546777 - DNA, 25 bp, Mus musculus
caaaggacgccgtgtagtccgtgct

SEQ ID NO: 546778 - DNA, 25 bp, Mus musculus
caaaggactaaccacactaaagaga

SEQ ID NO: 546779 - DNA, 25 bp, Mus musculus
caaaggactaacgacactaaagaga

SEQ ID NO: 546780 - DNA, 25 bp, Mus musculus
caaaggagaaaacgcaggcgaaaag

SEQ ID NO: 546781 - DNA, 25 bp, Mus musculus
caaaggagaaaaggcaggcgaaaag

SEQ ID NO: 546782 - DNA, 25 bp, Mus musculus
caaaggagaagaatgtgaaatacct

SEQ ID NO: 546783 - DNA, 25 bp, Mus musculus
caaaggagaagattgtgaaatacct

SEQ ID NO: 546784 - DNA, 25 bp, Mus musculus
caaaggaggaacaggctttggagaa

SEQ ID NO: 546785 - DNA, 25 bp, Mus musculus
caaaggaggaactggctttggagaa

SEQ ID NO: 546786 - DNA, 25 bp, Mus musculus
caaaggaggaggcacttctagaacg

SEQ ID NO: 546787 - DNA, 25 bp, Mus musculus
caaaggaggagggacttctagaacg

SEQ ID NO: 546788 - DNA, 25 bp, Mus musculus
caaaggaggcacattatcatacaat

SEQ ID NO: 546789 - DNA, 25 bp, Mus musculus
caaaggaggcactttatcatacaat

SEQ ID NO: 546790 - DNA, 25 bp, Mus musculus
caaaggaggcctagactcagagtgc

SEQ ID NO: 546791 - DNA, 25 bp, Mus musculus
caaaggaggccttgactcagagtgc

SEQ ID NO: 546792 - DNA, 25 bp, Mus musculus
caaaggaggcgcaggaggctcaccc

SEQ ID NO: 546793 - DNA, 25 bp, Mus musculus
caaaggaggcgctggaggctcaccc

SEQ ID NO: 546794 - DNA, 25 bp, Mus musculus
caaaggagtctgctgaccaatagtc

SEQ ID NO: 546795 - DNA, 25 bp, Mus musculus
caaaggagtctggtgaccaatagtc

SEQ ID NO: 546796 - DNA, 25 bp, Mus musculus
caaaggagtgtcaatattgcgagac

SEQ ID NO: 546797 - DNA, 25 bp, Mus musculus
caaaggagtgtctatattgcgagac

SEQ ID NO: 546798 - DNA, 25 bp, Mus musculus
caaaggagttgcctggagtaatcct

SEQ ID NO: 546799 - DNA, 25 bp, Mus musculus
caaaggagttgcgtggagtaatcct

SEQ ID NO: 546800 - DNA, 25 bp, Mus musculus
caaaggataactcggagactccagc

SEQ ID NO: 546801 - DNA, 25 bp, Mus musculus
caaaggataactgggagactccagc

SEQ ID NO: 546802 - DNA, 25 bp, Mus musculus
caaaggataattatacctgtgagac

SEQ ID NO: 546803 - DNA, 25 bp, Mus musculus
caaaggataattttacctgtgagac

SEQ ID NO: 546804 - DNA, 25 bp, Mus musculus
caaaggatggcacgtcagtgctaca

SEQ ID NO: 546805 - DNA, 25 bp, Mus musculus
caaaggatggcaggtcagtgctaca

SEQ ID NO: 546806 - DNA, 25 bp, Mus musculus
caaaggatgttaacattgagcaaga

SEQ ID NO: 546807 - DNA, 25 bp, Mus musculus
caaaggatgttatcattgagcaaga

SEQ ID NO: 546808 - DNA, 25 bp, Mus musculus
caaaggatgttccagagattgatga

SEQ ID NO: 546809 - DNA, 25 bp, Mus musculus
caaaggatgttcgagagattgatga

SEQ ID NO: 546810 - DNA, 25 bp, Mus musculus
caaaggatgtttcaggcagccgctg

SEQ ID NO: 546811 - DNA, 25 bp, Mus musculus
caaaggatgtttgaggcagccgctg

SEQ ID NO: 546812 - DNA, 25 bp, Mus musculus
caaaggattacacagcaagaaggag

SEQ ID NO: 546813 - DNA, 25 bp, Mus musculus
caaaggattacagagcaagaaggag

SEQ ID NO: 546814 - DNA, 25 bp, Mus musculus
caaaggatttctatggccatgaagc

SEQ ID NO: 546815 - DNA, 25 bp, Mus musculus
caaaggatttctttggccatgaagc

SEQ ID NO: 546816 - DNA, 25 bp, Mus musculus
caaaggcaacgacgtgaacatgggc

SEQ ID NO: 546817 - DNA, 25 bp, Mus musculus
caaaggcaacgaggtgaacatgggc

SEQ ID NO: 546818 - DNA, 25 bp, Mus musculus
caaaggcaatgaccccaatgtctca

SEQ ID NO: 546819 - DNA, 25 bp, Mus musculus
caaaggcaatgagcccaatgtctca

SEQ ID NO: 546820 - DNA, 25 bp, Mus musculus
caaaggcactagctttatcctgtaa

SEQ ID NO: 546821 - DNA, 25 bp, Mus musculus
caaaggcactaggtttatcctgtaa

SEQ ID NO: 546822 - DNA, 25 bp, Mus musculus
caaaggcacttactgtctaaaccaa

SEQ ID NO: 546823 - DNA, 25 bp, Mus musculus
caaaggcacttagtgtctaaaccaa

SEQ ID NO: 546824 - DNA, 25 bp, Mus musculus
caaaggcagagactaccgtgacaac

SEQ ID NO: 546825 - DNA, 25 bp, Mus musculus
caaaggcagagagtaccgtgacaac

SEQ ID NO: 546826 - DNA, 25 bp, Mus musculus
caaaggcagggaaaagcctcgactc

SEQ ID NO: 546827 - DNA, 25 bp, Mus musculus
caaaggcagggataagcctcgactc

SEQ ID NO: 546828 - DNA, 25 bp, Mus musculus
caaaggcagtgtaaacgtctgaaca

SEQ ID NO: 546829 - DNA, 25 bp, Mus musculus
caaaggcagtgttaacgtctgaaca

SEQ ID NO: 546830 - DNA, 25 bp, Mus musculus
caaaggcatagacagattggttttc

SEQ ID NO: 546831 - DNA, 25 bp, Mus musculus
caaaggcatagagagattggttttc

SEQ ID NO: 546832 - DNA, 25 bp, Mus musculus
caaaggcatagtcagagatttacaa

SEQ ID NO: 546833 - DNA, 25 bp, Mus musculus
caaaggcatagtgagagatttacaa

SEQ ID NO: 546834 - DNA, 25 bp, Mus musculus
caaaggcatgaacaacgccatgaac

SEQ ID NO: 546835 - DNA, 25 bp, Mus musculus
caaaggcatgaagaacgccatgaac

SEQ ID NO: 546836 - DNA, 25 bp, Mus musculus
caaaggccaagaatttgtcagccaa

SEQ ID NO: 546837 - DNA, 25 bp, Mus musculus
caaaggccaagattttgtcagccaa

SEQ ID NO: 546838 - DNA, 25 bp, Mus musculus
caaaggccagggaggcaagtccaag

SEQ ID NO: 546839 - DNA, 25 bp, Mus musculus
caaaggccagggtggcaagtccaag

SEQ ID NO: 546840 - DNA, 25 bp, Mus musculus
caaaggccatgtatgacgctgcgcc

SEQ ID NO: 546841 - DNA, 25 bp, Mus musculus
caaaggccatgtttgacgctgcgcc

SEQ ID NO: 546842 - DNA, 25 bp, Mus musculus
caaaggcccaagagaaacaccagag

SEQ ID NO: 546843 - DNA, 25 bp, Mus musculus
caaaggcccaagtgaaacaccagag

SEQ ID NO: 546844 - DNA, 25 bp, Mus musculus
caaaggccccatcagtgctgtttac

SEQ ID NO: 546845 - DNA, 25 bp, Mus musculus
caaaggccccatgagtgctgtttac

SEQ ID NO: 546846 - DNA, 25 bp, Mus musculus
caaaggcccgagcaaagggcctgct

SEQ ID NO: 546847 - DNA, 25 bp, Mus musculus
caaaggcccgaggaaagggcctgct

SEQ ID NO: 546848 - DNA, 25 bp, Mus musculus
caaaggcccgtgcaaaggcactggt

SEQ ID NO: 546849 - DNA, 25 bp, Mus musculus
caaaggcccgtggaaaggcactggt

SEQ ID NO: 546850 - DNA, 25 bp, Mus musculus
caaaggccctgccaagaactcagaa

SEQ ID NO: 546851 - DNA, 25 bp, Mus musculus
caaaggccctgcgaagaactcagaa

SEQ ID NO: 546852 - DNA, 25 bp, Mus musculus
caaaggccctgtagttggctctata

SEQ ID NO: 546853 - DNA, 25 bp, Mus musculus
caaaggccctgttgttggctctata

SEQ ID NO: 546854 - DNA, 25 bp, Mus musculus
caaaggccgcttcgaactctaccgg

SEQ ID NO: 546855 - DNA, 25 bp, Mus musculus
caaaggccgcttggaactctaccgg

SEQ ID NO: 546856 - DNA, 25 bp, Mus musculus
caaaggcctgaacactccaccaggg

SEQ ID NO: 546857 - DNA, 25 bp, Mus musculus
caaaggcctgaagactccaccaggg

SEQ ID NO: 546858 - DNA, 25 bp, Mus musculus
caaaggccttggagaaaatgcagct

SEQ ID NO: 546859 - DNA, 25 bp, Mus musculus
caaaggccttggtgaaaatgcagct

SEQ ID NO: 546860 - DNA, 25 bp, Mus musculus
caaaggcgaagtacagatggacggc

SEQ ID NO: 546861 - DNA, 25 bp, Mus musculus
caaaggcgaagttcagatggacggc

SEQ ID NO: 546862 - DNA, 25 bp, Mus musculus
caaaggcgatttaggataaggccac

SEQ ID NO: 546863 - DNA, 25 bp, Mus musculus
caaaggcgattttggataaggccac

SEQ ID NO: 546864 - DNA, 25 bp, Mus musculus
caaaggcggccgcttttacatcact

SEQ ID NO: 546865 - DNA, 25 bp, Mus musculus
caaaggcggccggttttacatcact

SEQ ID NO: 546866 - DNA, 25 bp, Mus musculus
caaaggcggtccactgactgatacc

SEQ ID NO: 546867 - DNA, 25 bp, Mus musculus
caaaggcggtcctctgactgatacc

SEQ ID NO: 546868 - DNA, 25 bp, Mus musculus
caaaggctacttcaaagacccagca

SEQ ID NO: 546869 - DNA, 25 bp, Mus musculus
caaaggctacttgaaagacccagca

SEQ ID NO: 546870 - DNA, 25 bp, Mus musculus
caaaggctatggagttggcactccc

SEQ ID NO: 546871 - DNA, 25 bp, Mus musculus
caaaggctatggtgttggcactccc

SEQ ID NO: 546872 - DNA, 25 bp, Mus musculus
caaaggctcatgaagttcggattaa

SEQ ID NO: 546873 - DNA, 25 bp, Mus musculus
caaaggctcatgtagttcggattaa

SEQ ID NO: 546874 - DNA, 25 bp, Mus musculus
caaaggctctcacgtggtggtcatc

SEQ ID NO: 546875 - DNA, 25 bp, Mus musculus
caaaggctctcaggtggtggtcatc

SEQ ID NO: 546876 - DNA, 25 bp, Mus musculus
caaaggctctcgatgtgtttagagc

SEQ ID NO: 546877 - DNA, 25 bp, Mus musculus
caaaggctctcgttgtgtttagagc

SEQ ID NO: 546878 - DNA, 25 bp, Mus musculus
caaaggctgcccagcggacttcatt

SEQ ID NO: 546879 - DNA, 25 bp, Mus musculus
caaaggctgccctgcggacttcatt

SEQ ID NO: 546880 - DNA, 25 bp, Mus musculus
caaaggcttcttcttgctggtggaa

SEQ ID NO: 546881 - DNA, 25 bp, Mus musculus
caaaggcttcttgttgctggtggaa

SEQ ID NO: 546882 - DNA, 25 bp, Mus musculus
caaaggcttgctcatcaattttatc

SEQ ID NO: 546883 - DNA, 25 bp, Mus musculus
caaaggcttgctgatcaattttatc

SEQ ID NO: 546884 - DNA, 25 bp, Mus musculus
caaaggctttggcttccaaacaaat

SEQ ID NO: 546885 - DNA, 25 bp, Mus musculus
caaaggctttgggttccaaacaaat

SEQ ID NO: 546886 - DNA, 25 bp, Mus musculus
caaaggctttgtcaagctggccctg

SEQ ID NO: 546887 - DNA, 25 bp, Mus musculus
caaaggctttgtgaagctggccctg

SEQ ID NO: 546888 - DNA, 25 bp, Mus musculus
caaagggaacacactcaaagaagac

SEQ ID NO: 546889 - DNA, 25 bp, Mus musculus
caaagggaacactctcaaagaagac

SEQ ID NO: 546890 - DNA, 25 bp, Mus musculus
caaagggaacctattggcacacaga

SEQ ID NO: 546891 - DNA, 25 bp, Mus musculus
caaagggaaccttttggcacacaga

SEQ ID NO: 546892 - DNA, 25 bp, Mus musculus
caaagggacactccatcaggaagtg

SEQ ID NO: 546893 - DNA, 25 bp, Mus musculus
caaagggacactgcatcaggaagtg

SEQ ID NO: 546894 - DNA, 25 bp, Mus musculus
caaagggaccccatattatgaaagc

SEQ ID NO: 546895 - DNA, 25 bp, Mus musculus
caaagggaccccttattatgaaagc

SEQ ID NO: 546896 - DNA, 25 bp, Mus musculus
caaagggagcttcgttactcacttg

SEQ ID NO: 546897 - DNA, 25 bp, Mus musculus
caaagggagcttggttactcacttg

SEQ ID NO: 546898 - DNA, 25 bp, Mus musculus
caaagggatatcacccacagtgtgg

SEQ ID NO: 546899 - DNA, 25 bp, Mus musculus
caaagggatatctcccacagtgtgg

SEQ ID NO: 546900 - DNA, 25 bp, Mus musculus
caaagggatgatccccgactttggg

SEQ ID NO: 546901 - DNA, 25 bp, Mus musculus
caaagggatgatgcccgactttggg

SEQ ID NO: 546902 - DNA, 25 bp, Mus musculus
caaagggattctatctcaggagacg

SEQ ID NO: 546903 - DNA, 25 bp, Mus musculus
caaagggattctttctcaggagacg

SEQ ID NO: 546904 - DNA, 25 bp, Mus musculus
caaagggcacatagcttcagttctt

SEQ ID NO: 546905 - DNA, 25 bp, Mus musculus
caaagggcacattgcttcagttctt

SEQ ID NO: 546906 - DNA, 25 bp, Mus musculus
caaagggcagaaatgcctgcaggcg

SEQ ID NO: 546907 - DNA, 25 bp, Mus musculus
caaagggcagaattgcctgcaggcg

SEQ ID NO: 546908 - DNA, 25 bp, Mus musculus
caaagggcaggaagtattatacaca

SEQ ID NO: 546909 - DNA, 25 bp, Mus musculus
caaagggcaggatgtattatacaca

SEQ ID NO: 546910 - DNA, 25 bp, Mus musculus
caaagggccctgacattagagtcaa

SEQ ID NO: 546911 - DNA, 25 bp, Mus musculus
caaagggccctgtcattagagtcaa

SEQ ID NO: 546912 - DNA, 25 bp, Mus musculus
caaagggcctggaaagactgtacca

SEQ ID NO: 546913 - DNA, 25 bp, Mus musculus
caaagggcctggtaagactgtacca

SEQ ID NO: 546914 - DNA, 25 bp, Mus musculus
caaagggctaaaagacaggccacag

SEQ ID NO: 546915 - DNA, 25 bp, Mus musculus
caaagggctaaatgacaggccacag

SEQ ID NO: 546916 - DNA, 25 bp, Mus musculus
caaagggtacttccctttatgcaga

SEQ ID NO: 546917 - DNA, 25 bp, Mus musculus
caaagggtacttgcctttatgcaga

SEQ ID NO: 546918 - DNA, 25 bp, Mus musculus
caaagggtctcacgtaagcactggc

SEQ ID NO: 546919 - DNA, 25 bp, Mus musculus
caaagggtctcaggtaagcactggc

SEQ ID NO: 546920 - DNA, 25 bp, Mus musculus
caaagggtgagaaaattgaaaagcc

SEQ ID NO: 546921 - DNA, 25 bp, Mus musculus
caaagggtgagataattgaaaagcc

SEQ ID NO: 546922 - DNA, 25 bp, Mus musculus
caaagggtggcaaaggattgtcaga

SEQ ID NO: 546923 - DNA, 25 bp, Mus musculus
caaagggtggcataggattgtcaga

SEQ ID NO: 546924 - DNA, 25 bp, Mus musculus
caaagggttactcggcattctggac

SEQ ID NO: 546925 - DNA, 25 bp, Mus musculus
caaagggttactgggcattctggac

SEQ ID NO: 546926 - DNA, 25 bp, Mus musculus
caaagggttcttacacaaattgatg

SEQ ID NO: 546927 - DNA, 25 bp, Mus musculus
caaagggttctttcacaaattgatg

SEQ ID NO: 546928 - DNA, 25 bp, Mus musculus
caaagggttgagctcctggacaata

SEQ ID NO: 546929 - DNA, 25 bp, Mus musculus
caaagggttgaggtcctggacaata

SEQ ID NO: 546930 - DNA, 25 bp, Mus musculus
caaaggtaacgcagcttgctgtgag

SEQ ID NO: 546931 - DNA, 25 bp, Mus musculus
caaaggtaacgctgcttgctgtgag

SEQ ID NO: 546932 - DNA, 25 bp, Mus musculus
caaaggtaagtcaagaaggaggcac

SEQ ID NO: 546933 - DNA, 25 bp, Mus musculus
caaaggtaagtctagaaggaggcac

SEQ ID NO: 546934 - DNA, 25 bp, Mus musculus
caaaggtactatagaagaactggct

SEQ ID NO: 546935 - DNA, 25 bp, Mus musculus
caaaggtactattgaagaactggct

SEQ ID NO: 546936 - DNA, 25 bp, Mus musculus
caaaggtactgcaaggccagtctag

SEQ ID NO: 546937 - DNA, 25 bp, Mus musculus
caaaggtactgctaggccagtctag

SEQ ID NO: 546938 - DNA, 25 bp, Mus musculus
caaaggtcaaccagaagagacctcc

SEQ ID NO: 546939 - DNA, 25 bp, Mus musculus
caaaggtcaaccctgtgcatgtgct

SEQ ID NO: 546940 - DNA, 25 bp, Mus musculus
caaaggtcaaccgtgtgcatgtgct

SEQ ID NO: 546941 - DNA, 25 bp, Mus musculus
caaaggtcaacctgaagagacctcc

SEQ ID NO: 546942 - DNA, 25 bp, Mus musculus
caaaggtcaaggcagtaaggtgttc

SEQ ID NO: 546943 - DNA, 25 bp, Mus musculus
caaaggtcaagggagtaaggtgttc

SEQ ID NO: 546944 - DNA, 25 bp, Mus musculus
caaaggtcaccaagaaggagatctt

SEQ ID NO: 546945 - DNA, 25 bp, Mus musculus
caaaggtcaccatgaaggagatctt

SEQ ID NO: 546946 - DNA, 25 bp, Mus musculus
caaaggtcgagacgccgtgagtatc

SEQ ID NO: 546947 - DNA, 25 bp, Mus musculus
caaaggtcgagaggccgtgagtatc

SEQ ID NO: 546948 - DNA, 25 bp, Mus musculus
caaaggtctctgctcccgctcagat

SEQ ID NO: 546949 - DNA, 25 bp, Mus musculus
caaaggtctctggtcccgctcagat

SEQ ID NO: 546950 - DNA, 25 bp, Mus musculus
caaaggtgaatgctgagcacaagga

SEQ ID NO: 546951 - DNA, 25 bp, Mus musculus
caaaggtgaatggtgagcacaagga

SEQ ID NO: 546952 - DNA, 25 bp, Mus musculus
caaaggtgacaacacgagcttctct

SEQ ID NO: 546953 - DNA, 25 bp, Mus musculus
caaaggtgacaagacgagcttctct

SEQ ID NO: 546954 - DNA, 25 bp, Mus musculus
caaaggtgagagctttcgttttcct

SEQ ID NO: 546955 - DNA, 25 bp, Mus musculus
caaaggtgagaggtttcgttttcct

SEQ ID NO: 546956 - DNA, 25 bp, Mus musculus
caaaggtgaggaattatttgaagat

SEQ ID NO: 546957 - DNA, 25 bp, Mus musculus
caaaggtgaggatttatttgaagat

SEQ ID NO: 546958 - DNA, 25 bp, Mus musculus
caaaggtgattgcagagctaatcca

SEQ ID NO: 546959 - DNA, 25 bp, Mus musculus
caaaggtgattggagagctaatcca

SEQ ID NO: 546960 - DNA, 25 bp, Mus musculus
caaaggtggagccagcagtcagttc

SEQ ID NO: 546961 - DNA, 25 bp, Mus musculus
caaaggtggagcgagcagtcagttc

SEQ ID NO: 546962 - DNA, 25 bp, Mus musculus
caaaggtgtgctctctgactttatg

SEQ ID NO: 546963 - DNA, 25 bp, Mus musculus
caaaggtgtgctgtctgactttatg

SEQ ID NO: 546964 - DNA, 25 bp, Mus musculus
caaaggtgtttgagcatattggaaa

SEQ ID NO: 546965 - DNA, 25 bp, Mus musculus
caaaggtgtttgtgcatattggaaa

SEQ ID NO: 546966 - DNA, 25 bp, Mus musculus
caaaggttatatctcccctagagaa

SEQ ID NO: 546967 - DNA, 25 bp, Mus musculus
caaaggttatatgtcccctagagaa

SEQ ID NO: 546968 - DNA, 25 bp, Mus musculus
caaaggttcaacacaagcatccggg

SEQ ID NO: 546969 - DNA, 25 bp, Mus musculus
caaaggttcaactcaagcatccggg

SEQ ID NO: 546970 - DNA, 25 bp, Mus musculus
caaaggttccaaccaggtgggcagc

SEQ ID NO: 546971 - DNA, 25 bp, Mus musculus
caaaggttccaagcaggtgggcagc

SEQ ID NO: 546972 - DNA, 25 bp, Mus musculus
caaaggttctgacgctcactgcaag

SEQ ID NO: 546973 - DNA, 25 bp, Mus musculus
caaaggttctgaggctcactgcaag

SEQ ID NO: 546974 - DNA, 25 bp, Mus musculus
caaaggtttcaaatggagtcttaag

SEQ ID NO: 546975 - DNA, 25 bp, Mus musculus
caaaggtttcaattggagtcttaag

SEQ ID NO: 546976 - DNA, 25 bp, Mus musculus
caaaggtttcgaaatcgtgtgagga

SEQ ID NO: 546977 - DNA, 25 bp, Mus musculus
caaaggtttcgatatcgtgtgagga

SEQ ID NO: 546978 - DNA, 25 bp, Mus musculus
caaagtaaggcaaggactgaatccc

SEQ ID NO: 546979 - DNA, 25 bp, Mus musculus
caaagtaaggcatggactgaatccc

SEQ ID NO: 546980 - DNA, 25 bp, Mus musculus
caaagtaagtaaatggaacaagcag

SEQ ID NO: 546981 - DNA, 25 bp, Mus musculus
caaagtaagtaattggaacaagcag

SEQ ID NO: 546982 - DNA, 25 bp, Mus musculus
caaagtacaacacctgcctaaatac

SEQ ID NO: 546983 - DNA, 25 bp, Mus musculus
caaagtacaacagctgcctaaatac

SEQ ID NO: 546984 - DNA, 25 bp, Mus musculus
caaagtacacttactgcgggaatgt

SEQ ID NO: 546985 - DNA, 25 bp, Mus musculus
caaagtacactttctgcgggaatgt

SEQ ID NO: 546986 - DNA, 25 bp, Mus musculus
caaagtacagaaagtcgcagttaac

SEQ ID NO: 546987 - DNA, 25 bp, Mus musculus
caaagtacagaatgtcgcagttaac

SEQ ID NO: 546988 - DNA, 25 bp, Mus musculus
caaagtacagatactgggaaaacag

SEQ ID NO: 546989 - DNA, 25 bp, Mus musculus
caaagtacagattctgggaaaacag

SEQ ID NO: 546990 - DNA, 25 bp, Mus musculus
caaagtacctacaatgtgtgtggac

SEQ ID NO: 546991 - DNA, 25 bp, Mus musculus
caaagtacctactatgtgtgtggac

SEQ ID NO: 546992 - DNA, 25 bp, Mus musculus
caaagtacttggctacgtcacgggt

SEQ ID NO: 546993 - DNA, 25 bp, Mus musculus
caaagtacttgggtacgtcacgggt

SEQ ID NO: 546994 - DNA, 25 bp, Mus musculus
caaagtagagatagaccctgttacg

SEQ ID NO: 546995 - DNA, 25 bp, Mus musculus
caaagtagagattgaccctgttacg

SEQ ID NO: 546996 - DNA, 25 bp, Mus musculus
caaagtagcatcaccattgtttgaa

SEQ ID NO: 546997 - DNA, 25 bp, Mus musculus
caaagtagcatctccattgtttgaa

SEQ ID NO: 546998 - DNA, 25 bp, Mus musculus
caaagtagcttgattggaccctctg

SEQ ID NO: 546999 - DNA, 25 bp, Mus musculus
caaagtagcttgtttggaccctctg

SEQ ID NO: 547000 - DNA, 25 bp, Mus musculus
caaagtaggcagaaataatgagaaa

SEQ ID NO: 547001 - DNA, 25 bp, Mus musculus
caaagtaggcagtaataatgagaaa

SEQ ID NO: 547002 - DNA, 25 bp, Mus musculus
caaagtagtgtcaaacttcatggat

SEQ ID NO: 547003 - DNA, 25 bp, Mus musculus
caaagtagtgtctaacttcatggat

SEQ ID NO: 547004 - DNA, 25 bp, Mus musculus
caaagtatatttctaagtaagtgct

SEQ ID NO: 547005 - DNA, 25 bp, Mus musculus
caaagtatatttgtaagtaagtgct

SEQ ID NO: 547006 - DNA, 25 bp, Mus musculus
caaagtatcagaagggattgacttt

SEQ ID NO: 547007 - DNA, 25 bp, Mus musculus
caaagtatcagatgggattgacttt

SEQ ID NO: 547008 - DNA, 25 bp, Mus musculus
caaagtatgcatcgatttgaatgat

SEQ ID NO: 547009 - DNA, 25 bp, Mus musculus
caaagtatgcatggatttgaatgat

SEQ ID NO: 547010 - DNA, 25 bp, Mus musculus
caaagtcaacctcaccttattggag

SEQ ID NO: 547011 - DNA, 25 bp, Mus musculus
caaagtcaacctgaccttattggag

SEQ ID NO: 547012 - DNA, 25 bp, Mus musculus
caaagtcaccaacgctatgaaccag

SEQ ID NO: 547013 - DNA, 25 bp, Mus musculus
caaagtcaccaaggctatgaaccag

SEQ ID NO: 547014 - DNA, 25 bp, Mus musculus
caaagtcactttctccaaggcccag

SEQ ID NO: 547015 - DNA, 25 bp, Mus musculus
caaagtcactttgtccaaggcccag

SEQ ID NO: 547016 - DNA, 25 bp, Mus musculus
caaagtcagcatactgtcaaccttc

SEQ ID NO: 547017 - DNA, 25 bp, Mus musculus
caaagtcagcattctgtcaaccttc

SEQ ID NO: 547018 - DNA, 25 bp, Mus musculus
caaagtcagcgaacaagcactggtc

SEQ ID NO: 547019 - DNA, 25 bp, Mus musculus
caaagtcagcgatcaagcactggtc

SEQ ID NO: 547020 - DNA, 25 bp, Mus musculus
caaagtcattaccaacaaagctgtt

SEQ ID NO: 547021 - DNA, 25 bp, Mus musculus
caaagtcattacgaacaaagctgtt

SEQ ID NO: 547022 - DNA, 25 bp, Mus musculus
caaagtcattccaacaccgggtaag

SEQ ID NO: 547023 - DNA, 25 bp, Mus musculus
caaagtcattcctacaccgggtaag

SEQ ID NO: 547024 - DNA, 25 bp, Mus musculus
caaagtcattgaacagcagaatgag

SEQ ID NO: 547025 - DNA, 25 bp, Mus musculus
caaagtcattgatcagcagaatgag

SEQ ID NO: 547026 - DNA, 25 bp, Mus musculus
caaagtccaggcacaatacccagga

SEQ ID NO: 547027 - DNA, 25 bp, Mus musculus
caaagtccaggctcaatacccagga

SEQ ID NO: 547028 - DNA, 25 bp, Mus musculus
caaagtcccaaacctcgaagcagcg

SEQ ID NO: 547029 - DNA, 25 bp, Mus musculus
caaagtcccaaagctcgaagcagcg

SEQ ID NO: 547030 - DNA, 25 bp, Mus musculus
caaagtcccagtcgccatcagggtc

SEQ ID NO: 547031 - DNA, 25 bp, Mus musculus
caaagtcccagtggccatcagggtc

SEQ ID NO: 547032 - DNA, 25 bp, Mus musculus
caaagtcccatgatggctaggcgcc

SEQ ID NO: 547033 - DNA, 25 bp, Mus musculus
caaagtcccatgttggctaggcgcc

SEQ ID NO: 547034 - DNA, 25 bp, Mus musculus
caaagtccctcacacatttgctgtc

SEQ ID NO: 547035 - DNA, 25 bp, Mus musculus
caaagtccctcagacatttgctgtc

SEQ ID NO: 547036 - DNA, 25 bp, Mus musculus
caaagtccggaaagtggcgactcca

SEQ ID NO: 547037 - DNA, 25 bp, Mus musculus
caaagtccggaatgtggcgactcca

SEQ ID NO: 547038 - DNA, 25 bp, Mus musculus
caaagtcctcaccttctacagaaag

SEQ ID NO: 547039 - DNA, 25 bp, Mus musculus
caaagtcctcacgttctacagaaag

SEQ ID NO: 547040 - DNA, 25 bp, Mus musculus
caaagtcctcgcaggattaccgtcg

SEQ ID NO: 547041 - DNA, 25 bp, Mus musculus
caaagtcctcgctggattaccgtcg

SEQ ID NO: 547042 - DNA, 25 bp, Mus musculus
caaagtcctgtcaagtgttattata

SEQ ID NO: 547043 - DNA, 25 bp, Mus musculus
caaagtcctgtctagtgttattata

SEQ ID NO: 547044 - DNA, 25 bp, Mus musculus
caaagtcgactcaaacatgtgcgtg

SEQ ID NO: 547045 - DNA, 25 bp, Mus musculus
caaagtcgactctaacatgtgcgtg

SEQ ID NO: 547046 - DNA, 25 bp, Mus musculus
caaagtcgaggaatgtatagcaaca

SEQ ID NO: 547047 - DNA, 25 bp, Mus musculus
caaagtcgaggattgtatagcaaca

SEQ ID NO: 547048 - DNA, 25 bp, Mus musculus
caaagtcgcgagctttcctgggcca

SEQ ID NO: 547049 - DNA, 25 bp, Mus musculus
caaagtcgcgaggtttcctgggcca

SEQ ID NO: 547050 - DNA, 25 bp, Mus musculus
caaagtcgtgatcctcagcaaggcg

SEQ ID NO: 547051 - DNA, 25 bp, Mus musculus
caaagtcgtgatgctcagcaaggcg

SEQ ID NO: 547052 - DNA, 25 bp, Mus musculus
caaagtctcggaatccgtggaacag

SEQ ID NO: 547053 - DNA, 25 bp, Mus musculus
caaagtctcggattccgtggaacag

SEQ ID NO: 547054 - DNA, 25 bp, Mus musculus
caaagtctctgcagcaaggtcgagg

SEQ ID NO: 547055 - DNA, 25 bp, Mus musculus
caaagtctctgctgcaaggtcgagg

SEQ ID NO: 547056 - DNA, 25 bp, Mus musculus
caaagtctggctatcagcaagctgc

SEQ ID NO: 547057 - DNA, 25 bp, Mus musculus
caaagtctggctttcagcaagctgc

SEQ ID NO: 547058 - DNA, 25 bp, Mus musculus
caaagtcttaatattcctcatacaa

SEQ ID NO: 547059 - DNA, 25 bp, Mus musculus
caaagtcttaattttcctcatacaa

SEQ ID NO: 547060 - DNA, 25 bp, Mus musculus
caaagtcttacacagacgcatcaag

SEQ ID NO: 547061 - DNA, 25 bp, Mus musculus
caaagtcttacagagacgcatcaag

SEQ ID NO: 547062 - DNA, 25 bp, Mus musculus
caaagtgaaaggactggtctccagc

SEQ ID NO: 547063 - DNA, 25 bp, Mus musculus
caaagtgaaaggtctggtctccagc

SEQ ID NO: 547064 - DNA, 25 bp, Mus musculus
caaagtgaaataccttcagcaaaca

SEQ ID NO: 547065 - DNA, 25 bp, Mus musculus
caaagtgaaatagcttcagcaaaca

SEQ ID NO: 547066 - DNA, 25 bp, Mus musculus
caaagtgaccttcgtgcggctacag

SEQ ID NO: 547067 - DNA, 25 bp, Mus musculus
caaagtgaccttggtgcggctacag

SEQ ID NO: 547068 - DNA, 25 bp, Mus musculus
caaagtgagaggaaccctcctccct

SEQ ID NO: 547069 - DNA, 25 bp, Mus musculus
caaagtgagaggtaccctcctccct

SEQ ID NO: 547070 - DNA, 25 bp, Mus musculus
caaagtgagtctagattctgcggtc

SEQ ID NO: 547071 - DNA, 25 bp, Mus musculus
caaagtgagtcttgattctgcggtc

SEQ ID NO: 547072 - DNA, 25 bp, Mus musculus
caaagtgagtgaacgtctctcccgg

SEQ ID NO: 547073 - DNA, 25 bp, Mus musculus
caaagtgagtgatcgtctctcccgg

SEQ ID NO: 547074 - DNA, 25 bp, Mus musculus
caaagtgcacccacatgttggacca

SEQ ID NO: 547075 - DNA, 25 bp, Mus musculus
caaagtgcaccctcatgttggacca

SEQ ID NO: 547076 - DNA, 25 bp, Mus musculus
caaagtgcagatacacggcagagcc

SEQ ID NO: 547077 - DNA, 25 bp, Mus musculus
caaagtgcagattcacggcagagcc

SEQ ID NO: 547078 - DNA, 25 bp, Mus musculus
caaagtgcatgtcttctacatcgac

SEQ ID NO: 547079 - DNA, 25 bp, Mus musculus
caaagtgcatgtgttctacatcgac

SEQ ID NO: 547080 - DNA, 25 bp, Mus musculus
caaagtgccaccaccatggaaaagg

SEQ ID NO: 547081 - DNA, 25 bp, Mus musculus
caaagtgccacctccatggaaaagg

SEQ ID NO: 547082 - DNA, 25 bp, Mus musculus
caaagtgcccaacggcgtgttcagc

SEQ ID NO: 547083 - DNA, 25 bp, Mus musculus
caaagtgcccaagggcgtgttcagc

SEQ ID NO: 547084 - DNA, 25 bp, Mus musculus
caaagtgcccacaggatccatactt

SEQ ID NO: 547085 - DNA, 25 bp, Mus musculus
caaagtgcccactggatccatactt

SEQ ID NO: 547086 - DNA, 25 bp, Mus musculus
caaagtgcccttaaccaatgaatca

SEQ ID NO: 547087 - DNA, 25 bp, Mus musculus
caaagtgccctttaccaatgaatca

SEQ ID NO: 547088 - DNA, 25 bp, Mus musculus
caaagtgctcaacttaggctgaaca

SEQ ID NO: 547089 - DNA, 25 bp, Mus musculus
caaagtgctcaagttaggctgaaca

SEQ ID NO: 547090 - DNA, 25 bp, Mus musculus
caaagtgctgagactggccaataac

SEQ ID NO: 547091 - DNA, 25 bp, Mus musculus
caaagtgctgagtctggccaataac

SEQ ID NO: 547092 - DNA, 25 bp, Mus musculus
caaagtgctgctcggttcccgggct

SEQ ID NO: 547093 - DNA, 25 bp, Mus musculus
caaagtgctgctgggttcccgggct

SEQ ID NO: 547094 - DNA, 25 bp, Mus musculus
caaagtgcttagctcctagggtgca

SEQ ID NO: 547095 - DNA, 25 bp, Mus musculus
caaagtgcttaggtcctagggtgca

SEQ ID NO: 547096 - DNA, 25 bp, Mus musculus
caaagtggacacaagagaccacagt

SEQ ID NO: 547097 - DNA, 25 bp, Mus musculus
caaagtggacactagagaccacagt

SEQ ID NO: 547098 - DNA, 25 bp, Mus musculus
caaagtggacgtagagtctgggaaa

SEQ ID NO: 547099 - DNA, 25 bp, Mus musculus
caaagtggacgttgagtctgggaaa

SEQ ID NO: 547100 - DNA, 25 bp, Mus musculus
caaagtggagtaagtcaggaagaag

SEQ ID NO: 547101 - DNA, 25 bp, Mus musculus
caaagtggagtatgtcaggaagaag

SEQ ID NO: 547102 - DNA, 25 bp, Mus musculus
caaagtggatcaatcatgcagatga

SEQ ID NO: 547103 - DNA, 25 bp, Mus musculus
caaagtggatcattcatgcagatga

SEQ ID NO: 547104 - DNA, 25 bp, Mus musculus
caaagtggccgtatggatctttcaa

SEQ ID NO: 547105 - DNA, 25 bp, Mus musculus
caaagtggccgtttggatctttcaa

SEQ ID NO: 547106 - DNA, 25 bp, Mus musculus
caaagtggcctgaacctgtattcgg

SEQ ID NO: 547107 - DNA, 25 bp, Mus musculus
caaagtggcctgtacctgtattcgg

SEQ ID NO: 547108 - DNA, 25 bp, Mus musculus
caaagtggcggacatagctcttcat

SEQ ID NO: 547109 - DNA, 25 bp, Mus musculus
caaagtggcggagatagctcttcat

SEQ ID NO: 547110 - DNA, 25 bp, Mus musculus
caaagtggctgcctctgactggaca

SEQ ID NO: 547111 - DNA, 25 bp, Mus musculus
caaagtggctgcgtctgactggaca

SEQ ID NO: 547112 - DNA, 25 bp, Mus musculus
caaagtgggatcacagacgactctg

SEQ ID NO: 547113 - DNA, 25 bp, Mus musculus
caaagtgggatctcagacgactctg

SEQ ID NO: 547114 - DNA, 25 bp, Mus musculus
caaagtgggcatcttcatcaaagtc

SEQ ID NO: 547115 - DNA, 25 bp, Mus musculus
caaagtgggcatgttcatcaaagtc

SEQ ID NO: 547116 - DNA, 25 bp, Mus musculus
caaagtgggccgagagggcatcatc

SEQ ID NO: 547117 - DNA, 25 bp, Mus musculus
caaagtgggccgtgagggcatcatc

SEQ ID NO: 547118 - DNA, 25 bp, Mus musculus
caaagtgggtctctggcattgctgc

SEQ ID NO: 547119 - DNA, 25 bp, Mus musculus
caaagtgggtctgtggcattgctgc

SEQ ID NO: 547120 - DNA, 25 bp, Mus musculus
caaagtggtatcaaccctctcagct

SEQ ID NO: 547121 - DNA, 25 bp, Mus musculus
caaagtggtatctaccctctcagct

SEQ ID NO: 547122 - DNA, 25 bp, Mus musculus
caaagtggtgaaccactggaaacca

SEQ ID NO: 547123 - DNA, 25 bp, Mus musculus
caaagtggtgaagcactggaaacca

SEQ ID NO: 547124 - DNA, 25 bp, Mus musculus
caaagtgtacaactatgaccgcgcc

SEQ ID NO: 547125 - DNA, 25 bp, Mus musculus
caaagtgtacaagtatgaccgcgcc

SEQ ID NO: 547126 - DNA, 25 bp, Mus musculus
caaagtgtcactcacgaatgtctca

SEQ ID NO: 547127 - DNA, 25 bp, Mus musculus
caaagtgtcactgacgaatgtctca

SEQ ID NO: 547128 - DNA, 25 bp, Mus musculus
caaagtgtgccgatgtctcttcggt

SEQ ID NO: 547129 - DNA, 25 bp, Mus musculus
caaagtgtgccgttgtctcttcggt

SEQ ID NO: 547130 - DNA, 25 bp, Mus musculus
caaagttagcagagcgactggtaca

SEQ ID NO: 547131 - DNA, 25 bp, Mus musculus
caaagttagcagtgcgactggtaca

SEQ ID NO: 547132 - DNA, 25 bp, Mus musculus
caaagttatctcatgggcaaaagga

SEQ ID NO: 547133 - DNA, 25 bp, Mus musculus
caaagttatctcttgggcaaaagga

SEQ ID NO: 547134 - DNA, 25 bp, Mus musculus
caaagttcagggagggacaagtact

SEQ ID NO: 547135 - DNA, 25 bp, Mus musculus
caaagttcagggtgggacaagtact

SEQ ID NO: 547136 - DNA, 25 bp, Mus musculus
caaagttccgtccagcaagggcttg

SEQ ID NO: 547137 - DNA, 25 bp, Mus musculus
caaagttccgtcgagcaagggcttg

SEQ ID NO: 547138 - DNA, 25 bp, Mus musculus
caaagttcctgtactcaaagacgga

SEQ ID NO: 547139 - DNA, 25 bp, Mus musculus
caaagttcctgttctcaaagacgga

SEQ ID NO: 547140 - DNA, 25 bp, Mus musculus
caaagttctgatcgttatggtacca

SEQ ID NO: 547141 - DNA, 25 bp, Mus musculus
caaagttctgatggttatggtacca

SEQ ID NO: 547142 - DNA, 25 bp, Mus musculus
caaagttctgtaacacagctgagct

SEQ ID NO: 547143 - DNA, 25 bp, Mus musculus
caaagttctgtatcacagctgagct

SEQ ID NO: 547144 - DNA, 25 bp, Mus musculus
caaagttgaaggctacatacaagat

SEQ ID NO: 547145 - DNA, 25 bp, Mus musculus
caaagttgaagggtacatacaagat

SEQ ID NO: 547146 - DNA, 25 bp, Mus musculus
caaagttgaataacatgctggtggc

SEQ ID NO: 547147 - DNA, 25 bp, Mus musculus
caaagttgaatatcatgctggtggc

SEQ ID NO: 547148 - DNA, 25 bp, Mus musculus
caaagttgagcaagaaaaaggtctt

SEQ ID NO: 547149 - DNA, 25 bp, Mus musculus
caaagttgagcatgaaaaaggtctt

SEQ ID NO: 547150 - DNA, 25 bp, Mus musculus
caaagttgccaacctcgacgggcta

SEQ ID NO: 547151 - DNA, 25 bp, Mus musculus
caaagttgccaagctcgacgggcta

SEQ ID NO: 547152 - DNA, 25 bp, Mus musculus
caaagttgccccagctggctttgac

SEQ ID NO: 547153 - DNA, 25 bp, Mus musculus
caaagttgcccctgctggctttgac

SEQ ID NO: 547154 - DNA, 25 bp, Mus musculus
caaagttggccacatcacagtgtcc

SEQ ID NO: 547155 - DNA, 25 bp, Mus musculus
caaagttggccagatcacagtgtcc

SEQ ID NO: 547156 - DNA, 25 bp, Mus musculus
caaagttggcgaattcttgagctgg

SEQ ID NO: 547157 - DNA, 25 bp, Mus musculus
caaagttggcgatttcttgagctgg

SEQ ID NO: 547158 - DNA, 25 bp, Mus musculus
caaagtttatgtccactacaaaggg

SEQ ID NO: 547159 - DNA, 25 bp, Mus musculus
caaagtttatgtgcactacaaaggg

SEQ ID NO: 547160 - DNA, 25 bp, Mus musculus
caaagtttcagtctgggatccctag

SEQ ID NO: 547161 - DNA, 25 bp, Mus musculus
caaagtttcagtgtgggatccctag

SEQ ID NO: 547162 - DNA, 25 bp, Mus musculus
caaagtttctagagcccctactgga

SEQ ID NO: 547163 - DNA, 25 bp, Mus musculus
caaagtttctagtgcccctactgga

SEQ ID NO: 547164 - DNA, 25 bp, Mus musculus
caaagtttgactctactgaaaatgg

SEQ ID NO: 547165 - DNA, 25 bp, Mus musculus
caaagtttgactgtactgaaaatgg

SEQ ID NO: 547166 - DNA, 25 bp, Mus musculus
caaagtttgatccttcttcgaaaat

SEQ ID NO: 547167 - DNA, 25 bp, Mus musculus
caaagtttgatcgttcttcgaaaat

SEQ ID NO: 547168 - DNA, 25 bp, Mus musculus
caaagtttgcagcaaagaatatgag

SEQ ID NO: 547169 - DNA, 25 bp, Mus musculus
caaagtttgcaggaaagaatatgag

SEQ ID NO: 547170 - DNA, 25 bp, Mus musculus
caaagtttgtttaggtgatggcata

SEQ ID NO: 547171 - DNA, 25 bp, Mus musculus
caaagtttgttttggtgatggcata

SEQ ID NO: 547172 - DNA, 25 bp, Mus musculus
caaataaaccaacatgtgccggtac

SEQ ID NO: 547173 - DNA, 25 bp, Mus musculus
caaataaaccaagatgtgccggtac

SEQ ID NO: 547174 - DNA, 25 bp, Mus musculus
caaataaactgccaagtgactgaga

SEQ ID NO: 547175 - DNA, 25 bp, Mus musculus
caaataaactgcgaagtgactgaga

SEQ ID NO: 547176 - DNA, 25 bp, Mus musculus
caaataaaggatcgcggcttaccag

SEQ ID NO: 547177 - DNA, 25 bp, Mus musculus
caaataaaggatggcggcttaccag

SEQ ID NO: 547178 - DNA, 25 bp, Mus musculus
caaataacagtgaacggagtcaacc

SEQ ID NO: 547179 - DNA, 25 bp, Mus musculus
caaataacagtgtacggagtcaacc

SEQ ID NO: 547180 - DNA, 25 bp, Mus musculus
caaataagaatacatcaagaactca

SEQ ID NO: 547181 - DNA, 25 bp, Mus musculus
caaataagaatagatcaagaactca

SEQ ID NO: 547182 - DNA, 25 bp, Mus musculus
caaataagttttagctccagccgag

SEQ ID NO: 547183 - DNA, 25 bp, Mus musculus
caaataagtttttgctccagccgag

SEQ ID NO: 547184 - DNA, 25 bp, Mus musculus
caaataatgattatctctgtatcca

SEQ ID NO: 547185 - DNA, 25 bp, Mus musculus
caaataatgattttctctgtatcca

SEQ ID NO: 547186 - DNA, 25 bp, Mus musculus
caaataatggaaattcgagtcttcc

SEQ ID NO: 547187 - DNA, 25 bp, Mus musculus
caaataatggaatttcgagtcttcc

SEQ ID NO: 547188 - DNA, 25 bp, Mus musculus
caaataatgtgacagtatcctttct

SEQ ID NO: 547189 - DNA, 25 bp, Mus musculus
caaataatgtgagagtatcctttct

SEQ ID NO: 547190 - DNA, 25 bp, Mus musculus
caaataatgttcagtcagttcccac

SEQ ID NO: 547191 - DNA, 25 bp, Mus musculus
caaataatgttctgtcagttcccac

SEQ ID NO: 547192 - DNA, 25 bp, Mus musculus
caaatacaagggacgggtctgaaca

SEQ ID NO: 547193 - DNA, 25 bp, Mus musculus
caaatacaagggtcgggtctgaaca

SEQ ID NO: 547194 - DNA, 25 bp, Mus musculus
caaatacagtcccagagttctctta

SEQ ID NO: 547195 - DNA, 25 bp, Mus musculus
caaatacagtccgagagttctctta

SEQ ID NO: 547196 - DNA, 25 bp, Mus musculus
caaataccagagagaagtaacttca

SEQ ID NO: 547197 - DNA, 25 bp, Mus musculus
caaataccagagtgaagtaacttca

SEQ ID NO: 547198 - DNA, 25 bp, Mus musculus
caaataccatgtctgtgacccaaag

SEQ ID NO: 547199 - DNA, 25 bp, Mus musculus
caaataccatgtgtgtgacccaaag

SEQ ID NO: 547200 - DNA, 25 bp, Mus musculus
caaataccggaccttctatgaggat

SEQ ID NO: 547201 - DNA, 25 bp, Mus musculus
caaataccggacgttctatgaggat

SEQ ID NO: 547202 - DNA, 25 bp, Mus musculus
caaatacctgtaagggatccgagtg

SEQ ID NO: 547203 - DNA, 25 bp, Mus musculus
caaatacctgtatgggatccgagtg

SEQ ID NO: 547204 - DNA, 25 bp, Mus musculus
caaatactacagcacggcaagtgtg

SEQ ID NO: 547205 - DNA, 25 bp, Mus musculus
caaatactacaggacggcaagtgtg

SEQ ID NO: 547206 - DNA, 25 bp, Mus musculus
caaatactaccgagtcaaccttaga

SEQ ID NO: 547207 - DNA, 25 bp, Mus musculus
caaatactaccgtgtcaaccttaga

SEQ ID NO: 547208 - DNA, 25 bp, Mus musculus
caaatactctgtctgaagcactgag

SEQ ID NO: 547209 - DNA, 25 bp, Mus musculus
caaatactctgtgtgaagcactgag

SEQ ID NO: 547210 - DNA, 25 bp, Mus musculus
caaatactgacgagatacactacca

SEQ ID NO: 547211 - DNA, 25 bp, Mus musculus
caaatactgacgtgatacactacca

SEQ ID NO: 547212 - DNA, 25 bp, Mus musculus
caaatactgcccatgcttacaggtg

SEQ ID NO: 547213 - DNA, 25 bp, Mus musculus
caaatactgcccttgcttacaggtg

SEQ ID NO: 547214 - DNA, 25 bp, Mus musculus
caaatactggagaaatatcaggatc

SEQ ID NO: 547215 - DNA, 25 bp, Mus musculus
caaatactggagtaatatcaggatc

SEQ ID NO: 547216 - DNA, 25 bp, Mus musculus
caaatactgggtaggcacgtttcca

SEQ ID NO: 547217 - DNA, 25 bp, Mus musculus
caaatactgggttggcacgtttcca

SEQ ID NO: 547218 - DNA, 25 bp, Mus musculus
caaatactgtgaacctgtagttaaa

SEQ ID NO: 547219 - DNA, 25 bp, Mus musculus
caaatactgtgatcctgtagttaaa

SEQ ID NO: 547220 - DNA, 25 bp, Mus musculus
caaatactgtggactgggtttacaa

SEQ ID NO: 547221 - DNA, 25 bp, Mus musculus
caaatactgtggtctgggtttacaa

SEQ ID NO: 547222 - DNA, 25 bp, Mus musculus
caaatagaaaagcacatactgcgcg

SEQ ID NO: 547223 - DNA, 25 bp, Mus musculus
caaatagaaaaggacatactgcgcg

SEQ ID NO: 547224 - DNA, 25 bp, Mus musculus
caaatagaccgactcttatgcagcc

SEQ ID NO: 547225 - DNA, 25 bp, Mus musculus
caaatagaccgagtcttatgcagcc

SEQ ID NO: 547226 - DNA, 25 bp, Mus musculus
caaatagatccccaagatccaggcc

SEQ ID NO: 547227 - DNA, 25 bp, Mus musculus
caaatagatcccgaagatccaggcc

SEQ ID NO: 547228 - DNA, 25 bp, Mus musculus
caaatagatgtaaatctgtgtgctc

SEQ ID NO: 547229 - DNA, 25 bp, Mus musculus
caaatagatgtatatctgtgtgctc

SEQ ID NO: 547230 - DNA, 25 bp, Mus musculus
caaatagccaagaggaacttgcagg

SEQ ID NO: 547231 - DNA, 25 bp, Mus musculus
caaatagccaagtggaacttgcagg

SEQ ID NO: 547232 - DNA, 25 bp, Mus musculus
caaatagctgtgaacctaaccgttt

SEQ ID NO: 547233 - DNA, 25 bp, Mus musculus
caaatagctgtgctagagttccttc

SEQ ID NO: 547234 - DNA, 25 bp, Mus musculus
caaatagctgtggtagagttccttc

SEQ ID NO: 547235 - DNA, 25 bp, Mus musculus
caaatagctgtgtacctaaccgttt

SEQ ID NO: 547236 - DNA, 25 bp, Mus musculus
caaataggagagctctacgtggtac

SEQ ID NO: 547237 - DNA, 25 bp, Mus musculus
caaataggagaggtctacgtggtac

SEQ ID NO: 547238 - DNA, 25 bp, Mus musculus
caaataggagcactagatgagtcac

SEQ ID NO: 547239 - DNA, 25 bp, Mus musculus
caaataggagcagtagatgagtcac

SEQ ID NO: 547240 - DNA, 25 bp, Mus musculus
caaatagggagtatcaggtcagtcg

SEQ ID NO: 547241 - DNA, 25 bp, Mus musculus
caaatagggagtttcaggtcagtcg

SEQ ID NO: 547242 - DNA, 25 bp, Mus musculus
caaataggtgaacaccttctcctga

SEQ ID NO: 547243 - DNA, 25 bp, Mus musculus
caaataggtgaagaccttctcctga

SEQ ID NO: 547244 - DNA, 25 bp, Mus musculus
caaatatagggacctaactcagtac

SEQ ID NO: 547245 - DNA, 25 bp, Mus musculus
caaatatagggagctaactcagtac

SEQ ID NO: 547246 - DNA, 25 bp, Mus musculus
caaatatatccaagccttcgtctca

SEQ ID NO: 547247 - DNA, 25 bp, Mus musculus
caaatatatccatgccttcgtctca

SEQ ID NO: 547248 - DNA, 25 bp, Mus musculus
caaatatcccacagtgagcagatgg

SEQ ID NO: 547249 - DNA, 25 bp, Mus musculus
caaatatcccactgtgagcagatgg

SEQ ID NO: 547250 - DNA, 25 bp, Mus musculus
caaatatgaagcaccccaaaccaca

SEQ ID NO: 547251 - DNA, 25 bp, Mus musculus
caaatatgaagctccccaaaccaca

SEQ ID NO: 547252 - DNA, 25 bp, Mus musculus
caaatatgccccaacagcgacaaga

SEQ ID NO: 547253 - DNA, 25 bp, Mus musculus
caaatatgcccctacagcgacaaga

SEQ ID NO: 547254 - DNA, 25 bp, Mus musculus
caaatatggagcctcctgtcaggta

SEQ ID NO: 547255 - DNA, 25 bp, Mus musculus
caaatatggagcgtcctgtcaggta

SEQ ID NO: 547256 - DNA, 25 bp, Mus musculus
caaatatggtatctggcggtctgaa

SEQ ID NO: 547257 - DNA, 25 bp, Mus musculus
caaatatggtatgtggcggtctgaa

SEQ ID NO: 547258 - DNA, 25 bp, Mus musculus
caaatattgccacagaggtgctgct

SEQ ID NO: 547259 - DNA, 25 bp, Mus musculus
caaatattgccagagaggtgctgct

SEQ ID NO: 547260 - DNA, 25 bp, Mus musculus
caaatcaaaaggcaaagctctatag

SEQ ID NO: 547261 - DNA, 25 bp, Mus musculus
caaatcaaaagggaaagctctatag

SEQ ID NO: 547262 - DNA, 25 bp, Mus musculus
caaatcaaagccatgaagacagccc

SEQ ID NO: 547263 - DNA, 25 bp, Mus musculus
caaatcaaagccttgaagacagccc

SEQ ID NO: 547264 - DNA, 25 bp, Mus musculus
caaatcaagatccttatcagagtcc

SEQ ID NO: 547265 - DNA, 25 bp, Mus musculus
caaatcaagatcgttatcagagtcc

SEQ ID NO: 547266 - DNA, 25 bp, Mus musculus
caaatcaatgtgctttctttggaac

SEQ ID NO: 547267 - DNA, 25 bp, Mus musculus
caaatcaatgtggtttctttggaac

SEQ ID NO: 547268 - DNA, 25 bp, Mus musculus
caaatcaattcaactggaagacaag

SEQ ID NO: 547269 - DNA, 25 bp, Mus musculus
caaatcaattcatctggaagacaag

SEQ ID NO: 547270 - DNA, 25 bp, Mus musculus
caaatcacatgaagctaaagatagc

SEQ ID NO: 547271 - DNA, 25 bp, Mus musculus
caaatcacatgatgctaaagatagc

SEQ ID NO: 547272 - DNA, 25 bp, Mus musculus
caaatcacctttaataaggagatca

SEQ ID NO: 547273 - DNA, 25 bp, Mus musculus
caaatcaccttttataaggagatca

SEQ ID NO: 547274 - DNA, 25 bp, Mus musculus
caaatcagaactctgtgagccctgg

SEQ ID NO: 547275 - DNA, 25 bp, Mus musculus
caaatcagaactgtgtgagccctgg

SEQ ID NO: 547276 - DNA, 25 bp, Mus musculus
caaatcagaggtcgaggagtggtcg

SEQ ID NO: 547277 - DNA, 25 bp, Mus musculus
caaatcagaggtggaggagtggtcg

SEQ ID NO: 547278 - DNA, 25 bp, Mus musculus
caaatcaggacgctcagcgtgtgca

SEQ ID NO: 547279 - DNA, 25 bp, Mus musculus
caaatcaggacggtcagcgtgtgca

SEQ ID NO: 547280 - DNA, 25 bp, Mus musculus
caaatcaggctcatgcagctggaac

SEQ ID NO: 547281 - DNA, 25 bp, Mus musculus
caaatcaggctcttgcagctggaac

SEQ ID NO: 547282 - DNA, 25 bp, Mus musculus
caaatcaggttacttcagccgctcc

SEQ ID NO: 547283 - DNA, 25 bp, Mus musculus
caaatcaggttagttcagccgctcc

SEQ ID NO: 547284 - DNA, 25 bp, Mus musculus
caaatcatcaagagcctcaaaggac

SEQ ID NO: 547285 - DNA, 25 bp, Mus musculus
caaatcatcaagtgcctcaaaggac

SEQ ID NO: 547286 - DNA, 25 bp, Mus musculus
caaatcatctttcgatcgtaaacta

SEQ ID NO: 547287 - DNA, 25 bp, Mus musculus
caaatcatctttggatcgtaaacta

SEQ ID NO: 547288 - DNA, 25 bp, Mus musculus
caaatcatgaagcacaggtggatca

SEQ ID NO: 547289 - DNA, 25 bp, Mus musculus
caaatcatgaaggacaggtggatca

SEQ ID NO: 547290 - DNA, 25 bp, Mus musculus
caaatcatgcgcctttgcgggaaca

SEQ ID NO: 547291 - DNA, 25 bp, Mus musculus
caaatcatgcgcgtttgcgggaaca

SEQ ID NO: 547292 - DNA, 25 bp, Mus musculus
caaatcattacaagttcgggagaca

SEQ ID NO: 547293 - DNA, 25 bp, Mus musculus
caaatcattacatgttcgggagaca

SEQ ID NO: 547294 - DNA, 25 bp, Mus musculus
caaatccagcaacaagaatgtgtta

SEQ ID NO: 547295 - DNA, 25 bp, Mus musculus
caaatccagcaagaagaatgtgtta

SEQ ID NO: 547296 - DNA, 25 bp, Mus musculus
caaatccaggatcgacgtgctggta

SEQ ID NO: 547297 - DNA, 25 bp, Mus musculus
caaatccaggatggacgtgctggta

SEQ ID NO: 547298 - DNA, 25 bp, Mus musculus
caaatccatagacaacaaggcactg

SEQ ID NO: 547299 - DNA, 25 bp, Mus musculus
caaatccatagagaacaaggcactg

SEQ ID NO: 547300 - DNA, 25 bp, Mus musculus
caaatccatcgacaataaagcacta

SEQ ID NO: 547301 - DNA, 25 bp, Mus musculus
caaatccatcgagaataaagcacta

SEQ ID NO: 547302 - DNA, 25 bp, Mus musculus
caaatccatcttaaatgaacggaag

SEQ ID NO: 547303 - DNA, 25 bp, Mus musculus
caaatccatctttaatgaacggaag

SEQ ID NO: 547304 - DNA, 25 bp, Mus musculus
caaatcccacggagaccctgaggca

SEQ ID NO: 547305 - DNA, 25 bp, Mus musculus
caaatcccacggtgaccctgaggca

SEQ ID NO: 547306 - DNA, 25 bp, Mus musculus
caaatcccacttcttctgtagactg

SEQ ID NO: 547307 - DNA, 25 bp, Mus musculus
caaatcccacttgttctgtagactg

SEQ ID NO: 547308 - DNA, 25 bp, Mus musculus
caaatccctctgcatgaaattgatg

SEQ ID NO: 547309 - DNA, 25 bp, Mus musculus
caaatccctctggatgaaattgatg

SEQ ID NO: 547310 - DNA, 25 bp, Mus musculus
caaatcccttagatctccaggaagt

SEQ ID NO: 547311 - DNA, 25 bp, Mus musculus
caaatcccttagttctccaggaagt

SEQ ID NO: 547312 - DNA, 25 bp, Mus musculus
caaatccggtaaccctggaggcgat

SEQ ID NO: 547313 - DNA, 25 bp, Mus musculus
caaatccggtaagcctggaggcgat

SEQ ID NO: 547314 - DNA, 25 bp, Mus musculus
caaatccggtaccatgctgtgacaa

SEQ ID NO: 547315 - DNA, 25 bp, Mus musculus
caaatccggtacgatgctgtgacaa

SEQ ID NO: 547316 - DNA, 25 bp, Mus musculus
caaatcctgcggaactttggcatgg

SEQ ID NO: 547317 - DNA, 25 bp, Mus musculus
caaatcctgcggtactttggcatgg

SEQ ID NO: 547318 - DNA, 25 bp, Mus musculus
caaatcctgggtcaccacagatgag

SEQ ID NO: 547319 - DNA, 25 bp, Mus musculus
caaatcctgggtgaccacagatgag

SEQ ID NO: 547320 - DNA, 25 bp, Mus musculus
caaatccttccaaaacagtaacagt

SEQ ID NO: 547321 - DNA, 25 bp, Mus musculus
caaatccttccataacagtaacagt

SEQ ID NO: 547322 - DNA, 25 bp, Mus musculus
caaatcgcagcacgtatggtctacc

SEQ ID NO: 547323 - DNA, 25 bp, Mus musculus
caaatcgcagcaggtatggtctacc

SEQ ID NO: 547324 - DNA, 25 bp, Mus musculus
caaatcgccgcacaccgagtagcag

SEQ ID NO: 547325 - DNA, 25 bp, Mus musculus
caaatcgccgcagaccgagtagcag

SEQ ID NO: 547326 - DNA, 25 bp, Mus musculus
caaatcggacaaatttagtggacaa

SEQ ID NO: 547327 - DNA, 25 bp, Mus musculus
caaatcggacaattttagtggacaa

SEQ ID NO: 547328 - DNA, 25 bp, Mus musculus
caaatcggaggccattgcaaagcca

SEQ ID NO: 547329 - DNA, 25 bp, Mus musculus
caaatcggaggcgattgcaaagcca

SEQ ID NO: 547330 - DNA, 25 bp, Mus musculus
caaatcggcctaagcactctgcaca

SEQ ID NO: 547331 - DNA, 25 bp, Mus musculus
caaatcggcctatgcactctgcaca

SEQ ID NO: 547332 - DNA, 25 bp, Mus musculus
caaatcggtgcactacaatggcagc

SEQ ID NO: 547333 - DNA, 25 bp, Mus musculus
caaatcggtgcagtacaatggcagc

SEQ ID NO: 547334 - DNA, 25 bp, Mus musculus
caaatcgtaacaatcctatagcctg

SEQ ID NO: 547335 - DNA, 25 bp, Mus musculus
caaatcgtaacattcctatagcctg

SEQ ID NO: 547336 - DNA, 25 bp, Mus musculus
caaatctactctcagttccgtgaga

SEQ ID NO: 547337 - DNA, 25 bp, Mus musculus
caaatctactctgagttccgtgaga

SEQ ID NO: 547338 - DNA, 25 bp, Mus musculus
caaatctagacccattatgagccaa

SEQ ID NO: 547339 - DNA, 25 bp, Mus musculus
caaatctagaccgattatgagccaa

SEQ ID NO: 547340 - DNA, 25 bp, Mus musculus
caaatctatagaagctggtggacta

SEQ ID NO: 547341 - DNA, 25 bp, Mus musculus
caaatctatagatgctggtggacta

SEQ ID NO: 547342 - DNA, 25 bp, Mus musculus
caaatctatgaaacgtgaatgcaga

SEQ ID NO: 547343 - DNA, 25 bp, Mus musculus
caaatctatgaatcgtgaatgcaga

SEQ ID NO: 547344 - DNA, 25 bp, Mus musculus
caaatctatggtaatgagggccggg

SEQ ID NO: 547345 - DNA, 25 bp, Mus musculus
caaatctatggttatgagggccggg

SEQ ID NO: 547346 - DNA, 25 bp, Mus musculus
caaatctcatatagaccaacttgtg

SEQ ID NO: 547347 - DNA, 25 bp, Mus musculus
caaatctcatattgaccaacttgtg

SEQ ID NO: 547348 - DNA, 25 bp, Mus musculus
caaatctcggtcacggacccgatct

SEQ ID NO: 547349 - DNA, 25 bp, Mus musculus
caaatctcggtctcggacccgatct

SEQ ID NO: 547350 - DNA, 25 bp, Mus musculus
caaatctctcccagcttttgggcaa

SEQ ID NO: 547351 - DNA, 25 bp, Mus musculus
caaatctctccctgcttttgggcaa

SEQ ID NO: 547352 - DNA, 25 bp, Mus musculus
caaatctctgagctcaaccgtcgat

SEQ ID NO: 547353 - DNA, 25 bp, Mus musculus
caaatctctgaggtcaaccgtcgat

SEQ ID NO: 547354 - DNA, 25 bp, Mus musculus
caaatctggagccaaaaaggaccca

SEQ ID NO: 547355 - DNA, 25 bp, Mus musculus
caaatctggagcgaaaaaggaccca

SEQ ID NO: 547356 - DNA, 25 bp, Mus musculus
caaatctggcctacgggtctcctgc

SEQ ID NO: 547357 - DNA, 25 bp, Mus musculus
caaatctggccttcgggtctcctgc

SEQ ID NO: 547358 - DNA, 25 bp, Mus musculus
caaatctgggatagtgtcttgagct

SEQ ID NO: 547359 - DNA, 25 bp, Mus musculus
caaatctgggattgtgtcttgagct

SEQ ID NO: 547360 - DNA, 25 bp, Mus musculus
caaatcttaaagatgcaaagaatcc

SEQ ID NO: 547361 - DNA, 25 bp, Mus musculus
caaatcttaaagttgcaaagaatcc

SEQ ID NO: 547362 - DNA, 25 bp, Mus musculus
caaatcttagtacccactgcagcac

SEQ ID NO: 547363 - DNA, 25 bp, Mus musculus
caaatcttagtagccactgcagcac

SEQ ID NO: 547364 - DNA, 25 bp, Mus musculus
caaatcttcgaacgactcctcgaag

SEQ ID NO: 547365 - DNA, 25 bp, Mus musculus
caaatcttcgaaggactcctcgaag

SEQ ID NO: 547366 - DNA, 25 bp, Mus musculus
caaatcttcgacaagagctagaaga

SEQ ID NO: 547367 - DNA, 25 bp, Mus musculus
caaatcttcgactagagctagaaga

SEQ ID NO: 547368 - DNA, 25 bp, Mus musculus
caaatcttctccacagcccttggtg

SEQ ID NO: 547369 - DNA, 25 bp, Mus musculus
caaatcttctcctcagcccttggtg

SEQ ID NO: 547370 - DNA, 25 bp, Mus musculus
caaatcttggtcaatgaggtctaca

SEQ ID NO: 547371 - DNA, 25 bp, Mus musculus
caaatcttggtctatgaggtctaca

SEQ ID NO: 547372 - DNA, 25 bp, Mus musculus
caaatctttggacttcaaacttgaa

SEQ ID NO: 547373 - DNA, 25 bp, Mus musculus
caaatctttggagttcaaacttgaa

SEQ ID NO: 547374 - DNA, 25 bp, Mus musculus
caaatcttttgcctgggctccttag

SEQ ID NO: 547375 - DNA, 25 bp, Mus musculus
caaatcttttgcgtgggctccttag

SEQ ID NO: 547376 - DNA, 25 bp, Mus musculus
caaatgaaaaccattgccaggctca

SEQ ID NO: 547377 - DNA, 25 bp, Mus musculus
caaatgaaaacctttgccaggctca

SEQ ID NO: 547378 - DNA, 25 bp, Mus musculus
caaatgaaaactctgccttgaagga

SEQ ID NO: 547379 - DNA, 25 bp, Mus musculus
caaatgaaaactgtgccttgaagga

SEQ ID NO: 547380 - DNA, 25 bp, Mus musculus
caaatgaaataacaatcagatggtc

SEQ ID NO: 547381 - DNA, 25 bp, Mus musculus
caaatgaaataagaatcagatggtc

SEQ ID NO: 547382 - DNA, 25 bp, Mus musculus
caaatgaaatcaagtcaactgtgaa

SEQ ID NO: 547383 - DNA, 25 bp, Mus musculus
caaatgaaatcatgtcaactgtgaa

SEQ ID NO: 547384 - DNA, 25 bp, Mus musculus
caaatgaaattcagaagattcacga

SEQ ID NO: 547385 - DNA, 25 bp, Mus musculus
caaatgaaattctgaagattcacga

SEQ ID NO: 547386 - DNA, 25 bp, Mus musculus
caaatgaagaatccttcaacgctgt

SEQ ID NO: 547387 - DNA, 25 bp, Mus musculus
caaatgaagaatgcttcaacgctgt

SEQ ID NO: 547388 - DNA, 25 bp, Mus musculus
caaatgaatgtgagtgaagcagccc

SEQ ID NO: 547389 - DNA, 25 bp, Mus musculus
caaatgaatgtgtgtgaagcagccc

SEQ ID NO: 547390 - DNA, 25 bp, Mus musculus
caaatgacaatgcaaattggtgtgc

SEQ ID NO: 547391 - DNA, 25 bp, Mus musculus
caaatgacaatggaaattggtgtgc

SEQ ID NO: 547392 - DNA, 25 bp, Mus musculus
caaatgacatacaactgagaacgga

SEQ ID NO: 547393 - DNA, 25 bp, Mus musculus
caaatgacatactactgagaacgga

SEQ ID NO: 547394 - DNA, 25 bp, Mus musculus
caaatgacatagcaggtgccaggac

SEQ ID NO: 547395 - DNA, 25 bp, Mus musculus
caaatgacataggaggtgccaggac

SEQ ID NO: 547396 - DNA, 25 bp, Mus musculus
caaatgacctcaatctgttcttaag

SEQ ID NO: 547397 - DNA, 25 bp, Mus musculus
caaatgacctcattctgttcttaag

SEQ ID NO: 547398 - DNA, 25 bp, Mus musculus
caaatgacgtggatgtcactgtccc

SEQ ID NO: 547399 - DNA, 25 bp, Mus musculus
caaatgacgtggttgtcactgtccc

SEQ ID NO: 547400 - DNA, 25 bp, Mus musculus
caaatgacttctcagctgcgttggg

SEQ ID NO: 547401 - DNA, 25 bp, Mus musculus
caaatgacttctgagctgcgttggg

SEQ ID NO: 547402 - DNA, 25 bp, Mus musculus
caaatgagccgacatctttctatcc

SEQ ID NO: 547403 - DNA, 25 bp, Mus musculus
caaatgagccgagatctttctatcc

SEQ ID NO: 547404 - DNA, 25 bp, Mus musculus
caaatgagcctgagtaccagctgcc

SEQ ID NO: 547405 - DNA, 25 bp, Mus musculus
caaatgagcctgtgtaccagctgcc

SEQ ID NO: 547406 - DNA, 25 bp, Mus musculus
caaatgagtctcaagatcttagcgt

SEQ ID NO: 547407 - DNA, 25 bp, Mus musculus
caaatgagtctctagatcttagcgt

SEQ ID NO: 547408 - DNA, 25 bp, Mus musculus
caaatgatagtgcagaccttgctcg

SEQ ID NO: 547409 - DNA, 25 bp, Mus musculus
caaatgatagtggagaccttgctcg

SEQ ID NO: 547410 - DNA, 25 bp, Mus musculus
caaatgatgaatcttgaggccactt

SEQ ID NO: 547411 - DNA, 25 bp, Mus musculus
caaatgatgaatgttgaggccactt

SEQ ID NO: 547412 - DNA, 25 bp, Mus musculus
caaatgatgcagagtggtccagagt

SEQ ID NO: 547413 - DNA, 25 bp, Mus musculus
caaatgatgcagtgtggtccagagt

SEQ ID NO: 547414 - DNA, 25 bp, Mus musculus
caaatgcaaaccctagtgcctcggg

SEQ ID NO: 547415 - DNA, 25 bp, Mus musculus
caaatgcaaaccgtagtgcctcggg

SEQ ID NO: 547416 - DNA, 25 bp, Mus musculus
caaatgcaaatgcaagttcagacag

SEQ ID NO: 547417 - DNA, 25 bp, Mus musculus
caaatgcaaatggaagttcagacag

SEQ ID NO: 547418 - DNA, 25 bp, Mus musculus
caaatgcaacaacagagtactcaga

SEQ ID NO: 547419 - DNA, 25 bp, Mus musculus
caaatgcaacaagagagtactcaga

SEQ ID NO: 547420 - DNA, 25 bp, Mus musculus
caaatgcaacctcctggcagagaag

SEQ ID NO: 547421 - DNA, 25 bp, Mus musculus
caaatgcaacctgctggcagagaag

SEQ ID NO: 547422 - DNA, 25 bp, Mus musculus
caaatgcaagttcagacagaaaccc

SEQ ID NO: 547423 - DNA, 25 bp, Mus musculus
caaatgcaagttgagacagaaaccc

SEQ ID NO: 547424 - DNA, 25 bp, Mus musculus
caaatgcaggcgaaagtcttccctg

SEQ ID NO: 547425 - DNA, 25 bp, Mus musculus
caaatgcaggcgtaagtcttccctg

SEQ ID NO: 547426 - DNA, 25 bp, Mus musculus
caaatgcatccacaaaaggcggcca

SEQ ID NO: 547427 - DNA, 25 bp, Mus musculus
caaatgcatccagaaaaggcggcca

SEQ ID NO: 547428 - DNA, 25 bp, Mus musculus
caaatgccagatactgatcaccaac

SEQ ID NO: 547429 - DNA, 25 bp, Mus musculus
caaatgccagattctgatcaccaac

SEQ ID NO: 547430 - DNA, 25 bp, Mus musculus
caaatgccatctatctgtacactag

SEQ ID NO: 547431 - DNA, 25 bp, Mus musculus
caaatgccatctttctgtacactag

SEQ ID NO: 547432 - DNA, 25 bp, Mus musculus
caaatgcgagttctgtgacgtccgt

SEQ ID NO: 547433 - DNA, 25 bp, Mus musculus
caaatgcgagttgtgtgacgtccgt

SEQ ID NO: 547434 - DNA, 25 bp, Mus musculus
caaatgcggaatatatgtctccatc

SEQ ID NO: 547435 - DNA, 25 bp, Mus musculus
caaatgcggaatttatgtctccatc

SEQ ID NO: 547436 - DNA, 25 bp, Mus musculus
caaatgcggagcagtgtcggtacct

SEQ ID NO: 547437 - DNA, 25 bp, Mus musculus
caaatgcggagctgtgtcggtacct

SEQ ID NO: 547438 - DNA, 25 bp, Mus musculus
caaatgcggcgcactgggaacaagg

SEQ ID NO: 547439 - DNA, 25 bp, Mus musculus
caaatgcggcgctctgggaacaagg

SEQ ID NO: 547440 - DNA, 25 bp, Mus musculus
caaatgcggtgcaccgtgaagttaa

SEQ ID NO: 547441 - DNA, 25 bp, Mus musculus
caaatgcggtgctccgtgaagttaa

SEQ ID NO: 547442 - DNA, 25 bp, Mus musculus
caaatgctaagccatggccagctgt

SEQ ID NO: 547443 - DNA, 25 bp, Mus musculus
caaatgctaagcgatggccagctgt

SEQ ID NO: 547444 - DNA, 25 bp, Mus musculus
caaatgctccctatgtgctcattgg

SEQ ID NO: 547445 - DNA, 25 bp, Mus musculus
caaatgctccctttgtgctcattgg

SEQ ID NO: 547446 - DNA, 25 bp, Mus musculus
caaatgctcgagatacatatgtttc

SEQ ID NO: 547447 - DNA, 25 bp, Mus musculus
caaatgctcgagttacatatgtttc

SEQ ID NO: 547448 - DNA, 25 bp, Mus musculus
caaatgctgatgacatctacctcca

SEQ ID NO: 547449 - DNA, 25 bp, Mus musculus
caaatgctgatgtcatctacctcca

SEQ ID NO: 547450 - DNA, 25 bp, Mus musculus
caaatgctggaaagaaaatctatga

SEQ ID NO: 547451 - DNA, 25 bp, Mus musculus
caaatgctggaatgaaaatctatga

SEQ ID NO: 547452 - DNA, 25 bp, Mus musculus
caaatgctggctcagtacgtggaga

SEQ ID NO: 547453 - DNA, 25 bp, Mus musculus
caaatgctggctccgctacatcgag

SEQ ID NO: 547454 - DNA, 25 bp, Mus musculus
caaatgctggctgagtacgtggaga

SEQ ID NO: 547455 - DNA, 25 bp, Mus musculus
caaatgctggctgcgctacatcgag

SEQ ID NO: 547456 - DNA, 25 bp, Mus musculus
caaatgctgtcaactctgtggaagg

SEQ ID NO: 547457 - DNA, 25 bp, Mus musculus
caaatgctgtcatctctgtggaagg

SEQ ID NO: 547458 - DNA, 25 bp, Mus musculus
caaatgcttggaagacttattccag

SEQ ID NO: 547459 - DNA, 25 bp, Mus musculus
caaatgcttggatgacttattccag

SEQ ID NO: 547460 - DNA, 25 bp, Mus musculus
caaatggaaactctgtgggctgctg

SEQ ID NO: 547461 - DNA, 25 bp, Mus musculus
caaatggaaactgtgtgggctgctg

SEQ ID NO: 547462 - DNA, 25 bp, Mus musculus
caaatggaacgacatggatgttctg

SEQ ID NO: 547463 - DNA, 25 bp, Mus musculus
caaatggaacgagatggatgttctg

SEQ ID NO: 547464 - DNA, 25 bp, Mus musculus
caaatggaccaacatacgttgtagg

SEQ ID NO: 547465 - DNA, 25 bp, Mus musculus
caaatggaccaagatacgttgtagg

SEQ ID NO: 547466 - DNA, 25 bp, Mus musculus
caaatggacgctccacaggcctggt

SEQ ID NO: 547467 - DNA, 25 bp, Mus musculus
caaatggacgctgcacaggcctggt

SEQ ID NO: 547468 - DNA, 25 bp, Mus musculus
caaatggactaacgtgatgaaggga

SEQ ID NO: 547469 - DNA, 25 bp, Mus musculus
caaatggactaaggtgatgaaggga

SEQ ID NO: 547470 - DNA, 25 bp, Mus musculus
caaatggagactcaatggcttgccg

SEQ ID NO: 547471 - DNA, 25 bp, Mus musculus
caaatggagactgaatggcttgccg

SEQ ID NO: 547472 - DNA, 25 bp, Mus musculus
caaatggagcctctttggaccacga

SEQ ID NO: 547473 - DNA, 25 bp, Mus musculus
caaatggagcctgtttggaccacga

SEQ ID NO: 547474 - DNA, 25 bp, Mus musculus
caaatggaggcccagatagacagga

SEQ ID NO: 547475 - DNA, 25 bp, Mus musculus
caaatggaggccgagatagacagga

SEQ ID NO: 547476 - DNA, 25 bp, Mus musculus
caaatggatgtcaagctccgctcac

SEQ ID NO: 547477 - DNA, 25 bp, Mus musculus
caaatggatgtctagctccgctcac

SEQ ID NO: 547478 - DNA, 25 bp, Mus musculus
caaatggatgtgctcgaaggcctaa

SEQ ID NO: 547479 - DNA, 25 bp, Mus musculus
caaatggatgtggtcgaaggcctaa

SEQ ID NO: 547480 - DNA, 25 bp, Mus musculus
caaatggcaagaatcggtgtaaatc

SEQ ID NO: 547481 - DNA, 25 bp, Mus musculus
caaatggcaagattcggtgtaaatc

SEQ ID NO: 547482 - DNA, 25 bp, Mus musculus
caaatggcatgtcttcagtatgcta

SEQ ID NO: 547483 - DNA, 25 bp, Mus musculus
caaatggcatgtgttcagtatgcta

SEQ ID NO: 547484 - DNA, 25 bp, Mus musculus
caaatggctacaacgaattgttgag

SEQ ID NO: 547485 - DNA, 25 bp, Mus musculus
caaatggctacatcgaattgttgag

SEQ ID NO: 547486 - DNA, 25 bp, Mus musculus
caaatggctgatcgtaactagcaac

SEQ ID NO: 547487 - DNA, 25 bp, Mus musculus
caaatggctgatggtaactagcaac

SEQ ID NO: 547488 - DNA, 25 bp, Mus musculus
caaatgggaacaagatcagcatcct

SEQ ID NO: 547489 - DNA, 25 bp, Mus musculus
caaatgggaacatgatcagcatcct

SEQ ID NO: 547490 - DNA, 25 bp, Mus musculus
caaatgggaccactagtttgccaac

SEQ ID NO: 547491 - DNA, 25 bp, Mus musculus
caaatgggaccagtagtttgccaac

SEQ ID NO: 547492 - DNA, 25 bp, Mus musculus
caaatgggacgcacaatctgagctc

SEQ ID NO: 547493 - DNA, 25 bp, Mus musculus
caaatgggacgctcaatctgagctc

SEQ ID NO: 547494 - DNA, 25 bp, Mus musculus
caaatgggattgatcattggtgcta

SEQ ID NO: 547495 - DNA, 25 bp, Mus musculus
caaatgggattgttcattggtgcta

SEQ ID NO: 547496 - DNA, 25 bp, Mus musculus
caaatgggcgtgattatcactttca

SEQ ID NO: 547497 - DNA, 25 bp, Mus musculus
caaatgggcgtgtttatcactttca

SEQ ID NO: 547498 - DNA, 25 bp, Mus musculus
caaatggtaacaagacatcctgagg

SEQ ID NO: 547499 - DNA, 25 bp, Mus musculus
caaatggtaacatgacatcctgagg

SEQ ID NO: 547500 - DNA, 25 bp, Mus musculus
caaatggtattacttctggaagaac

SEQ ID NO: 547501 - DNA, 25 bp, Mus musculus
caaatggtattagttctggaagaac

SEQ ID NO: 547502 - DNA, 25 bp, Mus musculus
caaatggtggaacgttcgggaccat

SEQ ID NO: 547503 - DNA, 25 bp, Mus musculus
caaatggtggaaggttcgggaccat

SEQ ID NO: 547504 - DNA, 25 bp, Mus musculus
caaatggtggcactgtctccagacc

SEQ ID NO: 547505 - DNA, 25 bp, Mus musculus
caaatggtggcagtgtctccagacc

SEQ ID NO: 547506 - DNA, 25 bp, Mus musculus
caaatggtggcgatcagaatcaaaa

SEQ ID NO: 547507 - DNA, 25 bp, Mus musculus
caaatggtggcgttcagaatcaaaa

SEQ ID NO: 547508 - DNA, 25 bp, Mus musculus
caaatggtgggccttcaaaagcatt

SEQ ID NO: 547509 - DNA, 25 bp, Mus musculus
caaatggtgggcgttcaaaagcatt

SEQ ID NO: 547510 - DNA, 25 bp, Mus musculus
caaatggttatgcatacactggccc

SEQ ID NO: 547511 - DNA, 25 bp, Mus musculus
caaatggttatggatacactggccc

SEQ ID NO: 547512 - DNA, 25 bp, Mus musculus
caaatgtaaaaacaagaactgcact

SEQ ID NO: 547513 - DNA, 25 bp, Mus musculus
caaatgtaaaaagaagaactgcact

SEQ ID NO: 547514 - DNA, 25 bp, Mus musculus
caaatgtacagaagcaatccgggag

SEQ ID NO: 547515 - DNA, 25 bp, Mus musculus
caaatgtacagatgcaatccgggag

SEQ ID NO: 547516 - DNA, 25 bp, Mus musculus
caaatgtattgaacccatcagctgt

SEQ ID NO: 547517 - DNA, 25 bp, Mus musculus
caaatgtattgatcccatcagctgt

SEQ ID NO: 547518 - DNA, 25 bp, Mus musculus
caaatgtcccacatgtggaagaacc

SEQ ID NO: 547519 - DNA, 25 bp, Mus musculus
caaatgtcccacttgtggaagaacc

SEQ ID NO: 547520 - DNA, 25 bp, Mus musculus
caaatgtccccaactaggcaaggtc

SEQ ID NO: 547521 - DNA, 25 bp, Mus musculus
caaatgtccccatctaggcaaggtc

SEQ ID NO: 547522 - DNA, 25 bp, Mus musculus
caaatgtcccgcaggtgaatactgg

SEQ ID NO: 547523 - DNA, 25 bp, Mus musculus
caaatgtcccgctggtgaatactgg

SEQ ID NO: 547524 - DNA, 25 bp, Mus musculus
caaatgtcgaacctcgttctgtggc

SEQ ID NO: 547525 - DNA, 25 bp, Mus musculus
caaatgtcgaacgtcgttctgtggc

SEQ ID NO: 547526 - DNA, 25 bp, Mus musculus
caaatgtctcagcagcaaaatgtca

SEQ ID NO: 547527 - DNA, 25 bp, Mus musculus
caaatgtctcaggagcaaaatgtca

SEQ ID NO: 547528 - DNA, 25 bp, Mus musculus
caaatgtctctgcaagcccggctat

SEQ ID NO: 547529 - DNA, 25 bp, Mus musculus
caaatgtctctggaagcccggctat

SEQ ID NO: 547530 - DNA, 25 bp, Mus musculus
caaatgtctgttcaacagatagacc

SEQ ID NO: 547531 - DNA, 25 bp, Mus musculus
caaatgtctgttgaacagatagacc

SEQ ID NO: 547532 - DNA, 25 bp, Mus musculus
caaatgtgaaaacaaacctggcagc

SEQ ID NO: 547533 - DNA, 25 bp, Mus musculus
caaatgtgaaaagaaacctggcagc

SEQ ID NO: 547534 - DNA, 25 bp, Mus musculus
caaatgtgatgtcaagagaatagct

SEQ ID NO: 547535 - DNA, 25 bp, Mus musculus
caaatgtgatgtgaagagaatagct

SEQ ID NO: 547536 - DNA, 25 bp, Mus musculus
caaatgtgcaaacatcaacagacgg

SEQ ID NO: 547537 - DNA, 25 bp, Mus musculus
caaatgtgcaaagatcaacagacgg

SEQ ID NO: 547538 - DNA, 25 bp, Mus musculus
caaatgtgccgtcatgtatgtgagc

SEQ ID NO: 547539 - DNA, 25 bp, Mus musculus
caaatgtgccgtgatgtatgtgagc

SEQ ID NO: 547540 - DNA, 25 bp, Mus musculus
caaatgtggcatcgaatgaattcac

SEQ ID NO: 547541 - DNA, 25 bp, Mus musculus
caaatgtggcatggaatgaattcac

SEQ ID NO: 547542 - DNA, 25 bp, Mus musculus
caaatgtgggaactgttacttccgc

SEQ ID NO: 547543 - DNA, 25 bp, Mus musculus
caaatgtgggaagtgttacttccgc

SEQ ID NO: 547544 - DNA, 25 bp, Mus musculus
caaatgtgggttaacgatgaagatg

SEQ ID NO: 547545 - DNA, 25 bp, Mus musculus
caaatgtgggtttacgatgaagatg

SEQ ID NO: 547546 - DNA, 25 bp, Mus musculus
caaatgtgtgctcaattttaagcca

SEQ ID NO: 547547 - DNA, 25 bp, Mus musculus
caaatgtgtgctgaattttaagcca

SEQ ID NO: 547548 - DNA, 25 bp, Mus musculus
caaatgtgttaaactgttactgtga

SEQ ID NO: 547549 - DNA, 25 bp, Mus musculus
caaatgtgttaatctgttactgtga

SEQ ID NO: 547550 - DNA, 25 bp, Mus musculus
caaatgtgttctctctggaccacca

SEQ ID NO: 547551 - DNA, 25 bp, Mus musculus
caaatgtgttctgtctggaccacca

SEQ ID NO: 547552 - DNA, 25 bp, Mus musculus
caaatgttagatataggttttgctg

SEQ ID NO: 547553 - DNA, 25 bp, Mus musculus
caaatgttagatttaggttttgctg

SEQ ID NO: 547554 - DNA, 25 bp, Mus musculus
caaatgttgaagctgcttttcagac

SEQ ID NO: 547555 - DNA, 25 bp, Mus musculus
caaatgttgaaggtgcttttcagac

SEQ ID NO: 547556 - DNA, 25 bp, Mus musculus
caaatgtttatcagcttgtgcctct

SEQ ID NO: 547557 - DNA, 25 bp, Mus musculus
caaatgtttatctgcttgtgcctct

SEQ ID NO: 547558 - DNA, 25 bp, Mus musculus
caaatgtttcggatacatctgggaa

SEQ ID NO: 547559 - DNA, 25 bp, Mus musculus
caaatgtttcggttacatctgggaa

SEQ ID NO: 547560 - DNA, 25 bp, Mus musculus
caaattaaaatccaaccaggcactc

SEQ ID NO: 547561 - DNA, 25 bp, Mus musculus
caaattaaaatcgaaccaggcactc

SEQ ID NO: 547562 - DNA, 25 bp, Mus musculus
caaattaccttgctcaaaaaacgtg

SEQ ID NO: 547563 - DNA, 25 bp, Mus musculus
caaattaccttggtcaaaaaacgtg

SEQ ID NO: 547564 - DNA, 25 bp, Mus musculus
caaattagcaaacaggaaaggcggc

SEQ ID NO: 547565 - DNA, 25 bp, Mus musculus
caaattagcaaagaggaaaggcggc

SEQ ID NO: 547566 - DNA, 25 bp, Mus musculus
caaattagccgtcaccaggagcagt

SEQ ID NO: 547567 - DNA, 25 bp, Mus musculus
caaattagccgtgaccaggagcagt

SEQ ID NO: 547568 - DNA, 25 bp, Mus musculus
caaattagtggcaccctctgagcga

SEQ ID NO: 547569 - DNA, 25 bp, Mus musculus
caaattagtggctccctctgagcga

SEQ ID NO: 547570 - DNA, 25 bp, Mus musculus
caaattatgaaacatcggtggatga

SEQ ID NO: 547571 - DNA, 25 bp, Mus musculus
caaattatgaaagatcggtggatga

SEQ ID NO: 547572 - DNA, 25 bp, Mus musculus
caaattatgctcagtccctaggctg

SEQ ID NO: 547573 - DNA, 25 bp, Mus musculus
caaattatgctctgtccctaggctg

SEQ ID NO: 547574 - DNA, 25 bp, Mus musculus
caaattcaaataccggcgcgtggca

SEQ ID NO: 547575 - DNA, 25 bp, Mus musculus
caaattcaaatagcggcgcgtggca

SEQ ID NO: 547576 - DNA, 25 bp, Mus musculus
caaattcaattcagggagtgaagag

SEQ ID NO: 547577 - DNA, 25 bp, Mus musculus
caaattcaattctgggagtgaagag

SEQ ID NO: 547578 - DNA, 25 bp, Mus musculus
caaattcacgttagttattctaagg

SEQ ID NO: 547579 - DNA, 25 bp, Mus musculus
caaattcacgtttgttattctaagg

SEQ ID NO: 547580 - DNA, 25 bp, Mus musculus
caaattcagtctcaaactcagtcac

SEQ ID NO: 547581 - DNA, 25 bp, Mus musculus
caaattcagtctgaaactcagtcac

SEQ ID NO: 547582 - DNA, 25 bp, Mus musculus
caaattccacagagcgtgctgtcac

SEQ ID NO: 547583 - DNA, 25 bp, Mus musculus
caaattccacagtgcgtgctgtcac

SEQ ID NO: 547584 - DNA, 25 bp, Mus musculus
caaattcccttgctcaaagaagtga

SEQ ID NO: 547585 - DNA, 25 bp, Mus musculus
caaattcccttggtcaaagaagtga

SEQ ID NO: 547586 - DNA, 25 bp, Mus musculus
caaattcctcatctgggacaccgct

SEQ ID NO: 547587 - DNA, 25 bp, Mus musculus
caaattcctcatgtgggacaccgct

SEQ ID NO: 547588 - DNA, 25 bp, Mus musculus
caaattcctgctcggacttgggacg

SEQ ID NO: 547589 - DNA, 25 bp, Mus musculus
caaattcctgctgggacttgggacg

SEQ ID NO: 547590 - DNA, 25 bp, Mus musculus
caaattcctttgcagactcggagcg

SEQ ID NO: 547591 - DNA, 25 bp, Mus musculus
caaattcctttggagactcggagcg

SEQ ID NO: 547592 - DNA, 25 bp, Mus musculus
caaattcggaatcgtattgacatcc

SEQ ID NO: 547593 - DNA, 25 bp, Mus musculus
caaattcggaatggtattgacatcc

SEQ ID NO: 547594 - DNA, 25 bp, Mus musculus
caaattctcaaccttggggctggga

SEQ ID NO: 547595 - DNA, 25 bp, Mus musculus
caaattctcaacgttggggctggga

SEQ ID NO: 547596 - DNA, 25 bp, Mus musculus
caaattctggacattcacaagatga

SEQ ID NO: 547597 - DNA, 25 bp, Mus musculus
caaattctggactttcacaagatga

SEQ ID NO: 547598 - DNA, 25 bp, Mus musculus
caaattctggatacagtagcttcac

SEQ ID NO: 547599 - DNA, 25 bp, Mus musculus
caaattctggattcagtagcttcac

SEQ ID NO: 547600 - DNA, 25 bp, Mus musculus
caaattctgtggagaatcttcaaga

SEQ ID NO: 547601 - DNA, 25 bp, Mus musculus
caaattctgtggtgaatcttcaaga

SEQ ID NO: 547602 - DNA, 25 bp, Mus musculus
caaattgaagatcggaaaggcacaa

SEQ ID NO: 547603 - DNA, 25 bp, Mus musculus
caaattgaagatgggaaaggcacaa

SEQ ID NO: 547604 - DNA, 25 bp, Mus musculus
caaattgaatgtcaagcgaaaggaa

SEQ ID NO: 547605 - DNA, 25 bp, Mus musculus
caaattgaatgtgaagcgaaaggaa

SEQ ID NO: 547606 - DNA, 25 bp, Mus musculus
caaattgacccacatcagacaaatc

SEQ ID NO: 547607 - DNA, 25 bp, Mus musculus
caaattgacccagatcagacaaatc

SEQ ID NO: 547608 - DNA, 25 bp, Mus musculus
caaattgagaagaagattggccgag

SEQ ID NO: 547609 - DNA, 25 bp, Mus musculus
caaattgagaagtagattggccgag

SEQ ID NO: 547610 - DNA, 25 bp, Mus musculus
caaattgaggcaacagctgcagctg

SEQ ID NO: 547611 - DNA, 25 bp, Mus musculus
caaattgaggcatcagctgcagctg

SEQ ID NO: 547612 - DNA, 25 bp, Mus musculus
caaattgatgcacacaacaatggat

SEQ ID NO: 547613 - DNA, 25 bp, Mus musculus
caaattgatgcagacaacaatggat

SEQ ID NO: 547614 - DNA, 25 bp, Mus musculus
caaattgcaggtcttgctagccagg

SEQ ID NO: 547615 - DNA, 25 bp, Mus musculus
caaattgcaggtgttgctagccagg

SEQ ID NO: 547616 - DNA, 25 bp, Mus musculus
caaattgccttcaagaacttggtgc

SEQ ID NO: 547617 - DNA, 25 bp, Mus musculus
caaattgccttctagaacttggtgc

SEQ ID NO: 547618 - DNA, 25 bp, Mus musculus
caaattgctgttactgctggctgta

SEQ ID NO: 547619 - DNA, 25 bp, Mus musculus
caaattgctgtttctgctggctgta

SEQ ID NO: 547620 - DNA, 25 bp, Mus musculus
caaattggagaaaatctcatcgtcc

SEQ ID NO: 547621 - DNA, 25 bp, Mus musculus
caaattggagaatatctcatcgtcc

SEQ ID NO: 547622 - DNA, 25 bp, Mus musculus
caaattggagctatttacaaatcga

SEQ ID NO: 547623 - DNA, 25 bp, Mus musculus
caaattggagctttttacaaatcga

SEQ ID NO: 547624 - DNA, 25 bp, Mus musculus
caaattggccgcacagggaaagttc

SEQ ID NO: 547625 - DNA, 25 bp, Mus musculus
caaattggccgctcagggaaagttc

SEQ ID NO: 547626 - DNA, 25 bp, Mus musculus
caaattgggtggctattcttgcatc

SEQ ID NO: 547627 - DNA, 25 bp, Mus musculus
caaattgggtgggtattcttgcatc

SEQ ID NO: 547628 - DNA, 25 bp, Mus musculus
caaattgggttcatgatgcagtctc

SEQ ID NO: 547629 - DNA, 25 bp, Mus musculus
caaattgggttcttgatgcagtctc

SEQ ID NO: 547630 - DNA, 25 bp, Mus musculus
caaattgtccttctcttggctgagc

SEQ ID NO: 547631 - DNA, 25 bp, Mus musculus
caaattgtccttgtcttggctgagc

SEQ ID NO: 547632 - DNA, 25 bp, Mus musculus
caaattgtggctctaaatgttcctc

SEQ ID NO: 547633 - DNA, 25 bp, Mus musculus
caaattgtggctgtaaatgttcctc

SEQ ID NO: 547634 - DNA, 25 bp, Mus musculus
caaatttcgaagagagcgcagcgat

SEQ ID NO: 547635 - DNA, 25 bp, Mus musculus
caaatttcgaagtgagcgcagcgat

SEQ ID NO: 547636 - DNA, 25 bp, Mus musculus
caaatttcgggcaccagaacattcc

SEQ ID NO: 547637 - DNA, 25 bp, Mus musculus
caaatttcgggctccagaacattcc

SEQ ID NO: 547638 - DNA, 25 bp, Mus musculus
caaatttgagaccagagaagatatt

SEQ ID NO: 547639 - DNA, 25 bp, Mus musculus
caaatttgagacgagagaagatatt

SEQ ID NO: 547640 - DNA, 25 bp, Mus musculus
caaatttgagtcaattcgtcattca

SEQ ID NO: 547641 - DNA, 25 bp, Mus musculus
caaatttgagtctattcgtcattca

SEQ ID NO: 547642 - DNA, 25 bp, Mus musculus
caaatttgcctcctgtttctacggt

SEQ ID NO: 547643 - DNA, 25 bp, Mus musculus
caaatttgcctcgtgtttctacggt

SEQ ID NO: 547644 - DNA, 25 bp, Mus musculus
caaatttggcctaaagaactgtgtc

SEQ ID NO: 547645 - DNA, 25 bp, Mus musculus
caaatttggccttaagaactgtgtc

SEQ ID NO: 547646 - DNA, 25 bp, Mus musculus
caaatttggtttctgccctagtgag

SEQ ID NO: 547647 - DNA, 25 bp, Mus musculus
caaatttggtttgtgccctagtgag

SEQ ID NO: 547648 - DNA, 25 bp, Mus musculus
caaatttgtatcaacttaaaaggcg

SEQ ID NO: 547649 - DNA, 25 bp, Mus musculus
caaatttgtatctacttaaaaggcg

SEQ ID NO: 547650 - DNA, 25 bp, Mus musculus
caaatttgtggaccggacattgcgg

SEQ ID NO: 547651 - DNA, 25 bp, Mus musculus
caaatttgtggagcggacattgcgg

SEQ ID NO: 547652 - DNA, 25 bp, Mus musculus
caaattttaaacaagctgagtcatc

SEQ ID NO: 547653 - DNA, 25 bp, Mus musculus
caaattttaaactagctgagtcatc

SEQ ID NO: 547654 - DNA, 25 bp, Mus musculus
caaattttacacagatcccgtggaa

SEQ ID NO: 547655 - DNA, 25 bp, Mus musculus
caaattttacactgatcccgtggaa

SEQ ID NO: 547656 - DNA, 25 bp, Mus musculus
caaattttcgaacagtctttcccat

SEQ ID NO: 547657 - DNA, 25 bp, Mus musculus
caaattttcgaagagtctttcccat

SEQ ID NO: 547658 - DNA, 25 bp, Mus musculus
caaattttggaaattgggcagacac

SEQ ID NO: 547659 - DNA, 25 bp, Mus musculus
caaattttggaatttgggcagacac

SEQ ID NO: 547660 - DNA, 25 bp, Mus musculus
caaatttttcctatctagcctgtgg

SEQ ID NO: 547661 - DNA, 25 bp, Mus musculus
caaatttttcctttctagcctgtgg

SEQ ID NO: 547662 - DNA, 25 bp, Mus musculus
caacaaaaagctagctgcgttctgg

SEQ ID NO: 547663 - DNA, 25 bp, Mus musculus
caacaaaaagcttgctgcgttctgg

SEQ ID NO: 547664 - DNA, 25 bp, Mus musculus
caacaaaacggaactgggcgaggag

SEQ ID NO: 547665 - DNA, 25 bp, Mus musculus
caacaaaacggatctgggcgaggag

SEQ ID NO: 547666 - DNA, 25 bp, Mus musculus
caacaaaagcggaaccagcagataa

SEQ ID NO: 547667 - DNA, 25 bp, Mus musculus
caacaaaagcggtaccagcagataa

SEQ ID NO: 547668 - DNA, 25 bp, Mus musculus
caacaaaataatcagatgaggacag

SEQ ID NO: 547669 - DNA, 25 bp, Mus musculus
caacaaaataatgagatgaggacag

SEQ ID NO: 547670 - DNA, 25 bp, Mus musculus
caacaaacacgaaggtgccctgaag

SEQ ID NO: 547671 - DNA, 25 bp, Mus musculus
caacaaacacgatggtgccctgaag

SEQ ID NO: 547672 - DNA, 25 bp, Mus musculus
caacaaacatatagtgaagatgctg

SEQ ID NO: 547673 - DNA, 25 bp, Mus musculus
caacaaacatattgtgaagatgctg

SEQ ID NO: 547674 - DNA, 25 bp, Mus musculus
caacaaactctgcaatgctaccaag

SEQ ID NO: 547675 - DNA, 25 bp, Mus musculus
caacaaactctggaatgctaccaag

SEQ ID NO: 547676 - DNA, 25 bp, Mus musculus
caacaaactgaacgagatggcacag

SEQ ID NO: 547677 - DNA, 25 bp, Mus musculus
caacaaactgaaggagatggcacag

SEQ ID NO: 547678 - DNA, 25 bp, Mus musculus
caacaaagaagacaacgggaagcca

SEQ ID NO: 547679 - DNA, 25 bp, Mus musculus
caacaaagaagagaacgggaagcca

SEQ ID NO: 547680 - DNA, 25 bp, Mus musculus
caacaaagacccagagtgtgtaaac

SEQ ID NO: 547681 - DNA, 25 bp, Mus musculus
caacaaagaccctgagtgtgtaaac

SEQ ID NO: 547682 - DNA, 25 bp, Mus musculus
caacaaagatctcctggcctgctgg

SEQ ID NO: 547683 - DNA, 25 bp, Mus musculus
caacaaagatctgctggcctgctgg

SEQ ID NO: 547684 - DNA, 25 bp, Mus musculus
caacaaagccaaagcacacatcaag

SEQ ID NO: 547685 - DNA, 25 bp, Mus musculus
caacaaagccaactgggatgcatgg

SEQ ID NO: 547686 - DNA, 25 bp, Mus musculus
caacaaagccaagtgggatgcatgg

SEQ ID NO: 547687 - DNA, 25 bp, Mus musculus
caacaaagccaatgcacacatcaag

SEQ ID NO: 547688 - DNA, 25 bp, Mus musculus
caacaaagccacctgggatgcaaga

SEQ ID NO: 547689 - DNA, 25 bp, Mus musculus
caacaaagccacgtgggatgcaaga

SEQ ID NO: 547690 - DNA, 25 bp, Mus musculus
caacaaagctagatcaaagccagtc

SEQ ID NO: 547691 - DNA, 25 bp, Mus musculus
caacaaagctagttcaaagccagtc

SEQ ID NO: 547692 - DNA, 25 bp, Mus musculus
caacaaaggaatcactatgactgag

SEQ ID NO: 547693 - DNA, 25 bp, Mus musculus
caacaaaggaatgactatgactgag

SEQ ID NO: 547694 - DNA, 25 bp, Mus musculus
caacaaaggccacggatcgaagctg

SEQ ID NO: 547695 - DNA, 25 bp, Mus musculus
caacaaaggccagggatcgaagctg

SEQ ID NO: 547696 - DNA, 25 bp, Mus musculus
caacaaagggctacaaaccagacag

SEQ ID NO: 547697 - DNA, 25 bp, Mus musculus
caacaaagggcttcaaaccagacag

SEQ ID NO: 547698 - DNA, 25 bp, Mus musculus
caacaaagtgcccttaaccaatgaa

SEQ ID NO: 547699 - DNA, 25 bp, Mus musculus
caacaaagtgccgttaaccaatgaa

SEQ ID NO: 547700 - DNA, 25 bp, Mus musculus
caacaaagtggcagacgaactgctc

SEQ ID NO: 547701 - DNA, 25 bp, Mus musculus
caacaaagtggctgacgaactgctc

SEQ ID NO: 547702 - DNA, 25 bp, Mus musculus
caacaaatactgctaacagagtgat

SEQ ID NO: 547703 - DNA, 25 bp, Mus musculus
caacaaatactggtaacagagtgat

SEQ ID NO: 547704 - DNA, 25 bp, Mus musculus
caacaaatcttcatcgaacttaccc

SEQ ID NO: 547705 - DNA, 25 bp, Mus musculus
caacaaatcttcttcgaacttaccc

SEQ ID NO: 547706 - DNA, 25 bp, Mus musculus
caacaaatttcgagacctcttgcag

SEQ ID NO: 547707 - DNA, 25 bp, Mus musculus
caacaaatttcgtgacctcttgcag

SEQ ID NO: 547708 - DNA, 25 bp, Mus musculus
caacaaatttgaaaggctgaaggcc

SEQ ID NO: 547709 - DNA, 25 bp, Mus musculus
caacaaatttgataggctgaaggcc

SEQ ID NO: 547710 - DNA, 25 bp, Mus musculus
caacaaatttttagcgatgtcaaaa

SEQ ID NO: 547711 - DNA, 25 bp, Mus musculus
caacaaattttttgcgatgtcaaaa

SEQ ID NO: 547712 - DNA, 25 bp, Mus musculus
caacaacaataaaggtgatgaaatc

SEQ ID NO: 547713 - DNA, 25 bp, Mus musculus
caacaacaataatggtgatgaaatc

SEQ ID NO: 547714 - DNA, 25 bp, Mus musculus
caacaacagtgccaagagaaacagc

SEQ ID NO: 547715 - DNA, 25 bp, Mus musculus
caacaacagtgcgaagagaaacagc

SEQ ID NO: 547716 - DNA, 25 bp, Mus musculus
caacaacatcaacagtgtcctggag

SEQ ID NO: 547717 - DNA, 25 bp, Mus musculus
caacaacatcaagagtgtcctggag

SEQ ID NO: 547718 - DNA, 25 bp, Mus musculus
caacaacatgaaccagttcatccgc

SEQ ID NO: 547719 - DNA, 25 bp, Mus musculus
caacaacatgaagcagttcatccgc

SEQ ID NO: 547720 - DNA, 25 bp, Mus musculus
caacaaccgtggataagcagagggt

SEQ ID NO: 547721 - DNA, 25 bp, Mus musculus
caacaaccgtggttaagcagagggt

SEQ ID NO: 547722 - DNA, 25 bp, Mus musculus
caacaacctgtacatggaactgaat

SEQ ID NO: 547723 - DNA, 25 bp, Mus musculus
caacaacctgtagatggaactgaat

SEQ ID NO: 547724 - DNA, 25 bp, Mus musculus
caacaacgagtgagagtccaaccct

SEQ ID NO: 547725 - DNA, 25 bp, Mus musculus
caacaacgagtgtgagtccaaccct

SEQ ID NO: 547726 - DNA, 25 bp, Mus musculus
caacaacgggacctatggcaagatc

SEQ ID NO: 547727 - DNA, 25 bp, Mus musculus
caacaacgggacgtatggcaagatc

SEQ ID NO: 547728 - DNA, 25 bp, Mus musculus
caacaacgtgttactgcgccatgaa

SEQ ID NO: 547729 - DNA, 25 bp, Mus musculus
caacaacgtgtttctgcgccatgaa

SEQ ID NO: 547730 - DNA, 25 bp, Mus musculus
caacaactgcacagtgtactgtgga

SEQ ID NO: 547731 - DNA, 25 bp, Mus musculus
caacaactgcactgtgtactgtgga

SEQ ID NO: 547732 - DNA, 25 bp, Mus musculus
caacaactgggtagctaataagact

SEQ ID NO: 547733 - DNA, 25 bp, Mus musculus
caacaactgggttgctaataagact

SEQ ID NO: 547734 - DNA, 25 bp, Mus musculus
caacaactgtatcaagactcagatg

SEQ ID NO: 547735 - DNA, 25 bp, Mus musculus
caacaactgtatgaagactcagatg

SEQ ID NO: 547736 - DNA, 25 bp, Mus musculus
caacaacttgaacgctctgatggcc

SEQ ID NO: 547737 - DNA, 25 bp, Mus musculus
caacaacttgaaggctctgatggcc

SEQ ID NO: 547738 - DNA, 25 bp, Mus musculus
caacaacttgttaggccctaagagg

SEQ ID NO: 547739 - DNA, 25 bp, Mus musculus
caacaacttgtttggccctaagagg

SEQ ID NO: 547740 - DNA, 25 bp, Mus musculus
caacaagaaatcctggcggcgaaac

SEQ ID NO: 547741 - DNA, 25 bp, Mus musculus
caacaagaaatcgtggcggcgaaac

SEQ ID NO: 547742 - DNA, 25 bp, Mus musculus
caacaagaagcccattcatatgtat

SEQ ID NO: 547743 - DNA, 25 bp, Mus musculus
caacaagaagccgattcatatgtat

SEQ ID NO: 547744 - DNA, 25 bp, Mus musculus
caacaagaaggacatggaagaggct

SEQ ID NO: 547745 - DNA, 25 bp, Mus musculus
caacaagaaggagatggaagaggct

SEQ ID NO: 547746 - DNA, 25 bp, Mus musculus
caacaagacagccatcggcgactac

SEQ ID NO: 547747 - DNA, 25 bp, Mus musculus
caacaagacagcgatcggcgactac

SEQ ID NO: 547748 - DNA, 25 bp, Mus musculus
caacaagacggcctcaaggaggtgt

SEQ ID NO: 547749 - DNA, 25 bp, Mus musculus
caacaagacggcgtcaaggaggtgt

SEQ ID NO: 547750 - DNA, 25 bp, Mus musculus
caacaagactgactttgagcgggcc

SEQ ID NO: 547751 - DNA, 25 bp, Mus musculus
caacaagactgagtttgagcgggcc

SEQ ID NO: 547752 - DNA, 25 bp, Mus musculus
caacaagacttgcttattttggaag

SEQ ID NO: 547753 - DNA, 25 bp, Mus musculus
caacaagacttggttattttggaag

SEQ ID NO: 547754 - DNA, 25 bp, Mus musculus
caacaagagaatagtgggctgcatc

SEQ ID NO: 547755 - DNA, 25 bp, Mus musculus
caacaagagaattgtgggctgcatc

SEQ ID NO: 547756 - DNA, 25 bp, Mus musculus
caacaagatgacagggtgctggctc

SEQ ID NO: 547757 - DNA, 25 bp, Mus musculus
caacaagatgactgggtgctggctc

SEQ ID NO: 547758 - DNA, 25 bp, Mus musculus
caacaagatgatccgggctcggcag

SEQ ID NO: 547759 - DNA, 25 bp, Mus musculus
caacaagatgatgcgggctcggcag

SEQ ID NO: 547760 - DNA, 25 bp, Mus musculus
caacaagcaaggctacaaatgcagg

SEQ ID NO: 547761 - DNA, 25 bp, Mus musculus
caacaagcaagggtacaaatgcagg

SEQ ID NO: 547762 - DNA, 25 bp, Mus musculus
caacaagcagaacgcttccggccag

SEQ ID NO: 547763 - DNA, 25 bp, Mus musculus
caacaagcagaaggcttccggccag

SEQ ID NO: 547764 - DNA, 25 bp, Mus musculus
caacaagcatgtcatggtccgagtg

SEQ ID NO: 547765 - DNA, 25 bp, Mus musculus
caacaagcatgtgatggtccgagtg

SEQ ID NO: 547766 - DNA, 25 bp, Mus musculus
caacaagcatttcgtagatgtgtgt

SEQ ID NO: 547767 - DNA, 25 bp, Mus musculus
caacaagcatttggtagatgtgtgt

SEQ ID NO: 547768 - DNA, 25 bp, Mus musculus
caacaagctaaaaacgagataagag

SEQ ID NO: 547769 - DNA, 25 bp, Mus musculus
caacaagctaaatacgagataagag

SEQ ID NO: 547770 - DNA, 25 bp, Mus musculus
caacaagctcttccgattaatgcag

SEQ ID NO: 547771 - DNA, 25 bp, Mus musculus
caacaagctcttgcgattaatgcag

SEQ ID NO: 547772 - DNA, 25 bp, Mus musculus
caacaagctgataagagaactgaag

SEQ ID NO: 547773 - DNA, 25 bp, Mus musculus
caacaagctgattagagaactgaag

SEQ ID NO: 547774 - DNA, 25 bp, Mus musculus
caacaagctgctaaggatctactcc

SEQ ID NO: 547775 - DNA, 25 bp, Mus musculus
caacaagctgcttaggatctactcc

SEQ ID NO: 547776 - DNA, 25 bp, Mus musculus
caacaaggaagaaccccattaaatg

SEQ ID NO: 547777 - DNA, 25 bp, Mus musculus
caacaaggaagatccccattaaatg

SEQ ID NO: 547778 - DNA, 25 bp, Mus musculus
caacaaggacatacgtggttccatc

SEQ ID NO: 547779 - DNA, 25 bp, Mus musculus
caacaaggacattcgtggttccatc

SEQ ID NO: 547780 - DNA, 25 bp, Mus musculus
caacaaggactacgccgactttgtc

SEQ ID NO: 547781 - DNA, 25 bp, Mus musculus
caacaaggactaggccgactttgtc

SEQ ID NO: 547782 - DNA, 25 bp, Mus musculus
caacaaggatccaagggaagcacca

SEQ ID NO: 547783 - DNA, 25 bp, Mus musculus
caacaaggatcctagggaagcacca

SEQ ID NO: 547784 - DNA, 25 bp, Mus musculus
caacaaggatgactagaatgggcca

SEQ ID NO: 547785 - DNA, 25 bp, Mus musculus
caacaaggatgagtagaatgggcca

SEQ ID NO: 547786 - DNA, 25 bp, Mus musculus
caacaaggcactctatgacactttc

SEQ ID NO: 547787 - DNA, 25 bp, Mus musculus
caacaaggcactgtatgacactttc

SEQ ID NO: 547788 - DNA, 25 bp, Mus musculus
caacaaggccatcgcagacgaggtg

SEQ ID NO: 547789 - DNA, 25 bp, Mus musculus
caacaaggccatggcagacgaggtg

SEQ ID NO: 547790 - DNA, 25 bp, Mus musculus
caacaagggaagaaatcgactggtc

SEQ ID NO: 547791 - DNA, 25 bp, Mus musculus
caacaagggaagtaatcgactggtc

SEQ ID NO: 547792 - DNA, 25 bp, Mus musculus
caacaagggccaagtcagctgagca

SEQ ID NO: 547793 - DNA, 25 bp, Mus musculus
caacaagggccatgtcagctgagca

SEQ ID NO: 547794 - DNA, 25 bp, Mus musculus
caacaaggtcttcctactattttga

SEQ ID NO: 547795 - DNA, 25 bp, Mus musculus
caacaaggtcttgctactattttga

SEQ ID NO: 547796 - DNA, 25 bp, Mus musculus
caacaaggtggcaaggcagttatca

SEQ ID NO: 547797 - DNA, 25 bp, Mus musculus
caacaaggtggctaggcagttatca

SEQ ID NO: 547798 - DNA, 25 bp, Mus musculus
caacaagtcactctcattcctggag

SEQ ID NO: 547799 - DNA, 25 bp, Mus musculus
caacaagtcactgtcattcctggag

SEQ ID NO: 547800 - DNA, 25 bp, Mus musculus
caacaagtccctatgtgaagccaaa

SEQ ID NO: 547801 - DNA, 25 bp, Mus musculus
caacaagtccctttgtgaagccaaa

SEQ ID NO: 547802 - DNA, 25 bp, Mus musculus
caacaagtctcaaggtgtctcaaca

SEQ ID NO: 547803 - DNA, 25 bp, Mus musculus
caacaagtctcatggtgtctcaaca

SEQ ID NO: 547804 - DNA, 25 bp, Mus musculus
caacaagtctttcaccaccctggga

SEQ ID NO: 547805 - DNA, 25 bp, Mus musculus
caacaagtctttgaccaccctggga

SEQ ID NO: 547806 - DNA, 25 bp, Mus musculus
caacaagtggagcacattcctgaag

SEQ ID NO: 547807 - DNA, 25 bp, Mus musculus
caacaagtggaggacattcctgaag

SEQ ID NO: 547808 - DNA, 25 bp, Mus musculus
caacaagtggcacaagatggaacag

SEQ ID NO: 547809 - DNA, 25 bp, Mus musculus
caacaagtggcagaagatggaacag

SEQ ID NO: 547810 - DNA, 25 bp, Mus musculus
caacaagttcaactgtcacagtggg

SEQ ID NO: 547811 - DNA, 25 bp, Mus musculus
caacaagttcaagtgtcacagtggg

SEQ ID NO: 547812 - DNA, 25 bp, Mus musculus
caacaagttgaacaagacaccccta

SEQ ID NO: 547813 - DNA, 25 bp, Mus musculus
caacaagttgaagaagacaccccta

SEQ ID NO: 547814 - DNA, 25 bp, Mus musculus
caacaagtttctatggatggtccgg

SEQ ID NO: 547815 - DNA, 25 bp, Mus musculus
caacaagtttctttggatggtccgg

SEQ ID NO: 547816 - DNA, 25 bp, Mus musculus
caacaatactttcacctgtgaggtg

SEQ ID NO: 547817 - DNA, 25 bp, Mus musculus
caacaatactttgacctgtgaggtg

SEQ ID NO: 547818 - DNA, 25 bp, Mus musculus
caacaatagggtcggctttgccaat

SEQ ID NO: 547819 - DNA, 25 bp, Mus musculus
caacaatagggtgggctttgccaat

SEQ ID NO: 547820 - DNA, 25 bp, Mus musculus
caacaatcaagtagcagttcgcaga

SEQ ID NO: 547821 - DNA, 25 bp, Mus musculus
caacaatcaagttgcagttcgcaga

SEQ ID NO: 547822 - DNA, 25 bp, Mus musculus
caacaatgacatccatgaaaggcac

SEQ ID NO: 547823 - DNA, 25 bp, Mus musculus
caacaatgacatgcatgaaaggcac

SEQ ID NO: 547824 - DNA, 25 bp, Mus musculus
caacaatgaggaattccaggtcggc

SEQ ID NO: 547825 - DNA, 25 bp, Mus musculus
caacaatgaggatttccaggtcggc

SEQ ID NO: 547826 - DNA, 25 bp, Mus musculus
caacaatgctatcatttgtgaccta

SEQ ID NO: 547827 - DNA, 25 bp, Mus musculus
caacaatgctatgatttgtgaccta

SEQ ID NO: 547828 - DNA, 25 bp, Mus musculus
caacaatggaacatgcgtggacctg

SEQ ID NO: 547829 - DNA, 25 bp, Mus musculus
caacaatggaacttgcgtggacctg

SEQ ID NO: 547830 - DNA, 25 bp, Mus musculus
caacaatggactagggaaaccacag

SEQ ID NO: 547831 - DNA, 25 bp, Mus musculus
caacaatggacttgggaaaccacag

SEQ ID NO: 547832 - DNA, 25 bp, Mus musculus
caacaatggtcccaagtgtctataa

SEQ ID NO: 547833 - DNA, 25 bp, Mus musculus
caacaatggtccgaagtgtctataa

SEQ ID NO: 547834 - DNA, 25 bp, Mus musculus
caacaatgttttcctggctgcaggc

SEQ ID NO: 547835 - DNA, 25 bp, Mus musculus
caacaatgttttgctggctgcaggc

SEQ ID NO: 547836 - DNA, 25 bp, Mus musculus
caacaattgaaacagactctggcta

SEQ ID NO: 547837 - DNA, 25 bp, Mus musculus
caacaattgaaagagactctggcta

SEQ ID NO: 547838 - DNA, 25 bp, Mus musculus
caacaattggccaagaaattctgcc

SEQ ID NO: 547839 - DNA, 25 bp, Mus musculus
caacaattggcctagaaattctgcc

SEQ ID NO: 547840 - DNA, 25 bp, Mus musculus
caacacacagaaaaatggaacctat

SEQ ID NO: 547841 - DNA, 25 bp, Mus musculus
caacacacagaataatggaacctat

SEQ ID NO: 547842 - DNA, 25 bp, Mus musculus
caacacagatcactgttggccagga

SEQ ID NO: 547843 - DNA, 25 bp, Mus musculus
caacacagatcagtgttggccagga

SEQ ID NO: 547844 - DNA, 25 bp, Mus musculus
caacacagcagtcaccccaggatga

SEQ ID NO: 547845 - DNA, 25 bp, Mus musculus
caacacagcagtgaccccaggatga

SEQ ID NO: 547846 - DNA, 25 bp, Mus musculus
caacacagccaaattcctatcctgg

SEQ ID NO: 547847 - DNA, 25 bp, Mus musculus
caacacagccaatttcctatcctgg

SEQ ID NO: 547848 - DNA, 25 bp, Mus musculus
caacacagccgcctttgctaagagt

SEQ ID NO: 547849 - DNA, 25 bp, Mus musculus
caacacagccgcgtttgctaagagt

SEQ ID NO: 547850 - DNA, 25 bp, Mus musculus
caacacagctcgatatgccgctgca

SEQ ID NO: 547851 - DNA, 25 bp, Mus musculus
caacacagctcgttatgccgctgca

SEQ ID NO: 547852 - DNA, 25 bp, Mus musculus
caacacagctgtatcttagacctag

SEQ ID NO: 547853 - DNA, 25 bp, Mus musculus
caacacagctgtttcttagacctag

SEQ ID NO: 547854 - DNA, 25 bp, Mus musculus
caacacagggtaccaggtccccagt

SEQ ID NO: 547855 - DNA, 25 bp, Mus musculus
caacacagggtagcaggtccccagt

SEQ ID NO: 547856 - DNA, 25 bp, Mus musculus
caacacagtctaagcaccaagagaa

SEQ ID NO: 547857 - DNA, 25 bp, Mus musculus
caacacagtctatgcaccaagagaa

SEQ ID NO: 547858 - DNA, 25 bp, Mus musculus
caacacatctacctctcgactagga

SEQ ID NO: 547859 - DNA, 25 bp, Mus musculus
caacacatctacgtctcgactagga

SEQ ID NO: 547860 - DNA, 25 bp, Mus musculus
caacacattcgcagtgtgcacggag

SEQ ID NO: 547861 - DNA, 25 bp, Mus musculus
caacacattcgctgtgtgcacggag

SEQ ID NO: 547862 - DNA, 25 bp, Mus musculus
caacaccaactaataccagtatggc

SEQ ID NO: 547863 - DNA, 25 bp, Mus musculus
caacaccaactattaccagtatggc

SEQ ID NO: 547864 - DNA, 25 bp, Mus musculus
caacaccaagtacccagaaaaaaga

SEQ ID NO: 547865 - DNA, 25 bp, Mus musculus
caacaccaagtagccagaaaaaaga

SEQ ID NO: 547866 - DNA, 25 bp, Mus musculus
caacaccaagtgaagctatgactct

SEQ ID NO: 547867 - DNA, 25 bp, Mus musculus
caacaccaagtgtagctatgactct

SEQ ID NO: 547868 - DNA, 25 bp, Mus musculus
caacaccagtcaccgtggagacctg

SEQ ID NO: 547869 - DNA, 25 bp, Mus musculus
caacaccagtcagcgtggagacctg

SEQ ID NO: 547870 - DNA, 25 bp, Mus musculus
caacaccagtttcgacagaggcgct

SEQ ID NO: 547871 - DNA, 25 bp, Mus musculus
caacaccagtttggacagaggcgct

SEQ ID NO: 547872 - DNA, 25 bp, Mus musculus
caacacccagggaaagtggttcctg

SEQ ID NO: 547873 - DNA, 25 bp, Mus musculus
caacacccagggtaagtggttcctg

SEQ ID NO: 547874 - DNA, 25 bp, Mus musculus
caacaccccgctcgtgaggataaca

SEQ ID NO: 547875 - DNA, 25 bp, Mus musculus
caacaccccgctggtgaggataaca

SEQ ID NO: 547876 - DNA, 25 bp, Mus musculus
caacaccccggaccaggcagatggt

SEQ ID NO: 547877 - DNA, 25 bp, Mus musculus
caacaccccggagcaggcagatggt

SEQ ID NO: 547878 - DNA, 25 bp, Mus musculus
caacacccctatattcttcatcagg

SEQ ID NO: 547879 - DNA, 25 bp, Mus musculus
caacacccctattttcttcatcagg

SEQ ID NO: 547880 - DNA, 25 bp, Mus musculus
caacacccgacaaagtgcagatgac

SEQ ID NO: 547881 - DNA, 25 bp, Mus musculus
caacacccgacatagtgcagatgac

SEQ ID NO: 547882 - DNA, 25 bp, Mus musculus
caacacccggaaagagattgcggag

SEQ ID NO: 547883 - DNA, 25 bp, Mus musculus
caacacccggaatgagattgcggag

SEQ ID NO: 547884 - DNA, 25 bp, Mus musculus
caacacccgtggacatgtggagcgt

SEQ ID NO: 547885 - DNA, 25 bp, Mus musculus
caacacccgtggtcatgtggagcgt

SEQ ID NO: 547886 - DNA, 25 bp, Mus musculus
caacaccctggaaagccggctggac

SEQ ID NO: 547887 - DNA, 25 bp, Mus musculus
caacaccctggatagccggctggac

SEQ ID NO: 547888 - DNA, 25 bp, Mus musculus
caacaccgacgaactcttcaatgct

SEQ ID NO: 547889 - DNA, 25 bp, Mus musculus
caacaccgacgatctcttcaatgct

SEQ ID NO: 547890 - DNA, 25 bp, Mus musculus
caacaccgataaagcgtgggcggtc

SEQ ID NO: 547891 - DNA, 25 bp, Mus musculus
caacaccgataatgcgtgggcggtc

SEQ ID NO: 547892 - DNA, 25 bp, Mus musculus
caacaccgatacatgtctgacttcg

SEQ ID NO: 547893 - DNA, 25 bp, Mus musculus
caacaccgatacttgtctgacttcg

SEQ ID NO: 547894 - DNA, 25 bp, Mus musculus
caacaccgcccgaggattcatctgt

SEQ ID NO: 547895 - DNA, 25 bp, Mus musculus
caacaccgcccgtggattcatctgt

SEQ ID NO: 547896 - DNA, 25 bp, Mus musculus
caacaccgtgggagctgccgctgag

SEQ ID NO: 547897 - DNA, 25 bp, Mus musculus
caacaccgtgggtgctgccgctgag

SEQ ID NO: 547898 - DNA, 25 bp, Mus musculus
caacacctatgaagatgcagctgcc

SEQ ID NO: 547899 - DNA, 25 bp, Mus musculus
caacacctatgatgatgcagctgcc

SEQ ID NO: 547900 - DNA, 25 bp, Mus musculus
caacacctatgtatcagaccgagag

SEQ ID NO: 547901 - DNA, 25 bp, Mus musculus
caacacctatgtttcagaccgagag

SEQ ID NO: 547902 - DNA, 25 bp, Mus musculus
caacacctgcgacctggtctttgaa

SEQ ID NO: 547903 - DNA, 25 bp, Mus musculus
caacacctgcgagctggtctttgaa

SEQ ID NO: 547904 - DNA, 25 bp, Mus musculus
caacacctgggcactttggtacctc

SEQ ID NO: 547905 - DNA, 25 bp, Mus musculus
caacacctgggctctttggtacctc

SEQ ID NO: 547906 - DNA, 25 bp, Mus musculus
caacacctgtgaaggacaattcccg

SEQ ID NO: 547907 - DNA, 25 bp, Mus musculus
caacacctgtgatggacaattcccg

SEQ ID NO: 547908 - DNA, 25 bp, Mus musculus
caacaccttcaacgaaacagtctga

SEQ ID NO: 547909 - DNA, 25 bp, Mus musculus
caacaccttcaaggaaacagtctga

SEQ ID NO: 547910 - DNA, 25 bp, Mus musculus
caacacgagccaagtcagtatgggc

SEQ ID NO: 547911 - DNA, 25 bp, Mus musculus
caacacgagccatgtcagtatgggc

SEQ ID NO: 547912 - DNA, 25 bp, Mus musculus
caacacgcatttagtgtcacagaac

SEQ ID NO: 547913 - DNA, 25 bp, Mus musculus
caacacgcattttgtgtcacagaac

SEQ ID NO: 547914 - DNA, 25 bp, Mus musculus
caacacgccccgatgtgaagtgtgt

SEQ ID NO: 547915 - DNA, 25 bp, Mus musculus
caacacgccccgttgtgaagtgtgt

SEQ ID NO: 547916 - DNA, 25 bp, Mus musculus
caacacgctaaacggcgctgtgcag

SEQ ID NO: 547917 - DNA, 25 bp, Mus musculus
caacacgctaaagggcgctgtgcag

SEQ ID NO: 547918 - DNA, 25 bp, Mus musculus
caacacgctgatcgccgtcgtggga

SEQ ID NO: 547919 - DNA, 25 bp, Mus musculus
caacacgctgatggccgtcgtggga

SEQ ID NO: 547920 - DNA, 25 bp, Mus musculus
caacacggccatcctaatttgctta

SEQ ID NO: 547921 - DNA, 25 bp, Mus musculus
caacacggccatgctaatttgctta

SEQ ID NO: 547922 - DNA, 25 bp, Mus musculus
caacacggttcgcaaagctcttgct

SEQ ID NO: 547923 - DNA, 25 bp, Mus musculus
caacacggttcggaaagctcttgct

SEQ ID NO: 547924 - DNA, 25 bp, Mus musculus
caacacggttctcgccaggctgaac

SEQ ID NO: 547925 - DNA, 25 bp, Mus musculus
caacacggttctggccaggctgaac

SEQ ID NO: 547926 - DNA, 25 bp, Mus musculus
caacacgtatgcagaaccccaattc

SEQ ID NO: 547927 - DNA, 25 bp, Mus musculus
caacacgtatgctgaaccccaattc

SEQ ID NO: 547928 - DNA, 25 bp, Mus musculus
caacacgtcagcagagcatgatacg

SEQ ID NO: 547929 - DNA, 25 bp, Mus musculus
caacacgtcagctgagcatgatacg

SEQ ID NO: 547930 - DNA, 25 bp, Mus musculus
caacacgtttatcgtgcaacagatc

SEQ ID NO: 547931 - DNA, 25 bp, Mus musculus
caacacgtttatggtgcaacagatc

SEQ ID NO: 547932 - DNA, 25 bp, Mus musculus
caacactatctcagccagctttggg

SEQ ID NO: 547933 - DNA, 25 bp, Mus musculus
caacactatctctgccagctttggg

SEQ ID NO: 547934 - DNA, 25 bp, Mus musculus
caacactcagttctttgggccctca

SEQ ID NO: 547935 - DNA, 25 bp, Mus musculus
caacactcagttgtttgggccctca

SEQ ID NO: 547936 - DNA, 25 bp, Mus musculus
caacactccccacgatgtgcttgtg

SEQ ID NO: 547937 - DNA, 25 bp, Mus musculus
caacactccccaggatgtgcttgtg

SEQ ID NO: 547938 - DNA, 25 bp, Mus musculus
caacactgaaggaggttacacctgc

SEQ ID NO: 547939 - DNA, 25 bp, Mus musculus
caacactgaaggtggttacacctgc

SEQ ID NO: 547940 - DNA, 25 bp, Mus musculus
caacactgagcccaagggactgggt

SEQ ID NO: 547941 - DNA, 25 bp, Mus musculus
caacactgagccgaagggactgggt

SEQ ID NO: 547942 - DNA, 25 bp, Mus musculus
caacactgcaagatttggaacagag

SEQ ID NO: 547943 - DNA, 25 bp, Mus musculus
caacactgcaagttttggaacagag

SEQ ID NO: 547944 - DNA, 25 bp, Mus musculus
caacactgcttaactttatgtcgtg

SEQ ID NO: 547945 - DNA, 25 bp, Mus musculus
caacactgcttacaggtttcttttg

SEQ ID NO: 547946 - DNA, 25 bp, Mus musculus
caacactgcttagaggtttcttttg

SEQ ID NO: 547947 - DNA, 25 bp, Mus musculus
caacactgcttatctttatgtcgtg

SEQ ID NO: 547948 - DNA, 25 bp, Mus musculus
caacactggccgaggtaaggcccca

SEQ ID NO: 547949 - DNA, 25 bp, Mus musculus
caacactggccgtggtaaggcccca

SEQ ID NO: 547950 - DNA, 25 bp, Mus musculus
caacactggcctcataattgcccag

SEQ ID NO: 547951 - DNA, 25 bp, Mus musculus
caacactggcctgataattgcccag

SEQ ID NO: 547952 - DNA, 25 bp, Mus musculus
caacactggtatacctggtcacagg

SEQ ID NO: 547953 - DNA, 25 bp, Mus musculus
caacactggtattcctggtcacagg

SEQ ID NO: 547954 - DNA, 25 bp, Mus musculus
caacactgtccacctgttttctatg

SEQ ID NO: 547955 - DNA, 25 bp, Mus musculus
caacactgtccagctgttttctatg

SEQ ID NO: 547956 - DNA, 25 bp, Mus musculus
caacactgtgccatacattgtggga

SEQ ID NO: 547957 - DNA, 25 bp, Mus musculus
caacactgtgccttacattgtggga

SEQ ID NO: 547958 - DNA, 25 bp, Mus musculus
caacacttgggacactcggaaagga

SEQ ID NO: 547959 - DNA, 25 bp, Mus musculus
caacacttgggagactcggaaagga

SEQ ID NO: 547960 - DNA, 25 bp, Mus musculus
caacactttgccagtgtagtcagac

SEQ ID NO: 547961 - DNA, 25 bp, Mus musculus
caacactttgcctgtgtagtcagac

SEQ ID NO: 547962 - DNA, 25 bp, Mus musculus
caacactttggactcagctgtctct

SEQ ID NO: 547963 - DNA, 25 bp, Mus musculus
caacactttggagtcagctgtctct

SEQ ID NO: 547964 - DNA, 25 bp, Mus musculus
caacagaacactcgaccgatctggg

SEQ ID NO: 547965 - DNA, 25 bp, Mus musculus
caacagaacactggaccgatctggg

SEQ ID NO: 547966 - DNA, 25 bp, Mus musculus
caacagaacggccacggggatcctg

SEQ ID NO: 547967 - DNA, 25 bp, Mus musculus
caacagaacggcgacggggatcctg

SEQ ID NO: 547968 - DNA, 25 bp, Mus musculus
caacagaagaaaaggtagtggtaca

SEQ ID NO: 547969 - DNA, 25 bp, Mus musculus
caacagaagaaatggtagtggtaca

SEQ ID NO: 547970 - DNA, 25 bp, Mus musculus
caacagaagactatgggaaggtgcc

SEQ ID NO: 547971 - DNA, 25 bp, Mus musculus
caacagaagactttgggaaggtgcc

SEQ ID NO: 547972 - DNA, 25 bp, Mus musculus
caacagaagattcggaacactggaa

SEQ ID NO: 547973 - DNA, 25 bp, Mus musculus
caacagaagattgggaacactggaa

SEQ ID NO: 547974 - DNA, 25 bp, Mus musculus
caacagaagctgaatttcgtaatga

SEQ ID NO: 547975 - DNA, 25 bp, Mus musculus
caacagaagctgtatttcgtaatga

SEQ ID NO: 547976 - DNA, 25 bp, Mus musculus
caacagaaggtcaggtttgccaaag

SEQ ID NO: 547977 - DNA, 25 bp, Mus musculus
caacagaaggtctggtttgccaaag

SEQ ID NO: 547978 - DNA, 25 bp, Mus musculus
caacagacaagtctgcattgacccg

SEQ ID NO: 547979 - DNA, 25 bp, Mus musculus
caacagacaagtgtgcattgacccg

SEQ ID NO: 547980 - DNA, 25 bp, Mus musculus
caacagacagaaagagtttctgacc

SEQ ID NO: 547981 - DNA, 25 bp, Mus musculus
caacagacagaatgagtttctgacc

SEQ ID NO: 547982 - DNA, 25 bp, Mus musculus
caacagacagttacgcagccatttc

SEQ ID NO: 547983 - DNA, 25 bp, Mus musculus
caacagacagtttcgcagccatttc

SEQ ID NO: 547984 - DNA, 25 bp, Mus musculus
caacagacatcaatagctcggaggt

SEQ ID NO: 547985 - DNA, 25 bp, Mus musculus
caacagacatcattagctcggaggt

SEQ ID NO: 547986 - DNA, 25 bp, Mus musculus
caacagacatgcagaagccaacaca

SEQ ID NO: 547987 - DNA, 25 bp, Mus musculus
caacagacatgctgaagccaacaca

SEQ ID NO: 547988 - DNA, 25 bp, Mus musculus
caacagacattaacagaactgtcag

SEQ ID NO: 547989 - DNA, 25 bp, Mus musculus
caacagacattatcagaactgtcag

SEQ ID NO: 547990 - DNA, 25 bp, Mus musculus
caacagacattcaacgaactagtgg

SEQ ID NO: 547991 - DNA, 25 bp, Mus musculus
caacagacattctacgaactagtgg

SEQ ID NO: 547992 - DNA, 25 bp, Mus musculus
caacagaccctcataggaaagaagt

SEQ ID NO: 547993 - DNA, 25 bp, Mus musculus
caacagaccctcttaggaaagaagt

SEQ ID NO: 547994 - DNA, 25 bp, Mus musculus
caacagacccttcatggtcattcat

SEQ ID NO: 547995 - DNA, 25 bp, Mus musculus
caacagacccttgatggtcattcat

SEQ ID NO: 547996 - DNA, 25 bp, Mus musculus
caacagacgacgagatctatgacgg

SEQ ID NO: 547997 - DNA, 25 bp, Mus musculus
caacagacgacgtgatctatgacgg

SEQ ID NO: 547998 - DNA, 25 bp, Mus musculus
caacagactggaccgagaggactaa

SEQ ID NO: 547999 - DNA, 25 bp, Mus musculus
caacagactggagcgagaggactaa

SEQ ID NO: 548000 - DNA, 25 bp, Mus musculus
caacagagaaagagactaatacttt

SEQ ID NO: 548001 - DNA, 25 bp, Mus musculus
caacagagaaagtgactaatacttt

SEQ ID NO: 548002 - DNA, 25 bp, Mus musculus
caacagagattgattccaggagaat

SEQ ID NO: 548003 - DNA, 25 bp, Mus musculus
caacagagattgtttccaggagaat

SEQ ID NO: 548004 - DNA, 25 bp, Mus musculus
caacagaggaagatggaattccttc

SEQ ID NO: 548005 - DNA, 25 bp, Mus musculus
caacagaggaagttggaattccttc

SEQ ID NO: 548006 - DNA, 25 bp, Mus musculus
caacagaggcacattccataaagtg

SEQ ID NO: 548007 - DNA, 25 bp, Mus musculus
caacagaggcactttccataaagtg

SEQ ID NO: 548008 - DNA, 25 bp, Mus musculus
caacagagggcaaacctgcaaggtc

SEQ ID NO: 548009 - DNA, 25 bp, Mus musculus
caacagagggcatacctgcaaggtc

SEQ ID NO: 548010 - DNA, 25 bp, Mus musculus
caacagagggtaaaattctgggctc

SEQ ID NO: 548011 - DNA, 25 bp, Mus musculus
caacagagggtataattctgggctc

SEQ ID NO: 548012 - DNA, 25 bp, Mus musculus
caacagagtctgacggaatatacca

SEQ ID NO: 548013 - DNA, 25 bp, Mus musculus
caacagagtctgtcggaatatacca

SEQ ID NO: 548014 - DNA, 25 bp, Mus musculus
caacagagtgaccttaacgatacct

SEQ ID NO: 548015 - DNA, 25 bp, Mus musculus
caacagagtgacgttaacgatacct

SEQ ID NO: 548016 - DNA, 25 bp, Mus musculus
caacagagtgatagctcgggcagag

SEQ ID NO: 548017 - DNA, 25 bp, Mus musculus
caacagagtgattgctcgggcagag

SEQ ID NO: 548018 - DNA, 25 bp, Mus musculus
caacagataacaatccacccatgaa

SEQ ID NO: 548019 - DNA, 25 bp, Mus musculus
caacagataacattccacccatgaa

SEQ ID NO: 548020 - DNA, 25 bp, Mus musculus
caacagatcatcaagttcaccaagg

SEQ ID NO: 548021 - DNA, 25 bp, Mus musculus
caacagatcatctagttcaccaagg

SEQ ID NO: 548022 - DNA, 25 bp, Mus musculus
caacagatctaacgtggaaaaacag

SEQ ID NO: 548023 - DNA, 25 bp, Mus musculus
caacagatctaaggtggaaaaacag

SEQ ID NO: 548024 - DNA, 25 bp, Mus musculus
caacagatgacactggaaggtccag

SEQ ID NO: 548025 - DNA, 25 bp, Mus musculus
caacagatgacagtggaaggtccag

SEQ ID NO: 548026 - DNA, 25 bp, Mus musculus
caacagatgcaacagttcagggaga

SEQ ID NO: 548027 - DNA, 25 bp, Mus musculus
caacagatgcaagagttcagggaga

SEQ ID NO: 548028 - DNA, 25 bp, Mus musculus
caacagatgcacaggctagcagcga

SEQ ID NO: 548029 - DNA, 25 bp, Mus musculus
caacagatgcactggctagcagcga

SEQ ID NO: 548030 - DNA, 25 bp, Mus musculus
caacagatgcgacggctcttcggta

SEQ ID NO: 548031 - DNA, 25 bp, Mus musculus
caacagatgcgagggctcttcggta

SEQ ID NO: 548032 - DNA, 25 bp, Mus musculus
caacagatgctgaacaccgttcatt

SEQ ID NO: 548033 - DNA, 25 bp, Mus musculus
caacagatgctgtacaccgttcatt

SEQ ID NO: 548034 - DNA, 25 bp, Mus musculus
caacagatgcttatggagtcatcaa

SEQ ID NO: 548035 - DNA, 25 bp, Mus musculus
caacagatgcttttggagtcatcaa

SEQ ID NO: 548036 - DNA, 25 bp, Mus musculus
caacagatgtaacgttaaatggacc

SEQ ID NO: 548037 - DNA, 25 bp, Mus musculus
caacagatgtaaggttaaatggacc

SEQ ID NO: 548038 - DNA, 25 bp, Mus musculus
caacagatgtggatttctaaacagg

SEQ ID NO: 548039 - DNA, 25 bp, Mus musculus
caacagatgtggttttctaaacagg

SEQ ID NO: 548040 - DNA, 25 bp, Mus musculus
caacagattggccagtatgtgccta

SEQ ID NO: 548041 - DNA, 25 bp, Mus musculus
caacagattggcgagtatgtgccta

SEQ ID NO: 548042 - DNA, 25 bp, Mus musculus
caacagcaagctctgggctaattcc

SEQ ID NO: 548043 - DNA, 25 bp, Mus musculus
caacagcaagctgtgggctaattcc

SEQ ID NO: 548044 - DNA, 25 bp, Mus musculus
caacagcaaggtcacatcagaagta

SEQ ID NO: 548045 - DNA, 25 bp, Mus musculus
caacagcaaggtgacatcagaagta

SEQ ID NO: 548046 - DNA, 25 bp, Mus musculus
caacagcaatgacatccgtgtggct

SEQ ID NO: 548047 - DNA, 25 bp, Mus musculus
caacagcaatgagatccgtgtggct

SEQ ID NO: 548048 - DNA, 25 bp, Mus musculus
caacagcaccatcgaacgcaagttc

SEQ ID NO: 548049 - DNA, 25 bp, Mus musculus
caacagcaccatggaacgcaagttc

SEQ ID NO: 548050 - DNA, 25 bp, Mus musculus
caacagcagaccacctgagtatgaa

SEQ ID NO: 548051 - DNA, 25 bp, Mus musculus
caacagcagacctcctgagtatgaa

SEQ ID NO: 548052 - DNA, 25 bp, Mus musculus
caacagcagataacagacgccctgg

SEQ ID NO: 548053 - DNA, 25 bp, Mus musculus
caacagcagatatcagacgccctgg

SEQ ID NO: 548054 - DNA, 25 bp, Mus musculus
caacagcagggcatgttggagttgt

SEQ ID NO: 548055 - DNA, 25 bp, Mus musculus
caacagcagggcttgttggagttgt

SEQ ID NO: 548056 - DNA, 25 bp, Mus musculus
caacagcagttgaaaggctgccctg

SEQ ID NO: 548057 - DNA, 25 bp, Mus musculus
caacagcagttgtaaggctgccctg

SEQ ID NO: 548058 - DNA, 25 bp, Mus musculus
caacagcatctgagagatcgacgaa

SEQ ID NO: 548059 - DNA, 25 bp, Mus musculus
caacagcatctgcaaccacaagttc

SEQ ID NO: 548060 - DNA, 25 bp, Mus musculus
caacagcatctgcaatcatcgctac

SEQ ID NO: 548061 - DNA, 25 bp, Mus musculus
caacagcatctggaaccacaagttc

SEQ ID NO: 548062 - DNA, 25 bp, Mus musculus
caacagcatctggaatcatcgctac

SEQ ID NO: 548063 - DNA, 25 bp, Mus musculus
caacagcatctgtgagatcgacgaa

SEQ ID NO: 548064 - DNA, 25 bp, Mus musculus
caacagccaaagaagcaggctgtcg

SEQ ID NO: 548065 - DNA, 25 bp, Mus musculus
caacagccaaagtagcaggctgtcg

SEQ ID NO: 548066 - DNA, 25 bp, Mus musculus
caacagccaaataaagtatcttgac

SEQ ID NO: 548067 - DNA, 25 bp, Mus musculus
caacagccaaattaagtatcttgac

SEQ ID NO: 548068 - DNA, 25 bp, Mus musculus
caacagccacgacaaaactatgagt

SEQ ID NO: 548069 - DNA, 25 bp, Mus musculus
caacagccacgagaaaactatgagt

SEQ ID NO: 548070 - DNA, 25 bp, Mus musculus
caacagccacttcacttctggaagt

SEQ ID NO: 548071 - DNA, 25 bp, Mus musculus
caacagccacttgacttctggaagt

SEQ ID NO: 548072 - DNA, 25 bp, Mus musculus
caacagccatgaataggccagaacc

SEQ ID NO: 548073 - DNA, 25 bp, Mus musculus
caacagccatgattaggccagaacc

SEQ ID NO: 548074 - DNA, 25 bp, Mus musculus
caacagcctatgaaagttctgagag

SEQ ID NO: 548075 - DNA, 25 bp, Mus musculus
caacagcctatgtaagttctgagag

SEQ ID NO: 548076 - DNA, 25 bp, Mus musculus
caacagcctctaccctgatgtcaat

SEQ ID NO: 548077 - DNA, 25 bp, Mus musculus
caacagcctctagcctgatgtcaat

SEQ ID NO: 548078 - DNA, 25 bp, Mus musculus
caacagcgggaacgtgatgtacgcc

SEQ ID NO: 548079 - DNA, 25 bp, Mus musculus
caacagcgggaaggtgatgtacgcc

SEQ ID NO: 548080 - DNA, 25 bp, Mus musculus
caacagcgtgaactacccgtaccat

SEQ ID NO: 548081 - DNA, 25 bp, Mus musculus
caacagcgtgaagtacccgtaccat

SEQ ID NO: 548082 - DNA, 25 bp, Mus musculus
caacagctacatagtcagcacgaag

SEQ ID NO: 548083 - DNA, 25 bp, Mus musculus
caacagctacattgtcagcacgaag

SEQ ID NO: 548084 - DNA, 25 bp, Mus musculus
caacagctcatcacgatttgactgc

SEQ ID NO: 548085 - DNA, 25 bp, Mus musculus
caacagctcatctcgatttgactgc

SEQ ID NO: 548086 - DNA, 25 bp, Mus musculus
caacagctcctcaatgtgaccaagg

SEQ ID NO: 548087 - DNA, 25 bp, Mus musculus
caacagctcctctatgtgaccaagg

SEQ ID NO: 548088 - DNA, 25 bp, Mus musculus
caacagctgaggctaataacctggc

SEQ ID NO: 548089 - DNA, 25 bp, Mus musculus
caacagctgagggtaataacctggc

SEQ ID NO: 548090 - DNA, 25 bp, Mus musculus
caacagctgctaaagaacaagaaat

SEQ ID NO: 548091 - DNA, 25 bp, Mus musculus
caacagctgctatagaacaagaaat

SEQ ID NO: 548092 - DNA, 25 bp, Mus musculus
caacagctggagagtgcctactgct

SEQ ID NO: 548093 - DNA, 25 bp, Mus musculus
caacagctggagtgtgcctactgct

SEQ ID NO: 548094 - DNA, 25 bp, Mus musculus
caacagctgtgacaagggtgacacc

SEQ ID NO: 548095 - DNA, 25 bp, Mus musculus
caacagctgtgagaagggtgacacc

SEQ ID NO: 548096 - DNA, 25 bp, Mus musculus
caacagctgtgtcagttcctgagga

SEQ ID NO: 548097 - DNA, 25 bp, Mus musculus
caacagctgtgtgagttcctgagga

SEQ ID NO: 548098 - DNA, 25 bp, Mus musculus
caacagcttgctccgtaccaggagg

SEQ ID NO: 548099 - DNA, 25 bp, Mus musculus
caacagcttgctgcgtaccaggagg

SEQ ID NO: 548100 - DNA, 25 bp, Mus musculus
caacagctttggcaagaatgtatct

SEQ ID NO: 548101 - DNA, 25 bp, Mus musculus
caacagctttgggaagaatgtatct

SEQ ID NO: 548102 - DNA, 25 bp, Mus musculus
caacaggacagaccttcagtacgag

SEQ ID NO: 548103 - DNA, 25 bp, Mus musculus
caacaggacagagcttcagtacgag

SEQ ID NO: 548104 - DNA, 25 bp, Mus musculus
caacaggacattaggagtcttccca

SEQ ID NO: 548105 - DNA, 25 bp, Mus musculus
caacaggacatttggagtcttccca

SEQ ID NO: 548106 - DNA, 25 bp, Mus musculus
caacaggagacactgcacgttcagg

SEQ ID NO: 548107 - DNA, 25 bp, Mus musculus
caacaggagacagtgcacgttcagg

SEQ ID NO: 548108 - DNA, 25 bp, Mus musculus
caacaggagctgctgtattactgca

SEQ ID NO: 548109 - DNA, 25 bp, Mus musculus
caacaggagctggtgtattactgca

SEQ ID NO: 548110 - DNA, 25 bp, Mus musculus
caacaggaggttagagcgctaccct

SEQ ID NO: 548111 - DNA, 25 bp, Mus musculus
caacaggaggtttgagcgctaccct

SEQ ID NO: 548112 - DNA, 25 bp, Mus musculus
caacaggagtctacgacgtcacacc

SEQ ID NO: 548113 - DNA, 25 bp, Mus musculus
caacaggagtcttcgacgtcacacc

SEQ ID NO: 548114 - DNA, 25 bp, Mus musculus
caacaggagtgaagagatggacatg

SEQ ID NO: 548115 - DNA, 25 bp, Mus musculus
caacaggagtgatgagatggacatg

SEQ ID NO: 548116 - DNA, 25 bp, Mus musculus
caacaggataataaagccatagggc

SEQ ID NO: 548117 - DNA, 25 bp, Mus musculus
caacaggataattaagccatagggc

SEQ ID NO: 548118 - DNA, 25 bp, Mus musculus
caacaggatgcccttgactgtgcca

SEQ ID NO: 548119 - DNA, 25 bp, Mus musculus
caacaggatgccgttgactgtgcca

SEQ ID NO: 548120 - DNA, 25 bp, Mus musculus
caacaggatgtactgtaagattaca

SEQ ID NO: 548121 - DNA, 25 bp, Mus musculus
caacaggatgtagtgtaagattaca

SEQ ID NO: 548122 - DNA, 25 bp, Mus musculus
caacaggcacctcactggtattgaa

SEQ ID NO: 548123 - DNA, 25 bp, Mus musculus
caacaggcacctgactggtattgaa

SEQ ID NO: 548124 - DNA, 25 bp, Mus musculus
caacaggccaggaggtgagttctca

SEQ ID NO: 548125 - DNA, 25 bp, Mus musculus
caacaggccaggtggtgagttctca

SEQ ID NO: 548126 - DNA, 25 bp, Mus musculus
caacaggccattcctttaccaactg

SEQ ID NO: 548127 - DNA, 25 bp, Mus musculus
caacaggccattgctttaccaactg

SEQ ID NO: 548128 - DNA, 25 bp, Mus musculus
caacaggcctttcaagaggctcgaa

SEQ ID NO: 548129 - DNA, 25 bp, Mus musculus
caacaggcctttgaagaggctcgaa

SEQ ID NO: 548130 - DNA, 25 bp, Mus musculus
caacagggacatccattccttctac

SEQ ID NO: 548131 - DNA, 25 bp, Mus musculus
caacagggacatgcattccttctac

SEQ ID NO: 548132 - DNA, 25 bp, Mus musculus
caacagggatcaaaacatactgtgt

SEQ ID NO: 548133 - DNA, 25 bp, Mus musculus
caacagggatcataacatactgtgt

SEQ ID NO: 548134 - DNA, 25 bp, Mus musculus
caacagggatggcagcaataaaata

SEQ ID NO: 548135 - DNA, 25 bp, Mus musculus
caacagggatgggagcaataaaata

SEQ ID NO: 548136 - DNA, 25 bp, Mus musculus
caacagggtaaaagcagcactgctt

SEQ ID NO: 548137 - DNA, 25 bp, Mus musculus
caacagggtaaatgcagcactgctt

SEQ ID NO: 548138 - DNA, 25 bp, Mus musculus
caacagggtcctccatctatagaac

SEQ ID NO: 548139 - DNA, 25 bp, Mus musculus
caacagggtcctgcatctatagaac

SEQ ID NO: 548140 - DNA, 25 bp, Mus musculus
caacaggtcaaactatagttgtcga

SEQ ID NO: 548141 - DNA, 25 bp, Mus musculus
caacaggtcaaagtatagttgtcga

SEQ ID NO: 548142 - DNA, 25 bp, Mus musculus
caacaggtgctgaagatctctccga

SEQ ID NO: 548143 - DNA, 25 bp, Mus musculus
caacaggtgctgtagatctctccga

SEQ ID NO: 548144 - DNA, 25 bp, Mus musculus
caacaggtggacatgctggcctata

SEQ ID NO: 548145 - DNA, 25 bp, Mus musculus
caacaggtggacttgctggcctata

SEQ ID NO: 548146 - DNA, 25 bp, Mus musculus
caacaggtgtagcagatgaggccct

SEQ ID NO: 548147 - DNA, 25 bp, Mus musculus
caacaggtgtaggagatgaggccct

SEQ ID NO: 548148 - DNA, 25 bp, Mus musculus
caacagtaatcacaataacagcaac

SEQ ID NO: 548149 - DNA, 25 bp, Mus musculus
caacagtaatcagaataacagcaac

SEQ ID NO: 548150 - DNA, 25 bp, Mus musculus
caacagtacactcgcaacgattcaa

SEQ ID NO: 548151 - DNA, 25 bp, Mus musculus
caacagtacactggcaacgattcaa

SEQ ID NO: 548152 - DNA, 25 bp, Mus musculus
caacagtactctcatcatcagcaac

SEQ ID NO: 548153 - DNA, 25 bp, Mus musculus
caacagtactctgatcatcagcaac

SEQ ID NO: 548154 - DNA, 25 bp, Mus musculus
caacagtagtaaatggctcaggttt

SEQ ID NO: 548155 - DNA, 25 bp, Mus musculus
caacagtagtaattggctcaggttt

SEQ ID NO: 548156 - DNA, 25 bp, Mus musculus
caacagtattagcatgtccgtggag

SEQ ID NO: 548157 - DNA, 25 bp, Mus musculus
caacagtattaggatgtccgtggag

SEQ ID NO: 548158 - DNA, 25 bp, Mus musculus
caacagtctctacgaagacatcgaa

SEQ ID NO: 548159 - DNA, 25 bp, Mus musculus
caacagtctctaggaagacatcgaa

SEQ ID NO: 548160 - DNA, 25 bp, Mus musculus
caacagtctttgatctttagatcac

SEQ ID NO: 548161 - DNA, 25 bp, Mus musculus
caacagtctttgttctttagatcac

SEQ ID NO: 548162 - DNA, 25 bp, Mus musculus
caacagtgaaaacattcttctgagc

SEQ ID NO: 548163 - DNA, 25 bp, Mus musculus
caacagtgaaaagattcttctgagc

SEQ ID NO: 548164 - DNA, 25 bp, Mus musculus
caacagtgaggtctaattggagaat

SEQ ID NO: 548165 - DNA, 25 bp, Mus musculus
caacagtgaggtgtaattggagaat

SEQ ID NO: 548166 - DNA, 25 bp, Mus musculus
caacagtgccaacgaggtcttccac

SEQ ID NO: 548167 - DNA, 25 bp, Mus musculus
caacagtgccaaggaggtcttccac

SEQ ID NO: 548168 - DNA, 25 bp, Mus musculus
caacagtgcctaactaatgttaata

SEQ ID NO: 548169 - DNA, 25 bp, Mus musculus
caacagtgcctatctaatgttaata

SEQ ID NO: 548170 - DNA, 25 bp, Mus musculus
caacagtgcgaacagaaacagcagc

SEQ ID NO: 548171 - DNA, 25 bp, Mus musculus
caacagtgcgaagagaaacagcagc

SEQ ID NO: 548172 - DNA, 25 bp, Mus musculus
caacagtgcgggagtcctgagtgct

SEQ ID NO: 548173 - DNA, 25 bp, Mus musculus
caacagtgcgggtgtcctgagtgct

SEQ ID NO: 548174 - DNA, 25 bp, Mus musculus
caacagtgctaaagaagacaatgtc

SEQ ID NO: 548175 - DNA, 25 bp, Mus musculus
caacagtgctaatgaagacaatgtc

SEQ ID NO: 548176 - DNA, 25 bp, Mus musculus
caacagtgcttcaacaatgagtcta

SEQ ID NO: 548177 - DNA, 25 bp, Mus musculus
caacagtgcttctacaatgagtcta

SEQ ID NO: 548178 - DNA, 25 bp, Mus musculus
caacagtggactcaaacggcgctga

SEQ ID NO: 548179 - DNA, 25 bp, Mus musculus
caacagtggactgaaacggcgctga

SEQ ID NO: 548180 - DNA, 25 bp, Mus musculus
caacagtggcgaagactcagatctc

SEQ ID NO: 548181 - DNA, 25 bp, Mus musculus
caacagtggcgatgactcagatctc

SEQ ID NO: 548182 - DNA, 25 bp, Mus musculus
caacagtggctgattgtcatcaaca

SEQ ID NO: 548183 - DNA, 25 bp, Mus musculus
caacagtggctgtttgtcatcaaca

SEQ ID NO: 548184 - DNA, 25 bp, Mus musculus
caacagtggtatctcggatacggac

SEQ ID NO: 548185 - DNA, 25 bp, Mus musculus
caacagtggtatgtcggatacggac

SEQ ID NO: 548186 - DNA, 25 bp, Mus musculus
caacagtgtccaccaggatagcgtc

SEQ ID NO: 548187 - DNA, 25 bp, Mus musculus
caacagtgtccagcaggatagcgtc

SEQ ID NO: 548188 - DNA, 25 bp, Mus musculus
caacagtgtggacataaagcagacc

SEQ ID NO: 548189 - DNA, 25 bp, Mus musculus
caacagtgtggagataaagcagacc

SEQ ID NO: 548190 - DNA, 25 bp, Mus musculus
caacagtgtgggaggtttctgccaa

SEQ ID NO: 548191 - DNA, 25 bp, Mus musculus
caacagtgtgggtggtttctgccaa

SEQ ID NO: 548192 - DNA, 25 bp, Mus musculus
caacagtgttgcatcctggcagtaa

SEQ ID NO: 548193 - DNA, 25 bp, Mus musculus
caacagtgttgcttcctggcagtaa

SEQ ID NO: 548194 - DNA, 25 bp, Mus musculus
caacagttactgctacagcaggcgc

SEQ ID NO: 548195 - DNA, 25 bp, Mus musculus
caacagttactggtacagcaggcgc

SEQ ID NO: 548196 - DNA, 25 bp, Mus musculus
caacagttcggtctgttctagcctg

SEQ ID NO: 548197 - DNA, 25 bp, Mus musculus
caacagttcggtgtgttctagcctg

SEQ ID NO: 548198 - DNA, 25 bp, Mus musculus
caacagttgactcctatgtggctgt

SEQ ID NO: 548199 - DNA, 25 bp, Mus musculus
caacagttgactgctatgtggctgt

SEQ ID NO: 548200 - DNA, 25 bp, Mus musculus
caacagttgatacagagaaatccag

SEQ ID NO: 548201 - DNA, 25 bp, Mus musculus
caacagttgatagagagaaatccag

SEQ ID NO: 548202 - DNA, 25 bp, Mus musculus
caacagttggcaagaaacgctctga

SEQ ID NO: 548203 - DNA, 25 bp, Mus musculus
caacagttggcacttcaatgggtcc

SEQ ID NO: 548204 - DNA, 25 bp, Mus musculus
caacagttggcagttcaatgggtcc

SEQ ID NO: 548205 - DNA, 25 bp, Mus musculus
caacagttggcatgaaacgctctga

SEQ ID NO: 548206 - DNA, 25 bp, Mus musculus
caacagtttcttcccatcaatggat

SEQ ID NO: 548207 - DNA, 25 bp, Mus musculus
caacagtttcttgccatcaatggat

SEQ ID NO: 548208 - DNA, 25 bp, Mus musculus
caacataccaacagggaccaattta

SEQ ID NO: 548209 - DNA, 25 bp, Mus musculus
caacataccaactgggaccaattta

SEQ ID NO: 548210 - DNA, 25 bp, Mus musculus
caacataccgaacagagacccagtg

SEQ ID NO: 548211 - DNA, 25 bp, Mus musculus
caacataccgaagagagacccagtg

SEQ ID NO: 548212 - DNA, 25 bp, Mus musculus
caacatactctccattgtcaaacag

SEQ ID NO: 548213 - DNA, 25 bp, Mus musculus
caacatactctcgattgtcaaacag

SEQ ID NO: 548214 - DNA, 25 bp, Mus musculus
caacatagagacactaccttagaaa

SEQ ID NO: 548215 - DNA, 25 bp, Mus musculus
caacatagagactctaccttagaaa

SEQ ID NO: 548216 - DNA, 25 bp, Mus musculus
caacatatacagcacatccaaaggc

SEQ ID NO: 548217 - DNA, 25 bp, Mus musculus
caacatatacaggacatccaaaggc

SEQ ID NO: 548218 - DNA, 25 bp, Mus musculus
caacatatatgacctcatctccaag

SEQ ID NO: 548219 - DNA, 25 bp, Mus musculus
caacatatatgagctcatctccaag

SEQ ID NO: 548220 - DNA, 25 bp, Mus musculus
caacatatgagcaggcattacaaac

SEQ ID NO: 548221 - DNA, 25 bp, Mus musculus
caacatatgagctggcattacaaac

SEQ ID NO: 548222 - DNA, 25 bp, Mus musculus
caacatatgtttattgttaacacag

SEQ ID NO: 548223 - DNA, 25 bp, Mus musculus
caacatatgttttttgttaacacag

SEQ ID NO: 548224 - DNA, 25 bp, Mus musculus
caacatcaaacacaacaacaagcag

SEQ ID NO: 548225 - DNA, 25 bp, Mus musculus
caacatcaaacagaacaacaagcag

SEQ ID NO: 548226 - DNA, 25 bp, Mus musculus
caacatcagcaaccgagccaagaag

SEQ ID NO: 548227 - DNA, 25 bp, Mus musculus
caacatcagcaagcgagccaagaag

SEQ ID NO: 548228 - DNA, 25 bp, Mus musculus
caacatcagccaagcaaggagccta

SEQ ID NO: 548229 - DNA, 25 bp, Mus musculus
caacatcagccatgcaaggagccta

SEQ ID NO: 548230 - DNA, 25 bp, Mus musculus
caacatcagttaatagtggctatcg

SEQ ID NO: 548231 - DNA, 25 bp, Mus musculus
caacatcagttattagtggctatcg

SEQ ID NO: 548232 - DNA, 25 bp, Mus musculus
caacatccccggagatgagggagga

SEQ ID NO: 548233 - DNA, 25 bp, Mus musculus
caacatccccggtgatgagggagga

SEQ ID NO: 548234 - DNA, 25 bp, Mus musculus
caacatccgtgtcgccttagagaag

SEQ ID NO: 548235 - DNA, 25 bp, Mus musculus
caacatccgtgtggccttagagaag

SEQ ID NO: 548236 - DNA, 25 bp, Mus musculus
caacatcctgaacgagagggctgag

SEQ ID NO: 548237 - DNA, 25 bp, Mus musculus
caacatcctgaaggagagggctgag

SEQ ID NO: 548238 - DNA, 25 bp, Mus musculus
caacatcctggcagcaatgtggaca

SEQ ID NO: 548239 - DNA, 25 bp, Mus musculus
caacatcctggctgcaatgtggaca

SEQ ID NO: 548240 - DNA, 25 bp, Mus musculus
caacatcgaccgaattggagcagac

SEQ ID NO: 548241 - DNA, 25 bp, Mus musculus
caacatcgaccgtattggagcagac

SEQ ID NO: 548242 - DNA, 25 bp, Mus musculus
caacatcgcacccaacatttcaagg

SEQ ID NO: 548243 - DNA, 25 bp, Mus musculus
caacatcgcaccgaacatttcaagg

SEQ ID NO: 548244 - DNA, 25 bp, Mus musculus
caacatcggtctattgtgggtgccc

SEQ ID NO: 548245 - DNA, 25 bp, Mus musculus
caacatcggtcttttgtgggtgccc

SEQ ID NO: 548246 - DNA, 25 bp, Mus musculus
caacatcgttctcaagagggaactt

SEQ ID NO: 548247 - DNA, 25 bp, Mus musculus
caacatcgttctgaagagggaactt

SEQ ID NO: 548248 - DNA, 25 bp, Mus musculus
caacatctccagaatccatttctgg

SEQ ID NO: 548249 - DNA, 25 bp, Mus musculus
caacatctccagtatccatttctgg

SEQ ID NO: 548250 - DNA, 25 bp, Mus musculus
caacatctcctcagccagtggcatg

SEQ ID NO: 548251 - DNA, 25 bp, Mus musculus
caacatctcctctgccagtggcatg

SEQ ID NO: 548252 - DNA, 25 bp, Mus musculus
caacatcttgagatgatggaagaca

SEQ ID NO: 548253 - DNA, 25 bp, Mus musculus
caacatcttgagttgatggaagaca

SEQ ID NO: 548254 - DNA, 25 bp, Mus musculus
caacatgaagaacgatgaagtgtgt

SEQ ID NO: 548255 - DNA, 25 bp, Mus musculus
caacatgaagaaggatgaagtgtgt

SEQ ID NO: 548256 - DNA, 25 bp, Mus musculus
caacatgaagaccaagtttaaagag

SEQ ID NO: 548257 - DNA, 25 bp, Mus musculus
caacatgaagacgaagtttaaagag

SEQ ID NO: 548258 - DNA, 25 bp, Mus musculus
caacatgaagcacttcatccgctac

SEQ ID NO: 548259 - DNA, 25 bp, Mus musculus
caacatgaagcagttcatccgctac

SEQ ID NO: 548260 - DNA, 25 bp, Mus musculus
caacatgaatgccacgagcgggtat

SEQ ID NO: 548261 - DNA, 25 bp, Mus musculus
caacatgaatgcgacgagcgggtat

SEQ ID NO: 548262 - DNA, 25 bp, Mus musculus
caacatgaccagaaacaggcggtta

SEQ ID NO: 548263 - DNA, 25 bp, Mus musculus
caacatgaccagtaacaggcggtta

SEQ ID NO: 548264 - DNA, 25 bp, Mus musculus
caacatgactatcgccacctttctg

SEQ ID NO: 548265 - DNA, 25 bp, Mus musculus
caacatgactatggccacctttctg

SEQ ID NO: 548266 - DNA, 25 bp, Mus musculus
caacatgagctcagagttctacgcc

SEQ ID NO: 548267 - DNA, 25 bp, Mus musculus
caacatgagctctgagttctacgcc

SEQ ID NO: 548268 - DNA, 25 bp, Mus musculus
caacatgaggatagccaaagaggag

SEQ ID NO: 548269 - DNA, 25 bp, Mus musculus
caacatgaggattgccaaagaggag

SEQ ID NO: 548270 - DNA, 25 bp, Mus musculus
caacatgatgtcctacagcgagaga

SEQ ID NO: 548271 - DNA, 25 bp, Mus musculus
caacatgatgtcgtacagcgagaga

SEQ ID NO: 548272 - DNA, 25 bp, Mus musculus
caacatgcaacgacttccatgggct

SEQ ID NO: 548273 - DNA, 25 bp, Mus musculus
caacatgcaacgtcttccatgggct

SEQ ID NO: 548274 - DNA, 25 bp, Mus musculus
caacatgccaatatggctggcacac

SEQ ID NO: 548275 - DNA, 25 bp, Mus musculus
caacatgccaatttggctggcacac

SEQ ID NO: 548276 - DNA, 25 bp, Mus musculus
caacatgccgtactgtctgggccaa

SEQ ID NO: 548277 - DNA, 25 bp, Mus musculus
caacatgccgtagtgtctgggccaa

SEQ ID NO: 548278 - DNA, 25 bp, Mus musculus
caacatgccgttagtgacgacactc

SEQ ID NO: 548279 - DNA, 25 bp, Mus musculus
caacatgccgtttgtgacgacactc

SEQ ID NO: 548280 - DNA, 25 bp, Mus musculus
caacatgcgcgtctatggtacagcc

SEQ ID NO: 548281 - DNA, 25 bp, Mus musculus
caacatgcgcgtgtatggtacagcc

SEQ ID NO: 548282 - DNA, 25 bp, Mus musculus
caacatgctggtccgctgtgtcact

SEQ ID NO: 548283 - DNA, 25 bp, Mus musculus
caacatgctggtgcgctgtgtcact

SEQ ID NO: 548284 - DNA, 25 bp, Mus musculus
caacatgctgtaaattgaatggagc

SEQ ID NO: 548285 - DNA, 25 bp, Mus musculus
caacatgctgtatattgaatggagc

SEQ ID NO: 548286 - DNA, 25 bp, Mus musculus
caacatggaacacaatcgaatcaac

SEQ ID NO: 548287 - DNA, 25 bp, Mus musculus
caacatggaacagaatcgaatcaac

SEQ ID NO: 548288 - DNA, 25 bp, Mus musculus
caacatggccaacaccgaggagatg

SEQ ID NO: 548289 - DNA, 25 bp, Mus musculus
caacatggccaagaccgaggagatg

SEQ ID NO: 548290 - DNA, 25 bp, Mus musculus
caacatggccagcagagctgatgca

SEQ ID NO: 548291 - DNA, 25 bp, Mus musculus
caacatggccaggagagctgatgca

SEQ ID NO: 548292 - DNA, 25 bp, Mus musculus
caacatggctatcgccagtctctct

SEQ ID NO: 548293 - DNA, 25 bp, Mus musculus
caacatggctatggccagtctctct

SEQ ID NO: 548294 - DNA, 25 bp, Mus musculus
caacatggctgtcgttacttgcggc

SEQ ID NO: 548295 - DNA, 25 bp, Mus musculus
caacatggctgtggttacttgcggc

SEQ ID NO: 548296 - DNA, 25 bp, Mus musculus
caacatggtgtgacagattctggaa

SEQ ID NO: 548297 - DNA, 25 bp, Mus musculus
caacatggtgtgtcagattctggaa

SEQ ID NO: 548298 - DNA, 25 bp, Mus musculus
caacatgtacagatgtgaaaaatgc

SEQ ID NO: 548299 - DNA, 25 bp, Mus musculus
caacatgtacagttgtgaaaaatgc

SEQ ID NO: 548300 - DNA, 25 bp, Mus musculus
caacatgtcagactgggagtcctac

SEQ ID NO: 548301 - DNA, 25 bp, Mus musculus
caacatgtcagagtgggagtcctac

SEQ ID NO: 548302 - DNA, 25 bp, Mus musculus
caacatgtcctgcagagctggtacc

SEQ ID NO: 548303 - DNA, 25 bp, Mus musculus
caacatgtcctggagagctggtacc

SEQ ID NO: 548304 - DNA, 25 bp, Mus musculus
caacatgtctgcaaagtggtgggtc

SEQ ID NO: 548305 - DNA, 25 bp, Mus musculus
caacatgtctgctaagtggtgggtc

SEQ ID NO: 548306 - DNA, 25 bp, Mus musculus
caacatgtgccaacctggacagcaa

SEQ ID NO: 548307 - DNA, 25 bp, Mus musculus
caacatgtgccatcctggacagcaa

SEQ ID NO: 548308 - DNA, 25 bp, Mus musculus
caacatgttctgaagcttagagcgc

SEQ ID NO: 548309 - DNA, 25 bp, Mus musculus
caacatgttctgtagcttagagcgc

SEQ ID NO: 548310 - DNA, 25 bp, Mus musculus
caacattaaattctgtcagccaagc

SEQ ID NO: 548311 - DNA, 25 bp, Mus musculus
caacattaaattgtgtcagccaagc

SEQ ID NO: 548312 - DNA, 25 bp, Mus musculus
caacattcaaaacacatgaagaatc

SEQ ID NO: 548313 - DNA, 25 bp, Mus musculus
caacattcaaaagacatgaagaatc

SEQ ID NO: 548314 - DNA, 25 bp, Mus musculus
caacattcccagaacaaccaagcgt

SEQ ID NO: 548315 - DNA, 25 bp, Mus musculus
caacattcccagtacaaccaagcgt

SEQ ID NO: 548316 - DNA, 25 bp, Mus musculus
caacattccttgctgaggccactaa

SEQ ID NO: 548317 - DNA, 25 bp, Mus musculus
caacattccttggtgaggccactaa

SEQ ID NO: 548318 - DNA, 25 bp, Mus musculus
caacattcggacatttggggagact

SEQ ID NO: 548319 - DNA, 25 bp, Mus musculus
caacattcggacttttggggagact

SEQ ID NO: 548320 - DNA, 25 bp, Mus musculus
caacattgacgaatgtgcgggcagc

SEQ ID NO: 548321 - DNA, 25 bp, Mus musculus
caacattgacgattgtgcgggcagc

SEQ ID NO: 548322 - DNA, 25 bp, Mus musculus
caacattgacttagaaattgaagag

SEQ ID NO: 548323 - DNA, 25 bp, Mus musculus
caacattgactttgaaattgaagag

SEQ ID NO: 548324 - DNA, 25 bp, Mus musculus
caacattgatcccaatgccaagggc

SEQ ID NO: 548325 - DNA, 25 bp, Mus musculus
caacattgatccgaatgccaagggc

SEQ ID NO: 548326 - DNA, 25 bp, Mus musculus
caacattgcttgctgcaggaggcgt

SEQ ID NO: 548327 - DNA, 25 bp, Mus musculus
caacattgcttggtgcaggaggcgt

SEQ ID NO: 548328 - DNA, 25 bp, Mus musculus
caacattggcgccagctgggtttct

SEQ ID NO: 548329 - DNA, 25 bp, Mus musculus
caacattggcgcgagctgggtttct

SEQ ID NO: 548330 - DNA, 25 bp, Mus musculus
caacattgtggacataattctggct

SEQ ID NO: 548331 - DNA, 25 bp, Mus musculus
caacattgtggagataattctggct

SEQ ID NO: 548332 - DNA, 25 bp, Mus musculus
caacattgtggcaccgtataagata

SEQ ID NO: 548333 - DNA, 25 bp, Mus musculus
caacattgtggctccgtataagata

SEQ ID NO: 548334 - DNA, 25 bp, Mus musculus
caacatttgacaaagcttcagatgc

SEQ ID NO: 548335 - DNA, 25 bp, Mus musculus
caacatttgacatagcttcagatgc

SEQ ID NO: 548336 - DNA, 25 bp, Mus musculus
caacatttggttaggagagcgagca

SEQ ID NO: 548337 - DNA, 25 bp, Mus musculus
caacatttggtttggagagcgagca

SEQ ID NO: 548338 - DNA, 25 bp, Mus musculus
caacattttctaaatgatggagtac

SEQ ID NO: 548339 - DNA, 25 bp, Mus musculus
caacattttctatatgatggagtac

SEQ ID NO: 548340 - DNA, 25 bp, Mus musculus
caaccaaaccgacaggcattctgga

SEQ ID NO: 548341 - DNA, 25 bp, Mus musculus
caaccaaaccgagaggcattctgga

SEQ ID NO: 548342 - DNA, 25 bp, Mus musculus
caaccaaagcaactttatgtagaca

SEQ ID NO: 548343 - DNA, 25 bp, Mus musculus
caaccaaagcaagtttatgtagaca

SEQ ID NO: 548344 - DNA, 25 bp, Mus musculus
caaccaaagtatctcaacctaaatc

SEQ ID NO: 548345 - DNA, 25 bp, Mus musculus
caaccaaagtatgtcaacctaaatc

SEQ ID NO: 548346 - DNA, 25 bp, Mus musculus
caaccaaagtgtctagctgttggcc

SEQ ID NO: 548347 - DNA, 25 bp, Mus musculus
caaccaaagtgtgtagctgttggcc

SEQ ID NO: 548348 - DNA, 25 bp, Mus musculus
caaccaaattttccagatttcagcc

SEQ ID NO: 548349 - DNA, 25 bp, Mus musculus
caaccaaattttgcagatttcagcc

SEQ ID NO: 548350 - DNA, 25 bp, Mus musculus
caaccaacagccatcattgccaaga

SEQ ID NO: 548351 - DNA, 25 bp, Mus musculus
caaccaacagccttcattgccaaga

SEQ ID NO: 548352 - DNA, 25 bp, Mus musculus
caaccaacatctacggcagagacag

SEQ ID NO: 548353 - DNA, 25 bp, Mus musculus
caaccaacatcttcggcagagacag

SEQ ID NO: 548354 - DNA, 25 bp, Mus musculus
caaccaaccactcgatgccaaagat

SEQ ID NO: 548355 - DNA, 25 bp, Mus musculus
caaccaaccactggatgccaaagat

SEQ ID NO: 548356 - DNA, 25 bp, Mus musculus
caaccaacttctccagttcaaaggg

SEQ ID NO: 548357 - DNA, 25 bp, Mus musculus
caaccaacttctgcagttcaaaggg

SEQ ID NO: 548358 - DNA, 25 bp, Mus musculus
caaccaactttcagtgcctttggga

SEQ ID NO: 548359 - DNA, 25 bp, Mus musculus
caaccaactttctgtgcctttggga

SEQ ID NO: 548360 - DNA, 25 bp, Mus musculus
caaccaagaagaaggtagctgagca

SEQ ID NO: 548361 - DNA, 25 bp, Mus musculus
caaccaagaagatggtagctgagca

SEQ ID NO: 548362 - DNA, 25 bp, Mus musculus
caaccaagaggaatatgcaagttac

SEQ ID NO: 548363 - DNA, 25 bp, Mus musculus
caaccaagaggattatgcaagttac

SEQ ID NO: 548364 - DNA, 25 bp, Mus musculus
caaccaaggagaccttgattttgag

SEQ ID NO: 548365 - DNA, 25 bp, Mus musculus
caaccaaggagagcttgattttgag

SEQ ID NO: 548366 - DNA, 25 bp, Mus musculus
caaccaagggccagaatactactac

SEQ ID NO: 548367 - DNA, 25 bp, Mus musculus
caaccaagggcctgaatactactac

SEQ ID NO: 548368 - DNA, 25 bp, Mus musculus
caaccaagtggaagtcctgcagagg

SEQ ID NO: 548369 - DNA, 25 bp, Mus musculus
caaccaagtggatgtcctgcagagg

SEQ ID NO: 548370 - DNA, 25 bp, Mus musculus
caaccaatccacattgtgtacgttc

SEQ ID NO: 548371 - DNA, 25 bp, Mus musculus
caaccaatccactttgtgtacgttc

SEQ ID NO: 548372 - DNA, 25 bp, Mus musculus
caaccaatgtggctgctcgtggctt

SEQ ID NO: 548373 - DNA, 25 bp, Mus musculus
caaccaatgtgggtgctcgtggctt

SEQ ID NO: 548374 - DNA, 25 bp, Mus musculus
caaccaattgccaatgtgatgctag

SEQ ID NO: 548375 - DNA, 25 bp, Mus musculus
caaccaattgcctatgtgatgctag

SEQ ID NO: 548376 - DNA, 25 bp, Mus musculus
caaccacaaagacccgagtgccgtg

SEQ ID NO: 548377 - DNA, 25 bp, Mus musculus
caaccacaaagagccgagtgccgtg

SEQ ID NO: 548378 - DNA, 25 bp, Mus musculus
caaccacaacaactacatggtgact

SEQ ID NO: 548379 - DNA, 25 bp, Mus musculus
caaccacaacaagtacatggtgact

SEQ ID NO: 548380 - DNA, 25 bp, Mus musculus
caaccacaagttctttgcggctacg

SEQ ID NO: 548381 - DNA, 25 bp, Mus musculus
caaccacaagttgtttgcggctacg

SEQ ID NO: 548382 - DNA, 25 bp, Mus musculus
caaccacacaatcgaagtggaaata

SEQ ID NO: 548383 - DNA, 25 bp, Mus musculus
caaccacacaatggaagtggaaata

SEQ ID NO: 548384 - DNA, 25 bp, Mus musculus
caaccacagtatccctgtgactctt

SEQ ID NO: 548385 - DNA, 25 bp, Mus musculus
caaccacagtatgcctgtgactctt

SEQ ID NO: 548386 - DNA, 25 bp, Mus musculus
caaccacagtgcaaacacggagagt

SEQ ID NO: 548387 - DNA, 25 bp, Mus musculus
caaccacagtgctaacacggagagt

SEQ ID NO: 548388 - DNA, 25 bp, Mus musculus
caaccacatcgacagatggcttgtt

SEQ ID NO: 548389 - DNA, 25 bp, Mus musculus
caaccacatcgagagatggcttgtt

SEQ ID NO: 548390 - DNA, 25 bp, Mus musculus
caaccacatggtaatagccaagatg

SEQ ID NO: 548391 - DNA, 25 bp, Mus musculus
caaccacatggttatagccaagatg

SEQ ID NO: 548392 - DNA, 25 bp, Mus musculus
caaccaccctggcacatttatttgt

SEQ ID NO: 548393 - DNA, 25 bp, Mus musculus
caaccaccctgggacatttatttgt

SEQ ID NO: 548394 - DNA, 25 bp, Mus musculus
caaccaccggctctctgaagagctg

SEQ ID NO: 548395 - DNA, 25 bp, Mus musculus
caaccaccggctgtctgaagagctg

SEQ ID NO: 548396 - DNA, 25 bp, Mus musculus
caaccaccgttacaaatcagagaaa

SEQ ID NO: 548397 - DNA, 25 bp, Mus musculus
caaccaccgttagaaatcagagaaa

SEQ ID NO: 548398 - DNA, 25 bp, Mus musculus
caaccacctcaaccaaagaaggcaa

SEQ ID NO: 548399 - DNA, 25 bp, Mus musculus
caaccacctcaagcaaagaaggcaa

SEQ ID NO: 548400 - DNA, 25 bp, Mus musculus
caaccacctctgacgccaaagaagt

SEQ ID NO: 548401 - DNA, 25 bp, Mus musculus
caaccacctctgtcgccaaagaagt

SEQ ID NO: 548402 - DNA, 25 bp, Mus musculus
caaccacctgggatgatatcaccac

SEQ ID NO: 548403 - DNA, 25 bp, Mus musculus
caaccacctgggttgatatcaccac

SEQ ID NO: 548404 - DNA, 25 bp, Mus musculus
caaccacctggtaggatcctcgtct

SEQ ID NO: 548405 - DNA, 25 bp, Mus musculus
caaccacctggttggatcctcgtct

SEQ ID NO: 548406 - DNA, 25 bp, Mus musculus
caaccacggcagctggcactagttt

SEQ ID NO: 548407 - DNA, 25 bp, Mus musculus
caaccacggcaggtggcactagttt

SEQ ID NO: 548408 - DNA, 25 bp, Mus musculus
caaccacgtcaaatttggccagcag

SEQ ID NO: 548409 - DNA, 25 bp, Mus musculus
caaccacgtcaattttggccagcag

SEQ ID NO: 548410 - DNA, 25 bp, Mus musculus
caaccactgcatcgccaagatgctg

SEQ ID NO: 548411 - DNA, 25 bp, Mus musculus
caaccactgcatggccaagatgctg

SEQ ID NO: 548412 - DNA, 25 bp, Mus musculus
caaccagaaaaaagggagcgtgcca

SEQ ID NO: 548413 - DNA, 25 bp, Mus musculus
caaccagaaaaatgggagcgtgcca

SEQ ID NO: 548414 - DNA, 25 bp, Mus musculus
caaccagaacaaactctgcaggaaa

SEQ ID NO: 548415 - DNA, 25 bp, Mus musculus
caaccagaacaatctctgcaggaaa

SEQ ID NO: 548416 - DNA, 25 bp, Mus musculus
caaccagaatttaggctacagatgc

SEQ ID NO: 548417 - DNA, 25 bp, Mus musculus
caaccagaattttggctacagatgc

SEQ ID NO: 548418 - DNA, 25 bp, Mus musculus
caaccagagagactacatgggacag

SEQ ID NO: 548419 - DNA, 25 bp, Mus musculus
caaccagagagagtacatgggacag

SEQ ID NO: 548420 - DNA, 25 bp, Mus musculus
caaccagagctgcttttcaatatga

SEQ ID NO: 548421 - DNA, 25 bp, Mus musculus
caaccagagctggttttcaatatga

SEQ ID NO: 548422 - DNA, 25 bp, Mus musculus
caaccagagggaatgccagcctggc

SEQ ID NO: 548423 - DNA, 25 bp, Mus musculus
caaccagagggattgccagcctggc

SEQ ID NO: 548424 - DNA, 25 bp, Mus musculus
caaccagagtgacatcgccatacag

SEQ ID NO: 548425 - DNA, 25 bp, Mus musculus
caaccagagtgagatcgccatacag

SEQ ID NO: 548426 - DNA, 25 bp, Mus musculus
caaccagatcgactcgaagctccag

SEQ ID NO: 548427 - DNA, 25 bp, Mus musculus
caaccagatcgagtcgaagctccag

SEQ ID NO: 548428 - DNA, 25 bp, Mus musculus
caaccagatgtaaagtctgaagcac

SEQ ID NO: 548429 - DNA, 25 bp, Mus musculus
caaccagatgtatagtctgaagcac

SEQ ID NO: 548430 - DNA, 25 bp, Mus musculus
caaccagcacaacgagcagcagctg

SEQ ID NO: 548431 - DNA, 25 bp, Mus musculus
caaccagcacaaggagcagcagctg

SEQ ID NO: 548432 - DNA, 25 bp, Mus musculus
caaccagcacgcctgaggaccttga

SEQ ID NO: 548433 - DNA, 25 bp, Mus musculus
caaccagcacgcgtgaggaccttga

SEQ ID NO: 548434 - DNA, 25 bp, Mus musculus
caaccagcctgacaacagatgcact

SEQ ID NO: 548435 - DNA, 25 bp, Mus musculus
caaccagcctgagaacagatgcact

SEQ ID NO: 548436 - DNA, 25 bp, Mus musculus
caaccagcgtcgcaatgtgtgacat

SEQ ID NO: 548437 - DNA, 25 bp, Mus musculus
caaccagcgtcggaatgtgtgacat

SEQ ID NO: 548438 - DNA, 25 bp, Mus musculus
caaccaggaatgaaacacgaagtac

SEQ ID NO: 548439 - DNA, 25 bp, Mus musculus
caaccaggaatgtaacacgaagtac

SEQ ID NO: 548440 - DNA, 25 bp, Mus musculus
caaccaggacaaccggactgtcagc

SEQ ID NO: 548441 - DNA, 25 bp, Mus musculus
caaccaggacaagcggactgtcagc

SEQ ID NO: 548442 - DNA, 25 bp, Mus musculus
caaccaggcagcagttattaacacg

SEQ ID NO: 548443 - DNA, 25 bp, Mus musculus
caaccaggcagctgttattaacacg

SEQ ID NO: 548444 - DNA, 25 bp, Mus musculus
caaccagggctaaatccgaaagcag

SEQ ID NO: 548445 - DNA, 25 bp, Mus musculus
caaccagggctatatccgaaagcag

SEQ ID NO: 548446 - DNA, 25 bp, Mus musculus
caaccagggttaactgctgagcaca

SEQ ID NO: 548447 - DNA, 25 bp, Mus musculus
caaccagggttatctgctgagcaca

SEQ ID NO: 548448 - DNA, 25 bp, Mus musculus
caaccagtatagaggcagtgaccaa

SEQ ID NO: 548449 - DNA, 25 bp, Mus musculus
caaccagtatagtggcagtgaccaa

SEQ ID NO: 548450 - DNA, 25 bp, Mus musculus
caaccagtcctcatttgacaacatc

SEQ ID NO: 548451 - DNA, 25 bp, Mus musculus
caaccagtcctcttttgacaacatc

SEQ ID NO: 548452 - DNA, 25 bp, Mus musculus
caaccagtgacgagatggtgcccgt

SEQ ID NO: 548453 - DNA, 25 bp, Mus musculus
caaccagtgacgtgatggtgcccgt

SEQ ID NO: 548454 - DNA, 25 bp, Mus musculus
caaccagtgatgctcttctgtccct

SEQ ID NO: 548455 - DNA, 25 bp, Mus musculus
caaccagtgatggtcttctgtccct

SEQ ID NO: 548456 - DNA, 25 bp, Mus musculus
caaccagtggatcaagtttaagtca

SEQ ID NO: 548457 - DNA, 25 bp, Mus musculus
caaccagtggatgaagtttaagtca

SEQ ID NO: 548458 - DNA, 25 bp, Mus musculus
caaccagtggcaacatgtgcgagtg

SEQ ID NO: 548459 - DNA, 25 bp, Mus musculus
caaccagtggcatcatgtgcgagtg

SEQ ID NO: 548460 - DNA, 25 bp, Mus musculus
caaccagtgggacagaaacgggctt

SEQ ID NO: 548461 - DNA, 25 bp, Mus musculus
caaccagtgggagagaaacgggctt

SEQ ID NO: 548462 - DNA, 25 bp, Mus musculus
caaccatacttacagatgttgatcc

SEQ ID NO: 548463 - DNA, 25 bp, Mus musculus
caaccatacttagagatgttgatcc

SEQ ID NO: 548464 - DNA, 25 bp, Mus musculus
caaccatagctgatgggatgttgtt

SEQ ID NO: 548465 - DNA, 25 bp, Mus musculus
caaccatagctgttgggatgttgtt

SEQ ID NO: 548466 - DNA, 25 bp, Mus musculus
caaccatcatggcagtggagtttga

SEQ ID NO: 548467 - DNA, 25 bp, Mus musculus
caaccatcatgggagtggagtttga

SEQ ID NO: 548468 - DNA, 25 bp, Mus musculus
caaccatcattaagtgacattcatc

SEQ ID NO: 548469 - DNA, 25 bp, Mus musculus
caaccatcattatgtgacattcatc

SEQ ID NO: 548470 - DNA, 25 bp, Mus musculus
caaccatccaagacaaagaataaca

SEQ ID NO: 548471 - DNA, 25 bp, Mus musculus
caaccatccaagtcaaagaataaca

SEQ ID NO: 548472 - DNA, 25 bp, Mus musculus
caaccatcctaaagaatttcctgta

SEQ ID NO: 548473 - DNA, 25 bp, Mus musculus
caaccatcctaatgaatttcctgta

SEQ ID NO: 548474 - DNA, 25 bp, Mus musculus
caaccatctcttcagatcgctcgga

SEQ ID NO: 548475 - DNA, 25 bp, Mus musculus
caaccatctcttgagatcgctcgga

SEQ ID NO: 548476 - DNA, 25 bp, Mus musculus
caaccatgaacccatactctcttta

SEQ ID NO: 548477 - DNA, 25 bp, Mus musculus
caaccatgaaccgatactctcttta

SEQ ID NO: 548478 - DNA, 25 bp, Mus musculus
caaccatgagggaacacctcaaagg

SEQ ID NO: 548479 - DNA, 25 bp, Mus musculus
caaccatgagggtacacctcaaagg

SEQ ID NO: 548480 - DNA, 25 bp, Mus musculus
caaccatgagtgcacgatcaaacac

SEQ ID NO: 548481 - DNA, 25 bp, Mus musculus
caaccatgagtggacgatcaaacac

SEQ ID NO: 548482 - DNA, 25 bp, Mus musculus
caaccattccttcgtgctgagtcag

SEQ ID NO: 548483 - DNA, 25 bp, Mus musculus
caaccattccttggtgctgagtcag

SEQ ID NO: 548484 - DNA, 25 bp, Mus musculus
caaccattgaaaactcagagcttcc

SEQ ID NO: 548485 - DNA, 25 bp, Mus musculus
caaccattgaaatctcagagcttcc

SEQ ID NO: 548486 - DNA, 25 bp, Mus musculus
caacccaaacttcacagtaagagac

SEQ ID NO: 548487 - DNA, 25 bp, Mus musculus
caacccaaacttgacagtaagagac

SEQ ID NO: 548488 - DNA, 25 bp, Mus musculus
caacccactgagatgtaatcctaca

SEQ ID NO: 548489 - DNA, 25 bp, Mus musculus
caacccactgagttgtaatcctaca

SEQ ID NO: 548490 - DNA, 25 bp, Mus musculus
caacccactgatcattacgttctgg

SEQ ID NO: 548491 - DNA, 25 bp, Mus musculus
caacccactgatgattacgttctgg

SEQ ID NO: 548492 - DNA, 25 bp, Mus musculus
caacccagacgacatggaggaggat

SEQ ID NO: 548493 - DNA, 25 bp, Mus musculus
caacccagacgagatggaggaggat

SEQ ID NO: 548494 - DNA, 25 bp, Mus musculus
caacccagacttcgatggagtggat

SEQ ID NO: 548495 - DNA, 25 bp, Mus musculus
caacccagacttggatggagtggat

SEQ ID NO: 548496 - DNA, 25 bp, Mus musculus
caacccagaggtcgtggtcgcagta

SEQ ID NO: 548497 - DNA, 25 bp, Mus musculus
caacccagaggtggtggtcgcagta

SEQ ID NO: 548498 - DNA, 25 bp, Mus musculus
caacccagatgccagtgatgagaag

SEQ ID NO: 548499 - DNA, 25 bp, Mus musculus
caacccagatgcgagtgatgagaag

SEQ ID NO: 548500 - DNA, 25 bp, Mus musculus
caacccagatggcttactggctctt

SEQ ID NO: 548501 - DNA, 25 bp, Mus musculus
caacccagatgggttactggctctt

SEQ ID NO: 548502 - DNA, 25 bp, Mus musculus
caacccagccgacatcaacgtggag

SEQ ID NO: 548503 - DNA, 25 bp, Mus musculus
caacccagccgagatcaacgtggag

SEQ ID NO: 548504 - DNA, 25 bp, Mus musculus
caacccaggagcagctgacgaaaga

SEQ ID NO: 548505 - DNA, 25 bp, Mus musculus
caacccaggagctgctgacgaaaga

SEQ ID NO: 548506 - DNA, 25 bp, Mus musculus
caacccaggtcacactggtggctgt

SEQ ID NO: 548507 - DNA, 25 bp, Mus musculus
caacccaggtcagactggtggctgt

SEQ ID NO: 548508 - DNA, 25 bp, Mus musculus
caacccagtccacgtggaaatggga

SEQ ID NO: 548509 - DNA, 25 bp, Mus musculus
caacccagtccaggtggaaatggga

SEQ ID NO: 548510 - DNA, 25 bp, Mus musculus
caacccagtcctcgccatagggtgg

SEQ ID NO: 548511 - DNA, 25 bp, Mus musculus
caacccagtcctggccatagggtgg

SEQ ID NO: 548512 - DNA, 25 bp, Mus musculus
caacccatagcactcaaaagaagga

SEQ ID NO: 548513 - DNA, 25 bp, Mus musculus
caacccatagcagtcaaaagaagga

SEQ ID NO: 548514 - DNA, 25 bp, Mus musculus
caacccatttgacttcgctagtcgg

SEQ ID NO: 548515 - DNA, 25 bp, Mus musculus
caacccatttgagttcgctagtcgg

SEQ ID NO: 548516 - DNA, 25 bp, Mus musculus
caaccccaaaggagcaatgatcact

SEQ ID NO: 548517 - DNA, 25 bp, Mus musculus
caaccccaaaggtgcaatgatcact

SEQ ID NO: 548518 - DNA, 25 bp, Mus musculus
caaccccaaattcctttgtgctgac

SEQ ID NO: 548519 - DNA, 25 bp, Mus musculus
caaccccaaattgctttgtgctgac

SEQ ID NO: 548520 - DNA, 25 bp, Mus musculus
caaccccatcatcagttatgacgga

SEQ ID NO: 548521 - DNA, 25 bp, Mus musculus
caaccccatcatgagttatgacgga

SEQ ID NO: 548522 - DNA, 25 bp, Mus musculus
caaccccatgtaccagaggatgcca

SEQ ID NO: 548523 - DNA, 25 bp, Mus musculus
caaccccatgtagcagaggatgcca

SEQ ID NO: 548524 - DNA, 25 bp, Mus musculus
caaccccgaggaagcgctgaaacgt

SEQ ID NO: 548525 - DNA, 25 bp, Mus musculus
caaccccgaggatgcgctgaaacgt

SEQ ID NO: 548526 - DNA, 25 bp, Mus musculus
caaccccgttcaagaatgccctgga

SEQ ID NO: 548527 - DNA, 25 bp, Mus musculus
caaccccgttcatgaatgccctgga

SEQ ID NO: 548528 - DNA, 25 bp, Mus musculus
caaccccgttgtcaggacggtgaag

SEQ ID NO: 548529 - DNA, 25 bp, Mus musculus
caaccccgttgtgaggacggtgaag

SEQ ID NO: 548530 - DNA, 25 bp, Mus musculus
caacccctatggcaacagagagagc

SEQ ID NO: 548531 - DNA, 25 bp, Mus musculus
caacccctatgggaacagagagagc

SEQ ID NO: 548532 - DNA, 25 bp, Mus musculus
caacccctcagcctgggtgggcagt

SEQ ID NO: 548533 - DNA, 25 bp, Mus musculus
caacccctcagcgtgggtgggcagt

SEQ ID NO: 548534 - DNA, 25 bp, Mus musculus
caacccctcggacatcagggtggca

SEQ ID NO: 548535 - DNA, 25 bp, Mus musculus
caacccctcggagatcagggtggca

SEQ ID NO: 548536 - DNA, 25 bp, Mus musculus
caacccctgaaacgtcaatgaagtc

SEQ ID NO: 548537 - DNA, 25 bp, Mus musculus
caacccctgaaaggtcaatgaagtc

SEQ ID NO: 548538 - DNA, 25 bp, Mus musculus
caacccctgcttatcatcgggaaag

SEQ ID NO: 548539 - DNA, 25 bp, Mus musculus
caacccctgcttttcatcgggaaag

SEQ ID NO: 548540 - DNA, 25 bp, Mus musculus
caacccctggagaaacacctgctat

SEQ ID NO: 548541 - DNA, 25 bp, Mus musculus
caacccctggagtaacacctgctat

SEQ ID NO: 548542 - DNA, 25 bp, Mus musculus
caacccctgtgccaatggtggccag

SEQ ID NO: 548543 - DNA, 25 bp, Mus musculus
caacccctgtgcgaatggtggccag

SEQ ID NO: 548544 - DNA, 25 bp, Mus musculus
caaccccttttgagaggagctgctg

SEQ ID NO: 548545 - DNA, 25 bp, Mus musculus
caaccccttttgtgaggagctgctg

SEQ ID NO: 548546 - DNA, 25 bp, Mus musculus
caacccgatagcagaagggtcaact

SEQ ID NO: 548547 - DNA, 25 bp, Mus musculus
caacccgatagctgaagggtcaact

SEQ ID NO: 548548 - DNA, 25 bp, Mus musculus
caacccgcttctcggagagacttat

SEQ ID NO: 548549 - DNA, 25 bp, Mus musculus
caacccgcttctgggagagacttat

SEQ ID NO: 548550 - DNA, 25 bp, Mus musculus
caacccggagagacctgacactgtg

SEQ ID NO: 548551 - DNA, 25 bp, Mus musculus
caacccggagagtcctgacactgtg

SEQ ID NO: 548552 - DNA, 25 bp, Mus musculus
caacccggcagcctcaatggagatc

SEQ ID NO: 548553 - DNA, 25 bp, Mus musculus
caacccggcagcgtcaatggagatc

SEQ ID NO: 548554 - DNA, 25 bp, Mus musculus
caacccggttgcctgtgaactgaag

SEQ ID NO: 548555 - DNA, 25 bp, Mus musculus
caacccggttgcgtgtgaactgaag

SEQ ID NO: 548556 - DNA, 25 bp, Mus musculus
caacccggtttgcaaataatgctgg

SEQ ID NO: 548557 - DNA, 25 bp, Mus musculus
caacccggtttggaaataatgctgg

SEQ ID NO: 548558 - DNA, 25 bp, Mus musculus
caacccgtgccacaaaggagggaca

SEQ ID NO: 548559 - DNA, 25 bp, Mus musculus
caacccgtgccagaaaggagggaca

SEQ ID NO: 548560 - DNA, 25 bp, Mus musculus
caaccctagggtacagagaaagatc

SEQ ID NO: 548561 - DNA, 25 bp, Mus musculus
caaccctagggttcagagaaagatc

SEQ ID NO: 548562 - DNA, 25 bp, Mus musculus
caaccctcaaaaccgttttgagtgc

SEQ ID NO: 548563 - DNA, 25 bp, Mus musculus
caaccctcaaaagcgttttgagtgc

SEQ ID NO: 548564 - DNA, 25 bp, Mus musculus
caaccctctaccatctatttgcaga

SEQ ID NO: 548565 - DNA, 25 bp, Mus musculus
caaccctctaccttctatttgcaga

SEQ ID NO: 548566 - DNA, 25 bp, Mus musculus
caaccctctgagcaagctctctgtg

SEQ ID NO: 548567 - DNA, 25 bp, Mus musculus
caaccctctgaggaagctctctgtg

SEQ ID NO: 548568 - DNA, 25 bp, Mus musculus
caaccctctttgactgggaaggatc

SEQ ID NO: 548569 - DNA, 25 bp, Mus musculus
caaccctctttgtctgggaaggatc

SEQ ID NO: 548570 - DNA, 25 bp, Mus musculus
caaccctgcgccaacaagatgatac

SEQ ID NO: 548571 - DNA, 25 bp, Mus musculus
caaccctgcgcctacaagatgatac

SEQ ID NO: 548572 - DNA, 25 bp, Mus musculus
caaccctggaccacattccaaggag

SEQ ID NO: 548573 - DNA, 25 bp, Mus musculus
caaccctggacctcattccaaggag

SEQ ID NO: 548574 - DNA, 25 bp, Mus musculus
caaccctggatgataagttactggg

SEQ ID NO: 548575 - DNA, 25 bp, Mus musculus
caaccctggatgttaagttactggg

SEQ ID NO: 548576 - DNA, 25 bp, Mus musculus
caaccctggctcagagcctaaggac

SEQ ID NO: 548577 - DNA, 25 bp, Mus musculus
caaccctggctctgagcctaaggac

SEQ ID NO: 548578 - DNA, 25 bp, Mus musculus
caaccctggctgctgatgttatgag

SEQ ID NO: 548579 - DNA, 25 bp, Mus musculus
caaccctggctggtgatgttatgag

SEQ ID NO: 548580 - DNA, 25 bp, Mus musculus
caaccctgggacagtgacccgactg

SEQ ID NO: 548581 - DNA, 25 bp, Mus musculus
caaccctgggactgtgacccgactg

SEQ ID NO: 548582 - DNA, 25 bp, Mus musculus
caaccctggtatcgcacaaatcctg

SEQ ID NO: 548583 - DNA, 25 bp, Mus musculus
caaccctggtatggcacaaatcctg

SEQ ID NO: 548584 - DNA, 25 bp, Mus musculus
caaccctgtgccatgctggtgagca

SEQ ID NO: 548585 - DNA, 25 bp, Mus musculus
caaccctgtgccttgctggtgagca

SEQ ID NO: 548586 - DNA, 25 bp, Mus musculus
caaccctgtgcgattattggaatag

SEQ ID NO: 548587 - DNA, 25 bp, Mus musculus
caaccctgtgcgtttattggaatag

SEQ ID NO: 548588 - DNA, 25 bp, Mus musculus
caaccctgtgctcccggacgaggtg

SEQ ID NO: 548589 - DNA, 25 bp, Mus musculus
caaccctgtgctgccggacgaggtg

SEQ ID NO: 548590 - DNA, 25 bp, Mus musculus
caaccctgtggccggcttggtcatt

SEQ ID NO: 548591 - DNA, 25 bp, Mus musculus
caaccctgtggcgggcttggtcatt

SEQ ID NO: 548592 - DNA, 25 bp, Mus musculus
caaccctgttccagtcattcagagg

SEQ ID NO: 548593 - DNA, 25 bp, Mus musculus
caaccctgttcctgtcattcagagg

SEQ ID NO: 548594 - DNA, 25 bp, Mus musculus
caacccttcgctcacctgattggtt

SEQ ID NO: 548595 - DNA, 25 bp, Mus musculus
caacccttcgctgacctgattggtt

SEQ ID NO: 548596 - DNA, 25 bp, Mus musculus
caacccttgtgtcaacggtggcacc

SEQ ID NO: 548597 - DNA, 25 bp, Mus musculus
caacccttgtgtgaacggtggcacc

SEQ ID NO: 548598 - DNA, 25 bp, Mus musculus
caaccctttgcccaatacatttaca

SEQ ID NO: 548599 - DNA, 25 bp, Mus musculus
caaccctttgccgaatacatttaca

SEQ ID NO: 548600 - DNA, 25 bp, Mus musculus
caaccgaagacaacaaagcagcgtt

SEQ ID NO: 548601 - DNA, 25 bp, Mus musculus
caaccgaagacatcaaagcagcgtt

SEQ ID NO: 548602 - DNA, 25 bp, Mus musculus
caaccgaatgatagctgtctgccag

SEQ ID NO: 548603 - DNA, 25 bp, Mus musculus
caaccgaatgattgctgtctgccag

SEQ ID NO: 548604 - DNA, 25 bp, Mus musculus
caaccgaatgtaaaacatggtcccc

SEQ ID NO: 548605 - DNA, 25 bp, Mus musculus
caaccgaatgtataacatggtcccc

SEQ ID NO: 548606 - DNA, 25 bp, Mus musculus
caaccgaggagactttttcatgact

SEQ ID NO: 548607 - DNA, 25 bp, Mus musculus
caaccgaggagagtttttcatgact

SEQ ID NO: 548608 - DNA, 25 bp, Mus musculus
caaccgatcattcttctctgacaag

SEQ ID NO: 548609 - DNA, 25 bp, Mus musculus
caaccgatcattgttctctgacaag

SEQ ID NO: 548610 - DNA, 25 bp, Mus musculus
caaccgattcttcaacccagatgga

SEQ ID NO: 548611 - DNA, 25 bp, Mus musculus
caaccgattcttgaacccagatgga

SEQ ID NO: 548612 - DNA, 25 bp, Mus musculus
caaccgattgaaatactcagcatga

SEQ ID NO: 548613 - DNA, 25 bp, Mus musculus
caaccgattgaattactcagcatga

SEQ ID NO: 548614 - DNA, 25 bp, Mus musculus
caaccgcatgaacagcaaccacatg

SEQ ID NO: 548615 - DNA, 25 bp, Mus musculus
caaccgcatgaagagcaaccacatg

SEQ ID NO: 548616 - DNA, 25 bp, Mus musculus
caaccgcatggccaactatacaaat

SEQ ID NO: 548617 - DNA, 25 bp, Mus musculus
caaccgcatggcgaactatacaaat

SEQ ID NO: 548618 - DNA, 25 bp, Mus musculus
caaccgcatggtcctggcgaggctt

SEQ ID NO: 548619 - DNA, 25 bp, Mus musculus
caaccgcatggtgctggcgaggctt

SEQ ID NO: 548620 - DNA, 25 bp, Mus musculus
caaccgccaagaatggacattcaca

SEQ ID NO: 548621 - DNA, 25 bp, Mus musculus
caaccgccaagattggacattcaca

SEQ ID NO: 548622 - DNA, 25 bp, Mus musculus
caaccgccgggtcacactgtgtaat

SEQ ID NO: 548623 - DNA, 25 bp, Mus musculus
caaccgccgggtgacactgtgtaat

SEQ ID NO: 548624 - DNA, 25 bp, Mus musculus
caaccgctgggtcgaatccaaacat

SEQ ID NO: 548625 - DNA, 25 bp, Mus musculus
caaccgctgggtggaatccaaacat

SEQ ID NO: 548626 - DNA, 25 bp, Mus musculus
caaccggaacccacggaatctggag

SEQ ID NO: 548627 - DNA, 25 bp, Mus musculus
caaccggaaccctcggaatctggag

SEQ ID NO: 548628 - DNA, 25 bp, Mus musculus
caaccggactgtcagcaagatcctg

SEQ ID NO: 548629 - DNA, 25 bp, Mus musculus
caaccggactgtgagcaagatcctg

SEQ ID NO: 548630 - DNA, 25 bp, Mus musculus
caaccggagagcaaatggcctctac

SEQ ID NO: 548631 - DNA, 25 bp, Mus musculus
caaccggagagctaatggcctctac

SEQ ID NO: 548632 - DNA, 25 bp, Mus musculus
caaccggagatccagacacagatct

SEQ ID NO: 548633 - DNA, 25 bp, Mus musculus
caaccggagatcgagacacagatct

SEQ ID NO: 548634 - DNA, 25 bp, Mus musculus
caaccggagcttcgattttaactgg

SEQ ID NO: 548635 - DNA, 25 bp, Mus musculus
caaccggagcttggattttaactgg

SEQ ID NO: 548636 - DNA, 25 bp, Mus musculus
caaccggagtctcaagtctggacca

SEQ ID NO: 548637 - DNA, 25 bp, Mus musculus
caaccggagtctgaagtctggacca

SEQ ID NO: 548638 - DNA, 25 bp, Mus musculus
caaccggatccgcagtggcatgttc

SEQ ID NO: 548639 - DNA, 25 bp, Mus musculus
caaccggatccggagtggcatgttc

SEQ ID NO: 548640 - DNA, 25 bp, Mus musculus
caaccggatctgcaaggtgctggct

SEQ ID NO: 548641 - DNA, 25 bp, Mus musculus
caaccggatctggaaggtgctggct

SEQ ID NO: 548642 - DNA, 25 bp, Mus musculus
caaccggatggaatggctgttttgg

SEQ ID NO: 548643 - DNA, 25 bp, Mus musculus
caaccggatggattggctgttttgg

SEQ ID NO: 548644 - DNA, 25 bp, Mus musculus
caaccggcaaggctagagcatacgc

SEQ ID NO: 548645 - DNA, 25 bp, Mus musculus
caaccggcaagggtagagcatacgc

SEQ ID NO: 548646 - DNA, 25 bp, Mus musculus
caaccggcttaacaagaagatgcag

SEQ ID NO: 548647 - DNA, 25 bp, Mus musculus
caaccggcttaagaagaagatgcag

SEQ ID NO: 548648 - DNA, 25 bp, Mus musculus
caaccgggaagaacgagtgtgacgt

SEQ ID NO: 548649 - DNA, 25 bp, Mus musculus
caaccgggaagatcgagtgtgacgt

SEQ ID NO: 548650 - DNA, 25 bp, Mus musculus
caaccgggacacactggctgtcatc

SEQ ID NO: 548651 - DNA, 25 bp, Mus musculus
caaccgggacactctggctgtcatc

SEQ ID NO: 548652 - DNA, 25 bp, Mus musculus
caaccgggtgctccactgtaacgcg

SEQ ID NO: 548653 - DNA, 25 bp, Mus musculus
caaccgggtgctgcactgtaacgcg

SEQ ID NO: 548654 - DNA, 25 bp, Mus musculus
caaccggtacctagctatgaaggaa

SEQ ID NO: 548655 - DNA, 25 bp, Mus musculus
caaccggtaccttgctatgaaggaa

SEQ ID NO: 548656 - DNA, 25 bp, Mus musculus
caaccggtggttctaagagaggaca

SEQ ID NO: 548657 - DNA, 25 bp, Mus musculus
caaccggtggttgtaagagaggaca

SEQ ID NO: 548658 - DNA, 25 bp, Mus musculus
caaccgtagaacacttgcttagcag

SEQ ID NO: 548659 - DNA, 25 bp, Mus musculus
caaccgtagaactcttgcttagcag

SEQ ID NO: 548660 - DNA, 25 bp, Mus musculus
caaccgtcgattagcagctatttct

SEQ ID NO: 548661 - DNA, 25 bp, Mus musculus
caaccgtcgatttgcagctatttct

SEQ ID NO: 548662 - DNA, 25 bp, Mus musculus
caaccgtctctgagcgccaaggaat

SEQ ID NO: 548663 - DNA, 25 bp, Mus musculus
caaccgtctctgtgcgccaaggaat

SEQ ID NO: 548664 - DNA, 25 bp, Mus musculus
caaccgtctgttacttcaggtccag

SEQ ID NO: 548665 - DNA, 25 bp, Mus musculus
caaccgtctgtttcttcaggtccag

SEQ ID NO: 548666 - DNA, 25 bp, Mus musculus
caaccgtgagatcgacaagcgcatg

SEQ ID NO: 548667 - DNA, 25 bp, Mus musculus
caaccgtgagatggacaagcgcatg

SEQ ID NO: 548668 - DNA, 25 bp, Mus musculus
caaccgtgcagcctgctacttgaag

SEQ ID NO: 548669 - DNA, 25 bp, Mus musculus
caaccgtgcagcgtgctacttgaag

SEQ ID NO: 548670 - DNA, 25 bp, Mus musculus
caaccgtgtgaccaaagtggccgtg

SEQ ID NO: 548671 - DNA, 25 bp, Mus musculus
caaccgtgtgacgaaagtggccgtg

SEQ ID NO: 548672 - DNA, 25 bp, Mus musculus
caaccgtgtggcagaaccagcccag

SEQ ID NO: 548673 - DNA, 25 bp, Mus musculus
caaccgtgtggctgaaccagcccag

SEQ ID NO: 548674 - DNA, 25 bp, Mus musculus
caaccgtgtggtcacattgtggtac

SEQ ID NO: 548675 - DNA, 25 bp, Mus musculus
caaccgtgtggtgacattgtggtac

SEQ ID NO: 548676 - DNA, 25 bp, Mus musculus
caaccgttctctagacatgtggtcg

SEQ ID NO: 548677 - DNA, 25 bp, Mus musculus
caaccgttctcttgacatgtggtcg

SEQ ID NO: 548678 - DNA, 25 bp, Mus musculus
caaccgttggatctgccaaaaggaa

SEQ ID NO: 548679 - DNA, 25 bp, Mus musculus
caaccgttggatgtgccaaaaggaa

SEQ ID NO: 548680 - DNA, 25 bp, Mus musculus
caacctaacgtcatcaacctgagtg

SEQ ID NO: 548681 - DNA, 25 bp, Mus musculus
caacctaacgtcttcaacctgagtg

SEQ ID NO: 548682 - DNA, 25 bp, Mus musculus
caacctaagcgacgagctgggagtt

SEQ ID NO: 548683 - DNA, 25 bp, Mus musculus
caacctaagcgaggagctgggagtt

SEQ ID NO: 548684 - DNA, 25 bp, Mus musculus
caacctacggcaaggctgatggaga

SEQ ID NO: 548685 - DNA, 25 bp, Mus musculus
caacctacggcatggctgatggaga

SEQ ID NO: 548686 - DNA, 25 bp, Mus musculus
caacctatctttcctgtcaccggtg

SEQ ID NO: 548687 - DNA, 25 bp, Mus musculus
caacctatctttgctgtcaccggtg

SEQ ID NO: 548688 - DNA, 25 bp, Mus musculus
caacctatggatctggtcagaaagc

SEQ ID NO: 548689 - DNA, 25 bp, Mus musculus
caacctatggatgtggtcagaaagc

SEQ ID NO: 548690 - DNA, 25 bp, Mus musculus
caacctcacgcaccttggtcttgga

SEQ ID NO: 548691 - DNA, 25 bp, Mus musculus
caacctcacgcagcttggtcttgga

SEQ ID NO: 548692 - DNA, 25 bp, Mus musculus
caacctcagtttaaacaagctttca

SEQ ID NO: 548693 - DNA, 25 bp, Mus musculus
caacctcagttttaacaagctttca

SEQ ID NO: 548694 - DNA, 25 bp, Mus musculus
caacctccaaagattatactatcag

SEQ ID NO: 548695 - DNA, 25 bp, Mus musculus
caacctccaaagtttatactatcag

SEQ ID NO: 548696 - DNA, 25 bp, Mus musculus
caacctccaggacagtaaccagact

SEQ ID NO: 548697 - DNA, 25 bp, Mus musculus
caacctccaggagagtaaccagact

SEQ ID NO: 548698 - DNA, 25 bp, Mus musculus
caacctccagttccttgggcagcag

SEQ ID NO: 548699 - DNA, 25 bp, Mus musculus
caacctccagttgcttgggcagcag

SEQ ID NO: 548700 - DNA, 25 bp, Mus musculus
caacctccattgagctttagaataa

SEQ ID NO: 548701 - DNA, 25 bp, Mus musculus
caacctccattgtgctttagaataa

SEQ ID NO: 548702 - DNA, 25 bp, Mus musculus
caacctccgcagagacaaagatcgg

SEQ ID NO: 548703 - DNA, 25 bp, Mus musculus
caacctccgcagtgacaaagatcgg

SEQ ID NO: 548704 - DNA, 25 bp, Mus musculus
caacctcgactaagcaaacactgaa

SEQ ID NO: 548705 - DNA, 25 bp, Mus musculus
caacctcgactatgcaaacactgaa

SEQ ID NO: 548706 - DNA, 25 bp, Mus musculus
caacctcggaggcagtgtcatcaat

SEQ ID NO: 548707 - DNA, 25 bp, Mus musculus
caacctcggagggagtgtcatcaat

SEQ ID NO: 548708 - DNA, 25 bp, Mus musculus
caacctctcatcacaactggcagga

SEQ ID NO: 548709 - DNA, 25 bp, Mus musculus
caacctctcatctcaactggcagga

SEQ ID NO: 548710 - DNA, 25 bp, Mus musculus
caacctctccggagacactgtagga

SEQ ID NO: 548711 - DNA, 25 bp, Mus musculus
caacctctccggtgacactgtagga

SEQ ID NO: 548712 - DNA, 25 bp, Mus musculus
caacctctccttcgcgtatgtggaa

SEQ ID NO: 548713 - DNA, 25 bp, Mus musculus
caacctctccttggcgtatgtggaa

SEQ ID NO: 548714 - DNA, 25 bp, Mus musculus
caacctctgcgtcaaccagattgtt

SEQ ID NO: 548715 - DNA, 25 bp, Mus musculus
caacctctgcgtgaaccagattgtt

SEQ ID NO: 548716 - DNA, 25 bp, Mus musculus
caacctctggaacgagttgctggag

SEQ ID NO: 548717 - DNA, 25 bp, Mus musculus
caacctctggaaggagttgctggag

SEQ ID NO: 548718 - DNA, 25 bp, Mus musculus
caacctctgtggctcccactgtggt

SEQ ID NO: 548719 - DNA, 25 bp, Mus musculus
caacctctgtgggtcccactgtggt

SEQ ID NO: 548720 - DNA, 25 bp, Mus musculus
caacctcttcataggcatcaatagc

SEQ ID NO: 548721 - DNA, 25 bp, Mus musculus
caacctcttcattggcatcaatagc

SEQ ID NO: 548722 - DNA, 25 bp, Mus musculus
caacctcttccactttgaattcaaa

SEQ ID NO: 548723 - DNA, 25 bp, Mus musculus
caacctcttccagtttgaattcaaa

SEQ ID NO: 548724 - DNA, 25 bp, Mus musculus
caacctgaaggcagtggtctgcaag

SEQ ID NO: 548725 - DNA, 25 bp, Mus musculus
caacctgaaggctgtggtctgcaag

SEQ ID NO: 548726 - DNA, 25 bp, Mus musculus
caacctgaatctcataggccggcct

SEQ ID NO: 548727 - DNA, 25 bp, Mus musculus
caacctgaatctgataggccggcct

SEQ ID NO: 548728 - DNA, 25 bp, Mus musculus
caacctgaatgacgaccctttgatg

SEQ ID NO: 548729 - DNA, 25 bp, Mus musculus
caacctgaatgaggaccctttgatg

SEQ ID NO: 548730 - DNA, 25 bp, Mus musculus
caacctgacggcctagggaaatcct

SEQ ID NO: 548731 - DNA, 25 bp, Mus musculus
caacctgacggcgtagggaaatcct

SEQ ID NO: 548732 - DNA, 25 bp, Mus musculus
caacctgactccagtcgttcagaaa

SEQ ID NO: 548733 - DNA, 25 bp, Mus musculus
caacctgactcctgtcgttcagaaa

SEQ ID NO: 548734 - DNA, 25 bp, Mus musculus
caacctgagcgtcgagaatgcctgg

SEQ ID NO: 548735 - DNA, 25 bp, Mus musculus
caacctgagcgtggagaatgcctgg

SEQ ID NO: 548736 - DNA, 25 bp, Mus musculus
caacctgagtccaacaggctggtca

SEQ ID NO: 548737 - DNA, 25 bp, Mus musculus
caacctgagtcctacaggctggtca

SEQ ID NO: 548738 - DNA, 25 bp, Mus musculus
caacctgatcaacaaaccggatgag

SEQ ID NO: 548739 - DNA, 25 bp, Mus musculus
caacctgatcaagaaaccggatgag

SEQ ID NO: 548740 - DNA, 25 bp, Mus musculus
caacctgattggactggtcgcctgc

SEQ ID NO: 548741 - DNA, 25 bp, Mus musculus
caacctgattggtctggtcgcctgc

SEQ ID NO: 548742 - DNA, 25 bp, Mus musculus
caacctgcacgcctgggaaatgaag

SEQ ID NO: 548743 - DNA, 25 bp, Mus musculus
caacctgcacgcgtgggaaatgaag

SEQ ID NO: 548744 - DNA, 25 bp, Mus musculus
caacctgccagtaccagggacggag

SEQ ID NO: 548745 - DNA, 25 bp, Mus musculus
caacctgccagttccagggacggag

SEQ ID NO: 548746 - DNA, 25 bp, Mus musculus
caacctgcccgaccctgtgtttgag

SEQ ID NO: 548747 - DNA, 25 bp, Mus musculus
caacctgcccgagcctgtgtttgag

SEQ ID NO: 548748 - DNA, 25 bp, Mus musculus
caacctgcctctaggaaactacaaa

SEQ ID NO: 548749 - DNA, 25 bp, Mus musculus
caacctgcctcttggaaactacaaa

SEQ ID NO: 548750 - DNA, 25 bp, Mus musculus
caacctgctcgtctaccttgcggag

SEQ ID NO: 548751 - DNA, 25 bp, Mus musculus
caacctgctcgtgtaccttgcggag

SEQ ID NO: 548752 - DNA, 25 bp, Mus musculus
caacctgctggcaattgctatcgag

SEQ ID NO: 548753 - DNA, 25 bp, Mus musculus
caacctgctggctattgctatcgag

SEQ ID NO: 548754 - DNA, 25 bp, Mus musculus
caacctggaagtccgtctcttggct

SEQ ID NO: 548755 - DNA, 25 bp, Mus musculus
caacctggaagtgcgtctcttggct

SEQ ID NO: 548756 - DNA, 25 bp, Mus musculus
caacctggaccaaccgagacaagtt

SEQ ID NO: 548757 - DNA, 25 bp, Mus musculus
caacctggaccatccgagacaagtt

SEQ ID NO: 548758 - DNA, 25 bp, Mus musculus
caacctggacctcaatcagcacaga

SEQ ID NO: 548759 - DNA, 25 bp, Mus musculus
caacctggacctgaatcagcacaga

SEQ ID NO: 548760 - DNA, 25 bp, Mus musculus
caacctggaggtagttctggcaacc

SEQ ID NO: 548761 - DNA, 25 bp, Mus musculus
caacctggaggttgttctggcaacc

SEQ ID NO: 548762 - DNA, 25 bp, Mus musculus
caacctggccgaagcagtagagggc

SEQ ID NO: 548763 - DNA, 25 bp, Mus musculus
caacctggccgatgcagtagagggc

SEQ ID NO: 548764 - DNA, 25 bp, Mus musculus
caacctgggaatccgctagaccgta

SEQ ID NO: 548765 - DNA, 25 bp, Mus musculus
caacctgggaatgcgctagaccgta

SEQ ID NO: 548766 - DNA, 25 bp, Mus musculus
caacctgggcaacggacgttacaag

SEQ ID NO: 548767 - DNA, 25 bp, Mus musculus
caacctgggcaagggacgttacaag

SEQ ID NO: 548768 - DNA, 25 bp, Mus musculus
caacctggggatcagctgcatcaac

SEQ ID NO: 548769 - DNA, 25 bp, Mus musculus
caacctggggatgagctgcatcaac

SEQ ID NO: 548770 - DNA, 25 bp, Mus musculus
caacctggtagaactggcaggctca

SEQ ID NO: 548771 - DNA, 25 bp, Mus musculus
caacctggtagatctggcaggctca

SEQ ID NO: 548772 - DNA, 25 bp, Mus musculus
caacctggtcatccagtatgcagct

SEQ ID NO: 548773 - DNA, 25 bp, Mus musculus
caacctggtcatgcagtatgcagct

SEQ ID NO: 548774 - DNA, 25 bp, Mus musculus
caacctgtacatatctaacctgccg

SEQ ID NO: 548775 - DNA, 25 bp, Mus musculus
caacctgtacatttctaacctgccg

SEQ ID NO: 548776 - DNA, 25 bp, Mus musculus
caacctgtatatccgaggactgcag

SEQ ID NO: 548777 - DNA, 25 bp, Mus musculus
caacctgtatatgcgaggactgcag

SEQ ID NO: 548778 - DNA, 25 bp, Mus musculus
caacctgtatctcgccaagcctaga

SEQ ID NO: 548779 - DNA, 25 bp, Mus musculus
caacctgtatctggccaagcctaga

SEQ ID NO: 548780 - DNA, 25 bp, Mus musculus
caacctgtgaacagtaaataggccc

SEQ ID NO: 548781 - DNA, 25 bp, Mus musculus
caacctgtgaactgtaaataggccc

SEQ ID NO: 548782 - DNA, 25 bp, Mus musculus
caacctgtgcgaaggtaaatttgac

SEQ ID NO: 548783 - DNA, 25 bp, Mus musculus
caacctgtgcgatggtaaatttgac

SEQ ID NO: 548784 - DNA, 25 bp, Mus musculus
caacctgtgtgtcatcggtggcgac

SEQ ID NO: 548785 - DNA, 25 bp, Mus musculus
caacctgtgtgtcgagtaaaagctc

SEQ ID NO: 548786 - DNA, 25 bp, Mus musculus
caacctgtgtgtgatcggtggcgac

SEQ ID NO: 548787 - DNA, 25 bp, Mus musculus
caacctgtgtgtggagtaaaagctc

SEQ ID NO: 548788 - DNA, 25 bp, Mus musculus
caacctgttgtgatcttcagtagac

SEQ ID NO: 548789 - DNA, 25 bp, Mus musculus
caacctgttgtgttcttcagtagac

SEQ ID NO: 548790 - DNA, 25 bp, Mus musculus
caacctgtttgaaacgtataagggc

SEQ ID NO: 548791 - DNA, 25 bp, Mus musculus
caacctgtttgatacgtataagggc

SEQ ID NO: 548792 - DNA, 25 bp, Mus musculus
caacctgtttttaagatgaaaccag

SEQ ID NO: 548793 - DNA, 25 bp, Mus musculus
caacctgttttttagatgaaaccag

SEQ ID NO: 548794 - DNA, 25 bp, Mus musculus
caaccttcgggaaatcgtggaacag

SEQ ID NO: 548795 - DNA, 25 bp, Mus musculus
caaccttcgggacacatggacaacc

SEQ ID NO: 548796 - DNA, 25 bp, Mus musculus
caaccttcgggagacatggacaacc

SEQ ID NO: 548797 - DNA, 25 bp, Mus musculus
caaccttcgggatatcgtggaacag

SEQ ID NO: 548798 - DNA, 25 bp, Mus musculus
caaccttgacttctacgaaggccac

SEQ ID NO: 548799 - DNA, 25 bp, Mus musculus
caaccttgacttgtacgaaggccac

SEQ ID NO: 548800 - DNA, 25 bp, Mus musculus
caaccttgccaaccaggaagctcag

SEQ ID NO: 548801 - DNA, 25 bp, Mus musculus
caaccttgccaagcaggaagctcag

SEQ ID NO: 548802 - DNA, 25 bp, Mus musculus
caaccttggcatacagagaagccta

SEQ ID NO: 548803 - DNA, 25 bp, Mus musculus
caaccttggcatagaagcaagcaag

SEQ ID NO: 548804 - DNA, 25 bp, Mus musculus
caaccttggcattcagagaagccta

SEQ ID NO: 548805 - DNA, 25 bp, Mus musculus
caaccttggcattgaagcaagcaag

SEQ ID NO: 548806 - DNA, 25 bp, Mus musculus
caaccttgggaaatccctgattgag

SEQ ID NO: 548807 - DNA, 25 bp, Mus musculus
caaccttgggaattccctgattgag

SEQ ID NO: 548808 - DNA, 25 bp, Mus musculus
caaccttgggcaagacgccgatgag

SEQ ID NO: 548809 - DNA, 25 bp, Mus musculus
caaccttgggcatgacgccgatgag

SEQ ID NO: 548810 - DNA, 25 bp, Mus musculus
caaccttgtaagacctgtggaacag

SEQ ID NO: 548811 - DNA, 25 bp, Mus musculus
caaccttgtaagtcctgtggaacag

SEQ ID NO: 548812 - DNA, 25 bp, Mus musculus
caaccttgtcctcctccttgttagg

SEQ ID NO: 548813 - DNA, 25 bp, Mus musculus
caaccttgtcctgctccttgttagg

SEQ ID NO: 548814 - DNA, 25 bp, Mus musculus
caaccttgttcacaccgcgcagtat

SEQ ID NO: 548815 - DNA, 25 bp, Mus musculus
caaccttgttcagaccgcgcagtat

SEQ ID NO: 548816 - DNA, 25 bp, Mus musculus
caacctttcagtactcaagccattc

SEQ ID NO: 548817 - DNA, 25 bp, Mus musculus
caacctttcagttctcaagccattc

SEQ ID NO: 548818 - DNA, 25 bp, Mus musculus
caacctttcgtaagcctccagctgg

SEQ ID NO: 548819 - DNA, 25 bp, Mus musculus
caacctttcgtatgcctccagctgg

SEQ ID NO: 548820 - DNA, 25 bp, Mus musculus
caacctttctggcatgtgctgaccc

SEQ ID NO: 548821 - DNA, 25 bp, Mus musculus
caacctttctgggatgtgctgaccc

SEQ ID NO: 548822 - DNA, 25 bp, Mus musculus
caacctttgagaaggctcacgatgg

SEQ ID NO: 548823 - DNA, 25 bp, Mus musculus
caacctttgagatggctcacgatgg

SEQ ID NO: 548824 - DNA, 25 bp, Mus musculus
caacctttgagtcaaaaatctcagg

SEQ ID NO: 548825 - DNA, 25 bp, Mus musculus
caacctttgagtgaaaaatctcagg

SEQ ID NO: 548826 - DNA, 25 bp, Mus musculus
caacctttggaaataactcatgtcc

SEQ ID NO: 548827 - DNA, 25 bp, Mus musculus
caacctttggaattaactcatgtcc

SEQ ID NO: 548828 - DNA, 25 bp, Mus musculus
caaccttttaatcctcatttgaagc

SEQ ID NO: 548829 - DNA, 25 bp, Mus musculus
caaccttttaatgctcatttgaagc

SEQ ID NO: 548830 - DNA, 25 bp, Mus musculus
caaccttttccaccgctacaaaagg

SEQ ID NO: 548831 - DNA, 25 bp, Mus musculus
caaccttttccagcgctacaaaagg

SEQ ID NO: 548832 - DNA, 25 bp, Mus musculus
caacgaaatagtcggcaatgaagac

SEQ ID NO: 548833 - DNA, 25 bp, Mus musculus
caacgaaatagtgggcaatgaagac

SEQ ID NO: 548834 - DNA, 25 bp, Mus musculus
caacgaatgaaacaacggtatgaac

SEQ ID NO: 548835 - DNA, 25 bp, Mus musculus
caacgaatgaaagaacggtatgaac

SEQ ID NO: 548836 - DNA, 25 bp, Mus musculus
caacgaatgcacatcgttactggag

SEQ ID NO: 548837 - DNA, 25 bp, Mus musculus
caacgaatgcacttcgttactggag

SEQ ID NO: 548838 - DNA, 25 bp, Mus musculus
caacgaatgcctcgtgagcgacagc

SEQ ID NO: 548839 - DNA, 25 bp, Mus musculus
caacgaatgcctggtgagcgacagc

SEQ ID NO: 548840 - DNA, 25 bp, Mus musculus
caacgaatggaaagtgaccacccga

SEQ ID NO: 548841 - DNA, 25 bp, Mus musculus
caacgaatggaatgtgaccacccga

SEQ ID NO: 548842 - DNA, 25 bp, Mus musculus
caacgaatggctcggaatcaagaac

SEQ ID NO: 548843 - DNA, 25 bp, Mus musculus
caacgaatggctgggaatcaagaac

SEQ ID NO: 548844 - DNA, 25 bp, Mus musculus
caacgaatgtgccatgcctggcatg

SEQ ID NO: 548845 - DNA, 25 bp, Mus musculus
caacgaatgtgcgatgcctggcatg

SEQ ID NO: 548846 - DNA, 25 bp, Mus musculus
caacgacaaacgacacagtggatga

SEQ ID NO: 548847 - DNA, 25 bp, Mus musculus
caacgacaaacgtcacagtggatga

SEQ ID NO: 548848 - DNA, 25 bp, Mus musculus
caacgacaaagtcatgggacctggg

SEQ ID NO: 548849 - DNA, 25 bp, Mus musculus
caacgacaaagtgatgggacctggg

SEQ ID NO: 548850 - DNA, 25 bp, Mus musculus
caacgacaacatctcctactctgtg

SEQ ID NO: 548851 - DNA, 25 bp, Mus musculus
caacgacaacatgtcctactctgtg

SEQ ID NO: 548852 - DNA, 25 bp, Mus musculus
caacgacagcatcggcagcccaagg

SEQ ID NO: 548853 - DNA, 25 bp, Mus musculus
caacgacagcatgggcagcccaagg

SEQ ID NO: 548854 - DNA, 25 bp, Mus musculus
caacgaccatcacttcagagactca

SEQ ID NO: 548855 - DNA, 25 bp, Mus musculus
caacgaccatcagttcagagactca

SEQ ID NO: 548856 - DNA, 25 bp, Mus musculus
caacgaccccgacgatgagagtaag

SEQ ID NO: 548857 - DNA, 25 bp, Mus musculus
caacgaccccgaggatgagagtaag

SEQ ID NO: 548858 - DNA, 25 bp, Mus musculus
caacgacctgatcggcctaaatgag

SEQ ID NO: 548859 - DNA, 25 bp, Mus musculus
caacgacctgatgggcctaaatgag

SEQ ID NO: 548860 - DNA, 25 bp, Mus musculus
caacgacgatggaaggtcttgccaa

SEQ ID NO: 548861 - DNA, 25 bp, Mus musculus
caacgacgatggtaggtcttgccaa

SEQ ID NO: 548862 - DNA, 25 bp, Mus musculus
caacgacgtcttactgctgcggact

SEQ ID NO: 548863 - DNA, 25 bp, Mus musculus
caacgacgtctttctgctgcggact

SEQ ID NO: 548864 - DNA, 25 bp, Mus musculus
caacgactcggcagtgctgtcactc

SEQ ID NO: 548865 - DNA, 25 bp, Mus musculus
caacgactcggctgtgctgtcactc

SEQ ID NO: 548866 - DNA, 25 bp, Mus musculus
caacgactggcacgaatccaagagt

SEQ ID NO: 548867 - DNA, 25 bp, Mus musculus
caacgactggcaggaatccaagagt

SEQ ID NO: 548868 - DNA, 25 bp, Mus musculus
caacgagaagctccactacgaggtc

SEQ ID NO: 548869 - DNA, 25 bp, Mus musculus
caacgagaagctcgatatggtcaag

SEQ ID NO: 548870 - DNA, 25 bp, Mus musculus
caacgagaagctgcactacgaggtc

SEQ ID NO: 548871 - DNA, 25 bp, Mus musculus
caacgagaagctggatatggtcaag

SEQ ID NO: 548872 - DNA, 25 bp, Mus musculus
caacgagaccaccttataccagcgt

SEQ ID NO: 548873 - DNA, 25 bp, Mus musculus
caacgagaccacgttataccagcgt

SEQ ID NO: 548874 - DNA, 25 bp, Mus musculus
caacgagaccagctgtcagtacgag

SEQ ID NO: 548875 - DNA, 25 bp, Mus musculus
caacgagaccaggtgtcagtacgag

SEQ ID NO: 548876 - DNA, 25 bp, Mus musculus
caacgagaggaacgtgtccacgcgc

SEQ ID NO: 548877 - DNA, 25 bp, Mus musculus
caacgagaggaaggtgtccacgcgc

SEQ ID NO: 548878 - DNA, 25 bp, Mus musculus
caacgagatcaacgcccgcaagatc

SEQ ID NO: 548879 - DNA, 25 bp, Mus musculus
caacgagatcaaggcccgcaagatc

SEQ ID NO: 548880 - DNA, 25 bp, Mus musculus
caacgagcgacaaaagccagagcat

SEQ ID NO: 548881 - DNA, 25 bp, Mus musculus
caacgagcgacataagccagagcat

SEQ ID NO: 548882 - DNA, 25 bp, Mus musculus
caacgagctctgagaagtgaaccgg

SEQ ID NO: 548883 - DNA, 25 bp, Mus musculus
caacgagctctgtgaagtgaaccgg

SEQ ID NO: 548884 - DNA, 25 bp, Mus musculus
caacgaggagaaccggatcacagag

SEQ ID NO: 548885 - DNA, 25 bp, Mus musculus
caacgaggagaagcggatcacagag

SEQ ID NO: 548886 - DNA, 25 bp, Mus musculus
caacgagggcatccccatctcggta

SEQ ID NO: 548887 - DNA, 25 bp, Mus musculus
caacgagggcatgcccatctcggta

SEQ ID NO: 548888 - DNA, 25 bp, Mus musculus
caacgagggttgcagcatgttgaac

SEQ ID NO: 548889 - DNA, 25 bp, Mus musculus
caacgagggttggagcatgttgaac

SEQ ID NO: 548890 - DNA, 25 bp, Mus musculus
caacgagtaagcagggaagacgctc

SEQ ID NO: 548891 - DNA, 25 bp, Mus musculus
caacgagtaagctgggaagacgctc

SEQ ID NO: 548892 - DNA, 25 bp, Mus musculus
caacgagtcatgagccgctggaaca

SEQ ID NO: 548893 - DNA, 25 bp, Mus musculus
caacgagtcatgtgccgctggaaca

SEQ ID NO: 548894 - DNA, 25 bp, Mus musculus
caacgagtgcagagtcaacaatgga

SEQ ID NO: 548895 - DNA, 25 bp, Mus musculus
caacgagtgcagtgtcaacaatgga

SEQ ID NO: 548896 - DNA, 25 bp, Mus musculus
caacgagtgccacctttaatgtcag

SEQ ID NO: 548897 - DNA, 25 bp, Mus musculus
caacgagtgccagctttaatgtcag

SEQ ID NO: 548898 - DNA, 25 bp, Mus musculus
caacgagtgcccaaatatagtacca

SEQ ID NO: 548899 - DNA, 25 bp, Mus musculus
caacgagtgccctaatatagtacca

SEQ ID NO: 548900 - DNA, 25 bp, Mus musculus
caacgagtgcttcatgaataacgga

SEQ ID NO: 548901 - DNA, 25 bp, Mus musculus
caacgagtgcttgatgaataacgga

SEQ ID NO: 548902 - DNA, 25 bp, Mus musculus
caacgagtggttccatggagactgc

SEQ ID NO: 548903 - DNA, 25 bp, Mus musculus
caacgagtggttgcatggagactgc

SEQ ID NO: 548904 - DNA, 25 bp, Mus musculus
caacgagtgtatcaggaacccctgt

SEQ ID NO: 548905 - DNA, 25 bp, Mus musculus
caacgagtgtatgaggaacccctgt

SEQ ID NO: 548906 - DNA, 25 bp, Mus musculus
caacgataccgcctggagcattaca

SEQ ID NO: 548907 - DNA, 25 bp, Mus musculus
caacgataccgcgtggagcattaca

SEQ ID NO: 548908 - DNA, 25 bp, Mus musculus
caacgatatcccaggctcagacatc

SEQ ID NO: 548909 - DNA, 25 bp, Mus musculus
caacgatatccctggctcagacatc

SEQ ID NO: 548910 - DNA, 25 bp, Mus musculus
caacgatcaagaagagctggtagcc

SEQ ID NO: 548911 - DNA, 25 bp, Mus musculus
caacgatcaagatgagctggtagcc

SEQ ID NO: 548912 - DNA, 25 bp, Mus musculus
caacgatgaggtcgatgaagatccc

SEQ ID NO: 548913 - DNA, 25 bp, Mus musculus
caacgatgaggtggatgaagatccc

SEQ ID NO: 548914 - DNA, 25 bp, Mus musculus
caacgattctctactgactgcagca

SEQ ID NO: 548915 - DNA, 25 bp, Mus musculus
caacgattctcttctgactgcagca

SEQ ID NO: 548916 - DNA, 25 bp, Mus musculus
caacgattttgacatttaccgacta

SEQ ID NO: 548917 - DNA, 25 bp, Mus musculus
caacgattttgagatttaccgacta

SEQ ID NO: 548918 - DNA, 25 bp, Mus musculus
caacgcaaagacaggcaaactggaa

SEQ ID NO: 548919 - DNA, 25 bp, Mus musculus
caacgcaaagactggcaaactggaa

SEQ ID NO: 548920 - DNA, 25 bp, Mus musculus
caacgcaagcctcaacatctgtcat

SEQ ID NO: 548921 - DNA, 25 bp, Mus musculus
caacgcaagcctgaacatctgtcat

SEQ ID NO: 548922 - DNA, 25 bp, Mus musculus
caacgcacagcgagtcggatacaag

SEQ ID NO: 548923 - DNA, 25 bp, Mus musculus
caacgcacagcgtgtcggatacaag

SEQ ID NO: 548924 - DNA, 25 bp, Mus musculus
caacgccaatagcatcaagcagatg

SEQ ID NO: 548925 - DNA, 25 bp, Mus musculus
caacgccaataggatcaagcagatg

SEQ ID NO: 548926 - DNA, 25 bp, Mus musculus
caacgccacagtacctgatggtgaa

SEQ ID NO: 548927 - DNA, 25 bp, Mus musculus
caacgccacagttcctgatggtgaa

SEQ ID NO: 548928 - DNA, 25 bp, Mus musculus
caacgccagtgcaccatctgtgagg

SEQ ID NO: 548929 - DNA, 25 bp, Mus musculus
caacgccagtgctccatctgtgagg

SEQ ID NO: 548930 - DNA, 25 bp, Mus musculus
caacgcccacaaagaggtggttaaa

SEQ ID NO: 548931 - DNA, 25 bp, Mus musculus
caacgcccacaatgaggtggttaaa

SEQ ID NO: 548932 - DNA, 25 bp, Mus musculus
caacgccctggccaactatgtgttt

SEQ ID NO: 548933 - DNA, 25 bp, Mus musculus
caacgccctggcgaactatgtgttt

SEQ ID NO: 548934 - DNA, 25 bp, Mus musculus
caacgccctgggagacaaaggagtc

SEQ ID NO: 548935 - DNA, 25 bp, Mus musculus
caacgccctgggtgacaaaggagtc

SEQ ID NO: 548936 - DNA, 25 bp, Mus musculus
caacgccgtggactcctattggaaa

SEQ ID NO: 548937 - DNA, 25 bp, Mus musculus
caacgccgtggagtcctattggaaa

SEQ ID NO: 548938 - DNA, 25 bp, Mus musculus
caacgcctggacctgatgcgggaaa

SEQ ID NO: 548939 - DNA, 25 bp, Mus musculus
caacgcctggacgtgatgcgggaaa

SEQ ID NO: 548940 - DNA, 25 bp, Mus musculus
caacgcctttgaagctgagcctcag

SEQ ID NO: 548941 - DNA, 25 bp, Mus musculus
caacgcctttgatgctgagcctcag

SEQ ID NO: 548942 - DNA, 25 bp, Mus musculus
caacgcgagcaacaaccagcaggat

SEQ ID NO: 548943 - DNA, 25 bp, Mus musculus
caacgcgagcaagaaccagcaggat

SEQ ID NO: 548944 - DNA, 25 bp, Mus musculus
caacgcgctcttcgagactcatgga

SEQ ID NO: 548945 - DNA, 25 bp, Mus musculus
caacgcgctcttggagactcatgga

SEQ ID NO: 548946 - DNA, 25 bp, Mus musculus
caacgcggagtgagagtgcattgaa

SEQ ID NO: 548947 - DNA, 25 bp, Mus musculus
caacgcggagtgtgagtgcattgaa

SEQ ID NO: 548948 - DNA, 25 bp, Mus musculus
caacgcgggcccagtttgaaacact

SEQ ID NO: 548949 - DNA, 25 bp, Mus musculus
caacgcgggccctgtttgaaacact

SEQ ID NO: 548950 - DNA, 25 bp, Mus musculus
caacgcgtctgtcctcaacagcgga

SEQ ID NO: 548951 - DNA, 25 bp, Mus musculus
caacgcgtctgtgctcaacagcgga

SEQ ID NO: 548952 - DNA, 25 bp, Mus musculus
caacgcgtggctctgggtgggagcc

SEQ ID NO: 548953 - DNA, 25 bp, Mus musculus
caacgcgtggctgtgggtgggagcc

SEQ ID NO: 548954 - DNA, 25 bp, Mus musculus
caacgctatgctcaggactatgagg

SEQ ID NO: 548955 - DNA, 25 bp, Mus musculus
caacgctatgctgaggactatgagg

SEQ ID NO: 548956 - DNA, 25 bp, Mus musculus
caacgctatggtagtgggcgccgaa

SEQ ID NO: 548957 - DNA, 25 bp, Mus musculus
caacgctatggttgtgggcgccgaa

SEQ ID NO: 548958 - DNA, 25 bp, Mus musculus
caacgctctggaattaaccacagtg

SEQ ID NO: 548959 - DNA, 25 bp, Mus musculus
caacgctctggatttaaccacagtg

SEQ ID NO: 548960 - DNA, 25 bp, Mus musculus
caacgctgacgtaggatattattcc

SEQ ID NO: 548961 - DNA, 25 bp, Mus musculus
caacgctgacgttggatattattcc

SEQ ID NO: 548962 - DNA, 25 bp, Mus musculus
caacgctgacttctctgacatgagg

SEQ ID NO: 548963 - DNA, 25 bp, Mus musculus
caacgctgacttgtctgacatgagg

SEQ ID NO: 548964 - DNA, 25 bp, Mus musculus
caacgctgattactcggaactcgag

SEQ ID NO: 548965 - DNA, 25 bp, Mus musculus
caacgctgattagtcggaactcgag

SEQ ID NO: 548966 - DNA, 25 bp, Mus musculus
caacgctgcaaaatgcaacttgaga

SEQ ID NO: 548967 - DNA, 25 bp, Mus musculus
caacgctgcaaattgcaacttgaga

SEQ ID NO: 548968 - DNA, 25 bp, Mus musculus
caacgctgcgctagtctattatgta

SEQ ID NO: 548969 - DNA, 25 bp, Mus musculus
caacgctgcgcttgtctattatgta

SEQ ID NO: 548970 - DNA, 25 bp, Mus musculus
caacgctggcgaagatgcttacgaa

SEQ ID NO: 548971 - DNA, 25 bp, Mus musculus
caacgctggcgatgatgcttacgaa

SEQ ID NO: 548972 - DNA, 25 bp, Mus musculus
caacggaaaaatccgaagctgtaat

SEQ ID NO: 548973 - DNA, 25 bp, Mus musculus
caacggaaaaatgcgaagctgtaat

SEQ ID NO: 548974 - DNA, 25 bp, Mus musculus
caacggaccgacagaggaggatgct

SEQ ID NO: 548975 - DNA, 25 bp, Mus musculus
caacggaccgactgaggaggatgct

SEQ ID NO: 548976 - DNA, 25 bp, Mus musculus
caacggagaacaacggtgcaagaac

SEQ ID NO: 548977 - DNA, 25 bp, Mus musculus
caacggagaacatcggtgcaagaac

SEQ ID NO: 548978 - DNA, 25 bp, Mus musculus
caacggagaaggacctgtcggatct

SEQ ID NO: 548979 - DNA, 25 bp, Mus musculus
caacggagaaggtcctgtcggatct

SEQ ID NO: 548980 - DNA, 25 bp, Mus musculus
caacggaggtcacgactgctgcaga

SEQ ID NO: 548981 - DNA, 25 bp, Mus musculus
caacggaggtcaggactgctgcaga

SEQ ID NO: 548982 - DNA, 25 bp, Mus musculus
caacggatatgtccgggatgagaca

SEQ ID NO: 548983 - DNA, 25 bp, Mus musculus
caacggatatgtgcgggatgagaca

SEQ ID NO: 548984 - DNA, 25 bp, Mus musculus
caacggcaacaaattctactctgag

SEQ ID NO: 548985 - DNA, 25 bp, Mus musculus
caacggcaacaatttctactctgag

SEQ ID NO: 548986 - DNA, 25 bp, Mus musculus
caacggcaagaaagtcactgagccc

SEQ ID NO: 548987 - DNA, 25 bp, Mus musculus
caacggcaagaatgtcactgagccc

SEQ ID NO: 548988 - DNA, 25 bp, Mus musculus
caacggcaagccatatgtcatctcg

SEQ ID NO: 548989 - DNA, 25 bp, Mus musculus
caacggcaagccttatgtcatctcg

SEQ ID NO: 548990 - DNA, 25 bp, Mus musculus
caacggcaagtaagatctggacttc

SEQ ID NO: 548991 - DNA, 25 bp, Mus musculus
caacggcaagtatgatctggacttc

SEQ ID NO: 548992 - DNA, 25 bp, Mus musculus
caacggcaagttagtgaccgccaag

SEQ ID NO: 548993 - DNA, 25 bp, Mus musculus
caacggcaagtttgtgaccgccaag

SEQ ID NO: 548994 - DNA, 25 bp, Mus musculus
caacggcagcttcagtgtgtggact

SEQ ID NO: 548995 - DNA, 25 bp, Mus musculus
caacggcagcttgagtgtgtggact

SEQ ID NO: 548996 - DNA, 25 bp, Mus musculus
caacggcagttgagatggctcttta

SEQ ID NO: 548997 - DNA, 25 bp, Mus musculus
caacggcagttgtgatggctcttta

SEQ ID NO: 548998 - DNA, 25 bp, Mus musculus
caacggccactcctttaacgttgag

SEQ ID NO: 548999 - DNA, 25 bp, Mus musculus
caacggccactcgtttaacgttgag

SEQ ID NO: 549000 - DNA, 25 bp, Mus musculus
caacggccggctctttgttcccagg

SEQ ID NO: 549001 - DNA, 25 bp, Mus musculus
caacggccggctgtttgttcccagg

SEQ ID NO: 549002 - DNA, 25 bp, Mus musculus
caacggcctgcgaaggatcttggat

SEQ ID NO: 549003 - DNA, 25 bp, Mus musculus
caacggcctgcgtaggatcttggat

SEQ ID NO: 549004 - DNA, 25 bp, Mus musculus
caacggccttgcagtgcacattttt

SEQ ID NO: 549005 - DNA, 25 bp, Mus musculus
caacggccttgctgtgcacattttt

SEQ ID NO: 549006 - DNA, 25 bp, Mus musculus
caacggcgccgacttgtggatatgt

SEQ ID NO: 549007 - DNA, 25 bp, Mus musculus
caacggcgccgagttgtggatatgt

SEQ ID NO: 549008 - DNA, 25 bp, Mus musculus
caacggcgtcgaagacaaagaggca

SEQ ID NO: 549009 - DNA, 25 bp, Mus musculus
caacggcgtcgatgacaaagaggca

SEQ ID NO: 549010 - DNA, 25 bp, Mus musculus
caacggctaagcagtactatttgaa

SEQ ID NO: 549011 - DNA, 25 bp, Mus musculus
caacggctaagctgtactatttgaa

SEQ ID NO: 549012 - DNA, 25 bp, Mus musculus
caacggctattgaggaacagcaatc

SEQ ID NO: 549013 - DNA, 25 bp, Mus musculus
caacggctattgtggaacagcaatc

SEQ ID NO: 549014 - DNA, 25 bp, Mus musculus
caacggctggctcctggacggtcct

SEQ ID NO: 549015 - DNA, 25 bp, Mus musculus
caacggctggctgctggacggtcct

SEQ ID NO: 549016 - DNA, 25 bp, Mus musculus
caacggctgttgaatgagggccaga

SEQ ID NO: 549017 - DNA, 25 bp, Mus musculus
caacggctgttgtatgagggccaga

SEQ ID NO: 549018 - DNA, 25 bp, Mus musculus
caacggcttcgcagtgaattggaca

SEQ ID NO: 549019 - DNA, 25 bp, Mus musculus
caacggcttcgctgtgaattggaca

SEQ ID NO: 549020 - DNA, 25 bp, Mus musculus
caacggcttctcaatgaggtcatgg

SEQ ID NO: 549021 - DNA, 25 bp, Mus musculus
caacggcttctctatgaggtcatgg

SEQ ID NO: 549022 - DNA, 25 bp, Mus musculus
caacgggacctaaggcaagatctgg

SEQ ID NO: 549023 - DNA, 25 bp, Mus musculus
caacgggacctatggcaagatctgg

SEQ ID NO: 549024 - DNA, 25 bp, Mus musculus
caacgggacctgaaggtcagccggc

SEQ ID NO: 549025 - DNA, 25 bp, Mus musculus
caacgggacctgtaggtcagccggc

SEQ ID NO: 549026 - DNA, 25 bp, Mus musculus
caacgggagataaacgttggagcct

SEQ ID NO: 549027 - DNA, 25 bp, Mus musculus
caacgggagatatacgttggagcct

SEQ ID NO: 549028 - DNA, 25 bp, Mus musculus
caacgggagggaatacctggagcac

SEQ ID NO: 549029 - DNA, 25 bp, Mus musculus
caacgggagggattacctggagcac

SEQ ID NO: 549030 - DNA, 25 bp, Mus musculus
caacgggcagatatagagaatgaga

SEQ ID NO: 549031 - DNA, 25 bp, Mus musculus
caacgggcagatttagagaatgaga

SEQ ID NO: 549032 - DNA, 25 bp, Mus musculus
caacgggcgagtcctcgagctgttc

SEQ ID NO: 549033 - DNA, 25 bp, Mus musculus
caacgggcgagtgctcgagctgttc

SEQ ID NO: 549034 - DNA, 25 bp, Mus musculus
caacgggctgatcacaaagtgcttc

SEQ ID NO: 549035 - DNA, 25 bp, Mus musculus
caacgggctgatgacaaagtgcttc

SEQ ID NO: 549036 - DNA, 25 bp, Mus musculus
caacggtactatccagggaaccagg

SEQ ID NO: 549037 - DNA, 25 bp, Mus musculus
caacggtactatgcagggaaccagg

SEQ ID NO: 549038 - DNA, 25 bp, Mus musculus
caacggtactgtccacctgatctgc

SEQ ID NO: 549039 - DNA, 25 bp, Mus musculus
caacggtactgtgcacctgatctgc

SEQ ID NO: 549040 - DNA, 25 bp, Mus musculus
caacggtgaccgctatgactttcct

SEQ ID NO: 549041 - DNA, 25 bp, Mus musculus
caacggtgaccggtatgactttcct

SEQ ID NO: 549042 - DNA, 25 bp, Mus musculus
caacggttgtctcgttgtgctccca

SEQ ID NO: 549043 - DNA, 25 bp, Mus musculus
caacggttgtctggttgtgctccca

SEQ ID NO: 549044 - DNA, 25 bp, Mus musculus
caacgtaaactcatggcttcactgg

SEQ ID NO: 549045 - DNA, 25 bp, Mus musculus
caacgtaaactcttggcttcactgg

SEQ ID NO: 549046 - DNA, 25 bp, Mus musculus
caacgtaaatgtcgcgtggacagga

SEQ ID NO: 549047 - DNA, 25 bp, Mus musculus
caacgtaaatgtggcgtggacagga

SEQ ID NO: 549048 - DNA, 25 bp, Mus musculus
caacgtaactgcaatttaatgttgg

SEQ ID NO: 549049 - DNA, 25 bp, Mus musculus
caacgtaactgctatttaatgttgg

SEQ ID NO: 549050 - DNA, 25 bp, Mus musculus
caacgtatcccgatgtggagtatga

SEQ ID NO: 549051 - DNA, 25 bp, Mus musculus
caacgtatcccgttgtggagtatga

SEQ ID NO: 549052 - DNA, 25 bp, Mus musculus
caacgtcaggagcatgcatactgct

SEQ ID NO: 549053 - DNA, 25 bp, Mus musculus
caacgtcaggaggatgcatactgct

SEQ ID NO: 549054 - DNA, 25 bp, Mus musculus
caacgtcagggcaaagtaccaaact

SEQ ID NO: 549055 - DNA, 25 bp, Mus musculus
caacgtcagggctaagtaccaaact

SEQ ID NO: 549056 - DNA, 25 bp, Mus musculus
caacgtcagttacaacgtggtggag

SEQ ID NO: 549057 - DNA, 25 bp, Mus musculus
caacgtcagttagaacgtggtggag

SEQ ID NO: 549058 - DNA, 25 bp, Mus musculus
caacgtcatgctcaatggctcggag

SEQ ID NO: 549059 - DNA, 25 bp, Mus musculus
caacgtcatgctgaatggctcggag

SEQ ID NO: 549060 - DNA, 25 bp, Mus musculus
caacgtccgggtcggaaatgcactg

SEQ ID NO: 549061 - DNA, 25 bp, Mus musculus
caacgtccgggtgggaaatgcactg

SEQ ID NO: 549062 - DNA, 25 bp, Mus musculus
caacgtcgctgaatgggcgagagac

SEQ ID NO: 549063 - DNA, 25 bp, Mus musculus
caacgtcgctgattgggcgagagac

SEQ ID NO: 549064 - DNA, 25 bp, Mus musculus
caacgtcgtgcacttgacagagaaa

SEQ ID NO: 549065 - DNA, 25 bp, Mus musculus
caacgtcgtgcagttgacagagaaa

SEQ ID NO: 549066 - DNA, 25 bp, Mus musculus
caacgtctatgactctatccaggag

SEQ ID NO: 549067 - DNA, 25 bp, Mus musculus
caacgtctatgagtctatccaggag

SEQ ID NO: 549068 - DNA, 25 bp, Mus musculus
caacgtctctgtcaatgccgtgcag

SEQ ID NO: 549069 - DNA, 25 bp, Mus musculus
caacgtctctgtgaatgccgtgcag

SEQ ID NO: 549070 - DNA, 25 bp, Mus musculus
caacgtctggtaagatccttcagaa

SEQ ID NO: 549071 - DNA, 25 bp, Mus musculus
caacgtctggtatgatccttcagaa

SEQ ID NO: 549072 - DNA, 25 bp, Mus musculus
caacgtgagacgcatgcatacagca

SEQ ID NO: 549073 - DNA, 25 bp, Mus musculus
caacgtgagacggatgcatacagca

SEQ ID NO: 549074 - DNA, 25 bp, Mus musculus
caacgtgagactcttctcacggcgg

SEQ ID NO: 549075 - DNA, 25 bp, Mus musculus
caacgtgagactgttctcacggcgg

SEQ ID NO: 549076 - DNA, 25 bp, Mus musculus
caacgtgaggagaataatatctgca

SEQ ID NO: 549077 - DNA, 25 bp, Mus musculus
caacgtgaggagtataatatctgca

SEQ ID NO: 549078 - DNA, 25 bp, Mus musculus
caacgtgatgaacaaacttgcaaaa

SEQ ID NO: 549079 - DNA, 25 bp, Mus musculus
caacgtgatgaagaaacttgcaaaa

SEQ ID NO: 549080 - DNA, 25 bp, Mus musculus
caacgtgctcctctccagtgatgga

SEQ ID NO: 549081 - DNA, 25 bp, Mus musculus
caacgtgctcctgtccagtgatgga

SEQ ID NO: 549082 - DNA, 25 bp, Mus musculus
caacgtgctgtaaatcgagtcccca

SEQ ID NO: 549083 - DNA, 25 bp, Mus musculus
caacgtgctgtatatcgagtcccca

SEQ ID NO: 549084 - DNA, 25 bp, Mus musculus
caacgtggataaaaccttccatgac

SEQ ID NO: 549085 - DNA, 25 bp, Mus musculus
caacgtggataataccttccatgac

SEQ ID NO: 549086 - DNA, 25 bp, Mus musculus
caacgtggcaagaatcaaagttctc

SEQ ID NO: 549087 - DNA, 25 bp, Mus musculus
caacgtggcaagtatcaaagttctc

SEQ ID NO: 549088 - DNA, 25 bp, Mus musculus
caacgtgggcatctcatacgagtat

SEQ ID NO: 549089 - DNA, 25 bp, Mus musculus
caacgtgggcatgtcatacgagtat

SEQ ID NO: 549090 - DNA, 25 bp, Mus musculus
caacgtggtcgtacctgtgacagcc

SEQ ID NO: 549091 - DNA, 25 bp, Mus musculus
caacgtggtcgttcctgtgacagcc

SEQ ID NO: 549092 - DNA, 25 bp, Mus musculus
caacgtgtggtactctgtcaatggg

SEQ ID NO: 549093 - DNA, 25 bp, Mus musculus
caacgtgtggtagtctgtcaatggg

SEQ ID NO: 549094 - DNA, 25 bp, Mus musculus
caacgttattgcactaaaaaactgt

SEQ ID NO: 549095 - DNA, 25 bp, Mus musculus
caacgttattgctctaaaaaactgt

SEQ ID NO: 549096 - DNA, 25 bp, Mus musculus
caacgttcctgcagtaaatacttga

SEQ ID NO: 549097 - DNA, 25 bp, Mus musculus
caacgttcctgctgtaaatacttga

SEQ ID NO: 549098 - DNA, 25 bp, Mus musculus
caacgttctcatcgcttaggaggct

SEQ ID NO: 549099 - DNA, 25 bp, Mus musculus
caacgttctcatggcttaggaggct

SEQ ID NO: 549100 - DNA, 25 bp, Mus musculus
caacgttgggtcagttggagcccaa

SEQ ID NO: 549101 - DNA, 25 bp, Mus musculus
caacgttgggtctgttggagcccaa

SEQ ID NO: 549102 - DNA, 25 bp, Mus musculus
caacgttgtgtgcttcaccaggcat

SEQ ID NO: 549103 - DNA, 25 bp, Mus musculus
caacgttgtgtggttcaccaggcat

SEQ ID NO: 549104 - DNA, 25 bp, Mus musculus
caacgtttcatactccattcagcca

SEQ ID NO: 549105 - DNA, 25 bp, Mus musculus
caacgtttcatagtccattcagcca

SEQ ID NO: 549106 - DNA, 25 bp, Mus musculus
caactaaacaatccaatgcatcgtc

SEQ ID NO: 549107 - DNA, 25 bp, Mus musculus
caactaaacaatgcaatgcatcgtc

SEQ ID NO: 549108 - DNA, 25 bp, Mus musculus
caactaactggcactcgcccgaggg

SEQ ID NO: 549109 - DNA, 25 bp, Mus musculus
caactaactggctctcgcccgaggg

SEQ ID NO: 549110 - DNA, 25 bp, Mus musculus
caactaattgataatttgatgctga

SEQ ID NO: 549111 - DNA, 25 bp, Mus musculus
caactaattgattatttgatgctga

SEQ ID NO: 549112 - DNA, 25 bp, Mus musculus
caactacaaacaagcaggtgactga

SEQ ID NO: 549113 - DNA, 25 bp, Mus musculus
caactacaaacatgcaggtgactga

SEQ ID NO: 549114 - DNA, 25 bp, Mus musculus
caactacaagtcctttggtgacacc

SEQ ID NO: 549115 - DNA, 25 bp, Mus musculus
caactacaagtcgtttggtgacacc

SEQ ID NO: 549116 - DNA, 25 bp, Mus musculus
caactacaccttatggtactcgagg

SEQ ID NO: 549117 - DNA, 25 bp, Mus musculus
caactacaccttttggtactcgagg

SEQ ID NO: 549118 - DNA, 25 bp, Mus musculus
caactacagacacacttactcagag

SEQ ID NO: 549119 - DNA, 25 bp, Mus musculus
caactacagacagacttactcagag

SEQ ID NO: 549120 - DNA, 25 bp, Mus musculus
caactacagggcaatgccattttaa

SEQ ID NO: 549121 - DNA, 25 bp, Mus musculus
caactacagggctatgccattttaa

SEQ ID NO: 549122 - DNA, 25 bp, Mus musculus
caactacagtttctccacagatggt

SEQ ID NO: 549123 - DNA, 25 bp, Mus musculus
caactacagtttgtccacagatggt

SEQ ID NO: 549124 - DNA, 25 bp, Mus musculus
caactaccctcacgaggaagctacg

SEQ ID NO: 549125 - DNA, 25 bp, Mus musculus
caactaccctcaggaggaagctacg

SEQ ID NO: 549126 - DNA, 25 bp, Mus musculus
caactacctacactgttttaccagt

SEQ ID NO: 549127 - DNA, 25 bp, Mus musculus
caactacctacagtgttttaccagt

SEQ ID NO: 549128 - DNA, 25 bp, Mus musculus
caactacctagtctggcgtgtggtg

SEQ ID NO: 549129 - DNA, 25 bp, Mus musculus
caactacctagtgtggcgtgtggtg

SEQ ID NO: 549130 - DNA, 25 bp, Mus musculus
caactacctctcatgtggcaactct

SEQ ID NO: 549131 - DNA, 25 bp, Mus musculus
caactacctctcttgtggcaactct

SEQ ID NO: 549132 - DNA, 25 bp, Mus musculus
caactacgtggtcatgcaattgcag

SEQ ID NO: 549133 - DNA, 25 bp, Mus musculus
caactacgtggtgatgcaattgcag

SEQ ID NO: 549134 - DNA, 25 bp, Mus musculus
caactactccatccatctgaatgga

SEQ ID NO: 549135 - DNA, 25 bp, Mus musculus
caactactccatgcatctgaatgga

SEQ ID NO: 549136 - DNA, 25 bp, Mus musculus
caactactcgctcatggagaacgga

SEQ ID NO: 549137 - DNA, 25 bp, Mus musculus
caactactcgctgatggagaacgga

SEQ ID NO: 549138 - DNA, 25 bp, Mus musculus
caactactgccgaaaacttgttgaa

SEQ ID NO: 549139 - DNA, 25 bp, Mus musculus
caactactgccgtaaacttgttgaa

SEQ ID NO: 549140 - DNA, 25 bp, Mus musculus
caactacttctgaagaaggctacac

SEQ ID NO: 549141 - DNA, 25 bp, Mus musculus
caactacttctgtagaaggctacac

SEQ ID NO: 549142 - DNA, 25 bp, Mus musculus
caactagaactcaaagagagggaat

SEQ ID NO: 549143 - DNA, 25 bp, Mus musculus
caactagaactctaagagagggaat

SEQ ID NO: 549144 - DNA, 25 bp, Mus musculus
caactagaagcaatgaaagcttttg

SEQ ID NO: 549145 - DNA, 25 bp, Mus musculus
caactagaagcattgaaagcttttg

SEQ ID NO: 549146 - DNA, 25 bp, Mus musculus
caactagaatgcagtggcaggcact

SEQ ID NO: 549147 - DNA, 25 bp, Mus musculus
caactagaatgctgtggcaggcact

SEQ ID NO: 549148 - DNA, 25 bp, Mus musculus
caactagacacaacccaagatgctt

SEQ ID NO: 549149 - DNA, 25 bp, Mus musculus
caactagacacatcccaagatgctt

SEQ ID NO: 549150 - DNA, 25 bp, Mus musculus
caactagagcaaccaaatactggag

SEQ ID NO: 549151 - DNA, 25 bp, Mus musculus
caactagagcaagcaaatactggag

SEQ ID NO: 549152 - DNA, 25 bp, Mus musculus
caactaggagttcacaggtgtctgg

SEQ ID NO: 549153 - DNA, 25 bp, Mus musculus
caactaggagttgacaggtgtctgg

SEQ ID NO: 549154 - DNA, 25 bp, Mus musculus
caactagggaccagcaagaacccct

SEQ ID NO: 549155 - DNA, 25 bp, Mus musculus
caactagggacctgcaagaacccct

SEQ ID NO: 549156 - DNA, 25 bp, Mus musculus
caactaggtgttagtggccacggga

SEQ ID NO: 549157 - DNA, 25 bp, Mus musculus
caactaggtgtttgtggccacggga

SEQ ID NO: 549158 - DNA, 25 bp, Mus musculus
caactagtagcgcaatggaggctgc

SEQ ID NO: 549159 - DNA, 25 bp, Mus musculus
caactagtagcggaatggaggctgc

SEQ ID NO: 549160 - DNA, 25 bp, Mus musculus
caactagtggagatgacgggcctca

SEQ ID NO: 549161 - DNA, 25 bp, Mus musculus
caactagtggagttgacgggcctca

SEQ ID NO: 549162 - DNA, 25 bp, Mus musculus
caactagttgtgaggttgctacccc

SEQ ID NO: 549163 - DNA, 25 bp, Mus musculus
caactagttgtgtggttgctacccc

SEQ ID NO: 549164 - DNA, 25 bp, Mus musculus
caactatagcagcttgtcaagagga

SEQ ID NO: 549165 - DNA, 25 bp, Mus musculus
caactatagcaggttgtcaagagga

SEQ ID NO: 549166 - DNA, 25 bp, Mus musculus
caactatagcgacctgcaggacgcg

SEQ ID NO: 549167 - DNA, 25 bp, Mus musculus
caactatagcgagctgcaggacgcg

SEQ ID NO: 549168 - DNA, 25 bp, Mus musculus
caactatagtccagtgaagtccaag

SEQ ID NO: 549169 - DNA, 25 bp, Mus musculus
caactatagtcctgtgaagtccaag

SEQ ID NO: 549170 - DNA, 25 bp, Mus musculus
caactatcaaagattagattaggga

SEQ ID NO: 549171 - DNA, 25 bp, Mus musculus
caactatcaaagtttagattaggga

SEQ ID NO: 549172 - DNA, 25 bp, Mus musculus
caactatggcagattttgctagaac

SEQ ID NO: 549173 - DNA, 25 bp, Mus musculus
caactatggcagtttttgctagaac

SEQ ID NO: 549174 - DNA, 25 bp, Mus musculus
caactatggctgcttggacaactgg

SEQ ID NO: 549175 - DNA, 25 bp, Mus musculus
caactatggctggttggacaactgg

SEQ ID NO: 549176 - DNA, 25 bp, Mus musculus
caactatgtccacaagcgtgagggt

SEQ ID NO: 549177 - DNA, 25 bp, Mus musculus
caactatgtccagaagcgtgagggt

SEQ ID NO: 549178 - DNA, 25 bp, Mus musculus
caactatgtgggatatggacactga

SEQ ID NO: 549179 - DNA, 25 bp, Mus musculus
caactatgtgggttatggacactga

SEQ ID NO: 549180 - DNA, 25 bp, Mus musculus
caactattgctcaaacatcatgcga

SEQ ID NO: 549181 - DNA, 25 bp, Mus musculus
caactattgctctaacatcatgcga

SEQ ID NO: 549182 - DNA, 25 bp, Mus musculus
caactattgtcgaaatccggacgga

SEQ ID NO: 549183 - DNA, 25 bp, Mus musculus
caactattgtcgtaatccggacgga

SEQ ID NO: 549184 - DNA, 25 bp, Mus musculus
caactcaacgagcactgcagcaaaa

SEQ ID NO: 549185 - DNA, 25 bp, Mus musculus
caactcaacgaggactgcagcaaaa

SEQ ID NO: 549186 - DNA, 25 bp, Mus musculus
caactcaaggaaaccaaatccagga

SEQ ID NO: 549187 - DNA, 25 bp, Mus musculus
caactcaaggaatccaaatccagga

SEQ ID NO: 549188 - DNA, 25 bp, Mus musculus
caactcaaggtgcacagcagcacca

SEQ ID NO: 549189 - DNA, 25 bp, Mus musculus
caactcaaggtggacagcagcacca

SEQ ID NO: 549190 - DNA, 25 bp, Mus musculus
caactcacaaagcaacgtggtctcc

SEQ ID NO: 549191 - DNA, 25 bp, Mus musculus
caactcacaaaggaacgtggtctcc

SEQ ID NO: 549192 - DNA, 25 bp, Mus musculus
caactcagagctacttccaaattct

SEQ ID NO: 549193 - DNA, 25 bp, Mus musculus
caactcagagcttcttccaaattct

SEQ ID NO: 549194 - DNA, 25 bp, Mus musculus
caactcagagtgacaatcatgaacc

SEQ ID NO: 549195 - DNA, 25 bp, Mus musculus
caactcagagtgtcaatcatgaacc

SEQ ID NO: 549196 - DNA, 25 bp, Mus musculus
caactcagcattcggagaagcagca

SEQ ID NO: 549197 - DNA, 25 bp, Mus musculus
caactcagcattgggagaagcagca

SEQ ID NO: 549198 - DNA, 25 bp, Mus musculus
caactcagccatatctgacattgag

SEQ ID NO: 549199 - DNA, 25 bp, Mus musculus
caactcagccatttctgacattgag

SEQ ID NO: 549200 - DNA, 25 bp, Mus musculus
caactcagggttacagggagtacaa

SEQ ID NO: 549201 - DNA, 25 bp, Mus musculus
caactcagggtttcagggagtacaa

SEQ ID NO: 549202 - DNA, 25 bp, Mus musculus
caactcagtgagaatagggacaata

SEQ ID NO: 549203 - DNA, 25 bp, Mus musculus
caactcagtgagtatagggacaata

SEQ ID NO: 549204 - DNA, 25 bp, Mus musculus
caactcagtgttaggccgatgggat

SEQ ID NO: 549205 - DNA, 25 bp, Mus musculus
caactcagtgtttggccgatgggat

SEQ ID NO: 549206 - DNA, 25 bp, Mus musculus
caactcataaatcccaatttcccag

SEQ ID NO: 549207 - DNA, 25 bp, Mus musculus
caactcataaatgccaatttcccag

SEQ ID NO: 549208 - DNA, 25 bp, Mus musculus
caactcatggatagagcaggcggca

SEQ ID NO: 549209 - DNA, 25 bp, Mus musculus
caactcatggattgagcaggcggca

SEQ ID NO: 549210 - DNA, 25 bp, Mus musculus
caactccactaaaggagagctgaac

SEQ ID NO: 549211 - DNA, 25 bp, Mus musculus
caactccactaatggagagctgaac

SEQ ID NO: 549212 - DNA, 25 bp, Mus musculus
caactccagagcaacttcaggcctt

SEQ ID NO: 549213 - DNA, 25 bp, Mus musculus
caactccagagctacttcaggcctt

SEQ ID NO: 549214 - DNA, 25 bp, Mus musculus
caactccaggagacactcagctgca

SEQ ID NO: 549215 - DNA, 25 bp, Mus musculus
caactccaggagtcactcagctgca

SEQ ID NO: 549216 - DNA, 25 bp, Mus musculus
caactccagggcctggtgttcgttt

SEQ ID NO: 549217 - DNA, 25 bp, Mus musculus
caactccagggcgtggtgttcgttt

SEQ ID NO: 549218 - DNA, 25 bp, Mus musculus
caactccatcagatctaacggagaa

SEQ ID NO: 549219 - DNA, 25 bp, Mus musculus
caactccatcagttctaacggagaa

SEQ ID NO: 549220 - DNA, 25 bp, Mus musculus
caactccctgctagttgtccaactt

SEQ ID NO: 549221 - DNA, 25 bp, Mus musculus
caactccctgcttgttgtccaactt

SEQ ID NO: 549222 - DNA, 25 bp, Mus musculus
caactccctggaatgatgaggcttt

SEQ ID NO: 549223 - DNA, 25 bp, Mus musculus
caactccctggattgatgaggcttt

SEQ ID NO: 549224 - DNA, 25 bp, Mus musculus
caactccgccggcttaaatcggact

SEQ ID NO: 549225 - DNA, 25 bp, Mus musculus
caactccgccgggttaaatcggact

SEQ ID NO: 549226 - DNA, 25 bp, Mus musculus
caactccggagacctggacgtagac

SEQ ID NO: 549227 - DNA, 25 bp, Mus musculus
caactccggagagctggacgtagac

SEQ ID NO: 549228 - DNA, 25 bp, Mus musculus
caactccgtagccatcacagctaaa

SEQ ID NO: 549229 - DNA, 25 bp, Mus musculus
caactccgtagcgatcacagctaaa

SEQ ID NO: 549230 - DNA, 25 bp, Mus musculus
caactcctacaactgttcctgcccc

SEQ ID NO: 549231 - DNA, 25 bp, Mus musculus
caactcctacaagtgttcctgcccc

SEQ ID NO: 549232 - DNA, 25 bp, Mus musculus
caactcctcggaaggagccagtggt

SEQ ID NO: 549233 - DNA, 25 bp, Mus musculus
caactcctcggatggagccagtggt

SEQ ID NO: 549234 - DNA, 25 bp, Mus musculus
caactcctcttgaccaaggcagtga

SEQ ID NO: 549235 - DNA, 25 bp, Mus musculus
caactcctcttgtccaaggcagtga

SEQ ID NO: 549236 - DNA, 25 bp, Mus musculus
caactcctgagacggaatgagacag

SEQ ID NO: 549237 - DNA, 25 bp, Mus musculus
caactcctgagagggaatgagacag

SEQ ID NO: 549238 - DNA, 25 bp, Mus musculus
caactcctttgaaggcctgagtgaa

SEQ ID NO: 549239 - DNA, 25 bp, Mus musculus
caactcctttgatggcctgagtgaa

SEQ ID NO: 549240 - DNA, 25 bp, Mus musculus
caactcgacttgatctccgaggtgc

SEQ ID NO: 549241 - DNA, 25 bp, Mus musculus
caactcgacttgttctccgaggtgc

SEQ ID NO: 549242 - DNA, 25 bp, Mus musculus
caactcgagatgagaaacggagggc

SEQ ID NO: 549243 - DNA, 25 bp, Mus musculus
caactcgagatgtgaaacggagggc

SEQ ID NO: 549244 - DNA, 25 bp, Mus musculus
caactcgcctctctttagaagacac

SEQ ID NO: 549245 - DNA, 25 bp, Mus musculus
caactcgcctctgtttagaagacac

SEQ ID NO: 549246 - DNA, 25 bp, Mus musculus
caactcggagcgcttctgcctgggc

SEQ ID NO: 549247 - DNA, 25 bp, Mus musculus
caactcggagcggttctgcctgggc

SEQ ID NO: 549248 - DNA, 25 bp, Mus musculus
caactcgttgaaacatccagcaaga

SEQ ID NO: 549249 - DNA, 25 bp, Mus musculus
caactcgttgaatcatccagcaaga

SEQ ID NO: 549250 - DNA, 25 bp, Mus musculus
caactctaacagaggaagccgctgc

SEQ ID NO: 549251 - DNA, 25 bp, Mus musculus
caactctaacagtggaagccgctgc

SEQ ID NO: 549252 - DNA, 25 bp, Mus musculus
caactctaactgacggagtctgaga

SEQ ID NO: 549253 - DNA, 25 bp, Mus musculus
caactctaactgtcggagtctgaga

SEQ ID NO: 549254 - DNA, 25 bp, Mus musculus
caactctaacttccctgaggaagaa

SEQ ID NO: 549255 - DNA, 25 bp, Mus musculus
caactctaacttgcctgaggaagaa

SEQ ID NO: 549256 - DNA, 25 bp, Mus musculus
caactctaagagacgaccagtcaat

SEQ ID NO: 549257 - DNA, 25 bp, Mus musculus
caactctaagagtcgaccagtcaat

SEQ ID NO: 549258 - DNA, 25 bp, Mus musculus
caactctaatccctgagaaaagaca

SEQ ID NO: 549259 - DNA, 25 bp, Mus musculus
caactctaatccgtgagaaaagaca

SEQ ID NO: 549260 - DNA, 25 bp, Mus musculus
caactctagccaaaaaggagggcgt

SEQ ID NO: 549261 - DNA, 25 bp, Mus musculus
caactctagccataaaggagggcgt

SEQ ID NO: 549262 - DNA, 25 bp, Mus musculus
caactctcagttaaaggagtcggcc

SEQ ID NO: 549263 - DNA, 25 bp, Mus musculus
caactctcagtttaaggagtcggcc

SEQ ID NO: 549264 - DNA, 25 bp, Mus musculus
caactctgcctcagtatcacggtga

SEQ ID NO: 549265 - DNA, 25 bp, Mus musculus
caactctgcctctgtatcacggtga

SEQ ID NO: 549266 - DNA, 25 bp, Mus musculus
caactctgcgacctgatttcctgag

SEQ ID NO: 549267 - DNA, 25 bp, Mus musculus
caactctgcgacgtgatttcctgag

SEQ ID NO: 549268 - DNA, 25 bp, Mus musculus
caactctgctaacaaagggcatcct

SEQ ID NO: 549269 - DNA, 25 bp, Mus musculus
caactctgctaagaaagggcatcct

SEQ ID NO: 549270 - DNA, 25 bp, Mus musculus
caactctggcacatccaggtactgg

SEQ ID NO: 549271 - DNA, 25 bp, Mus musculus
caactctggcacttccaggtactgg

SEQ ID NO: 549272 - DNA, 25 bp, Mus musculus
caactctggcatcacatacaggaag

SEQ ID NO: 549273 - DNA, 25 bp, Mus musculus
caactctggcatgacatacaggaag

SEQ ID NO: 549274 - DNA, 25 bp, Mus musculus
caactctgggatcattgacaagaac

SEQ ID NO: 549275 - DNA, 25 bp, Mus musculus
caactctgggatgattgacaagaac

SEQ ID NO: 549276 - DNA, 25 bp, Mus musculus
caactctgggcacaggtctcaaagg

SEQ ID NO: 549277 - DNA, 25 bp, Mus musculus
caactctgggcagaggtctcaaagg

SEQ ID NO: 549278 - DNA, 25 bp, Mus musculus
caactctgggccaaataggaggagc

SEQ ID NO: 549279 - DNA, 25 bp, Mus musculus
caactctgggcctaataggaggagc

SEQ ID NO: 549280 - DNA, 25 bp, Mus musculus
caactctggtgtcgtaccagcctga

SEQ ID NO: 549281 - DNA, 25 bp, Mus musculus
caactctggtgtggtaccagcctga

SEQ ID NO: 549282 - DNA, 25 bp, Mus musculus
caactcttaaggcactagaatacct

SEQ ID NO: 549283 - DNA, 25 bp, Mus musculus
caactcttaagggactagaatacct

SEQ ID NO: 549284 - DNA, 25 bp, Mus musculus
caactcttagagcaggtgtttgatc

SEQ ID NO: 549285 - DNA, 25 bp, Mus musculus
caactcttagaggaggtgtttgatc

SEQ ID NO: 549286 - DNA, 25 bp, Mus musculus
caactcttctccacgcaggagcgag

SEQ ID NO: 549287 - DNA, 25 bp, Mus musculus
caactcttctcctcgcaggagcgag

SEQ ID NO: 549288 - DNA, 25 bp, Mus musculus
caactcttgagaaggtgcacgtaga

SEQ ID NO: 549289 - DNA, 25 bp, Mus musculus
caactcttgagatggtgcacgtaga

SEQ ID NO: 549290 - DNA, 25 bp, Mus musculus
caactcttgaggagaagcgcggctc

SEQ ID NO: 549291 - DNA, 25 bp, Mus musculus
caactcttgaggtgaagcgcggctc

SEQ ID NO: 549292 - DNA, 25 bp, Mus musculus
caactctttggcaaaatcaaggata

SEQ ID NO: 549293 - DNA, 25 bp, Mus musculus
caactctttggctaaatcaaggata

SEQ ID NO: 549294 - DNA, 25 bp, Mus musculus
caactcttttgacaaggtacagagc

SEQ ID NO: 549295 - DNA, 25 bp, Mus musculus
caactcttttgagaaggtacagagc

SEQ ID NO: 549296 - DNA, 25 bp, Mus musculus
caactgaaactgacacatgactggc

SEQ ID NO: 549297 - DNA, 25 bp, Mus musculus
caactgaaactgtcacatgactggc

SEQ ID NO: 549298 - DNA, 25 bp, Mus musculus
caactgaaatcaagagggactatga

SEQ ID NO: 549299 - DNA, 25 bp, Mus musculus
caactgaaatcatgagggactatga

SEQ ID NO: 549300 - DNA, 25 bp, Mus musculus
caactgaaccatccgaatatcatca

SEQ ID NO: 549301 - DNA, 25 bp, Mus musculus
caactgaaccatgcgaatatcatca

SEQ ID NO: 549302 - DNA, 25 bp, Mus musculus
caactgaagccgacattgctggaat

SEQ ID NO: 549303 - DNA, 25 bp, Mus musculus
caactgaagccgtcattgctggaat

SEQ ID NO: 549304 - DNA, 25 bp, Mus musculus
caactgaaggatcatctgcggaagg

SEQ ID NO: 549305 - DNA, 25 bp, Mus musculus
caactgaaggatgatctgcggaagg

SEQ ID NO: 549306 - DNA, 25 bp, Mus musculus
caactgaaggctattaccaggctcc

SEQ ID NO: 549307 - DNA, 25 bp, Mus musculus
caactgaaggcttttaccaggctcc

SEQ ID NO: 549308 - DNA, 25 bp, Mus musculus
caactgaatatgagaggaacgggag

SEQ ID NO: 549309 - DNA, 25 bp, Mus musculus
caactgaatatgtgaggaacgggag

SEQ ID NO: 549310 - DNA, 25 bp, Mus musculus
caactgaattctaaatatgggaaaa

SEQ ID NO: 549311 - DNA, 25 bp, Mus musculus
caactgaattcttaatatgggaaaa

SEQ ID NO: 549312 - DNA, 25 bp, Mus musculus
caactgaattgaccataagaaaagc

SEQ ID NO: 549313 - DNA, 25 bp, Mus musculus
caactgaattgagcataagaaaagc

SEQ ID NO: 549314 - DNA, 25 bp, Mus musculus
caactgagaaggcaaaaggagctcc

SEQ ID NO: 549315 - DNA, 25 bp, Mus musculus
caactgagaagggaaaaggagctcc

SEQ ID NO: 549316 - DNA, 25 bp, Mus musculus
caactgagagggacttcctgggccc

SEQ ID NO: 549317 - DNA, 25 bp, Mus musculus
caactgagagggtcttcctgggccc

SEQ ID NO: 549318 - DNA, 25 bp, Mus musculus
caactgagatttaagagacacggct

SEQ ID NO: 549319 - DNA, 25 bp, Mus musculus
caactgagattttagagacacggct

SEQ ID NO: 549320 - DNA, 25 bp, Mus musculus
caactgatcatccagaaggataagg

SEQ ID NO: 549321 - DNA, 25 bp, Mus musculus
caactgatcatcgagaaggataagg

SEQ ID NO: 549322 - DNA, 25 bp, Mus musculus
caactgcaaacaaggaaatctcggt

SEQ ID NO: 549323 - DNA, 25 bp, Mus musculus
caactgcaaacatggaaatctcggt

SEQ ID NO: 549324 - DNA, 25 bp, Mus musculus
caactgcaacgactggttccatgga

SEQ ID NO: 549325 - DNA, 25 bp, Mus musculus
caactgcaacgagtggttccatgga

SEQ ID NO: 549326 - DNA, 25 bp, Mus musculus
caactgcaatgtaacattccaagag

SEQ ID NO: 549327 - DNA, 25 bp, Mus musculus
caactgcaatgttacattccaagag

SEQ ID NO: 549328 - DNA, 25 bp, Mus musculus
caactgcacgcaagctcgactagaa

SEQ ID NO: 549329 - DNA, 25 bp, Mus musculus
caactgcacgcatgctcgactagaa

SEQ ID NO: 549330 - DNA, 25 bp, Mus musculus
caactgcagtacctgcacaaggtag

SEQ ID NO: 549331 - DNA, 25 bp, Mus musculus
caactgcagtacgtgcacaaggtag

SEQ ID NO: 549332 - DNA, 25 bp, Mus musculus
caactgccacgtcacttttgtgacc

SEQ ID NO: 549333 - DNA, 25 bp, Mus musculus
caactgccacgtgacttttgtgacc

SEQ ID NO: 549334 - DNA, 25 bp, Mus musculus
caactgccatgacagggcctttgtg

SEQ ID NO: 549335 - DNA, 25 bp, Mus musculus
caactgccatgagagggcctttgtg

SEQ ID NO: 549336 - DNA, 25 bp, Mus musculus
caactgccatgtaacttgactcaca

SEQ ID NO: 549337 - DNA, 25 bp, Mus musculus
caactgccatgttacttgactcaca

SEQ ID NO: 549338 - DNA, 25 bp, Mus musculus
caactgccgtcgaatcgctttaacc

SEQ ID NO: 549339 - DNA, 25 bp, Mus musculus
caactgccgtcgtatcgctttaacc

SEQ ID NO: 549340 - DNA, 25 bp, Mus musculus
caactgcgagaacaagtaaacgacc

SEQ ID NO: 549341 - DNA, 25 bp, Mus musculus
caactgcgagaagaagtaaacgacc

SEQ ID NO: 549342 - DNA, 25 bp, Mus musculus
caactgcgagcacagtggaaattgt

SEQ ID NO: 549343 - DNA, 25 bp, Mus musculus
caactgcgagcagagtggaaattgt

SEQ ID NO: 549344 - DNA, 25 bp, Mus musculus
caactgcgctacacaggcatgctag

SEQ ID NO: 549345 - DNA, 25 bp, Mus musculus
caactgcgctactcaggcatgctag

SEQ ID NO: 549346 - DNA, 25 bp, Mus musculus
caactgcgggagattgctgggcata

SEQ ID NO: 549347 - DNA, 25 bp, Mus musculus
caactgcgggagtttgctgggcata

SEQ ID NO: 549348 - DNA, 25 bp, Mus musculus
caactgcgtggcacacacttcaaga

SEQ ID NO: 549349 - DNA, 25 bp, Mus musculus
caactgcgtggctcacacttcaaga

SEQ ID NO: 549350 - DNA, 25 bp, Mus musculus
caactgctaccaaatagctgtgaac

SEQ ID NO: 549351 - DNA, 25 bp, Mus musculus
caactgctaccatatagctgtgaac

SEQ ID NO: 549352 - DNA, 25 bp, Mus musculus
caactgctagtccatattggccacg

SEQ ID NO: 549353 - DNA, 25 bp, Mus musculus
caactgctagtcgatattggccacg

SEQ ID NO: 549354 - DNA, 25 bp, Mus musculus
caactgctcaggagtctacagggca

SEQ ID NO: 549355 - DNA, 25 bp, Mus musculus
caactgctcaggtgtctacagggca

SEQ ID NO: 549356 - DNA, 25 bp, Mus musculus
caactgctgaagatggaccagttaa

SEQ ID NO: 549357 - DNA, 25 bp, Mus musculus
caactgctgaagttggaccagttaa

SEQ ID NO: 549358 - DNA, 25 bp, Mus musculus
caactgctgactcattcttgtgggt

SEQ ID NO: 549359 - DNA, 25 bp, Mus musculus
caactgctgactgattcttgtgggt

SEQ ID NO: 549360 - DNA, 25 bp, Mus musculus
caactgctggtgctgtgcctgtgac

SEQ ID NO: 549361 - DNA, 25 bp, Mus musculus
caactgctggtggtgtgcctgtgac

SEQ ID NO: 549362 - DNA, 25 bp, Mus musculus
caactggaaaaaagggatgatgtca

SEQ ID NO: 549363 - DNA, 25 bp, Mus musculus
caactggaaaaatgggatgatgtca

SEQ ID NO: 549364 - DNA, 25 bp, Mus musculus
caactggaaatgcaacccagcctga

SEQ ID NO: 549365 - DNA, 25 bp, Mus musculus
caactggaaatggaacccagcctga

SEQ ID NO: 549366 - DNA, 25 bp, Mus musculus
caactggaaggtcttcctaggtgtg

SEQ ID NO: 549367 - DNA, 25 bp, Mus musculus
caactggaaggtgttcctaggtgtg

SEQ ID NO: 549368 - DNA, 25 bp, Mus musculus
caactggaagttctcttctacaaga

SEQ ID NO: 549369 - DNA, 25 bp, Mus musculus
caactggaagttgtcttctacaaga

SEQ ID NO: 549370 - DNA, 25 bp, Mus musculus
caactggaatccagagcccagggag

SEQ ID NO: 549371 - DNA, 25 bp, Mus musculus
caactggaatcctgagcccagggag

SEQ ID NO: 549372 - DNA, 25 bp, Mus musculus
caactggacagaatggacagataca

SEQ ID NO: 549373 - DNA, 25 bp, Mus musculus
caactggacagacaacgaggagctc

SEQ ID NO: 549374 - DNA, 25 bp, Mus musculus
caactggacagagaacgaggagctc

SEQ ID NO: 549375 - DNA, 25 bp, Mus musculus
caactggacagattggacagataca

SEQ ID NO: 549376 - DNA, 25 bp, Mus musculus
caactggacctgaaacttcattgtc

SEQ ID NO: 549377 - DNA, 25 bp, Mus musculus
caactggacctgtaacttcattgtc

SEQ ID NO: 549378 - DNA, 25 bp, Mus musculus
caactggacgatctgcatgcctttc

SEQ ID NO: 549379 - DNA, 25 bp, Mus musculus
caactggacgatgtgcatgcctttc

SEQ ID NO: 549380 - DNA, 25 bp, Mus musculus
caactggacgtaaagaggcctctgt

SEQ ID NO: 549381 - DNA, 25 bp, Mus musculus
caactggacgtatagaggcctctgt

SEQ ID NO: 549382 - DNA, 25 bp, Mus musculus
caactggagagaagtattagtctca

SEQ ID NO: 549383 - DNA, 25 bp, Mus musculus
caactggagagatgtattagtctca

SEQ ID NO: 549384 - DNA, 25 bp, Mus musculus
caactggaggatcaccgaagacagc

SEQ ID NO: 549385 - DNA, 25 bp, Mus musculus
caactggaggatgaccgaagacagc

SEQ ID NO: 549386 - DNA, 25 bp, Mus musculus
caactggagttccatccggagccag

SEQ ID NO: 549387 - DNA, 25 bp, Mus musculus
caactggagttcgatccggagccag

SEQ ID NO: 549388 - DNA, 25 bp, Mus musculus
caactggatcctatttatactcaag

SEQ ID NO: 549389 - DNA, 25 bp, Mus musculus
caactggatcctttttatactcaag

SEQ ID NO: 549390 - DNA, 25 bp, Mus musculus
caactggcaagcacaagggctatgg

SEQ ID NO: 549391 - DNA, 25 bp, Mus musculus
caactggcaagctcaagggctatgg

SEQ ID NO: 549392 - DNA, 25 bp, Mus musculus
caactggcacctcttggatctgtga

SEQ ID NO: 549393 - DNA, 25 bp, Mus musculus
caactggcacctgttggatctgtga

SEQ ID NO: 549394 - DNA, 25 bp, Mus musculus
caactggcagttcaattactggaac

SEQ ID NO: 549395 - DNA, 25 bp, Mus musculus
caactggcagttgaattactggaac

SEQ ID NO: 549396 - DNA, 25 bp, Mus musculus
caactggccatcctcattggcattc

SEQ ID NO: 549397 - DNA, 25 bp, Mus musculus
caactggccatcgtcattggcattc

SEQ ID NO: 549398 - DNA, 25 bp, Mus musculus
caactggcctcaagaaagtggaagg

SEQ ID NO: 549399 - DNA, 25 bp, Mus musculus
caactggcctcatgaaagtggaagg

SEQ ID NO: 549400 - DNA, 25 bp, Mus musculus
caactggcctgactcggattaccca

SEQ ID NO: 549401 - DNA, 25 bp, Mus musculus
caactggcctgagtcggattaccca

SEQ ID NO: 549402 - DNA, 25 bp, Mus musculus
caactggccttaaggccaccggcgt

SEQ ID NO: 549403 - DNA, 25 bp, Mus musculus
caactggccttatggccaccggcgt

SEQ ID NO: 549404 - DNA, 25 bp, Mus musculus
caactggcgccacggcttcaatgta

SEQ ID NO: 549405 - DNA, 25 bp, Mus musculus
caactggcgccagggcttcaatgta

SEQ ID NO: 549406 - DNA, 25 bp, Mus musculus
caactggctcctcggtgactctagg

SEQ ID NO: 549407 - DNA, 25 bp, Mus musculus
caactggctcctgggtgactctagg

SEQ ID NO: 549408 - DNA, 25 bp, Mus musculus
caactgggaatgctaaaacgggact

SEQ ID NO: 549409 - DNA, 25 bp, Mus musculus
caactgggaatggtaaaacgggact

SEQ ID NO: 549410 - DNA, 25 bp, Mus musculus
caactgggacacagaacaagccagc

SEQ ID NO: 549411 - DNA, 25 bp, Mus musculus
caactgggacactgaacaagccagc

SEQ ID NO: 549412 - DNA, 25 bp, Mus musculus
caactgggatcactgtggcaagatg

SEQ ID NO: 549413 - DNA, 25 bp, Mus musculus
caactgggatcagtgtggcaagatg

SEQ ID NO: 549414 - DNA, 25 bp, Mus musculus
caactgggcaggatattgccaaacc

SEQ ID NO: 549415 - DNA, 25 bp, Mus musculus
caactgggcaggctgtattttagca

SEQ ID NO: 549416 - DNA, 25 bp, Mus musculus
caactgggcagggtgtattttagca

SEQ ID NO: 549417 - DNA, 25 bp, Mus musculus
caactgggcaggttattgccaaacc

SEQ ID NO: 549418 - DNA, 25 bp, Mus musculus
caactgggcattaaatttgtatgac

SEQ ID NO: 549419 - DNA, 25 bp, Mus musculus
caactgggcatttaatttgtatgac

SEQ ID NO: 549420 - DNA, 25 bp, Mus musculus
caactgggccggaggtctacatcat

SEQ ID NO: 549421 - DNA, 25 bp, Mus musculus
caactgggccggtggtctacatcat

SEQ ID NO: 549422 - DNA, 25 bp, Mus musculus
caactgggtgtgagctcacgtgctc

SEQ ID NO: 549423 - DNA, 25 bp, Mus musculus
caactgggtgtgtgctcacgtgctc

SEQ ID NO: 549424 - DNA, 25 bp, Mus musculus
caactggtaaccacctcatttggga

SEQ ID NO: 549425 - DNA, 25 bp, Mus musculus
caactggtaacctcctcatttggga

SEQ ID NO: 549426 - DNA, 25 bp, Mus musculus
caactggtacctatcttgccggtga

SEQ ID NO: 549427 - DNA, 25 bp, Mus musculus
caactggtacctttcttgccggtga

SEQ ID NO: 549428 - DNA, 25 bp, Mus musculus
caactggtactaagagaaggatggg

SEQ ID NO: 549429 - DNA, 25 bp, Mus musculus
caactggtactatgagaaggatggg

SEQ ID NO: 549430 - DNA, 25 bp, Mus musculus
caactggtcttgctggccgctggat

SEQ ID NO: 549431 - DNA, 25 bp, Mus musculus
caactggtcttggtggccgctggat

SEQ ID NO: 549432 - DNA, 25 bp, Mus musculus
caactggtgatcaaccaagttggct

SEQ ID NO: 549433 - DNA, 25 bp, Mus musculus
caactggtgatcctttttcatgaca

SEQ ID NO: 549434 - DNA, 25 bp, Mus musculus
caactggtgatcgtttttcatgaca

SEQ ID NO: 549435 - DNA, 25 bp, Mus musculus
caactggtgatctaccaagttggct

SEQ ID NO: 549436 - DNA, 25 bp, Mus musculus
caactggtgggcagctgtcatcact

SEQ ID NO: 549437 - DNA, 25 bp, Mus musculus
caactggtgggctgctgtcatcact

SEQ ID NO: 549438 - DNA, 25 bp, Mus musculus
caactggtgttcaattcagtgacca

SEQ ID NO: 549439 - DNA, 25 bp, Mus musculus
caactggtgttctattcagtgacca

SEQ ID NO: 549440 - DNA, 25 bp, Mus musculus
caactgtacttgacctgaaatggag

SEQ ID NO: 549441 - DNA, 25 bp, Mus musculus
caactgtacttgtcctgaaatggag

SEQ ID NO: 549442 - DNA, 25 bp, Mus musculus
caactgtagcagcaagaacctcgac

SEQ ID NO: 549443 - DNA, 25 bp, Mus musculus
caactgtagcaggaagaacctcgac

SEQ ID NO: 549444 - DNA, 25 bp, Mus musculus
caactgtagtgtcgtctgtgctgac

SEQ ID NO: 549445 - DNA, 25 bp, Mus musculus
caactgtagtgtggtctgtgctgac

SEQ ID NO: 549446 - DNA, 25 bp, Mus musculus
caactgtataagaagtgcaaacgct

SEQ ID NO: 549447 - DNA, 25 bp, Mus musculus
caactgtataagtagtgcaaacgct

SEQ ID NO: 549448 - DNA, 25 bp, Mus musculus
caactgtattccatcacctggcaaa

SEQ ID NO: 549449 - DNA, 25 bp, Mus musculus
caactgtattccttcacctggcaaa

SEQ ID NO: 549450 - DNA, 25 bp, Mus musculus
caactgtgaagtcgatgtatccttc

SEQ ID NO: 549451 - DNA, 25 bp, Mus musculus
caactgtgaagtggatgtatccttc

SEQ ID NO: 549452 - DNA, 25 bp, Mus musculus
caactgtgcaggagaaattcaaaga

SEQ ID NO: 549453 - DNA, 25 bp, Mus musculus
caactgtgcaggtgaaattcaaaga

SEQ ID NO: 549454 - DNA, 25 bp, Mus musculus
caactgtgccaacaggaccatcctt

SEQ ID NO: 549455 - DNA, 25 bp, Mus musculus
caactgtgccaagaggaccatcctt

SEQ ID NO: 549456 - DNA, 25 bp, Mus musculus
caactgtgctataacctccctggat

SEQ ID NO: 549457 - DNA, 25 bp, Mus musculus
caactgtgctattacctccctggat

SEQ ID NO: 549458 - DNA, 25 bp, Mus musculus
caactgtgggacatgccgtcctggg

SEQ ID NO: 549459 - DNA, 25 bp, Mus musculus
caactgtgggacttgccgtcctggg

SEQ ID NO: 549460 - DNA, 25 bp, Mus musculus
caactgtgtcccctgtaagccggga

SEQ ID NO: 549461 - DNA, 25 bp, Mus musculus
caactgtgtcccgtgtaagccggga

SEQ ID NO: 549462 - DNA, 25 bp, Mus musculus
caactgtgtctgcaagcctggctac

SEQ ID NO: 549463 - DNA, 25 bp, Mus musculus
caactgtgtctggaagcctggctac

SEQ ID NO: 549464 - DNA, 25 bp, Mus musculus
caactgttctggctatgtgcagctg

SEQ ID NO: 549465 - DNA, 25 bp, Mus musculus
caactgttctgggtatgtgcagctg

SEQ ID NO: 549466 - DNA, 25 bp, Mus musculus
caactgttgcgtcatggagtaccac

SEQ ID NO: 549467 - DNA, 25 bp, Mus musculus
caactgttgcgtgatggagtaccac

SEQ ID NO: 549468 - DNA, 25 bp, Mus musculus
caacttaaagtcattgatgagcaca

SEQ ID NO: 549469 - DNA, 25 bp, Mus musculus
caacttaaagtctttgatgagcaca

SEQ ID NO: 549470 - DNA, 25 bp, Mus musculus
caacttaacctgaagccaaggataa

SEQ ID NO: 549471 - DNA, 25 bp, Mus musculus
caacttaacctgtagccaaggataa

SEQ ID NO: 549472 - DNA, 25 bp, Mus musculus
caacttaagagacggtgaattcagg

SEQ ID NO: 549473 - DNA, 25 bp, Mus musculus
caacttaagagagggtgaattcagg

SEQ ID NO: 549474 - DNA, 25 bp, Mus musculus
caacttaagggcaatcaacccagaa

SEQ ID NO: 549475 - DNA, 25 bp, Mus musculus
caacttaagggctatcaacccagaa

SEQ ID NO: 549476 - DNA, 25 bp, Mus musculus
caacttactatgctagaaaagcgaa

SEQ ID NO: 549477 - DNA, 25 bp, Mus musculus
caacttactatggtagaaaagcgaa

SEQ ID NO: 549478 - DNA, 25 bp, Mus musculus
caacttactgtgagaaagctcgcca

SEQ ID NO: 549479 - DNA, 25 bp, Mus musculus
caacttactgtgtgaaagctcgcca

SEQ ID NO: 549480 - DNA, 25 bp, Mus musculus
caacttagaggactatgatggcccc

SEQ ID NO: 549481 - DNA, 25 bp, Mus musculus
caacttagaggagtatgatggcccc

SEQ ID NO: 549482 - DNA, 25 bp, Mus musculus
caacttagtccgatcccattcttca

SEQ ID NO: 549483 - DNA, 25 bp, Mus musculus
caacttagtccgttcccattcttca

SEQ ID NO: 549484 - DNA, 25 bp, Mus musculus
caacttatacatcagtgggctccca

SEQ ID NO: 549485 - DNA, 25 bp, Mus musculus
caacttatacatgagtgggctccca

SEQ ID NO: 549486 - DNA, 25 bp, Mus musculus
caacttatccaaacctgtggctggt

SEQ ID NO: 549487 - DNA, 25 bp, Mus musculus
caacttatccaatcctgtggctggt

SEQ ID NO: 549488 - DNA, 25 bp, Mus musculus
caacttatgagacaaacattttcac

SEQ ID NO: 549489 - DNA, 25 bp, Mus musculus
caacttatgagagaaacattttcac

SEQ ID NO: 549490 - DNA, 25 bp, Mus musculus
caacttattggcatgatggagtgac

SEQ ID NO: 549491 - DNA, 25 bp, Mus musculus
caacttattggcttgatggagtgac

SEQ ID NO: 549492 - DNA, 25 bp, Mus musculus
caacttattttgacagcctttgatt

SEQ ID NO: 549493 - DNA, 25 bp, Mus musculus
caacttattttgtcagcctttgatt

SEQ ID NO: 549494 - DNA, 25 bp, Mus musculus
caacttcaaaacaggaagccccagg

SEQ ID NO: 549495 - DNA, 25 bp, Mus musculus
caacttcaaaactggaagccccagg

SEQ ID NO: 549496 - DNA, 25 bp, Mus musculus
caacttcaacttcaaacctgacaaa

SEQ ID NO: 549497 - DNA, 25 bp, Mus musculus
caacttcaacttgaaacctgacaaa

SEQ ID NO: 549498 - DNA, 25 bp, Mus musculus
caacttcagcagacaggagaaggga

SEQ ID NO: 549499 - DNA, 25 bp, Mus musculus
caacttcagcagtcaggagaaggga

SEQ ID NO: 549500 - DNA, 25 bp, Mus musculus
caacttcagccgaccattgcttctt

SEQ ID NO: 549501 - DNA, 25 bp, Mus musculus
caacttcagccgtccattgcttctt

SEQ ID NO: 549502 - DNA, 25 bp, Mus musculus
caacttcagcgactgctggtgggac

SEQ ID NO: 549503 - DNA, 25 bp, Mus musculus
caacttcagcgagtgctggtgggac

SEQ ID NO: 549504 - DNA, 25 bp, Mus musculus
caacttcatgaacgtcattccagcc

SEQ ID NO: 549505 - DNA, 25 bp, Mus musculus
caacttcatgaaggtcattccagcc

SEQ ID NO: 549506 - DNA, 25 bp, Mus musculus
caacttccaacacgatgtgggcaca

SEQ ID NO: 549507 - DNA, 25 bp, Mus musculus
caacttccaacaggatgtgggcaca

SEQ ID NO: 549508 - DNA, 25 bp, Mus musculus
caacttccaggacagtaactcgcta

SEQ ID NO: 549509 - DNA, 25 bp, Mus musculus
caacttccaggagagtaactcgcta

SEQ ID NO: 549510 - DNA, 25 bp, Mus musculus
caacttccgagaatcgggccggtca

SEQ ID NO: 549511 - DNA, 25 bp, Mus musculus
caacttccgagattcgggccggtca

SEQ ID NO: 549512 - DNA, 25 bp, Mus musculus
caacttccgcatcatcgagaggcac

SEQ ID NO: 549513 - DNA, 25 bp, Mus musculus
caacttccgcatgatcgagaggcac

SEQ ID NO: 549514 - DNA, 25 bp, Mus musculus
caacttccgcctcagtggtggacga

SEQ ID NO: 549515 - DNA, 25 bp, Mus musculus
caacttccgcctgagtggtggacga

SEQ ID NO: 549516 - DNA, 25 bp, Mus musculus
caacttccggttacaggatcgccct

SEQ ID NO: 549517 - DNA, 25 bp, Mus musculus
caacttccggtttcaggatcgccct

SEQ ID NO: 549518 - DNA, 25 bp, Mus musculus
caacttcctgcaaatcatggctgtc

SEQ ID NO: 549519 - DNA, 25 bp, Mus musculus
caacttcctgcatatcatggctgtc

SEQ ID NO: 549520 - DNA, 25 bp, Mus musculus
caacttcctgtaagatgcctccagc

SEQ ID NO: 549521 - DNA, 25 bp, Mus musculus
caacttcctgtatgatgcctccagc

SEQ ID NO: 549522 - DNA, 25 bp, Mus musculus
caacttccttctaggagtggaatgt

SEQ ID NO: 549523 - DNA, 25 bp, Mus musculus
caacttccttcttggagtggaatgt

SEQ ID NO: 549524 - DNA, 25 bp, Mus musculus
caacttcgggctcccggcgctatgt

SEQ ID NO: 549525 - DNA, 25 bp, Mus musculus
caacttcgggctgccggcgctatgt

SEQ ID NO: 549526 - DNA, 25 bp, Mus musculus
caacttctatgcctggcagcaccga

SEQ ID NO: 549527 - DNA, 25 bp, Mus musculus
caacttctatgcgtggcagcaccga

SEQ ID NO: 549528 - DNA, 25 bp, Mus musculus
caacttctattccaatctccatgac

SEQ ID NO: 549529 - DNA, 25 bp, Mus musculus
caacttctattcgaatctccatgac

SEQ ID NO: 549530 - DNA, 25 bp, Mus musculus
caacttctcacgcagcagtcggaga

SEQ ID NO: 549531 - DNA, 25 bp, Mus musculus
caacttctcacggagcagtcggaga

SEQ ID NO: 549532 - DNA, 25 bp, Mus musculus
caacttctccccacacatggaggaa

SEQ ID NO: 549533 - DNA, 25 bp, Mus musculus
caacttctcccctcacatggaggaa

SEQ ID NO: 549534 - DNA, 25 bp, Mus musculus
caacttctctcccaagagcgtagcg

SEQ ID NO: 549535 - DNA, 25 bp, Mus musculus
caacttctctccgaagagcgtagcg

SEQ ID NO: 549536 - DNA, 25 bp, Mus musculus
caacttctctgtaggggaacggcag

SEQ ID NO: 549537 - DNA, 25 bp, Mus musculus
caacttctctgtcttctattacgag

SEQ ID NO: 549538 - DNA, 25 bp, Mus musculus
caacttctctgtgttctattacgag

SEQ ID NO: 549539 - DNA, 25 bp, Mus musculus
caacttctctgttggggaacggcag

SEQ ID NO: 549540 - DNA, 25 bp, Mus musculus
caacttctgcagatcaaagggtcca

SEQ ID NO: 549541 - DNA, 25 bp, Mus musculus
caacttctgcagttcaaagggtcca

SEQ ID NO: 549542 - DNA, 25 bp, Mus musculus
caacttctgcggcatgcaaagcatc

SEQ ID NO: 549543 - DNA, 25 bp, Mus musculus
caacttctgcgggatgcaaagcatc

SEQ ID NO: 549544 - DNA, 25 bp, Mus musculus
caacttctgctaatctctgagaccg

SEQ ID NO: 549545 - DNA, 25 bp, Mus musculus
caacttctgctattctctgagaccg

SEQ ID NO: 549546 - DNA, 25 bp, Mus musculus
caacttctgggcatgtgtgaccatg

SEQ ID NO: 549547 - DNA, 25 bp, Mus musculus
caacttctgggcttgtgtgaccatg

SEQ ID NO: 549548 - DNA, 25 bp, Mus musculus
caacttctggtcctatgaggagacc

SEQ ID NO: 549549 - DNA, 25 bp, Mus musculus
caacttctggtcgtatgaggagacc

SEQ ID NO: 549550 - DNA, 25 bp, Mus musculus
caacttctgtgacatcgtagccgca

SEQ ID NO: 549551 - DNA, 25 bp, Mus musculus
caacttctgtgagatcgtagccgca

SEQ ID NO: 549552 - DNA, 25 bp, Mus musculus
caacttctgtgcaacaatagagcag

SEQ ID NO: 549553 - DNA, 25 bp, Mus musculus
caacttctgtgctacaatagagcag

SEQ ID NO: 549554 - DNA, 25 bp, Mus musculus
caacttgaaattcctccctgcctgg

SEQ ID NO: 549555 - DNA, 25 bp, Mus musculus
caacttgaaattgctccctgcctgg

SEQ ID NO: 549556 - DNA, 25 bp, Mus musculus
caacttgaagaaataaagccggctc

SEQ ID NO: 549557 - DNA, 25 bp, Mus musculus
caacttgaagaattaaagccggctc

SEQ ID NO: 549558 - DNA, 25 bp, Mus musculus
caacttgaagtcactggaggctcag

SEQ ID NO: 549559 - DNA, 25 bp, Mus musculus
caacttgaagtctctggaggctcag

SEQ ID NO: 549560 - DNA, 25 bp, Mus musculus
caacttgactgaagcgcgggtattg

SEQ ID NO: 549561 - DNA, 25 bp, Mus musculus
caacttgactgatgcgcgggtattg

SEQ ID NO: 549562 - DNA, 25 bp, Mus musculus
caacttgaggcgatacaatgaagcc

SEQ ID NO: 549563 - DNA, 25 bp, Mus musculus
caacttgaggcgttacaatgaagcc

SEQ ID NO: 549564 - DNA, 25 bp, Mus musculus
caacttgatgaaacaagcaaggctc

SEQ ID NO: 549565 - DNA, 25 bp, Mus musculus
caacttgatgaatcaagcaaggctc

SEQ ID NO: 549566 - DNA, 25 bp, Mus musculus
caacttgattaaacttctggtggca

SEQ ID NO: 549567 - DNA, 25 bp, Mus musculus
caacttgattaatcttctggtggca

SEQ ID NO: 549568 - DNA, 25 bp, Mus musculus
caacttgcagtgacagaatctcgac

SEQ ID NO: 549569 - DNA, 25 bp, Mus musculus
caacttgcagtgtcagaatctcgac

SEQ ID NO: 549570 - DNA, 25 bp, Mus musculus
caacttgcatcgaggcagtcattga

SEQ ID NO: 549571 - DNA, 25 bp, Mus musculus
caacttgcatcgtggcagtcattga

SEQ ID NO: 549572 - DNA, 25 bp, Mus musculus
caacttgccaagcacagtggagctc

SEQ ID NO: 549573 - DNA, 25 bp, Mus musculus
caacttgccaaggacagtggagctc

SEQ ID NO: 549574 - DNA, 25 bp, Mus musculus
caacttgcggctacaacaggatgga

SEQ ID NO: 549575 - DNA, 25 bp, Mus musculus
caacttgcggcttcaacaggatgga

SEQ ID NO: 549576 - DNA, 25 bp, Mus musculus
caacttgcttttcagtgtccctcca

SEQ ID NO: 549577 - DNA, 25 bp, Mus musculus
caacttgcttttgagtgtccctcca

SEQ ID NO: 549578 - DNA, 25 bp, Mus musculus
caacttggaggactactactttgag

SEQ ID NO: 549579 - DNA, 25 bp, Mus musculus
caacttggaggagtactactttgag

SEQ ID NO: 549580 - DNA, 25 bp, Mus musculus
caacttgggaggctggtatgacctt

SEQ ID NO: 549581 - DNA, 25 bp, Mus musculus
caacttgggagggtggtatgacctt

SEQ ID NO: 549582 - DNA, 25 bp, Mus musculus
caacttgggcttctcgggcaagttc

SEQ ID NO: 549583 - DNA, 25 bp, Mus musculus
caacttgggcttgtcgggcaagttc

SEQ ID NO: 549584 - DNA, 25 bp, Mus musculus
caacttgtaaaacgtgtaaatgtct

SEQ ID NO: 549585 - DNA, 25 bp, Mus musculus
caacttgtaaaaggtgtaaatgtct

SEQ ID NO: 549586 - DNA, 25 bp, Mus musculus
caacttgtaatcaaaggaagattcc

SEQ ID NO: 549587 - DNA, 25 bp, Mus musculus
caacttgtaatctaaggaagattcc

SEQ ID NO: 549588 - DNA, 25 bp, Mus musculus
caacttgtccagaggttcgtgagga

SEQ ID NO: 549589 - DNA, 25 bp, Mus musculus
caacttgtccagtggttcgtgagga

SEQ ID NO: 549590 - DNA, 25 bp, Mus musculus
caacttgtggatctgggatgtctga

SEQ ID NO: 549591 - DNA, 25 bp, Mus musculus
caacttgtggatgtgggatgtctga

SEQ ID NO: 549592 - DNA, 25 bp, Mus musculus
caacttgtggtcatcaagagtgatg

SEQ ID NO: 549593 - DNA, 25 bp, Mus musculus
caacttgtggtcttcaagagtgatg

SEQ ID NO: 549594 - DNA, 25 bp, Mus musculus
caacttgtgtgaaatgcattatgca

SEQ ID NO: 549595 - DNA, 25 bp, Mus musculus
caacttgtgtgatatgcattatgca

SEQ ID NO: 549596 - DNA, 25 bp, Mus musculus
caactttacagtaacctctgggatc

SEQ ID NO: 549597 - DNA, 25 bp, Mus musculus
caactttacagttacctctgggatc

SEQ ID NO: 549598 - DNA, 25 bp, Mus musculus
caactttccggaattaaactcgctg

SEQ ID NO: 549599 - DNA, 25 bp, Mus musculus
caactttccggatttaaactcgctg

SEQ ID NO: 549600 - DNA, 25 bp, Mus musculus
caactttccggcatccgcagtgaca

SEQ ID NO: 549601 - DNA, 25 bp, Mus musculus
caactttccggcttccgcagtgaca

SEQ ID NO: 549602 - DNA, 25 bp, Mus musculus
caactttctggtcggaatgctcttc

SEQ ID NO: 549603 - DNA, 25 bp, Mus musculus
caactttctggtgggaatgctcttc

SEQ ID NO: 549604 - DNA, 25 bp, Mus musculus
caactttgaagaaaagagcggcagt

SEQ ID NO: 549605 - DNA, 25 bp, Mus musculus
caactttgaagataagagcggcagt

SEQ ID NO: 549606 - DNA, 25 bp, Mus musculus
caactttgacaacgagactgtgatc

SEQ ID NO: 549607 - DNA, 25 bp, Mus musculus
caactttgacaaggagactgtgatc

SEQ ID NO: 549608 - DNA, 25 bp, Mus musculus
caactttgagagattcggcaacaaa

SEQ ID NO: 549609 - DNA, 25 bp, Mus musculus
caactttgagagctagatactacct

SEQ ID NO: 549610 - DNA, 25 bp, Mus musculus
caactttgagaggtagatactacct

SEQ ID NO: 549611 - DNA, 25 bp, Mus musculus
caactttgagagtttcggcaacaaa

SEQ ID NO: 549612 - DNA, 25 bp, Mus musculus
caactttgcagaaatgaataagctc

SEQ ID NO: 549613 - DNA, 25 bp, Mus musculus
caactttgcagatatgaataagctc

SEQ ID NO: 549614 - DNA, 25 bp, Mus musculus
caactttggacccttcgaaacagtg

SEQ ID NO: 549615 - DNA, 25 bp, Mus musculus
caactttggaccgttcgaaacagtg

SEQ ID NO: 549616 - DNA, 25 bp, Mus musculus
caactttggataaagaggtcgatgg

SEQ ID NO: 549617 - DNA, 25 bp, Mus musculus
caactttggatatagaggtcgatgg

SEQ ID NO: 549618 - DNA, 25 bp, Mus musculus
caactttggcttatggtcagagtct

SEQ ID NO: 549619 - DNA, 25 bp, Mus musculus
caactttggcttttggtcagagtct

SEQ ID NO: 549620 - DNA, 25 bp, Mus musculus
caactttgtaggctggattctgacc

SEQ ID NO: 549621 - DNA, 25 bp, Mus musculus
caactttgtagggtggattctgacc

SEQ ID NO: 549622 - DNA, 25 bp, Mus musculus
caactttgtggacaggtgggaccac

SEQ ID NO: 549623 - DNA, 25 bp, Mus musculus
caactttgtggagaggtgggaccac

SEQ ID NO: 549624 - DNA, 25 bp, Mus musculus
caactttgttagcagctggatagac

SEQ ID NO: 549625 - DNA, 25 bp, Mus musculus
caactttgttaggagctggatagac

SEQ ID NO: 549626 - DNA, 25 bp, Mus musculus
caacttttcccacctagacagacag

SEQ ID NO: 549627 - DNA, 25 bp, Mus musculus
caacttttcccagctagacagacag

SEQ ID NO: 549628 - DNA, 25 bp, Mus musculus
caacttttccctcgaggtcaatggg

SEQ ID NO: 549629 - DNA, 25 bp, Mus musculus
caacttttccctggaggtcaatggg

SEQ ID NO: 549630 - DNA, 25 bp, Mus musculus
caacttttctatctgtacatactag

SEQ ID NO: 549631 - DNA, 25 bp, Mus musculus
caacttttctatgtgtacatactag

SEQ ID NO: 549632 - DNA, 25 bp, Mus musculus
caactttttcatcaggagccaatga

SEQ ID NO: 549633 - DNA, 25 bp, Mus musculus
caactttttcatgaggagccaatga

SEQ ID NO: 549634 - DNA, 25 bp, Mus musculus
caagaaaaacctatggacagctgtt

SEQ ID NO: 549635 - DNA, 25 bp, Mus musculus
caagaaaaacctttggacagctgtt

SEQ ID NO: 549636 - DNA, 25 bp, Mus musculus
caagaaaaactcaactgggcattta

SEQ ID NO: 549637 - DNA, 25 bp, Mus musculus
caagaaaaactctactgggcattta

SEQ ID NO: 549638 - DNA, 25 bp, Mus musculus
caagaaaaagttcacaagttcatga

SEQ ID NO: 549639 - DNA, 25 bp, Mus musculus
caagaaaaagttgacaagttcatga

SEQ ID NO: 549640 - DNA, 25 bp, Mus musculus
caagaaaaatgaccccaatcctcag

SEQ ID NO: 549641 - DNA, 25 bp, Mus musculus
caagaaaaatgagcccaatcctcag

SEQ ID NO: 549642 - DNA, 25 bp, Mus musculus
caagaaaaatggattgacactgatt

SEQ ID NO: 549643 - DNA, 25 bp, Mus musculus
caagaaaaatggtttgacactgatt

SEQ ID NO: 549644 - DNA, 25 bp, Mus musculus
caagaaaacattaacaggtggttca

SEQ ID NO: 549645 - DNA, 25 bp, Mus musculus
caagaaaacatttacaggtggttca

SEQ ID NO: 549646 - DNA, 25 bp, Mus musculus
caagaaaacgatagtgaagtgtgca

SEQ ID NO: 549647 - DNA, 25 bp, Mus musculus
caagaaaacgattgtgaagtgtgca

SEQ ID NO: 549648 - DNA, 25 bp, Mus musculus
caagaaaactcaccaagtttgggtc

SEQ ID NO: 549649 - DNA, 25 bp, Mus musculus
caagaaaactcagcaagtttgggtc

SEQ ID NO: 549650 - DNA, 25 bp, Mus musculus
caagaaaaggaacgtgccacagaaa

SEQ ID NO: 549651 - DNA, 25 bp, Mus musculus
caagaaaaggaaggtgccacagaaa

SEQ ID NO: 549652 - DNA, 25 bp, Mus musculus
caagaaaagtcaccctgactgcagg

SEQ ID NO: 549653 - DNA, 25 bp, Mus musculus
caagaaaagtcagcctgactgcagg

SEQ ID NO: 549654 - DNA, 25 bp, Mus musculus
caagaaaagtgccagaggtggttta

SEQ ID NO: 549655 - DNA, 25 bp, Mus musculus
caagaaaagtgcgagaggtggttta

SEQ ID NO: 549656 - DNA, 25 bp, Mus musculus
caagaaaatcaaagtcgtcttcacc

SEQ ID NO: 549657 - DNA, 25 bp, Mus musculus
caagaaaatcaatgtcgtcttcacc

SEQ ID NO: 549658 - DNA, 25 bp, Mus musculus
caagaaaatgaacgtttgtctccac

SEQ ID NO: 549659 - DNA, 25 bp, Mus musculus
caagaaaatgaaggtttgtctccac

SEQ ID NO: 549660 - DNA, 25 bp, Mus musculus
caagaaaatgatagcagcctcctgg

SEQ ID NO: 549661 - DNA, 25 bp, Mus musculus
caagaaaatgattgcagcctcctgg

SEQ ID NO: 549662 - DNA, 25 bp, Mus musculus
caagaaaatgtgcaaaaggagtgat

SEQ ID NO: 549663 - DNA, 25 bp, Mus musculus
caagaaaatgtggaaaaggagtgat

SEQ ID NO: 549664 - DNA, 25 bp, Mus musculus
caagaaaattccatatagataggct

SEQ ID NO: 549665 - DNA, 25 bp, Mus musculus
caagaaaattccttatagataggct

SEQ ID NO: 549666 - DNA, 25 bp, Mus musculus
caagaaacaattcggatcaacaatt

SEQ ID NO: 549667 - DNA, 25 bp, Mus musculus
caagaaacaattgggatcaacaatt

SEQ ID NO: 549668 - DNA, 25 bp, Mus musculus
caagaaacaccaacgcaagcgttca

SEQ ID NO: 549669 - DNA, 25 bp, Mus musculus
caagaaacaccatcgcaagcgttca

SEQ ID NO: 549670 - DNA, 25 bp, Mus musculus
caagaaacccagataattcaggcca

SEQ ID NO: 549671 - DNA, 25 bp, Mus musculus
caagaaacccagttaattcaggcca

SEQ ID NO: 549672 - DNA, 25 bp, Mus musculus
caagaaacgactagacaaggatggc

SEQ ID NO: 549673 - DNA, 25 bp, Mus musculus
caagaaacgacttgacaaggatggc

SEQ ID NO: 549674 - DNA, 25 bp, Mus musculus
caagaaacgcaccttacgcaagagt

SEQ ID NO: 549675 - DNA, 25 bp, Mus musculus
caagaaacgcacgttacgcaagagt

SEQ ID NO: 549676 - DNA, 25 bp, Mus musculus
caagaaacgcgcatctgtttctgtg

SEQ ID NO: 549677 - DNA, 25 bp, Mus musculus
caagaaacgcgcttctgtttctgtg

SEQ ID NO: 549678 - DNA, 25 bp, Mus musculus
caagaaacggagatccccagatgat

SEQ ID NO: 549679 - DNA, 25 bp, Mus musculus
caagaaacggagttccccagatgat

SEQ ID NO: 549680 - DNA, 25 bp, Mus musculus
caagaaactcttacacaggctggac

SEQ ID NO: 549681 - DNA, 25 bp, Mus musculus
caagaaactctttcacaggctggac

SEQ ID NO: 549682 - DNA, 25 bp, Mus musculus
caagaaacttcaatctgccaatgtg

SEQ ID NO: 549683 - DNA, 25 bp, Mus musculus
caagaaacttcattctgccaatgtg

SEQ ID NO: 549684 - DNA, 25 bp, Mus musculus
caagaaacttttagctggctgcaga

SEQ ID NO: 549685 - DNA, 25 bp, Mus musculus
caagaaactttttgctggctgcaga

SEQ ID NO: 549686 - DNA, 25 bp, Mus musculus
caagaaagaagtaccactcagtgca

SEQ ID NO: 549687 - DNA, 25 bp, Mus musculus
caagaaagaagttccactcagtgca

SEQ ID NO: 549688 - DNA, 25 bp, Mus musculus
caagaaagacctctttggcgagaag

SEQ ID NO: 549689 - DNA, 25 bp, Mus musculus
caagaaagacctgtttggcgagaag

SEQ ID NO: 549690 - DNA, 25 bp, Mus musculus
caagaaagcaatcattgtcccagca

SEQ ID NO: 549691 - DNA, 25 bp, Mus musculus
caagaaagcaatgattgtcccagca

SEQ ID NO: 549692 - DNA, 25 bp, Mus musculus
caagaaagcactacagtcaggctga

SEQ ID NO: 549693 - DNA, 25 bp, Mus musculus
caagaaagcactcacgtacagcgac

SEQ ID NO: 549694 - DNA, 25 bp, Mus musculus
caagaaagcactgacgtacagcgac

SEQ ID NO: 549695 - DNA, 25 bp, Mus musculus
caagaaagcacttcagtcaggctga

SEQ ID NO: 549696 - DNA, 25 bp, Mus musculus
caagaaagcaggatggaccatagtt

SEQ ID NO: 549697 - DNA, 25 bp, Mus musculus
caagaaagcaggttggaccatagtt

SEQ ID NO: 549698 - DNA, 25 bp, Mus musculus
caagaaagccaacgaccctgatccc

SEQ ID NO: 549699 - DNA, 25 bp, Mus musculus
caagaaagccaaggaccctgatccc

SEQ ID NO: 549700 - DNA, 25 bp, Mus musculus
caagaaagggcgcagcaaggtcaca

SEQ ID NO: 549701 - DNA, 25 bp, Mus musculus
caagaaagggcggagcaaggtcaca

SEQ ID NO: 549702 - DNA, 25 bp, Mus musculus
caagaaagtagaagtaagttcttca

SEQ ID NO: 549703 - DNA, 25 bp, Mus musculus
caagaaagtagatgtaagttcttca

SEQ ID NO: 549704 - DNA, 25 bp, Mus musculus
caagaaagtcacagagcccagcatc

SEQ ID NO: 549705 - DNA, 25 bp, Mus musculus
caagaaagtcactgagcccagcatc

SEQ ID NO: 549706 - DNA, 25 bp, Mus musculus
caagaaagtcgacgctctggattca

SEQ ID NO: 549707 - DNA, 25 bp, Mus musculus
caagaaagtcgaggctctggattca

SEQ ID NO: 549708 - DNA, 25 bp, Mus musculus
caagaaagtggaaggaatacatggc

SEQ ID NO: 549709 - DNA, 25 bp, Mus musculus
caagaaagtggatggaatacatggc

SEQ ID NO: 549710 - DNA, 25 bp, Mus musculus
caagaaataaggaatacagacatga

SEQ ID NO: 549711 - DNA, 25 bp, Mus musculus
caagaaataaggtatacagacatga

SEQ ID NO: 549712 - DNA, 25 bp, Mus musculus
caagaaatagtgcataaatctggtg

SEQ ID NO: 549713 - DNA, 25 bp, Mus musculus
caagaaatagtggataaatctggtg

SEQ ID NO: 549714 - DNA, 25 bp, Mus musculus
caagaaatatgcaatggagcagagc

SEQ ID NO: 549715 - DNA, 25 bp, Mus musculus
caagaaatatgctatggagcagagc

SEQ ID NO: 549716 - DNA, 25 bp, Mus musculus
caagaaatcacccattggttacctg

SEQ ID NO: 549717 - DNA, 25 bp, Mus musculus
caagaaatcaccgattggttacctg

SEQ ID NO: 549718 - DNA, 25 bp, Mus musculus
caagaaatccttctgctcaattgaa

SEQ ID NO: 549719 - DNA, 25 bp, Mus musculus
caagaaatccttgtgctcaattgaa

SEQ ID NO: 549720 - DNA, 25 bp, Mus musculus
caagaaatcgaaattgatacttccc

SEQ ID NO: 549721 - DNA, 25 bp, Mus musculus
caagaaatcgaatttgatacttccc

SEQ ID NO: 549722 - DNA, 25 bp, Mus musculus
caagaaatcgataatgccagagaac

SEQ ID NO: 549723 - DNA, 25 bp, Mus musculus
caagaaatcgattatgccagagaac

SEQ ID NO: 549724 - DNA, 25 bp, Mus musculus
caagaaatcgcccagagagagctga

SEQ ID NO: 549725 - DNA, 25 bp, Mus musculus
caagaaatcgccgagagagagctga

SEQ ID NO: 549726 - DNA, 25 bp, Mus musculus
caagaaatctaacaaagcaggtggt

SEQ ID NO: 549727 - DNA, 25 bp, Mus musculus
caagaaatctaagaaagcaggtggt

SEQ ID NO: 549728 - DNA, 25 bp, Mus musculus
caagaaatgcagcatcacagtatca

SEQ ID NO: 549729 - DNA, 25 bp, Mus musculus
caagaaatgcaggatcacagtatca

SEQ ID NO: 549730 - DNA, 25 bp, Mus musculus
caagaaattcttagtgcagtaccaa

SEQ ID NO: 549731 - DNA, 25 bp, Mus musculus
caagaaattctttgtgcagtaccaa

SEQ ID NO: 549732 - DNA, 25 bp, Mus musculus
caagaaatttaacgacgcacctgat

SEQ ID NO: 549733 - DNA, 25 bp, Mus musculus
caagaaatttaaggacgcacctgat

SEQ ID NO: 549734 - DNA, 25 bp, Mus musculus
caagaacaaactacaggcgattgcc

SEQ ID NO: 549735 - DNA, 25 bp, Mus musculus
caagaacaaacttcaggcgattgcc

SEQ ID NO: 549736 - DNA, 25 bp, Mus musculus
caagaacaaatcaattatgtgggtc

SEQ ID NO: 549737 - DNA, 25 bp, Mus musculus
caagaacaaatctattatgtgggtc

SEQ ID NO: 549738 - DNA, 25 bp, Mus musculus
caagaacaactacagcgacactcag

SEQ ID NO: 549739 - DNA, 25 bp, Mus musculus
caagaacaactagagcgacactcag

SEQ ID NO: 549740 - DNA, 25 bp, Mus musculus
caagaacaagaaaggactcactgcc

SEQ ID NO: 549741 - DNA, 25 bp, Mus musculus
caagaacaagaatggactcactgcc

SEQ ID NO: 549742 - DNA, 25 bp, Mus musculus
caagaacaagagcttggtgatggca

SEQ ID NO: 549743 - DNA, 25 bp, Mus musculus
caagaacaagaggttggtgatggca

SEQ ID NO: 549744 - DNA, 25 bp, Mus musculus
caagaacaagtacgctccagcggcc

SEQ ID NO: 549745 - DNA, 25 bp, Mus musculus
caagaacaagtaggctccagcggcc

SEQ ID NO: 549746 - DNA, 25 bp, Mus musculus
caagaacaagtgcagcacaatctgg

SEQ ID NO: 549747 - DNA, 25 bp, Mus musculus
caagaacaagtggagcacaatctgg

SEQ ID NO: 549748 - DNA, 25 bp, Mus musculus
caagaacaagttcggcagtcgctcc

SEQ ID NO: 549749 - DNA, 25 bp, Mus musculus
caagaacaagttgggcagtcgctcc

SEQ ID NO: 549750 - DNA, 25 bp, Mus musculus
caagaacaataccaacaccggtgtg

SEQ ID NO: 549751 - DNA, 25 bp, Mus musculus
caagaacaatacgaacaccggtgtg

SEQ ID NO: 549752 - DNA, 25 bp, Mus musculus
caagaacacagtacaaggctttaaa

SEQ ID NO: 549753 - DNA, 25 bp, Mus musculus
caagaacacagtacatcaccaggaa

SEQ ID NO: 549754 - DNA, 25 bp, Mus musculus
caagaacacagttcaaggctttaaa

SEQ ID NO: 549755 - DNA, 25 bp, Mus musculus
caagaacacagttcatcaccaggaa

SEQ ID NO: 549756 - DNA, 25 bp, Mus musculus
caagaacacggaagagtccttcgtc

SEQ ID NO: 549757 - DNA, 25 bp, Mus musculus
caagaacacggatgagtccttcgtc

SEQ ID NO: 549758 - DNA, 25 bp, Mus musculus
caagaacagaggcactctttgactc

SEQ ID NO: 549759 - DNA, 25 bp, Mus musculus
caagaacagagggactctttgactc

SEQ ID NO: 549760 - DNA, 25 bp, Mus musculus
caagaacaggtaagagactctaaat

SEQ ID NO: 549761 - DNA, 25 bp, Mus musculus
caagaacaggtatgagactctaaat

SEQ ID NO: 549762 - DNA, 25 bp, Mus musculus
caagaacaggtccaagtcggaagag

SEQ ID NO: 549763 - DNA, 25 bp, Mus musculus
caagaacaggtcgaagtcggaagag

SEQ ID NO: 549764 - DNA, 25 bp, Mus musculus
caagaacagtctccccttgcaagag

SEQ ID NO: 549765 - DNA, 25 bp, Mus musculus
caagaacagtctgcccttgcaagag

SEQ ID NO: 549766 - DNA, 25 bp, Mus musculus
caagaacatcttaggcacacccgag

SEQ ID NO: 549767 - DNA, 25 bp, Mus musculus
caagaacatctttggcacacccgag

SEQ ID NO: 549768 - DNA, 25 bp, Mus musculus
caagaacatgaaactggcagatgat

SEQ ID NO: 549769 - DNA, 25 bp, Mus musculus
caagaacatgaatctggcagatgat

SEQ ID NO: 549770 - DNA, 25 bp, Mus musculus
caagaacatgatagggcaagcaccc

SEQ ID NO: 549771 - DNA, 25 bp, Mus musculus
caagaacatgattgggcaagcaccc

SEQ ID NO: 549772 - DNA, 25 bp, Mus musculus
caagaacattaccagaaaccagacc

SEQ ID NO: 549773 - DNA, 25 bp, Mus musculus
caagaacattacgagaaaccagacc

SEQ ID NO: 549774 - DNA, 25 bp, Mus musculus
caagaaccagagattgccatgccag

SEQ ID NO: 549775 - DNA, 25 bp, Mus musculus
caagaaccagagtttgccatgccag

SEQ ID NO: 549776 - DNA, 25 bp, Mus musculus
caagaaccataaacgctggagaaga

SEQ ID NO: 549777 - DNA, 25 bp, Mus musculus
caagaaccataatcgctggagaaga

SEQ ID NO: 549778 - DNA, 25 bp, Mus musculus
caagaacccaaaactgaagacatag

SEQ ID NO: 549779 - DNA, 25 bp, Mus musculus
caagaacccaaatctgaagacatag

SEQ ID NO: 549780 - DNA, 25 bp, Mus musculus
caagaacccgtgcatcgtgtgtgca

SEQ ID NO: 549781 - DNA, 25 bp, Mus musculus
caagaacccgtggatcgtgtgtgca

SEQ ID NO: 549782 - DNA, 25 bp, Mus musculus
caagaaccctacaagagtagaagaa

SEQ ID NO: 549783 - DNA, 25 bp, Mus musculus
caagaaccctactagagtagaagaa

SEQ ID NO: 549784 - DNA, 25 bp, Mus musculus
caagaaccctcgctggaacaaagtc

SEQ ID NO: 549785 - DNA, 25 bp, Mus musculus
caagaaccctcggtggaacaaagtc

SEQ ID NO: 549786 - DNA, 25 bp, Mus musculus
caagaaccgcacagtctctggtggg

SEQ ID NO: 549787 - DNA, 25 bp, Mus musculus
caagaaccgcactgtctctggtggg

SEQ ID NO: 549788 - DNA, 25 bp, Mus musculus
caagaaccgtgcctgtggctgtttc

SEQ ID NO: 549789 - DNA, 25 bp, Mus musculus
caagaaccgtgcgtgtggctgtttc

SEQ ID NO: 549790 - DNA, 25 bp, Mus musculus
caagaacctccgattggccacattc

SEQ ID NO: 549791 - DNA, 25 bp, Mus musculus
caagaacctccgtttggccacattc

SEQ ID NO: 549792 - DNA, 25 bp, Mus musculus
caagaacctgaacaactcacaaagc

SEQ ID NO: 549793 - DNA, 25 bp, Mus musculus
caagaacctgaagaactcacaaagc

SEQ ID NO: 549794 - DNA, 25 bp, Mus musculus
caagaacctgctaccccattggaag

SEQ ID NO: 549795 - DNA, 25 bp, Mus musculus
caagaacctgctcccaagcgaaaac

SEQ ID NO: 549796 - DNA, 25 bp, Mus musculus
caagaacctgctgccaagcgaaaac

SEQ ID NO: 549797 - DNA, 25 bp, Mus musculus
caagaacctgcttccccattggaag

SEQ ID NO: 549798 - DNA, 25 bp, Mus musculus
caagaacctttaactgcttccatgt

SEQ ID NO: 549799 - DNA, 25 bp, Mus musculus
caagaacctttatctgcttccatgt

SEQ ID NO: 549800 - DNA, 25 bp, Mus musculus
caagaacgaaaacgtacgtgcagga

SEQ ID NO: 549801 - DNA, 25 bp, Mus musculus
caagaacgaaaaggtacgtgcagga

SEQ ID NO: 549802 - DNA, 25 bp, Mus musculus
caagaacgactcaagggctgacagc

SEQ ID NO: 549803 - DNA, 25 bp, Mus musculus
caagaacgactctagggctgacagc

SEQ ID NO: 549804 - DNA, 25 bp, Mus musculus
caagaacgccgtctacaagtgtaag

SEQ ID NO: 549805 - DNA, 25 bp, Mus musculus
caagaacgccgtgtacaagtgtaag

SEQ ID NO: 549806 - DNA, 25 bp, Mus musculus
caagaacggccactttggagattaa

SEQ ID NO: 549807 - DNA, 25 bp, Mus musculus
caagaacggccagtttggagattaa

SEQ ID NO: 549808 - DNA, 25 bp, Mus musculus
caagaacggtgccaagtgcctggat

SEQ ID NO: 549809 - DNA, 25 bp, Mus musculus
caagaacggtgcgaagtgcctggat

SEQ ID NO: 549810 - DNA, 25 bp, Mus musculus
caagaacggtgtcgacctcctaatg

SEQ ID NO: 549811 - DNA, 25 bp, Mus musculus
caagaacggtgtggacctcctaatg

SEQ ID NO: 549812 - DNA, 25 bp, Mus musculus
caagaactacctcagctacctgacg

SEQ ID NO: 549813 - DNA, 25 bp, Mus musculus
caagaactacctgagctacctgacg

SEQ ID NO: 549814 - DNA, 25 bp, Mus musculus
caagaactacgacgaggcactccgt

SEQ ID NO: 549815 - DNA, 25 bp, Mus musculus
caagaactacgaggaggcactccgt

SEQ ID NO: 549816 - DNA, 25 bp, Mus musculus
caagaactagttcctcagatgggtc

SEQ ID NO: 549817 - DNA, 25 bp, Mus musculus
caagaactagttgctcagatgggtc

SEQ ID NO: 549818 - DNA, 25 bp, Mus musculus
caagaactatgtcatggatcaaaga

SEQ ID NO: 549819 - DNA, 25 bp, Mus musculus
caagaactatgtcgaagtgacccga

SEQ ID NO: 549820 - DNA, 25 bp, Mus musculus
caagaactatgtgatggatcaaaga

SEQ ID NO: 549821 - DNA, 25 bp, Mus musculus
caagaactatgtggaagtgacccga

SEQ ID NO: 549822 - DNA, 25 bp, Mus musculus
caagaactattcacatgcaatcaag

SEQ ID NO: 549823 - DNA, 25 bp, Mus musculus
caagaactattctcatgcaatcaag

SEQ ID NO: 549824 - DNA, 25 bp, Mus musculus
caagaactcattctcgggattaact

SEQ ID NO: 549825 - DNA, 25 bp, Mus musculus
caagaactcattgtcgggattaact

SEQ ID NO: 549826 - DNA, 25 bp, Mus musculus
caagaactccaaaggcgaggtgtat

SEQ ID NO: 549827 - DNA, 25 bp, Mus musculus
caagaactccaatggcgaggtgtat

SEQ ID NO: 549828 - DNA, 25 bp, Mus musculus
caagaactctaaacacgaggcaaca

SEQ ID NO: 549829 - DNA, 25 bp, Mus musculus
caagaactctaatcacgaggcaaca

SEQ ID NO: 549830 - DNA, 25 bp, Mus musculus
caagaactctagaggctggaaggaa

SEQ ID NO: 549831 - DNA, 25 bp, Mus musculus
caagaactctagtggctggaaggaa

SEQ ID NO: 549832 - DNA, 25 bp, Mus musculus
caagaactctataattgaagaagag

SEQ ID NO: 549833 - DNA, 25 bp, Mus musculus
caagaactctattattgaagaagag

SEQ ID NO: 549834 - DNA, 25 bp, Mus musculus
caagaactctgtcgcaacaacaacg

SEQ ID NO: 549835 - DNA, 25 bp, Mus musculus
caagaactctgtggcaacaacaacg

SEQ ID NO: 549836 - DNA, 25 bp, Mus musculus
caagaactgacccagttgaaggctg

SEQ ID NO: 549837 - DNA, 25 bp, Mus musculus
caagaactgaccgagttgaaggctg

SEQ ID NO: 549838 - DNA, 25 bp, Mus musculus
caagaactggccagtcagaatgacc

SEQ ID NO: 549839 - DNA, 25 bp, Mus musculus
caagaactggcctgtcagaatgacc

SEQ ID NO: 549840 - DNA, 25 bp, Mus musculus
caagaactgtagcaacctgacggtg

SEQ ID NO: 549841 - DNA, 25 bp, Mus musculus
caagaactgtaggaacctgacggtg

SEQ ID NO: 549842 - DNA, 25 bp, Mus musculus
caagaactgttgaaagactgggaat

SEQ ID NO: 549843 - DNA, 25 bp, Mus musculus
caagaactgttgtaagactgggaat

SEQ ID NO: 549844 - DNA, 25 bp, Mus musculus
caagaacttctaaggaggcaacggc

SEQ ID NO: 549845 - DNA, 25 bp, Mus musculus
caagaacttctatggaggcaacggc

SEQ ID NO: 549846 - DNA, 25 bp, Mus musculus
caagaactttcactggcattggact

SEQ ID NO: 549847 - DNA, 25 bp, Mus musculus
caagaactttcagtggcattggact

SEQ ID NO: 549848 - DNA, 25 bp, Mus musculus
caagaactttggagaccagccagac

SEQ ID NO: 549849 - DNA, 25 bp, Mus musculus
caagaactttggtgaccagccagac

SEQ ID NO: 549850 - DNA, 25 bp, Mus musculus
caagaagaaagcagatggctccgac

SEQ ID NO: 549851 - DNA, 25 bp, Mus musculus
caagaagaaagcagctcatgcagcc

SEQ ID NO: 549852 - DNA, 25 bp, Mus musculus
caagaagaaagctgatggctccgac

SEQ ID NO: 549853 - DNA, 25 bp, Mus musculus
caagaagaaagctgctcatgcagcc

SEQ ID NO: 549854 - DNA, 25 bp, Mus musculus
caagaagaacttagagtccctctca

SEQ ID NO: 549855 - DNA, 25 bp, Mus musculus
caagaagaactttgagtccctctca

SEQ ID NO: 549856 - DNA, 25 bp, Mus musculus
caagaagaagcaattcgtacagcag

SEQ ID NO: 549857 - DNA, 25 bp, Mus musculus
caagaagaagcatttcgtacagcag

SEQ ID NO: 549858 - DNA, 25 bp, Mus musculus
caagaagaagccatagaagctacag

SEQ ID NO: 549859 - DNA, 25 bp, Mus musculus
caagaagaagccttagaagctacag

SEQ ID NO: 549860 - DNA, 25 bp, Mus musculus
caagaagaaggtaaatgataagaac

SEQ ID NO: 549861 - DNA, 25 bp, Mus musculus
caagaagaaggttaatgataagaac

SEQ ID NO: 549862 - DNA, 25 bp, Mus musculus
caagaagacaacctagaaggacgga

SEQ ID NO: 549863 - DNA, 25 bp, Mus musculus
caagaagacaacgtagaaggacgga

SEQ ID NO: 549864 - DNA, 25 bp, Mus musculus
caagaagacatcagaggctcattcg

SEQ ID NO: 549865 - DNA, 25 bp, Mus musculus
caagaagacatctgaggctcattcg

SEQ ID NO: 549866 - DNA, 25 bp, Mus musculus
caagaagaccatcttccctgcctgt

SEQ ID NO: 549867 - DNA, 25 bp, Mus musculus
caagaagaccatgttccctgcctgt

SEQ ID NO: 549868 - DNA, 25 bp, Mus musculus
caagaagactaactttctaaagaag

SEQ ID NO: 549869 - DNA, 25 bp, Mus musculus
caagaagactaagtttctaaagaag

SEQ ID NO: 549870 - DNA, 25 bp, Mus musculus
caagaagactaccatcgcctgcggc

SEQ ID NO: 549871 - DNA, 25 bp, Mus musculus
caagaagactacgatcgcctgcggc

SEQ ID NO: 549872 - DNA, 25 bp, Mus musculus
caagaagactcaagaaactctttca

SEQ ID NO: 549873 - DNA, 25 bp, Mus musculus
caagaagactcatgaaactctttca

SEQ ID NO: 549874 - DNA, 25 bp, Mus musculus
caagaagactttctcttatgctggg

SEQ ID NO: 549875 - DNA, 25 bp, Mus musculus
caagaagactttgtcttatgctggg

SEQ ID NO: 549876 - DNA, 25 bp, Mus musculus
caagaagagagcacccattggcttc

SEQ ID NO: 549877 - DNA, 25 bp, Mus musculus
caagaagagagctcccattggcttc

SEQ ID NO: 549878 - DNA, 25 bp, Mus musculus
caagaagagcataccccggataacg

SEQ ID NO: 549879 - DNA, 25 bp, Mus musculus
caagaagagcattccccggataacg

SEQ ID NO: 549880 - DNA, 25 bp, Mus musculus
caagaagagctgaatgaagttgggc

SEQ ID NO: 549881 - DNA, 25 bp, Mus musculus
caagaagagctgatgaacaagagtg

SEQ ID NO: 549882 - DNA, 25 bp, Mus musculus
caagaagagctgtatgaagttgggc

SEQ ID NO: 549883 - DNA, 25 bp, Mus musculus
caagaagagctgttgaacaagagtg

SEQ ID NO: 549884 - DNA, 25 bp, Mus musculus
caagaagaggaaaacgaccctgctg

SEQ ID NO: 549885 - DNA, 25 bp, Mus musculus
caagaagaggaacgtcgaaatgaaa

SEQ ID NO: 549886 - DNA, 25 bp, Mus musculus
caagaagaggaaggtcgaaatgaaa

SEQ ID NO: 549887 - DNA, 25 bp, Mus musculus
caagaagaggaatacgaccctgctg

SEQ ID NO: 549888 - DNA, 25 bp, Mus musculus
caagaagaggccagttggagacccc

SEQ ID NO: 549889 - DNA, 25 bp, Mus musculus
caagaagaggcctgttggagacccc

SEQ ID NO: 549890 - DNA, 25 bp, Mus musculus
caagaagagttcactacttacctgc

SEQ ID NO: 549891 - DNA, 25 bp, Mus musculus
caagaagagttctctacttacctgc

SEQ ID NO: 549892 - DNA, 25 bp, Mus musculus
caagaagatacaattcaatgctcat

SEQ ID NO: 549893 - DNA, 25 bp, Mus musculus
caagaagatacatttcaatgctcat

SEQ ID NO: 549894 - DNA, 25 bp, Mus musculus
caagaagatacgcaggaaaaaggaa

SEQ ID NO: 549895 - DNA, 25 bp, Mus musculus
caagaagatacggaggaaaaaggaa

SEQ ID NO: 549896 - DNA, 25 bp, Mus musculus
caagaagatctacaaaactctccag

SEQ ID NO: 549897 - DNA, 25 bp, Mus musculus
caagaagatctagaaaactctccag

SEQ ID NO: 549898 - DNA, 25 bp, Mus musculus
caagaagatgctagcatatcttgac

SEQ ID NO: 549899 - DNA, 25 bp, Mus musculus
caagaagatgctcagggattaccga

SEQ ID NO: 549900 - DNA, 25 bp, Mus musculus
caagaagatgctgagggattaccga

SEQ ID NO: 549901 - DNA, 25 bp, Mus musculus
caagaagatgcttgcatatcttgac

SEQ ID NO: 549902 - DNA, 25 bp, Mus musculus
caagaagatggtccagtgctagttt

SEQ ID NO: 549903 - DNA, 25 bp, Mus musculus
caagaagatggtgcagtgctagttt

SEQ ID NO: 549904 - DNA, 25 bp, Mus musculus
caagaagcaccgcaacaagatgtac

SEQ ID NO: 549905 - DNA, 25 bp, Mus musculus
caagaagcaccggaacaagatgtac

SEQ ID NO: 549906 - DNA, 25 bp, Mus musculus
caagaagcagctatctgggcaacgc

SEQ ID NO: 549907 - DNA, 25 bp, Mus musculus
caagaagcagctttctgggcaacgc

SEQ ID NO: 549908 - DNA, 25 bp, Mus musculus
caagaagcatcactatgagattagg

SEQ ID NO: 549909 - DNA, 25 bp, Mus musculus
caagaagcatcagtatgagattagg

SEQ ID NO: 549910 - DNA, 25 bp, Mus musculus
caagaagcatgaagccttcctggtg

SEQ ID NO: 549911 - DNA, 25 bp, Mus musculus
caagaagcatgatgccttcctggtg

SEQ ID NO: 549912 - DNA, 25 bp, Mus musculus
caagaagccaacagtatgcaggtgc

SEQ ID NO: 549913 - DNA, 25 bp, Mus musculus
caagaagccaactgtatgcaggtgc

SEQ ID NO: 549914 - DNA, 25 bp, Mus musculus
caagaagccaccagctaaactgcag

SEQ ID NO: 549915 - DNA, 25 bp, Mus musculus
caagaagccaccctgggttcctgta

SEQ ID NO: 549916 - DNA, 25 bp, Mus musculus
caagaagccaccgtgggttcctgta

SEQ ID NO: 549917 - DNA, 25 bp, Mus musculus
caagaagccacctgctaaactgcag

SEQ ID NO: 549918 - DNA, 25 bp, Mus musculus
caagaagccatgctctcaatggaga

SEQ ID NO: 549919 - DNA, 25 bp, Mus musculus
caagaagccatggtctcaatggaga

SEQ ID NO: 549920 - DNA, 25 bp, Mus musculus
caagaagcccacactggtggccaaa

SEQ ID NO: 549921 - DNA, 25 bp, Mus musculus
caagaagcccactctggtggccaaa

SEQ ID NO: 549922 - DNA, 25 bp, Mus musculus
caagaagcccatacatatgtatatc

SEQ ID NO: 549923 - DNA, 25 bp, Mus musculus
caagaagcccattcatatgtatatc

SEQ ID NO: 549924 - DNA, 25 bp, Mus musculus
caagaagcctacattcctgaggcag

SEQ ID NO: 549925 - DNA, 25 bp, Mus musculus
caagaagcctactttcctgaggcag

SEQ ID NO: 549926 - DNA, 25 bp, Mus musculus
caagaagcctgacaatcggccagaa

SEQ ID NO: 549927 - DNA, 25 bp, Mus musculus
caagaagcctgagaatcggccagaa

SEQ ID NO: 549928 - DNA, 25 bp, Mus musculus
caagaagccttgagagaatgtccca

SEQ ID NO: 549929 - DNA, 25 bp, Mus musculus
caagaagccttgtgagaatgtccca

SEQ ID NO: 549930 - DNA, 25 bp, Mus musculus
caagaagcctttcacgtgtgccact

SEQ ID NO: 549931 - DNA, 25 bp, Mus musculus
caagaagcctttgacgtgtgccact

SEQ ID NO: 549932 - DNA, 25 bp, Mus musculus
caagaagcgcttaagaacgacctgg

SEQ ID NO: 549933 - DNA, 25 bp, Mus musculus
caagaagcgcttagaagttaaaaag

SEQ ID NO: 549934 - DNA, 25 bp, Mus musculus
caagaagcgctttagaacgacctgg

SEQ ID NO: 549935 - DNA, 25 bp, Mus musculus
caagaagcgctttgaagttaaaaag

SEQ ID NO: 549936 - DNA, 25 bp, Mus musculus
caagaagcggcaactgctggacagc

SEQ ID NO: 549937 - DNA, 25 bp, Mus musculus
caagaagcggcatctgctggacagc

SEQ ID NO: 549938 - DNA, 25 bp, Mus musculus
caagaagcggccatgaatcaggacg

SEQ ID NO: 549939 - DNA, 25 bp, Mus musculus
caagaagcggccttgaatcaggacg

SEQ ID NO: 549940 - DNA, 25 bp, Mus musculus
caagaagcggctatcagtcgagctg

SEQ ID NO: 549941 - DNA, 25 bp, Mus musculus
caagaagcggctcgagacttattac

SEQ ID NO: 549942 - DNA, 25 bp, Mus musculus
caagaagcggctggagacttattac

SEQ ID NO: 549943 - DNA, 25 bp, Mus musculus
caagaagcggctttcagtcgagctg

SEQ ID NO: 549944 - DNA, 25 bp, Mus musculus
caagaagcgtgacagataccgccat

SEQ ID NO: 549945 - DNA, 25 bp, Mus musculus
caagaagcgtgagagataccgccat

SEQ ID NO: 549946 - DNA, 25 bp, Mus musculus
caagaagctatgctggtactatatc

SEQ ID NO: 549947 - DNA, 25 bp, Mus musculus
caagaagctatggtggtactatatc

SEQ ID NO: 549948 - DNA, 25 bp, Mus musculus
caagaagctcctcgtctaattggcc

SEQ ID NO: 549949 - DNA, 25 bp, Mus musculus
caagaagctcctggtctaattggcc

SEQ ID NO: 549950 - DNA, 25 bp, Mus musculus
caagaagctctccatgtatggagtt

SEQ ID NO: 549951 - DNA, 25 bp, Mus musculus
caagaagctctcgatgtatggagtt

SEQ ID NO: 549952 - DNA, 25 bp, Mus musculus
caagaagctgaacgctaaccagagg

SEQ ID NO: 549953 - DNA, 25 bp, Mus musculus
caagaagctgaaggctaaccagagg

SEQ ID NO: 549954 - DNA, 25 bp, Mus musculus
caagaagctgacacgctacctcaac

SEQ ID NO: 549955 - DNA, 25 bp, Mus musculus
caagaagctgactcgctacctcaac

SEQ ID NO: 549956 - DNA, 25 bp, Mus musculus
caagaagctgatagggaaagaagtc

SEQ ID NO: 549957 - DNA, 25 bp, Mus musculus
caagaagctgattgggaaagaagtc

SEQ ID NO: 549958 - DNA, 25 bp, Mus musculus
caagaagctggaccgatatctgaag

SEQ ID NO: 549959 - DNA, 25 bp, Mus musculus
caagaagctggagcgatatctgaag

SEQ ID NO: 549960 - DNA, 25 bp, Mus musculus
caagaagctggcacggcgaagaaat

SEQ ID NO: 549961 - DNA, 25 bp, Mus musculus
caagaagctggctcggcgaagaaat

SEQ ID NO: 549962 - DNA, 25 bp, Mus musculus
caagaagcttgccagtgccgtgctg

SEQ ID NO: 549963 - DNA, 25 bp, Mus musculus
caagaagcttgcgagtgccgtgctg

SEQ ID NO: 549964 - DNA, 25 bp, Mus musculus
caagaaggacatcgaagaggctgtt

SEQ ID NO: 549965 - DNA, 25 bp, Mus musculus
caagaaggacatggaagaggctgtt

SEQ ID NO: 549966 - DNA, 25 bp, Mus musculus
caagaaggacctctgtctcaatgca

SEQ ID NO: 549967 - DNA, 25 bp, Mus musculus
caagaaggacctgtgtctcaatgca

SEQ ID NO: 549968 - DNA, 25 bp, Mus musculus
caagaaggacgtattctccgagaag

SEQ ID NO: 549969 - DNA, 25 bp, Mus musculus
caagaaggacgttttctccgagaag

SEQ ID NO: 549970 - DNA, 25 bp, Mus musculus
caagaaggagagacggtgactatgc

SEQ ID NO: 549971 - DNA, 25 bp, Mus musculus
caagaaggagagtcggtgactatgc

SEQ ID NO: 549972 - DNA, 25 bp, Mus musculus
caagaaggagcaagccatgtgcctg

SEQ ID NO: 549973 - DNA, 25 bp, Mus musculus
caagaaggagcatgccatgtgcctg

SEQ ID NO: 549974 - DNA, 25 bp, Mus musculus
caagaaggagtcaaccgcgacgaat

SEQ ID NO: 549975 - DNA, 25 bp, Mus musculus
caagaaggagtctaccgcgacgaat

SEQ ID NO: 549976 - DNA, 25 bp, Mus musculus
caagaaggcagaagccttccagatg

SEQ ID NO: 549977 - DNA, 25 bp, Mus musculus
caagaaggcagatgccttccagatg

SEQ ID NO: 549978 - DNA, 25 bp, Mus musculus
caagaaggccaaacgctttctgggc

SEQ ID NO: 549979 - DNA, 25 bp, Mus musculus
caagaaggccaatcgctttctgggc

SEQ ID NO: 549980 - DNA, 25 bp, Mus musculus
caagaaggccggctctatcctcctt

SEQ ID NO: 549981 - DNA, 25 bp, Mus musculus
caagaaggccgggtctatcctcctt

SEQ ID NO: 549982 - DNA, 25 bp, Mus musculus
caagaaggctgactatggctcccaa

SEQ ID NO: 549983 - DNA, 25 bp, Mus musculus
caagaaggctgagtatggctcccaa

SEQ ID NO: 549984 - DNA, 25 bp, Mus musculus
caagaaggctggaaacattggcaca

SEQ ID NO: 549985 - DNA, 25 bp, Mus musculus
caagaaggctggtaacattggcaca

SEQ ID NO: 549986 - DNA, 25 bp, Mus musculus
caagaagggaaacgacatcatccca

SEQ ID NO: 549987 - DNA, 25 bp, Mus musculus
caagaagggaaaggacatcatccca

SEQ ID NO: 549988 - DNA, 25 bp, Mus musculus
caagaagggattcttggcagttctc

SEQ ID NO: 549989 - DNA, 25 bp, Mus musculus
caagaagggattgttggcagttctc

SEQ ID NO: 549990 - DNA, 25 bp, Mus musculus
caagaagggccacagattatcagct

SEQ ID NO: 549991 - DNA, 25 bp, Mus musculus
caagaagggccagagattatcagct

SEQ ID NO: 549992 - DNA, 25 bp, Mus musculus
caagaaggtccaacgtccctggagg

SEQ ID NO: 549993 - DNA, 25 bp, Mus musculus
caagaaggtccatcgtccctggagg

SEQ ID NO: 549994 - DNA, 25 bp, Mus musculus
caagaaggtccgcaagtctctggct

SEQ ID NO: 549995 - DNA, 25 bp, Mus musculus
caagaaggtccggaagtctctggct

SEQ ID NO: 549996 - DNA, 25 bp, Mus musculus
caagaaggtgtcagagacccggaga

SEQ ID NO: 549997 - DNA, 25 bp, Mus musculus
caagaaggtgtctgagacccggaga

SEQ ID NO: 549998 - DNA, 25 bp, Mus musculus
caagaagtagacaagaccattgcag

SEQ ID NO: 549999 - DNA, 25 bp, Mus musculus
caagaagtagactagaccattgcag

SEQ ID NO: 550000 - DNA, 25 bp, Mus musculus
caagaagtataacaaccccaagatt

SEQ ID NO: 550001 - DNA, 25 bp, Mus musculus
caagaagtataacatgcgagtggaa

SEQ ID NO: 550002 - DNA, 25 bp, Mus musculus
caagaagtataagaaccccaagatt

SEQ ID NO: 550003 - DNA, 25 bp, Mus musculus
caagaagtataagatgcgagtggaa

SEQ ID NO: 550004 - DNA, 25 bp, Mus musculus
caagaagtatgcatcccgtgtgggc

SEQ ID NO: 550005 - DNA, 25 bp, Mus musculus
caagaagtatgcttcccgtgtgggc

SEQ ID NO: 550006 - DNA, 25 bp, Mus musculus
caagaagtccaaccccgttgtcagg

SEQ ID NO: 550007 - DNA, 25 bp, Mus musculus
caagaagtccaagcccgttgtcagg

SEQ ID NO: 550008 - DNA, 25 bp, Mus musculus
caagaagtcccaccatggaaccact

SEQ ID NO: 550009 - DNA, 25 bp, Mus musculus
caagaagtcccagcatggaaccact

SEQ ID NO: 550010 - DNA, 25 bp, Mus musculus
caagaagtcctcagagacgctgacc

SEQ ID NO: 550011 - DNA, 25 bp, Mus musculus
caagaagtcctctgagacgctgacc

SEQ ID NO: 550012 - DNA, 25 bp, Mus musculus
caagaagtcctgaagaagctcaaga

SEQ ID NO: 550013 - DNA, 25 bp, Mus musculus
caagaagtcctgtagaagctcaaga

SEQ ID NO: 550014 - DNA, 25 bp, Mus musculus
caagaagtcgacagtcaagagattt

SEQ ID NO: 550015 - DNA, 25 bp, Mus musculus
caagaagtcgactgtcaagagattt

SEQ ID NO: 550016 - DNA, 25 bp, Mus musculus
caagaagtcttcagtgacagcccta

SEQ ID NO: 550017 - DNA, 25 bp, Mus musculus
caagaagtcttctgtgacagcccta

SEQ ID NO: 550018 - DNA, 25 bp, Mus musculus
caagaagtgccgattcccagacgac

SEQ ID NO: 550019 - DNA, 25 bp, Mus musculus
caagaagtgccgtttcccagacgac

SEQ ID NO: 550020 - DNA, 25 bp, Mus musculus
caagaagttcccatgtgcacagact

SEQ ID NO: 550021 - DNA, 25 bp, Mus musculus
caagaagttcccttgtgcacagact

SEQ ID NO: 550022 - DNA, 25 bp, Mus musculus
caagaagttctaaaatacctgcgca

SEQ ID NO: 550023 - DNA, 25 bp, Mus musculus
caagaagttctataatacctgcgca

SEQ ID NO: 550024 - DNA, 25 bp, Mus musculus
caagaagttgtaccggcccttccag

SEQ ID NO: 550025 - DNA, 25 bp, Mus musculus
caagaagttgtagcggcccttccag

SEQ ID NO: 550026 - DNA, 25 bp, Mus musculus
caagaagttgtgagacttcaagtca

SEQ ID NO: 550027 - DNA, 25 bp, Mus musculus
caagaagttgtgtgacttcaagtca

SEQ ID NO: 550028 - DNA, 25 bp, Mus musculus
caagaagtttccaggcataaggccc

SEQ ID NO: 550029 - DNA, 25 bp, Mus musculus
caagaagtttcctggcataaggccc

SEQ ID NO: 550030 - DNA, 25 bp, Mus musculus
caagaagtttgtcatggtgaaattc

SEQ ID NO: 550031 - DNA, 25 bp, Mus musculus
caagaagtttgtgatggtgaaattc

SEQ ID NO: 550032 - DNA, 25 bp, Mus musculus
caagaatacagcaggaaggaaccgg

SEQ ID NO: 550033 - DNA, 25 bp, Mus musculus
caagaatacagctggaaggaaccgg

SEQ ID NO: 550034 - DNA, 25 bp, Mus musculus
caagaatacctgctttgtcacacaa

SEQ ID NO: 550035 - DNA, 25 bp, Mus musculus
caagaatacctggtttgtcacacaa

SEQ ID NO: 550036 - DNA, 25 bp, Mus musculus
caagaatactctactagatttggac

SEQ ID NO: 550037 - DNA, 25 bp, Mus musculus
caagaatactcttctagatttggac

SEQ ID NO: 550038 - DNA, 25 bp, Mus musculus
caagaatagagaactgggttatgca

SEQ ID NO: 550039 - DNA, 25 bp, Mus musculus
caagaatagagatctgggttatgca

SEQ ID NO: 550040 - DNA, 25 bp, Mus musculus
caagaatagcaaagagtcgggagac

SEQ ID NO: 550041 - DNA, 25 bp, Mus musculus
caagaatagcaatgagtcgggagac

SEQ ID NO: 550042 - DNA, 25 bp, Mus musculus
caagaatagtcactgatcgggaaac

SEQ ID NO: 550043 - DNA, 25 bp, Mus musculus
caagaatagtcagtgatcgggaaac

SEQ ID NO: 550044 - DNA, 25 bp, Mus musculus
caagaatccaatcgatcgtgttcac

SEQ ID NO: 550045 - DNA, 25 bp, Mus musculus
caagaatccaatggatcgtgttcac

SEQ ID NO: 550046 - DNA, 25 bp, Mus musculus
caagaatcccatagtcttccagccg

SEQ ID NO: 550047 - DNA, 25 bp, Mus musculus
caagaatcccattgtcttccagccg

SEQ ID NO: 550048 - DNA, 25 bp, Mus musculus
caagaatccccacaacatcagagtt

SEQ ID NO: 550049 - DNA, 25 bp, Mus musculus
caagaatccccagaacatcagagtt

SEQ ID NO: 550050 - DNA, 25 bp, Mus musculus
caagaatcctgcctgctcctgaatc

SEQ ID NO: 550051 - DNA, 25 bp, Mus musculus
caagaatcctgcgtgctcctgaatc

SEQ ID NO: 550052 - DNA, 25 bp, Mus musculus
caagaatcctgtcagtcccctgatg

SEQ ID NO: 550053 - DNA, 25 bp, Mus musculus
caagaatcctgtgagtcccctgatg

SEQ ID NO: 550054 - DNA, 25 bp, Mus musculus
caagaatccttcagctaagccaaga

SEQ ID NO: 550055 - DNA, 25 bp, Mus musculus
caagaatccttctgctaagccaaga

SEQ ID NO: 550056 - DNA, 25 bp, Mus musculus
caagaatcgctaacatagccatgac

SEQ ID NO: 550057 - DNA, 25 bp, Mus musculus
caagaatcgctatcatagccatgac

SEQ ID NO: 550058 - DNA, 25 bp, Mus musculus
caagaatctaaaacattgagccctg

SEQ ID NO: 550059 - DNA, 25 bp, Mus musculus
caagaatctaaatcattgagccctg

SEQ ID NO: 550060 - DNA, 25 bp, Mus musculus
caagaatgagctcctgaccatgtac

SEQ ID NO: 550061 - DNA, 25 bp, Mus musculus
caagaatgagctgctgaccatgtac

SEQ ID NO: 550062 - DNA, 25 bp, Mus musculus
caagaatgcagacaagtcaactggt

SEQ ID NO: 550063 - DNA, 25 bp, Mus musculus
caagaatgcagagaagtcaactggt

SEQ ID NO: 550064 - DNA, 25 bp, Mus musculus
caagaatgcattacccttgggtgct

SEQ ID NO: 550065 - DNA, 25 bp, Mus musculus
caagaatgcatttcccttgggtgct

SEQ ID NO: 550066 - DNA, 25 bp, Mus musculus
caagaatgccgaaggaactgtcaga

SEQ ID NO: 550067 - DNA, 25 bp, Mus musculus
caagaatgccgatggaactgtcaga

SEQ ID NO: 550068 - DNA, 25 bp, Mus musculus
caagaatgctacagatcccgaatcg

SEQ ID NO: 550069 - DNA, 25 bp, Mus musculus
caagaatgctactgatcccgaatcg

SEQ ID NO: 550070 - DNA, 25 bp, Mus musculus
caagaatggattcttatcgcttata

SEQ ID NO: 550071 - DNA, 25 bp, Mus musculus
caagaatggattgttatcgcttata

SEQ ID NO: 550072 - DNA, 25 bp, Mus musculus
caagaatggcttagtctacatgaag

SEQ ID NO: 550073 - DNA, 25 bp, Mus musculus
caagaatggctttgtctacatgaag

SEQ ID NO: 550074 - DNA, 25 bp, Mus musculus
caagaatgggagaggcaatgctatc

SEQ ID NO: 550075 - DNA, 25 bp, Mus musculus
caagaatgggagtggcaatgctatc

SEQ ID NO: 550076 - DNA, 25 bp, Mus musculus
caagaatggttcaaaacaaatctac

SEQ ID NO: 550077 - DNA, 25 bp, Mus musculus
caagaatggttcatcccaggaagcc

SEQ ID NO: 550078 - DNA, 25 bp, Mus musculus
caagaatggttctaaacaaatctac

SEQ ID NO: 550079 - DNA, 25 bp, Mus musculus
caagaatggttcttcccaggaagcc

SEQ ID NO: 550080 - DNA, 25 bp, Mus musculus
caagaatgtcgtcgcagccacttca

SEQ ID NO: 550081 - DNA, 25 bp, Mus musculus
caagaatgtcgtggcagccacttca

SEQ ID NO: 550082 - DNA, 25 bp, Mus musculus
caagaatgtctacccactctgctca

SEQ ID NO: 550083 - DNA, 25 bp, Mus musculus
caagaatgtctagccactctgctca

SEQ ID NO: 550084 - DNA, 25 bp, Mus musculus
caagaatgtcttctatgacaacggc

SEQ ID NO: 550085 - DNA, 25 bp, Mus musculus
caagaatgtcttgtatgacaacggc

SEQ ID NO: 550086 - DNA, 25 bp, Mus musculus
caagaatgttaaactttccagtggc

SEQ ID NO: 550087 - DNA, 25 bp, Mus musculus
caagaatgttaatctttccagtggc

SEQ ID NO: 550088 - DNA, 25 bp, Mus musculus
caagaattaacacggaagctcccgg

SEQ ID NO: 550089 - DNA, 25 bp, Mus musculus
caagaattaacagggaagctcccgg

SEQ ID NO: 550090 - DNA, 25 bp, Mus musculus
caagaattcaggcatgaggagactg

SEQ ID NO: 550091 - DNA, 25 bp, Mus musculus
caagaattcagggatgaggagactg

SEQ ID NO: 550092 - DNA, 25 bp, Mus musculus
caagaattccaccttctcggagctc

SEQ ID NO: 550093 - DNA, 25 bp, Mus musculus
caagaattccacgttctcggagctc

SEQ ID NO: 550094 - DNA, 25 bp, Mus musculus
caagaattccttcgagacggtgggc

SEQ ID NO: 550095 - DNA, 25 bp, Mus musculus
caagaattccttggagacggtgggc

SEQ ID NO: 550096 - DNA, 25 bp, Mus musculus
caagaattcggacaatgattggttc

SEQ ID NO: 550097 - DNA, 25 bp, Mus musculus
caagaattcggagaatgattggttc

SEQ ID NO: 550098 - DNA, 25 bp, Mus musculus
caagaattgcagctggaaccatgtg

SEQ ID NO: 550099 - DNA, 25 bp, Mus musculus
caagaattgcaggtggaaccatgtg

SEQ ID NO: 550100 - DNA, 25 bp, Mus musculus
caagaatttaaacacatcagaagag

SEQ ID NO: 550101 - DNA, 25 bp, Mus musculus
caagaatttaaagacatcagaagag

SEQ ID NO: 550102 - DNA, 25 bp, Mus musculus
caagaatttacaatctgcgaaagaa

SEQ ID NO: 550103 - DNA, 25 bp, Mus musculus
caagaatttacattctgcgaaagaa

SEQ ID NO: 550104 - DNA, 25 bp, Mus musculus
caagaatttcacagacgtccaccct

SEQ ID NO: 550105 - DNA, 25 bp, Mus musculus
caagaatttcactgacgtccaccct

SEQ ID NO: 550106 - DNA, 25 bp, Mus musculus
caagaatttgaactacagaatgacg

SEQ ID NO: 550107 - DNA, 25 bp, Mus musculus
caagaatttgaagtacagaatgacg

SEQ ID NO: 550108 - DNA, 25 bp, Mus musculus
caagaatttgcgaccgccttcttca

SEQ ID NO: 550109 - DNA, 25 bp, Mus musculus
caagaatttgcgtccgccttcttca

SEQ ID NO: 550110 - DNA, 25 bp, Mus musculus
caagacaaaagacgtccattgtggt

SEQ ID NO: 550111 - DNA, 25 bp, Mus musculus
caagacaaaagaggtccattgtggt

SEQ ID NO: 550112 - DNA, 25 bp, Mus musculus
caagacaaacctctacatccgaggc

SEQ ID NO: 550113 - DNA, 25 bp, Mus musculus
caagacaaacctgtacatccgaggc

SEQ ID NO: 550114 - DNA, 25 bp, Mus musculus
caagacaaagaacttggagatggaa

SEQ ID NO: 550115 - DNA, 25 bp, Mus musculus
caagacaaagaagttggagatggaa

SEQ ID NO: 550116 - DNA, 25 bp, Mus musculus
caagacaacaaacatgttaccacag

SEQ ID NO: 550117 - DNA, 25 bp, Mus musculus
caagacaacaaagatgttaccacag

SEQ ID NO: 550118 - DNA, 25 bp, Mus musculus
caagacaacagtagcagtcagacaa

SEQ ID NO: 550119 - DNA, 25 bp, Mus musculus
caagacaacagttgcagtcagacaa

SEQ ID NO: 550120 - DNA, 25 bp, Mus musculus
caagacaagcggagaccagagttct

SEQ ID NO: 550121 - DNA, 25 bp, Mus musculus
caagacaagcggtgaccagagttct

SEQ ID NO: 550122 - DNA, 25 bp, Mus musculus
caagacaagtgcagaaccctataga

SEQ ID NO: 550123 - DNA, 25 bp, Mus musculus
caagacaagtgctgaaccctataga

SEQ ID NO: 550124 - DNA, 25 bp, Mus musculus
caagacaagtttccatgcagccagg

SEQ ID NO: 550125 - DNA, 25 bp, Mus musculus
caagacaagtttgcatgcagccagg

SEQ ID NO: 550126 - DNA, 25 bp, Mus musculus
caagacacaaacatggctggacagc

SEQ ID NO: 550127 - DNA, 25 bp, Mus musculus
caagacacaaacttggctggacagc

SEQ ID NO: 550128 - DNA, 25 bp, Mus musculus
caagacacaaagaaaaccatccagt

SEQ ID NO: 550129 - DNA, 25 bp, Mus musculus
caagacacaaagtaaaccatccagt

SEQ ID NO: 550130 - DNA, 25 bp, Mus musculus
caagacacactgcagaacaaaggga

SEQ ID NO: 550131 - DNA, 25 bp, Mus musculus
caagacacactggagaacaaaggga

SEQ ID NO: 550132 - DNA, 25 bp, Mus musculus
caagacaccttgacatttgctctaa

SEQ ID NO: 550133 - DNA, 25 bp, Mus musculus
caagacaccttgtcatttgctctaa

SEQ ID NO: 550134 - DNA, 25 bp, Mus musculus
caagacacgtgtcgcaagttgccct

SEQ ID NO: 550135 - DNA, 25 bp, Mus musculus
caagacacgtgtggcaagttgccct

SEQ ID NO: 550136 - DNA, 25 bp, Mus musculus
caagacactcagcagctcctcgagt

SEQ ID NO: 550137 - DNA, 25 bp, Mus musculus
caagacactcaggagctcctcgagt

SEQ ID NO: 550138 - DNA, 25 bp, Mus musculus
caagacagaaggctactcaggagca

SEQ ID NO: 550139 - DNA, 25 bp, Mus musculus
caagacagaagggtactcaggagca

SEQ ID NO: 550140 - DNA, 25 bp, Mus musculus
caagacagaattatcccagtgccaa

SEQ ID NO: 550141 - DNA, 25 bp, Mus musculus
caagacagaattttcccagtgccaa

SEQ ID NO: 550142 - DNA, 25 bp, Mus musculus
caagacagctgtatatccatgcggc

SEQ ID NO: 550143 - DNA, 25 bp, Mus musculus
caagacagctgtttatccatgcggc

SEQ ID NO: 550144 - DNA, 25 bp, Mus musculus
caagacagctttccagccggtgcca

SEQ ID NO: 550145 - DNA, 25 bp, Mus musculus
caagacagctttgcagccggtgcca

SEQ ID NO: 550146 - DNA, 25 bp, Mus musculus
caagacaggaatagttgtcaacaat

SEQ ID NO: 550147 - DNA, 25 bp, Mus musculus
caagacaggaattgttgtcaacaat

SEQ ID NO: 550148 - DNA, 25 bp, Mus musculus
caagacaggcgacacccagagtctt

SEQ ID NO: 550149 - DNA, 25 bp, Mus musculus
caagacaggcgagacccagagtctt

SEQ ID NO: 550150 - DNA, 25 bp, Mus musculus
caagacaggcttcgagcttctgcaa

SEQ ID NO: 550151 - DNA, 25 bp, Mus musculus
caagacaggcttctcaaatggatgc

SEQ ID NO: 550152 - DNA, 25 bp, Mus musculus
caagacaggcttggagcttctgcaa

SEQ ID NO: 550153 - DNA, 25 bp, Mus musculus
caagacaggcttgtcaaatggatgc

SEQ ID NO: 550154 - DNA, 25 bp, Mus musculus
caagacagtcttaatacagtgtcca

SEQ ID NO: 550155 - DNA, 25 bp, Mus musculus
caagacagtctttatacagtgtcca

SEQ ID NO: 550156 - DNA, 25 bp, Mus musculus
caagacagtgccaaccagagcatcg

SEQ ID NO: 550157 - DNA, 25 bp, Mus musculus
caagacagtgcctaccagagcatcg

SEQ ID NO: 550158 - DNA, 25 bp, Mus musculus
caagacagtggcagaagctctgggt

SEQ ID NO: 550159 - DNA, 25 bp, Mus musculus
caagacagtggctgaagctctgggt

SEQ ID NO: 550160 - DNA, 25 bp, Mus musculus
caagacataaagacagccgggcctc

SEQ ID NO: 550161 - DNA, 25 bp, Mus musculus
caagacataaagtcagccgggcctc

SEQ ID NO: 550162 - DNA, 25 bp, Mus musculus
caagacataaatagctcagtgcaga

SEQ ID NO: 550163 - DNA, 25 bp, Mus musculus
caagacataaattgctcagtgcaga

SEQ ID NO: 550164 - DNA, 25 bp, Mus musculus
caagacataaggaatggcgacccca

SEQ ID NO: 550165 - DNA, 25 bp, Mus musculus
caagacataaggtatggcgacccca

SEQ ID NO: 550166 - DNA, 25 bp, Mus musculus
caagacatccagctcatgctcaagt

SEQ ID NO: 550167 - DNA, 25 bp, Mus musculus
caagacatccaggtcatgctcaagt

SEQ ID NO: 550168 - DNA, 25 bp, Mus musculus
caagacatctgacaggctggagaca

SEQ ID NO: 550169 - DNA, 25 bp, Mus musculus
caagacatctgagaggctggagaca

SEQ ID NO: 550170 - DNA, 25 bp, Mus musculus
caagacatggagagtgtgccctgcg

SEQ ID NO: 550171 - DNA, 25 bp, Mus musculus
caagacatggagtgtgtgccctgcg

SEQ ID NO: 550172 - DNA, 25 bp, Mus musculus
caagacatggccctgattgcaccca

SEQ ID NO: 550173 - DNA, 25 bp, Mus musculus
caagacatggccgtgattgcaccca

SEQ ID NO: 550174 - DNA, 25 bp, Mus musculus
caagacattgctatctttgatgcca

SEQ ID NO: 550175 - DNA, 25 bp, Mus musculus
caagacattgctttctttgatgcca

SEQ ID NO: 550176 - DNA, 25 bp, Mus musculus
caagaccaactcagcccagtgggaa

SEQ ID NO: 550177 - DNA, 25 bp, Mus musculus
caagaccaactctgcccagtgggaa

SEQ ID NO: 550178 - DNA, 25 bp, Mus musculus
caagaccagaaaatcttgggtccct

SEQ ID NO: 550179 - DNA, 25 bp, Mus musculus
caagaccagaaattcttgggtccct

SEQ ID NO: 550180 - DNA, 25 bp, Mus musculus
caagaccagagcatccgcatccaga

SEQ ID NO: 550181 - DNA, 25 bp, Mus musculus
caagaccagagcttccgcatccaga

SEQ ID NO: 550182 - DNA, 25 bp, Mus musculus
caagacccaaggctgtcatgagcag

SEQ ID NO: 550183 - DNA, 25 bp, Mus musculus
caagacccaagggtgtcatgagcag

SEQ ID NO: 550184 - DNA, 25 bp, Mus musculus
caagacccacaaagctgtgtgcatc

SEQ ID NO: 550185 - DNA, 25 bp, Mus musculus
caagacccacaatgctgtgtgcatc

SEQ ID NO: 550186 - DNA, 25 bp, Mus musculus
caagacccacatccaggagtgcaaa

SEQ ID NO: 550187 - DNA, 25 bp, Mus musculus
caagacccacatgcaggagtgcaaa

SEQ ID NO: 550188 - DNA, 25 bp, Mus musculus
caagacccatgaactgtacatccag

SEQ ID NO: 550189 - DNA, 25 bp, Mus musculus
caagacccatgatctgtacatccag

SEQ ID NO: 550190 - DNA, 25 bp, Mus musculus
caagaccccactcaaggagcgtgta

SEQ ID NO: 550191 - DNA, 25 bp, Mus musculus
caagaccccactgaaggagcgtgta

SEQ ID NO: 550192 - DNA, 25 bp, Mus musculus
caagaccccgctacaataatgttca

SEQ ID NO: 550193 - DNA, 25 bp, Mus musculus
caagaccccgcttcaataatgttca

SEQ ID NO: 550194 - DNA, 25 bp, Mus musculus
caagaccctcggagacacgagggta

SEQ ID NO: 550195 - DNA, 25 bp, Mus musculus
caagaccctcggtgacacgagggta

SEQ ID NO: 550196 - DNA, 25 bp, Mus musculus
caagaccctttaactaccaggagtg

SEQ ID NO: 550197 - DNA, 25 bp, Mus musculus
caagaccctttatctaccaggagtg

SEQ ID NO: 550198 - DNA, 25 bp, Mus musculus
caagaccgagtacctgtttccacag

SEQ ID NO: 550199 - DNA, 25 bp, Mus musculus
caagaccgagtagctgtttccacag

SEQ ID NO: 550200 - DNA, 25 bp, Mus musculus
caagaccggcctcaagtcggacaag

SEQ ID NO: 550201 - DNA, 25 bp, Mus musculus
caagaccggcctgaagtcggacaag

SEQ ID NO: 550202 - DNA, 25 bp, Mus musculus
caagaccgtggcctatttctacgac

SEQ ID NO: 550203 - DNA, 25 bp, Mus musculus
caagaccgtggcgtatttctacgac

SEQ ID NO: 550204 - DNA, 25 bp, Mus musculus
caagaccgtgtgaatacacctgtgt

SEQ ID NO: 550205 - DNA, 25 bp, Mus musculus
caagaccgtgtgtatacacctgtgt

SEQ ID NO: 550206 - DNA, 25 bp, Mus musculus
caagacctacctaatcagtcgctgt

SEQ ID NO: 550207 - DNA, 25 bp, Mus musculus
caagacctaccttatcagtcgctgt

SEQ ID NO: 550208 - DNA, 25 bp, Mus musculus
caagacctactcagagttctgcagc

SEQ ID NO: 550209 - DNA, 25 bp, Mus musculus
caagacctactctgagttctgcagc

SEQ ID NO: 550210 - DNA, 25 bp, Mus musculus
caagacctactgcacgctgtgtggg

SEQ ID NO: 550211 - DNA, 25 bp, Mus musculus
caagacctactggacgctgtgtggg

SEQ ID NO: 550212 - DNA, 25 bp, Mus musculus
caagacctacttcgatcttatcttc

SEQ ID NO: 550213 - DNA, 25 bp, Mus musculus
caagacctacttggatcttatcttc

SEQ ID NO: 550214 - DNA, 25 bp, Mus musculus
caagacctctggaaagatgggtcct

SEQ ID NO: 550215 - DNA, 25 bp, Mus musculus
caagacctctggtaagatgggtcct

SEQ ID NO: 550216 - DNA, 25 bp, Mus musculus
caagacctgccaccattggatatca

SEQ ID NO: 550217 - DNA, 25 bp, Mus musculus
caagacctgccagcattggatatca

SEQ ID NO: 550218 - DNA, 25 bp, Mus musculus
caagacctggccactgctgagatgt

SEQ ID NO: 550219 - DNA, 25 bp, Mus musculus
caagacctggcctctgctgagatgt

SEQ ID NO: 550220 - DNA, 25 bp, Mus musculus
caagaccttcagctccaaaagcgag

SEQ ID NO: 550221 - DNA, 25 bp, Mus musculus
caagaccttcaggtccaaaagcgag

SEQ ID NO: 550222 - DNA, 25 bp, Mus musculus
caagaccttcgtagaaaaatatgag

SEQ ID NO: 550223 - DNA, 25 bp, Mus musculus
caagaccttcgttgaaaaatatgag

SEQ ID NO: 550224 - DNA, 25 bp, Mus musculus
caagacctttggagtaattgagagt

SEQ ID NO: 550225 - DNA, 25 bp, Mus musculus
caagacctttggtgtaattgagagt

SEQ ID NO: 550226 - DNA, 25 bp, Mus musculus
caagacgaagcgagcgacgctctca

SEQ ID NO: 550227 - DNA, 25 bp, Mus musculus
caagacgaagcgtgcgacgctctca

SEQ ID NO: 550228 - DNA, 25 bp, Mus musculus
caagacgagcagctgtatgcggcct

SEQ ID NO: 550229 - DNA, 25 bp, Mus musculus
caagacgagcaggtgtatgcggcct

SEQ ID NO: 550230 - DNA, 25 bp, Mus musculus
caagacgagcctcgtggaacgatac

SEQ ID NO: 550231 - DNA, 25 bp, Mus musculus
caagacgagcctggtggaacgatac

SEQ ID NO: 550232 - DNA, 25 bp, Mus musculus
caagacgcaatgaatgattcaatgg

SEQ ID NO: 550233 - DNA, 25 bp, Mus musculus
caagacgcaatgtatgattcaatgg

SEQ ID NO: 550234 - DNA, 25 bp, Mus musculus
caagacgcacctccaaagaagaagt

SEQ ID NO: 550235 - DNA, 25 bp, Mus musculus
caagacgcacctgcaaagaagaagt

SEQ ID NO: 550236 - DNA, 25 bp, Mus musculus
caagacgcaggcactggacatgaag

SEQ ID NO: 550237 - DNA, 25 bp, Mus musculus
caagacgcaggctctggacatgaag

SEQ ID NO: 550238 - DNA, 25 bp, Mus musculus
caagacgcgcaacggcgttcagtgc

SEQ ID NO: 550239 - DNA, 25 bp, Mus musculus
caagacgcgcaagggcgttcagtgc

SEQ ID NO: 550240 - DNA, 25 bp, Mus musculus
caagacgctgctcagttactcggag

SEQ ID NO: 550241 - DNA, 25 bp, Mus musculus
caagacgctgctgagttactcggag

SEQ ID NO: 550242 - DNA, 25 bp, Mus musculus
caagacgctgttcagttaagacccc

SEQ ID NO: 550243 - DNA, 25 bp, Mus musculus
caagacgctgttgagttaagacccc

SEQ ID NO: 550244 - DNA, 25 bp, Mus musculus
caagacggccagatcagggtgatgc

SEQ ID NO: 550245 - DNA, 25 bp, Mus musculus
caagacggccagttcagggtgatgc

SEQ ID NO: 550246 - DNA, 25 bp, Mus musculus
caagacggtcatagctatcgactac

SEQ ID NO: 550247 - DNA, 25 bp, Mus musculus
caagacggtcattgctatcgactac

SEQ ID NO: 550248 - DNA, 25 bp, Mus musculus
caagacggtctaccgacatgacaag

SEQ ID NO: 550249 - DNA, 25 bp, Mus musculus
caagacggtctagcgacatgacaag

SEQ ID NO: 550250 - DNA, 25 bp, Mus musculus
caagacgtcggacaaaaaagctggg

SEQ ID NO: 550251 - DNA, 25 bp, Mus musculus
caagacgtcggagaaaaaagctggg

SEQ ID NO: 550252 - DNA, 25 bp, Mus musculus
caagacgtctctcgacatcaataag

SEQ ID NO: 550253 - DNA, 25 bp, Mus musculus
caagacgtctctggacatcaataag

SEQ ID NO: 550254 - DNA, 25 bp, Mus musculus
caagacgtggctactaaagtgttcc

SEQ ID NO: 550255 - DNA, 25 bp, Mus musculus
caagacgtggcttctaaagtgttcc

SEQ ID NO: 550256 - DNA, 25 bp, Mus musculus
caagacgtggtacctcagctcacga

SEQ ID NO: 550257 - DNA, 25 bp, Mus musculus
caagacgtggtagctcagctcacga

SEQ ID NO: 550258 - DNA, 25 bp, Mus musculus
caagacgttttaagctgacagagga

SEQ ID NO: 550259 - DNA, 25 bp, Mus musculus
caagacgttttatgctgacagagga

SEQ ID NO: 550260 - DNA, 25 bp, Mus musculus
caagactatgatcaagaaagctcag

SEQ ID NO: 550261 - DNA, 25 bp, Mus musculus
caagactatgatgaagaaagctcag

SEQ ID NO: 550262 - DNA, 25 bp, Mus musculus
caagactatgcaatgatgggtaccc

SEQ ID NO: 550263 - DNA, 25 bp, Mus musculus
caagactatgcattgatgggtaccc

SEQ ID NO: 550264 - DNA, 25 bp, Mus musculus
caagactccccacggacgagagtat

SEQ ID NO: 550265 - DNA, 25 bp, Mus musculus
caagactccccagggacgagagtat

SEQ ID NO: 550266 - DNA, 25 bp, Mus musculus
caagactcctgcctgtatgagtgct

SEQ ID NO: 550267 - DNA, 25 bp, Mus musculus
caagactcctgcgtgtatgagtgct

SEQ ID NO: 550268 - DNA, 25 bp, Mus musculus
caagactctagcaagactgttgtgg

SEQ ID NO: 550269 - DNA, 25 bp, Mus musculus
caagactctagctagactgttgtgg

SEQ ID NO: 550270 - DNA, 25 bp, Mus musculus
caagactctaggacctgctctgctg

SEQ ID NO: 550271 - DNA, 25 bp, Mus musculus
caagactctaggtcctgctctgctg

SEQ ID NO: 550272 - DNA, 25 bp, Mus musculus
caagactgacttagagcgggccaag

SEQ ID NO: 550273 - DNA, 25 bp, Mus musculus
caagactgactttgagcgggccaag

SEQ ID NO: 550274 - DNA, 25 bp, Mus musculus
caagactgagacatacgtggaggca

SEQ ID NO: 550275 - DNA, 25 bp, Mus musculus
caagactgagacttacgtggaggca

SEQ ID NO: 550276 - DNA, 25 bp, Mus musculus
caagactgataacctggtgcataca

SEQ ID NO: 550277 - DNA, 25 bp, Mus musculus
caagactgataagctggtgcataca

SEQ ID NO: 550278 - DNA, 25 bp, Mus musculus
caagactgcagacactggagtgacg

SEQ ID NO: 550279 - DNA, 25 bp, Mus musculus
caagactgcagagactggagtgacg

SEQ ID NO: 550280 - DNA, 25 bp, Mus musculus
caagactgcagtacatcttgagcca

SEQ ID NO: 550281 - DNA, 25 bp, Mus musculus
caagactgcagttcatcttgagcca

SEQ ID NO: 550282 - DNA, 25 bp, Mus musculus
caagactgctggcaacgtacttctg

SEQ ID NO: 550283 - DNA, 25 bp, Mus musculus
caagactgctgggaacgtacttctg

SEQ ID NO: 550284 - DNA, 25 bp, Mus musculus
caagactgggtcattgatgactgca

SEQ ID NO: 550285 - DNA, 25 bp, Mus musculus
caagactgggtctttgatgactgca

SEQ ID NO: 550286 - DNA, 25 bp, Mus musculus
caagactgggtgactgccacagata

SEQ ID NO: 550287 - DNA, 25 bp, Mus musculus
caagactgggtgtctgccacagata

SEQ ID NO: 550288 - DNA, 25 bp, Mus musculus
caagactggtggcacccagactgac

SEQ ID NO: 550289 - DNA, 25 bp, Mus musculus
caagactggtgggacccagactgac

SEQ ID NO: 550290 - DNA, 25 bp, Mus musculus
caagactgtcacattagtggaggcc

SEQ ID NO: 550291 - DNA, 25 bp, Mus musculus
caagactgtcactttagtggaggcc

SEQ ID NO: 550292 - DNA, 25 bp, Mus musculus
caagactgtctgacttcaagcaagt

SEQ ID NO: 550293 - DNA, 25 bp, Mus musculus
caagactgtctgtcttcaagcaagt

SEQ ID NO: 550294 - DNA, 25 bp, Mus musculus
caagactgtgaacccctaggcgaga

SEQ ID NO: 550295 - DNA, 25 bp, Mus musculus
caagactgtgaagccctaggcgaga

SEQ ID NO: 550296 - DNA, 25 bp, Mus musculus
caagactgtggcagatcttcaggga

SEQ ID NO: 550297 - DNA, 25 bp, Mus musculus
caagactgtggctgatcttcaggga

SEQ ID NO: 550298 - DNA, 25 bp, Mus musculus
caagactgtgtcaaggaaattggtc

SEQ ID NO: 550299 - DNA, 25 bp, Mus musculus
caagactgtgtctaggaaattggtc

SEQ ID NO: 550300 - DNA, 25 bp, Mus musculus
caagacttagaccttttgtaactca

SEQ ID NO: 550301 - DNA, 25 bp, Mus musculus
caagacttagacgttttgtaactca

SEQ ID NO: 550302 - DNA, 25 bp, Mus musculus
caagacttctaacgcaccaacaggt

SEQ ID NO: 550303 - DNA, 25 bp, Mus musculus
caagacttctaaggcaccaacaggt

SEQ ID NO: 550304 - DNA, 25 bp, Mus musculus
caagacttctgaactgctatcaggc

SEQ ID NO: 550305 - DNA, 25 bp, Mus musculus
caagacttctgatctgctatcaggc

SEQ ID NO: 550306 - DNA, 25 bp, Mus musculus
caagacttgtggactgtgaacggcc

SEQ ID NO: 550307 - DNA, 25 bp, Mus musculus
caagacttgtggtctgtgaacggcc

SEQ ID NO: 550308 - DNA, 25 bp, Mus musculus
caagactttgatagcaatgtgtcca

SEQ ID NO: 550309 - DNA, 25 bp, Mus musculus
caagactttgattgcaatgtgtcca

SEQ ID NO: 550310 - DNA, 25 bp, Mus musculus
caagactttggtcgacaaatggcct

SEQ ID NO: 550311 - DNA, 25 bp, Mus musculus
caagactttggtggacaaatggcct

SEQ ID NO: 550312 - DNA, 25 bp, Mus musculus
caagagaaaaaccagcccaaggtgc

SEQ ID NO: 550313 - DNA, 25 bp, Mus musculus
caagagaaaaacgagcccaaggtgc

SEQ ID NO: 550314 - DNA, 25 bp, Mus musculus
caagagaaaagcactagaagagacc

SEQ ID NO: 550315 - DNA, 25 bp, Mus musculus
caagagaaaagctctagaagagacc

SEQ ID NO: 550316 - DNA, 25 bp, Mus musculus
caagagaaacaccagagctgtgatg

SEQ ID NO: 550317 - DNA, 25 bp, Mus musculus
caagagaaacacgagagctgtgatg

SEQ ID NO: 550318 - DNA, 25 bp, Mus musculus
caagagaaacatcagtcaggtgaag

SEQ ID NO: 550319 - DNA, 25 bp, Mus musculus
caagagaaacatgagtcaggtgaag

SEQ ID NO: 550320 - DNA, 25 bp, Mus musculus
caagagaaatcacagtggtgtgaat

SEQ ID NO: 550321 - DNA, 25 bp, Mus musculus
caagagaaatcagagtggtgtgaat

SEQ ID NO: 550322 - DNA, 25 bp, Mus musculus
caagagaacaatatcttgctgctca

SEQ ID NO: 550323 - DNA, 25 bp, Mus musculus
caagagaacaatttcttgctgctca

SEQ ID NO: 550324 - DNA, 25 bp, Mus musculus
caagagaacatcatctgggctaacc

SEQ ID NO: 550325 - DNA, 25 bp, Mus musculus
caagagaacatcttctgggctaacc

SEQ ID NO: 550326 - DNA, 25 bp, Mus musculus
caagagaactctccctcgggaaggt

SEQ ID NO: 550327 - DNA, 25 bp, Mus musculus
caagagaactctgcctcgggaaggt

SEQ ID NO: 550328 - DNA, 25 bp, Mus musculus
caagagaagatcctgcttgcagctc

SEQ ID NO: 550329 - DNA, 25 bp, Mus musculus
caagagaagatcgtgcttgcagctc

SEQ ID NO: 550330 - DNA, 25 bp, Mus musculus
caagagaaggcaatgtgcccaatat

SEQ ID NO: 550331 - DNA, 25 bp, Mus musculus
caagagaaggcattgtgcccaatat

SEQ ID NO: 550332 - DNA, 25 bp, Mus musculus
caagagaaggcccttgttttccagg

SEQ ID NO: 550333 - DNA, 25 bp, Mus musculus
caagagaaggccgttgttttccagg

SEQ ID NO: 550334 - DNA, 25 bp, Mus musculus
caagagaagtatcttggaaatccca

SEQ ID NO: 550335 - DNA, 25 bp, Mus musculus
caagagaagtatgttggaaatccca

SEQ ID NO: 550336 - DNA, 25 bp, Mus musculus
caagagaattaacatcacagccacc

SEQ ID NO: 550337 - DNA, 25 bp, Mus musculus
caagagaattaagatcacagccacc

SEQ ID NO: 550338 - DNA, 25 bp, Mus musculus
caagagaattgtagtgaaactcggc

SEQ ID NO: 550339 - DNA, 25 bp, Mus musculus
caagagaattgttgtgaaactcggc

SEQ ID NO: 550340 - DNA, 25 bp, Mus musculus
caagagacaactctcaccaggaggc

SEQ ID NO: 550341 - DNA, 25 bp, Mus musculus
caagagacaactgtcaccaggaggc

SEQ ID NO: 550342 - DNA, 25 bp, Mus musculus
caagagacatacaagaaagtgatga

SEQ ID NO: 550343 - DNA, 25 bp, Mus musculus
caagagacatactagaaagtgatga

SEQ ID NO: 550344 - DNA, 25 bp, Mus musculus
caagagaccactcggaatgttatct

SEQ ID NO: 550345 - DNA, 25 bp, Mus musculus
caagagaccactgggaatgttatct

SEQ ID NO: 550346 - DNA, 25 bp, Mus musculus
caagagaccagtcccaggatttcca

SEQ ID NO: 550347 - DNA, 25 bp, Mus musculus
caagagaccagtgccaggatttcca

SEQ ID NO: 550348 - DNA, 25 bp, Mus musculus
caagagaccatcatgaattatgagc

SEQ ID NO: 550349 - DNA, 25 bp, Mus musculus
caagagaccatcttgaattatgagc

SEQ ID NO: 550350 - DNA, 25 bp, Mus musculus
caagagaccccactgatgtagagcc

SEQ ID NO: 550351 - DNA, 25 bp, Mus musculus
caagagaccccagtgatgtagagcc

SEQ ID NO: 550352 - DNA, 25 bp, Mus musculus
caagagaccttgaaaaatgccctga

SEQ ID NO: 550353 - DNA, 25 bp, Mus musculus
caagagaccttgtaaaatgccctga

SEQ ID NO: 550354 - DNA, 25 bp, Mus musculus
caagagacgcccagaataaaatgtt

SEQ ID NO: 550355 - DNA, 25 bp, Mus musculus
caagagacgccctgaataaaatgtt

SEQ ID NO: 550356 - DNA, 25 bp, Mus musculus
caagagactgccatggcgaagttac

SEQ ID NO: 550357 - DNA, 25 bp, Mus musculus
caagagactgccttggcgaagttac

SEQ ID NO: 550358 - DNA, 25 bp, Mus musculus
caagagagaaagcacatttgcctac

SEQ ID NO: 550359 - DNA, 25 bp, Mus musculus
caagagagaaaggacatttgcctac

SEQ ID NO: 550360 - DNA, 25 bp, Mus musculus
caagagagaactcgaaagaccagca

SEQ ID NO: 550361 - DNA, 25 bp, Mus musculus
caagagagaactggaaagaccagca

SEQ ID NO: 550362 - DNA, 25 bp, Mus musculus
caagagagaatgatgcagctagtct

SEQ ID NO: 550363 - DNA, 25 bp, Mus musculus
caagagagaatgttgcagctagtct

SEQ ID NO: 550364 - DNA, 25 bp, Mus musculus
caagagagccgtagtctgcagctgc

SEQ ID NO: 550365 - DNA, 25 bp, Mus musculus
caagagagccgttgtctgcagctgc

SEQ ID NO: 550366 - DNA, 25 bp, Mus musculus
caagagagcgccagcttccttgaag

SEQ ID NO: 550367 - DNA, 25 bp, Mus musculus
caagagagcgcctgcttccttgaag

SEQ ID NO: 550368 - DNA, 25 bp, Mus musculus
caagagagctgacccttgtcaacag

SEQ ID NO: 550369 - DNA, 25 bp, Mus musculus
caagagagctgagccttgtcaacag

SEQ ID NO: 550370 - DNA, 25 bp, Mus musculus
caagagaggaaaccggctcaagttc

SEQ ID NO: 550371 - DNA, 25 bp, Mus musculus
caagagaggaaagcggctcaagttc

SEQ ID NO: 550372 - DNA, 25 bp, Mus musculus
caagagaggattagccttacagggc

SEQ ID NO: 550373 - DNA, 25 bp, Mus musculus
caagagaggatttgccttacagggc

SEQ ID NO: 550374 - DNA, 25 bp, Mus musculus
caagagaggtacatccccgaggata

SEQ ID NO: 550375 - DNA, 25 bp, Mus musculus
caagagaggtacttccccgaggata

SEQ ID NO: 550376 - DNA, 25 bp, Mus musculus
caagagaggtataactacaacggcg

SEQ ID NO: 550377 - DNA, 25 bp, Mus musculus
caagagaggtattactacaacggcg

SEQ ID NO: 550378 - DNA, 25 bp, Mus musculus
caagagagtcagctccggaacgaag

SEQ ID NO: 550379 - DNA, 25 bp, Mus musculus
caagagagtcaggtccggaacgaag

SEQ ID NO: 550380 - DNA, 25 bp, Mus musculus
caagagagtcggcaaggataacttc

SEQ ID NO: 550381 - DNA, 25 bp, Mus musculus
caagagagtcgggaaggataacttc

SEQ ID NO: 550382 - DNA, 25 bp, Mus musculus
caagagagtgagatatgcacccagg

SEQ ID NO: 550383 - DNA, 25 bp, Mus musculus
caagagagtgagttatgcacccagg

SEQ ID NO: 550384 - DNA, 25 bp, Mus musculus
caagagagtgctcttatagagctaa

SEQ ID NO: 550385 - DNA, 25 bp, Mus musculus
caagagagtgctgttatagagctaa

SEQ ID NO: 550386 - DNA, 25 bp, Mus musculus
caagagagtgtgaaagaccgagtga

SEQ ID NO: 550387 - DNA, 25 bp, Mus musculus
caagagagtgtgtaagaccgagtga

SEQ ID NO: 550388 - DNA, 25 bp, Mus musculus
caagagatcacccagcactttgctg

SEQ ID NO: 550389 - DNA, 25 bp, Mus musculus
caagagatcaccgagcactttgctg

SEQ ID NO: 550390 - DNA, 25 bp, Mus musculus
caagagatctccattgatttcggtc

SEQ ID NO: 550391 - DNA, 25 bp, Mus musculus
caagagatctcctttgatttcggtc

SEQ ID NO: 550392 - DNA, 25 bp, Mus musculus
caagagatgagacttacaagcccca

SEQ ID NO: 550393 - DNA, 25 bp, Mus musculus
caagagatgagagttacaagcccca

SEQ ID NO: 550394 - DNA, 25 bp, Mus musculus
caagagatgcctctcaagagcgtcc

SEQ ID NO: 550395 - DNA, 25 bp, Mus musculus
caagagatgcctgtcaagagcgtcc

SEQ ID NO: 550396 - DNA, 25 bp, Mus musculus
caagagatgtacaaggaattcccgg

SEQ ID NO: 550397 - DNA, 25 bp, Mus musculus
caagagatgtactaggaattcccgg

SEQ ID NO: 550398 - DNA, 25 bp, Mus musculus
caagagatgtcgatgcaaattcaac

SEQ ID NO: 550399 - DNA, 25 bp, Mus musculus
caagagatgtcgttgcaaattcaac

SEQ ID NO: 550400 - DNA, 25 bp, Mus musculus
caagagatgttgcaaaacctgagtc

SEQ ID NO: 550401 - DNA, 25 bp, Mus musculus
caagagatgttggaaaacctgagtc

SEQ ID NO: 550402 - DNA, 25 bp, Mus musculus
caagagattgacaggatggcactga

SEQ ID NO: 550403 - DNA, 25 bp, Mus musculus
caagagattgactggatggcactga

SEQ ID NO: 550404 - DNA, 25 bp, Mus musculus
caagagattgatcaaaccaatgact

SEQ ID NO: 550405 - DNA, 25 bp, Mus musculus
caagagattgatgaaaccaatgact

SEQ ID NO: 550406 - DNA, 25 bp, Mus musculus
caagagatttctcagtccatcggtg

SEQ ID NO: 550407 - DNA, 25 bp, Mus musculus
caagagatttctgagtccatcggtg

SEQ ID NO: 550408 - DNA, 25 bp, Mus musculus
caagagcacaatacccattaagaga

SEQ ID NO: 550409 - DNA, 25 bp, Mus musculus
caagagcacaattcccattaagaga

SEQ ID NO: 550410 - DNA, 25 bp, Mus musculus
caagagcaccacctttagcacaaga

SEQ ID NO: 550411 - DNA, 25 bp, Mus musculus
caagagcaccacgtttagcacaaga

SEQ ID NO: 550412 - DNA, 25 bp, Mus musculus
caagagcaccccaagctcctgtaag

SEQ ID NO: 550413 - DNA, 25 bp, Mus musculus
caagagcacccctagctcctgtaag

SEQ ID NO: 550414 - DNA, 25 bp, Mus musculus
caagagcagatgaggacgttcaacc

SEQ ID NO: 550415 - DNA, 25 bp, Mus musculus
caagagcagatgtggacgttcaacc

SEQ ID NO: 550416 - DNA, 25 bp, Mus musculus
caagagcagattcaggctctggaga

SEQ ID NO: 550417 - DNA, 25 bp, Mus musculus
caagagcagattgaggctctggaga

SEQ ID NO: 550418 - DNA, 25 bp, Mus musculus
caagagcagttacagtcagcccgga

SEQ ID NO: 550419 - DNA, 25 bp, Mus musculus
caagagcagttagagtcagcccgga

SEQ ID NO: 550420 - DNA, 25 bp, Mus musculus
caagagcatcgaagatacctcaaac

SEQ ID NO: 550421 - DNA, 25 bp, Mus musculus
caagagcatcgatgatacctcaaac

SEQ ID NO: 550422 - DNA, 25 bp, Mus musculus
caagagcattgaaatgtcctgggac

SEQ ID NO: 550423 - DNA, 25 bp, Mus musculus
caagagcattgatatgtcctgggac

SEQ ID NO: 550424 - DNA, 25 bp, Mus musculus
caagagcattggctaaagagaggca

SEQ ID NO: 550425 - DNA, 25 bp, Mus musculus
caagagcattgggtaaagagaggca

SEQ ID NO: 550426 - DNA, 25 bp, Mus musculus
caagagcatttcaaaagggaagaag

SEQ ID NO: 550427 - DNA, 25 bp, Mus musculus
caagagcatttctaaagggaagaag

SEQ ID NO: 550428 - DNA, 25 bp, Mus musculus
caagagccacatcagcaatgaagaa

SEQ ID NO: 550429 - DNA, 25 bp, Mus musculus
caagagccacatgagcaatgaagaa

SEQ ID NO: 550430 - DNA, 25 bp, Mus musculus
caagagcccagaatttgaagaagtg

SEQ ID NO: 550431 - DNA, 25 bp, Mus musculus
caagagcccagattttgaagaagtg

SEQ ID NO: 550432 - DNA, 25 bp, Mus musculus
caagagcccagtaagagaatcccgt

SEQ ID NO: 550433 - DNA, 25 bp, Mus musculus
caagagcccagttagagaatcccgt

SEQ ID NO: 550434 - DNA, 25 bp, Mus musculus
caagagccctgaaacccacagcttg

SEQ ID NO: 550435 - DNA, 25 bp, Mus musculus
caagagccctgatacccacagcttg

SEQ ID NO: 550436 - DNA, 25 bp, Mus musculus
caagagcctcatctaccgtgacgtg

SEQ ID NO: 550437 - DNA, 25 bp, Mus musculus
caagagcctcatgtaccgtgacgtg

SEQ ID NO: 550438 - DNA, 25 bp, Mus musculus
caagagcctggaaaggagaccctgc

SEQ ID NO: 550439 - DNA, 25 bp, Mus musculus
caagagcctggataggagaccctgc

SEQ ID NO: 550440 - DNA, 25 bp, Mus musculus
caagagcctgtaagtggcagaatac

SEQ ID NO: 550441 - DNA, 25 bp, Mus musculus
caagagcctgtatgtggcagaatac

SEQ ID NO: 550442 - DNA, 25 bp, Mus musculus
caagagccttttcaactgcaggatc

SEQ ID NO: 550443 - DNA, 25 bp, Mus musculus
caagagccttttgaactgcaggatc

SEQ ID NO: 550444 - DNA, 25 bp, Mus musculus
caagagcgattaacggatcgtacca

SEQ ID NO: 550445 - DNA, 25 bp, Mus musculus
caagagcgattatcggatcgtacca

SEQ ID NO: 550446 - DNA, 25 bp, Mus musculus
caagagcgccgtcattccggattac

SEQ ID NO: 550447 - DNA, 25 bp, Mus musculus
caagagcgccgtgattccggattac

SEQ ID NO: 550448 - DNA, 25 bp, Mus musculus
caagagcgcctcagtggtggagaca

SEQ ID NO: 550449 - DNA, 25 bp, Mus musculus
caagagcgcctctgtggtggagaca

SEQ ID NO: 550450 - DNA, 25 bp, Mus musculus
caagagcgctgcattttgtgtccaa

SEQ ID NO: 550451 - DNA, 25 bp, Mus musculus
caagagcgctgctttttgtgtccaa

SEQ ID NO: 550452 - DNA, 25 bp, Mus musculus
caagagcgcttcagcgacgggaaca

SEQ ID NO: 550453 - DNA, 25 bp, Mus musculus
caagagcgcttctgcgacgggaaca

SEQ ID NO: 550454 - DNA, 25 bp, Mus musculus
caagagcggcgacgaacgcttgaaa

SEQ ID NO: 550455 - DNA, 25 bp, Mus musculus
caagagcggcgaggaacgcttgaaa

SEQ ID NO: 550456 - DNA, 25 bp, Mus musculus
caagagcgggtcatttgtgcactgt

SEQ ID NO: 550457 - DNA, 25 bp, Mus musculus
caagagcgggtcttttgtgcactgt

SEQ ID NO: 550458 - DNA, 25 bp, Mus musculus
caagagcggttgcttttaccagaag

SEQ ID NO: 550459 - DNA, 25 bp, Mus musculus
caagagcggttggttttaccagaag

SEQ ID NO: 550460 - DNA, 25 bp, Mus musculus
caagagcgttgtccaacaatacctg

SEQ ID NO: 550461 - DNA, 25 bp, Mus musculus
caagagcgttgtgcaacaatacctg

SEQ ID NO: 550462 - DNA, 25 bp, Mus musculus
caagagctacgaattcccctttggg

SEQ ID NO: 550463 - DNA, 25 bp, Mus musculus
caagagctacgatttcccctttggg

SEQ ID NO: 550464 - DNA, 25 bp, Mus musculus
caagagctcggacagaggcggagag

SEQ ID NO: 550465 - DNA, 25 bp, Mus musculus
caagagctcggagagaggcggagag

SEQ ID NO: 550466 - DNA, 25 bp, Mus musculus
caagagctgaagcataccgatctgg

SEQ ID NO: 550467 - DNA, 25 bp, Mus musculus
caagagctgaaggataccgatctgg

SEQ ID NO: 550468 - DNA, 25 bp, Mus musculus
caagagctgcacatgggaggcttca

SEQ ID NO: 550469 - DNA, 25 bp, Mus musculus
caagagctgcacttgggaggcttca

SEQ ID NO: 550470 - DNA, 25 bp, Mus musculus
caagagctgtgtatgacctggtggc

SEQ ID NO: 550471 - DNA, 25 bp, Mus musculus
caagagctgtgtttgacctggtggc

SEQ ID NO: 550472 - DNA, 25 bp, Mus musculus
caagagcttccacacctctgactgg

SEQ ID NO: 550473 - DNA, 25 bp, Mus musculus
caagagcttccagacctctgactgg

SEQ ID NO: 550474 - DNA, 25 bp, Mus musculus
caagagcttcttcaagcgcagcgtg

SEQ ID NO: 550475 - DNA, 25 bp, Mus musculus
caagagcttcttgaagcgcagcgtg

SEQ ID NO: 550476 - DNA, 25 bp, Mus musculus
caagagcttgtgaggtatgtaattc

SEQ ID NO: 550477 - DNA, 25 bp, Mus musculus
caagagcttgtgtggtatgtaattc

SEQ ID NO: 550478 - DNA, 25 bp, Mus musculus
caagaggaaagacttcctggatgac

SEQ ID NO: 550479 - DNA, 25 bp, Mus musculus
caagaggaaagagttcctggatgac

SEQ ID NO: 550480 - DNA, 25 bp, Mus musculus
caagaggaagatccttgtagctgcc

SEQ ID NO: 550481 - DNA, 25 bp, Mus musculus
caagaggaagatgcttgtagctgcc

SEQ ID NO: 550482 - DNA, 25 bp, Mus musculus
caagaggaaggaagctgaacagcag

SEQ ID NO: 550483 - DNA, 25 bp, Mus musculus
caagaggaaggatgctgaacagcag

SEQ ID NO: 550484 - DNA, 25 bp, Mus musculus
caagaggaaggtcacgaacctgttc

SEQ ID NO: 550485 - DNA, 25 bp, Mus musculus
caagaggaaggtgacgaacctgttc

SEQ ID NO: 550486 - DNA, 25 bp, Mus musculus
caagaggaatggcatcgacgtagac

SEQ ID NO: 550487 - DNA, 25 bp, Mus musculus
caagaggaatgggatcgacgtagac

SEQ ID NO: 550488 - DNA, 25 bp, Mus musculus
caagaggacacaaccagacctagag

SEQ ID NO: 550489 - DNA, 25 bp, Mus musculus
caagaggacacatccagacctagag

SEQ ID NO: 550490 - DNA, 25 bp, Mus musculus
caagaggacgacatccctgggagga

SEQ ID NO: 550491 - DNA, 25 bp, Mus musculus
caagaggacgacttccctgggagga

SEQ ID NO: 550492 - DNA, 25 bp, Mus musculus
caagaggagacacagtctggcagca

SEQ ID NO: 550493 - DNA, 25 bp, Mus musculus
caagaggagacacttgaagcagaga

SEQ ID NO: 550494 - DNA, 25 bp, Mus musculus
caagaggagacagagtctggcagca

SEQ ID NO: 550495 - DNA, 25 bp, Mus musculus
caagaggagacagttgaagcagaga

SEQ ID NO: 550496 - DNA, 25 bp, Mus musculus
caagaggagcccaaatgaccatgac

SEQ ID NO: 550497 - DNA, 25 bp, Mus musculus
caagaggagccctaatgaccatgac

SEQ ID NO: 550498 - DNA, 25 bp, Mus musculus
caagaggatgctatgtgttaaaggc

SEQ ID NO: 550499 - DNA, 25 bp, Mus musculus
caagaggatgctttgtgttaaaggc

SEQ ID NO: 550500 - DNA, 25 bp, Mus musculus
caagaggcacaaagatatctggtcc

SEQ ID NO: 550501 - DNA, 25 bp, Mus musculus
caagaggcacaatgatatctggtcc

SEQ ID NO: 550502 - DNA, 25 bp, Mus musculus
caagaggcacagagcaatccgagtc

SEQ ID NO: 550503 - DNA, 25 bp, Mus musculus
caagaggcacagtgcaatccgagtc

SEQ ID NO: 550504 - DNA, 25 bp, Mus musculus
caagaggcagacctaaagtggtaaa

SEQ ID NO: 550505 - DNA, 25 bp, Mus musculus
caagaggcagacgtaaagtggtaaa

SEQ ID NO: 550506 - DNA, 25 bp, Mus musculus
caagaggccctgagattcgggtgcc

SEQ ID NO: 550507 - DNA, 25 bp, Mus musculus
caagaggccctgtgattcgggtgcc

SEQ ID NO: 550508 - DNA, 25 bp, Mus musculus
caagaggcctgtcaaagctatgctc

SEQ ID NO: 550509 - DNA, 25 bp, Mus musculus
caagaggcctgtgaaagctatgctc

SEQ ID NO: 550510 - DNA, 25 bp, Mus musculus
caagaggcgcaaccagaagctccgg

SEQ ID NO: 550511 - DNA, 25 bp, Mus musculus
caagaggcgcaagcagaagctccgg

SEQ ID NO: 550512 - DNA, 25 bp, Mus musculus
caagaggctccacacttctggcagg

SEQ ID NO: 550513 - DNA, 25 bp, Mus musculus
caagaggctccagacttctggcagg

SEQ ID NO: 550514 - DNA, 25 bp, Mus musculus
caagaggctcgacaggaatctcgcg

SEQ ID NO: 550515 - DNA, 25 bp, Mus musculus
caagaggctcgagaggaatctcgcg

SEQ ID NO: 550516 - DNA, 25 bp, Mus musculus
caagaggctcgtatgagtcatgact

SEQ ID NO: 550517 - DNA, 25 bp, Mus musculus
caagaggctcgtttgagtcatgact

SEQ ID NO: 550518 - DNA, 25 bp, Mus musculus
caagaggctgctatggaagaaactc

SEQ ID NO: 550519 - DNA, 25 bp, Mus musculus
caagaggctgctttggaagaaactc

SEQ ID NO: 550520 - DNA, 25 bp, Mus musculus
caagaggctgggagtaacaggaaac

SEQ ID NO: 550521 - DNA, 25 bp, Mus musculus
caagaggctgggtgtaacaggaaac

SEQ ID NO: 550522 - DNA, 25 bp, Mus musculus
caagaggctgtacccatcaaggaag

SEQ ID NO: 550523 - DNA, 25 bp, Mus musculus
caagaggctgtagccatcaaggaag

SEQ ID NO: 550524 - DNA, 25 bp, Mus musculus
caagaggcttacactgtcacctgtg

SEQ ID NO: 550525 - DNA, 25 bp, Mus musculus
caagaggcttactctgtcacctgtg

SEQ ID NO: 550526 - DNA, 25 bp, Mus musculus
caagaggcttgccaccaaaaacagt

SEQ ID NO: 550527 - DNA, 25 bp, Mus musculus
caagaggcttgcgaccaaaaacagt

SEQ ID NO: 550528 - DNA, 25 bp, Mus musculus
caagagggagcactgcttgcaggag

SEQ ID NO: 550529 - DNA, 25 bp, Mus musculus
caagagggagcagtgcttgcaggag

SEQ ID NO: 550530 - DNA, 25 bp, Mus musculus
caagagggcactctgcagctagcta

SEQ ID NO: 550531 - DNA, 25 bp, Mus musculus
caagagggcactgtgcagctagcta

SEQ ID NO: 550532 - DNA, 25 bp, Mus musculus
caagagggcattctgagcaattcca

SEQ ID NO: 550533 - DNA, 25 bp, Mus musculus
caagagggcattgtgagcaattcca

SEQ ID NO: 550534 - DNA, 25 bp, Mus musculus
caagagggcgatcaaatggtccaaa

SEQ ID NO: 550535 - DNA, 25 bp, Mus musculus
caagagggcgatgaaatggtccaaa

SEQ ID NO: 550536 - DNA, 25 bp, Mus musculus
caagagggctatctaccctataata

SEQ ID NO: 550537 - DNA, 25 bp, Mus musculus
caagagggctatgtaccctataata

SEQ ID NO: 550538 - DNA, 25 bp, Mus musculus
caagagggtgccacgtacatgcagg

SEQ ID NO: 550539 - DNA, 25 bp, Mus musculus
caagagggtgcctcgtacatgcagg

SEQ ID NO: 550540 - DNA, 25 bp, Mus musculus
caagaggtaacactgaggctgacga

SEQ ID NO: 550541 - DNA, 25 bp, Mus musculus
caagaggtaacagtgaggctgacga

SEQ ID NO: 550542 - DNA, 25 bp, Mus musculus
caagaggtaccgctggctgaacttg

SEQ ID NO: 550543 - DNA, 25 bp, Mus musculus
caagaggtaccggtggctgaacttg

SEQ ID NO: 550544 - DNA, 25 bp, Mus musculus
caagaggtacgacacccagacctaa

SEQ ID NO: 550545 - DNA, 25 bp, Mus musculus
caagaggtacgagacccagacctaa

SEQ ID NO: 550546 - DNA, 25 bp, Mus musculus
caagaggtatcaaggtggagaaaca

SEQ ID NO: 550547 - DNA, 25 bp, Mus musculus
caagaggtatcatggtggagaaaca

SEQ ID NO: 550548 - DNA, 25 bp, Mus musculus
caagaggtccatcgtgtttaaggac

SEQ ID NO: 550549 - DNA, 25 bp, Mus musculus
caagaggtccatggtgtttaaggac

SEQ ID NO: 550550 - DNA, 25 bp, Mus musculus
caagaggtcttgaacgtggctcgct

SEQ ID NO: 550551 - DNA, 25 bp, Mus musculus
caagaggtcttgtacgtggctcgct

SEQ ID NO: 550552 - DNA, 25 bp, Mus musculus
caagaggtgctaccctgataaccac

SEQ ID NO: 550553 - DNA, 25 bp, Mus musculus
caagaggtgctagcctgataaccac

SEQ ID NO: 550554 - DNA, 25 bp, Mus musculus
caagaggtgctccacagttgtcagt

SEQ ID NO: 550555 - DNA, 25 bp, Mus musculus
caagaggtgctcgacagttgtcagt

SEQ ID NO: 550556 - DNA, 25 bp, Mus musculus
caagaggtggacaccattgaacagg

SEQ ID NO: 550557 - DNA, 25 bp, Mus musculus
caagaggtggactccattgaacagg

SEQ ID NO: 550558 - DNA, 25 bp, Mus musculus
caagaggtggtgcagcttttaatca

SEQ ID NO: 550559 - DNA, 25 bp, Mus musculus
caagaggtggtggagcttttaatca

SEQ ID NO: 550560 - DNA, 25 bp, Mus musculus
caagaggttccccagcgtgctggca

SEQ ID NO: 550561 - DNA, 25 bp, Mus musculus
caagaggttcccgagcgtgctggca

SEQ ID NO: 550562 - DNA, 25 bp, Mus musculus
caagagtactccatactgaatatgt

SEQ ID NO: 550563 - DNA, 25 bp, Mus musculus
caagagtactccttactgaatatgt

SEQ ID NO: 550564 - DNA, 25 bp, Mus musculus
caagagtagtaaccctggagagtca

SEQ ID NO: 550565 - DNA, 25 bp, Mus musculus
caagagtagtaagcctggagagtca

SEQ ID NO: 550566 - DNA, 25 bp, Mus musculus
caagagtataatctctatggtgaaa

SEQ ID NO: 550567 - DNA, 25 bp, Mus musculus
caagagtataatgtctatggtgaaa

SEQ ID NO: 550568 - DNA, 25 bp, Mus musculus
caagagtatataacctcgtcacgtc

SEQ ID NO: 550569 - DNA, 25 bp, Mus musculus
caagagtatatatcctcgtcacgtc

SEQ ID NO: 550570 - DNA, 25 bp, Mus musculus
caagagtatcacaaagagccatctt

SEQ ID NO: 550571 - DNA, 25 bp, Mus musculus
caagagtatcactaagagccatctt

SEQ ID NO: 550572 - DNA, 25 bp, Mus musculus
caagagtcaggaaggagagaatgaa

SEQ ID NO: 550573 - DNA, 25 bp, Mus musculus
caagagtcaggatggagagaatgaa

SEQ ID NO: 550574 - DNA, 25 bp, Mus musculus
caagagtccacactcaccgtgaagg

SEQ ID NO: 550575 - DNA, 25 bp, Mus musculus
caagagtccacagtcaccgtgaagg

SEQ ID NO: 550576 - DNA, 25 bp, Mus musculus
caagagtccagtctaaaatatgtcg

SEQ ID NO: 550577 - DNA, 25 bp, Mus musculus
caagagtccagtgtaaaatatgtcg

SEQ ID NO: 550578 - DNA, 25 bp, Mus musculus
caagagtcccctaactcagttgagc

SEQ ID NO: 550579 - DNA, 25 bp, Mus musculus
caagagtcccctccgattatttgtc

SEQ ID NO: 550580 - DNA, 25 bp, Mus musculus
caagagtcccctgcgattatttgtc

SEQ ID NO: 550581 - DNA, 25 bp, Mus musculus
caagagtccccttactcagttgagc

SEQ ID NO: 550582 - DNA, 25 bp, Mus musculus
caagagtcctttcaggcagatgagc

SEQ ID NO: 550583 - DNA, 25 bp, Mus musculus
caagagtcctttgaggcagatgagc

SEQ ID NO: 550584 - DNA, 25 bp, Mus musculus
caagagtctatcagaccatgtccaa

SEQ ID NO: 550585 - DNA, 25 bp, Mus musculus
caagagtctatctgaccatgtccaa

SEQ ID NO: 550586 - DNA, 25 bp, Mus musculus
caagagtctgctacgacacaaaagg

SEQ ID NO: 550587 - DNA, 25 bp, Mus musculus
caagagtctgcttcgacacaaaagg

SEQ ID NO: 550588 - DNA, 25 bp, Mus musculus
caagagtcttgcacagtgtgcctga

SEQ ID NO: 550589 - DNA, 25 bp, Mus musculus
caagagtcttgctcagtgtgcctga

SEQ ID NO: 550590 - DNA, 25 bp, Mus musculus
caagagtcttgtctacctctggttc

SEQ ID NO: 550591 - DNA, 25 bp, Mus musculus
caagagtcttgtgtacctctggttc

SEQ ID NO: 550592 - DNA, 25 bp, Mus musculus
caagagtgaattatccctggagccc

SEQ ID NO: 550593 - DNA, 25 bp, Mus musculus
caagagtgaattttccctggagccc

SEQ ID NO: 550594 - DNA, 25 bp, Mus musculus
caagagtgacgtcaagtcactggct

SEQ ID NO: 550595 - DNA, 25 bp, Mus musculus
caagagtgacgtgaagtcactggct

SEQ ID NO: 550596 - DNA, 25 bp, Mus musculus
caagagtgactacattagtctgctg

SEQ ID NO: 550597 - DNA, 25 bp, Mus musculus
caagagtgactagattagtctgctg

SEQ ID NO: 550598 - DNA, 25 bp, Mus musculus
caagagtgagatcattcccatgttc

SEQ ID NO: 550599 - DNA, 25 bp, Mus musculus
caagagtgagatgattcccatgttc

SEQ ID NO: 550600 - DNA, 25 bp, Mus musculus
caagagtgtattagaagcctttggc

SEQ ID NO: 550601 - DNA, 25 bp, Mus musculus
caagagtgtatttgaagcctttggc

SEQ ID NO: 550602 - DNA, 25 bp, Mus musculus
caagagttaactaagagaagccccg

SEQ ID NO: 550603 - DNA, 25 bp, Mus musculus
caagagttaacttagagaagccccg

SEQ ID NO: 550604 - DNA, 25 bp, Mus musculus
caagagttcccacaatctggcagta

SEQ ID NO: 550605 - DNA, 25 bp, Mus musculus
caagagttcccagaatctggcagta

SEQ ID NO: 550606 - DNA, 25 bp, Mus musculus
caagagttctgtcttggcccctgcc

SEQ ID NO: 550607 - DNA, 25 bp, Mus musculus
caagagttctgtgttggcccctgcc

SEQ ID NO: 550608 - DNA, 25 bp, Mus musculus
caagagttgcgacgactgatcttcc

SEQ ID NO: 550609 - DNA, 25 bp, Mus musculus
caagagttgcgaggactgatcttcc

SEQ ID NO: 550610 - DNA, 25 bp, Mus musculus
caagagttgtctaccaccccttcaa

SEQ ID NO: 550611 - DNA, 25 bp, Mus musculus
caagagttgtcttccaccccttcaa

SEQ ID NO: 550612 - DNA, 25 bp, Mus musculus
caagagttttataacgagaatgagc

SEQ ID NO: 550613 - DNA, 25 bp, Mus musculus
caagagttttattacgagaatgagc

SEQ ID NO: 550614 - DNA, 25 bp, Mus musculus
caagataaagctcggaatttgcaaa

SEQ ID NO: 550615 - DNA, 25 bp, Mus musculus
caagataaagctgggaatttgcaaa

SEQ ID NO: 550616 - DNA, 25 bp, Mus musculus
caagataagacgaaaacattacaca

SEQ ID NO: 550617 - DNA, 25 bp, Mus musculus
caagataagacgtaaacattacaca

SEQ ID NO: 550618 - DNA, 25 bp, Mus musculus
caagataatgagcaccccttggttg

SEQ ID NO: 550619 - DNA, 25 bp, Mus musculus
caagataatgaggaccccttggttg

SEQ ID NO: 550620 - DNA, 25 bp, Mus musculus
caagataatgtcacagaactgttca

SEQ ID NO: 550621 - DNA, 25 bp, Mus musculus
caagataatgtctcagaactgttca

SEQ ID NO: 550622 - DNA, 25 bp, Mus musculus
caagatacacagatcctccctgggt

SEQ ID NO: 550623 - DNA, 25 bp, Mus musculus
caagatacacagttcctccctgggt

SEQ ID NO: 550624 - DNA, 25 bp, Mus musculus
caagatacacttaacaggtcccgct

SEQ ID NO: 550625 - DNA, 25 bp, Mus musculus
caagatacactttacaggtcccgct

SEQ ID NO: 550626 - DNA, 25 bp, Mus musculus
caagatacagttaccagagttttcc

SEQ ID NO: 550627 - DNA, 25 bp, Mus musculus
caagatacagtttccagagttttcc

SEQ ID NO: 550628 - DNA, 25 bp, Mus musculus
caagatacctggatgtcagctcggc

SEQ ID NO: 550629 - DNA, 25 bp, Mus musculus
caagatacctggttgtcagctcggc

SEQ ID NO: 550630 - DNA, 25 bp, Mus musculus
caagatacgaacaatagagttagat

SEQ ID NO: 550631 - DNA, 25 bp, Mus musculus
caagatacgaactatagagttagat

SEQ ID NO: 550632 - DNA, 25 bp, Mus musculus
caagatacgttgaaggttgtcgtcg

SEQ ID NO: 550633 - DNA, 25 bp, Mus musculus
caagatacgttgtaggttgtcgtcg

SEQ ID NO: 550634 - DNA, 25 bp, Mus musculus
caagatactgaacatccacggcaag

SEQ ID NO: 550635 - DNA, 25 bp, Mus musculus
caagatactgaagatccacggcaag

SEQ ID NO: 550636 - DNA, 25 bp, Mus musculus
caagatagagatcaaaaatgccacc

SEQ ID NO: 550637 - DNA, 25 bp, Mus musculus
caagatagagatgaaaaatgccacc

SEQ ID NO: 550638 - DNA, 25 bp, Mus musculus
caagatagctatccactactgtgcc

SEQ ID NO: 550639 - DNA, 25 bp, Mus musculus
caagatagctatgcactactgtgcc

SEQ ID NO: 550640 - DNA, 25 bp, Mus musculus
caagatataaaacggcagtcagagg

SEQ ID NO: 550641 - DNA, 25 bp, Mus musculus
caagatataaaagggcagtcagagg

SEQ ID NO: 550642 - DNA, 25 bp, Mus musculus
caagatatagatctggccatactca

SEQ ID NO: 550643 - DNA, 25 bp, Mus musculus
caagatatagatgtggccatactca

SEQ ID NO: 550644 - DNA, 25 bp, Mus musculus
caagatatggcaagccgtgtacagt

SEQ ID NO: 550645 - DNA, 25 bp, Mus musculus
caagatatggcacgattggatgtcg

SEQ ID NO: 550646 - DNA, 25 bp, Mus musculus
caagatatggcaggattggatgtcg

SEQ ID NO: 550647 - DNA, 25 bp, Mus musculus
caagatatggcatgccgtgtacagt

SEQ ID NO: 550648 - DNA, 25 bp, Mus musculus
caagatatgtgaagctgttgttagc

SEQ ID NO: 550649 - DNA, 25 bp, Mus musculus
caagatatgtgatgctgttgttagc

SEQ ID NO: 550650 - DNA, 25 bp, Mus musculus
caagatattcatccgaaacccacgg

SEQ ID NO: 550651 - DNA, 25 bp, Mus musculus
caagatattcatgcgaaacccacgg

SEQ ID NO: 550652 - DNA, 25 bp, Mus musculus
caagatattcttctaaaatggcagc

SEQ ID NO: 550653 - DNA, 25 bp, Mus musculus
caagatattcttgtaaaatggcagc

SEQ ID NO: 550654 - DNA, 25 bp, Mus musculus
caagatatttacagcgggttggtcc

SEQ ID NO: 550655 - DNA, 25 bp, Mus musculus
caagatatttactgcgggttggtcc

SEQ ID NO: 550656 - DNA, 25 bp, Mus musculus
caagatattttcacctatgctaagg

SEQ ID NO: 550657 - DNA, 25 bp, Mus musculus
caagatattttctcctatgctaagg

SEQ ID NO: 550658 - DNA, 25 bp, Mus musculus
caagatcaaaggattggccaaggac

SEQ ID NO: 550659 - DNA, 25 bp, Mus musculus
caagatcaaaggtttggccaaggac

SEQ ID NO: 550660 - DNA, 25 bp, Mus musculus
caagatcaaccgcacacaggcggag

SEQ ID NO: 550661 - DNA, 25 bp, Mus musculus
caagatcaaccggacacaggcggag

SEQ ID NO: 550662 - DNA, 25 bp, Mus musculus
caagatcaagcccaaacagcagaag

SEQ ID NO: 550663 - DNA, 25 bp, Mus musculus
caagatcaagccgaaacagcagaag

SEQ ID NO: 550664 - DNA, 25 bp, Mus musculus
caagatcaagttcggaattctcctc

SEQ ID NO: 550665 - DNA, 25 bp, Mus musculus
caagatcaagttctggttggagatg

SEQ ID NO: 550666 - DNA, 25 bp, Mus musculus
caagatcaagttgggaattctcctc

SEQ ID NO: 550667 - DNA, 25 bp, Mus musculus
caagatcaagttgtggttggagatg

SEQ ID NO: 550668 - DNA, 25 bp, Mus musculus
caagatcacaggcaattctgggaag

SEQ ID NO: 550669 - DNA, 25 bp, Mus musculus
caagatcacagggaattctgggaag

SEQ ID NO: 550670 - DNA, 25 bp, Mus musculus
caagatcacctgctatatgtcctgg

SEQ ID NO: 550671 - DNA, 25 bp, Mus musculus
caagatcacctggtatatgtcctgg

SEQ ID NO: 550672 - DNA, 25 bp, Mus musculus
caagatcagagaagccaagtgccat

SEQ ID NO: 550673 - DNA, 25 bp, Mus musculus
caagatcagagatgccaagtgccat

SEQ ID NO: 550674 - DNA, 25 bp, Mus musculus
caagatcagaggcagaactctcctg

SEQ ID NO: 550675 - DNA, 25 bp, Mus musculus
caagatcagagggagaactctcctg

SEQ ID NO: 550676 - DNA, 25 bp, Mus musculus
caagatcagcaaaatcagtccagag

SEQ ID NO: 550677 - DNA, 25 bp, Mus musculus
caagatcagcaatatcagtccagag

SEQ ID NO: 550678 - DNA, 25 bp, Mus musculus
caagatcagcatcctccttagcaag

SEQ ID NO: 550679 - DNA, 25 bp, Mus musculus
caagatcagcatgctccttagcaag

SEQ ID NO: 550680 - DNA, 25 bp, Mus musculus
caagatcaggataggccaagatgac

SEQ ID NO: 550681 - DNA, 25 bp, Mus musculus
caagatcaggattggccaagatgac

SEQ ID NO: 550682 - DNA, 25 bp, Mus musculus
caagatcatcatactagatgaagca

SEQ ID NO: 550683 - DNA, 25 bp, Mus musculus
caagatcatcattctagatgaagca

SEQ ID NO: 550684 - DNA, 25 bp, Mus musculus
caagatcatgtgcttgtgtggcaaa

SEQ ID NO: 550685 - DNA, 25 bp, Mus musculus
caagatcatgtggttgtgtggcaaa

SEQ ID NO: 550686 - DNA, 25 bp, Mus musculus
caagatccaaacattcacaccatgg

SEQ ID NO: 550687 - DNA, 25 bp, Mus musculus
caagatccaaactttcacaccatgg

SEQ ID NO: 550688 - DNA, 25 bp, Mus musculus
caagatccacacatgtaccaacatc

SEQ ID NO: 550689 - DNA, 25 bp, Mus musculus
caagatccacacttgtaccaacatc

SEQ ID NO: 550690 - DNA, 25 bp, Mus musculus
caagatccaggacaatgctctgccc

SEQ ID NO: 550691 - DNA, 25 bp, Mus musculus
caagatccaggagaatgctctgccc

SEQ ID NO: 550692 - DNA, 25 bp, Mus musculus
caagatccagttcacatcgctatac

SEQ ID NO: 550693 - DNA, 25 bp, Mus musculus
caagatccagttgacatcgctatac

SEQ ID NO: 550694 - DNA, 25 bp, Mus musculus
caagatcccaaacggacaggactga

SEQ ID NO: 550695 - DNA, 25 bp, Mus musculus
caagatcccaaagggacaggactga

SEQ ID NO: 550696 - DNA, 25 bp, Mus musculus
caagatcccactcctggtcgtgggc

SEQ ID NO: 550697 - DNA, 25 bp, Mus musculus
caagatcccactgctggtcgtgggc

SEQ ID NO: 550698 - DNA, 25 bp, Mus musculus
caagatccgcatcgaacctgacgag

SEQ ID NO: 550699 - DNA, 25 bp, Mus musculus
caagatccgcatggaacctgacgag

SEQ ID NO: 550700 - DNA, 25 bp, Mus musculus
caagatccgggaagaaatggtggca

SEQ ID NO: 550701 - DNA, 25 bp, Mus musculus
caagatccgggaagtgcttcgtagg

SEQ ID NO: 550702 - DNA, 25 bp, Mus musculus
caagatccgggatgaaatggtggca

SEQ ID NO: 550703 - DNA, 25 bp, Mus musculus
caagatccgggatgtgcttcgtagg

SEQ ID NO: 550704 - DNA, 25 bp, Mus musculus
caagatccggtcagtgggcagacct

SEQ ID NO: 550705 - DNA, 25 bp, Mus musculus
caagatccggtctgtgggcagacct

SEQ ID NO: 550706 - DNA, 25 bp, Mus musculus
caagatccgtgtagtggccatcgga

SEQ ID NO: 550707 - DNA, 25 bp, Mus musculus
caagatccgtgttgtggccatcgga

SEQ ID NO: 550708 - DNA, 25 bp, Mus musculus
caagatcctaggaggtgttgggctc

SEQ ID NO: 550709 - DNA, 25 bp, Mus musculus
caagatcctaggtggtgttgggctc

SEQ ID NO: 550710 - DNA, 25 bp, Mus musculus
caagatcctcctctgtattgccaac

SEQ ID NO: 550711 - DNA, 25 bp, Mus musculus
caagatcctcctgtgtattgccaac

SEQ ID NO: 550712 - DNA, 25 bp, Mus musculus
caagatccttgaaaacaccaggagg

SEQ ID NO: 550713 - DNA, 25 bp, Mus musculus
caagatccttgataacaccaggagg

SEQ ID NO: 550714 - DNA, 25 bp, Mus musculus
caagatccttgtcgccactatggag

SEQ ID NO: 550715 - DNA, 25 bp, Mus musculus
caagatccttgtggccactatggag

SEQ ID NO: 550716 - DNA, 25 bp, Mus musculus
caagatccttttcttggacgaggcc

SEQ ID NO: 550717 - DNA, 25 bp, Mus musculus
caagatccttttgttggacgaggcc

SEQ ID NO: 550718 - DNA, 25 bp, Mus musculus
caagatcgatgaccccacagattcc

SEQ ID NO: 550719 - DNA, 25 bp, Mus musculus
caagatcgatgagcccacagattcc

SEQ ID NO: 550720 - DNA, 25 bp, Mus musculus
caagatcgcagacctggtatccaaa

SEQ ID NO: 550721 - DNA, 25 bp, Mus musculus
caagatcgcagagctggtatccaaa

SEQ ID NO: 550722 - DNA, 25 bp, Mus musculus
caagatcgccataaaaaactgtgat

SEQ ID NO: 550723 - DNA, 25 bp, Mus musculus
caagatcgccattaaaaactgtgat

SEQ ID NO: 550724 - DNA, 25 bp, Mus musculus
caagatcgctgactctaagagagcc

SEQ ID NO: 550725 - DNA, 25 bp, Mus musculus
caagatcgctgagtctaagagagcc

SEQ ID NO: 550726 - DNA, 25 bp, Mus musculus
caagatcgtgccctacgccgcggag

SEQ ID NO: 550727 - DNA, 25 bp, Mus musculus
caagatcgtgccgtacgccgcggag

SEQ ID NO: 550728 - DNA, 25 bp, Mus musculus
caagatctacgtctggaaaggcaaa

SEQ ID NO: 550729 - DNA, 25 bp, Mus musculus
caagatctacgtgtggaaaggcaaa

SEQ ID NO: 550730 - DNA, 25 bp, Mus musculus
caagatctacttacggcactgaaaa

SEQ ID NO: 550731 - DNA, 25 bp, Mus musculus
caagatctactttcggcactgaaaa

SEQ ID NO: 550732 - DNA, 25 bp, Mus musculus
caagatctctgcatgtgattcctaa

SEQ ID NO: 550733 - DNA, 25 bp, Mus musculus
caagatctctgcttgtgattcctaa

SEQ ID NO: 550734 - DNA, 25 bp, Mus musculus
caagatctctggagacgtgatgaat

SEQ ID NO: 550735 - DNA, 25 bp, Mus musculus
caagatctctggtgacgtgatgaat

SEQ ID NO: 550736 - DNA, 25 bp, Mus musculus
caagatctctttactaagacccaga

SEQ ID NO: 550737 - DNA, 25 bp, Mus musculus
caagatctcttttctaagacccaga

SEQ ID NO: 550738 - DNA, 25 bp, Mus musculus
caagatctgctccagccatagtcag

SEQ ID NO: 550739 - DNA, 25 bp, Mus musculus
caagatctgctcgagccatagtcag

SEQ ID NO: 550740 - DNA, 25 bp, Mus musculus
caagatctggatcagtgccaaatgg

SEQ ID NO: 550741 - DNA, 25 bp, Mus musculus
caagatctggatccagcctgtgacc

SEQ ID NO: 550742 - DNA, 25 bp, Mus musculus
caagatctggatgagtgccaaatgg

SEQ ID NO: 550743 - DNA, 25 bp, Mus musculus
caagatctggatgcagcctgtgacc

SEQ ID NO: 550744 - DNA, 25 bp, Mus musculus
caagatctggccaaagctgagggtg

SEQ ID NO: 550745 - DNA, 25 bp, Mus musculus
caagatctggcctaagctgagggtg

SEQ ID NO: 550746 - DNA, 25 bp, Mus musculus
caagatctggtcactggccgagacg

SEQ ID NO: 550747 - DNA, 25 bp, Mus musculus
caagatctggtctctggccgagacg

SEQ ID NO: 550748 - DNA, 25 bp, Mus musculus
caagatcttagaagaggatgcagct

SEQ ID NO: 550749 - DNA, 25 bp, Mus musculus
caagatcttagatgaggatgcagct

SEQ ID NO: 550750 - DNA, 25 bp, Mus musculus
caagatcttagcctgaatggctata

SEQ ID NO: 550751 - DNA, 25 bp, Mus musculus
caagatcttagcgtgaatggctata

SEQ ID NO: 550752 - DNA, 25 bp, Mus musculus
caagatcttcgaagagcagggccag

SEQ ID NO: 550753 - DNA, 25 bp, Mus musculus
caagatcttcgatgagcagggccag

SEQ ID NO: 550754 - DNA, 25 bp, Mus musculus
caagatcttggtcgtcactgtgcag

SEQ ID NO: 550755 - DNA, 25 bp, Mus musculus
caagatcttggtggtcactgtgcag

SEQ ID NO: 550756 - DNA, 25 bp, Mus musculus
caagatctttgaagcctattggttc

SEQ ID NO: 550757 - DNA, 25 bp, Mus musculus
caagatctttgatgcctattggttc

SEQ ID NO: 550758 - DNA, 25 bp, Mus musculus
caagatgaaaggatatcctcattgg

SEQ ID NO: 550759 - DNA, 25 bp, Mus musculus
caagatgaaaggttatcctcattgg

SEQ ID NO: 550760 - DNA, 25 bp, Mus musculus
caagatgaaccaagccttcttactg

SEQ ID NO: 550761 - DNA, 25 bp, Mus musculus
caagatgaaccatgccttcttactg

SEQ ID NO: 550762 - DNA, 25 bp, Mus musculus
caagatgaatgccatgctagagacc

SEQ ID NO: 550763 - DNA, 25 bp, Mus musculus
caagatgaatgcgatgctagagacc

SEQ ID NO: 550764 - DNA, 25 bp, Mus musculus
caagatgacctcaccagtgtatggc

SEQ ID NO: 550765 - DNA, 25 bp, Mus musculus
caagatgacctctccagtgtatggc

SEQ ID NO: 550766 - DNA, 25 bp, Mus musculus
caagatgagactcaccctgaagcag

SEQ ID NO: 550767 - DNA, 25 bp, Mus musculus
caagatgagactgaccctgaagcag

SEQ ID NO: 550768 - DNA, 25 bp, Mus musculus
caagatgagagactatacatgagcc

SEQ ID NO: 550769 - DNA, 25 bp, Mus musculus
caagatgagagagtatacatgagcc

SEQ ID NO: 550770 - DNA, 25 bp, Mus musculus
caagatgagataaaaaccctgtaaa

SEQ ID NO: 550771 - DNA, 25 bp, Mus musculus
caagatgagatataaaccctgtaaa

SEQ ID NO: 550772 - DNA, 25 bp, Mus musculus
caagatgagccgatctcacagccaa

SEQ ID NO: 550773 - DNA, 25 bp, Mus musculus
caagatgagccgttctcacagccaa

SEQ ID NO: 550774 - DNA, 25 bp, Mus musculus
caagatgaggagacgttcgagctgc

SEQ ID NO: 550775 - DNA, 25 bp, Mus musculus
caagatgaggagtcgttcgagctgc

SEQ ID NO: 550776 - DNA, 25 bp, Mus musculus
caagatgagtacctgcccatctggg

SEQ ID NO: 550777 - DNA, 25 bp, Mus musculus
caagatgagtacgtgcccatctggg

SEQ ID NO: 550778 - DNA, 25 bp, Mus musculus
caagatgagtatcatatggttcatc

SEQ ID NO: 550779 - DNA, 25 bp, Mus musculus
caagatgagtatgatatggttcatc

SEQ ID NO: 550780 - DNA, 25 bp, Mus musculus
caagatgagttcagccgattcggca

SEQ ID NO: 550781 - DNA, 25 bp, Mus musculus
caagatgagttctgccgattcggca

SEQ ID NO: 550782 - DNA, 25 bp, Mus musculus
caagatgataaacttgtttgcccaa

SEQ ID NO: 550783 - DNA, 25 bp, Mus musculus
caagatgataaagttgtttgcccaa

SEQ ID NO: 550784 - DNA, 25 bp, Mus musculus
caagatgatggcagacgaggccctg

SEQ ID NO: 550785 - DNA, 25 bp, Mus musculus
caagatgatggctgacgaggccctg

SEQ ID NO: 550786 - DNA, 25 bp, Mus musculus
caagatgatttcaccttggatgaga

SEQ ID NO: 550787 - DNA, 25 bp, Mus musculus
caagatgatttctccttggatgaga

SEQ ID NO: 550788 - DNA, 25 bp, Mus musculus
caagatgcaaggatgagggcacctt

SEQ ID NO: 550789 - DNA, 25 bp, Mus musculus
caagatgcaaggttgagggcacctt

SEQ ID NO: 550790 - DNA, 25 bp, Mus musculus
caagatgcagcgagttgagtgagac

SEQ ID NO: 550791 - DNA, 25 bp, Mus musculus
caagatgcagcgtgttgagtgagac

SEQ ID NO: 550792 - DNA, 25 bp, Mus musculus
caagatgcagtaccccaggcagacc

SEQ ID NO: 550793 - DNA, 25 bp, Mus musculus
caagatgcagtagcccaggcagacc

SEQ ID NO: 550794 - DNA, 25 bp, Mus musculus
caagatgcatttagatggccgcaag

SEQ ID NO: 550795 - DNA, 25 bp, Mus musculus
caagatgcatttccctgcattggaa

SEQ ID NO: 550796 - DNA, 25 bp, Mus musculus
caagatgcatttgcctgcattggaa

SEQ ID NO: 550797 - DNA, 25 bp, Mus musculus
caagatgcattttgatggccgcaag

SEQ ID NO: 550798 - DNA, 25 bp, Mus musculus
caagatgccagcagatcagctcagg

SEQ ID NO: 550799 - DNA, 25 bp, Mus musculus
caagatgccagctgatcagctcagg

SEQ ID NO: 550800 - DNA, 25 bp, Mus musculus
caagatgccattagaacttaaggaa

SEQ ID NO: 550801 - DNA, 25 bp, Mus musculus
caagatgccatttgaacttaaggaa

SEQ ID NO: 550802 - DNA, 25 bp, Mus musculus
caagatgcggagaattgactgcctc

SEQ ID NO: 550803 - DNA, 25 bp, Mus musculus
caagatgcggagtattgactgcctc

SEQ ID NO: 550804 - DNA, 25 bp, Mus musculus
caagatgcgggcagcagaaatggcc

SEQ ID NO: 550805 - DNA, 25 bp, Mus musculus
caagatgcgggctgcagaaatggcc

SEQ ID NO: 550806 - DNA, 25 bp, Mus musculus
caagatgctcatacacatccggaca

SEQ ID NO: 550807 - DNA, 25 bp, Mus musculus
caagatgctcattcacatccggaca

SEQ ID NO: 550808 - DNA, 25 bp, Mus musculus
caagatgctgaaagcgagagagccc

SEQ ID NO: 550809 - DNA, 25 bp, Mus musculus
caagatgctgaatgcgagagagccc

SEQ ID NO: 550810 - DNA, 25 bp, Mus musculus
caagatgctgcacttgacagtcagg

SEQ ID NO: 550811 - DNA, 25 bp, Mus musculus
caagatgctgcagttgacagtcagg

SEQ ID NO: 550812 - DNA, 25 bp, Mus musculus
caagatgctggcagtcaggtgctga

SEQ ID NO: 550813 - DNA, 25 bp, Mus musculus
caagatgctggctgtcaggtgctga

SEQ ID NO: 550814 - DNA, 25 bp, Mus musculus
caagatggaaagacataaaccaagt

SEQ ID NO: 550815 - DNA, 25 bp, Mus musculus
caagatggaaagtcataaaccaagt

SEQ ID NO: 550816 - DNA, 25 bp, Mus musculus
caagatggaacacaagtttcgcatt

SEQ ID NO: 550817 - DNA, 25 bp, Mus musculus
caagatggaacagaagtttcgcatt

SEQ ID NO: 550818 - DNA, 25 bp, Mus musculus
caagatggacagcaacgagttagcc

SEQ ID NO: 550819 - DNA, 25 bp, Mus musculus
caagatggacaggaacgagttagcc

SEQ ID NO: 550820 - DNA, 25 bp, Mus musculus
caagatggagaccagcatggaccac

SEQ ID NO: 550821 - DNA, 25 bp, Mus musculus
caagatggagacgagcatggaccac

SEQ ID NO: 550822 - DNA, 25 bp, Mus musculus
caagatggccctaaaggaaaccaag

SEQ ID NO: 550823 - DNA, 25 bp, Mus musculus
caagatggcccttaaggaaaccaag

SEQ ID NO: 550824 - DNA, 25 bp, Mus musculus
caagatggccgacgctgaccgcaca

SEQ ID NO: 550825 - DNA, 25 bp, Mus musculus
caagatggccgaggctgaccgcaca

SEQ ID NO: 550826 - DNA, 25 bp, Mus musculus
caagatggccggatcaaggaagtct

SEQ ID NO: 550827 - DNA, 25 bp, Mus musculus
caagatggccggttcaaggaagtct

SEQ ID NO: 550828 - DNA, 25 bp, Mus musculus
caagatggcctacagggcttctcag

SEQ ID NO: 550829 - DNA, 25 bp, Mus musculus
caagatggcctagagggcttctcag

SEQ ID NO: 550830 - DNA, 25 bp, Mus musculus
caagatggcgaccacggccgcatct

SEQ ID NO: 550831 - DNA, 25 bp, Mus musculus
caagatggcgacgacggccgcatct

SEQ ID NO: 550832 - DNA, 25 bp, Mus musculus
caagatggcgttatcaaaccctagc

SEQ ID NO: 550833 - DNA, 25 bp, Mus musculus
caagatggcgttttcaaaccctagc

SEQ ID NO: 550834 - DNA, 25 bp, Mus musculus
caagatgggagaatcttcattggca

SEQ ID NO: 550835 - DNA, 25 bp, Mus musculus
caagatgggagattcttcattggca

SEQ ID NO: 550836 - DNA, 25 bp, Mus musculus
caagatgggcatattctgctcagta

SEQ ID NO: 550837 - DNA, 25 bp, Mus musculus
caagatgggcattttctgctcagta

SEQ ID NO: 550838 - DNA, 25 bp, Mus musculus
caagatgggccgagtatccaagaag

SEQ ID NO: 550839 - DNA, 25 bp, Mus musculus
caagatgggccgtgtatccaagaag

SEQ ID NO: 550840 - DNA, 25 bp, Mus musculus
caagatggtaatcaagaacctttta

SEQ ID NO: 550841 - DNA, 25 bp, Mus musculus
caagatggtaatgaagaacctttta

SEQ ID NO: 550842 - DNA, 25 bp, Mus musculus
caagatggtacacgccatcaagtgg

SEQ ID NO: 550843 - DNA, 25 bp, Mus musculus
caagatggtacaggccatcaagtgg

SEQ ID NO: 550844 - DNA, 25 bp, Mus musculus
caagatggtcaaactgtacaaggcc

SEQ ID NO: 550845 - DNA, 25 bp, Mus musculus
caagatggtcaatctgtacaaggcc

SEQ ID NO: 550846 - DNA, 25 bp, Mus musculus
caagatggtgtcacgcaggaagaaa

SEQ ID NO: 550847 - DNA, 25 bp, Mus musculus
caagatggtgtctcgcaggaagaaa

SEQ ID NO: 550848 - DNA, 25 bp, Mus musculus
caagatgtaattcagacaagaggga

SEQ ID NO: 550849 - DNA, 25 bp, Mus musculus
caagatgtaattgagacaagaggga

SEQ ID NO: 550850 - DNA, 25 bp, Mus musculus
caagatgtacggcaagcactggtgt

SEQ ID NO: 550851 - DNA, 25 bp, Mus musculus
caagatgtacgggaagcactggtgt

SEQ ID NO: 550852 - DNA, 25 bp, Mus musculus
caagatgtacgtcaccaatgacaca

SEQ ID NO: 550853 - DNA, 25 bp, Mus musculus
caagatgtacgtgaccaatgacaca

SEQ ID NO: 550854 - DNA, 25 bp, Mus musculus
caagatgtccatctacaagagaatg

SEQ ID NO: 550855 - DNA, 25 bp, Mus musculus
caagatgtccatgtacaagagaatg

SEQ ID NO: 550856 - DNA, 25 bp, Mus musculus
caagatgtctataagcccaaggcgg

SEQ ID NO: 550857 - DNA, 25 bp, Mus musculus
caagatgtctataggtgtgccgatt

SEQ ID NO: 550858 - DNA, 25 bp, Mus musculus
caagatgtctattagcccaaggcgg

SEQ ID NO: 550859 - DNA, 25 bp, Mus musculus
caagatgtctattggtgtgccgatt

SEQ ID NO: 550860 - DNA, 25 bp, Mus musculus
caagatgtctctattgcctacccaa

SEQ ID NO: 550861 - DNA, 25 bp, Mus musculus
caagatgtctcttttgcctacccaa

SEQ ID NO: 550862 - DNA, 25 bp, Mus musculus
caagatgtgacacggtttaccggaa

SEQ ID NO: 550863 - DNA, 25 bp, Mus musculus
caagatgtgacagggtttaccggaa

SEQ ID NO: 550864 - DNA, 25 bp, Mus musculus
caagatgtgtatcatgtggtcaccc

SEQ ID NO: 550865 - DNA, 25 bp, Mus musculus
caagatgtgtatgatgtggtcaccc

SEQ ID NO: 550866 - DNA, 25 bp, Mus musculus
caagatgtgtccactacctgctgtc

SEQ ID NO: 550867 - DNA, 25 bp, Mus musculus
caagatgtgtcctctacctgctgtc

SEQ ID NO: 550868 - DNA, 25 bp, Mus musculus
caagatgttcacactaaagagagag

SEQ ID NO: 550869 - DNA, 25 bp, Mus musculus
caagatgttcactctaaagagagag

SEQ ID NO: 550870 - DNA, 25 bp, Mus musculus
caagattaaatcaaacacaagagaa

SEQ ID NO: 550871 - DNA, 25 bp, Mus musculus
caagattaaatctaacacaagagaa

SEQ ID NO: 550872 - DNA, 25 bp, Mus musculus
caagattaaatgctttccgtgaagt

SEQ ID NO: 550873 - DNA, 25 bp, Mus musculus
caagattaaatggtttccgtgaagt

SEQ ID NO: 550874 - DNA, 25 bp, Mus musculus
caagattagactagactgtttgtgg

SEQ ID NO: 550875 - DNA, 25 bp, Mus musculus
caagattagacttgactgtttgtgg

SEQ ID NO: 550876 - DNA, 25 bp, Mus musculus
caagattatcccactgctgacagac

SEQ ID NO: 550877 - DNA, 25 bp, Mus musculus
caagattatccctctgctgacagac

SEQ ID NO: 550878 - DNA, 25 bp, Mus musculus
caagattatctccttggcaacaggc

SEQ ID NO: 550879 - DNA, 25 bp, Mus musculus
caagattatctcgttggcaacaggc

SEQ ID NO: 550880 - DNA, 25 bp, Mus musculus
caagattcagagctattgctcctac

SEQ ID NO: 550881 - DNA, 25 bp, Mus musculus
caagattcagaggtattgctcctac

SEQ ID NO: 550882 - DNA, 25 bp, Mus musculus
caagattcatgtatctgaccaggag

SEQ ID NO: 550883 - DNA, 25 bp, Mus musculus
caagattcatgtttctgaccaggag

SEQ ID NO: 550884 - DNA, 25 bp, Mus musculus
caagattcctttccagctcaccatt

SEQ ID NO: 550885 - DNA, 25 bp, Mus musculus
caagattcctttgcagctcaccatt

SEQ ID NO: 550886 - DNA, 25 bp, Mus musculus
caagattcgggtctcagatggagcc

SEQ ID NO: 550887 - DNA, 25 bp, Mus musculus
caagattcgggtgtcagatggagcc

SEQ ID NO: 550888 - DNA, 25 bp, Mus musculus
caagattctatcacaagtaaccacc

SEQ ID NO: 550889 - DNA, 25 bp, Mus musculus
caagattctatctcaagtaaccacc

SEQ ID NO: 550890 - DNA, 25 bp, Mus musculus
caagattcttgcaaagcttgaacgc

SEQ ID NO: 550891 - DNA, 25 bp, Mus musculus
caagattcttgctaagcttgaacgc

SEQ ID NO: 550892 - DNA, 25 bp, Mus musculus
caagattgaaggacataaggaaatt

SEQ ID NO: 550893 - DNA, 25 bp, Mus musculus
caagattgaaggtcataaggaaatt

SEQ ID NO: 550894 - DNA, 25 bp, Mus musculus
caagattgaattagaacatgggacc

SEQ ID NO: 550895 - DNA, 25 bp, Mus musculus
caagattgaatttgaacatgggacc

SEQ ID NO: 550896 - DNA, 25 bp, Mus musculus
caagattgatggctacgaatgtgcc

SEQ ID NO: 550897 - DNA, 25 bp, Mus musculus
caagattgatgggtacgaatgtgcc

SEQ ID NO: 550898 - DNA, 25 bp, Mus musculus
caagattgcagcctgtgcccagtgt

SEQ ID NO: 550899 - DNA, 25 bp, Mus musculus
caagattgcagcgtgtgcccagtgt

SEQ ID NO: 550900 - DNA, 25 bp, Mus musculus
caagattggctcagagtgcctgtgt

SEQ ID NO: 550901 - DNA, 25 bp, Mus musculus
caagattggctctgagtgcctgtgt

SEQ ID NO: 550902 - DNA, 25 bp, Mus musculus
caagattgtgatcgagactgtgcca

SEQ ID NO: 550903 - DNA, 25 bp, Mus musculus
caagattgtgatggagactgtgcca

SEQ ID NO: 550904 - DNA, 25 bp, Mus musculus
caagattgtggcagagcgtcctggt

SEQ ID NO: 550905 - DNA, 25 bp, Mus musculus
caagattgtggctgagcgtcctggt

SEQ ID NO: 550906 - DNA, 25 bp, Mus musculus
caagattgttgtagagttcctgcaa

SEQ ID NO: 550907 - DNA, 25 bp, Mus musculus
caagattgttgtcaggagtctagcc

SEQ ID NO: 550908 - DNA, 25 bp, Mus musculus
caagattgttgtgaggagtctagcc

SEQ ID NO: 550909 - DNA, 25 bp, Mus musculus
caagattgttgttgagttcctgcaa

SEQ ID NO: 550910 - DNA, 25 bp, Mus musculus
caagatttatggactcagagggtca

SEQ ID NO: 550911 - DNA, 25 bp, Mus musculus
caagatttatggtctcagagggtca

SEQ ID NO: 550912 - DNA, 25 bp, Mus musculus
caagatttctgacttcagctggaat

SEQ ID NO: 550913 - DNA, 25 bp, Mus musculus
caagatttctgagttcagctggaat

SEQ ID NO: 550914 - DNA, 25 bp, Mus musculus
caagatttgaacaggcagcgaaaga

SEQ ID NO: 550915 - DNA, 25 bp, Mus musculus
caagatttgaactggcagcgaaaga

SEQ ID NO: 550916 - DNA, 25 bp, Mus musculus
caagatttgagcagctctgttctcc

SEQ ID NO: 550917 - DNA, 25 bp, Mus musculus
caagatttgagctgctctgttctcc

SEQ ID NO: 550918 - DNA, 25 bp, Mus musculus
caagatttgatgatgatgatcgtcg

SEQ ID NO: 550919 - DNA, 25 bp, Mus musculus
caagatttgatgttgatgatcgtcg

SEQ ID NO: 550920 - DNA, 25 bp, Mus musculus
caagatttggttatagactaccagc

SEQ ID NO: 550921 - DNA, 25 bp, Mus musculus
caagatttggttttagactaccagc

SEQ ID NO: 550922 - DNA, 25 bp, Mus musculus
caagcaaaaaagagtggctttgcct

SEQ ID NO: 550923 - DNA, 25 bp, Mus musculus
caagcaaaaaagtgtggctttgcct

SEQ ID NO: 550924 - DNA, 25 bp, Mus musculus
caagcaaaagaacaactgtggaagc

SEQ ID NO: 550925 - DNA, 25 bp, Mus musculus
caagcaaaagaagaactgtggaagc

SEQ ID NO: 550926 - DNA, 25 bp, Mus musculus
caagcaaaatcaccccaactgagct

SEQ ID NO: 550927 - DNA, 25 bp, Mus musculus
caagcaaaatcagcccaactgagct

SEQ ID NO: 550928 - DNA, 25 bp, Mus musculus
caagcaaaatccacatgcaggaaat

SEQ ID NO: 550929 - DNA, 25 bp, Mus musculus
caagcaaaatcctcatgcaggaaat

SEQ ID NO: 550930 - DNA, 25 bp, Mus musculus
caagcaaaggcaacgaagaaaggga

SEQ ID NO: 550931 - DNA, 25 bp, Mus musculus
caagcaaaggcatcgaagaaaggga

SEQ ID NO: 550932 - DNA, 25 bp, Mus musculus
caagcaacagcactattcagacctt

SEQ ID NO: 550933 - DNA, 25 bp, Mus musculus
caagcaacagcagtattcagacctt

SEQ ID NO: 550934 - DNA, 25 bp, Mus musculus
caagcaaccaaacatgctggcacta

SEQ ID NO: 550935 - DNA, 25 bp, Mus musculus
caagcaaccaaagatgctggcacta

SEQ ID NO: 550936 - DNA, 25 bp, Mus musculus
caagcaacgcatagacgagttcgag

SEQ ID NO: 550937 - DNA, 25 bp, Mus musculus
caagcaacgcattgacgagttcgag

SEQ ID NO: 550938 - DNA, 25 bp, Mus musculus
caagcaactgcacactccaactggg

SEQ ID NO: 550939 - DNA, 25 bp, Mus musculus
caagcaactgcagactccaactggg

SEQ ID NO: 550940 - DNA, 25 bp, Mus musculus
caagcaagaattcactccaaataaa

SEQ ID NO: 550941 - DNA, 25 bp, Mus musculus
caagcaagaattgactccaaataaa

SEQ ID NO: 550942 - DNA, 25 bp, Mus musculus
caagcaagattgacgcaaattttgc

SEQ ID NO: 550943 - DNA, 25 bp, Mus musculus
caagcaagattgtcgcaaattttgc

SEQ ID NO: 550944 - DNA, 25 bp, Mus musculus
caagcaagcatcattgtgaggctta

SEQ ID NO: 550945 - DNA, 25 bp, Mus musculus
caagcaagcatctttgtgaggctta

SEQ ID NO: 550946 - DNA, 25 bp, Mus musculus
caagcaagcgttaggtagggagtca

SEQ ID NO: 550947 - DNA, 25 bp, Mus musculus
caagcaagcgtttggtagggagtca

SEQ ID NO: 550948 - DNA, 25 bp, Mus musculus
caagcaaggaatctgtgaggagaat

SEQ ID NO: 550949 - DNA, 25 bp, Mus musculus
caagcaaggaatgtgtgaggagaat

SEQ ID NO: 550950 - DNA, 25 bp, Mus musculus
caagcaagggccaggaacaggtttt

SEQ ID NO: 550951 - DNA, 25 bp, Mus musculus
caagcaagggcctggaacaggtttt

SEQ ID NO: 550952 - DNA, 25 bp, Mus musculus
caagcaaggttcaggcagtagccag

SEQ ID NO: 550953 - DNA, 25 bp, Mus musculus
caagcaaggttctggcagtagccag

SEQ ID NO: 550954 - DNA, 25 bp, Mus musculus
caagcaagtactatggcagcatcga

SEQ ID NO: 550955 - DNA, 25 bp, Mus musculus
caagcaagtactttggcagcatcga

SEQ ID NO: 550956 - DNA, 25 bp, Mus musculus
caagcaagtcctacccaggaaagca

SEQ ID NO: 550957 - DNA, 25 bp, Mus musculus
caagcaagtccttcccaggaaagca

SEQ ID NO: 550958 - DNA, 25 bp, Mus musculus
caagcaagtgaacagcaagttggcc

SEQ ID NO: 550959 - DNA, 25 bp, Mus musculus
caagcaagtgaagagcaagttggcc

SEQ ID NO: 550960 - DNA, 25 bp, Mus musculus
caagcaagtggcaagttcaactggc

SEQ ID NO: 550961 - DNA, 25 bp, Mus musculus
caagcaagtggctagttcaactggc

SEQ ID NO: 550962 - DNA, 25 bp, Mus musculus
caagcaagtgttcgttgccccagga

SEQ ID NO: 550963 - DNA, 25 bp, Mus musculus
caagcaagtgttggttgccccagga

SEQ ID NO: 550964 - DNA, 25 bp, Mus musculus
caagcaatgcaaagagcgcctgtca

SEQ ID NO: 550965 - DNA, 25 bp, Mus musculus
caagcaatgcaatgagcgcctgtca

SEQ ID NO: 550966 - DNA, 25 bp, Mus musculus
caagcaatggcaagtgctcaggtga

SEQ ID NO: 550967 - DNA, 25 bp, Mus musculus
caagcaatggcatgtgctcaggtga

SEQ ID NO: 550968 - DNA, 25 bp, Mus musculus
caagcaatgggcaagaaaattatac

SEQ ID NO: 550969 - DNA, 25 bp, Mus musculus
caagcaatgggctagaaaattatac

SEQ ID NO: 550970 - DNA, 25 bp, Mus musculus
caagcaattagaacgaggagaggcc

SEQ ID NO: 550971 - DNA, 25 bp, Mus musculus
caagcaattagatcgaggagaggcc

SEQ ID NO: 550972 - DNA, 25 bp, Mus musculus
caagcacaagaacatcattaacctg

SEQ ID NO: 550973 - DNA, 25 bp, Mus musculus
caagcacaagaagatcattaacctg

SEQ ID NO: 550974 - DNA, 25 bp, Mus musculus
caagcacaagatcccggtcaagtac

SEQ ID NO: 550975 - DNA, 25 bp, Mus musculus
caagcacaagatgccggtcaagtac

SEQ ID NO: 550976 - DNA, 25 bp, Mus musculus
caagcacaagtgagggagcctatca

SEQ ID NO: 550977 - DNA, 25 bp, Mus musculus
caagcacaagtgtgggagcctatca

SEQ ID NO: 550978 - DNA, 25 bp, Mus musculus
caagcacagagacagttggcagagc

SEQ ID NO: 550979 - DNA, 25 bp, Mus musculus
caagcacagagagagttggcagagc

SEQ ID NO: 550980 - DNA, 25 bp, Mus musculus
caagcacagcaacatggcgagcttt

SEQ ID NO: 550981 - DNA, 25 bp, Mus musculus
caagcacagcaagatggcgagcttt

SEQ ID NO: 550982 - DNA, 25 bp, Mus musculus
caagcacagggtaagaagaagtgat

SEQ ID NO: 550983 - DNA, 25 bp, Mus musculus
caagcacagggttagaagaagtgat

SEQ ID NO: 550984 - DNA, 25 bp, Mus musculus
caagcacagtacaggcatgacccta

SEQ ID NO: 550985 - DNA, 25 bp, Mus musculus
caagcacagtactggcatgacccta

SEQ ID NO: 550986 - DNA, 25 bp, Mus musculus
caagcacatagaaggctggagcgcc

SEQ ID NO: 550987 - DNA, 25 bp, Mus musculus
caagcacatagatggctggagcgcc

SEQ ID NO: 550988 - DNA, 25 bp, Mus musculus
caagcacatctgagctatctgtggg

SEQ ID NO: 550989 - DNA, 25 bp, Mus musculus
caagcacatctgtgctatctgtggg

SEQ ID NO: 550990 - DNA, 25 bp, Mus musculus
caagcacattaacaagccgatccgc

SEQ ID NO: 550991 - DNA, 25 bp, Mus musculus
caagcacattaagaagccgatccgc

SEQ ID NO: 550992 - DNA, 25 bp, Mus musculus
caagcaccgtgtccagggaagagtt

SEQ ID NO: 550993 - DNA, 25 bp, Mus musculus
caagcaccgtgtgcagggaagagtt

SEQ ID NO: 550994 - DNA, 25 bp, Mus musculus
caagcacctagccagcctgaggtct

SEQ ID NO: 550995 - DNA, 25 bp, Mus musculus
caagcacctagcgagcctgaggtct

SEQ ID NO: 550996 - DNA, 25 bp, Mus musculus
caagcacgacatcattggagagttc

SEQ ID NO: 550997 - DNA, 25 bp, Mus musculus
caagcacgacatgattggagagttc

SEQ ID NO: 550998 - DNA, 25 bp, Mus musculus
caagcacgagtacggctttgtgagc

SEQ ID NO: 550999 - DNA, 25 bp, Mus musculus
caagcacgagtagggctttgtgagc

SEQ ID NO: 551000 - DNA, 25 bp, Mus musculus
caagcacgagtgaggcagacacgct

SEQ ID NO: 551001 - DNA, 25 bp, Mus musculus
caagcacgagtgtggcagacacgct

SEQ ID NO: 551002 - DNA, 25 bp, Mus musculus
caagcacgtttcattccaccgcaga

SEQ ID NO: 551003 - DNA, 25 bp, Mus musculus
caagcacgtttctttccaccgcaga

SEQ ID NO: 551004 - DNA, 25 bp, Mus musculus
caagcactcctgcaaagcacaggga

SEQ ID NO: 551005 - DNA, 25 bp, Mus musculus
caagcactcctggaaagcacaggga

SEQ ID NO: 551006 - DNA, 25 bp, Mus musculus
caagcactctgcaagtaagctaagt

SEQ ID NO: 551007 - DNA, 25 bp, Mus musculus
caagcactctgctagtaagctaagt

SEQ ID NO: 551008 - DNA, 25 bp, Mus musculus
caagcactgcagcttctggagaatt

SEQ ID NO: 551009 - DNA, 25 bp, Mus musculus
caagcactgcaggttctggagaatt

SEQ ID NO: 551010 - DNA, 25 bp, Mus musculus
caagcactgctaagaagactgaaaa

SEQ ID NO: 551011 - DNA, 25 bp, Mus musculus
caagcactgctatgaagactgaaaa

SEQ ID NO: 551012 - DNA, 25 bp, Mus musculus
caagcactggtgaggaacttcccca

SEQ ID NO: 551013 - DNA, 25 bp, Mus musculus
caagcactggtgtggaacttcccca

SEQ ID NO: 551014 - DNA, 25 bp, Mus musculus
caagcacttcatagataagctccta

SEQ ID NO: 551015 - DNA, 25 bp, Mus musculus
caagcacttcattgataagctccta

SEQ ID NO: 551016 - DNA, 25 bp, Mus musculus
caagcacttcctactgttgtttcta

SEQ ID NO: 551017 - DNA, 25 bp, Mus musculus
caagcacttccttctgttgtttcta

SEQ ID NO: 551018 - DNA, 25 bp, Mus musculus
caagcactttgcagactgaaccatg

SEQ ID NO: 551019 - DNA, 25 bp, Mus musculus
caagcactttgctgactgaaccatg

SEQ ID NO: 551020 - DNA, 25 bp, Mus musculus
caagcagaaaaccagaattggcacc

SEQ ID NO: 551021 - DNA, 25 bp, Mus musculus
caagcagaaaacgagaattggcacc

SEQ ID NO: 551022 - DNA, 25 bp, Mus musculus
caagcagaaactcgaaatgattggc

SEQ ID NO: 551023 - DNA, 25 bp, Mus musculus
caagcagaaactggaaatgattggc

SEQ ID NO: 551024 - DNA, 25 bp, Mus musculus
caagcagaacgtattctgaaactcc

SEQ ID NO: 551025 - DNA, 25 bp, Mus musculus
caagcagaacgttttctgaaactcc

SEQ ID NO: 551026 - DNA, 25 bp, Mus musculus
caagcagaagggagtattcccaggg

SEQ ID NO: 551027 - DNA, 25 bp, Mus musculus
caagcagaagggtgtattcccaggg

SEQ ID NO: 551028 - DNA, 25 bp, Mus musculus
caagcagaaggtcagctagatggca

SEQ ID NO: 551029 - DNA, 25 bp, Mus musculus
caagcagaaggtgagctagatggca

SEQ ID NO: 551030 - DNA, 25 bp, Mus musculus
caagcagacaggcttccagtgtgct

SEQ ID NO: 551031 - DNA, 25 bp, Mus musculus
caagcagacagggttccagtgtgct

SEQ ID NO: 551032 - DNA, 25 bp, Mus musculus
caagcagacccacctacttcaggtg

SEQ ID NO: 551033 - DNA, 25 bp, Mus musculus
caagcagacccagctacttcaggtg

SEQ ID NO: 551034 - DNA, 25 bp, Mus musculus
caagcagacgcgaaagagtggctcc

SEQ ID NO: 551035 - DNA, 25 bp, Mus musculus
caagcagacgcgtaagagtggctcc

SEQ ID NO: 551036 - DNA, 25 bp, Mus musculus
caagcagactacctctatgaaagtg

SEQ ID NO: 551037 - DNA, 25 bp, Mus musculus
caagcagactacgtctatgaaagtg

SEQ ID NO: 551038 - DNA, 25 bp, Mus musculus
caagcagactttcaaccctggagac

SEQ ID NO: 551039 - DNA, 25 bp, Mus musculus
caagcagactttgaaccctggagac

SEQ ID NO: 551040 - DNA, 25 bp, Mus musculus
caagcagagctgcttctagatgaga

SEQ ID NO: 551041 - DNA, 25 bp, Mus musculus
caagcagagctggttctagatgaga

SEQ ID NO: 551042 - DNA, 25 bp, Mus musculus
caagcagaggaaccgttagcgaaga

SEQ ID NO: 551043 - DNA, 25 bp, Mus musculus
caagcagaggaagcgttagcgaaga

SEQ ID NO: 551044 - DNA, 25 bp, Mus musculus
caagcagaggccctgttagagctcc

SEQ ID NO: 551045 - DNA, 25 bp, Mus musculus
caagcagaggccgtgttagagctcc

SEQ ID NO: 551046 - DNA, 25 bp, Mus musculus
caagcagaggtaagtctttgctgga

SEQ ID NO: 551047 - DNA, 25 bp, Mus musculus
caagcagaggtatgtctttgctgga

SEQ ID NO: 551048 - DNA, 25 bp, Mus musculus
caagcagagtgcagaaggtgctgtc

SEQ ID NO: 551049 - DNA, 25 bp, Mus musculus
caagcagagtgctgaaggtgctgtc

SEQ ID NO: 551050 - DNA, 25 bp, Mus musculus
caagcagataaaacgaatgatctcc

SEQ ID NO: 551051 - DNA, 25 bp, Mus musculus
caagcagataaatcgaatgatctcc

SEQ ID NO: 551052 - DNA, 25 bp, Mus musculus
caagcagatagtccgcaatgacatc

SEQ ID NO: 551053 - DNA, 25 bp, Mus musculus
caagcagatagtgcgcaatgacatc

SEQ ID NO: 551054 - DNA, 25 bp, Mus musculus
caagcagatatgctgctgcagccgt

SEQ ID NO: 551055 - DNA, 25 bp, Mus musculus
caagcagatatggtgctgcagccgt

SEQ ID NO: 551056 - DNA, 25 bp, Mus musculus
caagcagatcgtcctggttggccag

SEQ ID NO: 551057 - DNA, 25 bp, Mus musculus
caagcagatcgtgctggttggccag

SEQ ID NO: 551058 - DNA, 25 bp, Mus musculus
caagcagatgaacctactaagaggt

SEQ ID NO: 551059 - DNA, 25 bp, Mus musculus
caagcagatgaagctactaagaggt

SEQ ID NO: 551060 - DNA, 25 bp, Mus musculus
caagcagatgttaggaccacaagtg

SEQ ID NO: 551061 - DNA, 25 bp, Mus musculus
caagcagatgttcctggactggtgc

SEQ ID NO: 551062 - DNA, 25 bp, Mus musculus
caagcagatgttgctggactggtgc

SEQ ID NO: 551063 - DNA, 25 bp, Mus musculus
caagcagatgtttggaccacaagtg

SEQ ID NO: 551064 - DNA, 25 bp, Mus musculus
caagcagattggcacctttgcctct

SEQ ID NO: 551065 - DNA, 25 bp, Mus musculus
caagcagattgggacctttgcctct

SEQ ID NO: 551066 - DNA, 25 bp, Mus musculus
caagcagcagatattctctgtgcag

SEQ ID NO: 551067 - DNA, 25 bp, Mus musculus
caagcagcagattttctctgtgcag

SEQ ID NO: 551068 - DNA, 25 bp, Mus musculus
caagcagcagcaagaggacaataag

SEQ ID NO: 551069 - DNA, 25 bp, Mus musculus
caagcagcagcatgaggacaataag

SEQ ID NO: 551070 - DNA, 25 bp, Mus musculus
caagcagcagcgaatcaaagaggaa

SEQ ID NO: 551071 - DNA, 25 bp, Mus musculus
caagcagcagcgtatcaaagaggaa

SEQ ID NO: 551072 - DNA, 25 bp, Mus musculus
caagcagcagttatgtcctcaggag

SEQ ID NO: 551073 - DNA, 25 bp, Mus musculus
caagcagcagttttgtcctcaggag

SEQ ID NO: 551074 - DNA, 25 bp, Mus musculus
caagcagccactcctggaggatggc

SEQ ID NO: 551075 - DNA, 25 bp, Mus musculus
caagcagccactgctggaggatggc

SEQ ID NO: 551076 - DNA, 25 bp, Mus musculus
caagcagccagcagaaaatgttaat

SEQ ID NO: 551077 - DNA, 25 bp, Mus musculus
caagcagccagctgaaaatgttaat

SEQ ID NO: 551078 - DNA, 25 bp, Mus musculus
caagcagccattcttgcctgtggat

SEQ ID NO: 551079 - DNA, 25 bp, Mus musculus
caagcagccattgttgcctgtggat

SEQ ID NO: 551080 - DNA, 25 bp, Mus musculus
caagcagcccaacaatgacaatgta

SEQ ID NO: 551081 - DNA, 25 bp, Mus musculus
caagcagcccaagaatgacaatgta

SEQ ID NO: 551082 - DNA, 25 bp, Mus musculus
caagcagcccgacgaagtgtttgat

SEQ ID NO: 551083 - DNA, 25 bp, Mus musculus
caagcagcccgaggaagtgtttgat

SEQ ID NO: 551084 - DNA, 25 bp, Mus musculus
caagcagcctcacgttgttggagca

SEQ ID NO: 551085 - DNA, 25 bp, Mus musculus
caagcagcctcaggttgttggagca

SEQ ID NO: 551086 - DNA, 25 bp, Mus musculus
caagcagcgtgcagttgaatgtggc

SEQ ID NO: 551087 - DNA, 25 bp, Mus musculus
caagcagcgtgctgttgaatgtggc

SEQ ID NO: 551088 - DNA, 25 bp, Mus musculus
caagcagctaagaggcttcttctca

SEQ ID NO: 551089 - DNA, 25 bp, Mus musculus
caagcagctaagtggcttcttctca

SEQ ID NO: 551090 - DNA, 25 bp, Mus musculus
caagcagctgctacactgtatggcc

SEQ ID NO: 551091 - DNA, 25 bp, Mus musculus
caagcagctgcttcactgtatggcc

SEQ ID NO: 551092 - DNA, 25 bp, Mus musculus
caagcagctggacggagaaccctga

SEQ ID NO: 551093 - DNA, 25 bp, Mus musculus
caagcagctggagggagaaccctga

SEQ ID NO: 551094 - DNA, 25 bp, Mus musculus
caagcaggaagaacccgaagctcac

SEQ ID NO: 551095 - DNA, 25 bp, Mus musculus
caagcaggaagaatgctgcggtagc

SEQ ID NO: 551096 - DNA, 25 bp, Mus musculus
caagcaggaagatcccgaagctcac

SEQ ID NO: 551097 - DNA, 25 bp, Mus musculus
caagcaggaagattgctgcggtagc

SEQ ID NO: 551098 - DNA, 25 bp, Mus musculus
caagcaggacagagaaattccacca

SEQ ID NO: 551099 - DNA, 25 bp, Mus musculus
caagcaggacagtgaaattccacca

SEQ ID NO: 551100 - DNA, 25 bp, Mus musculus
caagcaggacatagtgtatgtggta

SEQ ID NO: 551101 - DNA, 25 bp, Mus musculus
caagcaggacattgtgtatgtggta

SEQ ID NO: 551102 - DNA, 25 bp, Mus musculus
caagcaggcggacaagacaacccgg

SEQ ID NO: 551103 - DNA, 25 bp, Mus musculus
caagcaggcggagaagacaacccgg

SEQ ID NO: 551104 - DNA, 25 bp, Mus musculus
caagcaggctctccatgaagcagtg

SEQ ID NO: 551105 - DNA, 25 bp, Mus musculus
caagcaggctctgcatgaagcagtg

SEQ ID NO: 551106 - DNA, 25 bp, Mus musculus
caagcaggctttaggcgtcatgaac

SEQ ID NO: 551107 - DNA, 25 bp, Mus musculus
caagcaggcttttggcgtcatgaac

SEQ ID NO: 551108 - DNA, 25 bp, Mus musculus
caagcagggacgctacgtgagtttt

SEQ ID NO: 551109 - DNA, 25 bp, Mus musculus
caagcagggacggtacgtgagtttt

SEQ ID NO: 551110 - DNA, 25 bp, Mus musculus
caagcagggaggacttgatgtgact

SEQ ID NO: 551111 - DNA, 25 bp, Mus musculus
caagcagggaggtcttgatgtgact

SEQ ID NO: 551112 - DNA, 25 bp, Mus musculus
caagcagggcttctactacgatggc

SEQ ID NO: 551113 - DNA, 25 bp, Mus musculus
caagcagggcttgtactacgatggc

SEQ ID NO: 551114 - DNA, 25 bp, Mus musculus
caagcagggtttctgatcaggctcc

SEQ ID NO: 551115 - DNA, 25 bp, Mus musculus
caagcagggtttgtgatcaggctcc

SEQ ID NO: 551116 - DNA, 25 bp, Mus musculus
caagcaggtagactgccgtggaagc

SEQ ID NO: 551117 - DNA, 25 bp, Mus musculus
caagcaggtagagtgccgtggaagc

SEQ ID NO: 551118 - DNA, 25 bp, Mus musculus
caagcagtagctcgtgttaggcacc

SEQ ID NO: 551119 - DNA, 25 bp, Mus musculus
caagcagtagctggtgttaggcacc

SEQ ID NO: 551120 - DNA, 25 bp, Mus musculus
caagcagtaggtagaggatttagac

SEQ ID NO: 551121 - DNA, 25 bp, Mus musculus
caagcagtaggttgaggatttagac

SEQ ID NO: 551122 - DNA, 25 bp, Mus musculus
caagcagtcagcctcagggacaaag

SEQ ID NO: 551123 - DNA, 25 bp, Mus musculus
caagcagtcagcgtcagggacaaag

SEQ ID NO: 551124 - DNA, 25 bp, Mus musculus
caagcagtccatattgtctgtacgc

SEQ ID NO: 551125 - DNA, 25 bp, Mus musculus
caagcagtccattttgtctgtacgc

SEQ ID NO: 551126 - DNA, 25 bp, Mus musculus
caagcagtcggcctatgacttcaag

SEQ ID NO: 551127 - DNA, 25 bp, Mus musculus
caagcagtcggcgtatgacttcaag

SEQ ID NO: 551128 - DNA, 25 bp, Mus musculus
caagcagtctacctctttgtacagt

SEQ ID NO: 551129 - DNA, 25 bp, Mus musculus
caagcagtctacgtctttgtacagt

SEQ ID NO: 551130 - DNA, 25 bp, Mus musculus
caagcagtgggactattatgcaagg

SEQ ID NO: 551131 - DNA, 25 bp, Mus musculus
caagcagtgggagtattatgcaagg

SEQ ID NO: 551132 - DNA, 25 bp, Mus musculus
caagcagtggtactgagtcagaaaa

SEQ ID NO: 551133 - DNA, 25 bp, Mus musculus
caagcagtggtagtgagtcagaaaa

SEQ ID NO: 551134 - DNA, 25 bp, Mus musculus
caagcagtggtcctattggcctatc

SEQ ID NO: 551135 - DNA, 25 bp, Mus musculus
caagcagtggtcgtattggcctatc

SEQ ID NO: 551136 - DNA, 25 bp, Mus musculus
caagcagttcctagattactttaag

SEQ ID NO: 551137 - DNA, 25 bp, Mus musculus
caagcagttccttgattactttaag

SEQ ID NO: 551138 - DNA, 25 bp, Mus musculus
caagcagttgctaggaaagggtctt

SEQ ID NO: 551139 - DNA, 25 bp, Mus musculus
caagcagttgcttggaaagggtctt

SEQ ID NO: 551140 - DNA, 25 bp, Mus musculus
caagcagttggtcgaagacctggac

SEQ ID NO: 551141 - DNA, 25 bp, Mus musculus
caagcagttggtggaagacctggac

SEQ ID NO: 551142 - DNA, 25 bp, Mus musculus
caagcagtttgtcgatatgtcactg

SEQ ID NO: 551143 - DNA, 25 bp, Mus musculus
caagcagtttgtggatatgtcactg

SEQ ID NO: 551144 - DNA, 25 bp, Mus musculus
caagcataagggaaaagaccgacac

SEQ ID NO: 551145 - DNA, 25 bp, Mus musculus
caagcataagggtaaagaccgacac

SEQ ID NO: 551146 - DNA, 25 bp, Mus musculus
caagcataccttccgttctgggacg

SEQ ID NO: 551147 - DNA, 25 bp, Mus musculus
caagcataccttgcgttctgggacg

SEQ ID NO: 551148 - DNA, 25 bp, Mus musculus
caagcatagagcaaatattcagcca

SEQ ID NO: 551149 - DNA, 25 bp, Mus musculus
caagcatagagctaatattcagcca

SEQ ID NO: 551150 - DNA, 25 bp, Mus musculus
caagcatagcgcagggcagcagaac

SEQ ID NO: 551151 - DNA, 25 bp, Mus musculus
caagcatagcgctgggcagcagaac

SEQ ID NO: 551152 - DNA, 25 bp, Mus musculus
caagcatagtgtcgacagtgattcc

SEQ ID NO: 551153 - DNA, 25 bp, Mus musculus
caagcatagtgtggacagtgattcc

SEQ ID NO: 551154 - DNA, 25 bp, Mus musculus
caagcatagttcattctccagctgt

SEQ ID NO: 551155 - DNA, 25 bp, Mus musculus
caagcatagttctttctccagctgt

SEQ ID NO: 551156 - DNA, 25 bp, Mus musculus
caagcatcatcaatgacgatgtgat

SEQ ID NO: 551157 - DNA, 25 bp, Mus musculus
caagcatcatcattgacgatgtgat

SEQ ID NO: 551158 - DNA, 25 bp, Mus musculus
caagcatccgggactttgagttctg

SEQ ID NO: 551159 - DNA, 25 bp, Mus musculus
caagcatccgggtctttgagttctg

SEQ ID NO: 551160 - DNA, 25 bp, Mus musculus
caagcatctcaacgacgacgtggtc

SEQ ID NO: 551161 - DNA, 25 bp, Mus musculus
caagcatctcaaggacgacgtggtc

SEQ ID NO: 551162 - DNA, 25 bp, Mus musculus
caagcatcttcgaaagctgaagcac

SEQ ID NO: 551163 - DNA, 25 bp, Mus musculus
caagcatcttcgtaagctgaagcac

SEQ ID NO: 551164 - DNA, 25 bp, Mus musculus
caagcatgaagaaaaccaccggcct

SEQ ID NO: 551165 - DNA, 25 bp, Mus musculus
caagcatgaagataaccaccggcct

SEQ ID NO: 551166 - DNA, 25 bp, Mus musculus
caagcatgcattcaagtggagggct

SEQ ID NO: 551167 - DNA, 25 bp, Mus musculus
caagcatgcattgaagtggagggct

SEQ ID NO: 551168 - DNA, 25 bp, Mus musculus
caagcatgccttagagatcatccac

SEQ ID NO: 551169 - DNA, 25 bp, Mus musculus
caagcatgcctttgagatcatccac

SEQ ID NO: 551170 - DNA, 25 bp, Mus musculus
caagcatggagaacctggtgatgca

SEQ ID NO: 551171 - DNA, 25 bp, Mus musculus
caagcatggagatcctggtgatgca

SEQ ID NO: 551172 - DNA, 25 bp, Mus musculus
caagcatggattaacactaggagag

SEQ ID NO: 551173 - DNA, 25 bp, Mus musculus
caagcatggatttacactaggagag

SEQ ID NO: 551174 - DNA, 25 bp, Mus musculus
caagcatggtcacctggagaaccga

SEQ ID NO: 551175 - DNA, 25 bp, Mus musculus
caagcatggtcagctggagaaccga

SEQ ID NO: 551176 - DNA, 25 bp, Mus musculus
caagcatgtatacccaggtctggaa

SEQ ID NO: 551177 - DNA, 25 bp, Mus musculus
caagcatgtatagccaggtctggaa

SEQ ID NO: 551178 - DNA, 25 bp, Mus musculus
caagcatgtctcatctgggaaaaca

SEQ ID NO: 551179 - DNA, 25 bp, Mus musculus
caagcatgtctcttctgggaaaaca

SEQ ID NO: 551180 - DNA, 25 bp, Mus musculus
caagcatgtctgagtatgattacct

SEQ ID NO: 551181 - DNA, 25 bp, Mus musculus
caagcatgtctgtgtatgattacct

SEQ ID NO: 551182 - DNA, 25 bp, Mus musculus
caagcattccaaaaacaaggccatg

SEQ ID NO: 551183 - DNA, 25 bp, Mus musculus
caagcattccaataacaaggccatg

SEQ ID NO: 551184 - DNA, 25 bp, Mus musculus
caagcattctctactacctggtttt

SEQ ID NO: 551185 - DNA, 25 bp, Mus musculus
caagcattctcttctacctggtttt

SEQ ID NO: 551186 - DNA, 25 bp, Mus musculus
caagcattggaactaggtcccggat

SEQ ID NO: 551187 - DNA, 25 bp, Mus musculus
caagcattggaagtaggtcccggat

SEQ ID NO: 551188 - DNA, 25 bp, Mus musculus
caagcattgttgacggagtcagcag

SEQ ID NO: 551189 - DNA, 25 bp, Mus musculus
caagcattgttgtcggagtcagcag

SEQ ID NO: 551190 - DNA, 25 bp, Mus musculus
caagccaaaggcacagattgtcaaa

SEQ ID NO: 551191 - DNA, 25 bp, Mus musculus
caagccaaaggctcagattgtcaaa

SEQ ID NO: 551192 - DNA, 25 bp, Mus musculus
caagccaaaggtccagtgctgtcag

SEQ ID NO: 551193 - DNA, 25 bp, Mus musculus
caagccaaaggtgcagtgctgtcag

SEQ ID NO: 551194 - DNA, 25 bp, Mus musculus
caagccaaatgtcagacgccaagca

SEQ ID NO: 551195 - DNA, 25 bp, Mus musculus
caagccaaatgtgagacgccaagca

SEQ ID NO: 551196 - DNA, 25 bp, Mus musculus
caagccaacactcgaggagtccaga

SEQ ID NO: 551197 - DNA, 25 bp, Mus musculus
caagccaacactggaggagtccaga

SEQ ID NO: 551198 - DNA, 25 bp, Mus musculus
caagccaacagacatgcacctttag

SEQ ID NO: 551199 - DNA, 25 bp, Mus musculus
caagccaacagagatgcacctttag

SEQ ID NO: 551200 - DNA, 25 bp, Mus musculus
caagccaagacacaatgtttgagac

SEQ ID NO: 551201 - DNA, 25 bp, Mus musculus
caagccaagacagaatgtttgagac

SEQ ID NO: 551202 - DNA, 25 bp, Mus musculus
caagccaagagcattggatcaacat

SEQ ID NO: 551203 - DNA, 25 bp, Mus musculus
caagccaagagcctaggagtgcttg

SEQ ID NO: 551204 - DNA, 25 bp, Mus musculus
caagccaagagcgtaggagtgcttg

SEQ ID NO: 551205 - DNA, 25 bp, Mus musculus
caagccaagagctttggatcaacat

SEQ ID NO: 551206 - DNA, 25 bp, Mus musculus
caagccaagggcacagccggagttg

SEQ ID NO: 551207 - DNA, 25 bp, Mus musculus
caagccaagggctcagccggagttg

SEQ ID NO: 551208 - DNA, 25 bp, Mus musculus
caagccaaggtaatccagatgccga

SEQ ID NO: 551209 - DNA, 25 bp, Mus musculus
caagccaaggtattccagatgccga

SEQ ID NO: 551210 - DNA, 25 bp, Mus musculus
caagccaagtcgctgggacttaaca

SEQ ID NO: 551211 - DNA, 25 bp, Mus musculus
caagccaagtcggtgggacttaaca

SEQ ID NO: 551212 - DNA, 25 bp, Mus musculus
caagccacaaatctaccttcaaggg

SEQ ID NO: 551213 - DNA, 25 bp, Mus musculus
caagccacaaatgtaccttcaaggg

SEQ ID NO: 551214 - DNA, 25 bp, Mus musculus
caagccacagagaatgccttcgcct

SEQ ID NO: 551215 - DNA, 25 bp, Mus musculus
caagccacagagtatgccttcgcct

SEQ ID NO: 551216 - DNA, 25 bp, Mus musculus
caagccacaggaatacaagaagcgg

SEQ ID NO: 551217 - DNA, 25 bp, Mus musculus
caagccacaggattacaagaagcgg

SEQ ID NO: 551218 - DNA, 25 bp, Mus musculus
caagccacattgcaagtatcgaccc

SEQ ID NO: 551219 - DNA, 25 bp, Mus musculus
caagccacattggaagtatcgaccc

SEQ ID NO: 551220 - DNA, 25 bp, Mus musculus
caagccacgcataaatgaagacccc

SEQ ID NO: 551221 - DNA, 25 bp, Mus musculus
caagccacgcattaatgaagacccc

SEQ ID NO: 551222 - DNA, 25 bp, Mus musculus
caagccacggctatcaagttttaat

SEQ ID NO: 551223 - DNA, 25 bp, Mus musculus
caagccacggctttcaagttttaat

SEQ ID NO: 551224 - DNA, 25 bp, Mus musculus
caagccactacaaggaacacaggga

SEQ ID NO: 551225 - DNA, 25 bp, Mus musculus
caagccactacatggaacacaggga

SEQ ID NO: 551226 - DNA, 25 bp, Mus musculus
caagccagaaggagtctacgatacc

SEQ ID NO: 551227 - DNA, 25 bp, Mus musculus
caagccagaaggtgtctacgatacc

SEQ ID NO: 551228 - DNA, 25 bp, Mus musculus
caagccagacaaccttctcttggac

SEQ ID NO: 551229 - DNA, 25 bp, Mus musculus
caagccagacaagcttctcttggac

SEQ ID NO: 551230 - DNA, 25 bp, Mus musculus
caagccagaggtcatcttcaaattg

SEQ ID NO: 551231 - DNA, 25 bp, Mus musculus
caagccagaggtgatcttcaaattg

SEQ ID NO: 551232 - DNA, 25 bp, Mus musculus
caagccagcacccatgttcctggat

SEQ ID NO: 551233 - DNA, 25 bp, Mus musculus
caagccagcaccgatgttcctggat

SEQ ID NO: 551234 - DNA, 25 bp, Mus musculus
caagccagccatcccttaagctggg

SEQ ID NO: 551235 - DNA, 25 bp, Mus musculus
caagccagccatgccttaagctggg

SEQ ID NO: 551236 - DNA, 25 bp, Mus musculus
caagccagcctaactgcagtcagga

SEQ ID NO: 551237 - DNA, 25 bp, Mus musculus
caagccagcctatctgcagtcagga

SEQ ID NO: 551238 - DNA, 25 bp, Mus musculus
caagccagctggaatcgcagcggat

SEQ ID NO: 551239 - DNA, 25 bp, Mus musculus
caagccagctggtatcgcagcggat

SEQ ID NO: 551240 - DNA, 25 bp, Mus musculus
caagccagctgtcttagcagcagga

SEQ ID NO: 551241 - DNA, 25 bp, Mus musculus
caagccagctgtgttagcagcagga

SEQ ID NO: 551242 - DNA, 25 bp, Mus musculus
caagccagggatatgttgtctaaga

SEQ ID NO: 551243 - DNA, 25 bp, Mus musculus
caagccagggatttgttgtctaaga

SEQ ID NO: 551244 - DNA, 25 bp, Mus musculus
caagccaggttgagtagagtacagc

SEQ ID NO: 551245 - DNA, 25 bp, Mus musculus
caagccaggttgtgtagagtacagc

SEQ ID NO: 551246 - DNA, 25 bp, Mus musculus
caagccagtgatagctgccattcac

SEQ ID NO: 551247 - DNA, 25 bp, Mus musculus
caagccagtgattgctgccattcac

SEQ ID NO: 551248 - DNA, 25 bp, Mus musculus
caagccatacagcaggaatttcagt

SEQ ID NO: 551249 - DNA, 25 bp, Mus musculus
caagccatacaggaggaatttcagt

SEQ ID NO: 551250 - DNA, 25 bp, Mus musculus
caagccatagacaagatgcagatga

SEQ ID NO: 551251 - DNA, 25 bp, Mus musculus
caagccatagactagatgcagatga

SEQ ID NO: 551252 - DNA, 25 bp, Mus musculus
caagccatagggagctctattggga

SEQ ID NO: 551253 - DNA, 25 bp, Mus musculus
caagccatagggtgctctattggga

SEQ ID NO: 551254 - DNA, 25 bp, Mus musculus
caagccatagtgagctggacttggc

SEQ ID NO: 551255 - DNA, 25 bp, Mus musculus
caagccatagtgtgctggacttggc

SEQ ID NO: 551256 - DNA, 25 bp, Mus musculus
caagccatagttaaacagggccatg

SEQ ID NO: 551257 - DNA, 25 bp, Mus musculus
caagccatagtttaacagggccatg

SEQ ID NO: 551258 - DNA, 25 bp, Mus musculus
caagccatctaccatgtggtttgga

SEQ ID NO: 551259 - DNA, 25 bp, Mus musculus
caagccatctacgatgtggtttgga

SEQ ID NO: 551260 - DNA, 25 bp, Mus musculus
caagccatctttcctcactgatcag

SEQ ID NO: 551261 - DNA, 25 bp, Mus musculus
caagccatctttgctcactgatcag

SEQ ID NO: 551262 - DNA, 25 bp, Mus musculus
caagccatggaaccgcagatggccc

SEQ ID NO: 551263 - DNA, 25 bp, Mus musculus
caagccatggaagcgcagatggccc

SEQ ID NO: 551264 - DNA, 25 bp, Mus musculus
caagccatgtgccttcagaaaggtc

SEQ ID NO: 551265 - DNA, 25 bp, Mus musculus
caagccatgtgcgttcagaaaggtc

SEQ ID NO: 551266 - DNA, 25 bp, Mus musculus
caagccattctccaacaagcgagga

SEQ ID NO: 551267 - DNA, 25 bp, Mus musculus
caagccattctcgaacaagcgagga

SEQ ID NO: 551268 - DNA, 25 bp, Mus musculus
caagcccaagaacaaagtctttgag

SEQ ID NO: 551269 - DNA, 25 bp, Mus musculus
caagcccaagaagaaagtctttgag

SEQ ID NO: 551270 - DNA, 25 bp, Mus musculus
caagcccaagcaatcataaagtcat

SEQ ID NO: 551271 - DNA, 25 bp, Mus musculus
caagcccaagcattcataaagtcat

SEQ ID NO: 551272 - DNA, 25 bp, Mus musculus
caagcccaagcccttagaagcagga

SEQ ID NO: 551273 - DNA, 25 bp, Mus musculus
caagcccaagccgttagaagcagga

SEQ ID NO: 551274 - DNA, 25 bp, Mus musculus
caagcccaaggacgcattgatatct

SEQ ID NO: 551275 - DNA, 25 bp, Mus musculus
caagcccaaggaggcattgatatct

SEQ ID NO: 551276 - DNA, 25 bp, Mus musculus
caagcccacgtgcagtgtgaaggcc

SEQ ID NO: 551277 - DNA, 25 bp, Mus musculus
caagcccacgtggagtgtgaaggcc

SEQ ID NO: 551278 - DNA, 25 bp, Mus musculus
caagcccactttagccacaatgagt

SEQ ID NO: 551279 - DNA, 25 bp, Mus musculus
caagcccacttttgccacaatgagt

SEQ ID NO: 551280 - DNA, 25 bp, Mus musculus
caagcccagaaaagccttatgtgga

SEQ ID NO: 551281 - DNA, 25 bp, Mus musculus
caagcccagaaatgccttatgtgga

SEQ ID NO: 551282 - DNA, 25 bp, Mus musculus
caagcccagcagaaagtccaacatg

SEQ ID NO: 551283 - DNA, 25 bp, Mus musculus
caagcccagcagtaagtccaacatg

SEQ ID NO: 551284 - DNA, 25 bp, Mus musculus
caagcccagcttatggagaccgacg

SEQ ID NO: 551285 - DNA, 25 bp, Mus musculus
caagcccagcttttggagaccgacg

SEQ ID NO: 551286 - DNA, 25 bp, Mus musculus
caagcccagggtctcccggtcatta

SEQ ID NO: 551287 - DNA, 25 bp, Mus musculus
caagcccagggtgtcccggtcatta

SEQ ID NO: 551288 - DNA, 25 bp, Mus musculus
caagcccagtgactgcggccgaaga

SEQ ID NO: 551289 - DNA, 25 bp, Mus musculus
caagcccagtgagtgcggccgaaga

SEQ ID NO: 551290 - DNA, 25 bp, Mus musculus
caagcccatagtaattgacactcag

SEQ ID NO: 551291 - DNA, 25 bp, Mus musculus
caagcccatagttattgacactcag

SEQ ID NO: 551292 - DNA, 25 bp, Mus musculus
caagcccattggaccctgtgtcaca

SEQ ID NO: 551293 - DNA, 25 bp, Mus musculus
caagcccattggtccctgtgtcaca

SEQ ID NO: 551294 - DNA, 25 bp, Mus musculus
caagcccattgtctccaaggatact

SEQ ID NO: 551295 - DNA, 25 bp, Mus musculus
caagcccattgtgtccaaggatact

SEQ ID NO: 551296 - DNA, 25 bp, Mus musculus
caagccccacacatgcagtcggtgt

SEQ ID NO: 551297 - DNA, 25 bp, Mus musculus
caagccccacacttgcagtcggtgt

SEQ ID NO: 551298 - DNA, 25 bp, Mus musculus
caagccccagaacgattagccagaa

SEQ ID NO: 551299 - DNA, 25 bp, Mus musculus
caagccccagaaggattagccagaa

SEQ ID NO: 551300 - DNA, 25 bp, Mus musculus
caagccccgactcaaccagttgtat

SEQ ID NO: 551301 - DNA, 25 bp, Mus musculus
caagccccgactgaaccagttgtat

SEQ ID NO: 551302 - DNA, 25 bp, Mus musculus
caagcccgaggtcgatttgctgaaa

SEQ ID NO: 551303 - DNA, 25 bp, Mus musculus
caagcccgaggtggatttgctgaaa

SEQ ID NO: 551304 - DNA, 25 bp, Mus musculus
caagcccgataaccatgaagctgct

SEQ ID NO: 551305 - DNA, 25 bp, Mus musculus
caagcccgataagcatgaagctgct

SEQ ID NO: 551306 - DNA, 25 bp, Mus musculus
caagcccgcatgctctacatagtta

SEQ ID NO: 551307 - DNA, 25 bp, Mus musculus
caagcccgcatggtctacatagtta

SEQ ID NO: 551308 - DNA, 25 bp, Mus musculus
caagcccggctaagcaggcaatggc

SEQ ID NO: 551309 - DNA, 25 bp, Mus musculus
caagcccggctatgcaggcaatggc

SEQ ID NO: 551310 - DNA, 25 bp, Mus musculus
caagcccgtgagagtcaaggtgtat

SEQ ID NO: 551311 - DNA, 25 bp, Mus musculus
caagcccgtgagtgtcaaggtgtat

SEQ ID NO: 551312 - DNA, 25 bp, Mus musculus
caagccctaaggatgctcttttcag

SEQ ID NO: 551313 - DNA, 25 bp, Mus musculus
caagccctaaggttgctcttttcag

SEQ ID NO: 551314 - DNA, 25 bp, Mus musculus
caagccctcagcagtgaactgagcg

SEQ ID NO: 551315 - DNA, 25 bp, Mus musculus
caagccctcagctgtgaactgagcg

SEQ ID NO: 551316 - DNA, 25 bp, Mus musculus
caagccctctacaggtggctggcag

SEQ ID NO: 551317 - DNA, 25 bp, Mus musculus
caagccctctactggtggctggcag

SEQ ID NO: 551318 - DNA, 25 bp, Mus musculus
caagccctgaagatggctttccagg

SEQ ID NO: 551319 - DNA, 25 bp, Mus musculus
caagccctgaagttggctttccagg

SEQ ID NO: 551320 - DNA, 25 bp, Mus musculus
caagccctgcaacctgatgctgcag

SEQ ID NO: 551321 - DNA, 25 bp, Mus musculus
caagccctgcaagctgatgctgcag

SEQ ID NO: 551322 - DNA, 25 bp, Mus musculus
caagccctggatctgcaagaagcac

SEQ ID NO: 551323 - DNA, 25 bp, Mus musculus
caagccctggatgtgcaagaagcac

SEQ ID NO: 551324 - DNA, 25 bp, Mus musculus
caagccctggcaacagaaaggcagt

SEQ ID NO: 551325 - DNA, 25 bp, Mus musculus
caagccctggcatcagaaaggcagt

SEQ ID NO: 551326 - DNA, 25 bp, Mus musculus
caagccctgtgtactgagcagtttc

SEQ ID NO: 551327 - DNA, 25 bp, Mus musculus
caagccctgtgttctgagcagtttc

SEQ ID NO: 551328 - DNA, 25 bp, Mus musculus
caagccctttcccagagactgggaa

SEQ ID NO: 551329 - DNA, 25 bp, Mus musculus
caagccctttccgagagactgggaa

SEQ ID NO: 551330 - DNA, 25 bp, Mus musculus
caagccgaaagacttaccagcctgg

SEQ ID NO: 551331 - DNA, 25 bp, Mus musculus
caagccgaaagagttaccagcctgg

SEQ ID NO: 551332 - DNA, 25 bp, Mus musculus
caagccgatctgcatgcatgctgag

SEQ ID NO: 551333 - DNA, 25 bp, Mus musculus
caagccgatctggatgcatgctgag

SEQ ID NO: 551334 - DNA, 25 bp, Mus musculus
caagccgattctcatatttgacgga

SEQ ID NO: 551335 - DNA, 25 bp, Mus musculus
caagccgattctgatatttgacgga

SEQ ID NO: 551336 - DNA, 25 bp, Mus musculus
caagccgcaaggacttccagctgct

SEQ ID NO: 551337 - DNA, 25 bp, Mus musculus
caagccgcaaggtcttccagctgct

SEQ ID NO: 551338 - DNA, 25 bp, Mus musculus
caagccgcttgcattatctccgtgg

SEQ ID NO: 551339 - DNA, 25 bp, Mus musculus
caagccgcttgctttatctccgtgg

SEQ ID NO: 551340 - DNA, 25 bp, Mus musculus
caagccggacatccatgagcaagat

SEQ ID NO: 551341 - DNA, 25 bp, Mus musculus
caagccggacatgcatgagcaagat

SEQ ID NO: 551342 - DNA, 25 bp, Mus musculus
caagccggagttagagcagattgtc

SEQ ID NO: 551343 - DNA, 25 bp, Mus musculus
caagccggagtttgagcagattgtc

SEQ ID NO: 551344 - DNA, 25 bp, Mus musculus
caagccgggaaaccaagaggagttc

SEQ ID NO: 551345 - DNA, 25 bp, Mus musculus
caagccgggaaagcaagaggagttc

SEQ ID NO: 551346 - DNA, 25 bp, Mus musculus
caagccgtgaggctccactgagact

SEQ ID NO: 551347 - DNA, 25 bp, Mus musculus
caagccgtgagggtccactgagact

SEQ ID NO: 551348 - DNA, 25 bp, Mus musculus
caagccgtgcagcagttggtcagcc

SEQ ID NO: 551349 - DNA, 25 bp, Mus musculus
caagccgtgcaggagttggtcagcc

SEQ ID NO: 551350 - DNA, 25 bp, Mus musculus
caagccgtgtgcatcagcacgaatg

SEQ ID NO: 551351 - DNA, 25 bp, Mus musculus
caagccgtgtgcttcagcacgaatg

SEQ ID NO: 551352 - DNA, 25 bp, Mus musculus
caagccgttgttcgattagtccgtc

SEQ ID NO: 551353 - DNA, 25 bp, Mus musculus
caagccgttgttggattagtccgtc

SEQ ID NO: 551354 - DNA, 25 bp, Mus musculus
caagcctacggtcgagagattcatc

SEQ ID NO: 551355 - DNA, 25 bp, Mus musculus
caagcctacggtggagagattcatc

SEQ ID NO: 551356 - DNA, 25 bp, Mus musculus
caagcctagaaaagtggagctgtct

SEQ ID NO: 551357 - DNA, 25 bp, Mus musculus
caagcctagaaatgtggagctgtct

SEQ ID NO: 551358 - DNA, 25 bp, Mus musculus
caagcctatatgcaacactgggagc

SEQ ID NO: 551359 - DNA, 25 bp, Mus musculus
caagcctatatggaacactgggagc

SEQ ID NO: 551360 - DNA, 25 bp, Mus musculus
caagcctatcttaacggacgagtcc

SEQ ID NO: 551361 - DNA, 25 bp, Mus musculus
caagcctatctttacggacgagtcc

SEQ ID NO: 551362 - DNA, 25 bp, Mus musculus
caagcctcagctaaacaagcccatg

SEQ ID NO: 551363 - DNA, 25 bp, Mus musculus
caagcctcagcttaacaagcccatg

SEQ ID NO: 551364 - DNA, 25 bp, Mus musculus
caagcctcctttccgtcactttaag

SEQ ID NO: 551365 - DNA, 25 bp, Mus musculus
caagcctcctttgcgtcactttaag

SEQ ID NO: 551366 - DNA, 25 bp, Mus musculus
caagcctcgagtcatccgggaagta

SEQ ID NO: 551367 - DNA, 25 bp, Mus musculus
caagcctcgagtgatccgggaagta

SEQ ID NO: 551368 - DNA, 25 bp, Mus musculus
caagcctcggcccaacaaaatggcg

SEQ ID NO: 551369 - DNA, 25 bp, Mus musculus
caagcctcggccgaacaaaatggcg

SEQ ID NO: 551370 - DNA, 25 bp, Mus musculus
caagcctctgtgatgcacatgcgcg

SEQ ID NO: 551371 - DNA, 25 bp, Mus musculus
caagcctctgtgttgcacatgcgcg

SEQ ID NO: 551372 - DNA, 25 bp, Mus musculus
caagcctgacgtagctgatgaaggt

SEQ ID NO: 551373 - DNA, 25 bp, Mus musculus
caagcctgacgttgctgatgaaggt

SEQ ID NO: 551374 - DNA, 25 bp, Mus musculus
caagcctgaggtaggtcgcgacgcc

SEQ ID NO: 551375 - DNA, 25 bp, Mus musculus
caagcctgaggttggtcgcgacgcc

SEQ ID NO: 551376 - DNA, 25 bp, Mus musculus
caagcctgcaatcctaagatgcaca

SEQ ID NO: 551377 - DNA, 25 bp, Mus musculus
caagcctgcaatgctaagatgcaca

SEQ ID NO: 551378 - DNA, 25 bp, Mus musculus
caagcctgccgcagagagtgtgcat

SEQ ID NO: 551379 - DNA, 25 bp, Mus musculus
caagcctgccgctgagagtgtgcat

SEQ ID NO: 551380 - DNA, 25 bp, Mus musculus
caagcctgcgctacagtggttctac

SEQ ID NO: 551381 - DNA, 25 bp, Mus musculus
caagcctgcgcttcagtggttctac

SEQ ID NO: 551382 - DNA, 25 bp, Mus musculus
caagcctggctacccaggaagtagc

SEQ ID NO: 551383 - DNA, 25 bp, Mus musculus
caagcctggctagccaggaagtagc

SEQ ID NO: 551384 - DNA, 25 bp, Mus musculus
caagcctggctgaagacaccaggtc

SEQ ID NO: 551385 - DNA, 25 bp, Mus musculus
caagcctggctgatatgtgtgcatg

SEQ ID NO: 551386 - DNA, 25 bp, Mus musculus
caagcctggctgtagacaccaggtc

SEQ ID NO: 551387 - DNA, 25 bp, Mus musculus
caagcctggctgttatgtgtgcatg

SEQ ID NO: 551388 - DNA, 25 bp, Mus musculus
caagcctggtgaaactcacataacc

SEQ ID NO: 551389 - DNA, 25 bp, Mus musculus
caagcctggtgaatacacattgctg

SEQ ID NO: 551390 - DNA, 25 bp, Mus musculus
caagcctggtgatactcacataacc

SEQ ID NO: 551391 - DNA, 25 bp, Mus musculus
caagcctggtgattacacattgctg

SEQ ID NO: 551392 - DNA, 25 bp, Mus musculus
caagcctgtcagcaattgatcccat

SEQ ID NO: 551393 - DNA, 25 bp, Mus musculus
caagcctgtcaggaattgatcccat

SEQ ID NO: 551394 - DNA, 25 bp, Mus musculus
caagcctgtgaaatacaaaaatgtt

SEQ ID NO: 551395 - DNA, 25 bp, Mus musculus
caagcctgtgaacaaggacacccaa

SEQ ID NO: 551396 - DNA, 25 bp, Mus musculus
caagcctgtgaagaaggacacccaa

SEQ ID NO: 551397 - DNA, 25 bp, Mus musculus
caagcctgtgaattacaaaaatgtt

SEQ ID NO: 551398 - DNA, 25 bp, Mus musculus
caagcctgtgtgcaagccctgctat

SEQ ID NO: 551399 - DNA, 25 bp, Mus musculus
caagcctgtgtggaagccctgctat

SEQ ID NO: 551400 - DNA, 25 bp, Mus musculus
caagccttaatgaccgagctgaaga

SEQ ID NO: 551401 - DNA, 25 bp, Mus musculus
caagccttaatgtccgagctgaaga

SEQ ID NO: 551402 - DNA, 25 bp, Mus musculus
caagccttaggtcccacgaggtagg

SEQ ID NO: 551403 - DNA, 25 bp, Mus musculus
caagccttaggtgccacgaggtagg

SEQ ID NO: 551404 - DNA, 25 bp, Mus musculus
caagccttatatctgcaaggtgcgc

SEQ ID NO: 551405 - DNA, 25 bp, Mus musculus
caagccttatatgtgcaaggtgcgc

SEQ ID NO: 551406 - DNA, 25 bp, Mus musculus
caagccttcgggacagcctccttaa

SEQ ID NO: 551407 - DNA, 25 bp, Mus musculus
caagccttcgggtcagcctccttaa

SEQ ID NO: 551408 - DNA, 25 bp, Mus musculus
caagcctttccaatgtgctctttcg

SEQ ID NO: 551409 - DNA, 25 bp, Mus musculus
caagcctttccattgtgctctttcg

SEQ ID NO: 551410 - DNA, 25 bp, Mus musculus
caagcctttgacagcttgcagccat

SEQ ID NO: 551411 - DNA, 25 bp, Mus musculus
caagcctttgactgcttgcagccat

SEQ ID NO: 551412 - DNA, 25 bp, Mus musculus
caagcctttgatctgatgcactcgg

SEQ ID NO: 551413 - DNA, 25 bp, Mus musculus
caagcctttgatgtgatgcactcgg

SEQ ID NO: 551414 - DNA, 25 bp, Mus musculus
caagcctttgctcatgccttgctca

SEQ ID NO: 551415 - DNA, 25 bp, Mus musculus
caagcctttgctgatgccttgctca

SEQ ID NO: 551416 - DNA, 25 bp, Mus musculus
caagcgaaagtgcatcggagagacc

SEQ ID NO: 551417 - DNA, 25 bp, Mus musculus
caagcgaaagtggatcggagagacc

SEQ ID NO: 551418 - DNA, 25 bp, Mus musculus
caagcgaatgagagagtgtcccatc

SEQ ID NO: 551419 - DNA, 25 bp, Mus musculus
caagcgaatgagtgagtgtcccatc

SEQ ID NO: 551420 - DNA, 25 bp, Mus musculus
caagcgaatgctcgacatgaaggcc

SEQ ID NO: 551421 - DNA, 25 bp, Mus musculus
caagcgaatgctggacatgaaggcc

SEQ ID NO: 551422 - DNA, 25 bp, Mus musculus
caagcgacgcgtcctgcaggaatac

SEQ ID NO: 551423 - DNA, 25 bp, Mus musculus
caagcgacgcgtgctgcaggaatac

SEQ ID NO: 551424 - DNA, 25 bp, Mus musculus
caagcgacggctcgattcggagaac

SEQ ID NO: 551425 - DNA, 25 bp, Mus musculus
caagcgacggctggattcggagaac

SEQ ID NO: 551426 - DNA, 25 bp, Mus musculus
caagcgagttgcaatagtaatcatc

SEQ ID NO: 551427 - DNA, 25 bp, Mus musculus
caagcgagttgctatagtaatcatc

SEQ ID NO: 551428 - DNA, 25 bp, Mus musculus
caagcgatggtaagatgtgcagagt

SEQ ID NO: 551429 - DNA, 25 bp, Mus musculus
caagcgatggtatgatgtgcagagt

SEQ ID NO: 551430 - DNA, 25 bp, Mus musculus
caagcgcaaaatcttttaacgcaac

SEQ ID NO: 551431 - DNA, 25 bp, Mus musculus
caagcgcaaaatgttttaacgcaac

SEQ ID NO: 551432 - DNA, 25 bp, Mus musculus
caagcgcaagagaactgcgcaggag

SEQ ID NO: 551433 - DNA, 25 bp, Mus musculus
caagcgcaagagtactgcgcaggag

SEQ ID NO: 551434 - DNA, 25 bp, Mus musculus
caagcgcaagatcaggagacgttcg

SEQ ID NO: 551435 - DNA, 25 bp, Mus musculus
caagcgcaagatgaggagacgttcg

SEQ ID NO: 551436 - DNA, 25 bp, Mus musculus
caagcgcagcataaaagagcggctc

SEQ ID NO: 551437 - DNA, 25 bp, Mus musculus
caagcgcagcattaaagagcggctc

SEQ ID NO: 551438 - DNA, 25 bp, Mus musculus
caagcgccaaaaaggcattgtatag

SEQ ID NO: 551439 - DNA, 25 bp, Mus musculus
caagcgccaaaatggcattgtatag

SEQ ID NO: 551440 - DNA, 25 bp, Mus musculus
caagcgccatgcagcgttgctggga

SEQ ID NO: 551441 - DNA, 25 bp, Mus musculus
caagcgccatgctgcgttgctggga

SEQ ID NO: 551442 - DNA, 25 bp, Mus musculus
caagcgccggcaagagacgcggctt

SEQ ID NO: 551443 - DNA, 25 bp, Mus musculus
caagcgccggcatgagacgcggctt

SEQ ID NO: 551444 - DNA, 25 bp, Mus musculus
caagcgccggttaacactggcggga

SEQ ID NO: 551445 - DNA, 25 bp, Mus musculus
caagcgccggtttacactggcggga

SEQ ID NO: 551446 - DNA, 25 bp, Mus musculus
caagcgcctactactagtcggtggg

SEQ ID NO: 551447 - DNA, 25 bp, Mus musculus
caagcgcctacttctagtcggtggg

SEQ ID NO: 551448 - DNA, 25 bp, Mus musculus
caagcgcgagggaaagagacactta

SEQ ID NO: 551449 - DNA, 25 bp, Mus musculus
caagcgcgagggtaagagacactta

SEQ ID NO: 551450 - DNA, 25 bp, Mus musculus
caagcgcgatttctggtttctggtg

SEQ ID NO: 551451 - DNA, 25 bp, Mus musculus
caagcgcgatttgtggtttctggtg

SEQ ID NO: 551452 - DNA, 25 bp, Mus musculus
caagcgctcacacagcagacaatca

SEQ ID NO: 551453 - DNA, 25 bp, Mus musculus
caagcgctcacagagcagacaatca

SEQ ID NO: 551454 - DNA, 25 bp, Mus musculus
caagcgctgctccagatgccagaat

SEQ ID NO: 551455 - DNA, 25 bp, Mus musculus
caagcgctgctcgagatgccagaat

SEQ ID NO: 551456 - DNA, 25 bp, Mus musculus
caagcgctggcactacaatgacagt

SEQ ID NO: 551457 - DNA, 25 bp, Mus musculus
caagcgctggcagtacaatgacagt

SEQ ID NO: 551458 - DNA, 25 bp, Mus musculus
caagcgcttccgcaaagcacaatgt

SEQ ID NO: 551459 - DNA, 25 bp, Mus musculus
caagcgcttccggaaagcacaatgt

SEQ ID NO: 551460 - DNA, 25 bp, Mus musculus
caagcgcttgagctgtcactgaagt

SEQ ID NO: 551461 - DNA, 25 bp, Mus musculus
caagcgcttgaggtgtcactgaagt

SEQ ID NO: 551462 - DNA, 25 bp, Mus musculus
caagcgcttgatccgggatgccgag

SEQ ID NO: 551463 - DNA, 25 bp, Mus musculus
caagcgcttgatgcgggatgccgag

SEQ ID NO: 551464 - DNA, 25 bp, Mus musculus
caagcgcttgtacgacttggccagc

SEQ ID NO: 551465 - DNA, 25 bp, Mus musculus
caagcgcttgtaggacttggccagc

SEQ ID NO: 551466 - DNA, 25 bp, Mus musculus
caagcgctttaccttaacagcgctc

SEQ ID NO: 551467 - DNA, 25 bp, Mus musculus
caagcgctttacgttaacagcgctc

SEQ ID NO: 551468 - DNA, 25 bp, Mus musculus
caagcgctttggaaacctgactgcc

SEQ ID NO: 551469 - DNA, 25 bp, Mus musculus
caagcgctttggtaacctgactgcc

SEQ ID NO: 551470 - DNA, 25 bp, Mus musculus
caagcggaatttattctctctcagc

SEQ ID NO: 551471 - DNA, 25 bp, Mus musculus
caagcggaattttttctctctcagc

SEQ ID NO: 551472 - DNA, 25 bp, Mus musculus
caagcggaccctaacaaccggagat

SEQ ID NO: 551473 - DNA, 25 bp, Mus musculus
caagcggacccttacaaccggagat

SEQ ID NO: 551474 - DNA, 25 bp, Mus musculus
caagcggactctccagactgaagac

SEQ ID NO: 551475 - DNA, 25 bp, Mus musculus
caagcggactctgcagactgaagac

SEQ ID NO: 551476 - DNA, 25 bp, Mus musculus
caagcggatcgactattcactgtac

SEQ ID NO: 551477 - DNA, 25 bp, Mus musculus
caagcggatcgagtattcactgtac

SEQ ID NO: 551478 - DNA, 25 bp, Mus musculus
caagcggcattacaacctgggtgaa

SEQ ID NO: 551479 - DNA, 25 bp, Mus musculus
caagcggcattagaacctgggtgaa

SEQ ID NO: 551480 - DNA, 25 bp, Mus musculus
caagcggctagaagacctatgcagc

SEQ ID NO: 551481 - DNA, 25 bp, Mus musculus
caagcggctagatgacctatgcagc

SEQ ID NO: 551482 - DNA, 25 bp, Mus musculus
caagcggcttataagcgttacagca

SEQ ID NO: 551483 - DNA, 25 bp, Mus musculus
caagcggcttattagcgttacagca

SEQ ID NO: 551484 - DNA, 25 bp, Mus musculus
caagcgggaagaagacgccgagtca

SEQ ID NO: 551485 - DNA, 25 bp, Mus musculus
caagcgggaagatgacgccgagtca

SEQ ID NO: 551486 - DNA, 25 bp, Mus musculus
caagcgggcttcacggacggttctt

SEQ ID NO: 551487 - DNA, 25 bp, Mus musculus
caagcgggcttctcggacggttctt

SEQ ID NO: 551488 - DNA, 25 bp, Mus musculus
caagcgggtgctcgctatcaccaca

SEQ ID NO: 551489 - DNA, 25 bp, Mus musculus
caagcgggtgctggctatcaccaca

SEQ ID NO: 551490 - DNA, 25 bp, Mus musculus
caagcggtctctcgtaggtggctaa

SEQ ID NO: 551491 - DNA, 25 bp, Mus musculus
caagcggtctctggtaggtggctaa

SEQ ID NO: 551492 - DNA, 25 bp, Mus musculus
caagcggtgcaacgacaagaaacgc

SEQ ID NO: 551493 - DNA, 25 bp, Mus musculus
caagcggtgcaaggacaagaaacgc

SEQ ID NO: 551494 - DNA, 25 bp, Mus musculus
caagcggttgtcaatcccggagcca

SEQ ID NO: 551495 - DNA, 25 bp, Mus musculus
caagcggttgtctatcccggagcca

SEQ ID NO: 551496 - DNA, 25 bp, Mus musculus
caagcggttgtgcaaggtctgcatc

SEQ ID NO: 551497 - DNA, 25 bp, Mus musculus
caagcggttgtggaaggtctgcatc

SEQ ID NO: 551498 - DNA, 25 bp, Mus musculus
caagcggtttggcaccttgaacaag

SEQ ID NO: 551499 - DNA, 25 bp, Mus musculus
caagcggtttgggaccttgaacaag

SEQ ID NO: 551500 - DNA, 25 bp, Mus musculus
caagcgtaacgacaaccagctcatt

SEQ ID NO: 551501 - DNA, 25 bp, Mus musculus
caagcgtaacgagaaccagctcatt

SEQ ID NO: 551502 - DNA, 25 bp, Mus musculus
caagcgtagcaactatttatgaaaa

SEQ ID NO: 551503 - DNA, 25 bp, Mus musculus
caagcgtagcaagtatttatgaaaa

SEQ ID NO: 551504 - DNA, 25 bp, Mus musculus
caagcgtcgcccaattgccaatggg

SEQ ID NO: 551505 - DNA, 25 bp, Mus musculus
caagcgtcgccctattgccaatggg

SEQ ID NO: 551506 - DNA, 25 bp, Mus musculus
caagcgtgaataccaggagttctcc

SEQ ID NO: 551507 - DNA, 25 bp, Mus musculus
caagcgtgaatagcaggagttctcc

SEQ ID NO: 551508 - DNA, 25 bp, Mus musculus
caagcgtgagctactatgggctggc

SEQ ID NO: 551509 - DNA, 25 bp, Mus musculus
caagcgtgagcttctatgggctggc

SEQ ID NO: 551510 - DNA, 25 bp, Mus musculus
caagcgtgccacaccaatcgaggtg

SEQ ID NO: 551511 - DNA, 25 bp, Mus musculus
caagcgtgccactccaatcgaggtg

SEQ ID NO: 551512 - DNA, 25 bp, Mus musculus
caagcgtggttcaatcaagagctcc

SEQ ID NO: 551513 - DNA, 25 bp, Mus musculus
caagcgtggttctatcaagagctcc

SEQ ID NO: 551514 - DNA, 25 bp, Mus musculus
caagcgttatccacctgtattcgtg

SEQ ID NO: 551515 - DNA, 25 bp, Mus musculus
caagcgttatcctcctgtattcgtg

SEQ ID NO: 551516 - DNA, 25 bp, Mus musculus
caagcgttcagcacagttcttcaac

SEQ ID NO: 551517 - DNA, 25 bp, Mus musculus
caagcgttcagctcagttcttcaac

SEQ ID NO: 551518 - DNA, 25 bp, Mus musculus
caagcgtttgttcgagtcatgccta

SEQ ID NO: 551519 - DNA, 25 bp, Mus musculus
caagcgtttgttggagtcatgccta

SEQ ID NO: 551520 - DNA, 25 bp, Mus musculus
caagctaaaaagcaagtactggtgg

SEQ ID NO: 551521 - DNA, 25 bp, Mus musculus
caagctaaaaaggaagtactggtgg

SEQ ID NO: 551522 - DNA, 25 bp, Mus musculus
caagctaaagaccaaccacattggc

SEQ ID NO: 551523 - DNA, 25 bp, Mus musculus
caagctaaagacgaaccacattggc

SEQ ID NO: 551524 - DNA, 25 bp, Mus musculus
caagctaaaggacaactgggattat

SEQ ID NO: 551525 - DNA, 25 bp, Mus musculus
caagctaaaggagaactgggattat

SEQ ID NO: 551526 - DNA, 25 bp, Mus musculus
caagctaaataactatcacgaacct

SEQ ID NO: 551527 - DNA, 25 bp, Mus musculus
caagctaaataagtatcacgaacct

SEQ ID NO: 551528 - DNA, 25 bp, Mus musculus
caagctaacctcagtgcctagtcac

SEQ ID NO: 551529 - DNA, 25 bp, Mus musculus
caagctaacctctgtgcctagtcac

SEQ ID NO: 551530 - DNA, 25 bp, Mus musculus
caagctaagcagagacgaggacctg

SEQ ID NO: 551531 - DNA, 25 bp, Mus musculus
caagctaagcagtgacgaggacctg

SEQ ID NO: 551532 - DNA, 25 bp, Mus musculus
caagctaagcgcctttgcagccgtc

SEQ ID NO: 551533 - DNA, 25 bp, Mus musculus
caagctaagcgcgtttgcagccgtc

SEQ ID NO: 551534 - DNA, 25 bp, Mus musculus
caagctaagtaaacgtttcttccct

SEQ ID NO: 551535 - DNA, 25 bp, Mus musculus
caagctaagtaatcgtttcttccct

SEQ ID NO: 551536 - DNA, 25 bp, Mus musculus
caagctaattgaagaatcgtgtcct

SEQ ID NO: 551537 - DNA, 25 bp, Mus musculus
caagctaattgatgaatcgtgtcct

SEQ ID NO: 551538 - DNA, 25 bp, Mus musculus
caagctacacgtaggagactttgtg

SEQ ID NO: 551539 - DNA, 25 bp, Mus musculus
caagctacacgttggagactttgtg

SEQ ID NO: 551540 - DNA, 25 bp, Mus musculus
caagctacggttcacagtggataaa

SEQ ID NO: 551541 - DNA, 25 bp, Mus musculus
caagctacggttgacagtggataaa

SEQ ID NO: 551542 - DNA, 25 bp, Mus musculus
caagctacgtggagcccggctcaag

SEQ ID NO: 551543 - DNA, 25 bp, Mus musculus
caagctacgtggtgcccggctcaag

SEQ ID NO: 551544 - DNA, 25 bp, Mus musculus
caagctagacagaagccgtagccga

SEQ ID NO: 551545 - DNA, 25 bp, Mus musculus
caagctagacagtagccgtagccga

SEQ ID NO: 551546 - DNA, 25 bp, Mus musculus
caagctagactcaatcaagcaggag

SEQ ID NO: 551547 - DNA, 25 bp, Mus musculus
caagctagactctatcaagcaggag

SEQ ID NO: 551548 - DNA, 25 bp, Mus musculus
caagctagtggtcgcagatacaaga

SEQ ID NO: 551549 - DNA, 25 bp, Mus musculus
caagctagtggtggcagatacaaga

SEQ ID NO: 551550 - DNA, 25 bp, Mus musculus
caagctatgccgacctagagtctca

SEQ ID NO: 551551 - DNA, 25 bp, Mus musculus
caagctatgccgtcctagagtctca

SEQ ID NO: 551552 - DNA, 25 bp, Mus musculus
caagctcaacggaaagaggattccc

SEQ ID NO: 551553 - DNA, 25 bp, Mus musculus
caagctcaacggtaagaggattccc

SEQ ID NO: 551554 - DNA, 25 bp, Mus musculus
caagctcaacttcaagatgaaggca

SEQ ID NO: 551555 - DNA, 25 bp, Mus musculus
caagctcaacttgaagatgaaggca

SEQ ID NO: 551556 - DNA, 25 bp, Mus musculus
caagctcaagaaaaccaatgtcttc

SEQ ID NO: 551557 - DNA, 25 bp, Mus musculus
caagctcaagaataccaatgtcttc

SEQ ID NO: 551558 - DNA, 25 bp, Mus musculus
caagctcaagacattggtggacaaa

SEQ ID NO: 551559 - DNA, 25 bp, Mus musculus
caagctcaagactttggtggacaaa

SEQ ID NO: 551560 - DNA, 25 bp, Mus musculus
caagctcagagccatttgaacgcca

SEQ ID NO: 551561 - DNA, 25 bp, Mus musculus
caagctcagagcgatttgaacgcca

SEQ ID NO: 551562 - DNA, 25 bp, Mus musculus
caagctcagcagctcaacaggacca

SEQ ID NO: 551563 - DNA, 25 bp, Mus musculus
caagctcagcaggtcaacaggacca

SEQ ID NO: 551564 - DNA, 25 bp, Mus musculus
caagctcaggatcgttccaggcagc

SEQ ID NO: 551565 - DNA, 25 bp, Mus musculus
caagctcaggatggttccaggcagc

SEQ ID NO: 551566 - DNA, 25 bp, Mus musculus
caagctcaggctccatgaagatcac

SEQ ID NO: 551567 - DNA, 25 bp, Mus musculus
caagctcaggctgcatgaagatcac

SEQ ID NO: 551568 - DNA, 25 bp, Mus musculus
caagctcattagcaagaagctggag

SEQ ID NO: 551569 - DNA, 25 bp, Mus musculus
caagctcattaggaagaagctggag

SEQ ID NO: 551570 - DNA, 25 bp, Mus musculus
caagctccagagatgtgggtcccca

SEQ ID NO: 551571 - DNA, 25 bp, Mus musculus
caagctccagagttgtgggtcccca

SEQ ID NO: 551572 - DNA, 25 bp, Mus musculus
caagctccatctctttgggcggaca

SEQ ID NO: 551573 - DNA, 25 bp, Mus musculus
caagctccatctgtttgggcggaca

SEQ ID NO: 551574 - DNA, 25 bp, Mus musculus
caagctccccagaggaagtctgtgg

SEQ ID NO: 551575 - DNA, 25 bp, Mus musculus
caagctccccagtggaagtctgtgg

SEQ ID NO: 551576 - DNA, 25 bp, Mus musculus
caagctccggagacaaagctatgac

SEQ ID NO: 551577 - DNA, 25 bp, Mus musculus
caagctccggagtcaaagctatgac

SEQ ID NO: 551578 - DNA, 25 bp, Mus musculus
caagctcctagacacaactgtggac

SEQ ID NO: 551579 - DNA, 25 bp, Mus musculus
caagctcctagagacaactgtggac

SEQ ID NO: 551580 - DNA, 25 bp, Mus musculus
caagctcctgaacgtgggctatctg

SEQ ID NO: 551581 - DNA, 25 bp, Mus musculus
caagctcctgaaggtgggctatctg

SEQ ID NO: 551582 - DNA, 25 bp, Mus musculus
caagctcctgtaagctgttgaacat

SEQ ID NO: 551583 - DNA, 25 bp, Mus musculus
caagctcctgtatgctgttgaacat

SEQ ID NO: 551584 - DNA, 25 bp, Mus musculus
caagctcgcctcaggtggtcaggga

SEQ ID NO: 551585 - DNA, 25 bp, Mus musculus
caagctcgcctctggtggtcaggga

SEQ ID NO: 551586 - DNA, 25 bp, Mus musculus
caagctcgcctgcttgtagtgggca

SEQ ID NO: 551587 - DNA, 25 bp, Mus musculus
caagctcgcctggttgtagtgggca

SEQ ID NO: 551588 - DNA, 25 bp, Mus musculus
caagctcgctttatattagagaaaa

SEQ ID NO: 551589 - DNA, 25 bp, Mus musculus
caagctcgctttttattagagaaaa

SEQ ID NO: 551590 - DNA, 25 bp, Mus musculus
caagctcggtgtcggatatttggtt

SEQ ID NO: 551591 - DNA, 25 bp, Mus musculus
caagctcggtgtgggatatttggtt

SEQ ID NO: 551592 - DNA, 25 bp, Mus musculus
caagctcgtctcagccgcaggtgta

SEQ ID NO: 551593 - DNA, 25 bp, Mus musculus
caagctcgtctctgccgcaggtgta

SEQ ID NO: 551594 - DNA, 25 bp, Mus musculus
caagctcgtgtcacggacaaacaac

SEQ ID NO: 551595 - DNA, 25 bp, Mus musculus
caagctcgtgtctcggacaaacaac

SEQ ID NO: 551596 - DNA, 25 bp, Mus musculus
caagctctctgaacagacagtgctg

SEQ ID NO: 551597 - DNA, 25 bp, Mus musculus
caagctctctgatcagacagtgctg

SEQ ID NO: 551598 - DNA, 25 bp, Mus musculus
caagctctctttcgagaccacgtta

SEQ ID NO: 551599 - DNA, 25 bp, Mus musculus
caagctctctttggagaccacgtta

SEQ ID NO: 551600 - DNA, 25 bp, Mus musculus
caagctctgaggcttccgctttgca

SEQ ID NO: 551601 - DNA, 25 bp, Mus musculus
caagctctgagggttccgctttgca

SEQ ID NO: 551602 - DNA, 25 bp, Mus musculus
caagctctgatccaactctgtaaag

SEQ ID NO: 551603 - DNA, 25 bp, Mus musculus
caagctctgatcgaactctgtaaag

SEQ ID NO: 551604 - DNA, 25 bp, Mus musculus
caagctctgcaaacgtaggatcgag

SEQ ID NO: 551605 - DNA, 25 bp, Mus musculus
caagctctgcaatcgtaggatcgag

SEQ ID NO: 551606 - DNA, 25 bp, Mus musculus
caagctctggtacacagtggacaaa

SEQ ID NO: 551607 - DNA, 25 bp, Mus musculus
caagctctggtagacagtggacaaa

SEQ ID NO: 551608 - DNA, 25 bp, Mus musculus
caagctctgttgcaagctctgaatc

SEQ ID NO: 551609 - DNA, 25 bp, Mus musculus
caagctctgttggaagctctgaatc

SEQ ID NO: 551610 - DNA, 25 bp, Mus musculus
caagctcttcagacagggcattgga

SEQ ID NO: 551611 - DNA, 25 bp, Mus musculus
caagctcttcagtcagggcattgga

SEQ ID NO: 551612 - DNA, 25 bp, Mus musculus
caagctcttgcaatagaatctcggg

SEQ ID NO: 551613 - DNA, 25 bp, Mus musculus
caagctcttgcattagaatctcggg

SEQ ID NO: 551614 - DNA, 25 bp, Mus musculus
caagctcttgcgcatgcctactttg

SEQ ID NO: 551615 - DNA, 25 bp, Mus musculus
caagctcttgcggatgcctactttg

SEQ ID NO: 551616 - DNA, 25 bp, Mus musculus
caagctcttggtctggagagcgctc

SEQ ID NO: 551617 - DNA, 25 bp, Mus musculus
caagctcttggtgtggagagcgctc

SEQ ID NO: 551618 - DNA, 25 bp, Mus musculus
caagctctttcacaagttgatcatc

SEQ ID NO: 551619 - DNA, 25 bp, Mus musculus
caagctctttcagaagttgatcatc

SEQ ID NO: 551620 - DNA, 25 bp, Mus musculus
caagctgaaagtaggctgccatgag

SEQ ID NO: 551621 - DNA, 25 bp, Mus musculus
caagctgaaagttggctgccatgag

SEQ ID NO: 551622 - DNA, 25 bp, Mus musculus
caagctgaactaccaggtgtctgag

SEQ ID NO: 551623 - DNA, 25 bp, Mus musculus
caagctgaactagcaggtgtctgag

SEQ ID NO: 551624 - DNA, 25 bp, Mus musculus
caagctgaagcaattgtccaagtac

SEQ ID NO: 551625 - DNA, 25 bp, Mus musculus
caagctgaagcatttgtccaagtac

SEQ ID NO: 551626 - DNA, 25 bp, Mus musculus
caagctgacagacgctttcaagtac

SEQ ID NO: 551627 - DNA, 25 bp, Mus musculus
caagctgacagaggctttcaagtac

SEQ ID NO: 551628 - DNA, 25 bp, Mus musculus
caagctgacgagattgtccaggaga

SEQ ID NO: 551629 - DNA, 25 bp, Mus musculus
caagctgacgagtttgtccaggaga

SEQ ID NO: 551630 - DNA, 25 bp, Mus musculus
caagctgactgcaacctggtgtcta

SEQ ID NO: 551631 - DNA, 25 bp, Mus musculus
caagctgactgctacctggtgtcta

SEQ ID NO: 551632 - DNA, 25 bp, Mus musculus
caagctgacttcaatgccgttgagt

SEQ ID NO: 551633 - DNA, 25 bp, Mus musculus
caagctgacttctatgccgttgagt

SEQ ID NO: 551634 - DNA, 25 bp, Mus musculus
caagctgagctgacagctcgattgc

SEQ ID NO: 551635 - DNA, 25 bp, Mus musculus
caagctgagctgtcagctcgattgc

SEQ ID NO: 551636 - DNA, 25 bp, Mus musculus
caagctgagggcatgtctgagaatg

SEQ ID NO: 551637 - DNA, 25 bp, Mus musculus
caagctgagggcttgtctgagaatg

SEQ ID NO: 551638 - DNA, 25 bp, Mus musculus
caagctgataagaaatgcctctgaa

SEQ ID NO: 551639 - DNA, 25 bp, Mus musculus
caagctgataagtaatgcctctgaa

SEQ ID NO: 551640 - DNA, 25 bp, Mus musculus
caagctgatactcctagtggcccgg

SEQ ID NO: 551641 - DNA, 25 bp, Mus musculus
caagctgatactgctagtggcccgg

SEQ ID NO: 551642 - DNA, 25 bp, Mus musculus
caagctgatcagagctgccatccgc

SEQ ID NO: 551643 - DNA, 25 bp, Mus musculus
caagctgatcagtgctgccatccgc

SEQ ID NO: 551644 - DNA, 25 bp, Mus musculus
caagctgatggactctgatggcctc

SEQ ID NO: 551645 - DNA, 25 bp, Mus musculus
caagctgatggagtctgatggcctc

SEQ ID NO: 551646 - DNA, 25 bp, Mus musculus
caagctgatggcagaattagttcat

SEQ ID NO: 551647 - DNA, 25 bp, Mus musculus
caagctgatggctgaattagttcat

SEQ ID NO: 551648 - DNA, 25 bp, Mus musculus
caagctgcacggagtgaacatcaat

SEQ ID NO: 551649 - DNA, 25 bp, Mus musculus
caagctgcacggtgtgaacatcaat

SEQ ID NO: 551650 - DNA, 25 bp, Mus musculus
caagctgcactgcaggagattcaca

SEQ ID NO: 551651 - DNA, 25 bp, Mus musculus
caagctgcactggaggagattcaca

SEQ ID NO: 551652 - DNA, 25 bp, Mus musculus
caagctgcagcaatttgagagtggc

SEQ ID NO: 551653 - DNA, 25 bp, Mus musculus
caagctgcagcattttgagagtggc

SEQ ID NO: 551654 - DNA, 25 bp, Mus musculus
caagctgcagctcctgggtattgcc

SEQ ID NO: 551655 - DNA, 25 bp, Mus musculus
caagctgcagctgctgggtattgcc

SEQ ID NO: 551656 - DNA, 25 bp, Mus musculus
caagctgcaggacagcggattctac

SEQ ID NO: 551657 - DNA, 25 bp, Mus musculus
caagctgcaggagagcggattctac

SEQ ID NO: 551658 - DNA, 25 bp, Mus musculus
caagctgcccagcttctgacggtaa

SEQ ID NO: 551659 - DNA, 25 bp, Mus musculus
caagctgcccaggttctgacggtaa

SEQ ID NO: 551660 - DNA, 25 bp, Mus musculus
caagctgcgagaagccctactgatg

SEQ ID NO: 551661 - DNA, 25 bp, Mus musculus
caagctgcgagatgccctactgatg

SEQ ID NO: 551662 - DNA, 25 bp, Mus musculus
caagctgcgcagacagactcgggtt

SEQ ID NO: 551663 - DNA, 25 bp, Mus musculus
caagctgcgcagtcagactcgggtt

SEQ ID NO: 551664 - DNA, 25 bp, Mus musculus
caagctgctaaacacagaattgtag

SEQ ID NO: 551665 - DNA, 25 bp, Mus musculus
caagctgctaaagacagaattgtag

SEQ ID NO: 551666 - DNA, 25 bp, Mus musculus
caagctgctactcatagctcagggc

SEQ ID NO: 551667 - DNA, 25 bp, Mus musculus
caagctgctactgatagctcagggc

SEQ ID NO: 551668 - DNA, 25 bp, Mus musculus
caagctgctctacgcgttcgccgag

SEQ ID NO: 551669 - DNA, 25 bp, Mus musculus
caagctgctctaggcgttcgccgag

SEQ ID NO: 551670 - DNA, 25 bp, Mus musculus
caagctgctgatagagcagttggag

SEQ ID NO: 551671 - DNA, 25 bp, Mus musculus
caagctgctgattgagcagttggag

SEQ ID NO: 551672 - DNA, 25 bp, Mus musculus
caagctgctggacaaactgctggtc

SEQ ID NO: 551673 - DNA, 25 bp, Mus musculus
caagctgctggagaaactgctggtc

SEQ ID NO: 551674 - DNA, 25 bp, Mus musculus
caagctgcttggcatactcactgat

SEQ ID NO: 551675 - DNA, 25 bp, Mus musculus
caagctgcttgggatactcactgat

SEQ ID NO: 551676 - DNA, 25 bp, Mus musculus
caagctgctttacagatgatggctc

SEQ ID NO: 551677 - DNA, 25 bp, Mus musculus
caagctgctttagagatgatggctc

SEQ ID NO: 551678 - DNA, 25 bp, Mus musculus
caagctggaaaaatatggtgcagaa

SEQ ID NO: 551679 - DNA, 25 bp, Mus musculus
caagctggaaaattatggtgcagaa

SEQ ID NO: 551680 - DNA, 25 bp, Mus musculus
caagctggaaatatgggaggaccta

SEQ ID NO: 551681 - DNA, 25 bp, Mus musculus
caagctggaaatttgggaggaccta

SEQ ID NO: 551682 - DNA, 25 bp, Mus musculus
caagctggaataactagtttttaca

SEQ ID NO: 551683 - DNA, 25 bp, Mus musculus
caagctggaatatctagtttttaca

SEQ ID NO: 551684 - DNA, 25 bp, Mus musculus
caagctggacagcacaagcgatcca

SEQ ID NO: 551685 - DNA, 25 bp, Mus musculus
caagctggacaggacaagcgatcca

SEQ ID NO: 551686 - DNA, 25 bp, Mus musculus
caagctggactcaagggttgtctgg

SEQ ID NO: 551687 - DNA, 25 bp, Mus musculus
caagctggactctagggttgtctgg

SEQ ID NO: 551688 - DNA, 25 bp, Mus musculus
caagctggagaaccgtaaggacatc

SEQ ID NO: 551689 - DNA, 25 bp, Mus musculus
caagctggagaagcgtaaggacatc

SEQ ID NO: 551690 - DNA, 25 bp, Mus musculus
caagctggaggtcgatgctaccgat

SEQ ID NO: 551691 - DNA, 25 bp, Mus musculus
caagctggaggtggatgctaccgat

SEQ ID NO: 551692 - DNA, 25 bp, Mus musculus
caagctggagttcgatgcagtcaca

SEQ ID NO: 551693 - DNA, 25 bp, Mus musculus
caagctggagttggatgcagtcaca

SEQ ID NO: 551694 - DNA, 25 bp, Mus musculus
caagctggatcacgcaagctccagc

SEQ ID NO: 551695 - DNA, 25 bp, Mus musculus
caagctggatcaggcaagctccagc

SEQ ID NO: 551696 - DNA, 25 bp, Mus musculus
caagctggcaaacggactgttgctt

SEQ ID NO: 551697 - DNA, 25 bp, Mus musculus
caagctggcaaagggactgttgctt

SEQ ID NO: 551698 - DNA, 25 bp, Mus musculus
caagctggcatcatccctgcagaag

SEQ ID NO: 551699 - DNA, 25 bp, Mus musculus
caagctggcatcttccctgcagaag

SEQ ID NO: 551700 - DNA, 25 bp, Mus musculus
caagctggcctcagggacgcccagg

SEQ ID NO: 551701 - DNA, 25 bp, Mus musculus
caagctggcctctgggacgcccagg

SEQ ID NO: 551702 - DNA, 25 bp, Mus musculus
caagctggcgctctctaagaagctg

SEQ ID NO: 551703 - DNA, 25 bp, Mus musculus
caagctggcgctgtctaagaagctg

SEQ ID NO: 551704 - DNA, 25 bp, Mus musculus
caagctggcggtccagggacttaac

SEQ ID NO: 551705 - DNA, 25 bp, Mus musculus
caagctggcggtgcagggacttaac

SEQ ID NO: 551706 - DNA, 25 bp, Mus musculus
caagctggcgtaagaacttcaaaac

SEQ ID NO: 551707 - DNA, 25 bp, Mus musculus
caagctggcgtatgaacttcaaaac

SEQ ID NO: 551708 - DNA, 25 bp, Mus musculus
caagctgggaagaaatgtagacttc

SEQ ID NO: 551709 - DNA, 25 bp, Mus musculus
caagctgggaagtaatgtagacttc

SEQ ID NO: 551710 - DNA, 25 bp, Mus musculus
caagctgggcagaatctctcgccaa

SEQ ID NO: 551711 - DNA, 25 bp, Mus musculus
caagctgggcagtatctctcgccaa

SEQ ID NO: 551712 - DNA, 25 bp, Mus musculus
caagctgggttacatgctccacgca

SEQ ID NO: 551713 - DNA, 25 bp, Mus musculus
caagctgggttagatgctccacgca

SEQ ID NO: 551714 - DNA, 25 bp, Mus musculus
caagctggtcaacatctgtgacttc

SEQ ID NO: 551715 - DNA, 25 bp, Mus musculus
caagctggtcaagatctgtgacttc

SEQ ID NO: 551716 - DNA, 25 bp, Mus musculus
caagctggtcatcgcaggtgtgatc

SEQ ID NO: 551717 - DNA, 25 bp, Mus musculus
caagctggtcatggcaggtgtgatc

SEQ ID NO: 551718 - DNA, 25 bp, Mus musculus
caagctggtccgagatgcttttgcc

SEQ ID NO: 551719 - DNA, 25 bp, Mus musculus
caagctggtccgtgatgcttttgcc

SEQ ID NO: 551720 - DNA, 25 bp, Mus musculus
caagctggtgaaactgctctccata

SEQ ID NO: 551721 - DNA, 25 bp, Mus musculus
caagctggtgaatctgctctccata

SEQ ID NO: 551722 - DNA, 25 bp, Mus musculus
caagctgtacaaaggatcttaggaa

SEQ ID NO: 551723 - DNA, 25 bp, Mus musculus
caagctgtacaatggatcttaggaa

SEQ ID NO: 551724 - DNA, 25 bp, Mus musculus
caagctgtcaggagctcagtatcag

SEQ ID NO: 551725 - DNA, 25 bp, Mus musculus
caagctgtcaggtgctcagtatcag

SEQ ID NO: 551726 - DNA, 25 bp, Mus musculus
caagctgtccagattggctgagccc

SEQ ID NO: 551727 - DNA, 25 bp, Mus musculus
caagctgtccagtttggctgagccc

SEQ ID NO: 551728 - DNA, 25 bp, Mus musculus
caagctgtcccgacgctggtcggcg

SEQ ID NO: 551729 - DNA, 25 bp, Mus musculus
caagctgtcccgtcgctggtcggcg

SEQ ID NO: 551730 - DNA, 25 bp, Mus musculus
caagctgtgaatctggtaataaact

SEQ ID NO: 551731 - DNA, 25 bp, Mus musculus
caagctgtgaatgtggtaataaact

SEQ ID NO: 551732 - DNA, 25 bp, Mus musculus
caagctgtgacccacactggcaaga

SEQ ID NO: 551733 - DNA, 25 bp, Mus musculus
caagctgtgaccgacactggcaaga

SEQ ID NO: 551734 - DNA, 25 bp, Mus musculus
caagctgtgggccatgaagccatca

SEQ ID NO: 551735 - DNA, 25 bp, Mus musculus
caagctgtgggcgatgaagccatca

SEQ ID NO: 551736 - DNA, 25 bp, Mus musculus
caagctgtggtgctctttggcagac

SEQ ID NO: 551737 - DNA, 25 bp, Mus musculus
caagctgtggtggtctttggcagac

SEQ ID NO: 551738 - DNA, 25 bp, Mus musculus
caagctgtgttaaaagtcagccaca

SEQ ID NO: 551739 - DNA, 25 bp, Mus musculus
caagctgtgttataagtcagccaca

SEQ ID NO: 551740 - DNA, 25 bp, Mus musculus
caagctgttgtcaacgacaacggca

SEQ ID NO: 551741 - DNA, 25 bp, Mus musculus
caagctgttgtctacgacaacggca

SEQ ID NO: 551742 - DNA, 25 bp, Mus musculus
caagcttacattctttgttaatagc

SEQ ID NO: 551743 - DNA, 25 bp, Mus musculus
caagcttacattgtttgttaatagc

SEQ ID NO: 551744 - DNA, 25 bp, Mus musculus
caagcttagcagaagttttccttga

SEQ ID NO: 551745 - DNA, 25 bp, Mus musculus
caagcttagcagtagttttccttga

SEQ ID NO: 551746 - DNA, 25 bp, Mus musculus
caagcttaggtacatgagccgcgat

SEQ ID NO: 551747 - DNA, 25 bp, Mus musculus
caagcttaggtagatgagccgcgat

SEQ ID NO: 551748 - DNA, 25 bp, Mus musculus
caagcttcagagatcagtttcaagg

SEQ ID NO: 551749 - DNA, 25 bp, Mus musculus
caagcttcagagttcagtttcaagg

SEQ ID NO: 551750 - DNA, 25 bp, Mus musculus
caagcttcggaacatgaaatgggag

SEQ ID NO: 551751 - DNA, 25 bp, Mus musculus
caagcttcggaagatgaaatgggag

SEQ ID NO: 551752 - DNA, 25 bp, Mus musculus
caagcttcgtgtctgacaagagacc

SEQ ID NO: 551753 - DNA, 25 bp, Mus musculus
caagcttcgtgtgtgacaagagacc

SEQ ID NO: 551754 - DNA, 25 bp, Mus musculus
caagcttctagcagtgaggaggtgc

SEQ ID NO: 551755 - DNA, 25 bp, Mus musculus
caagcttctagctgtgaggaggtgc

SEQ ID NO: 551756 - DNA, 25 bp, Mus musculus
caagcttctggaatttgtccctcac

SEQ ID NO: 551757 - DNA, 25 bp, Mus musculus
caagcttctggattttgtccctcac

SEQ ID NO: 551758 - DNA, 25 bp, Mus musculus
caagcttctgtgaaggatatcttca

SEQ ID NO: 551759 - DNA, 25 bp, Mus musculus
caagcttctgtgtaggatatcttca

SEQ ID NO: 551760 - DNA, 25 bp, Mus musculus
caagcttgacaaaggtggatactat

SEQ ID NO: 551761 - DNA, 25 bp, Mus musculus
caagcttgacaatggtggatactat

SEQ ID NO: 551762 - DNA, 25 bp, Mus musculus
caagcttgctttcaccgagcctcag

SEQ ID NO: 551763 - DNA, 25 bp, Mus musculus
caagcttgctttgaccgagcctcag

SEQ ID NO: 551764 - DNA, 25 bp, Mus musculus
caagcttggaggctttcaggaacac

SEQ ID NO: 551765 - DNA, 25 bp, Mus musculus
caagcttggagggtttcaggaacac

SEQ ID NO: 551766 - DNA, 25 bp, Mus musculus
caagcttgtatgagacgcaggatcc

SEQ ID NO: 551767 - DNA, 25 bp, Mus musculus
caagcttgtatgtgacgcaggatcc

SEQ ID NO: 551768 - DNA, 25 bp, Mus musculus
caagctttcattaatatcccacgag

SEQ ID NO: 551769 - DNA, 25 bp, Mus musculus
caagctttcatttatatcccacgag

SEQ ID NO: 551770 - DNA, 25 bp, Mus musculus
caagctttccaacgctatggccagg

SEQ ID NO: 551771 - DNA, 25 bp, Mus musculus
caagctttccaaggctatggccagg

SEQ ID NO: 551772 - DNA, 25 bp, Mus musculus
caagctttgcttcttcctgcattag

SEQ ID NO: 551773 - DNA, 25 bp, Mus musculus
caagctttgcttgttcctgcattag

SEQ ID NO: 551774 - DNA, 25 bp, Mus musculus
caagcttttcatatgccagaatctg

SEQ ID NO: 551775 - DNA, 25 bp, Mus musculus
caagcttttcatttgccagaatctg

SEQ ID NO: 551776 - DNA, 25 bp, Mus musculus
caagcttttgctcacttttacatgt

SEQ ID NO: 551777 - DNA, 25 bp, Mus musculus
caagcttttgctgacttttacatgt

SEQ ID NO: 551778 - DNA, 25 bp, Mus musculus
caagctttttaacaggacacgcctt

SEQ ID NO: 551779 - DNA, 25 bp, Mus musculus
caagctttttaagaggacacgcctt

SEQ ID NO: 551780 - DNA, 25 bp, Mus musculus
caaggaaaaatgacctattgaagaa

SEQ ID NO: 551781 - DNA, 25 bp, Mus musculus
caaggaaaaatgtcctattgaagaa

SEQ ID NO: 551782 - DNA, 25 bp, Mus musculus
caaggaaaagaaatggcaaccaaat

SEQ ID NO: 551783 - DNA, 25 bp, Mus musculus
caaggaaaagaattggcaaccaaat

SEQ ID NO: 551784 - DNA, 25 bp, Mus musculus
caaggaaaatttctacagagctctc

SEQ ID NO: 551785 - DNA, 25 bp, Mus musculus
caaggaaaatttgtacagagctctc

SEQ ID NO: 551786 - DNA, 25 bp, Mus musculus
caaggaaacagccatctagctaatg

SEQ ID NO: 551787 - DNA, 25 bp, Mus musculus
caaggaaacagcgatctagctaatg

SEQ ID NO: 551788 - DNA, 25 bp, Mus musculus
caaggaaacaggaactctggaatcc

SEQ ID NO: 551789 - DNA, 25 bp, Mus musculus
caaggaaacaggtactctggaatcc

SEQ ID NO: 551790 - DNA, 25 bp, Mus musculus
caaggaaacattcacctgctggtgg

SEQ ID NO: 551791 - DNA, 25 bp, Mus musculus
caaggaaacattgacctgctggtgg

SEQ ID NO: 551792 - DNA, 25 bp, Mus musculus
caaggaaaccaccatctgggtcagc

SEQ ID NO: 551793 - DNA, 25 bp, Mus musculus
caaggaaaccacgatctgggtcagc

SEQ ID NO: 551794 - DNA, 25 bp, Mus musculus
caaggaaactgcaggctgaaaaggc

SEQ ID NO: 551795 - DNA, 25 bp, Mus musculus
caaggaaactgctggctgaaaaggc

SEQ ID NO: 551796 - DNA, 25 bp, Mus musculus
caaggaaactgtccagaaccgggca

SEQ ID NO: 551797 - DNA, 25 bp, Mus musculus
caaggaaactgtgcagaaccgggca

SEQ ID NO: 551798 - DNA, 25 bp, Mus musculus
caaggaaagacactattttattgaa

SEQ ID NO: 551799 - DNA, 25 bp, Mus musculus
caaggaaagacagtattttattgaa

SEQ ID NO: 551800 - DNA, 25 bp, Mus musculus
caaggaaagcccctattctccgaga

SEQ ID NO: 551801 - DNA, 25 bp, Mus musculus
caaggaaagcccgtattctccgaga

SEQ ID NO: 551802 - DNA, 25 bp, Mus musculus
caaggaaagggcatcatggaactac

SEQ ID NO: 551803 - DNA, 25 bp, Mus musculus
caaggaaagggcttcatggaactac

SEQ ID NO: 551804 - DNA, 25 bp, Mus musculus
caaggaaatctccatcatgcagcag

SEQ ID NO: 551805 - DNA, 25 bp, Mus musculus
caaggaaatctcgatcatgcagcag

SEQ ID NO: 551806 - DNA, 25 bp, Mus musculus
caaggaaatggtccgggtcttaaag

SEQ ID NO: 551807 - DNA, 25 bp, Mus musculus
caaggaaatggtgcgggtcttaaag

SEQ ID NO: 551808 - DNA, 25 bp, Mus musculus
caaggaacagctactgcagtccaac

SEQ ID NO: 551809 - DNA, 25 bp, Mus musculus
caaggaacagcttctgcagtccaac

SEQ ID NO: 551810 - DNA, 25 bp, Mus musculus
caaggaacagtacggtgttgccagc

SEQ ID NO: 551811 - DNA, 25 bp, Mus musculus
caaggaacagtagggtgttgccagc

SEQ ID NO: 551812 - DNA, 25 bp, Mus musculus
caaggaacatggcactgcagtgaca

SEQ ID NO: 551813 - DNA, 25 bp, Mus musculus
caaggaacatgggactgcagtgaca

SEQ ID NO: 551814 - DNA, 25 bp, Mus musculus
caaggaacccaccacctggtgaaga

SEQ ID NO: 551815 - DNA, 25 bp, Mus musculus
caaggaacccacgacctggtgaaga

SEQ ID NO: 551816 - DNA, 25 bp, Mus musculus
caaggaacgagtcactgacagtgaa

SEQ ID NO: 551817 - DNA, 25 bp, Mus musculus
caaggaacgagtgactgacagtgaa

SEQ ID NO: 551818 - DNA, 25 bp, Mus musculus
caaggaacggccacaggatgtggat

SEQ ID NO: 551819 - DNA, 25 bp, Mus musculus
caaggaacggcctcaggatgtggat

SEQ ID NO: 551820 - DNA, 25 bp, Mus musculus
caaggaactacccagtgggctgatc

SEQ ID NO: 551821 - DNA, 25 bp, Mus musculus
caaggaactaccgagtgggctgatc

SEQ ID NO: 551822 - DNA, 25 bp, Mus musculus
caaggaactagtcctgcagcgagag

SEQ ID NO: 551823 - DNA, 25 bp, Mus musculus
caaggaactagtgctgcagcgagag

SEQ ID NO: 551824 - DNA, 25 bp, Mus musculus
caaggaactccgctcactcattgct

SEQ ID NO: 551825 - DNA, 25 bp, Mus musculus
caaggaactccggtcactcattgct

SEQ ID NO: 551826 - DNA, 25 bp, Mus musculus
caaggaagaagacatgactggagtt

SEQ ID NO: 551827 - DNA, 25 bp, Mus musculus
caaggaagaagagatgactggagtt

SEQ ID NO: 551828 - DNA, 25 bp, Mus musculus
caaggaagacaaacgagctgggagc

SEQ ID NO: 551829 - DNA, 25 bp, Mus musculus
caaggaagacaatcgagctgggagc

SEQ ID NO: 551830 - DNA, 25 bp, Mus musculus
caaggaagacctctgaagtctctgc

SEQ ID NO: 551831 - DNA, 25 bp, Mus musculus
caaggaagacctgtgaagtctctgc

SEQ ID NO: 551832 - DNA, 25 bp, Mus musculus
caaggaagagaactgccttcctcct

SEQ ID NO: 551833 - DNA, 25 bp, Mus musculus
caaggaagagaagtgccttcctcct

SEQ ID NO: 551834 - DNA, 25 bp, Mus musculus
caaggaagagacctccgtcaacaaa

SEQ ID NO: 551835 - DNA, 25 bp, Mus musculus
caaggaagagacgtccgtcaacaaa

SEQ ID NO: 551836 - DNA, 25 bp, Mus musculus
caaggaagagatcatggatgacagc

SEQ ID NO: 551837 - DNA, 25 bp, Mus musculus
caaggaagagatgatggatgacagc

SEQ ID NO: 551838 - DNA, 25 bp, Mus musculus
caaggaagaggcagtagtggccgca

SEQ ID NO: 551839 - DNA, 25 bp, Mus musculus
caaggaagaggctgtagtggccgca

SEQ ID NO: 551840 - DNA, 25 bp, Mus musculus
caaggaagagtgatgcagcaccggc

SEQ ID NO: 551841 - DNA, 25 bp, Mus musculus
caaggaagagtgttgcagcaccggc

SEQ ID NO: 551842 - DNA, 25 bp, Mus musculus
caaggaagatgcaccccgacagcat

SEQ ID NO: 551843 - DNA, 25 bp, Mus musculus
caaggaagatgctccccgacagcat

SEQ ID NO: 551844 - DNA, 25 bp, Mus musculus
caaggaagattccttcagacctgac

SEQ ID NO: 551845 - DNA, 25 bp, Mus musculus
caaggaagattcgttcagacctgac

SEQ ID NO: 551846 - DNA, 25 bp, Mus musculus
caaggaagcacaagaccgagcagaa

SEQ ID NO: 551847 - DNA, 25 bp, Mus musculus
caaggaagcacatgaccgagcagaa

SEQ ID NO: 551848 - DNA, 25 bp, Mus musculus
caaggaagccatccttcagaagcaa

SEQ ID NO: 551849 - DNA, 25 bp, Mus musculus
caaggaagccatgcttcagaagcaa

SEQ ID NO: 551850 - DNA, 25 bp, Mus musculus
caaggaagcccaatcaatttcagag

SEQ ID NO: 551851 - DNA, 25 bp, Mus musculus
caaggaagcccattcaatttcagag

SEQ ID NO: 551852 - DNA, 25 bp, Mus musculus
caaggaagccccatagttatcagcc

SEQ ID NO: 551853 - DNA, 25 bp, Mus musculus
caaggaagccccttagttatcagcc

SEQ ID NO: 551854 - DNA, 25 bp, Mus musculus
caaggaagcggcacggaacatagca

SEQ ID NO: 551855 - DNA, 25 bp, Mus musculus
caaggaagcggctcggaacatagca

SEQ ID NO: 551856 - DNA, 25 bp, Mus musculus
caaggaagctggaggtcaatgcgtc

SEQ ID NO: 551857 - DNA, 25 bp, Mus musculus
caaggaagctggtggtcaatgcgtc

SEQ ID NO: 551858 - DNA, 25 bp, Mus musculus
caaggaagctttctccctattcgat

SEQ ID NO: 551859 - DNA, 25 bp, Mus musculus
caaggaagctttgtccctattcgat

SEQ ID NO: 551860 - DNA, 25 bp, Mus musculus
caaggaaggaatcgacagaagacac

SEQ ID NO: 551861 - DNA, 25 bp, Mus musculus
caaggaaggaatggacagaagacac

SEQ ID NO: 551862 - DNA, 25 bp, Mus musculus
caaggaaggagaatctataaaggca

SEQ ID NO: 551863 - DNA, 25 bp, Mus musculus
caaggaaggagattctataaaggca

SEQ ID NO: 551864 - DNA, 25 bp, Mus musculus
caaggaaggattacagtcacactgg

SEQ ID NO: 551865 - DNA, 25 bp, Mus musculus
caaggaaggatttcagtcacactgg

SEQ ID NO: 551866 - DNA, 25 bp, Mus musculus
caaggaagggatcctcatagtaccc

SEQ ID NO: 551867 - DNA, 25 bp, Mus musculus
caaggaagggatgctcatagtaccc

SEQ ID NO: 551868 - DNA, 25 bp, Mus musculus
caaggaagtatcaacgttgaaacgc

SEQ ID NO: 551869 - DNA, 25 bp, Mus musculus
caaggaagtatctacgttgaaacgc

SEQ ID NO: 551870 - DNA, 25 bp, Mus musculus
caaggaagtcacaagttctggcaag

SEQ ID NO: 551871 - DNA, 25 bp, Mus musculus
caaggaagtcactagttctggcaag

SEQ ID NO: 551872 - DNA, 25 bp, Mus musculus
caaggaagtgcccatgaatcctgtg

SEQ ID NO: 551873 - DNA, 25 bp, Mus musculus
caaggaagtgccgatgaatcctgtg

SEQ ID NO: 551874 - DNA, 25 bp, Mus musculus
caaggaataccaaatagatgagaag

SEQ ID NO: 551875 - DNA, 25 bp, Mus musculus
caaggaataccatatagatgagaag

SEQ ID NO: 551876 - DNA, 25 bp, Mus musculus
caaggaatacgtcggcaagacgagc

SEQ ID NO: 551877 - DNA, 25 bp, Mus musculus
caaggaatacgtgggcaagacgagc

SEQ ID NO: 551878 - DNA, 25 bp, Mus musculus
caaggaatatgtccagaagctgcca

SEQ ID NO: 551879 - DNA, 25 bp, Mus musculus
caaggaatatgtgcagaagctgcca

SEQ ID NO: 551880 - DNA, 25 bp, Mus musculus
caaggaatcagtctgcagtgtggtc

SEQ ID NO: 551881 - DNA, 25 bp, Mus musculus
caaggaatcagtgtgcagtgtggtc

SEQ ID NO: 551882 - DNA, 25 bp, Mus musculus
caaggaatccaaatccaggatcgac

SEQ ID NO: 551883 - DNA, 25 bp, Mus musculus
caaggaatccaacgacatcatggag

SEQ ID NO: 551884 - DNA, 25 bp, Mus musculus
caaggaatccaaggacatcatggag

SEQ ID NO: 551885 - DNA, 25 bp, Mus musculus
caaggaatccaattccaggatcgac

SEQ ID NO: 551886 - DNA, 25 bp, Mus musculus
caaggaatccttcatcgaaacctca

SEQ ID NO: 551887 - DNA, 25 bp, Mus musculus
caaggaatccttgatcgaaacctca

SEQ ID NO: 551888 - DNA, 25 bp, Mus musculus
caaggaatcgaaaacccaggcttcg

SEQ ID NO: 551889 - DNA, 25 bp, Mus musculus
caaggaatcgaatacccaggcttcg

SEQ ID NO: 551890 - DNA, 25 bp, Mus musculus
caaggaatgcccagctctagctgtg

SEQ ID NO: 551891 - DNA, 25 bp, Mus musculus
caaggaatgccctgctctagctgtg

SEQ ID NO: 551892 - DNA, 25 bp, Mus musculus
caaggaattacacaaagttgaaggc

SEQ ID NO: 551893 - DNA, 25 bp, Mus musculus
caaggaattacagaaagttgaaggc

SEQ ID NO: 551894 - DNA, 25 bp, Mus musculus
caaggaattcaccaatgtttatatc

SEQ ID NO: 551895 - DNA, 25 bp, Mus musculus
caaggaattcacgaatgtttatatc

SEQ ID NO: 551896 - DNA, 25 bp, Mus musculus
caaggaattgggacttgggcccaca

SEQ ID NO: 551897 - DNA, 25 bp, Mus musculus
caaggaattgggtcttgggcccaca

SEQ ID NO: 551898 - DNA, 25 bp, Mus musculus
caaggacaacacaggctggagaaga

SEQ ID NO: 551899 - DNA, 25 bp, Mus musculus
caaggacaacactggctggagaaga

SEQ ID NO: 551900 - DNA, 25 bp, Mus musculus
caaggacaagaacggcaggaaaagc

SEQ ID NO: 551901 - DNA, 25 bp, Mus musculus
caaggacaagaagggcaggaaaagc

SEQ ID NO: 551902 - DNA, 25 bp, Mus musculus
caaggacaagacaggaattgttgtc

SEQ ID NO: 551903 - DNA, 25 bp, Mus musculus
caaggacaagactggaattgttgtc

SEQ ID NO: 551904 - DNA, 25 bp, Mus musculus
caaggacaagggattatctcagcca

SEQ ID NO: 551905 - DNA, 25 bp, Mus musculus
caaggacaagggtttatctcagcca

SEQ ID NO: 551906 - DNA, 25 bp, Mus musculus
caaggacaatgtcagaagtgtcacc

SEQ ID NO: 551907 - DNA, 25 bp, Mus musculus
caaggacaatgtcgtgctgtccaac

SEQ ID NO: 551908 - DNA, 25 bp, Mus musculus
caaggacaatgtgagaagtgtcacc

SEQ ID NO: 551909 - DNA, 25 bp, Mus musculus
caaggacaatgtggtgctgtccaac

SEQ ID NO: 551910 - DNA, 25 bp, Mus musculus
caaggacacacaatcttacaaagag

SEQ ID NO: 551911 - DNA, 25 bp, Mus musculus
caaggacacacattcttacaaagag

SEQ ID NO: 551912 - DNA, 25 bp, Mus musculus
caaggacacagtcttctaccgtttc

SEQ ID NO: 551913 - DNA, 25 bp, Mus musculus
caaggacacagtgttctaccgtttc

SEQ ID NO: 551914 - DNA, 25 bp, Mus musculus
caaggacaccgaccctgacagcaaa

SEQ ID NO: 551915 - DNA, 25 bp, Mus musculus
caaggacaccgagcctgacagcaaa

SEQ ID NO: 551916 - DNA, 25 bp, Mus musculus
caaggacaccttcctgaggacttac

SEQ ID NO: 551917 - DNA, 25 bp, Mus musculus
caaggacaccttgctgaggacttac

SEQ ID NO: 551918 - DNA, 25 bp, Mus musculus
caaggacactgcctggtcaagctgg

SEQ ID NO: 551919 - DNA, 25 bp, Mus musculus
caaggacactgcgtggtcaagctgg

SEQ ID NO: 551920 - DNA, 25 bp, Mus musculus
caaggacacttgagcggatgagtac

SEQ ID NO: 551921 - DNA, 25 bp, Mus musculus
caaggacacttgtgcggatgagtac

SEQ ID NO: 551922 - DNA, 25 bp, Mus musculus
caaggacagagactgctcctccaag

SEQ ID NO: 551923 - DNA, 25 bp, Mus musculus
caaggacagagagtgctcctccaag

SEQ ID NO: 551924 - DNA, 25 bp, Mus musculus
caaggacagatacttttgatgagcc

SEQ ID NO: 551925 - DNA, 25 bp, Mus musculus
caaggacagatagttttgatgagcc

SEQ ID NO: 551926 - DNA, 25 bp, Mus musculus
caaggacagctgactgaaaggaatc

SEQ ID NO: 551927 - DNA, 25 bp, Mus musculus
caaggacagctgtctgaaaggaatc

SEQ ID NO: 551928 - DNA, 25 bp, Mus musculus
caaggacagcttccgaaactatact

SEQ ID NO: 551929 - DNA, 25 bp, Mus musculus
caaggacagcttgcgaaactatact

SEQ ID NO: 551930 - DNA, 25 bp, Mus musculus
caaggacagtccagtactcttggac

SEQ ID NO: 551931 - DNA, 25 bp, Mus musculus
caaggacagtcctgtactcttggac

SEQ ID NO: 551932 - DNA, 25 bp, Mus musculus
caaggacagtttcggcagcgacagc

SEQ ID NO: 551933 - DNA, 25 bp, Mus musculus
caaggacagtttgggcagcgacagc

SEQ ID NO: 551934 - DNA, 25 bp, Mus musculus
caaggacattaccacgtcagtactg

SEQ ID NO: 551935 - DNA, 25 bp, Mus musculus
caaggacattacgacgtcagtactg

SEQ ID NO: 551936 - DNA, 25 bp, Mus musculus
caaggacattcgaggttccatcacc

SEQ ID NO: 551937 - DNA, 25 bp, Mus musculus
caaggacattcgtggttccatcacc

SEQ ID NO: 551938 - DNA, 25 bp, Mus musculus
caaggacattgcctggacggaagac

SEQ ID NO: 551939 - DNA, 25 bp, Mus musculus
caaggacattgcgtggacggaagac

SEQ ID NO: 551940 - DNA, 25 bp, Mus musculus
caaggacattggacaaagcaagcta

SEQ ID NO: 551941 - DNA, 25 bp, Mus musculus
caaggacattggtcaaagcaagcta

SEQ ID NO: 551942 - DNA, 25 bp, Mus musculus
caaggaccaataagatcagggacaa

SEQ ID NO: 551943 - DNA, 25 bp, Mus musculus
caaggaccaatatgatcagggacaa

SEQ ID NO: 551944 - DNA, 25 bp, Mus musculus
caaggaccacttagacactttgcac

SEQ ID NO: 551945 - DNA, 25 bp, Mus musculus
caaggaccactttgacactttgcac

SEQ ID NO: 551946 - DNA, 25 bp, Mus musculus
caaggaccaggcaaaaaccagatta

SEQ ID NO: 551947 - DNA, 25 bp, Mus musculus
caaggaccaggcacctgcttttcca

SEQ ID NO: 551948 - DNA, 25 bp, Mus musculus
caaggaccaggctaaaaccagatta

SEQ ID NO: 551949 - DNA, 25 bp, Mus musculus
caaggaccaggctcctgcttttcca

SEQ ID NO: 551950 - DNA, 25 bp, Mus musculus
caaggaccattcaggagctggacag

SEQ ID NO: 551951 - DNA, 25 bp, Mus musculus
caaggaccattctggagctggacag

SEQ ID NO: 551952 - DNA, 25 bp, Mus musculus
caaggacccagtccctgcgaacatg

SEQ ID NO: 551953 - DNA, 25 bp, Mus musculus
caaggacccagtgcctgcgaacatg

SEQ ID NO: 551954 - DNA, 25 bp, Mus musculus
caaggaccgaaaagtcaaatttagg

SEQ ID NO: 551955 - DNA, 25 bp, Mus musculus
caaggaccgaaatgtcaaatttagg

SEQ ID NO: 551956 - DNA, 25 bp, Mus musculus
caaggaccgaatcagggactagagt

SEQ ID NO: 551957 - DNA, 25 bp, Mus musculus
caaggaccgaatgagggactagagt

SEQ ID NO: 551958 - DNA, 25 bp, Mus musculus
caaggaccgcatctcctggcttggg

SEQ ID NO: 551959 - DNA, 25 bp, Mus musculus
caaggaccgcatgtcctggcttggg

SEQ ID NO: 551960 - DNA, 25 bp, Mus musculus
caaggaccgcctcttcataagctat

SEQ ID NO: 551961 - DNA, 25 bp, Mus musculus
caaggaccgcctgttcataagctat

SEQ ID NO: 551962 - DNA, 25 bp, Mus musculus
caaggacctgcactcagagttccag

SEQ ID NO: 551963 - DNA, 25 bp, Mus musculus
caaggacctgcagtcagagttccag

SEQ ID NO: 551964 - DNA, 25 bp, Mus musculus
caaggaccttccacttgcaacagag

SEQ ID NO: 551965 - DNA, 25 bp, Mus musculus
caaggaccttcctcttgcaacagag

SEQ ID NO: 551966 - DNA, 25 bp, Mus musculus
caaggacgatatcatcagattctac

SEQ ID NO: 551967 - DNA, 25 bp, Mus musculus
caaggacgatatgatcagattctac

SEQ ID NO: 551968 - DNA, 25 bp, Mus musculus
caaggacgccttaagagatggactc

SEQ ID NO: 551969 - DNA, 25 bp, Mus musculus
caaggacgcctttagagatggactc

SEQ ID NO: 551970 - DNA, 25 bp, Mus musculus
caaggacgggaacagtatcacttac

SEQ ID NO: 551971 - DNA, 25 bp, Mus musculus
caaggacgggaagagtatcacttac

SEQ ID NO: 551972 - DNA, 25 bp, Mus musculus
caaggacggtgccactatgaagaca

SEQ ID NO: 551973 - DNA, 25 bp, Mus musculus
caaggacggtgcgactatgaagaca

SEQ ID NO: 551974 - DNA, 25 bp, Mus musculus
caaggacgtcacagccttgaagata

SEQ ID NO: 551975 - DNA, 25 bp, Mus musculus
caaggacgtcactgccttgaagata

SEQ ID NO: 551976 - DNA, 25 bp, Mus musculus
caaggactacgtcctgtccctggac

SEQ ID NO: 551977 - DNA, 25 bp, Mus musculus
caaggactacgtgctgtccctggac

SEQ ID NO: 551978 - DNA, 25 bp, Mus musculus
caaggactcattcacttcatcaaaa

SEQ ID NO: 551979 - DNA, 25 bp, Mus musculus
caaggactcattcctgcctcggagg

SEQ ID NO: 551980 - DNA, 25 bp, Mus musculus
caaggactcattgacttcatcaaaa

SEQ ID NO: 551981 - DNA, 25 bp, Mus musculus
caaggactcattgctgcctcggagg

SEQ ID NO: 551982 - DNA, 25 bp, Mus musculus
caaggactccaactggtaccagcag

SEQ ID NO: 551983 - DNA, 25 bp, Mus musculus
caaggactccaagtggtaccagcag

SEQ ID NO: 551984 - DNA, 25 bp, Mus musculus
caaggactccatcaatatcaaggcc

SEQ ID NO: 551985 - DNA, 25 bp, Mus musculus
caaggactccatgaatatcaaggcc

SEQ ID NO: 551986 - DNA, 25 bp, Mus musculus
caaggactcccacaaacagctgttg

SEQ ID NO: 551987 - DNA, 25 bp, Mus musculus
caaggactcccagaaacagctgttg

SEQ ID NO: 551988 - DNA, 25 bp, Mus musculus
caaggactcgaccaacttggacgtg

SEQ ID NO: 551989 - DNA, 25 bp, Mus musculus
caaggactcgacgaacttggacgtg

SEQ ID NO: 551990 - DNA, 25 bp, Mus musculus
caaggactcgtgcagtgtagccagt

SEQ ID NO: 551991 - DNA, 25 bp, Mus musculus
caaggactcgtggagtgtagccagt

SEQ ID NO: 551992 - DNA, 25 bp, Mus musculus
caaggactctgcatttgtgtgggta

SEQ ID NO: 551993 - DNA, 25 bp, Mus musculus
caaggactctgcttttgtgtgggta

SEQ ID NO: 551994 - DNA, 25 bp, Mus musculus
caaggactgcctcatcgacaagaga

SEQ ID NO: 551995 - DNA, 25 bp, Mus musculus
caaggactgcctgatcgacaagaga

SEQ ID NO: 551996 - DNA, 25 bp, Mus musculus
caaggactggagctctggaccagca

SEQ ID NO: 551997 - DNA, 25 bp, Mus musculus
caaggactggaggtctggaccagca

SEQ ID NO: 551998 - DNA, 25 bp, Mus musculus
caaggactggcaagacaaggtggcc

SEQ ID NO: 551999 - DNA, 25 bp, Mus musculus
caaggactggcatgacaaggtggcc

SEQ ID NO: 552000 - DNA, 25 bp, Mus musculus
caaggactggccaggagcatttgaa

SEQ ID NO: 552001 - DNA, 25 bp, Mus musculus
caaggactggcctggagcatttgaa

SEQ ID NO: 552002 - DNA, 25 bp, Mus musculus
caaggacttcgacccagtggcttga

SEQ ID NO: 552003 - DNA, 25 bp, Mus musculus
caaggacttcgagccagtggcttga

SEQ ID NO: 552004 - DNA, 25 bp, Mus musculus
caaggacttctgcactcgggagaat

SEQ ID NO: 552005 - DNA, 25 bp, Mus musculus
caaggacttctggactcgggagaat

SEQ ID NO: 552006 - DNA, 25 bp, Mus musculus
caaggacttgagcttgaagatctgt

SEQ ID NO: 552007 - DNA, 25 bp, Mus musculus
caaggacttgaggttgaagatctgt

SEQ ID NO: 552008 - DNA, 25 bp, Mus musculus
caaggacttgatactgagccctcga

SEQ ID NO: 552009 - DNA, 25 bp, Mus musculus
caaggacttgattctgagccctcga

SEQ ID NO: 552010 - DNA, 25 bp, Mus musculus
caaggacttgttcgtaatgttctac

SEQ ID NO: 552011 - DNA, 25 bp, Mus musculus
caaggacttgttggtaatgttctac

SEQ ID NO: 552012 - DNA, 25 bp, Mus musculus
caaggagaagcgagcattggcttaa

SEQ ID NO: 552013 - DNA, 25 bp, Mus musculus
caaggagaagcgtgcattggcttaa

SEQ ID NO: 552014 - DNA, 25 bp, Mus musculus
caaggagaaggcacgagctactcgg

SEQ ID NO: 552015 - DNA, 25 bp, Mus musculus
caaggagaaggctcgagctactcgg

SEQ ID NO: 552016 - DNA, 25 bp, Mus musculus
caaggagaagtgagcagagcaggcg

SEQ ID NO: 552017 - DNA, 25 bp, Mus musculus
caaggagaagtgtgcagagcaggcg

SEQ ID NO: 552018 - DNA, 25 bp, Mus musculus
caaggagaatcaaagctcaggaggc

SEQ ID NO: 552019 - DNA, 25 bp, Mus musculus
caaggagaatcatagctcaggaggc

SEQ ID NO: 552020 - DNA, 25 bp, Mus musculus
caaggagaatctcaaggacaccatg

SEQ ID NO: 552021 - DNA, 25 bp, Mus musculus
caaggagaatctgaaggacaccatg

SEQ ID NO: 552022 - DNA, 25 bp, Mus musculus
caaggagacaatcgacaagaagttc

SEQ ID NO: 552023 - DNA, 25 bp, Mus musculus
caaggagacaatggacaagaagttc

SEQ ID NO: 552024 - DNA, 25 bp, Mus musculus
caaggagacaccaaggaacagtagg

SEQ ID NO: 552025 - DNA, 25 bp, Mus musculus
caaggagacacctaggaacagtagg

SEQ ID NO: 552026 - DNA, 25 bp, Mus musculus
caaggagacatcatctgaatatcaa

SEQ ID NO: 552027 - DNA, 25 bp, Mus musculus
caaggagacatcttctgaatatcaa

SEQ ID NO: 552028 - DNA, 25 bp, Mus musculus
caaggagacgacatatcaagaagcc

SEQ ID NO: 552029 - DNA, 25 bp, Mus musculus
caaggagacgacttatcaagaagcc

SEQ ID NO: 552030 - DNA, 25 bp, Mus musculus
caaggagactctcggaatgagacca

SEQ ID NO: 552031 - DNA, 25 bp, Mus musculus
caaggagactctgggaatgagacca

SEQ ID NO: 552032 - DNA, 25 bp, Mus musculus
caaggagactgtcatcaacccagag

SEQ ID NO: 552033 - DNA, 25 bp, Mus musculus
caaggagactgtgatcaacccagag

SEQ ID NO: 552034 - DNA, 25 bp, Mus musculus
caaggagacttacgaacttcgttat

SEQ ID NO: 552035 - DNA, 25 bp, Mus musculus
caaggagacttaggaacttcgttat

SEQ ID NO: 552036 - DNA, 25 bp, Mus musculus
caaggagagatacggctcaagagct

SEQ ID NO: 552037 - DNA, 25 bp, Mus musculus
caaggagagatagggctcaagagct

SEQ ID NO: 552038 - DNA, 25 bp, Mus musculus
caaggagagatccatgacacagctc

SEQ ID NO: 552039 - DNA, 25 bp, Mus musculus
caaggagagatcgatgacacagctc

SEQ ID NO: 552040 - DNA, 25 bp, Mus musculus
caaggagagcatacgagcaaagtgc

SEQ ID NO: 552041 - DNA, 25 bp, Mus musculus
caaggagagcattcgagcaaagtgc

SEQ ID NO: 552042 - DNA, 25 bp, Mus musculus
caaggagagcttcaggttcacttaa

SEQ ID NO: 552043 - DNA, 25 bp, Mus musculus
caaggagagcttgaggttcacttaa

SEQ ID NO: 552044 - DNA, 25 bp, Mus musculus
caaggagagtgtctaccgaaactac

SEQ ID NO: 552045 - DNA, 25 bp, Mus musculus
caaggagagtgtgtaccgaaactac

SEQ ID NO: 552046 - DNA, 25 bp, Mus musculus
caaggagatcatccagcaccggttc

SEQ ID NO: 552047 - DNA, 25 bp, Mus musculus
caaggagatcatgcagcaccggttc

SEQ ID NO: 552048 - DNA, 25 bp, Mus musculus
caaggagatcggaagtggtcagttt

SEQ ID NO: 552049 - DNA, 25 bp, Mus musculus
caaggagatcggtagtggtcagttt

SEQ ID NO: 552050 - DNA, 25 bp, Mus musculus
caaggagatctcacctgacaccaca

SEQ ID NO: 552051 - DNA, 25 bp, Mus musculus
caaggagatctctcctgacaccaca

SEQ ID NO: 552052 - DNA, 25 bp, Mus musculus
caaggagattcacactcctgaggat

SEQ ID NO: 552053 - DNA, 25 bp, Mus musculus
caaggagattcagactcctgaggat

SEQ ID NO: 552054 - DNA, 25 bp, Mus musculus
caaggagattctctgacttcagaag

SEQ ID NO: 552055 - DNA, 25 bp, Mus musculus
caaggagattctgtgacttcagaag

SEQ ID NO: 552056 - DNA, 25 bp, Mus musculus
caaggagattgacaaagtcatcttg

SEQ ID NO: 552057 - DNA, 25 bp, Mus musculus
caaggagattgacggccgtcttaag

SEQ ID NO: 552058 - DNA, 25 bp, Mus musculus
caaggagattgagaaagtcatcttg

SEQ ID NO: 552059 - DNA, 25 bp, Mus musculus
caaggagattgagggccgtcttaag

SEQ ID NO: 552060 - DNA, 25 bp, Mus musculus
caaggagcaccaaagagctgggacg

SEQ ID NO: 552061 - DNA, 25 bp, Mus musculus
caaggagcaccatagagctgggacg

SEQ ID NO: 552062 - DNA, 25 bp, Mus musculus
caaggagcagcgactcaactttggg

SEQ ID NO: 552063 - DNA, 25 bp, Mus musculus
caaggagcagcgtctcaactttggg

SEQ ID NO: 552064 - DNA, 25 bp, Mus musculus
caaggagcagtcatcttggattgta

SEQ ID NO: 552065 - DNA, 25 bp, Mus musculus
caaggagcagtcttcttggattgta

SEQ ID NO: 552066 - DNA, 25 bp, Mus musculus
caaggagcatccacaacaagttcat

SEQ ID NO: 552067 - DNA, 25 bp, Mus musculus
caaggagcatccacccggagcgggc

SEQ ID NO: 552068 - DNA, 25 bp, Mus musculus
caaggagcatcctcaacaagttcat

SEQ ID NO: 552069 - DNA, 25 bp, Mus musculus
caaggagcatcctcccggagcgggc

SEQ ID NO: 552070 - DNA, 25 bp, Mus musculus
caaggagcccttcaatagaagacag

SEQ ID NO: 552071 - DNA, 25 bp, Mus musculus
caaggagcccttgaatagaagacag

SEQ ID NO: 552072 - DNA, 25 bp, Mus musculus
caaggagcctacatgccacagtata

SEQ ID NO: 552073 - DNA, 25 bp, Mus musculus
caaggagcctacttgccacagtata

SEQ ID NO: 552074 - DNA, 25 bp, Mus musculus
caaggagcctgtaaagagagagaat

SEQ ID NO: 552075 - DNA, 25 bp, Mus musculus
caaggagcctgttaagagagagaat

SEQ ID NO: 552076 - DNA, 25 bp, Mus musculus
caaggagcgacgcaacctgttacgc

SEQ ID NO: 552077 - DNA, 25 bp, Mus musculus
caaggagcgacggaacctgttacgc

SEQ ID NO: 552078 - DNA, 25 bp, Mus musculus
caaggagcgatcatccgtcagggac

SEQ ID NO: 552079 - DNA, 25 bp, Mus musculus
caaggagcgatcttccgtcagggac

SEQ ID NO: 552080 - DNA, 25 bp, Mus musculus
caaggagcggcacagttgccagcaa

SEQ ID NO: 552081 - DNA, 25 bp, Mus musculus
caaggagcggcagagttgccagcaa

SEQ ID NO: 552082 - DNA, 25 bp, Mus musculus
caaggagcttacctggaaatcaaca

SEQ ID NO: 552083 - DNA, 25 bp, Mus musculus
caaggagcttacgtggaaatcaaca

SEQ ID NO: 552084 - DNA, 25 bp, Mus musculus
caaggaggactgaccaaaagaaagg

SEQ ID NO: 552085 - DNA, 25 bp, Mus musculus
caaggaggactgtccaaaagaaagg

SEQ ID NO: 552086 - DNA, 25 bp, Mus musculus
caaggaggagcaaaagtcagaaacc

SEQ ID NO: 552087 - DNA, 25 bp, Mus musculus
caaggaggagcataagtcagaaacc

SEQ ID NO: 552088 - DNA, 25 bp, Mus musculus
caaggaggagcgcagctgggagcag

SEQ ID NO: 552089 - DNA, 25 bp, Mus musculus
caaggaggagcggagctgggagcag

SEQ ID NO: 552090 - DNA, 25 bp, Mus musculus
caaggaggaggaatattttaacagg

SEQ ID NO: 552091 - DNA, 25 bp, Mus musculus
caaggaggaggattattttaacagg

SEQ ID NO: 552092 - DNA, 25 bp, Mus musculus
caaggaggcaccataactctgagct

SEQ ID NO: 552093 - DNA, 25 bp, Mus musculus
caaggaggcaccttaactctgagct

SEQ ID NO: 552094 - DNA, 25 bp, Mus musculus
caaggaggcatgattcggaacccaa

SEQ ID NO: 552095 - DNA, 25 bp, Mus musculus
caaggaggcatgtttcggaacccaa

SEQ ID NO: 552096 - DNA, 25 bp, Mus musculus
caaggaggcctccagataggtacag

SEQ ID NO: 552097 - DNA, 25 bp, Mus musculus
caaggaggcctcgagataggtacag

SEQ ID NO: 552098 - DNA, 25 bp, Mus musculus
caaggaggctctcttgcacaagcac

SEQ ID NO: 552099 - DNA, 25 bp, Mus musculus
caaggaggctctgttgcacaagcac

SEQ ID NO: 552100 - DNA, 25 bp, Mus musculus
caaggagggagcagtcctcgcgttc

SEQ ID NO: 552101 - DNA, 25 bp, Mus musculus
caaggagggagctgtcctcgcgttc

SEQ ID NO: 552102 - DNA, 25 bp, Mus musculus
caaggagggcagctttatatccaag

SEQ ID NO: 552103 - DNA, 25 bp, Mus musculus
caaggagggcaggtttatatccaag

SEQ ID NO: 552104 - DNA, 25 bp, Mus musculus
caaggagggtccattcttgggacaa

SEQ ID NO: 552105 - DNA, 25 bp, Mus musculus
caaggagggtcctttcttgggacaa

SEQ ID NO: 552106 - DNA, 25 bp, Mus musculus
caaggaggtaatcaactcagaagag

SEQ ID NO: 552107 - DNA, 25 bp, Mus musculus
caaggaggtaatgaactcagaagag

SEQ ID NO: 552108 - DNA, 25 bp, Mus musculus
caaggagtagaaaatgatacaggga

SEQ ID NO: 552109 - DNA, 25 bp, Mus musculus
caaggagtagaatatgatacaggga

SEQ ID NO: 552110 - DNA, 25 bp, Mus musculus
caaggagtatgactttcacctgctc

SEQ ID NO: 552111 - DNA, 25 bp, Mus musculus
caaggagtatgagtttcacctgctc

SEQ ID NO: 552112 - DNA, 25 bp, Mus musculus
caaggagtattgaccccaggtcttc

SEQ ID NO: 552113 - DNA, 25 bp, Mus musculus
caaggagtattgtccccaggtcttc

SEQ ID NO: 552114 - DNA, 25 bp, Mus musculus
caaggagtcagtccagattctgcga

SEQ ID NO: 552115 - DNA, 25 bp, Mus musculus
caaggagtcagtgcagattctgcga

SEQ ID NO: 552116 - DNA, 25 bp, Mus musculus
caaggagtccatacatgagggtgct

SEQ ID NO: 552117 - DNA, 25 bp, Mus musculus
caaggagtccattcatgagggtgct

SEQ ID NO: 552118 - DNA, 25 bp, Mus musculus
caaggagtctacatggtactgggta

SEQ ID NO: 552119 - DNA, 25 bp, Mus musculus
caaggagtctacttggtactgggta

SEQ ID NO: 552120 - DNA, 25 bp, Mus musculus
caaggagtgctgatataccctgacc

SEQ ID NO: 552121 - DNA, 25 bp, Mus musculus
caaggagtgctgttataccctgacc

SEQ ID NO: 552122 - DNA, 25 bp, Mus musculus
caaggagtggtgcttcaaaccatgt

SEQ ID NO: 552123 - DNA, 25 bp, Mus musculus
caaggagtggtggttcaaaccatgt

SEQ ID NO: 552124 - DNA, 25 bp, Mus musculus
caaggagttatgcatgacgtggtca

SEQ ID NO: 552125 - DNA, 25 bp, Mus musculus
caaggagttatggatgacgtggtca

SEQ ID NO: 552126 - DNA, 25 bp, Mus musculus
caaggagttcctctggtggctttga

SEQ ID NO: 552127 - DNA, 25 bp, Mus musculus
caaggagttcctgtggtggctttga

SEQ ID NO: 552128 - DNA, 25 bp, Mus musculus
caaggagttgctccgtttccaggaa

SEQ ID NO: 552129 - DNA, 25 bp, Mus musculus
caaggagttgctgcgtttccaggaa

SEQ ID NO: 552130 - DNA, 25 bp, Mus musculus
caaggagtttggcacagatcatatc

SEQ ID NO: 552131 - DNA, 25 bp, Mus musculus
caaggagtttgggacagatcatatc

SEQ ID NO: 552132 - DNA, 25 bp, Mus musculus
caaggataacatcaacgtgaagcaa

SEQ ID NO: 552133 - DNA, 25 bp, Mus musculus
caaggataacatgaacgtgaagcaa

SEQ ID NO: 552134 - DNA, 25 bp, Mus musculus
caaggataacttctgggccaaagct

SEQ ID NO: 552135 - DNA, 25 bp, Mus musculus
caaggataacttgtgggccaaagct

SEQ ID NO: 552136 - DNA, 25 bp, Mus musculus
caaggatacctaaggagacacgcta

SEQ ID NO: 552137 - DNA, 25 bp, Mus musculus
caaggatacctatggagacacgcta

SEQ ID NO: 552138 - DNA, 25 bp, Mus musculus
caaggatagaatcgtgaacagcaat

SEQ ID NO: 552139 - DNA, 25 bp, Mus musculus
caaggatagaatggtgaacagcaat

SEQ ID NO: 552140 - DNA, 25 bp, Mus musculus
caaggatagatgagatttataaaaa

SEQ ID NO: 552141 - DNA, 25 bp, Mus musculus
caaggatagatgtgatttataaaaa

SEQ ID NO: 552142 - DNA, 25 bp, Mus musculus
caaggatattaaaggcccgggcaca

SEQ ID NO: 552143 - DNA, 25 bp, Mus musculus
caaggatattaatggcccgggcaca

SEQ ID NO: 552144 - DNA, 25 bp, Mus musculus
caaggatcaaggagctctggctgct

SEQ ID NO: 552145 - DNA, 25 bp, Mus musculus
caaggatcaaggtgctctggctgct

SEQ ID NO: 552146 - DNA, 25 bp, Mus musculus
caaggatcactacaagttggctcta

SEQ ID NO: 552147 - DNA, 25 bp, Mus musculus
caaggatcactagaagttggctcta

SEQ ID NO: 552148 - DNA, 25 bp, Mus musculus
caaggatcagacagagaaaacccat

SEQ ID NO: 552149 - DNA, 25 bp, Mus musculus
caaggatcagactgagaaaacccat

SEQ ID NO: 552150 - DNA, 25 bp, Mus musculus
caaggatcagccagttcttacgagg

SEQ ID NO: 552151 - DNA, 25 bp, Mus musculus
caaggatcagcctgttcttacgagg

SEQ ID NO: 552152 - DNA, 25 bp, Mus musculus
caaggatccacactggcaattgtca

SEQ ID NO: 552153 - DNA, 25 bp, Mus musculus
caaggatccacagtggcaattgtca

SEQ ID NO: 552154 - DNA, 25 bp, Mus musculus
caaggatccgaaaccactttgcagt

SEQ ID NO: 552155 - DNA, 25 bp, Mus musculus
caaggatccgaatccactttgcagt

SEQ ID NO: 552156 - DNA, 25 bp, Mus musculus
caaggatcctcaacaaagaagagag

SEQ ID NO: 552157 - DNA, 25 bp, Mus musculus
caaggatcctcatcaaagaagagag

SEQ ID NO: 552158 - DNA, 25 bp, Mus musculus
caaggatcctgtattgggcacaaaa

SEQ ID NO: 552159 - DNA, 25 bp, Mus musculus
caaggatcctgttttgggcacaaaa

SEQ ID NO: 552160 - DNA, 25 bp, Mus musculus
caaggatcgaaaagcgaatcatcat

SEQ ID NO: 552161 - DNA, 25 bp, Mus musculus
caaggatcgaaatgcgaatcatcat

SEQ ID NO: 552162 - DNA, 25 bp, Mus musculus
caaggatcgagtaagcgcagagccg

SEQ ID NO: 552163 - DNA, 25 bp, Mus musculus
caaggatcgagttagcgcagagccg

SEQ ID NO: 552164 - DNA, 25 bp, Mus musculus
caaggatcgatcaggaaactgtgtc

SEQ ID NO: 552165 - DNA, 25 bp, Mus musculus
caaggatcgatctggaaactgtgtc

SEQ ID NO: 552166 - DNA, 25 bp, Mus musculus
caaggatcggcaagctttagaggga

SEQ ID NO: 552167 - DNA, 25 bp, Mus musculus
caaggatcggcatgctttagaggga

SEQ ID NO: 552168 - DNA, 25 bp, Mus musculus
caaggatctgggatatgactacagc

SEQ ID NO: 552169 - DNA, 25 bp, Mus musculus
caaggatctgggttatgactacagc

SEQ ID NO: 552170 - DNA, 25 bp, Mus musculus
caaggatctggtcatctaagttcac

SEQ ID NO: 552171 - DNA, 25 bp, Mus musculus
caaggatctggtgatctaagttcac

SEQ ID NO: 552172 - DNA, 25 bp, Mus musculus
caaggatgaagcaaggaaaaggctc

SEQ ID NO: 552173 - DNA, 25 bp, Mus musculus
caaggatgaagctaggaaaaggctc

SEQ ID NO: 552174 - DNA, 25 bp, Mus musculus
caaggatgacagagaattagacttt

SEQ ID NO: 552175 - DNA, 25 bp, Mus musculus
caaggatgacagtgaattagacttt

SEQ ID NO: 552176 - DNA, 25 bp, Mus musculus
caaggatgagaccatgactgtttac

SEQ ID NO: 552177 - DNA, 25 bp, Mus musculus
caaggatgagacgatgactgtttac

SEQ ID NO: 552178 - DNA, 25 bp, Mus musculus
caaggatgagcgatttctgctgtac

SEQ ID NO: 552179 - DNA, 25 bp, Mus musculus
caaggatgagcgttttctgctgtac

SEQ ID NO: 552180 - DNA, 25 bp, Mus musculus
caaggatgcccgagagcctgtcatt

SEQ ID NO: 552181 - DNA, 25 bp, Mus musculus
caaggatgcccgtgagcctgtcatt

SEQ ID NO: 552182 - DNA, 25 bp, Mus musculus
caaggatgcctgactgttccggagc

SEQ ID NO: 552183 - DNA, 25 bp, Mus musculus
caaggatgcctgtctgttccggagc

SEQ ID NO: 552184 - DNA, 25 bp, Mus musculus
caaggatgcggcaaagtatatggca

SEQ ID NO: 552185 - DNA, 25 bp, Mus musculus
caaggatgcggctaagtatatggca

SEQ ID NO: 552186 - DNA, 25 bp, Mus musculus
caaggatgcggtagaggctcacttt

SEQ ID NO: 552187 - DNA, 25 bp, Mus musculus
caaggatgcggttgaggctcacttt

SEQ ID NO: 552188 - DNA, 25 bp, Mus musculus
caaggatggaggaggcaatgtctca

SEQ ID NO: 552189 - DNA, 25 bp, Mus musculus
caaggatggaggtggcaatgtctca

SEQ ID NO: 552190 - DNA, 25 bp, Mus musculus
caaggatggatcatggtctggagat

SEQ ID NO: 552191 - DNA, 25 bp, Mus musculus
caaggatggatcttggtctggagat

SEQ ID NO: 552192 - DNA, 25 bp, Mus musculus
caaggatgggaaacttaagtaccag

SEQ ID NO: 552193 - DNA, 25 bp, Mus musculus
caaggatgggaatcttaagtaccag

SEQ ID NO: 552194 - DNA, 25 bp, Mus musculus
caaggatggtttagcacaatgaagg

SEQ ID NO: 552195 - DNA, 25 bp, Mus musculus
caaggatggttttgcacaatgaagg

SEQ ID NO: 552196 - DNA, 25 bp, Mus musculus
caaggatgtccacccctgtagggag

SEQ ID NO: 552197 - DNA, 25 bp, Mus musculus
caaggatgtccagccctgtagggag

SEQ ID NO: 552198 - DNA, 25 bp, Mus musculus
caaggatgtgtcaactctgtcactg

SEQ ID NO: 552199 - DNA, 25 bp, Mus musculus
caaggatgtgtctactctgtcactg

SEQ ID NO: 552200 - DNA, 25 bp, Mus musculus
caaggatgttaaaagccttggataa

SEQ ID NO: 552201 - DNA, 25 bp, Mus musculus
caaggatgttaatagccttggataa

SEQ ID NO: 552202 - DNA, 25 bp, Mus musculus
caaggattacctattgtgtgactac

SEQ ID NO: 552203 - DNA, 25 bp, Mus musculus
caaggattaccttttgtgtgactac

SEQ ID NO: 552204 - DNA, 25 bp, Mus musculus
caaggattatgtcaaaactctgcct

SEQ ID NO: 552205 - DNA, 25 bp, Mus musculus
caaggattatgtgaaaactctgcct

SEQ ID NO: 552206 - DNA, 25 bp, Mus musculus
caaggattcttccagccctcacagt

SEQ ID NO: 552207 - DNA, 25 bp, Mus musculus
caaggattcttcgagccctcacagt

SEQ ID NO: 552208 - DNA, 25 bp, Mus musculus
caaggattggctccaggtatgccag

SEQ ID NO: 552209 - DNA, 25 bp, Mus musculus
caaggattggctgcaggtatgccag

SEQ ID NO: 552210 - DNA, 25 bp, Mus musculus
caaggattgtttcagagatggacag

SEQ ID NO: 552211 - DNA, 25 bp, Mus musculus
caaggattgtttgagagatggacag

SEQ ID NO: 552212 - DNA, 25 bp, Mus musculus
caaggatttgagcaagcggagcttc

SEQ ID NO: 552213 - DNA, 25 bp, Mus musculus
caaggatttgaggaagcggagcttc

SEQ ID NO: 552214 - DNA, 25 bp, Mus musculus
caaggatttggcagacctggtctcc

SEQ ID NO: 552215 - DNA, 25 bp, Mus musculus
caaggatttggctgacctggtctcc

SEQ ID NO: 552216 - DNA, 25 bp, Mus musculus
caaggattttaaactgatctaccgg

SEQ ID NO: 552217 - DNA, 25 bp, Mus musculus
caaggattttaatctgatctaccgg

SEQ ID NO: 552218 - DNA, 25 bp, Mus musculus
caaggcaagcttcgcggacgcgcac

SEQ ID NO: 552219 - DNA, 25 bp, Mus musculus
caaggcaagcttggcggacgcgcac

SEQ ID NO: 552220 - DNA, 25 bp, Mus musculus
caaggcaatgcacacatgttctgga

SEQ ID NO: 552221 - DNA, 25 bp, Mus musculus
caaggcaatgcagacatgttctgga

SEQ ID NO: 552222 - DNA, 25 bp, Mus musculus
caaggcacagctcgatagcaagatc

SEQ ID NO: 552223 - DNA, 25 bp, Mus musculus
caaggcacagctggatagcaagatc

SEQ ID NO: 552224 - DNA, 25 bp, Mus musculus
caaggcactaggacctagaaggcaa

SEQ ID NO: 552225 - DNA, 25 bp, Mus musculus
caaggcactaggtcctagaaggcaa

SEQ ID NO: 552226 - DNA, 25 bp, Mus musculus
caaggcactgacacggcctttcaca

SEQ ID NO: 552227 - DNA, 25 bp, Mus musculus
caaggcactgactcggcctttcaca

SEQ ID NO: 552228 - DNA, 25 bp, Mus musculus
caaggcagctctaccgagtctgaca

SEQ ID NO: 552229 - DNA, 25 bp, Mus musculus
caaggcagctcttccgagtctgaca

SEQ ID NO: 552230 - DNA, 25 bp, Mus musculus
caaggcagggtcatcctggcattgg

SEQ ID NO: 552231 - DNA, 25 bp, Mus musculus
caaggcagggtcttcctggcattgg

SEQ ID NO: 552232 - DNA, 25 bp, Mus musculus
caaggcaggttgacacgctactcaa

SEQ ID NO: 552233 - DNA, 25 bp, Mus musculus
caaggcaggttgtcacgctactcaa

SEQ ID NO: 552234 - DNA, 25 bp, Mus musculus
caaggcagtcagaaacctgcatgga

SEQ ID NO: 552235 - DNA, 25 bp, Mus musculus
caaggcagtcagtaacctgcatgga

SEQ ID NO: 552236 - DNA, 25 bp, Mus musculus
caaggcagtcttcacaagagctcca

SEQ ID NO: 552237 - DNA, 25 bp, Mus musculus
caaggcagtcttgacaagagctcca

SEQ ID NO: 552238 - DNA, 25 bp, Mus musculus
caaggcagtgaacgctgctcgtgca

SEQ ID NO: 552239 - DNA, 25 bp, Mus musculus
caaggcagtgaaggctgctcgtgca

SEQ ID NO: 552240 - DNA, 25 bp, Mus musculus
caaggcagtgtcacgagaattgaac

SEQ ID NO: 552241 - DNA, 25 bp, Mus musculus
caaggcagtgtctcgagaattgaac

SEQ ID NO: 552242 - DNA, 25 bp, Mus musculus
caaggcatattcagctccacgacct

SEQ ID NO: 552243 - DNA, 25 bp, Mus musculus
caaggcatattctgctccacgacct

SEQ ID NO: 552244 - DNA, 25 bp, Mus musculus
caaggcatcacacagtagtagcatc

SEQ ID NO: 552245 - DNA, 25 bp, Mus musculus
caaggcatcacagagtagtagcatc

SEQ ID NO: 552246 - DNA, 25 bp, Mus musculus
caaggcatgtggactcctgggaagc

SEQ ID NO: 552247 - DNA, 25 bp, Mus musculus
caaggcatgtggtctcctgggaagc

SEQ ID NO: 552248 - DNA, 25 bp, Mus musculus
caaggcattacgacaccaagtgaga

SEQ ID NO: 552249 - DNA, 25 bp, Mus musculus
caaggcattacgtcaccaagtgaga

SEQ ID NO: 552250 - DNA, 25 bp, Mus musculus
caaggcattatgacattgctgagtc

SEQ ID NO: 552251 - DNA, 25 bp, Mus musculus
caaggcattatgtcattgctgagtc

SEQ ID NO: 552252 - DNA, 25 bp, Mus musculus
caaggccaaggaattcaccaatgtt

SEQ ID NO: 552253 - DNA, 25 bp, Mus musculus
caaggccaaggatttcaccaatgtt

SEQ ID NO: 552254 - DNA, 25 bp, Mus musculus
caaggccaagtaagggaaggacgcc

SEQ ID NO: 552255 - DNA, 25 bp, Mus musculus
caaggccaagtatgggaaggacgcc

SEQ ID NO: 552256 - DNA, 25 bp, Mus musculus
caaggccaccatagggagactgtca

SEQ ID NO: 552257 - DNA, 25 bp, Mus musculus
caaggccaccattgggagactgtca

SEQ ID NO: 552258 - DNA, 25 bp, Mus musculus
caaggccactgcaaacatttttgcc

SEQ ID NO: 552259 - DNA, 25 bp, Mus musculus
caaggccactgctaacatttttgcc

SEQ ID NO: 552260 - DNA, 25 bp, Mus musculus
caaggccatgatagagaagctagag

SEQ ID NO: 552261 - DNA, 25 bp, Mus musculus
caaggccatgattgagaagctagag

SEQ ID NO: 552262 - DNA, 25 bp, Mus musculus
caaggccatgtcactcacaactggg

SEQ ID NO: 552263 - DNA, 25 bp, Mus musculus
caaggccatgtctctcacaactggg

SEQ ID NO: 552264 - DNA, 25 bp, Mus musculus
caaggccatgttcccatcgtcactg

SEQ ID NO: 552265 - DNA, 25 bp, Mus musculus
caaggccatgttgccatcgtcactg

SEQ ID NO: 552266 - DNA, 25 bp, Mus musculus
caaggcccaagacattgatcaaacc

SEQ ID NO: 552267 - DNA, 25 bp, Mus musculus
caaggcccaagagattgatcaaacc

SEQ ID NO: 552268 - DNA, 25 bp, Mus musculus
caaggcccaagcagaggtactggct

SEQ ID NO: 552269 - DNA, 25 bp, Mus musculus
caaggcccaagctgaggtactggct

SEQ ID NO: 552270 - DNA, 25 bp, Mus musculus
caaggcccacccagattggaaatgg

SEQ ID NO: 552271 - DNA, 25 bp, Mus musculus
caaggcccaccctgattggaaatgg

SEQ ID NO: 552272 - DNA, 25 bp, Mus musculus
caaggcccagcactggctggaagac

SEQ ID NO: 552273 - DNA, 25 bp, Mus musculus
caaggcccagcagtggctggaagac

SEQ ID NO: 552274 - DNA, 25 bp, Mus musculus
caaggcccaggtaactacagcgcca

SEQ ID NO: 552275 - DNA, 25 bp, Mus musculus
caaggcccaggttactacagcgcca

SEQ ID NO: 552276 - DNA, 25 bp, Mus musculus
caaggcccagtaagagtaaccctgg

SEQ ID NO: 552277 - DNA, 25 bp, Mus musculus
caaggcccagtatgagtaaccctgg

SEQ ID NO: 552278 - DNA, 25 bp, Mus musculus
caaggcccctcaaggatatctgaag

SEQ ID NO: 552279 - DNA, 25 bp, Mus musculus
caaggcccctcatggatatctgaag

SEQ ID NO: 552280 - DNA, 25 bp, Mus musculus
caaggcccctgtcgtgaaggctaaa

SEQ ID NO: 552281 - DNA, 25 bp, Mus musculus
caaggcccctgtggtgaaggctaaa

SEQ ID NO: 552282 - DNA, 25 bp, Mus musculus
caaggcccggctacggtgatcccga

SEQ ID NO: 552283 - DNA, 25 bp, Mus musculus
caaggcccggcttcggtgatcccga

SEQ ID NO: 552284 - DNA, 25 bp, Mus musculus
caaggccctcagcaccattgtctag

SEQ ID NO: 552285 - DNA, 25 bp, Mus musculus
caaggccctcaggaccattgtctag

SEQ ID NO: 552286 - DNA, 25 bp, Mus musculus
caaggccgcagacataagctgttaa

SEQ ID NO: 552287 - DNA, 25 bp, Mus musculus
caaggccgcagagataagctgttaa

SEQ ID NO: 552288 - DNA, 25 bp, Mus musculus
caaggccgtgcaccagtgtgacaat

SEQ ID NO: 552289 - DNA, 25 bp, Mus musculus
caaggccgtgcagcagtgtgacaat

SEQ ID NO: 552290 - DNA, 25 bp, Mus musculus
caaggccgttccagcccagtgagca

SEQ ID NO: 552291 - DNA, 25 bp, Mus musculus
caaggccgttcctgcccagtgagca

SEQ ID NO: 552292 - DNA, 25 bp, Mus musculus
caaggcctaagcctacctgtgtcgt

SEQ ID NO: 552293 - DNA, 25 bp, Mus musculus
caaggcctaagcgtacctgtgtcgt

SEQ ID NO: 552294 - DNA, 25 bp, Mus musculus
caaggcctaccccacagtgtgtggg

SEQ ID NO: 552295 - DNA, 25 bp, Mus musculus
caaggcctacccgacagtgtgtggg

SEQ ID NO: 552296 - DNA, 25 bp, Mus musculus
caaggcctcacaatgcacgtgaaag

SEQ ID NO: 552297 - DNA, 25 bp, Mus musculus
caaggcctcacattgcacgtgaaag

SEQ ID NO: 552298 - DNA, 25 bp, Mus musculus
caaggcctcagaattgccgggttct

SEQ ID NO: 552299 - DNA, 25 bp, Mus musculus
caaggcctcagatttgccgggttct

SEQ ID NO: 552300 - DNA, 25 bp, Mus musculus
caaggcctccacaagtgactaccag

SEQ ID NO: 552301 - DNA, 25 bp, Mus musculus
caaggcctccactagtgactaccag

SEQ ID NO: 552302 - DNA, 25 bp, Mus musculus
caaggcctcgcacagacaatttgag

SEQ ID NO: 552303 - DNA, 25 bp, Mus musculus
caaggcctcgcagagacaatttgag

SEQ ID NO: 552304 - DNA, 25 bp, Mus musculus
caaggcctcttgactttagtcagga

SEQ ID NO: 552305 - DNA, 25 bp, Mus musculus
caaggcctcttgtctttagtcagga

SEQ ID NO: 552306 - DNA, 25 bp, Mus musculus
caaggcctgcaaccagtctactgat

SEQ ID NO: 552307 - DNA, 25 bp, Mus musculus
caaggcctgcaagcagtctactgat

SEQ ID NO: 552308 - DNA, 25 bp, Mus musculus
caaggcctgcttaagaaagttctgc

SEQ ID NO: 552309 - DNA, 25 bp, Mus musculus
caaggcctgctttagaaagttctgc

SEQ ID NO: 552310 - DNA, 25 bp, Mus musculus
caaggcctgtagagattgttgaagc

SEQ ID NO: 552311 - DNA, 25 bp, Mus musculus
caaggcctgtagtgattgttgaagc

SEQ ID NO: 552312 - DNA, 25 bp, Mus musculus
caaggcctgtcaagatgacgtcaca

SEQ ID NO: 552313 - DNA, 25 bp, Mus musculus
caaggcctgtcatgatgacgtcaca

SEQ ID NO: 552314 - DNA, 25 bp, Mus musculus
caaggcctgtcgagagtccgttact

SEQ ID NO: 552315 - DNA, 25 bp, Mus musculus
caaggcctgtcgtgagtccgttact

SEQ ID NO: 552316 - DNA, 25 bp, Mus musculus
caaggccttaaacctctataaggag

SEQ ID NO: 552317 - DNA, 25 bp, Mus musculus
caaggccttaaagctctataaggag

SEQ ID NO: 552318 - DNA, 25 bp, Mus musculus
caaggccttcagaaagtccttgaag

SEQ ID NO: 552319 - DNA, 25 bp, Mus musculus
caaggccttcagtaagtccttgaag

SEQ ID NO: 552320 - DNA, 25 bp, Mus musculus
caaggccttgatcggacttattcaa

SEQ ID NO: 552321 - DNA, 25 bp, Mus musculus
caaggccttgatgggacttattcaa

SEQ ID NO: 552322 - DNA, 25 bp, Mus musculus
caaggcgacgatcgtgacgccagca

SEQ ID NO: 552323 - DNA, 25 bp, Mus musculus
caaggcgacgatggtgacgccagca

SEQ ID NO: 552324 - DNA, 25 bp, Mus musculus
caaggcgatcagctgaaaaacaggg

SEQ ID NO: 552325 - DNA, 25 bp, Mus musculus
caaggcgatcaggtgaaaaacaggg

SEQ ID NO: 552326 - DNA, 25 bp, Mus musculus
caaggcggacagaggcagatacagc

SEQ ID NO: 552327 - DNA, 25 bp, Mus musculus
caaggcggacagtggcagatacagc

SEQ ID NO: 552328 - DNA, 25 bp, Mus musculus
caaggcggataacaaggcagctcag

SEQ ID NO: 552329 - DNA, 25 bp, Mus musculus
caaggcggataagaaggcagctcag

SEQ ID NO: 552330 - DNA, 25 bp, Mus musculus
caaggcggcaacatcgggctcccgg

SEQ ID NO: 552331 - DNA, 25 bp, Mus musculus
caaggcggcaacttcgggctcccgg

SEQ ID NO: 552332 - DNA, 25 bp, Mus musculus
caaggcggctgtacgtggatggcca

SEQ ID NO: 552333 - DNA, 25 bp, Mus musculus
caaggcggctgttcgtggatggcca

SEQ ID NO: 552334 - DNA, 25 bp, Mus musculus
caaggcgtccaacgacttatgcagg

SEQ ID NO: 552335 - DNA, 25 bp, Mus musculus
caaggcgtccaaggacttatgcagg

SEQ ID NO: 552336 - DNA, 25 bp, Mus musculus
caaggcgtgcaaagatatggtgaag

SEQ ID NO: 552337 - DNA, 25 bp, Mus musculus
caaggcgtgcaatgatatggtgaag

SEQ ID NO: 552338 - DNA, 25 bp, Mus musculus
caaggcgttgtgaaactggatgttc

SEQ ID NO: 552339 - DNA, 25 bp, Mus musculus
caaggcgttgtgtaactggatgttc

SEQ ID NO: 552340 - DNA, 25 bp, Mus musculus
caaggctaacacaagccagccaggt

SEQ ID NO: 552341 - DNA, 25 bp, Mus musculus
caaggctaacactagccagccaggt

SEQ ID NO: 552342 - DNA, 25 bp, Mus musculus
caaggctacaagatttgttggatat

SEQ ID NO: 552343 - DNA, 25 bp, Mus musculus
caaggctacaagttttgttggatat

SEQ ID NO: 552344 - DNA, 25 bp, Mus musculus
caaggctacggcaactatcgcactg

SEQ ID NO: 552345 - DNA, 25 bp, Mus musculus
caaggctacggctactatcgcactg

SEQ ID NO: 552346 - DNA, 25 bp, Mus musculus
caaggctactacatgcagatgcacc

SEQ ID NO: 552347 - DNA, 25 bp, Mus musculus
caaggctactacttgcagatgcacc

SEQ ID NO: 552348 - DNA, 25 bp, Mus musculus
caaggctactgtccccagtacagag

SEQ ID NO: 552349 - DNA, 25 bp, Mus musculus
caaggctactgtgcccagtacagag

SEQ ID NO: 552350 - DNA, 25 bp, Mus musculus
caaggctatggcaagctaagcagtg

SEQ ID NO: 552351 - DNA, 25 bp, Mus musculus
caaggctatggctagctaagcagtg

SEQ ID NO: 552352 - DNA, 25 bp, Mus musculus
caaggctattcaaaaagagactggc

SEQ ID NO: 552353 - DNA, 25 bp, Mus musculus
caaggctattcataaagagactggc

SEQ ID NO: 552354 - DNA, 25 bp, Mus musculus
caaggctcaaagacctcagagcaag

SEQ ID NO: 552355 - DNA, 25 bp, Mus musculus
caaggctcaaagtcctcagagcaag

SEQ ID NO: 552356 - DNA, 25 bp, Mus musculus
caaggctcaaatccaactgaacaag

SEQ ID NO: 552357 - DNA, 25 bp, Mus musculus
caaggctcaaatgcaactgaacaag

SEQ ID NO: 552358 - DNA, 25 bp, Mus musculus
caaggctcatcaagatggtggcagg

SEQ ID NO: 552359 - DNA, 25 bp, Mus musculus
caaggctcatcatgatggtggcagg

SEQ ID NO: 552360 - DNA, 25 bp, Mus musculus
caaggctctgttagatgtcctggca

SEQ ID NO: 552361 - DNA, 25 bp, Mus musculus
caaggctctgtttgatgtcctggca

SEQ ID NO: 552362 - DNA, 25 bp, Mus musculus
caaggctcttgtagattgggcttcc

SEQ ID NO: 552363 - DNA, 25 bp, Mus musculus
caaggctcttgttgattgggcttcc

SEQ ID NO: 552364 - DNA, 25 bp, Mus musculus
caaggctgaaatacaggcagttatt

SEQ ID NO: 552365 - DNA, 25 bp, Mus musculus
caaggctgaaattcaggcagttatt

SEQ ID NO: 552366 - DNA, 25 bp, Mus musculus
caaggctgacatcaagttcaagagc

SEQ ID NO: 552367 - DNA, 25 bp, Mus musculus
caaggctgacatgaagttcaagagc

SEQ ID NO: 552368 - DNA, 25 bp, Mus musculus
caaggctgacttccaagctgagagg

SEQ ID NO: 552369 - DNA, 25 bp, Mus musculus
caaggctgacttgcaagctgagagg

SEQ ID NO: 552370 - DNA, 25 bp, Mus musculus
caaggctgagaaactggttgagaac

SEQ ID NO: 552371 - DNA, 25 bp, Mus musculus
caaggctgagaatctggttgagaac

SEQ ID NO: 552372 - DNA, 25 bp, Mus musculus
caaggctgatgtcttccataggtca

SEQ ID NO: 552373 - DNA, 25 bp, Mus musculus
caaggctgatgtgttccataggtca

SEQ ID NO: 552374 - DNA, 25 bp, Mus musculus
caaggctgcagaccttgtcaacgac

SEQ ID NO: 552375 - DNA, 25 bp, Mus musculus
caaggctgcagagcttgtcaacgac

SEQ ID NO: 552376 - DNA, 25 bp, Mus musculus
caaggctgcagcaggcaaagttctg

SEQ ID NO: 552377 - DNA, 25 bp, Mus musculus
caaggctgcagctggcaaagttctg

SEQ ID NO: 552378 - DNA, 25 bp, Mus musculus
caaggctgccaacgaaagggagtct

SEQ ID NO: 552379 - DNA, 25 bp, Mus musculus
caaggctgccaaggaaagggagtct

SEQ ID NO: 552380 - DNA, 25 bp, Mus musculus
caaggctgctctctagatctgaagg

SEQ ID NO: 552381 - DNA, 25 bp, Mus musculus
caaggctgctctgtagatctgaagg

SEQ ID NO: 552382 - DNA, 25 bp, Mus musculus
caaggctggaacaacatcggcatag

SEQ ID NO: 552383 - DNA, 25 bp, Mus musculus
caaggctggaactacatcggcatag

SEQ ID NO: 552384 - DNA, 25 bp, Mus musculus
caaggctggaagagacctgctgtac

SEQ ID NO: 552385 - DNA, 25 bp, Mus musculus
caaggctggaagtgacctgctgtac

SEQ ID NO: 552386 - DNA, 25 bp, Mus musculus
caaggctggtgtcaacttcagtgaa

SEQ ID NO: 552387 - DNA, 25 bp, Mus musculus
caaggctggtgtgaacttcagtgaa

SEQ ID NO: 552388 - DNA, 25 bp, Mus musculus
caaggctgtatccattattgaatgt

SEQ ID NO: 552389 - DNA, 25 bp, Mus musculus
caaggctgtatcgattattgaatgt

SEQ ID NO: 552390 - DNA, 25 bp, Mus musculus
caaggctgtggacaatcctccagtt

SEQ ID NO: 552391 - DNA, 25 bp, Mus musculus
caaggctgtggagaatcctccagtt

SEQ ID NO: 552392 - DNA, 25 bp, Mus musculus
caaggctgttcaatcaatcttttca

SEQ ID NO: 552393 - DNA, 25 bp, Mus musculus
caaggctgttcattcaatcttttca

SEQ ID NO: 552394 - DNA, 25 bp, Mus musculus
caaggctgttgtcgtcttcgatgaa

SEQ ID NO: 552395 - DNA, 25 bp, Mus musculus
caaggctgttgtggtcttcgatgaa

SEQ ID NO: 552396 - DNA, 25 bp, Mus musculus
caaggcttagtgagagaaattcgca

SEQ ID NO: 552397 - DNA, 25 bp, Mus musculus
caaggcttagtgtgagaaattcgca

SEQ ID NO: 552398 - DNA, 25 bp, Mus musculus
caaggcttcgagaagacttgatgtc

SEQ ID NO: 552399 - DNA, 25 bp, Mus musculus
caaggcttcgagtagacttgatgtc

SEQ ID NO: 552400 - DNA, 25 bp, Mus musculus
caaggcttctccatttgaggaggac

SEQ ID NO: 552401 - DNA, 25 bp, Mus musculus
caaggcttctccttttgaggaggac

SEQ ID NO: 552402 - DNA, 25 bp, Mus musculus
caaggcttctgcatcaggatggttt

SEQ ID NO: 552403 - DNA, 25 bp, Mus musculus
caaggcttctgcttcaggatggttt

SEQ ID NO: 552404 - DNA, 25 bp, Mus musculus
caaggcttggacaggaagattttga

SEQ ID NO: 552405 - DNA, 25 bp, Mus musculus
caaggcttggactggaagattttga

SEQ ID NO: 552406 - DNA, 25 bp, Mus musculus
caaggcttgtgtaagagatgtcacc

SEQ ID NO: 552407 - DNA, 25 bp, Mus musculus
caaggcttgtgttagagatgtcacc

SEQ ID NO: 552408 - DNA, 25 bp, Mus musculus
caaggctttcacatttgatgatgaa

SEQ ID NO: 552409 - DNA, 25 bp, Mus musculus
caaggctttcacttttgatgatgaa

SEQ ID NO: 552410 - DNA, 25 bp, Mus musculus
caaggctttgacatctctccggttc

SEQ ID NO: 552411 - DNA, 25 bp, Mus musculus
caaggctttgacatgcaagaggttg

SEQ ID NO: 552412 - DNA, 25 bp, Mus musculus
caaggctttgacttctctccggttc

SEQ ID NO: 552413 - DNA, 25 bp, Mus musculus
caaggctttgacttgcaagaggttg

SEQ ID NO: 552414 - DNA, 25 bp, Mus musculus
caagggaaaagtaatcctgttgatg

SEQ ID NO: 552415 - DNA, 25 bp, Mus musculus
caagggaaaagttatcctgttgatg

SEQ ID NO: 552416 - DNA, 25 bp, Mus musculus
caagggaaagggatttcaaatgctg

SEQ ID NO: 552417 - DNA, 25 bp, Mus musculus
caagggaaagggttttcaaatgctg

SEQ ID NO: 552418 - DNA, 25 bp, Mus musculus
caagggaacagaagcttcgtgagtg

SEQ ID NO: 552419 - DNA, 25 bp, Mus musculus
caagggaacagatgcttcgtgagtg

SEQ ID NO: 552420 - DNA, 25 bp, Mus musculus
caagggaactggactgaaactgatg

SEQ ID NO: 552421 - DNA, 25 bp, Mus musculus
caagggaactggtctgaaactgatg

SEQ ID NO: 552422 - DNA, 25 bp, Mus musculus
caagggaagttgacgagatggcaga

SEQ ID NO: 552423 - DNA, 25 bp, Mus musculus
caagggaagttgtcgagatggcaga

SEQ ID NO: 552424 - DNA, 25 bp, Mus musculus
caagggaattggcaaatcaagtagc

SEQ ID NO: 552425 - DNA, 25 bp, Mus musculus
caagggaattgggaaatcaagtagc

SEQ ID NO: 552426 - DNA, 25 bp, Mus musculus
caagggacacatcattcactttaag

SEQ ID NO: 552427 - DNA, 25 bp, Mus musculus
caagggacacatgattcactttaag

SEQ ID NO: 552428 - DNA, 25 bp, Mus musculus
caagggacagcacagggccttttgc

SEQ ID NO: 552429 - DNA, 25 bp, Mus musculus
caagggacagcagagggccttttgc

SEQ ID NO: 552430 - DNA, 25 bp, Mus musculus
caagggaccaccaagtgacctgggt

SEQ ID NO: 552431 - DNA, 25 bp, Mus musculus
caagggaccacctagtgacctgggt

SEQ ID NO: 552432 - DNA, 25 bp, Mus musculus
caagggacccctcagtttccagagg

SEQ ID NO: 552433 - DNA, 25 bp, Mus musculus
caagggacccctgagtttccagagg

SEQ ID NO: 552434 - DNA, 25 bp, Mus musculus
caagggacctcgatctgcactggaa

SEQ ID NO: 552435 - DNA, 25 bp, Mus musculus
caagggacctcgttctgcactggaa

SEQ ID NO: 552436 - DNA, 25 bp, Mus musculus
caagggacgggcaattatagagaag

SEQ ID NO: 552437 - DNA, 25 bp, Mus musculus
caagggacgggctattatagagaag

SEQ ID NO: 552438 - DNA, 25 bp, Mus musculus
caagggactctgctcactgtctctg

SEQ ID NO: 552439 - DNA, 25 bp, Mus musculus
caagggactctggtcactgtctctg

SEQ ID NO: 552440 - DNA, 25 bp, Mus musculus
caagggactgaacatatgccggaca

SEQ ID NO: 552441 - DNA, 25 bp, Mus musculus
caagggactgaagatatgccggaca

SEQ ID NO: 552442 - DNA, 25 bp, Mus musculus
caagggagaaataccatcacctcag

SEQ ID NO: 552443 - DNA, 25 bp, Mus musculus
caagggagaaattccatcacctcag

SEQ ID NO: 552444 - DNA, 25 bp, Mus musculus
caagggagagcgctcttcccagctc

SEQ ID NO: 552445 - DNA, 25 bp, Mus musculus
caagggagagcggtcttcccagctc

SEQ ID NO: 552446 - DNA, 25 bp, Mus musculus
caagggagagctcgcacccgagcta

SEQ ID NO: 552447 - DNA, 25 bp, Mus musculus
caagggagagctggcacccgagcta

SEQ ID NO: 552448 - DNA, 25 bp, Mus musculus
caagggagtgatacaacattaccca

SEQ ID NO: 552449 - DNA, 25 bp, Mus musculus
caagggagtgattcaacattaccca

SEQ ID NO: 552450 - DNA, 25 bp, Mus musculus
caagggatacttcctcaatgagcca

SEQ ID NO: 552451 - DNA, 25 bp, Mus musculus
caagggatacttgctcaatgagcca

SEQ ID NO: 552452 - DNA, 25 bp, Mus musculus
caagggatccctcttcagtccagga

SEQ ID NO: 552453 - DNA, 25 bp, Mus musculus
caagggatccctgttcagtccagga

SEQ ID NO: 552454 - DNA, 25 bp, Mus musculus
caagggatcgccatgggaaagagcc

SEQ ID NO: 552455 - DNA, 25 bp, Mus musculus
caagggatcgccttgggaaagagcc

SEQ ID NO: 552456 - DNA, 25 bp, Mus musculus
caagggatgtagaaagcaaagtgtc

SEQ ID NO: 552457 - DNA, 25 bp, Mus musculus
caagggatgtagtaagcaaagtgtc

SEQ ID NO: 552458 - DNA, 25 bp, Mus musculus
caagggcaaaggcagtgacaaagac

SEQ ID NO: 552459 - DNA, 25 bp, Mus musculus
caagggcaaagggagtgacaaagac

SEQ ID NO: 552460 - DNA, 25 bp, Mus musculus
caagggcaagaaagtgctgatcaac

SEQ ID NO: 552461 - DNA, 25 bp, Mus musculus
caagggcaagaatgtgctgatcaac

SEQ ID NO: 552462 - DNA, 25 bp, Mus musculus
caagggcacgcgctacattgctgtg

SEQ ID NO: 552463 - DNA, 25 bp, Mus musculus
caagggcacgcggtacattgctgtg

SEQ ID NO: 552464 - DNA, 25 bp, Mus musculus
caagggcagagcatgtactagtctc

SEQ ID NO: 552465 - DNA, 25 bp, Mus musculus
caagggcagagcttgtactagtctc

SEQ ID NO: 552466 - DNA, 25 bp, Mus musculus
caagggcagcttatcctggaatcca

SEQ ID NO: 552467 - DNA, 25 bp, Mus musculus
caagggcagcttttcctggaatcca

SEQ ID NO: 552468 - DNA, 25 bp, Mus musculus
caagggcagggaccatgtctgatca

SEQ ID NO: 552469 - DNA, 25 bp, Mus musculus
caagggcagggagcatgtctgatca

SEQ ID NO: 552470 - DNA, 25 bp, Mus musculus
caagggcagtctctgatctctcgcc

SEQ ID NO: 552471 - DNA, 25 bp, Mus musculus
caagggcagtctgtgatctctcgcc

SEQ ID NO: 552472 - DNA, 25 bp, Mus musculus
caagggcagtgcctatttgaacatg

SEQ ID NO: 552473 - DNA, 25 bp, Mus musculus
caagggcagtgcgtatttgaacatg

SEQ ID NO: 552474 - DNA, 25 bp, Mus musculus
caagggcatcctccggaactttagg

SEQ ID NO: 552475 - DNA, 25 bp, Mus musculus
caagggcatcctgcggaactttagg

SEQ ID NO: 552476 - DNA, 25 bp, Mus musculus
caagggccagcaccgctatcagttc

SEQ ID NO: 552477 - DNA, 25 bp, Mus musculus
caagggccagcagcgctatcagttc

SEQ ID NO: 552478 - DNA, 25 bp, Mus musculus
caagggccagttactggatttctca

SEQ ID NO: 552479 - DNA, 25 bp, Mus musculus
caagggccagtttctggatttctca

SEQ ID NO: 552480 - DNA, 25 bp, Mus musculus
caagggcctcttctttctcagggtg

SEQ ID NO: 552481 - DNA, 25 bp, Mus musculus
caagggcctcttgtttctcagggtg

SEQ ID NO: 552482 - DNA, 25 bp, Mus musculus
caagggcctgccattgtcacgtggc

SEQ ID NO: 552483 - DNA, 25 bp, Mus musculus
caagggcctgcctttgtcacgtggc

SEQ ID NO: 552484 - DNA, 25 bp, Mus musculus
caagggcgatgcctgtgatgacgat

SEQ ID NO: 552485 - DNA, 25 bp, Mus musculus
caagggcgatgcgtgtgatgacgat

SEQ ID NO: 552486 - DNA, 25 bp, Mus musculus
caagggctaaccattgacactggga

SEQ ID NO: 552487 - DNA, 25 bp, Mus musculus
caagggctaacctttgacactggga

SEQ ID NO: 552488 - DNA, 25 bp, Mus musculus
caagggctatacctcagagcaggtg

SEQ ID NO: 552489 - DNA, 25 bp, Mus musculus
caagggctatacgtcagagcaggtg

SEQ ID NO: 552490 - DNA, 25 bp, Mus musculus
caagggctatggatttgtacacttt

SEQ ID NO: 552491 - DNA, 25 bp, Mus musculus
caagggctatggttttgtacacttt

SEQ ID NO: 552492 - DNA, 25 bp, Mus musculus
caagggctcgggagagaaactttgc

SEQ ID NO: 552493 - DNA, 25 bp, Mus musculus
caagggctcgggtgagaaactttgc

SEQ ID NO: 552494 - DNA, 25 bp, Mus musculus
caagggctgcaaattagaaactcat

SEQ ID NO: 552495 - DNA, 25 bp, Mus musculus
caagggctgcaacataagccgctgg

SEQ ID NO: 552496 - DNA, 25 bp, Mus musculus
caagggctgcaagataagccgctgg

SEQ ID NO: 552497 - DNA, 25 bp, Mus musculus
caagggctgcaatttagaaactcat

SEQ ID NO: 552498 - DNA, 25 bp, Mus musculus
caagggctgctaaacggttgacaac

SEQ ID NO: 552499 - DNA, 25 bp, Mus musculus
caagggctgctatacggttgacaac

SEQ ID NO: 552500 - DNA, 25 bp, Mus musculus
caagggcttcacagtgatgaacgag

SEQ ID NO: 552501 - DNA, 25 bp, Mus musculus
caagggcttcactgtgatgaacgag

SEQ ID NO: 552502 - DNA, 25 bp, Mus musculus
caagggcttgcacgtgcactagttc

SEQ ID NO: 552503 - DNA, 25 bp, Mus musculus
caagggcttgcaggtgcactagttc

SEQ ID NO: 552504 - DNA, 25 bp, Mus musculus
caagggtacaacctgaaggaccagc

SEQ ID NO: 552505 - DNA, 25 bp, Mus musculus
caagggtacaacgtgaaggaccagc

SEQ ID NO: 552506 - DNA, 25 bp, Mus musculus
caagggtacattcatcgcagacagc

SEQ ID NO: 552507 - DNA, 25 bp, Mus musculus
caagggtacattgatcgcagacagc

SEQ ID NO: 552508 - DNA, 25 bp, Mus musculus
caagggtacgttagatggagataag

SEQ ID NO: 552509 - DNA, 25 bp, Mus musculus
caagggtacgtttgatggagataag

SEQ ID NO: 552510 - DNA, 25 bp, Mus musculus
caagggtatccacgcaccgtgaact

SEQ ID NO: 552511 - DNA, 25 bp, Mus musculus
caagggtatccaggcaccgtgaact

SEQ ID NO: 552512 - DNA, 25 bp, Mus musculus
caagggtatcctagatgattcgcca

SEQ ID NO: 552513 - DNA, 25 bp, Mus musculus
caagggtatccttgatgattcgcca

SEQ ID NO: 552514 - DNA, 25 bp, Mus musculus
caagggtatctccatctgcttctcc

SEQ ID NO: 552515 - DNA, 25 bp, Mus musculus
caagggtatctcgatctgcttctcc

SEQ ID NO: 552516 - DNA, 25 bp, Mus musculus
caagggtattttatgagcaaggtgc

SEQ ID NO: 552517 - DNA, 25 bp, Mus musculus
caagggtattttttgagcaaggtgc

SEQ ID NO: 552518 - DNA, 25 bp, Mus musculus
caagggtcaagcactgtgctctcac

SEQ ID NO: 552519 - DNA, 25 bp, Mus musculus
caagggtcaagctctgtgctctcac

SEQ ID NO: 552520 - DNA, 25 bp, Mus musculus
caagggtcacatattagagcagcga

SEQ ID NO: 552521 - DNA, 25 bp, Mus musculus
caagggtcacattttagagcagcga

SEQ ID NO: 552522 - DNA, 25 bp, Mus musculus
caagggtccagacgcggctctccag

SEQ ID NO: 552523 - DNA, 25 bp, Mus musculus
caagggtccagaggcggctctccag

SEQ ID NO: 552524 - DNA, 25 bp, Mus musculus
caagggtcctgtagatgtgcctggc

SEQ ID NO: 552525 - DNA, 25 bp, Mus musculus
caagggtcctgttgatgtgcctggc

SEQ ID NO: 552526 - DNA, 25 bp, Mus musculus
caagggtccttccaagaactgtgca

SEQ ID NO: 552527 - DNA, 25 bp, Mus musculus
caagggtccttcgaagaactgtgca

SEQ ID NO: 552528 - DNA, 25 bp, Mus musculus
caagggtctgtaagctgagcagcaa

SEQ ID NO: 552529 - DNA, 25 bp, Mus musculus
caagggtctgtatgctgagcagcaa

SEQ ID NO: 552530 - DNA, 25 bp, Mus musculus
caagggtgcagcagacatggttgcc

SEQ ID NO: 552531 - DNA, 25 bp, Mus musculus
caagggtgcagctgacatggttgcc

SEQ ID NO: 552532 - DNA, 25 bp, Mus musculus
caagggtgccaaagtctcttgggag

SEQ ID NO: 552533 - DNA, 25 bp, Mus musculus
caagggtgccaatgtctcttgggag

SEQ ID NO: 552534 - DNA, 25 bp, Mus musculus
caagggtgcggcactaccacattca

SEQ ID NO: 552535 - DNA, 25 bp, Mus musculus
caagggtgcggctctaccacattca

SEQ ID NO: 552536 - DNA, 25 bp, Mus musculus
caagggtggcttcctgactaacgca

SEQ ID NO: 552537 - DNA, 25 bp, Mus musculus
caagggtggcttgctgactaacgca

SEQ ID NO: 552538 - DNA, 25 bp, Mus musculus
caagggttggcgatcagtcagatct

SEQ ID NO: 552539 - DNA, 25 bp, Mus musculus
caagggttggcgttcagtcagatct

SEQ ID NO: 552540 - DNA, 25 bp, Mus musculus
caagggttggctaacaagcaggaac

SEQ ID NO: 552541 - DNA, 25 bp, Mus musculus
caagggttggcttacaagcaggaac

SEQ ID NO: 552542 - DNA, 25 bp, Mus musculus
caagggtttcagcaggcccgtgcca

SEQ ID NO: 552543 - DNA, 25 bp, Mus musculus
caagggtttcaggaggcccgtgcca

SEQ ID NO: 552544 - DNA, 25 bp, Mus musculus
caagggtttggcaatagccctggac

SEQ ID NO: 552545 - DNA, 25 bp, Mus musculus
caagggtttggctatagccctggac

SEQ ID NO: 552546 - DNA, 25 bp, Mus musculus
caaggtaaatcaagatgaatatcca

SEQ ID NO: 552547 - DNA, 25 bp, Mus musculus
caaggtaaatcatgatgaatatcca

SEQ ID NO: 552548 - DNA, 25 bp, Mus musculus
caaggtaatctgaggttcagtgcca

SEQ ID NO: 552549 - DNA, 25 bp, Mus musculus
caaggtaatctgtggttcagtgcca

SEQ ID NO: 552550 - DNA, 25 bp, Mus musculus
caaggtaatggcaattggagttctc

SEQ ID NO: 552551 - DNA, 25 bp, Mus musculus
caaggtaatggctattggagttctc

SEQ ID NO: 552552 - DNA, 25 bp, Mus musculus
caaggtaattgtatcttcttaaaca

SEQ ID NO: 552553 - DNA, 25 bp, Mus musculus
caaggtaattgtcgccgtcatagga

SEQ ID NO: 552554 - DNA, 25 bp, Mus musculus
caaggtaattgtggccgtcatagga

SEQ ID NO: 552555 - DNA, 25 bp, Mus musculus
caaggtaattgtttcttcttaaaca

SEQ ID NO: 552556 - DNA, 25 bp, Mus musculus
caaggtacagtcactcaatgtggat

SEQ ID NO: 552557 - DNA, 25 bp, Mus musculus
caaggtacagtctctcaatgtggat

SEQ ID NO: 552558 - DNA, 25 bp, Mus musculus
caaggtagaattaacttttcatagc

SEQ ID NO: 552559 - DNA, 25 bp, Mus musculus
caaggtagaatttacttttcatagc

SEQ ID NO: 552560 - DNA, 25 bp, Mus musculus
caaggtagcagaccagcagtcaagg

SEQ ID NO: 552561 - DNA, 25 bp, Mus musculus
caaggtagcagagcagcagtcaagg

SEQ ID NO: 552562 - DNA, 25 bp, Mus musculus
caaggtatacataggaggtgaggac

SEQ ID NO: 552563 - DNA, 25 bp, Mus musculus
caaggtatacattggaggtgaggac

SEQ ID NO: 552564 - DNA, 25 bp, Mus musculus
caaggtatccctaactggcagtgag

SEQ ID NO: 552565 - DNA, 25 bp, Mus musculus
caaggtatcccttactggcagtgag

SEQ ID NO: 552566 - DNA, 25 bp, Mus musculus
caaggtatcctcaggaagcccactg

SEQ ID NO: 552567 - DNA, 25 bp, Mus musculus
caaggtatcctctggaagcccactg

SEQ ID NO: 552568 - DNA, 25 bp, Mus musculus
caaggtatctttccacccagggctc

SEQ ID NO: 552569 - DNA, 25 bp, Mus musculus
caaggtatctttgcacccagggctc

SEQ ID NO: 552570 - DNA, 25 bp, Mus musculus
caaggtattggtatgtattttgcct

SEQ ID NO: 552571 - DNA, 25 bp, Mus musculus
caaggtattggtttgtattttgcct

SEQ ID NO: 552572 - DNA, 25 bp, Mus musculus
caaggtcaaagtaggtaaagaagat

SEQ ID NO: 552573 - DNA, 25 bp, Mus musculus
caaggtcaaagttggtaaagaagat

SEQ ID NO: 552574 - DNA, 25 bp, Mus musculus
caaggtcaacaacgagctagtggag

SEQ ID NO: 552575 - DNA, 25 bp, Mus musculus
caaggtcaacaaggagctagtggag

SEQ ID NO: 552576 - DNA, 25 bp, Mus musculus
caaggtcaagaacctttaactgctt

SEQ ID NO: 552577 - DNA, 25 bp, Mus musculus
caaggtcaagaagctttaactgctt

SEQ ID NO: 552578 - DNA, 25 bp, Mus musculus
caaggtcaaggccaactgagaagca

SEQ ID NO: 552579 - DNA, 25 bp, Mus musculus
caaggtcaaggcgaactgagaagca

SEQ ID NO: 552580 - DNA, 25 bp, Mus musculus
caaggtcaatgacgacacgatggag

SEQ ID NO: 552581 - DNA, 25 bp, Mus musculus
caaggtcaatgaggacacgatggag

SEQ ID NO: 552582 - DNA, 25 bp, Mus musculus
caaggtcaccctaaacacaggccta

SEQ ID NO: 552583 - DNA, 25 bp, Mus musculus
caaggtcacccttaacacaggccta

SEQ ID NO: 552584 - DNA, 25 bp, Mus musculus
caaggtcaccgacgagtctgcagtg

SEQ ID NO: 552585 - DNA, 25 bp, Mus musculus
caaggtcaccgaggagtctgcagtg

SEQ ID NO: 552586 - DNA, 25 bp, Mus musculus
caaggtcactaacccattactgctg

SEQ ID NO: 552587 - DNA, 25 bp, Mus musculus
caaggtcactaagccattactgctg

SEQ ID NO: 552588 - DNA, 25 bp, Mus musculus
caaggtcactgcaaaggatgggctt

SEQ ID NO: 552589 - DNA, 25 bp, Mus musculus
caaggtcactgctaaggatgggctt

SEQ ID NO: 552590 - DNA, 25 bp, Mus musculus
caaggtcactggaggaattcaatga

SEQ ID NO: 552591 - DNA, 25 bp, Mus musculus
caaggtcactggtggaattcaatga

SEQ ID NO: 552592 - DNA, 25 bp, Mus musculus
caaggtcagcaactacagcagaggg

SEQ ID NO: 552593 - DNA, 25 bp, Mus musculus
caaggtcagcaagtacagcagaggg

SEQ ID NO: 552594 - DNA, 25 bp, Mus musculus
caaggtcagcttacacatggagtat

SEQ ID NO: 552595 - DNA, 25 bp, Mus musculus
caaggtcagctttcacatggagtat

SEQ ID NO: 552596 - DNA, 25 bp, Mus musculus
caaggtcaggacagatgaccatctg

SEQ ID NO: 552597 - DNA, 25 bp, Mus musculus
caaggtcaggacattgtgcctgcaa

SEQ ID NO: 552598 - DNA, 25 bp, Mus musculus
caaggtcaggactgatgaccatctg

SEQ ID NO: 552599 - DNA, 25 bp, Mus musculus
caaggtcaggactttgtgcctgcaa

SEQ ID NO: 552600 - DNA, 25 bp, Mus musculus
caaggtcatcatcgttggcagtgga

SEQ ID NO: 552601 - DNA, 25 bp, Mus musculus
caaggtcatcatggttggcagtgga

SEQ ID NO: 552602 - DNA, 25 bp, Mus musculus
caaggtcattcacaacctgaggagc

SEQ ID NO: 552603 - DNA, 25 bp, Mus musculus
caaggtcattcagaacctgaggagc

SEQ ID NO: 552604 - DNA, 25 bp, Mus musculus
caaggtcattgacctgatggacaca

SEQ ID NO: 552605 - DNA, 25 bp, Mus musculus
caaggtcattgagctgatggacaca

SEQ ID NO: 552606 - DNA, 25 bp, Mus musculus
caaggtccaaccaatccaatgttgt

SEQ ID NO: 552607 - DNA, 25 bp, Mus musculus
caaggtccaacctatccaatgttgt

SEQ ID NO: 552608 - DNA, 25 bp, Mus musculus
caaggtccaagaagccaatcccgct

SEQ ID NO: 552609 - DNA, 25 bp, Mus musculus
caaggtccaagatgccaatcccgct

SEQ ID NO: 552610 - DNA, 25 bp, Mus musculus
caaggtccatgtcctcacaagcagg

SEQ ID NO: 552611 - DNA, 25 bp, Mus musculus
caaggtccatgtgctcacaagcagg

SEQ ID NO: 552612 - DNA, 25 bp, Mus musculus
caaggtcctggacaagagcagtcca

SEQ ID NO: 552613 - DNA, 25 bp, Mus musculus
caaggtcctggagaagagcagtcca

SEQ ID NO: 552614 - DNA, 25 bp, Mus musculus
caaggtcctgggaatcatgtccaca

SEQ ID NO: 552615 - DNA, 25 bp, Mus musculus
caaggtcctgggtatcatgtccaca

SEQ ID NO: 552616 - DNA, 25 bp, Mus musculus
caaggtcgcctccacactgtttgga

SEQ ID NO: 552617 - DNA, 25 bp, Mus musculus
caaggtcgcctcgacactgtttgga

SEQ ID NO: 552618 - DNA, 25 bp, Mus musculus
caaggtcggtgaatatcacttccgt

SEQ ID NO: 552619 - DNA, 25 bp, Mus musculus
caaggtcggtgattatcacttccgt

SEQ ID NO: 552620 - DNA, 25 bp, Mus musculus
caaggtctgagcaaactcagcccct

SEQ ID NO: 552621 - DNA, 25 bp, Mus musculus
caaggtctgagctaactcagcccct

SEQ ID NO: 552622 - DNA, 25 bp, Mus musculus
caaggtcttacaagtgatcggaagg

SEQ ID NO: 552623 - DNA, 25 bp, Mus musculus
caaggtcttacatgtgatcggaagg

SEQ ID NO: 552624 - DNA, 25 bp, Mus musculus
caaggtcttgcacaagccagggact

SEQ ID NO: 552625 - DNA, 25 bp, Mus musculus
caaggtcttgcagaagccagggact

SEQ ID NO: 552626 - DNA, 25 bp, Mus musculus
caaggtcttggcagactgagtccta

SEQ ID NO: 552627 - DNA, 25 bp, Mus musculus
caaggtcttggccatatcactgaca

SEQ ID NO: 552628 - DNA, 25 bp, Mus musculus
caaggtcttggcgatatcactgaca

SEQ ID NO: 552629 - DNA, 25 bp, Mus musculus
caaggtcttggctgactgagtccta

SEQ ID NO: 552630 - DNA, 25 bp, Mus musculus
caaggtgaacctagtgaagatctcc

SEQ ID NO: 552631 - DNA, 25 bp, Mus musculus
caaggtgaaccttgtgaagatctcc

SEQ ID NO: 552632 - DNA, 25 bp, Mus musculus
caaggtgaacgtaatagaaccatgg

SEQ ID NO: 552633 - DNA, 25 bp, Mus musculus
caaggtgaacgttatagaaccatgg

SEQ ID NO: 552634 - DNA, 25 bp, Mus musculus
caaggtgaagaaactctccatagtc

SEQ ID NO: 552635 - DNA, 25 bp, Mus musculus
caaggtgaagaatctctccatagtc

SEQ ID NO: 552636 - DNA, 25 bp, Mus musculus
caaggtgaagcgcaagaatctaaac

SEQ ID NO: 552637 - DNA, 25 bp, Mus musculus
caaggtgaagcggaagaatctaaac

SEQ ID NO: 552638 - DNA, 25 bp, Mus musculus
caaggtgaatggattctctaacaac

SEQ ID NO: 552639 - DNA, 25 bp, Mus musculus
caaggtgaatggtttctctaacaac

SEQ ID NO: 552640 - DNA, 25 bp, Mus musculus
caaggtgacatcagctcggtgaatc

SEQ ID NO: 552641 - DNA, 25 bp, Mus musculus
caaggtgacatctgctcggtgaatc

SEQ ID NO: 552642 - DNA, 25 bp, Mus musculus
caaggtgagacccaggagtctccca

SEQ ID NO: 552643 - DNA, 25 bp, Mus musculus
caaggtgagaccgaggagtctccca

SEQ ID NO: 552644 - DNA, 25 bp, Mus musculus
caaggtgatcataattcaggcatgc

SEQ ID NO: 552645 - DNA, 25 bp, Mus musculus
caaggtgatcattattcaggcatgc

SEQ ID NO: 552646 - DNA, 25 bp, Mus musculus
caaggtgcccagactgtccaagctg

SEQ ID NO: 552647 - DNA, 25 bp, Mus musculus
caaggtgcccagtctgtccaagctg

SEQ ID NO: 552648 - DNA, 25 bp, Mus musculus
caaggtgccggtctacagtctctaa

SEQ ID NO: 552649 - DNA, 25 bp, Mus musculus
caaggtgccggtgtacagtctctaa

SEQ ID NO: 552650 - DNA, 25 bp, Mus musculus
caaggtgcctgactcttcctaacta

SEQ ID NO: 552651 - DNA, 25 bp, Mus musculus
caaggtgcctgagtcttcctaacta

SEQ ID NO: 552652 - DNA, 25 bp, Mus musculus
caaggtgcggaacatgaaggctatc

SEQ ID NO: 552653 - DNA, 25 bp, Mus musculus
caaggtgcggaagatgaaggctatc

SEQ ID NO: 552654 - DNA, 25 bp, Mus musculus
caaggtgctcaaccaggcgtttgga

SEQ ID NO: 552655 - DNA, 25 bp, Mus musculus
caaggtgctcaagcaggcgtttgga

SEQ ID NO: 552656 - DNA, 25 bp, Mus musculus
caaggtgctggcagtgaaccaggaa

SEQ ID NO: 552657 - DNA, 25 bp, Mus musculus
caaggtgctggctgtgaaccaggaa

SEQ ID NO: 552658 - DNA, 25 bp, Mus musculus
caaggtggagaaacagatctttgga

SEQ ID NO: 552659 - DNA, 25 bp, Mus musculus
caaggtggagaatcagatctttgga

SEQ ID NO: 552660 - DNA, 25 bp, Mus musculus
caaggtggagagatgttgtctctgc

SEQ ID NO: 552661 - DNA, 25 bp, Mus musculus
caaggtggagagttgttgtctctgc

SEQ ID NO: 552662 - DNA, 25 bp, Mus musculus
caaggtggatccacggaaggacgcc

SEQ ID NO: 552663 - DNA, 25 bp, Mus musculus
caaggtggatcctcggaaggacgcc

SEQ ID NO: 552664 - DNA, 25 bp, Mus musculus
caaggtggccgactacgcccgacgt

SEQ ID NO: 552665 - DNA, 25 bp, Mus musculus
caaggtggccgagtacgcccgacgt

SEQ ID NO: 552666 - DNA, 25 bp, Mus musculus
caaggtgggcaaactgtgcatctca

SEQ ID NO: 552667 - DNA, 25 bp, Mus musculus
caaggtgggcaatctgtgcatctca

SEQ ID NO: 552668 - DNA, 25 bp, Mus musculus
caaggtggtaacatggaccgaacag

SEQ ID NO: 552669 - DNA, 25 bp, Mus musculus
caaggtggtaacttggaccgaacag

SEQ ID NO: 552670 - DNA, 25 bp, Mus musculus
caaggtggtgtcaacgcatctccaa

SEQ ID NO: 552671 - DNA, 25 bp, Mus musculus
caaggtggtgtctacgcatctccaa

SEQ ID NO: 552672 - DNA, 25 bp, Mus musculus
caaggtggttcacacaagacccagg

SEQ ID NO: 552673 - DNA, 25 bp, Mus musculus
caaggtggttcagacaagacccagg

SEQ ID NO: 552674 - DNA, 25 bp, Mus musculus
caaggtgtacggcaaggcttcgcat

SEQ ID NO: 552675 - DNA, 25 bp, Mus musculus
caaggtgtacgggaaggcttcgcat

SEQ ID NO: 552676 - DNA, 25 bp, Mus musculus
caaggtgtatttcctatcaggaaac

SEQ ID NO: 552677 - DNA, 25 bp, Mus musculus
caaggtgtatttgctatcaggaaac

SEQ ID NO: 552678 - DNA, 25 bp, Mus musculus
caaggtgtcccaagccattaaagac

SEQ ID NO: 552679 - DNA, 25 bp, Mus musculus
caaggtgtcccatgccattaaagac

SEQ ID NO: 552680 - DNA, 25 bp, Mus musculus
caaggtgtgcgcagcatcaagaaga

SEQ ID NO: 552681 - DNA, 25 bp, Mus musculus
caaggtgtgcgctgcatcaagaaga

SEQ ID NO: 552682 - DNA, 25 bp, Mus musculus
caaggtgtgtgcatcatctaaaggc

SEQ ID NO: 552683 - DNA, 25 bp, Mus musculus
caaggtgtgtgcttcatctaaaggc

SEQ ID NO: 552684 - DNA, 25 bp, Mus musculus
caaggtgttcgcctgaagaactcgg

SEQ ID NO: 552685 - DNA, 25 bp, Mus musculus
caaggtgttcgcgtgaagaactcgg

SEQ ID NO: 552686 - DNA, 25 bp, Mus musculus
caaggtgtttgcaaatctaaataag

SEQ ID NO: 552687 - DNA, 25 bp, Mus musculus
caaggtgtttgctaatctaaataag

SEQ ID NO: 552688 - DNA, 25 bp, Mus musculus
caaggttacattaaaagtgggctca

SEQ ID NO: 552689 - DNA, 25 bp, Mus musculus
caaggttacatttaaagtgggctca

SEQ ID NO: 552690 - DNA, 25 bp, Mus musculus
caaggttaccggcatgctgcatcca

SEQ ID NO: 552691 - DNA, 25 bp, Mus musculus
caaggttaccgggatgctgcatcca

SEQ ID NO: 552692 - DNA, 25 bp, Mus musculus
caaggttatggtcacccactgatgc

SEQ ID NO: 552693 - DNA, 25 bp, Mus musculus
caaggttatggtgacccactgatgc

SEQ ID NO: 552694 - DNA, 25 bp, Mus musculus
caaggttattcaagaaaacttcggg

SEQ ID NO: 552695 - DNA, 25 bp, Mus musculus
caaggttattcatgaaaacttcggg

SEQ ID NO: 552696 - DNA, 25 bp, Mus musculus
caaggttccgtgcagtctgctgcgc

SEQ ID NO: 552697 - DNA, 25 bp, Mus musculus
caaggttccgtggagtctgctgcgc

SEQ ID NO: 552698 - DNA, 25 bp, Mus musculus
caaggttcggagcaccatgagcagc

SEQ ID NO: 552699 - DNA, 25 bp, Mus musculus
caaggttcggaggaccatgagcagc

SEQ ID NO: 552700 - DNA, 25 bp, Mus musculus
caaggttctcctctatggactagga

SEQ ID NO: 552701 - DNA, 25 bp, Mus musculus
caaggttctcctgtatggactagga

SEQ ID NO: 552702 - DNA, 25 bp, Mus musculus
caaggttctctaatttcagcaccaa

SEQ ID NO: 552703 - DNA, 25 bp, Mus musculus
caaggttctctattttcagcaccaa

SEQ ID NO: 552704 - DNA, 25 bp, Mus musculus
caaggttgatgcacccagcctgaaa

SEQ ID NO: 552705 - DNA, 25 bp, Mus musculus
caaggttgatgctcccagcctgaaa

SEQ ID NO: 552706 - DNA, 25 bp, Mus musculus
caaggttggaggcagacaacataca

SEQ ID NO: 552707 - DNA, 25 bp, Mus musculus
caaggttggagggagacaacataca

SEQ ID NO: 552708 - DNA, 25 bp, Mus musculus
caaggttgtaatattcacgagggcg

SEQ ID NO: 552709 - DNA, 25 bp, Mus musculus
caaggttgtaattttcacgagggcg

SEQ ID NO: 552710 - DNA, 25 bp, Mus musculus
caaggttgtataaactctgtccaaa

SEQ ID NO: 552711 - DNA, 25 bp, Mus musculus
caaggttgtatatactctgtccaaa

SEQ ID NO: 552712 - DNA, 25 bp, Mus musculus
caaggttgttctatgccatgtagca

SEQ ID NO: 552713 - DNA, 25 bp, Mus musculus
caaggttgttctttgccatgtagca

SEQ ID NO: 552714 - DNA, 25 bp, Mus musculus
caaggtttaagaagcctgtgggtgt

SEQ ID NO: 552715 - DNA, 25 bp, Mus musculus
caaggtttaagatgcctgtgggtgt

SEQ ID NO: 552716 - DNA, 25 bp, Mus musculus
caaggtttagcactcattgcatgta

SEQ ID NO: 552717 - DNA, 25 bp, Mus musculus
caaggtttagcagtcattgcatgta

SEQ ID NO: 552718 - DNA, 25 bp, Mus musculus
caaggtttataactacatgagcccc

SEQ ID NO: 552719 - DNA, 25 bp, Mus musculus
caaggtttataagtacatgagcccc

SEQ ID NO: 552720 - DNA, 25 bp, Mus musculus
caaggtttcgaaaaatgcctggagg

SEQ ID NO: 552721 - DNA, 25 bp, Mus musculus
caaggtttcgaataatgcctggagg

SEQ ID NO: 552722 - DNA, 25 bp, Mus musculus
caaggtttgtcaactaagcgggagc

SEQ ID NO: 552723 - DNA, 25 bp, Mus musculus
caaggtttgtcatctaagcgggagc

SEQ ID NO: 552724 - DNA, 25 bp, Mus musculus
caaggttttatcagatcccaagtcg

SEQ ID NO: 552725 - DNA, 25 bp, Mus musculus
caaggttttatctgatcccaagtcg

SEQ ID NO: 552726 - DNA, 25 bp, Mus musculus
caagtaaaatttcgaagctacttag

SEQ ID NO: 552727 - DNA, 25 bp, Mus musculus
caagtaaaatttggaagctacttag

SEQ ID NO: 552728 - DNA, 25 bp, Mus musculus
caagtaaacagcaggcggaacgaag

SEQ ID NO: 552729 - DNA, 25 bp, Mus musculus
caagtaaacagctggcggaacgaag

SEQ ID NO: 552730 - DNA, 25 bp, Mus musculus
caagtaaggtgactctgttctctgc

SEQ ID NO: 552731 - DNA, 25 bp, Mus musculus
caagtaaggtgagtctgttctctgc

SEQ ID NO: 552732 - DNA, 25 bp, Mus musculus
caagtaagtggaacattgaggacaa

SEQ ID NO: 552733 - DNA, 25 bp, Mus musculus
caagtaagtggatcattgaggacaa

SEQ ID NO: 552734 - DNA, 25 bp, Mus musculus
caagtaatcactcaggagtggaagc

SEQ ID NO: 552735 - DNA, 25 bp, Mus musculus
caagtaatcactgaggagtggaagc

SEQ ID NO: 552736 - DNA, 25 bp, Mus musculus
caagtacaacgcagagaagcctaag

SEQ ID NO: 552737 - DNA, 25 bp, Mus musculus
caagtacaacgctgagaagcctaag

SEQ ID NO: 552738 - DNA, 25 bp, Mus musculus
caagtacaagttactgcctatgctt

SEQ ID NO: 552739 - DNA, 25 bp, Mus musculus
caagtacaagtttctgcctatgctt

SEQ ID NO: 552740 - DNA, 25 bp, Mus musculus
caagtacacaggctacgggaatgct

SEQ ID NO: 552741 - DNA, 25 bp, Mus musculus
caagtacacagggtacgggaatgct

SEQ ID NO: 552742 - DNA, 25 bp, Mus musculus
caagtacaccatagagaacccaagg

SEQ ID NO: 552743 - DNA, 25 bp, Mus musculus
caagtacaccattgagaacccaagg

SEQ ID NO: 552744 - DNA, 25 bp, Mus musculus
caagtacagcatctgcaagagcggt

SEQ ID NO: 552745 - DNA, 25 bp, Mus musculus
caagtacagcatgtgcaagagcggt

SEQ ID NO: 552746 - DNA, 25 bp, Mus musculus
caagtacagctgaaaggccgtgacc

SEQ ID NO: 552747 - DNA, 25 bp, Mus musculus
caagtacagctgtaaggccgtgacc

SEQ ID NO: 552748 - DNA, 25 bp, Mus musculus
caagtacaggatctcaccaggagtc

SEQ ID NO: 552749 - DNA, 25 bp, Mus musculus
caagtacaggatgtcaccaggagtc

SEQ ID NO: 552750 - DNA, 25 bp, Mus musculus
caagtacagggaacggccaacgatc

SEQ ID NO: 552751 - DNA, 25 bp, Mus musculus
caagtacagggatcggccaacgatc

SEQ ID NO: 552752 - DNA, 25 bp, Mus musculus
caagtacagtgtcgtatagactaga

SEQ ID NO: 552753 - DNA, 25 bp, Mus musculus
caagtacagtgtggtatagactaga

SEQ ID NO: 552754 - DNA, 25 bp, Mus musculus
caagtacatattaacgctgaggacc

SEQ ID NO: 552755 - DNA, 25 bp, Mus musculus
caagtacatatttacgctgaggacc

SEQ ID NO: 552756 - DNA, 25 bp, Mus musculus
caagtacatcttcggccagcgcctg

SEQ ID NO: 552757 - DNA, 25 bp, Mus musculus
caagtacatcttgggccagcgcctg

SEQ ID NO: 552758 - DNA, 25 bp, Mus musculus
caagtacatggtcactgaacgtgcc

SEQ ID NO: 552759 - DNA, 25 bp, Mus musculus
caagtacatggtgactgaacgtgcc

SEQ ID NO: 552760 - DNA, 25 bp, Mus musculus
caagtacattggcatgcggaatgag

SEQ ID NO: 552761 - DNA, 25 bp, Mus musculus
caagtacattgggatgcggaatgag

SEQ ID NO: 552762 - DNA, 25 bp, Mus musculus
caagtaccacatacagcaagctcag

SEQ ID NO: 552763 - DNA, 25 bp, Mus musculus
caagtaccacattcagcaagctcag

SEQ ID NO: 552764 - DNA, 25 bp, Mus musculus
caagtaccaggaacgactggccaca

SEQ ID NO: 552765 - DNA, 25 bp, Mus musculus
caagtaccaggatcgactggccaca

SEQ ID NO: 552766 - DNA, 25 bp, Mus musculus
caagtaccgcagagcaagcagtgcc

SEQ ID NO: 552767 - DNA, 25 bp, Mus musculus
caagtaccgcagtgcaagcagtgcc

SEQ ID NO: 552768 - DNA, 25 bp, Mus musculus
caagtacctcatatgaagggataac

SEQ ID NO: 552769 - DNA, 25 bp, Mus musculus
caagtacctcatttgaagggataac

SEQ ID NO: 552770 - DNA, 25 bp, Mus musculus
caagtacctggtcaaacgccagagc

SEQ ID NO: 552771 - DNA, 25 bp, Mus musculus
caagtacctggtcgacaaccatgcc

SEQ ID NO: 552772 - DNA, 25 bp, Mus musculus
caagtacctggtgaaacgccagagc

SEQ ID NO: 552773 - DNA, 25 bp, Mus musculus
caagtacctggtggacaaccatgcc

SEQ ID NO: 552774 - DNA, 25 bp, Mus musculus
caagtacctgtgaattcgtaaggac

SEQ ID NO: 552775 - DNA, 25 bp, Mus musculus
caagtacctgtgtattcgtaaggac

SEQ ID NO: 552776 - DNA, 25 bp, Mus musculus
caagtaccttctccagcataggtgg

SEQ ID NO: 552777 - DNA, 25 bp, Mus musculus
caagtaccttctgcagcataggtgg

SEQ ID NO: 552778 - DNA, 25 bp, Mus musculus
caagtacgagttagcggtacagtcc

SEQ ID NO: 552779 - DNA, 25 bp, Mus musculus
caagtacgagtttgcggtacagtcc

SEQ ID NO: 552780 - DNA, 25 bp, Mus musculus
caagtactaaagacagcatatttgc

SEQ ID NO: 552781 - DNA, 25 bp, Mus musculus
caagtactaaagtcagcatatttgc

SEQ ID NO: 552782 - DNA, 25 bp, Mus musculus
caagtactacagcatgatgcagact

SEQ ID NO: 552783 - DNA, 25 bp, Mus musculus
caagtactacaggatgatgcagact

SEQ ID NO: 552784 - DNA, 25 bp, Mus musculus
caagtactacgacacattgaggcca

SEQ ID NO: 552785 - DNA, 25 bp, Mus musculus
caagtactacgagacattgaggcca

SEQ ID NO: 552786 - DNA, 25 bp, Mus musculus
caagtactatgaactggcccgcaag

SEQ ID NO: 552787 - DNA, 25 bp, Mus musculus
caagtactatgatctggcccgcaag

SEQ ID NO: 552788 - DNA, 25 bp, Mus musculus
caagtactctgacgccgaggctctg

SEQ ID NO: 552789 - DNA, 25 bp, Mus musculus
caagtactctgaggccgaggctctg

SEQ ID NO: 552790 - DNA, 25 bp, Mus musculus
caagtactgccgattcaaccaggac

SEQ ID NO: 552791 - DNA, 25 bp, Mus musculus
caagtactgccgtttcaaccaggac

SEQ ID NO: 552792 - DNA, 25 bp, Mus musculus
caagtactgcttagtgtatggccag

SEQ ID NO: 552793 - DNA, 25 bp, Mus musculus
caagtactgctttgtgtatggccag

SEQ ID NO: 552794 - DNA, 25 bp, Mus musculus
caagtactgggtatagttctgcgca

SEQ ID NO: 552795 - DNA, 25 bp, Mus musculus
caagtactgggtttagttctgcgca

SEQ ID NO: 552796 - DNA, 25 bp, Mus musculus
caagtactgtagcactcagagagac

SEQ ID NO: 552797 - DNA, 25 bp, Mus musculus
caagtactgtaggactcagagagac

SEQ ID NO: 552798 - DNA, 25 bp, Mus musculus
caagtactgttgctttacgtggcag

SEQ ID NO: 552799 - DNA, 25 bp, Mus musculus
caagtactgttggtttacgtggcag

SEQ ID NO: 552800 - DNA, 25 bp, Mus musculus
caagtacttcatatacaccacagga

SEQ ID NO: 552801 - DNA, 25 bp, Mus musculus
caagtacttcatttacaccacagga

SEQ ID NO: 552802 - DNA, 25 bp, Mus musculus
caagtacttccaaagaatgaccaca

SEQ ID NO: 552803 - DNA, 25 bp, Mus musculus
caagtacttccatagaatgaccaca

SEQ ID NO: 552804 - DNA, 25 bp, Mus musculus
caagtacttcctccaaggcatgggc

SEQ ID NO: 552805 - DNA, 25 bp, Mus musculus
caagtacttcctgcaaggcatgggc

SEQ ID NO: 552806 - DNA, 25 bp, Mus musculus
caagtacttctcaaagctggtgtgt

SEQ ID NO: 552807 - DNA, 25 bp, Mus musculus
caagtacttctctaagctggtgtgt

SEQ ID NO: 552808 - DNA, 25 bp, Mus musculus
caagtacttcttaatgagcccatgt

SEQ ID NO: 552809 - DNA, 25 bp, Mus musculus
caagtacttctttatgagcccatgt

SEQ ID NO: 552810 - DNA, 25 bp, Mus musculus
caagtacttgtcaccagtgagtgca

SEQ ID NO: 552811 - DNA, 25 bp, Mus musculus
caagtacttgtctccagtgagtgca

SEQ ID NO: 552812 - DNA, 25 bp, Mus musculus
caagtactttaacggaccatctcct

SEQ ID NO: 552813 - DNA, 25 bp, Mus musculus
caagtactttaagggaccatctcct

SEQ ID NO: 552814 - DNA, 25 bp, Mus musculus
caagtacttttaagaccaatgtcca

SEQ ID NO: 552815 - DNA, 25 bp, Mus musculus
caagtacttttatgaccaatgtcca

SEQ ID NO: 552816 - DNA, 25 bp, Mus musculus
caagtactttttccagggaatgggc

SEQ ID NO: 552817 - DNA, 25 bp, Mus musculus
caagtactttttgcagggaatgggc

SEQ ID NO: 552818 - DNA, 25 bp, Mus musculus
caagtagatcggcaacagaaagggc

SEQ ID NO: 552819 - DNA, 25 bp, Mus musculus
caagtagatcgggaacagaaagggc

SEQ ID NO: 552820 - DNA, 25 bp, Mus musculus
caagtagcatacaaaccctgggcct

SEQ ID NO: 552821 - DNA, 25 bp, Mus musculus
caagtagcatactaaccctgggcct

SEQ ID NO: 552822 - DNA, 25 bp, Mus musculus
caagtagcatctctgattggagctg

SEQ ID NO: 552823 - DNA, 25 bp, Mus musculus
caagtagcatctgtgattggagctg

SEQ ID NO: 552824 - DNA, 25 bp, Mus musculus
caagtagccagaaaaaagatacttc

SEQ ID NO: 552825 - DNA, 25 bp, Mus musculus
caagtagccagataaaagatacttc

SEQ ID NO: 552826 - DNA, 25 bp, Mus musculus
caagtagcctcacggctctgagctt

SEQ ID NO: 552827 - DNA, 25 bp, Mus musculus
caagtagcctcagggctctgagctt

SEQ ID NO: 552828 - DNA, 25 bp, Mus musculus
caagtagcctgtcagaagtacttcg

SEQ ID NO: 552829 - DNA, 25 bp, Mus musculus
caagtagcctgtgagaagtacttcg

SEQ ID NO: 552830 - DNA, 25 bp, Mus musculus
caagtagcgtgtccagtgttctagg

SEQ ID NO: 552831 - DNA, 25 bp, Mus musculus
caagtagcgtgtgcagtgttctagg

SEQ ID NO: 552832 - DNA, 25 bp, Mus musculus
caagtagctatgactgcacacgaaa

SEQ ID NO: 552833 - DNA, 25 bp, Mus musculus
caagtagctatgtctgcacacgaaa

SEQ ID NO: 552834 - DNA, 25 bp, Mus musculus
caagtagcttggcttgtagtggaaa

SEQ ID NO: 552835 - DNA, 25 bp, Mus musculus
caagtagcttgggttgtagtggaaa

SEQ ID NO: 552836 - DNA, 25 bp, Mus musculus
caagtaggataccagtccatggctg

SEQ ID NO: 552837 - DNA, 25 bp, Mus musculus
caagtaggatacgagtccatggctg

SEQ ID NO: 552838 - DNA, 25 bp, Mus musculus
caagtaggccagagcatcagggttc

SEQ ID NO: 552839 - DNA, 25 bp, Mus musculus
caagtaggccagtgcatcagggttc

SEQ ID NO: 552840 - DNA, 25 bp, Mus musculus
caagtaggctccattaaggagagat

SEQ ID NO: 552841 - DNA, 25 bp, Mus musculus
caagtaggctcctttaaggagagat

SEQ ID NO: 552842 - DNA, 25 bp, Mus musculus
caagtagtgctgagataccccagac

SEQ ID NO: 552843 - DNA, 25 bp, Mus musculus
caagtagtgctgtgataccccagac

SEQ ID NO: 552844 - DNA, 25 bp, Mus musculus
caagtagtgtcacaacttggcccaa

SEQ ID NO: 552845 - DNA, 25 bp, Mus musculus
caagtagtgtcagaacttggcccaa

SEQ ID NO: 552846 - DNA, 25 bp, Mus musculus
caagtagttaagatatttaagcccg

SEQ ID NO: 552847 - DNA, 25 bp, Mus musculus
caagtagttaagttatttaagcccg

SEQ ID NO: 552848 - DNA, 25 bp, Mus musculus
caagtagttacactccggcaagaca

SEQ ID NO: 552849 - DNA, 25 bp, Mus musculus
caagtagttacagtccggcaagaca

SEQ ID NO: 552850 - DNA, 25 bp, Mus musculus
caagtataacatattgatgctccac

SEQ ID NO: 552851 - DNA, 25 bp, Mus musculus
caagtataacattttgatgctccac

SEQ ID NO: 552852 - DNA, 25 bp, Mus musculus
caagtataaggtacctgaccactgg

SEQ ID NO: 552853 - DNA, 25 bp, Mus musculus
caagtataaggttcctgaccactgg

SEQ ID NO: 552854 - DNA, 25 bp, Mus musculus
caagtatcccaacaggaacagatcc

SEQ ID NO: 552855 - DNA, 25 bp, Mus musculus
caagtatcccaagaggaacagatcc

SEQ ID NO: 552856 - DNA, 25 bp, Mus musculus
caagtatcccctcaaagtcagtgag

SEQ ID NO: 552857 - DNA, 25 bp, Mus musculus
caagtatcccctgaaagtcagtgag

SEQ ID NO: 552858 - DNA, 25 bp, Mus musculus
caagtatcctgtctacgctggccaa

SEQ ID NO: 552859 - DNA, 25 bp, Mus musculus
caagtatcctgtgtacgctggccaa

SEQ ID NO: 552860 - DNA, 25 bp, Mus musculus
caagtatctggtcgtgaatgctgac

SEQ ID NO: 552861 - DNA, 25 bp, Mus musculus
caagtatctggtggtgaatgctgac

SEQ ID NO: 552862 - DNA, 25 bp, Mus musculus
caagtatctgtcagaagacattgcc

SEQ ID NO: 552863 - DNA, 25 bp, Mus musculus
caagtatctgtctgaagacattgcc

SEQ ID NO: 552864 - DNA, 25 bp, Mus musculus
caagtatgatgcaggagtggacgcc

SEQ ID NO: 552865 - DNA, 25 bp, Mus musculus
caagtatgatgctggagtggacgcc

SEQ ID NO: 552866 - DNA, 25 bp, Mus musculus
caagtatgatttcgcgacagtgggc

SEQ ID NO: 552867 - DNA, 25 bp, Mus musculus
caagtatgatttggcgacagtgggc

SEQ ID NO: 552868 - DNA, 25 bp, Mus musculus
caagtatgcacccagcggattctac

SEQ ID NO: 552869 - DNA, 25 bp, Mus musculus
caagtatgcaccgagcggattctac

SEQ ID NO: 552870 - DNA, 25 bp, Mus musculus
caagtatgcatacacgaagcagaaa

SEQ ID NO: 552871 - DNA, 25 bp, Mus musculus
caagtatgcatagacgaagcagaaa

SEQ ID NO: 552872 - DNA, 25 bp, Mus musculus
caagtatggctgactgtcctgggcc

SEQ ID NO: 552873 - DNA, 25 bp, Mus musculus
caagtatggctgtctgtcctgggcc

SEQ ID NO: 552874 - DNA, 25 bp, Mus musculus
caagtatggtgcagaggtgaagctt

SEQ ID NO: 552875 - DNA, 25 bp, Mus musculus
caagtatggtgctgaggtgaagctt

SEQ ID NO: 552876 - DNA, 25 bp, Mus musculus
caagtatgtgggagaatcagaggct

SEQ ID NO: 552877 - DNA, 25 bp, Mus musculus
caagtatgtgggtgaatcagaggct

SEQ ID NO: 552878 - DNA, 25 bp, Mus musculus
caagtatgttggaacaccaggtcaa

SEQ ID NO: 552879 - DNA, 25 bp, Mus musculus
caagtatgttggtacaccaggtcaa

SEQ ID NO: 552880 - DNA, 25 bp, Mus musculus
caagtattatggcagctactttaag

SEQ ID NO: 552881 - DNA, 25 bp, Mus musculus
caagtattatgggagctactttaag

SEQ ID NO: 552882 - DNA, 25 bp, Mus musculus
caagtattcaacacctccttggaga

SEQ ID NO: 552883 - DNA, 25 bp, Mus musculus
caagtattcaactcctccttggaga

SEQ ID NO: 552884 - DNA, 25 bp, Mus musculus
caagtattcaatatcctctactcac

SEQ ID NO: 552885 - DNA, 25 bp, Mus musculus
caagtattcaatttcctctactcac

SEQ ID NO: 552886 - DNA, 25 bp, Mus musculus
caagtattcaccactgagttaggcc

SEQ ID NO: 552887 - DNA, 25 bp, Mus musculus
caagtattcacctctgagttaggcc

SEQ ID NO: 552888 - DNA, 25 bp, Mus musculus
caagtattcctcacagttcggtggg

SEQ ID NO: 552889 - DNA, 25 bp, Mus musculus
caagtattcctcagaaatgagtgag

SEQ ID NO: 552890 - DNA, 25 bp, Mus musculus
caagtattcctctcagttcggtggg

SEQ ID NO: 552891 - DNA, 25 bp, Mus musculus
caagtattcctctgaaatgagtgag

SEQ ID NO: 552892 - DNA, 25 bp, Mus musculus
caagtatttggtcgtgtcagtagcc

SEQ ID NO: 552893 - DNA, 25 bp, Mus musculus
caagtatttggtggtgtcagtagcc

SEQ ID NO: 552894 - DNA, 25 bp, Mus musculus
caagtcaaaaagagaccagccaggc

SEQ ID NO: 552895 - DNA, 25 bp, Mus musculus
caagtcaaaaagtgaccagccaggc

SEQ ID NO: 552896 - DNA, 25 bp, Mus musculus
caagtcaaaatacatgcctgcctcg

SEQ ID NO: 552897 - DNA, 25 bp, Mus musculus
caagtcaaaatagatgcctgcctcg

SEQ ID NO: 552898 - DNA, 25 bp, Mus musculus
caagtcaactacctagaaaatggca

SEQ ID NO: 552899 - DNA, 25 bp, Mus musculus
caagtcaactacgtagaaaatggca

SEQ ID NO: 552900 - DNA, 25 bp, Mus musculus
caagtcaacttactccgttcccatt

SEQ ID NO: 552901 - DNA, 25 bp, Mus musculus
caagtcaacttagtccgttcccatt

SEQ ID NO: 552902 - DNA, 25 bp, Mus musculus
caagtcaagcgaaaaagcagaggag

SEQ ID NO: 552903 - DNA, 25 bp, Mus musculus
caagtcaagcgataaagcagaggag

SEQ ID NO: 552904 - DNA, 25 bp, Mus musculus
caagtcaagtttctccctggtgcga

SEQ ID NO: 552905 - DNA, 25 bp, Mus musculus
caagtcaagtttgtccctggtgcga

SEQ ID NO: 552906 - DNA, 25 bp, Mus musculus
caagtcacagatcggccttcctgta

SEQ ID NO: 552907 - DNA, 25 bp, Mus musculus
caagtcacagatgggccttcctgta

SEQ ID NO: 552908 - DNA, 25 bp, Mus musculus
caagtcaccccacatttagattgtg

SEQ ID NO: 552909 - DNA, 25 bp, Mus musculus
caagtcaccccagatttagattgtg

SEQ ID NO: 552910 - DNA, 25 bp, Mus musculus
caagtcacgctaattattgaaggcc

SEQ ID NO: 552911 - DNA, 25 bp, Mus musculus
caagtcacgctatttattgaaggcc

SEQ ID NO: 552912 - DNA, 25 bp, Mus musculus
caagtcactccacaagataggaccc

SEQ ID NO: 552913 - DNA, 25 bp, Mus musculus
caagtcactccagaagataggaccc

SEQ ID NO: 552914 - DNA, 25 bp, Mus musculus
caagtcactgtcattcctggagcag

SEQ ID NO: 552915 - DNA, 25 bp, Mus musculus
caagtcactgtctttcctggagcag

SEQ ID NO: 552916 - DNA, 25 bp, Mus musculus
caagtcactttgattgtagttacaa

SEQ ID NO: 552917 - DNA, 25 bp, Mus musculus
caagtcactttgtttgtagttacaa

SEQ ID NO: 552918 - DNA, 25 bp, Mus musculus
caagtcagaaagaaccatttgtgga

SEQ ID NO: 552919 - DNA, 25 bp, Mus musculus
caagtcagaaagtaccatttgtgga

SEQ ID NO: 552920 - DNA, 25 bp, Mus musculus
caagtcagaactaagagaagccctc

SEQ ID NO: 552921 - DNA, 25 bp, Mus musculus
caagtcagaacttagagaagccctc

SEQ ID NO: 552922 - DNA, 25 bp, Mus musculus
caagtcagaagcagatgtggctgtg

SEQ ID NO: 552923 - DNA, 25 bp, Mus musculus
caagtcagaagctgatgtggctgtg

SEQ ID NO: 552924 - DNA, 25 bp, Mus musculus
caagtcagaataccgtgaactggag

SEQ ID NO: 552925 - DNA, 25 bp, Mus musculus
caagtcagaatagcgtgaactggag

SEQ ID NO: 552926 - DNA, 25 bp, Mus musculus
caagtcagaccaataaaaccaggtt

SEQ ID NO: 552927 - DNA, 25 bp, Mus musculus
caagtcagaccattaaaaccaggtt

SEQ ID NO: 552928 - DNA, 25 bp, Mus musculus
caagtcagactacctccctgtaact

SEQ ID NO: 552929 - DNA, 25 bp, Mus musculus
caagtcagactagctccctgtaact

SEQ ID NO: 552930 - DNA, 25 bp, Mus musculus
caagtcagagctattaggcatacaa

SEQ ID NO: 552931 - DNA, 25 bp, Mus musculus
caagtcagagcttttaggcatacaa

SEQ ID NO: 552932 - DNA, 25 bp, Mus musculus
caagtcagaggccaaaatggtgttg

SEQ ID NO: 552933 - DNA, 25 bp, Mus musculus
caagtcagaggcgaaaatggtgttg

SEQ ID NO: 552934 - DNA, 25 bp, Mus musculus
caagtcagcactcgcttcagtcatc

SEQ ID NO: 552935 - DNA, 25 bp, Mus musculus
caagtcagcactggcttcagtcatc

SEQ ID NO: 552936 - DNA, 25 bp, Mus musculus
caagtcagcattcctgctgcagaac

SEQ ID NO: 552937 - DNA, 25 bp, Mus musculus
caagtcagcattgctgctgcagaac

SEQ ID NO: 552938 - DNA, 25 bp, Mus musculus
caagtcagcgacatgttcaaaactg

SEQ ID NO: 552939 - DNA, 25 bp, Mus musculus
caagtcagcgacttgttcaaaactg

SEQ ID NO: 552940 - DNA, 25 bp, Mus musculus
caagtcagctagaccggtacagaga

SEQ ID NO: 552941 - DNA, 25 bp, Mus musculus
caagtcagctagtccggtacagaga

SEQ ID NO: 552942 - DNA, 25 bp, Mus musculus
caagtcagctgaagggtatggagaa

SEQ ID NO: 552943 - DNA, 25 bp, Mus musculus
caagtcagctgatgggtatggagaa

SEQ ID NO: 552944 - DNA, 25 bp, Mus musculus
caagtcagctgcattgtcacaagat

SEQ ID NO: 552945 - DNA, 25 bp, Mus musculus
caagtcagctgctttgtcacaagat

SEQ ID NO: 552946 - DNA, 25 bp, Mus musculus
caagtcaggcatcggaaaaacagca

SEQ ID NO: 552947 - DNA, 25 bp, Mus musculus
caagtcaggcatgggaaaaacagca

SEQ ID NO: 552948 - DNA, 25 bp, Mus musculus
caagtcaggtgaaatatcttcgtcg

SEQ ID NO: 552949 - DNA, 25 bp, Mus musculus
caagtcaggtgatatatcttcgtcg

SEQ ID NO: 552950 - DNA, 25 bp, Mus musculus
caagtcagtacgagtgcgcagagct

SEQ ID NO: 552951 - DNA, 25 bp, Mus musculus
caagtcagtacgtgtgcgcagagct

SEQ ID NO: 552952 - DNA, 25 bp, Mus musculus
caagtcataagtcattgctgcctcc

SEQ ID NO: 552953 - DNA, 25 bp, Mus musculus
caagtcataagtgattgctgcctcc

SEQ ID NO: 552954 - DNA, 25 bp, Mus musculus
caagtcatcaaacccgtcaacgtgg

SEQ ID NO: 552955 - DNA, 25 bp, Mus musculus
caagtcatcaaagccgtcaacgtgg

SEQ ID NO: 552956 - DNA, 25 bp, Mus musculus
caagtcatcatgaccatgagacact

SEQ ID NO: 552957 - DNA, 25 bp, Mus musculus
caagtcatcatgtccatgagacact

SEQ ID NO: 552958 - DNA, 25 bp, Mus musculus
caagtcatctgaagtcttaggcaac

SEQ ID NO: 552959 - DNA, 25 bp, Mus musculus
caagtcatctgatgtcttaggcaac

SEQ ID NO: 552960 - DNA, 25 bp, Mus musculus
caagtcattcaacaggaaaatctcc

SEQ ID NO: 552961 - DNA, 25 bp, Mus musculus
caagtcattcaagaggaaaatctcc

SEQ ID NO: 552962 - DNA, 25 bp, Mus musculus
caagtcattgagctcgcctgtgggt

SEQ ID NO: 552963 - DNA, 25 bp, Mus musculus
caagtcattgaggtcgcctgtgggt

SEQ ID NO: 552964 - DNA, 25 bp, Mus musculus
caagtccaaaagcttatctcagaag

SEQ ID NO: 552965 - DNA, 25 bp, Mus musculus
caagtccaaaaggttatctcagaag

SEQ ID NO: 552966 - DNA, 25 bp, Mus musculus
caagtccacaggattaaaggtcaga

SEQ ID NO: 552967 - DNA, 25 bp, Mus musculus
caagtccacaggtttaaaggtcaga

SEQ ID NO: 552968 - DNA, 25 bp, Mus musculus
caagtccacataccaagctgcacaa

SEQ ID NO: 552969 - DNA, 25 bp, Mus musculus
caagtccacatagcaagctgcacaa

SEQ ID NO: 552970 - DNA, 25 bp, Mus musculus
caagtccagcagctctttaccagta

SEQ ID NO: 552971 - DNA, 25 bp, Mus musculus
caagtccagcaggtctttaccagta

SEQ ID NO: 552972 - DNA, 25 bp, Mus musculus
caagtccagccgagacactaagagc

SEQ ID NO: 552973 - DNA, 25 bp, Mus musculus
caagtccagccgtgacactaagagc

SEQ ID NO: 552974 - DNA, 25 bp, Mus musculus
caagtccaggcaagtccatccagga

SEQ ID NO: 552975 - DNA, 25 bp, Mus musculus
caagtccaggcatgtccatccagga

SEQ ID NO: 552976 - DNA, 25 bp, Mus musculus
caagtccaggtcaatgccacaaata

SEQ ID NO: 552977 - DNA, 25 bp, Mus musculus
caagtccaggtctatgccacaaata

SEQ ID NO: 552978 - DNA, 25 bp, Mus musculus
caagtccatcatcatatcaggcaat

SEQ ID NO: 552979 - DNA, 25 bp, Mus musculus
caagtccatcatgatatcaggcaat

SEQ ID NO: 552980 - DNA, 25 bp, Mus musculus
caagtccatgatagagaaggtgacc

SEQ ID NO: 552981 - DNA, 25 bp, Mus musculus
caagtccatgattgagaaggtgacc

SEQ ID NO: 552982 - DNA, 25 bp, Mus musculus
caagtccatgcacagcgccatcatg

SEQ ID NO: 552983 - DNA, 25 bp, Mus musculus
caagtccatgcagagcgccatcatg

SEQ ID NO: 552984 - DNA, 25 bp, Mus musculus
caagtcccacacagcagcttggtgc

SEQ ID NO: 552985 - DNA, 25 bp, Mus musculus
caagtcccacactgcagcttggtgc

SEQ ID NO: 552986 - DNA, 25 bp, Mus musculus
caagtcccaggaagcccaactggtc

SEQ ID NO: 552987 - DNA, 25 bp, Mus musculus
caagtcccaggatgcccaactggtc

SEQ ID NO: 552988 - DNA, 25 bp, Mus musculus
caagtcccatgcaaaggcaaacaca

SEQ ID NO: 552989 - DNA, 25 bp, Mus musculus
caagtcccatgctaaggcaaacaca

SEQ ID NO: 552990 - DNA, 25 bp, Mus musculus
caagtccccatccaaggaggtgtcc

SEQ ID NO: 552991 - DNA, 25 bp, Mus musculus
caagtccccatcgaaggaggtgtcc

SEQ ID NO: 552992 - DNA, 25 bp, Mus musculus
caagtcccctgaatctatatggaaa

SEQ ID NO: 552993 - DNA, 25 bp, Mus musculus
caagtcccctgattctatatggaaa

SEQ ID NO: 552994 - DNA, 25 bp, Mus musculus
caagtcccgactccggaagatgaag

SEQ ID NO: 552995 - DNA, 25 bp, Mus musculus
caagtcccgactgcggaagatgaag

SEQ ID NO: 552996 - DNA, 25 bp, Mus musculus
caagtcccgggactgcataatggga

SEQ ID NO: 552997 - DNA, 25 bp, Mus musculus
caagtcccgggagtgcataatggga

SEQ ID NO: 552998 - DNA, 25 bp, Mus musculus
caagtcccgggtcagttaagctgcc

SEQ ID NO: 552999 - DNA, 25 bp, Mus musculus
caagtcccgggtgagttaagctgcc

SEQ ID NO: 553000 - DNA, 25 bp, Mus musculus
caagtccctagcaccattggaggca

SEQ ID NO: 553001 - DNA, 25 bp, Mus musculus
caagtccctagctccattggaggca

SEQ ID NO: 553002 - DNA, 25 bp, Mus musculus
caagtccgggacaatctttgacaat

SEQ ID NO: 553003 - DNA, 25 bp, Mus musculus
caagtccgggactatctttgacaat

SEQ ID NO: 553004 - DNA, 25 bp, Mus musculus
caagtccgttctcaccatggagcct

SEQ ID NO: 553005 - DNA, 25 bp, Mus musculus
caagtccgttctgaccatggagcct

SEQ ID NO: 553006 - DNA, 25 bp, Mus musculus
caagtcctcagcatttctctgtgaa

SEQ ID NO: 553007 - DNA, 25 bp, Mus musculus
caagtcctcagcttttctctgtgaa

SEQ ID NO: 553008 - DNA, 25 bp, Mus musculus
caagtcctgaaacagggcattgccc

SEQ ID NO: 553009 - DNA, 25 bp, Mus musculus
caagtcctgaaagagggcattgccc

SEQ ID NO: 553010 - DNA, 25 bp, Mus musculus
caagtcctggagagggagacagcaa

SEQ ID NO: 553011 - DNA, 25 bp, Mus musculus
caagtcctggagtgggagacagcaa

SEQ ID NO: 553012 - DNA, 25 bp, Mus musculus
caagtcctggcaaaactacatgtgt

SEQ ID NO: 553013 - DNA, 25 bp, Mus musculus
caagtcctggcataactacatgtgt

SEQ ID NO: 553014 - DNA, 25 bp, Mus musculus
caagtcctgtttcctgtggtgttca

SEQ ID NO: 553015 - DNA, 25 bp, Mus musculus
caagtcctgtttgctgtggtgttca

SEQ ID NO: 553016 - DNA, 25 bp, Mus musculus
caagtccttcatcgaatacatcaag

SEQ ID NO: 553017 - DNA, 25 bp, Mus musculus
caagtccttcatggaatacatcaag

SEQ ID NO: 553018 - DNA, 25 bp, Mus musculus
caagtccttgctccacgagggctca

SEQ ID NO: 553019 - DNA, 25 bp, Mus musculus
caagtccttgctgcacgagggctca

SEQ ID NO: 553020 - DNA, 25 bp, Mus musculus
caagtcctttgaatccattaactac

SEQ ID NO: 553021 - DNA, 25 bp, Mus musculus
caagtcctttgattccattaactac

SEQ ID NO: 553022 - DNA, 25 bp, Mus musculus
caagtcgccgtactatttggtacaa

SEQ ID NO: 553023 - DNA, 25 bp, Mus musculus
caagtcgccgtagtatttggtacaa

SEQ ID NO: 553024 - DNA, 25 bp, Mus musculus
caagtcgctgggacttaacacctcc

SEQ ID NO: 553025 - DNA, 25 bp, Mus musculus
caagtcgctgggtcttaacacctcc

SEQ ID NO: 553026 - DNA, 25 bp, Mus musculus
caagtcgctgtcacagcacttagag

SEQ ID NO: 553027 - DNA, 25 bp, Mus musculus
caagtcgctgtctcagcacttagag

SEQ ID NO: 553028 - DNA, 25 bp, Mus musculus
caagtcggctttccattgggcggcc

SEQ ID NO: 553029 - DNA, 25 bp, Mus musculus
caagtcggctttgcattgggcggcc

SEQ ID NO: 553030 - DNA, 25 bp, Mus musculus
caagtcgttgggaatggaagagact

SEQ ID NO: 553031 - DNA, 25 bp, Mus musculus
caagtcgttgggtatggaagagact

SEQ ID NO: 553032 - DNA, 25 bp, Mus musculus
caagtctaaccgctgatttcccagc

SEQ ID NO: 553033 - DNA, 25 bp, Mus musculus
caagtctaaccggtgatttcccagc

SEQ ID NO: 553034 - DNA, 25 bp, Mus musculus
caagtctaagtcctgtggagtcagt

SEQ ID NO: 553035 - DNA, 25 bp, Mus musculus
caagtctaagtcgtgtggagtcagt

SEQ ID NO: 553036 - DNA, 25 bp, Mus musculus
caagtctaggagaccttttgttctc

SEQ ID NO: 553037 - DNA, 25 bp, Mus musculus
caagtctaggagtccttttgttctc

SEQ ID NO: 553038 - DNA, 25 bp, Mus musculus
caagtctcagctactgaagtttgtg

SEQ ID NO: 553039 - DNA, 25 bp, Mus musculus
caagtctcagcttctgaagtttgtg

SEQ ID NO: 553040 - DNA, 25 bp, Mus musculus
caagtctcagttcattacaatgaca

SEQ ID NO: 553041 - DNA, 25 bp, Mus musculus
caagtctcagttgattacaatgaca

SEQ ID NO: 553042 - DNA, 25 bp, Mus musculus
caagtctccaagacctggcataact

SEQ ID NO: 553043 - DNA, 25 bp, Mus musculus
caagtctccaagtcctggcataact

SEQ ID NO: 553044 - DNA, 25 bp, Mus musculus
caagtctccagcctgggatggctga

SEQ ID NO: 553045 - DNA, 25 bp, Mus musculus
caagtctccagcgtgggatggctga

SEQ ID NO: 553046 - DNA, 25 bp, Mus musculus
caagtctccatgaggctaagagtgt

SEQ ID NO: 553047 - DNA, 25 bp, Mus musculus
caagtctccatgtggctaagagtgt

SEQ ID NO: 553048 - DNA, 25 bp, Mus musculus
caagtctcccaacagctgagattaa

SEQ ID NO: 553049 - DNA, 25 bp, Mus musculus
caagtctcccaagagctgagattaa

SEQ ID NO: 553050 - DNA, 25 bp, Mus musculus
caagtctcccttactcggtgtgtga

SEQ ID NO: 553051 - DNA, 25 bp, Mus musculus
caagtctccctttctcggtgtgtga

SEQ ID NO: 553052 - DNA, 25 bp, Mus musculus
caagtctccggcagatattgtgaag

SEQ ID NO: 553053 - DNA, 25 bp, Mus musculus
caagtctccggctgatattgtgaag

SEQ ID NO: 553054 - DNA, 25 bp, Mus musculus
caagtctcgggaagaagacccgact

SEQ ID NO: 553055 - DNA, 25 bp, Mus musculus
caagtctcgggatgaagacccgact

SEQ ID NO: 553056 - DNA, 25 bp, Mus musculus
caagtctctcatcaaatcctggaaa

SEQ ID NO: 553057 - DNA, 25 bp, Mus musculus
caagtctctcatgaaatcctggaaa

SEQ ID NO: 553058 - DNA, 25 bp, Mus musculus
caagtctctgaaaatctttgggtca

SEQ ID NO: 553059 - DNA, 25 bp, Mus musculus
caagtctctgaatatctttgggtca

SEQ ID NO: 553060 - DNA, 25 bp, Mus musculus
caagtctcttgacgctcaggcggag

SEQ ID NO: 553061 - DNA, 25 bp, Mus musculus
caagtctcttgaggctcaggcggag

SEQ ID NO: 553062 - DNA, 25 bp, Mus musculus
caagtctgaaggatctccatcgcca

SEQ ID NO: 553063 - DNA, 25 bp, Mus musculus
caagtctgaaggttctccatcgcca

SEQ ID NO: 553064 - DNA, 25 bp, Mus musculus
caagtctgacatcgaaacggccaag

SEQ ID NO: 553065 - DNA, 25 bp, Mus musculus
caagtctgacatggaaacggccaag

SEQ ID NO: 553066 - DNA, 25 bp, Mus musculus
caagtctgaccccttcatggagatt

SEQ ID NO: 553067 - DNA, 25 bp, Mus musculus
caagtctgacccgttcatggagatt

SEQ ID NO: 553068 - DNA, 25 bp, Mus musculus
caagtctgatgtctggagtttcgga

SEQ ID NO: 553069 - DNA, 25 bp, Mus musculus
caagtctgatgtgtggagtttcgga

SEQ ID NO: 553070 - DNA, 25 bp, Mus musculus
caagtctggagacaatcgcggcaag

SEQ ID NO: 553071 - DNA, 25 bp, Mus musculus
caagtctggagagaatcgcggcaag

SEQ ID NO: 553072 - DNA, 25 bp, Mus musculus
caagtctgggtacctcagctcggag

SEQ ID NO: 553073 - DNA, 25 bp, Mus musculus
caagtctgggtagctcagctcggag

SEQ ID NO: 553074 - DNA, 25 bp, Mus musculus
caagtctggtctccactcaatggct

SEQ ID NO: 553075 - DNA, 25 bp, Mus musculus
caagtctggtctgcactcaatggct

SEQ ID NO: 553076 - DNA, 25 bp, Mus musculus
caagtctgtggaaaaggaccccatg

SEQ ID NO: 553077 - DNA, 25 bp, Mus musculus
caagtctgtggataaggaccccatg

SEQ ID NO: 553078 - DNA, 25 bp, Mus musculus
caagtcttgctacaatagagagatg

SEQ ID NO: 553079 - DNA, 25 bp, Mus musculus
caagtcttgctagaatagagagatg

SEQ ID NO: 553080 - DNA, 25 bp, Mus musculus
caagtcttggaaaattggaatactg

SEQ ID NO: 553081 - DNA, 25 bp, Mus musculus
caagtcttggaatattggaatactg

SEQ ID NO: 553082 - DNA, 25 bp, Mus musculus
caagtctttgaccaccctgggaaag

SEQ ID NO: 553083 - DNA, 25 bp, Mus musculus
caagtctttgacgaccctgggaaag

SEQ ID NO: 553084 - DNA, 25 bp, Mus musculus
caagtgaacctgatggattctgaag

SEQ ID NO: 553085 - DNA, 25 bp, Mus musculus
caagtgaacctgttggattctgaag

SEQ ID NO: 553086 - DNA, 25 bp, Mus musculus
caagtgaacggcacacacgtgtgcg

SEQ ID NO: 553087 - DNA, 25 bp, Mus musculus
caagtgaacggctcacacgtgtgcg

SEQ ID NO: 553088 - DNA, 25 bp, Mus musculus
caagtgaagaagagctatgtaggca

SEQ ID NO: 553089 - DNA, 25 bp, Mus musculus
caagtgaagaagtgctatgtaggca

SEQ ID NO: 553090 - DNA, 25 bp, Mus musculus
caagtgaagccacagtcaatatcca

SEQ ID NO: 553091 - DNA, 25 bp, Mus musculus
caagtgaagccagagtcaatatcca

SEQ ID NO: 553092 - DNA, 25 bp, Mus musculus
caagtgaagctgacattaaggacca

SEQ ID NO: 553093 - DNA, 25 bp, Mus musculus
caagtgaagctgtcattaaggacca

SEQ ID NO: 553094 - DNA, 25 bp, Mus musculus
caagtgaagttaatctgaggtgaag

SEQ ID NO: 553095 - DNA, 25 bp, Mus musculus
caagtgaagttattctgaggtgaag

SEQ ID NO: 553096 - DNA, 25 bp, Mus musculus
caagtgaatccaactgcccctgaag

SEQ ID NO: 553097 - DNA, 25 bp, Mus musculus
caagtgaatccatctgcccctgaag

SEQ ID NO: 553098 - DNA, 25 bp, Mus musculus
caagtgaatgacagccacgcgtggt

SEQ ID NO: 553099 - DNA, 25 bp, Mus musculus
caagtgaatgactgccacgcgtggt

SEQ ID NO: 553100 - DNA, 25 bp, Mus musculus
caagtgaattagcaataatccaaga

SEQ ID NO: 553101 - DNA, 25 bp, Mus musculus
caagtgaattaggaataatccaaga

SEQ ID NO: 553102 - DNA, 25 bp, Mus musculus
caagtgacctccacaaccaagtttt

SEQ ID NO: 553103 - DNA, 25 bp, Mus musculus
caagtgacctcctcaaccaagtttt

SEQ ID NO: 553104 - DNA, 25 bp, Mus musculus
caagtgacctgtactatccccatct

SEQ ID NO: 553105 - DNA, 25 bp, Mus musculus
caagtgacctgttctatccccatct

SEQ ID NO: 553106 - DNA, 25 bp, Mus musculus
caagtgacgatccacccgaatctgt

SEQ ID NO: 553107 - DNA, 25 bp, Mus musculus
caagtgacgatcgacccgaatctgt

SEQ ID NO: 553108 - DNA, 25 bp, Mus musculus
caagtgacggtgctctccaccaaga

SEQ ID NO: 553109 - DNA, 25 bp, Mus musculus
caagtgacggtggtctccaccaaga

SEQ ID NO: 553110 - DNA, 25 bp, Mus musculus
caagtgactgtgcagatgaaagctg

SEQ ID NO: 553111 - DNA, 25 bp, Mus musculus
caagtgactgtggagatgaaagctg

SEQ ID NO: 553112 - DNA, 25 bp, Mus musculus
caagtgactgttattctgcatggaa

SEQ ID NO: 553113 - DNA, 25 bp, Mus musculus
caagtgactgtttttctgcatggaa

SEQ ID NO: 553114 - DNA, 25 bp, Mus musculus
caagtgagactgatcgaatccaaag

SEQ ID NO: 553115 - DNA, 25 bp, Mus musculus
caagtgagactgttcgaatccaaag

SEQ ID NO: 553116 - DNA, 25 bp, Mus musculus
caagtgagacttcgaggctgagcat

SEQ ID NO: 553117 - DNA, 25 bp, Mus musculus
caagtgagacttggaggctgagcat

SEQ ID NO: 553118 - DNA, 25 bp, Mus musculus
caagtgagcaacaccacaatgaccg

SEQ ID NO: 553119 - DNA, 25 bp, Mus musculus
caagtgagcaactccacaatgaccg

SEQ ID NO: 553120 - DNA, 25 bp, Mus musculus
caagtgagcctgcaggattacatca

SEQ ID NO: 553121 - DNA, 25 bp, Mus musculus
caagtgagcctggaggattacatca

SEQ ID NO: 553122 - DNA, 25 bp, Mus musculus
caagtgagctatctatctgggatcc

SEQ ID NO: 553123 - DNA, 25 bp, Mus musculus
caagtgagctatgtatctgggatcc

SEQ ID NO: 553124 - DNA, 25 bp, Mus musculus
caagtgagctcgacatgagggccca

SEQ ID NO: 553125 - DNA, 25 bp, Mus musculus
caagtgagctcgtcatgagggccca

SEQ ID NO: 553126 - DNA, 25 bp, Mus musculus
caagtgagctctaccctacagtcct

SEQ ID NO: 553127 - DNA, 25 bp, Mus musculus
caagtgagctcttccctacagtcct

SEQ ID NO: 553128 - DNA, 25 bp, Mus musculus
caagtgagctgtagcgtactgtatc

SEQ ID NO: 553129 - DNA, 25 bp, Mus musculus
caagtgagctgttgcgtactgtatc

SEQ ID NO: 553130 - DNA, 25 bp, Mus musculus
caagtgaggctgaataaggacacct

SEQ ID NO: 553131 - DNA, 25 bp, Mus musculus
caagtgaggctgtataaggacacct

SEQ ID NO: 553132 - DNA, 25 bp, Mus musculus
caagtgagtcttcgtcagggcactg

SEQ ID NO: 553133 - DNA, 25 bp, Mus musculus
caagtgagtcttggtcagggcactg

SEQ ID NO: 553134 - DNA, 25 bp, Mus musculus
caagtgagtgttatctcctgtggta

SEQ ID NO: 553135 - DNA, 25 bp, Mus musculus
caagtgagtgttttctcctgtggta

SEQ ID NO: 553136 - DNA, 25 bp, Mus musculus
caagtgagtttaagccctggaatgt

SEQ ID NO: 553137 - DNA, 25 bp, Mus musculus
caagtgagtttatgccctggaatgt

SEQ ID NO: 553138 - DNA, 25 bp, Mus musculus
caagtgataactcttgacggcacca

SEQ ID NO: 553139 - DNA, 25 bp, Mus musculus
caagtgataactgttgacggcacca

SEQ ID NO: 553140 - DNA, 25 bp, Mus musculus
caagtgataagtaaagagtacgaac

SEQ ID NO: 553141 - DNA, 25 bp, Mus musculus
caagtgataagttaagagtacgaac

SEQ ID NO: 553142 - DNA, 25 bp, Mus musculus
caagtgataggtctaactggtaacc

SEQ ID NO: 553143 - DNA, 25 bp, Mus musculus
caagtgataggtgtaactggtaacc

SEQ ID NO: 553144 - DNA, 25 bp, Mus musculus
caagtgatccccatttatgctgtgt

SEQ ID NO: 553145 - DNA, 25 bp, Mus musculus
caagtgatccccttttatgctgtgt

SEQ ID NO: 553146 - DNA, 25 bp, Mus musculus
caagtgatcgcaaggacttctggac

SEQ ID NO: 553147 - DNA, 25 bp, Mus musculus
caagtgatcgcatggacttctggac

SEQ ID NO: 553148 - DNA, 25 bp, Mus musculus
caagtgattcagatggagttagatc

SEQ ID NO: 553149 - DNA, 25 bp, Mus musculus
caagtgattcagttggagttagatc

SEQ ID NO: 553150 - DNA, 25 bp, Mus musculus
caagtgatttcaccttcttctcagg

SEQ ID NO: 553151 - DNA, 25 bp, Mus musculus
caagtgatttcagcttcttctcagg

SEQ ID NO: 553152 - DNA, 25 bp, Mus musculus
caagtgcaaagaaccacagctggag

SEQ ID NO: 553153 - DNA, 25 bp, Mus musculus
caagtgcaaagatccacagctggag

SEQ ID NO: 553154 - DNA, 25 bp, Mus musculus
caagtgcaaatgacaccctggattt

SEQ ID NO: 553155 - DNA, 25 bp, Mus musculus
caagtgcaaatgtcaccctggattt

SEQ ID NO: 553156 - DNA, 25 bp, Mus musculus
caagtgcaaggcaggacacttacct

SEQ ID NO: 553157 - DNA, 25 bp, Mus musculus
caagtgcaaggcagtgtctcgagaa

SEQ ID NO: 553158 - DNA, 25 bp, Mus musculus
caagtgcaaggctggacacttacct

SEQ ID NO: 553159 - DNA, 25 bp, Mus musculus
caagtgcaaggctgtgtctcgagaa

SEQ ID NO: 553160 - DNA, 25 bp, Mus musculus
caagtgcacagtaacccatcctgag

SEQ ID NO: 553161 - DNA, 25 bp, Mus musculus
caagtgcacagttacccatcctgag

SEQ ID NO: 553162 - DNA, 25 bp, Mus musculus
caagtgcacattcgcttgccagcaa

SEQ ID NO: 553163 - DNA, 25 bp, Mus musculus
caagtgcacattggcttgccagcaa

SEQ ID NO: 553164 - DNA, 25 bp, Mus musculus
caagtgcagactagctgccatctcc

SEQ ID NO: 553165 - DNA, 25 bp, Mus musculus
caagtgcagacttgctgccatctcc

SEQ ID NO: 553166 - DNA, 25 bp, Mus musculus
caagtgcagcagcatggttctggtc

SEQ ID NO: 553167 - DNA, 25 bp, Mus musculus
caagtgcagcaggatggttctggtc

SEQ ID NO: 553168 - DNA, 25 bp, Mus musculus
caagtgcatctgcaataatgaatgg

SEQ ID NO: 553169 - DNA, 25 bp, Mus musculus
caagtgcatctggaataatgaatgg

SEQ ID NO: 553170 - DNA, 25 bp, Mus musculus
caagtgcattgcaagccagtctgga

SEQ ID NO: 553171 - DNA, 25 bp, Mus musculus
caagtgcattgctagccagtctgga

SEQ ID NO: 553172 - DNA, 25 bp, Mus musculus
caagtgccaagtcaaaagaaccaga

SEQ ID NO: 553173 - DNA, 25 bp, Mus musculus
caagtgccaagtgaaaagaaccaga

SEQ ID NO: 553174 - DNA, 25 bp, Mus musculus
caagtgccaggaatgcaagaaaacc

SEQ ID NO: 553175 - DNA, 25 bp, Mus musculus
caagtgccaggattgcaagaaaacc

SEQ ID NO: 553176 - DNA, 25 bp, Mus musculus
caagtgccatgaagtcgtcattgat

SEQ ID NO: 553177 - DNA, 25 bp, Mus musculus
caagtgccatgatgtcgtcattgat

SEQ ID NO: 553178 - DNA, 25 bp, Mus musculus
caagtgcccatgctagagatcgacg

SEQ ID NO: 553179 - DNA, 25 bp, Mus musculus
caagtgcccatggtagagatcgacg

SEQ ID NO: 553180 - DNA, 25 bp, Mus musculus
caagtgcccgcaacagtcatgaaag

SEQ ID NO: 553181 - DNA, 25 bp, Mus musculus
caagtgcccgcatcagtcatgaaag

SEQ ID NO: 553182 - DNA, 25 bp, Mus musculus
caagtgccctatctcacctatgatg

SEQ ID NO: 553183 - DNA, 25 bp, Mus musculus
caagtgccctatgtcacctatgatg

SEQ ID NO: 553184 - DNA, 25 bp, Mus musculus
caagtgcctattcaaagagactcac

SEQ ID NO: 553185 - DNA, 25 bp, Mus musculus
caagtgcctattgaaagagactcac

SEQ ID NO: 553186 - DNA, 25 bp, Mus musculus
caagtgcctggtcatcaagtatgcc

SEQ ID NO: 553187 - DNA, 25 bp, Mus musculus
caagtgcctggtgatcaagtatgcc

SEQ ID NO: 553188 - DNA, 25 bp, Mus musculus
caagtgcctgtcagtcgggatgtca

SEQ ID NO: 553189 - DNA, 25 bp, Mus musculus
caagtgcctgtctgtcgggatgtca

SEQ ID NO: 553190 - DNA, 25 bp, Mus musculus
caagtgcgaaccaggacagtggagt

SEQ ID NO: 553191 - DNA, 25 bp, Mus musculus
caagtgcgaacctggacagtggagt

SEQ ID NO: 553192 - DNA, 25 bp, Mus musculus
caagtgcgggcaaatctgtggaaac

SEQ ID NO: 553193 - DNA, 25 bp, Mus musculus
caagtgcgggcatatctgtggaaac

SEQ ID NO: 553194 - DNA, 25 bp, Mus musculus
caagtgctactgactcaacggatac

SEQ ID NO: 553195 - DNA, 25 bp, Mus musculus
caagtgctactgtctcaacggatac

SEQ ID NO: 553196 - DNA, 25 bp, Mus musculus
caagtgctcacacttctgcactaca

SEQ ID NO: 553197 - DNA, 25 bp, Mus musculus
caagtgctcacagttctgcactaca

SEQ ID NO: 553198 - DNA, 25 bp, Mus musculus
caagtgctcaccaggagtactaagc

SEQ ID NO: 553199 - DNA, 25 bp, Mus musculus
caagtgctcacctggagtactaagc

SEQ ID NO: 553200 - DNA, 25 bp, Mus musculus
caagtgctcaggagaggttctttca

SEQ ID NO: 553201 - DNA, 25 bp, Mus musculus
caagtgctcaggtgaggttctttca

SEQ ID NO: 553202 - DNA, 25 bp, Mus musculus
caagtgctccaaactggaagtgggc

SEQ ID NO: 553203 - DNA, 25 bp, Mus musculus
caagtgctccaatctggaagtgggc

SEQ ID NO: 553204 - DNA, 25 bp, Mus musculus
caagtgctccagcattacggtcagc

SEQ ID NO: 553205 - DNA, 25 bp, Mus musculus
caagtgctccaggattacggtcagc

SEQ ID NO: 553206 - DNA, 25 bp, Mus musculus
caagtgctgaatccaagcagagcca

SEQ ID NO: 553207 - DNA, 25 bp, Mus musculus
caagtgctgaatgcaagcagagcca

SEQ ID NO: 553208 - DNA, 25 bp, Mus musculus
caagtgctgcataacaagctgggct

SEQ ID NO: 553209 - DNA, 25 bp, Mus musculus
caagtgctgcattacaagctgggct

SEQ ID NO: 553210 - DNA, 25 bp, Mus musculus
caagtgctgggcaacgtccttgctt

SEQ ID NO: 553211 - DNA, 25 bp, Mus musculus
caagtgctgggctacgtccttgctt

SEQ ID NO: 553212 - DNA, 25 bp, Mus musculus
caagtgcttagaactggtgcctgga

SEQ ID NO: 553213 - DNA, 25 bp, Mus musculus
caagtgcttagatctggtgcctgga

SEQ ID NO: 553214 - DNA, 25 bp, Mus musculus
caagtgcttccgcagaggtctctgc

SEQ ID NO: 553215 - DNA, 25 bp, Mus musculus
caagtgcttccggagaggtctctgc

SEQ ID NO: 553216 - DNA, 25 bp, Mus musculus
caagtgcttcctctctaggacggag

SEQ ID NO: 553217 - DNA, 25 bp, Mus musculus
caagtgcttcctgtctaggacggag

SEQ ID NO: 553218 - DNA, 25 bp, Mus musculus
caagtgcttgaccattggacatagt

SEQ ID NO: 553219 - DNA, 25 bp, Mus musculus
caagtgcttgacgattggacatagt

SEQ ID NO: 553220 - DNA, 25 bp, Mus musculus
caagtggaacgtcaatgtcccgccc

SEQ ID NO: 553221 - DNA, 25 bp, Mus musculus
caagtggaacgtgaatgtcccgccc

SEQ ID NO: 553222 - DNA, 25 bp, Mus musculus
caagtggacagtacatctgtggaca

SEQ ID NO: 553223 - DNA, 25 bp, Mus musculus
caagtggacagttcatctgtggaca

SEQ ID NO: 553224 - DNA, 25 bp, Mus musculus
caagtggaccacagcaccatacact

SEQ ID NO: 553225 - DNA, 25 bp, Mus musculus
caagtggaccactgcaccatacact

SEQ ID NO: 553226 - DNA, 25 bp, Mus musculus
caagtggacccaccattagaggagt

SEQ ID NO: 553227 - DNA, 25 bp, Mus musculus
caagtggacccagcattagaggagt

SEQ ID NO: 553228 - DNA, 25 bp, Mus musculus
caagtggacgcccagaagatgaaaa

SEQ ID NO: 553229 - DNA, 25 bp, Mus musculus
caagtggacgccgagaagatgaaaa

SEQ ID NO: 553230 - DNA, 25 bp, Mus musculus
caagtggagaatctaatcctgatct

SEQ ID NO: 553231 - DNA, 25 bp, Mus musculus
caagtggagaatgtaatcctgatct

SEQ ID NO: 553232 - DNA, 25 bp, Mus musculus
caagtggagcacaatctggcttcag

SEQ ID NO: 553233 - DNA, 25 bp, Mus musculus
caagtggagcactatctggcttcag

SEQ ID NO: 553234 - DNA, 25 bp, Mus musculus
caagtggagcctagcacctcctcat

SEQ ID NO: 553235 - DNA, 25 bp, Mus musculus
caagtggagccttgcacctcctcat

SEQ ID NO: 553236 - DNA, 25 bp, Mus musculus
caagtggaggacacaaacggacatc

SEQ ID NO: 553237 - DNA, 25 bp, Mus musculus
caagtggaggactcaaacggacatc

SEQ ID NO: 553238 - DNA, 25 bp, Mus musculus
caagtggaggcacatccttcgagca

SEQ ID NO: 553239 - DNA, 25 bp, Mus musculus
caagtggaggcagatccttcgagca

SEQ ID NO: 553240 - DNA, 25 bp, Mus musculus
caagtggagtcaattccagagactg

SEQ ID NO: 553241 - DNA, 25 bp, Mus musculus
caagtggagtcatttccagagactg

SEQ ID NO: 553242 - DNA, 25 bp, Mus musculus
caagtggagtgcaaatctgctctga

SEQ ID NO: 553243 - DNA, 25 bp, Mus musculus
caagtggagtgctaatctgctctga

SEQ ID NO: 553244 - DNA, 25 bp, Mus musculus
caagtggagtttatgcggctcagca

SEQ ID NO: 553245 - DNA, 25 bp, Mus musculus
caagtggagtttttgcggctcagca

SEQ ID NO: 553246 - DNA, 25 bp, Mus musculus
caagtggatagtaggatgagcagac

SEQ ID NO: 553247 - DNA, 25 bp, Mus musculus
caagtggatagttggatgagcagac

SEQ ID NO: 553248 - DNA, 25 bp, Mus musculus
caagtggatatgaggctgtgcagac

SEQ ID NO: 553249 - DNA, 25 bp, Mus musculus
caagtggatatgtggctgtgcagac

SEQ ID NO: 553250 - DNA, 25 bp, Mus musculus
caagtggatccacgttgaggtgcat

SEQ ID NO: 553251 - DNA, 25 bp, Mus musculus
caagtggatccaggttgaggtgcat

SEQ ID NO: 553252 - DNA, 25 bp, Mus musculus
caagtggattggcacatgcctggca

SEQ ID NO: 553253 - DNA, 25 bp, Mus musculus
caagtggattgggacatgcctggca

SEQ ID NO: 553254 - DNA, 25 bp, Mus musculus
caagtggatttaaaccagtgaggct

SEQ ID NO: 553255 - DNA, 25 bp, Mus musculus
caagtggatttataccagtgaggct

SEQ ID NO: 553256 - DNA, 25 bp, Mus musculus
caagtggcaacaccaatgaattagc

SEQ ID NO: 553257 - DNA, 25 bp, Mus musculus
caagtggcaacagcaatgaattagc

SEQ ID NO: 553258 - DNA, 25 bp, Mus musculus
caagtggcaagtacaactggctttt

SEQ ID NO: 553259 - DNA, 25 bp, Mus musculus
caagtggcaagttcaactggctttt

SEQ ID NO: 553260 - DNA, 25 bp, Mus musculus
caagtggcaatgagtccaacggacc

SEQ ID NO: 553261 - DNA, 25 bp, Mus musculus
caagtggcaatgtgtccaacggacc

SEQ ID NO: 553262 - DNA, 25 bp, Mus musculus
caagtggcagcacacctttaaaaaa

SEQ ID NO: 553263 - DNA, 25 bp, Mus musculus
caagtggcagcagacctttaaaaaa

SEQ ID NO: 553264 - DNA, 25 bp, Mus musculus
caagtggcaggactctcaccagctg

SEQ ID NO: 553265 - DNA, 25 bp, Mus musculus
caagtggcaggagtctcaccagctg

SEQ ID NO: 553266 - DNA, 25 bp, Mus musculus
caagtggccaatcccatcataggcc

SEQ ID NO: 553267 - DNA, 25 bp, Mus musculus
caagtggccaatgccatcataggcc

SEQ ID NO: 553268 - DNA, 25 bp, Mus musculus
caagtggccactcgagtcatctcta

SEQ ID NO: 553269 - DNA, 25 bp, Mus musculus
caagtggccactggagtcatctcta

SEQ ID NO: 553270 - DNA, 25 bp, Mus musculus
caagtggcccaaagtttcagacatc

SEQ ID NO: 553271 - DNA, 25 bp, Mus musculus
caagtggcccaatgtttcagacatc

SEQ ID NO: 553272 - DNA, 25 bp, Mus musculus
caagtggccgctagagaagaataca

SEQ ID NO: 553273 - DNA, 25 bp, Mus musculus
caagtggccgcttgagaagaataca

SEQ ID NO: 553274 - DNA, 25 bp, Mus musculus
caagtggcggcaacctcttcgcgat

SEQ ID NO: 553275 - DNA, 25 bp, Mus musculus
caagtggcggcatcctcttcgcgat

SEQ ID NO: 553276 - DNA, 25 bp, Mus musculus
caagtggcgtctccgcgtgcagcat

SEQ ID NO: 553277 - DNA, 25 bp, Mus musculus
caagtggcgtctgcgcgtgcagcat

SEQ ID NO: 553278 - DNA, 25 bp, Mus musculus
caagtggctcaaagaagtagaattg

SEQ ID NO: 553279 - DNA, 25 bp, Mus musculus
caagtggctcaatgaagtagaattg

SEQ ID NO: 553280 - DNA, 25 bp, Mus musculus
caagtggctgatccggcttctctct

SEQ ID NO: 553281 - DNA, 25 bp, Mus musculus
caagtggctgatgcggcttctctct

SEQ ID NO: 553282 - DNA, 25 bp, Mus musculus
caagtggctgctctgcattgggtcc

SEQ ID NO: 553283 - DNA, 25 bp, Mus musculus
caagtggctgctgtgcattgggtcc

SEQ ID NO: 553284 - DNA, 25 bp, Mus musculus
caagtggctttaaagatcaaaatga

SEQ ID NO: 553285 - DNA, 25 bp, Mus musculus
caagtggctttatagatcaaaatga

SEQ ID NO: 553286 - DNA, 25 bp, Mus musculus
caagtgggaagaagtaccgaagtca

SEQ ID NO: 553287 - DNA, 25 bp, Mus musculus
caagtgggaagatgtaccgaagtca

SEQ ID NO: 553288 - DNA, 25 bp, Mus musculus
caagtgggacaacaaactccagtac

SEQ ID NO: 553289 - DNA, 25 bp, Mus musculus
caagtgggacaagaaactccagtac

SEQ ID NO: 553290 - DNA, 25 bp, Mus musculus
caagtgggagctcggtacaccttca

SEQ ID NO: 553291 - DNA, 25 bp, Mus musculus
caagtgggagctgggtacaccttca

SEQ ID NO: 553292 - DNA, 25 bp, Mus musculus
caagtgggagtgaccctgaatagga

SEQ ID NO: 553293 - DNA, 25 bp, Mus musculus
caagtgggagtgtccctgaatagga

SEQ ID NO: 553294 - DNA, 25 bp, Mus musculus
caagtgggctagatactactgttca

SEQ ID NO: 553295 - DNA, 25 bp, Mus musculus
caagtgggctagttactactgttca

SEQ ID NO: 553296 - DNA, 25 bp, Mus musculus
caagtgggctctagtgtatctggca

SEQ ID NO: 553297 - DNA, 25 bp, Mus musculus
caagtgggctcttgtgtatctggca

SEQ ID NO: 553298 - DNA, 25 bp, Mus musculus
caagtgggctgcatgtgcgatgtat

SEQ ID NO: 553299 - DNA, 25 bp, Mus musculus
caagtgggctgcttgtgcgatgtat

SEQ ID NO: 553300 - DNA, 25 bp, Mus musculus
caagtgggtcttccacatgatcgtc

SEQ ID NO: 553301 - DNA, 25 bp, Mus musculus
caagtgggtcttgcacatgatcgtc

SEQ ID NO: 553302 - DNA, 25 bp, Mus musculus
caagtgggtggtcaataagtcatct

SEQ ID NO: 553303 - DNA, 25 bp, Mus musculus
caagtgggtggtgaataagtcatct

SEQ ID NO: 553304 - DNA, 25 bp, Mus musculus
caagtgggtgtgagtacgtcctgca

SEQ ID NO: 553305 - DNA, 25 bp, Mus musculus
caagtgggtgtgtgtacgtcctgca

SEQ ID NO: 553306 - DNA, 25 bp, Mus musculus
caagtggtaagaatggtcccaagaa

SEQ ID NO: 553307 - DNA, 25 bp, Mus musculus
caagtggtaagattggtcccaagaa

SEQ ID NO: 553308 - DNA, 25 bp, Mus musculus
caagtggtacacagccgacagatta

SEQ ID NO: 553309 - DNA, 25 bp, Mus musculus
caagtggtacactgccgacagatta

SEQ ID NO: 553310 - DNA, 25 bp, Mus musculus
caagtggtagtacccaagtatgcac

SEQ ID NO: 553311 - DNA, 25 bp, Mus musculus
caagtggtagtagccaagtatgcac

SEQ ID NO: 553312 - DNA, 25 bp, Mus musculus
caagtggtgatcagagtcccctgcc

SEQ ID NO: 553313 - DNA, 25 bp, Mus musculus
caagtggtgatctgagtcccctgcc

SEQ ID NO: 553314 - DNA, 25 bp, Mus musculus
caagtggttcagaaagatcaaagac

SEQ ID NO: 553315 - DNA, 25 bp, Mus musculus
caagtggttcagtaagatcaaagac

SEQ ID NO: 553316 - DNA, 25 bp, Mus musculus
caagtggttcgtccagaggcctttg

SEQ ID NO: 553317 - DNA, 25 bp, Mus musculus
caagtggttcgtgcagaggcctttg

SEQ ID NO: 553318 - DNA, 25 bp, Mus musculus
caagtggtttggaaatgtacgactc

SEQ ID NO: 553319 - DNA, 25 bp, Mus musculus
caagtggtttggtaatgtacgactc

SEQ ID NO: 553320 - DNA, 25 bp, Mus musculus
caagtgtaagcccatcagcatggtg

SEQ ID NO: 553321 - DNA, 25 bp, Mus musculus
caagtgtaagccgatcagcatggtg

SEQ ID NO: 553322 - DNA, 25 bp, Mus musculus
caagtgtacaccatcactgaacgca

SEQ ID NO: 553323 - DNA, 25 bp, Mus musculus
caagtgtacaccttcactgaacgca

SEQ ID NO: 553324 - DNA, 25 bp, Mus musculus
caagtgtaccgccagctcagcaagc

SEQ ID NO: 553325 - DNA, 25 bp, Mus musculus
caagtgtaccgcgagctcagcaagc

SEQ ID NO: 553326 - DNA, 25 bp, Mus musculus
caagtgtactagctaccctgatggt

SEQ ID NO: 553327 - DNA, 25 bp, Mus musculus
caagtgtactaggtaccctgatggt

SEQ ID NO: 553328 - DNA, 25 bp, Mus musculus
caagtgtagatacatctggcttaag

SEQ ID NO: 553329 - DNA, 25 bp, Mus musculus
caagtgtagatagatctggcttaag

SEQ ID NO: 553330 - DNA, 25 bp, Mus musculus
caagtgtagtttccaaaaggccaag

SEQ ID NO: 553331 - DNA, 25 bp, Mus musculus
caagtgtagtttgcaaaaggccaag

SEQ ID NO: 553332 - DNA, 25 bp, Mus musculus
caagtgtataggcacagggtctctg

SEQ ID NO: 553333 - DNA, 25 bp, Mus musculus
caagtgtatagggacagggtctctg

SEQ ID NO: 553334 - DNA, 25 bp, Mus musculus
caagtgtatggaaacccacaacagt

SEQ ID NO: 553335 - DNA, 25 bp, Mus musculus
caagtgtatggaacggttgcaaccg

SEQ ID NO: 553336 - DNA, 25 bp, Mus musculus
caagtgtatggatacccacaacagt

SEQ ID NO: 553337 - DNA, 25 bp, Mus musculus
caagtgtatggatcggttgcaaccg

SEQ ID NO: 553338 - DNA, 25 bp, Mus musculus
caagtgtcacacaggtttcgacctc

SEQ ID NO: 553339 - DNA, 25 bp, Mus musculus
caagtgtcacactggtttcgacctc

SEQ ID NO: 553340 - DNA, 25 bp, Mus musculus
caagtgtcagataaacacctgcaag

SEQ ID NO: 553341 - DNA, 25 bp, Mus musculus
caagtgtcagattaacacctgcaag

SEQ ID NO: 553342 - DNA, 25 bp, Mus musculus
caagtgtcagttcctttggacgcta

SEQ ID NO: 553343 - DNA, 25 bp, Mus musculus
caagtgtcagttgctttggacgcta

SEQ ID NO: 553344 - DNA, 25 bp, Mus musculus
caagtgtccactatgcagtccctgt

SEQ ID NO: 553345 - DNA, 25 bp, Mus musculus
caagtgtccactttgcagtccctgt

SEQ ID NO: 553346 - DNA, 25 bp, Mus musculus
caagtgtcctgactgcacggccatc

SEQ ID NO: 553347 - DNA, 25 bp, Mus musculus
caagtgtcctgagtgcacggccatc

SEQ ID NO: 553348 - DNA, 25 bp, Mus musculus
caagtgtcctggagcatatggcccc

SEQ ID NO: 553349 - DNA, 25 bp, Mus musculus
caagtgtcctggtgcatatggcccc

SEQ ID NO: 553350 - DNA, 25 bp, Mus musculus
caagtgtcctttccctgagcacaag

SEQ ID NO: 553351 - DNA, 25 bp, Mus musculus
caagtgtcctttgcctgagcacaag

SEQ ID NO: 553352 - DNA, 25 bp, Mus musculus
caagtgtcggaaaatgctgccagca

SEQ ID NO: 553353 - DNA, 25 bp, Mus musculus
caagtgtcggaatatgctgccagca

SEQ ID NO: 553354 - DNA, 25 bp, Mus musculus
caagtgtctaaacaacagtgctgct

SEQ ID NO: 553355 - DNA, 25 bp, Mus musculus
caagtgtctaaagaacagtgctgct

SEQ ID NO: 553356 - DNA, 25 bp, Mus musculus
caagtgtctcatcgttctgaggtgt

SEQ ID NO: 553357 - DNA, 25 bp, Mus musculus
caagtgtctcatggttctgaggtgt

SEQ ID NO: 553358 - DNA, 25 bp, Mus musculus
caagtgtctcttcgttggcctcatc

SEQ ID NO: 553359 - DNA, 25 bp, Mus musculus
caagtgtctcttggttggcctcatc

SEQ ID NO: 553360 - DNA, 25 bp, Mus musculus
caagtgtctggaagcctcattagcc

SEQ ID NO: 553361 - DNA, 25 bp, Mus musculus
caagtgtctggatgcctcattagcc

SEQ ID NO: 553362 - DNA, 25 bp, Mus musculus
caagtgtctttcaggattaataagg

SEQ ID NO: 553363 - DNA, 25 bp, Mus musculus
caagtgtctttctggattaataagg

SEQ ID NO: 553364 - DNA, 25 bp, Mus musculus
caagtgtgaagacctgagtagtctc

SEQ ID NO: 553365 - DNA, 25 bp, Mus musculus
caagtgtgaagagctgagtagtctc

SEQ ID NO: 553366 - DNA, 25 bp, Mus musculus
caagtgtgagcccatagtcatgact

SEQ ID NO: 553367 - DNA, 25 bp, Mus musculus
caagtgtgagccgatagtcatgact

SEQ ID NO: 553368 - DNA, 25 bp, Mus musculus
caagtgtgaggccattactgttgag

SEQ ID NO: 553369 - DNA, 25 bp, Mus musculus
caagtgtgaggcgattactgttgag

SEQ ID NO: 553370 - DNA, 25 bp, Mus musculus
caagtgtgcattcacccgaaattaa

SEQ ID NO: 553371 - DNA, 25 bp, Mus musculus
caagtgtgcattgacccgaaattaa

SEQ ID NO: 553372 - DNA, 25 bp, Mus musculus
caagtgtgcggtcatcaaaacttct

SEQ ID NO: 553373 - DNA, 25 bp, Mus musculus
caagtgtgcggtgatcaaaacttct

SEQ ID NO: 553374 - DNA, 25 bp, Mus musculus
caagtgtggcataatccaccctgga

SEQ ID NO: 553375 - DNA, 25 bp, Mus musculus
caagtgtggcattatccaccctgga

SEQ ID NO: 553376 - DNA, 25 bp, Mus musculus
caagtgtggctccaaggataatatc

SEQ ID NO: 553377 - DNA, 25 bp, Mus musculus
caagtgtggctccttagggaacatc

SEQ ID NO: 553378 - DNA, 25 bp, Mus musculus
caagtgtggctcgaaggataatatc

SEQ ID NO: 553379 - DNA, 25 bp, Mus musculus
caagtgtggctcgttagggaacatc

SEQ ID NO: 553380 - DNA, 25 bp, Mus musculus
caagtgtgggccacccaggtcttca

SEQ ID NO: 553381 - DNA, 25 bp, Mus musculus
caagtgtgggcctcccaggtcttca

SEQ ID NO: 553382 - DNA, 25 bp, Mus musculus
caagtgtggtagctatcgacaacaa

SEQ ID NO: 553383 - DNA, 25 bp, Mus musculus
caagtgtggtaggtatcgacaacaa

SEQ ID NO: 553384 - DNA, 25 bp, Mus musculus
caagtgtgtaacagcccctggctgt

SEQ ID NO: 553385 - DNA, 25 bp, Mus musculus
caagtgtgtaactgcccctggctgt

SEQ ID NO: 553386 - DNA, 25 bp, Mus musculus
caagtgtgtactagcttctggccta

SEQ ID NO: 553387 - DNA, 25 bp, Mus musculus
caagtgtgtacttgcttctggccta

SEQ ID NO: 553388 - DNA, 25 bp, Mus musculus
caagtgtgtgaacaagaccaaactc

SEQ ID NO: 553389 - DNA, 25 bp, Mus musculus
caagtgtgtgaagaagaccaaactc

SEQ ID NO: 553390 - DNA, 25 bp, Mus musculus
caagtgttaagcattggagcctagc

SEQ ID NO: 553391 - DNA, 25 bp, Mus musculus
caagtgttaagctttggagcctagc

SEQ ID NO: 553392 - DNA, 25 bp, Mus musculus
caagtgttaggacctgaggatctac

SEQ ID NO: 553393 - DNA, 25 bp, Mus musculus
caagtgttaggagctgaggatctac

SEQ ID NO: 553394 - DNA, 25 bp, Mus musculus
caagtgttcccgctttctcaacgac

SEQ ID NO: 553395 - DNA, 25 bp, Mus musculus
caagtgttcccggtttctcaacgac

SEQ ID NO: 553396 - DNA, 25 bp, Mus musculus
caagtgttcttacttatcagtttag

SEQ ID NO: 553397 - DNA, 25 bp, Mus musculus
caagtgttcttagttatcagtttag

SEQ ID NO: 553398 - DNA, 25 bp, Mus musculus
caagtgttgaagaagaatcatttcc

SEQ ID NO: 553399 - DNA, 25 bp, Mus musculus
caagtgttgaagtagaatcatttcc

SEQ ID NO: 553400 - DNA, 25 bp, Mus musculus
caagtgttgcaaccagctggacgtc

SEQ ID NO: 553401 - DNA, 25 bp, Mus musculus
caagtgttgcaagcagctggacgtc

SEQ ID NO: 553402 - DNA, 25 bp, Mus musculus
caagtgtttacaactgggcgactcg

SEQ ID NO: 553403 - DNA, 25 bp, Mus musculus
caagtgtttacatctgggcgactcg

SEQ ID NO: 553404 - DNA, 25 bp, Mus musculus
caagtgtttcggagccatgtgcagc

SEQ ID NO: 553405 - DNA, 25 bp, Mus musculus
caagtgtttcggtgccatgtgcagc

SEQ ID NO: 553406 - DNA, 25 bp, Mus musculus
caagtgtttggaagtgcttctggcc

SEQ ID NO: 553407 - DNA, 25 bp, Mus musculus
caagtgtttggatgtgcttctggcc

SEQ ID NO: 553408 - DNA, 25 bp, Mus musculus
caagtgttttctccagtgtttgaaa

SEQ ID NO: 553409 - DNA, 25 bp, Mus musculus
caagtgttttctgcagtgtttgaaa

SEQ ID NO: 553410 - DNA, 25 bp, Mus musculus
caagttaactctcacctggaggtgg

SEQ ID NO: 553411 - DNA, 25 bp, Mus musculus
caagttaactctgacctggaggtgg

SEQ ID NO: 553412 - DNA, 25 bp, Mus musculus
caagttaagagtcggcagaacaaga

SEQ ID NO: 553413 - DNA, 25 bp, Mus musculus
caagttaagagtgggcagaacaaga

SEQ ID NO: 553414 - DNA, 25 bp, Mus musculus
caagttaaggtccaaagaggcagta

SEQ ID NO: 553415 - DNA, 25 bp, Mus musculus
caagttaaggtcgaaagaggcagta

SEQ ID NO: 553416 - DNA, 25 bp, Mus musculus
caagttaagtgtcaaatgcctgagg

SEQ ID NO: 553417 - DNA, 25 bp, Mus musculus
caagttaagtgtgaaatgcctgagg

SEQ ID NO: 553418 - DNA, 25 bp, Mus musculus
caagttacaaatctggaggcaaagc

SEQ ID NO: 553419 - DNA, 25 bp, Mus musculus
caagttacaaatgtggaggcaaagc

SEQ ID NO: 553420 - DNA, 25 bp, Mus musculus
caagttacacgtcggcaacatcagc

SEQ ID NO: 553421 - DNA, 25 bp, Mus musculus
caagttacacgtgggcaacatcagc

SEQ ID NO: 553422 - DNA, 25 bp, Mus musculus
caagttagaactacatcctcgatgg

SEQ ID NO: 553423 - DNA, 25 bp, Mus musculus
caagttagaacttcatcctcgatgg

SEQ ID NO: 553424 - DNA, 25 bp, Mus musculus
caagttagagtccagcatcgcagag

SEQ ID NO: 553425 - DNA, 25 bp, Mus musculus
caagttagagtcgagcatcgcagag

SEQ ID NO: 553426 - DNA, 25 bp, Mus musculus
caagttagcagtcgcctgggatcgc

SEQ ID NO: 553427 - DNA, 25 bp, Mus musculus
caagttagcagtggcctgggatcgc

SEQ ID NO: 553428 - DNA, 25 bp, Mus musculus
caagttagctgaagccaggactcca

SEQ ID NO: 553429 - DNA, 25 bp, Mus musculus
caagttagctgatgccaggactcca

SEQ ID NO: 553430 - DNA, 25 bp, Mus musculus
caagttatcaagaatttagcgctgc

SEQ ID NO: 553431 - DNA, 25 bp, Mus musculus
caagttatcaagtatttagcgctgc

SEQ ID NO: 553432 - DNA, 25 bp, Mus musculus
caagttatcatgcaaaagtctacaa

SEQ ID NO: 553433 - DNA, 25 bp, Mus musculus
caagttatcatggaaaagtctacaa

SEQ ID NO: 553434 - DNA, 25 bp, Mus musculus
caagttatgaaacgaaacagagtaa

SEQ ID NO: 553435 - DNA, 25 bp, Mus musculus
caagttatgaaaggaaacagagtaa

SEQ ID NO: 553436 - DNA, 25 bp, Mus musculus
caagttattattatgcaaccacaag

SEQ ID NO: 553437 - DNA, 25 bp, Mus musculus
caagttattattttgcaaccacaag

SEQ ID NO: 553438 - DNA, 25 bp, Mus musculus
caagttattcgaacggttgagaaaa

SEQ ID NO: 553439 - DNA, 25 bp, Mus musculus
caagttattcgatcggttgagaaaa

SEQ ID NO: 553440 - DNA, 25 bp, Mus musculus
caagttattgctactgaggatctgg

SEQ ID NO: 553441 - DNA, 25 bp, Mus musculus
caagttattgcttctgaggatctgg

SEQ ID NO: 553442 - DNA, 25 bp, Mus musculus
caagttcaaagcaacttatgatggc

SEQ ID NO: 553443 - DNA, 25 bp, Mus musculus
caagttcaaagctacttatgatggc

SEQ ID NO: 553444 - DNA, 25 bp, Mus musculus
caagttcaagaccaagaacctctct

SEQ ID NO: 553445 - DNA, 25 bp, Mus musculus
caagttcaagacgaagaacctctct

SEQ ID NO: 553446 - DNA, 25 bp, Mus musculus
caagttcaagcaccagcatgaggac

SEQ ID NO: 553447 - DNA, 25 bp, Mus musculus
caagttcaagcagcagcatgaggac

SEQ ID NO: 553448 - DNA, 25 bp, Mus musculus
caagttcaagctcgctatcctcatc

SEQ ID NO: 553449 - DNA, 25 bp, Mus musculus
caagttcaagctggctatcctcatc

SEQ ID NO: 553450 - DNA, 25 bp, Mus musculus
caagttcaaggactattgtccccag

SEQ ID NO: 553451 - DNA, 25 bp, Mus musculus
caagttcaaggagtattgtccccag

SEQ ID NO: 553452 - DNA, 25 bp, Mus musculus
caagttcaatctcaagtgtggctca

SEQ ID NO: 553453 - DNA, 25 bp, Mus musculus
caagttcaatctgaagtgtggctca

SEQ ID NO: 553454 - DNA, 25 bp, Mus musculus
caagttcacagtctatgaccatggt

SEQ ID NO: 553455 - DNA, 25 bp, Mus musculus
caagttcacagtgtatgaccatggt

SEQ ID NO: 553456 - DNA, 25 bp, Mus musculus
caagttcacgatcgactgcgcagcg

SEQ ID NO: 553457 - DNA, 25 bp, Mus musculus
caagttcacgatggactgcgcagcg

SEQ ID NO: 553458 - DNA, 25 bp, Mus musculus
caagttcacgttctctgagatcaag

SEQ ID NO: 553459 - DNA, 25 bp, Mus musculus
caagttcacgttgtctgagatcaag

SEQ ID NO: 553460 - DNA, 25 bp, Mus musculus
caagttcaggttcctttaggtgacg

SEQ ID NO: 553461 - DNA, 25 bp, Mus musculus
caagttcaggttgctttaggtgacg

SEQ ID NO: 553462 - DNA, 25 bp, Mus musculus
caagttcagtgccatgaagtacgag

SEQ ID NO: 553463 - DNA, 25 bp, Mus musculus
caagttcagtgcgatgaagtacgag

SEQ ID NO: 553464 - DNA, 25 bp, Mus musculus
caagttcatcccaagccaggctaag

SEQ ID NO: 553465 - DNA, 25 bp, Mus musculus
caagttcatccctagccaggctaag

SEQ ID NO: 553466 - DNA, 25 bp, Mus musculus
caagttcatgaccaatgagactcgg

SEQ ID NO: 553467 - DNA, 25 bp, Mus musculus
caagttcatgacgaatgagactcgg

SEQ ID NO: 553468 - DNA, 25 bp, Mus musculus
caagttcatgatagagctggacggg

SEQ ID NO: 553469 - DNA, 25 bp, Mus musculus
caagttcatgattgagctggacggg

SEQ ID NO: 553470 - DNA, 25 bp, Mus musculus
caagttccacaacctgaaggcagtg

SEQ ID NO: 553471 - DNA, 25 bp, Mus musculus
caagttccacaagctgaaggcagtg

SEQ ID NO: 553472 - DNA, 25 bp, Mus musculus
caagttccactacatggtgcacacg

SEQ ID NO: 553473 - DNA, 25 bp, Mus musculus
caagttccactagatggtgcacacg

SEQ ID NO: 553474 - DNA, 25 bp, Mus musculus
caagttccagctattggcgtcccct

SEQ ID NO: 553475 - DNA, 25 bp, Mus musculus
caagttccagcttttggcgtcccct

SEQ ID NO: 553476 - DNA, 25 bp, Mus musculus
caagttccccagacattgagtctga

SEQ ID NO: 553477 - DNA, 25 bp, Mus musculus
caagttccccagtcattgagtctga

SEQ ID NO: 553478 - DNA, 25 bp, Mus musculus
caagttccctagctagaagacctgg

SEQ ID NO: 553479 - DNA, 25 bp, Mus musculus
caagttccctaggtagaagacctgg

SEQ ID NO: 553480 - DNA, 25 bp, Mus musculus
caagttccgcagcaatgagcgagcc

SEQ ID NO: 553481 - DNA, 25 bp, Mus musculus
caagttccgcaggaatgagcgagcc

SEQ ID NO: 553482 - DNA, 25 bp, Mus musculus
caagttccgggccaaaggccgcaag

SEQ ID NO: 553483 - DNA, 25 bp, Mus musculus
caagttccgggcgaaaggccgcaag

SEQ ID NO: 553484 - DNA, 25 bp, Mus musculus
caagttcgactgaacgagctcttac

SEQ ID NO: 553485 - DNA, 25 bp, Mus musculus
caagttcgactgtacgagctcttac

SEQ ID NO: 553486 - DNA, 25 bp, Mus musculus
caagttcgatgtctctctgctacac

SEQ ID NO: 553487 - DNA, 25 bp, Mus musculus
caagttcgatgtgtctctgctacac

SEQ ID NO: 553488 - DNA, 25 bp, Mus musculus
caagttcgggaacaagacgttgtca

SEQ ID NO: 553489 - DNA, 25 bp, Mus musculus
caagttcgggaagaagacgttgtca

SEQ ID NO: 553490 - DNA, 25 bp, Mus musculus
caagttctacagcaagttggatcag

SEQ ID NO: 553491 - DNA, 25 bp, Mus musculus
caagttctacaggaagttggatcag

SEQ ID NO: 553492 - DNA, 25 bp, Mus musculus
caagttctacggagtctgtgtggag

SEQ ID NO: 553493 - DNA, 25 bp, Mus musculus
caagttctacggtgtctgtgtggag

SEQ ID NO: 553494 - DNA, 25 bp, Mus musculus
caagttctatgtcgaggagttgaag

SEQ ID NO: 553495 - DNA, 25 bp, Mus musculus
caagttctatgtggaggagttgaag

SEQ ID NO: 553496 - DNA, 25 bp, Mus musculus
caagttctcaagacacagggccact

SEQ ID NO: 553497 - DNA, 25 bp, Mus musculus
caagttctcaagtcacagggccact

SEQ ID NO: 553498 - DNA, 25 bp, Mus musculus
caagttctcacaaaggttctgtgct

SEQ ID NO: 553499 - DNA, 25 bp, Mus musculus
caagttctcacataggttctgtgct

SEQ ID NO: 553500 - DNA, 25 bp, Mus musculus
caagttctcaggcaggtgaccgtag

SEQ ID NO: 553501 - DNA, 25 bp, Mus musculus
caagttctcagggaggtgaccgtag

SEQ ID NO: 553502 - DNA, 25 bp, Mus musculus
caagttctcggcaaagcagcaggct

SEQ ID NO: 553503 - DNA, 25 bp, Mus musculus
caagttctcggctaagcagcaggct

SEQ ID NO: 553504 - DNA, 25 bp, Mus musculus
caagttctgacaaatctatggcatc

SEQ ID NO: 553505 - DNA, 25 bp, Mus musculus
caagttctgacatatctatggcatc

SEQ ID NO: 553506 - DNA, 25 bp, Mus musculus
caagttctgggtaaaggagctgcgc

SEQ ID NO: 553507 - DNA, 25 bp, Mus musculus
caagttctgggtcgtggatcagacc

SEQ ID NO: 553508 - DNA, 25 bp, Mus musculus
caagttctgggtggtggatcagacc

SEQ ID NO: 553509 - DNA, 25 bp, Mus musculus
caagttctgggttaaggagctgcgc

SEQ ID NO: 553510 - DNA, 25 bp, Mus musculus
caagttctggttcgagatgaattca

SEQ ID NO: 553511 - DNA, 25 bp, Mus musculus
caagttctggttggagatgaattca

SEQ ID NO: 553512 - DNA, 25 bp, Mus musculus
caagttctgtgtcgagcggctctct

SEQ ID NO: 553513 - DNA, 25 bp, Mus musculus
caagttctgtgtggagcggctctct

SEQ ID NO: 553514 - DNA, 25 bp, Mus musculus
caagttcttagtccgggcttcctat

SEQ ID NO: 553515 - DNA, 25 bp, Mus musculus
caagttcttagtgcgggcttcctat

SEQ ID NO: 553516 - DNA, 25 bp, Mus musculus
caagttcttctacagtatcacatcg

SEQ ID NO: 553517 - DNA, 25 bp, Mus musculus
caagttcttctagagtatcacatcg

SEQ ID NO: 553518 - DNA, 25 bp, Mus musculus
caagttctttgccttggctgccgtg

SEQ ID NO: 553519 - DNA, 25 bp, Mus musculus
caagttctttgcgttggctgccgtg

SEQ ID NO: 553520 - DNA, 25 bp, Mus musculus
caagttgaagaaattgtttatctgg

SEQ ID NO: 553521 - DNA, 25 bp, Mus musculus
caagttgaagaatttgtttatctgg

SEQ ID NO: 553522 - DNA, 25 bp, Mus musculus
caagttgacacaaacggacctcaaa

SEQ ID NO: 553523 - DNA, 25 bp, Mus musculus
caagttgacacatacggacctcaaa

SEQ ID NO: 553524 - DNA, 25 bp, Mus musculus
caagttgacctcagagaaatgaagt

SEQ ID NO: 553525 - DNA, 25 bp, Mus musculus
caagttgacctccacggtgatgcta

SEQ ID NO: 553526 - DNA, 25 bp, Mus musculus
caagttgacctcgacggtgatgcta

SEQ ID NO: 553527 - DNA, 25 bp, Mus musculus
caagttgacctctgagaaatgaagt

SEQ ID NO: 553528 - DNA, 25 bp, Mus musculus
caagttgacgagaggacatgtgtcc

SEQ ID NO: 553529 - DNA, 25 bp, Mus musculus
caagttgacgagtggacatgtgtcc

SEQ ID NO: 553530 - DNA, 25 bp, Mus musculus
caagttgaggaccaagcaagccagc

SEQ ID NO: 553531 - DNA, 25 bp, Mus musculus
caagttgaggacgaagcaagccagc

SEQ ID NO: 553532 - DNA, 25 bp, Mus musculus
caagttgagtacctccttattcatg

SEQ ID NO: 553533 - DNA, 25 bp, Mus musculus
caagttgagtacgtccttattcatg

SEQ ID NO: 553534 - DNA, 25 bp, Mus musculus
caagttgataaacaaagcactgtgc

SEQ ID NO: 553535 - DNA, 25 bp, Mus musculus
caagttgataaagaaagcactgtgc

SEQ ID NO: 553536 - DNA, 25 bp, Mus musculus
caagttgatgatcgaaaggaatggt

SEQ ID NO: 553537 - DNA, 25 bp, Mus musculus
caagttgatgatggaaaggaatggt

SEQ ID NO: 553538 - DNA, 25 bp, Mus musculus
caagttgatgctcttaaagatgttc

SEQ ID NO: 553539 - DNA, 25 bp, Mus musculus
caagttgatgctgttaaagatgttc

SEQ ID NO: 553540 - DNA, 25 bp, Mus musculus
caagttgctggaccccattagagag

SEQ ID NO: 553541 - DNA, 25 bp, Mus musculus
caagttgctggagcccattagagag

SEQ ID NO: 553542 - DNA, 25 bp, Mus musculus
caagttggaaaacgagtatgaccgg

SEQ ID NO: 553543 - DNA, 25 bp, Mus musculus
caagttggaaaaggagtatgaccgg

SEQ ID NO: 553544 - DNA, 25 bp, Mus musculus
caagttggcacgctggacctgctgt

SEQ ID NO: 553545 - DNA, 25 bp, Mus musculus
caagttggcacggtggacctgctgt

SEQ ID NO: 553546 - DNA, 25 bp, Mus musculus
caagttggcgggagcctataaaagc

SEQ ID NO: 553547 - DNA, 25 bp, Mus musculus
caagttggcgggtgcctataaaagc

SEQ ID NO: 553548 - DNA, 25 bp, Mus musculus
caagttggcgtgaagataaatggcc

SEQ ID NO: 553549 - DNA, 25 bp, Mus musculus
caagttggcgtgtagataaatggcc

SEQ ID NO: 553550 - DNA, 25 bp, Mus musculus
caagttggctccctggatccagaga

SEQ ID NO: 553551 - DNA, 25 bp, Mus musculus
caagttggctccgtggatccagaga

SEQ ID NO: 553552 - DNA, 25 bp, Mus musculus
caagttgggtttcatagcccagagc

SEQ ID NO: 553553 - DNA, 25 bp, Mus musculus
caagttgggtttcccgagagccaga

SEQ ID NO: 553554 - DNA, 25 bp, Mus musculus
caagttgggtttgatagcccagagc

SEQ ID NO: 553555 - DNA, 25 bp, Mus musculus
caagttgggtttgccgagagccaga

SEQ ID NO: 553556 - DNA, 25 bp, Mus musculus
caagttggtgagctagctaaggtca

SEQ ID NO: 553557 - DNA, 25 bp, Mus musculus
caagttggtgaggtagctaaggtca

SEQ ID NO: 553558 - DNA, 25 bp, Mus musculus
caagttggtgatccctacatccagg

SEQ ID NO: 553559 - DNA, 25 bp, Mus musculus
caagttggtgatgcctacatccagg

SEQ ID NO: 553560 - DNA, 25 bp, Mus musculus
caagttggtggaaaaagacaacagg

SEQ ID NO: 553561 - DNA, 25 bp, Mus musculus
caagttggtggataaagacaacagg

SEQ ID NO: 553562 - DNA, 25 bp, Mus musculus
caagttggttaaagcagatggagag

SEQ ID NO: 553563 - DNA, 25 bp, Mus musculus
caagttggttaatgcagatggagag

SEQ ID NO: 553564 - DNA, 25 bp, Mus musculus
caagttgtactgcagaatgtatcag

SEQ ID NO: 553565 - DNA, 25 bp, Mus musculus
caagttgtactggagaatgtatcag

SEQ ID NO: 553566 - DNA, 25 bp, Mus musculus
caagttgtcaccaagaaagaaaggt

SEQ ID NO: 553567 - DNA, 25 bp, Mus musculus
caagttgtcacctagaaagaaaggt

SEQ ID NO: 553568 - DNA, 25 bp, Mus musculus
caagttgtcagaagcagacctccgg

SEQ ID NO: 553569 - DNA, 25 bp, Mus musculus
caagttgtcagatgcagacctccgg

SEQ ID NO: 553570 - DNA, 25 bp, Mus musculus
caagttgtgattcctgcctggtaca

SEQ ID NO: 553571 - DNA, 25 bp, Mus musculus
caagttgtgattgctgcctggtaca

SEQ ID NO: 553572 - DNA, 25 bp, Mus musculus
caagttgtgtctccgtacgactctg

SEQ ID NO: 553573 - DNA, 25 bp, Mus musculus
caagttgtgtctgcgtacgactctg

SEQ ID NO: 553574 - DNA, 25 bp, Mus musculus
caagttgtgttactagatacactgg

SEQ ID NO: 553575 - DNA, 25 bp, Mus musculus
caagttgtgttagtagatacactgg

SEQ ID NO: 553576 - DNA, 25 bp, Mus musculus
caagttgttggtagggaacaaatgt

SEQ ID NO: 553577 - DNA, 25 bp, Mus musculus
caagttgttggttgggaacaaatgt

SEQ ID NO: 553578 - DNA, 25 bp, Mus musculus
caagttgtttggcttttctgaacca

SEQ ID NO: 553579 - DNA, 25 bp, Mus musculus
caagttgtttgggttttctgaacca

SEQ ID NO: 553580 - DNA, 25 bp, Mus musculus
caagtttaaaaacagcgcgctggcg

SEQ ID NO: 553581 - DNA, 25 bp, Mus musculus
caagtttaaaaagagcgcgctggcg

SEQ ID NO: 553582 - DNA, 25 bp, Mus musculus
caagtttaaagacaccatcgagaag

SEQ ID NO: 553583 - DNA, 25 bp, Mus musculus
caagtttaaagagaccatcgagaag

SEQ ID NO: 553584 - DNA, 25 bp, Mus musculus
caagtttaagagacctgttggcttt

SEQ ID NO: 553585 - DNA, 25 bp, Mus musculus
caagtttaagagtcctgttggcttt

SEQ ID NO: 553586 - DNA, 25 bp, Mus musculus
caagtttaagcacatcaccaaaggg

SEQ ID NO: 553587 - DNA, 25 bp, Mus musculus
caagtttaagcagatcaccaaaggg

SEQ ID NO: 553588 - DNA, 25 bp, Mus musculus
caagtttaatggattccacctgcca

SEQ ID NO: 553589 - DNA, 25 bp, Mus musculus
caagtttaatggtttccacctgcca

SEQ ID NO: 553590 - DNA, 25 bp, Mus musculus
caagtttaccccaggctcagctggc

SEQ ID NO: 553591 - DNA, 25 bp, Mus musculus
caagtttacccctggctcagctggc

SEQ ID NO: 553592 - DNA, 25 bp, Mus musculus
caagtttatgtacacaaattggctg

SEQ ID NO: 553593 - DNA, 25 bp, Mus musculus
caagtttatgtagacaaattggctg

SEQ ID NO: 553594 - DNA, 25 bp, Mus musculus
caagtttcaagaattcagccctaac

SEQ ID NO: 553595 - DNA, 25 bp, Mus musculus
caagtttcaagatttcagccctaac

SEQ ID NO: 553596 - DNA, 25 bp, Mus musculus
caagtttcatgaagtggtccattcc

SEQ ID NO: 553597 - DNA, 25 bp, Mus musculus
caagtttcatgatgtggtccattcc

SEQ ID NO: 553598 - DNA, 25 bp, Mus musculus
caagtttccggccttgcacagtgcc

SEQ ID NO: 553599 - DNA, 25 bp, Mus musculus
caagtttccggcgttgcacagtgcc

SEQ ID NO: 553600 - DNA, 25 bp, Mus musculus
caagtttctgcaaaagttggatttt

SEQ ID NO: 553601 - DNA, 25 bp, Mus musculus
caagtttctgcataagttggatttt

SEQ ID NO: 553602 - DNA, 25 bp, Mus musculus
caagtttctggtagatggaaaatac

SEQ ID NO: 553603 - DNA, 25 bp, Mus musculus
caagtttctggttgatggaaaatac

SEQ ID NO: 553604 - DNA, 25 bp, Mus musculus
caagtttgaaaccatgatcatagac

SEQ ID NO: 553605 - DNA, 25 bp, Mus musculus
caagtttgaaacgatgatcatagac

SEQ ID NO: 553606 - DNA, 25 bp, Mus musculus
caagtttgaaataaaagcaacagct

SEQ ID NO: 553607 - DNA, 25 bp, Mus musculus
caagtttgaaattaaagcaacagct

SEQ ID NO: 553608 - DNA, 25 bp, Mus musculus
caagtttgacaccaaaggcatcgag

SEQ ID NO: 553609 - DNA, 25 bp, Mus musculus
caagtttgacacgaaaggcatcgag

SEQ ID NO: 553610 - DNA, 25 bp, Mus musculus
caagtttgacatagggaaggacacc

SEQ ID NO: 553611 - DNA, 25 bp, Mus musculus
caagtttgacattgggaaggacacc

SEQ ID NO: 553612 - DNA, 25 bp, Mus musculus
caagtttgaccaagcaatggtagct

SEQ ID NO: 553613 - DNA, 25 bp, Mus musculus
caagtttgaccatgcaatggtagct

SEQ ID NO: 553614 - DNA, 25 bp, Mus musculus
caagtttgaggaactaaataagcgc

SEQ ID NO: 553615 - DNA, 25 bp, Mus musculus
caagtttgaggatctaaataagcgc

SEQ ID NO: 553616 - DNA, 25 bp, Mus musculus
caagtttgatttattagtcgatacc

SEQ ID NO: 553617 - DNA, 25 bp, Mus musculus
caagtttgattttttagtcgatacc

SEQ ID NO: 553618 - DNA, 25 bp, Mus musculus
caagtttgccctccgcggccttggg

SEQ ID NO: 553619 - DNA, 25 bp, Mus musculus
caagtttgccctgcgcggccttggg

SEQ ID NO: 553620 - DNA, 25 bp, Mus musculus
caagtttgcggaaggaggacagaaa

SEQ ID NO: 553621 - DNA, 25 bp, Mus musculus
caagtttgcggatggaggacagaaa

SEQ ID NO: 553622 - DNA, 25 bp, Mus musculus
caagtttggataatgagtggaaaga

SEQ ID NO: 553623 - DNA, 25 bp, Mus musculus
caagtttggatattgagtggaaaga

SEQ ID NO: 553624 - DNA, 25 bp, Mus musculus
caagtttggccacaagatgcttgag

SEQ ID NO: 553625 - DNA, 25 bp, Mus musculus
caagtttggccagaagatgcttgag

SEQ ID NO: 553626 - DNA, 25 bp, Mus musculus
caagtttggcctcattggtgttcaa

SEQ ID NO: 553627 - DNA, 25 bp, Mus musculus
caagtttggcctgattggtgttcaa

SEQ ID NO: 553628 - DNA, 25 bp, Mus musculus
caagtttgtcaacgtcttttggatc

SEQ ID NO: 553629 - DNA, 25 bp, Mus musculus
caagtttgtcaaggtcttttggatc

SEQ ID NO: 553630 - DNA, 25 bp, Mus musculus
caagtttgtcttagacgctgtcacc

SEQ ID NO: 553631 - DNA, 25 bp, Mus musculus
caagtttgtctttgacgctgtcacc

SEQ ID NO: 553632 - DNA, 25 bp, Mus musculus
caagtttgttccaaacctgcccaag

SEQ ID NO: 553633 - DNA, 25 bp, Mus musculus
caagtttgttcctaacctgcccaag

SEQ ID NO: 553634 - DNA, 25 bp, Mus musculus
caagttttgaggcaggttatccaca

SEQ ID NO: 553635 - DNA, 25 bp, Mus musculus
caagttttgagggaggttatccaca

SEQ ID NO: 553636 - DNA, 25 bp, Mus musculus
caagttttgccacaacaagtgagca

SEQ ID NO: 553637 - DNA, 25 bp, Mus musculus
caagttttgccagaacaagtgagca

SEQ ID NO: 553638 - DNA, 25 bp, Mus musculus
caagtttttcctaatggtgaacaag

SEQ ID NO: 553639 - DNA, 25 bp, Mus musculus
caagtttttccttatggtgaacaag

SEQ ID NO: 553640 - DNA, 25 bp, Mus musculus
caagtttttcttcccttagatgatg

SEQ ID NO: 553641 - DNA, 25 bp, Mus musculus
caagtttttcttgccttagatgatg

SEQ ID NO: 553642 - DNA, 25 bp, Mus musculus
caagtttttgaaatccccagtggag

SEQ ID NO: 553643 - DNA, 25 bp, Mus musculus
caagtttttgaattccccagtggag

SEQ ID NO: 553644 - DNA, 25 bp, Mus musculus
caataaaaaggacccgcacttatct

SEQ ID NO: 553645 - DNA, 25 bp, Mus musculus
caataaaaaggagccgcacttatct

SEQ ID NO: 553646 - DNA, 25 bp, Mus musculus
caataaaacattactctgcaatacc

SEQ ID NO: 553647 - DNA, 25 bp, Mus musculus
caataaaacatttctctgcaatacc

SEQ ID NO: 553648 - DNA, 25 bp, Mus musculus
caataaaaggaaagtgcattctgta

SEQ ID NO: 553649 - DNA, 25 bp, Mus musculus
caataaaaggaatgtgcattctgta

SEQ ID NO: 553650 - DNA, 25 bp, Mus musculus
caataaaagtgaattgtgggtgtca

SEQ ID NO: 553651 - DNA, 25 bp, Mus musculus
caataaaagtgatttgtgggtgtca

SEQ ID NO: 553652 - DNA, 25 bp, Mus musculus
caataaactgttcgtggaaccaggg

SEQ ID NO: 553653 - DNA, 25 bp, Mus musculus
caataaactgttggtggaaccaggg

SEQ ID NO: 553654 - DNA, 25 bp, Mus musculus
caataaagataaattcgcaaaggcc

SEQ ID NO: 553655 - DNA, 25 bp, Mus musculus
caataaagataatttcgcaaaggcc

SEQ ID NO: 553656 - DNA, 25 bp, Mus musculus
caataaagatggagacctcgttgac

SEQ ID NO: 553657 - DNA, 25 bp, Mus musculus
caataaagatggtgacctcgttgac

SEQ ID NO: 553658 - DNA, 25 bp, Mus musculus
caataaagcattaagcagtacaatc

SEQ ID NO: 553659 - DNA, 25 bp, Mus musculus
caataaagcatttagcagtacaatc

SEQ ID NO: 553660 - DNA, 25 bp, Mus musculus
caataaagccctattgagaactgtg

SEQ ID NO: 553661 - DNA, 25 bp, Mus musculus
caataaagcccttttgagaactgtg

SEQ ID NO: 553662 - DNA, 25 bp, Mus musculus
caataaagccgaaatccctgagcgc

SEQ ID NO: 553663 - DNA, 25 bp, Mus musculus
caataaagccgatatccctgagcgc

SEQ ID NO: 553664 - DNA, 25 bp, Mus musculus
caataaagcgcacagtgggcgaatc

SEQ ID NO: 553665 - DNA, 25 bp, Mus musculus
caataaagcgcagagtgggcgaatc

SEQ ID NO: 553666 - DNA, 25 bp, Mus musculus
caataaagctatcctggacgacttg

SEQ ID NO: 553667 - DNA, 25 bp, Mus musculus
caataaagctatgctggacgacttg

SEQ ID NO: 553668 - DNA, 25 bp, Mus musculus
caataaagtgaaagataaacctgag

SEQ ID NO: 553669 - DNA, 25 bp, Mus musculus
caataaagtgaatgataaacctgag

SEQ ID NO: 553670 - DNA, 25 bp, Mus musculus
caataaatacgcagaagaacttgcc

SEQ ID NO: 553671 - DNA, 25 bp, Mus musculus
caataaatacgctgaagaacttgcc

SEQ ID NO: 553672 - DNA, 25 bp, Mus musculus
caataaatcatcaatggagagtgaa

SEQ ID NO: 553673 - DNA, 25 bp, Mus musculus
caataaatcatctatggagagtgaa

SEQ ID NO: 553674 - DNA, 25 bp, Mus musculus
caataaatgaaaaggtgccgcagcg

SEQ ID NO: 553675 - DNA, 25 bp, Mus musculus
caataaatgaaatggtgccgcagcg

SEQ ID NO: 553676 - DNA, 25 bp, Mus musculus
caataacaccctactctggaatggt

SEQ ID NO: 553677 - DNA, 25 bp, Mus musculus
caataacacccttctctggaatggt

SEQ ID NO: 553678 - DNA, 25 bp, Mus musculus
caataacatctgcaagagctggccc

SEQ ID NO: 553679 - DNA, 25 bp, Mus musculus
caataacatctggaagagctggccc

SEQ ID NO: 553680 - DNA, 25 bp, Mus musculus
caataacatttcaactctaccagag

SEQ ID NO: 553681 - DNA, 25 bp, Mus musculus
caataacatttctactctaccagag

SEQ ID NO: 553682 - DNA, 25 bp, Mus musculus
caataacgctgaatgtggctgggac

SEQ ID NO: 553683 - DNA, 25 bp, Mus musculus
caataacgctgattgtggctgggac

SEQ ID NO: 553684 - DNA, 25 bp, Mus musculus
caataacgtcatctcaatccaaggc

SEQ ID NO: 553685 - DNA, 25 bp, Mus musculus
caataacgtcatgtcaatccaaggc

SEQ ID NO: 553686 - DNA, 25 bp, Mus musculus
caataacgtctcaggatgcaactgg

SEQ ID NO: 553687 - DNA, 25 bp, Mus musculus
caataacgtctctggatgcaactgg

SEQ ID NO: 553688 - DNA, 25 bp, Mus musculus
caataacgttaaacagtggctgcag

SEQ ID NO: 553689 - DNA, 25 bp, Mus musculus
caataacgttaatcagtggctgcag

SEQ ID NO: 553690 - DNA, 25 bp, Mus musculus
caataagactgtattcaaggctaca

SEQ ID NO: 553691 - DNA, 25 bp, Mus musculus
caataagactgttttcaaggctaca

SEQ ID NO: 553692 - DNA, 25 bp, Mus musculus
caataagcatttagacagttgttta

SEQ ID NO: 553693 - DNA, 25 bp, Mus musculus
caataagcattttgacagttgttta

SEQ ID NO: 553694 - DNA, 25 bp, Mus musculus
caataagcccacacgaggctggctg

SEQ ID NO: 553695 - DNA, 25 bp, Mus musculus
caataagcccactcgaggctggctg

SEQ ID NO: 553696 - DNA, 25 bp, Mus musculus
caataagctggcaccttccggcaag

SEQ ID NO: 553697 - DNA, 25 bp, Mus musculus
caataagctggctccttccggcaag

SEQ ID NO: 553698 - DNA, 25 bp, Mus musculus
caataaggacacctggctgtggtct

SEQ ID NO: 553699 - DNA, 25 bp, Mus musculus
caataaggacacgtggctgtggtct

SEQ ID NO: 553700 - DNA, 25 bp, Mus musculus
caataaggcgttctctctgaaggaa

SEQ ID NO: 553701 - DNA, 25 bp, Mus musculus
caataaggcgttgtctctgaaggaa

SEQ ID NO: 553702 - DNA, 25 bp, Mus musculus
caataagggccacacactggtggta

SEQ ID NO: 553703 - DNA, 25 bp, Mus musculus
caataagggccagacactggtggta

SEQ ID NO: 553704 - DNA, 25 bp, Mus musculus
caataagtacttcctgggcacacca

SEQ ID NO: 553705 - DNA, 25 bp, Mus musculus
caataagtacttgctgggcacacca

SEQ ID NO: 553706 - DNA, 25 bp, Mus musculus
caataagtgacacagatgagtgcac

SEQ ID NO: 553707 - DNA, 25 bp, Mus musculus
caataagtgacagagatgagtgcac

SEQ ID NO: 553708 - DNA, 25 bp, Mus musculus
caataatattgcacccaggctctcc

SEQ ID NO: 553709 - DNA, 25 bp, Mus musculus
caataatattgctcccaggctctcc

SEQ ID NO: 553710 - DNA, 25 bp, Mus musculus
caataatcatggagagaagagagag

SEQ ID NO: 553711 - DNA, 25 bp, Mus musculus
caataatcatggtgagaagagagag

SEQ ID NO: 553712 - DNA, 25 bp, Mus musculus
caataatcttttcggctgccatcca

SEQ ID NO: 553713 - DNA, 25 bp, Mus musculus
caataatcttttgggctgccatcca

SEQ ID NO: 553714 - DNA, 25 bp, Mus musculus
caataatgatatagagcaatggatt

SEQ ID NO: 553715 - DNA, 25 bp, Mus musculus
caataatgatattgagcaatggatt

SEQ ID NO: 553716 - DNA, 25 bp, Mus musculus
caataatgcctaagctggcgtccag

SEQ ID NO: 553717 - DNA, 25 bp, Mus musculus
caataatgcctatgctggcgtccag

SEQ ID NO: 553718 - DNA, 25 bp, Mus musculus
caataattggctcgcagagcgccaa

SEQ ID NO: 553719 - DNA, 25 bp, Mus musculus
caataattggctggcagagcgccaa

SEQ ID NO: 553720 - DNA, 25 bp, Mus musculus
caatacaaagcaagtcatcaccaag

SEQ ID NO: 553721 - DNA, 25 bp, Mus musculus
caatacaaagcaattgtagacagac

SEQ ID NO: 553722 - DNA, 25 bp, Mus musculus
caatacaaagcatgtcatcaccaag

SEQ ID NO: 553723 - DNA, 25 bp, Mus musculus
caatacaaagcatttgtagacagac

SEQ ID NO: 553724 - DNA, 25 bp, Mus musculus
caatacaaaggaacaagagaaagga

SEQ ID NO: 553725 - DNA, 25 bp, Mus musculus
caatacaaaggatcaagagaaagga

SEQ ID NO: 553726 - DNA, 25 bp, Mus musculus
caatacaagtatcatttggcgacag

SEQ ID NO: 553727 - DNA, 25 bp, Mus musculus
caatacaagtatgatttggcgacag

SEQ ID NO: 553728 - DNA, 25 bp, Mus musculus
caatacagagacaatatggtgggtc

SEQ ID NO: 553729 - DNA, 25 bp, Mus musculus
caatacagagactatatggtgggtc

SEQ ID NO: 553730 - DNA, 25 bp, Mus musculus
caatacagatgcaatggtgcacaca

SEQ ID NO: 553731 - DNA, 25 bp, Mus musculus
caatacagatgctatggtgcacaca

SEQ ID NO: 553732 - DNA, 25 bp, Mus musculus
caatacagccctacgggacaacgag

SEQ ID NO: 553733 - DNA, 25 bp, Mus musculus
caatacagcccttcgggacaacgag

SEQ ID NO: 553734 - DNA, 25 bp, Mus musculus
caatacagctggacgtcactgccac

SEQ ID NO: 553735 - DNA, 25 bp, Mus musculus
caatacagctggtcgtcactgccac

SEQ ID NO: 553736 - DNA, 25 bp, Mus musculus
caatacatacctagcattgcactat

SEQ ID NO: 553737 - DNA, 25 bp, Mus musculus
caatacataccttgcattgcactat

SEQ ID NO: 553738 - DNA, 25 bp, Mus musculus
caatacatgcccatggggtgaaaac

SEQ ID NO: 553739 - DNA, 25 bp, Mus musculus
caatacatgcccttggggtgaaaac

SEQ ID NO: 553740 - DNA, 25 bp, Mus musculus
caataccaagccagagaaggcagag

SEQ ID NO: 553741 - DNA, 25 bp, Mus musculus
caataccaagcctgagaaggcagag

SEQ ID NO: 553742 - DNA, 25 bp, Mus musculus
caataccacttcaaagccgagccat

SEQ ID NO: 553743 - DNA, 25 bp, Mus musculus
caataccacttctaagccgagccat

SEQ ID NO: 553744 - DNA, 25 bp, Mus musculus
caataccaggaaaggtctagcctcc

SEQ ID NO: 553745 - DNA, 25 bp, Mus musculus
caataccaggaatggtctagcctcc

SEQ ID NO: 553746 - DNA, 25 bp, Mus musculus
caataccatgtgcttttcttcaaca

SEQ ID NO: 553747 - DNA, 25 bp, Mus musculus
caataccatgtggttttcttcaaca

SEQ ID NO: 553748 - DNA, 25 bp, Mus musculus
caataccattccattgtttgtgcag

SEQ ID NO: 553749 - DNA, 25 bp, Mus musculus
caataccattcctttgtttgtgcag

SEQ ID NO: 553750 - DNA, 25 bp, Mus musculus
caatacccacacattaagaccaaga

SEQ ID NO: 553751 - DNA, 25 bp, Mus musculus
caatacccacactttaagaccaaga

SEQ ID NO: 553752 - DNA, 25 bp, Mus musculus
caataccctgagctatgcaggtgga

SEQ ID NO: 553753 - DNA, 25 bp, Mus musculus
caataccctgaggtatgcaggtgga

SEQ ID NO: 553754 - DNA, 25 bp, Mus musculus
caataccgttcacaagtcttggact

SEQ ID NO: 553755 - DNA, 25 bp, Mus musculus
caataccgttcagaagtcttggact

SEQ ID NO: 553756 - DNA, 25 bp, Mus musculus
caataccgttgcaatttgttgatgc

SEQ ID NO: 553757 - DNA, 25 bp, Mus musculus
caataccgttgctatttgttgatgc

SEQ ID NO: 553758 - DNA, 25 bp, Mus musculus
caatacctacgacctccaggagagc

SEQ ID NO: 553759 - DNA, 25 bp, Mus musculus
caatacctacgagctccaggagagc

SEQ ID NO: 553760 - DNA, 25 bp, Mus musculus
caatacctgcagactccgggaggaa

SEQ ID NO: 553761 - DNA, 25 bp, Mus musculus
caatacctgcagtctccgggaggaa

SEQ ID NO: 553762 - DNA, 25 bp, Mus musculus
caatacctgtttactcgtgtgtcca

SEQ ID NO: 553763 - DNA, 25 bp, Mus musculus
caatacctgttttctcgtgtgtcca

SEQ ID NO: 553764 - DNA, 25 bp, Mus musculus
caataccttgctcaagaaggagtca

SEQ ID NO: 553765 - DNA, 25 bp, Mus musculus
caataccttgctgaagaaggagtca

SEQ ID NO: 553766 - DNA, 25 bp, Mus musculus
caatacgaagttagtggcgttggcc

SEQ ID NO: 553767 - DNA, 25 bp, Mus musculus
caatacgaagtttgtggcgttggcc

SEQ ID NO: 553768 - DNA, 25 bp, Mus musculus
caatacgaggggatgagcacaggcc

SEQ ID NO: 553769 - DNA, 25 bp, Mus musculus
caatacgaggggttgagcacaggcc

SEQ ID NO: 553770 - DNA, 25 bp, Mus musculus
caatacgccgggagtctacacaaaa

SEQ ID NO: 553771 - DNA, 25 bp, Mus musculus
caatacgccgggtgtctacacaaaa

SEQ ID NO: 553772 - DNA, 25 bp, Mus musculus
caatacggagttctggaacccagac

SEQ ID NO: 553773 - DNA, 25 bp, Mus musculus
caatacggagttgtggaacccagac

SEQ ID NO: 553774 - DNA, 25 bp, Mus musculus
caatacggtcttcacgttggtctcg

SEQ ID NO: 553775 - DNA, 25 bp, Mus musculus
caatacggtcttgacgttggtctcg

SEQ ID NO: 553776 - DNA, 25 bp, Mus musculus
caatacggtgtgcagagtcggcttc

SEQ ID NO: 553777 - DNA, 25 bp, Mus musculus
caatacggtgtggagagtcggcttc

SEQ ID NO: 553778 - DNA, 25 bp, Mus musculus
caatactatgaacattaatgcctcc

SEQ ID NO: 553779 - DNA, 25 bp, Mus musculus
caatactatgaagattaatgcctcc

SEQ ID NO: 553780 - DNA, 25 bp, Mus musculus
caatacttccttagatgatgcaata

SEQ ID NO: 553781 - DNA, 25 bp, Mus musculus
caatacttcctttgatgatgcaata

SEQ ID NO: 553782 - DNA, 25 bp, Mus musculus
caatacttctcaaccaagggtggac

SEQ ID NO: 553783 - DNA, 25 bp, Mus musculus
caatacttctcatccaagggtggac

SEQ ID NO: 553784 - DNA, 25 bp, Mus musculus
caatacttttccacactggtgaatt

SEQ ID NO: 553785 - DNA, 25 bp, Mus musculus
caatacttttcctcactggtgaatt

SEQ ID NO: 553786 - DNA, 25 bp, Mus musculus
caatagaaacccagtggaacctagg

SEQ ID NO: 553787 - DNA, 25 bp, Mus musculus
caatagaaaccctgtggaacctagg

SEQ ID NO: 553788 - DNA, 25 bp, Mus musculus
caatagaatctactggtccgacctg

SEQ ID NO: 553789 - DNA, 25 bp, Mus musculus
caatagaatctagtggtccgacctg

SEQ ID NO: 553790 - DNA, 25 bp, Mus musculus
caatagaccagaattgatagacgaa

SEQ ID NO: 553791 - DNA, 25 bp, Mus musculus
caatagaccagatttgatagacgaa

SEQ ID NO: 553792 - DNA, 25 bp, Mus musculus
caatagactaggaactgcagtatca

SEQ ID NO: 553793 - DNA, 25 bp, Mus musculus
caatagactaggtactgcagtatca

SEQ ID NO: 553794 - DNA, 25 bp, Mus musculus
caatagactgacatgggacctcaca

SEQ ID NO: 553795 - DNA, 25 bp, Mus musculus
caatagactgacatttattccaggg

SEQ ID NO: 553796 - DNA, 25 bp, Mus musculus
caatagactgacttgggacctcaca

SEQ ID NO: 553797 - DNA, 25 bp, Mus musculus
caatagactgacttttattccaggg

SEQ ID NO: 553798 - DNA, 25 bp, Mus musculus
caatagatcttgataatccacagga

SEQ ID NO: 553799 - DNA, 25 bp, Mus musculus
caatagatcttgttaatccacagga

SEQ ID NO: 553800 - DNA, 25 bp, Mus musculus
caatagatctttctatggcggctgt

SEQ ID NO: 553801 - DNA, 25 bp, Mus musculus
caatagatctttgtatggcggctgt

SEQ ID NO: 553802 - DNA, 25 bp, Mus musculus
caatagcacaatctggcctgtcttc

SEQ ID NO: 553803 - DNA, 25 bp, Mus musculus
caatagcacaatgtggcctgtcttc

SEQ ID NO: 553804 - DNA, 25 bp, Mus musculus
caatagcactaaaatgcaaccctgt

SEQ ID NO: 553805 - DNA, 25 bp, Mus musculus
caatagcactaatatgcaaccctgt

SEQ ID NO: 553806 - DNA, 25 bp, Mus musculus
caatagccaccactcttagcagaac

SEQ ID NO: 553807 - DNA, 25 bp, Mus musculus
caatagccaccagtcttagcagaac

SEQ ID NO: 553808 - DNA, 25 bp, Mus musculus
caatagcctcctcggctgagctcgg

SEQ ID NO: 553809 - DNA, 25 bp, Mus musculus
caatagcctcctgggctgagctcgg

SEQ ID NO: 553810 - DNA, 25 bp, Mus musculus
caatagcctgagatcaccctgtgta

SEQ ID NO: 553811 - DNA, 25 bp, Mus musculus
caatagcctgagttcaccctgtgta

SEQ ID NO: 553812 - DNA, 25 bp, Mus musculus
caatagcctttgagaaggacatcat

SEQ ID NO: 553813 - DNA, 25 bp, Mus musculus
caatagcctttgtgaaggacatcat

SEQ ID NO: 553814 - DNA, 25 bp, Mus musculus
caatagcggcatcggaaagatgaca

SEQ ID NO: 553815 - DNA, 25 bp, Mus musculus
caatagcggcatgggaaagatgaca

SEQ ID NO: 553816 - DNA, 25 bp, Mus musculus
caataggaaacgacaaaaccttgca

SEQ ID NO: 553817 - DNA, 25 bp, Mus musculus
caataggaaacgtcaaaaccttgca

SEQ ID NO: 553818 - DNA, 25 bp, Mus musculus
caataggaagtaactggaggcagag

SEQ ID NO: 553819 - DNA, 25 bp, Mus musculus
caataggaagtatctggaggcagag

SEQ ID NO: 553820 - DNA, 25 bp, Mus musculus
caataggacccgaaaggcaggagtg

SEQ ID NO: 553821 - DNA, 25 bp, Mus musculus
caataggacccgtaaggcaggagtg

SEQ ID NO: 553822 - DNA, 25 bp, Mus musculus
caataggacctgcaggacaatgtca

SEQ ID NO: 553823 - DNA, 25 bp, Mus musculus
caataggacctggaggacaatgtca

SEQ ID NO: 553824 - DNA, 25 bp, Mus musculus
caataggagttcatgttttctacac

SEQ ID NO: 553825 - DNA, 25 bp, Mus musculus
caataggagttcttgttttctacac

SEQ ID NO: 553826 - DNA, 25 bp, Mus musculus
caatagggacccaggcagagttgct

SEQ ID NO: 553827 - DNA, 25 bp, Mus musculus
caatagggaccctggcagagttgct

SEQ ID NO: 553828 - DNA, 25 bp, Mus musculus
caatagggcttaccgggtaaagcgc

SEQ ID NO: 553829 - DNA, 25 bp, Mus musculus
caatagggcttagcgggtaaagcgc

SEQ ID NO: 553830 - DNA, 25 bp, Mus musculus
caatagtacatacctgacagggcaa

SEQ ID NO: 553831 - DNA, 25 bp, Mus musculus
caatagtacatagctgacagggcaa

SEQ ID NO: 553832 - DNA, 25 bp, Mus musculus
caatagtcaccactaaggtctacag

SEQ ID NO: 553833 - DNA, 25 bp, Mus musculus
caatagtcaccagtaaggtctacag

SEQ ID NO: 553834 - DNA, 25 bp, Mus musculus
caatagtccccgagagcagtaggta

SEQ ID NO: 553835 - DNA, 25 bp, Mus musculus
caatagtccccgtgagcagtaggta

SEQ ID NO: 553836 - DNA, 25 bp, Mus musculus
caatagtgactaagacggtggcagt

SEQ ID NO: 553837 - DNA, 25 bp, Mus musculus
caatagtgactatgacggtggcagt

SEQ ID NO: 553838 - DNA, 25 bp, Mus musculus
caatagtgttttaacttacaacctg

SEQ ID NO: 553839 - DNA, 25 bp, Mus musculus
caatagtgtttttacttacaacctg

SEQ ID NO: 553840 - DNA, 25 bp, Mus musculus
caatagttatcactacctggttcac

SEQ ID NO: 553841 - DNA, 25 bp, Mus musculus
caatagttatcagtacctggttcac

SEQ ID NO: 553842 - DNA, 25 bp, Mus musculus
caatagttgtctcaatccgatgctc

SEQ ID NO: 553843 - DNA, 25 bp, Mus musculus
caatagttgtctgaatccgatgctc

SEQ ID NO: 553844 - DNA, 25 bp, Mus musculus
caatagttttcacgtgttgcccaca

SEQ ID NO: 553845 - DNA, 25 bp, Mus musculus
caatagttttcaggtgttgcccaca

SEQ ID NO: 553846 - DNA, 25 bp, Mus musculus
caatataaagaaactcatggaagac

SEQ ID NO: 553847 - DNA, 25 bp, Mus musculus
caatataaagaatctcatggaagac

SEQ ID NO: 553848 - DNA, 25 bp, Mus musculus
caatataaatccacaagcagcctga

SEQ ID NO: 553849 - DNA, 25 bp, Mus musculus
caatataaatcctcaagcagcctga

SEQ ID NO: 553850 - DNA, 25 bp, Mus musculus
caatataagaaaaaccgaatggagc

SEQ ID NO: 553851 - DNA, 25 bp, Mus musculus
caatataagaaataccgaatggagc

SEQ ID NO: 553852 - DNA, 25 bp, Mus musculus
caatataagctcaaatgctatcaga

SEQ ID NO: 553853 - DNA, 25 bp, Mus musculus
caatataagctctaatgctatcaga

SEQ ID NO: 553854 - DNA, 25 bp, Mus musculus
caatataatgctacgaagcacagga

SEQ ID NO: 553855 - DNA, 25 bp, Mus musculus
caatataatgcttcgaagcacagga

SEQ ID NO: 553856 - DNA, 25 bp, Mus musculus
caatataccagcctagtcccttgga

SEQ ID NO: 553857 - DNA, 25 bp, Mus musculus
caatataccagcgtagtcccttgga

SEQ ID NO: 553858 - DNA, 25 bp, Mus musculus
caatatatgctaattaggctggcct

SEQ ID NO: 553859 - DNA, 25 bp, Mus musculus
caatatatgctatttaggctggcct

SEQ ID NO: 553860 - DNA, 25 bp, Mus musculus
caatatcatccaagtgcagacgcta

SEQ ID NO: 553861 - DNA, 25 bp, Mus musculus
caatatcatccatgtgcagacgcta

SEQ ID NO: 553862 - DNA, 25 bp, Mus musculus
caatatccgacaacaacaagacacc

SEQ ID NO: 553863 - DNA, 25 bp, Mus musculus
caatatccgacatcaacaagacacc

SEQ ID NO: 553864 - DNA, 25 bp, Mus musculus
caatatccggacagtcgtaagaggt

SEQ ID NO: 553865 - DNA, 25 bp, Mus musculus
caatatccggactgtcgtaagaggt

SEQ ID NO: 553866 - DNA, 25 bp, Mus musculus
caatatcctgaacttgagcgggaag

SEQ ID NO: 553867 - DNA, 25 bp, Mus musculus
caatatcctgaagttgagcgggaag

SEQ ID NO: 553868 - DNA, 25 bp, Mus musculus
caatatcctgtcatattttccagaa

SEQ ID NO: 553869 - DNA, 25 bp, Mus musculus
caatatcctgtcttattttccagaa

SEQ ID NO: 553870 - DNA, 25 bp, Mus musculus
caatatctacaaacagcagttggga

SEQ ID NO: 553871 - DNA, 25 bp, Mus musculus
caatatctacaatcagcagttggga

SEQ ID NO: 553872 - DNA, 25 bp, Mus musculus
caatatctggtgcagtaagccactc

SEQ ID NO: 553873 - DNA, 25 bp, Mus musculus
caatatctggtggagtaagccactc

SEQ ID NO: 553874 - DNA, 25 bp, Mus musculus
caatatctttgccatggaattctcc

SEQ ID NO: 553875 - DNA, 25 bp, Mus musculus
caatatctttgcgatggaattctcc

SEQ ID NO: 553876 - DNA, 25 bp, Mus musculus
caatatgaagcccaaactgatgtac

SEQ ID NO: 553877 - DNA, 25 bp, Mus musculus
caatatgaagccgaaactgatgtac

SEQ ID NO: 553878 - DNA, 25 bp, Mus musculus
caatatgagtttactggggaccgtg

SEQ ID NO: 553879 - DNA, 25 bp, Mus musculus
caatatgagttttctggggaccgtg

SEQ ID NO: 553880 - DNA, 25 bp, Mus musculus
caatatgatcggagttggagatatg

SEQ ID NO: 553881 - DNA, 25 bp, Mus musculus
caatatgatcggtgttggagatatg

SEQ ID NO: 553882 - DNA, 25 bp, Mus musculus
caatatgcagctctctttgttgtgg

SEQ ID NO: 553883 - DNA, 25 bp, Mus musculus
caatatgcagctgtctttgttgtgg

SEQ ID NO: 553884 - DNA, 25 bp, Mus musculus
caatatgctaccaccaaaggcagct

SEQ ID NO: 553885 - DNA, 25 bp, Mus musculus
caatatgctacctccaaaggcagct

SEQ ID NO: 553886 - DNA, 25 bp, Mus musculus
caatatgcttggagagctccggacc

SEQ ID NO: 553887 - DNA, 25 bp, Mus musculus
caatatgcttggtgagctccggacc

SEQ ID NO: 553888 - DNA, 25 bp, Mus musculus
caatatggaggcagaggactaccgc

SEQ ID NO: 553889 - DNA, 25 bp, Mus musculus
caatatggaggctgaggactaccgc

SEQ ID NO: 553890 - DNA, 25 bp, Mus musculus
caatatgggaatatcttaaagcatg

SEQ ID NO: 553891 - DNA, 25 bp, Mus musculus
caatatgggaatttcttaaagcatg

SEQ ID NO: 553892 - DNA, 25 bp, Mus musculus
caatatgtgcctaggttttcctggc

SEQ ID NO: 553893 - DNA, 25 bp, Mus musculus
caatatgtgccttggttttcctggc

SEQ ID NO: 553894 - DNA, 25 bp, Mus musculus
caatattaagtaatccttggtggac

SEQ ID NO: 553895 - DNA, 25 bp, Mus musculus
caatattaagtattccttggtggac

SEQ ID NO: 553896 - DNA, 25 bp, Mus musculus
caatattacaatcaactcttaaggg

SEQ ID NO: 553897 - DNA, 25 bp, Mus musculus
caatattacaatgaactcttaaggg

SEQ ID NO: 553898 - DNA, 25 bp, Mus musculus
caatattactgcaatcattggagaa

SEQ ID NO: 553899 - DNA, 25 bp, Mus musculus
caatattactgctatcattggagaa

SEQ ID NO: 553900 - DNA, 25 bp, Mus musculus
caatattcatacctttaaaggaagg

SEQ ID NO: 553901 - DNA, 25 bp, Mus musculus
caatattcatacgtttaaaggaagg

SEQ ID NO: 553902 - DNA, 25 bp, Mus musculus
caatattccggacaggagagaaact

SEQ ID NO: 553903 - DNA, 25 bp, Mus musculus
caatattccggagaggagagaaact

SEQ ID NO: 553904 - DNA, 25 bp, Mus musculus
caatattctcagaagacaaattggt

SEQ ID NO: 553905 - DNA, 25 bp, Mus musculus
caatattctcagtagacaaattggt

SEQ ID NO: 553906 - DNA, 25 bp, Mus musculus
caatattgcaagagggaagacgaca

SEQ ID NO: 553907 - DNA, 25 bp, Mus musculus
caatattgcaagtgggaagacgaca

SEQ ID NO: 553908 - DNA, 25 bp, Mus musculus
caatattggcttacaagaggccttg

SEQ ID NO: 553909 - DNA, 25 bp, Mus musculus
caatattggctttcaagaggccttg

SEQ ID NO: 553910 - DNA, 25 bp, Mus musculus
caatattggtgcaggtgtgatccag

SEQ ID NO: 553911 - DNA, 25 bp, Mus musculus
caatattggtgctggtgtgatccag

SEQ ID NO: 553912 - DNA, 25 bp, Mus musculus
caatattgtatactatagtggacag

SEQ ID NO: 553913 - DNA, 25 bp, Mus musculus
caatattgtatagtatagtggacag

SEQ ID NO: 553914 - DNA, 25 bp, Mus musculus
caatattgtatgcaagtatcagcgg

SEQ ID NO: 553915 - DNA, 25 bp, Mus musculus
caatattgtatggaagtatcagcgg

SEQ ID NO: 553916 - DNA, 25 bp, Mus musculus
caatattgtggaagccaaatgggac

SEQ ID NO: 553917 - DNA, 25 bp, Mus musculus
caatattgtggatgccaaatgggac

SEQ ID NO: 553918 - DNA, 25 bp, Mus musculus
caatatttccatcgagacaacaccc

SEQ ID NO: 553919 - DNA, 25 bp, Mus musculus
caatatttccatggagacaacaccc

SEQ ID NO: 553920 - DNA, 25 bp, Mus musculus
caatattttttaatgcagagagatg

SEQ ID NO: 553921 - DNA, 25 bp, Mus musculus
caatattttttattgcagagagatg

SEQ ID NO: 553922 - DNA, 25 bp, Mus musculus
caatcaaaatggagctgtatctctg

SEQ ID NO: 553923 - DNA, 25 bp, Mus musculus
caatcaaaatggtgctgtatctctg

SEQ ID NO: 553924 - DNA, 25 bp, Mus musculus
caatcaaagggcaaaatgacaggcc

SEQ ID NO: 553925 - DNA, 25 bp, Mus musculus
caatcaaagggctaaatgacaggcc

SEQ ID NO: 553926 - DNA, 25 bp, Mus musculus
caatcaacaggacgccgtctacttt

SEQ ID NO: 553927 - DNA, 25 bp, Mus musculus
caatcaacaggaggccgtctacttt

SEQ ID NO: 553928 - DNA, 25 bp, Mus musculus
caatcaacggaaccatcatgcctgt

SEQ ID NO: 553929 - DNA, 25 bp, Mus musculus
caatcaacggaagcatcatgcctgt

SEQ ID NO: 553930 - DNA, 25 bp, Mus musculus
caatcaagcgctctacagtgggttg

SEQ ID NO: 553931 - DNA, 25 bp, Mus musculus
caatcaagcgctgtacagtgggttg

SEQ ID NO: 553932 - DNA, 25 bp, Mus musculus
caatcaagtctgacgtatggtcttt

SEQ ID NO: 553933 - DNA, 25 bp, Mus musculus
caatcaagtctgtcgtatggtcttt

SEQ ID NO: 553934 - DNA, 25 bp, Mus musculus
caatcaataattacagactgggtcg

SEQ ID NO: 553935 - DNA, 25 bp, Mus musculus
caatcaataatttcagactgggtcg

SEQ ID NO: 553936 - DNA, 25 bp, Mus musculus
caatcaataggtcctgggacctgga

SEQ ID NO: 553937 - DNA, 25 bp, Mus musculus
caatcaataggtgctgggacctgga

SEQ ID NO: 553938 - DNA, 25 bp, Mus musculus
caatcaattcagctgtggaggccgt

SEQ ID NO: 553939 - DNA, 25 bp, Mus musculus
caatcaattcaggtgtggaggccgt

SEQ ID NO: 553940 - DNA, 25 bp, Mus musculus
caatcaattctcagcgacagaacgg

SEQ ID NO: 553941 - DNA, 25 bp, Mus musculus
caatcaattctctgcgacagaacgg

SEQ ID NO: 553942 - DNA, 25 bp, Mus musculus
caatcacacgaaaattttatgcctt

SEQ ID NO: 553943 - DNA, 25 bp, Mus musculus
caatcacacgaatattttatgcctt

SEQ ID NO: 553944 - DNA, 25 bp, Mus musculus
caatcaccaacactattaaacagca

SEQ ID NO: 553945 - DNA, 25 bp, Mus musculus
caatcaccaacagtattaaacagca

SEQ ID NO: 553946 - DNA, 25 bp, Mus musculus
caatcacctctgagaaaatcaagga

SEQ ID NO: 553947 - DNA, 25 bp, Mus musculus
caatcacctctgtgaaaatcaagga

SEQ ID NO: 553948 - DNA, 25 bp, Mus musculus
caatcacgatccaacgaaaggctgg

SEQ ID NO: 553949 - DNA, 25 bp, Mus musculus
caatcacgatcctacgaaaggctgg

SEQ ID NO: 553950 - DNA, 25 bp, Mus musculus
caatcactggaccaagtgaagaatt

SEQ ID NO: 553951 - DNA, 25 bp, Mus musculus
caatcactggacgaagtgaagaatt

SEQ ID NO: 553952 - DNA, 25 bp, Mus musculus
caatcacttccacttattacagagg

SEQ ID NO: 553953 - DNA, 25 bp, Mus musculus
caatcacttccagttattacagagg

SEQ ID NO: 553954 - DNA, 25 bp, Mus musculus
caatcagacacccagcagtgttaca

SEQ ID NO: 553955 - DNA, 25 bp, Mus musculus
caatcagacaccgagcagtgttaca

SEQ ID NO: 553956 - DNA, 25 bp, Mus musculus
caatcagactgacgacttagggcca

SEQ ID NO: 553957 - DNA, 25 bp, Mus musculus
caatcagactgaggacttagggcca

SEQ ID NO: 553958 - DNA, 25 bp, Mus musculus
caatcagatctgcacaccctggcta

SEQ ID NO: 553959 - DNA, 25 bp, Mus musculus
caatcagatctggacaccctggcta

SEQ ID NO: 553960 - DNA, 25 bp, Mus musculus
caatcagatgctcagggaacgctgt

SEQ ID NO: 553961 - DNA, 25 bp, Mus musculus
caatcagatgctgagggaacgctgt

SEQ ID NO: 553962 - DNA, 25 bp, Mus musculus
caatcagatgggaggagcatgttat

SEQ ID NO: 553963 - DNA, 25 bp, Mus musculus
caatcagatgggtggagcatgttat

SEQ ID NO: 553964 - DNA, 25 bp, Mus musculus
caatcagcctggaggaataagaatt

SEQ ID NO: 553965 - DNA, 25 bp, Mus musculus
caatcagcctggtggaataagaatt

SEQ ID NO: 553966 - DNA, 25 bp, Mus musculus
caatcagcggctagaggttgattac

SEQ ID NO: 553967 - DNA, 25 bp, Mus musculus
caatcagcggcttgaggttgattac

SEQ ID NO: 553968 - DNA, 25 bp, Mus musculus
caatcaggaagacgatctccgggaa

SEQ ID NO: 553969 - DNA, 25 bp, Mus musculus
caatcaggaagaggatctccgggaa

SEQ ID NO: 553970 - DNA, 25 bp, Mus musculus
caatcaggacatcgatgaggatggc

SEQ ID NO: 553971 - DNA, 25 bp, Mus musculus
caatcaggacatggatgaggatggc

SEQ ID NO: 553972 - DNA, 25 bp, Mus musculus
caatcaggagaaacccagctggaaa

SEQ ID NO: 553973 - DNA, 25 bp, Mus musculus
caatcaggagaatcccagctggaaa

SEQ ID NO: 553974 - DNA, 25 bp, Mus musculus
caatcaggtgatcatgatgaaggag

SEQ ID NO: 553975 - DNA, 25 bp, Mus musculus
caatcaggtgatgatgatgaaggag

SEQ ID NO: 553976 - DNA, 25 bp, Mus musculus
caatcaggtgtcctgtaacagtccc

SEQ ID NO: 553977 - DNA, 25 bp, Mus musculus
caatcaggtgtcgtgtaacagtccc

SEQ ID NO: 553978 - DNA, 25 bp, Mus musculus
caatcaggttgtatactggagtcac

SEQ ID NO: 553979 - DNA, 25 bp, Mus musculus
caatcaggttgtttactggagtcac

SEQ ID NO: 553980 - DNA, 25 bp, Mus musculus
caatcagtatgacatggtgtaaaga

SEQ ID NO: 553981 - DNA, 25 bp, Mus musculus
caatcagtatgagatggtgtaaaga

SEQ ID NO: 553982 - DNA, 25 bp, Mus musculus
caatcagtgagactctaaaagcccc

SEQ ID NO: 553983 - DNA, 25 bp, Mus musculus
caatcagtgagagtctaaaagcccc

SEQ ID NO: 553984 - DNA, 25 bp, Mus musculus
caatcagtgcataccatgcagaagg

SEQ ID NO: 553985 - DNA, 25 bp, Mus musculus
caatcagtgcatccggtgacagcct

SEQ ID NO: 553986 - DNA, 25 bp, Mus musculus
caatcagtgcatgcggtgacagcct

SEQ ID NO: 553987 - DNA, 25 bp, Mus musculus
caatcagtgcattccatgcagaagg

SEQ ID NO: 553988 - DNA, 25 bp, Mus musculus
caatcagtgcccatgagctgcaccg

SEQ ID NO: 553989 - DNA, 25 bp, Mus musculus
caatcagtgcccttgagctgcaccg

SEQ ID NO: 553990 - DNA, 25 bp, Mus musculus
caatcagtttgtacctttaaacaca

SEQ ID NO: 553991 - DNA, 25 bp, Mus musculus
caatcagtttgtcgatcttgaggca

SEQ ID NO: 553992 - DNA, 25 bp, Mus musculus
caatcagtttgtggatcttgaggca

SEQ ID NO: 553993 - DNA, 25 bp, Mus musculus
caatcagtttgttcctttaaacaca

SEQ ID NO: 553994 - DNA, 25 bp, Mus musculus
caatcatactctaggtagtaaacaa

SEQ ID NO: 553995 - DNA, 25 bp, Mus musculus
caatcatactcttggtagtaaacaa

SEQ ID NO: 553996 - DNA, 25 bp, Mus musculus
caatcatatctacttacacaagcgg

SEQ ID NO: 553997 - DNA, 25 bp, Mus musculus
caatcatatctagttacacaagcgg

SEQ ID NO: 553998 - DNA, 25 bp, Mus musculus
caatcatcaccgacagccttagcgt

SEQ ID NO: 553999 - DNA, 25 bp, Mus musculus
caatcatcaccgtcagccttagcgt

SEQ ID NO: 554000 - DNA, 25 bp, Mus musculus
caatcatgaagaagtttcattggga

SEQ ID NO: 554001 - DNA, 25 bp, Mus musculus
caatcatgaagatgtttcattggga

SEQ ID NO: 554002 - DNA, 25 bp, Mus musculus
caatcatgcccgagactctgggtta

SEQ ID NO: 554003 - DNA, 25 bp, Mus musculus
caatcatgcccgtgactctgggtta

SEQ ID NO: 554004 - DNA, 25 bp, Mus musculus
caatcatggcccacatgactgtgga

SEQ ID NO: 554005 - DNA, 25 bp, Mus musculus
caatcatggccctcatgactgtgga

SEQ ID NO: 554006 - DNA, 25 bp, Mus musculus
caatcatgggcaaactgcggagcct

SEQ ID NO: 554007 - DNA, 25 bp, Mus musculus
caatcatgggcatactgcggagcct

SEQ ID NO: 554008 - DNA, 25 bp, Mus musculus
caatcatgtatgctgcccgagacgg

SEQ ID NO: 554009 - DNA, 25 bp, Mus musculus
caatcatgtatggtgcccgagacgg

SEQ ID NO: 554010 - DNA, 25 bp, Mus musculus
caatcatgtcccagtctcttcagaa

SEQ ID NO: 554011 - DNA, 25 bp, Mus musculus
caatcatgtccctgtctcttcagaa

SEQ ID NO: 554012 - DNA, 25 bp, Mus musculus
caatcatgttaccagtgacacaggg

SEQ ID NO: 554013 - DNA, 25 bp, Mus musculus
caatcatgttacgagtgacacaggg

SEQ ID NO: 554014 - DNA, 25 bp, Mus musculus
caatccaagaagatgcttgcatatc

SEQ ID NO: 554015 - DNA, 25 bp, Mus musculus
caatccaagaagttgcttgcatatc

SEQ ID NO: 554016 - DNA, 25 bp, Mus musculus
caatccagaccactgtgaatgctct

SEQ ID NO: 554017 - DNA, 25 bp, Mus musculus
caatccagaccagtgtgaatgctct

SEQ ID NO: 554018 - DNA, 25 bp, Mus musculus
caatccaggcatacaatgaagctgg

SEQ ID NO: 554019 - DNA, 25 bp, Mus musculus
caatccaggcattcaatgaagctgg

SEQ ID NO: 554020 - DNA, 25 bp, Mus musculus
caatccaggtggaaggctctgccgt

SEQ ID NO: 554021 - DNA, 25 bp, Mus musculus
caatccaggtggtaggctctgccgt

SEQ ID NO: 554022 - DNA, 25 bp, Mus musculus
caatccagtcttcaatgaacagttt

SEQ ID NO: 554023 - DNA, 25 bp, Mus musculus
caatccagtcttgaatgaacagttt

SEQ ID NO: 554024 - DNA, 25 bp, Mus musculus
caatccataccactataagagagtg

SEQ ID NO: 554025 - DNA, 25 bp, Mus musculus
caatccataccagtataagagagtg

SEQ ID NO: 554026 - DNA, 25 bp, Mus musculus
caatccatagaactcttggacaggc

SEQ ID NO: 554027 - DNA, 25 bp, Mus musculus
caatccatagaagtcttggacaggc

SEQ ID NO: 554028 - DNA, 25 bp, Mus musculus
caatcccagtgtatggtataccagt

SEQ ID NO: 554029 - DNA, 25 bp, Mus musculus
caatcccagtgtttggtataccagt

SEQ ID NO: 554030 - DNA, 25 bp, Mus musculus
caatcccatgcacagggcaagaggc

SEQ ID NO: 554031 - DNA, 25 bp, Mus musculus
caatcccatgcagagggcaagaggc

SEQ ID NO: 554032 - DNA, 25 bp, Mus musculus
caatccccgtgtctgctgtgcgagg

SEQ ID NO: 554033 - DNA, 25 bp, Mus musculus
caatccccgtgtgtgctgtgcgagg

SEQ ID NO: 554034 - DNA, 25 bp, Mus musculus
caatcccgaaccagaatatccttgt

SEQ ID NO: 554035 - DNA, 25 bp, Mus musculus
caatcccgaacctgaatatccttgt

SEQ ID NO: 554036 - DNA, 25 bp, Mus musculus
caatcccgaatcactaagaccttta

SEQ ID NO: 554037 - DNA, 25 bp, Mus musculus
caatcccgaatctctaagaccttta

SEQ ID NO: 554038 - DNA, 25 bp, Mus musculus
caatcccgagttatgtggaccgcat

SEQ ID NO: 554039 - DNA, 25 bp, Mus musculus
caatcccgagttttgtggaccgcat

SEQ ID NO: 554040 - DNA, 25 bp, Mus musculus
caatcccggaagcacaactccaatt

SEQ ID NO: 554041 - DNA, 25 bp, Mus musculus
caatcccggaaggacaactccaatt

SEQ ID NO: 554042 - DNA, 25 bp, Mus musculus
caatcccgggccagtctgtctcatt

SEQ ID NO: 554043 - DNA, 25 bp, Mus musculus
caatcccgggcctgtctgtctcatt

SEQ ID NO: 554044 - DNA, 25 bp, Mus musculus
caatccctccagaaagtgctacatg

SEQ ID NO: 554045 - DNA, 25 bp, Mus musculus
caatccctccagtaagtgctacatg

SEQ ID NO: 554046 - DNA, 25 bp, Mus musculus
caatccctgaggctctgcctgctgt

SEQ ID NO: 554047 - DNA, 25 bp, Mus musculus
caatccctgagggtctgcctgctgt

SEQ ID NO: 554048 - DNA, 25 bp, Mus musculus
caatccctgcttagctggtgccaag

SEQ ID NO: 554049 - DNA, 25 bp, Mus musculus
caatccctgctttgctggtgccaag

SEQ ID NO: 554050 - DNA, 25 bp, Mus musculus
caatccctgtggcagtctcaagcca

SEQ ID NO: 554051 - DNA, 25 bp, Mus musculus
caatccctgtgggagtctcaagcca

SEQ ID NO: 554052 - DNA, 25 bp, Mus musculus
caatccctgttgatactatccgtgc

SEQ ID NO: 554053 - DNA, 25 bp, Mus musculus
caatccctgttgttactatccgtgc

SEQ ID NO: 554054 - DNA, 25 bp, Mus musculus
caatccgctccacaaggtacaggac

SEQ ID NO: 554055 - DNA, 25 bp, Mus musculus
caatccgctccagaaggtacaggac

SEQ ID NO: 554056 - DNA, 25 bp, Mus musculus
caatccggtcaacatgatctgccaa

SEQ ID NO: 554057 - DNA, 25 bp, Mus musculus
caatccggtcaagatgatctgccaa

SEQ ID NO: 554058 - DNA, 25 bp, Mus musculus
caatccgtttctcgcagctctctga

SEQ ID NO: 554059 - DNA, 25 bp, Mus musculus
caatccgtttctggcagctctctga

SEQ ID NO: 554060 - DNA, 25 bp, Mus musculus
caatcctaagatcctgccagttggg

SEQ ID NO: 554061 - DNA, 25 bp, Mus musculus
caatcctaagatgctgccagttggg

SEQ ID NO: 554062 - DNA, 25 bp, Mus musculus
caatcctacaatcatatacactgtg

SEQ ID NO: 554063 - DNA, 25 bp, Mus musculus
caatcctacaatgatatacactgtg

SEQ ID NO: 554064 - DNA, 25 bp, Mus musculus
caatcctaggaacttccctggaagt

SEQ ID NO: 554065 - DNA, 25 bp, Mus musculus
caatcctaggaagttccctggaagt

SEQ ID NO: 554066 - DNA, 25 bp, Mus musculus
caatcctccagactttactgccatg

SEQ ID NO: 554067 - DNA, 25 bp, Mus musculus
caatcctccagagtttactgccatg

SEQ ID NO: 554068 - DNA, 25 bp, Mus musculus
caatcctcccgtctgtgacagagac

SEQ ID NO: 554069 - DNA, 25 bp, Mus musculus
caatcctcccgtgtgtgacagagac

SEQ ID NO: 554070 - DNA, 25 bp, Mus musculus
caatcctcggagaaaatgcatcatc

SEQ ID NO: 554071 - DNA, 25 bp, Mus musculus
caatcctcggagtaaatgcatcatc

SEQ ID NO: 554072 - DNA, 25 bp, Mus musculus
caatcctgagctaggtgcaagagca

SEQ ID NO: 554073 - DNA, 25 bp, Mus musculus
caatcctgagctccatagaaatgtg

SEQ ID NO: 554074 - DNA, 25 bp, Mus musculus
caatcctgagctgcatagaaatgtg

SEQ ID NO: 554075 - DNA, 25 bp, Mus musculus
caatcctgagcttggtgcaagagca

SEQ ID NO: 554076 - DNA, 25 bp, Mus musculus
caatcctggagtctatgtcaaatga

SEQ ID NO: 554077 - DNA, 25 bp, Mus musculus
caatcctggagtgtatgtcaaatga

SEQ ID NO: 554078 - DNA, 25 bp, Mus musculus
caatcctggtcaatatcttggtcat

SEQ ID NO: 554079 - DNA, 25 bp, Mus musculus
caatcctggtcattatcttggtcat

SEQ ID NO: 554080 - DNA, 25 bp, Mus musculus
caatcctggttgagtgtgcactttt

SEQ ID NO: 554081 - DNA, 25 bp, Mus musculus
caatcctggttgtgtgtgcactttt

SEQ ID NO: 554082 - DNA, 25 bp, Mus musculus
caatcctgtggacgttggcatccag

SEQ ID NO: 554083 - DNA, 25 bp, Mus musculus
caatcctgtggaggttggcatccag

SEQ ID NO: 554084 - DNA, 25 bp, Mus musculus
caatccttacatccctggtacaggg

SEQ ID NO: 554085 - DNA, 25 bp, Mus musculus
caatccttacatgcctggtacaggg

SEQ ID NO: 554086 - DNA, 25 bp, Mus musculus
caatccttggctatacatatgaaat

SEQ ID NO: 554087 - DNA, 25 bp, Mus musculus
caatccttggctttacatatgaaat

SEQ ID NO: 554088 - DNA, 25 bp, Mus musculus
caatcgaaaggtagctgggctccca

SEQ ID NO: 554089 - DNA, 25 bp, Mus musculus
caatcgaaaggttgctgggctccca

SEQ ID NO: 554090 - DNA, 25 bp, Mus musculus
caatcgaaagtacctcatgtgcggg

SEQ ID NO: 554091 - DNA, 25 bp, Mus musculus
caatcgaaagtagctcatgtgcggg

SEQ ID NO: 554092 - DNA, 25 bp, Mus musculus
caatcgaagccccttggtcaagcgg

SEQ ID NO: 554093 - DNA, 25 bp, Mus musculus
caatcgaagcccgttggtcaagcgg

SEQ ID NO: 554094 - DNA, 25 bp, Mus musculus
caatcgaatacaaaggccccatgag

SEQ ID NO: 554095 - DNA, 25 bp, Mus musculus
caatcgaatacataggccccatgag

SEQ ID NO: 554096 - DNA, 25 bp, Mus musculus
caatcgacaacactaaaattgcggt

SEQ ID NO: 554097 - DNA, 25 bp, Mus musculus
caatcgacaacagtaaaattgcggt

SEQ ID NO: 554098 - DNA, 25 bp, Mus musculus
caatcgaccgtccaagatccaggag

SEQ ID NO: 554099 - DNA, 25 bp, Mus musculus
caatcgaccgtcgaagatccaggag

SEQ ID NO: 554100 - DNA, 25 bp, Mus musculus
caatcgagagaaagcagcaaggcct

SEQ ID NO: 554101 - DNA, 25 bp, Mus musculus
caatcgagagaatgcagcaaggcct

SEQ ID NO: 554102 - DNA, 25 bp, Mus musculus
caatcgatgcaacgcatgcatcttt

SEQ ID NO: 554103 - DNA, 25 bp, Mus musculus
caatcgatgcaaggcatgcatcttt

SEQ ID NO: 554104 - DNA, 25 bp, Mus musculus
caatcgcagaagcacgtgggatgta

SEQ ID NO: 554105 - DNA, 25 bp, Mus musculus
caatcgcagaaggacgtgggatgta

SEQ ID NO: 554106 - DNA, 25 bp, Mus musculus
caatcgcgcaccaaaagaagataga

SEQ ID NO: 554107 - DNA, 25 bp, Mus musculus
caatcgcgcacctaaagaagataga

SEQ ID NO: 554108 - DNA, 25 bp, Mus musculus
caatcgctgtcgctctagtttataa

SEQ ID NO: 554109 - DNA, 25 bp, Mus musculus
caatcgctgtcggtctagtttataa

SEQ ID NO: 554110 - DNA, 25 bp, Mus musculus
caatcgctgtgacagctgctacggc

SEQ ID NO: 554111 - DNA, 25 bp, Mus musculus
caatcgctgtgagagctgctacggc

SEQ ID NO: 554112 - DNA, 25 bp, Mus musculus
caatcggaatgcatttcgtctcctg

SEQ ID NO: 554113 - DNA, 25 bp, Mus musculus
caatcggaatgcttttcgtctcctg

SEQ ID NO: 554114 - DNA, 25 bp, Mus musculus
caatcggaggatacgcaacgagaag

SEQ ID NO: 554115 - DNA, 25 bp, Mus musculus
caatcggaggattcgcaacgagaag

SEQ ID NO: 554116 - DNA, 25 bp, Mus musculus
caatcggaggccaccacgacggggc

SEQ ID NO: 554117 - DNA, 25 bp, Mus musculus
caatcggaggcctccacgacggggc

SEQ ID NO: 554118 - DNA, 25 bp, Mus musculus
caatcggagggactaagccaagagt

SEQ ID NO: 554119 - DNA, 25 bp, Mus musculus
caatcggagggagtaagccaagagt

SEQ ID NO: 554120 - DNA, 25 bp, Mus musculus
caatcggataacagcaaacacggaa

SEQ ID NO: 554121 - DNA, 25 bp, Mus musculus
caatcggataactgcaaacacggaa

SEQ ID NO: 554122 - DNA, 25 bp, Mus musculus
caatcggcatctaccttggaggtgg

SEQ ID NO: 554123 - DNA, 25 bp, Mus musculus
caatcggcatctcttcaaagacaag

SEQ ID NO: 554124 - DNA, 25 bp, Mus musculus
caatcggcatctgttcaaagacaag

SEQ ID NO: 554125 - DNA, 25 bp, Mus musculus
caatcggcatcttccttggaggtgg

SEQ ID NO: 554126 - DNA, 25 bp, Mus musculus
caatcggcctatctcgctatggagg

SEQ ID NO: 554127 - DNA, 25 bp, Mus musculus
caatcggcctatgtcgctatggagg

SEQ ID NO: 554128 - DNA, 25 bp, Mus musculus
caatcggtgatgactgctgccggct

SEQ ID NO: 554129 - DNA, 25 bp, Mus musculus
caatcggtgatgtctgctgccggct

SEQ ID NO: 554130 - DNA, 25 bp, Mus musculus
caatcggttaatagttgatgaagcc

SEQ ID NO: 554131 - DNA, 25 bp, Mus musculus
caatcggttaattgttgatgaagcc

SEQ ID NO: 554132 - DNA, 25 bp, Mus musculus
caatcgtcaccaagaatgggcagaa

SEQ ID NO: 554133 - DNA, 25 bp, Mus musculus
caatcgtcaccatgaatgggcagaa

SEQ ID NO: 554134 - DNA, 25 bp, Mus musculus
caatcgtcagcgaaaagggagaggt

SEQ ID NO: 554135 - DNA, 25 bp, Mus musculus
caatcgtcagcgtaaagggagaggt

SEQ ID NO: 554136 - DNA, 25 bp, Mus musculus
caatcgtccacaatggtttcttttg

SEQ ID NO: 554137 - DNA, 25 bp, Mus musculus
caatcgtccacattggtttcttttg

SEQ ID NO: 554138 - DNA, 25 bp, Mus musculus
caatcgtgatttctgtaagtcaacg

SEQ ID NO: 554139 - DNA, 25 bp, Mus musculus
caatcgtgatttgtgtaagtcaacg

SEQ ID NO: 554140 - DNA, 25 bp, Mus musculus
caatcgtgcccgctgtgagagtgaa

SEQ ID NO: 554141 - DNA, 25 bp, Mus musculus
caatcgtgcccggtgtgagagtgaa

SEQ ID NO: 554142 - DNA, 25 bp, Mus musculus
caatcgtggctacggatgcagactc

SEQ ID NO: 554143 - DNA, 25 bp, Mus musculus
caatcgtggctagggatgcagactc

SEQ ID NO: 554144 - DNA, 25 bp, Mus musculus
caatcgtggtagaagccgacgcact

SEQ ID NO: 554145 - DNA, 25 bp, Mus musculus
caatcgtggtagtagccgacgcact

SEQ ID NO: 554146 - DNA, 25 bp, Mus musculus
caatcgttttggaacccgtgaggcg

SEQ ID NO: 554147 - DNA, 25 bp, Mus musculus
caatcgttttggtacccgtgaggcg

SEQ ID NO: 554148 - DNA, 25 bp, Mus musculus
caatctaaattgcaagcccggaaag

SEQ ID NO: 554149 - DNA, 25 bp, Mus musculus
caatctaaattggaagcccggaaag

SEQ ID NO: 554150 - DNA, 25 bp, Mus musculus
caatctacaagaacaaaggtttggc

SEQ ID NO: 554151 - DNA, 25 bp, Mus musculus
caatctacaagatcaaaggtttggc

SEQ ID NO: 554152 - DNA, 25 bp, Mus musculus
caatctagccataaataaaagtgcc

SEQ ID NO: 554153 - DNA, 25 bp, Mus musculus
caatctagccattaataaaagtgcc

SEQ ID NO: 554154 - DNA, 25 bp, Mus musculus
caatctatctctatcgcgtccggtg

SEQ ID NO: 554155 - DNA, 25 bp, Mus musculus
caatctatctctttcgcgtccggtg

SEQ ID NO: 554156 - DNA, 25 bp, Mus musculus
caatctcagaggcaacctagggtac

SEQ ID NO: 554157 - DNA, 25 bp, Mus musculus
caatctcagagggaacctagggtac

SEQ ID NO: 554158 - DNA, 25 bp, Mus musculus
caatctcatggaaatgctggtcaac

SEQ ID NO: 554159 - DNA, 25 bp, Mus musculus
caatctcatggatatgctggtcaac

SEQ ID NO: 554160 - DNA, 25 bp, Mus musculus
caatctccccgtcggtggtgcctat

SEQ ID NO: 554161 - DNA, 25 bp, Mus musculus
caatctccccgtgggtggtgcctat

SEQ ID NO: 554162 - DNA, 25 bp, Mus musculus
caatctccgggactatctacaggcc

SEQ ID NO: 554163 - DNA, 25 bp, Mus musculus
caatctccgggacttccttcgggcg

SEQ ID NO: 554164 - DNA, 25 bp, Mus musculus
caatctccgggagtatctacaggcc

SEQ ID NO: 554165 - DNA, 25 bp, Mus musculus
caatctccgggagttccttcgggcg

SEQ ID NO: 554166 - DNA, 25 bp, Mus musculus
caatctcgaagaaaatggacgagag

SEQ ID NO: 554167 - DNA, 25 bp, Mus musculus
caatctcgaagataatggacgagag

SEQ ID NO: 554168 - DNA, 25 bp, Mus musculus
caatctctaggtctttgtgaaagct

SEQ ID NO: 554169 - DNA, 25 bp, Mus musculus
caatctctaggtgtttgtgaaagct

SEQ ID NO: 554170 - DNA, 25 bp, Mus musculus
caatctctatgcaccgtgtgctggt

SEQ ID NO: 554171 - DNA, 25 bp, Mus musculus
caatctctatgctccgtgtgctggt

SEQ ID NO: 554172 - DNA, 25 bp, Mus musculus
caatctctgcagcaaaagtgaatct

SEQ ID NO: 554173 - DNA, 25 bp, Mus musculus
caatctctgcaggaaaagtgaatct

SEQ ID NO: 554174 - DNA, 25 bp, Mus musculus
caatctgaacgtctgtccttgaagg

SEQ ID NO: 554175 - DNA, 25 bp, Mus musculus
caatctgaacgtgtgtccttgaagg

SEQ ID NO: 554176 - DNA, 25 bp, Mus musculus
caatctgaatagcaacaactttctc

SEQ ID NO: 554177 - DNA, 25 bp, Mus musculus
caatctgaataggaacaactttctc

SEQ ID NO: 554178 - DNA, 25 bp, Mus musculus
caatctgaggaaattcagctgctcc

SEQ ID NO: 554179 - DNA, 25 bp, Mus musculus
caatctgaggaatttcagctgctcc

SEQ ID NO: 554180 - DNA, 25 bp, Mus musculus
caatctgagtttaggagtgtccaca

SEQ ID NO: 554181 - DNA, 25 bp, Mus musculus
caatctgagttttggagtgtccaca

SEQ ID NO: 554182 - DNA, 25 bp, Mus musculus
caatctgataccaaaggagcaggcc

SEQ ID NO: 554183 - DNA, 25 bp, Mus musculus
caatctgatacctaaggagcaggcc

SEQ ID NO: 554184 - DNA, 25 bp, Mus musculus
caatctgatcaaagccatcttgtca

SEQ ID NO: 554185 - DNA, 25 bp, Mus musculus
caatctgatcaatgccatcttgtca

SEQ ID NO: 554186 - DNA, 25 bp, Mus musculus
caatctgattctcaggaggcaaaca

SEQ ID NO: 554187 - DNA, 25 bp, Mus musculus
caatctgattctccagtgttgctaa

SEQ ID NO: 554188 - DNA, 25 bp, Mus musculus
caatctgattctgaggaggcaaaca

SEQ ID NO: 554189 - DNA, 25 bp, Mus musculus
caatctgattctgcagtgttgctaa

SEQ ID NO: 554190 - DNA, 25 bp, Mus musculus
caatctgcagatccatcatgtgggt

SEQ ID NO: 554191 - DNA, 25 bp, Mus musculus
caatctgcagatgcatcatgtgggt

SEQ ID NO: 554192 - DNA, 25 bp, Mus musculus
caatctgcagcgaggtgggctgaca

SEQ ID NO: 554193 - DNA, 25 bp, Mus musculus
caatctgcagcgtggtgggctgaca

SEQ ID NO: 554194 - DNA, 25 bp, Mus musculus
caatctgcctggaaacttgagagca

SEQ ID NO: 554195 - DNA, 25 bp, Mus musculus
caatctgcctggtaacttgagagca

SEQ ID NO: 554196 - DNA, 25 bp, Mus musculus
caatctgctcagatttgtgaggagc

SEQ ID NO: 554197 - DNA, 25 bp, Mus musculus
caatctgctcagttttgtgaggagc

SEQ ID NO: 554198 - DNA, 25 bp, Mus musculus
caatctgctccgacctcaagcggag

SEQ ID NO: 554199 - DNA, 25 bp, Mus musculus
caatctgctccgtcctcaagcggag

SEQ ID NO: 554200 - DNA, 25 bp, Mus musculus
caatctgctgatccaactggtcaag

SEQ ID NO: 554201 - DNA, 25 bp, Mus musculus
caatctgctgatgcaactggtcaag

SEQ ID NO: 554202 - DNA, 25 bp, Mus musculus
caatctgctgtgagctgagacccgg

SEQ ID NO: 554203 - DNA, 25 bp, Mus musculus
caatctgctgtgtgctgagacccgg

SEQ ID NO: 554204 - DNA, 25 bp, Mus musculus
caatctggagcaaaagatcctgcag

SEQ ID NO: 554205 - DNA, 25 bp, Mus musculus
caatctggagcataagatcctgcag

SEQ ID NO: 554206 - DNA, 25 bp, Mus musculus
caatctggccacagttagggaggca

SEQ ID NO: 554207 - DNA, 25 bp, Mus musculus
caatctggccactgttagggaggca

SEQ ID NO: 554208 - DNA, 25 bp, Mus musculus
caatctggctgcaggccttgttggg

SEQ ID NO: 554209 - DNA, 25 bp, Mus musculus
caatctggctgctggccttgttggg

SEQ ID NO: 554210 - DNA, 25 bp, Mus musculus
caatctgggtaaaaagcatggacaa

SEQ ID NO: 554211 - DNA, 25 bp, Mus musculus
caatctgggtaataagcatggacaa

SEQ ID NO: 554212 - DNA, 25 bp, Mus musculus
caatctgggttacctcagcctgtct

SEQ ID NO: 554213 - DNA, 25 bp, Mus musculus
caatctgggttagctcagcctgtct

SEQ ID NO: 554214 - DNA, 25 bp, Mus musculus
caatctggtcctcaatgtcttccag

SEQ ID NO: 554215 - DNA, 25 bp, Mus musculus
caatctggtcctgaatgtcttccag

SEQ ID NO: 554216 - DNA, 25 bp, Mus musculus
caatctgtatccatcaggatgagcc

SEQ ID NO: 554217 - DNA, 25 bp, Mus musculus
caatctgtatccttcaggatgagcc

SEQ ID NO: 554218 - DNA, 25 bp, Mus musculus
caatctgtattcacgccctgttgga

SEQ ID NO: 554219 - DNA, 25 bp, Mus musculus
caatctgtattctcgccctgttgga

SEQ ID NO: 554220 - DNA, 25 bp, Mus musculus
caatctgtcaaaatcccaggaatat

SEQ ID NO: 554221 - DNA, 25 bp, Mus musculus
caatctgtcaaattcccaggaatat

SEQ ID NO: 554222 - DNA, 25 bp, Mus musculus
caatctgtgaatactctgactgagg

SEQ ID NO: 554223 - DNA, 25 bp, Mus musculus
caatctgtgaattctctgactgagg

SEQ ID NO: 554224 - DNA, 25 bp, Mus musculus
caatctgtgcctcttggaggcatac

SEQ ID NO: 554225 - DNA, 25 bp, Mus musculus
caatctgtgcctgttggaggcatac

SEQ ID NO: 554226 - DNA, 25 bp, Mus musculus
caatctgttatacgaaaccatccaa

SEQ ID NO: 554227 - DNA, 25 bp, Mus musculus
caatctgttataggaaaccatccaa

SEQ ID NO: 554228 - DNA, 25 bp, Mus musculus
caatctgttcggatcttgggcagcc

SEQ ID NO: 554229 - DNA, 25 bp, Mus musculus
caatctgttcggttcttgggcagcc

SEQ ID NO: 554230 - DNA, 25 bp, Mus musculus
caatcttaggataacctgggacacg

SEQ ID NO: 554231 - DNA, 25 bp, Mus musculus
caatcttaggattacctgggacacg

SEQ ID NO: 554232 - DNA, 25 bp, Mus musculus
caatcttctaaacacagtctgtttg

SEQ ID NO: 554233 - DNA, 25 bp, Mus musculus
caatcttctaaagacagtctgtttg

SEQ ID NO: 554234 - DNA, 25 bp, Mus musculus
caatcttgccgaactgaagggtttc

SEQ ID NO: 554235 - DNA, 25 bp, Mus musculus
caatcttgccgatctgaagggtttc

SEQ ID NO: 554236 - DNA, 25 bp, Mus musculus
caatcttgggaacttacattcctgg

SEQ ID NO: 554237 - DNA, 25 bp, Mus musculus
caatcttgggaagttacattcctgg

SEQ ID NO: 554238 - DNA, 25 bp, Mus musculus
caatcttgggctattgctagaactg

SEQ ID NO: 554239 - DNA, 25 bp, Mus musculus
caatcttgggcttttgctagaactg

SEQ ID NO: 554240 - DNA, 25 bp, Mus musculus
caatcttgggtgaagggctgtcagt

SEQ ID NO: 554241 - DNA, 25 bp, Mus musculus
caatcttgggtgtagggctgtcagt

SEQ ID NO: 554242 - DNA, 25 bp, Mus musculus
caatcttgtgtgactactggtggga

SEQ ID NO: 554243 - DNA, 25 bp, Mus musculus
caatcttgtgtgtctactggtggga

SEQ ID NO: 554244 - DNA, 25 bp, Mus musculus
caatctttatggacttctacatggc

SEQ ID NO: 554245 - DNA, 25 bp, Mus musculus
caatctttatggtcttctacatggc

SEQ ID NO: 554246 - DNA, 25 bp, Mus musculus
caatctttccagaaaccagctgaag

SEQ ID NO: 554247 - DNA, 25 bp, Mus musculus
caatctttccagtaaccagctgaag

SEQ ID NO: 554248 - DNA, 25 bp, Mus musculus
caatctttccgacttccagcatgtc

SEQ ID NO: 554249 - DNA, 25 bp, Mus musculus
caatctttccgagttccagcatgtc

SEQ ID NO: 554250 - DNA, 25 bp, Mus musculus
caatctttctggactcggcgctggc

SEQ ID NO: 554251 - DNA, 25 bp, Mus musculus
caatctttctggtctcggcgctggc

SEQ ID NO: 554252 - DNA, 25 bp, Mus musculus
caatcttttaaccattcaggaccgt

SEQ ID NO: 554253 - DNA, 25 bp, Mus musculus
caatcttttaacgattcaggaccgt

SEQ ID NO: 554254 - DNA, 25 bp, Mus musculus
caatcttttatcaagttggagctgg

SEQ ID NO: 554255 - DNA, 25 bp, Mus musculus
caatcttttatctagttggagctgg

SEQ ID NO: 554256 - DNA, 25 bp, Mus musculus
caatgaaactgcagaccttgagaca

SEQ ID NO: 554257 - DNA, 25 bp, Mus musculus
caatgaaactgctgaccttgagaca

SEQ ID NO: 554258 - DNA, 25 bp, Mus musculus
caatgaaaggaaagcgcaagactct

SEQ ID NO: 554259 - DNA, 25 bp, Mus musculus
caatgaaaggaatgcgcaagactct

SEQ ID NO: 554260 - DNA, 25 bp, Mus musculus
caatgaaagggaacttagagttggc

SEQ ID NO: 554261 - DNA, 25 bp, Mus musculus
caatgaaagggatcttagagttggc

SEQ ID NO: 554262 - DNA, 25 bp, Mus musculus
caatgaaatgtacacagaatatctc

SEQ ID NO: 554263 - DNA, 25 bp, Mus musculus
caatgaaatgtagacagaatatctc

SEQ ID NO: 554264 - DNA, 25 bp, Mus musculus
caatgaaattgaagctttgccttcc

SEQ ID NO: 554265 - DNA, 25 bp, Mus musculus
caatgaaattgatgctttgccttcc

SEQ ID NO: 554266 - DNA, 25 bp, Mus musculus
caatgaaattggagtaaagcaacca

SEQ ID NO: 554267 - DNA, 25 bp, Mus musculus
caatgaaattggtgtaaagcaacca

SEQ ID NO: 554268 - DNA, 25 bp, Mus musculus
caatgaacaggaagtggagagcagt

SEQ ID NO: 554269 - DNA, 25 bp, Mus musculus
caatgaacaggatgtggagagcagt

SEQ ID NO: 554270 - DNA, 25 bp, Mus musculus
caatgaacagggagtccattctctg

SEQ ID NO: 554271 - DNA, 25 bp, Mus musculus
caatgaacagggtgtccattctctg

SEQ ID NO: 554272 - DNA, 25 bp, Mus musculus
caatgaacatagacaacttccccac

SEQ ID NO: 554273 - DNA, 25 bp, Mus musculus
caatgaacatagtcaacttccccac

SEQ ID NO: 554274 - DNA, 25 bp, Mus musculus
caatgaaccaataggcaatttaaag

SEQ ID NO: 554275 - DNA, 25 bp, Mus musculus
caatgaaccaattggcaatttaaag

SEQ ID NO: 554276 - DNA, 25 bp, Mus musculus
caatgaactgaaccgccgtggcaga

SEQ ID NO: 554277 - DNA, 25 bp, Mus musculus
caatgaactgaagcgccgtggcaga

SEQ ID NO: 554278 - DNA, 25 bp, Mus musculus
caatgaagacatagtctcccgaaac

SEQ ID NO: 554279 - DNA, 25 bp, Mus musculus
caatgaagacattgtctcccgaaac

SEQ ID NO: 554280 - DNA, 25 bp, Mus musculus
caatgaagacgcagtgccactgtgc

SEQ ID NO: 554281 - DNA, 25 bp, Mus musculus
caatgaagacgctgtgccactgtgc

SEQ ID NO: 554282 - DNA, 25 bp, Mus musculus
caatgaagaggactacgaacagtac

SEQ ID NO: 554283 - DNA, 25 bp, Mus musculus
caatgaagaggagtacgaacagtac

SEQ ID NO: 554284 - DNA, 25 bp, Mus musculus
caatgaagataacagcgtggtgtcc

SEQ ID NO: 554285 - DNA, 25 bp, Mus musculus
caatgaagataagagcgtggtgtcc

SEQ ID NO: 554286 - DNA, 25 bp, Mus musculus
caatgaagatgacgttgaagcttac

SEQ ID NO: 554287 - DNA, 25 bp, Mus musculus
caatgaagatgaggttgaagcttac

SEQ ID NO: 554288 - DNA, 25 bp, Mus musculus
caatgaagctatccagtggatggag

SEQ ID NO: 554289 - DNA, 25 bp, Mus musculus
caatgaagctatgcagtggatggag

SEQ ID NO: 554290 - DNA, 25 bp, Mus musculus
caatgaagctgtcggaccataggct

SEQ ID NO: 554291 - DNA, 25 bp, Mus musculus
caatgaagctgtgggaccataggct

SEQ ID NO: 554292 - DNA, 25 bp, Mus musculus
caatgaagcttcatatgctgcataa

SEQ ID NO: 554293 - DNA, 25 bp, Mus musculus
caatgaagcttcttatgctgcataa

SEQ ID NO: 554294 - DNA, 25 bp, Mus musculus
caatgaaggaagacgtgctctacca

SEQ ID NO: 554295 - DNA, 25 bp, Mus musculus
caatgaaggaagtcgtgctctacca

SEQ ID NO: 554296 - DNA, 25 bp, Mus musculus
caatgaaggactaacagctgaagct

SEQ ID NO: 554297 - DNA, 25 bp, Mus musculus
caatgaaggactatacaagcctgtg

SEQ ID NO: 554298 - DNA, 25 bp, Mus musculus
caatgaaggacttacagctgaagct

SEQ ID NO: 554299 - DNA, 25 bp, Mus musculus
caatgaaggactttacaagcctgtg

SEQ ID NO: 554300 - DNA, 25 bp, Mus musculus
caatgaaggcttccaggcttacgat

SEQ ID NO: 554301 - DNA, 25 bp, Mus musculus
caatgaaggcttgcaggcttacgat

SEQ ID NO: 554302 - DNA, 25 bp, Mus musculus
caatgaaggtataagctatgtttct

SEQ ID NO: 554303 - DNA, 25 bp, Mus musculus
caatgaaggtattagctatgtttct

SEQ ID NO: 554304 - DNA, 25 bp, Mus musculus
caatgaaggttccatgtctgaagaa

SEQ ID NO: 554305 - DNA, 25 bp, Mus musculus
caatgaaggttcgatgtctgaagaa

SEQ ID NO: 554306 - DNA, 25 bp, Mus musculus
caatgaagttgtagagccaagtgct

SEQ ID NO: 554307 - DNA, 25 bp, Mus musculus
caatgaagttgttgagccaagtgct

SEQ ID NO: 554308 - DNA, 25 bp, Mus musculus
caatgaatcacccttctaatcctaa

SEQ ID NO: 554309 - DNA, 25 bp, Mus musculus
caatgaatcaccgttctaatcctaa

SEQ ID NO: 554310 - DNA, 25 bp, Mus musculus
caatgaatggacatgttcccgcagt

SEQ ID NO: 554311 - DNA, 25 bp, Mus musculus
caatgaatggacttgttcccgcagt

SEQ ID NO: 554312 - DNA, 25 bp, Mus musculus
caatgaatggagaaggttacctcta

SEQ ID NO: 554313 - DNA, 25 bp, Mus musculus
caatgaatggagtaggttacctcta

SEQ ID NO: 554314 - DNA, 25 bp, Mus musculus
caatgaattccactcctcaggtggc

SEQ ID NO: 554315 - DNA, 25 bp, Mus musculus
caatgaattccagtcctcaggtggc

SEQ ID NO: 554316 - DNA, 25 bp, Mus musculus
caatgaattgaactgcacaaaaagt

SEQ ID NO: 554317 - DNA, 25 bp, Mus musculus
caatgaattgaagtgcacaaaaagt

SEQ ID NO: 554318 - DNA, 25 bp, Mus musculus
caatgacaaatgatccactggaagc

SEQ ID NO: 554319 - DNA, 25 bp, Mus musculus
caatgacaaatgttccactggaagc

SEQ ID NO: 554320 - DNA, 25 bp, Mus musculus
caatgacaaggtcaagactgacgtg

SEQ ID NO: 554321 - DNA, 25 bp, Mus musculus
caatgacaaggtgaagactgacgtg

SEQ ID NO: 554322 - DNA, 25 bp, Mus musculus
caatgacaatgtcattgccagtggc

SEQ ID NO: 554323 - DNA, 25 bp, Mus musculus
caatgacaatgtgattgccagtggc

SEQ ID NO: 554324 - DNA, 25 bp, Mus musculus
caatgacaccaccaggtgctctggg

SEQ ID NO: 554325 - DNA, 25 bp, Mus musculus
caatgacaccacgaggtgctctggg

SEQ ID NO: 554326 - DNA, 25 bp, Mus musculus
caatgacagagaccgtgtgaacgag

SEQ ID NO: 554327 - DNA, 25 bp, Mus musculus
caatgacagagagcgtgtgaacgag

SEQ ID NO: 554328 - DNA, 25 bp, Mus musculus
caatgacagcggcagtgacaaggac

SEQ ID NO: 554329 - DNA, 25 bp, Mus musculus
caatgacagcgggagtgacaaggac

SEQ ID NO: 554330 - DNA, 25 bp, Mus musculus
caatgacatcaacaaccacaagtgg

SEQ ID NO: 554331 - DNA, 25 bp, Mus musculus
caatgacatcaagaaccacaagtgg

SEQ ID NO: 554332 - DNA, 25 bp, Mus musculus
caatgacatccgagtggctggcaca

SEQ ID NO: 554333 - DNA, 25 bp, Mus musculus
caatgacatccgtgtggctggcaca

SEQ ID NO: 554334 - DNA, 25 bp, Mus musculus
caatgacatgtcatcaatgtccaca

SEQ ID NO: 554335 - DNA, 25 bp, Mus musculus
caatgacatgtcttcaatgtccaca

SEQ ID NO: 554336 - DNA, 25 bp, Mus musculus
caatgacattccacggaggcccagg

SEQ ID NO: 554337 - DNA, 25 bp, Mus musculus
caatgacattcctcggaggcccagg

SEQ ID NO: 554338 - DNA, 25 bp, Mus musculus
caatgacattctcggctttgacagc

SEQ ID NO: 554339 - DNA, 25 bp, Mus musculus
caatgacattctgggctttgacagc

SEQ ID NO: 554340 - DNA, 25 bp, Mus musculus
caatgaccaggcagatttctcgaca

SEQ ID NO: 554341 - DNA, 25 bp, Mus musculus
caatgaccaggctgatttctcgaca

SEQ ID NO: 554342 - DNA, 25 bp, Mus musculus
caatgaccgtctaaagcatgcctta

SEQ ID NO: 554343 - DNA, 25 bp, Mus musculus
caatgaccgtcttaagcatgcctta

SEQ ID NO: 554344 - DNA, 25 bp, Mus musculus
caatgaccgtggacagcagcatgag

SEQ ID NO: 554345 - DNA, 25 bp, Mus musculus
caatgaccgtggtcagcagcatgag

SEQ ID NO: 554346 - DNA, 25 bp, Mus musculus
caatgacctatgatgacattccaca

SEQ ID NO: 554347 - DNA, 25 bp, Mus musculus
caatgacctatgttgacattccaca

SEQ ID NO: 554348 - DNA, 25 bp, Mus musculus
caatgacctgatcttactacgcctc

SEQ ID NO: 554349 - DNA, 25 bp, Mus musculus
caatgacctgatgttactacgcctc

SEQ ID NO: 554350 - DNA, 25 bp, Mus musculus
caatgaccttgtagacaaggttcaa

SEQ ID NO: 554351 - DNA, 25 bp, Mus musculus
caatgaccttgttgacaaggttcaa

SEQ ID NO: 554352 - DNA, 25 bp, Mus musculus
caatgacgacgcagtacgggtgctt

SEQ ID NO: 554353 - DNA, 25 bp, Mus musculus
caatgacgacgctgtacgggtgctt

SEQ ID NO: 554354 - DNA, 25 bp, Mus musculus
caatgacgacgtcctcaggacgatg

SEQ ID NO: 554355 - DNA, 25 bp, Mus musculus
caatgacgacgtgctcaggacgatg

SEQ ID NO: 554356 - DNA, 25 bp, Mus musculus
caatgacgataaactctacttcttc

SEQ ID NO: 554357 - DNA, 25 bp, Mus musculus
caatgacgataatctctacttcttc

SEQ ID NO: 554358 - DNA, 25 bp, Mus musculus
caatgacgatgacctgtatggctaa

SEQ ID NO: 554359 - DNA, 25 bp, Mus musculus
caatgacgatgagctgtatggctaa

SEQ ID NO: 554360 - DNA, 25 bp, Mus musculus
caatgacggaaaattcgacgttgcc

SEQ ID NO: 554361 - DNA, 25 bp, Mus musculus
caatgacggaaatttcgacgttgcc

SEQ ID NO: 554362 - DNA, 25 bp, Mus musculus
caatgacggagacatttgtgctcac

SEQ ID NO: 554363 - DNA, 25 bp, Mus musculus
caatgacggagagatttgtgctcac

SEQ ID NO: 554364 - DNA, 25 bp, Mus musculus
caatgacgtgatattggagagagtg

SEQ ID NO: 554365 - DNA, 25 bp, Mus musculus
caatgacgtgattttggagagagtg

SEQ ID NO: 554366 - DNA, 25 bp, Mus musculus
caatgactacatcactagtcctgcg

SEQ ID NO: 554367 - DNA, 25 bp, Mus musculus
caatgactacatgactagtcctgcg

SEQ ID NO: 554368 - DNA, 25 bp, Mus musculus
caatgactactgatgagggcaccag

SEQ ID NO: 554369 - DNA, 25 bp, Mus musculus
caatgactactgttgagggcaccag

SEQ ID NO: 554370 - DNA, 25 bp, Mus musculus
caatgactacttcacttgcataact

SEQ ID NO: 554371 - DNA, 25 bp, Mus musculus
caatgactacttgacttgcataact

SEQ ID NO: 554372 - DNA, 25 bp, Mus musculus
caatgactatacagccacgctgtct

SEQ ID NO: 554373 - DNA, 25 bp, Mus musculus
caatgactatactgccacgctgtct

SEQ ID NO: 554374 - DNA, 25 bp, Mus musculus
caatgactatggaaggtgcctggac

SEQ ID NO: 554375 - DNA, 25 bp, Mus musculus
caatgactatggtaggtgcctggac

SEQ ID NO: 554376 - DNA, 25 bp, Mus musculus
caatgactcactacaacttccacaa

SEQ ID NO: 554377 - DNA, 25 bp, Mus musculus
caatgactcacttcaacttccacaa

SEQ ID NO: 554378 - DNA, 25 bp, Mus musculus
caatgactgggcagctctgctggaa

SEQ ID NO: 554379 - DNA, 25 bp, Mus musculus
caatgactgggctgctctgctggaa

SEQ ID NO: 554380 - DNA, 25 bp, Mus musculus
caatgacttcacagacggtgtccaa

SEQ ID NO: 554381 - DNA, 25 bp, Mus musculus
caatgacttcactgacggtgtccaa

SEQ ID NO: 554382 - DNA, 25 bp, Mus musculus
caatgagaaagaacctgacaacaag

SEQ ID NO: 554383 - DNA, 25 bp, Mus musculus
caatgagaaagatcctgacaacaag

SEQ ID NO: 554384 - DNA, 25 bp, Mus musculus
caatgagaacagagccctaagggaa

SEQ ID NO: 554385 - DNA, 25 bp, Mus musculus
caatgagaacagtgccctaagggaa

SEQ ID NO: 554386 - DNA, 25 bp, Mus musculus
caatgagaagaacgcaacatgtggc

SEQ ID NO: 554387 - DNA, 25 bp, Mus musculus
caatgagaagaaggcaacatgtggc

SEQ ID NO: 554388 - DNA, 25 bp, Mus musculus
caatgagaagcccttcacagggttt

SEQ ID NO: 554389 - DNA, 25 bp, Mus musculus
caatgagaagccgttcacagggttt

SEQ ID NO: 554390 - DNA, 25 bp, Mus musculus
caatgagaatgcacaaccctctgaa

SEQ ID NO: 554391 - DNA, 25 bp, Mus musculus
caatgagaatgcagttgtccgaaac

SEQ ID NO: 554392 - DNA, 25 bp, Mus musculus
caatgagaatgctcaaccctctgaa

SEQ ID NO: 554393 - DNA, 25 bp, Mus musculus
caatgagaatgctgttgtccgaaac

SEQ ID NO: 554394 - DNA, 25 bp, Mus musculus
caatgagacactccggctcacggct

SEQ ID NO: 554395 - DNA, 25 bp, Mus musculus
caatgagacactgcggctcacggct

SEQ ID NO: 554396 - DNA, 25 bp, Mus musculus
caatgagaccgtccttactgtgtgg

SEQ ID NO: 554397 - DNA, 25 bp, Mus musculus
caatgagaccgtgcttactgtgtgg

SEQ ID NO: 554398 - DNA, 25 bp, Mus musculus
caatgagacgtcagagacagcccca

SEQ ID NO: 554399 - DNA, 25 bp, Mus musculus
caatgagacgtctgagacagcccca

SEQ ID NO: 554400 - DNA, 25 bp, Mus musculus
caatgagactgaccgagactagggc

SEQ ID NO: 554401 - DNA, 25 bp, Mus musculus
caatgagactgagcgagactagggc

SEQ ID NO: 554402 - DNA, 25 bp, Mus musculus
caatgagagcgcagtttctcatccc

SEQ ID NO: 554403 - DNA, 25 bp, Mus musculus
caatgagagcgctgtttctcatccc

SEQ ID NO: 554404 - DNA, 25 bp, Mus musculus
caatgagaggcactatttttaaggg

SEQ ID NO: 554405 - DNA, 25 bp, Mus musculus
caatgagaggcagtatttttaaggg

SEQ ID NO: 554406 - DNA, 25 bp, Mus musculus
caatgagaggtaagactcgccttct

SEQ ID NO: 554407 - DNA, 25 bp, Mus musculus
caatgagaggtatgactcgccttct

SEQ ID NO: 554408 - DNA, 25 bp, Mus musculus
caatgagagtctcgtatgccatcag

SEQ ID NO: 554409 - DNA, 25 bp, Mus musculus
caatgagagtctggtatgccatcag

SEQ ID NO: 554410 - DNA, 25 bp, Mus musculus
caatgagatccgaaggcaatccagt

SEQ ID NO: 554411 - DNA, 25 bp, Mus musculus
caatgagatccgtaggcaatccagt

SEQ ID NO: 554412 - DNA, 25 bp, Mus musculus
caatgagatgatcaatccaaactac

SEQ ID NO: 554413 - DNA, 25 bp, Mus musculus
caatgagatgatgaatccaaactac

SEQ ID NO: 554414 - DNA, 25 bp, Mus musculus
caatgagcacgaaggagccacacca

SEQ ID NO: 554415 - DNA, 25 bp, Mus musculus
caatgagcacgatggagccacacca

SEQ ID NO: 554416 - DNA, 25 bp, Mus musculus
caatgagcattaagacgtcgcccga

SEQ ID NO: 554417 - DNA, 25 bp, Mus musculus
caatgagcattatgacgtcgcccga

SEQ ID NO: 554418 - DNA, 25 bp, Mus musculus
caatgagcttcaccaagcattatcc

SEQ ID NO: 554419 - DNA, 25 bp, Mus musculus
caatgagcttcagcaagcattatcc

SEQ ID NO: 554420 - DNA, 25 bp, Mus musculus
caatgaggacgaccggctaatgcca

SEQ ID NO: 554421 - DNA, 25 bp, Mus musculus
caatgaggacgagcggctaatgcca

SEQ ID NO: 554422 - DNA, 25 bp, Mus musculus
caatgaggagctagagacgtttaat

SEQ ID NO: 554423 - DNA, 25 bp, Mus musculus
caatgaggagctccagtcgcgcctg

SEQ ID NO: 554424 - DNA, 25 bp, Mus musculus
caatgaggagctgcagtcgcgcctg

SEQ ID NO: 554425 - DNA, 25 bp, Mus musculus
caatgaggagcttgagacgtttaat

SEQ ID NO: 554426 - DNA, 25 bp, Mus musculus
caatgaggataccatcagggagatg

SEQ ID NO: 554427 - DNA, 25 bp, Mus musculus
caatgaggatacgatcagggagatg

SEQ ID NO: 554428 - DNA, 25 bp, Mus musculus
caatgaggatttccaggtcggccaa

SEQ ID NO: 554429 - DNA, 25 bp, Mus musculus
caatgaggatttgcaggtcggccaa

SEQ ID NO: 554430 - DNA, 25 bp, Mus musculus
caatgaggtactcttttcagggaac

SEQ ID NO: 554431 - DNA, 25 bp, Mus musculus
caatgaggtactgttttcagggaac

SEQ ID NO: 554432 - DNA, 25 bp, Mus musculus
caatgaggtcatcgtggaacacttc

SEQ ID NO: 554433 - DNA, 25 bp, Mus musculus
caatgaggtcatggtggaacacttc

SEQ ID NO: 554434 - DNA, 25 bp, Mus musculus
caatgaggtggacattcgctacgtg

SEQ ID NO: 554435 - DNA, 25 bp, Mus musculus
caatgaggtggagattcgctacgtg

SEQ ID NO: 554436 - DNA, 25 bp, Mus musculus
caatgaggttctcggacgagaactg

SEQ ID NO: 554437 - DNA, 25 bp, Mus musculus
caatgaggttctgggacgagaactg

SEQ ID NO: 554438 - DNA, 25 bp, Mus musculus
caatgagtcagcaaattccctggcc

SEQ ID NO: 554439 - DNA, 25 bp, Mus musculus
caatgagtcagctaattccctggcc

SEQ ID NO: 554440 - DNA, 25 bp, Mus musculus
caatgagtcctacaagaagaacctg

SEQ ID NO: 554441 - DNA, 25 bp, Mus musculus
caatgagtcctagaagaagaacctg

SEQ ID NO: 554442 - DNA, 25 bp, Mus musculus
caatgagtccttagcgttgccctac

SEQ ID NO: 554443 - DNA, 25 bp, Mus musculus
caatgagtcctttgcgttgccctac

SEQ ID NO: 554444 - DNA, 25 bp, Mus musculus
caatgagtcgggagactttcgcgga

SEQ ID NO: 554445 - DNA, 25 bp, Mus musculus
caatgagtcgggtgactttcgcgga

SEQ ID NO: 554446 - DNA, 25 bp, Mus musculus
caatgagtctgtagaggaaaatatc

SEQ ID NO: 554447 - DNA, 25 bp, Mus musculus
caatgagtctgttgaggaaaatatc

SEQ ID NO: 554448 - DNA, 25 bp, Mus musculus
caatgagtctttcgccttcgacata

SEQ ID NO: 554449 - DNA, 25 bp, Mus musculus
caatgagtctttggccttcgacata

SEQ ID NO: 554450 - DNA, 25 bp, Mus musculus
caatgagtgagcaagcctgtggcgt

SEQ ID NO: 554451 - DNA, 25 bp, Mus musculus
caatgagtgagctagcctgtggcgt

SEQ ID NO: 554452 - DNA, 25 bp, Mus musculus
caatgagtgggcacaggagacactc

SEQ ID NO: 554453 - DNA, 25 bp, Mus musculus
caatgagtgggctcaggagacactc

SEQ ID NO: 554454 - DNA, 25 bp, Mus musculus
caatgagtgtctcacccctgggata

SEQ ID NO: 554455 - DNA, 25 bp, Mus musculus
caatgagtgtctgacccctgggata

SEQ ID NO: 554456 - DNA, 25 bp, Mus musculus
caatgagtgttacattctcagcaac

SEQ ID NO: 554457 - DNA, 25 bp, Mus musculus
caatgagtgttagattctcagcaac

SEQ ID NO: 554458 - DNA, 25 bp, Mus musculus
caatgagttccaatgtcagtgcccc

SEQ ID NO: 554459 - DNA, 25 bp, Mus musculus
caatgagttccattgtcagtgcccc

SEQ ID NO: 554460 - DNA, 25 bp, Mus musculus
caatgagtttgacacagaatcccaa

SEQ ID NO: 554461 - DNA, 25 bp, Mus musculus
caatgagtttgagacagaatcccaa

SEQ ID NO: 554462 - DNA, 25 bp, Mus musculus
caatgagttttacggcctgaacttc

SEQ ID NO: 554463 - DNA, 25 bp, Mus musculus
caatgagttttagggcctgaacttc

SEQ ID NO: 554464 - DNA, 25 bp, Mus musculus
caatgataggtgacaagagttcaac

SEQ ID NO: 554465 - DNA, 25 bp, Mus musculus
caatgataggtgtcaagagttcaac

SEQ ID NO: 554466 - DNA, 25 bp, Mus musculus
caatgatcagatagacaacatggac

SEQ ID NO: 554467 - DNA, 25 bp, Mus musculus
caatgatcagattgacaacatggac

SEQ ID NO: 554468 - DNA, 25 bp, Mus musculus
caatgatccagtcacgtcagacgct

SEQ ID NO: 554469 - DNA, 25 bp, Mus musculus
caatgatccagtgacgtcagacgct

SEQ ID NO: 554470 - DNA, 25 bp, Mus musculus
caatgatcccttagaactttcccag

SEQ ID NO: 554471 - DNA, 25 bp, Mus musculus
caatgatccctttgaactttcccag

SEQ ID NO: 554472 - DNA, 25 bp, Mus musculus
caatgatcggcaaagcagtggagca

SEQ ID NO: 554473 - DNA, 25 bp, Mus musculus
caatgatcggcatagcagtggagca

SEQ ID NO: 554474 - DNA, 25 bp, Mus musculus
caatgatctggacgcgtctgccgct

SEQ ID NO: 554475 - DNA, 25 bp, Mus musculus
caatgatctggaggcgtctgccgct

SEQ ID NO: 554476 - DNA, 25 bp, Mus musculus
caatgatcttctccgtttcgatgtg

SEQ ID NO: 554477 - DNA, 25 bp, Mus musculus
caatgatcttctgcgtttcgatgtg

SEQ ID NO: 554478 - DNA, 25 bp, Mus musculus
caatgatcttgacgctaaatgcagt

SEQ ID NO: 554479 - DNA, 25 bp, Mus musculus
caatgatcttgaggctaaatgcagt

SEQ ID NO: 554480 - DNA, 25 bp, Mus musculus
caatgatgacggcacctacagtcag

SEQ ID NO: 554481 - DNA, 25 bp, Mus musculus
caatgatgacgggacctacagtcag

SEQ ID NO: 554482 - DNA, 25 bp, Mus musculus
caatgatgaggaactgccgtccaaa

SEQ ID NO: 554483 - DNA, 25 bp, Mus musculus
caatgatgaggatctgccgtccaaa

SEQ ID NO: 554484 - DNA, 25 bp, Mus musculus
caatgatgatgacaagtgaccagga

SEQ ID NO: 554485 - DNA, 25 bp, Mus musculus
caatgatgatgagaagtgaccagga

SEQ ID NO: 554486 - DNA, 25 bp, Mus musculus
caatgatggaggctactatgaccca

SEQ ID NO: 554487 - DNA, 25 bp, Mus musculus
caatgatggagggtactatgaccca

SEQ ID NO: 554488 - DNA, 25 bp, Mus musculus
caatgatgggctagtcacagtggta

SEQ ID NO: 554489 - DNA, 25 bp, Mus musculus
caatgatgggcttgtcacagtggta

SEQ ID NO: 554490 - DNA, 25 bp, Mus musculus
caatgatgtacccatccagtgtgaa

SEQ ID NO: 554491 - DNA, 25 bp, Mus musculus
caatgatgtaccgatccagtgtgaa

SEQ ID NO: 554492 - DNA, 25 bp, Mus musculus
caatgatgtccgagtcaaccagacg

SEQ ID NO: 554493 - DNA, 25 bp, Mus musculus
caatgatgtccgtgtcaaccagacg

SEQ ID NO: 554494 - DNA, 25 bp, Mus musculus
caatgatgtggcacgttagacccga

SEQ ID NO: 554495 - DNA, 25 bp, Mus musculus
caatgatgtggctcgttagacccga

SEQ ID NO: 554496 - DNA, 25 bp, Mus musculus
caatgattcagaatgaagggtgcaa

SEQ ID NO: 554497 - DNA, 25 bp, Mus musculus
caatgattcagattgaagggtgcaa

SEQ ID NO: 554498 - DNA, 25 bp, Mus musculus
caatgattggttccgactggagtcc

SEQ ID NO: 554499 - DNA, 25 bp, Mus musculus
caatgattggttgcgactggagtcc

SEQ ID NO: 554500 - DNA, 25 bp, Mus musculus
caatgcaaaggacttcaaccctcgt

SEQ ID NO: 554501 - DNA, 25 bp, Mus musculus
caatgcaaaggagttcaaccctcgt

SEQ ID NO: 554502 - DNA, 25 bp, Mus musculus
caatgcaagcataacagattaatct

SEQ ID NO: 554503 - DNA, 25 bp, Mus musculus
caatgcaagcattacagattaatct

SEQ ID NO: 554504 - DNA, 25 bp, Mus musculus
caatgcacatcgatgccaccttcaa

SEQ ID NO: 554505 - DNA, 25 bp, Mus musculus
caatgcacatcgttgccaccttcaa

SEQ ID NO: 554506 - DNA, 25 bp, Mus musculus
caatgcacctatcggccataacaga

SEQ ID NO: 554507 - DNA, 25 bp, Mus musculus
caatgcacctatgggccataacaga

SEQ ID NO: 554508 - DNA, 25 bp, Mus musculus
caatgcactcaacggaaggtcagag

SEQ ID NO: 554509 - DNA, 25 bp, Mus musculus
caatgcactcaagggaaggtcagag

SEQ ID NO: 554510 - DNA, 25 bp, Mus musculus
caatgcagaacaacttatggagaac

SEQ ID NO: 554511 - DNA, 25 bp, Mus musculus
caatgcagaacatcttatggagaac

SEQ ID NO: 554512 - DNA, 25 bp, Mus musculus
caatgcagaagacctgaagcgctgg

SEQ ID NO: 554513 - DNA, 25 bp, Mus musculus
caatgcagaagagctgaagcgctgg

SEQ ID NO: 554514 - DNA, 25 bp, Mus musculus
caatgcagaaggaggacagaacaac

SEQ ID NO: 554515 - DNA, 25 bp, Mus musculus
caatgcagaaggtggacagaacaac

SEQ ID NO: 554516 - DNA, 25 bp, Mus musculus
caatgcagaagtcctggctctgttc

SEQ ID NO: 554517 - DNA, 25 bp, Mus musculus
caatgcagaagtgctggctctgttc

SEQ ID NO: 554518 - DNA, 25 bp, Mus musculus
caatgcagcatcacttgctgtgcag

SEQ ID NO: 554519 - DNA, 25 bp, Mus musculus
caatgcagcatctcttgctgtgcag

SEQ ID NO: 554520 - DNA, 25 bp, Mus musculus
caatgcagctctaagaaagggtcac

SEQ ID NO: 554521 - DNA, 25 bp, Mus musculus
caatgcagctcttagaaagggtcac

SEQ ID NO: 554522 - DNA, 25 bp, Mus musculus
caatgcagggatcccaggatggtca

SEQ ID NO: 554523 - DNA, 25 bp, Mus musculus
caatgcagggatgccaggatggtca

SEQ ID NO: 554524 - DNA, 25 bp, Mus musculus
caatgcagggcgctttgttcgctac

SEQ ID NO: 554525 - DNA, 25 bp, Mus musculus
caatgcagggcggtttgttcgctac

SEQ ID NO: 554526 - DNA, 25 bp, Mus musculus
caatgcagtaccaagcagcctgggt

SEQ ID NO: 554527 - DNA, 25 bp, Mus musculus
caatgcagtacctagcagcctgggt

SEQ ID NO: 554528 - DNA, 25 bp, Mus musculus
caatgcagttcaacagccaccgatt

SEQ ID NO: 554529 - DNA, 25 bp, Mus musculus
caatgcagttcatcagccaccgatt

SEQ ID NO: 554530 - DNA, 25 bp, Mus musculus
caatgcagttgaccacgtcctggaa

SEQ ID NO: 554531 - DNA, 25 bp, Mus musculus
caatgcagttgagcacgtcctggaa

SEQ ID NO: 554532 - DNA, 25 bp, Mus musculus
caatgcatccgtaccagcggtgagt

SEQ ID NO: 554533 - DNA, 25 bp, Mus musculus
caatgcatccgttccagcggtgagt

SEQ ID NO: 554534 - DNA, 25 bp, Mus musculus
caatgcatctctcaatctctaggtg

SEQ ID NO: 554535 - DNA, 25 bp, Mus musculus
caatgcatctctgaatctctaggtg

SEQ ID NO: 554536 - DNA, 25 bp, Mus musculus
caatgcatgcttacgagacgccaga

SEQ ID NO: 554537 - DNA, 25 bp, Mus musculus
caatgcatgctttcgagacgccaga

SEQ ID NO: 554538 - DNA, 25 bp, Mus musculus
caatgcatttgaagtggctgagaaa

SEQ ID NO: 554539 - DNA, 25 bp, Mus musculus
caatgcatttgatgtggctgagaaa

SEQ ID NO: 554540 - DNA, 25 bp, Mus musculus
caatgcattttaagcacaggctcca

SEQ ID NO: 554541 - DNA, 25 bp, Mus musculus
caatgcattttatgcacaggctcca

SEQ ID NO: 554542 - DNA, 25 bp, Mus musculus
caatgccaaaagattacagcacaga

SEQ ID NO: 554543 - DNA, 25 bp, Mus musculus
caatgccaaaagtttacagcacaga

SEQ ID NO: 554544 - DNA, 25 bp, Mus musculus
caatgccaacgcagtaggtcccgta

SEQ ID NO: 554545 - DNA, 25 bp, Mus musculus
caatgccaacgctgtaggtcccgta

SEQ ID NO: 554546 - DNA, 25 bp, Mus musculus
caatgccaacttactttggaaggag

SEQ ID NO: 554547 - DNA, 25 bp, Mus musculus
caatgccaactttctttggaaggag

SEQ ID NO: 554548 - DNA, 25 bp, Mus musculus
caatgccacatcagtggcggatgga

SEQ ID NO: 554549 - DNA, 25 bp, Mus musculus
caatgccacatctgtggcggatgga

SEQ ID NO: 554550 - DNA, 25 bp, Mus musculus
caatgccagtgaaatttaatgagcc

SEQ ID NO: 554551 - DNA, 25 bp, Mus musculus
caatgccagtgatatttaatgagcc

SEQ ID NO: 554552 - DNA, 25 bp, Mus musculus
caatgccatagtcctggtggccaca

SEQ ID NO: 554553 - DNA, 25 bp, Mus musculus
caatgccatagtgctggtggccaca

SEQ ID NO: 554554 - DNA, 25 bp, Mus musculus
caatgccatatcagagatcaagaga

SEQ ID NO: 554555 - DNA, 25 bp, Mus musculus
caatgccatatctgagatcaagaga

SEQ ID NO: 554556 - DNA, 25 bp, Mus musculus
caatgccatcatcaatgaagacccc

SEQ ID NO: 554557 - DNA, 25 bp, Mus musculus
caatgccatcatgaatgaagacccc

SEQ ID NO: 554558 - DNA, 25 bp, Mus musculus
caatgccattcacatctgtactgag

SEQ ID NO: 554559 - DNA, 25 bp, Mus musculus
caatgccattcagatctgtactgag

SEQ ID NO: 554560 - DNA, 25 bp, Mus musculus
caatgcccagacacaatttagtgag

SEQ ID NO: 554561 - DNA, 25 bp, Mus musculus
caatgcccagacagttcatggggcc

SEQ ID NO: 554562 - DNA, 25 bp, Mus musculus
caatgcccagactcaatttagtgag

SEQ ID NO: 554563 - DNA, 25 bp, Mus musculus
caatgcccagactgttcatggggcc

SEQ ID NO: 554564 - DNA, 25 bp, Mus musculus
caatgcccggtgcatcgcactgctt

SEQ ID NO: 554565 - DNA, 25 bp, Mus musculus
caatgcccggtggatcgcactgctt

SEQ ID NO: 554566 - DNA, 25 bp, Mus musculus
caatgcccttctcatcattggagga

SEQ ID NO: 554567 - DNA, 25 bp, Mus musculus
caatgcccttctgatcattggagga

SEQ ID NO: 554568 - DNA, 25 bp, Mus musculus
caatgccgaaggcacggtggacact

SEQ ID NO: 554569 - DNA, 25 bp, Mus musculus
caatgccgaagggacggtggacact

SEQ ID NO: 554570 - DNA, 25 bp, Mus musculus
caatgccgcggcctcctatgagata

SEQ ID NO: 554571 - DNA, 25 bp, Mus musculus
caatgccgcggcgtcctatgagata

SEQ ID NO: 554572 - DNA, 25 bp, Mus musculus
caatgccgtagccttgggtgtctca

SEQ ID NO: 554573 - DNA, 25 bp, Mus musculus
caatgccgtagcgttgggtgtctca

SEQ ID NO: 554574 - DNA, 25 bp, Mus musculus
caatgccgttgactatatcaatact

SEQ ID NO: 554575 - DNA, 25 bp, Mus musculus
caatgccgttgagtatatcaatact

SEQ ID NO: 554576 - DNA, 25 bp, Mus musculus
caatgcctaagaaagccggtgcgac

SEQ ID NO: 554577 - DNA, 25 bp, Mus musculus
caatgcctaagatagccggtgcgac

SEQ ID NO: 554578 - DNA, 25 bp, Mus musculus
caatgcctacacagaggccacaaaa

SEQ ID NO: 554579 - DNA, 25 bp, Mus musculus
caatgcctacactgaggccacaaaa

SEQ ID NO: 554580 - DNA, 25 bp, Mus musculus
caatgcctactaactgcccaacaag

SEQ ID NO: 554581 - DNA, 25 bp, Mus musculus
caatgcctactatctgcccaacaag

SEQ ID NO: 554582 - DNA, 25 bp, Mus musculus
caatgcctcgctccttttcagacgg

SEQ ID NO: 554583 - DNA, 25 bp, Mus musculus
caatgcctcgctgcttttcagacgg

SEQ ID NO: 554584 - DNA, 25 bp, Mus musculus
caatgcctgcagctacggtgtgact

SEQ ID NO: 554585 - DNA, 25 bp, Mus musculus
caatgcctgcaggtacggtgtgact

SEQ ID NO: 554586 - DNA, 25 bp, Mus musculus
caatgcctggagcacctggtgactc

SEQ ID NO: 554587 - DNA, 25 bp, Mus musculus
caatgcctggagcatcatccagact

SEQ ID NO: 554588 - DNA, 25 bp, Mus musculus
caatgcctggaggacctggtgactc

SEQ ID NO: 554589 - DNA, 25 bp, Mus musculus
caatgcctggaggatcatccagact

SEQ ID NO: 554590 - DNA, 25 bp, Mus musculus
caatgcctgggcattcaaactcatt

SEQ ID NO: 554591 - DNA, 25 bp, Mus musculus
caatgcctgggctttcaaactcatt

SEQ ID NO: 554592 - DNA, 25 bp, Mus musculus
caatgccttagaactggatgacagt

SEQ ID NO: 554593 - DNA, 25 bp, Mus musculus
caatgccttagacaaggaggtagag

SEQ ID NO: 554594 - DNA, 25 bp, Mus musculus
caatgccttagagaaggaggtagag

SEQ ID NO: 554595 - DNA, 25 bp, Mus musculus
caatgccttagatctggatgacagt

SEQ ID NO: 554596 - DNA, 25 bp, Mus musculus
caatgcgaacggagcgatcaagaag

SEQ ID NO: 554597 - DNA, 25 bp, Mus musculus
caatgcgaacggtgcgatcaagaag

SEQ ID NO: 554598 - DNA, 25 bp, Mus musculus
caatgcgagcccatgacttcaatac

SEQ ID NO: 554599 - DNA, 25 bp, Mus musculus
caatgcgagcccttgacttcaatac

SEQ ID NO: 554600 - DNA, 25 bp, Mus musculus
caatgcggtagcctttgaccatgcg

SEQ ID NO: 554601 - DNA, 25 bp, Mus musculus
caatgcggtagcgtttgaccatgcg

SEQ ID NO: 554602 - DNA, 25 bp, Mus musculus
caatgcggttgccacactagagaaa

SEQ ID NO: 554603 - DNA, 25 bp, Mus musculus
caatgcggttgcgacactagagaaa

SEQ ID NO: 554604 - DNA, 25 bp, Mus musculus
caatgctaaagtcgctgtcctggga

SEQ ID NO: 554605 - DNA, 25 bp, Mus musculus
caatgctaaagtggctgtcctggga

SEQ ID NO: 554606 - DNA, 25 bp, Mus musculus
caatgctatcatatgtgacctaata

SEQ ID NO: 554607 - DNA, 25 bp, Mus musculus
caatgctatcatttgtgacctaata

SEQ ID NO: 554608 - DNA, 25 bp, Mus musculus
caatgctattggcttctcccaggga

SEQ ID NO: 554609 - DNA, 25 bp, Mus musculus
caatgctattgggttctcccaggga

SEQ ID NO: 554610 - DNA, 25 bp, Mus musculus
caatgctcatatctggactaaatca

SEQ ID NO: 554611 - DNA, 25 bp, Mus musculus
caatgctcatatgtggactaaatca

SEQ ID NO: 554612 - DNA, 25 bp, Mus musculus
caatgctccagactcagcctgtgtg

SEQ ID NO: 554613 - DNA, 25 bp, Mus musculus
caatgctccagagtcagcctgtgtg

SEQ ID NO: 554614 - DNA, 25 bp, Mus musculus
caatgctcctggctcctaatggaca

SEQ ID NO: 554615 - DNA, 25 bp, Mus musculus
caatgctcctgggtcctaatggaca

SEQ ID NO: 554616 - DNA, 25 bp, Mus musculus
caatgctccttaagtgttggaggac

SEQ ID NO: 554617 - DNA, 25 bp, Mus musculus
caatgctccttatgtgttggaggac

SEQ ID NO: 554618 - DNA, 25 bp, Mus musculus
caatgctgagcacaaggcctgagga

SEQ ID NO: 554619 - DNA, 25 bp, Mus musculus
caatgctgagcagaaggcctgagga

SEQ ID NO: 554620 - DNA, 25 bp, Mus musculus
caatgctgagctaatgtacgaggtc

SEQ ID NO: 554621 - DNA, 25 bp, Mus musculus
caatgctgagcttatgtacgaggtc

SEQ ID NO: 554622 - DNA, 25 bp, Mus musculus
caatgctgaggacatagatgcagga

SEQ ID NO: 554623 - DNA, 25 bp, Mus musculus
caatgctgaggagatagatgcagga

SEQ ID NO: 554624 - DNA, 25 bp, Mus musculus
caatgctgccccatcaggaagagag

SEQ ID NO: 554625 - DNA, 25 bp, Mus musculus
caatgctgccccttcaggaagagag

SEQ ID NO: 554626 - DNA, 25 bp, Mus musculus
caatgctgcgctcctggtttatgac

SEQ ID NO: 554627 - DNA, 25 bp, Mus musculus
caatgctgcgctccttggtgaagac

SEQ ID NO: 554628 - DNA, 25 bp, Mus musculus
caatgctgcgctgctggtttatgac

SEQ ID NO: 554629 - DNA, 25 bp, Mus musculus
caatgctgcgctgcttggtgaagac

SEQ ID NO: 554630 - DNA, 25 bp, Mus musculus
caatgctgctaacacatccatgtca

SEQ ID NO: 554631 - DNA, 25 bp, Mus musculus
caatgctgctaagacatccatgtca

SEQ ID NO: 554632 - DNA, 25 bp, Mus musculus
caatgctgctgaaattgaaagccgg

SEQ ID NO: 554633 - DNA, 25 bp, Mus musculus
caatgctgctgatattgaaagccgg

SEQ ID NO: 554634 - DNA, 25 bp, Mus musculus
caatgctgctttcaccctgtatgag

SEQ ID NO: 554635 - DNA, 25 bp, Mus musculus
caatgctgctttgaccctgtatgag

SEQ ID NO: 554636 - DNA, 25 bp, Mus musculus
caatgctggaacctggttcctagag

SEQ ID NO: 554637 - DNA, 25 bp, Mus musculus
caatgctggaacgtggttcctagag

SEQ ID NO: 554638 - DNA, 25 bp, Mus musculus
caatgctggatgaggcctttgggat

SEQ ID NO: 554639 - DNA, 25 bp, Mus musculus
caatgctggatgtggcctttgggat

SEQ ID NO: 554640 - DNA, 25 bp, Mus musculus
caatgctgtagccaacctgttccgc

SEQ ID NO: 554641 - DNA, 25 bp, Mus musculus
caatgctgtagcgaacctgttccgc

SEQ ID NO: 554642 - DNA, 25 bp, Mus musculus
caatgctgtattccctcctaagtgc

SEQ ID NO: 554643 - DNA, 25 bp, Mus musculus
caatgctgtattgcctcctaagtgc

SEQ ID NO: 554644 - DNA, 25 bp, Mus musculus
caatgctgtctacagagccccgagt

SEQ ID NO: 554645 - DNA, 25 bp, Mus musculus
caatgctgtctagagagccccgagt

SEQ ID NO: 554646 - DNA, 25 bp, Mus musculus
caatgctgttatcaaacaaaacccc

SEQ ID NO: 554647 - DNA, 25 bp, Mus musculus
caatgctgttatgaaacaaaacccc

SEQ ID NO: 554648 - DNA, 25 bp, Mus musculus
caatgctgttcacgcagccgacgtc

SEQ ID NO: 554649 - DNA, 25 bp, Mus musculus
caatgctgttcaggcagccgacgtc

SEQ ID NO: 554650 - DNA, 25 bp, Mus musculus
caatgcttcttgagaaattgtgtac

SEQ ID NO: 554651 - DNA, 25 bp, Mus musculus
caatgcttcttgtgaaattgtgtac

SEQ ID NO: 554652 - DNA, 25 bp, Mus musculus
caatgctttcccataaataagcttg

SEQ ID NO: 554653 - DNA, 25 bp, Mus musculus
caatgctttcccttaaataagcttg

SEQ ID NO: 554654 - DNA, 25 bp, Mus musculus
caatgctttcttcgacaacatgttt

SEQ ID NO: 554655 - DNA, 25 bp, Mus musculus
caatgctttcttggacaacatgttt

SEQ ID NO: 554656 - DNA, 25 bp, Mus musculus
caatggaaagtcctggctgccggaa

SEQ ID NO: 554657 - DNA, 25 bp, Mus musculus
caatggaaagtcgtggctgccggaa

SEQ ID NO: 554658 - DNA, 25 bp, Mus musculus
caatggaaatccagggcagagcttc

SEQ ID NO: 554659 - DNA, 25 bp, Mus musculus
caatggaaatcctgggcagagcttc

SEQ ID NO: 554660 - DNA, 25 bp, Mus musculus
caatggaaattgctgtgcagcatca

SEQ ID NO: 554661 - DNA, 25 bp, Mus musculus
caatggaaattggtgtgcagcatca

SEQ ID NO: 554662 - DNA, 25 bp, Mus musculus
caatggaacacgcaagggtgataac

SEQ ID NO: 554663 - DNA, 25 bp, Mus musculus
caatggaacacggaagggtgataac

SEQ ID NO: 554664 - DNA, 25 bp, Mus musculus
caatggaacagactccaggagatgc

SEQ ID NO: 554665 - DNA, 25 bp, Mus musculus
caatggaacagagtccaggagatgc

SEQ ID NO: 554666 - DNA, 25 bp, Mus musculus
caatggaaccaaactctcagaggac

SEQ ID NO: 554667 - DNA, 25 bp, Mus musculus
caatggaaccaatctctcagaggac

SEQ ID NO: 554668 - DNA, 25 bp, Mus musculus
caatggaactcacgtgacactgctg

SEQ ID NO: 554669 - DNA, 25 bp, Mus musculus
caatggaactcaggtgacactgctg

SEQ ID NO: 554670 - DNA, 25 bp, Mus musculus
caatggaagaacaagaccaatctct

SEQ ID NO: 554671 - DNA, 25 bp, Mus musculus
caatggaagaactagaccaatctct

SEQ ID NO: 554672 - DNA, 25 bp, Mus musculus
caatggaagcagacaaggcaaggtg

SEQ ID NO: 554673 - DNA, 25 bp, Mus musculus
caatggaagcagtcaaggcaaggtg

SEQ ID NO: 554674 - DNA, 25 bp, Mus musculus
caatggaagtcccagcaatggcagg

SEQ ID NO: 554675 - DNA, 25 bp, Mus musculus
caatggaagtccgagcaatggcagg

SEQ ID NO: 554676 - DNA, 25 bp, Mus musculus
caatggaatggaatggttcgtgagc

SEQ ID NO: 554677 - DNA, 25 bp, Mus musculus
caatggaatggattggttcgtgagc

SEQ ID NO: 554678 - DNA, 25 bp, Mus musculus
caatggaattaaaacactaggagaa

SEQ ID NO: 554679 - DNA, 25 bp, Mus musculus
caatggaattaatacactaggagaa

SEQ ID NO: 554680 - DNA, 25 bp, Mus musculus
caatggaattcaccaacgtggtcgt

SEQ ID NO: 554681 - DNA, 25 bp, Mus musculus
caatggaattcagcaacgtggtcgt

SEQ ID NO: 554682 - DNA, 25 bp, Mus musculus
caatggacaaacactggcgcaagag

SEQ ID NO: 554683 - DNA, 25 bp, Mus musculus
caatggacaaactctggcgcaagag

SEQ ID NO: 554684 - DNA, 25 bp, Mus musculus
caatggacaagaagttcggctcctc

SEQ ID NO: 554685 - DNA, 25 bp, Mus musculus
caatggacaagatgttcggctcctc

SEQ ID NO: 554686 - DNA, 25 bp, Mus musculus
caatggacagatctgtgagtggccc

SEQ ID NO: 554687 - DNA, 25 bp, Mus musculus
caatggacagatgtgtgagtggccc

SEQ ID NO: 554688 - DNA, 25 bp, Mus musculus
caatggacattgatcttcggagacc

SEQ ID NO: 554689 - DNA, 25 bp, Mus musculus
caatggacattgttcttcggagacc

SEQ ID NO: 554690 - DNA, 25 bp, Mus musculus
caatggacgattcgtttatgtcttc

SEQ ID NO: 554691 - DNA, 25 bp, Mus musculus
caatggacgattggtttatgtcttc

SEQ ID NO: 554692 - DNA, 25 bp, Mus musculus
caatggactgaacaatgtgcttgtc

SEQ ID NO: 554693 - DNA, 25 bp, Mus musculus
caatggactgaagaatgtgcttgtc

SEQ ID NO: 554694 - DNA, 25 bp, Mus musculus
caatggactgcaagcatagtggaac

SEQ ID NO: 554695 - DNA, 25 bp, Mus musculus
caatggactgcatgcatagtggaac

SEQ ID NO: 554696 - DNA, 25 bp, Mus musculus
caatggactgcgagttgtggataac

SEQ ID NO: 554697 - DNA, 25 bp, Mus musculus
caatggactgcgtgttgtggataac

SEQ ID NO: 554698 - DNA, 25 bp, Mus musculus
caatggacttgcctcctatgagcag

SEQ ID NO: 554699 - DNA, 25 bp, Mus musculus
caatggacttgcgtcctatgagcag

SEQ ID NO: 554700 - DNA, 25 bp, Mus musculus
caatggagaatgactagacctgatc

SEQ ID NO: 554701 - DNA, 25 bp, Mus musculus
caatggagaatgtctagacctgatc

SEQ ID NO: 554702 - DNA, 25 bp, Mus musculus
caatggagacatacctacacagctt

SEQ ID NO: 554703 - DNA, 25 bp, Mus musculus
caatggagacatcacctccttgtca

SEQ ID NO: 554704 - DNA, 25 bp, Mus musculus
caatggagacatgacctccttgtca

SEQ ID NO: 554705 - DNA, 25 bp, Mus musculus
caatggagacattcctacacagctt

SEQ ID NO: 554706 - DNA, 25 bp, Mus musculus
caatggagaccacagtgaccaactg

SEQ ID NO: 554707 - DNA, 25 bp, Mus musculus
caatggagaccagagtgaccaactg

SEQ ID NO: 554708 - DNA, 25 bp, Mus musculus
caatggagacgacgctgttgtttcc

SEQ ID NO: 554709 - DNA, 25 bp, Mus musculus
caatggagacgaggctgttgtttcc

SEQ ID NO: 554710 - DNA, 25 bp, Mus musculus
caatggagatggacgagtggacttt

SEQ ID NO: 554711 - DNA, 25 bp, Mus musculus
caatggagatggtcgagtggacttt

SEQ ID NO: 554712 - DNA, 25 bp, Mus musculus
caatggaggatcctgtgagatcaca

SEQ ID NO: 554713 - DNA, 25 bp, Mus musculus
caatggaggatcgtgtgagatcaca

SEQ ID NO: 554714 - DNA, 25 bp, Mus musculus
caatggaggctgcttcttcccggat

SEQ ID NO: 554715 - DNA, 25 bp, Mus musculus
caatggaggctggttcttcccggat

SEQ ID NO: 554716 - DNA, 25 bp, Mus musculus
caatggagtataagggtgaactagc

SEQ ID NO: 554717 - DNA, 25 bp, Mus musculus
caatggagtatatgggtgaactagc

SEQ ID NO: 554718 - DNA, 25 bp, Mus musculus
caatggagtctacgcagctcgaggc

SEQ ID NO: 554719 - DNA, 25 bp, Mus musculus
caatggagtctaggcagctcgaggc

SEQ ID NO: 554720 - DNA, 25 bp, Mus musculus
caatggagtggaactcggccaaact

SEQ ID NO: 554721 - DNA, 25 bp, Mus musculus
caatggagtggatctcggccaaact

SEQ ID NO: 554722 - DNA, 25 bp, Mus musculus
caatggatcggaagatggcaaatat

SEQ ID NO: 554723 - DNA, 25 bp, Mus musculus
caatggatcggatgatggcaaatat

SEQ ID NO: 554724 - DNA, 25 bp, Mus musculus
caatggatcgtcctcttccaagtgg

SEQ ID NO: 554725 - DNA, 25 bp, Mus musculus
caatggatcgtcgtcttccaagtgg

SEQ ID NO: 554726 - DNA, 25 bp, Mus musculus
caatggatcttaactaaatgatagc

SEQ ID NO: 554727 - DNA, 25 bp, Mus musculus
caatggatcttatctaaatgatagc

SEQ ID NO: 554728 - DNA, 25 bp, Mus musculus
caatggatgcccatctcaggaaaga

SEQ ID NO: 554729 - DNA, 25 bp, Mus musculus
caatggatgcccttctcaggaaaga

SEQ ID NO: 554730 - DNA, 25 bp, Mus musculus
caatggatgggtaacacagatcgcc

SEQ ID NO: 554731 - DNA, 25 bp, Mus musculus
caatggatgggttacacagatcgcc

SEQ ID NO: 554732 - DNA, 25 bp, Mus musculus
caatggatgtcaccccatggagatc

SEQ ID NO: 554733 - DNA, 25 bp, Mus musculus
caatggatgtcagcccatggagatc

SEQ ID NO: 554734 - DNA, 25 bp, Mus musculus
caatggattctccacttcaaaggat

SEQ ID NO: 554735 - DNA, 25 bp, Mus musculus
caatggattctcgacttcaaaggat

SEQ ID NO: 554736 - DNA, 25 bp, Mus musculus
caatggattttgatacatctgctgc

SEQ ID NO: 554737 - DNA, 25 bp, Mus musculus
caatggattttgttacatctgctgc

SEQ ID NO: 554738 - DNA, 25 bp, Mus musculus
caatggcaacctcgtggatatcttc

SEQ ID NO: 554739 - DNA, 25 bp, Mus musculus
caatggcaacctggtggatatcttc

SEQ ID NO: 554740 - DNA, 25 bp, Mus musculus
caatggcaactgagtccttggtcac

SEQ ID NO: 554741 - DNA, 25 bp, Mus musculus
caatggcaactgtgtccttggtcac

SEQ ID NO: 554742 - DNA, 25 bp, Mus musculus
caatggcaaggtcatacccagtcac

SEQ ID NO: 554743 - DNA, 25 bp, Mus musculus
caatggcaaggtccatacacggcgc

SEQ ID NO: 554744 - DNA, 25 bp, Mus musculus
caatggcaaggtgatacccagtcac

SEQ ID NO: 554745 - DNA, 25 bp, Mus musculus
caatggcaaggtgcatacacggcgc

SEQ ID NO: 554746 - DNA, 25 bp, Mus musculus
caatggcaattacccgtcctggacg

SEQ ID NO: 554747 - DNA, 25 bp, Mus musculus
caatggcaattagccgtcctggacg

SEQ ID NO: 554748 - DNA, 25 bp, Mus musculus
caatggcaattgaaattgaacagct

SEQ ID NO: 554749 - DNA, 25 bp, Mus musculus
caatggcaattgtaattgaacagct

SEQ ID NO: 554750 - DNA, 25 bp, Mus musculus
caatggcagccaattatggcgagga

SEQ ID NO: 554751 - DNA, 25 bp, Mus musculus
caatggcagccatttatggcgagga

SEQ ID NO: 554752 - DNA, 25 bp, Mus musculus
caatggcagctaattcgacagaggt

SEQ ID NO: 554753 - DNA, 25 bp, Mus musculus
caatggcagctatttcgacagaggt

SEQ ID NO: 554754 - DNA, 25 bp, Mus musculus
caatggcagggaatatcattcctgc

SEQ ID NO: 554755 - DNA, 25 bp, Mus musculus
caatggcagggattatcattcctgc

SEQ ID NO: 554756 - DNA, 25 bp, Mus musculus
caatggcagttaaagggagacccct

SEQ ID NO: 554757 - DNA, 25 bp, Mus musculus
caatggcagttatagggagacccct

SEQ ID NO: 554758 - DNA, 25 bp, Mus musculus
caatggcatcatctgcggagaggac

SEQ ID NO: 554759 - DNA, 25 bp, Mus musculus
caatggcatcatgtgcggagaggac

SEQ ID NO: 554760 - DNA, 25 bp, Mus musculus
caatggcattgactccctgggtgtg

SEQ ID NO: 554761 - DNA, 25 bp, Mus musculus
caatggcattgagtccctgggtgtg

SEQ ID NO: 554762 - DNA, 25 bp, Mus musculus
caatggccaaaaagcaagtagaagt

SEQ ID NO: 554763 - DNA, 25 bp, Mus musculus
caatggccaaaatgcaagtagaagt

SEQ ID NO: 554764 - DNA, 25 bp, Mus musculus
caatggccaccgcattcaaagcagt

SEQ ID NO: 554765 - DNA, 25 bp, Mus musculus
caatggccaccggattcaaagcagt

SEQ ID NO: 554766 - DNA, 25 bp, Mus musculus
caatggccaggtccctcggaaaaag

SEQ ID NO: 554767 - DNA, 25 bp, Mus musculus
caatggccaggtgcctcggaaaaag

SEQ ID NO: 554768 - DNA, 25 bp, Mus musculus
caatggccatagcaagtctgaacgg

SEQ ID NO: 554769 - DNA, 25 bp, Mus musculus
caatggccataggaagtctgaacgg

SEQ ID NO: 554770 - DNA, 25 bp, Mus musculus
caatggcccctgctgctgatactca

SEQ ID NO: 554771 - DNA, 25 bp, Mus musculus
caatggcccctggtgctgatactca

SEQ ID NO: 554772 - DNA, 25 bp, Mus musculus
caatggccgagacccattgttggat

SEQ ID NO: 554773 - DNA, 25 bp, Mus musculus
caatggccgagagccattgttggat

SEQ ID NO: 554774 - DNA, 25 bp, Mus musculus
caatggccgagtcgatggaatctcc

SEQ ID NO: 554775 - DNA, 25 bp, Mus musculus
caatggccgagtggatggaatctcc

SEQ ID NO: 554776 - DNA, 25 bp, Mus musculus
caatggcctaatcgaattacactcg

SEQ ID NO: 554777 - DNA, 25 bp, Mus musculus
caatggcctaatggaattacactcg

SEQ ID NO: 554778 - DNA, 25 bp, Mus musculus
caatggcctcaaagagcacgatgga

SEQ ID NO: 554779 - DNA, 25 bp, Mus musculus
caatggcctcaatgagcacgatgga

SEQ ID NO: 554780 - DNA, 25 bp, Mus musculus
caatggcctgctcatctaccgggac

SEQ ID NO: 554781 - DNA, 25 bp, Mus musculus
caatggcctgctgatctaccgggac

SEQ ID NO: 554782 - DNA, 25 bp, Mus musculus
caatggcctgtgcagcaaaaagtct

SEQ ID NO: 554783 - DNA, 25 bp, Mus musculus
caatggcctgtggagcaaaaagtct

SEQ ID NO: 554784 - DNA, 25 bp, Mus musculus
caatggcgcctcagcaggtgtagct

SEQ ID NO: 554785 - DNA, 25 bp, Mus musculus
caatggcgcctctgcaggtgtagct

SEQ ID NO: 554786 - DNA, 25 bp, Mus musculus
caatggcgtcctccagatcctagat

SEQ ID NO: 554787 - DNA, 25 bp, Mus musculus
caatggcgtcctgcagatcctagat

SEQ ID NO: 554788 - DNA, 25 bp, Mus musculus
caatggctaaagcattagttgcctg

SEQ ID NO: 554789 - DNA, 25 bp, Mus musculus
caatggctaaaggattagttgcctg

SEQ ID NO: 554790 - DNA, 25 bp, Mus musculus
caatggctacttccaccactgacaa

SEQ ID NO: 554791 - DNA, 25 bp, Mus musculus
caatggctacttgcaccactgacaa

SEQ ID NO: 554792 - DNA, 25 bp, Mus musculus
caatggctagtgagacctctggcca

SEQ ID NO: 554793 - DNA, 25 bp, Mus musculus
caatggctagtgtgacctctggcca

SEQ ID NO: 554794 - DNA, 25 bp, Mus musculus
caatggctatgacccccagttcatc

SEQ ID NO: 554795 - DNA, 25 bp, Mus musculus
caatggctatgagccccagttcatc

SEQ ID NO: 554796 - DNA, 25 bp, Mus musculus
caatggctcagcacagagttctgag

SEQ ID NO: 554797 - DNA, 25 bp, Mus musculus
caatggctcagctcagagttctgag

SEQ ID NO: 554798 - DNA, 25 bp, Mus musculus
caatggctccgcagagctggatgat

SEQ ID NO: 554799 - DNA, 25 bp, Mus musculus
caatggctccgctgagctggatgat

SEQ ID NO: 554800 - DNA, 25 bp, Mus musculus
caatggctcttcagtctttaccacc

SEQ ID NO: 554801 - DNA, 25 bp, Mus musculus
caatggctcttctgtctttaccacc

SEQ ID NO: 554802 - DNA, 25 bp, Mus musculus
caatggctgaaaatggagataatga

SEQ ID NO: 554803 - DNA, 25 bp, Mus musculus
caatggctgaaattggagataatga

SEQ ID NO: 554804 - DNA, 25 bp, Mus musculus
caatggctgaatcaagttgaacagt

SEQ ID NO: 554805 - DNA, 25 bp, Mus musculus
caatggctgaatgaagttgaacagt

SEQ ID NO: 554806 - DNA, 25 bp, Mus musculus
caatggctgacactttacagagaga

SEQ ID NO: 554807 - DNA, 25 bp, Mus musculus
caatggctgacagtttacagagaga

SEQ ID NO: 554808 - DNA, 25 bp, Mus musculus
caatggctgtggcaggtgccaatca

SEQ ID NO: 554809 - DNA, 25 bp, Mus musculus
caatggctgtgggaggtgccaatca

SEQ ID NO: 554810 - DNA, 25 bp, Mus musculus
caatggcttctgaaccagctttaca

SEQ ID NO: 554811 - DNA, 25 bp, Mus musculus
caatggcttctgtaccagctttaca

SEQ ID NO: 554812 - DNA, 25 bp, Mus musculus
caatggcttggcagatccctatgtg

SEQ ID NO: 554813 - DNA, 25 bp, Mus musculus
caatggcttggctgatccctatgtg

SEQ ID NO: 554814 - DNA, 25 bp, Mus musculus
caatggctttatcacacgcgagttc

SEQ ID NO: 554815 - DNA, 25 bp, Mus musculus
caatggctttatgacacgcgagttc

SEQ ID NO: 554816 - DNA, 25 bp, Mus musculus
caatgggaaatccagaaaacatcga

SEQ ID NO: 554817 - DNA, 25 bp, Mus musculus
caatgggaaatcgagaaaacatcga

SEQ ID NO: 554818 - DNA, 25 bp, Mus musculus
caatgggacggacagctgaaattaa

SEQ ID NO: 554819 - DNA, 25 bp, Mus musculus
caatgggacggagagctgaaattaa

SEQ ID NO: 554820 - DNA, 25 bp, Mus musculus
caatgggactgcatatctgccgtgc

SEQ ID NO: 554821 - DNA, 25 bp, Mus musculus
caatgggactgcttatctgccgtgc

SEQ ID NO: 554822 - DNA, 25 bp, Mus musculus
caatgggagcaactttgtaggcaaa

SEQ ID NO: 554823 - DNA, 25 bp, Mus musculus
caatgggagcaagtttgtaggcaaa

SEQ ID NO: 554824 - DNA, 25 bp, Mus musculus
caatgggagctgattttcacttctc

SEQ ID NO: 554825 - DNA, 25 bp, Mus musculus
caatgggagctgtttttcacttctc

SEQ ID NO: 554826 - DNA, 25 bp, Mus musculus
caatgggcaaaacttaacagacctc

SEQ ID NO: 554827 - DNA, 25 bp, Mus musculus
caatgggcaaaagttaacagacctc

SEQ ID NO: 554828 - DNA, 25 bp, Mus musculus
caatgggcatacagctaggtgggaa

SEQ ID NO: 554829 - DNA, 25 bp, Mus musculus
caatgggcatactgctaggtgggaa

SEQ ID NO: 554830 - DNA, 25 bp, Mus musculus
caatgggcccacaaaagaccttgtt

SEQ ID NO: 554831 - DNA, 25 bp, Mus musculus
caatgggcccactaaagaccttgtt

SEQ ID NO: 554832 - DNA, 25 bp, Mus musculus
caatgggccgcaacaagaagaagaa

SEQ ID NO: 554833 - DNA, 25 bp, Mus musculus
caatgggccgcatcaagaagaagaa

SEQ ID NO: 554834 - DNA, 25 bp, Mus musculus
caatgggcctctcgctgatctgcag

SEQ ID NO: 554835 - DNA, 25 bp, Mus musculus
caatgggcctctggctgatctgcag

SEQ ID NO: 554836 - DNA, 25 bp, Mus musculus
caatgggcctttagctcacaaggag

SEQ ID NO: 554837 - DNA, 25 bp, Mus musculus
caatgggccttttgctcacaaggag

SEQ ID NO: 554838 - DNA, 25 bp, Mus musculus
caatgggcgactagtcagctgcaga

SEQ ID NO: 554839 - DNA, 25 bp, Mus musculus
caatgggcgacttgtcagctgcaga

SEQ ID NO: 554840 - DNA, 25 bp, Mus musculus
caatgggctactcgtctaccagggc

SEQ ID NO: 554841 - DNA, 25 bp, Mus musculus
caatgggctactggtctaccagggc

SEQ ID NO: 554842 - DNA, 25 bp, Mus musculus
caatgggctattcatgacacatggc

SEQ ID NO: 554843 - DNA, 25 bp, Mus musculus
caatgggctattgatgacacatggc

SEQ ID NO: 554844 - DNA, 25 bp, Mus musculus
caatgggctgatagccgggcaaaca

SEQ ID NO: 554845 - DNA, 25 bp, Mus musculus
caatgggctgattgccgggcaaaca

SEQ ID NO: 554846 - DNA, 25 bp, Mus musculus
caatgggctttgcagatcctctctc

SEQ ID NO: 554847 - DNA, 25 bp, Mus musculus
caatgggctttggagatcctctctc

SEQ ID NO: 554848 - DNA, 25 bp, Mus musculus
caatgggtcgttacttcagctgcgg

SEQ ID NO: 554849 - DNA, 25 bp, Mus musculus
caatgggtcgtttcttcagctgcgg

SEQ ID NO: 554850 - DNA, 25 bp, Mus musculus
caatgggtctgcagagcttgatggc

SEQ ID NO: 554851 - DNA, 25 bp, Mus musculus
caatgggtctgctgagcttgatggc

SEQ ID NO: 554852 - DNA, 25 bp, Mus musculus
caatggtacattctcactggatgag

SEQ ID NO: 554853 - DNA, 25 bp, Mus musculus
caatggtacattgtcactggatgag

SEQ ID NO: 554854 - DNA, 25 bp, Mus musculus
caatggtatcttacttttccgagaa

SEQ ID NO: 554855 - DNA, 25 bp, Mus musculus
caatggtatctttcttttccgagaa

SEQ ID NO: 554856 - DNA, 25 bp, Mus musculus
caatggtcatggagaacattgcaca

SEQ ID NO: 554857 - DNA, 25 bp, Mus musculus
caatggtcatggtgaacattgcaca

SEQ ID NO: 554858 - DNA, 25 bp, Mus musculus
caatggtccatcagagtcaagtgag

SEQ ID NO: 554859 - DNA, 25 bp, Mus musculus
caatggtccatctgagtcaagtgag

SEQ ID NO: 554860 - DNA, 25 bp, Mus musculus
caatggtcccaactgtctataagaa

SEQ ID NO: 554861 - DNA, 25 bp, Mus musculus
caatggtcccaagtgtctataagaa

SEQ ID NO: 554862 - DNA, 25 bp, Mus musculus
caatggtgaaagacttcatgacaac

SEQ ID NO: 554863 - DNA, 25 bp, Mus musculus
caatggtgaaagtcttcatgacaac

SEQ ID NO: 554864 - DNA, 25 bp, Mus musculus
caatggtgaccccaacaccctagag

SEQ ID NO: 554865 - DNA, 25 bp, Mus musculus
caatggtgacccgaacaccctagag

SEQ ID NO: 554866 - DNA, 25 bp, Mus musculus
caatggtgattgatcccactagaga

SEQ ID NO: 554867 - DNA, 25 bp, Mus musculus
caatggtgattgttcccactagaga

SEQ ID NO: 554868 - DNA, 25 bp, Mus musculus
caatggtggcggagccgccttttct

SEQ ID NO: 554869 - DNA, 25 bp, Mus musculus
caatggtggcggtgccgccttttct

SEQ ID NO: 554870 - DNA, 25 bp, Mus musculus
caatggtggcttcacttcggtggat

SEQ ID NO: 554871 - DNA, 25 bp, Mus musculus
caatggtggcttgacttcggtggat

SEQ ID NO: 554872 - DNA, 25 bp, Mus musculus
caatggtgtccccttgtggatcatc

SEQ ID NO: 554873 - DNA, 25 bp, Mus musculus
caatggtgtcccgttgtggatcatc

SEQ ID NO: 554874 - DNA, 25 bp, Mus musculus
caatggtgtccgagatcgggcttac

SEQ ID NO: 554875 - DNA, 25 bp, Mus musculus
caatggtgtccgtgatcgggcttac

SEQ ID NO: 554876 - DNA, 25 bp, Mus musculus
caatggtgtctacacgaacagcgca

SEQ ID NO: 554877 - DNA, 25 bp, Mus musculus
caatggtgtctagacgaacagcgca

SEQ ID NO: 554878 - DNA, 25 bp, Mus musculus
caatggtgtcttagaagtggtggcc

SEQ ID NO: 554879 - DNA, 25 bp, Mus musculus
caatggtgtctttgaagtggtggcc

SEQ ID NO: 554880 - DNA, 25 bp, Mus musculus
caatggtgtgaaccccgtcgacagt

SEQ ID NO: 554881 - DNA, 25 bp, Mus musculus
caatggtgtgaagcccgtcgacagt

SEQ ID NO: 554882 - DNA, 25 bp, Mus musculus
caatggttcagcctgctgagtcagg

SEQ ID NO: 554883 - DNA, 25 bp, Mus musculus
caatggttcagcgtgctgagtcagg

SEQ ID NO: 554884 - DNA, 25 bp, Mus musculus
caatggttcgagcactggcactacg

SEQ ID NO: 554885 - DNA, 25 bp, Mus musculus
caatggttcgaggactggcactacg

SEQ ID NO: 554886 - DNA, 25 bp, Mus musculus
caatggttctcgaattgaaatcaac

SEQ ID NO: 554887 - DNA, 25 bp, Mus musculus
caatggttctcgtattgaaatcaac

SEQ ID NO: 554888 - DNA, 25 bp, Mus musculus
caatggtttgacactactgatttta

SEQ ID NO: 554889 - DNA, 25 bp, Mus musculus
caatggtttgactctactgatttta

SEQ ID NO: 554890 - DNA, 25 bp, Mus musculus
caatgtaagcagcagaaaggatgag

SEQ ID NO: 554891 - DNA, 25 bp, Mus musculus
caatgtaagcaggagaaaggatgag

SEQ ID NO: 554892 - DNA, 25 bp, Mus musculus
caatgtaagcccctcctcatggagt

SEQ ID NO: 554893 - DNA, 25 bp, Mus musculus
caatgtaagcccgtcctcatggagt

SEQ ID NO: 554894 - DNA, 25 bp, Mus musculus
caatgtaaggataaagaagcagcga

SEQ ID NO: 554895 - DNA, 25 bp, Mus musculus
caatgtaaggattaagaagcagcga

SEQ ID NO: 554896 - DNA, 25 bp, Mus musculus
caatgtacgattcacaagagtcagc

SEQ ID NO: 554897 - DNA, 25 bp, Mus musculus
caatgtacgattgacaagagtcagc

SEQ ID NO: 554898 - DNA, 25 bp, Mus musculus
caatgtacttgtattgagtcagcac

SEQ ID NO: 554899 - DNA, 25 bp, Mus musculus
caatgtacttgttttgagtcagcac

SEQ ID NO: 554900 - DNA, 25 bp, Mus musculus
caatgtagccgtcatcaatgtaggg

SEQ ID NO: 554901 - DNA, 25 bp, Mus musculus
caatgtagccgtgatcaatgtaggg

SEQ ID NO: 554902 - DNA, 25 bp, Mus musculus
caatgtagtagaaaagtgtgttact

SEQ ID NO: 554903 - DNA, 25 bp, Mus musculus
caatgtagtagataagtgtgttact

SEQ ID NO: 554904 - DNA, 25 bp, Mus musculus
caatgtatggtacgtgctttagcga

SEQ ID NO: 554905 - DNA, 25 bp, Mus musculus
caatgtatggtaggtgctttagcga

SEQ ID NO: 554906 - DNA, 25 bp, Mus musculus
caatgtatttttctgtactactata

SEQ ID NO: 554907 - DNA, 25 bp, Mus musculus
caatgtatttttgtgtactactata

SEQ ID NO: 554908 - DNA, 25 bp, Mus musculus
caatgtcaacaacgcactgcgggtc

SEQ ID NO: 554909 - DNA, 25 bp, Mus musculus
caatgtcaacaaggcactgcgggtc

SEQ ID NO: 554910 - DNA, 25 bp, Mus musculus
caatgtcaacacatctgaggatgag

SEQ ID NO: 554911 - DNA, 25 bp, Mus musculus
caatgtcaacacttctgaggatgag

SEQ ID NO: 554912 - DNA, 25 bp, Mus musculus
caatgtcaagagagagatcattccc

SEQ ID NO: 554913 - DNA, 25 bp, Mus musculus
caatgtcaagagtgagatcattccc

SEQ ID NO: 554914 - DNA, 25 bp, Mus musculus
caatgtcacaggcatttcagtggga

SEQ ID NO: 554915 - DNA, 25 bp, Mus musculus
caatgtcacagggatttcagtggga

SEQ ID NO: 554916 - DNA, 25 bp, Mus musculus
caatgtcaccctagccctggatctg

SEQ ID NO: 554917 - DNA, 25 bp, Mus musculus
caatgtcacccttgccctggatctg

SEQ ID NO: 554918 - DNA, 25 bp, Mus musculus
caatgtcacctacaagaagagagcc

SEQ ID NO: 554919 - DNA, 25 bp, Mus musculus
caatgtcacctagaagaagagagcc

SEQ ID NO: 554920 - DNA, 25 bp, Mus musculus
caatgtcactagcaccagaggaacc

SEQ ID NO: 554921 - DNA, 25 bp, Mus musculus
caatgtcactaggaccagaggaacc

SEQ ID NO: 554922 - DNA, 25 bp, Mus musculus
caatgtcactccaggtgaaaatgaa

SEQ ID NO: 554923 - DNA, 25 bp, Mus musculus
caatgtcactcctggtgaaaatgaa

SEQ ID NO: 554924 - DNA, 25 bp, Mus musculus
caatgtcatcaacacctgggctctt

SEQ ID NO: 554925 - DNA, 25 bp, Mus musculus
caatgtcatcaagacctgggctctt

SEQ ID NO: 554926 - DNA, 25 bp, Mus musculus
caatgtcattgtcaagactgaacaa

SEQ ID NO: 554927 - DNA, 25 bp, Mus musculus
caatgtcattgtgaagactgaacaa

SEQ ID NO: 554928 - DNA, 25 bp, Mus musculus
caatgtccacagatccgactttggc

SEQ ID NO: 554929 - DNA, 25 bp, Mus musculus
caatgtccacagttccgactttggc

SEQ ID NO: 554930 - DNA, 25 bp, Mus musculus
caatgtccagccaggtcattccagc

SEQ ID NO: 554931 - DNA, 25 bp, Mus musculus
caatgtccagcctggtcattccagc

SEQ ID NO: 554932 - DNA, 25 bp, Mus musculus
caatgtcccatcctggagcgcctta

SEQ ID NO: 554933 - DNA, 25 bp, Mus musculus
caatgtcccatcgtggagcgcctta

SEQ ID NO: 554934 - DNA, 25 bp, Mus musculus
caatgtcccttaaggtgtgggcaaa

SEQ ID NO: 554935 - DNA, 25 bp, Mus musculus
caatgtcccttatggtgtgggcaaa

SEQ ID NO: 554936 - DNA, 25 bp, Mus musculus
caatgtccgaagagaacttctggcc

SEQ ID NO: 554937 - DNA, 25 bp, Mus musculus
caatgtccgaagtgaacttctggcc

SEQ ID NO: 554938 - DNA, 25 bp, Mus musculus
caatgtccgagcaggagatgtcatc

SEQ ID NO: 554939 - DNA, 25 bp, Mus musculus
caatgtccgagctggagatgtcatc

SEQ ID NO: 554940 - DNA, 25 bp, Mus musculus
caatgtccgtctattgtaccccaaa

SEQ ID NO: 554941 - DNA, 25 bp, Mus musculus
caatgtccgtcttttgtaccccaaa

SEQ ID NO: 554942 - DNA, 25 bp, Mus musculus
caatgtcgtggcctggcatggaaac

SEQ ID NO: 554943 - DNA, 25 bp, Mus musculus
caatgtcgtggcgtggcatggaaac

SEQ ID NO: 554944 - DNA, 25 bp, Mus musculus
caatgtctaatgcttatgaagacca

SEQ ID NO: 554945 - DNA, 25 bp, Mus musculus
caatgtctaatggttatgaagacca

SEQ ID NO: 554946 - DNA, 25 bp, Mus musculus
caatgtctatgtagtctctccctac

SEQ ID NO: 554947 - DNA, 25 bp, Mus musculus
caatgtctatgtctgctctggccct

SEQ ID NO: 554948 - DNA, 25 bp, Mus musculus
caatgtctatgtgtgctctggccct

SEQ ID NO: 554949 - DNA, 25 bp, Mus musculus
caatgtctatgttgtctctccctac

SEQ ID NO: 554950 - DNA, 25 bp, Mus musculus
caatgtctgaccctcaagagagtgc

SEQ ID NO: 554951 - DNA, 25 bp, Mus musculus
caatgtctgaccgtcaagagagtgc

SEQ ID NO: 554952 - DNA, 25 bp, Mus musculus
caatgtctgcatagactccatgagt

SEQ ID NO: 554953 - DNA, 25 bp, Mus musculus
caatgtctgcattgactccatgagt

SEQ ID NO: 554954 - DNA, 25 bp, Mus musculus
caatgtctgcttagcatacacatca

SEQ ID NO: 554955 - DNA, 25 bp, Mus musculus
caatgtctgctttgcatacacatca

SEQ ID NO: 554956 - DNA, 25 bp, Mus musculus
caatgtctgtgtatgtccagggtcc

SEQ ID NO: 554957 - DNA, 25 bp, Mus musculus
caatgtctgtgtttgtccagggtcc

SEQ ID NO: 554958 - DNA, 25 bp, Mus musculus
caatgtgaacagcatcggtgttccc

SEQ ID NO: 554959 - DNA, 25 bp, Mus musculus
caatgtgaacaggatcggtgttccc

SEQ ID NO: 554960 - DNA, 25 bp, Mus musculus
caatgtgacagacatgtttcctgaa

SEQ ID NO: 554961 - DNA, 25 bp, Mus musculus
caatgtgacagagatgtttcctgaa

SEQ ID NO: 554962 - DNA, 25 bp, Mus musculus
caatgtgaccacagcagtatcagaa

SEQ ID NO: 554963 - DNA, 25 bp, Mus musculus
caatgtgaccactgcagtatcagaa

SEQ ID NO: 554964 - DNA, 25 bp, Mus musculus
caatgtgactccactgccggggatc

SEQ ID NO: 554965 - DNA, 25 bp, Mus musculus
caatgtgactcctctgccggggatc

SEQ ID NO: 554966 - DNA, 25 bp, Mus musculus
caatgtgactcgctggtttaacact

SEQ ID NO: 554967 - DNA, 25 bp, Mus musculus
caatgtgactcggtggtttaacact

SEQ ID NO: 554968 - DNA, 25 bp, Mus musculus
caatgtgactgcaccgacagcttca

SEQ ID NO: 554969 - DNA, 25 bp, Mus musculus
caatgtgactgctccgacagcttca

SEQ ID NO: 554970 - DNA, 25 bp, Mus musculus
caatgtgactgtatagtggaacaga

SEQ ID NO: 554971 - DNA, 25 bp, Mus musculus
caatgtgactgtttagtggaacaga

SEQ ID NO: 554972 - DNA, 25 bp, Mus musculus
caatgtgagaagagtcacccaggaa

SEQ ID NO: 554973 - DNA, 25 bp, Mus musculus
caatgtgagaagtgtcacccaggaa

SEQ ID NO: 554974 - DNA, 25 bp, Mus musculus
caatgtgatatacctcagcatggaa

SEQ ID NO: 554975 - DNA, 25 bp, Mus musculus
caatgtgatatagctcagcatggaa

SEQ ID NO: 554976 - DNA, 25 bp, Mus musculus
caatgtgatgctagacagggacggc

SEQ ID NO: 554977 - DNA, 25 bp, Mus musculus
caatgtgatgcttgacagggacggc

SEQ ID NO: 554978 - DNA, 25 bp, Mus musculus
caatgtgattgaagtgcagacgggc

SEQ ID NO: 554979 - DNA, 25 bp, Mus musculus
caatgtgattgatgtgcagacgggc

SEQ ID NO: 554980 - DNA, 25 bp, Mus musculus
caatgtgcacctatggaaggatgga

SEQ ID NO: 554981 - DNA, 25 bp, Mus musculus
caatgtgcacctttggaaggatgga

SEQ ID NO: 554982 - DNA, 25 bp, Mus musculus
caatgtgccatcacgctgtctgctg

SEQ ID NO: 554983 - DNA, 25 bp, Mus musculus
caatgtgccatctcgctgtctgctg

SEQ ID NO: 554984 - DNA, 25 bp, Mus musculus
caatgtgcccaaaatcatcattgct

SEQ ID NO: 554985 - DNA, 25 bp, Mus musculus
caatgtgcccaatatcatcattgct

SEQ ID NO: 554986 - DNA, 25 bp, Mus musculus
caatgtgctgcaaggtgaagtggca

SEQ ID NO: 554987 - DNA, 25 bp, Mus musculus
caatgtgctgcatggtgaagtggca

SEQ ID NO: 554988 - DNA, 25 bp, Mus musculus
caatgtgctgccaactttgagaact

SEQ ID NO: 554989 - DNA, 25 bp, Mus musculus
caatgtgctgcctactttgagaact

SEQ ID NO: 554990 - DNA, 25 bp, Mus musculus
caatgtgctggaagatgattacctt

SEQ ID NO: 554991 - DNA, 25 bp, Mus musculus
caatgtgctggatgatgattacctt

SEQ ID NO: 554992 - DNA, 25 bp, Mus musculus
caatgtgctgtccaggctgctgaac

SEQ ID NO: 554993 - DNA, 25 bp, Mus musculus
caatgtgctgtcgaggctgctgaac

SEQ ID NO: 554994 - DNA, 25 bp, Mus musculus
caatgtgctttcatcagtgtacggg

SEQ ID NO: 554995 - DNA, 25 bp, Mus musculus
caatgtgctttcttcagtgtacggg

SEQ ID NO: 554996 - DNA, 25 bp, Mus musculus
caatgtggaaaaccggacgttgatc

SEQ ID NO: 554997 - DNA, 25 bp, Mus musculus
caatgtggaaaagcggacgttgatc

SEQ ID NO: 554998 - DNA, 25 bp, Mus musculus
caatgtggaattatctgaaacgtca

SEQ ID NO: 554999 - DNA, 25 bp, Mus musculus
caatgtggaattttctgaaacgtca

SEQ ID NO: 555000 - DNA, 25 bp, Mus musculus
caatgtggagacagttgaatacaag

SEQ ID NO: 555001 - DNA, 25 bp, Mus musculus
caatgtggagactgttgaatacaag

SEQ ID NO: 555002 - DNA, 25 bp, Mus musculus
caatgtggagcactccttcttcaat

SEQ ID NO: 555003 - DNA, 25 bp, Mus musculus
caatgtggagcagtccttcttcaat

SEQ ID NO: 555004 - DNA, 25 bp, Mus musculus
caatgtggatcgaccgtcagtggca

SEQ ID NO: 555005 - DNA, 25 bp, Mus musculus
caatgtggatcgtccgtcagtggca

SEQ ID NO: 555006 - DNA, 25 bp, Mus musculus
caatgtggatgaacctggaagccac

SEQ ID NO: 555007 - DNA, 25 bp, Mus musculus
caatgtggatgatcctggaagccac

SEQ ID NO: 555008 - DNA, 25 bp, Mus musculus
caatgtggatgccataatccgtggt

SEQ ID NO: 555009 - DNA, 25 bp, Mus musculus
caatgtggatgcgataatccgtggt

SEQ ID NO: 555010 - DNA, 25 bp, Mus musculus
caatgtggcaagaacagatacttga

SEQ ID NO: 555011 - DNA, 25 bp, Mus musculus
caatgtggcaagtacagatacttga

SEQ ID NO: 555012 - DNA, 25 bp, Mus musculus
caatgtggcagccatcttagaactg

SEQ ID NO: 555013 - DNA, 25 bp, Mus musculus
caatgtggcagcgatcttagaactg

SEQ ID NO: 555014 - DNA, 25 bp, Mus musculus
caatgtggccaactcactccagaag

SEQ ID NO: 555015 - DNA, 25 bp, Mus musculus
caatgtggccaagtcactccagaag

SEQ ID NO: 555016 - DNA, 25 bp, Mus musculus
caatgtggcccaagcaactgaaggc

SEQ ID NO: 555017 - DNA, 25 bp, Mus musculus
caatgtggcccatgcaactgaaggc

SEQ ID NO: 555018 - DNA, 25 bp, Mus musculus
caatgtggccttcgaatgctgagca

SEQ ID NO: 555019 - DNA, 25 bp, Mus musculus
caatgtggccttggaatgctgagca

SEQ ID NO: 555020 - DNA, 25 bp, Mus musculus
caatgtggctgcacgtggcttggac

SEQ ID NO: 555021 - DNA, 25 bp, Mus musculus
caatgtggctgctcgtggcttggac

SEQ ID NO: 555022 - DNA, 25 bp, Mus musculus
caatgtgggactcagcggcccagcc

SEQ ID NO: 555023 - DNA, 25 bp, Mus musculus
caatgtgggactgagcggcccagcc

SEQ ID NO: 555024 - DNA, 25 bp, Mus musculus
caatgtgggcaactgcaattggttc

SEQ ID NO: 555025 - DNA, 25 bp, Mus musculus
caatgtgggcaagtgcaattggttc

SEQ ID NO: 555026 - DNA, 25 bp, Mus musculus
caatgtgggtacatcgatcaccagc

SEQ ID NO: 555027 - DNA, 25 bp, Mus musculus
caatgtgggtacttcgatcaccagc

SEQ ID NO: 555028 - DNA, 25 bp, Mus musculus
caatgtggtgttcgacacggccatg

SEQ ID NO: 555029 - DNA, 25 bp, Mus musculus
caatgtggtgttggacacggccatg

SEQ ID NO: 555030 - DNA, 25 bp, Mus musculus
caatgtgtgcagacatcctcgcagt

SEQ ID NO: 555031 - DNA, 25 bp, Mus musculus
caatgtgtgcagtcatcctcgcagt

SEQ ID NO: 555032 - DNA, 25 bp, Mus musculus
caatgtgttaaaagtggtgagatgc

SEQ ID NO: 555033 - DNA, 25 bp, Mus musculus
caatgtgttaaatgtggtgagatgc

SEQ ID NO: 555034 - DNA, 25 bp, Mus musculus
caatgttaaagtagagcccctggaa

SEQ ID NO: 555035 - DNA, 25 bp, Mus musculus
caatgttaaagttgagcccctggaa

SEQ ID NO: 555036 - DNA, 25 bp, Mus musculus
caatgttactgtagtccagctacgg

SEQ ID NO: 555037 - DNA, 25 bp, Mus musculus
caatgttactgttgtccagctacgg

SEQ ID NO: 555038 - DNA, 25 bp, Mus musculus
caatgttacttccttagcctagcaa

SEQ ID NO: 555039 - DNA, 25 bp, Mus musculus
caatgttacttcgttagcctagcaa

SEQ ID NO: 555040 - DNA, 25 bp, Mus musculus
caatgttagcaaaacagctttgctg

SEQ ID NO: 555041 - DNA, 25 bp, Mus musculus
caatgttagcaatacagctttgctg

SEQ ID NO: 555042 - DNA, 25 bp, Mus musculus
caatgttagtggcatctggagctgc

SEQ ID NO: 555043 - DNA, 25 bp, Mus musculus
caatgttagtgggatctggagctgc

SEQ ID NO: 555044 - DNA, 25 bp, Mus musculus
caatgttatccaagggactagagga

SEQ ID NO: 555045 - DNA, 25 bp, Mus musculus
caatgttatccatgggactagagga

SEQ ID NO: 555046 - DNA, 25 bp, Mus musculus
caatgttatgggaagttctgcgggc

SEQ ID NO: 555047 - DNA, 25 bp, Mus musculus
caatgttatgggtagttctgcgggc

SEQ ID NO: 555048 - DNA, 25 bp, Mus musculus
caatgttcacccagatcagtcaggc

SEQ ID NO: 555049 - DNA, 25 bp, Mus musculus
caatgttcaccctgatcagtcaggc

SEQ ID NO: 555050 - DNA, 25 bp, Mus musculus
caatgttcagagctttggagacaac

SEQ ID NO: 555051 - DNA, 25 bp, Mus musculus
caatgttcagaggtttggagacaac

SEQ ID NO: 555052 - DNA, 25 bp, Mus musculus
caatgttcagttattggaccaagac

SEQ ID NO: 555053 - DNA, 25 bp, Mus musculus
caatgttcagtttttggaccaagac

SEQ ID NO: 555054 - DNA, 25 bp, Mus musculus
caatgttcggacagtgcgggccttc

SEQ ID NO: 555055 - DNA, 25 bp, Mus musculus
caatgttcggactgtgcgggccttc

SEQ ID NO: 555056 - DNA, 25 bp, Mus musculus
caatgttctggaccagcagctgggc

SEQ ID NO: 555057 - DNA, 25 bp, Mus musculus
caatgttctggagcagcagctgggc

SEQ ID NO: 555058 - DNA, 25 bp, Mus musculus
caatgttctttccaccttaaagcgt

SEQ ID NO: 555059 - DNA, 25 bp, Mus musculus
caatgttctttcgaccttaaagcgt

SEQ ID NO: 555060 - DNA, 25 bp, Mus musculus
caatgttgagctagccttccagact

SEQ ID NO: 555061 - DNA, 25 bp, Mus musculus
caatgttgagcttgccttccagact

SEQ ID NO: 555062 - DNA, 25 bp, Mus musculus
caatgttgcccaaccgatggatgcc

SEQ ID NO: 555063 - DNA, 25 bp, Mus musculus
caatgttgcccatccgatggatgcc

SEQ ID NO: 555064 - DNA, 25 bp, Mus musculus
caatgttggcataatgttcagaggc

SEQ ID NO: 555065 - DNA, 25 bp, Mus musculus
caatgttggcattatgttcagaggc

SEQ ID NO: 555066 - DNA, 25 bp, Mus musculus
caatgttggctcactcctgagtgca

SEQ ID NO: 555067 - DNA, 25 bp, Mus musculus
caatgttggctctctcctgagtgca

SEQ ID NO: 555068 - DNA, 25 bp, Mus musculus
caatgttgtggacaagtgtgttact

SEQ ID NO: 555069 - DNA, 25 bp, Mus musculus
caatgttgtggagaagtgtgttact

SEQ ID NO: 555070 - DNA, 25 bp, Mus musculus
caatgttgtggtatctttcgagggc

SEQ ID NO: 555071 - DNA, 25 bp, Mus musculus
caatgttgtggtttctttcgagggc

SEQ ID NO: 555072 - DNA, 25 bp, Mus musculus
caatgtttctgaacttgagctgcct

SEQ ID NO: 555073 - DNA, 25 bp, Mus musculus
caatgtttctgatcttgagctgcct

SEQ ID NO: 555074 - DNA, 25 bp, Mus musculus
caatgtttcttcaggttaaggctgc

SEQ ID NO: 555075 - DNA, 25 bp, Mus musculus
caatgtttcttctggttaaggctgc

SEQ ID NO: 555076 - DNA, 25 bp, Mus musculus
caatgtttgttgagagaagaattca

SEQ ID NO: 555077 - DNA, 25 bp, Mus musculus
caatgtttgttgtgagaagaattca

SEQ ID NO: 555078 - DNA, 25 bp, Mus musculus
caatgttttgctcgctgcaggctcc

SEQ ID NO: 555079 - DNA, 25 bp, Mus musculus
caatgttttgctggctgcaggctcc

SEQ ID NO: 555080 - DNA, 25 bp, Mus musculus
caattaaagaaacgattggctatcc

SEQ ID NO: 555081 - DNA, 25 bp, Mus musculus
caattaaagaaacttggcagctcct

SEQ ID NO: 555082 - DNA, 25 bp, Mus musculus
caattaaagaaaggattggctatcc

SEQ ID NO: 555083 - DNA, 25 bp, Mus musculus
caattaaagaaagttggcagctcct

SEQ ID NO: 555084 - DNA, 25 bp, Mus musculus
caattaaatgaaacaggaggagcag

SEQ ID NO: 555085 - DNA, 25 bp, Mus musculus
caattaaatgaatcaggaggagcag

SEQ ID NO: 555086 - DNA, 25 bp, Mus musculus
caattaaccaaacgcataggctggc

SEQ ID NO: 555087 - DNA, 25 bp, Mus musculus
caattaaccaaaggcataggctggc

SEQ ID NO: 555088 - DNA, 25 bp, Mus musculus
caattaaccagaacccacagcctgg

SEQ ID NO: 555089 - DNA, 25 bp, Mus musculus
caattaaccagatcccacagcctgg

SEQ ID NO: 555090 - DNA, 25 bp, Mus musculus
caattaatgtatctaccagactcaa

SEQ ID NO: 555091 - DNA, 25 bp, Mus musculus
caattaatgtatgtaccagactcaa

SEQ ID NO: 555092 - DNA, 25 bp, Mus musculus
caattacaacccactacctgaagag

SEQ ID NO: 555093 - DNA, 25 bp, Mus musculus
caattacaaccctctacctgaagag

SEQ ID NO: 555094 - DNA, 25 bp, Mus musculus
caattacacatacaagcgcttcgag

SEQ ID NO: 555095 - DNA, 25 bp, Mus musculus
caattacacatagaagcgcttcgag

SEQ ID NO: 555096 - DNA, 25 bp, Mus musculus
caattaccagccctactaaaggagg

SEQ ID NO: 555097 - DNA, 25 bp, Mus musculus
caattaccagccgtactaaaggagg

SEQ ID NO: 555098 - DNA, 25 bp, Mus musculus
caattaccatgacccaacagtgaaa

SEQ ID NO: 555099 - DNA, 25 bp, Mus musculus
caattaccatgagccaacagtgaaa

SEQ ID NO: 555100 - DNA, 25 bp, Mus musculus
caattacctgcgcatctcagaggcc

SEQ ID NO: 555101 - DNA, 25 bp, Mus musculus
caattacctgcggatctcagaggcc

SEQ ID NO: 555102 - DNA, 25 bp, Mus musculus
caattacctggaacttgattatgag

SEQ ID NO: 555103 - DNA, 25 bp, Mus musculus
caattacctggatcttgattatgag

SEQ ID NO: 555104 - DNA, 25 bp, Mus musculus
caattacctgtgatgctgtctagct

SEQ ID NO: 555105 - DNA, 25 bp, Mus musculus
caattacctgtgttgctgtctagct

SEQ ID NO: 555106 - DNA, 25 bp, Mus musculus
caattactatctccctatggtagag

SEQ ID NO: 555107 - DNA, 25 bp, Mus musculus
caattactatctgcctatggtagag

SEQ ID NO: 555108 - DNA, 25 bp, Mus musculus
caattagaacgacgagaggcctctg

SEQ ID NO: 555109 - DNA, 25 bp, Mus musculus
caattagaacgaggagaggcctctg

SEQ ID NO: 555110 - DNA, 25 bp, Mus musculus
caattagaaggcattattcctggag

SEQ ID NO: 555111 - DNA, 25 bp, Mus musculus
caattagaaggctttattcctggag

SEQ ID NO: 555112 - DNA, 25 bp, Mus musculus
caattagagacaagggtataaagag

SEQ ID NO: 555113 - DNA, 25 bp, Mus musculus
caattagagacatgggtataaagag

SEQ ID NO: 555114 - DNA, 25 bp, Mus musculus
caattagccgtgatttgggccccga

SEQ ID NO: 555115 - DNA, 25 bp, Mus musculus
caattagccgtgttttgggccccga

SEQ ID NO: 555116 - DNA, 25 bp, Mus musculus
caattaggacctagacagggtgggc

SEQ ID NO: 555117 - DNA, 25 bp, Mus musculus
caattaggaccttgacagggtgggc

SEQ ID NO: 555118 - DNA, 25 bp, Mus musculus
caattaggcgagatcattttggctc

SEQ ID NO: 555119 - DNA, 25 bp, Mus musculus
caattaggcgagttcattttggctc

SEQ ID NO: 555120 - DNA, 25 bp, Mus musculus
caattaggtgtcatatctcccgtga

SEQ ID NO: 555121 - DNA, 25 bp, Mus musculus
caattaggtgtcttatctcccgtga

SEQ ID NO: 555122 - DNA, 25 bp, Mus musculus
caattatacaccagggcatctggag

SEQ ID NO: 555123 - DNA, 25 bp, Mus musculus
caattatacacctgggcatctggag

SEQ ID NO: 555124 - DNA, 25 bp, Mus musculus
caattatactgacgtggctgctaca

SEQ ID NO: 555125 - DNA, 25 bp, Mus musculus
caattatactgaggtggctgctaca

SEQ ID NO: 555126 - DNA, 25 bp, Mus musculus
caattatactttaggtacaaaggag

SEQ ID NO: 555127 - DNA, 25 bp, Mus musculus
caattatacttttggtacaaaggag

SEQ ID NO: 555128 - DNA, 25 bp, Mus musculus
caattatcagtgacatttggcatcc

SEQ ID NO: 555129 - DNA, 25 bp, Mus musculus
caattatcagtgtcatttggcatcc

SEQ ID NO: 555130 - DNA, 25 bp, Mus musculus
caattatgactgctatgggaaaccc

SEQ ID NO: 555131 - DNA, 25 bp, Mus musculus
caattatgactggtatgggaaaccc

SEQ ID NO: 555132 - DNA, 25 bp, Mus musculus
caattatgaggtcgagtacttgtgt

SEQ ID NO: 555133 - DNA, 25 bp, Mus musculus
caattatgaggtggagtacttgtgt

SEQ ID NO: 555134 - DNA, 25 bp, Mus musculus
caattatgtgtactgcgccaagcag

SEQ ID NO: 555135 - DNA, 25 bp, Mus musculus
caattatgtgtagtgcgccaagcag

SEQ ID NO: 555136 - DNA, 25 bp, Mus musculus
caattcaaagatccaggcctcagta

SEQ ID NO: 555137 - DNA, 25 bp, Mus musculus
caattcaaagatgcaggcctcagta

SEQ ID NO: 555138 - DNA, 25 bp, Mus musculus
caattcaatgctcatatctggacta

SEQ ID NO: 555139 - DNA, 25 bp, Mus musculus
caattcaatgctgatatctggacta

SEQ ID NO: 555140 - DNA, 25 bp, Mus musculus
caattcacagagacgagcatgagct

SEQ ID NO: 555141 - DNA, 25 bp, Mus musculus
caattcacagagtcgagcatgagct

SEQ ID NO: 555142 - DNA, 25 bp, Mus musculus
caattcacctcactggcatggacga

SEQ ID NO: 555143 - DNA, 25 bp, Mus musculus
caattcacctcagtggcatggacga

SEQ ID NO: 555144 - DNA, 25 bp, Mus musculus
caattcagattactcttcaccacag

SEQ ID NO: 555145 - DNA, 25 bp, Mus musculus
caattcagattagtcttcaccacag

SEQ ID NO: 555146 - DNA, 25 bp, Mus musculus
caattcagctgtcgaggccgtgtca

SEQ ID NO: 555147 - DNA, 25 bp, Mus musculus
caattcagctgtggaggccgtgtca

SEQ ID NO: 555148 - DNA, 25 bp, Mus musculus
caattcaggattatgatgcatgcag

SEQ ID NO: 555149 - DNA, 25 bp, Mus musculus
caattcaggattttgatgcatgcag

SEQ ID NO: 555150 - DNA, 25 bp, Mus musculus
caattcaggcacattcaagatccca

SEQ ID NO: 555151 - DNA, 25 bp, Mus musculus
caattcaggcactttcaagatccca

SEQ ID NO: 555152 - DNA, 25 bp, Mus musculus
caattcagtcccctaagtgtgttag

SEQ ID NO: 555153 - DNA, 25 bp, Mus musculus
caattcagtcccgtaagtgtgttag

SEQ ID NO: 555154 - DNA, 25 bp, Mus musculus
caattcagtgaacctttccaaactg

SEQ ID NO: 555155 - DNA, 25 bp, Mus musculus
caattcagtgaagctttccaaactg

SEQ ID NO: 555156 - DNA, 25 bp, Mus musculus
caattcatgacaacgtgctttccta

SEQ ID NO: 555157 - DNA, 25 bp, Mus musculus
caattcatgacatcgtgctttccta

SEQ ID NO: 555158 - DNA, 25 bp, Mus musculus
caattcatgcaaatgttggagacaa

SEQ ID NO: 555159 - DNA, 25 bp, Mus musculus
caattcatgcaattgttggagacaa

SEQ ID NO: 555160 - DNA, 25 bp, Mus musculus
caattccaaggtcaaatttgtcatg

SEQ ID NO: 555161 - DNA, 25 bp, Mus musculus
caattccaaggtgaaatttgtcatg

SEQ ID NO: 555162 - DNA, 25 bp, Mus musculus
caattccaagtaaatcaaggagtct

SEQ ID NO: 555163 - DNA, 25 bp, Mus musculus
caattccaagtatatcaaggagtct

SEQ ID NO: 555164 - DNA, 25 bp, Mus musculus
caattccagaagaaagagacacacc

SEQ ID NO: 555165 - DNA, 25 bp, Mus musculus
caattccagaagtaagagacacacc

SEQ ID NO: 555166 - DNA, 25 bp, Mus musculus
caattccagggtcccgggaccagct

SEQ ID NO: 555167 - DNA, 25 bp, Mus musculus
caattccagggtgccgggaccagct

SEQ ID NO: 555168 - DNA, 25 bp, Mus musculus
caattcccagtaacggagctacccg

SEQ ID NO: 555169 - DNA, 25 bp, Mus musculus
caattcccagtatcggagctacccg

SEQ ID NO: 555170 - DNA, 25 bp, Mus musculus
caattcccgttcatgggctcgcagt

SEQ ID NO: 555171 - DNA, 25 bp, Mus musculus
caattcccgttcttgggctcgcagt

SEQ ID NO: 555172 - DNA, 25 bp, Mus musculus
caattccctcagaccaagggtaggg

SEQ ID NO: 555173 - DNA, 25 bp, Mus musculus
caattccctcagtccaagggtaggg

SEQ ID NO: 555174 - DNA, 25 bp, Mus musculus
caattccgatatcttggtggtaacc

SEQ ID NO: 555175 - DNA, 25 bp, Mus musculus
caattccgatatgttggtggtaacc

SEQ ID NO: 555176 - DNA, 25 bp, Mus musculus
caattccgggatctgggaaagctga

SEQ ID NO: 555177 - DNA, 25 bp, Mus musculus
caattccgggatgtgggaaagctga

SEQ ID NO: 555178 - DNA, 25 bp, Mus musculus
caattccgggcgctgtcacgagtga

SEQ ID NO: 555179 - DNA, 25 bp, Mus musculus
caattccgggcggtgtcacgagtga

SEQ ID NO: 555180 - DNA, 25 bp, Mus musculus
caattcctagtactagggaagagaa

SEQ ID NO: 555181 - DNA, 25 bp, Mus musculus
caattcctagtagtagggaagagaa

SEQ ID NO: 555182 - DNA, 25 bp, Mus musculus
caattcctggctatggcttctcaga

SEQ ID NO: 555183 - DNA, 25 bp, Mus musculus
caattcctggctttggcttctcaga

SEQ ID NO: 555184 - DNA, 25 bp, Mus musculus
caattcctgtttctttagcaagcag

SEQ ID NO: 555185 - DNA, 25 bp, Mus musculus
caattcctgtttgtttagcaagcag

SEQ ID NO: 555186 - DNA, 25 bp, Mus musculus
caattcgaaaagaagtgggaagatt

SEQ ID NO: 555187 - DNA, 25 bp, Mus musculus
caattcgaaaagtagtgggaagatt

SEQ ID NO: 555188 - DNA, 25 bp, Mus musculus
caattcgctcagaaagaataccatt

SEQ ID NO: 555189 - DNA, 25 bp, Mus musculus
caattcgctcagtaagaataccatt

SEQ ID NO: 555190 - DNA, 25 bp, Mus musculus
caattcgctttgcaagaatgccaag

SEQ ID NO: 555191 - DNA, 25 bp, Mus musculus
caattcgctttggaagaatgccaag

SEQ ID NO: 555192 - DNA, 25 bp, Mus musculus
caattcgtcaggcagctgaggcaca

SEQ ID NO: 555193 - DNA, 25 bp, Mus musculus
caattcgtcagggagctgaggcaca

SEQ ID NO: 555194 - DNA, 25 bp, Mus musculus
caattcgtggaactttgggcctcac

SEQ ID NO: 555195 - DNA, 25 bp, Mus musculus
caattcgtggaagtttgggcctcac

SEQ ID NO: 555196 - DNA, 25 bp, Mus musculus
caattctagcagatgtgaaggatcc

SEQ ID NO: 555197 - DNA, 25 bp, Mus musculus
caattctagcagttgtgaaggatcc

SEQ ID NO: 555198 - DNA, 25 bp, Mus musculus
caattctcagctcggctttgcccta

SEQ ID NO: 555199 - DNA, 25 bp, Mus musculus
caattctcagctgggctttgcccta

SEQ ID NO: 555200 - DNA, 25 bp, Mus musculus
caattctcatctcggacttcctgaa

SEQ ID NO: 555201 - DNA, 25 bp, Mus musculus
caattctcatctgggacttcctgaa

SEQ ID NO: 555202 - DNA, 25 bp, Mus musculus
caattctcccagctgaactgcttaa

SEQ ID NO: 555203 - DNA, 25 bp, Mus musculus
caattctcccaggtgaactgcttaa

SEQ ID NO: 555204 - DNA, 25 bp, Mus musculus
caattctcggaaccaagaagcggag

SEQ ID NO: 555205 - DNA, 25 bp, Mus musculus
caattctcggaagcaagaagcggag

SEQ ID NO: 555206 - DNA, 25 bp, Mus musculus
caattctctaggacctgcactggaa

SEQ ID NO: 555207 - DNA, 25 bp, Mus musculus
caattctctaggtcctgcactggaa

SEQ ID NO: 555208 - DNA, 25 bp, Mus musculus
caattctctccgatttcattcagca

SEQ ID NO: 555209 - DNA, 25 bp, Mus musculus
caattctctccgttttcattcagca

SEQ ID NO: 555210 - DNA, 25 bp, Mus musculus
caattctgagcaaggataaagactg

SEQ ID NO: 555211 - DNA, 25 bp, Mus musculus
caattctgagcatggataaagactg

SEQ ID NO: 555212 - DNA, 25 bp, Mus musculus
caattctgagttctatactggctgg

SEQ ID NO: 555213 - DNA, 25 bp, Mus musculus
caattctgagttgtatactggctgg

SEQ ID NO: 555214 - DNA, 25 bp, Mus musculus
caattctggccccatcatttgtggc

SEQ ID NO: 555215 - DNA, 25 bp, Mus musculus
caattctggcccgatcatttgtggc

SEQ ID NO: 555216 - DNA, 25 bp, Mus musculus
caattctggccgcttgtggagatcc

SEQ ID NO: 555217 - DNA, 25 bp, Mus musculus
caattctggccggttgtggagatcc

SEQ ID NO: 555218 - DNA, 25 bp, Mus musculus
caattctgggagagaagagagaatc

SEQ ID NO: 555219 - DNA, 25 bp, Mus musculus
caattctgggagtgaagagagaatc

SEQ ID NO: 555220 - DNA, 25 bp, Mus musculus
caattcttccaaaagtgtctgtgaa

SEQ ID NO: 555221 - DNA, 25 bp, Mus musculus
caattcttccaatagtgtctgtgaa

SEQ ID NO: 555222 - DNA, 25 bp, Mus musculus
caattcttccggcacgttcatcgtg

SEQ ID NO: 555223 - DNA, 25 bp, Mus musculus
caattcttccgggacgttcatcgtg

SEQ ID NO: 555224 - DNA, 25 bp, Mus musculus
caattcttcgttccccagacggcgt

SEQ ID NO: 555225 - DNA, 25 bp, Mus musculus
caattcttcgttgcccagacggcgt

SEQ ID NO: 555226 - DNA, 25 bp, Mus musculus
caattctttaatctgcgggactcgt

SEQ ID NO: 555227 - DNA, 25 bp, Mus musculus
caattctttaatgtgcgggactcgt

SEQ ID NO: 555228 - DNA, 25 bp, Mus musculus
caattgaaattgaacagcttttggc

SEQ ID NO: 555229 - DNA, 25 bp, Mus musculus
caattgaaattgtacagcttttggc

SEQ ID NO: 555230 - DNA, 25 bp, Mus musculus
caattgaacagaagaaggcgtatga

SEQ ID NO: 555231 - DNA, 25 bp, Mus musculus
caattgaacagatgaaggcgtatga

SEQ ID NO: 555232 - DNA, 25 bp, Mus musculus
caattgacaagtctgctgtcttcca

SEQ ID NO: 555233 - DNA, 25 bp, Mus musculus
caattgacaagtgtgctgtcttcca

SEQ ID NO: 555234 - DNA, 25 bp, Mus musculus
caattgacatatatccacaagaagt

SEQ ID NO: 555235 - DNA, 25 bp, Mus musculus
caattgacatatttccacaagaagt

SEQ ID NO: 555236 - DNA, 25 bp, Mus musculus
caattgaccgaaagcaagaggtacc

SEQ ID NO: 555237 - DNA, 25 bp, Mus musculus
caattgaccgaatgcaagaggtacc

SEQ ID NO: 555238 - DNA, 25 bp, Mus musculus
caattgacttgaaaaacaacttgct

SEQ ID NO: 555239 - DNA, 25 bp, Mus musculus
caattgacttgataaacaacttgct

SEQ ID NO: 555240 - DNA, 25 bp, Mus musculus
caattgagaaccacggtgtgagcta

SEQ ID NO: 555241 - DNA, 25 bp, Mus musculus
caattgagaacctcggtgtgagcta

SEQ ID NO: 555242 - DNA, 25 bp, Mus musculus
caattgagctctcgtaccatgaccc

SEQ ID NO: 555243 - DNA, 25 bp, Mus musculus
caattgagctctggtaccatgaccc

SEQ ID NO: 555244 - DNA, 25 bp, Mus musculus
caattgaggtcacgtttgctgggta

SEQ ID NO: 555245 - DNA, 25 bp, Mus musculus
caattgaggtcaggtttgctgggta

SEQ ID NO: 555246 - DNA, 25 bp, Mus musculus
caattgagtgtgcatcacggtagaa

SEQ ID NO: 555247 - DNA, 25 bp, Mus musculus
caattgagtgtggatcacggtagaa

SEQ ID NO: 555248 - DNA, 25 bp, Mus musculus
caattgatgacaaggttggtagaca

SEQ ID NO: 555249 - DNA, 25 bp, Mus musculus
caattgatgacatggttggtagaca

SEQ ID NO: 555250 - DNA, 25 bp, Mus musculus
caattgattgacagagaatctgata

SEQ ID NO: 555251 - DNA, 25 bp, Mus musculus
caattgattgactgagaatctgata

SEQ ID NO: 555252 - DNA, 25 bp, Mus musculus
caattgccaataatccagcagcagc

SEQ ID NO: 555253 - DNA, 25 bp, Mus musculus
caattgccaatattccagcagcagc

SEQ ID NO: 555254 - DNA, 25 bp, Mus musculus
caattgccaggacccctctataaag

SEQ ID NO: 555255 - DNA, 25 bp, Mus musculus
caattgccaggagccctctataaag

SEQ ID NO: 555256 - DNA, 25 bp, Mus musculus
caattgccgaaaagagcaaggcagg

SEQ ID NO: 555257 - DNA, 25 bp, Mus musculus
caattgccgaaatgagcaaggcagg

SEQ ID NO: 555258 - DNA, 25 bp, Mus musculus
caattgccgcagatgagagcttccc

SEQ ID NO: 555259 - DNA, 25 bp, Mus musculus
caattgccgcagttgagagcttccc

SEQ ID NO: 555260 - DNA, 25 bp, Mus musculus
caattgcctataccattttgtggga

SEQ ID NO: 555261 - DNA, 25 bp, Mus musculus
caattgcctatagcattttgtggga

SEQ ID NO: 555262 - DNA, 25 bp, Mus musculus
caattgcgaagaagaaggctctgtg

SEQ ID NO: 555263 - DNA, 25 bp, Mus musculus
caattgcgaagatgaaggctctgtg

SEQ ID NO: 555264 - DNA, 25 bp, Mus musculus
caattgctgaaaatcgagccatctg

SEQ ID NO: 555265 - DNA, 25 bp, Mus musculus
caattgctgaaattcgagccatctg

SEQ ID NO: 555266 - DNA, 25 bp, Mus musculus
caattgctggagaagatttttccat

SEQ ID NO: 555267 - DNA, 25 bp, Mus musculus
caattgctggagtagatttttccat

SEQ ID NO: 555268 - DNA, 25 bp, Mus musculus
caattgctgggaaaattaagtctcc

SEQ ID NO: 555269 - DNA, 25 bp, Mus musculus
caattgctgggataattaagtctcc

SEQ ID NO: 555270 - DNA, 25 bp, Mus musculus
caattggaaaacagggcgtatggtg

SEQ ID NO: 555271 - DNA, 25 bp, Mus musculus
caattggaaaactgggcgtatggtg

SEQ ID NO: 555272 - DNA, 25 bp, Mus musculus
caattggagatacagcctggccacc

SEQ ID NO: 555273 - DNA, 25 bp, Mus musculus
caattggagatagagcctggccacc

SEQ ID NO: 555274 - DNA, 25 bp, Mus musculus
caattggatgaaaacacaataggct

SEQ ID NO: 555275 - DNA, 25 bp, Mus musculus
caattggatgaatacacaataggct

SEQ ID NO: 555276 - DNA, 25 bp, Mus musculus
caattggcacaacggatggaactgg

SEQ ID NO: 555277 - DNA, 25 bp, Mus musculus
caattggcacaagggatggaactgg

SEQ ID NO: 555278 - DNA, 25 bp, Mus musculus
caattgggagacagatctcttgtga

SEQ ID NO: 555279 - DNA, 25 bp, Mus musculus
caattgggagactgatctcttgtga

SEQ ID NO: 555280 - DNA, 25 bp, Mus musculus
caattggtaaagctgtgtactgctc

SEQ ID NO: 555281 - DNA, 25 bp, Mus musculus
caattggtaaaggtgtgtactgctc

SEQ ID NO: 555282 - DNA, 25 bp, Mus musculus
caattggtacccacaactgaagagc

SEQ ID NO: 555283 - DNA, 25 bp, Mus musculus
caattggtaccctcaactgaagagc

SEQ ID NO: 555284 - DNA, 25 bp, Mus musculus
caattggtaccgatgaggatttagc

SEQ ID NO: 555285 - DNA, 25 bp, Mus musculus
caattggtaccgttgaggatttagc

SEQ ID NO: 555286 - DNA, 25 bp, Mus musculus
caattggtggtgctttcactgaaca

SEQ ID NO: 555287 - DNA, 25 bp, Mus musculus
caattggtggtggtttcactgaaca

SEQ ID NO: 555288 - DNA, 25 bp, Mus musculus
caattggttccgaacccagggccag

SEQ ID NO: 555289 - DNA, 25 bp, Mus musculus
caattggttccgtacccagggccag

SEQ ID NO: 555290 - DNA, 25 bp, Mus musculus
caattggttgctcagtgccaaatgg

SEQ ID NO: 555291 - DNA, 25 bp, Mus musculus
caattggttgctgagtgccaaatgg

SEQ ID NO: 555292 - DNA, 25 bp, Mus musculus
caattgtaccagagtataatgggct

SEQ ID NO: 555293 - DNA, 25 bp, Mus musculus
caattgtaccagtgtataatgggct

SEQ ID NO: 555294 - DNA, 25 bp, Mus musculus
caattgtccaaccaccatttcactg

SEQ ID NO: 555295 - DNA, 25 bp, Mus musculus
caattgtccaacgaccatttcactg

SEQ ID NO: 555296 - DNA, 25 bp, Mus musculus
caattgtctgtaactgactggactg

SEQ ID NO: 555297 - DNA, 25 bp, Mus musculus
caattgtctgtatctgactggactg

SEQ ID NO: 555298 - DNA, 25 bp, Mus musculus
caattgtcttggcaaactctctact

SEQ ID NO: 555299 - DNA, 25 bp, Mus musculus
caattgtcttgggaaactctctact

SEQ ID NO: 555300 - DNA, 25 bp, Mus musculus
caattgtgaaccagtgggacctgtc

SEQ ID NO: 555301 - DNA, 25 bp, Mus musculus
caattgtgaacctgtgggacctgtc

SEQ ID NO: 555302 - DNA, 25 bp, Mus musculus
caattgtgaaggctaaagatcagca

SEQ ID NO: 555303 - DNA, 25 bp, Mus musculus
caattgtgaagggtaaagatcagca

SEQ ID NO: 555304 - DNA, 25 bp, Mus musculus
caattgtgagaacgacgccgtgatt

SEQ ID NO: 555305 - DNA, 25 bp, Mus musculus
caattgtgagaaggacgccgtgatt

SEQ ID NO: 555306 - DNA, 25 bp, Mus musculus
caattgtgcactaggccgaatgacc

SEQ ID NO: 555307 - DNA, 25 bp, Mus musculus
caattgtgcacttggccgaatgacc

SEQ ID NO: 555308 - DNA, 25 bp, Mus musculus
caattgtgccttcgcgccttgtctg

SEQ ID NO: 555309 - DNA, 25 bp, Mus musculus
caattgtgccttggcgccttgtctg

SEQ ID NO: 555310 - DNA, 25 bp, Mus musculus
caattgttcagtctccatgcagtgt

SEQ ID NO: 555311 - DNA, 25 bp, Mus musculus
caattgttcagtgtccatgcagtgt

SEQ ID NO: 555312 - DNA, 25 bp, Mus musculus
caattgtttgcgcttaatgaatgaa

SEQ ID NO: 555313 - DNA, 25 bp, Mus musculus
caattgtttgcggttaatgaatgaa

SEQ ID NO: 555314 - DNA, 25 bp, Mus musculus
caatttaaacaccagcatcctcggg

SEQ ID NO: 555315 - DNA, 25 bp, Mus musculus
caatttaaacacgagcatcctcggg

SEQ ID NO: 555316 - DNA, 25 bp, Mus musculus
caatttaaagacagcaggctaaaaa

SEQ ID NO: 555317 - DNA, 25 bp, Mus musculus
caatttaaagactgcaggctaaaaa

SEQ ID NO: 555318 - DNA, 25 bp, Mus musculus
caatttaagtataatgtggaagaga

SEQ ID NO: 555319 - DNA, 25 bp, Mus musculus
caatttaagtattatgtggaagaga

SEQ ID NO: 555320 - DNA, 25 bp, Mus musculus
caatttacagcgcaagatacatttt

SEQ ID NO: 555321 - DNA, 25 bp, Mus musculus
caatttacagcggaagatacatttt

SEQ ID NO: 555322 - DNA, 25 bp, Mus musculus
caatttaccccaaactgaagttctg

SEQ ID NO: 555323 - DNA, 25 bp, Mus musculus
caatttaccccatactgaagttctg

SEQ ID NO: 555324 - DNA, 25 bp, Mus musculus
caatttactaatacctgtggtgacg

SEQ ID NO: 555325 - DNA, 25 bp, Mus musculus
caatttactaattcctgtggtgacg

SEQ ID NO: 555326 - DNA, 25 bp, Mus musculus
caatttagaataaagccctggcttg

SEQ ID NO: 555327 - DNA, 25 bp, Mus musculus
caatttagaatatagccctggcttg

SEQ ID NO: 555328 - DNA, 25 bp, Mus musculus
caatttaggcacatggaggaaggta

SEQ ID NO: 555329 - DNA, 25 bp, Mus musculus
caatttaggcacttggaggaaggta

SEQ ID NO: 555330 - DNA, 25 bp, Mus musculus
caatttatcgaccacagatttggag

SEQ ID NO: 555331 - DNA, 25 bp, Mus musculus
caatttatcgacgacagatttggag

SEQ ID NO: 555332 - DNA, 25 bp, Mus musculus
caatttatttcaccaacaagctgca

SEQ ID NO: 555333 - DNA, 25 bp, Mus musculus
caatttatttcagcaacaagctgca

SEQ ID NO: 555334 - DNA, 25 bp, Mus musculus
caatttccagaaatcacttcgggag

SEQ ID NO: 555335 - DNA, 25 bp, Mus musculus
caatttccagaattcacttcgggag

SEQ ID NO: 555336 - DNA, 25 bp, Mus musculus
caatttccatatcagtgtggaggaa

SEQ ID NO: 555337 - DNA, 25 bp, Mus musculus
caatttccatatgagtgtggaggaa

SEQ ID NO: 555338 - DNA, 25 bp, Mus musculus
caatttcccagtcgacccacagagg

SEQ ID NO: 555339 - DNA, 25 bp, Mus musculus
caatttcccagtggacccacagagg

SEQ ID NO: 555340 - DNA, 25 bp, Mus musculus
caatttccctgtcatcctgaccaga

SEQ ID NO: 555341 - DNA, 25 bp, Mus musculus
caatttccctgtgatcctgaccaga

SEQ ID NO: 555342 - DNA, 25 bp, Mus musculus
caatttcctgtaacccgcggccagg

SEQ ID NO: 555343 - DNA, 25 bp, Mus musculus
caatttcctgtatcccgcggccagg

SEQ ID NO: 555344 - DNA, 25 bp, Mus musculus
caatttctctgtctgtggttggagc

SEQ ID NO: 555345 - DNA, 25 bp, Mus musculus
caatttctctgtgtgtggttggagc

SEQ ID NO: 555346 - DNA, 25 bp, Mus musculus
caatttctgagacgcaacaggcggc

SEQ ID NO: 555347 - DNA, 25 bp, Mus musculus
caatttctgagaggcaacaggcggc

SEQ ID NO: 555348 - DNA, 25 bp, Mus musculus
caatttcttcacaggctgccctaag

SEQ ID NO: 555349 - DNA, 25 bp, Mus musculus
caatttcttcactggctgccctaag

SEQ ID NO: 555350 - DNA, 25 bp, Mus musculus
caatttgaaggtaaacgtggccctg

SEQ ID NO: 555351 - DNA, 25 bp, Mus musculus
caatttgaaggttaacgtggccctg

SEQ ID NO: 555352 - DNA, 25 bp, Mus musculus
caatttgaattcagagggacaatat

SEQ ID NO: 555353 - DNA, 25 bp, Mus musculus
caatttgaattctgagggacaatat

SEQ ID NO: 555354 - DNA, 25 bp, Mus musculus
caatttgacatcaggactggctccg

SEQ ID NO: 555355 - DNA, 25 bp, Mus musculus
caatttgacatctggactggctccg

SEQ ID NO: 555356 - DNA, 25 bp, Mus musculus
caatttgagagcagtgctgccaagc

SEQ ID NO: 555357 - DNA, 25 bp, Mus musculus
caatttgagagctgtgctgccaagc

SEQ ID NO: 555358 - DNA, 25 bp, Mus musculus
caatttgagatgcaggagctaatcc

SEQ ID NO: 555359 - DNA, 25 bp, Mus musculus
caatttgagatggaggagctaatcc

SEQ ID NO: 555360 - DNA, 25 bp, Mus musculus
caatttgcacagctcatggctgaag

SEQ ID NO: 555361 - DNA, 25 bp, Mus musculus
caatttgcacaggtcatggctgaag

SEQ ID NO: 555362 - DNA, 25 bp, Mus musculus
caatttgccacgagacaagttttta

SEQ ID NO: 555363 - DNA, 25 bp, Mus musculus
caatttgccacgtgacaagttttta

SEQ ID NO: 555364 - DNA, 25 bp, Mus musculus
caatttgccgacaaccctgctatca

SEQ ID NO: 555365 - DNA, 25 bp, Mus musculus
caatttgccgactaccctgctatca

SEQ ID NO: 555366 - DNA, 25 bp, Mus musculus
caatttgcctgaaatttattaaagt

SEQ ID NO: 555367 - DNA, 25 bp, Mus musculus
caatttgcctgatatttattaaagt

SEQ ID NO: 555368 - DNA, 25 bp, Mus musculus
caatttgctcatacacgagaggacc

SEQ ID NO: 555369 - DNA, 25 bp, Mus musculus
caatttgctcattcacgagaggacc

SEQ ID NO: 555370 - DNA, 25 bp, Mus musculus
caatttggaacacacctctctagca

SEQ ID NO: 555371 - DNA, 25 bp, Mus musculus
caatttggaacagacctctctagca

SEQ ID NO: 555372 - DNA, 25 bp, Mus musculus
caatttggagcaaagacttgggtca

SEQ ID NO: 555373 - DNA, 25 bp, Mus musculus
caatttggagcatagacttgggtca

SEQ ID NO: 555374 - DNA, 25 bp, Mus musculus
caatttggctaaagaaaaatgacag

SEQ ID NO: 555375 - DNA, 25 bp, Mus musculus
caatttggctaatgaaaaatgacag

SEQ ID NO: 555376 - DNA, 25 bp, Mus musculus
caatttggctatcttgctagagtaa

SEQ ID NO: 555377 - DNA, 25 bp, Mus musculus
caatttggctatgttgctagagtaa

SEQ ID NO: 555378 - DNA, 25 bp, Mus musculus
caatttggtataagccattaggaac

SEQ ID NO: 555379 - DNA, 25 bp, Mus musculus
caatttggtatatgccattaggaac

SEQ ID NO: 555380 - DNA, 25 bp, Mus musculus
caatttgtagatcatcaggtgctag

SEQ ID NO: 555381 - DNA, 25 bp, Mus musculus
caatttgtagatgatcaggtgctag

SEQ ID NO: 555382 - DNA, 25 bp, Mus musculus
caatttgttggacagctatctcaag

SEQ ID NO: 555383 - DNA, 25 bp, Mus musculus
caatttgttggagagctatctcaag

SEQ ID NO: 555384 - DNA, 25 bp, Mus musculus
caattttagttgctggaatgtccac

SEQ ID NO: 555385 - DNA, 25 bp, Mus musculus
caattttagttggtggaatgtccac

SEQ ID NO: 555386 - DNA, 25 bp, Mus musculus
caattttcattcattactctccagc

SEQ ID NO: 555387 - DNA, 25 bp, Mus musculus
caattttcattctttactctccagc

SEQ ID NO: 555388 - DNA, 25 bp, Mus musculus
caattttctagacacatacaagctg

SEQ ID NO: 555389 - DNA, 25 bp, Mus musculus
caattttctagagacatacaagctg

SEQ ID NO: 555390 - DNA, 25 bp, Mus musculus
caattttctgccatcaaagagtccc

SEQ ID NO: 555391 - DNA, 25 bp, Mus musculus
caattttctgccttcaaagagtccc

SEQ ID NO: 555392 - DNA, 25 bp, Mus musculus
caattttgcccaagtcatctttcaa

SEQ ID NO: 555393 - DNA, 25 bp, Mus musculus
caattttgcccatgtcatctttcaa

SEQ ID NO: 555394 - DNA, 25 bp, Mus musculus
caattttgctgaagaagatcaccga

SEQ ID NO: 555395 - DNA, 25 bp, Mus musculus
caattttgctgatgaagatcaccga

SEQ ID NO: 555396 - DNA, 25 bp, Mus musculus
caattttggagcaactcctttatgg

SEQ ID NO: 555397 - DNA, 25 bp, Mus musculus
caattttggagctactcctttatgg

SEQ ID NO: 555398 - DNA, 25 bp, Mus musculus
caattttggcgtcaagcattatgca

SEQ ID NO: 555399 - DNA, 25 bp, Mus musculus
caattttggcgtgaagcattatgca

SEQ ID NO: 555400 - DNA, 25 bp, Mus musculus
caattttggctaaactcctgttctg

SEQ ID NO: 555401 - DNA, 25 bp, Mus musculus
caattttggctatactcctgttctg

SEQ ID NO: 555402 - DNA, 25 bp, Mus musculus
caattttgtgcacacctggaccaac

SEQ ID NO: 555403 - DNA, 25 bp, Mus musculus
caattttgtgcaccgggacttggct

SEQ ID NO: 555404 - DNA, 25 bp, Mus musculus
caattttgtgcagacctggaccaac

SEQ ID NO: 555405 - DNA, 25 bp, Mus musculus
caattttgtgcagcgggacttggct

SEQ ID NO: 555406 - DNA, 25 bp, Mus musculus
caattttgtggaagttttagatggg

SEQ ID NO: 555407 - DNA, 25 bp, Mus musculus
caattttgtggatgttttagatggg

SEQ ID NO: 555408 - DNA, 25 bp, Mus musculus
caatttttcagaaggaggaccaggc

SEQ ID NO: 555409 - DNA, 25 bp, Mus musculus
caatttttcagatggaggaccaggc

SEQ ID NO: 555410 - DNA, 25 bp, Mus musculus
caatttttgatacttctgacctttc

SEQ ID NO: 555411 - DNA, 25 bp, Mus musculus
caatttttgatagttctgacctttc

SEQ ID NO: 555412 - DNA, 25 bp, Mus musculus
cacaaaaaaggaagttctgagacac

SEQ ID NO: 555413 - DNA, 25 bp, Mus musculus
cacaaaaaaggatgttctgagacac

SEQ ID NO: 555414 - DNA, 25 bp, Mus musculus
cacaaaaagggtaaagttgtcagtg

SEQ ID NO: 555415 - DNA, 25 bp, Mus musculus
cacaaaaagggttaagttgtcagtg

SEQ ID NO: 555416 - DNA, 25 bp, Mus musculus
cacaaaaccaagagcgcttcagcga

SEQ ID NO: 555417 - DNA, 25 bp, Mus musculus
cacaaaaccaagtgcgcttcagcga

SEQ ID NO: 555418 - DNA, 25 bp, Mus musculus
cacaaaacctttcaccgttacactg

SEQ ID NO: 555419 - DNA, 25 bp, Mus musculus
cacaaaacctttgaccgttacactg

SEQ ID NO: 555420 - DNA, 25 bp, Mus musculus
cacaaaactgccacctgattgaggg

SEQ ID NO: 555421 - DNA, 25 bp, Mus musculus
cacaaaactgcctcctgattgaggg

SEQ ID NO: 555422 - DNA, 25 bp, Mus musculus
cacaaaactggaattttgccctatc

SEQ ID NO: 555423 - DNA, 25 bp, Mus musculus
cacaaaactggatttttgccctatc

SEQ ID NO: 555424 - DNA, 25 bp, Mus musculus
cacaaaactgttagtgacacaacgg

SEQ ID NO: 555425 - DNA, 25 bp, Mus musculus
cacaaaactgtttgtgacacaacgg

SEQ ID NO: 555426 - DNA, 25 bp, Mus musculus
cacaaaagaaatagattattactac

SEQ ID NO: 555427 - DNA, 25 bp, Mus musculus
cacaaaagaaattgattattactac

SEQ ID NO: 555428 - DNA, 25 bp, Mus musculus
cacaaaaggcttactaggaggccaa

SEQ ID NO: 555429 - DNA, 25 bp, Mus musculus
cacaaaaggctttctaggaggccaa

SEQ ID NO: 555430 - DNA, 25 bp, Mus musculus
cacaaaagtaatccagtggatttat

SEQ ID NO: 555431 - DNA, 25 bp, Mus musculus
cacaaaagtaatgcagtggatttat

SEQ ID NO: 555432 - DNA, 25 bp, Mus musculus
cacaaaatcagcctgagaagcggga

SEQ ID NO: 555433 - DNA, 25 bp, Mus musculus
cacaaaatcagcgtgagaagcggga

SEQ ID NO: 555434 - DNA, 25 bp, Mus musculus
cacaaaatcttacaaatggagggaa

SEQ ID NO: 555435 - DNA, 25 bp, Mus musculus
cacaaaatcttagaaatggagggaa

SEQ ID NO: 555436 - DNA, 25 bp, Mus musculus
cacaaaatgcggattgtttaatgca

SEQ ID NO: 555437 - DNA, 25 bp, Mus musculus
cacaaaatgcggtttgtttaatgca

SEQ ID NO: 555438 - DNA, 25 bp, Mus musculus
cacaaaattataaaacagcctatgg

SEQ ID NO: 555439 - DNA, 25 bp, Mus musculus
cacaaaattatataacagcctatgg

SEQ ID NO: 555440 - DNA, 25 bp, Mus musculus
cacaaacatcagaaagcttctcttc

SEQ ID NO: 555441 - DNA, 25 bp, Mus musculus
cacaaacatcagtaagcttctcttc

SEQ ID NO: 555442 - DNA, 25 bp, Mus musculus
cacaaaccaatgctctggactttca

SEQ ID NO: 555443 - DNA, 25 bp, Mus musculus
cacaaaccaatggtctggactttca

SEQ ID NO: 555444 - DNA, 25 bp, Mus musculus
cacaaaccagatctccgtgtgcagg

SEQ ID NO: 555445 - DNA, 25 bp, Mus musculus
cacaaaccagatgtccgtgtgcagg

SEQ ID NO: 555446 - DNA, 25 bp, Mus musculus
cacaaaccggcaacgtgggaatgag

SEQ ID NO: 555447 - DNA, 25 bp, Mus musculus
cacaaaccggcatcgtgggaatgag

SEQ ID NO: 555448 - DNA, 25 bp, Mus musculus
cacaaacctaatcgccagagcatct

SEQ ID NO: 555449 - DNA, 25 bp, Mus musculus
cacaaacctaatggccagagcatct

SEQ ID NO: 555450 - DNA, 25 bp, Mus musculus
cacaaacctgggagcctcaccaaat

SEQ ID NO: 555451 - DNA, 25 bp, Mus musculus
cacaaacctgggtgcctcaccaaat

SEQ ID NO: 555452 - DNA, 25 bp, Mus musculus
cacaaacgcagtatataggtgctgg

SEQ ID NO: 555453 - DNA, 25 bp, Mus musculus
cacaaacgcagtttataggtgctgg

SEQ ID NO: 555454 - DNA, 25 bp, Mus musculus
cacaaacgcggtcattcatgaggtg

SEQ ID NO: 555455 - DNA, 25 bp, Mus musculus
cacaaacgcggtgattcatgaggtg

SEQ ID NO: 555456 - DNA, 25 bp, Mus musculus
cacaaacggagcattgtaatctcgg

SEQ ID NO: 555457 - DNA, 25 bp, Mus musculus
cacaaacggagctttgtaatctcgg

SEQ ID NO: 555458 - DNA, 25 bp, Mus musculus
cacaaacggcttagacctggaccgc

SEQ ID NO: 555459 - DNA, 25 bp, Mus musculus
cacaaacggctttgacctggaccgc

SEQ ID NO: 555460 - DNA, 25 bp, Mus musculus
cacaaactatggaccaaatccaaga

SEQ ID NO: 555461 - DNA, 25 bp, Mus musculus
cacaaactatggtccaaatccaaga

SEQ ID NO: 555462 - DNA, 25 bp, Mus musculus
cacaaactggatcgcaaattgatag

SEQ ID NO: 555463 - DNA, 25 bp, Mus musculus
cacaaactggatggcaaattgatag

SEQ ID NO: 555464 - DNA, 25 bp, Mus musculus
cacaaactgtcccttagggtggcct

SEQ ID NO: 555465 - DNA, 25 bp, Mus musculus
cacaaactgtccgttagggtggcct

SEQ ID NO: 555466 - DNA, 25 bp, Mus musculus
cacaaacttcagctagagcagttcc

SEQ ID NO: 555467 - DNA, 25 bp, Mus musculus
cacaaacttcaggtagagcagttcc

SEQ ID NO: 555468 - DNA, 25 bp, Mus musculus
cacaaacttgtactatggcccaaac

SEQ ID NO: 555469 - DNA, 25 bp, Mus musculus
cacaaacttgtagtatggcccaaac

SEQ ID NO: 555470 - DNA, 25 bp, Mus musculus
cacaaagacagaattggagaaatta

SEQ ID NO: 555471 - DNA, 25 bp, Mus musculus
cacaaagacagatttggagaaatta

SEQ ID NO: 555472 - DNA, 25 bp, Mus musculus
cacaaagataggctccctccagaaa

SEQ ID NO: 555473 - DNA, 25 bp, Mus musculus
cacaaagatagggtccctccagaaa

SEQ ID NO: 555474 - DNA, 25 bp, Mus musculus
cacaaagatcccagaggatgtgtct

SEQ ID NO: 555475 - DNA, 25 bp, Mus musculus
cacaaagatccctgaggatgtgtct

SEQ ID NO: 555476 - DNA, 25 bp, Mus musculus
cacaaagatgttcgaaggaaaacca

SEQ ID NO: 555477 - DNA, 25 bp, Mus musculus
cacaaagatgttggaaggaaaacca

SEQ ID NO: 555478 - DNA, 25 bp, Mus musculus
cacaaagatttgaccactgctgaga

SEQ ID NO: 555479 - DNA, 25 bp, Mus musculus
cacaaagatttgtccactgctgaga

SEQ ID NO: 555480 - DNA, 25 bp, Mus musculus
cacaaagcaagcatctgtctggagg

SEQ ID NO: 555481 - DNA, 25 bp, Mus musculus
cacaaagcaagcttctgtctggagg

SEQ ID NO: 555482 - DNA, 25 bp, Mus musculus
cacaaagcctcgcatccttggatct

SEQ ID NO: 555483 - DNA, 25 bp, Mus musculus
cacaaagcctcggatccttggatct

SEQ ID NO: 555484 - DNA, 25 bp, Mus musculus
cacaaaggacgcctggaagccagga

SEQ ID NO: 555485 - DNA, 25 bp, Mus musculus
cacaaaggacgcgtggaagccagga

SEQ ID NO: 555486 - DNA, 25 bp, Mus musculus
cacaaaggcgatattggataaggcc

SEQ ID NO: 555487 - DNA, 25 bp, Mus musculus
cacaaaggcgattttggataaggcc

SEQ ID NO: 555488 - DNA, 25 bp, Mus musculus
cacaaaggcgtcaagggacccagaa

SEQ ID NO: 555489 - DNA, 25 bp, Mus musculus
cacaaaggcgtctagggacccagaa

SEQ ID NO: 555490 - DNA, 25 bp, Mus musculus
cacaaagggtggcaaaggattgtca

SEQ ID NO: 555491 - DNA, 25 bp, Mus musculus
cacaaagggtgggaaaggattgtca

SEQ ID NO: 555492 - DNA, 25 bp, Mus musculus
cacaaaggtggcatcagtatacatg

SEQ ID NO: 555493 - DNA, 25 bp, Mus musculus
cacaaaggtggcttcagtatacatg

SEQ ID NO: 555494 - DNA, 25 bp, Mus musculus
cacaaaggtgtgagaaagttcgagt

SEQ ID NO: 555495 - DNA, 25 bp, Mus musculus
cacaaaggtgtgtgaaagttcgagt

SEQ ID NO: 555496 - DNA, 25 bp, Mus musculus
cacaaagtcaacctgcagggtgagc

SEQ ID NO: 555497 - DNA, 25 bp, Mus musculus
cacaaagtcaacgtgcagggtgagc

SEQ ID NO: 555498 - DNA, 25 bp, Mus musculus
cacaaagttctaatggatctccaga

SEQ ID NO: 555499 - DNA, 25 bp, Mus musculus
cacaaagttctattggatctccaga

SEQ ID NO: 555500 - DNA, 25 bp, Mus musculus
cacaaatatcaccagtgccagtgct

SEQ ID NO: 555501 - DNA, 25 bp, Mus musculus
cacaaatatcacgagtgccagtgct

SEQ ID NO: 555502 - DNA, 25 bp, Mus musculus
cacaaatatgagaacgacctggcac

SEQ ID NO: 555503 - DNA, 25 bp, Mus musculus
cacaaatatgagtacgacctggcac

SEQ ID NO: 555504 - DNA, 25 bp, Mus musculus
cacaaatccggtacgatgctgtgac

SEQ ID NO: 555505 - DNA, 25 bp, Mus musculus
cacaaatccggttcgatgctgtgac

SEQ ID NO: 555506 - DNA, 25 bp, Mus musculus
cacaaatcttccagtatgatgcctt

SEQ ID NO: 555507 - DNA, 25 bp, Mus musculus
cacaaatcttcctgtatgatgcctt

SEQ ID NO: 555508 - DNA, 25 bp, Mus musculus
cacaaatcttcgaaggactcctcga

SEQ ID NO: 555509 - DNA, 25 bp, Mus musculus
cacaaatcttcgtaggactcctcga

SEQ ID NO: 555510 - DNA, 25 bp, Mus musculus
cacaaatgcagaaccactcgctgga

SEQ ID NO: 555511 - DNA, 25 bp, Mus musculus
cacaaatgcagatccactcgctgga

SEQ ID NO: 555512 - DNA, 25 bp, Mus musculus
cacaaatgcatccacaaaaggcggc

SEQ ID NO: 555513 - DNA, 25 bp, Mus musculus
cacaaatgcatcgacaaaaggcggc

SEQ ID NO: 555514 - DNA, 25 bp, Mus musculus
cacaaatgccgtcgtcggaagcagc

SEQ ID NO: 555515 - DNA, 25 bp, Mus musculus
cacaaatgccgtggtcggaagcagc

SEQ ID NO: 555516 - DNA, 25 bp, Mus musculus
cacaaatggaatcttggccatgctg

SEQ ID NO: 555517 - DNA, 25 bp, Mus musculus
cacaaatggaatgttggccatgctg

SEQ ID NO: 555518 - DNA, 25 bp, Mus musculus
cacaaatggcaccttggtagcagct

SEQ ID NO: 555519 - DNA, 25 bp, Mus musculus
cacaaatggcacgttggtagcagct

SEQ ID NO: 555520 - DNA, 25 bp, Mus musculus
cacaaatgtgtgctggattcctgcc

SEQ ID NO: 555521 - DNA, 25 bp, Mus musculus
cacaaatgtgtggtggattcctgcc

SEQ ID NO: 555522 - DNA, 25 bp, Mus musculus
cacaaattctgtcgagaatcttcaa

SEQ ID NO: 555523 - DNA, 25 bp, Mus musculus
cacaaattctgtggagaatcttcaa

SEQ ID NO: 555524 - DNA, 25 bp, Mus musculus
cacaaattggagatcaccatgctgt

SEQ ID NO: 555525 - DNA, 25 bp, Mus musculus
cacaaattggagttcaccatgctgt

SEQ ID NO: 555526 - DNA, 25 bp, Mus musculus
cacaacaaagccattggtgttggct

SEQ ID NO: 555527 - DNA, 25 bp, Mus musculus
cacaacaaagcctttggtgttggct

SEQ ID NO: 555528 - DNA, 25 bp, Mus musculus
cacaacacacatctccttggttgga

SEQ ID NO: 555529 - DNA, 25 bp, Mus musculus
cacaacacacatgtccttggttgga

SEQ ID NO: 555530 - DNA, 25 bp, Mus musculus
cacaacacagccatgcgagatggcg

SEQ ID NO: 555531 - DNA, 25 bp, Mus musculus
cacaacacagccttgcgagatggcg

SEQ ID NO: 555532 - DNA, 25 bp, Mus musculus
cacaacacgtggatgccgctgatga

SEQ ID NO: 555533 - DNA, 25 bp, Mus musculus
cacaacacgtggttgccgctgatga

SEQ ID NO: 555534 - DNA, 25 bp, Mus musculus
cacaacactgttcgatgtgaacact

SEQ ID NO: 555535 - DNA, 25 bp, Mus musculus
cacaacactgttggatgtgaacact

SEQ ID NO: 555536 - DNA, 25 bp, Mus musculus
cacaacagatctcgtgcccatgcgg

SEQ ID NO: 555537 - DNA, 25 bp, Mus musculus
cacaacagatctggtgcccatgcgg

SEQ ID NO: 555538 - DNA, 25 bp, Mus musculus
cacaacagccacctagtctgcggta

SEQ ID NO: 555539 - DNA, 25 bp, Mus musculus
cacaacagccacgtagtctgcggta

SEQ ID NO: 555540 - DNA, 25 bp, Mus musculus
cacaacagctcaactcgatttgact

SEQ ID NO: 555541 - DNA, 25 bp, Mus musculus
cacaacagctcatctcgatttgact

SEQ ID NO: 555542 - DNA, 25 bp, Mus musculus
cacaacaggtggctacagtcataca

SEQ ID NO: 555543 - DNA, 25 bp, Mus musculus
cacaacaggtgggtacagtcataca

SEQ ID NO: 555544 - DNA, 25 bp, Mus musculus
cacaacagtggccaagactcagatc

SEQ ID NO: 555545 - DNA, 25 bp, Mus musculus
cacaacagtggcgaagactcagatc

SEQ ID NO: 555546 - DNA, 25 bp, Mus musculus
cacaacataacacaagagataccca

SEQ ID NO: 555547 - DNA, 25 bp, Mus musculus
cacaacataacagaagagataccca

SEQ ID NO: 555548 - DNA, 25 bp, Mus musculus
cacaacatcgtgctgaatggaaaag

SEQ ID NO: 555549 - DNA, 25 bp, Mus musculus
cacaacatcgtggtgaatggaaaag

SEQ ID NO: 555550 - DNA, 25 bp, Mus musculus
cacaacattaaaagcagatgaagct

SEQ ID NO: 555551 - DNA, 25 bp, Mus musculus
cacaacattaaatgcagatgaagct

SEQ ID NO: 555552 - DNA, 25 bp, Mus musculus
cacaacattacgacaagttttgtca

SEQ ID NO: 555553 - DNA, 25 bp, Mus musculus
cacaacattacgtcaagttttgtca

SEQ ID NO: 555554 - DNA, 25 bp, Mus musculus
cacaacattcaccacggcatggatg

SEQ ID NO: 555555 - DNA, 25 bp, Mus musculus
cacaacattcacgacggcatggatg

SEQ ID NO: 555556 - DNA, 25 bp, Mus musculus
cacaaccagcgaatccgggtacctt

SEQ ID NO: 555557 - DNA, 25 bp, Mus musculus
cacaaccagcgattccgggtacctt

SEQ ID NO: 555558 - DNA, 25 bp, Mus musculus
cacaaccagcgtcggaatgtgtgac

SEQ ID NO: 555559 - DNA, 25 bp, Mus musculus
cacaaccagcgtgggaatgtgtgac

SEQ ID NO: 555560 - DNA, 25 bp, Mus musculus
cacaaccagcttatcttcattgcct

SEQ ID NO: 555561 - DNA, 25 bp, Mus musculus
cacaaccagcttttcttcattgcct

SEQ ID NO: 555562 - DNA, 25 bp, Mus musculus
cacaacccaaacatcacagtaagag

SEQ ID NO: 555563 - DNA, 25 bp, Mus musculus
cacaacccaaacttcacagtaagag

SEQ ID NO: 555564 - DNA, 25 bp, Mus musculus
cacaacccaagtcgtggatgggtca

SEQ ID NO: 555565 - DNA, 25 bp, Mus musculus
cacaacccaagtggtggatgggtca

SEQ ID NO: 555566 - DNA, 25 bp, Mus musculus
cacaacccagaacacactaggtggg

SEQ ID NO: 555567 - DNA, 25 bp, Mus musculus
cacaacccagaagacactaggtggg

SEQ ID NO: 555568 - DNA, 25 bp, Mus musculus
cacaaccgaaaacgagcttcttgac

SEQ ID NO: 555569 - DNA, 25 bp, Mus musculus
cacaaccgaaaaggagcttcttgac

SEQ ID NO: 555570 - DNA, 25 bp, Mus musculus
cacaaccggattctaatccgaggac

SEQ ID NO: 555571 - DNA, 25 bp, Mus musculus
cacaaccggattgtaatccgaggac

SEQ ID NO: 555572 - DNA, 25 bp, Mus musculus
cacaacctacggcatggctgatgga

SEQ ID NO: 555573 - DNA, 25 bp, Mus musculus
cacaacctacgggatggctgatgga

SEQ ID NO: 555574 - DNA, 25 bp, Mus musculus
cacaacctgctgctggtcagtgagg

SEQ ID NO: 555575 - DNA, 25 bp, Mus musculus
cacaacctgctggtggtcagtgagg

SEQ ID NO: 555576 - DNA, 25 bp, Mus musculus
cacaacctgtacattgaggcggcct

SEQ ID NO: 555577 - DNA, 25 bp, Mus musculus
cacaacctgtactttgaggcggcct

SEQ ID NO: 555578 - DNA, 25 bp, Mus musculus
cacaacctgttcaagaaacgactag

SEQ ID NO: 555579 - DNA, 25 bp, Mus musculus
cacaacctgttctagaaacgactag

SEQ ID NO: 555580 - DNA, 25 bp, Mus musculus
cacaaccttggtagccggtggctca

SEQ ID NO: 555581 - DNA, 25 bp, Mus musculus
cacaaccttggttgccggtggctca

SEQ ID NO: 555582 - DNA, 25 bp, Mus musculus
cacaacgagttcattggtgagacca

SEQ ID NO: 555583 - DNA, 25 bp, Mus musculus
cacaacgagttctttggtgagacca

SEQ ID NO: 555584 - DNA, 25 bp, Mus musculus
cacaacgggaatcggtactgggaca

SEQ ID NO: 555585 - DNA, 25 bp, Mus musculus
cacaacgggaatgggtactgggaca

SEQ ID NO: 555586 - DNA, 25 bp, Mus musculus
cacaacgggcacagtgagaaaggct

SEQ ID NO: 555587 - DNA, 25 bp, Mus musculus
cacaacgggcactgtgagaaaggct

SEQ ID NO: 555588 - DNA, 25 bp, Mus musculus
cacaacgtcaacacacggtgccaga

SEQ ID NO: 555589 - DNA, 25 bp, Mus musculus
cacaacgtcaactcacggtgccaga

SEQ ID NO: 555590 - DNA, 25 bp, Mus musculus
cacaacgtgtgcacgctggtgccac

SEQ ID NO: 555591 - DNA, 25 bp, Mus musculus
cacaacgtgtgctcgctggtgccac

SEQ ID NO: 555592 - DNA, 25 bp, Mus musculus
cacaacgttcagcaggagtgggtcc

SEQ ID NO: 555593 - DNA, 25 bp, Mus musculus
cacaacgttcaggaggagtgggtcc

SEQ ID NO: 555594 - DNA, 25 bp, Mus musculus
cacaacgtttgaaaagcaacccaga

SEQ ID NO: 555595 - DNA, 25 bp, Mus musculus
cacaacgtttgataagcaacccaga

SEQ ID NO: 555596 - DNA, 25 bp, Mus musculus
cacaactaaaggctcagaaagaggc

SEQ ID NO: 555597 - DNA, 25 bp, Mus musculus
cacaactaaagggtcagaaagaggc

SEQ ID NO: 555598 - DNA, 25 bp, Mus musculus
cacaactacggaacatctttatcac

SEQ ID NO: 555599 - DNA, 25 bp, Mus musculus
cacaactacggatcatctttatcac

SEQ ID NO: 555600 - DNA, 25 bp, Mus musculus
cacaactcgtatcaatgctgctgaa

SEQ ID NO: 555601 - DNA, 25 bp, Mus musculus
cacaactcgtatgaatgctgctgaa

SEQ ID NO: 555602 - DNA, 25 bp, Mus musculus
cacaactctctcagtggtcattgga

SEQ ID NO: 555603 - DNA, 25 bp, Mus musculus
cacaactctctctgtggtcattgga

SEQ ID NO: 555604 - DNA, 25 bp, Mus musculus
cacaactgctaccaaatagctgtga

SEQ ID NO: 555605 - DNA, 25 bp, Mus musculus
cacaactgctacgaaatagctgtga

SEQ ID NO: 555606 - DNA, 25 bp, Mus musculus
cacaactgcttcacaaacctgggct

SEQ ID NO: 555607 - DNA, 25 bp, Mus musculus
cacaactgcttctcaaacctgggct

SEQ ID NO: 555608 - DNA, 25 bp, Mus musculus
cacaactggagtaccatccggagcc

SEQ ID NO: 555609 - DNA, 25 bp, Mus musculus
cacaactggagttccatccggagcc

SEQ ID NO: 555610 - DNA, 25 bp, Mus musculus
cacaactggcaaccacaagggctat

SEQ ID NO: 555611 - DNA, 25 bp, Mus musculus
cacaactggcaagcacaagggctat

SEQ ID NO: 555612 - DNA, 25 bp, Mus musculus
cacaactggcttcaaaggcagctcc

SEQ ID NO: 555613 - DNA, 25 bp, Mus musculus
cacaactggcttgaaaggcagctcc

SEQ ID NO: 555614 - DNA, 25 bp, Mus musculus
cacaactgggagcaactgcaaagcc

SEQ ID NO: 555615 - DNA, 25 bp, Mus musculus
cacaactgggaggaactgcaaagcc

SEQ ID NO: 555616 - DNA, 25 bp, Mus musculus
cacaactgtggactagtgaaagcct

SEQ ID NO: 555617 - DNA, 25 bp, Mus musculus
cacaactgtggagtagtgaaagcct

SEQ ID NO: 555618 - DNA, 25 bp, Mus musculus
cacaacttatgacgaggacccagcc

SEQ ID NO: 555619 - DNA, 25 bp, Mus musculus
cacaacttatgaggaggacccagcc

SEQ ID NO: 555620 - DNA, 25 bp, Mus musculus
cacaacttggagaaaatgttagaac

SEQ ID NO: 555621 - DNA, 25 bp, Mus musculus
cacaacttggagtaaatgttagaac

SEQ ID NO: 555622 - DNA, 25 bp, Mus musculus
cacaactttcagcaggaatttgacc

SEQ ID NO: 555623 - DNA, 25 bp, Mus musculus
cacaactttcaggaggaatttgacc

SEQ ID NO: 555624 - DNA, 25 bp, Mus musculus
cacaagaaatcgcagcggcggtgtt

SEQ ID NO: 555625 - DNA, 25 bp, Mus musculus
cacaagaaatcggagcggcggtgtt

SEQ ID NO: 555626 - DNA, 25 bp, Mus musculus
cacaagaaatgtctataggataatc

SEQ ID NO: 555627 - DNA, 25 bp, Mus musculus
cacaagaaatgtgtataggataatc

SEQ ID NO: 555628 - DNA, 25 bp, Mus musculus
cacaagaaccagaaggatgaaatca

SEQ ID NO: 555629 - DNA, 25 bp, Mus musculus
cacaagaaccagtaggatgaaatca

SEQ ID NO: 555630 - DNA, 25 bp, Mus musculus
cacaagaaccggctacaagatgttt

SEQ ID NO: 555631 - DNA, 25 bp, Mus musculus
cacaagaaccgggtacaagatgttt

SEQ ID NO: 555632 - DNA, 25 bp, Mus musculus
cacaagaagacgacttgagaggtgc

SEQ ID NO: 555633 - DNA, 25 bp, Mus musculus
cacaagaagacgtcttgagaggtgc

SEQ ID NO: 555634 - DNA, 25 bp, Mus musculus
cacaagaatggtacttcccaggaag

SEQ ID NO: 555635 - DNA, 25 bp, Mus musculus
cacaagaatggttcttcccaggaag

SEQ ID NO: 555636 - DNA, 25 bp, Mus musculus
cacaagacacaaaggctgagtatgg

SEQ ID NO: 555637 - DNA, 25 bp, Mus musculus
cacaagacacaatggctgagtatgg

SEQ ID NO: 555638 - DNA, 25 bp, Mus musculus
cacaagaccataagcgattgctgga

SEQ ID NO: 555639 - DNA, 25 bp, Mus musculus
cacaagaccatatgcgattgctgga

SEQ ID NO: 555640 - DNA, 25 bp, Mus musculus
cacaagacgcttattcagattcaag

SEQ ID NO: 555641 - DNA, 25 bp, Mus musculus
cacaagacgctttttcagattcaag

SEQ ID NO: 555642 - DNA, 25 bp, Mus musculus
cacaagagaaaaaggcgcaacagga

SEQ ID NO: 555643 - DNA, 25 bp, Mus musculus
cacaagagaaaatggcgcaacagga

SEQ ID NO: 555644 - DNA, 25 bp, Mus musculus
cacaagagatacaagtctgaatggc

SEQ ID NO: 555645 - DNA, 25 bp, Mus musculus
cacaagagatactagtctgaatggc

SEQ ID NO: 555646 - DNA, 25 bp, Mus musculus
cacaagaggttgcagctcagggaca

SEQ ID NO: 555647 - DNA, 25 bp, Mus musculus
cacaagaggttggagctcagggaca

SEQ ID NO: 555648 - DNA, 25 bp, Mus musculus
cacaagatcagcaacctcatcgaca

SEQ ID NO: 555649 - DNA, 25 bp, Mus musculus
cacaagatcagctacctcatcgaca

SEQ ID NO: 555650 - DNA, 25 bp, Mus musculus
cacaagatcattatcgttccggaac

SEQ ID NO: 555651 - DNA, 25 bp, Mus musculus
cacaagatcattttcgttccggaac

SEQ ID NO: 555652 - DNA, 25 bp, Mus musculus
cacaagatttaacgcagtgggacct

SEQ ID NO: 555653 - DNA, 25 bp, Mus musculus
cacaagatttaaggcagtgggacct

SEQ ID NO: 555654 - DNA, 25 bp, Mus musculus
cacaagatttgcacgaggaaggcga

SEQ ID NO: 555655 - DNA, 25 bp, Mus musculus
cacaagatttgctcgaggaaggcga

SEQ ID NO: 555656 - DNA, 25 bp, Mus musculus
cacaagcagctcaattagagtccag

SEQ ID NO: 555657 - DNA, 25 bp, Mus musculus
cacaagcagctctattagagtccag

SEQ ID NO: 555658 - DNA, 25 bp, Mus musculus
cacaagcagtggaagtgagtcagaa

SEQ ID NO: 555659 - DNA, 25 bp, Mus musculus
cacaagcagtggtagtgagtcagaa

SEQ ID NO: 555660 - DNA, 25 bp, Mus musculus
cacaagccacacattgctggccaag

SEQ ID NO: 555661 - DNA, 25 bp, Mus musculus
cacaagccacactttgctggccaag

SEQ ID NO: 555662 - DNA, 25 bp, Mus musculus
cacaagccgaaacagttaccagcct

SEQ ID NO: 555663 - DNA, 25 bp, Mus musculus
cacaagccgaaagagttaccagcct

SEQ ID NO: 555664 - DNA, 25 bp, Mus musculus
cacaagccgatcaggatgcatgctg

SEQ ID NO: 555665 - DNA, 25 bp, Mus musculus
cacaagccgatctggatgcatgctg

SEQ ID NO: 555666 - DNA, 25 bp, Mus musculus
cacaagccggttcatgcaaatggga

SEQ ID NO: 555667 - DNA, 25 bp, Mus musculus
cacaagccggttgatgcaaatggga

SEQ ID NO: 555668 - DNA, 25 bp, Mus musculus
cacaagccgttgatggattagtccg

SEQ ID NO: 555669 - DNA, 25 bp, Mus musculus
cacaagccgttgttggattagtccg

SEQ ID NO: 555670 - DNA, 25 bp, Mus musculus
cacaagcctggaacggccattactt

SEQ ID NO: 555671 - DNA, 25 bp, Mus musculus
cacaagcctggatcggccattactt

SEQ ID NO: 555672 - DNA, 25 bp, Mus musculus
cacaagcgagtcactgaccacctga

SEQ ID NO: 555673 - DNA, 25 bp, Mus musculus
cacaagcgagtctctgaccacctga

SEQ ID NO: 555674 - DNA, 25 bp, Mus musculus
cacaagcggaagctagagcgcaaga

SEQ ID NO: 555675 - DNA, 25 bp, Mus musculus
cacaagcggaaggtagagcgcaaga

SEQ ID NO: 555676 - DNA, 25 bp, Mus musculus
cacaagcggtcacgcagtcaacaaa

SEQ ID NO: 555677 - DNA, 25 bp, Mus musculus
cacaagcggtcaggcagtcaacaaa

SEQ ID NO: 555678 - DNA, 25 bp, Mus musculus
cacaagctaaagacgggccattttc

SEQ ID NO: 555679 - DNA, 25 bp, Mus musculus
cacaagctaaagtcgggccattttc

SEQ ID NO: 555680 - DNA, 25 bp, Mus musculus
cacaagctccaaacggtgatgtctg

SEQ ID NO: 555681 - DNA, 25 bp, Mus musculus
cacaagctccaatcggtgatgtctg

SEQ ID NO: 555682 - DNA, 25 bp, Mus musculus
cacaagctccttcagagttctagcc

SEQ ID NO: 555683 - DNA, 25 bp, Mus musculus
cacaagctccttgagagttctagcc

SEQ ID NO: 555684 - DNA, 25 bp, Mus musculus
cacaagctcttgctctggagagcgc

SEQ ID NO: 555685 - DNA, 25 bp, Mus musculus
cacaagctcttggtctggagagcgc

SEQ ID NO: 555686 - DNA, 25 bp, Mus musculus
cacaagctgaagaagaatatctaga

SEQ ID NO: 555687 - DNA, 25 bp, Mus musculus
cacaagctgaagtagaatatctaga

SEQ ID NO: 555688 - DNA, 25 bp, Mus musculus
cacaagctttccaggtccagaggaa

SEQ ID NO: 555689 - DNA, 25 bp, Mus musculus
cacaagctttcctggtccagaggaa

SEQ ID NO: 555690 - DNA, 25 bp, Mus musculus
cacaagcttttcatatgccagaatc

SEQ ID NO: 555691 - DNA, 25 bp, Mus musculus
cacaagcttttcttatgccagaatc

SEQ ID NO: 555692 - DNA, 25 bp, Mus musculus
cacaaggacactcgtgcagggatga

SEQ ID NO: 555693 - DNA, 25 bp, Mus musculus
cacaaggacactggtgcagggatga

SEQ ID NO: 555694 - DNA, 25 bp, Mus musculus
cacaaggacccgcacataaagagcc

SEQ ID NO: 555695 - DNA, 25 bp, Mus musculus
cacaaggacccggacataaagagcc

SEQ ID NO: 555696 - DNA, 25 bp, Mus musculus
cacaaggacttccagccagtggctt

SEQ ID NO: 555697 - DNA, 25 bp, Mus musculus
cacaaggacttcgagccagtggctt

SEQ ID NO: 555698 - DNA, 25 bp, Mus musculus
cacaaggagaaactatacctgagag

SEQ ID NO: 555699 - DNA, 25 bp, Mus musculus
cacaaggagaaagtatacctgagag

SEQ ID NO: 555700 - DNA, 25 bp, Mus musculus
cacaaggagagaattcaaatgatgt

SEQ ID NO: 555701 - DNA, 25 bp, Mus musculus
cacaaggagagatttcaaatgatgt

SEQ ID NO: 555702 - DNA, 25 bp, Mus musculus
cacaaggagattcacggccgtctta

SEQ ID NO: 555703 - DNA, 25 bp, Mus musculus
cacaaggagattgacggccgtctta

SEQ ID NO: 555704 - DNA, 25 bp, Mus musculus
cacaaggagcaaaggaacatgaaga

SEQ ID NO: 555705 - DNA, 25 bp, Mus musculus
cacaaggagcaatggaacatgaaga

SEQ ID NO: 555706 - DNA, 25 bp, Mus musculus
cacaaggaggaaatatagagaactt

SEQ ID NO: 555707 - DNA, 25 bp, Mus musculus
cacaaggaggaattatagagaactt

SEQ ID NO: 555708 - DNA, 25 bp, Mus musculus
cacaaggatgacagtgaattagact

SEQ ID NO: 555709 - DNA, 25 bp, Mus musculus
cacaaggatgactgtgaattagact

SEQ ID NO: 555710 - DNA, 25 bp, Mus musculus
cacaaggcagggatgggacacatgc

SEQ ID NO: 555711 - DNA, 25 bp, Mus musculus
cacaaggcagggttgggacacatgc

SEQ ID NO: 555712 - DNA, 25 bp, Mus musculus
cacaaggccttcaatactgtccggg

SEQ ID NO: 555713 - DNA, 25 bp, Mus musculus
cacaaggccttctatactgtccggg

SEQ ID NO: 555714 - DNA, 25 bp, Mus musculus
cacaaggcgtccaacgacttatgca

SEQ ID NO: 555715 - DNA, 25 bp, Mus musculus
cacaaggcgtcctacgacttatgca

SEQ ID NO: 555716 - DNA, 25 bp, Mus musculus
cacaaggctcatagacaatgaccac

SEQ ID NO: 555717 - DNA, 25 bp, Mus musculus
cacaaggctcattgacaatgaccac

SEQ ID NO: 555718 - DNA, 25 bp, Mus musculus
cacaaggctgcacgctcttctacag

SEQ ID NO: 555719 - DNA, 25 bp, Mus musculus
cacaaggctgcaggctcttctacag

SEQ ID NO: 555720 - DNA, 25 bp, Mus musculus
cacaagggaactcctctgcacagct

SEQ ID NO: 555721 - DNA, 25 bp, Mus musculus
cacaagggaactgctctgcacagct

SEQ ID NO: 555722 - DNA, 25 bp, Mus musculus
cacaagggatggaactggtcctcgg

SEQ ID NO: 555723 - DNA, 25 bp, Mus musculus
cacaagggatggtactggtcctcgg

SEQ ID NO: 555724 - DNA, 25 bp, Mus musculus
cacaaggtaggcagcgtttttccag

SEQ ID NO: 555725 - DNA, 25 bp, Mus musculus
cacaaggtaggctgcgtttttccag

SEQ ID NO: 555726 - DNA, 25 bp, Mus musculus
cacaaggtgatcagtgtcctcgctg

SEQ ID NO: 555727 - DNA, 25 bp, Mus musculus
cacaaggtgatctgtgtcctcgctg

SEQ ID NO: 555728 - DNA, 25 bp, Mus musculus
cacaaggtgctgataggaagctcca

SEQ ID NO: 555729 - DNA, 25 bp, Mus musculus
cacaaggtgctgttaggaagctcca

SEQ ID NO: 555730 - DNA, 25 bp, Mus musculus
cacaaggtggaactggaccgtgtca

SEQ ID NO: 555731 - DNA, 25 bp, Mus musculus
cacaaggtggaagtggaccgtgtca

SEQ ID NO: 555732 - DNA, 25 bp, Mus musculus
cacaaggtgggcacgtgtacatgtg

SEQ ID NO: 555733 - DNA, 25 bp, Mus musculus
cacaaggtgggctcgtgtacatgtg

SEQ ID NO: 555734 - DNA, 25 bp, Mus musculus
cacaagtaaccaccagagagctcca

SEQ ID NO: 555735 - DNA, 25 bp, Mus musculus
cacaagtaaccagcagagagctcca

SEQ ID NO: 555736 - DNA, 25 bp, Mus musculus
cacaagtagtcaacctgagacggac

SEQ ID NO: 555737 - DNA, 25 bp, Mus musculus
cacaagtagtcatcctgagacggac

SEQ ID NO: 555738 - DNA, 25 bp, Mus musculus
cacaagtagtctcgtgatggtgaac

SEQ ID NO: 555739 - DNA, 25 bp, Mus musculus
cacaagtagtctggtgatggtgaac

SEQ ID NO: 555740 - DNA, 25 bp, Mus musculus
cacaagtatgatatcagcccagtat

SEQ ID NO: 555741 - DNA, 25 bp, Mus musculus
cacaagtatgatttcagcccagtat

SEQ ID NO: 555742 - DNA, 25 bp, Mus musculus
cacaagtcaagccataaagcagagg

SEQ ID NO: 555743 - DNA, 25 bp, Mus musculus
cacaagtcaagcgataaagcagagg

SEQ ID NO: 555744 - DNA, 25 bp, Mus musculus
cacaagtcaaggatatgttttgcca

SEQ ID NO: 555745 - DNA, 25 bp, Mus musculus
cacaagtcaaggttatgttttgcca

SEQ ID NO: 555746 - DNA, 25 bp, Mus musculus
cacaagtcagtacgtgtgcgcagag

SEQ ID NO: 555747 - DNA, 25 bp, Mus musculus
cacaagtcagtaggtgtgcgcagag

SEQ ID NO: 555748 - DNA, 25 bp, Mus musculus
cacaagtctgaacagagtgaggagc

SEQ ID NO: 555749 - DNA, 25 bp, Mus musculus
cacaagtctgaagagagtgaggagc

SEQ ID NO: 555750 - DNA, 25 bp, Mus musculus
cacaagtctggaaggacaaatatat

SEQ ID NO: 555751 - DNA, 25 bp, Mus musculus
cacaagtctggatggacaaatatat

SEQ ID NO: 555752 - DNA, 25 bp, Mus musculus
cacaagtcttcacaagagttttgag

SEQ ID NO: 555753 - DNA, 25 bp, Mus musculus
cacaagtcttcagaagagttttgag

SEQ ID NO: 555754 - DNA, 25 bp, Mus musculus
cacaagtcttggcaccatttgggtc

SEQ ID NO: 555755 - DNA, 25 bp, Mus musculus
cacaagtcttgggaccatttgggtc

SEQ ID NO: 555756 - DNA, 25 bp, Mus musculus
cacaagtgagacagatcgaatccaa

SEQ ID NO: 555757 - DNA, 25 bp, Mus musculus
cacaagtgagactgatcgaatccaa

SEQ ID NO: 555758 - DNA, 25 bp, Mus musculus
cacaagtgagctctaccctacagtc

SEQ ID NO: 555759 - DNA, 25 bp, Mus musculus
cacaagtgagctgtaccctacagtc

SEQ ID NO: 555760 - DNA, 25 bp, Mus musculus
cacaagtgatccagacatgagacgg

SEQ ID NO: 555761 - DNA, 25 bp, Mus musculus
cacaagtgatcctgacatgagacgg

SEQ ID NO: 555762 - DNA, 25 bp, Mus musculus
cacaagtgccacctgtgcgactacg

SEQ ID NO: 555763 - DNA, 25 bp, Mus musculus
cacaagtgccacgtgtgcgactacg

SEQ ID NO: 555764 - DNA, 25 bp, Mus musculus
cacaagtgcccacaagcatgttctc

SEQ ID NO: 555765 - DNA, 25 bp, Mus musculus
cacaagtgcccagaagcatgttctc

SEQ ID NO: 555766 - DNA, 25 bp, Mus musculus
cacaagtggactcgtgactcaactc

SEQ ID NO: 555767 - DNA, 25 bp, Mus musculus
cacaagtggactggtgactcaactc

SEQ ID NO: 555768 - DNA, 25 bp, Mus musculus
cacaagtgggttcgacatctaagcc

SEQ ID NO: 555769 - DNA, 25 bp, Mus musculus
cacaagtgggttggacatctaagcc

SEQ ID NO: 555770 - DNA, 25 bp, Mus musculus
cacaagtgtagcagcccagaggtat

SEQ ID NO: 555771 - DNA, 25 bp, Mus musculus
cacaagtgtagctgcccagaggtat

SEQ ID NO: 555772 - DNA, 25 bp, Mus musculus
cacaagtgtcagattgcaggctggg

SEQ ID NO: 555773 - DNA, 25 bp, Mus musculus
cacaagtgtcagtttgcaggctggg

SEQ ID NO: 555774 - DNA, 25 bp, Mus musculus
cacaagtgtgggagcctatcactac

SEQ ID NO: 555775 - DNA, 25 bp, Mus musculus
cacaagtgtgggtgcctatcactac

SEQ ID NO: 555776 - DNA, 25 bp, Mus musculus
cacaagttcttcactgacctataca

SEQ ID NO: 555777 - DNA, 25 bp, Mus musculus
cacaagttcttctctgacctataca

SEQ ID NO: 555778 - DNA, 25 bp, Mus musculus
cacaagttctttccggctacgtcca

SEQ ID NO: 555779 - DNA, 25 bp, Mus musculus
cacaagttctttgcggctacgtcca

SEQ ID NO: 555780 - DNA, 25 bp, Mus musculus
cacaagttggtgatgcctacatcca

SEQ ID NO: 555781 - DNA, 25 bp, Mus musculus
cacaagttggtgttgcctacatcca

SEQ ID NO: 555782 - DNA, 25 bp, Mus musculus
cacaagtttaagcagttgcagaggg

SEQ ID NO: 555783 - DNA, 25 bp, Mus musculus
cacaagtttaaggagttgcagaggg

SEQ ID NO: 555784 - DNA, 25 bp, Mus musculus
cacaataaaagaattgaggcgtctc

SEQ ID NO: 555785 - DNA, 25 bp, Mus musculus
cacaataaaagatttgaggcgtctc

SEQ ID NO: 555786 - DNA, 25 bp, Mus musculus
cacaatacagctcgaagagttacaa

SEQ ID NO: 555787 - DNA, 25 bp, Mus musculus
cacaatacagctggaagagttacaa

SEQ ID NO: 555788 - DNA, 25 bp, Mus musculus
cacaatacagggatctgcaggagcc

SEQ ID NO: 555789 - DNA, 25 bp, Mus musculus
cacaatacagggttctgcaggagcc

SEQ ID NO: 555790 - DNA, 25 bp, Mus musculus
cacaataggctacttcaaatctgaa

SEQ ID NO: 555791 - DNA, 25 bp, Mus musculus
cacaataggctagttcaaatctgaa

SEQ ID NO: 555792 - DNA, 25 bp, Mus musculus
cacaatataattctcaaatggagac

SEQ ID NO: 555793 - DNA, 25 bp, Mus musculus
cacaatataattgtcaaatggagac

SEQ ID NO: 555794 - DNA, 25 bp, Mus musculus
cacaatatgaagaatgagctggtca

SEQ ID NO: 555795 - DNA, 25 bp, Mus musculus
cacaatatgaagtatgagctggtca

SEQ ID NO: 555796 - DNA, 25 bp, Mus musculus
cacaatatgacgacagcccatctgc

SEQ ID NO: 555797 - DNA, 25 bp, Mus musculus
cacaatatgacgtcagcccatctgc

SEQ ID NO: 555798 - DNA, 25 bp, Mus musculus
cacaatatgggaatatcttaaagca

SEQ ID NO: 555799 - DNA, 25 bp, Mus musculus
cacaatatgggattatcttaaagca

SEQ ID NO: 555800 - DNA, 25 bp, Mus musculus
cacaatattcgcatgactgtctgga

SEQ ID NO: 555801 - DNA, 25 bp, Mus musculus
cacaatattcgcttgactgtctgga

SEQ ID NO: 555802 - DNA, 25 bp, Mus musculus
cacaatcactggctgtaccgtacac

SEQ ID NO: 555803 - DNA, 25 bp, Mus musculus
cacaatcactgggtgtaccgtacac

SEQ ID NO: 555804 - DNA, 25 bp, Mus musculus
cacaatcactgtcgatcagaaaacc

SEQ ID NO: 555805 - DNA, 25 bp, Mus musculus
cacaatcactgtggatcagaaaacc

SEQ ID NO: 555806 - DNA, 25 bp, Mus musculus
cacaatcgcccgagcacttggaatc

SEQ ID NO: 555807 - DNA, 25 bp, Mus musculus
cacaatcgcccgtgcacttggaatc

SEQ ID NO: 555808 - DNA, 25 bp, Mus musculus
cacaatcggcatctcttcaaagaca

SEQ ID NO: 555809 - DNA, 25 bp, Mus musculus
cacaatcggcatgtcttcaaagaca

SEQ ID NO: 555810 - DNA, 25 bp, Mus musculus
cacaatctctgtctttacaagagct

SEQ ID NO: 555811 - DNA, 25 bp, Mus musculus
cacaatctctgtgtttacaagagct

SEQ ID NO: 555812 - DNA, 25 bp, Mus musculus
cacaatctgtggatactaaggaaac

SEQ ID NO: 555813 - DNA, 25 bp, Mus musculus
cacaatctgtggttactaaggaaac

SEQ ID NO: 555814 - DNA, 25 bp, Mus musculus
cacaatctgttaaaggaaaccatcc

SEQ ID NO: 555815 - DNA, 25 bp, Mus musculus
cacaatctgttataggaaaccatcc

SEQ ID NO: 555816 - DNA, 25 bp, Mus musculus
cacaatcttacgatgcttatggatg

SEQ ID NO: 555817 - DNA, 25 bp, Mus musculus
cacaatcttacgttgcttatggatg

SEQ ID NO: 555818 - DNA, 25 bp, Mus musculus
cacaatcttatgcatgggtattgca

SEQ ID NO: 555819 - DNA, 25 bp, Mus musculus
cacaatcttatggatgggtattgca

SEQ ID NO: 555820 - DNA, 25 bp, Mus musculus
cacaatctttcacatgatgaacact

SEQ ID NO: 555821 - DNA, 25 bp, Mus musculus
cacaatctttcagatgatgaacact

SEQ ID NO: 555822 - DNA, 25 bp, Mus musculus
cacaatctttgcattggaaacttga

SEQ ID NO: 555823 - DNA, 25 bp, Mus musculus
cacaatctttgctttggaaacttga

SEQ ID NO: 555824 - DNA, 25 bp, Mus musculus
cacaatgaagaaaccgttcgccagg

SEQ ID NO: 555825 - DNA, 25 bp, Mus musculus
cacaatgaagaatccgttcgccagg

SEQ ID NO: 555826 - DNA, 25 bp, Mus musculus
cacaatgagaggaaagactcgcctt

SEQ ID NO: 555827 - DNA, 25 bp, Mus musculus
cacaatgagaggtaagactcgcctt

SEQ ID NO: 555828 - DNA, 25 bp, Mus musculus
cacaatgagctgacttgcatccccg

SEQ ID NO: 555829 - DNA, 25 bp, Mus musculus
cacaatgagctgtcttgcatccccg

SEQ ID NO: 555830 - DNA, 25 bp, Mus musculus
cacaatgaggcaagctagactgtcc

SEQ ID NO: 555831 - DNA, 25 bp, Mus musculus
cacaatgaggcatgctagactgtcc

SEQ ID NO: 555832 - DNA, 25 bp, Mus musculus
cacaatgatcggcaaagcagtggag

SEQ ID NO: 555833 - DNA, 25 bp, Mus musculus
cacaatgatcgggaaagcagtggag

SEQ ID NO: 555834 - DNA, 25 bp, Mus musculus
cacaatgcacgtcaaagatgaagtc

SEQ ID NO: 555835 - DNA, 25 bp, Mus musculus
cacaatgcacgtgaaagatgaagtc

SEQ ID NO: 555836 - DNA, 25 bp, Mus musculus
cacaatgcaggaaaggatcaccacc

SEQ ID NO: 555837 - DNA, 25 bp, Mus musculus
cacaatgcaggataggatcaccacc

SEQ ID NO: 555838 - DNA, 25 bp, Mus musculus
cacaatgcccaacgagatgtcagac

SEQ ID NO: 555839 - DNA, 25 bp, Mus musculus
cacaatgcccaaggagatgtcagac

SEQ ID NO: 555840 - DNA, 25 bp, Mus musculus
cacaatgcccgtcaccagtggttgc

SEQ ID NO: 555841 - DNA, 25 bp, Mus musculus
cacaatgcccgtgaccagtggttgc

SEQ ID NO: 555842 - DNA, 25 bp, Mus musculus
cacaatgcgcacaattggaggctca

SEQ ID NO: 555843 - DNA, 25 bp, Mus musculus
cacaatgcgcactattggaggctca

SEQ ID NO: 555844 - DNA, 25 bp, Mus musculus
cacaatgctgttcacgcagccgacg

SEQ ID NO: 555845 - DNA, 25 bp, Mus musculus
cacaatgctgttgacgcagccgacg

SEQ ID NO: 555846 - DNA, 25 bp, Mus musculus
cacaatggaaagacagccgactcct

SEQ ID NO: 555847 - DNA, 25 bp, Mus musculus
cacaatggaaagtcagccgactcct

SEQ ID NO: 555848 - DNA, 25 bp, Mus musculus
cacaatggacacagcaagggtctac

SEQ ID NO: 555849 - DNA, 25 bp, Mus musculus
cacaatggacactgcaagggtctac

SEQ ID NO: 555850 - DNA, 25 bp, Mus musculus
cacaatggaggcctatgtctgccct

SEQ ID NO: 555851 - DNA, 25 bp, Mus musculus
cacaatggaggcgtatgtctgccct

SEQ ID NO: 555852 - DNA, 25 bp, Mus musculus
cacaatggatatcgatttttctacc

SEQ ID NO: 555853 - DNA, 25 bp, Mus musculus
cacaatggatatggatttttctacc

SEQ ID NO: 555854 - DNA, 25 bp, Mus musculus
cacaatggcaacctggtggtagctg

SEQ ID NO: 555855 - DNA, 25 bp, Mus musculus
cacaatggcaaccttcaccatgacg

SEQ ID NO: 555856 - DNA, 25 bp, Mus musculus
cacaatggcaacgtggtggtagctg

SEQ ID NO: 555857 - DNA, 25 bp, Mus musculus
cacaatggcaacgttcaccatgacg

SEQ ID NO: 555858 - DNA, 25 bp, Mus musculus
cacaatggcagcctcttttgctcag

SEQ ID NO: 555859 - DNA, 25 bp, Mus musculus
cacaatggcagcgtcttttgctcag

SEQ ID NO: 555860 - DNA, 25 bp, Mus musculus
cacaatggccatcatcgactctgtc

SEQ ID NO: 555861 - DNA, 25 bp, Mus musculus
cacaatggccatgatcgactctgtc

SEQ ID NO: 555862 - DNA, 25 bp, Mus musculus
cacaatggccttaccggaagaactc

SEQ ID NO: 555863 - DNA, 25 bp, Mus musculus
cacaatggcctttccggaagaactc

SEQ ID NO: 555864 - DNA, 25 bp, Mus musculus
cacaatggctggaagctaaggaaga

SEQ ID NO: 555865 - DNA, 25 bp, Mus musculus
cacaatggctggtagctaaggaaga

SEQ ID NO: 555866 - DNA, 25 bp, Mus musculus
cacaatggtgaaagctgaccctctg

SEQ ID NO: 555867 - DNA, 25 bp, Mus musculus
cacaatggtgaatgctgaccctctg

SEQ ID NO: 555868 - DNA, 25 bp, Mus musculus
cacaatggttgtctacaagactgat

SEQ ID NO: 555869 - DNA, 25 bp, Mus musculus
cacaatggttgtgtacaagactgat

SEQ ID NO: 555870 - DNA, 25 bp, Mus musculus
cacaatgtcattctcaagactgaac

SEQ ID NO: 555871 - DNA, 25 bp, Mus musculus
cacaatgtcattgtcaagactgaac

SEQ ID NO: 555872 - DNA, 25 bp, Mus musculus
cacaatgtctacagtgggttatggg

SEQ ID NO: 555873 - DNA, 25 bp, Mus musculus
cacaatgtctactgtgggttatggg

SEQ ID NO: 555874 - DNA, 25 bp, Mus musculus
cacaatgtggacactttcatctccc

SEQ ID NO: 555875 - DNA, 25 bp, Mus musculus
cacaatgtggactctttcatctccc

SEQ ID NO: 555876 - DNA, 25 bp, Mus musculus
cacaattaccatcctttgcctgtag

SEQ ID NO: 555877 - DNA, 25 bp, Mus musculus
cacaattaccatgctttgcctgtag

SEQ ID NO: 555878 - DNA, 25 bp, Mus musculus
cacaattacttgatagctcagggtc

SEQ ID NO: 555879 - DNA, 25 bp, Mus musculus
cacaattacttgttagctcagggtc

SEQ ID NO: 555880 - DNA, 25 bp, Mus musculus
cacaattatgacaaagtacatcagc

SEQ ID NO: 555881 - DNA, 25 bp, Mus musculus
cacaattatgactaagtacatcagc

SEQ ID NO: 555882 - DNA, 25 bp, Mus musculus
cacaattctgttcgtcctgggactc

SEQ ID NO: 555883 - DNA, 25 bp, Mus musculus
cacaattctgttggtcctgggactc

SEQ ID NO: 555884 - DNA, 25 bp, Mus musculus
cacaattggcctctttgggaaaact

SEQ ID NO: 555885 - DNA, 25 bp, Mus musculus
cacaattggcctgtttgggaaaact

SEQ ID NO: 555886 - DNA, 25 bp, Mus musculus
cacaattgtgatcaatgagggctgg

SEQ ID NO: 555887 - DNA, 25 bp, Mus musculus
cacaattgtgatgaatgagggctgg

SEQ ID NO: 555888 - DNA, 25 bp, Mus musculus
cacaattttggtagggcaagaccga

SEQ ID NO: 555889 - DNA, 25 bp, Mus musculus
cacaattttggttgggcaagaccga

SEQ ID NO: 555890 - DNA, 25 bp, Mus musculus
cacaattttgtgcaagttttagatg

SEQ ID NO: 555891 - DNA, 25 bp, Mus musculus
cacaattttgtggaagttttagatg

SEQ ID NO: 555892 - DNA, 25 bp, Mus musculus
cacacaaacgctagttccggaactt

SEQ ID NO: 555893 - DNA, 25 bp, Mus musculus
cacacaaacgcttgttccggaactt

SEQ ID NO: 555894 - DNA, 25 bp, Mus musculus
cacacaaatactccgacgaaggagg

SEQ ID NO: 555895 - DNA, 25 bp, Mus musculus
cacacaaatactgcgacgaaggagg

SEQ ID NO: 555896 - DNA, 25 bp, Mus musculus
cacacaacacgacgccaagaaagcg

SEQ ID NO: 555897 - DNA, 25 bp, Mus musculus
cacacaacacgaggccaagaaagcg

SEQ ID NO: 555898 - DNA, 25 bp, Mus musculus
cacacaacactgacggaaggctctg

SEQ ID NO: 555899 - DNA, 25 bp, Mus musculus
cacacaacactgtcggaaggctctg

SEQ ID NO: 555900 - DNA, 25 bp, Mus musculus
cacacaaccagcatttcttcattgc

SEQ ID NO: 555901 - DNA, 25 bp, Mus musculus
cacacaaccagcttttcttcattgc

SEQ ID NO: 555902 - DNA, 25 bp, Mus musculus
cacacaacgaacaagaaaagcacag

SEQ ID NO: 555903 - DNA, 25 bp, Mus musculus
cacacaacgaactagaaaagcacag

SEQ ID NO: 555904 - DNA, 25 bp, Mus musculus
cacacaacggttatgccctttatat

SEQ ID NO: 555905 - DNA, 25 bp, Mus musculus
cacacaacggttttgccctttatat

SEQ ID NO: 555906 - DNA, 25 bp, Mus musculus
cacacaagctaaagacgggccattt

SEQ ID NO: 555907 - DNA, 25 bp, Mus musculus
cacacaagctaatgacgggccattt

SEQ ID NO: 555908 - DNA, 25 bp, Mus musculus
cacacaaggagtatgagcaactggc

SEQ ID NO: 555909 - DNA, 25 bp, Mus musculus
cacacaaggagtcctgggtcctagc

SEQ ID NO: 555910 - DNA, 25 bp, Mus musculus
cacacaaggagtgctgggtcctagc

SEQ ID NO: 555911 - DNA, 25 bp, Mus musculus
cacacaaggagtttgagcaactggc

SEQ ID NO: 555912 - DNA, 25 bp, Mus musculus
cacacaaggtgtaccacgtgggctc

SEQ ID NO: 555913 - DNA, 25 bp, Mus musculus
cacacaaggtgttccacgtgggctc

SEQ ID NO: 555914 - DNA, 25 bp, Mus musculus
cacacaagtctgatgcaggaaccag

SEQ ID NO: 555915 - DNA, 25 bp, Mus musculus
cacacaagtctgttgcaggaaccag

SEQ ID NO: 555916 - DNA, 25 bp, Mus musculus
cacacaatagcccaggctgaggcac

SEQ ID NO: 555917 - DNA, 25 bp, Mus musculus
cacacaatagccgaggctgaggcac

SEQ ID NO: 555918 - DNA, 25 bp, Mus musculus
cacacaatataaatctcaaatggag

SEQ ID NO: 555919 - DNA, 25 bp, Mus musculus
cacacaatataattctcaaatggag

SEQ ID NO: 555920 - DNA, 25 bp, Mus musculus
cacacaatatccatggcttagggtt

SEQ ID NO: 555921 - DNA, 25 bp, Mus musculus
cacacaatatccttggcttagggtt

SEQ ID NO: 555922 - DNA, 25 bp, Mus musculus
cacacaatccccaggatgtgaggag

SEQ ID NO: 555923 - DNA, 25 bp, Mus musculus
cacacaatcccctggatgtgaggag

SEQ ID NO: 555924 - DNA, 25 bp, Mus musculus
cacacacaaactcaaaaggacctca

SEQ ID NO: 555925 - DNA, 25 bp, Mus musculus
cacacacaaactgaaaaggacctca

SEQ ID NO: 555926 - DNA, 25 bp, Mus musculus
cacacacaagaacttcagaacattg

SEQ ID NO: 555927 - DNA, 25 bp, Mus musculus
cacacacaagaagttcagaacattg

SEQ ID NO: 555928 - DNA, 25 bp, Mus musculus
cacacacaatacacagggctggctg

SEQ ID NO: 555929 - DNA, 25 bp, Mus musculus
cacacacaatactcagggctggctg

SEQ ID NO: 555930 - DNA, 25 bp, Mus musculus
cacacacactataggaggacgcata

SEQ ID NO: 555931 - DNA, 25 bp, Mus musculus
cacacacactattggaggacgcata

SEQ ID NO: 555932 - DNA, 25 bp, Mus musculus
cacacacagaagactgtatggcacg

SEQ ID NO: 555933 - DNA, 25 bp, Mus musculus
cacacacagaagtctgtatggcacg

SEQ ID NO: 555934 - DNA, 25 bp, Mus musculus
cacacacagggcatcaataagcttg

SEQ ID NO: 555935 - DNA, 25 bp, Mus musculus
cacacacagggcttcaataagcttg

SEQ ID NO: 555936 - DNA, 25 bp, Mus musculus
cacacaccactcagttaatggatgc

SEQ ID NO: 555937 - DNA, 25 bp, Mus musculus
cacacaccactctgttaatggatgc

SEQ ID NO: 555938 - DNA, 25 bp, Mus musculus
cacacaccagatcttggtgggctgt

SEQ ID NO: 555939 - DNA, 25 bp, Mus musculus
cacacaccagatgttggtgggctgt

SEQ ID NO: 555940 - DNA, 25 bp, Mus musculus
cacacaccaggtactgttgagaatc

SEQ ID NO: 555941 - DNA, 25 bp, Mus musculus
cacacaccaggttctgttgagaatc

SEQ ID NO: 555942 - DNA, 25 bp, Mus musculus
cacacaccagtgatgctgtctgcgg

SEQ ID NO: 555943 - DNA, 25 bp, Mus musculus
cacacaccagtgttgctgtctgcgg

SEQ ID NO: 555944 - DNA, 25 bp, Mus musculus
cacacaccgggactgtggtgacagt

SEQ ID NO: 555945 - DNA, 25 bp, Mus musculus
cacacaccgggagtgtggtgacagt

SEQ ID NO: 555946 - DNA, 25 bp, Mus musculus
cacacacctgcgcaagatgcgcaag

SEQ ID NO: 555947 - DNA, 25 bp, Mus musculus
cacacacctgcggaagatgcgcaag

SEQ ID NO: 555948 - DNA, 25 bp, Mus musculus
cacacacctgtgcaagaagcagagt

SEQ ID NO: 555949 - DNA, 25 bp, Mus musculus
cacacacctgtggaagaagcagagt

SEQ ID NO: 555950 - DNA, 25 bp, Mus musculus
cacacacgcactacctgtacattgg

SEQ ID NO: 555951 - DNA, 25 bp, Mus musculus
cacacacgcacttcctgtacattgg

SEQ ID NO: 555952 - DNA, 25 bp, Mus musculus
cacacacgggtaaggacttcctgct

SEQ ID NO: 555953 - DNA, 25 bp, Mus musculus
cacacacgggtatggacttcctgct

SEQ ID NO: 555954 - DNA, 25 bp, Mus musculus
cacacacgtgaaaactgctaagaca

SEQ ID NO: 555955 - DNA, 25 bp, Mus musculus
cacacacgtgaatactgctaagaca

SEQ ID NO: 555956 - DNA, 25 bp, Mus musculus
cacacacgtggacggaaagcattct

SEQ ID NO: 555957 - DNA, 25 bp, Mus musculus
cacacacgtggagggaaagcattct

SEQ ID NO: 555958 - DNA, 25 bp, Mus musculus
cacacactctttccactggctttgt

SEQ ID NO: 555959 - DNA, 25 bp, Mus musculus
cacacactctttgcactggctttgt

SEQ ID NO: 555960 - DNA, 25 bp, Mus musculus
cacacactgaatacgagacttttca

SEQ ID NO: 555961 - DNA, 25 bp, Mus musculus
cacacactgaattcgagacttttca

SEQ ID NO: 555962 - DNA, 25 bp, Mus musculus
cacacactgaggctcgcctgtgact

SEQ ID NO: 555963 - DNA, 25 bp, Mus musculus
cacacactgagggtcgcctgtgact

SEQ ID NO: 555964 - DNA, 25 bp, Mus musculus
cacacactggatcgtgctgcatgtc

SEQ ID NO: 555965 - DNA, 25 bp, Mus musculus
cacacactggatggtgctgcatgtc

SEQ ID NO: 555966 - DNA, 25 bp, Mus musculus
cacacactgtggcagccagaggaca

SEQ ID NO: 555967 - DNA, 25 bp, Mus musculus
cacacactgtggcttgcattcgcca

SEQ ID NO: 555968 - DNA, 25 bp, Mus musculus
cacacactgtgggagccagaggaca

SEQ ID NO: 555969 - DNA, 25 bp, Mus musculus
cacacactgtgggttgcattcgcca

SEQ ID NO: 555970 - DNA, 25 bp, Mus musculus
cacacacttggccagaacatcgcag

SEQ ID NO: 555971 - DNA, 25 bp, Mus musculus
cacacacttggcgagaacatcgcag

SEQ ID NO: 555972 - DNA, 25 bp, Mus musculus
cacacactttgcagatatcaacacg

SEQ ID NO: 555973 - DNA, 25 bp, Mus musculus
cacacactttgctgatatcaacacg

SEQ ID NO: 555974 - DNA, 25 bp, Mus musculus
cacacagaaagaaggtgagaaggaa

SEQ ID NO: 555975 - DNA, 25 bp, Mus musculus
cacacagaaagatggtgagaaggaa

SEQ ID NO: 555976 - DNA, 25 bp, Mus musculus
cacacagaactgcagaaatatgaac

SEQ ID NO: 555977 - DNA, 25 bp, Mus musculus
cacacagaactgcatatggtaccag

SEQ ID NO: 555978 - DNA, 25 bp, Mus musculus
cacacagaactgctgcgaggacctg

SEQ ID NO: 555979 - DNA, 25 bp, Mus musculus
cacacagaactggagaaatatgaac

SEQ ID NO: 555980 - DNA, 25 bp, Mus musculus
cacacagaactggatatggtaccag

SEQ ID NO: 555981 - DNA, 25 bp, Mus musculus
cacacagaactggtgcgaggacctg

SEQ ID NO: 555982 - DNA, 25 bp, Mus musculus
cacacagaccagctcacaggagttt

SEQ ID NO: 555983 - DNA, 25 bp, Mus musculus
cacacagaccaggtcacaggagttt

SEQ ID NO: 555984 - DNA, 25 bp, Mus musculus
cacacagaccgaccgtttctgagca

SEQ ID NO: 555985 - DNA, 25 bp, Mus musculus
cacacagaccgagcgtttctgagca

SEQ ID NO: 555986 - DNA, 25 bp, Mus musculus
cacacagagataccgcctgcaacag

SEQ ID NO: 555987 - DNA, 25 bp, Mus musculus
cacacagagatagcgcctgcaacag

SEQ ID NO: 555988 - DNA, 25 bp, Mus musculus
cacacagagccgatgggtggtaaga

SEQ ID NO: 555989 - DNA, 25 bp, Mus musculus
cacacagagccgttgggtggtaaga

SEQ ID NO: 555990 - DNA, 25 bp, Mus musculus
cacacagagcttactgggccacaga

SEQ ID NO: 555991 - DNA, 25 bp, Mus musculus
cacacagagctttctgggccacaga

SEQ ID NO: 555992 - DNA, 25 bp, Mus musculus
cacacagcacacagctgagctgagt

SEQ ID NO: 555993 - DNA, 25 bp, Mus musculus
cacacagcacactgctgagctgagt

SEQ ID NO: 555994 - DNA, 25 bp, Mus musculus
cacacagcacagaggtgcccagaga

SEQ ID NO: 555995 - DNA, 25 bp, Mus musculus
cacacagcacagtggtgcccagaga

SEQ ID NO: 555996 - DNA, 25 bp, Mus musculus
cacacagcatgaaggggagtctcta

SEQ ID NO: 555997 - DNA, 25 bp, Mus musculus
cacacagcatgatggggagtctcta

SEQ ID NO: 555998 - DNA, 25 bp, Mus musculus
cacacagccctgcttgacaaggctg

SEQ ID NO: 555999 - DNA, 25 bp, Mus musculus
cacacagccctggttgacaaggctg

SEQ ID NO: 556000 - DNA, 25 bp, Mus musculus
cacacagcccttaggattcaaggca

SEQ ID NO: 556001 - DNA, 25 bp, Mus musculus
cacacagccctttggattcaaggca

SEQ ID NO: 556002 - DNA, 25 bp, Mus musculus
cacacagctataccactcgagtctg

SEQ ID NO: 556003 - DNA, 25 bp, Mus musculus
cacacagctatagcactcgagtctg

SEQ ID NO: 556004 - DNA, 25 bp, Mus musculus
cacacagctcatcgtatgctcctga

SEQ ID NO: 556005 - DNA, 25 bp, Mus musculus
cacacagctcatggtatgctcctga

SEQ ID NO: 556006 - DNA, 25 bp, Mus musculus
cacacagctggactgagccgtcgct

SEQ ID NO: 556007 - DNA, 25 bp, Mus musculus
cacacagctggagtgagccgtcgct

SEQ ID NO: 556008 - DNA, 25 bp, Mus musculus
cacacagcttagcagtgaggtcttc

SEQ ID NO: 556009 - DNA, 25 bp, Mus musculus
cacacagcttaggagtgaggtcttc

SEQ ID NO: 556010 - DNA, 25 bp, Mus musculus
cacacaggaaccacagcttcaagtg

SEQ ID NO: 556011 - DNA, 25 bp, Mus musculus
cacacaggaacctcagcttcaagtg

SEQ ID NO: 556012 - DNA, 25 bp, Mus musculus
cacacaggacagaattttataggaa

SEQ ID NO: 556013 - DNA, 25 bp, Mus musculus
cacacaggacagagatatgcagact

SEQ ID NO: 556014 - DNA, 25 bp, Mus musculus
cacacaggacagtattttataggaa

SEQ ID NO: 556015 - DNA, 25 bp, Mus musculus
cacacaggacagtgatatgcagact

SEQ ID NO: 556016 - DNA, 25 bp, Mus musculus
cacacaggccatcgagaagtacaac

SEQ ID NO: 556017 - DNA, 25 bp, Mus musculus
cacacaggccatggagaagtacaac

SEQ ID NO: 556018 - DNA, 25 bp, Mus musculus
cacacaggctgcatatgttgccacc

SEQ ID NO: 556019 - DNA, 25 bp, Mus musculus
cacacaggctgcttatgttgccacc

SEQ ID NO: 556020 - DNA, 25 bp, Mus musculus
cacacaggctggaagatacactaca

SEQ ID NO: 556021 - DNA, 25 bp, Mus musculus
cacacaggctggcaacaagctaaag

SEQ ID NO: 556022 - DNA, 25 bp, Mus musculus
cacacaggctgggaacaagctaaag

SEQ ID NO: 556023 - DNA, 25 bp, Mus musculus
cacacaggctggtagatacactaca

SEQ ID NO: 556024 - DNA, 25 bp, Mus musculus
cacacagggagcctgcgcctgcaga

SEQ ID NO: 556025 - DNA, 25 bp, Mus musculus
cacacagggagcgtgcgcctgcaga

SEQ ID NO: 556026 - DNA, 25 bp, Mus musculus
cacacagggctccttaaggataacg

SEQ ID NO: 556027 - DNA, 25 bp, Mus musculus
cacacagggctcgttaaggataacg

SEQ ID NO: 556028 - DNA, 25 bp, Mus musculus
cacacagggctgcaacagtatgcca

SEQ ID NO: 556029 - DNA, 25 bp, Mus musculus
cacacagggctggaacagtatgcca

SEQ ID NO: 556030 - DNA, 25 bp, Mus musculus
cacacaggtacaactggtccatcct

SEQ ID NO: 556031 - DNA, 25 bp, Mus musculus
cacacaggtacatctggtccatcct

SEQ ID NO: 556032 - DNA, 25 bp, Mus musculus
cacacaggtggacaaggtcgtaaac

SEQ ID NO: 556033 - DNA, 25 bp, Mus musculus
cacacaggtggagaaggtcgtaaac

SEQ ID NO: 556034 - DNA, 25 bp, Mus musculus
cacacagtagcaaaaaattgatgcc

SEQ ID NO: 556035 - DNA, 25 bp, Mus musculus
cacacagtagcataaaattgatgcc

SEQ ID NO: 556036 - DNA, 25 bp, Mus musculus
cacacagtagtaaataatgttcctc

SEQ ID NO: 556037 - DNA, 25 bp, Mus musculus
cacacagtagtatataatgttcctc

SEQ ID NO: 556038 - DNA, 25 bp, Mus musculus
cacacagtcggcatgggtcccggga

SEQ ID NO: 556039 - DNA, 25 bp, Mus musculus
cacacagtcggcttgggtcccggga

SEQ ID NO: 556040 - DNA, 25 bp, Mus musculus
cacacagtgaatcaagctaggctct

SEQ ID NO: 556041 - DNA, 25 bp, Mus musculus
cacacagtgaatgaagctaggctct

SEQ ID NO: 556042 - DNA, 25 bp, Mus musculus
cacacagtgtatactagataacggg

SEQ ID NO: 556043 - DNA, 25 bp, Mus musculus
cacacagtgtattctagataacggg

SEQ ID NO: 556044 - DNA, 25 bp, Mus musculus
cacacagtgttacgagcatctcagc

SEQ ID NO: 556045 - DNA, 25 bp, Mus musculus
cacacagtgttaggagcatctcagc

SEQ ID NO: 556046 - DNA, 25 bp, Mus musculus
cacacagttctgcattaaatttgca

SEQ ID NO: 556047 - DNA, 25 bp, Mus musculus
cacacagttctggattaaatttgca

SEQ ID NO: 556048 - DNA, 25 bp, Mus musculus
cacacataggatctgggagctctgg

SEQ ID NO: 556049 - DNA, 25 bp, Mus musculus
cacacataggatgtgggagctctgg

SEQ ID NO: 556050 - DNA, 25 bp, Mus musculus
cacacatcgtttagagaatttccac

SEQ ID NO: 556051 - DNA, 25 bp, Mus musculus
cacacatcgttttgagaatttccac

SEQ ID NO: 556052 - DNA, 25 bp, Mus musculus
cacacatcttgaccgagaaggcatc

SEQ ID NO: 556053 - DNA, 25 bp, Mus musculus
cacacatcttgagcgagaaggcatc

SEQ ID NO: 556054 - DNA, 25 bp, Mus musculus
cacacatgaggacgacctcaccaag

SEQ ID NO: 556055 - DNA, 25 bp, Mus musculus
cacacatgaggaggacctcaccaag

SEQ ID NO: 556056 - DNA, 25 bp, Mus musculus
cacacatgagggacatatcaccagc

SEQ ID NO: 556057 - DNA, 25 bp, Mus musculus
cacacatgagggtcatatcaccagc

SEQ ID NO: 556058 - DNA, 25 bp, Mus musculus
cacacatgcctcacataagcgaatg

SEQ ID NO: 556059 - DNA, 25 bp, Mus musculus
cacacatgcctctcataagcgaatg

SEQ ID NO: 556060 - DNA, 25 bp, Mus musculus
cacacatggcacacaactctgcagg

SEQ ID NO: 556061 - DNA, 25 bp, Mus musculus
cacacatggcactcaactctgcagg

SEQ ID NO: 556062 - DNA, 25 bp, Mus musculus
cacacatggccaatctgggcagtca

SEQ ID NO: 556063 - DNA, 25 bp, Mus musculus
cacacatggccattctgggcagtca

SEQ ID NO: 556064 - DNA, 25 bp, Mus musculus
cacacatgggttatgagcaggtcag

SEQ ID NO: 556065 - DNA, 25 bp, Mus musculus
cacacatgggttttgagcaggtcag

SEQ ID NO: 556066 - DNA, 25 bp, Mus musculus
cacacatggttcatggtgccagaat

SEQ ID NO: 556067 - DNA, 25 bp, Mus musculus
cacacatggttcttggtgccagaat

SEQ ID NO: 556068 - DNA, 25 bp, Mus musculus
cacacatgtgaaagacgtagccagt

SEQ ID NO: 556069 - DNA, 25 bp, Mus musculus
cacacatgtgaatgacgtagccagt

SEQ ID NO: 556070 - DNA, 25 bp, Mus musculus
cacacattagaaactgcagcttgga

SEQ ID NO: 556071 - DNA, 25 bp, Mus musculus
cacacattagaatctgcagcttgga

SEQ ID NO: 556072 - DNA, 25 bp, Mus musculus
cacacattgtatcggcttctaagca

SEQ ID NO: 556073 - DNA, 25 bp, Mus musculus
cacacattgtatgggcttctaagca

SEQ ID NO: 556074 - DNA, 25 bp, Mus musculus
cacacatttcttccagcaactgggc

SEQ ID NO: 556075 - DNA, 25 bp, Mus musculus
cacacatttcttgcagcaactgggc

SEQ ID NO: 556076 - DNA, 25 bp, Mus musculus
cacacattttttccaagccacagac

SEQ ID NO: 556077 - DNA, 25 bp, Mus musculus
cacacattttttgcaagccacagac

SEQ ID NO: 556078 - DNA, 25 bp, Mus musculus
cacaccaacagccatgattaggcca

SEQ ID NO: 556079 - DNA, 25 bp, Mus musculus
cacaccaacagcgatgattaggcca

SEQ ID NO: 556080 - DNA, 25 bp, Mus musculus
cacaccaactatcacgaatatgcca

SEQ ID NO: 556081 - DNA, 25 bp, Mus musculus
cacaccaactatgacgaatatgcca

SEQ ID NO: 556082 - DNA, 25 bp, Mus musculus
cacaccaagaggcttggcatcgtgg

SEQ ID NO: 556083 - DNA, 25 bp, Mus musculus
cacaccaagagggttggcatcgtgg

SEQ ID NO: 556084 - DNA, 25 bp, Mus musculus
cacaccaaggagattgacctggtca

SEQ ID NO: 556085 - DNA, 25 bp, Mus musculus
cacaccaaggagtttgacctggtca

SEQ ID NO: 556086 - DNA, 25 bp, Mus musculus
cacaccaaggccataaagctctata

SEQ ID NO: 556087 - DNA, 25 bp, Mus musculus
cacaccaaggccttaaagctctata

SEQ ID NO: 556088 - DNA, 25 bp, Mus musculus
cacaccaaggtcaaaggcatagcag

SEQ ID NO: 556089 - DNA, 25 bp, Mus musculus
cacaccaaggtctaaggcatagcag

SEQ ID NO: 556090 - DNA, 25 bp, Mus musculus
cacaccaatcgacgtgctgtgtgag

SEQ ID NO: 556091 - DNA, 25 bp, Mus musculus
cacaccaatcgaggtgctgtgtgag

SEQ ID NO: 556092 - DNA, 25 bp, Mus musculus
cacaccaattggatgctcagtgcca

SEQ ID NO: 556093 - DNA, 25 bp, Mus musculus
cacaccaattggttgctcagtgcca

SEQ ID NO: 556094 - DNA, 25 bp, Mus musculus
cacaccacagaaatccctagaagaa

SEQ ID NO: 556095 - DNA, 25 bp, Mus musculus
cacaccacagaattccctagaagaa

SEQ ID NO: 556096 - DNA, 25 bp, Mus musculus
cacaccaccctgacaaagtcagatg

SEQ ID NO: 556097 - DNA, 25 bp, Mus musculus
cacaccaccctgtcaaagtcagatg

SEQ ID NO: 556098 - DNA, 25 bp, Mus musculus
cacaccactaaccagtgcaagttgg

SEQ ID NO: 556099 - DNA, 25 bp, Mus musculus
cacaccactaacgagtgcaagttgg

SEQ ID NO: 556100 - DNA, 25 bp, Mus musculus
cacaccactcttaccctagaagaag

SEQ ID NO: 556101 - DNA, 25 bp, Mus musculus
cacaccactctttccctagaagaag

SEQ ID NO: 556102 - DNA, 25 bp, Mus musculus
cacaccactttgatctcttgggccg

SEQ ID NO: 556103 - DNA, 25 bp, Mus musculus
cacaccactttgttctcttgggccg

SEQ ID NO: 556104 - DNA, 25 bp, Mus musculus
cacaccagaagtagggaagcagaat

SEQ ID NO: 556105 - DNA, 25 bp, Mus musculus
cacaccagaagttgggaagcagaat

SEQ ID NO: 556106 - DNA, 25 bp, Mus musculus
cacaccagtgggacctatctaagga

SEQ ID NO: 556107 - DNA, 25 bp, Mus musculus
cacaccagtgggtcctatctaagga

SEQ ID NO: 556108 - DNA, 25 bp, Mus musculus
cacaccataaggctgagaaggaaac

SEQ ID NO: 556109 - DNA, 25 bp, Mus musculus
cacaccataagggtgagaaggaaac

SEQ ID NO: 556110 - DNA, 25 bp, Mus musculus
cacaccatatggaaaccaaaccgac

SEQ ID NO: 556111 - DNA, 25 bp, Mus musculus
cacaccatatggtaaccaaaccgac

SEQ ID NO: 556112 - DNA, 25 bp, Mus musculus
cacaccatctctagggcctcagtgg

SEQ ID NO: 556113 - DNA, 25 bp, Mus musculus
cacaccatctcttgggcctcagtgg

SEQ ID NO: 556114 - DNA, 25 bp, Mus musculus
cacaccattccgagacctgcagtgt

SEQ ID NO: 556115 - DNA, 25 bp, Mus musculus
cacaccattccgtgacctgcagtgt

SEQ ID NO: 556116 - DNA, 25 bp, Mus musculus
cacacccacgagagattttcaagca

SEQ ID NO: 556117 - DNA, 25 bp, Mus musculus
cacacccacgagtgattttcaagca

SEQ ID NO: 556118 - DNA, 25 bp, Mus musculus
cacacccagactatggctctcatga

SEQ ID NO: 556119 - DNA, 25 bp, Mus musculus
cacacccagactttggctctcatga

SEQ ID NO: 556120 - DNA, 25 bp, Mus musculus
cacacccaggagacttgattgaagt

SEQ ID NO: 556121 - DNA, 25 bp, Mus musculus
cacacccaggagtcttgattgaagt

SEQ ID NO: 556122 - DNA, 25 bp, Mus musculus
cacaccccagttaggaggcaaagac

SEQ ID NO: 556123 - DNA, 25 bp, Mus musculus
cacaccccagtttggaggcaaagac

SEQ ID NO: 556124 - DNA, 25 bp, Mus musculus
cacacccgagtaacgtttgagcaga

SEQ ID NO: 556125 - DNA, 25 bp, Mus musculus
cacacccgagtatcgtttgagcaga

SEQ ID NO: 556126 - DNA, 25 bp, Mus musculus
cacacccgtgtgctagtgggcgttc

SEQ ID NO: 556127 - DNA, 25 bp, Mus musculus
cacacccgtgtggtagtgggcgttc

SEQ ID NO: 556128 - DNA, 25 bp, Mus musculus
cacaccctctggaacattcgcatag

SEQ ID NO: 556129 - DNA, 25 bp, Mus musculus
cacaccctctggtacattcgcatag

SEQ ID NO: 556130 - DNA, 25 bp, Mus musculus
cacaccctctgtagggaggaggcca

SEQ ID NO: 556131 - DNA, 25 bp, Mus musculus
cacaccctctgttgggaggaggcca

SEQ ID NO: 556132 - DNA, 25 bp, Mus musculus
cacaccctgcttatatttgcctaca

SEQ ID NO: 556133 - DNA, 25 bp, Mus musculus
cacaccctgcttttatttgcctaca

SEQ ID NO: 556134 - DNA, 25 bp, Mus musculus
cacacccttaccagtatgaactgga

SEQ ID NO: 556135 - DNA, 25 bp, Mus musculus
cacacccttacctgtatgaactgga

SEQ ID NO: 556136 - DNA, 25 bp, Mus musculus
cacaccgccgataggtacgggagaa

SEQ ID NO: 556137 - DNA, 25 bp, Mus musculus
cacaccgccgattggtacgggagaa

SEQ ID NO: 556138 - DNA, 25 bp, Mus musculus
cacaccggccagatctgggtgctgg

SEQ ID NO: 556139 - DNA, 25 bp, Mus musculus
cacaccggccagttctgggtgctgg

SEQ ID NO: 556140 - DNA, 25 bp, Mus musculus
cacaccgtaggacaaggtcagcttt

SEQ ID NO: 556141 - DNA, 25 bp, Mus musculus
cacaccgtaggagaaggtcagcttt

SEQ ID NO: 556142 - DNA, 25 bp, Mus musculus
cacaccgtggcaaggactgccggtg

SEQ ID NO: 556143 - DNA, 25 bp, Mus musculus
cacaccgtggcatggactgccggtg

SEQ ID NO: 556144 - DNA, 25 bp, Mus musculus
cacaccgttggcagtggctttcgaa

SEQ ID NO: 556145 - DNA, 25 bp, Mus musculus
cacaccgttggctgtggctttcgaa

SEQ ID NO: 556146 - DNA, 25 bp, Mus musculus
cacacctaccacctcgatgtcgttg

SEQ ID NO: 556147 - DNA, 25 bp, Mus musculus
cacacctaccacgtcgatgtcgttg

SEQ ID NO: 556148 - DNA, 25 bp, Mus musculus
cacacctaccagcttgacgtcgtgg

SEQ ID NO: 556149 - DNA, 25 bp, Mus musculus
cacacctaccaggttgacgtcgtgg

SEQ ID NO: 556150 - DNA, 25 bp, Mus musculus
cacacctacgacaggggcacaggga

SEQ ID NO: 556151 - DNA, 25 bp, Mus musculus
cacacctacgactggggcacaggga

SEQ ID NO: 556152 - DNA, 25 bp, Mus musculus
cacacctagagtccgactgtcattc

SEQ ID NO: 556153 - DNA, 25 bp, Mus musculus
cacacctagagtgcgactgtcattc

SEQ ID NO: 556154 - DNA, 25 bp, Mus musculus
cacacctaggaacttcgtgatttcc

SEQ ID NO: 556155 - DNA, 25 bp, Mus musculus
cacacctaggaagttcgtgatttcc

SEQ ID NO: 556156 - DNA, 25 bp, Mus musculus
cacacctcacttcgaggattctggg

SEQ ID NO: 556157 - DNA, 25 bp, Mus musculus
cacacctcacttggaggattctggg

SEQ ID NO: 556158 - DNA, 25 bp, Mus musculus
cacacctcattccaggaagtggttc

SEQ ID NO: 556159 - DNA, 25 bp, Mus musculus
cacacctcattcgaggaagtggttc

SEQ ID NO: 556160 - DNA, 25 bp, Mus musculus
cacacctgaattcctttgcctaagg

SEQ ID NO: 556161 - DNA, 25 bp, Mus musculus
cacacctgaattgctttgcctaagg

SEQ ID NO: 556162 - DNA, 25 bp, Mus musculus
cacacctgagtaccactgtggagac

SEQ ID NO: 556163 - DNA, 25 bp, Mus musculus
cacacctgagtagcactgtggagac

SEQ ID NO: 556164 - DNA, 25 bp, Mus musculus
cacacctgatcacatttctggaacg

SEQ ID NO: 556165 - DNA, 25 bp, Mus musculus
cacacctgatcagatttctggaacg

SEQ ID NO: 556166 - DNA, 25 bp, Mus musculus
cacacctgatgactctctggacgac

SEQ ID NO: 556167 - DNA, 25 bp, Mus musculus
cacacctgatgagtctctggacgac

SEQ ID NO: 556168 - DNA, 25 bp, Mus musculus
cacacctgccaaaagttatgctcca

SEQ ID NO: 556169 - DNA, 25 bp, Mus musculus
cacacctgccaatagttatgctcca

SEQ ID NO: 556170 - DNA, 25 bp, Mus musculus
cacacctggctaatgaagttgcttt

SEQ ID NO: 556171 - DNA, 25 bp, Mus musculus
cacacctggctattgaagttgcttt

SEQ ID NO: 556172 - DNA, 25 bp, Mus musculus
cacacctggcttatggatgcctgga

SEQ ID NO: 556173 - DNA, 25 bp, Mus musculus
cacacctggcttttggatgcctgga

SEQ ID NO: 556174 - DNA, 25 bp, Mus musculus
cacacctggtgtcgcagcagatctg

SEQ ID NO: 556175 - DNA, 25 bp, Mus musculus
cacacctggtgtggcagcagatctg

SEQ ID NO: 556176 - DNA, 25 bp, Mus musculus
cacacctgtataccagacaattcct

SEQ ID NO: 556177 - DNA, 25 bp, Mus musculus
cacacctgtatagcagacaattcct

SEQ ID NO: 556178 - DNA, 25 bp, Mus musculus
cacacctgtgctagagcctgggaaa

SEQ ID NO: 556179 - DNA, 25 bp, Mus musculus
cacacctgtgcttgagcctgggaaa

SEQ ID NO: 556180 - DNA, 25 bp, Mus musculus
cacaccttcaagatggttaatgcag

SEQ ID NO: 556181 - DNA, 25 bp, Mus musculus
cacaccttcaagttggttaatgcag

SEQ ID NO: 556182 - DNA, 25 bp, Mus musculus
cacaccttcctgcattatatcatgg

SEQ ID NO: 556183 - DNA, 25 bp, Mus musculus
cacaccttcctggattatatcatgg

SEQ ID NO: 556184 - DNA, 25 bp, Mus musculus
cacaccttgcctattaataacatca

SEQ ID NO: 556185 - DNA, 25 bp, Mus musculus
cacaccttgccttttaataacatca

SEQ ID NO: 556186 - DNA, 25 bp, Mus musculus
cacaccttggtgcaatcgttcctat

SEQ ID NO: 556187 - DNA, 25 bp, Mus musculus
cacaccttggtggaatcgttcctat

SEQ ID NO: 556188 - DNA, 25 bp, Mus musculus
cacacctttgaaccctagggctggg

SEQ ID NO: 556189 - DNA, 25 bp, Mus musculus
cacacctttgaagcctagggctggg

SEQ ID NO: 556190 - DNA, 25 bp, Mus musculus
cacacctttgtgagaaatccatggg

SEQ ID NO: 556191 - DNA, 25 bp, Mus musculus
cacacctttgtgtgaaatccatggg

SEQ ID NO: 556192 - DNA, 25 bp, Mus musculus
cacacgaagtggcattggtctctgg

SEQ ID NO: 556193 - DNA, 25 bp, Mus musculus
cacacgaagtgggattggtctctgg

SEQ ID NO: 556194 - DNA, 25 bp, Mus musculus
cacacgaatggaacacaagatggcg

SEQ ID NO: 556195 - DNA, 25 bp, Mus musculus
cacacgaatggatcacaagatggcg

SEQ ID NO: 556196 - DNA, 25 bp, Mus musculus
cacacgataaagacacagacatgtt

SEQ ID NO: 556197 - DNA, 25 bp, Mus musculus
cacacgataaagtcacagacatgtt

SEQ ID NO: 556198 - DNA, 25 bp, Mus musculus
cacacgatgtgaaaatggctctgga

SEQ ID NO: 556199 - DNA, 25 bp, Mus musculus
cacacgatgtgataatggctctgga

SEQ ID NO: 556200 - DNA, 25 bp, Mus musculus
cacacgcacaaaaggatgtcaagct

SEQ ID NO: 556201 - DNA, 25 bp, Mus musculus
cacacgcacaaatggatgtcaagct

SEQ ID NO: 556202 - DNA, 25 bp, Mus musculus
cacacgcagagtaaattttgtaaaa

SEQ ID NO: 556203 - DNA, 25 bp, Mus musculus
cacacgcagagttaattttgtaaaa

SEQ ID NO: 556204 - DNA, 25 bp, Mus musculus
cacacgcaggatactgcatggcgat

SEQ ID NO: 556205 - DNA, 25 bp, Mus musculus
cacacgcaggattctgcatggcgat

SEQ ID NO: 556206 - DNA, 25 bp, Mus musculus
cacacgccaggcctttgctctggag

SEQ ID NO: 556207 - DNA, 25 bp, Mus musculus
cacacgccaggcgtttgctctggag

SEQ ID NO: 556208 - DNA, 25 bp, Mus musculus
cacacgccctctctggatggatggg

SEQ ID NO: 556209 - DNA, 25 bp, Mus musculus
cacacgccctctgtggatggatggg

SEQ ID NO: 556210 - DNA, 25 bp, Mus musculus
cacacgcgtgcgagttttcagggcc

SEQ ID NO: 556211 - DNA, 25 bp, Mus musculus
cacacgcgtgcgtgttttcagggcc

SEQ ID NO: 556212 - DNA, 25 bp, Mus musculus
cacacgctaggaagggcacacgcgt

SEQ ID NO: 556213 - DNA, 25 bp, Mus musculus
cacacgctaggatgggcacacgcgt

SEQ ID NO: 556214 - DNA, 25 bp, Mus musculus
cacacgctgcaacattgcttggtgc

SEQ ID NO: 556215 - DNA, 25 bp, Mus musculus
cacacgctgcaagattgcttggtgc

SEQ ID NO: 556216 - DNA, 25 bp, Mus musculus
cacacggaaccgctgagcagagcag

SEQ ID NO: 556217 - DNA, 25 bp, Mus musculus
cacacggaaccggtgagcagagcag

SEQ ID NO: 556218 - DNA, 25 bp, Mus musculus
cacacggaatttccagtaactgggt

SEQ ID NO: 556219 - DNA, 25 bp, Mus musculus
cacacggaatttgcagtaactgggt

SEQ ID NO: 556220 - DNA, 25 bp, Mus musculus
cacacggaggatcatgctgactttg

SEQ ID NO: 556221 - DNA, 25 bp, Mus musculus
cacacggaggatgatgctgactttg

SEQ ID NO: 556222 - DNA, 25 bp, Mus musculus
cacacggatgaacaaggatttaccc

SEQ ID NO: 556223 - DNA, 25 bp, Mus musculus
cacacggatgaagaaggatttaccc

SEQ ID NO: 556224 - DNA, 25 bp, Mus musculus
cacacggcaactagctgcacagatg

SEQ ID NO: 556225 - DNA, 25 bp, Mus musculus
cacacggcaacttgctgcacagatg

SEQ ID NO: 556226 - DNA, 25 bp, Mus musculus
cacacggcagctcgagagcgtgcat

SEQ ID NO: 556227 - DNA, 25 bp, Mus musculus
cacacggcagctggagagcgtgcat

SEQ ID NO: 556228 - DNA, 25 bp, Mus musculus
cacacggccaccatgcttgagatag

SEQ ID NO: 556229 - DNA, 25 bp, Mus musculus
cacacggccaccttgcttgagatag

SEQ ID NO: 556230 - DNA, 25 bp, Mus musculus
cacacggcctgaagatgaggcggac

SEQ ID NO: 556231 - DNA, 25 bp, Mus musculus
cacacggcctgatgatgaggcggac

SEQ ID NO: 556232 - DNA, 25 bp, Mus musculus
cacacgggatgaagaccggacagca

SEQ ID NO: 556233 - DNA, 25 bp, Mus musculus
cacacgggatgatgaccggacagca

SEQ ID NO: 556234 - DNA, 25 bp, Mus musculus
cacacgggcccgacgcagtgctgat

SEQ ID NO: 556235 - DNA, 25 bp, Mus musculus
cacacgggcccgtcgcagtgctgat

SEQ ID NO: 556236 - DNA, 25 bp, Mus musculus
cacacgggtaagcacttcctgcttt

SEQ ID NO: 556237 - DNA, 25 bp, Mus musculus
cacacgggtaaggacttcctgcttt

SEQ ID NO: 556238 - DNA, 25 bp, Mus musculus
cacacggtgaatctcctggggaact

SEQ ID NO: 556239 - DNA, 25 bp, Mus musculus
cacacggtgaatgtcctggggaact

SEQ ID NO: 556240 - DNA, 25 bp, Mus musculus
cacacggtggaaatattgccacagg

SEQ ID NO: 556241 - DNA, 25 bp, Mus musculus
cacacggtggaattattgccacagg

SEQ ID NO: 556242 - DNA, 25 bp, Mus musculus
cacacgtcggttactggacggcgat

SEQ ID NO: 556243 - DNA, 25 bp, Mus musculus
cacacgtcggtttctggacggcgat

SEQ ID NO: 556244 - DNA, 25 bp, Mus musculus
cacacgtgacggaatggaatcctcc

SEQ ID NO: 556245 - DNA, 25 bp, Mus musculus
cacacgtgacggtatggaatcctcc

SEQ ID NO: 556246 - DNA, 25 bp, Mus musculus
cacacgtgccatagccatattggta

SEQ ID NO: 556247 - DNA, 25 bp, Mus musculus
cacacgtgccattgccatattggta

SEQ ID NO: 556248 - DNA, 25 bp, Mus musculus
cacacgtgggcaaggatgaatcaga

SEQ ID NO: 556249 - DNA, 25 bp, Mus musculus
cacacgtgggcatggatgaatcaga

SEQ ID NO: 556250 - DNA, 25 bp, Mus musculus
cacacgtggtgccacctctgtggag

SEQ ID NO: 556251 - DNA, 25 bp, Mus musculus
cacacgtggtgcgacctctgtggag

SEQ ID NO: 556252 - DNA, 25 bp, Mus musculus
cacacgttctgcagcctgctgggca

SEQ ID NO: 556253 - DNA, 25 bp, Mus musculus
cacacgttctgctgcctgctgggca

SEQ ID NO: 556254 - DNA, 25 bp, Mus musculus
cacactacagggagagggcctgagt

SEQ ID NO: 556255 - DNA, 25 bp, Mus musculus
cacactacagggtgagggcctgagt

SEQ ID NO: 556256 - DNA, 25 bp, Mus musculus
cacactacctaaaaataggcagatt

SEQ ID NO: 556257 - DNA, 25 bp, Mus musculus
cacactacctaataataggcagatt

SEQ ID NO: 556258 - DNA, 25 bp, Mus musculus
cacactacctcaactacgggaaggg

SEQ ID NO: 556259 - DNA, 25 bp, Mus musculus
cacactacctcatctacgggaaggg

SEQ ID NO: 556260 - DNA, 25 bp, Mus musculus
cacactagagatcgttggtcatcct

SEQ ID NO: 556261 - DNA, 25 bp, Mus musculus
cacactagagatggttggtcatcct

SEQ ID NO: 556262 - DNA, 25 bp, Mus musculus
cacactaggaacagggtggcaaggt

SEQ ID NO: 556263 - DNA, 25 bp, Mus musculus
cacactaggaactgggtggcaaggt

SEQ ID NO: 556264 - DNA, 25 bp, Mus musculus
cacactaggcatagactatgcagag

SEQ ID NO: 556265 - DNA, 25 bp, Mus musculus
cacactaggcattgactatgcagag

SEQ ID NO: 556266 - DNA, 25 bp, Mus musculus
cacactagggagctggcttttcaga

SEQ ID NO: 556267 - DNA, 25 bp, Mus musculus
cacactagggaggtggcttttcaga

SEQ ID NO: 556268 - DNA, 25 bp, Mus musculus
cacactagtccgacctgtctttgga

SEQ ID NO: 556269 - DNA, 25 bp, Mus musculus
cacactagtccgtcctgtctttgga

SEQ ID NO: 556270 - DNA, 25 bp, Mus musculus
cacactattccgatgctaaagcaga

SEQ ID NO: 556271 - DNA, 25 bp, Mus musculus
cacactattccgttgctaaagcaga

SEQ ID NO: 556272 - DNA, 25 bp, Mus musculus
cacactattgtcctttttgcccaca

SEQ ID NO: 556273 - DNA, 25 bp, Mus musculus
cacactattgtcgtttttgcccaca

SEQ ID NO: 556274 - DNA, 25 bp, Mus musculus
cacactattttcagccaccagatga

SEQ ID NO: 556275 - DNA, 25 bp, Mus musculus
cacactattttctgccaccagatga

SEQ ID NO: 556276 - DNA, 25 bp, Mus musculus
cacactcaacatatcgggaagagaa

SEQ ID NO: 556277 - DNA, 25 bp, Mus musculus
cacactcaacatttcgggaagagaa

SEQ ID NO: 556278 - DNA, 25 bp, Mus musculus
cacactcaagacaccggagagggaa

SEQ ID NO: 556279 - DNA, 25 bp, Mus musculus
cacactcaagactccggagagggaa

SEQ ID NO: 556280 - DNA, 25 bp, Mus musculus
cacactcaccggcaggatccaggag

SEQ ID NO: 556281 - DNA, 25 bp, Mus musculus
cacactcaccgggaggatccaggag

SEQ ID NO: 556282 - DNA, 25 bp, Mus musculus
cacactcagtgaaagaaatgggtgc

SEQ ID NO: 556283 - DNA, 25 bp, Mus musculus
cacactcagtgatagaaatgggtgc

SEQ ID NO: 556284 - DNA, 25 bp, Mus musculus
cacactcatcagaagaatctgagga

SEQ ID NO: 556285 - DNA, 25 bp, Mus musculus
cacactcatcagtagaatctgagga

SEQ ID NO: 556286 - DNA, 25 bp, Mus musculus
cacactcattgcacctagaatcgaa

SEQ ID NO: 556287 - DNA, 25 bp, Mus musculus
cacactcattgctcctagaatcgaa

SEQ ID NO: 556288 - DNA, 25 bp, Mus musculus
cacactcccaacacgcattttgtgt

SEQ ID NO: 556289 - DNA, 25 bp, Mus musculus
cacactcccaactcgcattttgtgt

SEQ ID NO: 556290 - DNA, 25 bp, Mus musculus
cacactccgctcaggagaaaggact

SEQ ID NO: 556291 - DNA, 25 bp, Mus musculus
cacactccgctctggagaaaggact

SEQ ID NO: 556292 - DNA, 25 bp, Mus musculus
cacactccttccaggtgtccggaaa

SEQ ID NO: 556293 - DNA, 25 bp, Mus musculus
cacactccttcctggtgtccggaaa

SEQ ID NO: 556294 - DNA, 25 bp, Mus musculus
cacactcctttcaggccgagttgtc

SEQ ID NO: 556295 - DNA, 25 bp, Mus musculus
cacactcctttctggccgagttgtc

SEQ ID NO: 556296 - DNA, 25 bp, Mus musculus
cacactcgactgcaatactgatgaa

SEQ ID NO: 556297 - DNA, 25 bp, Mus musculus
cacactcgactggaatactgatgaa

SEQ ID NO: 556298 - DNA, 25 bp, Mus musculus
cacactcgcttgattgaggacaacg

SEQ ID NO: 556299 - DNA, 25 bp, Mus musculus
cacactcgcttgtttgaggacaacg

SEQ ID NO: 556300 - DNA, 25 bp, Mus musculus
cacactctcagacaagaagcccatt

SEQ ID NO: 556301 - DNA, 25 bp, Mus musculus
cacactctcagagaagaagcccatt

SEQ ID NO: 556302 - DNA, 25 bp, Mus musculus
cacactctgagtaacaagcctccgc

SEQ ID NO: 556303 - DNA, 25 bp, Mus musculus
cacactctgagttacaagcctccgc

SEQ ID NO: 556304 - DNA, 25 bp, Mus musculus
cacactcttggaattacggctgggc

SEQ ID NO: 556305 - DNA, 25 bp, Mus musculus
cacactcttggatttacggctgggc

SEQ ID NO: 556306 - DNA, 25 bp, Mus musculus
cacactgaaacgcaggctgacctgg

SEQ ID NO: 556307 - DNA, 25 bp, Mus musculus
cacactgaaacggaggctgacctgg

SEQ ID NO: 556308 - DNA, 25 bp, Mus musculus
cacactgaaccgcatgctcaggact

SEQ ID NO: 556309 - DNA, 25 bp, Mus musculus
cacactgaaccggatgctcaggact

SEQ ID NO: 556310 - DNA, 25 bp, Mus musculus
cacactgaacggcttgagactccag

SEQ ID NO: 556311 - DNA, 25 bp, Mus musculus
cacactgaacgggttgagactccag

SEQ ID NO: 556312 - DNA, 25 bp, Mus musculus
cacactgaagcaactagcgtgtgtt

SEQ ID NO: 556313 - DNA, 25 bp, Mus musculus
cacactgaagcatctagcgtgtgtt

SEQ ID NO: 556314 - DNA, 25 bp, Mus musculus
cacactgaaggaacccctgggttct

SEQ ID NO: 556315 - DNA, 25 bp, Mus musculus
cacactgaaggatcccctgggttct

SEQ ID NO: 556316 - DNA, 25 bp, Mus musculus
cacactgaatgacagaggagaccac

SEQ ID NO: 556317 - DNA, 25 bp, Mus musculus
cacactgaatgagagaggagaccac

SEQ ID NO: 556318 - DNA, 25 bp, Mus musculus
cacactgacccacatcaatgaggtc

SEQ ID NO: 556319 - DNA, 25 bp, Mus musculus
cacactgacccagatcaatgaggtc

SEQ ID NO: 556320 - DNA, 25 bp, Mus musculus
cacactgaccctcaatgtcaagagt

SEQ ID NO: 556321 - DNA, 25 bp, Mus musculus
cacactgaccctgaatgtcaagagt

SEQ ID NO: 556322 - DNA, 25 bp, Mus musculus
cacactgaccggcaagttcatgagc

SEQ ID NO: 556323 - DNA, 25 bp, Mus musculus
cacactgaccggcagttatgactgt

SEQ ID NO: 556324 - DNA, 25 bp, Mus musculus
cacactgaccgggaagttcatgagc

SEQ ID NO: 556325 - DNA, 25 bp, Mus musculus
cacactgaccgggagttatgactgt

SEQ ID NO: 556326 - DNA, 25 bp, Mus musculus
cacactgagtgccaggccctgtgtc

SEQ ID NO: 556327 - DNA, 25 bp, Mus musculus
cacactgagtgcgaggccctgtgtc

SEQ ID NO: 556328 - DNA, 25 bp, Mus musculus
cacactgagttgctggctgctttta

SEQ ID NO: 556329 - DNA, 25 bp, Mus musculus
cacactgagttggtggctgctttta

SEQ ID NO: 556330 - DNA, 25 bp, Mus musculus
cacactgatcaactatttcccacag

SEQ ID NO: 556331 - DNA, 25 bp, Mus musculus
cacactgatcaagtatttcccacag

SEQ ID NO: 556332 - DNA, 25 bp, Mus musculus
cacactgatttaagtcagtacatgg

SEQ ID NO: 556333 - DNA, 25 bp, Mus musculus
cacactgatttatgtcagtacatgg

SEQ ID NO: 556334 - DNA, 25 bp, Mus musculus
cacactgcagtcaggaggctactgg

SEQ ID NO: 556335 - DNA, 25 bp, Mus musculus
cacactgcagtctggaggctactgg

SEQ ID NO: 556336 - DNA, 25 bp, Mus musculus
cacactgcgagaagagccgcttcat

SEQ ID NO: 556337 - DNA, 25 bp, Mus musculus
cacactgcgagatgagccgcttcat

SEQ ID NO: 556338 - DNA, 25 bp, Mus musculus
cacactgcggtgaactggagtttgt

SEQ ID NO: 556339 - DNA, 25 bp, Mus musculus
cacactgcggtgtactggagtttgt

SEQ ID NO: 556340 - DNA, 25 bp, Mus musculus
cacactgcgtggagtgtcgcgctgc

SEQ ID NO: 556341 - DNA, 25 bp, Mus musculus
cacactgcgtggtgtgtcgcgctgc

SEQ ID NO: 556342 - DNA, 25 bp, Mus musculus
cacactggaatgcaagcggattctc

SEQ ID NO: 556343 - DNA, 25 bp, Mus musculus
cacactggaatggaagcggattctc

SEQ ID NO: 556344 - DNA, 25 bp, Mus musculus
cacactggacacactgctttttatc

SEQ ID NO: 556345 - DNA, 25 bp, Mus musculus
cacactggacactctgctttttatc

SEQ ID NO: 556346 - DNA, 25 bp, Mus musculus
cacactggacagaagatgcctctga

SEQ ID NO: 556347 - DNA, 25 bp, Mus musculus
cacactggacagtagatgcctctga

SEQ ID NO: 556348 - DNA, 25 bp, Mus musculus
cacactggcaggcactgagactcta

SEQ ID NO: 556349 - DNA, 25 bp, Mus musculus
cacactggcagggactgagactcta

SEQ ID NO: 556350 - DNA, 25 bp, Mus musculus
cacactggcctcactgcagcgattg

SEQ ID NO: 556351 - DNA, 25 bp, Mus musculus
cacactggcctctctgcagcgattg

SEQ ID NO: 556352 - DNA, 25 bp, Mus musculus
cacactgggagtagcaggaggattt

SEQ ID NO: 556353 - DNA, 25 bp, Mus musculus
cacactgggagttgcaggaggattt

SEQ ID NO: 556354 - DNA, 25 bp, Mus musculus
cacactgggcacaaagggcaacgtg

SEQ ID NO: 556355 - DNA, 25 bp, Mus musculus
cacactgggcactaagggcaacgtg

SEQ ID NO: 556356 - DNA, 25 bp, Mus musculus
cacactggtgcacaatctggttaac

SEQ ID NO: 556357 - DNA, 25 bp, Mus musculus
cacactggtgcagaatctggttaac

SEQ ID NO: 556358 - DNA, 25 bp, Mus musculus
cacactggtttccacctcatgtaca

SEQ ID NO: 556359 - DNA, 25 bp, Mus musculus
cacactggtttcgacctcatgtaca

SEQ ID NO: 556360 - DNA, 25 bp, Mus musculus
cacactgtagctattctgtagtctt

SEQ ID NO: 556361 - DNA, 25 bp, Mus musculus
cacactgtagcttttctgtagtctt

SEQ ID NO: 556362 - DNA, 25 bp, Mus musculus
cacactgtcggacatcgtggtcaca

SEQ ID NO: 556363 - DNA, 25 bp, Mus musculus
cacactgtcggagatcgtggtcaca

SEQ ID NO: 556364 - DNA, 25 bp, Mus musculus
cacactgtgctgaattgctgctgaa

SEQ ID NO: 556365 - DNA, 25 bp, Mus musculus
cacactgtgctgctgaggacatagc

SEQ ID NO: 556366 - DNA, 25 bp, Mus musculus
cacactgtgctggtgaggacatagc

SEQ ID NO: 556367 - DNA, 25 bp, Mus musculus
cacactgtgctgtattgctgctgaa

SEQ ID NO: 556368 - DNA, 25 bp, Mus musculus
cacactgtgtaaaggaacctatgaa

SEQ ID NO: 556369 - DNA, 25 bp, Mus musculus
cacactgtgtaatggaacctatgaa

SEQ ID NO: 556370 - DNA, 25 bp, Mus musculus
cacacttaagggatgggatggtcag

SEQ ID NO: 556371 - DNA, 25 bp, Mus musculus
cacacttaagggttgggatggtcag

SEQ ID NO: 556372 - DNA, 25 bp, Mus musculus
cacacttacctgaggcgtcgccagt

SEQ ID NO: 556373 - DNA, 25 bp, Mus musculus
cacacttacctgtggcgtcgccagt

SEQ ID NO: 556374 - DNA, 25 bp, Mus musculus
cacacttaggagacaacacgacttt

SEQ ID NO: 556375 - DNA, 25 bp, Mus musculus
cacacttaggagtcaacacgacttt

SEQ ID NO: 556376 - DNA, 25 bp, Mus musculus
cacacttcgagaagttctccttgtc

SEQ ID NO: 556377 - DNA, 25 bp, Mus musculus
cacacttcgagatgttctccttgtc

SEQ ID NO: 556378 - DNA, 25 bp, Mus musculus
cacacttcgcagagacttttcccgg

SEQ ID NO: 556379 - DNA, 25 bp, Mus musculus
cacacttcgcagtgacttttcccgg

SEQ ID NO: 556380 - DNA, 25 bp, Mus musculus
cacacttgaccaacgccggtctggt

SEQ ID NO: 556381 - DNA, 25 bp, Mus musculus
cacacttgaccatcgccggtctggt

SEQ ID NO: 556382 - DNA, 25 bp, Mus musculus
cacacttggagaactcctcagagaa

SEQ ID NO: 556383 - DNA, 25 bp, Mus musculus
cacacttggagatctcctcagagaa

SEQ ID NO: 556384 - DNA, 25 bp, Mus musculus
cacacttggcgacaacatcgcagac

SEQ ID NO: 556385 - DNA, 25 bp, Mus musculus
cacacttggcgagaacatcgcagac

SEQ ID NO: 556386 - DNA, 25 bp, Mus musculus
cacacttggctgcatatgtcagaca

SEQ ID NO: 556387 - DNA, 25 bp, Mus musculus
cacacttggctggatatgtcagaca

SEQ ID NO: 556388 - DNA, 25 bp, Mus musculus
cacacttgtcagaggcttaggcttt

SEQ ID NO: 556389 - DNA, 25 bp, Mus musculus
cacacttgtcagtggcttaggcttt

SEQ ID NO: 556390 - DNA, 25 bp, Mus musculus
cacacttgtgctatctatcggagag

SEQ ID NO: 556391 - DNA, 25 bp, Mus musculus
cacacttgtgctttctatcggagag

SEQ ID NO: 556392 - DNA, 25 bp, Mus musculus
cacacttgtttcacgatgccttctt

SEQ ID NO: 556393 - DNA, 25 bp, Mus musculus
cacacttgtttctcgatgccttctt

SEQ ID NO: 556394 - DNA, 25 bp, Mus musculus
cacactttaaacacagcaggcgatg

SEQ ID NO: 556395 - DNA, 25 bp, Mus musculus
cacactttaaactcagcaggcgatg

SEQ ID NO: 556396 - DNA, 25 bp, Mus musculus
cacactttaagccaacgaagcataa

SEQ ID NO: 556397 - DNA, 25 bp, Mus musculus
cacactttaagcgaacgaagcataa

SEQ ID NO: 556398 - DNA, 25 bp, Mus musculus
cacactttctgcattcctggaaggg

SEQ ID NO: 556399 - DNA, 25 bp, Mus musculus
cacactttctgctttcctggaaggg

SEQ ID NO: 556400 - DNA, 25 bp, Mus musculus
cacactttggaaccagatatgaaca

SEQ ID NO: 556401 - DNA, 25 bp, Mus musculus
cacactttggaagcagatatgaaca

SEQ ID NO: 556402 - DNA, 25 bp, Mus musculus
cacactttgtctctgatgccatgag

SEQ ID NO: 556403 - DNA, 25 bp, Mus musculus
cacactttgtctgtgatgccatgag

SEQ ID NO: 556404 - DNA, 25 bp, Mus musculus
cacagaaaacagattgatgacttaa

SEQ ID NO: 556405 - DNA, 25 bp, Mus musculus
cacagaaaacagtttgatgacttaa

SEQ ID NO: 556406 - DNA, 25 bp, Mus musculus
cacagaaaagatcaaaacccgggat

SEQ ID NO: 556407 - DNA, 25 bp, Mus musculus
cacagaaaagatgaaaacccgggat

SEQ ID NO: 556408 - DNA, 25 bp, Mus musculus
cacagaaaagcgcttcctgaaggac

SEQ ID NO: 556409 - DNA, 25 bp, Mus musculus
cacagaaaagcggttcctgaaggac

SEQ ID NO: 556410 - DNA, 25 bp, Mus musculus
cacagaaaagctaaaggagtcacct

SEQ ID NO: 556411 - DNA, 25 bp, Mus musculus
cacagaaaagcttaaggagtcacct

SEQ ID NO: 556412 - DNA, 25 bp, Mus musculus
cacagaaaagttctatgatgagata

SEQ ID NO: 556413 - DNA, 25 bp, Mus musculus
cacagaaaagttgtatgatgagata

SEQ ID NO: 556414 - DNA, 25 bp, Mus musculus
cacagaaaatagaaggttctgctaa

SEQ ID NO: 556415 - DNA, 25 bp, Mus musculus
cacagaaaatagtaggttctgctaa

SEQ ID NO: 556416 - DNA, 25 bp, Mus musculus
cacagaaacaccctggaggccgtaa

SEQ ID NO: 556417 - DNA, 25 bp, Mus musculus
cacagaaacaccgtggaggccgtaa

SEQ ID NO: 556418 - DNA, 25 bp, Mus musculus
cacagaaacccaaaatcactggtta

SEQ ID NO: 556419 - DNA, 25 bp, Mus musculus
cacagaaacccataatcactggtta

SEQ ID NO: 556420 - DNA, 25 bp, Mus musculus
cacagaaactgtacagcttcacagt

SEQ ID NO: 556421 - DNA, 25 bp, Mus musculus
cacagaaactgttcagcttcacagt

SEQ ID NO: 556422 - DNA, 25 bp, Mus musculus
cacagaaagaagattgcaaagcgta

SEQ ID NO: 556423 - DNA, 25 bp, Mus musculus
cacagaaagaagtttgcaaagcgta

SEQ ID NO: 556424 - DNA, 25 bp, Mus musculus
cacagaaagcaccttggtatcgggc

SEQ ID NO: 556425 - DNA, 25 bp, Mus musculus
cacagaaagcacgttggtatcgggc

SEQ ID NO: 556426 - DNA, 25 bp, Mus musculus
cacagaaatccacctgctggtgcct

SEQ ID NO: 556427 - DNA, 25 bp, Mus musculus
cacagaaatccagctgctggtgcct

SEQ ID NO: 556428 - DNA, 25 bp, Mus musculus
cacagaaatcgtctctcaggaccag

SEQ ID NO: 556429 - DNA, 25 bp, Mus musculus
cacagaaatcgtgtctcaggaccag

SEQ ID NO: 556430 - DNA, 25 bp, Mus musculus
cacagaaatggtcgcaagtcctaca

SEQ ID NO: 556431 - DNA, 25 bp, Mus musculus
cacagaaatggtggcaagtcctaca

SEQ ID NO: 556432 - DNA, 25 bp, Mus musculus
cacagaaatgttaggcactggcgac

SEQ ID NO: 556433 - DNA, 25 bp, Mus musculus
cacagaaatgtttggcactggcgac

SEQ ID NO: 556434 - DNA, 25 bp, Mus musculus
cacagaacaaagcttccggagcact

SEQ ID NO: 556435 - DNA, 25 bp, Mus musculus
cacagaacaaaggttccggagcact

SEQ ID NO: 556436 - DNA, 25 bp, Mus musculus
cacagaacaactccaacaatacagc

SEQ ID NO: 556437 - DNA, 25 bp, Mus musculus
cacagaacaactgcaacaatacagc

SEQ ID NO: 556438 - DNA, 25 bp, Mus musculus
cacagaacagatcaccaacgagaag

SEQ ID NO: 556439 - DNA, 25 bp, Mus musculus
cacagaacagatgaccaacgagaag

SEQ ID NO: 556440 - DNA, 25 bp, Mus musculus
cacagaacccctcaaatcagcaaag

SEQ ID NO: 556441 - DNA, 25 bp, Mus musculus
cacagaacccctgaaatcagcaaag

SEQ ID NO: 556442 - DNA, 25 bp, Mus musculus
cacagaaccctgatccaagacagag

SEQ ID NO: 556443 - DNA, 25 bp, Mus musculus
cacagaaccctgttccaagacagag

SEQ ID NO: 556444 - DNA, 25 bp, Mus musculus
cacagaacctgaagctctttgaaag

SEQ ID NO: 556445 - DNA, 25 bp, Mus musculus
cacagaacctgatgctctttgaaag

SEQ ID NO: 556446 - DNA, 25 bp, Mus musculus
cacagaacgatcacagcgcacagat

SEQ ID NO: 556447 - DNA, 25 bp, Mus musculus
cacagaacgatctcagcgcacagat

SEQ ID NO: 556448 - DNA, 25 bp, Mus musculus
cacagaactcggcatgtaccagcct

SEQ ID NO: 556449 - DNA, 25 bp, Mus musculus
cacagaactcgggatgtaccagcct

SEQ ID NO: 556450 - DNA, 25 bp, Mus musculus
cacagaactgagacactgagtaact

SEQ ID NO: 556451 - DNA, 25 bp, Mus musculus
cacagaactgagtcactgagtaact

SEQ ID NO: 556452 - DNA, 25 bp, Mus musculus
cacagaactgctccgaggacctggc

SEQ ID NO: 556453 - DNA, 25 bp, Mus musculus
cacagaactgctgcgaggacctggc

SEQ ID NO: 556454 - DNA, 25 bp, Mus musculus
cacagaactggaaatggtaccagga

SEQ ID NO: 556455 - DNA, 25 bp, Mus musculus
cacagaactggacccggttaccacg

SEQ ID NO: 556456 - DNA, 25 bp, Mus musculus
cacagaactggagccggttaccacg

SEQ ID NO: 556457 - DNA, 25 bp, Mus musculus
cacagaactggatatggtaccagga

SEQ ID NO: 556458 - DNA, 25 bp, Mus musculus
cacagaagaagtcaagataggcaac

SEQ ID NO: 556459 - DNA, 25 bp, Mus musculus
cacagaagaagtgaagataggcaac

SEQ ID NO: 556460 - DNA, 25 bp, Mus musculus
cacagaagaataagcttcgacatct

SEQ ID NO: 556461 - DNA, 25 bp, Mus musculus
cacagaagaatatgcttcgacatct

SEQ ID NO: 556462 - DNA, 25 bp, Mus musculus
cacagaagagaaagaggtgtttgcc

SEQ ID NO: 556463 - DNA, 25 bp, Mus musculus
cacagaagagaatgaggtgtttgcc

SEQ ID NO: 556464 - DNA, 25 bp, Mus musculus
cacagaagagctactagagcgcatg

SEQ ID NO: 556465 - DNA, 25 bp, Mus musculus
cacagaagagcttctagagcgcatg

SEQ ID NO: 556466 - DNA, 25 bp, Mus musculus
cacagaagataaatgccaggctcca

SEQ ID NO: 556467 - DNA, 25 bp, Mus musculus
cacagaagataattgccaggctcca

SEQ ID NO: 556468 - DNA, 25 bp, Mus musculus
cacagaagattcaagacagcatgcc

SEQ ID NO: 556469 - DNA, 25 bp, Mus musculus
cacagaagattctagacagcatgcc

SEQ ID NO: 556470 - DNA, 25 bp, Mus musculus
cacagaagcctcacttgaatgacag

SEQ ID NO: 556471 - DNA, 25 bp, Mus musculus
cacagaagcctctcttgaatgacag

SEQ ID NO: 556472 - DNA, 25 bp, Mus musculus
cacagaagctgtcctgcacatgcca

SEQ ID NO: 556473 - DNA, 25 bp, Mus musculus
cacagaagctgtgctgcacatgcca

SEQ ID NO: 556474 - DNA, 25 bp, Mus musculus
cacagaaggaatctgagccccaacc

SEQ ID NO: 556475 - DNA, 25 bp, Mus musculus
cacagaaggaatgtgagccccaacc

SEQ ID NO: 556476 - DNA, 25 bp, Mus musculus
cacagaaggcttacgcaatgccaag

SEQ ID NO: 556477 - DNA, 25 bp, Mus musculus
cacagaaggctttcgcaatgccaag

SEQ ID NO: 556478 - DNA, 25 bp, Mus musculus
cacagaagggtgcttacttagtttt

SEQ ID NO: 556479 - DNA, 25 bp, Mus musculus
cacagaagggtggttacttagtttt

SEQ ID NO: 556480 - DNA, 25 bp, Mus musculus
cacagaaggtttaagactgagaaat

SEQ ID NO: 556481 - DNA, 25 bp, Mus musculus
cacagaaggttttagactgagaaat

SEQ ID NO: 556482 - DNA, 25 bp, Mus musculus
cacagaagtcgtcaaggccaaggct

SEQ ID NO: 556483 - DNA, 25 bp, Mus musculus
cacagaagtcgtgaaggccaaggct

SEQ ID NO: 556484 - DNA, 25 bp, Mus musculus
cacagaagtcttcgagtatgatgat

SEQ ID NO: 556485 - DNA, 25 bp, Mus musculus
cacagaagtcttggagtatgatgat

SEQ ID NO: 556486 - DNA, 25 bp, Mus musculus
cacagaagttggcaaattcaaatgt

SEQ ID NO: 556487 - DNA, 25 bp, Mus musculus
cacagaagttgggaaattcaaatgt

SEQ ID NO: 556488 - DNA, 25 bp, Mus musculus
cacagaagtttgcaatggtggtcca

SEQ ID NO: 556489 - DNA, 25 bp, Mus musculus
cacagaagtttggaatggtggtcca

SEQ ID NO: 556490 - DNA, 25 bp, Mus musculus
cacagaataatgcaacctattttaa

SEQ ID NO: 556491 - DNA, 25 bp, Mus musculus
cacagaataatggaacctattttaa

SEQ ID NO: 556492 - DNA, 25 bp, Mus musculus
cacagaatacagacttattgtggag

SEQ ID NO: 556493 - DNA, 25 bp, Mus musculus
cacagaatacagcagagtttgggac

SEQ ID NO: 556494 - DNA, 25 bp, Mus musculus
cacagaatacaggagagtttgggac

SEQ ID NO: 556495 - DNA, 25 bp, Mus musculus
cacagaatacagtcttattgtggag

SEQ ID NO: 556496 - DNA, 25 bp, Mus musculus
cacagaatgaaaacttggtgcgact

SEQ ID NO: 556497 - DNA, 25 bp, Mus musculus
cacagaatgaaaccggcgctcttca

SEQ ID NO: 556498 - DNA, 25 bp, Mus musculus
cacagaatgaaagcggcgctcttca

SEQ ID NO: 556499 - DNA, 25 bp, Mus musculus
cacagaatgaaatcttggtgcgact

SEQ ID NO: 556500 - DNA, 25 bp, Mus musculus
cacagaatgtatacgacatcctata

SEQ ID NO: 556501 - DNA, 25 bp, Mus musculus
cacagaatgtattcgacatcctata

SEQ ID NO: 556502 - DNA, 25 bp, Mus musculus
cacagacaacacctataaatacgag

SEQ ID NO: 556503 - DNA, 25 bp, Mus musculus
cacagacaacacgtataaatacgag

SEQ ID NO: 556504 - DNA, 25 bp, Mus musculus
cacagacaagatcaagtacccacgg

SEQ ID NO: 556505 - DNA, 25 bp, Mus musculus
cacagacaagatgaagtacccacgg

SEQ ID NO: 556506 - DNA, 25 bp, Mus musculus
cacagacacagcagatcaggtcatc

SEQ ID NO: 556507 - DNA, 25 bp, Mus musculus
cacagacacagctgatcaggtcatc

SEQ ID NO: 556508 - DNA, 25 bp, Mus musculus
cacagacacatacagttcttgagtg

SEQ ID NO: 556509 - DNA, 25 bp, Mus musculus
cacagacacatagagttcttgagtg

SEQ ID NO: 556510 - DNA, 25 bp, Mus musculus
cacagacaccagacttgcttgcaag

SEQ ID NO: 556511 - DNA, 25 bp, Mus musculus
cacagacaccagcagaaaacaaggc

SEQ ID NO: 556512 - DNA, 25 bp, Mus musculus
cacagacaccaggagaaaacaaggc

SEQ ID NO: 556513 - DNA, 25 bp, Mus musculus
cacagacaccagtcttgcttgcaag

SEQ ID NO: 556514 - DNA, 25 bp, Mus musculus
cacagacagcatagtctcttcctag

SEQ ID NO: 556515 - DNA, 25 bp, Mus musculus
cacagacagcattgtctcttcctag

SEQ ID NO: 556516 - DNA, 25 bp, Mus musculus
cacagacatgaccattggtacagat

SEQ ID NO: 556517 - DNA, 25 bp, Mus musculus
cacagacatgacgattggtacagat

SEQ ID NO: 556518 - DNA, 25 bp, Mus musculus
cacagacatgatcgcgcttattgac

SEQ ID NO: 556519 - DNA, 25 bp, Mus musculus
cacagacatgatggcgcttattgac

SEQ ID NO: 556520 - DNA, 25 bp, Mus musculus
cacagacatggtaaatggccaagca

SEQ ID NO: 556521 - DNA, 25 bp, Mus musculus
cacagacatggttaatggccaagca

SEQ ID NO: 556522 - DNA, 25 bp, Mus musculus
cacagaccagcacaaacttatttat

SEQ ID NO: 556523 - DNA, 25 bp, Mus musculus
cacagaccagcagaaacttatttat

SEQ ID NO: 556524 - DNA, 25 bp, Mus musculus
cacagaccagctcacaggagtttct

SEQ ID NO: 556525 - DNA, 25 bp, Mus musculus
cacagaccagctgacaggagtttct

SEQ ID NO: 556526 - DNA, 25 bp, Mus musculus
cacagaccattcctggatgcgtcta

SEQ ID NO: 556527 - DNA, 25 bp, Mus musculus
cacagaccattcgtggatgcgtcta

SEQ ID NO: 556528 - DNA, 25 bp, Mus musculus
cacagacccagcatatgaaaagcca

SEQ ID NO: 556529 - DNA, 25 bp, Mus musculus
cacagacccagcttatgaaaagcca

SEQ ID NO: 556530 - DNA, 25 bp, Mus musculus
cacagacccaggcagtgaggatgtt

SEQ ID NO: 556531 - DNA, 25 bp, Mus musculus
cacagacccagggagtgaggatgtt

SEQ ID NO: 556532 - DNA, 25 bp, Mus musculus
cacagacccgaaagttgagcgagaa

SEQ ID NO: 556533 - DNA, 25 bp, Mus musculus
cacagacccgaatgttgagcgagaa

SEQ ID NO: 556534 - DNA, 25 bp, Mus musculus
cacagaccgacacgcagaggaagca

SEQ ID NO: 556535 - DNA, 25 bp, Mus musculus
cacagaccgacaggcagaggaagca

SEQ ID NO: 556536 - DNA, 25 bp, Mus musculus
cacagacctaatcaagaaatggaaa

SEQ ID NO: 556537 - DNA, 25 bp, Mus musculus
cacagacctaatgaagaaatggaaa

SEQ ID NO: 556538 - DNA, 25 bp, Mus musculus
cacagacctgagacggaccctgcag

SEQ ID NO: 556539 - DNA, 25 bp, Mus musculus
cacagacctgagtcggaccctgcag

SEQ ID NO: 556540 - DNA, 25 bp, Mus musculus
cacagaccttgccattgaatatgag

SEQ ID NO: 556541 - DNA, 25 bp, Mus musculus
cacagaccttgcgattgaatatgag

SEQ ID NO: 556542 - DNA, 25 bp, Mus musculus
cacagacgacccagtcatccggaag

SEQ ID NO: 556543 - DNA, 25 bp, Mus musculus
cacagacgaccctgtcatccggaag

SEQ ID NO: 556544 - DNA, 25 bp, Mus musculus
cacagacgatgaccgggacaagttc

SEQ ID NO: 556545 - DNA, 25 bp, Mus musculus
cacagacgatgagcgggacaagttc

SEQ ID NO: 556546 - DNA, 25 bp, Mus musculus
cacagacggtatatgcagccagtgc

SEQ ID NO: 556547 - DNA, 25 bp, Mus musculus
cacagacggtatttgcagccagtgc

SEQ ID NO: 556548 - DNA, 25 bp, Mus musculus
cacagacgtggtatccgagctcaga

SEQ ID NO: 556549 - DNA, 25 bp, Mus musculus
cacagacgtggtttccgagctcaga

SEQ ID NO: 556550 - DNA, 25 bp, Mus musculus
cacagacgtgtgagagtctatgaag

SEQ ID NO: 556551 - DNA, 25 bp, Mus musculus
cacagacgtgtgtgagtctatgaag

SEQ ID NO: 556552 - DNA, 25 bp, Mus musculus
cacagactacatccagcaggtgtcc

SEQ ID NO: 556553 - DNA, 25 bp, Mus musculus
cacagactacatgcagcaggtgtcc

SEQ ID NO: 556554 - DNA, 25 bp, Mus musculus
cacagactgcgaaaggtagaatgcc

SEQ ID NO: 556555 - DNA, 25 bp, Mus musculus
cacagactgcgaatcacgacggatg

SEQ ID NO: 556556 - DNA, 25 bp, Mus musculus
cacagactgcgacaaccttctcaag

SEQ ID NO: 556557 - DNA, 25 bp, Mus musculus
cacagactgcgagaaccttctcaag

SEQ ID NO: 556558 - DNA, 25 bp, Mus musculus
cacagactgcgataggtagaatgcc

SEQ ID NO: 556559 - DNA, 25 bp, Mus musculus
cacagactgcgattcacgacggatg

SEQ ID NO: 556560 - DNA, 25 bp, Mus musculus
cacagactgctgaggtgcagagaga

SEQ ID NO: 556561 - DNA, 25 bp, Mus musculus
cacagactgctgtggtgcagagaga

SEQ ID NO: 556562 - DNA, 25 bp, Mus musculus
cacagagaactgctaaaaatcaaca

SEQ ID NO: 556563 - DNA, 25 bp, Mus musculus
cacagagaactggtaaaaatcaaca

SEQ ID NO: 556564 - DNA, 25 bp, Mus musculus
cacagagaagccaggttcacctgta

SEQ ID NO: 556565 - DNA, 25 bp, Mus musculus
cacagagaagcctggttcacctgta

SEQ ID NO: 556566 - DNA, 25 bp, Mus musculus
cacagagaagtcaaaaatatactct

SEQ ID NO: 556567 - DNA, 25 bp, Mus musculus
cacagagaagtctaaaatatactct

SEQ ID NO: 556568 - DNA, 25 bp, Mus musculus
cacagagaatgacgagggctgcacc

SEQ ID NO: 556569 - DNA, 25 bp, Mus musculus
cacagagaatgaggagggctgcacc

SEQ ID NO: 556570 - DNA, 25 bp, Mus musculus
cacagagacagaagaactttgggcc

SEQ ID NO: 556571 - DNA, 25 bp, Mus musculus
cacagagacagatgaactttgggcc

SEQ ID NO: 556572 - DNA, 25 bp, Mus musculus
cacagagacattaggtctaaagaga

SEQ ID NO: 556573 - DNA, 25 bp, Mus musculus
cacagagacatttggtctaaagaga

SEQ ID NO: 556574 - DNA, 25 bp, Mus musculus
cacagagacctcaagtcaagaaacg

SEQ ID NO: 556575 - DNA, 25 bp, Mus musculus
cacagagacctctagtcaagaaacg

SEQ ID NO: 556576 - DNA, 25 bp, Mus musculus
cacagagactcacaaaatggtgctt

SEQ ID NO: 556577 - DNA, 25 bp, Mus musculus
cacagagactcagaaaatggtgctt

SEQ ID NO: 556578 - DNA, 25 bp, Mus musculus
cacagagactctcttagattggcct

SEQ ID NO: 556579 - DNA, 25 bp, Mus musculus
cacagagactctgttagattggcct

SEQ ID NO: 556580 - DNA, 25 bp, Mus musculus
cacagagagagtaggcagagctgtt

SEQ ID NO: 556581 - DNA, 25 bp, Mus musculus
cacagagagagttggcagagctgtt

SEQ ID NO: 556582 - DNA, 25 bp, Mus musculus
cacagagagcagcatacaaagcagc

SEQ ID NO: 556583 - DNA, 25 bp, Mus musculus
cacagagagcaggatacaaagcagc

SEQ ID NO: 556584 - DNA, 25 bp, Mus musculus
cacagagaggatccgttccatcgaa

SEQ ID NO: 556585 - DNA, 25 bp, Mus musculus
cacagagaggatgcgttccatcgaa

SEQ ID NO: 556586 - DNA, 25 bp, Mus musculus
cacagagaggtgattcgggccgtcc

SEQ ID NO: 556587 - DNA, 25 bp, Mus musculus
cacagagaggtgtttcgggccgtcc

SEQ ID NO: 556588 - DNA, 25 bp, Mus musculus
cacagagagttgagtggaagttcaa

SEQ ID NO: 556589 - DNA, 25 bp, Mus musculus
cacagagagttgtgtggaagttcaa

SEQ ID NO: 556590 - DNA, 25 bp, Mus musculus
cacagagatactcacaggctgcaca

SEQ ID NO: 556591 - DNA, 25 bp, Mus musculus
cacagagatactgacaggctgcaca

SEQ ID NO: 556592 - DNA, 25 bp, Mus musculus
cacagagatagtatggacttacaga

SEQ ID NO: 556593 - DNA, 25 bp, Mus musculus
cacagagatagtttggacttacaga

SEQ ID NO: 556594 - DNA, 25 bp, Mus musculus
cacagagatatcaagccagacaacc

SEQ ID NO: 556595 - DNA, 25 bp, Mus musculus
cacagagatatcaccactattaaac

SEQ ID NO: 556596 - DNA, 25 bp, Mus musculus
cacagagatatctagccagacaacc

SEQ ID NO: 556597 - DNA, 25 bp, Mus musculus
cacagagatatctccactattaaac

SEQ ID NO: 556598 - DNA, 25 bp, Mus musculus
cacagagatgcacgacagattgcgc

SEQ ID NO: 556599 - DNA, 25 bp, Mus musculus
cacagagatgcaggacagattgcgc

SEQ ID NO: 556600 - DNA, 25 bp, Mus musculus
cacagagcaagacgatgcggccgtc

SEQ ID NO: 556601 - DNA, 25 bp, Mus musculus
cacagagcaagaggatgcggccgtc

SEQ ID NO: 556602 - DNA, 25 bp, Mus musculus
cacagagcacccagtacaaagtgag

SEQ ID NO: 556603 - DNA, 25 bp, Mus musculus
cacagagcaccctgtacaaagtgag

SEQ ID NO: 556604 - DNA, 25 bp, Mus musculus
cacagagcagacaatcagagaccat

SEQ ID NO: 556605 - DNA, 25 bp, Mus musculus
cacagagcagactatcagagaccat

SEQ ID NO: 556606 - DNA, 25 bp, Mus musculus
cacagagcagatccgggagaccctg

SEQ ID NO: 556607 - DNA, 25 bp, Mus musculus
cacagagcagatgcgggagaccctg

SEQ ID NO: 556608 - DNA, 25 bp, Mus musculus
cacagagccaggagctttgcggatg

SEQ ID NO: 556609 - DNA, 25 bp, Mus musculus
cacagagccaggtgctttgcggatg

SEQ ID NO: 556610 - DNA, 25 bp, Mus musculus
cacagagcccaacgtcctagcaaaa

SEQ ID NO: 556611 - DNA, 25 bp, Mus musculus
cacagagcccaaggtcctagcaaaa

SEQ ID NO: 556612 - DNA, 25 bp, Mus musculus
cacagagccccaaatgctggaaaca

SEQ ID NO: 556613 - DNA, 25 bp, Mus musculus
cacagagccccatatgctggaaaca

SEQ ID NO: 556614 - DNA, 25 bp, Mus musculus
cacagagccctcatgagtcgggaac

SEQ ID NO: 556615 - DNA, 25 bp, Mus musculus
cacagagccctcttgagtcgggaac

SEQ ID NO: 556616 - DNA, 25 bp, Mus musculus
cacagagccgatcggtggtaagaaa

SEQ ID NO: 556617 - DNA, 25 bp, Mus musculus
cacagagccgatgggtggtaagaaa

SEQ ID NO: 556618 - DNA, 25 bp, Mus musculus
cacagagccgcaagcagagtgaggc

SEQ ID NO: 556619 - DNA, 25 bp, Mus musculus
cacagagccgcatgcagagtgaggc

SEQ ID NO: 556620 - DNA, 25 bp, Mus musculus
cacagagcctagctctcggagtttt

SEQ ID NO: 556621 - DNA, 25 bp, Mus musculus
cacagagcctaggtctcggagtttt

SEQ ID NO: 556622 - DNA, 25 bp, Mus musculus
cacagagcctgtcgtgtgcatcact

SEQ ID NO: 556623 - DNA, 25 bp, Mus musculus
cacagagcctgtggtgtgcatcact

SEQ ID NO: 556624 - DNA, 25 bp, Mus musculus
cacagagcgcagaaaccactaccta

SEQ ID NO: 556625 - DNA, 25 bp, Mus musculus
cacagagcgcagtaaccactaccta

SEQ ID NO: 556626 - DNA, 25 bp, Mus musculus
cacagagcgttacatgggtctccca

SEQ ID NO: 556627 - DNA, 25 bp, Mus musculus
cacagagcgttagatgggtctccca

SEQ ID NO: 556628 - DNA, 25 bp, Mus musculus
cacagagctcccagaccatctgttt

SEQ ID NO: 556629 - DNA, 25 bp, Mus musculus
cacagagctccctgaccatctgttt

SEQ ID NO: 556630 - DNA, 25 bp, Mus musculus
cacagagcttcacaatcttggagaa

SEQ ID NO: 556631 - DNA, 25 bp, Mus musculus
cacagagcttcagaatcttggagaa

SEQ ID NO: 556632 - DNA, 25 bp, Mus musculus
cacagagcttctcatcgtggtgaag

SEQ ID NO: 556633 - DNA, 25 bp, Mus musculus
cacagagcttctgatcgtggtgaag

SEQ ID NO: 556634 - DNA, 25 bp, Mus musculus
cacagaggaggtctttcgaagctac

SEQ ID NO: 556635 - DNA, 25 bp, Mus musculus
cacagaggaggtgtttcgaagctac

SEQ ID NO: 556636 - DNA, 25 bp, Mus musculus
cacagaggatcgaggaaggtcagtt

SEQ ID NO: 556637 - DNA, 25 bp, Mus musculus
cacagaggatcgtggaaggtcagtt

SEQ ID NO: 556638 - DNA, 25 bp, Mus musculus
cacagaggcagaatgaagagatgca

SEQ ID NO: 556639 - DNA, 25 bp, Mus musculus
cacagaggcagattgaagagatgca

SEQ ID NO: 556640 - DNA, 25 bp, Mus musculus
cacagaggctgtccaaacagtagac

SEQ ID NO: 556641 - DNA, 25 bp, Mus musculus
cacagaggctgtgcaaacagtagac

SEQ ID NO: 556642 - DNA, 25 bp, Mus musculus
cacagaggttctactccgagccggt

SEQ ID NO: 556643 - DNA, 25 bp, Mus musculus
cacagaggttcttctccgagccggt

SEQ ID NO: 556644 - DNA, 25 bp, Mus musculus
cacagagtactgagtttagctccag

SEQ ID NO: 556645 - DNA, 25 bp, Mus musculus
cacagagtactgtgtttagctccag

SEQ ID NO: 556646 - DNA, 25 bp, Mus musculus
cacagagtcgttctcggagccgaag

SEQ ID NO: 556647 - DNA, 25 bp, Mus musculus
cacagagtcgttgtcggagccgaag

SEQ ID NO: 556648 - DNA, 25 bp, Mus musculus
cacagagtctatagagtaatgagca

SEQ ID NO: 556649 - DNA, 25 bp, Mus musculus
cacagagtctattgagtaatgagca

SEQ ID NO: 556650 - DNA, 25 bp, Mus musculus
cacagagtctgaagcaagagcattg

SEQ ID NO: 556651 - DNA, 25 bp, Mus musculus
cacagagtctgatgcaagagcattg

SEQ ID NO: 556652 - DNA, 25 bp, Mus musculus
cacagagtgacacgagggattctca

SEQ ID NO: 556653 - DNA, 25 bp, Mus musculus
cacagagtgacaggagggattctca

SEQ ID NO: 556654 - DNA, 25 bp, Mus musculus
cacagagtgagaccaattcattctg

SEQ ID NO: 556655 - DNA, 25 bp, Mus musculus
cacagagtgagagcaattcattctg

SEQ ID NO: 556656 - DNA, 25 bp, Mus musculus
cacagagtggacagggtcaacctgc

SEQ ID NO: 556657 - DNA, 25 bp, Mus musculus
cacagagtggactgggtcaacctgc

SEQ ID NO: 556658 - DNA, 25 bp, Mus musculus
cacagagtgggaagaggaatatgaa

SEQ ID NO: 556659 - DNA, 25 bp, Mus musculus
cacagagtgggatgaggaatatgaa

SEQ ID NO: 556660 - DNA, 25 bp, Mus musculus
cacagagtggtcctgctttatagac

SEQ ID NO: 556661 - DNA, 25 bp, Mus musculus
cacagagtggtcgtgctttatagac

SEQ ID NO: 556662 - DNA, 25 bp, Mus musculus
cacagagtgtgaacattgagcagct

SEQ ID NO: 556663 - DNA, 25 bp, Mus musculus
cacagagtgtgatcattgagcagct

SEQ ID NO: 556664 - DNA, 25 bp, Mus musculus
cacagagtgtgtatcattgacgaga

SEQ ID NO: 556665 - DNA, 25 bp, Mus musculus
cacagagtgtgtttcattgacgaga

SEQ ID NO: 556666 - DNA, 25 bp, Mus musculus
cacagagtgttcaactgaagtggca

SEQ ID NO: 556667 - DNA, 25 bp, Mus musculus
cacagagtgttctactgaagtggca

SEQ ID NO: 556668 - DNA, 25 bp, Mus musculus
cacagagttaagcaacctgttacac

SEQ ID NO: 556669 - DNA, 25 bp, Mus musculus
cacagagttaaggaacctgttacac

SEQ ID NO: 556670 - DNA, 25 bp, Mus musculus
cacagagttactcaagacagacaag

SEQ ID NO: 556671 - DNA, 25 bp, Mus musculus
cacagagttactgaagacagacaag

SEQ ID NO: 556672 - DNA, 25 bp, Mus musculus
cacagagttccacaatttactagaa

SEQ ID NO: 556673 - DNA, 25 bp, Mus musculus
cacagagttccagaatttactagaa

SEQ ID NO: 556674 - DNA, 25 bp, Mus musculus
cacagagttcctatacaacctgtac

SEQ ID NO: 556675 - DNA, 25 bp, Mus musculus
cacagagttcctttacaacctgtac

SEQ ID NO: 556676 - DNA, 25 bp, Mus musculus
cacagataaagtcaagcagggcttt

SEQ ID NO: 556677 - DNA, 25 bp, Mus musculus
cacagataaagtgaagcagggcttt

SEQ ID NO: 556678 - DNA, 25 bp, Mus musculus
cacagataaggacacaggatgaaag

SEQ ID NO: 556679 - DNA, 25 bp, Mus musculus
cacagataaggagacaggatgaaag

SEQ ID NO: 556680 - DNA, 25 bp, Mus musculus
cacagatacaatagatattgctcca

SEQ ID NO: 556681 - DNA, 25 bp, Mus musculus
cacagatacaattgatattgctcca

SEQ ID NO: 556682 - DNA, 25 bp, Mus musculus
cacagatacctcatagcatccaatg

SEQ ID NO: 556683 - DNA, 25 bp, Mus musculus
cacagatacctcttagcatccaatg

SEQ ID NO: 556684 - DNA, 25 bp, Mus musculus
cacagatagcgaagaagagatccgc

SEQ ID NO: 556685 - DNA, 25 bp, Mus musculus
cacagatagcgatgaagagatccgc

SEQ ID NO: 556686 - DNA, 25 bp, Mus musculus
cacagatatcttcggcactaaccca

SEQ ID NO: 556687 - DNA, 25 bp, Mus musculus
cacagatatcttgggcactaaccca

SEQ ID NO: 556688 - DNA, 25 bp, Mus musculus
cacagatatgagcaagatgtccttc

SEQ ID NO: 556689 - DNA, 25 bp, Mus musculus
cacagatatgaggaagatgtccttc

SEQ ID NO: 556690 - DNA, 25 bp, Mus musculus
cacagatatggtagaggcctagtct

SEQ ID NO: 556691 - DNA, 25 bp, Mus musculus
cacagatatggttgaggcctagtct

SEQ ID NO: 556692 - DNA, 25 bp, Mus musculus
cacagatcaattcctcaatgactag

SEQ ID NO: 556693 - DNA, 25 bp, Mus musculus
cacagatcaattgctcaatgactag

SEQ ID NO: 556694 - DNA, 25 bp, Mus musculus
cacagatccgacagctttctgaaag

SEQ ID NO: 556695 - DNA, 25 bp, Mus musculus
cacagatccgaccagttatgatggc

SEQ ID NO: 556696 - DNA, 25 bp, Mus musculus
cacagatccgacgagttatgatggc

SEQ ID NO: 556697 - DNA, 25 bp, Mus musculus
cacagatccgactgctttctgaaag

SEQ ID NO: 556698 - DNA, 25 bp, Mus musculus
cacagatcggccatcctgtagcacg

SEQ ID NO: 556699 - DNA, 25 bp, Mus musculus
cacagatcggccttcctgtagcacg

SEQ ID NO: 556700 - DNA, 25 bp, Mus musculus
cacagatctactcacctgaggagag

SEQ ID NO: 556701 - DNA, 25 bp, Mus musculus
cacagatctactgacctgaggagag

SEQ ID NO: 556702 - DNA, 25 bp, Mus musculus
cacagatctcaccagtctggttgca

SEQ ID NO: 556703 - DNA, 25 bp, Mus musculus
cacagatctcacgagtctggttgca

SEQ ID NO: 556704 - DNA, 25 bp, Mus musculus
cacagatctgacaggtgactcaata

SEQ ID NO: 556705 - DNA, 25 bp, Mus musculus
cacagatctgactggtgactcaata

SEQ ID NO: 556706 - DNA, 25 bp, Mus musculus
cacagatgagagaaagcgagaggaa

SEQ ID NO: 556707 - DNA, 25 bp, Mus musculus
cacagatgagagtaagcgagaggaa

SEQ ID NO: 556708 - DNA, 25 bp, Mus musculus
cacagatgaggacacgcacctggtg

SEQ ID NO: 556709 - DNA, 25 bp, Mus musculus
cacagatgaggagacgcacctggtg

SEQ ID NO: 556710 - DNA, 25 bp, Mus musculus
cacagatgatttcgacgagattgag

SEQ ID NO: 556711 - DNA, 25 bp, Mus musculus
cacagatgatttggacgagattgag

SEQ ID NO: 556712 - DNA, 25 bp, Mus musculus
cacagatgcctgagttggcaaagaa

SEQ ID NO: 556713 - DNA, 25 bp, Mus musculus
cacagatgcctgtgttggcaaagaa

SEQ ID NO: 556714 - DNA, 25 bp, Mus musculus
cacagatggactcgaaccggaagcg

SEQ ID NO: 556715 - DNA, 25 bp, Mus musculus
cacagatggactggaaccggaagcg

SEQ ID NO: 556716 - DNA, 25 bp, Mus musculus
cacagatggagaaggagcgctgtct

SEQ ID NO: 556717 - DNA, 25 bp, Mus musculus
cacagatggagatggagcgctgtct

SEQ ID NO: 556718 - DNA, 25 bp, Mus musculus
cacagatggatgacgcagagctgct

SEQ ID NO: 556719 - DNA, 25 bp, Mus musculus
cacagatggatgtcgcagagctgct

SEQ ID NO: 556720 - DNA, 25 bp, Mus musculus
cacagatggcttaaaagctggcttt

SEQ ID NO: 556721 - DNA, 25 bp, Mus musculus
cacagatggctttaaagctggcttt

SEQ ID NO: 556722 - DNA, 25 bp, Mus musculus
cacagatgtagtatgtccccaacag

SEQ ID NO: 556723 - DNA, 25 bp, Mus musculus
cacagatgtagtttgtccccaacag

SEQ ID NO: 556724 - DNA, 25 bp, Mus musculus
cacagatgtcatcgtcacagagaac

SEQ ID NO: 556725 - DNA, 25 bp, Mus musculus
cacagatgtcatggtcacagagaac

SEQ ID NO: 556726 - DNA, 25 bp, Mus musculus
cacagatgtcttagtccggttccag

SEQ ID NO: 556727 - DNA, 25 bp, Mus musculus
cacagatgtctttgtccggttccag

SEQ ID NO: 556728 - DNA, 25 bp, Mus musculus
cacagatgtgcccacttcggaatgg

SEQ ID NO: 556729 - DNA, 25 bp, Mus musculus
cacagatgtgccgacttcggaatgg

SEQ ID NO: 556730 - DNA, 25 bp, Mus musculus
cacagatgtgtgctgacgtcttgcc

SEQ ID NO: 556731 - DNA, 25 bp, Mus musculus
cacagatgtgtggtgacgtcttgcc

SEQ ID NO: 556732 - DNA, 25 bp, Mus musculus
cacagatgtttgctagcttcaaaag

SEQ ID NO: 556733 - DNA, 25 bp, Mus musculus
cacagatgtttggtagcttcaaaag

SEQ ID NO: 556734 - DNA, 25 bp, Mus musculus
cacagattcggaaatatccggtgga

SEQ ID NO: 556735 - DNA, 25 bp, Mus musculus
cacagattcggatatatccggtgga

SEQ ID NO: 556736 - DNA, 25 bp, Mus musculus
cacagattgactcggaaggtgatct

SEQ ID NO: 556737 - DNA, 25 bp, Mus musculus
cacagattgactgggaaggtgatct

SEQ ID NO: 556738 - DNA, 25 bp, Mus musculus
cacagattggatcgtatgggttgcc

SEQ ID NO: 556739 - DNA, 25 bp, Mus musculus
cacagattggatggtatgggttgcc

SEQ ID NO: 556740 - DNA, 25 bp, Mus musculus
cacagattggctaaagtttgccaga

SEQ ID NO: 556741 - DNA, 25 bp, Mus musculus
cacagattggcttaagtttgccaga

SEQ ID NO: 556742 - DNA, 25 bp, Mus musculus
cacagcaacgacagcatgggcagcc

SEQ ID NO: 556743 - DNA, 25 bp, Mus musculus
cacagcaacgactgcatgggcagcc

SEQ ID NO: 556744 - DNA, 25 bp, Mus musculus
cacagcaagatgaacactctggcca

SEQ ID NO: 556745 - DNA, 25 bp, Mus musculus
cacagcaagatgtacactctggcca

SEQ ID NO: 556746 - DNA, 25 bp, Mus musculus
cacagcaaggcaagctttgatgtcc

SEQ ID NO: 556747 - DNA, 25 bp, Mus musculus
cacagcaaggcatgctttgatgtcc

SEQ ID NO: 556748 - DNA, 25 bp, Mus musculus
cacagcaagggtctactttggttta

SEQ ID NO: 556749 - DNA, 25 bp, Mus musculus
cacagcaagggtgtactttggttta

SEQ ID NO: 556750 - DNA, 25 bp, Mus musculus
cacagcaaggtcatggctgactgag

SEQ ID NO: 556751 - DNA, 25 bp, Mus musculus
cacagcaaggtcttggctgactgag

SEQ ID NO: 556752 - DNA, 25 bp, Mus musculus
cacagcaagtttcgaatcaggactc

SEQ ID NO: 556753 - DNA, 25 bp, Mus musculus
cacagcaagtttggaatcaggactc

SEQ ID NO: 556754 - DNA, 25 bp, Mus musculus
cacagcaatgcaatcctcctacatt

SEQ ID NO: 556755 - DNA, 25 bp, Mus musculus
cacagcaatgcattcctcctacatt

SEQ ID NO: 556756 - DNA, 25 bp, Mus musculus
cacagcacctgaatctgaatgagaa

SEQ ID NO: 556757 - DNA, 25 bp, Mus musculus
cacagcacctgattctgaatgagaa

SEQ ID NO: 556758 - DNA, 25 bp, Mus musculus
cacagcactatacccaaagagtctg

SEQ ID NO: 556759 - DNA, 25 bp, Mus musculus
cacagcactatagccaaagagtctg

SEQ ID NO: 556760 - DNA, 25 bp, Mus musculus
cacagcacttgaatatgacatagac

SEQ ID NO: 556761 - DNA, 25 bp, Mus musculus
cacagcacttgattatgacatagac

SEQ ID NO: 556762 - DNA, 25 bp, Mus musculus
cacagcagaagtattcaagaagcac

SEQ ID NO: 556763 - DNA, 25 bp, Mus musculus
cacagcagaagttttcaagaagcac

SEQ ID NO: 556764 - DNA, 25 bp, Mus musculus
cacagcagagaaatccgagtgtggg

SEQ ID NO: 556765 - DNA, 25 bp, Mus musculus
cacagcagagaattccgagtgtggg

SEQ ID NO: 556766 - DNA, 25 bp, Mus musculus
cacagcagagtaaggatatacagtt

SEQ ID NO: 556767 - DNA, 25 bp, Mus musculus
cacagcagagtatggatatacagtt

SEQ ID NO: 556768 - DNA, 25 bp, Mus musculus
cacagcagatcaaccctgtggcaaa

SEQ ID NO: 556769 - DNA, 25 bp, Mus musculus
cacagcagatcatccctgtggcaaa

SEQ ID NO: 556770 - DNA, 25 bp, Mus musculus
cacagcagccggagagccaagagtg

SEQ ID NO: 556771 - DNA, 25 bp, Mus musculus
cacagcagccggtgagccaagagtg

SEQ ID NO: 556772 - DNA, 25 bp, Mus musculus
cacagcagcctcatcgacatcgaga

SEQ ID NO: 556773 - DNA, 25 bp, Mus musculus
cacagcagcctcttcgacatcgaga

SEQ ID NO: 556774 - DNA, 25 bp, Mus musculus
cacagcagggctcaatggcttgtct

SEQ ID NO: 556775 - DNA, 25 bp, Mus musculus
cacagcagggctgaatggcttgtct

SEQ ID NO: 556776 - DNA, 25 bp, Mus musculus
cacagcagtaggaatgcattggagg

SEQ ID NO: 556777 - DNA, 25 bp, Mus musculus
cacagcagtaggtatgcattggagg

SEQ ID NO: 556778 - DNA, 25 bp, Mus musculus
cacagcagtatcagaagtcagtgtt

SEQ ID NO: 556779 - DNA, 25 bp, Mus musculus
cacagcagtatctgaagtcagtgtt

SEQ ID NO: 556780 - DNA, 25 bp, Mus musculus
cacagcagtgacatctcctgggctg

SEQ ID NO: 556781 - DNA, 25 bp, Mus musculus
cacagcagtgacttctcctgggctg

SEQ ID NO: 556782 - DNA, 25 bp, Mus musculus
cacagcatcgaacaagatgagtggc

SEQ ID NO: 556783 - DNA, 25 bp, Mus musculus
cacagcatcgaagaagatgagtggc

SEQ ID NO: 556784 - DNA, 25 bp, Mus musculus
cacagcatgagtcaccctggagtaa

SEQ ID NO: 556785 - DNA, 25 bp, Mus musculus
cacagcatgagtgaccctggagtaa

SEQ ID NO: 556786 - DNA, 25 bp, Mus musculus
cacagcatgccaccgtgtgacttct

SEQ ID NO: 556787 - DNA, 25 bp, Mus musculus
cacagcatgccagcgtgtgacttct

SEQ ID NO: 556788 - DNA, 25 bp, Mus musculus
cacagcatgcgtactgactgggcag

SEQ ID NO: 556789 - DNA, 25 bp, Mus musculus
cacagcatgcgttctgactgggcag

SEQ ID NO: 556790 - DNA, 25 bp, Mus musculus
cacagcatggataatgtggcgtacc

SEQ ID NO: 556791 - DNA, 25 bp, Mus musculus
cacagcatggattatgtggcgtacc

SEQ ID NO: 556792 - DNA, 25 bp, Mus musculus
cacagcattatgacagtagctcaga

SEQ ID NO: 556793 - DNA, 25 bp, Mus musculus
cacagcattatgtcagtagctcaga

SEQ ID NO: 556794 - DNA, 25 bp, Mus musculus
cacagcattggtaacagtgccgccc

SEQ ID NO: 556795 - DNA, 25 bp, Mus musculus
cacagcattggttacagtgccgccc

SEQ ID NO: 556796 - DNA, 25 bp, Mus musculus
cacagccaaccaaactttggtttca

SEQ ID NO: 556797 - DNA, 25 bp, Mus musculus
cacagccaaccatactttggtttca

SEQ ID NO: 556798 - DNA, 25 bp, Mus musculus
cacagccaagaacgcacatctggtg

SEQ ID NO: 556799 - DNA, 25 bp, Mus musculus
cacagccaagaaggcacatctggtg

SEQ ID NO: 556800 - DNA, 25 bp, Mus musculus
cacagccaatggaccaagatttatc

SEQ ID NO: 556801 - DNA, 25 bp, Mus musculus
cacagccaatggtccaagatttatc

SEQ ID NO: 556802 - DNA, 25 bp, Mus musculus
cacagccactgtcaggcaagtggat

SEQ ID NO: 556803 - DNA, 25 bp, Mus musculus
cacagccactgtgaggcaagtggat

SEQ ID NO: 556804 - DNA, 25 bp, Mus musculus
cacagccagagtatttagtcacatc

SEQ ID NO: 556805 - DNA, 25 bp, Mus musculus
cacagccagagtttttagtcacatc

SEQ ID NO: 556806 - DNA, 25 bp, Mus musculus
cacagccagtatagcaggagcccca

SEQ ID NO: 556807 - DNA, 25 bp, Mus musculus
cacagccagtattgcaggagcccca

SEQ ID NO: 556808 - DNA, 25 bp, Mus musculus
cacagccagttcatcagtatggcaa

SEQ ID NO: 556809 - DNA, 25 bp, Mus musculus
cacagccagttcttcagtatggcaa

SEQ ID NO: 556810 - DNA, 25 bp, Mus musculus
cacagccatcttcatttacctgagt

SEQ ID NO: 556811 - DNA, 25 bp, Mus musculus
cacagccatcttgatttacctgagt

SEQ ID NO: 556812 - DNA, 25 bp, Mus musculus
cacagccatgaacagacatatcaag

SEQ ID NO: 556813 - DNA, 25 bp, Mus musculus
cacagccatgaagagacatatcaag

SEQ ID NO: 556814 - DNA, 25 bp, Mus musculus
cacagccatgcgagatggcggcaag

SEQ ID NO: 556815 - DNA, 25 bp, Mus musculus
cacagccatgcgtgatggcggcaag

SEQ ID NO: 556816 - DNA, 25 bp, Mus musculus
cacagccatgtgagtacccctctga

SEQ ID NO: 556817 - DNA, 25 bp, Mus musculus
cacagccatgtgtgtacccctctga

SEQ ID NO: 556818 - DNA, 25 bp, Mus musculus
cacagccattgaagacatggaagcc

SEQ ID NO: 556819 - DNA, 25 bp, Mus musculus
cacagccattgatgacatggaagcc

SEQ ID NO: 556820 - DNA, 25 bp, Mus musculus
cacagccattgtcgctgacctgggc

SEQ ID NO: 556821 - DNA, 25 bp, Mus musculus
cacagccattgtggctgacctgggc

SEQ ID NO: 556822 - DNA, 25 bp, Mus musculus
cacagcccctgcaggttctggcagt

SEQ ID NO: 556823 - DNA, 25 bp, Mus musculus
cacagcccctgctggttctggcagt

SEQ ID NO: 556824 - DNA, 25 bp, Mus musculus
cacagccctactcggcctgaaggag

SEQ ID NO: 556825 - DNA, 25 bp, Mus musculus
cacagccctactgggcctgaaggag

SEQ ID NO: 556826 - DNA, 25 bp, Mus musculus
cacagccctaggatcatagacaaga

SEQ ID NO: 556827 - DNA, 25 bp, Mus musculus
cacagccctaggttcatagacaaga

SEQ ID NO: 556828 - DNA, 25 bp, Mus musculus
cacagccctgtcctcttaaggcaaa

SEQ ID NO: 556829 - DNA, 25 bp, Mus musculus
cacagccctgtcgtcttaaggcaaa

SEQ ID NO: 556830 - DNA, 25 bp, Mus musculus
cacagccgagacaataagaacccag

SEQ ID NO: 556831 - DNA, 25 bp, Mus musculus
cacagccgagactataagaacccag

SEQ ID NO: 556832 - DNA, 25 bp, Mus musculus
cacagccgctcacgattggtgctag

SEQ ID NO: 556833 - DNA, 25 bp, Mus musculus
cacagccgctcaggattggtgctag

SEQ ID NO: 556834 - DNA, 25 bp, Mus musculus
cacagccgctctagaggctctggcg

SEQ ID NO: 556835 - DNA, 25 bp, Mus musculus
cacagccgctcttgaggctctggcg

SEQ ID NO: 556836 - DNA, 25 bp, Mus musculus
cacagcctcagaccacagggtgatt

SEQ ID NO: 556837 - DNA, 25 bp, Mus musculus
cacagcctcagagcacagggtgatt

SEQ ID NO: 556838 - DNA, 25 bp, Mus musculus
cacagcctcataccagttggcggag

SEQ ID NO: 556839 - DNA, 25 bp, Mus musculus
cacagcctcatagcagttggcggag

SEQ ID NO: 556840 - DNA, 25 bp, Mus musculus
cacagcctcccaaacgaaactggat

SEQ ID NO: 556841 - DNA, 25 bp, Mus musculus
cacagcctcccatacgaaactggat

SEQ ID NO: 556842 - DNA, 25 bp, Mus musculus
cacagcctcggacgctgtctggcaa

SEQ ID NO: 556843 - DNA, 25 bp, Mus musculus
cacagcctcggaggctgtctggcaa

SEQ ID NO: 556844 - DNA, 25 bp, Mus musculus
cacagcctcggtatagttccactca

SEQ ID NO: 556845 - DNA, 25 bp, Mus musculus
cacagcctcggtttagttccactca

SEQ ID NO: 556846 - DNA, 25 bp, Mus musculus
cacagcctgcacaagactgccatat

SEQ ID NO: 556847 - DNA, 25 bp, Mus musculus
cacagcctgcactagactgccatat

SEQ ID NO: 556848 - DNA, 25 bp, Mus musculus
cacagcctgtaaactttccccaaag

SEQ ID NO: 556849 - DNA, 25 bp, Mus musculus
cacagcctgtaatctttccccaaag

SEQ ID NO: 556850 - DNA, 25 bp, Mus musculus
cacagcctgtagctagaccagagta

SEQ ID NO: 556851 - DNA, 25 bp, Mus musculus
cacagcctgtaggtagaccagagta

SEQ ID NO: 556852 - DNA, 25 bp, Mus musculus
cacagcctgtgacaaattctccaac

SEQ ID NO: 556853 - DNA, 25 bp, Mus musculus
cacagcctgtgagaaattctccaac

SEQ ID NO: 556854 - DNA, 25 bp, Mus musculus
cacagcctgtggcacgcggcgttct

SEQ ID NO: 556855 - DNA, 25 bp, Mus musculus
cacagcctgtgggacgcggcgttct

SEQ ID NO: 556856 - DNA, 25 bp, Mus musculus
cacagccttcggagactctttgagt

SEQ ID NO: 556857 - DNA, 25 bp, Mus musculus
cacagccttcggtgactctttgagt

SEQ ID NO: 556858 - DNA, 25 bp, Mus musculus
cacagccttcgtctccagctttgag

SEQ ID NO: 556859 - DNA, 25 bp, Mus musculus
cacagccttcgtgtccagctttgag

SEQ ID NO: 556860 - DNA, 25 bp, Mus musculus
cacagccttgagaagtcggagactc

SEQ ID NO: 556861 - DNA, 25 bp, Mus musculus
cacagccttgagtagtcggagactc

SEQ ID NO: 556862 - DNA, 25 bp, Mus musculus
cacagccttggacacatgctccgga

SEQ ID NO: 556863 - DNA, 25 bp, Mus musculus
cacagccttggagacatgctccgga

SEQ ID NO: 556864 - DNA, 25 bp, Mus musculus
cacagcgactggacatccctgtgga

SEQ ID NO: 556865 - DNA, 25 bp, Mus musculus
cacagcgactggtcatccctgtgga

SEQ ID NO: 556866 - DNA, 25 bp, Mus musculus
cacagcgagggtcgtcttctcatcc

SEQ ID NO: 556867 - DNA, 25 bp, Mus musculus
cacagcgagggtggtcttctcatcc

SEQ ID NO: 556868 - DNA, 25 bp, Mus musculus
cacagcgatatccagacattcagag

SEQ ID NO: 556869 - DNA, 25 bp, Mus musculus
cacagcgatatcgagacattcagag

SEQ ID NO: 556870 - DNA, 25 bp, Mus musculus
cacagcgcggagacgcagttgttct

SEQ ID NO: 556871 - DNA, 25 bp, Mus musculus
cacagcgcggagtcgcagttgttct

SEQ ID NO: 556872 - DNA, 25 bp, Mus musculus
cacagcgctgcgcattggagccttc

SEQ ID NO: 556873 - DNA, 25 bp, Mus musculus
cacagcgctgcggattggagccttc

SEQ ID NO: 556874 - DNA, 25 bp, Mus musculus
cacagcgctggactttgcaagtgat

SEQ ID NO: 556875 - DNA, 25 bp, Mus musculus
cacagcgctggagtttgcaagtgat

SEQ ID NO: 556876 - DNA, 25 bp, Mus musculus
cacagcggacagattggcacaatca

SEQ ID NO: 556877 - DNA, 25 bp, Mus musculus
cacagcggacagtttggcacaatca

SEQ ID NO: 556878 - DNA, 25 bp, Mus musculus
cacagcggcgagaagcagtacaaat

SEQ ID NO: 556879 - DNA, 25 bp, Mus musculus
cacagcggcgagtagcagtacaaat

SEQ ID NO: 556880 - DNA, 25 bp, Mus musculus
cacagcgggctaacggcatttttcc

SEQ ID NO: 556881 - DNA, 25 bp, Mus musculus
cacagcgggctatcggcatttttcc

SEQ ID NO: 556882 - DNA, 25 bp, Mus musculus
cacagcgtgaggcttctgcaggaac

SEQ ID NO: 556883 - DNA, 25 bp, Mus musculus
cacagcgtgagggttctgcaggaac

SEQ ID NO: 556884 - DNA, 25 bp, Mus musculus
cacagcgttcacaaggtaattgtat

SEQ ID NO: 556885 - DNA, 25 bp, Mus musculus
cacagcgttcactaggtaattgtat

SEQ ID NO: 556886 - DNA, 25 bp, Mus musculus
cacagcgtttggagttgattcgagc

SEQ ID NO: 556887 - DNA, 25 bp, Mus musculus
cacagcgtttggtgttgattcgagc

SEQ ID NO: 556888 - DNA, 25 bp, Mus musculus
cacagctaagctcgtgctggatccc

SEQ ID NO: 556889 - DNA, 25 bp, Mus musculus
cacagctaagctggtgctggatccc

SEQ ID NO: 556890 - DNA, 25 bp, Mus musculus
cacagctacttaaccagggttggaa

SEQ ID NO: 556891 - DNA, 25 bp, Mus musculus
cacagctacttatccagggttggaa

SEQ ID NO: 556892 - DNA, 25 bp, Mus musculus
cacagctatgctcgtctgttctacc

SEQ ID NO: 556893 - DNA, 25 bp, Mus musculus
cacagctatgctggtctgttctacc

SEQ ID NO: 556894 - DNA, 25 bp, Mus musculus
cacagctcaaggagagaaagagatg

SEQ ID NO: 556895 - DNA, 25 bp, Mus musculus
cacagctcaaggtgagaaagagatg

SEQ ID NO: 556896 - DNA, 25 bp, Mus musculus
cacagctcacagatacctcttagca

SEQ ID NO: 556897 - DNA, 25 bp, Mus musculus
cacagctcacagttacctcttagca

SEQ ID NO: 556898 - DNA, 25 bp, Mus musculus
cacagctcagacacaaacccataga

SEQ ID NO: 556899 - DNA, 25 bp, Mus musculus
cacagctcagactcaaacccataga

SEQ ID NO: 556900 - DNA, 25 bp, Mus musculus
cacagctccgtgaacttcgtggctc

SEQ ID NO: 556901 - DNA, 25 bp, Mus musculus
cacagctccgtgtacttcgtggctc

SEQ ID NO: 556902 - DNA, 25 bp, Mus musculus
cacagctcctggctcggaagtgact

SEQ ID NO: 556903 - DNA, 25 bp, Mus musculus
cacagctcctgggtcggaagtgact

SEQ ID NO: 556904 - DNA, 25 bp, Mus musculus
cacagctcggagattccctttccgg

SEQ ID NO: 556905 - DNA, 25 bp, Mus musculus
cacagctcggagtttccctttccgg

SEQ ID NO: 556906 - DNA, 25 bp, Mus musculus
cacagctgaataactattggaggaa

SEQ ID NO: 556907 - DNA, 25 bp, Mus musculus
cacagctgaatatctattggaggaa

SEQ ID NO: 556908 - DNA, 25 bp, Mus musculus
cacagctgacacagcattgcccaag

SEQ ID NO: 556909 - DNA, 25 bp, Mus musculus
cacagctgacactgcattgcccaag

SEQ ID NO: 556910 - DNA, 25 bp, Mus musculus
cacagctgagatagcggtcatggga

SEQ ID NO: 556911 - DNA, 25 bp, Mus musculus
cacagctgagattgcggtcatggga

SEQ ID NO: 556912 - DNA, 25 bp, Mus musculus
cacagctgccagaggtgaactttgg

SEQ ID NO: 556913 - DNA, 25 bp, Mus musculus
cacagctgccagtggtgaactttgg

SEQ ID NO: 556914 - DNA, 25 bp, Mus musculus
cacagctggactcagccgtcgctgt

SEQ ID NO: 556915 - DNA, 25 bp, Mus musculus
cacagctggactgagccgtcgctgt

SEQ ID NO: 556916 - DNA, 25 bp, Mus musculus
cacagctggtgtcggatcttagtct

SEQ ID NO: 556917 - DNA, 25 bp, Mus musculus
cacagctggtgtgggatcttagtct

SEQ ID NO: 556918 - DNA, 25 bp, Mus musculus
cacagctggtttaactggcgaccat

SEQ ID NO: 556919 - DNA, 25 bp, Mus musculus
cacagctggttttactggcgaccat

SEQ ID NO: 556920 - DNA, 25 bp, Mus musculus
cacagctgtgacagaggaaagaggc

SEQ ID NO: 556921 - DNA, 25 bp, Mus musculus
cacagctgtgactgaggaaagaggc

SEQ ID NO: 556922 - DNA, 25 bp, Mus musculus
cacagctgtgttcgaccgggagtcc

SEQ ID NO: 556923 - DNA, 25 bp, Mus musculus
cacagctgtgttggaccgggagtcc

SEQ ID NO: 556924 - DNA, 25 bp, Mus musculus
cacagcttactccaaactggtgaag

SEQ ID NO: 556925 - DNA, 25 bp, Mus musculus
cacagcttactcgaaactggtgaag

SEQ ID NO: 556926 - DNA, 25 bp, Mus musculus
cacagcttccggaaactcagggact

SEQ ID NO: 556927 - DNA, 25 bp, Mus musculus
cacagcttccggtaactcagggact

SEQ ID NO: 556928 - DNA, 25 bp, Mus musculus
cacagcttcctaaccaaagaggagc

SEQ ID NO: 556929 - DNA, 25 bp, Mus musculus
cacagcttcctatccaaagaggagc

SEQ ID NO: 556930 - DNA, 25 bp, Mus musculus
cacagctttgtgactcatggctgca

SEQ ID NO: 556931 - DNA, 25 bp, Mus musculus
cacagctttgtgtctcatggctgca

SEQ ID NO: 556932 - DNA, 25 bp, Mus musculus
cacagcttttctcctcgatcgggtt

SEQ ID NO: 556933 - DNA, 25 bp, Mus musculus
cacagcttttctgctcgatcgggtt

SEQ ID NO: 556934 - DNA, 25 bp, Mus musculus
cacaggaaacggatcctctcccagg

SEQ ID NO: 556935 - DNA, 25 bp, Mus musculus
cacaggaaacggttcctctcccagg

SEQ ID NO: 556936 - DNA, 25 bp, Mus musculus
cacaggaaaggccaagtgccaccag

SEQ ID NO: 556937 - DNA, 25 bp, Mus musculus
cacaggaaaggcgaagtgccaccag

SEQ ID NO: 556938 - DNA, 25 bp, Mus musculus
cacaggaaatggataatcgtcccaa

SEQ ID NO: 556939 - DNA, 25 bp, Mus musculus
cacaggaaatggttaatcgtcccaa

SEQ ID NO: 556940 - DNA, 25 bp, Mus musculus
cacaggaaccggatccattcaccta

SEQ ID NO: 556941 - DNA, 25 bp, Mus musculus
cacaggaaccggttccattcaccta

SEQ ID NO: 556942 - DNA, 25 bp, Mus musculus
cacaggaagagaccaaagtataata

SEQ ID NO: 556943 - DNA, 25 bp, Mus musculus
cacaggaagagagcaaagtataata

SEQ ID NO: 556944 - DNA, 25 bp, Mus musculus
cacaggaagagtcagcttttgccca

SEQ ID NO: 556945 - DNA, 25 bp, Mus musculus
cacaggaagagtgagcttttgccca

SEQ ID NO: 556946 - DNA, 25 bp, Mus musculus
cacaggaagctgagttaaagttgca

SEQ ID NO: 556947 - DNA, 25 bp, Mus musculus
cacaggaagctgtgttaaagttgca

SEQ ID NO: 556948 - DNA, 25 bp, Mus musculus
cacaggaagtcaccatggtgcggaa

SEQ ID NO: 556949 - DNA, 25 bp, Mus musculus
cacaggaagtcagcatggtgcggaa

SEQ ID NO: 556950 - DNA, 25 bp, Mus musculus
cacaggaatacgagatagaagaggc

SEQ ID NO: 556951 - DNA, 25 bp, Mus musculus
cacaggaatacgtgatagaagaggc

SEQ ID NO: 556952 - DNA, 25 bp, Mus musculus
cacaggaatgtccaagaaaatgcca

SEQ ID NO: 556953 - DNA, 25 bp, Mus musculus
cacaggaatgtcgaagaaaatgcca

SEQ ID NO: 556954 - DNA, 25 bp, Mus musculus
cacaggaatgttagcaggtccaaag

SEQ ID NO: 556955 - DNA, 25 bp, Mus musculus
cacaggaatgtttgcaggtccaaag

SEQ ID NO: 556956 - DNA, 25 bp, Mus musculus
cacaggaattgcatctctgctccag

SEQ ID NO: 556957 - DNA, 25 bp, Mus musculus
cacaggaattgcttctctgctccag

SEQ ID NO: 556958 - DNA, 25 bp, Mus musculus
cacaggacaataagacagtagatga

SEQ ID NO: 556959 - DNA, 25 bp, Mus musculus
cacaggacaatatgacagtagatga

SEQ ID NO: 556960 - DNA, 25 bp, Mus musculus
cacaggacagaaatttataggaacc

SEQ ID NO: 556961 - DNA, 25 bp, Mus musculus
cacaggacagaattttataggaacc

SEQ ID NO: 556962 - DNA, 25 bp, Mus musculus
cacaggacagagatccaaggtttcc

SEQ ID NO: 556963 - DNA, 25 bp, Mus musculus
cacaggacagagttccaaggtttcc

SEQ ID NO: 556964 - DNA, 25 bp, Mus musculus
cacaggacaggtaacgacccggcgg

SEQ ID NO: 556965 - DNA, 25 bp, Mus musculus
cacaggacaggttacgacccggcgg

SEQ ID NO: 556966 - DNA, 25 bp, Mus musculus
cacaggacattcagtacaatggctc

SEQ ID NO: 556967 - DNA, 25 bp, Mus musculus
cacaggacattctgtacaatggctc

SEQ ID NO: 556968 - DNA, 25 bp, Mus musculus
cacaggaccccgagttgtgcccaaa

SEQ ID NO: 556969 - DNA, 25 bp, Mus musculus
cacaggaccccgtgttgtgcccaaa

SEQ ID NO: 556970 - DNA, 25 bp, Mus musculus
cacaggaccggacgctttgagatga

SEQ ID NO: 556971 - DNA, 25 bp, Mus musculus
cacaggaccggaggctttgagatga

SEQ ID NO: 556972 - DNA, 25 bp, Mus musculus
cacaggacgaagacgcaacgaccag

SEQ ID NO: 556973 - DNA, 25 bp, Mus musculus
cacaggacgaagtcgcaacgaccag

SEQ ID NO: 556974 - DNA, 25 bp, Mus musculus
cacaggactaatcgtaaaggccaaa

SEQ ID NO: 556975 - DNA, 25 bp, Mus musculus
cacaggactaatggtaaaggccaaa

SEQ ID NO: 556976 - DNA, 25 bp, Mus musculus
cacaggactgatccatatggaagaa

SEQ ID NO: 556977 - DNA, 25 bp, Mus musculus
cacaggactgatgcatatggaagaa

SEQ ID NO: 556978 - DNA, 25 bp, Mus musculus
cacaggactggactgcatgactgca

SEQ ID NO: 556979 - DNA, 25 bp, Mus musculus
cacaggactggagtgcatgactgca

SEQ ID NO: 556980 - DNA, 25 bp, Mus musculus
cacaggagaacaataaggccaccca

SEQ ID NO: 556981 - DNA, 25 bp, Mus musculus
cacaggagaacattaaggccaccca

SEQ ID NO: 556982 - DNA, 25 bp, Mus musculus
cacaggagaggacattcagtacatg

SEQ ID NO: 556983 - DNA, 25 bp, Mus musculus
cacaggagaggagattcagtacatg

SEQ ID NO: 556984 - DNA, 25 bp, Mus musculus
cacaggagagtgaaaaagtggtata

SEQ ID NO: 556985 - DNA, 25 bp, Mus musculus
cacaggagagtgtaaaagtggtata

SEQ ID NO: 556986 - DNA, 25 bp, Mus musculus
cacaggagcaaccatggggagcctc

SEQ ID NO: 556987 - DNA, 25 bp, Mus musculus
cacaggagcaacgatggggagcctc

SEQ ID NO: 556988 - DNA, 25 bp, Mus musculus
cacaggagcctgcagggctgcatac

SEQ ID NO: 556989 - DNA, 25 bp, Mus musculus
cacaggagcctggagggctgcatac

SEQ ID NO: 556990 - DNA, 25 bp, Mus musculus
cacaggagctgaaagctgattatca

SEQ ID NO: 556991 - DNA, 25 bp, Mus musculus
cacaggagctgatagctgattatca

SEQ ID NO: 556992 - DNA, 25 bp, Mus musculus
cacaggagctgtacgagtcgtcaca

SEQ ID NO: 556993 - DNA, 25 bp, Mus musculus
cacaggagctgttcgagtcgtcaca

SEQ ID NO: 556994 - DNA, 25 bp, Mus musculus
cacaggagtggtattcgttaagaat

SEQ ID NO: 556995 - DNA, 25 bp, Mus musculus
cacaggagtggttttcgttaagaat

SEQ ID NO: 556996 - DNA, 25 bp, Mus musculus
cacaggagtttcaggttcccaatga

SEQ ID NO: 556997 - DNA, 25 bp, Mus musculus
cacaggagtttctggttcccaatga

SEQ ID NO: 556998 - DNA, 25 bp, Mus musculus
cacaggataggacattctcacagca

SEQ ID NO: 556999 - DNA, 25 bp, Mus musculus
cacaggataggagattctcacagca

SEQ ID NO: 557000 - DNA, 25 bp, Mus musculus
cacaggattacaagaagcggctttc

SEQ ID NO: 557001 - DNA, 25 bp, Mus musculus
cacaggattacatgaagcggctttc

SEQ ID NO: 557002 - DNA, 25 bp, Mus musculus
cacaggatttatacgtgccaacaat

SEQ ID NO: 557003 - DNA, 25 bp, Mus musculus
cacaggatttattcgtgccaacaat

SEQ ID NO: 557004 - DNA, 25 bp, Mus musculus
cacaggcaaagtcatggtcatgaag

SEQ ID NO: 557005 - DNA, 25 bp, Mus musculus
cacaggcaaagtgatggtcatgaag

SEQ ID NO: 557006 - DNA, 25 bp, Mus musculus
cacaggcaaatactttgacaaagcc

SEQ ID NO: 557007 - DNA, 25 bp, Mus musculus
cacaggcaaatagtttgacaaagcc

SEQ ID NO: 557008 - DNA, 25 bp, Mus musculus
cacaggcaagaacgcgtggcggatc

SEQ ID NO: 557009 - DNA, 25 bp, Mus musculus
cacaggcaagaaggcgtggcggatc

SEQ ID NO: 557010 - DNA, 25 bp, Mus musculus
cacaggcaagctcccacgttgtggg

SEQ ID NO: 557011 - DNA, 25 bp, Mus musculus
cacaggcaagctgccacgttgtggg

SEQ ID NO: 557012 - DNA, 25 bp, Mus musculus
cacaggcaccgtcataaaggtgatc

SEQ ID NO: 557013 - DNA, 25 bp, Mus musculus
cacaggcaccgtgataaaggtgatc

SEQ ID NO: 557014 - DNA, 25 bp, Mus musculus
cacaggcaggatcgcattgaactca

SEQ ID NO: 557015 - DNA, 25 bp, Mus musculus
cacaggcaggatggcattgaactca

SEQ ID NO: 557016 - DNA, 25 bp, Mus musculus
cacaggcaggtgaagcattatcgaa

SEQ ID NO: 557017 - DNA, 25 bp, Mus musculus
cacaggcaggtgtagcattatcgaa

SEQ ID NO: 557018 - DNA, 25 bp, Mus musculus
cacaggcagtatatgcacgcgtggc

SEQ ID NO: 557019 - DNA, 25 bp, Mus musculus
cacaggcagtatttgcacgcgtggc

SEQ ID NO: 557020 - DNA, 25 bp, Mus musculus
cacaggcagtgccactgcgcaggtt

SEQ ID NO: 557021 - DNA, 25 bp, Mus musculus
cacaggcagtgcgactgcgcaggtt

SEQ ID NO: 557022 - DNA, 25 bp, Mus musculus
cacaggcatattacgtcaagtaggg

SEQ ID NO: 557023 - DNA, 25 bp, Mus musculus
cacaggcatatttcgtcaagtaggg

SEQ ID NO: 557024 - DNA, 25 bp, Mus musculus
cacaggcatttcagtgggacatggc

SEQ ID NO: 557025 - DNA, 25 bp, Mus musculus
cacaggcatttctgtgggacatggc

SEQ ID NO: 557026 - DNA, 25 bp, Mus musculus
cacaggccccgactggtatgggaca

SEQ ID NO: 557027 - DNA, 25 bp, Mus musculus
cacaggccccgagtggtatgggaca

SEQ ID NO: 557028 - DNA, 25 bp, Mus musculus
cacaggcccgtgcatcctgttcagg

SEQ ID NO: 557029 - DNA, 25 bp, Mus musculus
cacaggcccgtggatcctgttcagg

SEQ ID NO: 557030 - DNA, 25 bp, Mus musculus
cacaggcctcccaagaggtggcaga

SEQ ID NO: 557031 - DNA, 25 bp, Mus musculus
cacaggcctccctagaggtggcaga

SEQ ID NO: 557032 - DNA, 25 bp, Mus musculus
cacaggcctggtaggagctagttga

SEQ ID NO: 557033 - DNA, 25 bp, Mus musculus
cacaggcctggttggagctagttga

SEQ ID NO: 557034 - DNA, 25 bp, Mus musculus
cacaggcgctcaatgcctactatct

SEQ ID NO: 557035 - DNA, 25 bp, Mus musculus
cacaggcgctcattgcctactatct

SEQ ID NO: 557036 - DNA, 25 bp, Mus musculus
cacaggctacaaatccaactatcgg

SEQ ID NO: 557037 - DNA, 25 bp, Mus musculus
cacaggctacaattccaactatcgg

SEQ ID NO: 557038 - DNA, 25 bp, Mus musculus
cacaggctcaccatgatgatcaagg

SEQ ID NO: 557039 - DNA, 25 bp, Mus musculus
cacaggctcaccttgatgatcaagg

SEQ ID NO: 557040 - DNA, 25 bp, Mus musculus
cacaggctctgtcctatgtgagtgc

SEQ ID NO: 557041 - DNA, 25 bp, Mus musculus
cacaggctctgtgctatgtgagtgc

SEQ ID NO: 557042 - DNA, 25 bp, Mus musculus
cacaggctgagaaattggaaaccca

SEQ ID NO: 557043 - DNA, 25 bp, Mus musculus
cacaggctgagatattggaaaccca

SEQ ID NO: 557044 - DNA, 25 bp, Mus musculus
cacaggctgagcaattggttccgaa

SEQ ID NO: 557045 - DNA, 25 bp, Mus musculus
cacaggctgagctattggttccgaa

SEQ ID NO: 557046 - DNA, 25 bp, Mus musculus
cacaggctgccaagatgtctactga

SEQ ID NO: 557047 - DNA, 25 bp, Mus musculus
cacaggctgccatgatgtctactga

SEQ ID NO: 557048 - DNA, 25 bp, Mus musculus
cacaggctggacagaaaacatcagc

SEQ ID NO: 557049 - DNA, 25 bp, Mus musculus
cacaggctggactgaaaacatcagc

SEQ ID NO: 557050 - DNA, 25 bp, Mus musculus
cacaggctgtgaagactgttatcaa

SEQ ID NO: 557051 - DNA, 25 bp, Mus musculus
cacaggctgtgatgactgttatcaa

SEQ ID NO: 557052 - DNA, 25 bp, Mus musculus
cacaggctgttaagaggcggaaccc

SEQ ID NO: 557053 - DNA, 25 bp, Mus musculus
cacaggctgttactcaggcccaact

SEQ ID NO: 557054 - DNA, 25 bp, Mus musculus
cacaggctgttagtcaggcccaact

SEQ ID NO: 557055 - DNA, 25 bp, Mus musculus
cacaggctgttatgaggcggaaccc

SEQ ID NO: 557056 - DNA, 25 bp, Mus musculus
cacaggcttcatctgctttgacgca

SEQ ID NO: 557057 - DNA, 25 bp, Mus musculus
cacaggcttcatgtgctttgacgca

SEQ ID NO: 557058 - DNA, 25 bp, Mus musculus
cacaggctttccacactacagggtg

SEQ ID NO: 557059 - DNA, 25 bp, Mus musculus
cacaggctttcctcactacagggtg

SEQ ID NO: 557060 - DNA, 25 bp, Mus musculus
cacagggaagttccatggacactac

SEQ ID NO: 557061 - DNA, 25 bp, Mus musculus
cacagggaagttgcatggacactac

SEQ ID NO: 557062 - DNA, 25 bp, Mus musculus
cacagggacatgaaggctgcgaatg

SEQ ID NO: 557063 - DNA, 25 bp, Mus musculus
cacagggacatgtaggctgcgaatg

SEQ ID NO: 557064 - DNA, 25 bp, Mus musculus
cacagggagaccaccatggtgcatg

SEQ ID NO: 557065 - DNA, 25 bp, Mus musculus
cacagggagacctccatggtgcatg

SEQ ID NO: 557066 - DNA, 25 bp, Mus musculus
cacagggaggcacgctgtactcaag

SEQ ID NO: 557067 - DNA, 25 bp, Mus musculus
cacagggaggcaggctgtactcaag

SEQ ID NO: 557068 - DNA, 25 bp, Mus musculus
cacagggagtagaaaccgtggccca

SEQ ID NO: 557069 - DNA, 25 bp, Mus musculus
cacagggagtagtaaccgtggccca

SEQ ID NO: 557070 - DNA, 25 bp, Mus musculus
cacagggatttgagcagtaaggaca

SEQ ID NO: 557071 - DNA, 25 bp, Mus musculus
cacagggatttgtgcagtaaggaca

SEQ ID NO: 557072 - DNA, 25 bp, Mus musculus
cacagggcaaaactgctcttgacct

SEQ ID NO: 557073 - DNA, 25 bp, Mus musculus
cacagggcaaaagtgctcttgacct

SEQ ID NO: 557074 - DNA, 25 bp, Mus musculus
cacagggcacgaccgggaaatcacg

SEQ ID NO: 557075 - DNA, 25 bp, Mus musculus
cacagggcacgagcgggaaatcacg

SEQ ID NO: 557076 - DNA, 25 bp, Mus musculus
cacagggcatgtctacgcaatgaaa

SEQ ID NO: 557077 - DNA, 25 bp, Mus musculus
cacagggcatgtgtacgcaatgaaa

SEQ ID NO: 557078 - DNA, 25 bp, Mus musculus
cacagggccagacgcatcagttctg

SEQ ID NO: 557079 - DNA, 25 bp, Mus musculus
cacagggccagaggcatcagttctg

SEQ ID NO: 557080 - DNA, 25 bp, Mus musculus
cacagggcctgcagactgatgaaga

SEQ ID NO: 557081 - DNA, 25 bp, Mus musculus
cacagggcctgcatccattccaggg

SEQ ID NO: 557082 - DNA, 25 bp, Mus musculus
cacagggcctgctgactgatgaaga

SEQ ID NO: 557083 - DNA, 25 bp, Mus musculus
cacagggcctgcttccattccaggg

SEQ ID NO: 557084 - DNA, 25 bp, Mus musculus
cacagggccttgctgctggaagaac

SEQ ID NO: 557085 - DNA, 25 bp, Mus musculus
cacagggccttggtgctggaagaac

SEQ ID NO: 557086 - DNA, 25 bp, Mus musculus
cacagggcgctgatatccgtgccat

SEQ ID NO: 557087 - DNA, 25 bp, Mus musculus
cacagggcgctgttatccgtgccat

SEQ ID NO: 557088 - DNA, 25 bp, Mus musculus
cacagggcgtttaatcttgcgccaa

SEQ ID NO: 557089 - DNA, 25 bp, Mus musculus
cacagggcgttttatcttgcgccaa

SEQ ID NO: 557090 - DNA, 25 bp, Mus musculus
cacagggctttcatcactcttggtc

SEQ ID NO: 557091 - DNA, 25 bp, Mus musculus
cacagggctttcttcactcttggtc

SEQ ID NO: 557092 - DNA, 25 bp, Mus musculus
cacaggggtcataacccaaggaagg

SEQ ID NO: 557093 - DNA, 25 bp, Mus musculus
cacaggggtcattacccaaggaagg

SEQ ID NO: 557094 - DNA, 25 bp, Mus musculus
cacagggtacatctcacagtaagac

SEQ ID NO: 557095 - DNA, 25 bp, Mus musculus
cacagggtacatgtcacagtaagac

SEQ ID NO: 557096 - DNA, 25 bp, Mus musculus
cacagggtatcaacatggccaacag

SEQ ID NO: 557097 - DNA, 25 bp, Mus musculus
cacagggtatcatcatggccaacag

SEQ ID NO: 557098 - DNA, 25 bp, Mus musculus
cacagggtatggcactctggtacag

SEQ ID NO: 557099 - DNA, 25 bp, Mus musculus
cacagggtatgggactctggtacag

SEQ ID NO: 557100 - DNA, 25 bp, Mus musculus
cacagggtgctgaacagacccaagg

SEQ ID NO: 557101 - DNA, 25 bp, Mus musculus
cacagggtgctgtacagacccaagg

SEQ ID NO: 557102 - DNA, 25 bp, Mus musculus
cacagggttctaacagaagccagcc

SEQ ID NO: 557103 - DNA, 25 bp, Mus musculus
cacagggttctatcagaagccagcc

SEQ ID NO: 557104 - DNA, 25 bp, Mus musculus
cacagggttcttccagtaggtgaca

SEQ ID NO: 557105 - DNA, 25 bp, Mus musculus
cacagggttcttgcagtaggtgaca

SEQ ID NO: 557106 - DNA, 25 bp, Mus musculus
cacaggtacagaacgagtggatgga

SEQ ID NO: 557107 - DNA, 25 bp, Mus musculus
cacaggtacagatcgagtggatgga

SEQ ID NO: 557108 - DNA, 25 bp, Mus musculus
cacaggtagcccaggacggcattca

SEQ ID NO: 557109 - DNA, 25 bp, Mus musculus
cacaggtagccctggacggcattca

SEQ ID NO: 557110 - DNA, 25 bp, Mus musculus
cacaggtcaatgacatcaagttggg

SEQ ID NO: 557111 - DNA, 25 bp, Mus musculus
cacaggtcaatgtcatcaagttggg

SEQ ID NO: 557112 - DNA, 25 bp, Mus musculus
cacaggtcagacaaacagtgatgct

SEQ ID NO: 557113 - DNA, 25 bp, Mus musculus
cacaggtcagactaacagtgatgct

SEQ ID NO: 557114 - DNA, 25 bp, Mus musculus
cacaggtcaggaccgatgacaggct

SEQ ID NO: 557115 - DNA, 25 bp, Mus musculus
cacaggtcaggagcgatgacaggct

SEQ ID NO: 557116 - DNA, 25 bp, Mus musculus
cacaggtgagaaccttgacctgctc

SEQ ID NO: 557117 - DNA, 25 bp, Mus musculus
cacaggtgagaagcttgacctgctc

SEQ ID NO: 557118 - DNA, 25 bp, Mus musculus
cacaggtgcaagagtctctgcttgc

SEQ ID NO: 557119 - DNA, 25 bp, Mus musculus
cacaggtgcaagtgtctctgcttgc

SEQ ID NO: 557120 - DNA, 25 bp, Mus musculus
cacaggtgccaacactggtatacct

SEQ ID NO: 557121 - DNA, 25 bp, Mus musculus
cacaggtgccaagactggtatacct

SEQ ID NO: 557122 - DNA, 25 bp, Mus musculus
cacaggtgccgtcttgggttatctc

SEQ ID NO: 557123 - DNA, 25 bp, Mus musculus
cacaggtgccgtgttgggttatctc

SEQ ID NO: 557124 - DNA, 25 bp, Mus musculus
cacaggtgccttcgcctcggcagtg

SEQ ID NO: 557125 - DNA, 25 bp, Mus musculus
cacaggtgccttggcctcggcagtg

SEQ ID NO: 557126 - DNA, 25 bp, Mus musculus
cacaggtgcgccacggctgctgcag

SEQ ID NO: 557127 - DNA, 25 bp, Mus musculus
cacaggtgcgcctcggctgctgcag

SEQ ID NO: 557128 - DNA, 25 bp, Mus musculus
cacaggtggcatcaagcaaaaatac

SEQ ID NO: 557129 - DNA, 25 bp, Mus musculus
cacaggtggcatgaagcaaaaatac

SEQ ID NO: 557130 - DNA, 25 bp, Mus musculus
cacaggtgtagtatggtgcatttca

SEQ ID NO: 557131 - DNA, 25 bp, Mus musculus
cacaggtgtagtttggtgcatttca

SEQ ID NO: 557132 - DNA, 25 bp, Mus musculus
cacaggtgtgatctctatcttggcg

SEQ ID NO: 557133 - DNA, 25 bp, Mus musculus
cacaggtgtgatgtctatcttggcg

SEQ ID NO: 557134 - DNA, 25 bp, Mus musculus
cacaggtgtgcaacgtgtgccagaa

SEQ ID NO: 557135 - DNA, 25 bp, Mus musculus
cacaggtgtgcatcgtgtgccagaa

SEQ ID NO: 557136 - DNA, 25 bp, Mus musculus
cacaggtgtgtcatgccgggacgtc

SEQ ID NO: 557137 - DNA, 25 bp, Mus musculus
cacaggtgtgtcttgccgggacgtc

SEQ ID NO: 557138 - DNA, 25 bp, Mus musculus
cacaggtgttacagtgatgccgccg

SEQ ID NO: 557139 - DNA, 25 bp, Mus musculus
cacaggtgttactgtgatgccgccg

SEQ ID NO: 557140 - DNA, 25 bp, Mus musculus
cacaggtgttgcatgcgccacttct

SEQ ID NO: 557141 - DNA, 25 bp, Mus musculus
cacaggtgttgcttgcgccacttct

SEQ ID NO: 557142 - DNA, 25 bp, Mus musculus
cacaggttagtgactgagcacatgg

SEQ ID NO: 557143 - DNA, 25 bp, Mus musculus
cacaggttagtgtctgagcacatgg

SEQ ID NO: 557144 - DNA, 25 bp, Mus musculus
cacaggttccaccagtcatgtcaac

SEQ ID NO: 557145 - DNA, 25 bp, Mus musculus
cacaggttccacgagtcatgtcaac

SEQ ID NO: 557146 - DNA, 25 bp, Mus musculus
cacaggttgacgagaagactaacgc

SEQ ID NO: 557147 - DNA, 25 bp, Mus musculus
cacaggttgacgtgaagactaacgc

SEQ ID NO: 557148 - DNA, 25 bp, Mus musculus
cacagtaaatgccacgaacgaaatg

SEQ ID NO: 557149 - DNA, 25 bp, Mus musculus
cacagtaaatgcgacgaacgaaatg

SEQ ID NO: 557150 - DNA, 25 bp, Mus musculus
cacagtaacggacataatggagtcc

SEQ ID NO: 557151 - DNA, 25 bp, Mus musculus
cacagtaacggagataatggagtcc

SEQ ID NO: 557152 - DNA, 25 bp, Mus musculus
cacagtacagtaccccgtcttcaaa

SEQ ID NO: 557153 - DNA, 25 bp, Mus musculus
cacagtacagtagcccgtcttcaaa

SEQ ID NO: 557154 - DNA, 25 bp, Mus musculus
cacagtacctggcttcggagttcca

SEQ ID NO: 557155 - DNA, 25 bp, Mus musculus
cacagtacctgggttcggagttcca

SEQ ID NO: 557156 - DNA, 25 bp, Mus musculus
cacagtacgacacattccacatagg

SEQ ID NO: 557157 - DNA, 25 bp, Mus musculus
cacagtacgacagattccacatagg

SEQ ID NO: 557158 - DNA, 25 bp, Mus musculus
cacagtacgagtcacaactgctgcc

SEQ ID NO: 557159 - DNA, 25 bp, Mus musculus
cacagtacgagtgacaactgctgcc

SEQ ID NO: 557160 - DNA, 25 bp, Mus musculus
cacagtactgttaccctctgggacc

SEQ ID NO: 557161 - DNA, 25 bp, Mus musculus
cacagtactgtttccctctgggacc

SEQ ID NO: 557162 - DNA, 25 bp, Mus musculus
cacagtagggcaatctattcgtcag

SEQ ID NO: 557163 - DNA, 25 bp, Mus musculus
cacagtagggcattctattcgtcag

SEQ ID NO: 557164 - DNA, 25 bp, Mus musculus
cacagtagttttaggctgcatagcg

SEQ ID NO: 557165 - DNA, 25 bp, Mus musculus
cacagtagtttttggctgcatagcg

SEQ ID NO: 557166 - DNA, 25 bp, Mus musculus
cacagtatatgacttcgagcaggag

SEQ ID NO: 557167 - DNA, 25 bp, Mus musculus
cacagtatatgagttcgagcaggag

SEQ ID NO: 557168 - DNA, 25 bp, Mus musculus
cacagtatctagctatggcggcagt

SEQ ID NO: 557169 - DNA, 25 bp, Mus musculus
cacagtatctaggtatggcggcagt

SEQ ID NO: 557170 - DNA, 25 bp, Mus musculus
cacagtatgtgcacattggcatcag

SEQ ID NO: 557171 - DNA, 25 bp, Mus musculus
cacagtatgtgctcattggcatcag

SEQ ID NO: 557172 - DNA, 25 bp, Mus musculus
cacagtattactaccctttgtcggg

SEQ ID NO: 557173 - DNA, 25 bp, Mus musculus
cacagtattacttccctttgtcggg

SEQ ID NO: 557174 - DNA, 25 bp, Mus musculus
cacagtattagcagtgcgaccaccc

SEQ ID NO: 557175 - DNA, 25 bp, Mus musculus
cacagtattagctgtgcgaccaccc

SEQ ID NO: 557176 - DNA, 25 bp, Mus musculus
cacagtattgtcactggcctactca

SEQ ID NO: 557177 - DNA, 25 bp, Mus musculus
cacagtattgtctctggcctactca

SEQ ID NO: 557178 - DNA, 25 bp, Mus musculus
cacagtcaaatcaggagccaaaaag

SEQ ID NO: 557179 - DNA, 25 bp, Mus musculus
cacagtcaaatctggagccaaaaag

SEQ ID NO: 557180 - DNA, 25 bp, Mus musculus
cacagtcactcgaagcttccgcagt

SEQ ID NO: 557181 - DNA, 25 bp, Mus musculus
cacagtcactcgtagcttccgcagt

SEQ ID NO: 557182 - DNA, 25 bp, Mus musculus
cacagtcactgcagttcatcatcga

SEQ ID NO: 557183 - DNA, 25 bp, Mus musculus
cacagtcactgctgttcatcatcga

SEQ ID NO: 557184 - DNA, 25 bp, Mus musculus
cacagtcaggtaactctttagtcgc

SEQ ID NO: 557185 - DNA, 25 bp, Mus musculus
cacagtcaggtatctctttagtcgc

SEQ ID NO: 557186 - DNA, 25 bp, Mus musculus
cacagtcagtctacatggcaggtat

SEQ ID NO: 557187 - DNA, 25 bp, Mus musculus
cacagtcagtcttcatggcaggtat

SEQ ID NO: 557188 - DNA, 25 bp, Mus musculus
cacagtcagtgacatcgtgctcaag

SEQ ID NO: 557189 - DNA, 25 bp, Mus musculus
cacagtcagtgagatcgtgctcaag

SEQ ID NO: 557190 - DNA, 25 bp, Mus musculus
cacagtcagtggcaactacaagaaa

SEQ ID NO: 557191 - DNA, 25 bp, Mus musculus
cacagtcagtgggaactacaagaaa

SEQ ID NO: 557192 - DNA, 25 bp, Mus musculus
cacagtcatcgtcgttgttggagcc

SEQ ID NO: 557193 - DNA, 25 bp, Mus musculus
cacagtcatcgtggttgttggagcc

SEQ ID NO: 557194 - DNA, 25 bp, Mus musculus
cacagtccatatctacattcaatac

SEQ ID NO: 557195 - DNA, 25 bp, Mus musculus
cacagtccatatgtacattcaatac

SEQ ID NO: 557196 - DNA, 25 bp, Mus musculus
cacagtccgtgacactacagcagca

SEQ ID NO: 557197 - DNA, 25 bp, Mus musculus
cacagtccgtgagactacagcagca

SEQ ID NO: 557198 - DNA, 25 bp, Mus musculus
cacagtccgtgtatcctacctggaa

SEQ ID NO: 557199 - DNA, 25 bp, Mus musculus
cacagtccgtgtttcctacctggaa

SEQ ID NO: 557200 - DNA, 25 bp, Mus musculus
cacagtcctcatctacactagtgat

SEQ ID NO: 557201 - DNA, 25 bp, Mus musculus
cacagtcctcatgtacactagtgat

SEQ ID NO: 557202 - DNA, 25 bp, Mus musculus
cacagtcctttccatgagcatgtgc

SEQ ID NO: 557203 - DNA, 25 bp, Mus musculus
cacagtcctttcgatgagcatgtgc

SEQ ID NO: 557204 - DNA, 25 bp, Mus musculus
cacagtcggtggagctacgtgttct

SEQ ID NO: 557205 - DNA, 25 bp, Mus musculus
cacagtcggtggtgctacgtgttct

SEQ ID NO: 557206 - DNA, 25 bp, Mus musculus
cacagtcgtggcaggacacagcaga

SEQ ID NO: 557207 - DNA, 25 bp, Mus musculus
cacagtcgtggcatataaggatgcc

SEQ ID NO: 557208 - DNA, 25 bp, Mus musculus
cacagtcgtggctggacacagcaga

SEQ ID NO: 557209 - DNA, 25 bp, Mus musculus
cacagtcgtggcttataaggatgcc

SEQ ID NO: 557210 - DNA, 25 bp, Mus musculus
cacagtctcattcggatttggtgtc

SEQ ID NO: 557211 - DNA, 25 bp, Mus musculus
cacagtctcattgggatttggtgtc

SEQ ID NO: 557212 - DNA, 25 bp, Mus musculus
cacagtctccaaagtattctactta

SEQ ID NO: 557213 - DNA, 25 bp, Mus musculus
cacagtctccaatgtattctactta

SEQ ID NO: 557214 - DNA, 25 bp, Mus musculus
cacagtctgctgcatgtctaagcca

SEQ ID NO: 557215 - DNA, 25 bp, Mus musculus
cacagtctgctggatgtctaagcca

SEQ ID NO: 557216 - DNA, 25 bp, Mus musculus
cacagtctgtttcattcatgtaaga

SEQ ID NO: 557217 - DNA, 25 bp, Mus musculus
cacagtctgtttgattcatgtaaga

SEQ ID NO: 557218 - DNA, 25 bp, Mus musculus
cacagtcttcacctggaagttctct

SEQ ID NO: 557219 - DNA, 25 bp, Mus musculus
cacagtcttcacgtggaagttctct

SEQ ID NO: 557220 - DNA, 25 bp, Mus musculus
cacagtcttcgacgctggaatagca

SEQ ID NO: 557221 - DNA, 25 bp, Mus musculus
cacagtcttcgaggctggaatagca

SEQ ID NO: 557222 - DNA, 25 bp, Mus musculus
cacagtcttctaccgtttcctgaag

SEQ ID NO: 557223 - DNA, 25 bp, Mus musculus
cacagtcttctagcgtttcctgaag

SEQ ID NO: 557224 - DNA, 25 bp, Mus musculus
cacagtgaaactcaaagttacagac

SEQ ID NO: 557225 - DNA, 25 bp, Mus musculus
cacagtgaaactgaaagttacagac

SEQ ID NO: 557226 - DNA, 25 bp, Mus musculus
cacagtgaagctcggcattttagac

SEQ ID NO: 557227 - DNA, 25 bp, Mus musculus
cacagtgaagctgggcattttagac

SEQ ID NO: 557228 - DNA, 25 bp, Mus musculus
cacagtgagcctcataaaagggccg

SEQ ID NO: 557229 - DNA, 25 bp, Mus musculus
cacagtgagcctgataaaagggccg

SEQ ID NO: 557230 - DNA, 25 bp, Mus musculus
cacagtgagtccagttttgaaataa

SEQ ID NO: 557231 - DNA, 25 bp, Mus musculus
cacagtgagtcctgttttgaaataa

SEQ ID NO: 557232 - DNA, 25 bp, Mus musculus
cacagtgatcttagttcagggaacg

SEQ ID NO: 557233 - DNA, 25 bp, Mus musculus
cacagtgatctttgttcagggaacg

SEQ ID NO: 557234 - DNA, 25 bp, Mus musculus
cacagtgatggacatcattcgcaac

SEQ ID NO: 557235 - DNA, 25 bp, Mus musculus
cacagtgatggagatcattcgcaac

SEQ ID NO: 557236 - DNA, 25 bp, Mus musculus
cacagtgcaaacacggagagtgcgt

SEQ ID NO: 557237 - DNA, 25 bp, Mus musculus
cacagtgcaaactcggagagtgcgt

SEQ ID NO: 557238 - DNA, 25 bp, Mus musculus
cacagtgcaagcctgtagggacaca

SEQ ID NO: 557239 - DNA, 25 bp, Mus musculus
cacagtgcaagcgtgtagggacaca

SEQ ID NO: 557240 - DNA, 25 bp, Mus musculus
cacagtgcacacagggtaatcagca

SEQ ID NO: 557241 - DNA, 25 bp, Mus musculus
cacagtgcacactgggtaatcagca

SEQ ID NO: 557242 - DNA, 25 bp, Mus musculus
cacagtgcaccacggccaaacttgg

SEQ ID NO: 557243 - DNA, 25 bp, Mus musculus
cacagtgcaccagggccaaacttgg

SEQ ID NO: 557244 - DNA, 25 bp, Mus musculus
cacagtgcagcacaaatggagttcc

SEQ ID NO: 557245 - DNA, 25 bp, Mus musculus
cacagtgcagcagaaatggagttcc

SEQ ID NO: 557246 - DNA, 25 bp, Mus musculus
cacagtgccagtccaggcccaggga

SEQ ID NO: 557247 - DNA, 25 bp, Mus musculus
cacagtgccagtgcaggcccaggga

SEQ ID NO: 557248 - DNA, 25 bp, Mus musculus
cacagtgccgtaaccgtcgtcatgg

SEQ ID NO: 557249 - DNA, 25 bp, Mus musculus
cacagtgccgtatccgtcgtcatgg

SEQ ID NO: 557250 - DNA, 25 bp, Mus musculus
cacagtgcctcactgaaatagagat

SEQ ID NO: 557251 - DNA, 25 bp, Mus musculus
cacagtgcctcagtgaaatagagat

SEQ ID NO: 557252 - DNA, 25 bp, Mus musculus
cacagtgccttaaacaccatgatga

SEQ ID NO: 557253 - DNA, 25 bp, Mus musculus
cacagtgccttatacaccatgatga

SEQ ID NO: 557254 - DNA, 25 bp, Mus musculus
cacagtgctcctccgagcctgggtg

SEQ ID NO: 557255 - DNA, 25 bp, Mus musculus
cacagtgctcctgcgagcctgggtg

SEQ ID NO: 557256 - DNA, 25 bp, Mus musculus
cacagtgctcttctgaccggcgttg

SEQ ID NO: 557257 - DNA, 25 bp, Mus musculus
cacagtgctcttgtgaccggcgttg

SEQ ID NO: 557258 - DNA, 25 bp, Mus musculus
cacagtgctgaaagtgatctcagtc

SEQ ID NO: 557259 - DNA, 25 bp, Mus musculus
cacagtgctgaatgtgatctcagtc

SEQ ID NO: 557260 - DNA, 25 bp, Mus musculus
cacagtgctgacctttctgaggaca

SEQ ID NO: 557261 - DNA, 25 bp, Mus musculus
cacagtgctgacgtttctgaggaca

SEQ ID NO: 557262 - DNA, 25 bp, Mus musculus
cacagtgctgtaagacgtacaggag

SEQ ID NO: 557263 - DNA, 25 bp, Mus musculus
cacagtgctgtatgacgtacaggag

SEQ ID NO: 557264 - DNA, 25 bp, Mus musculus
cacagtggaaaacatgggcagagtt

SEQ ID NO: 557265 - DNA, 25 bp, Mus musculus
cacagtggaaaagatgggcagagtt

SEQ ID NO: 557266 - DNA, 25 bp, Mus musculus
cacagtggaagaccatgtgaaaaac

SEQ ID NO: 557267 - DNA, 25 bp, Mus musculus
cacagtggaagagcatgtgaaaaac

SEQ ID NO: 557268 - DNA, 25 bp, Mus musculus
cacagtggagcacaacttcaaagct

SEQ ID NO: 557269 - DNA, 25 bp, Mus musculus
cacagtggagcagaacttcaaagct

SEQ ID NO: 557270 - DNA, 25 bp, Mus musculus
cacagtggagctctacaaaggcaga

SEQ ID NO: 557271 - DNA, 25 bp, Mus musculus
cacagtggagctgtacaaaggcaga

SEQ ID NO: 557272 - DNA, 25 bp, Mus musculus
cacagtggatcgaaagccaagcctg

SEQ ID NO: 557273 - DNA, 25 bp, Mus musculus
cacagtggatcgtaagccaagcctg

SEQ ID NO: 557274 - DNA, 25 bp, Mus musculus
cacagtggatttagactcggatgaa

SEQ ID NO: 557275 - DNA, 25 bp, Mus musculus
cacagtggattttgactcggatgaa

SEQ ID NO: 557276 - DNA, 25 bp, Mus musculus
cacagtggctatcacatgccctatg

SEQ ID NO: 557277 - DNA, 25 bp, Mus musculus
cacagtggctatgacatgccctatg

SEQ ID NO: 557278 - DNA, 25 bp, Mus musculus
cacagtgggagccaggagaattcta

SEQ ID NO: 557279 - DNA, 25 bp, Mus musculus
cacagtgggagcgaggagaattcta

SEQ ID NO: 557280 - DNA, 25 bp, Mus musculus
cacagtgggccaattatgtcaaggg

SEQ ID NO: 557281 - DNA, 25 bp, Mus musculus
cacagtgggccatttatgtcaaggg

SEQ ID NO: 557282 - DNA, 25 bp, Mus musculus
cacagtgggcctaaaaggcacgcag

SEQ ID NO: 557283 - DNA, 25 bp, Mus musculus
cacagtgggccttaaaggcacgcag

SEQ ID NO: 557284 - DNA, 25 bp, Mus musculus
cacagtgggcggaatctgccaggac

SEQ ID NO: 557285 - DNA, 25 bp, Mus musculus
cacagtgggcggtatctgccaggac

SEQ ID NO: 557286 - DNA, 25 bp, Mus musculus
cacagtgggtaaagttaggtggcac

SEQ ID NO: 557287 - DNA, 25 bp, Mus musculus
cacagtgggtaatgttaggtggcac

SEQ ID NO: 557288 - DNA, 25 bp, Mus musculus
cacagtggtaacaagagcgtcgcga

SEQ ID NO: 557289 - DNA, 25 bp, Mus musculus
cacagtggtaactagagcgtcgcga

SEQ ID NO: 557290 - DNA, 25 bp, Mus musculus
cacagtggtctgaatcctggagatt

SEQ ID NO: 557291 - DNA, 25 bp, Mus musculus
cacagtggtctgtatcctggagatt

SEQ ID NO: 557292 - DNA, 25 bp, Mus musculus
cacagtggtggcagatcctcttggg

SEQ ID NO: 557293 - DNA, 25 bp, Mus musculus
cacagtggtggctgatcctcttggg

SEQ ID NO: 557294 - DNA, 25 bp, Mus musculus
cacagtggtgggattagtggtcaca

SEQ ID NO: 557295 - DNA, 25 bp, Mus musculus
cacagtggtgggtttagtggtcaca

SEQ ID NO: 557296 - DNA, 25 bp, Mus musculus
cacagtggttctagaaggtgagaac

SEQ ID NO: 557297 - DNA, 25 bp, Mus musculus
cacagtggttctcaagtgtcaagta

SEQ ID NO: 557298 - DNA, 25 bp, Mus musculus
cacagtggttctgaagtgtcaagta

SEQ ID NO: 557299 - DNA, 25 bp, Mus musculus
cacagtggttcttgaaggtgagaac

SEQ ID NO: 557300 - DNA, 25 bp, Mus musculus
cacagtgtaacaagcaaacggcagg

SEQ ID NO: 557301 - DNA, 25 bp, Mus musculus
cacagtgtaacatgcaaacggcagg

SEQ ID NO: 557302 - DNA, 25 bp, Mus musculus
cacagtgtatgaccatggtgtcaac

SEQ ID NO: 557303 - DNA, 25 bp, Mus musculus
cacagtgtatgagcatggtgtcaac

SEQ ID NO: 557304 - DNA, 25 bp, Mus musculus
cacagtgtatggattggtcccttga

SEQ ID NO: 557305 - DNA, 25 bp, Mus musculus
cacagtgtatggtttggtcccttga

SEQ ID NO: 557306 - DNA, 25 bp, Mus musculus
cacagtgtcctgagttgagccccag

SEQ ID NO: 557307 - DNA, 25 bp, Mus musculus
cacagtgtcctgtgttgagccccag

SEQ ID NO: 557308 - DNA, 25 bp, Mus musculus
cacagtgtcgctccagagagggcca

SEQ ID NO: 557309 - DNA, 25 bp, Mus musculus
cacagtgtcgctgcagagagggcca

SEQ ID NO: 557310 - DNA, 25 bp, Mus musculus
cacagtgtgaagaattgccctaccc

SEQ ID NO: 557311 - DNA, 25 bp, Mus musculus
cacagtgtgaagtattgccctaccc

SEQ ID NO: 557312 - DNA, 25 bp, Mus musculus
cacagtgtggagcataagctatatc

SEQ ID NO: 557313 - DNA, 25 bp, Mus musculus
cacagtgtggaggataagctatatc

SEQ ID NO: 557314 - DNA, 25 bp, Mus musculus
cacagtgtgggccagcttcagcata

SEQ ID NO: 557315 - DNA, 25 bp, Mus musculus
cacagtgtgggcgagcttcagcata

SEQ ID NO: 557316 - DNA, 25 bp, Mus musculus
cacagtgttattagtctgcaggcag

SEQ ID NO: 557317 - DNA, 25 bp, Mus musculus
cacagtgttatttgtctgcaggcag

SEQ ID NO: 557318 - DNA, 25 bp, Mus musculus
cacagtgttgtgctccagctgcagc

SEQ ID NO: 557319 - DNA, 25 bp, Mus musculus
cacagtgttgtggtccagctgcagc

SEQ ID NO: 557320 - DNA, 25 bp, Mus musculus
cacagtgtttgcctatgggacctat

SEQ ID NO: 557321 - DNA, 25 bp, Mus musculus
cacagtgtttgcgtatgggacctat

SEQ ID NO: 557322 - DNA, 25 bp, Mus musculus
cacagttaaactccagctgggtgga

SEQ ID NO: 557323 - DNA, 25 bp, Mus musculus
cacagttaaactgcagctgggtgga

SEQ ID NO: 557324 - DNA, 25 bp, Mus musculus
cacagttaaggaaactcgagcagag

SEQ ID NO: 557325 - DNA, 25 bp, Mus musculus
cacagttaaggatactcgagcagag

SEQ ID NO: 557326 - DNA, 25 bp, Mus musculus
cacagttacctaagagtgggctccc

SEQ ID NO: 557327 - DNA, 25 bp, Mus musculus
cacagttacctatgagtgggctccc

SEQ ID NO: 557328 - DNA, 25 bp, Mus musculus
cacagttatcaacaagacaacgtag

SEQ ID NO: 557329 - DNA, 25 bp, Mus musculus
cacagttatcaagaagacaacgtag

SEQ ID NO: 557330 - DNA, 25 bp, Mus musculus
cacagttcatcaatggacccggagg

SEQ ID NO: 557331 - DNA, 25 bp, Mus musculus
cacagttcatcaccaggaacaagaa

SEQ ID NO: 557332 - DNA, 25 bp, Mus musculus
cacagttcatcagcaggaacaagaa

SEQ ID NO: 557333 - DNA, 25 bp, Mus musculus
cacagttcatcattggacccggagg

SEQ ID NO: 557334 - DNA, 25 bp, Mus musculus
cacagttcctgaaggtgaatgctgc

SEQ ID NO: 557335 - DNA, 25 bp, Mus musculus
cacagttcctgatggtgaatgctgc

SEQ ID NO: 557336 - DNA, 25 bp, Mus musculus
cacagttcgatccttcatgaaacgc

SEQ ID NO: 557337 - DNA, 25 bp, Mus musculus
cacagttcgatcgttcatgaaacgc

SEQ ID NO: 557338 - DNA, 25 bp, Mus musculus
cacagttcgcagctgagcggcgctc

SEQ ID NO: 557339 - DNA, 25 bp, Mus musculus
cacagttcgcaggtgagcggcgctc

SEQ ID NO: 557340 - DNA, 25 bp, Mus musculus
cacagttcggacacgggaccgcgag

SEQ ID NO: 557341 - DNA, 25 bp, Mus musculus
cacagttcggactcgggaccgcgag

SEQ ID NO: 557342 - DNA, 25 bp, Mus musculus
cacagttcgtggagagcttaaagga

SEQ ID NO: 557343 - DNA, 25 bp, Mus musculus
cacagttcgtggtgagcttaaagga

SEQ ID NO: 557344 - DNA, 25 bp, Mus musculus
cacagttgcctccttgctggaacgc

SEQ ID NO: 557345 - DNA, 25 bp, Mus musculus
cacagttgcctcgttgctggaacgc

SEQ ID NO: 557346 - DNA, 25 bp, Mus musculus
cacagttggactcattcagggagct

SEQ ID NO: 557347 - DNA, 25 bp, Mus musculus
cacagttggactgattcagggagct

SEQ ID NO: 557348 - DNA, 25 bp, Mus musculus
cacagttggagaccgccttgtcttc

SEQ ID NO: 557349 - DNA, 25 bp, Mus musculus
cacagttggagagcgccttgtcttc

SEQ ID NO: 557350 - DNA, 25 bp, Mus musculus
cacagttggattactcgttcagaag

SEQ ID NO: 557351 - DNA, 25 bp, Mus musculus
cacagttggatttctcgttcagaag

SEQ ID NO: 557352 - DNA, 25 bp, Mus musculus
cacagttggtggctacttcctggca

SEQ ID NO: 557353 - DNA, 25 bp, Mus musculus
cacagttggtgggtacttcctggca

SEQ ID NO: 557354 - DNA, 25 bp, Mus musculus
cacagttgtcagagtccatgattca

SEQ ID NO: 557355 - DNA, 25 bp, Mus musculus
cacagttgtcagtgtccatgattca

SEQ ID NO: 557356 - DNA, 25 bp, Mus musculus
cacagttgtctgaggcccaaagtat

SEQ ID NO: 557357 - DNA, 25 bp, Mus musculus
cacagttgtctgtggcccaaagtat

SEQ ID NO: 557358 - DNA, 25 bp, Mus musculus
cacagttgttcaaggtgagcaagac

SEQ ID NO: 557359 - DNA, 25 bp, Mus musculus
cacagttgttcatggtgagcaagac

SEQ ID NO: 557360 - DNA, 25 bp, Mus musculus
cacagttgttccacccatggtggga

SEQ ID NO: 557361 - DNA, 25 bp, Mus musculus
cacagttgttcctcccatggtggga

SEQ ID NO: 557362 - DNA, 25 bp, Mus musculus
cacagtttacaacagcctagctctg

SEQ ID NO: 557363 - DNA, 25 bp, Mus musculus
cacagtttacaagagcctagctctg

SEQ ID NO: 557364 - DNA, 25 bp, Mus musculus
cacagtttccacactgggaaggcag

SEQ ID NO: 557365 - DNA, 25 bp, Mus musculus
cacagtttccactctgggaaggcag

SEQ ID NO: 557366 - DNA, 25 bp, Mus musculus
cacagtttcctcatggtgtgatgga

SEQ ID NO: 557367 - DNA, 25 bp, Mus musculus
cacagtttcctcttggtgtgatgga

SEQ ID NO: 557368 - DNA, 25 bp, Mus musculus
cacagtttctggagcaagcacagag

SEQ ID NO: 557369 - DNA, 25 bp, Mus musculus
cacagtttctggtgcaagcacagag

SEQ ID NO: 557370 - DNA, 25 bp, Mus musculus
cacagtttgaagatgtcctggagta

SEQ ID NO: 557371 - DNA, 25 bp, Mus musculus
cacagtttgaagttgtcctggagta

SEQ ID NO: 557372 - DNA, 25 bp, Mus musculus
cacagtttgggacgattcctggcca

SEQ ID NO: 557373 - DNA, 25 bp, Mus musculus
cacagtttgggaggattcctggcca

SEQ ID NO: 557374 - DNA, 25 bp, Mus musculus
cacataaaagggagctccagaattt

SEQ ID NO: 557375 - DNA, 25 bp, Mus musculus
cacataaaagggtgctccagaattt

SEQ ID NO: 557376 - DNA, 25 bp, Mus musculus
cacataaagccaatgaaaaagaaac

SEQ ID NO: 557377 - DNA, 25 bp, Mus musculus
cacataaagccattgaaaaagaaac

SEQ ID NO: 557378 - DNA, 25 bp, Mus musculus
cacataactcctcctcaggcgagat

SEQ ID NO: 557379 - DNA, 25 bp, Mus musculus
cacataactcctgctcaggcgagat

SEQ ID NO: 557380 - DNA, 25 bp, Mus musculus
cacataagacagagtaagactgctg

SEQ ID NO: 557381 - DNA, 25 bp, Mus musculus
cacataagacagtgtaagactgctg

SEQ ID NO: 557382 - DNA, 25 bp, Mus musculus
cacataagtgtaaccagtgcggcaa

SEQ ID NO: 557383 - DNA, 25 bp, Mus musculus
cacataagtgtatccagtgcggcaa

SEQ ID NO: 557384 - DNA, 25 bp, Mus musculus
cacataatcacgctagtgagcccga

SEQ ID NO: 557385 - DNA, 25 bp, Mus musculus
cacataatcacggtagtgagcccga

SEQ ID NO: 557386 - DNA, 25 bp, Mus musculus
cacataatttggacctgcctaagca

SEQ ID NO: 557387 - DNA, 25 bp, Mus musculus
cacataatttggtcctgcctaagca

SEQ ID NO: 557388 - DNA, 25 bp, Mus musculus
cacatacaagctcccaaagttaaaa

SEQ ID NO: 557389 - DNA, 25 bp, Mus musculus
cacatacaagctgccaaagttaaaa

SEQ ID NO: 557390 - DNA, 25 bp, Mus musculus
cacatacacacgaaaacgttttcga

SEQ ID NO: 557391 - DNA, 25 bp, Mus musculus
cacatacacacgtaaacgttttcga

SEQ ID NO: 557392 - DNA, 25 bp, Mus musculus
cacatacacagtaccgagaggttag

SEQ ID NO: 557393 - DNA, 25 bp, Mus musculus
cacatacacagttccgagaggttag

SEQ ID NO: 557394 - DNA, 25 bp, Mus musculus
cacatacactctcgagcggcgggtg

SEQ ID NO: 557395 - DNA, 25 bp, Mus musculus
cacatacactctggagcggcgggtg

SEQ ID NO: 557396 - DNA, 25 bp, Mus musculus
cacatacagagaaggtcgagtggca

SEQ ID NO: 557397 - DNA, 25 bp, Mus musculus
cacatacagagatggtcgagtggca

SEQ ID NO: 557398 - DNA, 25 bp, Mus musculus
cacatacatttcacagggccatggt

SEQ ID NO: 557399 - DNA, 25 bp, Mus musculus
cacatacatttctcagggccatggt

SEQ ID NO: 557400 - DNA, 25 bp, Mus musculus
cacataccagatcatgaaggtagaa

SEQ ID NO: 557401 - DNA, 25 bp, Mus musculus
cacataccagatgatgaaggtagaa

SEQ ID NO: 557402 - DNA, 25 bp, Mus musculus
cacatacccgccagaaacaaacggg

SEQ ID NO: 557403 - DNA, 25 bp, Mus musculus
cacatacccgcctgaaacaaacggg

SEQ ID NO: 557404 - DNA, 25 bp, Mus musculus
cacatacctatcctaacagcactgt

SEQ ID NO: 557405 - DNA, 25 bp, Mus musculus
cacatacctatcgtaacagcactgt

SEQ ID NO: 557406 - DNA, 25 bp, Mus musculus
cacatacgacgaagtggtgaagatc

SEQ ID NO: 557407 - DNA, 25 bp, Mus musculus
cacatacgacgatgtggtgaagatc

SEQ ID NO: 557408 - DNA, 25 bp, Mus musculus
cacatacgagcacataaaagagtta

SEQ ID NO: 557409 - DNA, 25 bp, Mus musculus
cacatacgagcagataaaagagtta

SEQ ID NO: 557410 - DNA, 25 bp, Mus musculus
cacatacgtgcacaaggccactggg

SEQ ID NO: 557411 - DNA, 25 bp, Mus musculus
cacatacgtgcagaaggccactggg

SEQ ID NO: 557412 - DNA, 25 bp, Mus musculus
cacatactaaatccacatgtgtagg

SEQ ID NO: 557413 - DNA, 25 bp, Mus musculus
cacatactaaatgcacatgtgtagg

SEQ ID NO: 557414 - DNA, 25 bp, Mus musculus
cacatactaccgaagtcgtgggagg

SEQ ID NO: 557415 - DNA, 25 bp, Mus musculus
cacatactaccgtagtcgtgggagg

SEQ ID NO: 557416 - DNA, 25 bp, Mus musculus
cacatactcagactcccatgatgca

SEQ ID NO: 557417 - DNA, 25 bp, Mus musculus
cacatactcagagtcccatgatgca

SEQ ID NO: 557418 - DNA, 25 bp, Mus musculus
cacatactccagagctttctgcagg

SEQ ID NO: 557419 - DNA, 25 bp, Mus musculus
cacatactccagtgctttctgcagg

SEQ ID NO: 557420 - DNA, 25 bp, Mus musculus
cacatactgtggctgatgttctgga

SEQ ID NO: 557421 - DNA, 25 bp, Mus musculus
cacatactgtgggtgatgttctgga

SEQ ID NO: 557422 - DNA, 25 bp, Mus musculus
cacatacttaaacctggccttcagg

SEQ ID NO: 557423 - DNA, 25 bp, Mus musculus
cacatacttaaagctggccttcagg

SEQ ID NO: 557424 - DNA, 25 bp, Mus musculus
cacatagaaatgactcttcagttaa

SEQ ID NO: 557425 - DNA, 25 bp, Mus musculus
cacatagaaatgtctcttcagttaa

SEQ ID NO: 557426 - DNA, 25 bp, Mus musculus
cacatagaatgtagtctgtcctcag

SEQ ID NO: 557427 - DNA, 25 bp, Mus musculus
cacatagaatgttgtctgtcctcag

SEQ ID NO: 557428 - DNA, 25 bp, Mus musculus
cacatagcaggtaaatgagaagcga

SEQ ID NO: 557429 - DNA, 25 bp, Mus musculus
cacatagcaggttaatgagaagcga

SEQ ID NO: 557430 - DNA, 25 bp, Mus musculus
cacataggaagacatccaactgcag

SEQ ID NO: 557431 - DNA, 25 bp, Mus musculus
cacataggaagagatccaactgcag

SEQ ID NO: 557432 - DNA, 25 bp, Mus musculus
cacataggctatcggcacaaatcaa

SEQ ID NO: 557433 - DNA, 25 bp, Mus musculus
cacataggctatgggcacaaatcaa

SEQ ID NO: 557434 - DNA, 25 bp, Mus musculus
cacataggctgtcggcggtacgtga

SEQ ID NO: 557435 - DNA, 25 bp, Mus musculus
cacataggctgtgggcggtacgtga

SEQ ID NO: 557436 - DNA, 25 bp, Mus musculus
cacatagggctcatcccaggagtcc

SEQ ID NO: 557437 - DNA, 25 bp, Mus musculus
cacatagggctcttcccaggagtcc

SEQ ID NO: 557438 - DNA, 25 bp, Mus musculus
cacataggtacacattcaattcagc

SEQ ID NO: 557439 - DNA, 25 bp, Mus musculus
cacataggtacagattcaattcagc

SEQ ID NO: 557440 - DNA, 25 bp, Mus musculus
cacataggttttctaactaagtact

SEQ ID NO: 557441 - DNA, 25 bp, Mus musculus
cacataggttttgtaactaagtact

SEQ ID NO: 557442 - DNA, 25 bp, Mus musculus
cacatagtagtaccccagtggtgct

SEQ ID NO: 557443 - DNA, 25 bp, Mus musculus
cacatagtagtagcccagtggtgct

SEQ ID NO: 557444 - DNA, 25 bp, Mus musculus
cacatagtcctgaacagtttgaggc

SEQ ID NO: 557445 - DNA, 25 bp, Mus musculus
cacatagtcctgtacagtttgaggc

SEQ ID NO: 557446 - DNA, 25 bp, Mus musculus
cacatataaccacacggcgctggac

SEQ ID NO: 557447 - DNA, 25 bp, Mus musculus
cacatataaccagacggcgctggac

SEQ ID NO: 557448 - DNA, 25 bp, Mus musculus
cacatatgctttacagagtcttcat

SEQ ID NO: 557449 - DNA, 25 bp, Mus musculus
cacatatgcttttcagagtcttcat

SEQ ID NO: 557450 - DNA, 25 bp, Mus musculus
cacatatgtagtcattggagatgga

SEQ ID NO: 557451 - DNA, 25 bp, Mus musculus
cacatatgtagtgattggagatgga

SEQ ID NO: 557452 - DNA, 25 bp, Mus musculus
cacatattaactacatggctgcaaa

SEQ ID NO: 557453 - DNA, 25 bp, Mus musculus
cacatattaacttcatggctgcaaa

SEQ ID NO: 557454 - DNA, 25 bp, Mus musculus
cacatattctatccactgctggcag

SEQ ID NO: 557455 - DNA, 25 bp, Mus musculus
cacatattctatgcactgctggcag

SEQ ID NO: 557456 - DNA, 25 bp, Mus musculus
cacatatttcatctggtgccaggcg

SEQ ID NO: 557457 - DNA, 25 bp, Mus musculus
cacatatttcatgtggtgccaggcg

SEQ ID NO: 557458 - DNA, 25 bp, Mus musculus
cacatatttgaaatcctcctatggg

SEQ ID NO: 557459 - DNA, 25 bp, Mus musculus
cacatatttgaattcctcctatggg

SEQ ID NO: 557460 - DNA, 25 bp, Mus musculus
cacatcaaactcaaggaccaggtgc

SEQ ID NO: 557461 - DNA, 25 bp, Mus musculus
cacatcaaactctaggaccaggtgc

SEQ ID NO: 557462 - DNA, 25 bp, Mus musculus
cacatcaaagctcggtgcatcttgt

SEQ ID NO: 557463 - DNA, 25 bp, Mus musculus
cacatcaaagctgggtgcatcttgt

SEQ ID NO: 557464 - DNA, 25 bp, Mus musculus
cacatcaacaagactctaggtcctg

SEQ ID NO: 557465 - DNA, 25 bp, Mus musculus
cacatcaacaagtctctaggtcctg

SEQ ID NO: 557466 - DNA, 25 bp, Mus musculus
cacatcaagacacaataaacccacg

SEQ ID NO: 557467 - DNA, 25 bp, Mus musculus
cacatcaagacagaataaacccacg

SEQ ID NO: 557468 - DNA, 25 bp, Mus musculus
cacatcaagcagctttgcatgagag

SEQ ID NO: 557469 - DNA, 25 bp, Mus musculus
cacatcaagcaggtttgcatgagag

SEQ ID NO: 557470 - DNA, 25 bp, Mus musculus
cacatcaagttgacaacagaagctg

SEQ ID NO: 557471 - DNA, 25 bp, Mus musculus
cacatcaagttgtcaacagaagctg

SEQ ID NO: 557472 - DNA, 25 bp, Mus musculus
cacatcacagcacagtttgaggtgg

SEQ ID NO: 557473 - DNA, 25 bp, Mus musculus
cacatcacagcagagtttgaggtgg

SEQ ID NO: 557474 - DNA, 25 bp, Mus musculus
cacatcacagctcgaattccaggtc

SEQ ID NO: 557475 - DNA, 25 bp, Mus musculus
cacatcacagctggaattccaggtc

SEQ ID NO: 557476 - DNA, 25 bp, Mus musculus
cacatcacatgtcgtgtaactatct

SEQ ID NO: 557477 - DNA, 25 bp, Mus musculus
cacatcacatgtggtgtaactatct

SEQ ID NO: 557478 - DNA, 25 bp, Mus musculus
cacatcacctgcaagaagacgggaa

SEQ ID NO: 557479 - DNA, 25 bp, Mus musculus
cacatcacctgctagaagacgggaa

SEQ ID NO: 557480 - DNA, 25 bp, Mus musculus
cacatcacgctgcagctccatggag

SEQ ID NO: 557481 - DNA, 25 bp, Mus musculus
cacatcacgctggagctccatggag

SEQ ID NO: 557482 - DNA, 25 bp, Mus musculus
cacatcactgccattttgggtcaca

SEQ ID NO: 557483 - DNA, 25 bp, Mus musculus
cacatcactgcctttttgggtcaca

SEQ ID NO: 557484 - DNA, 25 bp, Mus musculus
cacatcactgtacttgcccattcaa

SEQ ID NO: 557485 - DNA, 25 bp, Mus musculus
cacatcactgtagttgcccattcaa

SEQ ID NO: 557486 - DNA, 25 bp, Mus musculus
cacatcagaagactgtgtgctgcac

SEQ ID NO: 557487 - DNA, 25 bp, Mus musculus
cacatcagaagagtgtgtgctgcac

SEQ ID NO: 557488 - DNA, 25 bp, Mus musculus
cacatcagacgccacagggcttgat

SEQ ID NO: 557489 - DNA, 25 bp, Mus musculus
cacatcagacgcgacagggcttgat

SEQ ID NO: 557490 - DNA, 25 bp, Mus musculus
cacatcagactgctgctgcgcatct

SEQ ID NO: 557491 - DNA, 25 bp, Mus musculus
cacatcagactggtgctgcgcatct

SEQ ID NO: 557492 - DNA, 25 bp, Mus musculus
cacatcagagccagctatgccgctg

SEQ ID NO: 557493 - DNA, 25 bp, Mus musculus
cacatcagagcctgctatgccgctg

SEQ ID NO: 557494 - DNA, 25 bp, Mus musculus
cacatcagagtcctagtgaaaggca

SEQ ID NO: 557495 - DNA, 25 bp, Mus musculus
cacatcagagtcgtagtgaaaggca

SEQ ID NO: 557496 - DNA, 25 bp, Mus musculus
cacatcagcccacgaggtggtacaa

SEQ ID NO: 557497 - DNA, 25 bp, Mus musculus
cacatcagcccaggaggtggtacaa

SEQ ID NO: 557498 - DNA, 25 bp, Mus musculus
cacatcagcgctaccagttcagcag

SEQ ID NO: 557499 - DNA, 25 bp, Mus musculus
cacatcagcgcttccagttcagcag

SEQ ID NO: 557500 - DNA, 25 bp, Mus musculus
cacatcagctgaccacactgggcat

SEQ ID NO: 557501 - DNA, 25 bp, Mus musculus
cacatcagctgagcacactgggcat

SEQ ID NO: 557502 - DNA, 25 bp, Mus musculus
cacatcaggcaaccgggttgtgtac

SEQ ID NO: 557503 - DNA, 25 bp, Mus musculus
cacatcaggcaagcgggttgtgtac

SEQ ID NO: 557504 - DNA, 25 bp, Mus musculus
cacatcaggcctagttggtggccaa

SEQ ID NO: 557505 - DNA, 25 bp, Mus musculus
cacatcaggccttgttggtggccaa

SEQ ID NO: 557506 - DNA, 25 bp, Mus musculus
cacatcaggtctcagagctaggagc

SEQ ID NO: 557507 - DNA, 25 bp, Mus musculus
cacatcaggtctgagagctaggagc

SEQ ID NO: 557508 - DNA, 25 bp, Mus musculus
cacatcaggtgtattcagtgtgact

SEQ ID NO: 557509 - DNA, 25 bp, Mus musculus
cacatcaggtgttttcagtgtgact

SEQ ID NO: 557510 - DNA, 25 bp, Mus musculus
cacatcagtgggaaccctggcctgt

SEQ ID NO: 557511 - DNA, 25 bp, Mus musculus
cacatcagtgggtaccctggcctgt

SEQ ID NO: 557512 - DNA, 25 bp, Mus musculus
cacatccactgaagctgaggcgcat

SEQ ID NO: 557513 - DNA, 25 bp, Mus musculus
cacatccactgatgctgaggcgcat

SEQ ID NO: 557514 - DNA, 25 bp, Mus musculus
cacatccactggcagcagtaacatg

SEQ ID NO: 557515 - DNA, 25 bp, Mus musculus
cacatccactgggagcagtaacatg

SEQ ID NO: 557516 - DNA, 25 bp, Mus musculus
cacatccagagaaaggacgcattca

SEQ ID NO: 557517 - DNA, 25 bp, Mus musculus
cacatccagagataggacgcattca

SEQ ID NO: 557518 - DNA, 25 bp, Mus musculus
cacatccatagaaggcgccacttta

SEQ ID NO: 557519 - DNA, 25 bp, Mus musculus
cacatccatagatggcgccacttta

SEQ ID NO: 557520 - DNA, 25 bp, Mus musculus
cacatccattttaacagcggaccag

SEQ ID NO: 557521 - DNA, 25 bp, Mus musculus
cacatccatttttacagcggaccag

SEQ ID NO: 557522 - DNA, 25 bp, Mus musculus
cacatcccggcgaatgagtgagttc

SEQ ID NO: 557523 - DNA, 25 bp, Mus musculus
cacatcccggcgtatgagtgagttc

SEQ ID NO: 557524 - DNA, 25 bp, Mus musculus
cacatccctagacacgtggtgaggg

SEQ ID NO: 557525 - DNA, 25 bp, Mus musculus
cacatccctagagacgtggtgaggg

SEQ ID NO: 557526 - DNA, 25 bp, Mus musculus
cacatccctggtatgcctgataaag

SEQ ID NO: 557527 - DNA, 25 bp, Mus musculus
cacatccctggtttgcctgataaag

SEQ ID NO: 557528 - DNA, 25 bp, Mus musculus
cacatccgaaagcaggaagggtcct

SEQ ID NO: 557529 - DNA, 25 bp, Mus musculus
cacatccgaaaggaggaagggtcct

SEQ ID NO: 557530 - DNA, 25 bp, Mus musculus
cacatccgaagcaacaagcagaagg

SEQ ID NO: 557531 - DNA, 25 bp, Mus musculus
cacatccgaagctacaagcagaagg

SEQ ID NO: 557532 - DNA, 25 bp, Mus musculus
cacatccgcaagaagcggctcttca

SEQ ID NO: 557533 - DNA, 25 bp, Mus musculus
cacatccgcaagtagcggctcttca

SEQ ID NO: 557534 - DNA, 25 bp, Mus musculus
cacatccgcagcagggtgttccggg

SEQ ID NO: 557535 - DNA, 25 bp, Mus musculus
cacatccgcagctgggtgttccggg

SEQ ID NO: 557536 - DNA, 25 bp, Mus musculus
cacatccgcatcaagcacagtggga

SEQ ID NO: 557537 - DNA, 25 bp, Mus musculus
cacatccgcatctagcacagtggga

SEQ ID NO: 557538 - DNA, 25 bp, Mus musculus
cacatccgtggaaagtccaggttct

SEQ ID NO: 557539 - DNA, 25 bp, Mus musculus
cacatccgtggatagtccaggttct

SEQ ID NO: 557540 - DNA, 25 bp, Mus musculus
cacatcctagaaagtgagctagaga

SEQ ID NO: 557541 - DNA, 25 bp, Mus musculus
cacatcctagaatgtgagctagaga

SEQ ID NO: 557542 - DNA, 25 bp, Mus musculus
cacatcctcagcacgggcgtagatg

SEQ ID NO: 557543 - DNA, 25 bp, Mus musculus
cacatcctcagctcgggcgtagatg

SEQ ID NO: 557544 - DNA, 25 bp, Mus musculus
cacatcctgcagctggtcctaggct

SEQ ID NO: 557545 - DNA, 25 bp, Mus musculus
cacatcctgcaggtggtcctaggct

SEQ ID NO: 557546 - DNA, 25 bp, Mus musculus
cacatcctgcgtagagatgggcagc

SEQ ID NO: 557547 - DNA, 25 bp, Mus musculus
cacatcctgcgttgagatgggcagc

SEQ ID NO: 557548 - DNA, 25 bp, Mus musculus
cacatcctggaaattctgctgcttc

SEQ ID NO: 557549 - DNA, 25 bp, Mus musculus
cacatcctggaatttctgctgcttc

SEQ ID NO: 557550 - DNA, 25 bp, Mus musculus
cacatccttcctctcggatgacata

SEQ ID NO: 557551 - DNA, 25 bp, Mus musculus
cacatccttcctgtcggatgacata

SEQ ID NO: 557552 - DNA, 25 bp, Mus musculus
cacatccttctgatctacaaagcat

SEQ ID NO: 557553 - DNA, 25 bp, Mus musculus
cacatccttctgttctacaaagcat

SEQ ID NO: 557554 - DNA, 25 bp, Mus musculus
cacatccttggtagatctttacccg

SEQ ID NO: 557555 - DNA, 25 bp, Mus musculus
cacatccttggttgatctttacccg

SEQ ID NO: 557556 - DNA, 25 bp, Mus musculus
cacatcgaagcgatatggcctggga

SEQ ID NO: 557557 - DNA, 25 bp, Mus musculus
cacatcgaagcgttatggcctggga

SEQ ID NO: 557558 - DNA, 25 bp, Mus musculus
cacatcgagtttctgtcaaggactg

SEQ ID NO: 557559 - DNA, 25 bp, Mus musculus
cacatcgagtttgtgtcaaggactg

SEQ ID NO: 557560 - DNA, 25 bp, Mus musculus
cacatcgcgcttcgtggctgaagta

SEQ ID NO: 557561 - DNA, 25 bp, Mus musculus
cacatcgcgcttggtggctgaagta

SEQ ID NO: 557562 - DNA, 25 bp, Mus musculus
cacatcgcggtgctagtgttgctct

SEQ ID NO: 557563 - DNA, 25 bp, Mus musculus
cacatcgcggtggtagtgttgctct

SEQ ID NO: 557564 - DNA, 25 bp, Mus musculus
cacatcggaggtagggtggtcacac

SEQ ID NO: 557565 - DNA, 25 bp, Mus musculus
cacatcggaggttgggtggtcacac

SEQ ID NO: 557566 - DNA, 25 bp, Mus musculus
cacatcgtgctcatcgactttgggc

SEQ ID NO: 557567 - DNA, 25 bp, Mus musculus
cacatcgtgctcttcgactttgggc

SEQ ID NO: 557568 - DNA, 25 bp, Mus musculus
cacatctatgagaagagcggtgcca

SEQ ID NO: 557569 - DNA, 25 bp, Mus musculus
cacatctatgagtagagcggtgcca

SEQ ID NO: 557570 - DNA, 25 bp, Mus musculus
cacatctcgggtcactgaggacaca

SEQ ID NO: 557571 - DNA, 25 bp, Mus musculus
cacatctcgggtgactgaggacaca

SEQ ID NO: 557572 - DNA, 25 bp, Mus musculus
cacatctctctcagcatggtggata

SEQ ID NO: 557573 - DNA, 25 bp, Mus musculus
cacatctctctctgcatggtggata

SEQ ID NO: 557574 - DNA, 25 bp, Mus musculus
cacatctgcacacaacaagatgttg

SEQ ID NO: 557575 - DNA, 25 bp, Mus musculus
cacatctgcacagaacaagatgttg

SEQ ID NO: 557576 - DNA, 25 bp, Mus musculus
cacatctgctggataacacggagag

SEQ ID NO: 557577 - DNA, 25 bp, Mus musculus
cacatctgctggttaacacggagag

SEQ ID NO: 557578 - DNA, 25 bp, Mus musculus
cacatctggagacattgtttatctt

SEQ ID NO: 557579 - DNA, 25 bp, Mus musculus
cacatctggagagattgtttatctt

SEQ ID NO: 557580 - DNA, 25 bp, Mus musculus
cacatctggatgcaagcgagctttg

SEQ ID NO: 557581 - DNA, 25 bp, Mus musculus
cacatctggatggaagcgagctttg

SEQ ID NO: 557582 - DNA, 25 bp, Mus musculus
cacatctgggacctgaagacagacc

SEQ ID NO: 557583 - DNA, 25 bp, Mus musculus
cacatctgggacgtgaagacagacc

SEQ ID NO: 557584 - DNA, 25 bp, Mus musculus
cacatcttctttagacttcaggccg

SEQ ID NO: 557585 - DNA, 25 bp, Mus musculus
cacatcttcttttgacttcaggccg

SEQ ID NO: 557586 - DNA, 25 bp, Mus musculus
cacatcttgagccagaaggcatctt

SEQ ID NO: 557587 - DNA, 25 bp, Mus musculus
cacatcttgagcgagaaggcatctt

SEQ ID NO: 557588 - DNA, 25 bp, Mus musculus
cacatcttgcagacttaaaaatgca

SEQ ID NO: 557589 - DNA, 25 bp, Mus musculus
cacatcttgcagtcttaaaaatgca

SEQ ID NO: 557590 - DNA, 25 bp, Mus musculus
cacatcttggagctctccaggaaag

SEQ ID NO: 557591 - DNA, 25 bp, Mus musculus
cacatcttggaggtctccaggaaag

SEQ ID NO: 557592 - DNA, 25 bp, Mus musculus
cacatctttgatcgtgtgagggcca

SEQ ID NO: 557593 - DNA, 25 bp, Mus musculus
cacatctttgatggtgtgagggcca

SEQ ID NO: 557594 - DNA, 25 bp, Mus musculus
cacatgaaagaaaatgcctggtctt

SEQ ID NO: 557595 - DNA, 25 bp, Mus musculus
cacatgaaagaatatgcctggtctt

SEQ ID NO: 557596 - DNA, 25 bp, Mus musculus
cacatgaaaggaataagggctcctt

SEQ ID NO: 557597 - DNA, 25 bp, Mus musculus
cacatgaaaggattaagggctcctt

SEQ ID NO: 557598 - DNA, 25 bp, Mus musculus
cacatgaaaggcctcagttctggga

SEQ ID NO: 557599 - DNA, 25 bp, Mus musculus
cacatgaaaggcgtcagttctggga

SEQ ID NO: 557600 - DNA, 25 bp, Mus musculus
cacatgaactgtcaagatattgcca

SEQ ID NO: 557601 - DNA, 25 bp, Mus musculus
cacatgaactgtgaagatattgcca

SEQ ID NO: 557602 - DNA, 25 bp, Mus musculus
cacatgacatggaagcagtggacag

SEQ ID NO: 557603 - DNA, 25 bp, Mus musculus
cacatgacatggtagcagtggacag

SEQ ID NO: 557604 - DNA, 25 bp, Mus musculus
cacatgacgacacagatgatgatgg

SEQ ID NO: 557605 - DNA, 25 bp, Mus musculus
cacatgacgacagagatgatgatgg

SEQ ID NO: 557606 - DNA, 25 bp, Mus musculus
cacatgacttccagtccaaaggcgc

SEQ ID NO: 557607 - DNA, 25 bp, Mus musculus
cacatgacttcctgtccaaaggcgc

SEQ ID NO: 557608 - DNA, 25 bp, Mus musculus
cacatgagagacatccgagattacc

SEQ ID NO: 557609 - DNA, 25 bp, Mus musculus
cacatgagagacttccgagattacc

SEQ ID NO: 557610 - DNA, 25 bp, Mus musculus
cacatgagcactctgccttttggaa

SEQ ID NO: 557611 - DNA, 25 bp, Mus musculus
cacatgagcactgtgccttttggaa

SEQ ID NO: 557612 - DNA, 25 bp, Mus musculus
cacatgagccaaaggtaagatgcat

SEQ ID NO: 557613 - DNA, 25 bp, Mus musculus
cacatgagccaatggtaagatgcat

SEQ ID NO: 557614 - DNA, 25 bp, Mus musculus
cacatgaggatactgaagctggaga

SEQ ID NO: 557615 - DNA, 25 bp, Mus musculus
cacatgaggatagtgaagctggaga

SEQ ID NO: 557616 - DNA, 25 bp, Mus musculus
cacatgaggcttcgctgaggcgaca

SEQ ID NO: 557617 - DNA, 25 bp, Mus musculus
cacatgaggcttggctgaggcgaca

SEQ ID NO: 557618 - DNA, 25 bp, Mus musculus
cacatgatatggcttgtgctccact

SEQ ID NO: 557619 - DNA, 25 bp, Mus musculus
cacatgatatgggttgtgctccact

SEQ ID NO: 557620 - DNA, 25 bp, Mus musculus
cacatgatcaagctgcacggagccc

SEQ ID NO: 557621 - DNA, 25 bp, Mus musculus
cacatgatcaaggtgcacggagccc

SEQ ID NO: 557622 - DNA, 25 bp, Mus musculus
cacatgatccttaattttgccaaag

SEQ ID NO: 557623 - DNA, 25 bp, Mus musculus
cacatgatcctttattttgccaaag

SEQ ID NO: 557624 - DNA, 25 bp, Mus musculus
cacatgatgaagataagctatgatg

SEQ ID NO: 557625 - DNA, 25 bp, Mus musculus
cacatgatgaagttaagctatgatg

SEQ ID NO: 557626 - DNA, 25 bp, Mus musculus
cacatgatgccacgaagactgagca

SEQ ID NO: 557627 - DNA, 25 bp, Mus musculus
cacatgatgccaggaagactgagca

SEQ ID NO: 557628 - DNA, 25 bp, Mus musculus
cacatgatgctaaagatagctgagg

SEQ ID NO: 557629 - DNA, 25 bp, Mus musculus
cacatgatgctatagatagctgagg

SEQ ID NO: 557630 - DNA, 25 bp, Mus musculus
cacatgatggatatcaggtgttgta

SEQ ID NO: 557631 - DNA, 25 bp, Mus musculus
cacatgatggatttcaggtgttgta

SEQ ID NO: 557632 - DNA, 25 bp, Mus musculus
cacatgatggcgatacgggagctca

SEQ ID NO: 557633 - DNA, 25 bp, Mus musculus
cacatgatggcgttacgggagctca

SEQ ID NO: 557634 - DNA, 25 bp, Mus musculus
cacatgatggctatcattgaacaag

SEQ ID NO: 557635 - DNA, 25 bp, Mus musculus
cacatgatggctttcattgaacaag

SEQ ID NO: 557636 - DNA, 25 bp, Mus musculus
cacatgattcttctcatggtgagcc

SEQ ID NO: 557637 - DNA, 25 bp, Mus musculus
cacatgattcttgtcatggtgagcc

SEQ ID NO: 557638 - DNA, 25 bp, Mus musculus
cacatgcacatgatcctgtcgttta

SEQ ID NO: 557639 - DNA, 25 bp, Mus musculus
cacatgcacatgttcctgtcgttta

SEQ ID NO: 557640 - DNA, 25 bp, Mus musculus
cacatgcacgcgcagttgagcgcac

SEQ ID NO: 557641 - DNA, 25 bp, Mus musculus
cacatgcacgcggagttgagcgcac

SEQ ID NO: 557642 - DNA, 25 bp, Mus musculus
cacatgcactgcatcctcaagtggc

SEQ ID NO: 557643 - DNA, 25 bp, Mus musculus
cacatgcactgcttcctcaagtggc

SEQ ID NO: 557644 - DNA, 25 bp, Mus musculus
cacatgcagattcgagtgaatgcag

SEQ ID NO: 557645 - DNA, 25 bp, Mus musculus
cacatgcagattggagtgaatgcag

SEQ ID NO: 557646 - DNA, 25 bp, Mus musculus
cacatgcagctgagaacctctctca

SEQ ID NO: 557647 - DNA, 25 bp, Mus musculus
cacatgcagctgtgaacctctctca

SEQ ID NO: 557648 - DNA, 25 bp, Mus musculus
cacatgcaggctctttgacctccgt

SEQ ID NO: 557649 - DNA, 25 bp, Mus musculus
cacatgcaggctgtttgacctccgt

SEQ ID NO: 557650 - DNA, 25 bp, Mus musculus
cacatgcatggcctctaatgagcag

SEQ ID NO: 557651 - DNA, 25 bp, Mus musculus
cacatgcatggcgtctaatgagcag

SEQ ID NO: 557652 - DNA, 25 bp, Mus musculus
cacatgcccatgcttgtacacagag

SEQ ID NO: 557653 - DNA, 25 bp, Mus musculus
cacatgcccatggttgtacacagag

SEQ ID NO: 557654 - DNA, 25 bp, Mus musculus
cacatgcctcatcgagggagcccaa

SEQ ID NO: 557655 - DNA, 25 bp, Mus musculus
cacatgcctcatggagggagcccaa

SEQ ID NO: 557656 - DNA, 25 bp, Mus musculus
cacatgcctgtcaggtaggggaact

SEQ ID NO: 557657 - DNA, 25 bp, Mus musculus
cacatgcctgtctggtaggggaact

SEQ ID NO: 557658 - DNA, 25 bp, Mus musculus
cacatgccttgcagtttcagacgac

SEQ ID NO: 557659 - DNA, 25 bp, Mus musculus
cacatgccttgctgtttcagacgac

SEQ ID NO: 557660 - DNA, 25 bp, Mus musculus
cacatgcgtccaaattgcacaggag

SEQ ID NO: 557661 - DNA, 25 bp, Mus musculus
cacatgcgtccatattgcacaggag

SEQ ID NO: 557662 - DNA, 25 bp, Mus musculus
cacatgcgtgttagtgtttccagcc

SEQ ID NO: 557663 - DNA, 25 bp, Mus musculus
cacatgcgtgtttgtgtttccagcc

SEQ ID NO: 557664 - DNA, 25 bp, Mus musculus
cacatgctccgtatgccaggagacc

SEQ ID NO: 557665 - DNA, 25 bp, Mus musculus
cacatgctccgtttgccaggagacc

SEQ ID NO: 557666 - DNA, 25 bp, Mus musculus
cacatgctctccaaagttggaacgt

SEQ ID NO: 557667 - DNA, 25 bp, Mus musculus
cacatgctctcctaagttggaacgt

SEQ ID NO: 557668 - DNA, 25 bp, Mus musculus
cacatgctgaagcagggaaaaggtc

SEQ ID NO: 557669 - DNA, 25 bp, Mus musculus
cacatgctgaaggagggaaaaggtc

SEQ ID NO: 557670 - DNA, 25 bp, Mus musculus
cacatgctgacgacaatgccgtgga

SEQ ID NO: 557671 - DNA, 25 bp, Mus musculus
cacatgctgacgtcaatgccgtgga

SEQ ID NO: 557672 - DNA, 25 bp, Mus musculus
cacatgctggatacaaaaagatatg

SEQ ID NO: 557673 - DNA, 25 bp, Mus musculus
cacatgctggattcaaaaagatatg

SEQ ID NO: 557674 - DNA, 25 bp, Mus musculus
cacatgctgtggacgggcatccagg

SEQ ID NO: 557675 - DNA, 25 bp, Mus musculus
cacatgctgtggtcgggcatccagg

SEQ ID NO: 557676 - DNA, 25 bp, Mus musculus
cacatgctgttgagatgtttcacag

SEQ ID NO: 557677 - DNA, 25 bp, Mus musculus
cacatgctgttgtgatgtttcacag

SEQ ID NO: 557678 - DNA, 25 bp, Mus musculus
cacatgctgtttcgagtcagcctga

SEQ ID NO: 557679 - DNA, 25 bp, Mus musculus
cacatgctgtttggagtcagcctga

SEQ ID NO: 557680 - DNA, 25 bp, Mus musculus
cacatgcttactcacttggctgagg

SEQ ID NO: 557681 - DNA, 25 bp, Mus musculus
cacatgcttactgacttggctgagg

SEQ ID NO: 557682 - DNA, 25 bp, Mus musculus
cacatggaagctcctgtcaaggtga

SEQ ID NO: 557683 - DNA, 25 bp, Mus musculus
cacatggaagctgctgtcaaggtga

SEQ ID NO: 557684 - DNA, 25 bp, Mus musculus
cacatggacagcagattttggtctg

SEQ ID NO: 557685 - DNA, 25 bp, Mus musculus
cacatggacagctgattttggtctg

SEQ ID NO: 557686 - DNA, 25 bp, Mus musculus
cacatggagatccacgacagagtgg

SEQ ID NO: 557687 - DNA, 25 bp, Mus musculus
cacatggagatcgacgacagagtgg

SEQ ID NO: 557688 - DNA, 25 bp, Mus musculus
cacatggagattcttggtacccaag

SEQ ID NO: 557689 - DNA, 25 bp, Mus musculus
cacatggagattgttggtacccaag

SEQ ID NO: 557690 - DNA, 25 bp, Mus musculus
cacatggagcacagctacttttgca

SEQ ID NO: 557691 - DNA, 25 bp, Mus musculus
cacatggagcactgctacttttgca

SEQ ID NO: 557692 - DNA, 25 bp, Mus musculus
cacatggaggtgacccgtctggaag

SEQ ID NO: 557693 - DNA, 25 bp, Mus musculus
cacatggaggtgtcccgtctggaag

SEQ ID NO: 557694 - DNA, 25 bp, Mus musculus
cacatggatactcgctctgggaatt

SEQ ID NO: 557695 - DNA, 25 bp, Mus musculus
cacatggatactggctctgggaatt

SEQ ID NO: 557696 - DNA, 25 bp, Mus musculus
cacatggatcagagctggaaatacc

SEQ ID NO: 557697 - DNA, 25 bp, Mus musculus
cacatggatcagtgctggaaatacc

SEQ ID NO: 557698 - DNA, 25 bp, Mus musculus
cacatggatgaaacagacagctctc

SEQ ID NO: 557699 - DNA, 25 bp, Mus musculus
cacatggatgaatcagacagctctc

SEQ ID NO: 557700 - DNA, 25 bp, Mus musculus
cacatggcaccgcttgggcagtttg

SEQ ID NO: 557701 - DNA, 25 bp, Mus musculus
cacatggcaccggttgggcagtttg

SEQ ID NO: 557702 - DNA, 25 bp, Mus musculus
cacatggcactcaggctaagccttc

SEQ ID NO: 557703 - DNA, 25 bp, Mus musculus
cacatggcactctggctaagccttc

SEQ ID NO: 557704 - DNA, 25 bp, Mus musculus
cacatggccactatggaagccctgc

SEQ ID NO: 557705 - DNA, 25 bp, Mus musculus
cacatggccactttggaagccctgc

SEQ ID NO: 557706 - DNA, 25 bp, Mus musculus
cacatggccattctgggcagtcatg

SEQ ID NO: 557707 - DNA, 25 bp, Mus musculus
cacatggccattgtgggcagtcatg

SEQ ID NO: 557708 - DNA, 25 bp, Mus musculus
cacatggccctgcactggattatga

SEQ ID NO: 557709 - DNA, 25 bp, Mus musculus
cacatggccctggactggattatga

SEQ ID NO: 557710 - DNA, 25 bp, Mus musculus
cacatggcctccagctcgagggagt

SEQ ID NO: 557711 - DNA, 25 bp, Mus musculus
cacatggcctcctgctcgagggagt

SEQ ID NO: 557712 - DNA, 25 bp, Mus musculus
cacatggcgaccacacggagtttgg

SEQ ID NO: 557713 - DNA, 25 bp, Mus musculus
cacatggcgacctcacggagtttgg

SEQ ID NO: 557714 - DNA, 25 bp, Mus musculus
cacatggctaaaaaggactgacacg

SEQ ID NO: 557715 - DNA, 25 bp, Mus musculus
cacatggctaaataggactgacacg

SEQ ID NO: 557716 - DNA, 25 bp, Mus musculus
cacatggctgagaaaatgcccgcga

SEQ ID NO: 557717 - DNA, 25 bp, Mus musculus
cacatggctgagtaaatgcccgcga

SEQ ID NO: 557718 - DNA, 25 bp, Mus musculus
cacatggctgcgaagggaaaagcta

SEQ ID NO: 557719 - DNA, 25 bp, Mus musculus
cacatggctgcgtagggaaaagcta

SEQ ID NO: 557720 - DNA, 25 bp, Mus musculus
cacatggctgctacctttctgaaga

SEQ ID NO: 557721 - DNA, 25 bp, Mus musculus
cacatggctgcttcctttctgaaga

SEQ ID NO: 557722 - DNA, 25 bp, Mus musculus
cacatggctgtactgagaatcaaca

SEQ ID NO: 557723 - DNA, 25 bp, Mus musculus
cacatggctgtagtgagaatcaaca

SEQ ID NO: 557724 - DNA, 25 bp, Mus musculus
cacatgggacacaaatcctaatgag

SEQ ID NO: 557725 - DNA, 25 bp, Mus musculus
cacatgggacactaatcctaatgag

SEQ ID NO: 557726 - DNA, 25 bp, Mus musculus
cacatgggacagatctgctgcagag

SEQ ID NO: 557727 - DNA, 25 bp, Mus musculus
cacatgggacagttctgctgcagag

SEQ ID NO: 557728 - DNA, 25 bp, Mus musculus
cacatgggattgctcagacgaagct

SEQ ID NO: 557729 - DNA, 25 bp, Mus musculus
cacatgggattggtcagacgaagct

SEQ ID NO: 557730 - DNA, 25 bp, Mus musculus
cacatgggcaccaatgtcattgttg

SEQ ID NO: 557731 - DNA, 25 bp, Mus musculus
cacatgggcacctatgtcattgttg

SEQ ID NO: 557732 - DNA, 25 bp, Mus musculus
cacatgggcccacgtaattgccaga

SEQ ID NO: 557733 - DNA, 25 bp, Mus musculus
cacatgggcccaggtaattgccaga

SEQ ID NO: 557734 - DNA, 25 bp, Mus musculus
cacatgggtgatcctgtatgcctaa

SEQ ID NO: 557735 - DNA, 25 bp, Mus musculus
cacatgggtgatgctgtatgcctaa

SEQ ID NO: 557736 - DNA, 25 bp, Mus musculus
cacatgggtgctcagcgtctgcagc

SEQ ID NO: 557737 - DNA, 25 bp, Mus musculus
cacatgggtgctgagcgtctgcagc

SEQ ID NO: 557738 - DNA, 25 bp, Mus musculus
cacatggtaaagacgaaagcttcac

SEQ ID NO: 557739 - DNA, 25 bp, Mus musculus
cacatggtaaagtcgaaagcttcac

SEQ ID NO: 557740 - DNA, 25 bp, Mus musculus
cacatggtagagaggtgagtctgcc

SEQ ID NO: 557741 - DNA, 25 bp, Mus musculus
cacatggtagagtggtgagtctgcc

SEQ ID NO: 557742 - DNA, 25 bp, Mus musculus
cacatggtatgacgttcctgtccat

SEQ ID NO: 557743 - DNA, 25 bp, Mus musculus
cacatggtatgaggttcctgtccat

SEQ ID NO: 557744 - DNA, 25 bp, Mus musculus
cacatggtatgtcttcagttggagc

SEQ ID NO: 557745 - DNA, 25 bp, Mus musculus
cacatggtatgtgttcagttggagc

SEQ ID NO: 557746 - DNA, 25 bp, Mus musculus
cacatggtggctcattctggtgtgt

SEQ ID NO: 557747 - DNA, 25 bp, Mus musculus
cacatggtggctgattctggtgtgt

SEQ ID NO: 557748 - DNA, 25 bp, Mus musculus
cacatggtggtcactacaagccagt

SEQ ID NO: 557749 - DNA, 25 bp, Mus musculus
cacatggtggtctctacaagccagt

SEQ ID NO: 557750 - DNA, 25 bp, Mus musculus
cacatggtgtaaccatgactgggct

SEQ ID NO: 557751 - DNA, 25 bp, Mus musculus
cacatggtgtaagcatgactgggct

SEQ ID NO: 557752 - DNA, 25 bp, Mus musculus
cacatggtgttaatgtggccgtccc

SEQ ID NO: 557753 - DNA, 25 bp, Mus musculus
cacatggtgttattgtggccgtccc

SEQ ID NO: 557754 - DNA, 25 bp, Mus musculus
cacatggttatacccaagatgtcca

SEQ ID NO: 557755 - DNA, 25 bp, Mus musculus
cacatggttatagccaagatgtcca

SEQ ID NO: 557756 - DNA, 25 bp, Mus musculus
cacatgtaaatccattggaatcacc

SEQ ID NO: 557757 - DNA, 25 bp, Mus musculus
cacatgtaaatcgattggaatcacc

SEQ ID NO: 557758 - DNA, 25 bp, Mus musculus
cacatgtaccaacatcaaccagagt

SEQ ID NO: 557759 - DNA, 25 bp, Mus musculus
cacatgtaccaagatcaaccagagt

SEQ ID NO: 557760 - DNA, 25 bp, Mus musculus
cacatgtacgtgcattccgaagcca

SEQ ID NO: 557761 - DNA, 25 bp, Mus musculus
cacatgtacgtggattccgaagcca

SEQ ID NO: 557762 - DNA, 25 bp, Mus musculus
cacatgtactctcaatggcctgaga

SEQ ID NO: 557763 - DNA, 25 bp, Mus musculus
cacatgtactctgaatggcctgaga

SEQ ID NO: 557764 - DNA, 25 bp, Mus musculus
cacatgtaggttatagatgagctaa

SEQ ID NO: 557765 - DNA, 25 bp, Mus musculus
cacatgtaggttttagatgagctaa

SEQ ID NO: 557766 - DNA, 25 bp, Mus musculus
cacatgtcacaacgagaggctcttt

SEQ ID NO: 557767 - DNA, 25 bp, Mus musculus
cacatgtcacaaggagaggctcttt

SEQ ID NO: 557768 - DNA, 25 bp, Mus musculus
cacatgtcatgacttcactgaagct

SEQ ID NO: 557769 - DNA, 25 bp, Mus musculus
cacatgtcatgagttcactgaagct

SEQ ID NO: 557770 - DNA, 25 bp, Mus musculus
cacatgtccttgcttggaactttcc

SEQ ID NO: 557771 - DNA, 25 bp, Mus musculus
cacatgtccttggttggaactttcc

SEQ ID NO: 557772 - DNA, 25 bp, Mus musculus
cacatgtcgcggcacgtgttcctca

SEQ ID NO: 557773 - DNA, 25 bp, Mus musculus
cacatgtcgcgggacgtgttcctca

SEQ ID NO: 557774 - DNA, 25 bp, Mus musculus
cacatgtctcttcaatgaaagtcac

SEQ ID NO: 557775 - DNA, 25 bp, Mus musculus
cacatgtctcttgaatgaaagtcac

SEQ ID NO: 557776 - DNA, 25 bp, Mus musculus
cacatgtgacttatggagaggaagc

SEQ ID NO: 557777 - DNA, 25 bp, Mus musculus
cacatgtgacttttggagaggaagc

SEQ ID NO: 557778 - DNA, 25 bp, Mus musculus
cacatgtgagaaacaaggtcctacc

SEQ ID NO: 557779 - DNA, 25 bp, Mus musculus
cacatgtgagaatcaaggtcctacc

SEQ ID NO: 557780 - DNA, 25 bp, Mus musculus
cacatgtgaggtaagcagttcataa

SEQ ID NO: 557781 - DNA, 25 bp, Mus musculus
cacatgtgaggttagcagttcataa

SEQ ID NO: 557782 - DNA, 25 bp, Mus musculus
cacatgtgagtactgcggcaaggtc

SEQ ID NO: 557783 - DNA, 25 bp, Mus musculus
cacatgtgagtagtgcggcaaggtc

SEQ ID NO: 557784 - DNA, 25 bp, Mus musculus
cacatgtgatgaaccttctccgaga

SEQ ID NO: 557785 - DNA, 25 bp, Mus musculus
cacatgtgatgatccttctccgaga

SEQ ID NO: 557786 - DNA, 25 bp, Mus musculus
cacatgtggaagaacctttaatcag

SEQ ID NO: 557787 - DNA, 25 bp, Mus musculus
cacatgtggaagtacctttaatcag

SEQ ID NO: 557788 - DNA, 25 bp, Mus musculus
cacatgtggacactttcagggtggt

SEQ ID NO: 557789 - DNA, 25 bp, Mus musculus
cacatgtggacagtttcagggtggt

SEQ ID NO: 557790 - DNA, 25 bp, Mus musculus
cacatgtggtgtaactatctgtatt

SEQ ID NO: 557791 - DNA, 25 bp, Mus musculus
cacatgtggtgttactatctgtatt

SEQ ID NO: 557792 - DNA, 25 bp, Mus musculus
cacatgtgtaggctgcaagtcctct

SEQ ID NO: 557793 - DNA, 25 bp, Mus musculus
cacatgtgtagggtgcaagtcctct

SEQ ID NO: 557794 - DNA, 25 bp, Mus musculus
cacatgtttgaacaagtgccgattg

SEQ ID NO: 557795 - DNA, 25 bp, Mus musculus
cacatgtttgaagaagtgccgattg

SEQ ID NO: 557796 - DNA, 25 bp, Mus musculus
cacattaagtgaccagcttcaggat

SEQ ID NO: 557797 - DNA, 25 bp, Mus musculus
cacattaagtgagcagcttcaggat

SEQ ID NO: 557798 - DNA, 25 bp, Mus musculus
cacattacagatcgacatggctttc

SEQ ID NO: 557799 - DNA, 25 bp, Mus musculus
cacattacagatggacatggctttc

SEQ ID NO: 557800 - DNA, 25 bp, Mus musculus
cacattacttcacgaggaggttaca

SEQ ID NO: 557801 - DNA, 25 bp, Mus musculus
cacattacttcaggaggaggttaca

SEQ ID NO: 557802 - DNA, 25 bp, Mus musculus
cacattaggtctaccttcgtgtccc

SEQ ID NO: 557803 - DNA, 25 bp, Mus musculus
cacattaggtcttccttcgtgtccc

SEQ ID NO: 557804 - DNA, 25 bp, Mus musculus
cacattcaacttacagggcagagcc

SEQ ID NO: 557805 - DNA, 25 bp, Mus musculus
cacattcaactttcagggcagagcc

SEQ ID NO: 557806 - DNA, 25 bp, Mus musculus
cacattcagagaagaccttctcaac

SEQ ID NO: 557807 - DNA, 25 bp, Mus musculus
cacattcagagatgaccttctcaac

SEQ ID NO: 557808 - DNA, 25 bp, Mus musculus
cacattcaggcaccacgggtggcta

SEQ ID NO: 557809 - DNA, 25 bp, Mus musculus
cacattcaggcagcacgggtggcta

SEQ ID NO: 557810 - DNA, 25 bp, Mus musculus
cacattccggacattggcttagagc

SEQ ID NO: 557811 - DNA, 25 bp, Mus musculus
cacattccggactttggcttagagc

SEQ ID NO: 557812 - DNA, 25 bp, Mus musculus
cacattccgtaacccagagctgtgg

SEQ ID NO: 557813 - DNA, 25 bp, Mus musculus
cacattccgtaagccagagctgtgg

SEQ ID NO: 557814 - DNA, 25 bp, Mus musculus
cacattcctgaccattggctatggg

SEQ ID NO: 557815 - DNA, 25 bp, Mus musculus
cacattcctgacgattggctatggg

SEQ ID NO: 557816 - DNA, 25 bp, Mus musculus
cacattcgaatgaacctggaaaacg

SEQ ID NO: 557817 - DNA, 25 bp, Mus musculus
cacattcgaatgtacctggaaaacg

SEQ ID NO: 557818 - DNA, 25 bp, Mus musculus
cacattcgacaacaggaaaggagcc

SEQ ID NO: 557819 - DNA, 25 bp, Mus musculus
cacattcgacaagaggaaaggagcc

SEQ ID NO: 557820 - DNA, 25 bp, Mus musculus
cacattcgcctcctttcctgaggga

SEQ ID NO: 557821 - DNA, 25 bp, Mus musculus
cacattcgcctcgtttcctgaggga

SEQ ID NO: 557822 - DNA, 25 bp, Mus musculus
cacattcgctgtctgcacggagcac

SEQ ID NO: 557823 - DNA, 25 bp, Mus musculus
cacattcgctgtgtgcacggagcac

SEQ ID NO: 557824 - DNA, 25 bp, Mus musculus
cacattcgttccaaagggcatgtcc

SEQ ID NO: 557825 - DNA, 25 bp, Mus musculus
cacattcgttcctaagggcatgtcc

SEQ ID NO: 557826 - DNA, 25 bp, Mus musculus
cacattctaatgataacggagttgg

SEQ ID NO: 557827 - DNA, 25 bp, Mus musculus
cacattctaatgttaacggagttgg

SEQ ID NO: 557828 - DNA, 25 bp, Mus musculus
cacattctatgtaactagttggcta

SEQ ID NO: 557829 - DNA, 25 bp, Mus musculus
cacattctatgttactagttggcta

SEQ ID NO: 557830 - DNA, 25 bp, Mus musculus
cacattctctgtatgttagcctgcg

SEQ ID NO: 557831 - DNA, 25 bp, Mus musculus
cacattctctgtttgttagcctgcg

SEQ ID NO: 557832 - DNA, 25 bp, Mus musculus
cacattctgatgagtggactgcaca

SEQ ID NO: 557833 - DNA, 25 bp, Mus musculus
cacattctgatgtgtggactgcaca

SEQ ID NO: 557834 - DNA, 25 bp, Mus musculus
cacattctgcctctggataatcccg

SEQ ID NO: 557835 - DNA, 25 bp, Mus musculus
cacattctgcctgtggataatcccg

SEQ ID NO: 557836 - DNA, 25 bp, Mus musculus
cacattctgttgatcgtcatgcgtt

SEQ ID NO: 557837 - DNA, 25 bp, Mus musculus
cacattctgttgttcgtcatgcgtt

SEQ ID NO: 557838 - DNA, 25 bp, Mus musculus
cacattcttaggactggagcctgga

SEQ ID NO: 557839 - DNA, 25 bp, Mus musculus
cacattcttaggtctggagcctgga

SEQ ID NO: 557840 - DNA, 25 bp, Mus musculus
cacattcttgtgaatctttctggga

SEQ ID NO: 557841 - DNA, 25 bp, Mus musculus
cacattcttgtgtatctttctggga

SEQ ID NO: 557842 - DNA, 25 bp, Mus musculus
cacattgaggctaactgggctggct

SEQ ID NO: 557843 - DNA, 25 bp, Mus musculus
cacattgaggcttactgggctggct

SEQ ID NO: 557844 - DNA, 25 bp, Mus musculus
cacattgaggttagggaacggccac

SEQ ID NO: 557845 - DNA, 25 bp, Mus musculus
cacattgaggtttgggaacggccac

SEQ ID NO: 557846 - DNA, 25 bp, Mus musculus
cacattgagtaacagcatggctcca

SEQ ID NO: 557847 - DNA, 25 bp, Mus musculus
cacattgagtaagagcatggctcca

SEQ ID NO: 557848 - DNA, 25 bp, Mus musculus
cacattgatgaaaggctaggactct

SEQ ID NO: 557849 - DNA, 25 bp, Mus musculus
cacattgatgaatggctaggactct

SEQ ID NO: 557850 - DNA, 25 bp, Mus musculus
cacattgcaatccaagcagtgctgc

SEQ ID NO: 557851 - DNA, 25 bp, Mus musculus
cacattgcaatcgaagcagtgctgc

SEQ ID NO: 557852 - DNA, 25 bp, Mus musculus
cacattgccaacctggagcgcgtac

SEQ ID NO: 557853 - DNA, 25 bp, Mus musculus
cacattgccaacgtggagcgcgtac

SEQ ID NO: 557854 - DNA, 25 bp, Mus musculus
cacattgccgtgctgtgtcgaggca

SEQ ID NO: 557855 - DNA, 25 bp, Mus musculus
cacattgccgtggtgtgtcgaggca

SEQ ID NO: 557856 - DNA, 25 bp, Mus musculus
cacattggatcacaggatcatcaag

SEQ ID NO: 557857 - DNA, 25 bp, Mus musculus
cacattggatcagaggatcatcaag

SEQ ID NO: 557858 - DNA, 25 bp, Mus musculus
cacattggatgtcttagagactgac

SEQ ID NO: 557859 - DNA, 25 bp, Mus musculus
cacattggatgtgttagagactgac

SEQ ID NO: 557860 - DNA, 25 bp, Mus musculus
cacattggattgatatgattccctc

SEQ ID NO: 557861 - DNA, 25 bp, Mus musculus
cacattggattgttatgattccctc

SEQ ID NO: 557862 - DNA, 25 bp, Mus musculus
cacattgggtgaccctcctggcttc

SEQ ID NO: 557863 - DNA, 25 bp, Mus musculus
cacattgggtgagcctcctggcttc

SEQ ID NO: 557864 - DNA, 25 bp, Mus musculus
cacattggtcctagtgagaacctca

SEQ ID NO: 557865 - DNA, 25 bp, Mus musculus
cacattggtccttgtgagaacctca

SEQ ID NO: 557866 - DNA, 25 bp, Mus musculus
cacattgtcgatcagcaaaagaaga

SEQ ID NO: 557867 - DNA, 25 bp, Mus musculus
cacattgtcgatgagcaaaagaaga

SEQ ID NO: 557868 - DNA, 25 bp, Mus musculus
cacattgtcgccattgcagaggaag

SEQ ID NO: 557869 - DNA, 25 bp, Mus musculus
cacattgtcgcctttgcagaggaag

SEQ ID NO: 557870 - DNA, 25 bp, Mus musculus
cacattgtgggcaatcatgaacatg

SEQ ID NO: 557871 - DNA, 25 bp, Mus musculus
cacattgtgggctatcatgaacatg

SEQ ID NO: 557872 - DNA, 25 bp, Mus musculus
cacattgttagcagagcctgagggc

SEQ ID NO: 557873 - DNA, 25 bp, Mus musculus
cacattgttagctgagcctgagggc

SEQ ID NO: 557874 - DNA, 25 bp, Mus musculus
cacatttactggcaagcaggcttgc

SEQ ID NO: 557875 - DNA, 25 bp, Mus musculus
cacatttactgggaagcaggcttgc

SEQ ID NO: 557876 - DNA, 25 bp, Mus musculus
cacatttagggtaaatcctttgcag

SEQ ID NO: 557877 - DNA, 25 bp, Mus musculus
cacatttagggttaatcctttgcag

SEQ ID NO: 557878 - DNA, 25 bp, Mus musculus
cacatttccaggactgactgggacc

SEQ ID NO: 557879 - DNA, 25 bp, Mus musculus
cacatttccaggtctgactgggacc

SEQ ID NO: 557880 - DNA, 25 bp, Mus musculus
cacatttctcacaggaaacgtactc

SEQ ID NO: 557881 - DNA, 25 bp, Mus musculus
cacatttctcactggaaacgtactc

SEQ ID NO: 557882 - DNA, 25 bp, Mus musculus
cacatttctggtccatcaagctttg

SEQ ID NO: 557883 - DNA, 25 bp, Mus musculus
cacatttctggtgcatcaagctttg

SEQ ID NO: 557884 - DNA, 25 bp, Mus musculus
cacatttcttatatggactagtgaa

SEQ ID NO: 557885 - DNA, 25 bp, Mus musculus
cacatttcttatttggactagtgaa

SEQ ID NO: 557886 - DNA, 25 bp, Mus musculus
cacatttgccgaagccaggatggct

SEQ ID NO: 557887 - DNA, 25 bp, Mus musculus
cacatttgccgatgccaggatggct

SEQ ID NO: 557888 - DNA, 25 bp, Mus musculus
cacatttgttaccagcaggcgaata

SEQ ID NO: 557889 - DNA, 25 bp, Mus musculus
cacatttgttacgagcaggcgaata

SEQ ID NO: 557890 - DNA, 25 bp, Mus musculus
cacattttcgggatggtcctcatga

SEQ ID NO: 557891 - DNA, 25 bp, Mus musculus
cacattttcgggttggtcctcatga

SEQ ID NO: 557892 - DNA, 25 bp, Mus musculus
caccaaacaccaaagatctggatgt

SEQ ID NO: 557893 - DNA, 25 bp, Mus musculus
caccaaacaccatagatctggatgt

SEQ ID NO: 557894 - DNA, 25 bp, Mus musculus
caccaaacatttcagatatggaagc

SEQ ID NO: 557895 - DNA, 25 bp, Mus musculus
caccaaacatttgagatatggaagc

SEQ ID NO: 557896 - DNA, 25 bp, Mus musculus
caccaaacctctccttccaagtcag

SEQ ID NO: 557897 - DNA, 25 bp, Mus musculus
caccaaacctctgcttccaagtcag

SEQ ID NO: 557898 - DNA, 25 bp, Mus musculus
caccaaagacggcaatgtactgctt

SEQ ID NO: 557899 - DNA, 25 bp, Mus musculus
caccaaagacgggaatgtactgctt

SEQ ID NO: 557900 - DNA, 25 bp, Mus musculus
caccaaagaggacctcgaggacatt

SEQ ID NO: 557901 - DNA, 25 bp, Mus musculus
caccaaagaggagctcgaggacatt

SEQ ID NO: 557902 - DNA, 25 bp, Mus musculus
caccaaagcagaaggccgatgcata

SEQ ID NO: 557903 - DNA, 25 bp, Mus musculus
caccaaagcagatggccgatgcata

SEQ ID NO: 557904 - DNA, 25 bp, Mus musculus
caccaaagcgaaatgacactcccag

SEQ ID NO: 557905 - DNA, 25 bp, Mus musculus
caccaaagcgaattgacactcccag

SEQ ID NO: 557906 - DNA, 25 bp, Mus musculus
caccaaaggctaaggaagtccgtgt

SEQ ID NO: 557907 - DNA, 25 bp, Mus musculus
caccaaaggctatggaagtccgtgt

SEQ ID NO: 557908 - DNA, 25 bp, Mus musculus
caccaaaggtggcaatgggaccatc

SEQ ID NO: 557909 - DNA, 25 bp, Mus musculus
caccaaaggtgggaatgggaccatc

SEQ ID NO: 557910 - DNA, 25 bp, Mus musculus
caccaaagtagaagtagacatggag

SEQ ID NO: 557911 - DNA, 25 bp, Mus musculus
caccaaagtagatgtagacatggag

SEQ ID NO: 557912 - DNA, 25 bp, Mus musculus
caccaaagtcctacaggaagagccc

SEQ ID NO: 557913 - DNA, 25 bp, Mus musculus
caccaaagtccttcaggaagagccc

SEQ ID NO: 557914 - DNA, 25 bp, Mus musculus
caccaaatctctctttgttgggcac

SEQ ID NO: 557915 - DNA, 25 bp, Mus musculus
caccaaatctctgtttgttgggcac

SEQ ID NO: 557916 - DNA, 25 bp, Mus musculus
caccaaatggaacacccatcagtgg

SEQ ID NO: 557917 - DNA, 25 bp, Mus musculus
caccaaatggaagacccatcagtgg

SEQ ID NO: 557918 - DNA, 25 bp, Mus musculus
caccaaatgggaagctgtaaggaca

SEQ ID NO: 557919 - DNA, 25 bp, Mus musculus
caccaaatgggatgctgtaaggaca

SEQ ID NO: 557920 - DNA, 25 bp, Mus musculus
caccaaattggtctggtgagtttcc

SEQ ID NO: 557921 - DNA, 25 bp, Mus musculus
caccaaattggtgtggtgagtttcc

SEQ ID NO: 557922 - DNA, 25 bp, Mus musculus
caccaacaaggacaattacactgaa

SEQ ID NO: 557923 - DNA, 25 bp, Mus musculus
caccaacaaggagaattacactgaa

SEQ ID NO: 557924 - DNA, 25 bp, Mus musculus
caccaacaccatagtggccctgatg

SEQ ID NO: 557925 - DNA, 25 bp, Mus musculus
caccaacaccattgtggccctgatg

SEQ ID NO: 557926 - DNA, 25 bp, Mus musculus
caccaacagacgacgagatctatga

SEQ ID NO: 557927 - DNA, 25 bp, Mus musculus
caccaacagacgtcgagatctatga

SEQ ID NO: 557928 - DNA, 25 bp, Mus musculus
caccaacatggccagcagagctgat

SEQ ID NO: 557929 - DNA, 25 bp, Mus musculus
caccaacatggcgagcagagctgat

SEQ ID NO: 557930 - DNA, 25 bp, Mus musculus
caccaacattgtcgacataattctg

SEQ ID NO: 557931 - DNA, 25 bp, Mus musculus
caccaacattgtggacataattctg

SEQ ID NO: 557932 - DNA, 25 bp, Mus musculus
caccaaccaaatcggcatcgggcga

SEQ ID NO: 557933 - DNA, 25 bp, Mus musculus
caccaaccaaatgggcatcgggcga

SEQ ID NO: 557934 - DNA, 25 bp, Mus musculus
caccaaccaggaatatgctgtcaag

SEQ ID NO: 557935 - DNA, 25 bp, Mus musculus
caccaaccaggattatgctgtcaag

SEQ ID NO: 557936 - DNA, 25 bp, Mus musculus
caccaaccagttcactcaagagcag

SEQ ID NO: 557937 - DNA, 25 bp, Mus musculus
caccaaccagttgactcaagagcag

SEQ ID NO: 557938 - DNA, 25 bp, Mus musculus
caccaaccctagctttgatggacga

SEQ ID NO: 557939 - DNA, 25 bp, Mus musculus
caccaaccctaggtttgatggacga

SEQ ID NO: 557940 - DNA, 25 bp, Mus musculus
caccaaccggacaggaagggccgag

SEQ ID NO: 557941 - DNA, 25 bp, Mus musculus
caccaaccggactggaagggccgag

SEQ ID NO: 557942 - DNA, 25 bp, Mus musculus
caccaacgaacgagccatgcgtatg

SEQ ID NO: 557943 - DNA, 25 bp, Mus musculus
caccaacgaacgtgccatgcgtatg

SEQ ID NO: 557944 - DNA, 25 bp, Mus musculus
caccaacgagtgcagtgtcaacaat

SEQ ID NO: 557945 - DNA, 25 bp, Mus musculus
caccaacgagtggagtgtcaacaat

SEQ ID NO: 557946 - DNA, 25 bp, Mus musculus
caccaacgtggacaccgtcaacgat

SEQ ID NO: 557947 - DNA, 25 bp, Mus musculus
caccaacgtggagaccgtcaacgat

SEQ ID NO: 557948 - DNA, 25 bp, Mus musculus
caccaactatggctatggtatggcc

SEQ ID NO: 557949 - DNA, 25 bp, Mus musculus
caccaactatgggtatggtatggcc

SEQ ID NO: 557950 - DNA, 25 bp, Mus musculus
caccaactctgaaggctcttcacag

SEQ ID NO: 557951 - DNA, 25 bp, Mus musculus
caccaactctgatggctcttcacag

SEQ ID NO: 557952 - DNA, 25 bp, Mus musculus
caccaagaaaagacagcctgactgc

SEQ ID NO: 557953 - DNA, 25 bp, Mus musculus
caccaagaaaagtcagcctgactgc

SEQ ID NO: 557954 - DNA, 25 bp, Mus musculus
caccaagaagacatcgatgcttcaa

SEQ ID NO: 557955 - DNA, 25 bp, Mus musculus
caccaagaagacttcgatgcttcaa

SEQ ID NO: 557956 - DNA, 25 bp, Mus musculus
caccaagaagagagcacccattggc

SEQ ID NO: 557957 - DNA, 25 bp, Mus musculus
caccaagaagagtgcacccattggc

SEQ ID NO: 557958 - DNA, 25 bp, Mus musculus
caccaagaagcaacagtatgagatt

SEQ ID NO: 557959 - DNA, 25 bp, Mus musculus
caccaagaagcatcagtatgagatt

SEQ ID NO: 557960 - DNA, 25 bp, Mus musculus
caccaagaaggcaggcgggaccgaa

SEQ ID NO: 557961 - DNA, 25 bp, Mus musculus
caccaagaaggctggcgggaccgaa

SEQ ID NO: 557962 - DNA, 25 bp, Mus musculus
caccaagaagggaatcggaccaact

SEQ ID NO: 557963 - DNA, 25 bp, Mus musculus
caccaagaagggtatcggaccaact

SEQ ID NO: 557964 - DNA, 25 bp, Mus musculus
caccaagaagtacacacaggctggg

SEQ ID NO: 557965 - DNA, 25 bp, Mus musculus
caccaagaagtagacacaggctggg

SEQ ID NO: 557966 - DNA, 25 bp, Mus musculus
caccaagaatgaagccaaccagcct

SEQ ID NO: 557967 - DNA, 25 bp, Mus musculus
caccaagaatgatgccaaccagcct

SEQ ID NO: 557968 - DNA, 25 bp, Mus musculus
caccaagacatacggggagcctgag

SEQ ID NO: 557969 - DNA, 25 bp, Mus musculus
caccaagacatagggggagcctgag

SEQ ID NO: 557970 - DNA, 25 bp, Mus musculus
caccaagagctgaggggccgcagct

SEQ ID NO: 557971 - DNA, 25 bp, Mus musculus
caccaagagctgtggggccgcagct

SEQ ID NO: 557972 - DNA, 25 bp, Mus musculus
caccaagagcttaccaccaaagaag

SEQ ID NO: 557973 - DNA, 25 bp, Mus musculus
caccaagagctttccaccaaagaag

SEQ ID NO: 557974 - DNA, 25 bp, Mus musculus
caccaagagggtaggcatcgtggcc

SEQ ID NO: 557975 - DNA, 25 bp, Mus musculus
caccaagagggttggcatcgtggcc

SEQ ID NO: 557976 - DNA, 25 bp, Mus musculus
caccaagatcccagtaggttctcct

SEQ ID NO: 557977 - DNA, 25 bp, Mus musculus
caccaagatccctgtaggttctcct

SEQ ID NO: 557978 - DNA, 25 bp, Mus musculus
caccaagatctacgtgtggaaaggc

SEQ ID NO: 557979 - DNA, 25 bp, Mus musculus
caccaagatctaggtgtggaaaggc

SEQ ID NO: 557980 - DNA, 25 bp, Mus musculus
caccaagcactccattatgggacag

SEQ ID NO: 557981 - DNA, 25 bp, Mus musculus
caccaagcactcgattatgggacag

SEQ ID NO: 557982 - DNA, 25 bp, Mus musculus
caccaagcagtaagagttcatcagg

SEQ ID NO: 557983 - DNA, 25 bp, Mus musculus
caccaagcagtatgagttcatcagg

SEQ ID NO: 557984 - DNA, 25 bp, Mus musculus
caccaagccctacgaagcagtcaaa

SEQ ID NO: 557985 - DNA, 25 bp, Mus musculus
caccaagccctaggaagcagtcaaa

SEQ ID NO: 557986 - DNA, 25 bp, Mus musculus
caccaagcctagctgataatttcca

SEQ ID NO: 557987 - DNA, 25 bp, Mus musculus
caccaagcctaggtgataatttcca

SEQ ID NO: 557988 - DNA, 25 bp, Mus musculus
caccaagcctgactatgacatccga

SEQ ID NO: 557989 - DNA, 25 bp, Mus musculus
caccaagcctgagtatgacatccga

SEQ ID NO: 557990 - DNA, 25 bp, Mus musculus
caccaagcgaggagatgcttgtgaa

SEQ ID NO: 557991 - DNA, 25 bp, Mus musculus
caccaagcgaggtgatgcttgtgaa

SEQ ID NO: 557992 - DNA, 25 bp, Mus musculus
caccaagcgcagcattaaagagcgg

SEQ ID NO: 557993 - DNA, 25 bp, Mus musculus
caccaagcgcaggattaaagagcgg

SEQ ID NO: 557994 - DNA, 25 bp, Mus musculus
caccaagcgcttagggaacctcaag

SEQ ID NO: 557995 - DNA, 25 bp, Mus musculus
caccaagcgctttgggaacctcaag

SEQ ID NO: 557996 - DNA, 25 bp, Mus musculus
caccaagctgtgcattatcatggag

SEQ ID NO: 557997 - DNA, 25 bp, Mus musculus
caccaagctgtggattatcatggag

SEQ ID NO: 557998 - DNA, 25 bp, Mus musculus
caccaaggaacactagggtgttgcc

SEQ ID NO: 557999 - DNA, 25 bp, Mus musculus
caccaaggaacagtagggtgttgcc

SEQ ID NO: 558000 - DNA, 25 bp, Mus musculus
caccaaggaacgagacagtcttaag

SEQ ID NO: 558001 - DNA, 25 bp, Mus musculus
caccaaggaacgtgacagtcttaag

SEQ ID NO: 558002 - DNA, 25 bp, Mus musculus
caccaaggaagtcgtggccatcaag

SEQ ID NO: 558003 - DNA, 25 bp, Mus musculus
caccaaggaagtggtggccatcaag

SEQ ID NO: 558004 - DNA, 25 bp, Mus musculus
caccaaggacgtcgttctgcagtgg

SEQ ID NO: 558005 - DNA, 25 bp, Mus musculus
caccaaggacgtggttctgcagtgg

SEQ ID NO: 558006 - DNA, 25 bp, Mus musculus
caccaaggccttattgccacgtatg

SEQ ID NO: 558007 - DNA, 25 bp, Mus musculus
caccaaggcctttttgccacgtatg

SEQ ID NO: 558008 - DNA, 25 bp, Mus musculus
caccaaggtggaatgggacgagcac

SEQ ID NO: 558009 - DNA, 25 bp, Mus musculus
caccaaggtggattgggacgagcac

SEQ ID NO: 558010 - DNA, 25 bp, Mus musculus
caccaaggttgacaaacaggcggcc

SEQ ID NO: 558011 - DNA, 25 bp, Mus musculus
caccaaggttgagaaacaggcggcc

SEQ ID NO: 558012 - DNA, 25 bp, Mus musculus
caccaagtacgcaaacttttccgag

SEQ ID NO: 558013 - DNA, 25 bp, Mus musculus
caccaagtacgctaacttttccgag

SEQ ID NO: 558014 - DNA, 25 bp, Mus musculus
caccaagtagccagaaaaaagatac

SEQ ID NO: 558015 - DNA, 25 bp, Mus musculus
caccaagtagcctgaaaaaagatac

SEQ ID NO: 558016 - DNA, 25 bp, Mus musculus
caccaagtcagaagctgatgtggct

SEQ ID NO: 558017 - DNA, 25 bp, Mus musculus
caccaagtcagatgctgatgtggct

SEQ ID NO: 558018 - DNA, 25 bp, Mus musculus
caccaagtccttcgttcacagacta

SEQ ID NO: 558019 - DNA, 25 bp, Mus musculus
caccaagtccttggttcacagacta

SEQ ID NO: 558020 - DNA, 25 bp, Mus musculus
caccaagtctgaagtgtggagtttc

SEQ ID NO: 558021 - DNA, 25 bp, Mus musculus
caccaagtctgatgtgtggagtttc

SEQ ID NO: 558022 - DNA, 25 bp, Mus musculus
caccaagtgatcactgcctttactt

SEQ ID NO: 558023 - DNA, 25 bp, Mus musculus
caccaagtgatctctgcctttactt

SEQ ID NO: 558024 - DNA, 25 bp, Mus musculus
caccaagtggcaaaggaactgctca

SEQ ID NO: 558025 - DNA, 25 bp, Mus musculus
caccaagtggcataggaactgctca

SEQ ID NO: 558026 - DNA, 25 bp, Mus musculus
caccaagttcttagtgcgggcttcc

SEQ ID NO: 558027 - DNA, 25 bp, Mus musculus
caccaagttctttgtgcgggcttcc

SEQ ID NO: 558028 - DNA, 25 bp, Mus musculus
caccaagttgaacttagctactaag

SEQ ID NO: 558029 - DNA, 25 bp, Mus musculus
caccaagttgaagttagctactaag

SEQ ID NO: 558030 - DNA, 25 bp, Mus musculus
caccaagtttctacaggccgcgttc

SEQ ID NO: 558031 - DNA, 25 bp, Mus musculus
caccaagtttcttcaggccgcgttc

SEQ ID NO: 558032 - DNA, 25 bp, Mus musculus
caccaatcggttctctcggaatcag

SEQ ID NO: 558033 - DNA, 25 bp, Mus musculus
caccaatcggttgtctcggaatcag

SEQ ID NO: 558034 - DNA, 25 bp, Mus musculus
caccaatgagctaggcagtgccgaa

SEQ ID NO: 558035 - DNA, 25 bp, Mus musculus
caccaatgagcttggcagtgccgaa

SEQ ID NO: 558036 - DNA, 25 bp, Mus musculus
caccaatgatgacgcctatgcagag

SEQ ID NO: 558037 - DNA, 25 bp, Mus musculus
caccaatgatgaggcctatgcagag

SEQ ID NO: 558038 - DNA, 25 bp, Mus musculus
caccaatgcctccaatgaactttga

SEQ ID NO: 558039 - DNA, 25 bp, Mus musculus
caccaatgcctcgaatgaactttga

SEQ ID NO: 558040 - DNA, 25 bp, Mus musculus
caccaatgcgctatcaggagacaat

SEQ ID NO: 558041 - DNA, 25 bp, Mus musculus
caccaatgcgctttcaggagacaat

SEQ ID NO: 558042 - DNA, 25 bp, Mus musculus
caccaatggcccagatgctgatatc

SEQ ID NO: 558043 - DNA, 25 bp, Mus musculus
caccaatggccctgatgctgatatc

SEQ ID NO: 558044 - DNA, 25 bp, Mus musculus
caccaatggtgccaagcctgtggag

SEQ ID NO: 558045 - DNA, 25 bp, Mus musculus
caccaatggtgcgaagcctgtggag

SEQ ID NO: 558046 - DNA, 25 bp, Mus musculus
caccaatgtaagaaaactcacctcc

SEQ ID NO: 558047 - DNA, 25 bp, Mus musculus
caccaatgtaagtaaactcacctcc

SEQ ID NO: 558048 - DNA, 25 bp, Mus musculus
caccaatgtagccaagaatgtcatc

SEQ ID NO: 558049 - DNA, 25 bp, Mus musculus
caccaatgtagcgaagaatgtcatc

SEQ ID NO: 558050 - DNA, 25 bp, Mus musculus
caccaatgtgtcagtggtaccttta

SEQ ID NO: 558051 - DNA, 25 bp, Mus musculus
caccaatgtgtctgtggtaccttta

SEQ ID NO: 558052 - DNA, 25 bp, Mus musculus
caccaatgttgacctagccttccag

SEQ ID NO: 558053 - DNA, 25 bp, Mus musculus
caccaatgttgagctagccttccag

SEQ ID NO: 558054 - DNA, 25 bp, Mus musculus
caccaattggttcctcagtgccaaa

SEQ ID NO: 558055 - DNA, 25 bp, Mus musculus
caccaattggttgctcagtgccaaa

SEQ ID NO: 558056 - DNA, 25 bp, Mus musculus
caccaatttcataggcgtggctgag

SEQ ID NO: 558057 - DNA, 25 bp, Mus musculus
caccaatttcattggcgtggctgag

SEQ ID NO: 558058 - DNA, 25 bp, Mus musculus
caccacaacgagatgagcctcgtgg

SEQ ID NO: 558059 - DNA, 25 bp, Mus musculus
caccacaacgagttgagcctcgtgg

SEQ ID NO: 558060 - DNA, 25 bp, Mus musculus
caccacaagaagaattgcagggagg

SEQ ID NO: 558061 - DNA, 25 bp, Mus musculus
caccacaagaagcagtgctacctta

SEQ ID NO: 558062 - DNA, 25 bp, Mus musculus
caccacaagaaggagtgctacctta

SEQ ID NO: 558063 - DNA, 25 bp, Mus musculus
caccacaagaagtattgcagggagg

SEQ ID NO: 558064 - DNA, 25 bp, Mus musculus
caccacaagaatcgttcttcccagg

SEQ ID NO: 558065 - DNA, 25 bp, Mus musculus
caccacaagaatggttcttcccagg

SEQ ID NO: 558066 - DNA, 25 bp, Mus musculus
caccacaagagaaacaagtctgaat

SEQ ID NO: 558067 - DNA, 25 bp, Mus musculus
caccacaagagatacaagtctgaat

SEQ ID NO: 558068 - DNA, 25 bp, Mus musculus
caccacaagttcacagaaacacacg

SEQ ID NO: 558069 - DNA, 25 bp, Mus musculus
caccacaagttctcagaaacacacg

SEQ ID NO: 558070 - DNA, 25 bp, Mus musculus
caccacaattagaccacgataccaa

SEQ ID NO: 558071 - DNA, 25 bp, Mus musculus
caccacaattagtccacgataccaa

SEQ ID NO: 558072 - DNA, 25 bp, Mus musculus
caccacacctagcataaacacttta

SEQ ID NO: 558073 - DNA, 25 bp, Mus musculus
caccacacctaggataaacacttta

SEQ ID NO: 558074 - DNA, 25 bp, Mus musculus
caccacagaaatccctagaagaatt

SEQ ID NO: 558075 - DNA, 25 bp, Mus musculus
caccacagaaatgcctagaagaatt

SEQ ID NO: 558076 - DNA, 25 bp, Mus musculus
caccacagacctcgtgggtcgcatg

SEQ ID NO: 558077 - DNA, 25 bp, Mus musculus
caccacagacctggtgggtcgcatg

SEQ ID NO: 558078 - DNA, 25 bp, Mus musculus
caccacagcaaacccttcaaggagt

SEQ ID NO: 558079 - DNA, 25 bp, Mus musculus
caccacagcaaagccttcaaggagt

SEQ ID NO: 558080 - DNA, 25 bp, Mus musculus
caccacagctggatactagtttgac

SEQ ID NO: 558081 - DNA, 25 bp, Mus musculus
caccacagctggttactagtttgac

SEQ ID NO: 558082 - DNA, 25 bp, Mus musculus
caccacagctttacctaagaagaga

SEQ ID NO: 558083 - DNA, 25 bp, Mus musculus
caccacagcttttcctaagaagaga

SEQ ID NO: 558084 - DNA, 25 bp, Mus musculus
caccacagggttactccagtatgca

SEQ ID NO: 558085 - DNA, 25 bp, Mus musculus
caccacagggtttctccagtatgca

SEQ ID NO: 558086 - DNA, 25 bp, Mus musculus
caccacagtaagcaatgctctgaag

SEQ ID NO: 558087 - DNA, 25 bp, Mus musculus
caccacagtaaggaatgctctgaag

SEQ ID NO: 558088 - DNA, 25 bp, Mus musculus
caccacagtactaaccgtcgtaggc

SEQ ID NO: 558089 - DNA, 25 bp, Mus musculus
caccacagtacttaccgtcgtaggc

SEQ ID NO: 558090 - DNA, 25 bp, Mus musculus
caccacagttcaacattggacccgg

SEQ ID NO: 558091 - DNA, 25 bp, Mus musculus
caccacagttcatcattggacccgg

SEQ ID NO: 558092 - DNA, 25 bp, Mus musculus
caccacatgtatacaagagctggag

SEQ ID NO: 558093 - DNA, 25 bp, Mus musculus
caccacatgtattcaagagctggag

SEQ ID NO: 558094 - DNA, 25 bp, Mus musculus
caccacatgtgacttttggagagga

SEQ ID NO: 558095 - DNA, 25 bp, Mus musculus
caccacatgtgagttttggagagga

SEQ ID NO: 558096 - DNA, 25 bp, Mus musculus
caccacattaaaaaccagcatttgc

SEQ ID NO: 558097 - DNA, 25 bp, Mus musculus
caccacattaaataccagcatttgc

SEQ ID NO: 558098 - DNA, 25 bp, Mus musculus
caccacattgacaactataagaaaa

SEQ ID NO: 558099 - DNA, 25 bp, Mus musculus
caccacattgactactataagaaaa

SEQ ID NO: 558100 - DNA, 25 bp, Mus musculus
caccaccaacaactctttctgggaa

SEQ ID NO: 558101 - DNA, 25 bp, Mus musculus
caccaccaacaagtctttctgggaa

SEQ ID NO: 558102 - DNA, 25 bp, Mus musculus
caccaccaagcgagtgggtttcctt

SEQ ID NO: 558103 - DNA, 25 bp, Mus musculus
caccaccaagcgtgtgggtttcctt

SEQ ID NO: 558104 - DNA, 25 bp, Mus musculus
caccaccacctcctcaaaagaagag

SEQ ID NO: 558105 - DNA, 25 bp, Mus musculus
caccaccacctcgtcaaaagaagag

SEQ ID NO: 558106 - DNA, 25 bp, Mus musculus
caccaccactagaggtatctcttgg

SEQ ID NO: 558107 - DNA, 25 bp, Mus musculus
caccaccactagtggtatctcttgg

SEQ ID NO: 558108 - DNA, 25 bp, Mus musculus
caccaccagaagcaaggctggagcg

SEQ ID NO: 558109 - DNA, 25 bp, Mus musculus
caccaccagaaggaaggctggagcg

SEQ ID NO: 558110 - DNA, 25 bp, Mus musculus
caccaccccgagatgtggccatttt

SEQ ID NO: 558111 - DNA, 25 bp, Mus musculus
caccaccccgagttgtggccatttt

SEQ ID NO: 558112 - DNA, 25 bp, Mus musculus
caccacccctgtctgtgaagacatt

SEQ ID NO: 558113 - DNA, 25 bp, Mus musculus
caccacccctgtgtgtgaagacatt

SEQ ID NO: 558114 - DNA, 25 bp, Mus musculus
caccaccctggactttgaaaatgtg

SEQ ID NO: 558115 - DNA, 25 bp, Mus musculus
caccaccctggagtttgaaaatgtg

SEQ ID NO: 558116 - DNA, 25 bp, Mus musculus
caccaccgagttacgctgcaagctg

SEQ ID NO: 558117 - DNA, 25 bp, Mus musculus
caccaccgagtttcgctgcaagctg

SEQ ID NO: 558118 - DNA, 25 bp, Mus musculus
caccaccgctggagatctggcatgg

SEQ ID NO: 558119 - DNA, 25 bp, Mus musculus
caccaccgctggtgatctggcatgg

SEQ ID NO: 558120 - DNA, 25 bp, Mus musculus
caccaccggactcagcagcaggtgg

SEQ ID NO: 558121 - DNA, 25 bp, Mus musculus
caccaccggactgagcagcaggtgg

SEQ ID NO: 558122 - DNA, 25 bp, Mus musculus
caccaccgggaaccagctctttgat

SEQ ID NO: 558123 - DNA, 25 bp, Mus musculus
caccaccgggaagcagctctttgat

SEQ ID NO: 558124 - DNA, 25 bp, Mus musculus
caccacctgtggaagacactgctca

SEQ ID NO: 558125 - DNA, 25 bp, Mus musculus
caccacctgtggtagacactgctca

SEQ ID NO: 558126 - DNA, 25 bp, Mus musculus
caccaccttcctctttgaagagtaa

SEQ ID NO: 558127 - DNA, 25 bp, Mus musculus
caccaccttcctgtttgaagagtaa

SEQ ID NO: 558128 - DNA, 25 bp, Mus musculus
caccacgaggagctcattttcttgc

SEQ ID NO: 558129 - DNA, 25 bp, Mus musculus
caccacgaggaggtcattttcttgc

SEQ ID NO: 558130 - DNA, 25 bp, Mus musculus
caccacgatgacatgtacctcaatg

SEQ ID NO: 558131 - DNA, 25 bp, Mus musculus
caccacgatgacttgtacctcaatg

SEQ ID NO: 558132 - DNA, 25 bp, Mus musculus
caccacgccaggcatgtgttcgctt

SEQ ID NO: 558133 - DNA, 25 bp, Mus musculus
caccacgccagggatgtgttcgctt

SEQ ID NO: 558134 - DNA, 25 bp, Mus musculus
caccacggccagaggactttcctgg

SEQ ID NO: 558135 - DNA, 25 bp, Mus musculus
caccacggccagtggactttcctgg

SEQ ID NO: 558136 - DNA, 25 bp, Mus musculus
caccacggcttgctactttggaaca

SEQ ID NO: 558137 - DNA, 25 bp, Mus musculus
caccacggcttggtactttggaaca

SEQ ID NO: 558138 - DNA, 25 bp, Mus musculus
caccacgggagaccctggcgcatgt

SEQ ID NO: 558139 - DNA, 25 bp, Mus musculus
caccacgggagagcctggcgcatgt

SEQ ID NO: 558140 - DNA, 25 bp, Mus musculus
caccacggtagtctctggacagagt

SEQ ID NO: 558141 - DNA, 25 bp, Mus musculus
caccacggtagtgtctggacagagt

SEQ ID NO: 558142 - DNA, 25 bp, Mus musculus
caccactaaccactgcaagttggta

SEQ ID NO: 558143 - DNA, 25 bp, Mus musculus
caccactaaccagtgcaagttggta

SEQ ID NO: 558144 - DNA, 25 bp, Mus musculus
caccactacaccaggaaaaatatct

SEQ ID NO: 558145 - DNA, 25 bp, Mus musculus
caccactacacctggaaaaatatct

SEQ ID NO: 558146 - DNA, 25 bp, Mus musculus
caccactatagtccctacaagaggg

SEQ ID NO: 558147 - DNA, 25 bp, Mus musculus
caccactatagtgcctacaagaggg

SEQ ID NO: 558148 - DNA, 25 bp, Mus musculus
caccactattaaacttctcaatgag

SEQ ID NO: 558149 - DNA, 25 bp, Mus musculus
caccactattaatcttctcaatgag

SEQ ID NO: 558150 - DNA, 25 bp, Mus musculus
caccactccaaaagccagctagaga

SEQ ID NO: 558151 - DNA, 25 bp, Mus musculus
caccactccaaatgccagctagaga

SEQ ID NO: 558152 - DNA, 25 bp, Mus musculus
caccactccgtgagtggacgtaaaa

SEQ ID NO: 558153 - DNA, 25 bp, Mus musculus
caccactccgtgtgtggacgtaaaa

SEQ ID NO: 558154 - DNA, 25 bp, Mus musculus
caccactcggtgcttccctggagtt

SEQ ID NO: 558155 - DNA, 25 bp, Mus musculus
caccactcggtggttccctggagtt

SEQ ID NO: 558156 - DNA, 25 bp, Mus musculus
caccactctgctctggtctatggga

SEQ ID NO: 558157 - DNA, 25 bp, Mus musculus
caccactctgctgtggtctatggga

SEQ ID NO: 558158 - DNA, 25 bp, Mus musculus
caccactggcgaactacaattggca

SEQ ID NO: 558159 - DNA, 25 bp, Mus musculus
caccactggcgatctacaattggca

SEQ ID NO: 558160 - DNA, 25 bp, Mus musculus
caccactgggaacaggagctgtggg

SEQ ID NO: 558161 - DNA, 25 bp, Mus musculus
caccactgggaagaggagctgtggg

SEQ ID NO: 558162 - DNA, 25 bp, Mus musculus
caccactgtggcacccatcattcac

SEQ ID NO: 558163 - DNA, 25 bp, Mus musculus
caccactgtggctcccatcattcac

SEQ ID NO: 558164 - DNA, 25 bp, Mus musculus
caccacttcctgagatgccagggag

SEQ ID NO: 558165 - DNA, 25 bp, Mus musculus
caccacttcctgtgatgccagggag

SEQ ID NO: 558166 - DNA, 25 bp, Mus musculus
caccacttcttaatgttctggaagc

SEQ ID NO: 558167 - DNA, 25 bp, Mus musculus
caccacttcttattgttctggaagc

SEQ ID NO: 558168 - DNA, 25 bp, Mus musculus
caccactttgagagatgtctggtct

SEQ ID NO: 558169 - DNA, 25 bp, Mus musculus
caccactttgagtgatgtctggtct

SEQ ID NO: 558170 - DNA, 25 bp, Mus musculus
caccagaaaagaacaggcgcttgca

SEQ ID NO: 558171 - DNA, 25 bp, Mus musculus
caccagaaaagatcaggcgcttgca

SEQ ID NO: 558172 - DNA, 25 bp, Mus musculus
caccagaaccgtctaggtcctgaca

SEQ ID NO: 558173 - DNA, 25 bp, Mus musculus
caccagaaccgtgtaggtcctgaca

SEQ ID NO: 558174 - DNA, 25 bp, Mus musculus
caccagaacctgctgtttgccaaca

SEQ ID NO: 558175 - DNA, 25 bp, Mus musculus
caccagaacctggtgtttgccaaca

SEQ ID NO: 558176 - DNA, 25 bp, Mus musculus
caccagaactgtctggagacctgag

SEQ ID NO: 558177 - DNA, 25 bp, Mus musculus
caccagaactgtgtggagacctgag

SEQ ID NO: 558178 - DNA, 25 bp, Mus musculus
caccagaagttcattgttcatagag

SEQ ID NO: 558179 - DNA, 25 bp, Mus musculus
caccagaagttctttgttcatagag

SEQ ID NO: 558180 - DNA, 25 bp, Mus musculus
caccagaagttgatttgttttccat

SEQ ID NO: 558181 - DNA, 25 bp, Mus musculus
caccagaagttgttttgttttccat

SEQ ID NO: 558182 - DNA, 25 bp, Mus musculus
caccagactgcaagagctgcaccga

SEQ ID NO: 558183 - DNA, 25 bp, Mus musculus
caccagactgcatgagctgcaccga

SEQ ID NO: 558184 - DNA, 25 bp, Mus musculus
caccagagacaccattgtgacagag

SEQ ID NO: 558185 - DNA, 25 bp, Mus musculus
caccagagacacgattgtgacagag

SEQ ID NO: 558186 - DNA, 25 bp, Mus musculus
caccagagaggaagggctcaagtac

SEQ ID NO: 558187 - DNA, 25 bp, Mus musculus
caccagagaggatgggctcaagtac

SEQ ID NO: 558188 - DNA, 25 bp, Mus musculus
caccagagcgtccttgtgctgttag

SEQ ID NO: 558189 - DNA, 25 bp, Mus musculus
caccagagcgtcgttgtgctgttag

SEQ ID NO: 558190 - DNA, 25 bp, Mus musculus
caccagagctctaagaaagggaagc

SEQ ID NO: 558191 - DNA, 25 bp, Mus musculus
caccagagctcttagaaagggaagc

SEQ ID NO: 558192 - DNA, 25 bp, Mus musculus
caccagagctgtcatgtgtccaaat

SEQ ID NO: 558193 - DNA, 25 bp, Mus musculus
caccagagctgtgatgtgtccaaat

SEQ ID NO: 558194 - DNA, 25 bp, Mus musculus
caccagaggaccatcgtcctggagg

SEQ ID NO: 558195 - DNA, 25 bp, Mus musculus
caccagaggaccattgttttggagg

SEQ ID NO: 558196 - DNA, 25 bp, Mus musculus
caccagaggaccttcgtcctggagg

SEQ ID NO: 558197 - DNA, 25 bp, Mus musculus
caccagaggacctttgttttggagg

SEQ ID NO: 558198 - DNA, 25 bp, Mus musculus
caccagaggcccattttgaccgagt

SEQ ID NO: 558199 - DNA, 25 bp, Mus musculus
caccagaggccctttttgaccgagt

SEQ ID NO: 558200 - DNA, 25 bp, Mus musculus
caccagaggctgaataggaagtcgt

SEQ ID NO: 558201 - DNA, 25 bp, Mus musculus
caccagaggctgtataggaagtcgt

SEQ ID NO: 558202 - DNA, 25 bp, Mus musculus
caccagagtaggagacaaaggcact

SEQ ID NO: 558203 - DNA, 25 bp, Mus musculus
caccagagtaggtgacaaaggcact

SEQ ID NO: 558204 - DNA, 25 bp, Mus musculus
caccagagtataagctgtgtctaca

SEQ ID NO: 558205 - DNA, 25 bp, Mus musculus
caccagagtatatgctgtgtctaca

SEQ ID NO: 558206 - DNA, 25 bp, Mus musculus
caccagatccaaaaccacttctaag

SEQ ID NO: 558207 - DNA, 25 bp, Mus musculus
caccagatccaataccacttctaag

SEQ ID NO: 558208 - DNA, 25 bp, Mus musculus
caccagattgtgatgtggactttcc

SEQ ID NO: 558209 - DNA, 25 bp, Mus musculus
caccagattgtgttgtggactttcc

SEQ ID NO: 558210 - DNA, 25 bp, Mus musculus
caccagcaaaagaaaggagtctatt

SEQ ID NO: 558211 - DNA, 25 bp, Mus musculus
caccagcaaaagtaaggagtctatt

SEQ ID NO: 558212 - DNA, 25 bp, Mus musculus
caccagcacaaaccgaagcaggaac

SEQ ID NO: 558213 - DNA, 25 bp, Mus musculus
caccagcacaaagcgaagcaggaac

SEQ ID NO: 558214 - DNA, 25 bp, Mus musculus
caccagcacctgagtatattctaac

SEQ ID NO: 558215 - DNA, 25 bp, Mus musculus
caccagcacctgtgtatattctaac

SEQ ID NO: 558216 - DNA, 25 bp, Mus musculus
caccagcactggctcctaagagctg

SEQ ID NO: 558217 - DNA, 25 bp, Mus musculus
caccagcactgggtcctaagagctg

SEQ ID NO: 558218 - DNA, 25 bp, Mus musculus
caccagcagaaaacaaggcggagtc

SEQ ID NO: 558219 - DNA, 25 bp, Mus musculus
caccagcagaaatcaaggcggagtc

SEQ ID NO: 558220 - DNA, 25 bp, Mus musculus
caccagcagaagagatgactaagaa

SEQ ID NO: 558221 - DNA, 25 bp, Mus musculus
caccagcagaagcagacgatacgct

SEQ ID NO: 558222 - DNA, 25 bp, Mus musculus
caccagcagaaggagacgatacgct

SEQ ID NO: 558223 - DNA, 25 bp, Mus musculus
caccagcagaagtgatgactaagaa

SEQ ID NO: 558224 - DNA, 25 bp, Mus musculus
caccagcagctccactttggacagt

SEQ ID NO: 558225 - DNA, 25 bp, Mus musculus
caccagcagctcgactttggacagt

SEQ ID NO: 558226 - DNA, 25 bp, Mus musculus
caccagcagctgaccttgcagcagg

SEQ ID NO: 558227 - DNA, 25 bp, Mus musculus
caccagcagctgtccttgcagcagg

SEQ ID NO: 558228 - DNA, 25 bp, Mus musculus
caccagcagtgaagagaataccatg

SEQ ID NO: 558229 - DNA, 25 bp, Mus musculus
caccagcagtgatgagaataccatg

SEQ ID NO: 558230 - DNA, 25 bp, Mus musculus
caccagcatgataggcgtgggcctt

SEQ ID NO: 558231 - DNA, 25 bp, Mus musculus
caccagcatgattggcgtgggcctt

SEQ ID NO: 558232 - DNA, 25 bp, Mus musculus
caccagcatgtcatccagtaaacag

SEQ ID NO: 558233 - DNA, 25 bp, Mus musculus
caccagcatgtcttccagtaaacag

SEQ ID NO: 558234 - DNA, 25 bp, Mus musculus
caccagcatttgctaagtgcttggt

SEQ ID NO: 558235 - DNA, 25 bp, Mus musculus
caccagcatttggtaagtgcttggt

SEQ ID NO: 558236 - DNA, 25 bp, Mus musculus
caccagccagctactgttggagaca

SEQ ID NO: 558237 - DNA, 25 bp, Mus musculus
caccagccagcttctgttggagaca

SEQ ID NO: 558238 - DNA, 25 bp, Mus musculus
caccagccatctcaggtaactagaa

SEQ ID NO: 558239 - DNA, 25 bp, Mus musculus
caccagccatctgaggtaactagaa

SEQ ID NO: 558240 - DNA, 25 bp, Mus musculus
caccagccattgatgcttactcgga

SEQ ID NO: 558241 - DNA, 25 bp, Mus musculus
caccagccattgttgcttactcgga

SEQ ID NO: 558242 - DNA, 25 bp, Mus musculus
caccagccgaatcatcaaatacatg

SEQ ID NO: 558243 - DNA, 25 bp, Mus musculus
caccagccgaatgatcaaatacatg

SEQ ID NO: 558244 - DNA, 25 bp, Mus musculus
caccagcctcggcatgggtaactgc

SEQ ID NO: 558245 - DNA, 25 bp, Mus musculus
caccagcctcggctgggcagaggct

SEQ ID NO: 558246 - DNA, 25 bp, Mus musculus
caccagcctcgggatgggtaactgc

SEQ ID NO: 558247 - DNA, 25 bp, Mus musculus
caccagcctcgggtgggcagaggct

SEQ ID NO: 558248 - DNA, 25 bp, Mus musculus
caccagcctgtccagttgcaggtgg

SEQ ID NO: 558249 - DNA, 25 bp, Mus musculus
caccagcctgtcgagttgcaggtgg

SEQ ID NO: 558250 - DNA, 25 bp, Mus musculus
caccagcgagagacatcaaagagcc

SEQ ID NO: 558251 - DNA, 25 bp, Mus musculus
caccagcgagagtcatcaaagagcc

SEQ ID NO: 558252 - DNA, 25 bp, Mus musculus
caccagcgccatatataagcaagac

SEQ ID NO: 558253 - DNA, 25 bp, Mus musculus
caccagcgccatttataagcaagac

SEQ ID NO: 558254 - DNA, 25 bp, Mus musculus
caccagcggccaaaggaccgcggag

SEQ ID NO: 558255 - DNA, 25 bp, Mus musculus
caccagcggccataggaccgcggag

SEQ ID NO: 558256 - DNA, 25 bp, Mus musculus
caccagcgttatattttgcacagag

SEQ ID NO: 558257 - DNA, 25 bp, Mus musculus
caccagcgttattttttgcacagag

SEQ ID NO: 558258 - DNA, 25 bp, Mus musculus
caccagctaggcctgagctcagaac

SEQ ID NO: 558259 - DNA, 25 bp, Mus musculus
caccagctaggcgtgagctcagaac

SEQ ID NO: 558260 - DNA, 25 bp, Mus musculus
caccagctcgcacagctatgagcag

SEQ ID NO: 558261 - DNA, 25 bp, Mus musculus
caccagctcgcagagctatgagcag

SEQ ID NO: 558262 - DNA, 25 bp, Mus musculus
caccagctgggaatcatccacagag

SEQ ID NO: 558263 - DNA, 25 bp, Mus musculus
caccagctgggattcatccacagag

SEQ ID NO: 558264 - DNA, 25 bp, Mus musculus
caccagctgtgcaatgtttgaagcc

SEQ ID NO: 558265 - DNA, 25 bp, Mus musculus
caccagctgtgctatgtttgaagcc

SEQ ID NO: 558266 - DNA, 25 bp, Mus musculus
caccagcttttcatgcagctcaaga

SEQ ID NO: 558267 - DNA, 25 bp, Mus musculus
caccagcttttcttgcagctcaaga

SEQ ID NO: 558268 - DNA, 25 bp, Mus musculus
caccaggaacaacaaatataggacc

SEQ ID NO: 558269 - DNA, 25 bp, Mus musculus
caccaggaacaagaaatataggacc

SEQ ID NO: 558270 - DNA, 25 bp, Mus musculus
caccaggaacatcactctgagaagt

SEQ ID NO: 558271 - DNA, 25 bp, Mus musculus
caccaggaacatgactctgagaagt

SEQ ID NO: 558272 - DNA, 25 bp, Mus musculus
caccaggaatgtaaatgatgcagac

SEQ ID NO: 558273 - DNA, 25 bp, Mus musculus
caccaggaatgttaatgatgcagac

SEQ ID NO: 558274 - DNA, 25 bp, Mus musculus
caccaggaccttatgaaaggtatcc

SEQ ID NO: 558275 - DNA, 25 bp, Mus musculus
caccaggaccttttgaaaggtatcc

SEQ ID NO: 558276 - DNA, 25 bp, Mus musculus
caccaggaggttctagcaaggtcac

SEQ ID NO: 558277 - DNA, 25 bp, Mus musculus
caccaggaggttgtagcaaggtcac

SEQ ID NO: 558278 - DNA, 25 bp, Mus musculus
caccaggagtacctgaagatgctgg

SEQ ID NO: 558279 - DNA, 25 bp, Mus musculus
caccaggagtacgtgaagatgctgg

SEQ ID NO: 558280 - DNA, 25 bp, Mus musculus
caccaggagtatctggcatgccaac

SEQ ID NO: 558281 - DNA, 25 bp, Mus musculus
caccaggagtatgtggcatgccaac

SEQ ID NO: 558282 - DNA, 25 bp, Mus musculus
caccaggagtcaccatctcctttga

SEQ ID NO: 558283 - DNA, 25 bp, Mus musculus
caccaggagtcagcatctcctttga

SEQ ID NO: 558284 - DNA, 25 bp, Mus musculus
caccaggataatatctcagtgaacc

SEQ ID NO: 558285 - DNA, 25 bp, Mus musculus
caccaggataatttctcagtgaacc

SEQ ID NO: 558286 - DNA, 25 bp, Mus musculus
caccaggatgtgcatcacttcaact

SEQ ID NO: 558287 - DNA, 25 bp, Mus musculus
caccaggatgtggatcacttcaact

SEQ ID NO: 558288 - DNA, 25 bp, Mus musculus
caccaggcagagaggcttcctaggg

SEQ ID NO: 558289 - DNA, 25 bp, Mus musculus
caccaggcagagtggcttcctaggg

SEQ ID NO: 558290 - DNA, 25 bp, Mus musculus
caccaggcagttcgctgctcagtgc

SEQ ID NO: 558291 - DNA, 25 bp, Mus musculus
caccaggcagttggctgctcagtgc

SEQ ID NO: 558292 - DNA, 25 bp, Mus musculus
caccaggccccaattgttgtgctga

SEQ ID NO: 558293 - DNA, 25 bp, Mus musculus
caccaggccccatttgttgtgctga

SEQ ID NO: 558294 - DNA, 25 bp, Mus musculus
caccaggcgctgataagcaatacct

SEQ ID NO: 558295 - DNA, 25 bp, Mus musculus
caccaggcgctgttaagcaatacct

SEQ ID NO: 558296 - DNA, 25 bp, Mus musculus
caccaggctacaacggccatgaaga

SEQ ID NO: 558297 - DNA, 25 bp, Mus musculus
caccaggctacatcggccatgaaga

SEQ ID NO: 558298 - DNA, 25 bp, Mus musculus
caccaggctttcagtgctgcttccg

SEQ ID NO: 558299 - DNA, 25 bp, Mus musculus
caccaggctttctgtgctgcttccg

SEQ ID NO: 558300 - DNA, 25 bp, Mus musculus
caccagggagctagttagttccggg

SEQ ID NO: 558301 - DNA, 25 bp, Mus musculus
caccagggagcttgttagttccggg

SEQ ID NO: 558302 - DNA, 25 bp, Mus musculus
caccagggatctcagcatggtccag

SEQ ID NO: 558303 - DNA, 25 bp, Mus musculus
caccagggatctgagcatggtccag

SEQ ID NO: 558304 - DNA, 25 bp, Mus musculus
caccagggcaagatctacgtcctcg

SEQ ID NO: 558305 - DNA, 25 bp, Mus musculus
caccagggcaagttctacgtcctcg

SEQ ID NO: 558306 - DNA, 25 bp, Mus musculus
caccagggcattccaaagctgtacc

SEQ ID NO: 558307 - DNA, 25 bp, Mus musculus
caccagggcattgcaaagctgtacc

SEQ ID NO: 558308 - DNA, 25 bp, Mus musculus
caccagggccacacatctgtggaag

SEQ ID NO: 558309 - DNA, 25 bp, Mus musculus
caccagggccactcatctgtggaag

SEQ ID NO: 558310 - DNA, 25 bp, Mus musculus
caccagggcctgaaattgtatgcgg

SEQ ID NO: 558311 - DNA, 25 bp, Mus musculus
caccagggcctgtaattgtatgcgg

SEQ ID NO: 558312 - DNA, 25 bp, Mus musculus
caccaggtatttcgatgaggagttc

SEQ ID NO: 558313 - DNA, 25 bp, Mus musculus
caccaggtatttggatgaggagttc

SEQ ID NO: 558314 - DNA, 25 bp, Mus musculus
caccaggtcgccatctggcagagga

SEQ ID NO: 558315 - DNA, 25 bp, Mus musculus
caccaggtcgccttctggcagagga

SEQ ID NO: 558316 - DNA, 25 bp, Mus musculus
caccaggtcgctctggatatccagg

SEQ ID NO: 558317 - DNA, 25 bp, Mus musculus
caccaggtcgctgtggatatccagg

SEQ ID NO: 558318 - DNA, 25 bp, Mus musculus
caccaggtgaagaggtggcagtacc

SEQ ID NO: 558319 - DNA, 25 bp, Mus musculus
caccaggtgaagtggtggcagtacc

SEQ ID NO: 558320 - DNA, 25 bp, Mus musculus
caccaggtgacaatgtaataaccac

SEQ ID NO: 558321 - DNA, 25 bp, Mus musculus
caccaggtgacattgtaataaccac

SEQ ID NO: 558322 - DNA, 25 bp, Mus musculus
caccaggtggctagacagatgcacg

SEQ ID NO: 558323 - DNA, 25 bp, Mus musculus
caccaggtggcttgacagatgcacg

SEQ ID NO: 558324 - DNA, 25 bp, Mus musculus
caccaggtgttgcgctcggaccagt

SEQ ID NO: 558325 - DNA, 25 bp, Mus musculus
caccaggtgttgggctcggaccagt

SEQ ID NO: 558326 - DNA, 25 bp, Mus musculus
caccaggttctgatgagaatcttcg

SEQ ID NO: 558327 - DNA, 25 bp, Mus musculus
caccaggttctgttgagaatcttcg

SEQ ID NO: 558328 - DNA, 25 bp, Mus musculus
caccagtaccagagactcgtcagag

SEQ ID NO: 558329 - DNA, 25 bp, Mus musculus
caccagtaccagtgactcgtcagag

SEQ ID NO: 558330 - DNA, 25 bp, Mus musculus
caccagtcagcgaggagacctgagc

SEQ ID NO: 558331 - DNA, 25 bp, Mus musculus
caccagtcagcgtggagacctgagc

SEQ ID NO: 558332 - DNA, 25 bp, Mus musculus
caccagtcagtgaagcttcagctcc

SEQ ID NO: 558333 - DNA, 25 bp, Mus musculus
caccagtcagtgtagcttcagctcc

SEQ ID NO: 558334 - DNA, 25 bp, Mus musculus
caccagtctggtagcaactgaagag

SEQ ID NO: 558335 - DNA, 25 bp, Mus musculus
caccagtctggttgcaactgaagag

SEQ ID NO: 558336 - DNA, 25 bp, Mus musculus
caccagtgaagacgaagactatgtc

SEQ ID NO: 558337 - DNA, 25 bp, Mus musculus
caccagtgaagaggaagactatgtc

SEQ ID NO: 558338 - DNA, 25 bp, Mus musculus
caccagtgaccaccatttggacgct

SEQ ID NO: 558339 - DNA, 25 bp, Mus musculus
caccagtgaccagcatttggacgct

SEQ ID NO: 558340 - DNA, 25 bp, Mus musculus
caccagtgagtaagaaagttccttc

SEQ ID NO: 558341 - DNA, 25 bp, Mus musculus
caccagtgagtatgaaagttccttc

SEQ ID NO: 558342 - DNA, 25 bp, Mus musculus
caccagtgcatgctttctcttgcaa

SEQ ID NO: 558343 - DNA, 25 bp, Mus musculus
caccagtgcatggtttctcttgcaa

SEQ ID NO: 558344 - DNA, 25 bp, Mus musculus
caccagtggactaggctgcttgggc

SEQ ID NO: 558345 - DNA, 25 bp, Mus musculus
caccagtggacttggctgcttgggc

SEQ ID NO: 558346 - DNA, 25 bp, Mus musculus
caccagtgggtgacctaccagggtc

SEQ ID NO: 558347 - DNA, 25 bp, Mus musculus
caccagtgggtgtcctaccagggtc

SEQ ID NO: 558348 - DNA, 25 bp, Mus musculus
caccagtggtatcagtacaagaggc

SEQ ID NO: 558349 - DNA, 25 bp, Mus musculus
caccagtggtatgagtacaagaggc

SEQ ID NO: 558350 - DNA, 25 bp, Mus musculus
caccagtggtggcaagcctgtcgta

SEQ ID NO: 558351 - DNA, 25 bp, Mus musculus
caccagtggtgggaagcctgtcgta

SEQ ID NO: 558352 - DNA, 25 bp, Mus musculus
caccagtgtgataatgtgggacccc

SEQ ID NO: 558353 - DNA, 25 bp, Mus musculus
caccagtgtgattatgtgggacccc

SEQ ID NO: 558354 - DNA, 25 bp, Mus musculus
caccagtgtggtctatgtctgtggc

SEQ ID NO: 558355 - DNA, 25 bp, Mus musculus
caccagtgtggtgtatgtctgtggc

SEQ ID NO: 558356 - DNA, 25 bp, Mus musculus
caccagtgttctcggatgacccaca

SEQ ID NO: 558357 - DNA, 25 bp, Mus musculus
caccagtgttctgggatgacccaca

SEQ ID NO: 558358 - DNA, 25 bp, Mus musculus
caccagtgttggctattggccagct

SEQ ID NO: 558359 - DNA, 25 bp, Mus musculus
caccagtgttgggtattggccagct

SEQ ID NO: 558360 - DNA, 25 bp, Mus musculus
caccagttcctaccatggagtcaat

SEQ ID NO: 558361 - DNA, 25 bp, Mus musculus
caccagttcctagcatggagtcaat

SEQ ID NO: 558362 - DNA, 25 bp, Mus musculus
caccagttggatctagaacgtgccc

SEQ ID NO: 558363 - DNA, 25 bp, Mus musculus
caccagttggatgtagaacgtgccc

SEQ ID NO: 558364 - DNA, 25 bp, Mus musculus
caccagttgttgaggactttcatgc

SEQ ID NO: 558365 - DNA, 25 bp, Mus musculus
caccagttgttgtggactttcatgc

SEQ ID NO: 558366 - DNA, 25 bp, Mus musculus
caccagtttcctcggcaaggtgtgc

SEQ ID NO: 558367 - DNA, 25 bp, Mus musculus
caccagtttcctgggcaaggtgtgc

SEQ ID NO: 558368 - DNA, 25 bp, Mus musculus
caccagtttgacatactggctgagc

SEQ ID NO: 558369 - DNA, 25 bp, Mus musculus
caccagtttgacttactggctgagc

SEQ ID NO: 558370 - DNA, 25 bp, Mus musculus
caccatacagtaatgccacaaaccg

SEQ ID NO: 558371 - DNA, 25 bp, Mus musculus
caccatacagtattgccacaaaccg

SEQ ID NO: 558372 - DNA, 25 bp, Mus musculus
caccatactacaagtcacccgagag

SEQ ID NO: 558373 - DNA, 25 bp, Mus musculus
caccatactacatgtcacccgagag

SEQ ID NO: 558374 - DNA, 25 bp, Mus musculus
caccatactaggaccactggcgtgg

SEQ ID NO: 558375 - DNA, 25 bp, Mus musculus
caccatactaggtccactggcgtgg

SEQ ID NO: 558376 - DNA, 25 bp, Mus musculus
caccatactccgagacagcggagct

SEQ ID NO: 558377 - DNA, 25 bp, Mus musculus
caccatactccgtgacagcggagct

SEQ ID NO: 558378 - DNA, 25 bp, Mus musculus
caccatagatgtatgagcaggagag

SEQ ID NO: 558379 - DNA, 25 bp, Mus musculus
caccatagatgtttgagcaggagag

SEQ ID NO: 558380 - DNA, 25 bp, Mus musculus
caccatagcagcagtcatagccgca

SEQ ID NO: 558381 - DNA, 25 bp, Mus musculus
caccatagcagctgtcatagccgca

SEQ ID NO: 558382 - DNA, 25 bp, Mus musculus
caccatagccacagtgagggaggcc

SEQ ID NO: 558383 - DNA, 25 bp, Mus musculus
caccatagccactgtgagggaggcc

SEQ ID NO: 558384 - DNA, 25 bp, Mus musculus
caccatagtgccaagccagtacagg

SEQ ID NO: 558385 - DNA, 25 bp, Mus musculus
caccatagtgcctagccagtacagg

SEQ ID NO: 558386 - DNA, 25 bp, Mus musculus
caccatcaaaaacgacgactatact

SEQ ID NO: 558387 - DNA, 25 bp, Mus musculus
caccatcaaaaaggacgactatact

SEQ ID NO: 558388 - DNA, 25 bp, Mus musculus
caccatcaaagcagaaccaggctct

SEQ ID NO: 558389 - DNA, 25 bp, Mus musculus
caccatcaaagctgaaccaggctct

SEQ ID NO: 558390 - DNA, 25 bp, Mus musculus
caccatcaccctaaaaacgttgcag

SEQ ID NO: 558391 - DNA, 25 bp, Mus musculus
caccatcacccttaaaacgttgcag

SEQ ID NO: 558392 - DNA, 25 bp, Mus musculus
caccatcatccgagaggcagtagag

SEQ ID NO: 558393 - DNA, 25 bp, Mus musculus
caccatcatccgtgaggcagtagag

SEQ ID NO: 558394 - DNA, 25 bp, Mus musculus
caccatccaaagaacttgtcaagac

SEQ ID NO: 558395 - DNA, 25 bp, Mus musculus
caccatccaaagtacttgtcaagac

SEQ ID NO: 558396 - DNA, 25 bp, Mus musculus
caccatccacacataagtatctggg

SEQ ID NO: 558397 - DNA, 25 bp, Mus musculus
caccatccacacttaagtatctggg

SEQ ID NO: 558398 - DNA, 25 bp, Mus musculus
caccatccagataaccaattccaag

SEQ ID NO: 558399 - DNA, 25 bp, Mus musculus
caccatccagattaccaattccaag

SEQ ID NO: 558400 - DNA, 25 bp, Mus musculus
caccatccgtgaattggtgtcacgg

SEQ ID NO: 558401 - DNA, 25 bp, Mus musculus
caccatccgtgatttggtgtcacgg

SEQ ID NO: 558402 - DNA, 25 bp, Mus musculus
caccatcctggcactatttgatgct

SEQ ID NO: 558403 - DNA, 25 bp, Mus musculus
caccatcctggctctatttgatgct

SEQ ID NO: 558404 - DNA, 25 bp, Mus musculus
caccatcggcagaacaaattgactt

SEQ ID NO: 558405 - DNA, 25 bp, Mus musculus
caccatcggcagtacaaattgactt

SEQ ID NO: 558406 - DNA, 25 bp, Mus musculus
caccatcgggcacgcctttgagttg

SEQ ID NO: 558407 - DNA, 25 bp, Mus musculus
caccatcgggcaggcctttgagttg

SEQ ID NO: 558408 - DNA, 25 bp, Mus musculus
caccatcgtggccaaatgctgagaa

SEQ ID NO: 558409 - DNA, 25 bp, Mus musculus
caccatcgtggcgaaatgctgagaa

SEQ ID NO: 558410 - DNA, 25 bp, Mus musculus
caccatctacaacaaaacatttctc

SEQ ID NO: 558411 - DNA, 25 bp, Mus musculus
caccatctacaagaaaacatttctc

SEQ ID NO: 558412 - DNA, 25 bp, Mus musculus
caccatctacctcggttttgggcaa

SEQ ID NO: 558413 - DNA, 25 bp, Mus musculus
caccatctacctgggttttgggcaa

SEQ ID NO: 558414 - DNA, 25 bp, Mus musculus
caccatctacgacgttgtcgatgcc

SEQ ID NO: 558415 - DNA, 25 bp, Mus musculus
caccatctacgaggttgtcgatgcc

SEQ ID NO: 558416 - DNA, 25 bp, Mus musculus
caccatctcacaacggacagaaaca

SEQ ID NO: 558417 - DNA, 25 bp, Mus musculus
caccatctcacatcggacagaaaca

SEQ ID NO: 558418 - DNA, 25 bp, Mus musculus
caccatctggctcgatttcaacttg

SEQ ID NO: 558419 - DNA, 25 bp, Mus musculus
caccatctggctggatttcaacttg

SEQ ID NO: 558420 - DNA, 25 bp, Mus musculus
caccatctgtgaagatgacttcacg

SEQ ID NO: 558421 - DNA, 25 bp, Mus musculus
caccatctgtgatgatgacttcacg

SEQ ID NO: 558422 - DNA, 25 bp, Mus musculus
caccatcttcataggcacttggaac

SEQ ID NO: 558423 - DNA, 25 bp, Mus musculus
caccatcttcattggcacttggaac

SEQ ID NO: 558424 - DNA, 25 bp, Mus musculus
caccatcttggcatctgtgatcctc

SEQ ID NO: 558425 - DNA, 25 bp, Mus musculus
caccatcttggcttctgtgatcctc

SEQ ID NO: 558426 - DNA, 25 bp, Mus musculus
caccatgaagacaatggaggaccag

SEQ ID NO: 558427 - DNA, 25 bp, Mus musculus
caccatgaagactatggaggaccag

SEQ ID NO: 558428 - DNA, 25 bp, Mus musculus
caccatgaagatctggacttcggag

SEQ ID NO: 558429 - DNA, 25 bp, Mus musculus
caccatgaagatgtggacttcggag

SEQ ID NO: 558430 - DNA, 25 bp, Mus musculus
caccatgaatatacggaagcccctc

SEQ ID NO: 558431 - DNA, 25 bp, Mus musculus
caccatgaatattcggaagcccctc

SEQ ID NO: 558432 - DNA, 25 bp, Mus musculus
caccatgaccatagattggcaggaa

SEQ ID NO: 558433 - DNA, 25 bp, Mus musculus
caccatgaccattgattggcaggaa

SEQ ID NO: 558434 - DNA, 25 bp, Mus musculus
caccatgactgaagaacgtttgcgc

SEQ ID NO: 558435 - DNA, 25 bp, Mus musculus
caccatgactgatgaacgtttgcgc

SEQ ID NO: 558436 - DNA, 25 bp, Mus musculus
caccatgatctgcaagctagctgag

SEQ ID NO: 558437 - DNA, 25 bp, Mus musculus
caccatgatctggaagctagctgag

SEQ ID NO: 558438 - DNA, 25 bp, Mus musculus
caccatgatgctcagttcctaccag

SEQ ID NO: 558439 - DNA, 25 bp, Mus musculus
caccatgatgctgagttcctaccag

SEQ ID NO: 558440 - DNA, 25 bp, Mus musculus
caccatgatggaagacgacggacag

SEQ ID NO: 558441 - DNA, 25 bp, Mus musculus
caccatgatggatgacgacggacag

SEQ ID NO: 558442 - DNA, 25 bp, Mus musculus
caccatgcaaaaattgtgtgcctgg

SEQ ID NO: 558443 - DNA, 25 bp, Mus musculus
caccatgcaaaatttgtgtgcctgg

SEQ ID NO: 558444 - DNA, 25 bp, Mus musculus
caccatgccaatcactcgaatgcgg

SEQ ID NO: 558445 - DNA, 25 bp, Mus musculus
caccatgccaatgactcgaatgcgg

SEQ ID NO: 558446 - DNA, 25 bp, Mus musculus
caccatgcgtgacgccaagtatgag

SEQ ID NO: 558447 - DNA, 25 bp, Mus musculus
caccatgcgtgaggccaagtatgag

SEQ ID NO: 558448 - DNA, 25 bp, Mus musculus
caccatgctaagaacctgaatgcat

SEQ ID NO: 558449 - DNA, 25 bp, Mus musculus
caccatgctaagtacctgaatgcat

SEQ ID NO: 558450 - DNA, 25 bp, Mus musculus
caccatgctcagcacaatcttatgg

SEQ ID NO: 558451 - DNA, 25 bp, Mus musculus
caccatgctcaggacaatcttatgg

SEQ ID NO: 558452 - DNA, 25 bp, Mus musculus
caccatgctgcacgtggaattgccc

SEQ ID NO: 558453 - DNA, 25 bp, Mus musculus
caccatgctgcaggtggaattgccc

SEQ ID NO: 558454 - DNA, 25 bp, Mus musculus
caccatgctgtcactagactttcta

SEQ ID NO: 558455 - DNA, 25 bp, Mus musculus
caccatgctgtctctagactttcta

SEQ ID NO: 558456 - DNA, 25 bp, Mus musculus
caccatgcttaaaattgagatgttc

SEQ ID NO: 558457 - DNA, 25 bp, Mus musculus
caccatgcttaatattgagatgttc

SEQ ID NO: 558458 - DNA, 25 bp, Mus musculus
caccatgcttgacataggaaccagt

SEQ ID NO: 558459 - DNA, 25 bp, Mus musculus
caccatgcttgagataggaaccagt

SEQ ID NO: 558460 - DNA, 25 bp, Mus musculus
caccatggaggacgatgacagctat

SEQ ID NO: 558461 - DNA, 25 bp, Mus musculus
caccatggaggaggatgacagctat

SEQ ID NO: 558462 - DNA, 25 bp, Mus musculus
caccatggaggcagggaactactgg

SEQ ID NO: 558463 - DNA, 25 bp, Mus musculus
caccatggaggctgggaactactgg

SEQ ID NO: 558464 - DNA, 25 bp, Mus musculus
caccatggagttctctcatccacgc

SEQ ID NO: 558465 - DNA, 25 bp, Mus musculus
caccatggagttgtctcatccacgc

SEQ ID NO: 558466 - DNA, 25 bp, Mus musculus
caccatgggacaccggccaaattac

SEQ ID NO: 558467 - DNA, 25 bp, Mus musculus
caccatgggacagcggccaaattac

SEQ ID NO: 558468 - DNA, 25 bp, Mus musculus
caccatgggcttcagggtcactaac

SEQ ID NO: 558469 - DNA, 25 bp, Mus musculus
caccatgggcttcgcaatccttatc

SEQ ID NO: 558470 - DNA, 25 bp, Mus musculus
caccatgggcttgagggtcactaac

SEQ ID NO: 558471 - DNA, 25 bp, Mus musculus
caccatgggcttggcaatccttatc

SEQ ID NO: 558472 - DNA, 25 bp, Mus musculus
caccatggggagatgactggccact

SEQ ID NO: 558473 - DNA, 25 bp, Mus musculus
caccatggggagttgactggccact

SEQ ID NO: 558474 - DNA, 25 bp, Mus musculus
caccatgggtggcagccatcatgct

SEQ ID NO: 558475 - DNA, 25 bp, Mus musculus
caccatgggtgggagccatcatgct

SEQ ID NO: 558476 - DNA, 25 bp, Mus musculus
caccatggtgaaaagggactaaatc

SEQ ID NO: 558477 - DNA, 25 bp, Mus musculus
caccatggtgaatagggactaaatc

SEQ ID NO: 558478 - DNA, 25 bp, Mus musculus
caccatggtgatcaacacggaggac

SEQ ID NO: 558479 - DNA, 25 bp, Mus musculus
caccatggtgatgaacacggaggac

SEQ ID NO: 558480 - DNA, 25 bp, Mus musculus
caccatgtagagaagaggcacttcc

SEQ ID NO: 558481 - DNA, 25 bp, Mus musculus
caccatgtagagtagaggcacttcc

SEQ ID NO: 558482 - DNA, 25 bp, Mus musculus
caccatgtcgcacggttcggctcgt

SEQ ID NO: 558483 - DNA, 25 bp, Mus musculus
caccatgtcgcagggttcggctcgt

SEQ ID NO: 558484 - DNA, 25 bp, Mus musculus
caccatgtgcataaaggagagccta

SEQ ID NO: 558485 - DNA, 25 bp, Mus musculus
caccatgtgcattaaggagagccta

SEQ ID NO: 558486 - DNA, 25 bp, Mus musculus
caccatgttactctccttgagctaa

SEQ ID NO: 558487 - DNA, 25 bp, Mus musculus
caccatgttactgtccttgagctaa

SEQ ID NO: 558488 - DNA, 25 bp, Mus musculus
caccatgtttgaagcggtgctcatc

SEQ ID NO: 558489 - DNA, 25 bp, Mus musculus
caccatgtttgatgcggtgctcatc

SEQ ID NO: 558490 - DNA, 25 bp, Mus musculus
caccattaagccataccgtcgaggg

SEQ ID NO: 558491 - DNA, 25 bp, Mus musculus
caccattaagccttaccgtcgaggg

SEQ ID NO: 558492 - DNA, 25 bp, Mus musculus
caccattaagtgactgattcagatg

SEQ ID NO: 558493 - DNA, 25 bp, Mus musculus
caccattaagtgtctgattcagatg

SEQ ID NO: 558494 - DNA, 25 bp, Mus musculus
caccattaccctaagaagttataca

SEQ ID NO: 558495 - DNA, 25 bp, Mus musculus
caccattacccttagaagttataca

SEQ ID NO: 558496 - DNA, 25 bp, Mus musculus
caccattagaaaagtcgcctgcgac

SEQ ID NO: 558497 - DNA, 25 bp, Mus musculus
caccattagaaatgtcgcctgcgac

SEQ ID NO: 558498 - DNA, 25 bp, Mus musculus
caccattccctacttgcatgtgagg

SEQ ID NO: 558499 - DNA, 25 bp, Mus musculus
caccattccctagttgcatgtgagg

SEQ ID NO: 558500 - DNA, 25 bp, Mus musculus
caccattccgagacctgcagtgttc

SEQ ID NO: 558501 - DNA, 25 bp, Mus musculus
caccattccgagtcctgcagtgttc

SEQ ID NO: 558502 - DNA, 25 bp, Mus musculus
caccattgaagactcctacctgaag

SEQ ID NO: 558503 - DNA, 25 bp, Mus musculus
caccattgaagagtcctacctgaag

SEQ ID NO: 558504 - DNA, 25 bp, Mus musculus
caccattgacaactcgcgcgttgtc

SEQ ID NO: 558505 - DNA, 25 bp, Mus musculus
caccattgacaagtcgcgcgttgtc

SEQ ID NO: 558506 - DNA, 25 bp, Mus musculus
caccattgacatatggcactcccag

SEQ ID NO: 558507 - DNA, 25 bp, Mus musculus
caccattgacatttggcactcccag

SEQ ID NO: 558508 - DNA, 25 bp, Mus musculus
caccattgagcactgtcggcgagag

SEQ ID NO: 558509 - DNA, 25 bp, Mus musculus
caccattgagcagtgtcggcgagag

SEQ ID NO: 558510 - DNA, 25 bp, Mus musculus
caccattgagtgactgcaacaggga

SEQ ID NO: 558511 - DNA, 25 bp, Mus musculus
caccattgagtgtctgcaacaggga

SEQ ID NO: 558512 - DNA, 25 bp, Mus musculus
caccattgataacacacaggatgca

SEQ ID NO: 558513 - DNA, 25 bp, Mus musculus
caccattgataagacacaggatgca

SEQ ID NO: 558514 - DNA, 25 bp, Mus musculus
caccattgatggcatcaggagtata

SEQ ID NO: 558515 - DNA, 25 bp, Mus musculus
caccattgatgggatcaggagtata

SEQ ID NO: 558516 - DNA, 25 bp, Mus musculus
caccattgcactcctccgagagggt

SEQ ID NO: 558517 - DNA, 25 bp, Mus musculus
caccattgcactgctccgagagggt

SEQ ID NO: 558518 - DNA, 25 bp, Mus musculus
caccattgcctccagctacgaagag

SEQ ID NO: 558519 - DNA, 25 bp, Mus musculus
caccattgcctcgagctacgaagag

SEQ ID NO: 558520 - DNA, 25 bp, Mus musculus
caccattgcgggaaaaagacttcgg

SEQ ID NO: 558521 - DNA, 25 bp, Mus musculus
caccattgcgggtaaaagacttcgg

SEQ ID NO: 558522 - DNA, 25 bp, Mus musculus
caccattgggatcctgctttctcgg

SEQ ID NO: 558523 - DNA, 25 bp, Mus musculus
caccattgggatgctgctttctcgg

SEQ ID NO: 558524 - DNA, 25 bp, Mus musculus
caccattggtaactcagctccttgt

SEQ ID NO: 558525 - DNA, 25 bp, Mus musculus
caccattggtaagtcagctccttgt

SEQ ID NO: 558526 - DNA, 25 bp, Mus musculus
caccattgtatacatgaagcctgta

SEQ ID NO: 558527 - DNA, 25 bp, Mus musculus
caccattgtatagatgaagcctgta

SEQ ID NO: 558528 - DNA, 25 bp, Mus musculus
caccattgtcacaggcgttgggaac

SEQ ID NO: 558529 - DNA, 25 bp, Mus musculus
caccattgtcactggcgttgggaac

SEQ ID NO: 558530 - DNA, 25 bp, Mus musculus
caccatttcagtcgacctcctcctg

SEQ ID NO: 558531 - DNA, 25 bp, Mus musculus
caccatttcagtggacctcctcctg

SEQ ID NO: 558532 - DNA, 25 bp, Mus musculus
caccatttgccgacgtgggggcacc

SEQ ID NO: 558533 - DNA, 25 bp, Mus musculus
caccatttgccgtcgtgggggcacc

SEQ ID NO: 558534 - DNA, 25 bp, Mus musculus
caccatttgcttcaacttggacggg

SEQ ID NO: 558535 - DNA, 25 bp, Mus musculus
caccatttgcttgaacttggacggg

SEQ ID NO: 558536 - DNA, 25 bp, Mus musculus
caccatttggtgaggagccatggcc

SEQ ID NO: 558537 - DNA, 25 bp, Mus musculus
caccatttggtgtggagccatggcc

SEQ ID NO: 558538 - DNA, 25 bp, Mus musculus
caccatttgtaaaggagaagtggat

SEQ ID NO: 558539 - DNA, 25 bp, Mus musculus
caccatttgtaatggagaagtggat

SEQ ID NO: 558540 - DNA, 25 bp, Mus musculus
cacccaaaccaactgcaaagtctat

SEQ ID NO: 558541 - DNA, 25 bp, Mus musculus
cacccaaaccaagtgcaaagtctat

SEQ ID NO: 558542 - DNA, 25 bp, Mus musculus
cacccaaagatcaggatcatcactc

SEQ ID NO: 558543 - DNA, 25 bp, Mus musculus
cacccaaagatctggatcatcactc

SEQ ID NO: 558544 - DNA, 25 bp, Mus musculus
cacccaaatctgatcaaatcagtgg

SEQ ID NO: 558545 - DNA, 25 bp, Mus musculus
cacccaaatctgttcaaatcagtgg

SEQ ID NO: 558546 - DNA, 25 bp, Mus musculus
cacccaaatcttctgtgtttaccca

SEQ ID NO: 558547 - DNA, 25 bp, Mus musculus
cacccaaatcttgtgtgtttaccca

SEQ ID NO: 558548 - DNA, 25 bp, Mus musculus
cacccaacctgtccctttgtggagg

SEQ ID NO: 558549 - DNA, 25 bp, Mus musculus
cacccaacctgtgcctttgtggagg

SEQ ID NO: 558550 - DNA, 25 bp, Mus musculus
cacccaagacgcagggccattagag

SEQ ID NO: 558551 - DNA, 25 bp, Mus musculus
cacccaagacgctgggccattagag

SEQ ID NO: 558552 - DNA, 25 bp, Mus musculus
cacccaagagctacagctttgatta

SEQ ID NO: 558553 - DNA, 25 bp, Mus musculus
cacccaagagcttcagctttgatta

SEQ ID NO: 558554 - DNA, 25 bp, Mus musculus
cacccaagcctacaaaagtggagct

SEQ ID NO: 558555 - DNA, 25 bp, Mus musculus
cacccaagcctagaaaagtggagct

SEQ ID NO: 558556 - DNA, 25 bp, Mus musculus
cacccaagtcttacaaatgtctctg

SEQ ID NO: 558557 - DNA, 25 bp, Mus musculus
cacccaagtctttcaaatgtctctg

SEQ ID NO: 558558 - DNA, 25 bp, Mus musculus
cacccaatgacgagtgcttcttcat

SEQ ID NO: 558559 - DNA, 25 bp, Mus musculus
cacccaatgacgtgtgcttcttcat

SEQ ID NO: 558560 - DNA, 25 bp, Mus musculus
cacccacacgatcttctataatgag

SEQ ID NO: 558561 - DNA, 25 bp, Mus musculus
cacccacacgatgttctataatgag

SEQ ID NO: 558562 - DNA, 25 bp, Mus musculus
cacccacagccgctatgaggagcat

SEQ ID NO: 558563 - DNA, 25 bp, Mus musculus
cacccacagccggtatgaggagcat

SEQ ID NO: 558564 - DNA, 25 bp, Mus musculus
cacccaccgggacagagcaatgaag

SEQ ID NO: 558565 - DNA, 25 bp, Mus musculus
cacccaccgggagagagcaatgaag

SEQ ID NO: 558566 - DNA, 25 bp, Mus musculus
cacccacctacaaaatgatctctgg

SEQ ID NO: 558567 - DNA, 25 bp, Mus musculus
cacccacctacataatgatctctgg

SEQ ID NO: 558568 - DNA, 25 bp, Mus musculus
cacccacgagagattttcaagcaga

SEQ ID NO: 558569 - DNA, 25 bp, Mus musculus
cacccacgagagtttttcaagcaga

SEQ ID NO: 558570 - DNA, 25 bp, Mus musculus
cacccacggtgtcgccatgtctgga

SEQ ID NO: 558571 - DNA, 25 bp, Mus musculus
cacccacggtgtggccatgtctgga

SEQ ID NO: 558572 - DNA, 25 bp, Mus musculus
cacccactgaatagggaccctctgt

SEQ ID NO: 558573 - DNA, 25 bp, Mus musculus
cacccactgaattgggaccctctgt

SEQ ID NO: 558574 - DNA, 25 bp, Mus musculus
cacccactgttgcaagagatctaca

SEQ ID NO: 558575 - DNA, 25 bp, Mus musculus
cacccactgttggaagagatctaca

SEQ ID NO: 558576 - DNA, 25 bp, Mus musculus
cacccacttggaagcattcttggac

SEQ ID NO: 558577 - DNA, 25 bp, Mus musculus
cacccacttggatgcattcttggac

SEQ ID NO: 558578 - DNA, 25 bp, Mus musculus
cacccagaatctataggtaaatgag

SEQ ID NO: 558579 - DNA, 25 bp, Mus musculus
cacccagaatctttaggtaaatgag

SEQ ID NO: 558580 - DNA, 25 bp, Mus musculus
cacccagaccagatgtccaagaaga

SEQ ID NO: 558581 - DNA, 25 bp, Mus musculus
cacccagaccagttgtccaagaaga

SEQ ID NO: 558582 - DNA, 25 bp, Mus musculus
cacccagacctgcaacaaagtgcga

SEQ ID NO: 558583 - DNA, 25 bp, Mus musculus
cacccagacctggaacaaagtgcga

SEQ ID NO: 558584 - DNA, 25 bp, Mus musculus
cacccagacttacgtcatgatcttc

SEQ ID NO: 558585 - DNA, 25 bp, Mus musculus
cacccagacttaggtcatgatcttc

SEQ ID NO: 558586 - DNA, 25 bp, Mus musculus
cacccagagaccaattccaatgaga

SEQ ID NO: 558587 - DNA, 25 bp, Mus musculus
cacccagagacctattccaatgaga

SEQ ID NO: 558588 - DNA, 25 bp, Mus musculus
cacccagaggacacgcttcaaatgg

SEQ ID NO: 558589 - DNA, 25 bp, Mus musculus
cacccagaggactcgcttcaaatgg

SEQ ID NO: 558590 - DNA, 25 bp, Mus musculus
cacccagaggtgagaagtgaggccc

SEQ ID NO: 558591 - DNA, 25 bp, Mus musculus
cacccagaggtgtgaagtgaggccc

SEQ ID NO: 558592 - DNA, 25 bp, Mus musculus
cacccagatgcacatagcctttatg

SEQ ID NO: 558593 - DNA, 25 bp, Mus musculus
cacccagatgcagatagcctttatg

SEQ ID NO: 558594 - DNA, 25 bp, Mus musculus
cacccagattggatgctgctgataa

SEQ ID NO: 558595 - DNA, 25 bp, Mus musculus
cacccagattggttgctgctgataa

SEQ ID NO: 558596 - DNA, 25 bp, Mus musculus
cacccagcagttagcagcactacag

SEQ ID NO: 558597 - DNA, 25 bp, Mus musculus
cacccagcagtttgcagcactacag

SEQ ID NO: 558598 - DNA, 25 bp, Mus musculus
cacccagcatcaccgaggaacagat

SEQ ID NO: 558599 - DNA, 25 bp, Mus musculus
cacccagcatcacgtggaactatgt

SEQ ID NO: 558600 - DNA, 25 bp, Mus musculus
cacccagcatcagcgaggaacagat

SEQ ID NO: 558601 - DNA, 25 bp, Mus musculus
cacccagcatcaggtggaactatgt

SEQ ID NO: 558602 - DNA, 25 bp, Mus musculus
cacccagcttatcatgataaggaca

SEQ ID NO: 558603 - DNA, 25 bp, Mus musculus
cacccagcttatgatgataaggaca

SEQ ID NO: 558604 - DNA, 25 bp, Mus musculus
cacccaggaagcctttgatcttata

SEQ ID NO: 558605 - DNA, 25 bp, Mus musculus
cacccaggaagcgtttgatcttata

SEQ ID NO: 558606 - DNA, 25 bp, Mus musculus
cacccaggaatccaggcaaagacag

SEQ ID NO: 558607 - DNA, 25 bp, Mus musculus
cacccaggaatcgaggcaaagacag

SEQ ID NO: 558608 - DNA, 25 bp, Mus musculus
cacccaggacagagttttaagagca

SEQ ID NO: 558609 - DNA, 25 bp, Mus musculus
cacccaggacagtgttttaagagca

SEQ ID NO: 558610 - DNA, 25 bp, Mus musculus
cacccaggaccaccatgggtgtgag

SEQ ID NO: 558611 - DNA, 25 bp, Mus musculus
cacccaggaccagcatgggtgtgag

SEQ ID NO: 558612 - DNA, 25 bp, Mus musculus
cacccaggagctacggttggaactg

SEQ ID NO: 558613 - DNA, 25 bp, Mus musculus
cacccaggagctatcaggagcagga

SEQ ID NO: 558614 - DNA, 25 bp, Mus musculus
cacccaggagcttcggttggaactg

SEQ ID NO: 558615 - DNA, 25 bp, Mus musculus
cacccaggagctttcaggagcagga

SEQ ID NO: 558616 - DNA, 25 bp, Mus musculus
cacccaggcaggaagtgagtttcgc

SEQ ID NO: 558617 - DNA, 25 bp, Mus musculus
cacccaggcaggtagtgagtttcgc

SEQ ID NO: 558618 - DNA, 25 bp, Mus musculus
cacccaggccatcatgtatttttct

SEQ ID NO: 558619 - DNA, 25 bp, Mus musculus
cacccaggccatgatgtatttttct

SEQ ID NO: 558620 - DNA, 25 bp, Mus musculus
cacccaggccttcagagtcagatgt

SEQ ID NO: 558621 - DNA, 25 bp, Mus musculus
cacccaggccttgagagtcagatgt

SEQ ID NO: 558622 - DNA, 25 bp, Mus musculus
cacccaggctgaacttgagaagata

SEQ ID NO: 558623 - DNA, 25 bp, Mus musculus
cacccaggctgatcttgagaagata

SEQ ID NO: 558624 - DNA, 25 bp, Mus musculus
cacccagggactcgtggtccctgtg

SEQ ID NO: 558625 - DNA, 25 bp, Mus musculus
cacccagggactggtggtccctgtg

SEQ ID NO: 558626 - DNA, 25 bp, Mus musculus
cacccaggggcaagatcagtaacat

SEQ ID NO: 558627 - DNA, 25 bp, Mus musculus
cacccaggggcatgatcagtaacat

SEQ ID NO: 558628 - DNA, 25 bp, Mus musculus
cacccaggggtcaaccagccatttt

SEQ ID NO: 558629 - DNA, 25 bp, Mus musculus
cacccaggggtctaccagccatttt

SEQ ID NO: 558630 - DNA, 25 bp, Mus musculus
cacccagtcagactaagcacagaac

SEQ ID NO: 558631 - DNA, 25 bp, Mus musculus
cacccagtcagagtaagcacagaac

SEQ ID NO: 558632 - DNA, 25 bp, Mus musculus
cacccagtctggcagaagacatgag

SEQ ID NO: 558633 - DNA, 25 bp, Mus musculus
cacccagtctgggagaagacatgag

SEQ ID NO: 558634 - DNA, 25 bp, Mus musculus
cacccagtgaggacctgagatccac

SEQ ID NO: 558635 - DNA, 25 bp, Mus musculus
cacccagtgaggtcctgagatccac

SEQ ID NO: 558636 - DNA, 25 bp, Mus musculus
cacccagtgcgacaagattgtacag

SEQ ID NO: 558637 - DNA, 25 bp, Mus musculus
cacccagtgcgagaagattgtacag

SEQ ID NO: 558638 - DNA, 25 bp, Mus musculus
cacccagtggtaacacctatgaccg

SEQ ID NO: 558639 - DNA, 25 bp, Mus musculus
cacccagtggtatcacctatgaccg

SEQ ID NO: 558640 - DNA, 25 bp, Mus musculus
cacccatagtgtcggggcgacagta

SEQ ID NO: 558641 - DNA, 25 bp, Mus musculus
cacccatagtgtgggggcgacagta

SEQ ID NO: 558642 - DNA, 25 bp, Mus musculus
cacccatcccagatgaagattgtca

SEQ ID NO: 558643 - DNA, 25 bp, Mus musculus
cacccatcccagttgaagattgtca

SEQ ID NO: 558644 - DNA, 25 bp, Mus musculus
cacccatcgctgcatgaaaacctga

SEQ ID NO: 558645 - DNA, 25 bp, Mus musculus
cacccatcgctggatgaaaacctga

SEQ ID NO: 558646 - DNA, 25 bp, Mus musculus
cacccatctaggattccagagagaa

SEQ ID NO: 558647 - DNA, 25 bp, Mus musculus
cacccatctaggtttccagagagaa

SEQ ID NO: 558648 - DNA, 25 bp, Mus musculus
cacccatgaaataggtttgtggtca

SEQ ID NO: 558649 - DNA, 25 bp, Mus musculus
cacccatgaaattggtttgtggtca

SEQ ID NO: 558650 - DNA, 25 bp, Mus musculus
cacccatgagtgagatgacaggcaa

SEQ ID NO: 558651 - DNA, 25 bp, Mus musculus
cacccatgagtgtgatgacaggcaa

SEQ ID NO: 558652 - DNA, 25 bp, Mus musculus
cacccattaattccgtgtgtctgca

SEQ ID NO: 558653 - DNA, 25 bp, Mus musculus
cacccattaattgcgtgtgtctgca

SEQ ID NO: 558654 - DNA, 25 bp, Mus musculus
cacccattcagacgacgcagaagag

SEQ ID NO: 558655 - DNA, 25 bp, Mus musculus
cacccattcagaggacgcagaagag

SEQ ID NO: 558656 - DNA, 25 bp, Mus musculus
caccccaactgtctgtgctagtctg

SEQ ID NO: 558657 - DNA, 25 bp, Mus musculus
caccccaactgtgtgtgctagtctg

SEQ ID NO: 558658 - DNA, 25 bp, Mus musculus
caccccaagtcgcattagagagaat

SEQ ID NO: 558659 - DNA, 25 bp, Mus musculus
caccccaagtcggattagagagaat

SEQ ID NO: 558660 - DNA, 25 bp, Mus musculus
caccccacgagtatgtgccctgggt

SEQ ID NO: 558661 - DNA, 25 bp, Mus musculus
caccccacgagtttgtgccctgggt

SEQ ID NO: 558662 - DNA, 25 bp, Mus musculus
caccccactctgcaggcgagatggg

SEQ ID NO: 558663 - DNA, 25 bp, Mus musculus
caccccactctggaggcgagatggg

SEQ ID NO: 558664 - DNA, 25 bp, Mus musculus
caccccactcttaagtataggatca

SEQ ID NO: 558665 - DNA, 25 bp, Mus musculus
caccccactctttagtataggatca

SEQ ID NO: 558666 - DNA, 25 bp, Mus musculus
caccccaggaaacagggcactttgg

SEQ ID NO: 558667 - DNA, 25 bp, Mus musculus
caccccaggaaagagggcactttgg

SEQ ID NO: 558668 - DNA, 25 bp, Mus musculus
caccccagtggaaactcctggaaag

SEQ ID NO: 558669 - DNA, 25 bp, Mus musculus
caccccagtggatactcctggaaag

SEQ ID NO: 558670 - DNA, 25 bp, Mus musculus
caccccgagaagagggaccagcggt

SEQ ID NO: 558671 - DNA, 25 bp, Mus musculus
caccccgagaagtgggaccagcggt

SEQ ID NO: 558672 - DNA, 25 bp, Mus musculus
caccccgagatgaggccattttgca

SEQ ID NO: 558673 - DNA, 25 bp, Mus musculus
caccccgagatgtggccattttgca

SEQ ID NO: 558674 - DNA, 25 bp, Mus musculus
caccccgagcaacttagtctataca

SEQ ID NO: 558675 - DNA, 25 bp, Mus musculus
caccccgagcaagttagtctataca

SEQ ID NO: 558676 - DNA, 25 bp, Mus musculus
caccccgagtcccagattgtggagg

SEQ ID NO: 558677 - DNA, 25 bp, Mus musculus
caccccgagtccgagattgtggagg

SEQ ID NO: 558678 - DNA, 25 bp, Mus musculus
caccccgatggacctctcgatggaa

SEQ ID NO: 558679 - DNA, 25 bp, Mus musculus
caccccgatggagctctcgatggaa

SEQ ID NO: 558680 - DNA, 25 bp, Mus musculus
caccccgggagtcacatactgctgt

SEQ ID NO: 558681 - DNA, 25 bp, Mus musculus
caccccgggagtgacatactgctgt

SEQ ID NO: 558682 - DNA, 25 bp, Mus musculus
caccccgtgaacctgcaatggagaa

SEQ ID NO: 558683 - DNA, 25 bp, Mus musculus
caccccgtgaacgtgcaatggagaa

SEQ ID NO: 558684 - DNA, 25 bp, Mus musculus
cacccctagaccaagcctgtgaatt

SEQ ID NO: 558685 - DNA, 25 bp, Mus musculus
cacccctagacctagcctgtgaatt

SEQ ID NO: 558686 - DNA, 25 bp, Mus musculus
cacccctcgtggaagcaggctcttt

SEQ ID NO: 558687 - DNA, 25 bp, Mus musculus
cacccctcgtggtagcaggctcttt

SEQ ID NO: 558688 - DNA, 25 bp, Mus musculus
cacccctctggtcatggtacatggc

SEQ ID NO: 558689 - DNA, 25 bp, Mus musculus
cacccctctggtgatggtacatggc

SEQ ID NO: 558690 - DNA, 25 bp, Mus musculus
cacccctgccagctggtcatatgat

SEQ ID NO: 558691 - DNA, 25 bp, Mus musculus
cacccctgccaggtggtcatatgat

SEQ ID NO: 558692 - DNA, 25 bp, Mus musculus
cacccctggaagaggcgcctgctgt

SEQ ID NO: 558693 - DNA, 25 bp, Mus musculus
cacccctggaagtggcgcctgctgt

SEQ ID NO: 558694 - DNA, 25 bp, Mus musculus
cacccctggattatgcccgggaagg

SEQ ID NO: 558695 - DNA, 25 bp, Mus musculus
cacccctggattttgcccgggaagg

SEQ ID NO: 558696 - DNA, 25 bp, Mus musculus
cacccctggctgagacggttctgga

SEQ ID NO: 558697 - DNA, 25 bp, Mus musculus
cacccctggctgtgacggttctgga

SEQ ID NO: 558698 - DNA, 25 bp, Mus musculus
cacccctgggtacatgatatttgac

SEQ ID NO: 558699 - DNA, 25 bp, Mus musculus
cacccctgggtagatgatatttgac

SEQ ID NO: 558700 - DNA, 25 bp, Mus musculus
cacccctgggttctatggctgctct

SEQ ID NO: 558701 - DNA, 25 bp, Mus musculus
cacccctgggttgtatggctgctct

SEQ ID NO: 558702 - DNA, 25 bp, Mus musculus
cacccctgttggatgatacttattt

SEQ ID NO: 558703 - DNA, 25 bp, Mus musculus
cacccctgttggttgatacttattt

SEQ ID NO: 558704 - DNA, 25 bp, Mus musculus
caccccttcatcaaggagtaccagg

SEQ ID NO: 558705 - DNA, 25 bp, Mus musculus
caccccttcatctaggagtaccagg

SEQ ID NO: 558706 - DNA, 25 bp, Mus musculus
caccccttggtgatggtggacaaag

SEQ ID NO: 558707 - DNA, 25 bp, Mus musculus
caccccttggtgttggtggacaaag

SEQ ID NO: 558708 - DNA, 25 bp, Mus musculus
cacccgaagccactttgaggaggca

SEQ ID NO: 558709 - DNA, 25 bp, Mus musculus
cacccgaagccagtttgaggaggca

SEQ ID NO: 558710 - DNA, 25 bp, Mus musculus
cacccgaatcacagaggccatggct

SEQ ID NO: 558711 - DNA, 25 bp, Mus musculus
cacccgaatcactgaggccatggct

SEQ ID NO: 558712 - DNA, 25 bp, Mus musculus
cacccgaatggtcagcgagggctac

SEQ ID NO: 558713 - DNA, 25 bp, Mus musculus
cacccgaatggtgagcgagggctac

SEQ ID NO: 558714 - DNA, 25 bp, Mus musculus
cacccgacctgcagttctcaggaga

SEQ ID NO: 558715 - DNA, 25 bp, Mus musculus
cacccgacctgctgttctcaggaga

SEQ ID NO: 558716 - DNA, 25 bp, Mus musculus
cacccgagatccctctgtcttggat

SEQ ID NO: 558717 - DNA, 25 bp, Mus musculus
cacccgagatccgtctgtcttggat

SEQ ID NO: 558718 - DNA, 25 bp, Mus musculus
cacccgagcttcagtcgatggcctg

SEQ ID NO: 558719 - DNA, 25 bp, Mus musculus
cacccgagcttctgtcgatggcctg

SEQ ID NO: 558720 - DNA, 25 bp, Mus musculus
cacccgaggaaaactagaatgaagc

SEQ ID NO: 558721 - DNA, 25 bp, Mus musculus
cacccgaggaaatctagaatgaagc

SEQ ID NO: 558722 - DNA, 25 bp, Mus musculus
cacccgatgtgacacagaactcaga

SEQ ID NO: 558723 - DNA, 25 bp, Mus musculus
cacccgatgtgagacagaactcaga

SEQ ID NO: 558724 - DNA, 25 bp, Mus musculus
cacccgcaaggtcactggaggaatt

SEQ ID NO: 558725 - DNA, 25 bp, Mus musculus
cacccgcaaggtgactggaggaatt

SEQ ID NO: 558726 - DNA, 25 bp, Mus musculus
cacccgcaggtgctagatgactaca

SEQ ID NO: 558727 - DNA, 25 bp, Mus musculus
cacccgcaggtggtagatgactaca

SEQ ID NO: 558728 - DNA, 25 bp, Mus musculus
cacccgccaggaaagagggcatcag

SEQ ID NO: 558729 - DNA, 25 bp, Mus musculus
cacccgccaggatagagggcatcag

SEQ ID NO: 558730 - DNA, 25 bp, Mus musculus
cacccggaagaacatcaagagcatc

SEQ ID NO: 558731 - DNA, 25 bp, Mus musculus
cacccggaagaagatcaagagcatc

SEQ ID NO: 558732 - DNA, 25 bp, Mus musculus
cacccggagagacaagaaatgatgc

SEQ ID NO: 558733 - DNA, 25 bp, Mus musculus
cacccggagagagaagaaatgatgc

SEQ ID NO: 558734 - DNA, 25 bp, Mus musculus
cacccggagaggacgccttgagaag

SEQ ID NO: 558735 - DNA, 25 bp, Mus musculus
cacccggagaggtcgccttgagaag

SEQ ID NO: 558736 - DNA, 25 bp, Mus musculus
cacccggagctgcacacagatggag

SEQ ID NO: 558737 - DNA, 25 bp, Mus musculus
cacccggagctggacacagatggag

SEQ ID NO: 558738 - DNA, 25 bp, Mus musculus
cacccggcctcaaagctggtttcag

SEQ ID NO: 558739 - DNA, 25 bp, Mus musculus
cacccggcctcatagctggtttcag

SEQ ID NO: 558740 - DNA, 25 bp, Mus musculus
cacccgggacatagtgctacctgat

SEQ ID NO: 558741 - DNA, 25 bp, Mus musculus
cacccgggacattgtgctacctgat

SEQ ID NO: 558742 - DNA, 25 bp, Mus musculus
cacccggtggagactttctgaatct

SEQ ID NO: 558743 - DNA, 25 bp, Mus musculus
cacccggtggagtctttctgaatct

SEQ ID NO: 558744 - DNA, 25 bp, Mus musculus
cacccgtattggctgaccttggcgc

SEQ ID NO: 558745 - DNA, 25 bp, Mus musculus
cacccgtattgggtgaccttggcgc

SEQ ID NO: 558746 - DNA, 25 bp, Mus musculus
cacccgtgaaggcttccgcctgaag

SEQ ID NO: 558747 - DNA, 25 bp, Mus musculus
cacccgtgaagggttccgcctgaag

SEQ ID NO: 558748 - DNA, 25 bp, Mus musculus
cacccgtgaggaagacaaataccgc

SEQ ID NO: 558749 - DNA, 25 bp, Mus musculus
cacccgtgaggatgacaaataccgc

SEQ ID NO: 558750 - DNA, 25 bp, Mus musculus
cacccgtgaggtcatggcagacctg

SEQ ID NO: 558751 - DNA, 25 bp, Mus musculus
cacccgtgaggtgatggcagacctg

SEQ ID NO: 558752 - DNA, 25 bp, Mus musculus
cacccgtttgttaagagtgccaaag

SEQ ID NO: 558753 - DNA, 25 bp, Mus musculus
cacccgtttgtttagagtgccaaag

SEQ ID NO: 558754 - DNA, 25 bp, Mus musculus
caccctaaggctcgccatggtgctg

SEQ ID NO: 558755 - DNA, 25 bp, Mus musculus
caccctaaggctggccatggtgctg

SEQ ID NO: 558756 - DNA, 25 bp, Mus musculus
caccctacaagtacaacctagagaa

SEQ ID NO: 558757 - DNA, 25 bp, Mus musculus
caccctacaagttcaacctagagaa

SEQ ID NO: 558758 - DNA, 25 bp, Mus musculus
caccctactccacgatgcagtaatg

SEQ ID NO: 558759 - DNA, 25 bp, Mus musculus
caccctactccaggatgcagtaatg

SEQ ID NO: 558760 - DNA, 25 bp, Mus musculus
caccctagtcatacattgctaacag

SEQ ID NO: 558761 - DNA, 25 bp, Mus musculus
caccctagtcattcattgctaacag

SEQ ID NO: 558762 - DNA, 25 bp, Mus musculus
caccctcactgcagggaggtctggg

SEQ ID NO: 558763 - DNA, 25 bp, Mus musculus
caccctcactgctgggaggtctggg

SEQ ID NO: 558764 - DNA, 25 bp, Mus musculus
caccctcaggagacgctgaaagagt

SEQ ID NO: 558765 - DNA, 25 bp, Mus musculus
caccctcaggagtcgctgaaagagt

SEQ ID NO: 558766 - DNA, 25 bp, Mus musculus
caccctcaggcacacataaaagcag

SEQ ID NO: 558767 - DNA, 25 bp, Mus musculus
caccctcaggcagacataaaagcag

SEQ ID NO: 558768 - DNA, 25 bp, Mus musculus
caccctccactgacatgaggagaat

SEQ ID NO: 558769 - DNA, 25 bp, Mus musculus
caccctccactgtcatgaggagaat

SEQ ID NO: 558770 - DNA, 25 bp, Mus musculus
caccctccctcgaatagatgcgctt

SEQ ID NO: 558771 - DNA, 25 bp, Mus musculus
caccctccctcgtatagatgcgctt

SEQ ID NO: 558772 - DNA, 25 bp, Mus musculus
caccctcctggcagcattagtctta

SEQ ID NO: 558773 - DNA, 25 bp, Mus musculus
caccctcctggctgcattagtctta

SEQ ID NO: 558774 - DNA, 25 bp, Mus musculus
caccctcgagccatgtcctgggctg

SEQ ID NO: 558775 - DNA, 25 bp, Mus musculus
caccctcgagccttgtcctgggctg

SEQ ID NO: 558776 - DNA, 25 bp, Mus musculus
caccctcgggtgctctacattgata

SEQ ID NO: 558777 - DNA, 25 bp, Mus musculus
caccctcgggtggtctacattgata

SEQ ID NO: 558778 - DNA, 25 bp, Mus musculus
caccctcgtgggagttctgttgcaa

SEQ ID NO: 558779 - DNA, 25 bp, Mus musculus
caccctcgtgggtgttctgttgcaa

SEQ ID NO: 558780 - DNA, 25 bp, Mus musculus
caccctcgtgtgagggaggattccc

SEQ ID NO: 558781 - DNA, 25 bp, Mus musculus
caccctcgtgtgtgggaggattccc

SEQ ID NO: 558782 - DNA, 25 bp, Mus musculus
caccctctaagcaagtgggctccat

SEQ ID NO: 558783 - DNA, 25 bp, Mus musculus
caccctctaagctagtgggctccat

SEQ ID NO: 558784 - DNA, 25 bp, Mus musculus
caccctctaggactgtggcctttga

SEQ ID NO: 558785 - DNA, 25 bp, Mus musculus
caccctctaggagtgtggcctttga

SEQ ID NO: 558786 - DNA, 25 bp, Mus musculus
caccctctgaccagctgagtacaag

SEQ ID NO: 558787 - DNA, 25 bp, Mus musculus
caccctctgacctgctgagtacaag

SEQ ID NO: 558788 - DNA, 25 bp, Mus musculus
caccctctgagacagtgctctgcga

SEQ ID NO: 558789 - DNA, 25 bp, Mus musculus
caccctctgagagagtgctctgcga

SEQ ID NO: 558790 - DNA, 25 bp, Mus musculus
caccctctgctgctggaaagctcgg

SEQ ID NO: 558791 - DNA, 25 bp, Mus musculus
caccctctgctggtggaaagctcgg

SEQ ID NO: 558792 - DNA, 25 bp, Mus musculus
caccctgaagaaccgcaaaggcttt

SEQ ID NO: 558793 - DNA, 25 bp, Mus musculus
caccctgaagaagcgcaaaggcttt

SEQ ID NO: 558794 - DNA, 25 bp, Mus musculus
caccctgaagtgcatcctggagaac

SEQ ID NO: 558795 - DNA, 25 bp, Mus musculus
caccctgaagtggatcctggagaac

SEQ ID NO: 558796 - DNA, 25 bp, Mus musculus
caccctgagattagtggctgtgggc

SEQ ID NO: 558797 - DNA, 25 bp, Mus musculus
caccctgagatttgtggctgtgggc

SEQ ID NO: 558798 - DNA, 25 bp, Mus musculus
caccctgaggaaagtaaggctctgc

SEQ ID NO: 558799 - DNA, 25 bp, Mus musculus
caccctgaggaatgtaaggctctgc

SEQ ID NO: 558800 - DNA, 25 bp, Mus musculus
caccctgagtacagagaggaactag

SEQ ID NO: 558801 - DNA, 25 bp, Mus musculus
caccctgagtactgagaggaactag

SEQ ID NO: 558802 - DNA, 25 bp, Mus musculus
caccctgatcgccaagctgaagtca

SEQ ID NO: 558803 - DNA, 25 bp, Mus musculus
caccctgatcgcgaagctgaagtca

SEQ ID NO: 558804 - DNA, 25 bp, Mus musculus
caccctgatgagctgggaaagcgtc

SEQ ID NO: 558805 - DNA, 25 bp, Mus musculus
caccctgatgaggtgggaaagcgtc

SEQ ID NO: 558806 - DNA, 25 bp, Mus musculus
caccctgatggccaagaacgagtat

SEQ ID NO: 558807 - DNA, 25 bp, Mus musculus
caccctgatggcgaagaacgagtat

SEQ ID NO: 558808 - DNA, 25 bp, Mus musculus
caccctgatgttattgggttcactc

SEQ ID NO: 558809 - DNA, 25 bp, Mus musculus
caccctgatgtttttgggttcactc

SEQ ID NO: 558810 - DNA, 25 bp, Mus musculus
caccctgcaggtcgagcaataccag

SEQ ID NO: 558811 - DNA, 25 bp, Mus musculus
caccctgcaggtggagcaataccag

SEQ ID NO: 558812 - DNA, 25 bp, Mus musculus
caccctgcccggctgggaagaattt

SEQ ID NO: 558813 - DNA, 25 bp, Mus musculus
caccctgcccgggtgggaagaattt

SEQ ID NO: 558814 - DNA, 25 bp, Mus musculus
caccctgcctttagactcctggtta

SEQ ID NO: 558815 - DNA, 25 bp, Mus musculus
caccctgccttttgactcctggtta

SEQ ID NO: 558816 - DNA, 25 bp, Mus musculus
caccctgctcacaagagctgacaat

SEQ ID NO: 558817 - DNA, 25 bp, Mus musculus
caccctgctcactagagctgacaat

SEQ ID NO: 558818 - DNA, 25 bp, Mus musculus
caccctgctcttcagggaggtcagt

SEQ ID NO: 558819 - DNA, 25 bp, Mus musculus
caccctgctcttgagggaggtcagt

SEQ ID NO: 558820 - DNA, 25 bp, Mus musculus
caccctggacttcgctcttgtaaca

SEQ ID NO: 558821 - DNA, 25 bp, Mus musculus
caccctggacttggctcttgtaaca

SEQ ID NO: 558822 - DNA, 25 bp, Mus musculus
caccctggagaacaattacctgacg

SEQ ID NO: 558823 - DNA, 25 bp, Mus musculus
caccctggagaagaattacctgacg

SEQ ID NO: 558824 - DNA, 25 bp, Mus musculus
caccctggccctagacagtagggtt

SEQ ID NO: 558825 - DNA, 25 bp, Mus musculus
caccctggcccttgacagtagggtt

SEQ ID NO: 558826 - DNA, 25 bp, Mus musculus
caccctgggcaactatggtgctgag

SEQ ID NO: 558827 - DNA, 25 bp, Mus musculus
caccctgggcaagtatggtgctgag

SEQ ID NO: 558828 - DNA, 25 bp, Mus musculus
caccctggttggaatcatagttggc

SEQ ID NO: 558829 - DNA, 25 bp, Mus musculus
caccctggttggtatcatagttggc

SEQ ID NO: 558830 - DNA, 25 bp, Mus musculus
caccctgtatgacttctggcaggat

SEQ ID NO: 558831 - DNA, 25 bp, Mus musculus
caccctgtatgagttctggcaggat

SEQ ID NO: 558832 - DNA, 25 bp, Mus musculus
caccctgtcaaactcagatgccaaa

SEQ ID NO: 558833 - DNA, 25 bp, Mus musculus
caccctgtcaaagtcagatgccaaa

SEQ ID NO: 558834 - DNA, 25 bp, Mus musculus
caccctgtggaaacactacgtctac

SEQ ID NO: 558835 - DNA, 25 bp, Mus musculus
caccctgtggaatcactacgtctac

SEQ ID NO: 558836 - DNA, 25 bp, Mus musculus
caccctgtgggtatacttcaacaga

SEQ ID NO: 558837 - DNA, 25 bp, Mus musculus
caccctgtgggtttacttcaacaga

SEQ ID NO: 558838 - DNA, 25 bp, Mus musculus
caccctgtggttcaaagcctccgaa

SEQ ID NO: 558839 - DNA, 25 bp, Mus musculus
caccctgtggttgaaagcctccgaa

SEQ ID NO: 558840 - DNA, 25 bp, Mus musculus
caccctgttgaacagctcttagatt

SEQ ID NO: 558841 - DNA, 25 bp, Mus musculus
caccctgttgaagagctcttagatt

SEQ ID NO: 558842 - DNA, 25 bp, Mus musculus
caccctgttgcacgaagagctgcgg

SEQ ID NO: 558843 - DNA, 25 bp, Mus musculus
caccctgttgcaggaagagctgcgg

SEQ ID NO: 558844 - DNA, 25 bp, Mus musculus
caccctgttgtgcacttgataaagc

SEQ ID NO: 558845 - DNA, 25 bp, Mus musculus
caccctgttgtggacttgataaagc

SEQ ID NO: 558846 - DNA, 25 bp, Mus musculus
cacccttatttgaggcaccacagag

SEQ ID NO: 558847 - DNA, 25 bp, Mus musculus
cacccttatttgtggcaccacagag

SEQ ID NO: 558848 - DNA, 25 bp, Mus musculus
cacccttcaagtccgtgtggagcag

SEQ ID NO: 558849 - DNA, 25 bp, Mus musculus
cacccttcaagtgcgtgtggagcag

SEQ ID NO: 558850 - DNA, 25 bp, Mus musculus
cacccttcagtaaggacagtgtggg

SEQ ID NO: 558851 - DNA, 25 bp, Mus musculus
cacccttcagtatggacagtgtggg

SEQ ID NO: 558852 - DNA, 25 bp, Mus musculus
cacccttcatctcctggtgcgggat
